United States Patent 11,369,692 (MATERIALS AND METHODS FOR TREATMENT OF DUCHENNE MUSCULAR DYSTROPHY) - sequence listing, part 16

SEQ ID NO: 514553 - DNA, 20 bp, Artificial Sequence
  chemically synthesized
caataagtacgagctaaaca

SEQ ID NO: 514554 - DNA, 20 bp, Artificial Sequence
  chemically synthesized
gtgtttagctcgtacttatt

SEQ ID NO: 514555 - DNA, 20 bp, Artificial Sequence
  chemically synthesized
actaacacagaaacagaaaa

SEQ ID NO: 514556 - DNA, 20 bp, Artificial Sequence
  chemically synthesized
tgtttctgtgttagtttact

SEQ ID NO: 514557 - DNA, 20 bp, Artificial Sequence
  chemically synthesized
tgtcctttgcagcaacatgg

SEQ ID NO: 514558 - DNA, 20 bp, Artificial Sequence
  chemically synthesized
atcatgtcctttgcagcaac

SEQ ID NO: 514559 - DNA, 20 bp, Artificial Sequence
  chemically synthesized
aatactatgcagccacagaa

SEQ ID NO: 514560 - DNA, 20 bp, Artificial Sequence
  chemically synthesized
tattatttttttttttgata

SEQ ID NO: 514561 - DNA, 20 bp, Artificial Sequence
  chemically synthesized
tctcgctctgcctcccaggc

SEQ ID NO: 514562 - DNA, 20 bp, Artificial Sequence
  chemically synthesized
acccagaggctgaggttgca

SEQ ID NO: 514563 - DNA, 20 bp, Artificial Sequence
  chemically synthesized
actcactgcaacctcagcct

SEQ ID NO: 514564 - DNA, 20 bp, Artificial Sequence
  chemically synthesized
tactcgggaggctgaggtag

SEQ ID NO: 514565 - DNA, 20 bp, Artificial Sequence
  chemically synthesized
aattctcctacctcagcctc

SEQ ID NO: 514566 - DNA, 20 bp, Artificial Sequence
  chemically synthesized
acctcagcctcccgagtagc

SEQ ID NO: 514567 - DNA, 20 bp, Artificial Sequence
  chemically synthesized
ctaaaaaatacaaaaattag

SEQ ID NO: 514568 - DNA, 20 bp, Artificial Sequence
  chemically synthesized
tttgtattttttagtagaga

SEQ ID NO: 514569 - DNA, 20 bp, Artificial Sequence
  chemically synthesized
ctggcagatcaccagaggtc

SEQ ID NO: 514570 - DNA, 20 bp, Artificial Sequence
  chemically synthesized
gcctcggcctcccacagtgc

SEQ ID NO: 514571 - DNA, 20 bp, Artificial Sequence
  chemically synthesized
tgtaccgcattttctttatg

SEQ ID NO: 514572 - DNA, 20 bp, Artificial Sequence
  chemically synthesized
cgcattttctttatgcagga

SEQ ID NO: 514573 - DNA, 20 bp, Artificial Sequence
  chemically synthesized
ttatgcaggattgagtttta

SEQ ID NO: 514574 - DNA, 20 bp, Artificial Sequence
  chemically synthesized
tcatttaaaaaaacaaactt

SEQ ID NO: 514575 - DNA, 20 bp, Artificial Sequence
  chemically synthesized
gtgaagaaaagagcggaaca

SEQ ID NO: 514576 - DNA, 20 bp, Artificial Sequence
  chemically synthesized
ttcactgctacattttgaaa

SEQ ID NO: 514577 - DNA, 20 bp, Artificial Sequence
  chemically synthesized
atcagtgtcattgacattat

SEQ ID NO: 514578 - DNA, 20 bp, Artificial Sequence
  chemically synthesized
caatgacactgatatttcca

SEQ ID NO: 514579 - DNA, 20 bp, Artificial Sequence
  chemically synthesized
ctcatagattattctggctg

SEQ ID NO: 514580 - DNA, 20 bp, Artificial Sequence
  chemically synthesized
tagatttttcactccgcagc

SEQ ID NO: 514581 - DNA, 20 bp, Artificial Sequence
  chemically synthesized
ggttaaaggtgacaatgacc

SEQ ID NO: 514582 - DNA, 20 bp, Artificial Sequence
  chemically synthesized
attggctgattttatgaatt

SEQ ID NO: 514583 - DNA, 20 bp, Artificial Sequence
  chemically synthesized
gcaattaattggctgatttt

SEQ ID NO: 514584 - DNA, 20 bp, Artificial Sequence
  chemically synthesized
ataagctgagcaacatttgg

SEQ ID NO: 514585 - DNA, 20 bp, Artificial Sequence
  chemically synthesized
ctcttaaaataaccataagc

SEQ ID NO: 514586 - DNA, 20 bp, Artificial Sequence
  chemically synthesized
tccctgcttatggttatttt

SEQ ID NO: 514587 - DNA, 20 bp, Artificial Sequence
  chemically synthesized
gatcaacgtactcaatgtac

SEQ ID NO: 514588 - DNA, 20 bp, Artificial Sequence
  chemically synthesized
caaagataaactcaagtaca

SEQ ID NO: 514589 - DNA, 20 bp, Artificial Sequence
  chemically synthesized
ttggtcgattagacagattt

SEQ ID NO: 514590 - DNA, 20 bp, Artificial Sequence
  chemically synthesized
ccaatgccatgacacagggg

SEQ ID NO: 514591 - DNA, 20 bp, Artificial Sequence
  chemically synthesized
ccaagtggttcagaggagat

SEQ ID NO: 514592 - DNA, 20 bp, Artificial Sequence
  chemically synthesized
aaaccaagtaggcaggtcag

SEQ ID NO: 514593 - DNA, 20 bp, Artificial Sequence
  chemically synthesized
tttttttggtttagatttaa

SEQ ID NO: 514594 - DNA, 20 bp, Artificial Sequence
  chemically synthesized
tcactatttttacttggggt

SEQ ID NO: 514595 - DNA, 20 bp, Artificial Sequence
  chemically synthesized
gaaacatcactatttttact

SEQ ID NO: 514596 - DNA, 20 bp, Artificial Sequence
  chemically synthesized
ggcagtgttttgtgcaacaa

SEQ ID NO: 514597 - DNA, 20 bp, Artificial Sequence
  chemically synthesized
caaaacactgccgtaagaaa

SEQ ID NO: 514598 - DNA, 20 bp, Artificial Sequence
  chemically synthesized
acttcgggaggctgaggcag

SEQ ID NO: 514599 - DNA, 20 bp, Artificial Sequence
  chemically synthesized
caggtggatcacctgaggtc

SEQ ID NO: 514600 - DNA, 20 bp, Artificial Sequence
  chemically synthesized
ttttgtatttttagtagaga

SEQ ID NO: 514601 - DNA, 20 bp, Artificial Sequence
  chemically synthesized
gtctcagcctcccgagtagc

SEQ ID NO: 514602 - DNA, 20 bp, Artificial Sequence
  chemically synthesized
tattctcctgtctcagcctc

SEQ ID NO: 514603 - DNA, 20 bp, Artificial Sequence
  chemically synthesized
tactcgggaggctgagacag

SEQ ID NO: 514604 - DNA, 20 bp, Artificial Sequence
  chemically synthesized
aatagcttaaacctggaagg

SEQ ID NO: 514605 - DNA, 20 bp, Artificial Sequence
  chemically synthesized
ctcgctcttctgtcccaggc

SEQ ID NO: 514606 - DNA, 20 bp, Artificial Sequence
  chemically synthesized
ctttttttttttttttgaga

SEQ ID NO: 514607 - DNA, 20 bp, Artificial Sequence
  chemically synthesized
aagcaaagtaagaaaagaaa

SEQ ID NO: 514608 - DNA, 20 bp, Artificial Sequence
  chemically synthesized
tggcagcatgcatttgcttc

SEQ ID NO: 514609 - DNA, 20 bp, Artificial Sequence
  chemically synthesized
ttagccacaatcaggcatac

SEQ ID NO: 514610 - DNA, 20 bp, Artificial Sequence
  chemically synthesized
agaactggtctgatttacaa

SEQ ID NO: 514611 - DNA, 20 bp, Artificial Sequence
  chemically synthesized
tgacacagcatgcttcatgt

SEQ ID NO: 514612 - DNA, 20 bp, Artificial Sequence
  chemically synthesized
agtagtaccctggacaaggt

SEQ ID NO: 514613 - DNA, 20 bp, Artificial Sequence
  chemically synthesized
cacagcatccagaccttgtc

SEQ ID NO: 514614 - DNA, 20 bp, Artificial Sequence
  chemically synthesized
aacaatgtcaacaaggcact

SEQ ID NO: 514615 - DNA, 20 bp, Artificial Sequence
  chemically synthesized
tgttcagggcatgaactctt

SEQ ID NO: 514616 - DNA, 20 bp, Artificial Sequence
  chemically synthesized
ccaaaagaaaaaggatccac

SEQ ID NO: 514617 - DNA, 20 bp, Artificial Sequence
  chemically synthesized
ttgttctcagccaaaagaaa

SEQ ID NO: 514618 - DNA, 20 bp, Artificial Sequence
  chemically synthesized
tttggctgagaacaaaacaa

SEQ ID NO: 514619 - DNA, 20 bp, Artificial Sequence
  chemically synthesized
ttataatttcactattaagc

SEQ ID NO: 514620 - DNA, 20 bp, Artificial Sequence
  chemically synthesized
gcctgtgaggcattaatata

SEQ ID NO: 514621 - DNA, 20 bp, Artificial Sequence
  chemically synthesized
tagcataaaccaaccactct

SEQ ID NO: 514622 - DNA, 20 bp, Artificial Sequence
  chemically synthesized
agaaaaagtgttgccattct

SEQ ID NO: 514623 - DNA, 20 bp, Artificial Sequence
  chemically synthesized
agtaatccccaactgggcta

SEQ ID NO: 514624 - DNA, 20 bp, Artificial Sequence
  chemically synthesized
cttcattctatagcccagtt

SEQ ID NO: 514625 - DNA, 20 bp, Artificial Sequence
  chemically synthesized
tagatttttctaaaaagttt

SEQ ID NO: 514626 - DNA, 20 bp, Artificial Sequence
  chemically synthesized
ttggcattatataattttgc

SEQ ID NO: 514627 - DNA, 20 bp, Artificial Sequence
  chemically synthesized
caaaattatataatgccaaa

SEQ ID NO: 514628 - DNA, 20 bp, Artificial Sequence
  chemically synthesized
aagatacaacttttgggatt

SEQ ID NO: 514629 - DNA, 20 bp, Artificial Sequence
  chemically synthesized
acaggataagatacaacttt

SEQ ID NO: 514630 - DNA, 20 bp, Artificial Sequence
  chemically synthesized
agatgttggtttaaaaatta

SEQ ID NO: 514631 - DNA, 20 bp, Artificial Sequence
  chemically synthesized
aaaactctacaacttaataa

SEQ ID NO: 514632 - DNA, 20 bp, Artificial Sequence
  chemically synthesized
ttaactcatttattaagttg

SEQ ID NO: 514633 - DNA, 20 bp, Artificial Sequence
  chemically synthesized
aaaacaggttatcataatgg

SEQ ID NO: 514634 - DNA, 20 bp, Artificial Sequence
  chemically synthesized
aaggtaaaagaaatgaaaat

SEQ ID NO: 514635 - DNA, 20 bp, Artificial Sequence
  chemically synthesized
aaggatgaaaaaaatggtga

SEQ ID NO: 514636 - DNA, 20 bp, Artificial Sequence
  chemically synthesized
aaggaaggatgaaaaaaatg

SEQ ID NO: 514637 - DNA, 20 bp, Artificial Sequence
  chemically synthesized
cattgttgatggtatgaagg

SEQ ID NO: 514638 - DNA, 20 bp, Artificial Sequence
  chemically synthesized
caaagttctcacctaaacat

SEQ ID NO: 514639 - DNA, 20 bp, Artificial Sequence
  chemically synthesized
agagctacaaagctgactgc

SEQ ID NO: 514640 - DNA, 20 bp, Artificial Sequence
  chemically synthesized
acaactgctctgatttacaa

SEQ ID NO: 514641 - DNA, 20 bp, Artificial Sequence
  chemically synthesized
aatgcagagaagaaagtatg

SEQ ID NO: 514642 - DNA, 20 bp, Artificial Sequence
  chemically synthesized
tgagacagcatgcttcatgt

SEQ ID NO: 514643 - DNA, 20 bp, Artificial Sequence
  chemically synthesized
acatgaagcatgctgtctca

SEQ ID NO: 514644 - DNA, 20 bp, Artificial Sequence
  chemically synthesized
agtagtgccctggacaaggt

SEQ ID NO: 514645 - DNA, 20 bp, Artificial Sequence
  chemically synthesized
attgtacatatggtttctgg

SEQ ID NO: 514646 - DNA, 20 bp, Artificial Sequence
  chemically synthesized
gctttatgcatatcgacaca

SEQ ID NO: 514647 - DNA, 20 bp, Artificial Sequence
  chemically synthesized
cgtagtatgtgccaagtact

SEQ ID NO: 514648 - DNA, 20 bp, Artificial Sequence
  chemically synthesized
aactaactgccttgcaaggc

SEQ ID NO: 514649 - DNA, 20 bp, Artificial Sequence
  chemically synthesized
gaggttcacttctgtacaat

SEQ ID NO: 514650 - DNA, 20 bp, Artificial Sequence
  chemically synthesized
ctacagacacagacaaaagt

SEQ ID NO: 514651 - DNA, 20 bp, Artificial Sequence
  chemically synthesized
ggagctttgctggaaagtat

SEQ ID NO: 514652 - DNA, 20 bp, Artificial Sequence
  chemically synthesized
gtgcaaatgataaggagttc

SEQ ID NO: 514653 - DNA, 20 bp, Artificial Sequence
  chemically synthesized
agcaggcagtgcaaatgata

SEQ ID NO: 514654 - DNA, 20 bp, Artificial Sequence
  chemically synthesized
taagatggctttagcttaat

SEQ ID NO: 514655 - DNA, 20 bp, Artificial Sequence
  chemically synthesized
atatcaggcaagttaccttg

SEQ ID NO: 514656 - DNA, 20 bp, Artificial Sequence
  chemically synthesized
gatgtcaatactgtgttata

SEQ ID NO: 514657 - DNA, 20 bp, Artificial Sequence
  chemically synthesized
ttaaggctaaccttatgaac

SEQ ID NO: 514658 - DNA, 20 bp, Artificial Sequence
  chemically synthesized
tacctcttagattttcctcc

SEQ ID NO: 514659 - DNA, 20 bp, Artificial Sequence
  chemically synthesized
agattttcctccaagaatgt

SEQ ID NO: 514660 - DNA, 20 bp, Artificial Sequence
  chemically synthesized
gtggaaagtgggagaaatat

SEQ ID NO: 514661 - DNA, 20 bp, Artificial Sequence
  chemically synthesized
ttttgtatttttagtagaca

SEQ ID NO: 514662 - DNA, 20 bp, Artificial Sequence
  chemically synthesized
ctcactgcaacctctgcctc

SEQ ID NO: 514663 - DNA, 20 bp, Artificial Sequence
  chemically synthesized
tcttactctgtcgcccaggc

SEQ ID NO: 514664 - DNA, 20 bp, Artificial Sequence
  chemically synthesized
gctgactccagcctgggcga

SEQ ID NO: 514665 - DNA, 20 bp, Artificial Sequence
  chemically synthesized
gtattttttttttattttga

SEQ ID NO: 514666 - DNA, 20 bp, Artificial Sequence
  chemically synthesized
ctactaggcagagaactgat

SEQ ID NO: 514667 - DNA, 20 bp, Artificial Sequence
  chemically synthesized
cacatgtgtacatttaatgt

SEQ ID NO: 514668 - DNA, 20 bp, Artificial Sequence
  chemically synthesized
cagaaactgcagctttttaa

SEQ ID NO: 514669 - DNA, 20 bp, Artificial Sequence
  chemically synthesized
cagattttaagttcccactt

SEQ ID NO: 514670 - DNA, 20 bp, Artificial Sequence
  chemically synthesized
aacttaaaatctgcccctat

SEQ ID NO: 514671 - DNA, 20 bp, Artificial Sequence
  chemically synthesized
cccctattagagtctccttg

SEQ ID NO: 514672 - DNA, 20 bp, Artificial Sequence
  chemically synthesized
agtaccttccttttaaccct

SEQ ID NO: 514673 - DNA, 20 bp, Artificial Sequence
  chemically synthesized
ttattggctcaggacatccc

SEQ ID NO: 514674 - DNA, 20 bp, Artificial Sequence
  chemically synthesized
ctactcagaagcatctgcat

SEQ ID NO: 514675 - DNA, 20 bp, Artificial Sequence
  chemically synthesized
taatccaaatgcagatgctt

SEQ ID NO: 514676 - DNA, 20 bp, Artificial Sequence
  chemically synthesized
caaatgcagatgcttctgag

SEQ ID NO: 514677 - DNA, 20 bp, Artificial Sequence
  chemically synthesized
tagtatacatgcctcccatt

SEQ ID NO: 514678 - DNA, 20 bp, Artificial Sequence
  chemically synthesized
tatatctctacagaaactat

SEQ ID NO: 514679 - DNA, 20 bp, Artificial Sequence
  chemically synthesized
ccaattcgctatgccttgtc

SEQ ID NO: 514680 - DNA, 20 bp, Artificial Sequence
  chemically synthesized
agaattcaagacaaggcata

SEQ ID NO: 514681 - DNA, 20 bp, Artificial Sequence
  chemically synthesized
caagacaaggcatagcgaat

SEQ ID NO: 514682 - DNA, 20 bp, Artificial Sequence
  chemically synthesized
ggcatagcgaattggagttc

SEQ ID NO: 514683 - DNA, 20 bp, Artificial Sequence
  chemically synthesized
attttgcctttctcataaag

SEQ ID NO: 514684 - DNA, 20 bp, Artificial Sequence
  chemically synthesized
agatctgtcagccctggtct

SEQ ID NO: 514685 - DNA, 20 bp, Artificial Sequence
  chemically synthesized
tgtgattaggacaaacaatg

SEQ ID NO: 514686 - DNA, 20 bp, Artificial Sequence
  chemically synthesized
attaggacaaacaatggtga

SEQ ID NO: 514687 - DNA, 20 bp, Artificial Sequence
  chemically synthesized
atttcagatactgctactaa

SEQ ID NO: 514688 - DNA, 20 bp, Artificial Sequence
  chemically synthesized
accttatactggccaatctc

SEQ ID NO: 514689 - DNA, 20 bp, Artificial Sequence
  chemically synthesized
tatgcataaatgcaaatcat

SEQ ID NO: 514690 - DNA, 20 bp, Artificial Sequence
  chemically synthesized
tggttttttctttatatcaa

SEQ ID NO: 514691 - DNA, 20 bp, Artificial Sequence
  chemically synthesized
gagaaaggcttatctcatat

SEQ ID NO: 514692 - DNA, 20 bp, Artificial Sequence
  chemically synthesized
tcgtaattcataagcatgat

SEQ ID NO: 514693 - DNA, 20 bp, Artificial Sequence
  chemically synthesized
taaacacccaaatcatgctt

SEQ ID NO: 514694 - DNA, 20 bp, Artificial Sequence
  chemically synthesized
atcatgcttatgaattacga

SEQ ID NO: 514695 - DNA, 20 bp, Artificial Sequence
  chemically synthesized
catacataatgtttaagata

SEQ ID NO: 514696 - DNA, 20 bp, Artificial Sequence
  chemically synthesized
atcacccaaagcaatttagt

SEQ ID NO: 514697 - DNA, 20 bp, Artificial Sequence
  chemically synthesized
ttaaccctgactaaattgct

SEQ ID NO: 514698 - DNA, 20 bp, Artificial Sequence
  chemically synthesized
taaattgctttgggtgatag

SEQ ID NO: 514699 - DNA, 20 bp, Artificial Sequence
  chemically synthesized
tcctctggtcatttccctga

SEQ ID NO: 514700 - DNA, 20 bp, Artificial Sequence
  chemically synthesized
ctcagtcagggaaatgacca

SEQ ID NO: 514701 - DNA, 20 bp, Artificial Sequence
  chemically synthesized
taacagagggccaggacaag

SEQ ID NO: 514702 - DNA, 20 bp, Artificial Sequence
  chemically synthesized
aagtcagtcctactttgtta

SEQ ID NO: 514703 - DNA, 20 bp, Artificial Sequence
  chemically synthesized
taacaaagtaggactgactt

SEQ ID NO: 514704 - DNA, 20 bp, Artificial Sequence
  chemically synthesized
tgtgaacaatttacatatat

SEQ ID NO: 514705 - DNA, 20 bp, Artificial Sequence
  chemically synthesized
attgttcacagtcataggag

SEQ ID NO: 514706 - DNA, 20 bp, Artificial Sequence
  chemically synthesized
gttcagacttcttgaaaaaa

SEQ ID NO: 514707 - DNA, 20 bp, Artificial Sequence
  chemically synthesized
tatgtgagattaatactaaa

SEQ ID NO: 514708 - DNA, 20 bp, Artificial Sequence
  chemically synthesized
gtctcttctgtataggactt

SEQ ID NO: 514709 - DNA, 20 bp, Artificial Sequence
  chemically synthesized
acttcagaatttaattgagg

SEQ ID NO: 514710 - DNA, 20 bp, Artificial Sequence
  chemically synthesized
agacaaaaatgggccttctg

SEQ ID NO: 514711 - DNA, 20 bp, Artificial Sequence
  chemically synthesized
caaggtttctggcagacagt

SEQ ID NO: 514712 - DNA, 20 bp, Artificial Sequence
  chemically synthesized
gtatatattgtcagatatct

SEQ ID NO: 514713 - DNA, 20 bp, Artificial Sequence
  chemically synthesized
ctgacaatatataccgagaa

SEQ ID NO: 514714 - DNA, 20 bp, Artificial Sequence
  chemically synthesized
aagtgttacaggaggcaggc

SEQ ID NO: 514715 - DNA, 20 bp, Artificial Sequence
  chemically synthesized
aggaggcaggctggggtaga

SEQ ID NO: 514716 - DNA, 20 bp, Artificial Sequence
  chemically synthesized
gtgtgtatgtgcatgtgctg

SEQ ID NO: 514717 - DNA, 20 bp, Artificial Sequence
  chemically synthesized
agacgaaggctatgatttag

SEQ ID NO: 514718 - DNA, 20 bp, Artificial Sequence
  chemically synthesized
ggggcttaaactctactttt

SEQ ID NO: 514719 - DNA, 20 bp, Artificial Sequence
  chemically synthesized
tagattgctattctaaaaag

SEQ ID NO: 514720 - DNA, 20 bp, Artificial Sequence
  chemically synthesized
taagacgattatttcagtca

SEQ ID NO: 514721 - DNA, 20 bp, Artificial Sequence
  chemically synthesized
ttcagtcaggggatttcaat

SEQ ID NO: 514722 - DNA, 20 bp, Artificial Sequence
  chemically synthesized
tatcaatcatgtatcttcac

SEQ ID NO: 514723 - DNA, 20 bp, Artificial Sequence
  chemically synthesized
cctgtatgagtttatacatg

SEQ ID NO: 514724 - DNA, 20 bp, Artificial Sequence
  chemically synthesized
ttattttacaaggaacctgt

SEQ ID NO: 514725 - DNA, 20 bp, Artificial Sequence
  chemically synthesized
atagataccaagtagtaaaa

SEQ ID NO: 514726 - DNA, 20 bp, Artificial Sequence
  chemically synthesized
tttactttttctgcaggcgg

SEQ ID NO: 514727 - DNA, 20 bp, Artificial Sequence
  chemically synthesized
catacgaggttgctttacta

SEQ ID NO: 514728 - DNA, 20 bp, Artificial Sequence
  chemically synthesized
catagttttatgacatctag

SEQ ID NO: 514729 - DNA, 20 bp, Artificial Sequence
  chemically synthesized
aaagttaactttaaacttag

SEQ ID NO: 514730 - DNA, 20 bp, Artificial Sequence
  chemically synthesized
agaacctcttcagtgaccta

SEQ ID NO: 514731 - DNA, 20 bp, Artificial Sequence
  chemically synthesized
tggaagtgtgctttgttaaa

SEQ ID NO: 514732 - DNA, 20 bp, Artificial Sequence
  chemically synthesized
tatagctttagttttcaaaa

SEQ ID NO: 514733 - DNA, 20 bp, Artificial Sequence
  chemically synthesized
tgaaaactaaagctatattt

SEQ ID NO: 514734 - DNA, 20 bp, Artificial Sequence
  chemically synthesized
taattaatctgccgaagatg

SEQ ID NO: 514735 - DNA, 20 bp, Artificial Sequence
  chemically synthesized
ttatcataggtcaagtctat

SEQ ID NO: 514736 - DNA, 20 bp, Artificial Sequence
  chemically synthesized
tcaagtctatttgaattagt

SEQ ID NO: 514737 - DNA, 20 bp, Artificial Sequence
  chemically synthesized
tttgaattagtttgaatagc

SEQ ID NO: 514738 - DNA, 20 bp, Artificial Sequence
  chemically synthesized
agtgaattaattagatcatt

SEQ ID NO: 514739 - DNA, 20 bp, Artificial Sequence
  chemically synthesized
gatctaattaattcactgaa

SEQ ID NO: 514740 - DNA, 20 bp, Artificial Sequence
  chemically synthesized
tagaatctatattcatttca

SEQ ID NO: 514741 - DNA, 20 bp, Artificial Sequence
  chemically synthesized
tgtattttttctctccttca

SEQ ID NO: 514742 - DNA, 20 bp, Artificial Sequence
  chemically synthesized
caggcatgatcaaggcagtt

SEQ ID NO: 514743 - DNA, 20 bp, Artificial Sequence
  chemically synthesized
agcaaaagaccacaatctac

SEQ ID NO: 514744 - DNA, 20 bp, Artificial Sequence
  chemically synthesized
aaagaccacaatctacctgg

SEQ ID NO: 514745 - DNA, 20 bp, Artificial Sequence
  chemically synthesized
acataaagtttaaccattct

SEQ ID NO: 514746 - DNA, 20 bp, Artificial Sequence
  chemically synthesized
cactctgactggtatattcc

SEQ ID NO: 514747 - DNA, 20 bp, Artificial Sequence
  chemically synthesized
cattcttggaatataccagt

SEQ ID NO: 514748 - DNA, 20 bp, Artificial Sequence
  chemically synthesized
gcaagcatgttttgagtgat

SEQ ID NO: 514749 - DNA, 20 bp, Artificial Sequence
  chemically synthesized
gtatgcacagcaagcatgtt

SEQ ID NO: 514750 - DNA, 20 bp, Artificial Sequence
  chemically synthesized
tgctatgacctattctcata

SEQ ID NO: 514751 - DNA, 20 bp, Artificial Sequence
  chemically synthesized
aaatttgagttatccagtat

SEQ ID NO: 514752 - DNA, 20 bp, Artificial Sequence
  chemically synthesized
tactggataactcaaatttt

SEQ ID NO: 514753 - DNA, 20 bp, Artificial Sequence
  chemically synthesized
aaacccgatattcctaaaat

SEQ ID NO: 514754 - DNA, 20 bp, Artificial Sequence
  chemically synthesized
taactcaaattttaggaata

SEQ ID NO: 514755 - DNA, 20 bp, Artificial Sequence
  chemically synthesized
aaatagatgaaaagctctca

SEQ ID NO: 514756 - DNA, 20 bp, Artificial Sequence
  chemically synthesized
tataattcctgagcaaagaa

SEQ ID NO: 514757 - DNA, 20 bp, Artificial Sequence
  chemically synthesized
ttttactcagttctttgctc

SEQ ID NO: 514758 - DNA, 20 bp, Artificial Sequence
  chemically synthesized
ctcatttaatagtgtgtctc

SEQ ID NO: 514759 - DNA, 20 bp, Artificial Sequence
  chemically synthesized
ctcatgagacacactattaa

SEQ ID NO: 514760 - DNA, 20 bp, Artificial Sequence
  chemically synthesized
tgagacacactattaaatga

SEQ ID NO: 514761 - DNA, 20 bp, Artificial Sequence
  chemically synthesized
ctctaagtatctcatgtaag

SEQ ID NO: 514762 - DNA, 20 bp, Artificial Sequence
  chemically synthesized
gtggctctttgtcatgaaac

SEQ ID NO: 514763 - DNA, 20 bp, Artificial Sequence
  chemically synthesized
tctttgtcatgaaactagaa

SEQ ID NO: 514764 - DNA, 20 bp, Artificial Sequence
  chemically synthesized
tggctcagatctgtctaatt

SEQ ID NO: 514765 - DNA, 20 bp, Artificial Sequence
  chemically synthesized
agattgaaagaacaagaacc

SEQ ID NO: 514766 - DNA, 20 bp, Artificial Sequence
  chemically synthesized
attacctcatgaggggattg

SEQ ID NO: 514767 - DNA, 20 bp, Artificial Sequence
  chemically synthesized
agctgggaattacctcatga

SEQ ID NO: 514768 - DNA, 20 bp, Artificial Sequence
  chemically synthesized
agataggtgatgaaaaagct

SEQ ID NO: 514769 - DNA, 20 bp, Artificial Sequence
  chemically synthesized
tgtctttgactgattaaatt

SEQ ID NO: 514770 - DNA, 20 bp, Artificial Sequence
  chemically synthesized
cagtcaaagacatattgagc

SEQ ID NO: 514771 - DNA, 20 bp, Artificial Sequence
  chemically synthesized
gaataaacctgagctaggta

SEQ ID NO: 514772 - DNA, 20 bp, Artificial Sequence
  chemically synthesized
ggcccagaccctatagaact

SEQ ID NO: 514773 - DNA, 20 bp, Artificial Sequence
  chemically synthesized
ttgctggactctaagttcta

SEQ ID NO: 514774 - DNA, 20 bp, Artificial Sequence
  chemically synthesized
tctatgtaatagtacctttt

SEQ ID NO: 514775 - DNA, 20 bp, Artificial Sequence
  chemically synthesized
gtgggagctctcacaagcct

SEQ ID NO: 514776 - DNA, 20 bp, Artificial Sequence
  chemically synthesized
tttccaaaaaacgtcaggtg

SEQ ID NO: 514777 - DNA, 20 bp, Artificial Sequence
  chemically synthesized
gatgggtctaacattagcct

SEQ ID NO: 514778 - DNA, 20 bp, Artificial Sequence
  chemically synthesized
gtgctctttacatacactcc

SEQ ID NO: 514779 - DNA, 20 bp, Artificial Sequence
  chemically synthesized
caaagtttatatgtgatcca

SEQ ID NO: 514780 - DNA, 20 bp, Artificial Sequence
  chemically synthesized
ccttggatcacatataaact

SEQ ID NO: 514781 - DNA, 20 bp, Artificial Sequence
  chemically synthesized
atgtcttttgcctggaaacc

SEQ ID NO: 514782 - DNA, 20 bp, Artificial Sequence
  chemically synthesized
tttttaatcgtggaagttta

SEQ ID NO: 514783 - DNA, 20 bp, Artificial Sequence
  chemically synthesized
aacttccacgattaaaaaca

SEQ ID NO: 514784 - DNA, 20 bp, Artificial Sequence
  chemically synthesized
tgacatggctacctggttgt

SEQ ID NO: 514785 - DNA, 20 bp, Artificial Sequence
  chemically synthesized
atgacaagacctgtaaatgc

SEQ ID NO: 514786 - DNA, 20 bp, Artificial Sequence
  chemically synthesized
gtccctgtgtgcccagcttt

SEQ ID NO: 514787 - DNA, 20 bp, Artificial Sequence
  chemically synthesized
ttgtctaagtatatatgtgg

SEQ ID NO: 514788 - DNA, 20 bp, Artificial Sequence
  chemically synthesized
tatatacttagacaaaaatt

SEQ ID NO: 514789 - DNA, 20 bp, Artificial Sequence
  chemically synthesized
ctatttgagtagaatttcaa

SEQ ID NO: 514790 - DNA, 20 bp, Artificial Sequence
  chemically synthesized
tgaaaatggatctatttgag

SEQ ID NO: 514791 - DNA, 20 bp, Artificial Sequence
  chemically synthesized
gaatttgaaaatggatctat

SEQ ID NO: 514792 - DNA, 20 bp, Artificial Sequence
  chemically synthesized
ttttcccatggaatttgaaa

SEQ ID NO: 514793 - DNA, 20 bp, Artificial Sequence
  chemically synthesized
gtgttatgttctttttccca

SEQ ID NO: 514794 - DNA, 20 bp, Artificial Sequence
  chemically synthesized
aacacaaaaccctaacatgc

SEQ ID NO: 514795 - DNA, 20 bp, Artificial Sequence
  chemically synthesized
ctttaaaaattctagcatgt

SEQ ID NO: 514796 - DNA, 20 bp, Artificial Sequence
  chemically synthesized
ctaacatgctagaattttta

SEQ ID NO: 514797 - DNA, 20 bp, Artificial Sequence
  chemically synthesized
agatggtaggaaagacagtt

SEQ ID NO: 514798 - DNA, 20 bp, Artificial Sequence
  chemically synthesized
cctctgccaggggatggggg

SEQ ID NO: 514799 - DNA, 20 bp, Artificial Sequence
  chemically synthesized
atgagacatggcctctgcca

SEQ ID NO: 514800 - DNA, 20 bp, Artificial Sequence
  chemically synthesized
tgcttgcaggagggagggcg

SEQ ID NO: 514801 - DNA, 20 bp, Artificial Sequence
  chemically synthesized
cccactgtgacagggcagca

SEQ ID NO: 514802 - DNA, 20 bp, Artificial Sequence
  chemically synthesized
cagtgggaagcaacacaggg

SEQ ID NO: 514803 - DNA, 20 bp, Artificial Sequence
  chemically synthesized
gtgccctctatgtgcgcttg

SEQ ID NO: 514804 - DNA, 20 bp, Artificial Sequence
  chemically synthesized
ctgagatgggtgatacctcc

SEQ ID NO: 514805 - DNA, 20 bp, Artificial Sequence
  chemically synthesized
ctcagcttctaactgctgag

SEQ ID NO: 514806 - DNA, 20 bp, Artificial Sequence
  chemically synthesized
cccatctcagcagttagaag

SEQ ID NO: 514807 - DNA, 20 bp, Artificial Sequence
  chemically synthesized
cagtgtgagctcaagcactt

SEQ ID NO: 514808 - DNA, 20 bp, Artificial Sequence
  chemically synthesized
ggtcctaaataaacttcaaa

SEQ ID NO: 514809 - DNA, 20 bp, Artificial Sequence
  chemically synthesized
cacgacaccaagacttgccc

SEQ ID NO: 514810 - DNA, 20 bp, Artificial Sequence
  chemically synthesized
gcccaccaagtcccctgact

SEQ ID NO: 514811 - DNA, 20 bp, Artificial Sequence
  chemically synthesized
gtacaagcactggtgtctta

SEQ ID NO: 514812 - DNA, 20 bp, Artificial Sequence
  chemically synthesized
cactgttaggggttagagga

SEQ ID NO: 514813 - DNA, 20 bp, Artificial Sequence
  chemically synthesized
agctgcactgttaggggtta

SEQ ID NO: 514814 - DNA, 20 bp, Artificial Sequence
  chemically synthesized
aagctgtcagctgcactgtt

SEQ ID NO: 514815 - DNA, 20 bp, Artificial Sequence
  chemically synthesized
ctgcttcttccacttgagga

SEQ ID NO: 514816 - DNA, 20 bp, Artificial Sequence
  chemically synthesized
ggacacaagctcaaccacag

SEQ ID NO: 514817 - DNA, 20 bp, Artificial Sequence
  chemically synthesized
cagtaggataaggcatcagg

SEQ ID NO: 514818 - DNA, 20 bp, Artificial Sequence
  chemically synthesized
aggagccagggcctggaatg

SEQ ID NO: 514819 - DNA, 20 bp, Artificial Sequence
  chemically synthesized
gtcactcaggagccagggcc

SEQ ID NO: 514820 - DNA, 20 bp, Artificial Sequence
  chemically synthesized
cccattccaggccctggctc

SEQ ID NO: 514821 - DNA, 20 bp, Artificial Sequence
  chemically synthesized
ttctggccctgggtgtattt

SEQ ID NO: 514822 - DNA, 20 bp, Artificial Sequence
  chemically synthesized
tagcaagttcccttctggcc

SEQ ID NO: 514823 - DNA, 20 bp, Artificial Sequence
  chemically synthesized
gaacttgctaccttgaagag

SEQ ID NO: 514824 - DNA, 20 bp, Artificial Sequence
  chemically synthesized
agagaagaatccagtcctgg

SEQ ID NO: 514825 - DNA, 20 bp, Artificial Sequence
  chemically synthesized
ggtgacgaattctaccagga

SEQ ID NO: 514826 - DNA, 20 bp, Artificial Sequence
  chemically synthesized
gactctttagtcagcaggtg

SEQ ID NO: 514827 - DNA, 20 bp, Artificial Sequence
  chemically synthesized
aattcgtcacctgctgacta

SEQ ID NO: 514828 - DNA, 20 bp, Artificial Sequence
  chemically synthesized
acctgctgactaaagagtcc

SEQ ID NO: 514829 - DNA, 20 bp, Artificial Sequence
  chemically synthesized
gactaaagagtccctgggtc

SEQ ID NO: 514830 - DNA, 20 bp, Artificial Sequence
  chemically synthesized
caggcagtattcaccaagtc

SEQ ID NO: 514831 - DNA, 20 bp, Artificial Sequence
  chemically synthesized
tgagtcttacccaagacttg

SEQ ID NO: 514832 - DNA, 20 bp, Artificial Sequence
  chemically synthesized
cacccaaagacagcatggct

SEQ ID NO: 514833 - DNA, 20 bp, Artificial Sequence
  chemically synthesized
gactcagagccatgctgtct

SEQ ID NO: 514834 - DNA, 20 bp, Artificial Sequence
  chemically synthesized
tccccatggccaccacactt

SEQ ID NO: 514835 - DNA, 20 bp, Artificial Sequence
  chemically synthesized
ttcccaagtgtggtggccat

SEQ ID NO: 514836 - DNA, 20 bp, Artificial Sequence
  chemically synthesized
ctctcctttccaaaagcaca

SEQ ID NO: 514837 - DNA, 20 bp, Artificial Sequence
  chemically synthesized
cttttggaaaggagaggcaa

SEQ ID NO: 514838 - DNA, 20 bp, Artificial Sequence
  chemically synthesized
agtggactttgtcttgcagc

SEQ ID NO: 514839 - DNA, 20 bp, Artificial Sequence
  chemically synthesized
gtagaccatcaagcaagctc

SEQ ID NO: 514840 - DNA, 20 bp, Artificial Sequence
  chemically synthesized
ctgattgcaggccttggctc

SEQ ID NO: 514841 - DNA, 20 bp, Artificial Sequence
  chemically synthesized
gggttctcctcaggccccag

SEQ ID NO: 514842 - DNA, 20 bp, Artificial Sequence
  chemically synthesized
gggtctctccgttctgtgca

SEQ ID NO: 514843 - DNA, 20 bp, Artificial Sequence
  chemically synthesized
aggagtaaacgctgcgaggc

SEQ ID NO: 514844 - DNA, 20 bp, Artificial Sequence
  chemically synthesized
caagagctttttagttaact

SEQ ID NO: 514845 - DNA, 20 bp, Artificial Sequence
  chemically synthesized
aactaaaaagctcttgggcc

SEQ ID NO: 514846 - DNA, 20 bp, Artificial Sequence
  chemically synthesized
accactgcctcaggctcatg

SEQ ID NO: 514847 - DNA, 20 bp, Artificial Sequence
  chemically synthesized
ctttcccatttcataagcag

SEQ ID NO: 514848 - DNA, 20 bp, Artificial Sequence
  chemically synthesized
tgcttatgaaatgggaaagg

SEQ ID NO: 514849 - DNA, 20 bp, Artificial Sequence
  chemically synthesized
gacaaactttgtattgtggc

SEQ ID NO: 514850 - DNA, 20 bp, Artificial Sequence
  chemically synthesized
aggcctgaagttgcatcttt

SEQ ID NO: 514851 - DNA, 20 bp, Artificial Sequence
  chemically synthesized
gatggcaagcatcaaaagtc

SEQ ID NO: 514852 - DNA, 20 bp, Artificial Sequence
  chemically synthesized
tcaaaagtcaaggataaaga

SEQ ID NO: 514853 - DNA, 20 bp, Artificial Sequence
  chemically synthesized
atcttttctcttgctgcttt

SEQ ID NO: 514854 - DNA, 20 bp, Artificial Sequence
  chemically synthesized
ctagttgttgttaagctttt

SEQ ID NO: 514855 - DNA, 20 bp, Artificial Sequence
  chemically synthesized
aaggaaaagaccctttatgc

SEQ ID NO: 514856 - DNA, 20 bp, Artificial Sequence
  chemically synthesized
ggatgcactatcctagcata

SEQ ID NO: 514857 - DNA, 20 bp, Artificial Sequence
  chemically synthesized
ttgttggaaggagattttca

SEQ ID NO: 514858 - DNA, 20 bp, Artificial Sequence
  chemically synthesized
accttccaagacagaagctg

SEQ ID NO: 514859 - DNA, 20 bp, Artificial Sequence
  chemically synthesized
gttctacaagaaatgctaaa

SEQ ID NO: 514860 - DNA, 20 bp, Artificial Sequence
  chemically synthesized
tttgtgtttgtctgtactta

SEQ ID NO: 514861 - DNA, 20 bp, Artificial Sequence
  chemically synthesized
atgtatgaactactcatatc

SEQ ID NO: 514862 - DNA, 20 bp, Artificial Sequence
  chemically synthesized
ttactcttcttattcaagat

SEQ ID NO: 514863 - DNA, 20 bp, Artificial Sequence
  chemically synthesized
ctactcatatcttgaataag

SEQ ID NO: 514864 - DNA, 20 bp, Artificial Sequence
  chemically synthesized
tgtctatgtcttaaagttat

SEQ ID NO: 514865 - DNA, 20 bp, Artificial Sequence
  chemically synthesized
aagattaaaagagacgaagt

SEQ ID NO: 514866 - DNA, 20 bp, Artificial Sequence
  chemically synthesized
agtgttgtctgtttgaaata

SEQ ID NO: 514867 - DNA, 20 bp, Artificial Sequence
  chemically synthesized
tttcttgctttttaaatttt

SEQ ID NO: 514868 - DNA, 20 bp, Artificial Sequence
  chemically synthesized
gccttcactaaaaaggaaga

SEQ ID NO: 514869 - DNA, 20 bp, Artificial Sequence
  chemically synthesized
caaccagaaaacaaaatggt

SEQ ID NO: 514870 - DNA, 20 bp, Artificial Sequence
  chemically synthesized
ctgtcactgtgttttgattg

SEQ ID NO: 514871 - DNA, 20 bp, Artificial Sequence
  chemically synthesized
tgtttcttgtaggcaacaga

SEQ ID NO: 514872 - DNA, 20 bp, Artificial Sequence
  chemically synthesized
caaagccagacttaaaatta

SEQ ID NO: 514873 - DNA, 20 bp, Artificial Sequence
  chemically synthesized
ttttttggttgctatcgaca

SEQ ID NO: 514874 - DNA, 20 bp, Artificial Sequence
  chemically synthesized
gatagcaaccaaaaaagaac

SEQ ID NO: 514875 - DNA, 20 bp, Artificial Sequence
  chemically synthesized
aaatatattttgtttgatgt

SEQ ID NO: 514876 - DNA, 20 bp, Artificial Sequence
  chemically synthesized
caaagatcaacatataataa

SEQ ID NO: 514877 - DNA, 20 bp, Artificial Sequence
  chemically synthesized
aataatgttgctttatatat

SEQ ID NO: 514878 - DNA, 20 bp, Artificial Sequence
  chemically synthesized
atgacgtccaaggctgaaag

SEQ ID NO: 514879 - DNA, 20 bp, Artificial Sequence
  chemically synthesized
aacatttcaaccaacagctg

SEQ ID NO: 514880 - DNA, 20 bp, Artificial Sequence
  chemically synthesized
atcctccatgtggtgatgag

SEQ ID NO: 514881 - DNA, 20 bp, Artificial Sequence
  chemically synthesized
attcctctcatcaccacatg

SEQ ID NO: 514882 - DNA, 20 bp, Artificial Sequence
  chemically synthesized
tcaccacatggaggattctc

SEQ ID NO: 514883 - DNA, 20 bp, Artificial Sequence
  chemically synthesized
ctaacatatggcccatcctt

SEQ ID NO: 514884 - DNA, 20 bp, Artificial Sequence
  chemically synthesized
atactttatatttcaatttt

SEQ ID NO: 514885 - DNA, 20 bp, Artificial Sequence
  chemically synthesized
agtatcttatctgaccacag

SEQ ID NO: 514886 - DNA, 20 bp, Artificial Sequence
  chemically synthesized
gaactgagaaatcagtaatg

SEQ ID NO: 514887 - DNA, 20 bp, Artificial Sequence
  chemically synthesized
gaaaattatacaaaacacaa

SEQ ID NO: 514888 - DNA, 20 bp, Artificial Sequence
  chemically synthesized
gggaattaatctatattctc

SEQ ID NO: 514889 - DNA, 20 bp, Artificial Sequence
  chemically synthesized
ttgacccactgatcattcaa

SEQ ID NO: 514890 - DNA, 20 bp, Artificial Sequence
  chemically synthesized
tatattctcttgaatgatca

SEQ ID NO: 514891 - DNA, 20 bp, Artificial Sequence
  chemically synthesized
agaaattttataacttcctt

SEQ ID NO: 514892 - DNA, 20 bp, Artificial Sequence
  chemically synthesized
aacaatacatcttaaagaac

SEQ ID NO: 514893 - DNA, 20 bp, Artificial Sequence
  chemically synthesized
cttcatgacacaatctaatt

SEQ ID NO: 514894 - DNA, 20 bp, Artificial Sequence
  chemically synthesized
attacttgttgttggtctgt

SEQ ID NO: 514895 - DNA, 20 bp, Artificial Sequence
  chemically synthesized
gagacctgatggcttcactg

SEQ ID NO: 514896 - DNA, 20 bp, Artificial Sequence
  chemically synthesized
ctcctctttttcacaatagt

SEQ ID NO: 514897 - DNA, 20 bp, Artificial Sequence
  chemically synthesized
gctaatattggcctcacaga

SEQ ID NO: 514898 - DNA, 20 bp, Artificial Sequence
  chemically synthesized
tcaggctaatattggcctca

SEQ ID NO: 514899 - DNA, 20 bp, Artificial Sequence
  chemically synthesized
atagcctgcagttttgtttt

SEQ ID NO: 514900 - DNA, 20 bp, Artificial Sequence
  chemically synthesized
tggtttgctagtattttgtt

SEQ ID NO: 514901 - DNA, 20 bp, Artificial Sequence
  chemically synthesized
atgacctttttaatgttgtg

SEQ ID NO: 514902 - DNA, 20 bp, Artificial Sequence
  chemically synthesized
acaaataccacttggttata

SEQ ID NO: 514903 - DNA, 20 bp, Artificial Sequence
  chemically synthesized
aaccaagtggtatttgtcct

SEQ ID NO: 514904 - DNA, 20 bp, Artificial Sequence
  chemically synthesized
tttgtcctagggatgccaag

SEQ ID NO: 514905 - DNA, 20 bp, Artificial Sequence
  chemically synthesized
aatgtgatagatcgtatgaa

SEQ ID NO: 514906 - DNA, 20 bp, Artificial Sequence
  chemically synthesized
gtttttatcatgaaggcatg

SEQ ID NO: 514907 - DNA, 20 bp, Artificial Sequence
  chemically synthesized
catgataaaaactctcaaaa

SEQ ID NO: 514908 - DNA, 20 bp, Artificial Sequence
  chemically synthesized
ctgcttctatacccagtttt

SEQ ID NO: 514909 - DNA, 20 bp, Artificial Sequence
  chemically synthesized
cattcagtatgaaattagct

SEQ ID NO: 514910 - DNA, 20 bp, Artificial Sequence
  chemically synthesized
aacccacagctaatttcata

SEQ ID NO: 514911 - DNA, 20 bp, Artificial Sequence
  chemically synthesized
ttttctctaagatctgtaac

SEQ ID NO: 514912 - DNA, 20 bp, Artificial Sequence
  chemically synthesized
tttgattcttccttttcaat

SEQ ID NO: 514913 - DNA, 20 bp, Artificial Sequence
  chemically synthesized
gggcatccagattgaaaagg

SEQ ID NO: 514914 - DNA, 20 bp, Artificial Sequence
  chemically synthesized
ggattcctagttttgtaaac

SEQ ID NO: 514915 - DNA, 20 bp, Artificial Sequence
  chemically synthesized
tgatccttgtttacaaaact

SEQ ID NO: 514916 - DNA, 20 bp, Artificial Sequence
  chemically synthesized
tataatttgaagtcaggtaa

SEQ ID NO: 514917 - DNA, 20 bp, Artificial Sequence
  chemically synthesized
agacacatagaccaatggaa

SEQ ID NO: 514918 - DNA, 20 bp, Artificial Sequence
  chemically synthesized
atgagtttactttaggtctg

SEQ ID NO: 514919 - DNA, 20 bp, Artificial Sequence
  chemically synthesized
tcttggcacctttgttaaaa

SEQ ID NO: 514920 - DNA, 20 bp, Artificial Sequence
  chemically synthesized
aataaatggtgctgagaaaa

SEQ ID NO: 514921 - DNA, 20 bp, Artificial Sequence
  chemically synthesized
tggtgctgagaaaactggat

SEQ ID NO: 514922 - DNA, 20 bp, Artificial Sequence
  chemically synthesized
aactggatatggatatgcaa

SEQ ID NO: 514923 - DNA, 20 bp, Artificial Sequence
  chemically synthesized
ttttgtatatggcgagagat

SEQ ID NO: 514924 - DNA, 20 bp, Artificial Sequence
  chemically synthesized
aaactactacaagaaatcat

SEQ ID NO: 514925 - DNA, 20 bp, Artificial Sequence
  chemically synthesized
ctttgattgcttgtgcttgg

SEQ ID NO: 514926 - DNA, 20 bp, Artificial Sequence
  chemically synthesized
taaaaagcttctacacagca

SEQ ID NO: 514927 - DNA, 20 bp, Artificial Sequence
  chemically synthesized
caaagtgaagacacaacaca

SEQ ID NO: 514928 - DNA, 20 bp, Artificial Sequence
  chemically synthesized
acacaacacacagagtagga

SEQ ID NO: 514929 - DNA, 20 bp, Artificial Sequence
  chemically synthesized
ggccaactacccacctgaca

SEQ ID NO: 514930 - DNA, 20 bp, Artificial Sequence
  chemically synthesized
ttttggttattccttgtcag

SEQ ID NO: 514931 - DNA, 20 bp, Artificial Sequence
  chemically synthesized
attatatatatttttttcta

SEQ ID NO: 514932 - DNA, 20 bp, Artificial Sequence
  chemically synthesized
attgaaagaagggcaaaaat

SEQ ID NO: 514933 - DNA, 20 bp, Artificial Sequence
  chemically synthesized
agatgacacaaatgtcaaag

SEQ ID NO: 514934 - DNA, 20 bp, Artificial Sequence
  chemically synthesized
tggatataagccattttaac

SEQ ID NO: 514935 - DNA, 20 bp, Artificial Sequence
  chemically synthesized
gcattgatgttgcctgtctg

SEQ ID NO: 514936 - DNA, 20 bp, Artificial Sequence
  chemically synthesized
aaccttggtacatcgttgtt

SEQ ID NO: 514937 - DNA, 20 bp, Artificial Sequence
  chemically synthesized
tatacccggcagtaggattg

SEQ ID NO: 514938 - DNA, 20 bp, Artificial Sequence
  chemically synthesized
ataatccagcaatcctactg

SEQ ID NO: 514939 - DNA, 20 bp, Artificial Sequence
  chemically synthesized
tttgggtatatacccggcag

SEQ ID NO: 514940 - DNA, 20 bp, Artificial Sequence
  chemically synthesized
acaaactgatttcctttctt

SEQ ID NO: 514941 - DNA, 20 bp, Artificial Sequence
  chemically synthesized
aatagggttgcaataaacat

SEQ ID NO: 514942 - DNA, 20 bp, Artificial Sequence
  chemically synthesized
caaatcttggctattgtgaa

SEQ ID NO: 514943 - DNA, 20 bp, Artificial Sequence
  chemically synthesized
gcttccaaatcttggctatt

SEQ ID NO: 514944 - DNA, 20 bp, Artificial Sequence
  chemically synthesized
attcatttgttaatggatac

SEQ ID NO: 514945 - DNA, 20 bp, Artificial Sequence
  chemically synthesized
atccaagtatccattaacaa

SEQ ID NO: 514946 - DNA, 20 bp, Artificial Sequence
  chemically synthesized
ctttatccattcatttgtta

SEQ ID NO: 514947 - DNA, 20 bp, Artificial Sequence
  chemically synthesized
aagtatccattaacaaatga

SEQ ID NO: 514948 - DNA, 20 bp, Artificial Sequence
  chemically synthesized
tgtggtacatatatacgtag

SEQ ID NO: 514949 - DNA, 20 bp, Artificial Sequence
  chemically synthesized
cgtctcatttttttttatga

SEQ ID NO: 514950 - DNA, 20 bp, Artificial Sequence
  chemically synthesized
acgctgtcatttgcaacaac

SEQ ID NO: 514951 - DNA, 20 bp, Artificial Sequence
  chemically synthesized
tgcaacaacgtggatggaac

SEQ ID NO: 514952 - DNA, 20 bp, Artificial Sequence
  chemically synthesized
ttaatttttagttactgcat

SEQ ID NO: 514953 - DNA, 20 bp, Artificial Sequence
  chemically synthesized
caattgaactcatggagaca

SEQ ID NO: 514954 - DNA, 20 bp, Artificial Sequence
  chemically synthesized
tcattctactctctgtctcc

SEQ ID NO: 514955 - DNA, 20 bp, Artificial Sequence
  chemically synthesized
gaactcatggagacagagag

SEQ ID NO: 514956 - DNA, 20 bp, Artificial Sequence
  chemically synthesized
gagagtagaatgatgtttac

SEQ ID NO: 514957 - DNA, 20 bp, Artificial Sequence
  chemically synthesized
gatgtttaccagagtgtagt

SEQ ID NO: 514958 - DNA, 20 bp, Artificial Sequence
  chemically synthesized
tatgggtagttggggacagg

SEQ ID NO: 514959 - DNA, 20 bp, Artificial Sequence
  chemically synthesized
tagttggggacaggaggagt

SEQ ID NO: 514960 - DNA, 20 bp, Artificial Sequence
  chemically synthesized
aggaggagtgggaatgttta

SEQ ID NO: 514961 - DNA, 20 bp, Artificial Sequence
  chemically synthesized
agtgggtacaaaaatctagt

SEQ ID NO: 514962 - DNA, 20 bp, Artificial Sequence
  chemically synthesized
ggtacaaaaatctagttaga

SEQ ID NO: 514963 - DNA, 20 bp, Artificial Sequence
  chemically synthesized
agatctatttggcaacacaa

SEQ ID NO: 514964 - DNA, 20 bp, Artificial Sequence
  chemically synthesized
caacaatttactgtacattt

SEQ ID NO: 514965 - DNA, 20 bp, Artificial Sequence
  chemically synthesized
gcctcggcctcccaaagtgt

SEQ ID NO: 514966 - DNA, 20 bp, Artificial Sequence
  chemically synthesized
actttgggaggccgaggcag

SEQ ID NO: 514967 - DNA, 20 bp, Artificial Sequence
  chemically synthesized
cggggtttcactgtgttagc

SEQ ID NO: 514968 - DNA, 20 bp, Artificial Sequence
  chemically synthesized
ttttgtatttttagtagaga

SEQ ID NO: 514969 - DNA, 20 bp, Artificial Sequence
  chemically synthesized
ctcattgcaagctccgcctc

SEQ ID NO: 514970 - DNA, 20 bp, Artificial Sequence
  chemically synthesized
tagcatcactgcactccacc

SEQ ID NO: 514971 - DNA, 20 bp, Artificial Sequence
  chemically synthesized
tcttgctctgtcacccaggg

SEQ ID NO: 514972 - DNA, 20 bp, Artificial Sequence
  chemically synthesized
cgcagtcttgctctgtcacc

SEQ ID NO: 514973 - DNA, 20 bp, Artificial Sequence
  chemically synthesized
aaaaaaaaaaaaatttgaag

SEQ ID NO: 514974 - DNA, 20 bp, Artificial Sequence
  chemically synthesized
gaatgtttgtggcacaaaga

SEQ ID NO: 514975 - DNA, 20 bp, Artificial Sequence
  chemically synthesized
agtgaagtatctgtcacctc

SEQ ID NO: 514976 - DNA, 20 bp, Artificial Sequence
  chemically synthesized
catgcgaagcataatcatat

SEQ ID NO: 514977 - DNA, 20 bp, Artificial Sequence
  chemically synthesized
atggatacatagtatattta

SEQ ID NO: 514978 - DNA, 20 bp, Artificial Sequence
  chemically synthesized
ctttgttttagattaaattt

SEQ ID NO: 514979 - DNA, 20 bp, Artificial Sequence
  chemically synthesized
caagaacttcatatctaacc

SEQ ID NO: 514980 - DNA, 20 bp, Artificial Sequence
  chemically synthesized
acctggaataatttggtatt

SEQ ID NO: 514981 - DNA, 20 bp, Artificial Sequence
  chemically synthesized
gtaataatttgtttttcaaa

SEQ ID NO: 514982 - DNA, 20 bp, Artificial Sequence
  chemically synthesized
gtgcataagattattttttg

SEQ ID NO: 514983 - DNA, 20 bp, Artificial Sequence
  chemically synthesized
ttttatgaaaagaaaaaatc

SEQ ID NO: 514984 - DNA, 20 bp, Artificial Sequence
  chemically synthesized
acagacttcaactttctacc

SEQ ID NO: 514985 - DNA, 20 bp, Artificial Sequence
  chemically synthesized
cccagtctctgctcctcttt

SEQ ID NO: 514986 - DNA, 20 bp, Artificial Sequence
  chemically synthesized
gggaaaggtgagagaagtct

SEQ ID NO: 514987 - DNA, 20 bp, Artificial Sequence
  chemically synthesized
gtgagagaagtcttggagta

SEQ ID NO: 514988 - DNA, 20 bp, Artificial Sequence
  chemically synthesized
cttggagtacagaataaaac

SEQ ID NO: 514989 - DNA, 20 bp, Artificial Sequence
  chemically synthesized
aacatgaatcccaaagccat

SEQ ID NO: 514990 - DNA, 20 bp, Artificial Sequence
  chemically synthesized
ctatatgatcctgatggctt

SEQ ID NO: 514991 - DNA, 20 bp, Artificial Sequence
  chemically synthesized
ccaaacgtagtccttgtgtc

SEQ ID NO: 514992 - DNA, 20 bp, Artificial Sequence
  chemically synthesized
ccaagacacaaggactacgt

SEQ ID NO: 514993 - DNA, 20 bp, Artificial Sequence
  chemically synthesized
gcaaaggtcaaaaacgcaga

SEQ ID NO: 514994 - DNA, 20 bp, Artificial Sequence
  chemically synthesized
ggaggtaaccaaaatggaga

SEQ ID NO: 514995 - DNA, 20 bp, Artificial Sequence
  chemically synthesized
accaaaatggagagggagta

SEQ ID NO: 514996 - DNA, 20 bp, Artificial Sequence
  chemically synthesized
aaaggattataggtcaggta

SEQ ID NO: 514997 - DNA, 20 bp, Artificial Sequence
  chemically synthesized
gtgccccagctaggtgtaca

SEQ ID NO: 514998 - DNA, 20 bp, Artificial Sequence
  chemically synthesized
cgtattattttcgaaactca

SEQ ID NO: 514999 - DNA, 20 bp, Artificial Sequence
  chemically synthesized
tttaatatatcattgactct

SEQ ID NO: 515000 - DNA, 20 bp, Artificial Sequence
  chemically synthesized
gtgaatatgactaatagaaa

SEQ ID NO: 515001 - DNA, 20 bp, Artificial Sequence
  chemically synthesized
gcactctattagagaatatg

SEQ ID NO: 515002 - DNA, 20 bp, Artificial Sequence
  chemically synthesized
atattcaccatattctctaa

SEQ ID NO: 515003 - DNA, 20 bp, Artificial Sequence
  chemically synthesized
ttctgagaagcactctatta

SEQ ID NO: 515004 - DNA, 20 bp, Artificial Sequence
  chemically synthesized
ttctctaatagagtgcttct

SEQ ID NO: 515005 - DNA, 20 bp, Artificial Sequence
  chemically synthesized
ttcctggaaggatgctctgg

SEQ ID NO: 515006 - DNA, 20 bp, Artificial Sequence
  chemically synthesized
ccttcaatttcatttcctgg

SEQ ID NO: 515007 - DNA, 20 bp, Artificial Sequence
  chemically synthesized
cttccaggaaatgaaattga

SEQ ID NO: 515008 - DNA, 20 bp, Artificial Sequence
  chemically synthesized
gaaattgaaggaatttaccc

SEQ ID NO: 515009 - DNA, 20 bp, Artificial Sequence
  chemically synthesized
taatttatactgccagactc

SEQ ID NO: 515010 - DNA, 20 bp, Artificial Sequence
  chemically synthesized
aagaagaaggcaaaatctct

SEQ ID NO: 515011 - DNA, 20 bp, Artificial Sequence
  chemically synthesized
ttatcatttattttttgaga

SEQ ID NO: 515012 - DNA, 20 bp, Artificial Sequence
  chemically synthesized
gtctcgctctgttgccaggc

SEQ ID NO: 515013 - DNA, 20 bp, Artificial Sequence
  chemically synthesized
tacttgggaggctgaggcag

SEQ ID NO: 515014 - DNA, 20 bp, Artificial Sequence
  chemically synthesized
ttttgtatttttagtagaga

SEQ ID NO: 515015 - DNA, 20 bp, Artificial Sequence
  chemically synthesized
actttgggaagctgagggag

SEQ ID NO: 515016 - DNA, 20 bp, Artificial Sequence
  chemically synthesized
ccctcagcttcccaaagtac

SEQ ID NO: 515017 - DNA, 20 bp, Artificial Sequence
  chemically synthesized
aaaagtaattttaagtactt

SEQ ID NO: 515018 - DNA, 20 bp, Artificial Sequence
  chemically synthesized
ccacatcagaccgtgggaac

SEQ ID NO: 515019 - DNA, 20 bp, Artificial Sequence
  chemically synthesized
tggggtattcatactacagg

SEQ ID NO: 515020 - DNA, 20 bp, Artificial Sequence
  chemically synthesized
agttttattctccctgtagt

SEQ ID NO: 515021 - DNA, 20 bp, Artificial Sequence
  chemically synthesized
atagtatgttagattttacc

SEQ ID NO: 515022 - DNA, 20 bp, Artificial Sequence
  chemically synthesized
aatctaacatactatttctc

SEQ ID NO: 515023 - DNA, 20 bp, Artificial Sequence
  chemically synthesized
cctgcctgcaacttactcta

SEQ ID NO: 515024 - DNA, 20 bp, Artificial Sequence
  chemically synthesized
ctatagtatctataattcta

SEQ ID NO: 515025 - DNA, 20 bp, Artificial Sequence
  chemically synthesized
gctatttctgcttctgaaac

SEQ ID NO: 515026 - DNA, 20 bp, Artificial Sequence
  chemically synthesized
ctagtgagtgagtgagagac

SEQ ID NO: 515027 - DNA, 20 bp, Artificial Sequence
  chemically synthesized
caagataacacagctagtga

SEQ ID NO: 515028 - DNA, 20 bp, Artificial Sequence
  chemically synthesized
tgcccaagataacacagcta

SEQ ID NO: 515029 - DNA, 20 bp, Artificial Sequence
  chemically synthesized
aggcacaatttattcactat

SEQ ID NO: 515030 - DNA, 20 bp, Artificial Sequence
  chemically synthesized
atttgagccccattctaata

SEQ ID NO: 515031 - DNA, 20 bp, Artificial Sequence
  chemically synthesized
tgaacctcacgggagtgctc

SEQ ID NO: 515032 - DNA, 20 bp, Artificial Sequence
  chemically synthesized
gtgttgcagttgaacctcac

SEQ ID NO: 515033 - DNA, 20 bp, Artificial Sequence
  chemically synthesized
taaaaatcaatctatattta

SEQ ID NO: 515034 - DNA, 20 bp, Artificial Sequence
  chemically synthesized
gagttaaacgtttttacacc

SEQ ID NO: 515035 - DNA, 20 bp, Artificial Sequence
  chemically synthesized
gtgtgagccactgcacctgg

SEQ ID NO: 515036 - DNA, 20 bp, Artificial Sequence
  chemically synthesized
gcctcagcgtcccaaagtgc

SEQ ID NO: 515037 - DNA, 20 bp, Artificial Sequence
  chemically synthesized
caggtggctcacttaaggtc

SEQ ID NO: 515038 - DNA, 20 bp, Artificial Sequence
  chemically synthesized
catgtctctactaaaaatac

SEQ ID NO: 515039 - DNA, 20 bp, Artificial Sequence
  chemically synthesized
gcctcagcctctcgagtagt

SEQ ID NO: 515040 - DNA, 20 bp, Artificial Sequence
  chemically synthesized
gattctcctgcctcagcctc

SEQ ID NO: 515041 - DNA, 20 bp, Artificial Sequence
  chemically synthesized
tactcgagaggctgaggcag

SEQ ID NO: 515042 - DNA, 20 bp, Artificial Sequence
  chemically synthesized
tcttgcttcgtcacaaaggc

SEQ ID NO: 515043 - DNA, 20 bp, Artificial Sequence
  chemically synthesized
aaatattatattagaaagtg

SEQ ID NO: 515044 - DNA, 20 bp, Artificial Sequence
  chemically synthesized
tattagtttggcatccctgt

SEQ ID NO: 515045 - DNA, 20 bp, Artificial Sequence
  chemically synthesized
ctattgacttgcactcccac

SEQ ID NO: 515046 - DNA, 20 bp, Artificial Sequence
  chemically synthesized
ccagttttagtaattgtata

SEQ ID NO: 515047 - DNA, 20 bp, Artificial Sequence
  chemically synthesized
ctatacaattactaaaactg

SEQ ID NO: 515048 - DNA, 20 bp, Artificial Sequence
  chemically synthesized
tggtgaatgcagatggtaca

SEQ ID NO: 515049 - DNA, 20 bp, Artificial Sequence
  chemically synthesized
atgaaaggggagaacaacaa

SEQ ID NO: 515050 - DNA, 20 bp, Artificial Sequence
  chemically synthesized
taaagaaaaaatattgttct

SEQ ID NO: 515051 - DNA, 20 bp, Artificial Sequence
  chemically synthesized
gaaaaggaagccattaaagg

SEQ ID NO: 515052 - DNA, 20 bp, Artificial Sequence
  chemically synthesized
ttttgtgaagcacacaaaac

SEQ ID NO: 515053 - DNA, 20 bp, Artificial Sequence
  chemically synthesized
cagggtcgcctggcccaagg

SEQ ID NO: 515054 - DNA, 20 bp, Artificial Sequence
  chemically synthesized
gaactgaagacagagagcta

SEQ ID NO: 515055 - DNA, 20 bp, Artificial Sequence
  chemically synthesized
gatttcccttatcaagtgaa

SEQ ID NO: 515056 - DNA, 20 bp, Artificial Sequence
  chemically synthesized
tcccttatcaagtgaactga

SEQ ID NO: 515057 - DNA, 20 bp, Artificial Sequence
  chemically synthesized
atatatgcagatacattaaa

SEQ ID NO: 515058 - DNA, 20 bp, Artificial Sequence
  chemically synthesized
aggtcctttcgtgttgtggt

SEQ ID NO: 515059 - DNA, 20 bp, Artificial Sequence
  chemically synthesized
catactaaaaaggatttgga

SEQ ID NO: 515060 - DNA, 20 bp, Artificial Sequence
  chemically synthesized
tttctttatttcatactaaa

SEQ ID NO: 515061 - DNA, 20 bp, Artificial Sequence
  chemically synthesized
ttaagtggtttctgattctt

SEQ ID NO: 515062 - DNA, 20 bp, Artificial Sequence
  chemically synthesized
aaaagaccaatacaactctg

SEQ ID NO: 515063 - DNA, 20 bp, Artificial Sequence
  chemically synthesized
cttttaacctgaaaatccaa

SEQ ID NO: 515064 - DNA, 20 bp, Artificial Sequence
  chemically synthesized
actgaaacgtattgatccct

SEQ ID NO: 515065 - DNA, 20 bp, Artificial Sequence
  chemically synthesized
cagtagaaagtaaagaacac

SEQ ID NO: 515066 - DNA, 20 bp, Artificial Sequence
  chemically synthesized
ttttggtgtttccaatgtct

SEQ ID NO: 515067 - DNA, 20 bp, Artificial Sequence
  chemically synthesized
aaaatatcgcaaataccaca

SEQ ID NO: 515068 - DNA, 20 bp, Artificial Sequence
  chemically synthesized
ccacaaagaattgcaaaact

SEQ ID NO: 515069 - DNA, 20 bp, Artificial Sequence
  chemically synthesized
gcagcgttcttcagtaagtt

SEQ ID NO: 515070 - DNA, 20 bp, Artificial Sequence
  chemically synthesized
agcttcctatttacatgaaa

SEQ ID NO: 515071 - DNA, 20 bp, Artificial Sequence
  chemically synthesized
tcatgtaaataggaagcttt

SEQ ID NO: 515072 - DNA, 20 bp, Artificial Sequence
  chemically synthesized
ttttttttgttttcttaaat

SEQ ID NO: 515073 - DNA, 20 bp, Artificial Sequence
  chemically synthesized
aataaagcagtattctgttg

SEQ ID NO: 515074 - DNA, 20 bp, Artificial Sequence
  chemically synthesized
ctatgtatattattccgcaa

SEQ ID NO: 515075 - DNA, 20 bp, Artificial Sequence
  chemically synthesized
cgtcttaagtgtacagctca

SEQ ID NO: 515076 - DNA, 20 bp, Artificial Sequence
  chemically synthesized
cagcatcgagatttaagaaa

SEQ ID NO: 515077 - DNA, 20 bp, Artificial Sequence
  chemically synthesized
agggggtgtgaggaagctgc

SEQ ID NO: 515078 - DNA, 20 bp, Artificial Sequence
  chemically synthesized
ttgaggggagcttccacata

SEQ ID NO: 515079 - DNA, 20 bp, Artificial Sequence
  chemically synthesized
cctatgtggaagctcccctc

SEQ ID NO: 515080 - DNA, 20 bp, Artificial Sequence
  chemically synthesized
taggttagttttctcttgaa

SEQ ID NO: 515081 - DNA, 20 bp, Artificial Sequence
  chemically synthesized
aaaaatgctggttttgtatt

SEQ ID NO: 515082 - DNA, 20 bp, Artificial Sequence
  chemically synthesized
gctggttttgtattttgagt

SEQ ID NO: 515083 - DNA, 20 bp, Artificial Sequence
  chemically synthesized
atacattagatttatgcaga

SEQ ID NO: 515084 - DNA, 20 bp, Artificial Sequence
  chemically synthesized
atatgctttggaaaacacgg

SEQ ID NO: 515085 - DNA, 20 bp, Artificial Sequence
  chemically synthesized
cgggggaatggtatgatgcc

SEQ ID NO: 515086 - DNA, 20 bp, Artificial Sequence
  chemically synthesized
aatggtatgatgccatgaat

SEQ ID NO: 515087 - DNA, 20 bp, Artificial Sequence
  chemically synthesized
aagaatgttgactgtacacc

SEQ ID NO: 515088 - DNA, 20 bp, Artificial Sequence
  chemically synthesized
gactgtacacccagaatgcc

SEQ ID NO: 515089 - DNA, 20 bp, Artificial Sequence
  chemically synthesized
ggagttgaacccaaggcatt

SEQ ID NO: 515090 - DNA, 20 bp, Artificial Sequence
  chemically synthesized
caagatcacactgcagagct

SEQ ID NO: 515091 - DNA, 20 bp, Artificial Sequence
  chemically synthesized
atgctctttctatagatgaa

SEQ ID NO: 515092 - DNA, 20 bp, Artificial Sequence
  chemically synthesized
cgtgtgatagctaacactta

SEQ ID NO: 515093 - DNA, 20 bp, Artificial Sequence
  chemically synthesized
attatttggcttagaaagtt

SEQ ID NO: 515094 - DNA, 20 bp, Artificial Sequence
  chemically synthesized
caaggaaagttatagacgat

SEQ ID NO: 515095 - DNA, 20 bp, Artificial Sequence
  chemically synthesized
agggaccaacttcaaaatat

SEQ ID NO: 515096 - DNA, 20 bp, Artificial Sequence
  chemically synthesized
cttcaaaatatgagaattaa

SEQ ID NO: 515097 - DNA, 20 bp, Artificial Sequence
  chemically synthesized
ggtgataacatttaacagga

SEQ ID NO: 515098 - DNA, 20 bp, Artificial Sequence
  chemically synthesized
aatgttatcacctggaggtg

SEQ ID NO: 515099 - DNA, 20 bp, Artificial Sequence
  chemically synthesized
tggccatataaatttcaaag

SEQ ID NO: 515100 - DNA, 20 bp, Artificial Sequence
  chemically synthesized
caggactttggtaatctgag

SEQ ID NO: 515101 - DNA, 20 bp, Artificial Sequence
  chemically synthesized
cttttcattcttaggagtct

SEQ ID NO: 515102 - DNA, 20 bp, Artificial Sequence
  chemically synthesized
actactactcttagactcct

SEQ ID NO: 515103 - DNA, 20 bp, Artificial Sequence
  chemically synthesized
ctctccttcttttcattctt

SEQ ID NO: 515104 - DNA, 20 bp, Artificial Sequence
  chemically synthesized
ctcctaagaatgaaaagaag

SEQ ID NO: 515105 - DNA, 20 bp, Artificial Sequence
  chemically synthesized
atctgacaggagctttgata

SEQ ID NO: 515106 - DNA, 20 bp, Artificial Sequence
  chemically synthesized
ggagctttgatattgggtga

SEQ ID NO: 515107 - DNA, 20 bp, Artificial Sequence
  chemically synthesized
ctttgccctctggctactag

SEQ ID NO: 515108 - DNA, 20 bp, Artificial Sequence
  chemically synthesized
tcccaaggaagacaaaagtg

SEQ ID NO: 515109 - DNA, 20 bp, Artificial Sequence
  chemically synthesized
ttgcttccatgtctagggtg

SEQ ID NO: 515110 - DNA, 20 bp, Artificial Sequence
  chemically synthesized
aggaaatttgcttccatgtc

SEQ ID NO: 515111 - DNA, 20 bp, Artificial Sequence
  chemically synthesized
gagccaaggagatcaatgcc

SEQ ID NO: 515112 - DNA, 20 bp, Artificial Sequence
  chemically synthesized
tctctggtgatgtcattgta

SEQ ID NO: 515113 - DNA, 20 bp, Artificial Sequence
  chemically synthesized
taatagtgatatcaaaatac

SEQ ID NO: 515114 - DNA, 20 bp, Artificial Sequence
  chemically synthesized
gtatttgacgctaaggaata

SEQ ID NO: 515115 - DNA, 20 bp, Artificial Sequence
  chemically synthesized
tctacaagtatttgacgcta

SEQ ID NO: 515116 - DNA, 20 bp, Artificial Sequence
  chemically synthesized
ttgaacacttgctagctgca

SEQ ID NO: 515117 - DNA, 20 bp, Artificial Sequence
  chemically synthesized
ttaatagagtaacatacata

SEQ ID NO: 515118 - DNA, 20 bp, Artificial Sequence
  chemically synthesized
atcatttctagtgtacttaa

SEQ ID NO: 515119 - DNA, 20 bp, Artificial Sequence
  chemically synthesized
aagttcgaatgcacatctgt

SEQ ID NO: 515120 - DNA, 20 bp, Artificial Sequence
  chemically synthesized
tgtggtttcctatttaaagt

SEQ ID NO: 515121 - DNA, 20 bp, Artificial Sequence
  chemically synthesized
atcaagttgttatatgtaag

SEQ ID NO: 515122 - DNA, 20 bp, Artificial Sequence
  chemically synthesized
actttttgttaagcatactt

SEQ ID NO: 515123 - DNA, 20 bp, Artificial Sequence
  chemically synthesized
aggatagacctgatcagaca

SEQ ID NO: 515124 - DNA, 20 bp, Artificial Sequence
  chemically synthesized
gttttattacaaaacatgtt

SEQ ID NO: 515125 - DNA, 20 bp, Artificial Sequence
  chemically synthesized
tagaatacctggtaaaatga

SEQ ID NO: 515126 - DNA, 20 bp, Artificial Sequence
  chemically synthesized
cctttagaatacctggtaaa

SEQ ID NO: 515127 - DNA, 20 bp, Artificial Sequence
  chemically synthesized
aattttattaatatttcctt

SEQ ID NO: 515128 - DNA, 20 bp, Artificial Sequence
  chemically synthesized
acaaattttaaaataacttt

SEQ ID NO: 515129 - DNA, 20 bp, Artificial Sequence
  chemically synthesized
caaagttattttaaaatttg

SEQ ID NO: 515130 - DNA, 20 bp, Artificial Sequence
  chemically synthesized
gtggtgtaattagtataatc

SEQ ID NO: 515131 - DNA, 20 bp, Artificial Sequence
  chemically synthesized
tcagaatgttcaattttata

SEQ ID NO: 515132 - DNA, 20 bp, Artificial Sequence
  chemically synthesized
aaaaaactgggtttaacttt

SEQ ID NO: 515133 - DNA, 20 bp, Artificial Sequence
  chemically synthesized
gtctcaacaacaacaaaaaa

SEQ ID NO: 515134 - DNA, 20 bp, Artificial Sequence
  chemically synthesized
ctacactccagccaaggtga

SEQ ID NO: 515135 - DNA, 20 bp, Artificial Sequence
  chemically synthesized
tgagactctgtcaccttggc

SEQ ID NO: 515136 - DNA, 20 bp, Artificial Sequence
  chemically synthesized
tactagggacgcggaggcag

SEQ ID NO: 515137 - DNA, 20 bp, Artificial Sequence
  chemically synthesized
gcctccgcgtccctagtagc

SEQ ID NO: 515138 - DNA, 20 bp, Artificial Sequence
  chemically synthesized
ttttatatttttagtagaga

SEQ ID NO: 515139 - DNA, 20 bp, Artificial Sequence
  chemically synthesized
actttgggaggctgaggcag

SEQ ID NO: 515140 - DNA, 20 bp, Artificial Sequence
  chemically synthesized
tatgtgaatcaaaagaaaaa

SEQ ID NO: 515141 - DNA, 20 bp, Artificial Sequence
  chemically synthesized
aatgcaaatcatgtatctat

SEQ ID NO: 515142 - DNA, 20 bp, Artificial Sequence
  chemically synthesized
tctgtcagaaaagcaaccat

SEQ ID NO: 515143 - DNA, 20 bp, Artificial Sequence
  chemically synthesized
gcctatagatttcttttttg

SEQ ID NO: 515144 - DNA, 20 bp, Artificial Sequence
  chemically synthesized
ttctcggcctcccaaagtac

SEQ ID NO: 515145 - DNA, 20 bp, Artificial Sequence
  chemically synthesized
agggcagatcacttgaagcc

SEQ ID NO: 515146 - DNA, 20 bp, Artificial Sequence
  chemically synthesized
ttttgtatttttagtaaagg

SEQ ID NO: 515147 - DNA, 20 bp, Artificial Sequence
  chemically synthesized
cttgggaggctaaggtggga

SEQ ID NO: 515148 - DNA, 20 bp, Artificial Sequence
  chemically synthesized
ttgcaccactgcactccagc

SEQ ID NO: 515149 - DNA, 20 bp, Artificial Sequence
  chemically synthesized
tctcactctgccacccaggc

SEQ ID NO: 515150 - DNA, 20 bp, Artificial Sequence
  chemically synthesized
ctgcactccagcctgggtgg

SEQ ID NO: 515151 - DNA, 20 bp, Artificial Sequence
  chemically synthesized
ttttttttttttttttgaga

SEQ ID NO: 515152 - DNA, 20 bp, Artificial Sequence
  chemically synthesized
acacatataccatgacataa

SEQ ID NO: 515153 - DNA, 20 bp, Artificial Sequence
  chemically synthesized
ggctcactagacaaacatct

SEQ ID NO: 515154 - DNA, 20 bp, Artificial Sequence
  chemically synthesized
tctctgcaatttccctggaa

SEQ ID NO: 515155 - DNA, 20 bp, Artificial Sequence
  chemically synthesized
ttcattaattaaagtcatct

SEQ ID NO: 515156 - DNA, 20 bp, Artificial Sequence
  chemically synthesized
tccaaagatgactttaatta

SEQ ID NO: 515157 - DNA, 20 bp, Artificial Sequence
  chemically synthesized
tagggtaattgagaaattat

SEQ ID NO: 515158 - DNA, 20 bp, Artificial Sequence
  chemically synthesized
gtccatacacaactgcaccg

SEQ ID NO: 515159 - DNA, 20 bp, Artificial Sequence
  chemically synthesized
cttcccagtaggtggaggat

SEQ ID NO: 515160 - DNA, 20 bp, Artificial Sequence
  chemically synthesized
ggatgacttcccagtaggtg

SEQ ID NO: 515161 - DNA, 20 bp, Artificial Sequence
  chemically synthesized
gaagaaagaatgaataaacc

SEQ ID NO: 515162 - DNA, 20 bp, Artificial Sequence
  chemically synthesized
caggcatggaagaagaaaga

SEQ ID NO: 515163 - DNA, 20 bp, Artificial Sequence
  chemically synthesized
cttacaggcatggaagaaga

SEQ ID NO: 515164 - DNA, 20 bp, Artificial Sequence
  chemically synthesized
ctttcttcttccatgcctgt

SEQ ID NO: 515165 - DNA, 20 bp, Artificial Sequence
  chemically synthesized
cagaaaagataaatgtcaca

SEQ ID NO: 515166 - DNA, 20 bp, Artificial Sequence
  chemically synthesized
atcttctgtcaaaagtcaca

SEQ ID NO: 515167 - DNA, 20 bp, Artificial Sequence
  chemically synthesized
tatttgacaatatttgactt

SEQ ID NO: 515168 - DNA, 20 bp, Artificial Sequence
  chemically synthesized
catctttctgatacatgagg

SEQ ID NO: 515169 - DNA, 20 bp, Artificial Sequence
  chemically synthesized
acctcatgtatcagaaagat

SEQ ID NO: 515170 - DNA, 20 bp, Artificial Sequence
  chemically synthesized
gctacttctgtgtacttttt

SEQ ID NO: 515171 - DNA, 20 bp, Artificial Sequence
  chemically synthesized
tgtttcatcagttgtaaaat

SEQ ID NO: 515172 - DNA, 20 bp, Artificial Sequence
  chemically synthesized
acagacacaatataagtaac

SEQ ID NO: 515173 - DNA, 20 bp, Artificial Sequence
  chemically synthesized
taaacagcagttgcaaagta

SEQ ID NO: 515174 - DNA, 20 bp, Artificial Sequence
  chemically synthesized
ctatcatcacattcaggggc

SEQ ID NO: 515175 - DNA, 20 bp, Artificial Sequence
  chemically synthesized
aactcacctaacccttgccc

SEQ ID NO: 515176 - DNA, 20 bp, Artificial Sequence
  chemically synthesized
cattcaggggcaagggttag

SEQ ID NO: 515177 - DNA, 20 bp, Artificial Sequence
  chemically synthesized
attttcctaatgtatatatg

SEQ ID NO: 515178 - DNA, 20 bp, Artificial Sequence
  chemically synthesized
aataggaatttgggactttg

SEQ ID NO: 515179 - DNA, 20 bp, Artificial Sequence
  chemically synthesized
atgtcaaatgatataacaat

SEQ ID NO: 515180 - DNA, 20 bp, Artificial Sequence
  chemically synthesized
ttgttatatcatttgacatc

SEQ ID NO: 515181 - DNA, 20 bp, Artificial Sequence
  chemically synthesized
ctgagcacactggagtcctg

SEQ ID NO: 515182 - DNA, 20 bp, Artificial Sequence
  chemically synthesized
attgagtctgctgagcacac

SEQ ID NO: 515183 - DNA, 20 bp, Artificial Sequence
  chemically synthesized
tctaaaatagtatttagtaa

SEQ ID NO: 515184 - DNA, 20 bp, Artificial Sequence
  chemically synthesized
tagagcacactgcaaattgt

SEQ ID NO: 515185 - DNA, 20 bp, Artificial Sequence
  chemically synthesized
catttttcaaatacattaga

SEQ ID NO: 515186 - DNA, 20 bp, Artificial Sequence
  chemically synthesized
gccacatttttcaaatacat

SEQ ID NO: 515187 - DNA, 20 bp, Artificial Sequence
  chemically synthesized
tatatagccttaagtttttg

SEQ ID NO: 515188 - DNA, 20 bp, Artificial Sequence
  chemically synthesized
atttaatccttatcaacttc

SEQ ID NO: 515189 - DNA, 20 bp, Artificial Sequence
  chemically synthesized
atataatccttgaagttgat

SEQ ID NO: 515190 - DNA, 20 bp, Artificial Sequence
  chemically synthesized
taaggaactggcacttttca

SEQ ID NO: 515191 - DNA, 20 bp, Artificial Sequence
  chemically synthesized
ttatttaacttacaactaca

SEQ ID NO: 515192 - DNA, 20 bp, Artificial Sequence
  chemically synthesized
ttccttatgtgtcagacgag

SEQ ID NO: 515193 - DNA, 20 bp, Artificial Sequence
  chemically synthesized
ataatactggttacatttag

SEQ ID NO: 515194 - DNA, 20 bp, Artificial Sequence
  chemically synthesized
ggaaggaaatatacatttaa

SEQ ID NO: 515195 - DNA, 20 bp, Artificial Sequence
  chemically synthesized
gacaaaaaaatcactattaa

SEQ ID NO: 515196 - DNA, 20 bp, Artificial Sequence
  chemically synthesized
atcttcactggagagaacaa

SEQ ID NO: 515197 - DNA, 20 bp, Artificial Sequence
  chemically synthesized
gaacaacagagtgaaaatcc

SEQ ID NO: 515198 - DNA, 20 bp, Artificial Sequence
  chemically synthesized
acagagtgaaaatccctgaa

SEQ ID NO: 515199 - DNA, 20 bp, Artificial Sequence
  chemically synthesized
caaccttgtatattctattc

SEQ ID NO: 515200 - DNA, 20 bp, Artificial Sequence
  chemically synthesized
cagaggaaacttcacatgct

SEQ ID NO: 515201 - DNA, 20 bp, Artificial Sequence
  chemically synthesized
acttcttggaacgtaagtgg

SEQ ID NO: 515202 - DNA, 20 bp, Artificial Sequence
  chemically synthesized
agaggtacaagacaccccat

SEQ ID NO: 515203 - DNA, 20 bp, Artificial Sequence
  chemically synthesized
atcaagtcggtacactcgga

SEQ ID NO: 515204 - DNA, 20 bp, Artificial Sequence
  chemically synthesized
ggttaatcaagtcggtacac

SEQ ID NO: 515205 - DNA, 20 bp, Artificial Sequence
  chemically synthesized
agacatttgcctaagcagct

SEQ ID NO: 515206 - DNA, 20 bp, Artificial Sequence
  chemically synthesized
tcaaaattagttatgtttga

SEQ ID NO: 515207 - DNA, 20 bp, Artificial Sequence
  chemically synthesized
gttaaagtgtcagtcaaaat

SEQ ID NO: 515208 - DNA, 20 bp, Artificial Sequence
  chemically synthesized
gcctagtatttcatcctttc

SEQ ID NO: 515209 - DNA, 20 bp, Artificial Sequence
  chemically synthesized
caaagggtatggattcagga

SEQ ID NO: 515210 - DNA, 20 bp, Artificial Sequence
  chemically synthesized
aatgctacattgcaaagggt

SEQ ID NO: 515211 - DNA, 20 bp, Artificial Sequence
  chemically synthesized
aacagcaatgctacattgca

SEQ ID NO: 515212 - DNA, 20 bp, Artificial Sequence
  chemically synthesized
tatttccctgcttcttaaat

SEQ ID NO: 515213 - DNA, 20 bp, Artificial Sequence
  chemically synthesized
attgcactctgttggtcaaa

SEQ ID NO: 515214 - DNA, 20 bp, Artificial Sequence
  chemically synthesized
atttgactcattttgaccaa

SEQ ID NO: 515215 - DNA, 20 bp, Artificial Sequence
  chemically synthesized
acatcagagctagacagcag

SEQ ID NO: 515216 - DNA, 20 bp, Artificial Sequence
  chemically synthesized
ggaggatgagacaagtggaa

SEQ ID NO: 515217 - DNA, 20 bp, Artificial Sequence
  chemically synthesized
tcgtgtgtctctagttagct

SEQ ID NO: 515218 - DNA, 20 bp, Artificial Sequence
  chemically synthesized
ccccagctaactagagacac

SEQ ID NO: 515219 - DNA, 20 bp, Artificial Sequence
  chemically synthesized
gaagttcttcaccttactgc

SEQ ID NO: 515220 - DNA, 20 bp, Artificial Sequence
  chemically synthesized
atgttggttgttttaaccta

SEQ ID NO: 515221 - DNA, 20 bp, Artificial Sequence
  chemically synthesized
gctaatatgtgtacatacat

SEQ ID NO: 515222 - DNA, 20 bp, Artificial Sequence
  chemically synthesized
aatatttttaaaagagccct

SEQ ID NO: 515223 - DNA, 20 bp, Artificial Sequence
  chemically synthesized
aaattattttactgctgaaa

SEQ ID NO: 515224 - DNA, 20 bp, Artificial Sequence
  chemically synthesized
gtgttcttttctaatagcac

SEQ ID NO: 515225 - DNA, 20 bp, Artificial Sequence
  chemically synthesized
attgcattggaggaactgca

SEQ ID NO: 515226 - DNA, 20 bp, Artificial Sequence
  chemically synthesized
tccaatgcaatcttgcaaaa

SEQ ID NO: 515227 - DNA, 20 bp, Artificial Sequence
  chemically synthesized
acacacacttttttttgggg

SEQ ID NO: 515228 - DNA, 20 bp, Artificial Sequence
  chemically synthesized
ttttttttgggggggggtgg

SEQ ID NO: 515229 - DNA, 20 bp, Artificial Sequence
  chemically synthesized
ggggggtgggggggggggga

SEQ ID NO: 515230 - DNA, 20 bp, Artificial Sequence
  chemically synthesized
ctgcgctgcaggctgggcga

SEQ ID NO: 515231 - DNA, 20 bp, Artificial Sequence
  chemically synthesized
tacttggaaggctgaggcag

SEQ ID NO: 515232 - DNA, 20 bp, Artificial Sequence
  chemically synthesized
gcctcagccttccaagtagc

SEQ ID NO: 515233 - DNA, 20 bp, Artificial Sequence
  chemically synthesized
ttgtatttttttagtagaaa

SEQ ID NO: 515234 - DNA, 20 bp, Artificial Sequence
  chemically synthesized
ggtgggcggatcacgaggtc

SEQ ID NO: 515235 - DNA, 20 bp, Artificial Sequence
  chemically synthesized
actttgggaggccgaggtgg

SEQ ID NO: 515236 - DNA, 20 bp, Artificial Sequence
  chemically synthesized
acctcggcctcccaaagtgc

SEQ ID NO: 515237 - DNA, 20 bp, Artificial Sequence
  chemically synthesized
tagaaatatttgaaagttgg

SEQ ID NO: 515238 - DNA, 20 bp, Artificial Sequence
  chemically synthesized
caatacagtggctacaacag

SEQ ID NO: 515239 - DNA, 20 bp, Artificial Sequence
  chemically synthesized
tcaaatgaacatattgggca

SEQ ID NO: 515240 - DNA, 20 bp, Artificial Sequence
  chemically synthesized
tatttttgttttggaaatgt

SEQ ID NO: 515241 - DNA, 20 bp, Artificial Sequence
  chemically synthesized
aaatgcattttaaaataaag

SEQ ID NO: 515242 - DNA, 20 bp, Artificial Sequence
  chemically synthesized
gaataagagccaaaggaaag

SEQ ID NO: 515243 - DNA, 20 bp, Artificial Sequence
  chemically synthesized
ttgctgataaagatgaatca

SEQ ID NO: 515244 - DNA, 20 bp, Artificial Sequence
  chemically synthesized
gcaaatgtttgctgataaag

SEQ ID NO: 515245 - DNA, 20 bp, Artificial Sequence
  chemically synthesized
tgaaataaaaatattttgta

SEQ ID NO: 515246 - DNA, 20 bp, Artificial Sequence
  chemically synthesized
attggtgctcactcacctgg

SEQ ID NO: 515247 - DNA, 20 bp, Artificial Sequence
  chemically synthesized
gaggtaggtcattcagccag

SEQ ID NO: 515248 - DNA, 20 bp, Artificial Sequence
  chemically synthesized
tagactgtaatatccaatat

SEQ ID NO: 515249 - DNA, 20 bp, Artificial Sequence
  chemically synthesized
tttttgcttaaattcccata

SEQ ID NO: 515250 - DNA, 20 bp, Artificial Sequence
  chemically synthesized
cactgagaagaaccaaaacc

SEQ ID NO: 515251 - DNA, 20 bp, Artificial Sequence
  chemically synthesized
gagaagaaccaaaaccgtga

SEQ ID NO: 515252 - DNA, 20 bp, Artificial Sequence
  chemically synthesized
ggacacctctgttgctggtg

SEQ ID NO: 515253 - DNA, 20 bp, Artificial Sequence
  chemically synthesized
catgagagcgcaaggaaaag

SEQ ID NO: 515254 - DNA, 20 bp, Artificial Sequence
  chemically synthesized
actcactacctcccttggct

SEQ ID NO: 515255 - DNA, 20 bp, Artificial Sequence
  chemically synthesized
actcccagccaagggaggta

SEQ ID NO: 515256 - DNA, 20 bp, Artificial Sequence
  chemically synthesized
aaaaagaaagatttcccagg

SEQ ID NO: 515257 - DNA, 20 bp, Artificial Sequence
  chemically synthesized
caagtgggatctcctgatct

SEQ ID NO: 515258 - DNA, 20 bp, Artificial Sequence
  chemically synthesized
tgttggcatgggctcgcaag

SEQ ID NO: 515259 - DNA, 20 bp, Artificial Sequence
  chemically synthesized
gagcccatgccaacagggcc

SEQ ID NO: 515260 - DNA, 20 bp, Artificial Sequence
  chemically synthesized
tctccatccgagtggcctgc

SEQ ID NO: 515261 - DNA, 20 bp, Artificial Sequence
  chemically synthesized
tgcagattctcgcaggccac

SEQ ID NO: 515262 - DNA, 20 bp, Artificial Sequence
  chemically synthesized
tcttaaggagtcgtctccat

SEQ ID NO: 515263 - DNA, 20 bp, Artificial Sequence
  chemically synthesized
ccggaaactgagcagtctta

SEQ ID NO: 515264 - DNA, 20 bp, Artificial Sequence
  chemically synthesized
ctggacagtttgaacccagg

SEQ ID NO: 515265 - DNA, 20 bp, Artificial Sequence
  chemically synthesized
tgtactgcagggaattcctc

SEQ ID NO: 515266 - DNA, 20 bp, Artificial Sequence
  chemically synthesized
agctggtgtgctgtactgca

SEQ ID NO: 515267 - DNA, 20 bp, Artificial Sequence
  chemically synthesized
cccagtgaggagggatgggt

SEQ ID NO: 515268 - DNA, 20 bp, Artificial Sequence
  chemically synthesized
gccctgcccagtgaggaggg

SEQ ID NO: 515269 - DNA, 20 bp, Artificial Sequence
  chemically synthesized
gcaggccctgcccagtgagg

SEQ ID NO: 515270 - DNA, 20 bp, Artificial Sequence
  chemically synthesized
actgggcagggcctgcttgc

SEQ ID NO: 515271 - DNA, 20 bp, Artificial Sequence
  chemically synthesized
aaacccctggctggagttac

SEQ ID NO: 515272 - DNA, 20 bp, Artificial Sequence
  chemically synthesized
gaattccagtaactccagcc

SEQ ID NO: 515273 - DNA, 20 bp, Artificial Sequence
  chemically synthesized
tctttccctaaacccctggc

SEQ ID NO: 515274 - DNA, 20 bp, Artificial Sequence
  chemically synthesized
gggctcaggtccaggggaat

SEQ ID NO: 515275 - DNA, 20 bp, Artificial Sequence
  chemically synthesized
ccctaggggctcaggtccag

SEQ ID NO: 515276 - DNA, 20 bp, Artificial Sequence
  chemically synthesized
ggacctgagcccctaggggg

SEQ ID NO: 515277 - DNA, 20 bp, Artificial Sequence
  chemically synthesized
cccggattctttagagccag

SEQ ID NO: 515278 - DNA, 20 bp, Artificial Sequence
  chemically synthesized
tctttaccctgctggctcta

SEQ ID NO: 515279 - DNA, 20 bp, Artificial Sequence
  chemically synthesized
atcccacttgtctgggcttc

SEQ ID NO: 515280 - DNA, 20 bp, Artificial Sequence
  chemically synthesized
atccgggaagcccagacaag

SEQ ID NO: 515281 - DNA, 20 bp, Artificial Sequence
  chemically synthesized
gagggggtttgctgtcctgg

SEQ ID NO: 515282 - DNA, 20 bp, Artificial Sequence
  chemically synthesized
tctggctgccccttggtcga

SEQ ID NO: 515283 - DNA, 20 bp, Artificial Sequence
  chemically synthesized
cccctcgaccaaggggcagc

SEQ ID NO: 515284 - DNA, 20 bp, Artificial Sequence
  chemically synthesized
cagccagagtgcttccttaa

SEQ ID NO: 515285 - DNA, 20 bp, Artificial Sequence
  chemically synthesized
agtgcttccttaagtgggtc

SEQ ID NO: 515286 - DNA, 20 bp, Artificial Sequence
  chemically synthesized
tctcacccagtcagggtgca

SEQ ID NO: 515287 - DNA, 20 bp, Artificial Sequence
  chemically synthesized
ctggatcccgtgcaccctga

SEQ ID NO: 515288 - DNA, 20 bp, Artificial Sequence
  chemically synthesized
gggggtgggtctcacccagt

SEQ ID NO: 515289 - DNA, 20 bp, Artificial Sequence
  chemically synthesized
tctagcgactgctgttgggg

SEQ ID NO: 515290 - DNA, 20 bp, Artificial Sequence
  chemically synthesized
ggtgtctagcgactgctgtt

SEQ ID NO: 515291 - DNA, 20 bp, Artificial Sequence
  chemically synthesized
cctctagtatctctgtccct

SEQ ID NO: 515292 - DNA, 20 bp, Artificial Sequence
  chemically synthesized
caagtgcagaagggacccag

SEQ ID NO: 515293 - DNA, 20 bp, Artificial Sequence
  chemically synthesized
gcagaagggacccaggtgaa

SEQ ID NO: 515294 - DNA, 20 bp, Artificial Sequence
  chemically synthesized
tcgctccagaccccattcac

SEQ ID NO: 515295 - DNA, 20 bp, Artificial Sequence
  chemically synthesized
tagggctgctgcagtttgtt

SEQ ID NO: 515296 - DNA, 20 bp, Artificial Sequence
  chemically synthesized
cctttggatggggttttaat

SEQ ID NO: 515297 - DNA, 20 bp, Artificial Sequence
  chemically synthesized
ggaggctgctgacctttgga

SEQ ID NO: 515298 - DNA, 20 bp, Artificial Sequence
  chemically synthesized
atcttggaggctgctgacct

SEQ ID NO: 515299 - DNA, 20 bp, Artificial Sequence
  chemically synthesized
ctagacaaactcatgaagat

SEQ ID NO: 515300 - DNA, 20 bp, Artificial Sequence
  chemically synthesized
gttttttgattctcatcttc

SEQ ID NO: 515301 - DNA, 20 bp, Artificial Sequence
  chemically synthesized
acactgaaaactcaaaaagc

SEQ ID NO: 515302 - DNA, 20 bp, Artificial Sequence
  chemically synthesized
agaagaggcactctggcttt

SEQ ID NO: 515303 - DNA, 20 bp, Artificial Sequence
  chemically synthesized
cttctgtgcccttgctggag

SEQ ID NO: 515304 - DNA, 20 bp, Artificial Sequence
  chemically synthesized
gtggacagaggctgagacgg

SEQ ID NO: 515305 - DNA, 20 bp, Artificial Sequence
  chemically synthesized
acagaagtaggcttcagaag

SEQ ID NO: 515306 - DNA, 20 bp, Artificial Sequence
  chemically synthesized
tggctcttaacttctttgca

SEQ ID NO: 515307 - DNA, 20 bp, Artificial Sequence
  chemically synthesized
acattacaggagctgttaac

SEQ ID NO: 515308 - DNA, 20 bp, Artificial Sequence
  chemically synthesized
taacaagaattatcagtcta

SEQ ID NO: 515309 - DNA, 20 bp, Artificial Sequence
  chemically synthesized
cttgtgttttttcagctccc

SEQ ID NO: 515310 - DNA, 20 bp, Artificial Sequence
  chemically synthesized
taaccaaatagaccaagcag

SEQ ID NO: 515311 - DNA, 20 bp, Artificial Sequence
  chemically synthesized
caaatagaccaagcagaaga

SEQ ID NO: 515312 - DNA, 20 bp, Artificial Sequence
  chemically synthesized
gcagacaagattagagaaaa

SEQ ID NO: 515313 - DNA, 20 bp, Artificial Sequence
  chemically synthesized
ttagagaaaaaagaatgcaa

SEQ ID NO: 515314 - DNA, 20 bp, Artificial Sequence
  chemically synthesized
agaaaaaagaatgcaaagga

SEQ ID NO: 515315 - DNA, 20 bp, Artificial Sequence
  chemically synthesized
gtttttaacatgaaaggatg

SEQ ID NO: 515316 - DNA, 20 bp, Artificial Sequence
  chemically synthesized
actgaaggtttttaacatga

SEQ ID NO: 515317 - DNA, 20 bp, Artificial Sequence
  chemically synthesized
cttgtcttgtgctggttttc

SEQ ID NO: 515318 - DNA, 20 bp, Artificial Sequence
  chemically synthesized
cttgaaaaccagcacaagac

SEQ ID NO: 515319 - DNA, 20 bp, Artificial Sequence
  chemically synthesized
attccaatacagtgttgaat

SEQ ID NO: 515320 - DNA, 20 bp, Artificial Sequence
  chemically synthesized
ccagaaattccaatacagtg

SEQ ID NO: 515321 - DNA, 20 bp, Artificial Sequence
  chemically synthesized
attcctattcaacactgtat

SEQ ID NO: 515322 - DNA, 20 bp, Artificial Sequence
  chemically synthesized
tcaggcaagagaaagaaatc

SEQ ID NO: 515323 - DNA, 20 bp, Artificial Sequence
  chemically synthesized
gagattttggggtgagacga

SEQ ID NO: 515324 - DNA, 20 bp, Artificial Sequence
  chemically synthesized
ttgccagcttaaggagattt

SEQ ID NO: 515325 - DNA, 20 bp, Artificial Sequence
  chemically synthesized
ttttgtatcctgagactttg

SEQ ID NO: 515326 - DNA, 20 bp, Artificial Sequence
  chemically synthesized
aagcaaattcagcaaagtct

SEQ ID NO: 515327 - DNA, 20 bp, Artificial Sequence
  chemically synthesized
ggctctctgtctattgttgt

SEQ ID NO: 515328 - DNA, 20 bp, Artificial Sequence
  chemically synthesized
tctttgtagccattgtaaat

SEQ ID NO: 515329 - DNA, 20 bp, Artificial Sequence
  chemically synthesized
ccatttacaatggctacaaa

SEQ ID NO: 515330 - DNA, 20 bp, Artificial Sequence
  chemically synthesized
acaaagagaataaagtaagt

SEQ ID NO: 515331 - DNA, 20 bp, Artificial Sequence
  chemically synthesized
tggaagaacattccatgctc

SEQ ID NO: 515332 - DNA, 20 bp, Artificial Sequence
  chemically synthesized
attgattctatccatgagca

SEQ ID NO: 515333 - DNA, 20 bp, Artificial Sequence
  chemically synthesized
gaacattccatgctcatgga

SEQ ID NO: 515334 - DNA, 20 bp, Artificial Sequence
  chemically synthesized
gtagataaatgggaatagca

SEQ ID NO: 515335 - DNA, 20 bp, Artificial Sequence
  chemically synthesized
aatgtcaatggtagataaat

SEQ ID NO: 515336 - DNA, 20 bp, Artificial Sequence
  chemically synthesized
tctaccattgacattattca

SEQ ID NO: 515337 - DNA, 20 bp, Artificial Sequence
  chemically synthesized
ttttctttttttctaattct

SEQ ID NO: 515338 - DNA, 20 bp, Artificial Sequence
  chemically synthesized
gggctcctttttggttctgt

SEQ ID NO: 515339 - DNA, 20 bp, Artificial Sequence
  chemically synthesized
ctagctttgttatttttgct

SEQ ID NO: 515340 - DNA, 20 bp, Artificial Sequence
  chemically synthesized
tctaccagtaccatgatgtt

SEQ ID NO: 515341 - DNA, 20 bp, Artificial Sequence
  chemically synthesized
gtttgtcaaacatcagttgg

SEQ ID NO: 515342 - DNA, 20 bp, Artificial Sequence
  chemically synthesized
acaaaaacaagcaatgggga

SEQ ID NO: 515343 - DNA, 20 bp, Artificial Sequence
  chemically synthesized
ccagcaccatttattaaata

SEQ ID NO: 515344 - DNA, 20 bp, Artificial Sequence
  chemically synthesized
aggtgtccagtttcagtttt

SEQ ID NO: 515345 - DNA, 20 bp, Artificial Sequence
  chemically synthesized
tatacaaaaattaactcaag

SEQ ID NO: 515346 - DNA, 20 bp, Artificial Sequence
  chemically synthesized
gtttaagtctttaatccatc

SEQ ID NO: 515347 - DNA, 20 bp, Artificial Sequence
  chemically synthesized
ttacagggtttttatagtta

SEQ ID NO: 515348 - DNA, 20 bp, Artificial Sequence
  chemically synthesized
gtattgcttagattttctta

SEQ ID NO: 515349 - DNA, 20 bp, Artificial Sequence
  chemically synthesized
aaaatctaagcaataccatt

SEQ ID NO: 515350 - DNA, 20 bp, Artificial Sequence
  chemically synthesized
tctttgcctgtgcatatatc

SEQ ID NO: 515351 - DNA, 20 bp, Artificial Sequence
  chemically synthesized
aaaaccacaaaacccatcat

SEQ ID NO: 515352 - DNA, 20 bp, Artificial Sequence
  chemically synthesized
tttgcctgttcattctgatg

SEQ ID NO: 515353 - DNA, 20 bp, Artificial Sequence
  chemically synthesized
cagaatgaacaggcaaacta

SEQ ID NO: 515354 - DNA, 20 bp, Artificial Sequence
  chemically synthesized
ttacggcaaggatgcagggg

SEQ ID NO: 515355 - DNA, 20 bp, Artificial Sequence
  chemically synthesized
ctgaggtcgaagcttacggc

SEQ ID NO: 515356 - DNA, 20 bp, Artificial Sequence
  chemically synthesized
cgtaagcttcgacctcagcc

SEQ ID NO: 515357 - DNA, 20 bp, Artificial Sequence
  chemically synthesized
agattgcaggttggaggagg

SEQ ID NO: 515358 - DNA, 20 bp, Artificial Sequence
  chemically synthesized
gaaaagattgcaggttggag

SEQ ID NO: 515359 - DNA, 20 bp, Artificial Sequence
  chemically synthesized
gtttcagaagacactgaaga

SEQ ID NO: 515360 - DNA, 20 bp, Artificial Sequence
  chemically synthesized
ttcagtgtcttctgaaaccc

SEQ ID NO: 515361 - DNA, 20 bp, Artificial Sequence
  chemically synthesized
ttctgaaaccctagaataat

SEQ ID NO: 515362 - DNA, 20 bp, Artificial Sequence
  chemically synthesized
gacaaccattcaaattattc

SEQ ID NO: 515363 - DNA, 20 bp, Artificial Sequence
  chemically synthesized
taagtaaggagagtttgtta

SEQ ID NO: 515364 - DNA, 20 bp, Artificial Sequence
  chemically synthesized
cataacaaactctccttact

SEQ ID NO: 515365 - DNA, 20 bp, Artificial Sequence
  chemically synthesized
aagatcaaattctaagtaag

SEQ ID NO: 515366 - DNA, 20 bp, Artificial Sequence
  chemically synthesized
agtacacatatatagcttcc

SEQ ID NO: 515367 - DNA, 20 bp, Artificial Sequence
  chemically synthesized
aatacaaggaaagagacatc

SEQ ID NO: 515368 - DNA, 20 bp, Artificial Sequence
  chemically synthesized
tgtgtttctcagtaattccc

SEQ ID NO: 515369 - DNA, 20 bp, Artificial Sequence
  chemically synthesized
aatcttatcaatagattcca

SEQ ID NO: 515370 - DNA, 20 bp, Artificial Sequence
  chemically synthesized
tcattggtgctcaatatact

SEQ ID NO: 515371 - DNA, 20 bp, Artificial Sequence
  chemically synthesized
tgaaaaacatttcctttgga

SEQ ID NO: 515372 - DNA, 20 bp, Artificial Sequence
  chemically synthesized
aagttgaaaaacatttcctt

SEQ ID NO: 515373 - DNA, 20 bp, Artificial Sequence
  chemically synthesized
ggaacaagaacagtattgta

SEQ ID NO: 515374 - DNA, 20 bp, Artificial Sequence
  chemically synthesized
acttagtctcagagtgggag

SEQ ID NO: 515375 - DNA, 20 bp, Artificial Sequence
  chemically synthesized
ctgaaacttagtctcagagt

SEQ ID NO: 515376 - DNA, 20 bp, Artificial Sequence
  chemically synthesized
gggtttctgaaacttagtct

SEQ ID NO: 515377 - DNA, 20 bp, Artificial Sequence
  chemically synthesized
ggaattcttctaaacctata

SEQ ID NO: 515378 - DNA, 20 bp, Artificial Sequence
  chemically synthesized
gaaaccctatataggtttag

SEQ ID NO: 515379 - DNA, 20 bp, Artificial Sequence
  chemically synthesized
atataggtttagaagaattc

SEQ ID NO: 515380 - DNA, 20 bp, Artificial Sequence
  chemically synthesized
agcaaggtacatcttaactc

SEQ ID NO: 515381 - DNA, 20 bp, Artificial Sequence
  chemically synthesized
ttaagatgtaccttgcttgc

SEQ ID NO: 515382 - DNA, 20 bp, Artificial Sequence
  chemically synthesized
gggagggagggggtgactga

SEQ ID NO: 515383 - DNA, 20 bp, Artificial Sequence
  chemically synthesized
gatggggagggagggggtga

SEQ ID NO: 515384 - DNA, 20 bp, Artificial Sequence
  chemically synthesized
agtgttatgatggggaggga

SEQ ID NO: 515385 - DNA, 20 bp, Artificial Sequence
  chemically synthesized
ctagcacagtaggttaaggc

SEQ ID NO: 515386 - DNA, 20 bp, Artificial Sequence
  chemically synthesized
cacagtaggttaaggcatga

SEQ ID NO: 515387 - DNA, 20 bp, Artificial Sequence
  chemically synthesized
cataccaatttaatcatgcc

SEQ ID NO: 515388 - DNA, 20 bp, Artificial Sequence
  chemically synthesized
actgggatccagtcaagccc

SEQ ID NO: 515389 - DNA, 20 bp, Artificial Sequence
  chemically synthesized
catgatatccaagggcttga

SEQ ID NO: 515390 - DNA, 20 bp, Artificial Sequence
  chemically synthesized
atgtcaccaccaacgatgac

SEQ ID NO: 515391 - DNA, 20 bp, Artificial Sequence
  chemically synthesized
gtcatcgttggtggtgacat

SEQ ID NO: 515392 - DNA, 20 bp, Artificial Sequence
  chemically synthesized
tggggatagagaccaacaga

SEQ ID NO: 515393 - DNA, 20 bp, Artificial Sequence
  chemically synthesized
atcagcagaagacttcaaga

SEQ ID NO: 515394 - DNA, 20 bp, Artificial Sequence
  chemically synthesized
aggcttgtcatccccgattt

SEQ ID NO: 515395 - DNA, 20 bp, Artificial Sequence
  chemically synthesized
ttaagtcacatccagaaatc

SEQ ID NO: 515396 - DNA, 20 bp, Artificial Sequence
  chemically synthesized
acctcgaaccatcctacccc

SEQ ID NO: 515397 - DNA, 20 bp, Artificial Sequence
  chemically synthesized
actgtgtgtgatccatgggg

SEQ ID NO: 515398 - DNA, 20 bp, Artificial Sequence
  chemically synthesized
aattcactgtgtgtgatcca

SEQ ID NO: 515399 - DNA, 20 bp, Artificial Sequence
  chemically synthesized
taccccatggatcacacaca

SEQ ID NO: 515400 - DNA, 20 bp, Artificial Sequence
  chemically synthesized
tgtcacattgtagataatac

SEQ ID NO: 515401 - DNA, 20 bp, Artificial Sequence
  chemically synthesized
agatatcacatgaggttaga

SEQ ID NO: 515402 - DNA, 20 bp, Artificial Sequence
  chemically synthesized
agaaataaagtcaactgaaa

SEQ ID NO: 515403 - DNA, 20 bp, Artificial Sequence
  chemically synthesized
ctcctttttaagatcatacc

SEQ ID NO: 515404 - DNA, 20 bp, Artificial Sequence
  chemically synthesized
aggagattttataaaaaggg

SEQ ID NO: 515405 - DNA, 20 bp, Artificial Sequence
  chemically synthesized
cacaaagggaagtaggggaa

SEQ ID NO: 515406 - DNA, 20 bp, Artificial Sequence
  chemically synthesized
aatgaagttagtgggcaaag

SEQ ID NO: 515407 - DNA, 20 bp, Artificial Sequence
  chemically synthesized
ttagtgggcaaagaaggata

SEQ ID NO: 515408 - DNA, 20 bp, Artificial Sequence
  chemically synthesized
tagagatgcttttacaggct

SEQ ID NO: 515409 - DNA, 20 bp, Artificial Sequence
  chemically synthesized
aaaatgaatgcatgaggcac

SEQ ID NO: 515410 - DNA, 20 bp, Artificial Sequence
  chemically synthesized
ccaccactaagagttttaaa

SEQ ID NO: 515411 - DNA, 20 bp, Artificial Sequence
  chemically synthesized
aaataagattagccaccact

SEQ ID NO: 515412 - DNA, 20 bp, Artificial Sequence
  chemically synthesized
taaagcaattatgatcaaca

SEQ ID NO: 515413 - DNA, 20 bp, Artificial Sequence
  chemically synthesized
ggaactaaaagaatcggagg

SEQ ID NO: 515414 - DNA, 20 bp, Artificial Sequence
  chemically synthesized
gcaatcaaaaagggaactaa

SEQ ID NO: 515415 - DNA, 20 bp, Artificial Sequence
  chemically synthesized
ctgggttatatgaccacttc

SEQ ID NO: 515416 - DNA, 20 bp, Artificial Sequence
  chemically synthesized
tgtcctgaggacctacaggc

SEQ ID NO: 515417 - DNA, 20 bp, Artificial Sequence
  chemically synthesized
gacatttgagcaaagcagga

SEQ ID NO: 515418 - DNA, 20 bp, Artificial Sequence
  chemically synthesized
ctgctttgctcaaatgtcag

SEQ ID NO: 515419 - DNA, 20 bp, Artificial Sequence
  chemically synthesized
tatctcaaaagcacatattt

SEQ ID NO: 515420 - DNA, 20 bp, Artificial Sequence
  chemically synthesized
taattggctaccaacatctc

SEQ ID NO: 515421 - DNA, 20 bp, Artificial Sequence
  chemically synthesized
gtatgtgaacgaggagggaa

SEQ ID NO: 515422 - DNA, 20 bp, Artificial Sequence
  chemically synthesized
atatggcaggcagtaggcat

SEQ ID NO: 515423 - DNA, 20 bp, Artificial Sequence
  chemically synthesized
ctaaagtctgagaaacaggc

SEQ ID NO: 515424 - DNA, 20 bp, Artificial Sequence
  chemically synthesized
ttagtatatattagaaccac

SEQ ID NO: 515425 - DNA, 20 bp, Artificial Sequence
  chemically synthesized
agtcctctgtacacttggat

SEQ ID NO: 515426 - DNA, 20 bp, Artificial Sequence
  chemically synthesized
aattgtagtcctctgtacac

SEQ ID NO: 515427 - DNA, 20 bp, Artificial Sequence
  chemically synthesized
atcagtggtaaagctgagcc

SEQ ID NO: 515428 - DNA, 20 bp, Artificial Sequence
  chemically synthesized
ttaccactgattaagtagcc

SEQ ID NO: 515429 - DNA, 20 bp, Artificial Sequence
  chemically synthesized
acttcattttcatataagaa

SEQ ID NO: 515430 - DNA, 20 bp, Artificial Sequence
  chemically synthesized
ggttacagtggttattctct

SEQ ID NO: 515431 - DNA, 20 bp, Artificial Sequence
  chemically synthesized
gagtgctgagagtatcctta

SEQ ID NO: 515432 - DNA, 20 bp, Artificial Sequence
  chemically synthesized
aataggggactgtgagtgct

SEQ ID NO: 515433 - DNA, 20 bp, Artificial Sequence
  chemically synthesized
tagacacagaataggggact

SEQ ID NO: 515434 - DNA, 20 bp, Artificial Sequence
  chemically synthesized
acagtcccctattctgtgtc

SEQ ID NO: 515435 - DNA, 20 bp, Artificial Sequence
  chemically synthesized
ccttatttagattctagaca

SEQ ID NO: 515436 - DNA, 20 bp, Artificial Sequence
  chemically synthesized
atgataacattgtaaaagct

SEQ ID NO: 515437 - DNA, 20 bp, Artificial Sequence
  chemically synthesized
tattcgactttggagaagca

SEQ ID NO: 515438 - DNA, 20 bp, Artificial Sequence
  chemically synthesized
aaccctttgcttctccaaag

SEQ ID NO: 515439 - DNA, 20 bp, Artificial Sequence
  chemically synthesized
ttgccatcaaataaaaggaa

SEQ ID NO: 515440 - DNA, 20 bp, Artificial Sequence
  chemically synthesized
attttatcttagcctaagct

SEQ ID NO: 515441 - DNA, 20 bp, Artificial Sequence
  chemically synthesized
aacaagtcctttgcaatgat

SEQ ID NO: 515442 - DNA, 20 bp, Artificial Sequence
  chemically synthesized
taatgaaacatcccttagat

SEQ ID NO: 515443 - DNA, 20 bp, Artificial Sequence
  chemically synthesized
tgttgagaaactctgatcta

SEQ ID NO: 515444 - DNA, 20 bp, Artificial Sequence
  chemically synthesized
ggcgctatcctagacctcac

SEQ ID NO: 515445 - DNA, 20 bp, Artificial Sequence
  chemically synthesized
gtgcagactcgtgtgaggtc

SEQ ID NO: 515446 - DNA, 20 bp, Artificial Sequence
  chemically synthesized
cctagattgcagaccataat

SEQ ID NO: 515447 - DNA, 20 bp, Artificial Sequence
  chemically synthesized
ttggtatgacagctgctgtg

SEQ ID NO: 515448 - DNA, 20 bp, Artificial Sequence
  chemically synthesized
atctgtgttcacccattgtt

SEQ ID NO: 515449 - DNA, 20 bp, Artificial Sequence
  chemically synthesized
gcaatgttctaccctcaaca

SEQ ID NO: 515450 - DNA, 20 bp, Artificial Sequence
  chemically synthesized
aatatcagaaaacttccttg

SEQ ID NO: 515451 - DNA, 20 bp, Artificial Sequence
  chemically synthesized
gctcaatctttgtatcaata

SEQ ID NO: 515452 - DNA, 20 bp, Artificial Sequence
  chemically synthesized
attgagcttagaaaatgtag

SEQ ID NO: 515453 - DNA, 20 bp, Artificial Sequence
  chemically synthesized
aggaaacaattgatggtagc

SEQ ID NO: 515454 - DNA, 20 bp, Artificial Sequence
  chemically synthesized
ctcgcctggcttgtttgtgc

SEQ ID NO: 515455 - DNA, 20 bp, Artificial Sequence
  chemically synthesized
tttcttctgcccttctcagc

SEQ ID NO: 515456 - DNA, 20 bp, Artificial Sequence
  chemically synthesized
tgatgcatatctcacaggag

SEQ ID NO: 515457 - DNA, 20 bp, Artificial Sequence
  chemically synthesized
ttcctcctcctaccatggta

SEQ ID NO: 515458 - DNA, 20 bp, Artificial Sequence
  chemically synthesized
acaaatccgagctttaaggg

SEQ ID NO: 515459 - DNA, 20 bp, Artificial Sequence
  chemically synthesized
tctaattctccccttaaagc

SEQ ID NO: 515460 - DNA, 20 bp, Artificial Sequence
  chemically synthesized
ttagcaacttgtctgccaag

SEQ ID NO: 515461 - DNA, 20 bp, Artificial Sequence
  chemically synthesized
tgtctgccaagtagaatgca

SEQ ID NO: 515462 - DNA, 20 bp, Artificial Sequence
  chemically synthesized
tagtaacttttagcctcttt

SEQ ID NO: 515463 - DNA, 20 bp, Artificial Sequence
  chemically synthesized
tagcctctttatgggtttct

SEQ ID NO: 515464 - DNA, 20 bp, Artificial Sequence
  chemically synthesized
ggcatcttagggctcccaga

SEQ ID NO: 515465 - DNA, 20 bp, Artificial Sequence
  chemically synthesized
gcatggcatcttagggctcc

SEQ ID NO: 515466 - DNA, 20 bp, Artificial Sequence
  chemically synthesized
cttctacagcatggtggttt

SEQ ID NO: 515467 - DNA, 20 bp, Artificial Sequence
  chemically synthesized
ttaatgcttaatgccattgt

SEQ ID NO: 515468 - DNA, 20 bp, Artificial Sequence
  chemically synthesized
acaatggcattaagcattaa

SEQ ID NO: 515469 - DNA, 20 bp, Artificial Sequence
  chemically synthesized
ctagtggatgtgctggtctg

SEQ ID NO: 515470 - DNA, 20 bp, Artificial Sequence
  chemically synthesized
cagaccagcacatccactag

SEQ ID NO: 515471 - DNA, 20 bp, Artificial Sequence
  chemically synthesized
cacttggcagaattcagcta

SEQ ID NO: 515472 - DNA, 20 bp, Artificial Sequence
  chemically synthesized
tgtcagttgacatcacttgg

SEQ ID NO: 515473 - DNA, 20 bp, Artificial Sequence
  chemically synthesized
tgatgtcaactgacaccaca

SEQ ID NO: 515474 - DNA, 20 bp, Artificial Sequence
  chemically synthesized
aatcaataagctgaacacgg

SEQ ID NO: 515475 - DNA, 20 bp, Artificial Sequence
  chemically synthesized
tttatctgattttgtgaatc

SEQ ID NO: 515476 - DNA, 20 bp, Artificial Sequence
  chemically synthesized
ttatctttttatctgatttt

SEQ ID NO: 515477 - DNA, 20 bp, Artificial Sequence
  chemically synthesized
ttattttaagccactgtact

SEQ ID NO: 515478 - DNA, 20 bp, Artificial Sequence
  chemically synthesized
acatagtaatagaaaaccag

SEQ ID NO: 515479 - DNA, 20 bp, Artificial Sequence
  chemically synthesized
cctccattccagagggagct

SEQ ID NO: 515480 - DNA, 20 bp, Artificial Sequence
  chemically synthesized
agagtatcctaagctccctc

SEQ ID NO: 515481 - DNA, 20 bp, Artificial Sequence
  chemically synthesized
tctggaatggaggctctgcc

SEQ ID NO: 515482 - DNA, 20 bp, Artificial Sequence
  chemically synthesized
cagggaaccagaaagagttc

SEQ ID NO: 515483 - DNA, 20 bp, Artificial Sequence
  chemically synthesized
tagtaaatcagggaaccaga

SEQ ID NO: 515484 - DNA, 20 bp, Artificial Sequence
  chemically synthesized
agagactgagtgctgggaga

SEQ ID NO: 515485 - DNA, 20 bp, Artificial Sequence
  chemically synthesized
caggtgtaactaagaagaga

SEQ ID NO: 515486 - DNA, 20 bp, Artificial Sequence
  chemically synthesized
cagtctcttcttagttacac

SEQ ID NO: 515487 - DNA, 20 bp, Artificial Sequence
  chemically synthesized
agcctacactgctataacct

SEQ ID NO: 515488 - DNA, 20 bp, Artificial Sequence
  chemically synthesized
tatcatggaaacactttgca

SEQ ID NO: 515489 - DNA, 20 bp, Artificial Sequence
  chemically synthesized
gcttacaaccgggcctggca

SEQ ID NO: 515490 - DNA, 20 bp, Artificial Sequence
  chemically synthesized
aggcccggttgtaagcaccg

SEQ ID NO: 515491 - DNA, 20 bp, Artificial Sequence
  chemically synthesized
ttgtaagcaccgaagaataa

SEQ ID NO: 515492 - DNA, 20 bp, Artificial Sequence
  chemically synthesized
gaagaataaatgaatgacta

SEQ ID NO: 515493 - DNA, 20 bp, Artificial Sequence
  chemically synthesized
aatgaatgactattggataa

SEQ ID NO: 515494 - DNA, 20 bp, Artificial Sequence
  chemically synthesized
actattggataagtgaatta

SEQ ID NO: 515495 - DNA, 20 bp, Artificial Sequence
  chemically synthesized
ttggataagtgaattagtga

SEQ ID NO: 515496 - DNA, 20 bp, Artificial Sequence
  chemically synthesized
ataagtgaattagtgagtga

SEQ ID NO: 515497 - DNA, 20 bp, Artificial Sequence
  chemically synthesized
ttttaaagtaacaatttcag

SEQ ID NO: 515498 - DNA, 20 bp, Artificial Sequence
  chemically synthesized
tagtcaaagcaaccagaaaa

SEQ ID NO: 515499 - DNA, 20 bp, Artificial Sequence
  chemically synthesized
tgattgaattgaaatttact

SEQ ID NO: 515500 - DNA, 20 bp, Artificial Sequence
  chemically synthesized
acattgaccaaaggcagtga

SEQ ID NO: 515501 - DNA, 20 bp, Artificial Sequence
  chemically synthesized
atatctgcacgtatttaaat

SEQ ID NO: 515502 - DNA, 20 bp, Artificial Sequence
  chemically synthesized
gaacccaaaaccaagtcttg

SEQ ID NO: 515503 - DNA, 20 bp, Artificial Sequence
  chemically synthesized
gaattctccaagacttggtt

SEQ ID NO: 515504 - DNA, 20 bp, Artificial Sequence
  chemically synthesized
gggggcagatgatacggcaa

SEQ ID NO: 515505 - DNA, 20 bp, Artificial Sequence
  chemically synthesized
tggtttgggggtaatcaata

SEQ ID NO: 515506 - DNA, 20 bp, Artificial Sequence
  chemically synthesized
acaactaaagaaaatggttt

SEQ ID NO: 515507 - DNA, 20 bp, Artificial Sequence
  chemically synthesized
ataatctccggaaaatatgt

SEQ ID NO: 515508 - DNA, 20 bp, Artificial Sequence
  chemically synthesized
gacatattttccggagatta

SEQ ID NO: 515509 - DNA, 20 bp, Artificial Sequence
  chemically synthesized
tattgtctttgatgtattga

SEQ ID NO: 515510 - DNA, 20 bp, Artificial Sequence
  chemically synthesized
atggggaagtgatttgtatt

SEQ ID NO: 515511 - DNA, 20 bp, Artificial Sequence
  chemically synthesized
ttgagaggatggtggtatca

SEQ ID NO: 515512 - DNA, 20 bp, Artificial Sequence
  chemically synthesized
tcttagggctgaaaaattga

SEQ ID NO: 515513 - DNA, 20 bp, Artificial Sequence
  chemically synthesized
atgtaattaaaggatgtggc

SEQ ID NO: 515514 - DNA, 20 bp, Artificial Sequence
  chemically synthesized
tatcagtattgatgtaatta

SEQ ID NO: 515515 - DNA, 20 bp, Artificial Sequence
  chemically synthesized
attttgtatctagagacaac

SEQ ID NO: 515516 - DNA, 20 bp, Artificial Sequence
  chemically synthesized
tataggtgaagaaaccattt

SEQ ID NO: 515517 - DNA, 20 bp, Artificial Sequence
  chemically synthesized
ttggataactgtcaagattt

SEQ ID NO: 515518 - DNA, 20 bp, Artificial Sequence
  chemically synthesized
gttgtactacatagactaaa

SEQ ID NO: 515519 - DNA, 20 bp, Artificial Sequence
  chemically synthesized
cactagggggcaactgtggt

SEQ ID NO: 515520 - DNA, 20 bp, Artificial Sequence
  chemically synthesized
gaacacaaaaatacaatcta

SEQ ID NO: 515521 - DNA, 20 bp, Artificial Sequence
  chemically synthesized
gccttgaagaaaggtgttgg

SEQ ID NO: 515522 - DNA, 20 bp, Artificial Sequence
  chemically synthesized
acctttcttcaaggctctgt

SEQ ID NO: 515523 - DNA, 20 bp, Artificial Sequence
  chemically synthesized
ttcttcaaggctctgtttga

SEQ ID NO: 515524 - DNA, 20 bp, Artificial Sequence
  chemically synthesized
tggcaaggcacatgggaatc

SEQ ID NO: 515525 - DNA, 20 bp, Artificial Sequence
  chemically synthesized
aaaggaatggcaaggcacat

SEQ ID NO: 515526 - DNA, 20 bp, Artificial Sequence
  chemically synthesized
ttttttggagttggttataa

SEQ ID NO: 515527 - DNA, 20 bp, Artificial Sequence
  chemically synthesized
agatcaggagggactttttt

SEQ ID NO: 515528 - DNA, 20 bp, Artificial Sequence
  chemically synthesized
agacaatgctagttttagta

SEQ ID NO: 515529 - DNA, 20 bp, Artificial Sequence
  chemically synthesized
agcattgtctattgcacata

SEQ ID NO: 515530 - DNA, 20 bp, Artificial Sequence
  chemically synthesized
cagctacattcactttttga

SEQ ID NO: 515531 - DNA, 20 bp, Artificial Sequence
  chemically synthesized
tggtacaactcagtcaaaaa

SEQ ID NO: 515532 - DNA, 20 bp, Artificial Sequence
  chemically synthesized
ttaatgttttcattgaacgc

SEQ ID NO: 515533 - DNA, 20 bp, Artificial Sequence
  chemically synthesized
attgattataaatcatttga

SEQ ID NO: 515534 - DNA, 20 bp, Artificial Sequence
  chemically synthesized
ttcaactaagatagacacaa

SEQ ID NO: 515535 - DNA, 20 bp, Artificial Sequence
  chemically synthesized
atagacacaaaggggtgcca

SEQ ID NO: 515536 - DNA, 20 bp, Artificial Sequence
  chemically synthesized
ctctagcaattattctgatg

SEQ ID NO: 515537 - DNA, 20 bp, Artificial Sequence
  chemically synthesized
tcttaagactgattctgcat

SEQ ID NO: 515538 - DNA, 20 bp, Artificial Sequence
  chemically synthesized
ggtgtcagaagtgtagtcaa

SEQ ID NO: 515539 - DNA, 20 bp, Artificial Sequence
  chemically synthesized
tccatatacatttccccaac

SEQ ID NO: 515540 - DNA, 20 bp, Artificial Sequence
  chemically synthesized
ccctggttggggaaatgtat

SEQ ID NO: 515541 - DNA, 20 bp, Artificial Sequence
  chemically synthesized
gacaagggatcatttaaatt

SEQ ID NO: 515542 - DNA, 20 bp, Artificial Sequence
  chemically synthesized
aaccacagggctcttggaca

SEQ ID NO: 515543 - DNA, 20 bp, Artificial Sequence
  chemically synthesized
agagccctgtggttatcatt

SEQ ID NO: 515544 - DNA, 20 bp, Artificial Sequence
  chemically synthesized
atacttaatgacttgtgcag

SEQ ID NO: 515545 - DNA, 20 bp, Artificial Sequence
  chemically synthesized
cggaacaaaatagttttcca

SEQ ID NO: 515546 - DNA, 20 bp, Artificial Sequence
  chemically synthesized
aaaatgtaaagtcaagaagc

SEQ ID NO: 515547 - DNA, 20 bp, Artificial Sequence
  chemically synthesized
tctaatataaacaaaaagtt

SEQ ID NO: 515548 - DNA, 20 bp, Artificial Sequence
  chemically synthesized
atctctaattgtactatagc

SEQ ID NO: 515549 - DNA, 20 bp, Artificial Sequence
  chemically synthesized
ggacccaattaagcacttac

SEQ ID NO: 515550 - DNA, 20 bp, Artificial Sequence
  chemically synthesized
ttattcaggtaagtgcttaa

SEQ ID NO: 515551 - DNA, 20 bp, Artificial Sequence
  chemically synthesized
ttaatggaatcttagtggat

SEQ ID NO: 515552 - DNA, 20 bp, Artificial Sequence
  chemically synthesized
gaagtgttaatggaatctta

SEQ ID NO: 515553 - DNA, 20 bp, Artificial Sequence
  chemically synthesized
tgggcacgcagaagtgttaa

SEQ ID NO: 515554 - DNA, 20 bp, Artificial Sequence
  chemically synthesized
acataaacaccaaggcactt

SEQ ID NO: 515555 - DNA, 20 bp, Artificial Sequence
  chemically synthesized
ccttggtgtttatgtcacct

SEQ ID NO: 515556 - DNA, 20 bp, Artificial Sequence
  chemically synthesized
aggcaatgactggtgactac

SEQ ID NO: 515557 - DNA, 20 bp, Artificial Sequence
  chemically synthesized
gtgagcaagagaagtagaat

SEQ ID NO: 515558 - DNA, 20 bp, Artificial Sequence
  chemically synthesized
aagtaggtgagcaagagaag

SEQ ID NO: 515559 - DNA, 20 bp, Artificial Sequence
  chemically synthesized
ttaattaaggaaatgttctc

SEQ ID NO: 515560 - DNA, 20 bp, Artificial Sequence
  chemically synthesized
ggtaaagcccatgtggagag

SEQ ID NO: 515561 - DNA, 20 bp, Artificial Sequence
  chemically synthesized
aggaatgcttatgtttcagg

SEQ ID NO: 515562 - DNA, 20 bp, Artificial Sequence
  chemically synthesized
gcctttattactgtaattag

SEQ ID NO: 515563 - DNA, 20 bp, Artificial Sequence
  chemically synthesized
gatttctatttgaaaatact

SEQ ID NO: 515564 - DNA, 20 bp, Artificial Sequence
  chemically synthesized
tcctcggcctcccaaagtgc

SEQ ID NO: 515565 - DNA, 20 bp, Artificial Sequence
  chemically synthesized
actttgggaggccgaggagg

SEQ ID NO: 515566 - DNA, 20 bp, Artificial Sequence
  chemically synthesized
tggggtttcaccgtgttagc

SEQ ID NO: 515567 - DNA, 20 bp, Artificial Sequence
  chemically synthesized
gtctttttattagagagaga

SEQ ID NO: 515568 - DNA, 20 bp, Artificial Sequence
  chemically synthesized
aataaaaagacaaaaattag

SEQ ID NO: 515569 - DNA, 20 bp, Artificial Sequence
  chemically synthesized
cattctcctgccttagcctc

SEQ ID NO: 515570 - DNA, 20 bp, Artificial Sequence
  chemically synthesized
tactcgggaggctaaggcag

SEQ ID NO: 515571 - DNA, 20 bp, Artificial Sequence
  chemically synthesized
tctcactctgtcgcccaggc

SEQ ID NO: 515572 - DNA, 20 bp, Artificial Sequence
  chemically synthesized
ctgcaccccagcctgggcga

SEQ ID NO: 515573 - DNA, 20 bp, Artificial Sequence
  chemically synthesized
tgattaatctttaacttcga

SEQ ID NO: 515574 - DNA, 20 bp, Artificial Sequence
  chemically synthesized
ctttaacttcgacagaatgt

SEQ ID NO: 515575 - DNA, 20 bp, Artificial Sequence
  chemically synthesized
cttagtaacatattgtgtta

SEQ ID NO: 515576 - DNA, 20 bp, Artificial Sequence
  chemically synthesized
agaaaatctctaaaaaagtt

SEQ ID NO: 515577 - DNA, 20 bp, Artificial Sequence
  chemically synthesized
ctgccaatggtttgattaga

SEQ ID NO: 515578 - DNA, 20 bp, Artificial Sequence
  chemically synthesized
tttccatctctaatcatgaa

SEQ ID NO: 515579 - DNA, 20 bp, Artificial Sequence
  chemically synthesized
aaaagagtggtgaggtaggg

SEQ ID NO: 515580 - DNA, 20 bp, Artificial Sequence
  chemically synthesized
actttgggaggctgaggcag

SEQ ID NO: 515581 - DNA, 20 bp, Artificial Sequence
  chemically synthesized
ggcaggtggatcacgaggtc

SEQ ID NO: 515582 - DNA, 20 bp, Artificial Sequence
  chemically synthesized
ttttgtgtttttaatagaga

SEQ ID NO: 515583 - DNA, 20 bp, Artificial Sequence
  chemically synthesized
gcctcagcctccccagtagc

SEQ ID NO: 515584 - DNA, 20 bp, Artificial Sequence
  chemically synthesized
tactggggaggctgaggcag

SEQ ID NO: 515585 - DNA, 20 bp, Artificial Sequence
  chemically synthesized
ctcaatgcaacctccgcctc

SEQ ID NO: 515586 - DNA, 20 bp, Artificial Sequence
  chemically synthesized
cccgggaggcggaggttgca

SEQ ID NO: 515587 - DNA, 20 bp, Artificial Sequence
  chemically synthesized
tcttggtctgtcgcctaggc

SEQ ID NO: 515588 - DNA, 20 bp, Artificial Sequence
  chemically synthesized
ttgtatattaatataaactc

SEQ ID NO: 515589 - DNA, 20 bp, Artificial Sequence
  chemically synthesized
tattatgtcatgagggattc

SEQ ID NO: 515590 - DNA, 20 bp, Artificial Sequence
  chemically synthesized
cacatggatattatgtcatg

SEQ ID NO: 515591 - DNA, 20 bp, Artificial Sequence
  chemically synthesized
aataaaaaggcttgatacac

SEQ ID NO: 515592 - DNA, 20 bp, Artificial Sequence
  chemically synthesized
agaataacggtaacagatgc

SEQ ID NO: 515593 - DNA, 20 bp, Artificial Sequence
  chemically synthesized
ctggctgtgagaggcatagg

SEQ ID NO: 515594 - DNA, 20 bp, Artificial Sequence
  chemically synthesized
ttaataaatgccatctctac

SEQ ID NO: 515595 - DNA, 20 bp, Artificial Sequence
  chemically synthesized
taaacagcattggaggaaga

SEQ ID NO: 515596 - DNA, 20 bp, Artificial Sequence
  chemically synthesized
taagcaacacaagctgtgat

SEQ ID NO: 515597 - DNA, 20 bp, Artificial Sequence
  chemically synthesized
gcaagggcaaagtcaaactg

SEQ ID NO: 515598 - DNA, 20 bp, Artificial Sequence
  chemically synthesized
acaaagtggtaatttgccag

SEQ ID NO: 515599 - DNA, 20 bp, Artificial Sequence
  chemically synthesized
gttcccattttatgaaatta

SEQ ID NO: 515600 - DNA, 20 bp, Artificial Sequence
  chemically synthesized
tgtcattcaataaatatttt

SEQ ID NO: 515601 - DNA, 20 bp, Artificial Sequence
  chemically synthesized
gttcattcaaaaaatattta

SEQ ID NO: 515602 - DNA, 20 bp, Artificial Sequence
  chemically synthesized
atcttttccagttcaacagg

SEQ ID NO: 515603 - DNA, 20 bp, Artificial Sequence
  chemically synthesized
tttccagttcaacaggctgg

SEQ ID NO: 515604 - DNA, 20 bp, Artificial Sequence
  chemically synthesized
gagtggtatggtaccataaa

SEQ ID NO: 515605 - DNA, 20 bp, Artificial Sequence
  chemically synthesized
tgccatggctgtttgttaga

SEQ ID NO: 515606 - DNA, 20 bp, Artificial Sequence
  chemically synthesized
atgtggaaatgaagctctct

SEQ ID NO: 515607 - DNA, 20 bp, Artificial Sequence
  chemically synthesized
gtctgaaaggcaatcactat

SEQ ID NO: 515608 - DNA, 20 bp, Artificial Sequence
  chemically synthesized
agaccttcctcttctcccat

SEQ ID NO: 515609 - DNA, 20 bp, Artificial Sequence
  chemically synthesized
tttgaatagacattagcctc

SEQ ID NO: 515610 - DNA, 20 bp, Artificial Sequence
  chemically synthesized
tatgcagaatcgtgtatggg

SEQ ID NO: 515611 - DNA, 20 bp, Artificial Sequence
  chemically synthesized
ttacatttggtggctatatg

SEQ ID NO: 515612 - DNA, 20 bp, Artificial Sequence
  chemically synthesized
tgattccttgctcaattgag

SEQ ID NO: 515613 - DNA, 20 bp, Artificial Sequence
  chemically synthesized
acattcatctcaattgagca

SEQ ID NO: 515614 - DNA, 20 bp, Artificial Sequence
  chemically synthesized
ggactggggatacaatgtgg

SEQ ID NO: 515615 - DNA, 20 bp, Artificial Sequence
  chemically synthesized
aggtggactggggatacaat

SEQ ID NO: 515616 - DNA, 20 bp, Artificial Sequence
  chemically synthesized
ggatgcgggaaaggtggact

SEQ ID NO: 515617 - DNA, 20 bp, Artificial Sequence
  chemically synthesized
gcaattggcaaaaaattgaa

SEQ ID NO: 515618 - DNA, 20 bp, Artificial Sequence
  chemically synthesized
catgaccgtaatggaggttt

SEQ ID NO: 515619 - DNA, 20 bp, Artificial Sequence
  chemically synthesized
agtatgaagtcacaaaccaa

SEQ ID NO: 515620 - DNA, 20 bp, Artificial Sequence
  chemically synthesized
aaaaaaaaaaaaaaatgctg

SEQ ID NO: 515621 - DNA, 20 bp, Artificial Sequence
  chemically synthesized
aatgtttggaagagatggac

SEQ ID NO: 515622 - DNA, 20 bp, Artificial Sequence
  chemically synthesized
aaagggattttcatgccaac

SEQ ID NO: 515623 - DNA, 20 bp, Artificial Sequence
  chemically synthesized
actatagactagaaacttaa

SEQ ID NO: 515624 - DNA, 20 bp, Artificial Sequence
  chemically synthesized
ttgcttggctagggttgtat

SEQ ID NO: 515625 - DNA, 20 bp, Artificial Sequence
  chemically synthesized
agagacgaattttgcttggc

SEQ ID NO: 515626 - DNA, 20 bp, Artificial Sequence
  chemically synthesized
gggagcagaaggaagaagag

SEQ ID NO: 515627 - DNA, 20 bp, Artificial Sequence
  chemically synthesized
tatatagtatgtcctaccac

SEQ ID NO: 515628 - DNA, 20 bp, Artificial Sequence
  chemically synthesized
ctacagtgccaggtatatgg

SEQ ID NO: 515629 - DNA, 20 bp, Artificial Sequence
  chemically synthesized
tatatggcagaatctcaaaa

SEQ ID NO: 515630 - DNA, 20 bp, Artificial Sequence
  chemically synthesized
acctcggccgtctaaagtgc

SEQ ID NO: 515631 - DNA, 20 bp, Artificial Sequence
  chemically synthesized
tgggaagaccacctgaggtc

SEQ ID NO: 515632 - DNA, 20 bp, Artificial Sequence
  chemically synthesized
gcctcagcctcctgagtagc

SEQ ID NO: 515633 - DNA, 20 bp, Artificial Sequence
  chemically synthesized
gattctcctgcctcagcctc

SEQ ID NO: 515634 - DNA, 20 bp, Artificial Sequence
  chemically synthesized
tactcaggaggctgaggcag

SEQ ID NO: 515635 - DNA, 20 bp, Artificial Sequence
  chemically synthesized
ctcaccgcaacctccgcctt

SEQ ID NO: 515636 - DNA, 20 bp, Artificial Sequence
  chemically synthesized
tttgctgtcgttgcccaggc

SEQ ID NO: 515637 - DNA, 20 bp, Artificial Sequence
  chemically synthesized
tctttttcttttttttgaga

SEQ ID NO: 515638 - DNA, 20 bp, Artificial Sequence
  chemically synthesized
aagatttttagctttttaaa

SEQ ID NO: 515639 - DNA, 20 bp, Artificial Sequence
  chemically synthesized
aaaaagctaaaaatcttaga

SEQ ID NO: 515640 - DNA, 20 bp, Artificial Sequence
  chemically synthesized
aatcttagattgagttattt

SEQ ID NO: 515641 - DNA, 20 bp, Artificial Sequence
  chemically synthesized
aggcagctggcaaaaaatac

SEQ ID NO: 515642 - DNA, 20 bp, Artificial Sequence
  chemically synthesized
tagaactagcttcaaagaga

SEQ ID NO: 515643 - DNA, 20 bp, Artificial Sequence
  chemically synthesized
ctaaaaacaatagaaacaaa

SEQ ID NO: 515644 - DNA, 20 bp, Artificial Sequence
  chemically synthesized
aacttgctttaccttggcta

SEQ ID NO: 515645 - DNA, 20 bp, Artificial Sequence
  chemically synthesized
agaatactttaagaactatt

SEQ ID NO: 515646 - DNA, 20 bp, Artificial Sequence
  chemically synthesized
ttcacagaaagaaaccagtt

SEQ ID NO: 515647 - DNA, 20 bp, Artificial Sequence
  chemically synthesized
tgtgaagacaattatgattt

SEQ ID NO: 515648 - DNA, 20 bp, Artificial Sequence
  chemically synthesized
caattatgatttctgagtct

SEQ ID NO: 515649 - DNA, 20 bp, Artificial Sequence
  chemically synthesized
atcatatttaacttattttt

SEQ ID NO: 515650 - DNA, 20 bp, Artificial Sequence
  chemically synthesized
tgctgcctactattgaatat

SEQ ID NO: 515651 - DNA, 20 bp, Artificial Sequence
  chemically synthesized
gtaataattgctgcctacta

SEQ ID NO: 515652 - DNA, 20 bp, Artificial Sequence
  chemically synthesized
ctcttgaatttttcaaagat

SEQ ID NO: 515653 - DNA, 20 bp, Artificial Sequence
  chemically synthesized
ggcaaaattagtttgccctc

SEQ ID NO: 515654 - DNA, 20 bp, Artificial Sequence
  chemically synthesized
taagtatttgactgaatttc

SEQ ID NO: 515655 - DNA, 20 bp, Artificial Sequence
  chemically synthesized
aataattattaagtatttga

SEQ ID NO: 515656 - DNA, 20 bp, Artificial Sequence
  chemically synthesized
agataaaatctctaaccagc

SEQ ID NO: 515657 - DNA, 20 bp, Artificial Sequence
  chemically synthesized
cgttgcaaagtagggtttag

SEQ ID NO: 515658 - DNA, 20 bp, Artificial Sequence
  chemically synthesized
tttgcctcagcgttgcaaag

SEQ ID NO: 515659 - DNA, 20 bp, Artificial Sequence
  chemically synthesized
aaagccagaagtacggtttg

SEQ ID NO: 515660 - DNA, 20 bp, Artificial Sequence
  chemically synthesized
tggctttactgactgactct

SEQ ID NO: 515661 - DNA, 20 bp, Artificial Sequence
  chemically synthesized
gctccctacctttagattct

SEQ ID NO: 515662 - DNA, 20 bp, Artificial Sequence
  chemically synthesized
gcaagcctggaggagggaca

SEQ ID NO: 515663 - DNA, 20 bp, Artificial Sequence
  chemically synthesized
tgcatgggaagctagtgtga

SEQ ID NO: 515664 - DNA, 20 bp, Artificial Sequence
  chemically synthesized
taagtgcatgggaagctagt

SEQ ID NO: 515665 - DNA, 20 bp, Artificial Sequence
  chemically synthesized
aaaacaaaacacaagctaaa

SEQ ID NO: 515666 - DNA, 20 bp, Artificial Sequence
  chemically synthesized
ttttgtttttcaaaagctta

SEQ ID NO: 515667 - DNA, 20 bp, Artificial Sequence
  chemically synthesized
gcccttcctgctatcccaga

SEQ ID NO: 515668 - DNA, 20 bp, Artificial Sequence
  chemically synthesized
gtggctggtgctaccctctc

SEQ ID NO: 515669 - DNA, 20 bp, Artificial Sequence
  chemically synthesized
ctacaaagctgagctcaggt

SEQ ID NO: 515670 - DNA, 20 bp, Artificial Sequence
  chemically synthesized
cagacctgagctcagctttg

SEQ ID NO: 515671 - DNA, 20 bp, Artificial Sequence
  chemically synthesized
gctttgtagagtccttcctc

SEQ ID NO: 515672 - DNA, 20 bp, Artificial Sequence
  chemically synthesized
gggctgggaagacaaaaggt

SEQ ID NO: 515673 - DNA, 20 bp, Artificial Sequence
  chemically synthesized
aataatgtaacaagaggaat

SEQ ID NO: 515674 - DNA, 20 bp, Artificial Sequence
  chemically synthesized
gcagaaaataatgtaacaag

SEQ ID NO: 515675 - DNA, 20 bp, Artificial Sequence
  chemically synthesized
agttaacagacagaaaccac

SEQ ID NO: 515676 - DNA, 20 bp, Artificial Sequence
  chemically synthesized
gtttgggatgatgtgtcagc

SEQ ID NO: 515677 - DNA, 20 bp, Artificial Sequence
  chemically synthesized
atagtgacaagttttgggtt

SEQ ID NO: 515678 - DNA, 20 bp, Artificial Sequence
  chemically synthesized
cattttgatagtgacaagtt

SEQ ID NO: 515679 - DNA, 20 bp, Artificial Sequence
  chemically synthesized
aaatggaaatacattaagtg

SEQ ID NO: 515680 - DNA, 20 bp, Artificial Sequence
  chemically synthesized
aagtgttgggtctgtgttta

SEQ ID NO: 515681 - DNA, 20 bp, Artificial Sequence
  chemically synthesized
tgggtctgtgtttaatgggt

SEQ ID NO: 515682 - DNA, 20 bp, Artificial Sequence
  chemically synthesized
atataatatgtggtctttgg

SEQ ID NO: 515683 - DNA, 20 bp, Artificial Sequence
  chemically synthesized
aaagtagtagaaaacaatag

SEQ ID NO: 515684 - DNA, 20 bp, Artificial Sequence
  chemically synthesized
atatagatatacttcagtac

SEQ ID NO: 515685 - DNA, 20 bp, Artificial Sequence
  chemically synthesized
tctacagaaagaatgcacat

SEQ ID NO: 515686 - DNA, 20 bp, Artificial Sequence
  chemically synthesized
aactgagttccatctacaga

SEQ ID NO: 515687 - DNA, 20 bp, Artificial Sequence
  chemically synthesized
tagatggaactcagttgtat

SEQ ID NO: 515688 - DNA, 20 bp, Artificial Sequence
  chemically synthesized
agtttttgactctaatacaa

SEQ ID NO: 515689 - DNA, 20 bp, Artificial Sequence
  chemically synthesized
ttgattcaactgtccatggt

SEQ ID NO: 515690 - DNA, 20 bp, Artificial Sequence
  chemically synthesized
aaaattctaaccatggacag

SEQ ID NO: 515691 - DNA, 20 bp, Artificial Sequence
  chemically synthesized
agttatttttcaaagtcaac

SEQ ID NO: 515692 - DNA, 20 bp, Artificial Sequence
  chemically synthesized
atggtatagcaattttccag

SEQ ID NO: 515693 - DNA, 20 bp, Artificial Sequence
  chemically synthesized
atccatattatgtgtatagt

SEQ ID NO: 515694 - DNA, 20 bp, Artificial Sequence
  chemically synthesized
atccatactatacacataat

SEQ ID NO: 515695 - DNA, 20 bp, Artificial Sequence
  chemically synthesized
acactctggctttttgctct

SEQ ID NO: 515696 - DNA, 20 bp, Artificial Sequence
  chemically synthesized
aaactcaaagagcaaaaagc

SEQ ID NO: 515697 - DNA, 20 bp, Artificial Sequence
  chemically synthesized
gggcttaccttagaggcagg

SEQ ID NO: 515698 - DNA, 20 bp, Artificial Sequence
  chemically synthesized
agcatattacaaatgctgtg

SEQ ID NO: 515699 - DNA, 20 bp, Artificial Sequence
  chemically synthesized
tttgtaatatgcttgtgatc

SEQ ID NO: 515700 - DNA, 20 bp, Artificial Sequence
  chemically synthesized
taatatgcttgtgatcaaga

SEQ ID NO: 515701 - DNA, 20 bp, Artificial Sequence
  chemically synthesized
tgatcaagaatggatggaaa

SEQ ID NO: 515702 - DNA, 20 bp, Artificial Sequence
  chemically synthesized
taatctgtatgactaagagt

SEQ ID NO: 515703 - DNA, 20 bp, Artificial Sequence
  chemically synthesized
gttctttaatctgtatgact

SEQ ID NO: 515704 - DNA, 20 bp, Artificial Sequence
  chemically synthesized
aattaccctttctgatttcc

SEQ ID NO: 515705 - DNA, 20 bp, Artificial Sequence
  chemically synthesized
aggaacccaaggaaatcaga

SEQ ID NO: 515706 - DNA, 20 bp, Artificial Sequence
  chemically synthesized
tgtaagagcaactttctaag

SEQ ID NO: 515707 - DNA, 20 bp, Artificial Sequence
  chemically synthesized
aatttataatacaatgaaat

SEQ ID NO: 515708 - DNA, 20 bp, Artificial Sequence
  chemically synthesized
ccagtgtccaaataagaaat

SEQ ID NO: 515709 - DNA, 20 bp, Artificial Sequence
  chemically synthesized
ggggtagtgccagctagtat

SEQ ID NO: 515710 - DNA, 20 bp, Artificial Sequence
  chemically synthesized
aagttaaagggaaaaaatat

SEQ ID NO: 515711 - DNA, 20 bp, Artificial Sequence
  chemically synthesized
atattttttccctttaactt

SEQ ID NO: 515712 - DNA, 20 bp, Artificial Sequence
  chemically synthesized
cttttaaaaaattgtcattc

SEQ ID NO: 515713 - DNA, 20 bp, Artificial Sequence
  chemically synthesized
agctggtagcatgttaactc

SEQ ID NO: 515714 - DNA, 20 bp, Artificial Sequence
  chemically synthesized
ggctcggcctcccaaagtgc

SEQ ID NO: 515715 - DNA, 20 bp, Artificial Sequence
  chemically synthesized
actttgggaggccgagccag

SEQ ID NO: 515716 - DNA, 20 bp, Artificial Sequence
  chemically synthesized
gccaggtggatcacgaggtc

SEQ ID NO: 515717 - DNA, 20 bp, Artificial Sequence
  chemically synthesized
cggggtttcaccgtgttagc

SEQ ID NO: 515718 - DNA, 20 bp, Artificial Sequence
  chemically synthesized
ttttgtatttttagtagaga

SEQ ID NO: 515719 - DNA, 20 bp, Artificial Sequence
  chemically synthesized
tacttgggaggctgaggcag

SEQ ID NO: 515720 - DNA, 20 bp, Artificial Sequence
  chemically synthesized
ctcactgcaacctctgcctc

SEQ ID NO: 515721 - DNA, 20 bp, Artificial Sequence
  chemically synthesized
tcatgccactgcactccagc

SEQ ID NO: 515722 - DNA, 20 bp, Artificial Sequence
  chemically synthesized
tcttgctctgtcacccaggc

SEQ ID NO: 515723 - DNA, 20 bp, Artificial Sequence
  chemically synthesized
ttttttttttttttttgaaa

SEQ ID NO: 515724 - DNA, 20 bp, Artificial Sequence
  chemically synthesized
catttttaagagcctaaatt

SEQ ID NO: 515725 - DNA, 20 bp, Artificial Sequence
  chemically synthesized
atattaagaatatcatgaaa

SEQ ID NO: 515726 - DNA, 20 bp, Artificial Sequence
  chemically synthesized
atctacagaacattaatatt

SEQ ID NO: 515727 - DNA, 20 bp, Artificial Sequence
  chemically synthesized
ttctgtctttattagatatg

SEQ ID NO: 515728 - DNA, 20 bp, Artificial Sequence
  chemically synthesized
aagaaaaaacaggcaaggga

SEQ ID NO: 515729 - DNA, 20 bp, Artificial Sequence
  chemically synthesized
tggtcaagaaaaaacaggca

SEQ ID NO: 515730 - DNA, 20 bp, Artificial Sequence
  chemically synthesized
taggggacattgggaatatt

SEQ ID NO: 515731 - DNA, 20 bp, Artificial Sequence
  chemically synthesized
gtcttagtataggggacatt

SEQ ID NO: 515732 - DNA, 20 bp, Artificial Sequence
  chemically synthesized
aactttaagttccttcagtc

SEQ ID NO: 515733 - DNA, 20 bp, Artificial Sequence
  chemically synthesized
aagttcccactaggaaatag

SEQ ID NO: 515734 - DNA, 20 bp, Artificial Sequence
  chemically synthesized
actaaagaaaatcttttcgg

SEQ ID NO: 515735 - DNA, 20 bp, Artificial Sequence
  chemically synthesized
aaccactaaagaaaatcttt

SEQ ID NO: 515736 - DNA, 20 bp, Artificial Sequence
  chemically synthesized
ctatacaaacataccaccca

SEQ ID NO: 515737 - DNA, 20 bp, Artificial Sequence
  chemically synthesized
cactgggcctgctgtattcc

SEQ ID NO: 515738 - DNA, 20 bp, Artificial Sequence
  chemically synthesized
atcattatgttgaatatgtc

SEQ ID NO: 515739 - DNA, 20 bp, Artificial Sequence
  chemically synthesized
cctgattggaaatcattatg

SEQ ID NO: 515740 - DNA, 20 bp, Artificial Sequence
  chemically synthesized
caggaaatgaggaaaagctg

SEQ ID NO: 515741 - DNA, 20 bp, Artificial Sequence
  chemically synthesized
ttgccttcctgaattttttg

SEQ ID NO: 515742 - DNA, 20 bp, Artificial Sequence
  chemically synthesized
tattgacaaatattgccttc

SEQ ID NO: 515743 - DNA, 20 bp, Artificial Sequence
  chemically synthesized
aggcaatatttgtcaatatt

SEQ ID NO: 515744 - DNA, 20 bp, Artificial Sequence
  chemically synthesized
ttttattttttaaaccaatg

SEQ ID NO: 515745 - DNA, 20 bp, Artificial Sequence
  chemically synthesized
ctaaaactaacagatgttgc

SEQ ID NO: 515746 - DNA, 20 bp, Artificial Sequence
  chemically synthesized
tgatgaaacttagagttgcg

SEQ ID NO: 515747 - DNA, 20 bp, Artificial Sequence
  chemically synthesized
tccagtgtattgatgaaact

SEQ ID NO: 515748 - DNA, 20 bp, Artificial Sequence
  chemically synthesized
aaggggaatgagtatatgaa

SEQ ID NO: 515749 - DNA, 20 bp, Artificial Sequence
  chemically synthesized
atggtaatagactaagggga

SEQ ID NO: 515750 - DNA, 20 bp, Artificial Sequence
  chemically synthesized
tttcatggtaatagactaag

SEQ ID NO: 515751 - DNA, 20 bp, Artificial Sequence
  chemically synthesized
gtacttggaattgtaaggtg

SEQ ID NO: 515752 - DNA, 20 bp, Artificial Sequence
  chemically synthesized
tttccacacttgtctgtact

SEQ ID NO: 515753 - DNA, 20 bp, Artificial Sequence
  chemically synthesized
atacacttctccttgtttgg

SEQ ID NO: 515754 - DNA, 20 bp, Artificial Sequence
  chemically synthesized
ctgtcgcctttacatcttct

SEQ ID NO: 515755 - DNA, 20 bp, Artificial Sequence
  chemically synthesized
gcctgaaatttaagaactac

SEQ ID NO: 515756 - DNA, 20 bp, Artificial Sequence
  chemically synthesized
gacacagcattttctcaggc

SEQ ID NO: 515757 - DNA, 20 bp, Artificial Sequence
  chemically synthesized
tcatataatgctgaaggtca

SEQ ID NO: 515758 - DNA, 20 bp, Artificial Sequence
  chemically synthesized
tatgctcttgccagatttgt

SEQ ID NO: 515759 - DNA, 20 bp, Artificial Sequence
  chemically synthesized
acgtgtgagtggtgctaggc

SEQ ID NO: 515760 - DNA, 20 bp, Artificial Sequence
  chemically synthesized
tttttaataaatgattacgt

SEQ ID NO: 515761 - DNA, 20 bp, Artificial Sequence
  chemically synthesized
gatcatgatgctaatctgtt

SEQ ID NO: 515762 - DNA, 20 bp, Artificial Sequence
  chemically synthesized
ccataaagacaatatttcct

SEQ ID NO: 515763 - DNA, 20 bp, Artificial Sequence
  chemically synthesized
atctcattaactgaacaaac

SEQ ID NO: 515764 - DNA, 20 bp, Artificial Sequence
  chemically synthesized
cattaactgaacaaaccaga

SEQ ID NO: 515765 - DNA, 20 bp, Artificial Sequence
  chemically synthesized
acaatatctctaatttgtct

SEQ ID NO: 515766 - DNA, 20 bp, Artificial Sequence
  chemically synthesized
gaaatcaaagataacaccac

SEQ ID NO: 515767 - DNA, 20 bp, Artificial Sequence
  chemically synthesized
tctttagtaggcttaatatt

SEQ ID NO: 515768 - DNA, 20 bp, Artificial Sequence
  chemically synthesized
aaaatattaagcctactaaa

SEQ ID NO: 515769 - DNA, 20 bp, Artificial Sequence
  chemically synthesized
ttataccagtagtttatctc

SEQ ID NO: 515770 - DNA, 20 bp, Artificial Sequence
  chemically synthesized
gtgttgaaatttccctattg

SEQ ID NO: 515771 - DNA, 20 bp, Artificial Sequence
  chemically synthesized
aaaatgtagaagcgaaattt

SEQ ID NO: 515772 - DNA, 20 bp, Artificial Sequence
  chemically synthesized
agaagcgaaatttgagggtt

SEQ ID NO: 515773 - DNA, 20 bp, Artificial Sequence
  chemically synthesized
tagatttggagagacaaggg

SEQ ID NO: 515774 - DNA, 20 bp, Artificial Sequence
  chemically synthesized
agtctagatttggagagaca

SEQ ID NO: 515775 - DNA, 20 bp, Artificial Sequence
  chemically synthesized
tattgtgactaatatatatt

SEQ ID NO: 515776 - DNA, 20 bp, Artificial Sequence
  chemically synthesized
tagtcaagcagaataagaat

SEQ ID NO: 515777 - DNA, 20 bp, Artificial Sequence
  chemically synthesized
acaaattagtcaagcagaat

SEQ ID NO: 515778 - DNA, 20 bp, Artificial Sequence
  chemically synthesized
ttgactacaaattagtcaag

SEQ ID NO: 515779 - DNA, 20 bp, Artificial Sequence
  chemically synthesized
ttgactaatttgtagtcaag

SEQ ID NO: 515780 - DNA, 20 bp, Artificial Sequence
  chemically synthesized
tgaatacaattcagtggaaa

SEQ ID NO: 515781 - DNA, 20 bp, Artificial Sequence
  chemically synthesized
tatttcatattcagtttcca

SEQ ID NO: 515782 - DNA, 20 bp, Artificial Sequence
  chemically synthesized
cattggtacctttttattag

SEQ ID NO: 515783 - DNA, 20 bp, Artificial Sequence
  chemically synthesized
aggaaagctgccatgtggga

SEQ ID NO: 515784 - DNA, 20 bp, Artificial Sequence
  chemically synthesized
attccaggaaagctgccatg

SEQ ID NO: 515785 - DNA, 20 bp, Artificial Sequence
  chemically synthesized
atcccacatggcagctttcc

SEQ ID NO: 515786 - DNA, 20 bp, Artificial Sequence
  chemically synthesized
tataaaatcattttatcatt

SEQ ID NO: 515787 - DNA, 20 bp, Artificial Sequence
  chemically synthesized
tattattttaaaaacatgct

SEQ ID NO: 515788 - DNA, 20 bp, Artificial Sequence
  chemically synthesized
aaaatttaatatctcaaaag

SEQ ID NO: 515789 - DNA, 20 bp, Artificial Sequence
  chemically synthesized
attgtcacataaaactgtgt

SEQ ID NO: 515790 - DNA, 20 bp, Artificial Sequence
  chemically synthesized
caggatattaacatttttta

SEQ ID NO: 515791 - DNA, 20 bp, Artificial Sequence
  chemically synthesized
cttgagccaccgtgcccagc

SEQ ID NO: 515792 - DNA, 20 bp, Artificial Sequence
  chemically synthesized
acctcggcctcccaaagtgc

SEQ ID NO: 515793 - DNA, 20 bp, Artificial Sequence
  chemically synthesized
cggggtttcaccgtgttcgc

SEQ ID NO: 515794 - DNA, 20 bp, Artificial Sequence
  chemically synthesized
ttttgtatttttagtagaga

SEQ ID NO: 515795 - DNA, 20 bp, Artificial Sequence
  chemically synthesized
cattctcctgcctcagcctc

SEQ ID NO: 515796 - DNA, 20 bp, Artificial Sequence
  chemically synthesized
tactcgggaggctgaggcag

SEQ ID NO: 515797 - DNA, 20 bp, Artificial Sequence
  chemically synthesized
ctcactgcaagcttcgcctc

SEQ ID NO: 515798 - DNA, 20 bp, Artificial Sequence
  chemically synthesized
tcttgctctgtcgcccaggc

SEQ ID NO: 515799 - DNA, 20 bp, Artificial Sequence
  chemically synthesized
tattacctttttttttgaga

SEQ ID NO: 515800 - DNA, 20 bp, Artificial Sequence
  chemically synthesized
cgcatgaaattattaggtca

SEQ ID NO: 515801 - DNA, 20 bp, Artificial Sequence
  chemically synthesized
aaaggaaacaaaatggtcta

SEQ ID NO: 515802 - DNA, 20 bp, Artificial Sequence
  chemically synthesized
aaaaactaaatgcctaactt

SEQ ID NO: 515803 - DNA, 20 bp, Artificial Sequence
  chemically synthesized
tcacttatgtgatagtaaaa

SEQ ID NO: 515804 - DNA, 20 bp, Artificial Sequence
  chemically synthesized
aatagcagaaaaccctcatt

SEQ ID NO: 515805 - DNA, 20 bp, Artificial Sequence
  chemically synthesized
ggttcctttttacccgaaat

SEQ ID NO: 515806 - DNA, 20 bp, Artificial Sequence
  chemically synthesized
tatcattttggcatatttca

SEQ ID NO: 515807 - DNA, 20 bp, Artificial Sequence
  chemically synthesized
tgataacaatgactttaagt

SEQ ID NO: 515808 - DNA, 20 bp, Artificial Sequence
  chemically synthesized
tttacttcttccattcaatt

SEQ ID NO: 515809 - DNA, 20 bp, Artificial Sequence
  chemically synthesized
ccaattattaatattcccaa

SEQ ID NO: 515810 - DNA, 20 bp, Artificial Sequence
  chemically synthesized
gagccaccatgcccagctgt

SEQ ID NO: 515811 - DNA, 20 bp, Artificial Sequence
  chemically synthesized
gcctcagcctcccaaagtgc

SEQ ID NO: 515812 - DNA, 20 bp, Artificial Sequence
  chemically synthesized
cggggtttcaccgtgttagc

SEQ ID NO: 515813 - DNA, 20 bp, Artificial Sequence
  chemically synthesized
ttttgtatttttagtagaga

SEQ ID NO: 515814 - DNA, 20 bp, Artificial Sequence
  chemically synthesized
tacttgggaggctgaggcag

SEQ ID NO: 515815 - DNA, 20 bp, Artificial Sequence
  chemically synthesized
ctcactgcaagctccgcctc

SEQ ID NO: 515816 - DNA, 20 bp, Artificial Sequence
  chemically synthesized
tccaggctggagtgcagtga

SEQ ID NO: 515817 - DNA, 20 bp, Artificial Sequence
  chemically synthesized
tcccatcactgcactccagc

SEQ ID NO: 515818 - DNA, 20 bp, Artificial Sequence
  chemically synthesized
tcttgctctgtcatccaggc

SEQ ID NO: 515819 - DNA, 20 bp, Artificial Sequence
  chemically synthesized
tccagcctggatgacagagc

SEQ ID NO: 515820 - DNA, 20 bp, Artificial Sequence
  chemically synthesized
atttatttattttttttgag

SEQ ID NO: 515821 - DNA, 20 bp, Artificial Sequence
  chemically synthesized
gattcttgtatataacagat

SEQ ID NO: 515822 - DNA, 20 bp, Artificial Sequence
  chemically synthesized
gacccttatctgttatatac

SEQ ID NO: 515823 - DNA, 20 bp, Artificial Sequence
  chemically synthesized
tatacaagaatcgactcaaa

SEQ ID NO: 515824 - DNA, 20 bp, Artificial Sequence
  chemically synthesized
ctgtaagtctttaatccatt

SEQ ID NO: 515825 - DNA, 20 bp, Artificial Sequence
  chemically synthesized
gcctcaacctcccaaagtac

SEQ ID NO: 515826 - DNA, 20 bp, Artificial Sequence
  chemically synthesized
ggcgggcagatcatgaggtc

SEQ ID NO: 515827 - DNA, 20 bp, Artificial Sequence
  chemically synthesized
ttttgtatttttagtagaga

SEQ ID NO: 515828 - DNA, 20 bp, Artificial Sequence
  chemically synthesized
gattctcctgcctcagcctc

SEQ ID NO: 515829 - DNA, 20 bp, Artificial Sequence
  chemically synthesized
tactcaggaggctgaggcag

SEQ ID NO: 515830 - DNA, 20 bp, Artificial Sequence
  chemically synthesized
ccgcaccattgcattccagc

SEQ ID NO: 515831 - DNA, 20 bp, Artificial Sequence
  chemically synthesized
tcttgctttgtcacccaggc

SEQ ID NO: 515832 - DNA, 20 bp, Artificial Sequence
  chemically synthesized
cttatgacattggtctgggc

SEQ ID NO: 515833 - DNA, 20 bp, Artificial Sequence
  chemically synthesized
ttggtctgggcaaggatttt

SEQ ID NO: 515834 - DNA, 20 bp, Artificial Sequence
  chemically synthesized
tatttttgttgcctatgctc

SEQ ID NO: 515835 - DNA, 20 bp, Artificial Sequence
  chemically synthesized
tgtataccatatacctgaaa

SEQ ID NO: 515836 - DNA, 20 bp, Artificial Sequence
  chemically synthesized
caaatattttctcctgctcc

SEQ ID NO: 515837 - DNA, 20 bp, Artificial Sequence
  chemically synthesized
atatatttttggatattaat

SEQ ID NO: 515838 - DNA, 20 bp, Artificial Sequence
  chemically synthesized
ttaaggtttcttatatattt

SEQ ID NO: 515839 - DNA, 20 bp, Artificial Sequence
  chemically synthesized
attgggttgttgtattgcta

SEQ ID NO: 515840 - DNA, 20 bp, Artificial Sequence
  chemically synthesized
ggtcctttgcccatatttaa

SEQ ID NO: 515841 - DNA, 20 bp, Artificial Sequence
  chemically synthesized
tggcaactgtgattaaggaa

SEQ ID NO: 515842 - DNA, 20 bp, Artificial Sequence
  chemically synthesized
tttttattttttttaagttc

SEQ ID NO: 515843 - DNA, 20 bp, Artificial Sequence
  chemically synthesized
caggacttaaaacctagatg

SEQ ID NO: 515844 - DNA, 20 bp, Artificial Sequence
  chemically synthesized
catgacagaccggagcctgt

SEQ ID NO: 515845 - DNA, 20 bp, Artificial Sequence
  chemically synthesized
tgctatcaccccacacctgt

SEQ ID NO: 515846 - DNA, 20 bp, Artificial Sequence
  chemically synthesized
aatagccattctgacaggtg

SEQ ID NO: 515847 - DNA, 20 bp, Artificial Sequence
  chemically synthesized
tagttatcctttgtcttttt

SEQ ID NO: 515848 - DNA, 20 bp, Artificial Sequence
  chemically synthesized
tggctattctcaaaaagaca

SEQ ID NO: 515849 - DNA, 20 bp, Artificial Sequence
  chemically synthesized
aaaggataactagtgttggt

SEQ ID NO: 515850 - DNA, 20 bp, Artificial Sequence
  chemically synthesized
tacctatttatgttcccatt

SEQ ID NO: 515851 - DNA, 20 bp, Artificial Sequence
  chemically synthesized
tgtacccagtagtgagattg

SEQ ID NO: 515852 - DNA, 20 bp, Artificial Sequence
  chemically synthesized
acaatccagcaatctcacta

SEQ ID NO: 515853 - DNA, 20 bp, Artificial Sequence
  chemically synthesized
tgaatactgccacaataaac

SEQ ID NO: 515854 - DNA, 20 bp, Artificial Sequence
  chemically synthesized
gattccatatcttgtctaat

SEQ ID NO: 515855 - DNA, 20 bp, Artificial Sequence
  chemically synthesized
tattcacattagacaagata

SEQ ID NO: 515856 - DNA, 20 bp, Artificial Sequence
  chemically synthesized
aagtaaccatcaacagatga

SEQ ID NO: 515857 - DNA, 20 bp, Artificial Sequence
  chemically synthesized
gatgaacggattcaaaaatg

SEQ ID NO: 515858 - DNA, 20 bp, Artificial Sequence
  chemically synthesized
tgtgtgtatattccacattt

SEQ ID NO: 515859 - DNA, 20 bp, Artificial Sequence
  chemically synthesized
acaggattttcttattaaag

SEQ ID NO: 515860 - DNA, 20 bp, Artificial Sequence
  chemically synthesized
aaccacattgttcccaatta

SEQ ID NO: 515861 - DNA, 20 bp, Artificial Sequence
  chemically synthesized
gaacaatgtggttgaacctg

SEQ ID NO: 515862 - DNA, 20 bp, Artificial Sequence
  chemically synthesized
tggttgaacctggaggattt

SEQ ID NO: 515863 - DNA, 20 bp, Artificial Sequence
  chemically synthesized
aattttccgtgcctggactt

SEQ ID NO: 515864 - DNA, 20 bp, Artificial Sequence
  chemically synthesized
ctagatactattttcctgga

SEQ ID NO: 515865 - DNA, 20 bp, Artificial Sequence
  chemically synthesized
ctattttcctggactggatg

SEQ ID NO: 515866 - DNA, 20 bp, Artificial Sequence
  chemically synthesized
ggagaatgtaaagtagaaac

SEQ ID NO: 515867 - DNA, 20 bp, Artificial Sequence
  chemically synthesized
agagtgtgttcctgagagga

SEQ ID NO: 515868 - DNA, 20 bp, Artificial Sequence
  chemically synthesized
ccaccacaacagagaaggtt

SEQ ID NO: 515869 - DNA, 20 bp, Artificial Sequence
  chemically synthesized
ggacccaattacttctgcac

SEQ ID NO: 515870 - DNA, 20 bp, Artificial Sequence
  chemically synthesized
gtatccaggtgcagaagtaa

SEQ ID NO: 515871 - DNA, 20 bp, Artificial Sequence
  chemically synthesized
gaagtaattgggtcccattc

SEQ ID NO: 515872 - DNA, 20 bp, Artificial Sequence
  chemically synthesized
tgcattcctgggctggactc

SEQ ID NO: 515873 - DNA, 20 bp, Artificial Sequence
  chemically synthesized
cccattccagagtccagccc

SEQ ID NO: 515874 - DNA, 20 bp, Artificial Sequence
  chemically synthesized
gcctgggtctgacataactt

SEQ ID NO: 515875 - DNA, 20 bp, Artificial Sequence
  chemically synthesized
aagttatgtcagacccaggc

SEQ ID NO: 515876 - DNA, 20 bp, Artificial Sequence
  chemically synthesized
cacatgctcacgattcttgc

SEQ ID NO: 515877 - DNA, 20 bp, Artificial Sequence
  chemically synthesized
cctgctgaagtgcctgggta

SEQ ID NO: 515878 - DNA, 20 bp, Artificial Sequence
  chemically synthesized
cctatatcctgctgaagtgc

SEQ ID NO: 515879 - DNA, 20 bp, Artificial Sequence
  chemically synthesized
ccagtacccaggcacttcag

SEQ ID NO: 515880 - DNA, 20 bp, Artificial Sequence
  chemically synthesized
ccaggcacttcagcaggata

SEQ ID NO: 515881 - DNA, 20 bp, Artificial Sequence
  chemically synthesized
cagcaggatatagggtacag

SEQ ID NO: 515882 - DNA, 20 bp, Artificial Sequence
  chemically synthesized
tccagcaaacacagtgctca

SEQ ID NO: 515883 - DNA, 20 bp, Artificial Sequence
  chemically synthesized
cagtgctcaatgggtttttg

SEQ ID NO: 515884 - DNA, 20 bp, Artificial Sequence
  chemically synthesized
caatgggtttttggaggatg

SEQ ID NO: 515885 - DNA, 20 bp, Artificial Sequence
  chemically synthesized
gccaaggaacaaggtcccta

SEQ ID NO: 515886 - DNA, 20 bp, Artificial Sequence
  chemically synthesized
aggaacaaggtccctatggg

SEQ ID NO: 515887 - DNA, 20 bp, Artificial Sequence
  chemically synthesized
tacagtgccaggatttgaag

SEQ ID NO: 515888 - DNA, 20 bp, Artificial Sequence
  chemically synthesized
tcctgacactgatacagtgc

SEQ ID NO: 515889 - DNA, 20 bp, Artificial Sequence
  chemically synthesized
ggggatatgatggcttagct

SEQ ID NO: 515890 - DNA, 20 bp, Artificial Sequence
  chemically synthesized
atgtataagggcaggtcaca

SEQ ID NO: 515891 - DNA, 20 bp, Artificial Sequence
  chemically synthesized
cttcagttgcttcaggccat

SEQ ID NO: 515892 - DNA, 20 bp, Artificial Sequence
  chemically synthesized
aagcaactgaagatccacaa

SEQ ID NO: 515893 - DNA, 20 bp, Artificial Sequence
  chemically synthesized
aaggctattttcactctttt

SEQ ID NO: 515894 - DNA, 20 bp, Artificial Sequence
  chemically synthesized
gcagaaacaaatcacaatgg

SEQ ID NO: 515895 - DNA, 20 bp, Artificial Sequence
  chemically synthesized
tacaaagtacattgatcagt

SEQ ID NO: 515896 - DNA, 20 bp, Artificial Sequence
  chemically synthesized
gaatgacaaagaaccttctt

SEQ ID NO: 515897 - DNA, 20 bp, Artificial Sequence
  chemically synthesized
agtacattctcaagggtggg

SEQ ID NO: 515898 - DNA, 20 bp, Artificial Sequence
  chemically synthesized
ttgtcattctccccaccctt

SEQ ID NO: 515899 - DNA, 20 bp, Artificial Sequence
  chemically synthesized
atctcacaaagtacattctc

SEQ ID NO: 515900 - DNA, 20 bp, Artificial Sequence
  chemically synthesized
cgatgttttgcgagcagggg

SEQ ID NO: 515901 - DNA, 20 bp, Artificial Sequence
  chemically synthesized
ggagcgatgttttgcgagca

SEQ ID NO: 515902 - DNA, 20 bp, Artificial Sequence
  chemically synthesized
acaggttttgggataggcgg

SEQ ID NO: 515903 - DNA, 20 bp, Artificial Sequence
  chemically synthesized
tcattagttcttacaggttt

SEQ ID NO: 515904 - DNA, 20 bp, Artificial Sequence
  chemically synthesized
aaggagtcagccaagggtgg

SEQ ID NO: 515905 - DNA, 20 bp, Artificial Sequence
  chemically synthesized
gtctgaaaaaggagtcagcc

SEQ ID NO: 515906 - DNA, 20 bp, Artificial Sequence
  chemically synthesized
aggtgggctgagtctgaaaa

SEQ ID NO: 515907 - DNA, 20 bp, Artificial Sequence
  chemically synthesized
ttcacctgggtgcaggtggg

SEQ ID NO: 515908 - DNA, 20 bp, Artificial Sequence
  chemically synthesized
aacaaggctgtttatttcac

SEQ ID NO: 515909 - DNA, 20 bp, Artificial Sequence
  chemically synthesized
gacctgattgtcacgcccct

SEQ ID NO: 515910 - DNA, 20 bp, Artificial Sequence
  chemically synthesized
tgagatgccccccctttctc

SEQ ID NO: 515911 - DNA, 20 bp, Artificial Sequence
  chemically synthesized
attggctgagatgaaatatg

SEQ ID NO: 515912 - DNA, 20 bp, Artificial Sequence
  chemically synthesized
atctcaataactgccttttc

SEQ ID NO: 515913 - DNA, 20 bp, Artificial Sequence
  chemically synthesized
aggatctacatgcagtggca

SEQ ID NO: 515914 - DNA, 20 bp, Artificial Sequence
  chemically synthesized
ctgcatgtagatccttatgt

SEQ ID NO: 515915 - DNA, 20 bp, Artificial Sequence
  chemically synthesized
attcttagaaatccccacat

SEQ ID NO: 515916 - DNA, 20 bp, Artificial Sequence
  chemically synthesized
atccttatgtggggatttct

SEQ ID NO: 515917 - DNA, 20 bp, Artificial Sequence
  chemically synthesized
cacatttgcaggctgcttct

SEQ ID NO: 515918 - DNA, 20 bp, Artificial Sequence
  chemically synthesized
aaatggacattcagaagtca

SEQ ID NO: 515919 - DNA, 20 bp, Artificial Sequence
  chemically synthesized
gttcagaaactcactgactt

SEQ ID NO: 515920 - DNA, 20 bp, Artificial Sequence
  chemically synthesized
tgtggactgctttatatgtt

SEQ ID NO: 515921 - DNA, 20 bp, Artificial Sequence
  chemically synthesized
gcgaaaagtttgagtccttt

SEQ ID NO: 515922 - DNA, 20 bp, Artificial Sequence
  chemically synthesized
tttccttccccgcgaaaagt

SEQ ID NO: 515923 - DNA, 20 bp, Artificial Sequence
  chemically synthesized
tgtagatattaaggcctgtg

SEQ ID NO: 515924 - DNA, 20 bp, Artificial Sequence
  chemically synthesized
ggtgtggcttttcccagata

SEQ ID NO: 515925 - DNA, 20 bp, Artificial Sequence
  chemically synthesized
atcactgtttatgatggatt

SEQ ID NO: 515926 - DNA, 20 bp, Artificial Sequence
  chemically synthesized
cccaggcatcactgtttatg

SEQ ID NO: 515927 - DNA, 20 bp, Artificial Sequence
  chemically synthesized
ttgagactacaccttggagg

SEQ ID NO: 515928 - DNA, 20 bp, Artificial Sequence
  chemically synthesized
gaaatgtgtttcttttggag

SEQ ID NO: 515929 - DNA, 20 bp, Artificial Sequence
  chemically synthesized
ccattgaaatgtgtttcttt

SEQ ID NO: 515930 - DNA, 20 bp, Artificial Sequence
  chemically synthesized
tttcttttttttagacaatc

SEQ ID NO: 515931 - DNA, 20 bp, Artificial Sequence
  chemically synthesized
tgataaaacgttctgatttc

SEQ ID NO: 515932 - DNA, 20 bp, Artificial Sequence
  chemically synthesized
cagaacgttttatcatgatc

SEQ ID NO: 515933 - DNA, 20 bp, Artificial Sequence
  chemically synthesized
aatgaagttatggttaatgg

SEQ ID NO: 515934 - DNA, 20 bp, Artificial Sequence
  chemically synthesized
aattcagttgccatattttc

SEQ ID NO: 515935 - DNA, 20 bp, Artificial Sequence
  chemically synthesized
aacccatgaaaatatggcaa

SEQ ID NO: 515936 - DNA, 20 bp, Artificial Sequence
  chemically synthesized
attttacatttacagcacat

SEQ ID NO: 515937 - DNA, 20 bp, Artificial Sequence
  chemically synthesized
gtactaaatcattaaggttg

SEQ ID NO: 515938 - DNA, 20 bp, Artificial Sequence
  chemically synthesized
agacattttacgttagtgaa

SEQ ID NO: 515939 - DNA, 20 bp, Artificial Sequence
  chemically synthesized
atatatgtaatttaaacttt

SEQ ID NO: 515940 - DNA, 20 bp, Artificial Sequence
  chemically synthesized
tcttttggacagcactggcc

SEQ ID NO: 515941 - DNA, 20 bp, Artificial Sequence
  chemically synthesized
tcaaaaatagggcaaaaatt

SEQ ID NO: 515942 - DNA, 20 bp, Artificial Sequence
  chemically synthesized
cagatgtggaagaagtaact

SEQ ID NO: 515943 - DNA, 20 bp, Artificial Sequence
  chemically synthesized
cagagttacttcttccacat

SEQ ID NO: 515944 - DNA, 20 bp, Artificial Sequence
  chemically synthesized
cagactggtgtgtatgtagc

SEQ ID NO: 515945 - DNA, 20 bp, Artificial Sequence
  chemically synthesized
cacctgccctctgtatatga

SEQ ID NO: 515946 - DNA, 20 bp, Artificial Sequence
  chemically synthesized
ccctcatatacagagggcag

SEQ ID NO: 515947 - DNA, 20 bp, Artificial Sequence
  chemically synthesized
gagagaagactgagaggtaa

SEQ ID NO: 515948 - DNA, 20 bp, Artificial Sequence
  chemically synthesized
ttaagatggcctaacaacat

SEQ ID NO: 515949 - DNA, 20 bp, Artificial Sequence
  chemically synthesized
cctaacaacattagaatcat

SEQ ID NO: 515950 - DNA, 20 bp, Artificial Sequence
  chemically synthesized
tggactgttgtcataagtta

SEQ ID NO: 515951 - DNA, 20 bp, Artificial Sequence
  chemically synthesized
taataggtttcatgaaaatc

SEQ ID NO: 515952 - DNA, 20 bp, Artificial Sequence
  chemically synthesized
acagttggaaagtgttggag

SEQ ID NO: 515953 - DNA, 20 bp, Artificial Sequence
  chemically synthesized
tcatgacagttggaaagtgt

SEQ ID NO: 515954 - DNA, 20 bp, Artificial Sequence
  chemically synthesized
catccaaattttactgatca

SEQ ID NO: 515955 - DNA, 20 bp, Artificial Sequence
  chemically synthesized
aattctctgatcagtaaaat

SEQ ID NO: 515956 - DNA, 20 bp, Artificial Sequence
  chemically synthesized
atgttttcattttgtctcaa

SEQ ID NO: 515957 - DNA, 20 bp, Artificial Sequence
  chemically synthesized
agacaaaatgaaaacataag

SEQ ID NO: 515958 - DNA, 20 bp, Artificial Sequence
  chemically synthesized
ttgctaacaataaaatacta

SEQ ID NO: 515959 - DNA, 20 bp, Artificial Sequence
  chemically synthesized
gaaaactgacaactccaagg

SEQ ID NO: 515960 - DNA, 20 bp, Artificial Sequence
  chemically synthesized
ggcttcatgccatccagcct

SEQ ID NO: 515961 - DNA, 20 bp, Artificial Sequence
  chemically synthesized
aaaaaatgattaggctgggg

SEQ ID NO: 515962 - DNA, 20 bp, Artificial Sequence
  chemically synthesized
tcattttttctcttcagacc

SEQ ID NO: 515963 - DNA, 20 bp, Artificial Sequence
  chemically synthesized
actatgacgcgagaggatgg

SEQ ID NO: 515964 - DNA, 20 bp, Artificial Sequence
  chemically synthesized
acccccaaactatgacgcga

SEQ ID NO: 515965 - DNA, 20 bp, Artificial Sequence
  chemically synthesized
atcctctcgcgtcatagttt

SEQ ID NO: 515966 - DNA, 20 bp, Artificial Sequence
  chemically synthesized
gctaacacattgaataactg

SEQ ID NO: 515967 - DNA, 20 bp, Artificial Sequence
  chemically synthesized
ccaagttgtcagctaacaca

SEQ ID NO: 515968 - DNA, 20 bp, Artificial Sequence
  chemically synthesized
tttcaggaagtaacttggag

SEQ ID NO: 515969 - DNA, 20 bp, Artificial Sequence
  chemically synthesized
ctgcttttcaggaagtaact

SEQ ID NO: 515970 - DNA, 20 bp, Artificial Sequence
  chemically synthesized
tgtaggtaaaatgtaaagct

SEQ ID NO: 515971 - DNA, 20 bp, Artificial Sequence
  chemically synthesized
gaaagccgaggccagatcat

SEQ ID NO: 515972 - DNA, 20 bp, Artificial Sequence
  chemically synthesized
atgaaactgtaacagttgta

SEQ ID NO: 515973 - DNA, 20 bp, Artificial Sequence
  chemically synthesized
ccagtactggaaggaagtgt

SEQ ID NO: 515974 - DNA, 20 bp, Artificial Sequence
  chemically synthesized
cagggctgaaaacctaaaag

SEQ ID NO: 515975 - DNA, 20 bp, Artificial Sequence
  chemically synthesized
ggtacagatttaaaagctcc

SEQ ID NO: 515976 - DNA, 20 bp, Artificial Sequence
  chemically synthesized
tgttttttgtttctttgaga

SEQ ID NO: 515977 - DNA, 20 bp, Artificial Sequence
  chemically synthesized
tgcgctccagcctgggcaaa

SEQ ID NO: 515978 - DNA, 20 bp, Artificial Sequence
  chemically synthesized
ctcactgcaacctctgcctc

SEQ ID NO: 515979 - DNA, 20 bp, Artificial Sequence
  chemically synthesized
gcctcggcctcccaaatagc

SEQ ID NO: 515980 - DNA, 20 bp, Artificial Sequence
  chemically synthesized
caaatacaaaaaaaaattag

SEQ ID NO: 515981 - DNA, 20 bp, Artificial Sequence
  chemically synthesized
ttttgtatttgtagtagaga

SEQ ID NO: 515982 - DNA, 20 bp, Artificial Sequence
  chemically synthesized
cggggtttcaccatgttggc

SEQ ID NO: 515983 - DNA, 20 bp, Artificial Sequence
  chemically synthesized
acttcgggaggctgaggcgg

SEQ ID NO: 515984 - DNA, 20 bp, Artificial Sequence
  chemically synthesized
cagcacttcgggaggctgag

SEQ ID NO: 515985 - DNA, 20 bp, Artificial Sequence
  chemically synthesized
gcctcagcctcccgaagtgc

SEQ ID NO: 515986 - DNA, 20 bp, Artificial Sequence
  chemically synthesized
aagaaagggggcattagagg

SEQ ID NO: 515987 - DNA, 20 bp, Artificial Sequence
  chemically synthesized
tcaataagtaatacagtata

SEQ ID NO: 515988 - DNA, 20 bp, Artificial Sequence
  chemically synthesized
gatcattgtggccagagaga

SEQ ID NO: 515989 - DNA, 20 bp, Artificial Sequence
  chemically synthesized
aaggctgaaaaccaacttaa

SEQ ID NO: 515990 - DNA, 20 bp, Artificial Sequence
  chemically synthesized
aaccaacttaaaggaatggg

SEQ ID NO: 515991 - DNA, 20 bp, Artificial Sequence
  chemically synthesized
taagtctcccacacatgatg

SEQ ID NO: 515992 - DNA, 20 bp, Artificial Sequence
  chemically synthesized
ttctcctgggaagtttatgt

SEQ ID NO: 515993 - DNA, 20 bp, Artificial Sequence
  chemically synthesized
gtaaaaatcatgtatcatta

SEQ ID NO: 515994 - DNA, 20 bp, Artificial Sequence
  chemically synthesized
taatgctaaaagcaaggact

SEQ ID NO: 515995 - DNA, 20 bp, Artificial Sequence
  chemically synthesized
actgagagtagttaattcat

SEQ ID NO: 515996 - DNA, 20 bp, Artificial Sequence
  chemically synthesized
agagtagttaattcatgaga

SEQ ID NO: 515997 - DNA, 20 bp, Artificial Sequence
  chemically synthesized
ggattccatcattcattctc

SEQ ID NO: 515998 - DNA, 20 bp, Artificial Sequence
  chemically synthesized
taattcatgagaatgaatga

SEQ ID NO: 515999 - DNA, 20 bp, Artificial Sequence
  chemically synthesized
gcagctgatctatcacgtca

SEQ ID NO: 516000 - DNA, 20 bp, Artificial Sequence
  chemically synthesized
actacgatcagtgtaatttt

SEQ ID NO: 516001 - DNA, 20 bp, Artificial Sequence
  chemically synthesized
ttactcagttgtctgaccaa

SEQ ID NO: 516002 - DNA, 20 bp, Artificial Sequence
  chemically synthesized
ttattcggttggtcagacaa

SEQ ID NO: 516003 - DNA, 20 bp, Artificial Sequence
  chemically synthesized
aaggtcaagaaactgaacaa

SEQ ID NO: 516004 - DNA, 20 bp, Artificial Sequence
  chemically synthesized
cagcttatgttaaggaagca

SEQ ID NO: 516005 - DNA, 20 bp, Artificial Sequence
  chemically synthesized
ccatgcttccttaacataag

SEQ ID NO: 516006 - DNA, 20 bp, Artificial Sequence
  chemically synthesized
gaaatggaagacatgagaga

SEQ ID NO: 516007 - DNA, 20 bp, Artificial Sequence
  chemically synthesized
gaaagaaatggaagacatga

SEQ ID NO: 516008 - DNA, 20 bp, Artificial Sequence
  chemically synthesized
catttctttccttaaaaaat

SEQ ID NO: 516009 - DNA, 20 bp, Artificial Sequence
  chemically synthesized
aacatgtttacaagatatat

SEQ ID NO: 516010 - DNA, 20 bp, Artificial Sequence
  chemically synthesized
cttgcacagttagcatctct

SEQ ID NO: 516011 - DNA, 20 bp, Artificial Sequence
  chemically synthesized
ttaatggctttgataagaca

SEQ ID NO: 516012 - DNA, 20 bp, Artificial Sequence
  chemically synthesized
agcaaatttaatcacctctg

SEQ ID NO: 516013 - DNA, 20 bp, Artificial Sequence
  chemically synthesized
aaatttgctgtgataaacag

SEQ ID NO: 516014 - DNA, 20 bp, Artificial Sequence
  chemically synthesized
agtgggcttgctgctttttt

SEQ ID NO: 516015 - DNA, 20 bp, Artificial Sequence
  chemically synthesized
ttatttagtagcacaaacag

SEQ ID NO: 516016 - DNA, 20 bp, Artificial Sequence
  chemically synthesized
aacctacagtaggaaaagta

SEQ ID NO: 516017 - DNA, 20 bp, Artificial Sequence
  chemically synthesized
actttctcattcctacttaa

SEQ ID NO: 516018 - DNA, 20 bp, Artificial Sequence
  chemically synthesized
gatatgccatcctattaagt

SEQ ID NO: 516019 - DNA, 20 bp, Artificial Sequence
  chemically synthesized
atgtgatagcctttggtcaa

SEQ ID NO: 516020 - DNA, 20 bp, Artificial Sequence
  chemically synthesized
acaacctatgaaaacatgca

SEQ ID NO: 516021 - DNA, 20 bp, Artificial Sequence
  chemically synthesized
tcacgtccagaggcacacac

SEQ ID NO: 516022 - DNA, 20 bp, Artificial Sequence
  chemically synthesized
ctttcagcggcaggtttggt

SEQ ID NO: 516023 - DNA, 20 bp, Artificial Sequence
  chemically synthesized
cattaattctcatggtcatg

SEQ ID NO: 516024 - DNA, 20 bp, Artificial Sequence
  chemically synthesized
gccaaaccccgcatgaccat

SEQ ID NO: 516025 - DNA, 20 bp, Artificial Sequence
  chemically synthesized
ccttcgctattgagggttat

SEQ ID NO: 516026 - DNA, 20 bp, Artificial Sequence
  chemically synthesized
aacctgatgccttcgctatt

SEQ ID NO: 516027 - DNA, 20 bp, Artificial Sequence
  chemically synthesized
caatgcctcgtttgctggct

SEQ ID NO: 516028 - DNA, 20 bp, Artificial Sequence
  chemically synthesized
catagccagcaaacgaggca

SEQ ID NO: 516029 - DNA, 20 bp, Artificial Sequence
  chemically synthesized
agaggtttacatacagggga

SEQ ID NO: 516030 - DNA, 20 bp, Artificial Sequence
  chemically synthesized
tcctgtccagcccaccacta

SEQ ID NO: 516031 - DNA, 20 bp, Artificial Sequence
  chemically synthesized
tcttgtccagtctgccacca

SEQ ID NO: 516032 - DNA, 20 bp, Artificial Sequence
  chemically synthesized
agtggtagtgatggcggcgg

SEQ ID NO: 516033 - DNA, 20 bp, Artificial Sequence
  chemically synthesized
ggtgaacgtcattaagggca

SEQ ID NO: 516034 - DNA, 20 bp, Artificial Sequence
  chemically synthesized
ttgaggccccgagttttggg

SEQ ID NO: 516035 - DNA, 20 bp, Artificial Sequence
  chemically synthesized
gcggattgaggccccgagtt

SEQ ID NO: 516036 - DNA, 20 bp, Artificial Sequence
  chemically synthesized
acatacagcggattgaggcc

SEQ ID NO: 516037 - DNA, 20 bp, Artificial Sequence
  chemically synthesized
gaacacgggccatacataca

SEQ ID NO: 516038 - DNA, 20 bp, Artificial Sequence
  chemically synthesized
tatgtatggcccgtgttcca

SEQ ID NO: 516039 - DNA, 20 bp, Artificial Sequence
  chemically synthesized
ttttccgagctacggaatct

SEQ ID NO: 516040 - DNA, 20 bp, Artificial Sequence
  chemically synthesized
tgaatgtgttttccgagcta

SEQ ID NO: 516041 - DNA, 20 bp, Artificial Sequence
  chemically synthesized
accctgtactgcagacacac

SEQ ID NO: 516042 - DNA, 20 bp, Artificial Sequence
  chemically synthesized
attcaggtgtgtctgcagta

SEQ ID NO: 516043 - DNA, 20 bp, Artificial Sequence
  chemically synthesized
ctgcagtacagggtcattct

SEQ ID NO: 516044 - DNA, 20 bp, Artificial Sequence
  chemically synthesized
caataatgtgcgcataccct

SEQ ID NO: 516045 - DNA, 20 bp, Artificial Sequence
  chemically synthesized
gtgtgtacgtgtgtgtatgc

SEQ ID NO: 516046 - DNA, 20 bp, Artificial Sequence
  chemically synthesized
tgtatgcatgggtgttttta

SEQ ID NO: 516047 - DNA, 20 bp, Artificial Sequence
  chemically synthesized
tcttgttacagcaggctgaa

SEQ ID NO: 516048 - DNA, 20 bp, Artificial Sequence
  chemically synthesized
tgttttctttacacgggcca

SEQ ID NO: 516049 - DNA, 20 bp, Artificial Sequence
  chemically synthesized
tggaacctttgggaattaat

SEQ ID NO: 516050 - DNA, 20 bp, Artificial Sequence
  chemically synthesized
tatttggagatggaaccttt

SEQ ID NO: 516051 - DNA, 20 bp, Artificial Sequence
  chemically synthesized
tctccaaatatcgtcccatt

SEQ ID NO: 516052 - DNA, 20 bp, Artificial Sequence
  chemically synthesized
gggggttagggcttcagcat

SEQ ID NO: 516053 - DNA, 20 bp, Artificial Sequence
  chemically synthesized
catatgaatttggggcaaac

SEQ ID NO: 516054 - DNA, 20 bp, Artificial Sequence
  chemically synthesized
taacaacaagtgaaggacta

SEQ ID NO: 516055 - DNA, 20 bp, Artificial Sequence
  chemically synthesized
tctggttcagttcatcataa

SEQ ID NO: 516056 - DNA, 20 bp, Artificial Sequence
  chemically synthesized
acagctctccttttatattt

SEQ ID NO: 516057 - DNA, 20 bp, Artificial Sequence
  chemically synthesized
agaaaaatcttccttcgtgt

SEQ ID NO: 516058 - DNA, 20 bp, Artificial Sequence
  chemically synthesized
aaatcttccttcgtgtagga

SEQ ID NO: 516059 - DNA, 20 bp, Artificial Sequence
  chemically synthesized
cttcgtgtaggagtgggttt

SEQ ID NO: 516060 - DNA, 20 bp, Artificial Sequence
  chemically synthesized
ttactgtgctaatccacacc

SEQ ID NO: 516061 - DNA, 20 bp, Artificial Sequence
  chemically synthesized
tgacgcccaaaactccaggt

SEQ ID NO: 516062 - DNA, 20 bp, Artificial Sequence
  chemically synthesized
ttttgggcgtcaaggttgat

SEQ ID NO: 516063 - DNA, 20 bp, Artificial Sequence
  chemically synthesized
cgtcaaggttgataagggtc

SEQ ID NO: 516064 - DNA, 20 bp, Artificial Sequence
  chemically synthesized
ggttgataagggtcaagggt

SEQ ID NO: 516065 - DNA, 20 bp, Artificial Sequence
  chemically synthesized
tgtctgaccagctggtgccc

SEQ ID NO: 516066 - DNA, 20 bp, Artificial Sequence
  chemically synthesized
aaactatgtcccattggaat

SEQ ID NO: 516067 - DNA, 20 bp, Artificial Sequence
  chemically synthesized
tgttgaaaactatgtcccat

SEQ ID NO: 516068 - DNA, 20 bp, Artificial Sequence
  chemically synthesized
ggacatagttttcaacagag

SEQ ID NO: 516069 - DNA, 20 bp, Artificial Sequence
  chemically synthesized
ttgtattgccttatatacac

SEQ ID NO: 516070 - DNA, 20 bp, Artificial Sequence
  chemically synthesized
ggcttccaggccttagcaag

SEQ ID NO: 516071 - DNA, 20 bp, Artificial Sequence
  chemically synthesized
caggccttagcaagaagaat

SEQ ID NO: 516072 - DNA, 20 bp, Artificial Sequence
  chemically synthesized
aactggaacattttctaatt

SEQ ID NO: 516073 - DNA, 20 bp, Artificial Sequence
  chemically synthesized
ttctaattgagggtggtaga

SEQ ID NO: 516074 - DNA, 20 bp, Artificial Sequence
  chemically synthesized
tcagccgaatatataaatat

SEQ ID NO: 516075 - DNA, 20 bp, Artificial Sequence
  chemically synthesized
ttgaaagctctcaacctcag

SEQ ID NO: 516076 - DNA, 20 bp, Artificial Sequence
  chemically synthesized
ggctgaggttgagagctttc

SEQ ID NO: 516077 - DNA, 20 bp, Artificial Sequence
  chemically synthesized
tgctgagctggctgctggct

SEQ ID NO: 516078 - DNA, 20 bp, Artificial Sequence
  chemically synthesized
cttatcttgccgaggtttaa

SEQ ID NO: 516079 - DNA, 20 bp, Artificial Sequence
  chemically synthesized
gtacacagctgtgcgatgaa

SEQ ID NO: 516080 - DNA, 20 bp, Artificial Sequence
  chemically synthesized
gccctgatgcttttgcaata

SEQ ID NO: 516081 - DNA, 20 bp, Artificial Sequence
  chemically synthesized
ctctgggttgtactaaggag

SEQ ID NO: 516082 - DNA, 20 bp, Artificial Sequence
  chemically synthesized
gactgctctgggttgtacta

SEQ ID NO: 516083 - DNA, 20 bp, Artificial Sequence
  chemically synthesized
gcaggctacagcagactgct

SEQ ID NO: 516084 - DNA, 20 bp, Artificial Sequence
  chemically synthesized
accctaggggtgtaatcaag

SEQ ID NO: 516085 - DNA, 20 bp, Artificial Sequence
  chemically synthesized
atccctcttgattacacccc

SEQ ID NO: 516086 - DNA, 20 bp, Artificial Sequence
  chemically synthesized
cctgcctcctattataccct

SEQ ID NO: 516087 - DNA, 20 bp, Artificial Sequence
  chemically synthesized
tacagaaagtaaactgcttt

SEQ ID NO: 516088 - DNA, 20 bp, Artificial Sequence
  chemically synthesized
aggggtggctggtgtcaata

SEQ ID NO: 516089 - DNA, 20 bp, Artificial Sequence
  chemically synthesized
tgatgagccttgaagtcacc

SEQ ID NO: 516090 - DNA, 20 bp, Artificial Sequence
  chemically synthesized
aactgttttaaaataaagca

SEQ ID NO: 516091 - DNA, 20 bp, Artificial Sequence
  chemically synthesized
ataaagcaaagagtcacatg

SEQ ID NO: 516092 - DNA, 20 bp, Artificial Sequence
  chemically synthesized
caaagagtcacatgtagaat

SEQ ID NO: 516093 - DNA, 20 bp, Artificial Sequence
  chemically synthesized
acatgtagaattggaattac

SEQ ID NO: 516094 - DNA, 20 bp, Artificial Sequence
  chemically synthesized
cctaaaagacacactactga

SEQ ID NO: 516095 - DNA, 20 bp, Artificial Sequence
  chemically synthesized
acacactactgatggggtct

SEQ ID NO: 516096 - DNA, 20 bp, Artificial Sequence
  chemically synthesized
aagtgaattatcttagttac

SEQ ID NO: 516097 - DNA, 20 bp, Artificial Sequence
  chemically synthesized
tttgcttgtcttgcagtcaa

SEQ ID NO: 516098 - DNA, 20 bp, Artificial Sequence
  chemically synthesized
actgcaagacaagcaaaata

SEQ ID NO: 516099 - DNA, 20 bp, Artificial Sequence
  chemically synthesized
tagttgctccaaattttaac

SEQ ID NO: 516100 - DNA, 20 bp, Artificial Sequence
  chemically synthesized
accacagtgttgttgaatct

SEQ ID NO: 516101 - DNA, 20 bp, Artificial Sequence
  chemically synthesized
ttctgcgtaccacagtgttg

SEQ ID NO: 516102 - DNA, 20 bp, Artificial Sequence
  chemically synthesized
aacactgtggtacgcagaac

SEQ ID NO: 516103 - DNA, 20 bp, Artificial Sequence
  chemically synthesized
agggctataaacactttgtc

SEQ ID NO: 516104 - DNA, 20 bp, Artificial Sequence
  chemically synthesized
tgtttatagccctttctttt

SEQ ID NO: 516105 - DNA, 20 bp, Artificial Sequence
  chemically synthesized
taacatgggccttcaagcac

SEQ ID NO: 516106 - DNA, 20 bp, Artificial Sequence
  chemically synthesized
taagaaatttatctcagaaa

SEQ ID NO: 516107 - DNA, 20 bp, Artificial Sequence
  chemically synthesized
caccattaatattttttaca

SEQ ID NO: 516108 - DNA, 20 bp, Artificial Sequence
  chemically synthesized
cacaggtaatcagaacaaac

SEQ ID NO: 516109 - DNA, 20 bp, Artificial Sequence
  chemically synthesized
aaacaggaataaaaagaaca

SEQ ID NO: 516110 - DNA, 20 bp, Artificial Sequence
  chemically synthesized
aggaaaggggaaatataagg

SEQ ID NO: 516111 - DNA, 20 bp, Artificial Sequence
  chemically synthesized
gggaaatataaggaggagta

SEQ ID NO: 516112 - DNA, 20 bp, Artificial Sequence
  chemically synthesized
gagaaaatctatgacattag

SEQ ID NO: 516113 - DNA, 20 bp, Artificial Sequence
  chemically synthesized
aacctcatagttttaggtag

SEQ ID NO: 516114 - DNA, 20 bp, Artificial Sequence
  chemically synthesized
ggtaggagggttcttattgg

SEQ ID NO: 516115 - DNA, 20 bp, Artificial Sequence
  chemically synthesized
cagaacaattaatggataat

SEQ ID NO: 516116 - DNA, 20 bp, Artificial Sequence
  chemically synthesized
taaatcagacagaacaatta

SEQ ID NO: 516117 - DNA, 20 bp, Artificial Sequence
  chemically synthesized
tggtatgcccaaaggcttat

SEQ ID NO: 516118 - DNA, 20 bp, Artificial Sequence
  chemically synthesized
tgaacttcaaaatggaaaaa

SEQ ID NO: 516119 - DNA, 20 bp, Artificial Sequence
  chemically synthesized
cacattttgtattgattgca

SEQ ID NO: 516120 - DNA, 20 bp, Artificial Sequence
  chemically synthesized
tgttaagaagccttagttca

SEQ ID NO: 516121 - DNA, 20 bp, Artificial Sequence
  chemically synthesized
gcagcaaatggaaacgtaat

SEQ ID NO: 516122 - DNA, 20 bp, Artificial Sequence
  chemically synthesized
tgacatcccctttattttgg

SEQ ID NO: 516123 - DNA, 20 bp, Artificial Sequence
  chemically synthesized
tagtattctgccaaaataaa

SEQ ID NO: 516124 - DNA, 20 bp, Artificial Sequence
  chemically synthesized
gatttgtgatgctatttagc

SEQ ID NO: 516125 - DNA, 20 bp, Artificial Sequence
  chemically synthesized
agcatcacaaatcccatatg

SEQ ID NO: 516126 - DNA, 20 bp, Artificial Sequence
  chemically synthesized
taaaatgataattctacata

SEQ ID NO: 516127 - DNA, 20 bp, Artificial Sequence
  chemically synthesized
agaattatcattttattttt

SEQ ID NO: 516128 - DNA, 20 bp, Artificial Sequence
  chemically synthesized
agttttttccaccaaaagcc

SEQ ID NO: 516129 - DNA, 20 bp, Artificial Sequence
  chemically synthesized
ccaagaataaaattgctttg

SEQ ID NO: 516130 - DNA, 20 bp, Artificial Sequence
  chemically synthesized
cttcccttactgccacccac

SEQ ID NO: 516131 - DNA, 20 bp, Artificial Sequence
  chemically synthesized
tcttgcttttatttactctt

SEQ ID NO: 516132 - DNA, 20 bp, Artificial Sequence
  chemically synthesized
tggcgttttggaagtcaaac

SEQ ID NO: 516133 - DNA, 20 bp, Artificial Sequence
  chemically synthesized
tcagagcccaggaacttctt

SEQ ID NO: 516134 - DNA, 20 bp, Artificial Sequence
  chemically synthesized
tctgaagaagttcctgggct

SEQ ID NO: 516135 - DNA, 20 bp, Artificial Sequence
  chemically synthesized
gagtatcatgctacacagta

SEQ ID NO: 516136 - DNA, 20 bp, Artificial Sequence
  chemically synthesized
tagccaaatgtatctcaggc

SEQ ID NO: 516137 - DNA, 20 bp, Artificial Sequence
  chemically synthesized
aaaatcagggcttggcctgg

SEQ ID NO: 516138 - DNA, 20 bp, Artificial Sequence
  chemically synthesized
attctttcctaggcaaagcc

SEQ ID NO: 516139 - DNA, 20 bp, Artificial Sequence
  chemically synthesized
attcttggctttgcctagga

SEQ ID NO: 516140 - DNA, 20 bp, Artificial Sequence
  chemically synthesized
ttaacgccactggctcgccc

SEQ ID NO: 516141 - DNA, 20 bp, Artificial Sequence
  chemically synthesized
caactttggaggcactgcct

SEQ ID NO: 516142 - DNA, 20 bp, Artificial Sequence
  chemically synthesized
ggcagtgcctccaaagttgg

SEQ ID NO: 516143 - DNA, 20 bp, Artificial Sequence
  chemically synthesized
gtaattgaaagtgggtataa

SEQ ID NO: 516144 - DNA, 20 bp, Artificial Sequence
  chemically synthesized
taatttacatgtaattgaaa

SEQ ID NO: 516145 - DNA, 20 bp, Artificial Sequence
  chemically synthesized
tatttagaactttctaggaa

SEQ ID NO: 516146 - DNA, 20 bp, Artificial Sequence
  chemically synthesized
taggaaaggggtggtaactt

SEQ ID NO: 516147 - DNA, 20 bp, Artificial Sequence
  chemically synthesized
taaactgtcatggtgctggt

SEQ ID NO: 516148 - DNA, 20 bp, Artificial Sequence
  chemically synthesized
aatatgcaatgagggctgct

SEQ ID NO: 516149 - DNA, 20 bp, Artificial Sequence
  chemically synthesized
gtttcttcactttatcctct

SEQ ID NO: 516150 - DNA, 20 bp, Artificial Sequence
  chemically synthesized
ggacttatttcccattccca

SEQ ID NO: 516151 - DNA, 20 bp, Artificial Sequence
  chemically synthesized
attctgtgcaagcctgaggt

SEQ ID NO: 516152 - DNA, 20 bp, Artificial Sequence
  chemically synthesized
actcctacctcaggcttgca

SEQ ID NO: 516153 - DNA, 20 bp, Artificial Sequence
  chemically synthesized
taggcagtgatgtatatttg

SEQ ID NO: 516154 - DNA, 20 bp, Artificial Sequence
  chemically synthesized
caggcactgttccaagtgct

SEQ ID NO: 516155 - DNA, 20 bp, Artificial Sequence
  chemically synthesized
tgtgtgcatgttgtctactg

SEQ ID NO: 516156 - DNA, 20 bp, Artificial Sequence
  chemically synthesized
gaggcaaatatatagtgcac

SEQ ID NO: 516157 - DNA, 20 bp, Artificial Sequence
  chemically synthesized
tcaagaggaacttaagaatc

SEQ ID NO: 516158 - DNA, 20 bp, Artificial Sequence
  chemically synthesized
ttatttttcaagaggaactt

SEQ ID NO: 516159 - DNA, 20 bp, Artificial Sequence
  chemically synthesized
cagtctagcagtgtccatgt

SEQ ID NO: 516160 - DNA, 20 bp, Artificial Sequence
  chemically synthesized
ctgacatggacactgctaga

SEQ ID NO: 516161 - DNA, 20 bp, Artificial Sequence
  chemically synthesized
cggacattgtgtaaattgga

SEQ ID NO: 516162 - DNA, 20 bp, Artificial Sequence
  chemically synthesized
atacctgcaaggacctgaaa

SEQ ID NO: 516163 - DNA, 20 bp, Artificial Sequence
  chemically synthesized
aaataaaataatacagtgaa

SEQ ID NO: 516164 - DNA, 20 bp, Artificial Sequence
  chemically synthesized
aaataaaataaaataataca

SEQ ID NO: 516165 - DNA, 20 bp, Artificial Sequence
  chemically synthesized
tcagttcagtttgtatcatt

SEQ ID NO: 516166 - DNA, 20 bp, Artificial Sequence
  chemically synthesized
gtttgtacttaattctacgg

SEQ ID NO: 516167 - DNA, 20 bp, Artificial Sequence
  chemically synthesized
tgagccaccgcacccggccg

SEQ ID NO: 516168 - DNA, 20 bp, Artificial Sequence
  chemically synthesized
actttgggaggctgaggcgg

SEQ ID NO: 516169 - DNA, 20 bp, Artificial Sequence
  chemically synthesized
cggggtttcaccatgttggt

SEQ ID NO: 516170 - DNA, 20 bp, Artificial Sequence
  chemically synthesized
ttttgtatttttagtagcga

SEQ ID NO: 516171 - DNA, 20 bp, Artificial Sequence
  chemically synthesized
gattcttctgcctcagcctc

SEQ ID NO: 516172 - DNA, 20 bp, Artificial Sequence
  chemically synthesized
tactcaggaggctgaggcag

SEQ ID NO: 516173 - DNA, 20 bp, Artificial Sequence
  chemically synthesized
tcttgctctgttgtccaggc

SEQ ID NO: 516174 - DNA, 20 bp, Artificial Sequence
  chemically synthesized
ttttttttttttttttgaga

SEQ ID NO: 516175 - DNA, 20 bp, Artificial Sequence
  chemically synthesized
gtttgtacttaattctaatg

SEQ ID NO: 516176 - DNA, 20 bp, Artificial Sequence
  chemically synthesized
gaatccataacattctgcat

SEQ ID NO: 516177 - DNA, 20 bp, Artificial Sequence
  chemically synthesized
taattctaatgcagaatgtt

SEQ ID NO: 516178 - DNA, 20 bp, Artificial Sequence
  chemically synthesized
atttataccagaaccaatat

SEQ ID NO: 516179 - DNA, 20 bp, Artificial Sequence
  chemically synthesized
gagaatatatttggaccaca

SEQ ID NO: 516180 - DNA, 20 bp, Artificial Sequence
  chemically synthesized
agtcaaactcttactttact

SEQ ID NO: 516181 - DNA, 20 bp, Artificial Sequence
  chemically synthesized
aaatatattctcagtaaagt

SEQ ID NO: 516182 - DNA, 20 bp, Artificial Sequence
  chemically synthesized
agtaagagtttgacttattt

SEQ ID NO: 516183 - DNA, 20 bp, Artificial Sequence
  chemically synthesized
acttatttgtgggtttgaaa

SEQ ID NO: 516184 - DNA, 20 bp, Artificial Sequence
  chemically synthesized
tacagcagctcaactgaatt

SEQ ID NO: 516185 - DNA, 20 bp, Artificial Sequence
  chemically synthesized
ctgaaattacagcagctcaa

SEQ ID NO: 516186 - DNA, 20 bp, Artificial Sequence
  chemically synthesized
ttgtatataaaaagttaaat

SEQ ID NO: 516187 - DNA, 20 bp, Artificial Sequence
  chemically synthesized
ttccttaaaattccctaagt

SEQ ID NO: 516188 - DNA, 20 bp, Artificial Sequence
  chemically synthesized
taagatattattccaactta

SEQ ID NO: 516189 - DNA, 20 bp, Artificial Sequence
  chemically synthesized
tctggtaaaattgtgttggt

SEQ ID NO: 516190 - DNA, 20 bp, Artificial Sequence
  chemically synthesized
aaaattgtgttggtatgaat

SEQ ID NO: 516191 - DNA, 20 bp, Artificial Sequence
  chemically synthesized
aaaaatgaaaattgggaaga

SEQ ID NO: 516192 - DNA, 20 bp, Artificial Sequence
  chemically synthesized
agaatagtggtgcatttggg

SEQ ID NO: 516193 - DNA, 20 bp, Artificial Sequence
  chemically synthesized
ggcatgtggaggagggcttc

SEQ ID NO: 516194 - DNA, 20 bp, Artificial Sequence
  chemically synthesized
tctcttaaagaaaaattgac

SEQ ID NO: 516195 - DNA, 20 bp, Artificial Sequence
  chemically synthesized
ctaaacttcagcctgggaaa

SEQ ID NO: 516196 - DNA, 20 bp, Artificial Sequence
  chemically synthesized
tcatagctctcagtctaacc

SEQ ID NO: 516197 - DNA, 20 bp, Artificial Sequence
  chemically synthesized
tactcaggaggctgaggcag

SEQ ID NO: 516198 - DNA, 20 bp, Artificial Sequence
  chemically synthesized
cattcaactgcctcagcctc

SEQ ID NO: 516199 - DNA, 20 bp, Artificial Sequence
  chemically synthesized
gattgcttgtgtccaggagt

SEQ ID NO: 516200 - DNA, 20 bp, Artificial Sequence
  chemically synthesized
tggtaggattgcttgtgtcc

SEQ ID NO: 516201 - DNA, 20 bp, Artificial Sequence
  chemically synthesized
gttttgggaggctgaggtgg

SEQ ID NO: 516202 - DNA, 20 bp, Artificial Sequence
  chemically synthesized
acctcagcctcccaaaactc

SEQ ID NO: 516203 - DNA, 20 bp, Artificial Sequence
  chemically synthesized
gtggcttgtgcttgtaatcc

SEQ ID NO: 516204 - DNA, 20 bp, Artificial Sequence
  chemically synthesized
ttcacttaagaaataggggg

SEQ ID NO: 516205 - DNA, 20 bp, Artificial Sequence
  chemically synthesized
tcttaagtgaagtgattatg

SEQ ID NO: 516206 - DNA, 20 bp, Artificial Sequence
  chemically synthesized
gtaaggaatatagagcaata

SEQ ID NO: 516207 - DNA, 20 bp, Artificial Sequence
  chemically synthesized
atataagatttacatgtgta

SEQ ID NO: 516208 - DNA, 20 bp, Artificial Sequence
  chemically synthesized
tctatagcaaatgaaaaaaa

SEQ ID NO: 516209 - DNA, 20 bp, Artificial Sequence
  chemically synthesized
tttaacaaaatatctttact

SEQ ID NO: 516210 - DNA, 20 bp, Artificial Sequence
  chemically synthesized
atattgtattattatttatt

SEQ ID NO: 516211 - DNA, 20 bp, Artificial Sequence
  chemically synthesized
tattatttattaagaattac

SEQ ID NO: 516212 - DNA, 20 bp, Artificial Sequence
  chemically synthesized
ttttcatcattttggcttat

SEQ ID NO: 516213 - DNA, 20 bp, Artificial Sequence
  chemically synthesized
tcatcttttggagttattgg

SEQ ID NO: 516214 - DNA, 20 bp, Artificial Sequence
  chemically synthesized
ccaaacatattttcatcttt

SEQ ID NO: 516215 - DNA, 20 bp, Artificial Sequence
  chemically synthesized
atagttttgattatttataa

SEQ ID NO: 516216 - DNA, 20 bp, Artificial Sequence
  chemically synthesized
ttttgattatttataaaaga

SEQ ID NO: 516217 - DNA, 20 bp, Artificial Sequence
  chemically synthesized
tatatttaaaataattaagt

SEQ ID NO: 516218 - DNA, 20 bp, Artificial Sequence
  chemically synthesized
atattcttttccctttaaaa

SEQ ID NO: 516219 - DNA, 20 bp, Artificial Sequence
  chemically synthesized
caattcttttttaaagggaa

SEQ ID NO: 516220 - DNA, 20 bp, Artificial Sequence
  chemically synthesized
gtaataattttgaagagaag

SEQ ID NO: 516221 - DNA, 20 bp, Artificial Sequence
  chemically synthesized
tgtatttaataatggatttt

SEQ ID NO: 516222 - DNA, 20 bp, Artificial Sequence
  chemically synthesized
tttgaaaattgtatttaata

SEQ ID NO: 516223 - DNA, 20 bp, Artificial Sequence
  chemically synthesized
aaaatttgtgtttcaaaaaa

SEQ ID NO: 516224 - DNA, 20 bp, Artificial Sequence
  chemically synthesized
ggtggaatatggacttttta

SEQ ID NO: 516225 - DNA, 20 bp, Artificial Sequence
  chemically synthesized
atatttagcacatgactagg

SEQ ID NO: 516226 - DNA, 20 bp, Artificial Sequence
  chemically synthesized
aataatattataggaaaacg

SEQ ID NO: 516227 - DNA, 20 bp, Artificial Sequence
  chemically synthesized
ttataaaatagaaaaataaa

SEQ ID NO: 516228 - DNA, 20 bp, Artificial Sequence
  chemically synthesized
aaaataaacagagtttagta

SEQ ID NO: 516229 - DNA, 20 bp, Artificial Sequence
  chemically synthesized
gtctgaacatgtgtaaagca

SEQ ID NO: 516230 - DNA, 20 bp, Artificial Sequence
  chemically synthesized
aaacagataaaagtagatga

SEQ ID NO: 516231 - DNA, 20 bp, Artificial Sequence
  chemically synthesized
tttccataaagccaaagatt

SEQ ID NO: 516232 - DNA, 20 bp, Artificial Sequence
  chemically synthesized
cagttttattatgactgtat

SEQ ID NO: 516233 - DNA, 20 bp, Artificial Sequence
  chemically synthesized
atagcatatgtttttgtaaa

SEQ ID NO: 516234 - DNA, 20 bp, Artificial Sequence
  chemically synthesized
atctttgtattaatttttgt

SEQ ID NO: 516235 - DNA, 20 bp, Artificial Sequence
  chemically synthesized
atatattgtgtaagtattta

SEQ ID NO: 516236 - DNA, 20 bp, Artificial Sequence
  chemically synthesized
agggtaataatacatatcat

SEQ ID NO: 516237 - DNA, 20 bp, Artificial Sequence
  chemically synthesized
atacatatcatacgaatgtt

SEQ ID NO: 516238 - DNA, 20 bp, Artificial Sequence
  chemically synthesized
gtgtgtgatgcttgcttatg

SEQ ID NO: 516239 - DNA, 20 bp, Artificial Sequence
  chemically synthesized
attttacctgaaaatttttt

SEQ ID NO: 516240 - DNA, 20 bp, Artificial Sequence
  chemically synthesized
gtaaaatgtcctgtaaatgt

SEQ ID NO: 516241 - DNA, 20 bp, Artificial Sequence
  chemically synthesized
ggtgtctttctaaatatatc

SEQ ID NO: 516242 - DNA, 20 bp, Artificial Sequence
  chemically synthesized
tatatatttggttaattaaa

SEQ ID NO: 516243 - DNA, 20 bp, Artificial Sequence
  chemically synthesized
caaattagagaatacttatt

SEQ ID NO: 516244 - DNA, 20 bp, Artificial Sequence
  chemically synthesized
tgttgctaatttccaaatta

SEQ ID NO: 516245 - DNA, 20 bp, Artificial Sequence
  chemically synthesized
gggatactcctatgccaggg

SEQ ID NO: 516246 - DNA, 20 bp, Artificial Sequence
  chemically synthesized
tattaatccatccctggcat

SEQ ID NO: 516247 - DNA, 20 bp, Artificial Sequence
  chemically synthesized
cattgggatactcctatgcc

SEQ ID NO: 516248 - DNA, 20 bp, Artificial Sequence
  chemically synthesized
aagagttcaaattagtacat

SEQ ID NO: 516249 - DNA, 20 bp, Artificial Sequence
  chemically synthesized
tattgaactgaatgctttat

SEQ ID NO: 516250 - DNA, 20 bp, Artificial Sequence
  chemically synthesized
atttaatgagttatattgaa

SEQ ID NO: 516251 - DNA, 20 bp, Artificial Sequence
  chemically synthesized
ttgggctgtagggccattta

SEQ ID NO: 516252 - DNA, 20 bp, Artificial Sequence
  chemically synthesized
gccttggcctcccaaagtgc

SEQ ID NO: 516253 - DNA, 20 bp, Artificial Sequence
  chemically synthesized
cagcactttgggaggccaag

SEQ ID NO: 516254 - DNA, 20 bp, Artificial Sequence
  chemically synthesized
actttgggaggccaaggcgg

SEQ ID NO: 516255 - DNA, 20 bp, Artificial Sequence
  chemically synthesized
cgggtggatcacccgaggtc

SEQ ID NO: 516256 - DNA, 20 bp, Artificial Sequence
  chemically synthesized
ctggtctcaaactcctgacc

SEQ ID NO: 516257 - DNA, 20 bp, Artificial Sequence
  chemically synthesized
ttttgtatttttagtagaga

SEQ ID NO: 516258 - DNA, 20 bp, Artificial Sequence
  chemically synthesized
gattctcttgcctcagcctc

SEQ ID NO: 516259 - DNA, 20 bp, Artificial Sequence
  chemically synthesized
tactcaggaggctgaggcaa

SEQ ID NO: 516260 - DNA, 20 bp, Artificial Sequence
  chemically synthesized
acctccgcctcccgggttca

SEQ ID NO: 516261 - DNA, 20 bp, Artificial Sequence
  chemically synthesized
tgggctgcaacctccgcctc

SEQ ID NO: 516262 - DNA, 20 bp, Artificial Sequence
  chemically synthesized
ttgcagcccagcctgggcga

SEQ ID NO: 516263 - DNA, 20 bp, Artificial Sequence
  chemically synthesized
ttttttttttttttttgaga

SEQ ID NO: 516264 - DNA, 20 bp, Artificial Sequence
  chemically synthesized
catttattatcagcaactaa

SEQ ID NO: 516265 - DNA, 20 bp, Artificial Sequence
  chemically synthesized
aggggaagactggtatgtgt

SEQ ID NO: 516266 - DNA, 20 bp, Artificial Sequence
  chemically synthesized
aaaagtctttgtttcttctg

SEQ ID NO: 516267 - DNA, 20 bp, Artificial Sequence
  chemically synthesized
ttcagaagaaacaaagactt

SEQ ID NO: 516268 - DNA, 20 bp, Artificial Sequence
  chemically synthesized
tgcaatgaaatgtatgtagg

SEQ ID NO: 516269 - DNA, 20 bp, Artificial Sequence
  chemically synthesized
gggaaaaagtgggagaagaa

SEQ ID NO: 516270 - DNA, 20 bp, Artificial Sequence
  chemically synthesized
gggcattttgtgcaatgctg

SEQ ID NO: 516271 - DNA, 20 bp, Artificial Sequence
  chemically synthesized
gagcattttaagaaagctcc

SEQ ID NO: 516272 - DNA, 20 bp, Artificial Sequence
  chemically synthesized
atctctgggtatgagggact

SEQ ID NO: 516273 - DNA, 20 bp, Artificial Sequence
  chemically synthesized
gataaattaaatcagaatct

SEQ ID NO: 516274 - DNA, 20 bp, Artificial Sequence
  chemically synthesized
ccacccaagataaattaaat

SEQ ID NO: 516275 - DNA, 20 bp, Artificial Sequence
  chemically synthesized
agattctgatttaatttatc

SEQ ID NO: 516276 - DNA, 20 bp, Artificial Sequence
  chemically synthesized
ggttgctaacggctgtgtta

SEQ ID NO: 516277 - DNA, 20 bp, Artificial Sequence
  chemically synthesized
acacaatcagatttatattg

SEQ ID NO: 516278 - DNA, 20 bp, Artificial Sequence
  chemically synthesized
aaaatcagtctaaatactgc

SEQ ID NO: 516279 - DNA, 20 bp, Artificial Sequence
  chemically synthesized
ggcagtatttagactgattt

SEQ ID NO: 516280 - DNA, 20 bp, Artificial Sequence
  chemically synthesized
ttggaatagactaaactgca

SEQ ID NO: 516281 - DNA, 20 bp, Artificial Sequence
  chemically synthesized
ctaaagtgaagccaggtagt

SEQ ID NO: 516282 - DNA, 20 bp, Artificial Sequence
  chemically synthesized
agtgaagccaggtagtaagg

SEQ ID NO: 516283 - DNA, 20 bp, Artificial Sequence
  chemically synthesized
ccaggtagtaaggatggata

SEQ ID NO: 516284 - DNA, 20 bp, Artificial Sequence
  chemically synthesized
agtaaggatggataaggagt

SEQ ID NO: 516285 - DNA, 20 bp, Artificial Sequence
  chemically synthesized
gttccagtcgcattaaaact

SEQ ID NO: 516286 - DNA, 20 bp, Artificial Sequence
  chemically synthesized
tagtgattataaatattgac

SEQ ID NO: 516287 - DNA, 20 bp, Artificial Sequence
  chemically synthesized
ggcaggagtagagtttgaat

SEQ ID NO: 516288 - DNA, 20 bp, Artificial Sequence
  chemically synthesized
caaagtggcaggagtagagt

SEQ ID NO: 516289 - DNA, 20 bp, Artificial Sequence
  chemically synthesized
caacaacaaagtggcaggag

SEQ ID NO: 516290 - DNA, 20 bp, Artificial Sequence
  chemically synthesized
tcacacaacaacaaagtggc

SEQ ID NO: 516291 - DNA, 20 bp, Artificial Sequence
  chemically synthesized
catatgagcaaaaagagact

SEQ ID NO: 516292 - DNA, 20 bp, Artificial Sequence
  chemically synthesized
accaggtaaggaagttaata

SEQ ID NO: 516293 - DNA, 20 bp, Artificial Sequence
  chemically synthesized
ttcataatgactgtccattg

SEQ ID NO: 516294 - DNA, 20 bp, Artificial Sequence
  chemically synthesized
tagctgtctcagtaaatgtg

SEQ ID NO: 516295 - DNA, 20 bp, Artificial Sequence
  chemically synthesized
tgtctcagtaaatgtgctgg

SEQ ID NO: 516296 - DNA, 20 bp, Artificial Sequence
  chemically synthesized
gaaaggtgtagcttggcttc

SEQ ID NO: 516297 - DNA, 20 bp, Artificial Sequence
  chemically synthesized
attacatttgtgaaaactta

SEQ ID NO: 516298 - DNA, 20 bp, Artificial Sequence
  chemically synthesized
cttgatctgatactggttaa

SEQ ID NO: 516299 - DNA, 20 bp, Artificial Sequence
  chemically synthesized
cctaggagacatgacttgaa

SEQ ID NO: 516300 - DNA, 20 bp, Artificial Sequence
  chemically synthesized
ccctttcaagtcatgtctcc

SEQ ID NO: 516301 - DNA, 20 bp, Artificial Sequence
  chemically synthesized
agaggaagataggtttaatt

SEQ ID NO: 516302 - DNA, 20 bp, Artificial Sequence
  chemically synthesized
taggtttaattttggataag

SEQ ID NO: 516303 - DNA, 20 bp, Artificial Sequence
  chemically synthesized
taagtggggtcaagagcctg

SEQ ID NO: 516304 - DNA, 20 bp, Artificial Sequence
  chemically synthesized
aaccttcttgaattttccat

SEQ ID NO: 516305 - DNA, 20 bp, Artificial Sequence
  chemically synthesized
ttattctgctcaaaaccttc

SEQ ID NO: 516306 - DNA, 20 bp, Artificial Sequence
  chemically synthesized
aaattcaagaaggttttgag

SEQ ID NO: 516307 - DNA, 20 bp, Artificial Sequence
  chemically synthesized
agaaggttttgagcagaata

SEQ ID NO: 516308 - DNA, 20 bp, Artificial Sequence
  chemically synthesized
ttcttttctttttttggaga

SEQ ID NO: 516309 - DNA, 20 bp, Artificial Sequence
  chemically synthesized
tctcgctctgtcacccaggc

SEQ ID NO: 516310 - DNA, 20 bp, Artificial Sequence
  chemically synthesized
atccgccattgcactccagc

SEQ ID NO: 516311 - DNA, 20 bp, Artificial Sequence
  chemically synthesized
acccaggctggagtgcaatg

SEQ ID NO: 516312 - DNA, 20 bp, Artificial Sequence
  chemically synthesized
tacttgggaggctgaggcag

SEQ ID NO: 516313 - DNA, 20 bp, Artificial Sequence
  chemically synthesized
gcctcagcctcccaagtagc

SEQ ID NO: 516314 - DNA, 20 bp, Artificial Sequence
  chemically synthesized
aattagccgggcgtgtggtg

SEQ ID NO: 516315 - DNA, 20 bp, Artificial Sequence
  chemically synthesized
ttttgtatttttggtagaga

SEQ ID NO: 516316 - DNA, 20 bp, Artificial Sequence
  chemically synthesized
caggtggattacctgaggtc

SEQ ID NO: 516317 - DNA, 20 bp, Artificial Sequence
  chemically synthesized
actttggaaggccaaggcag

SEQ ID NO: 516318 - DNA, 20 bp, Artificial Sequence
  chemically synthesized
gccttggccttccaaagtgc

SEQ ID NO: 516319 - DNA, 20 bp, Artificial Sequence
  chemically synthesized
caccattaaaacattatggg

SEQ ID NO: 516320 - DNA, 20 bp, Artificial Sequence
  chemically synthesized
aacatattatgcctagtcac

SEQ ID NO: 516321 - DNA, 20 bp, Artificial Sequence
  chemically synthesized
tgttaaacctagcaaaagag

SEQ ID NO: 516322 - DNA, 20 bp, Artificial Sequence
  chemically synthesized
cacaatgttaaacctagcaa

SEQ ID NO: 516323 - DNA, 20 bp, Artificial Sequence
  chemically synthesized
aggtcatatggtcccaatat

SEQ ID NO: 516324 - DNA, 20 bp, Artificial Sequence
  chemically synthesized
aattatctaaaaaatgctca

SEQ ID NO: 516325 - DNA, 20 bp, Artificial Sequence
  chemically synthesized
agtaggaagtacataagaca

SEQ ID NO: 516326 - DNA, 20 bp, Artificial Sequence
  chemically synthesized
attaagttctcaccaagtta

SEQ ID NO: 516327 - DNA, 20 bp, Artificial Sequence
  chemically synthesized
ctagactaatccccttagca

SEQ ID NO: 516328 - DNA, 20 bp, Artificial Sequence
  chemically synthesized
aatcatagattctttgctaa

SEQ ID NO: 516329 - DNA, 20 bp, Artificial Sequence
  chemically synthesized
aaattgttcaaattattttt

SEQ ID NO: 516330 - DNA, 20 bp, Artificial Sequence
  chemically synthesized
atatatatagtaaacattta

SEQ ID NO: 516331 - DNA, 20 bp, Artificial Sequence
  chemically synthesized
actatatatataagttgggg

SEQ ID NO: 516332 - DNA, 20 bp, Artificial Sequence
  chemically synthesized
ctgagtctttctttcattct

SEQ ID NO: 516333 - DNA, 20 bp, Artificial Sequence
  chemically synthesized
ggtgtttatgctaagaccca

SEQ ID NO: 516334 - DNA, 20 bp, Artificial Sequence
  chemically synthesized
tctcatggacaaggggacaa

SEQ ID NO: 516335 - DNA, 20 bp, Artificial Sequence
  chemically synthesized
atgtatactttcaaattatg

SEQ ID NO: 516336 - DNA, 20 bp, Artificial Sequence
  chemically synthesized
tattgactatcttctcctta

SEQ ID NO: 516337 - DNA, 20 bp, Artificial Sequence
  chemically synthesized
ggaatatgacagtgaaccaa

SEQ ID NO: 516338 - DNA, 20 bp, Artificial Sequence
  chemically synthesized
caacaacccttctaggtgcc

SEQ ID NO: 516339 - DNA, 20 bp, Artificial Sequence
  chemically synthesized
gtcatattcctggcacctag

SEQ ID NO: 516340 - DNA, 20 bp, Artificial Sequence
  chemically synthesized
atctcagtagcaccaagatt

SEQ ID NO: 516341 - DNA, 20 bp, Artificial Sequence
  chemically synthesized
caagatgattctttattatg

SEQ ID NO: 516342 - DNA, 20 bp, Artificial Sequence
  chemically synthesized
caggtcaacccaccataata

SEQ ID NO: 516343 - DNA, 20 bp, Artificial Sequence
  chemically synthesized
gtgtctagtgggtagagacc

SEQ ID NO: 516344 - DNA, 20 bp, Artificial Sequence
  chemically synthesized
atgtttgctactggtgtcta

SEQ ID NO: 516345 - DNA, 20 bp, Artificial Sequence
  chemically synthesized
cttcttttagttatgccact

SEQ ID NO: 516346 - DNA, 20 bp, Artificial Sequence
  chemically synthesized
tctgggtggttttgccgtcc

SEQ ID NO: 516347 - DNA, 20 bp, Artificial Sequence
  chemically synthesized
ccctggacggcaaaaccacc

SEQ ID NO: 516348 - DNA, 20 bp, Artificial Sequence
  chemically synthesized
cggcaaaaccacccagagtt

SEQ ID NO: 516349 - DNA, 20 bp, Artificial Sequence
  chemically synthesized
ttattcagtgattctcaact

SEQ ID NO: 516350 - DNA, 20 bp, Artificial Sequence
  chemically synthesized
ccacccagagttgagaatca

SEQ ID NO: 516351 - DNA, 20 bp, Artificial Sequence
  chemically synthesized
tttaatacataaatgaacaa

SEQ ID NO: 516352 - DNA, 20 bp, Artificial Sequence
  chemically synthesized
atacataaatgaacaaatga

SEQ ID NO: 516353 - DNA, 20 bp, Artificial Sequence
  chemically synthesized
ataaatgaacaaatgagtga

SEQ ID NO: 516354 - DNA, 20 bp, Artificial Sequence
  chemically synthesized
atgaacaaatgagtgagtga

SEQ ID NO: 516355 - DNA, 20 bp, Artificial Sequence
  chemically synthesized
acaaatgagtgagtgaatga

SEQ ID NO: 516356 - DNA, 20 bp, Artificial Sequence
  chemically synthesized
atgagtgagtgaatgaatga

SEQ ID NO: 516357 - DNA, 20 bp, Artificial Sequence
  chemically synthesized
gtgaatgaatgaatgagtta

SEQ ID NO: 516358 - DNA, 20 bp, Artificial Sequence
  chemically synthesized
aaaccatatcactatctgac

SEQ ID NO: 516359 - DNA, 20 bp, Artificial Sequence
  chemically synthesized
acatgagatttcgtggggac

SEQ ID NO: 516360 - DNA, 20 bp, Artificial Sequence
  chemically synthesized
tgtccccacgaaatctcatg

SEQ ID NO: 516361 - DNA, 20 bp, Artificial Sequence
  chemically synthesized
caggccccacctctaacatt

SEQ ID NO: 516362 - DNA, 20 bp, Artificial Sequence
  chemically synthesized
tggggcctggtggcaggtga

SEQ ID NO: 516363 - DNA, 20 bp, Artificial Sequence
  chemically synthesized
tatcgcgagaacagcatcaa

SEQ ID NO: 516364 - DNA, 20 bp, Artificial Sequence
  chemically synthesized
cttgcccttgctcccaccgt

SEQ ID NO: 516365 - DNA, 20 bp, Artificial Sequence
  chemically synthesized
ctgtaaagaaatacctgaca

SEQ ID NO: 516366 - DNA, 20 bp, Artificial Sequence
  chemically synthesized
gtatttctttacagcaatgc

SEQ ID NO: 516367 - DNA, 20 bp, Artificial Sequence
  chemically synthesized
ctggagctacaagagcaaag

SEQ ID NO: 516368 - DNA, 20 bp, Artificial Sequence
  chemically synthesized
taggtcaaggttaaaaggtt

SEQ ID NO: 516369 - DNA, 20 bp, Artificial Sequence
  chemically synthesized
ggtttggaatttactcttgg

SEQ ID NO: 516370 - DNA, 20 bp, Artificial Sequence
  chemically synthesized
aaaacgcctctcattctacc

SEQ ID NO: 516371 - DNA, 20 bp, Artificial Sequence
  chemically synthesized
gttgctccaaatgctgaaat

SEQ ID NO: 516372 - DNA, 20 bp, Artificial Sequence
  chemically synthesized
ctgaaattaggatttataga

SEQ ID NO: 516373 - DNA, 20 bp, Artificial Sequence
  chemically synthesized
actacatgagagagagcagt

SEQ ID NO: 516374 - DNA, 20 bp, Artificial Sequence
  chemically synthesized
gtgtaccatcagctccttcc

SEQ ID NO: 516375 - DNA, 20 bp, Artificial Sequence
  chemically synthesized
aaatcaatcggccaagcaaa

SEQ ID NO: 516376 - DNA, 20 bp, Artificial Sequence
  chemically synthesized
tcatgatcataatatttata

SEQ ID NO: 516377 - DNA, 20 bp, Artificial Sequence
  chemically synthesized
tatgatcatgaacaatatat

SEQ ID NO: 516378 - DNA, 20 bp, Artificial Sequence
  chemically synthesized
tcacttagtctctgtatttg

SEQ ID NO: 516379 - DNA, 20 bp, Artificial Sequence
  chemically synthesized
ctatgatatcatccaaattc

SEQ ID NO: 516380 - DNA, 20 bp, Artificial Sequence
  chemically synthesized
gaatgtttttattctggaat

SEQ ID NO: 516381 - DNA, 20 bp, Artificial Sequence
  chemically synthesized
actatagaatgtttttattc

SEQ ID NO: 516382 - DNA, 20 bp, Artificial Sequence
  chemically synthesized
tttctcatgaatttacacta

SEQ ID NO: 516383 - DNA, 20 bp, Artificial Sequence
  chemically synthesized
actcaatagggtattttctc

SEQ ID NO: 516384 - DNA, 20 bp, Artificial Sequence
  chemically synthesized
attcatgagaaaatacccta

SEQ ID NO: 516385 - DNA, 20 bp, Artificial Sequence
  chemically synthesized
ataaggccaataatactcaa

SEQ ID NO: 516386 - DNA, 20 bp, Artificial Sequence
  chemically synthesized
ttcacttaactttacaattg

SEQ ID NO: 516387 - DNA, 20 bp, Artificial Sequence
  chemically synthesized
aagcattttgaagtagtttc

SEQ ID NO: 516388 - DNA, 20 bp, Artificial Sequence
  chemically synthesized
cacattggcaaagcagttat

SEQ ID NO: 516389 - DNA, 20 bp, Artificial Sequence
  chemically synthesized
agttttcagaaaatcaaaca

SEQ ID NO: 516390 - DNA, 20 bp, Artificial Sequence
  chemically synthesized
agggaaggagattatgagaa

SEQ ID NO: 516391 - DNA, 20 bp, Artificial Sequence
  chemically synthesized
cgtagaactgtatgtacatg

SEQ ID NO: 516392 - DNA, 20 bp, Artificial Sequence
  chemically synthesized
tgattaattcaatgaaccgc

SEQ ID NO: 516393 - DNA, 20 bp, Artificial Sequence
  chemically synthesized
taagaaattcaagcggttca

SEQ ID NO: 516394 - DNA, 20 bp, Artificial Sequence
  chemically synthesized
tgaattaatcactaatagga

SEQ ID NO: 516395 - DNA, 20 bp, Artificial Sequence
  chemically synthesized
ttttcttccttcaaaatcat

SEQ ID NO: 516396 - DNA, 20 bp, Artificial Sequence
  chemically synthesized
tatgaaatacaaagctttac

SEQ ID NO: 516397 - DNA, 20 bp, Artificial Sequence
  chemically synthesized
tctgaattgtcaccaatatg

SEQ ID NO: 516398 - DNA, 20 bp, Artificial Sequence
  chemically synthesized
ttggtgacaattcagacact

SEQ ID NO: 516399 - DNA, 20 bp, Artificial Sequence
  chemically synthesized
ttgtgttccactctcagtgt

SEQ ID NO: 516400 - DNA, 20 bp, Artificial Sequence
  chemically synthesized
acactgagagtggaacacaa

SEQ ID NO: 516401 - DNA, 20 bp, Artificial Sequence
  chemically synthesized
gagagtggaacacaaaggaa

SEQ ID NO: 516402 - DNA, 20 bp, Artificial Sequence
  chemically synthesized
ttgggtaacgagatcactaa

SEQ ID NO: 516403 - DNA, 20 bp, Artificial Sequence
  chemically synthesized
aagacagtttctcaacattc

SEQ ID NO: 516404 - DNA, 20 bp, Artificial Sequence
  chemically synthesized
tttatgtaattgaattattc

SEQ ID NO: 516405 - DNA, 20 bp, Artificial Sequence
  chemically synthesized
ttatatgaatttttatgtaa

SEQ ID NO: 516406 - DNA, 20 bp, Artificial Sequence
  chemically synthesized
tgtcatttaattactattat

SEQ ID NO: 516407 - DNA, 20 bp, Artificial Sequence
  chemically synthesized
aattaaatgacaaaatactt

SEQ ID NO: 516408 - DNA, 20 bp, Artificial Sequence
  chemically synthesized
ttgcaaatttcaggtctctg

SEQ ID NO: 516409 - DNA, 20 bp, Artificial Sequence
  chemically synthesized
gcaagactatatagcttaat

SEQ ID NO: 516410 - DNA, 20 bp, Artificial Sequence
  chemically synthesized
ctatatagcttaatttgaat

SEQ ID NO: 516411 - DNA, 20 bp, Artificial Sequence
  chemically synthesized
agtatttacgaccaagataa

SEQ ID NO: 516412 - DNA, 20 bp, Artificial Sequence
  chemically synthesized
tcaaattctatgaggtagag

SEQ ID NO: 516413 - DNA, 20 bp, Artificial Sequence
  chemically synthesized
ccaaatccctctctacctca

SEQ ID NO: 516414 - DNA, 20 bp, Artificial Sequence
  chemically synthesized
ttctgctaactttttgaaag

SEQ ID NO: 516415 - DNA, 20 bp, Artificial Sequence
  chemically synthesized
aggagaatagttctgttgct

SEQ ID NO: 516416 - DNA, 20 bp, Artificial Sequence
  chemically synthesized
gtttggtcttgcaaagggtc

SEQ ID NO: 516417 - DNA, 20 bp, Artificial Sequence
  chemically synthesized
tcggcatgtttggtcttgca

SEQ ID NO: 516418 - DNA, 20 bp, Artificial Sequence
  chemically synthesized
tgatgatgatattaatgtca

SEQ ID NO: 516419 - DNA, 20 bp, Artificial Sequence
  chemically synthesized
tgcaccaaacattttaactt

SEQ ID NO: 516420 - DNA, 20 bp, Artificial Sequence
  chemically synthesized
aattcaccaatatgacgata

SEQ ID NO: 516421 - DNA, 20 bp, Artificial Sequence
  chemically synthesized
gatcctgtatcgtcatattg

SEQ ID NO: 516422 - DNA, 20 bp, Artificial Sequence
  chemically synthesized
agtctgtctttagcactaac

SEQ ID NO: 516423 - DNA, 20 bp, Artificial Sequence
  chemically synthesized
gatgtcaaagtatttttaga

SEQ ID NO: 516424 - DNA, 20 bp, Artificial Sequence
  chemically synthesized
ttcagatgtcaaagtatttt

SEQ ID NO: 516425 - DNA, 20 bp, Artificial Sequence
  chemically synthesized
ttctaaaaatactttgacat

SEQ ID NO: 516426 - DNA, 20 bp, Artificial Sequence
  chemically synthesized
gaaagggctcaaataccaaa

SEQ ID NO: 516427 - DNA, 20 bp, Artificial Sequence
  chemically synthesized
aaaggatcttccagattcac

SEQ ID NO: 516428 - DNA, 20 bp, Artificial Sequence
  chemically synthesized
acctcaggaactttattcat

SEQ ID NO: 516429 - DNA, 20 bp, Artificial Sequence
  chemically synthesized
ttcacataattggcatgaca

SEQ ID NO: 516430 - DNA, 20 bp, Artificial Sequence
  chemically synthesized
ttagatcacacctgaaaatt

SEQ ID NO: 516431 - DNA, 20 bp, Artificial Sequence
  chemically synthesized
ctagtgagatgcaaaggtgt

SEQ ID NO: 516432 - DNA, 20 bp, Artificial Sequence
  chemically synthesized
ctttgcatctcactaggcaa

SEQ ID NO: 516433 - DNA, 20 bp, Artificial Sequence
  chemically synthesized
acaaaacagttagatggtac

SEQ ID NO: 516434 - DNA, 20 bp, Artificial Sequence
  chemically synthesized
tgttttgtttttattccaaa

SEQ ID NO: 516435 - DNA, 20 bp, Artificial Sequence
  chemically synthesized
gaaagggccaatatcctatt

SEQ ID NO: 516436 - DNA, 20 bp, Artificial Sequence
  chemically synthesized
ggatattggccctttctaaa

SEQ ID NO: 516437 - DNA, 20 bp, Artificial Sequence
  chemically synthesized
aaaaaaaaaaaaaaagtaac

SEQ ID NO: 516438 - DNA, 20 bp, Artificial Sequence
  chemically synthesized
agaaaatcagtatacacagg

SEQ ID NO: 516439 - DNA, 20 bp, Artificial Sequence
  chemically synthesized
ggtaggatttatctgccata

SEQ ID NO: 516440 - DNA, 20 bp, Artificial Sequence
  chemically synthesized
aaagaatagttcactgctat

SEQ ID NO: 516441 - DNA, 20 bp, Artificial Sequence
  chemically synthesized
atttcttacaagaaactcta

SEQ ID NO: 516442 - DNA, 20 bp, Artificial Sequence
  chemically synthesized
ctagaaggttgattatccag

SEQ ID NO: 516443 - DNA, 20 bp, Artificial Sequence
  chemically synthesized
aaccttctagtcaaactcca

SEQ ID NO: 516444 - DNA, 20 bp, Artificial Sequence
  chemically synthesized
ttaaactacattgaattccc

SEQ ID NO: 516445 - DNA, 20 bp, Artificial Sequence
  chemically synthesized
tgtattgagtttaaactaca

SEQ ID NO: 516446 - DNA, 20 bp, Artificial Sequence
  chemically synthesized
tgtgatttccctaatatgta

SEQ ID NO: 516447 - DNA, 20 bp, Artificial Sequence
  chemically synthesized
catattagggaaatcacaaa

SEQ ID NO: 516448 - DNA, 20 bp, Artificial Sequence
  chemically synthesized
gaatcatatgtagtcattct

SEQ ID NO: 516449 - DNA, 20 bp, Artificial Sequence
  chemically synthesized
catatgtagtcattctatgg

SEQ ID NO: 516450 - DNA, 20 bp, Artificial Sequence
  chemically synthesized
ctagattgtgaactcatcca

SEQ ID NO: 516451 - DNA, 20 bp, Artificial Sequence
  chemically synthesized
aatctagatagtatttccgt

SEQ ID NO: 516452 - DNA, 20 bp, Artificial Sequence
  chemically synthesized
gtatttccgtgggggtaatg

SEQ ID NO: 516453 - DNA, 20 bp, Artificial Sequence
  chemically synthesized
ggagtatctcgccacgtcag

SEQ ID NO: 516454 - DNA, 20 bp, Artificial Sequence
  chemically synthesized
tatctcgccacgtcagagga

SEQ ID NO: 516455 - DNA, 20 bp, Artificial Sequence
  chemically synthesized
tgttatacttaagaaggcag

SEQ ID NO: 516456 - DNA, 20 bp, Artificial Sequence
  chemically synthesized
attttcttgaagtaacagta

SEQ ID NO: 516457 - DNA, 20 bp, Artificial Sequence
  chemically synthesized
agagtactatggcaagaaaa

SEQ ID NO: 516458 - DNA, 20 bp, Artificial Sequence
  chemically synthesized
ccatagtactctgcaacatg

SEQ ID NO: 516459 - DNA, 20 bp, Artificial Sequence
  chemically synthesized
accgtggattcagcatgttg

SEQ ID NO: 516460 - DNA, 20 bp, Artificial Sequence
  chemically synthesized
gacgcatttctacaaaaacc

SEQ ID NO: 516461 - DNA, 20 bp, Artificial Sequence
  chemically synthesized
gcgtccacaaaatttatgcc

SEQ ID NO: 516462 - DNA, 20 bp, Artificial Sequence
  chemically synthesized
tacacacatccagtaagaaa

SEQ ID NO: 516463 - DNA, 20 bp, Artificial Sequence
  chemically synthesized
tgattgaattcaatttctta

SEQ ID NO: 516464 - DNA, 20 bp, Artificial Sequence
  chemically synthesized
tggccaagcttatctactga

SEQ ID NO: 516465 - DNA, 20 bp, Artificial Sequence
  chemically synthesized
cacaattaatgatttagttt

SEQ ID NO: 516466 - DNA, 20 bp, Artificial Sequence
  chemically synthesized
taaaaatagtaagaatgttt

SEQ ID NO: 516467 - DNA, 20 bp, Artificial Sequence
  chemically synthesized
ctttcttagttaaaaatagt

SEQ ID NO: 516468 - DNA, 20 bp, Artificial Sequence
  chemically synthesized
tggcaggattagagaattga

SEQ ID NO: 516469 - DNA, 20 bp, Artificial Sequence
  chemically synthesized
tggggtggatggcaggatta

SEQ ID NO: 516470 - DNA, 20 bp, Artificial Sequence
  chemically synthesized
gaaagatatggggtggatgg

SEQ ID NO: 516471 - DNA, 20 bp, Artificial Sequence
  chemically synthesized
aaatgaaagaaagatatggg

SEQ ID NO: 516472 - DNA, 20 bp, Artificial Sequence
  chemically synthesized
ttccaaatgaaagaaagata

SEQ ID NO: 516473 - DNA, 20 bp, Artificial Sequence
  chemically synthesized
ccccatatctttctttcatt

SEQ ID NO: 516474 - DNA, 20 bp, Artificial Sequence
  chemically synthesized
ttatatgcctgagtctacaa

SEQ ID NO: 516475 - DNA, 20 bp, Artificial Sequence
  chemically synthesized
ctaaaacacaagttatatgc

SEQ ID NO: 516476 - DNA, 20 bp, Artificial Sequence
  chemically synthesized
tgtattttgtctttgtgcaa

SEQ ID NO: 516477 - DNA, 20 bp, Artificial Sequence
  chemically synthesized
gattttgatacatttatgtc

SEQ ID NO: 516478 - DNA, 20 bp, Artificial Sequence
  chemically synthesized
aaaatcacacaataatttaa

SEQ ID NO: 516479 - DNA, 20 bp, Artificial Sequence
  chemically synthesized
acacaataatttaatagaat

SEQ ID NO: 516480 - DNA, 20 bp, Artificial Sequence
  chemically synthesized
ttgttgtgctttggtttacc

SEQ ID NO: 516481 - DNA, 20 bp, Artificial Sequence
  chemically synthesized
gacagctgagagctactcct

SEQ ID NO: 516482 - DNA, 20 bp, Artificial Sequence
  chemically synthesized
tgaggtgttctgtcatccaa

SEQ ID NO: 516483 - DNA, 20 bp, Artificial Sequence
  chemically synthesized
atgacagaacacctcaactt

SEQ ID NO: 516484 - DNA, 20 bp, Artificial Sequence
  chemically synthesized
ataatattttcttgatgatt

SEQ ID NO: 516485 - DNA, 20 bp, Artificial Sequence
  chemically synthesized
ttttcttgatgatttagggt

SEQ ID NO: 516486 - DNA, 20 bp, Artificial Sequence
  chemically synthesized
atgtgaagatatgactgtgg

SEQ ID NO: 516487 - DNA, 20 bp, Artificial Sequence
  chemically synthesized
aggattgatcccaggtacat

SEQ ID NO: 516488 - DNA, 20 bp, Artificial Sequence
  chemically synthesized
ggtgaacatccacatgtacc

SEQ ID NO: 516489 - DNA, 20 bp, Artificial Sequence
  chemically synthesized
tacatgtggatgttcacccc

SEQ ID NO: 516490 - DNA, 20 bp, Artificial Sequence
  chemically synthesized
agaaaaagaaattgcattct

SEQ ID NO: 516491 - DNA, 20 bp, Artificial Sequence
  chemically synthesized
tttcttttattttttttaga

SEQ ID NO: 516492 - DNA, 20 bp, Artificial Sequence
  chemically synthesized
tctcacactgtcacccgggc

SEQ ID NO: 516493 - DNA, 20 bp, Artificial Sequence
  chemically synthesized
tcacaccattgcactccagc

SEQ ID NO: 516494 - DNA, 20 bp, Artificial Sequence
  chemically synthesized
gcaggagaatcgcttggcag

SEQ ID NO: 516495 - DNA, 20 bp, Artificial Sequence
  chemically synthesized
tactcaggaggctgaggcag

SEQ ID NO: 516496 - DNA, 20 bp, Artificial Sequence
  chemically synthesized
gattctcctgcctcagcctc

SEQ ID NO: 516497 - DNA, 20 bp, Artificial Sequence
  chemically synthesized
gcctcagcctcctgagtagc

SEQ ID NO: 516498 - DNA, 20 bp, Artificial Sequence
  chemically synthesized
caggcatggcggcgggcacc

SEQ ID NO: 516499 - DNA, 20 bp, Artificial Sequence
  chemically synthesized
gtgtgcatttttagtagaga

SEQ ID NO: 516500 - DNA, 20 bp, Artificial Sequence
  chemically synthesized
aggcaggcggatcacgaggt

SEQ ID NO: 516501 - DNA, 20 bp, Artificial Sequence
  chemically synthesized
actttggggggccgaggcag

SEQ ID NO: 516502 - DNA, 20 bp, Artificial Sequence
  chemically synthesized
gcctcggccccccaaagtgc

SEQ ID NO: 516503 - DNA, 20 bp, Artificial Sequence
  chemically synthesized
ccccaaagtgctgggattac

SEQ ID NO: 516504 - DNA, 20 bp, Artificial Sequence
  chemically synthesized
ttttactgttacagtatttt

SEQ ID NO: 516505 - DNA, 20 bp, Artificial Sequence
  chemically synthesized
gtcttagagctctttcaatt

SEQ ID NO: 516506 - DNA, 20 bp, Artificial Sequence
  chemically synthesized
gggtattaaaccagtatgac

SEQ ID NO: 516507 - DNA, 20 bp, Artificial Sequence
  chemically synthesized
aaacattagctctgtgtgga

SEQ ID NO: 516508 - DNA, 20 bp, Artificial Sequence
  chemically synthesized
tgttgatgaagactgcagac

SEQ ID NO: 516509 - DNA, 20 bp, Artificial Sequence
  chemically synthesized
gcttaaaatattgaaatagc

SEQ ID NO: 516510 - DNA, 20 bp, Artificial Sequence
  chemically synthesized
attttaagctgacacatttt

SEQ ID NO: 516511 - DNA, 20 bp, Artificial Sequence
  chemically synthesized
agaccacttttagagtgtaa

SEQ ID NO: 516512 - DNA, 20 bp, Artificial Sequence
  chemically synthesized
ataaatatatagaccacttt

SEQ ID NO: 516513 - DNA, 20 bp, Artificial Sequence
  chemically synthesized
tctcaaggcatgatatagcc

SEQ ID NO: 516514 - DNA, 20 bp, Artificial Sequence
  chemically synthesized
cctagaattttctggaacct

SEQ ID NO: 516515 - DNA, 20 bp, Artificial Sequence
  chemically synthesized
atggaccttcagtgtcaata

SEQ ID NO: 516516 - DNA, 20 bp, Artificial Sequence
  chemically synthesized
gtaccacagtcattgatctt

SEQ ID NO: 516517 - DNA, 20 bp, Artificial Sequence
  chemically synthesized
ttttgaaactggtttagtgt

SEQ ID NO: 516518 - DNA, 20 bp, Artificial Sequence
  chemically synthesized
aaatcagaacatgttatggc

SEQ ID NO: 516519 - DNA, 20 bp, Artificial Sequence
  chemically synthesized
aagttctacaatatactata

SEQ ID NO: 516520 - DNA, 20 bp, Artificial Sequence
  chemically synthesized
actcatttaatttagcagat

SEQ ID NO: 516521 - DNA, 20 bp, Artificial Sequence
  chemically synthesized
attcatatctgctaaattaa

SEQ ID NO: 516522 - DNA, 20 bp, Artificial Sequence
  chemically synthesized
atatctgctaaattaaatga

SEQ ID NO: 516523 - DNA, 20 bp, Artificial Sequence
  chemically synthesized
aaatcaaagtacagccttaa

SEQ ID NO: 516524 - DNA, 20 bp, Artificial Sequence
  chemically synthesized
aaaggaatatacatttaata

SEQ ID NO: 516525 - DNA, 20 bp, Artificial Sequence
  chemically synthesized
tttaaatgcagacaattgtt

SEQ ID NO: 516526 - DNA, 20 bp, Artificial Sequence
  chemically synthesized
ttgaattgcattaatgaaaa

SEQ ID NO: 516527 - DNA, 20 bp, Artificial Sequence
  chemically synthesized
tttctagctgtggatttact

SEQ ID NO: 516528 - DNA, 20 bp, Artificial Sequence
  chemically synthesized
gtataaaattgtttctagct

SEQ ID NO: 516529 - DNA, 20 bp, Artificial Sequence
  chemically synthesized
agaaacaattttatactcaa

SEQ ID NO: 516530 - DNA, 20 bp, Artificial Sequence
  chemically synthesized
cttaacttttggctactctg

SEQ ID NO: 516531 - DNA, 20 bp, Artificial Sequence
  chemically synthesized
agtttgacattgtcaagtgt

SEQ ID NO: 516532 - DNA, 20 bp, Artificial Sequence
  chemically synthesized
tgttagaatttgggagcaag

SEQ ID NO: 516533 - DNA, 20 bp, Artificial Sequence
  chemically synthesized
agcagaatttttaagttcgt

SEQ ID NO: 516534 - DNA, 20 bp, Artificial Sequence
  chemically synthesized
tagaaatacatcatgtcagt

SEQ ID NO: 516535 - DNA, 20 bp, Artificial Sequence
  chemically synthesized
aaatcagaaagcttaaatta

SEQ ID NO: 516536 - DNA, 20 bp, Artificial Sequence
  chemically synthesized
tgaaacaaatgagagaagaa

SEQ ID NO: 516537 - DNA, 20 bp, Artificial Sequence
  chemically synthesized
ctgtggaggacaaagtgact

SEQ ID NO: 516538 - DNA, 20 bp, Artificial Sequence
  chemically synthesized
cttcctgtggttgctaaact

SEQ ID NO: 516539 - DNA, 20 bp, Artificial Sequence
  chemically synthesized
ccttcctctccctgtacttt

SEQ ID NO: 516540 - DNA, 20 bp, Artificial Sequence
  chemically synthesized
aggaagggagaggagagaag

SEQ ID NO: 516541 - DNA, 20 bp, Artificial Sequence
  chemically synthesized
agagagagagagagaaggag

SEQ ID NO: 516542 - DNA, 20 bp, Artificial Sequence
  chemically synthesized
tggggaggaggaagaggaga

SEQ ID NO: 516543 - DNA, 20 bp, Artificial Sequence
  chemically synthesized
aggaggaggaaagaagaagg

SEQ ID NO: 516544 - DNA, 20 bp, Artificial Sequence
  chemically synthesized
gaaagaagaaggcagggtgc

SEQ ID NO: 516545 - DNA, 20 bp, Artificial Sequence
  chemically synthesized
aggcagggtgcatgaattca

SEQ ID NO: 516546 - DNA, 20 bp, Artificial Sequence
  chemically synthesized
tgatctcataacctcattca

SEQ ID NO: 516547 - DNA, 20 bp, Artificial Sequence
  chemically synthesized
cactatagctgcagcttcca

SEQ ID NO: 516548 - DNA, 20 bp, Artificial Sequence
  chemically synthesized
tggaaactcagggaagacac

SEQ ID NO: 516549 - DNA, 20 bp, Artificial Sequence
  chemically synthesized
gaagcactcttgtgtcttcc

SEQ ID NO: 516550 - DNA, 20 bp, Artificial Sequence
  chemically synthesized
gctctctttggctgatggtg

SEQ ID NO: 516551 - DNA, 20 bp, Artificial Sequence
  chemically synthesized
agagcagtgtaaaggagcca

SEQ ID NO: 516552 - DNA, 20 bp, Artificial Sequence
  chemically synthesized
tacatgtaggagtgggattg

SEQ ID NO: 516553 - DNA, 20 bp, Artificial Sequence
  chemically synthesized
tccttgtatacatgtaggag

SEQ ID NO: 516554 - DNA, 20 bp, Artificial Sequence
  chemically synthesized
aaggttccttgtatacatgt

SEQ ID NO: 516555 - DNA, 20 bp, Artificial Sequence
  chemically synthesized
aaccttgtttgtaataggaa

SEQ ID NO: 516556 - DNA, 20 bp, Artificial Sequence
  chemically synthesized
atactactgttgatggatac

SEQ ID NO: 516557 - DNA, 20 bp, Artificial Sequence
  chemically synthesized
atttatgcatactactgttg

SEQ ID NO: 516558 - DNA, 20 bp, Artificial Sequence
  chemically synthesized
gtagtatgcataaataaatt

SEQ ID NO: 516559 - DNA, 20 bp, Artificial Sequence
  chemically synthesized
attgtgggttatttctatga

SEQ ID NO: 516560 - DNA, 20 bp, Artificial Sequence
  chemically synthesized
ataatgctgcagtcacagac

SEQ ID NO: 516561 - DNA, 20 bp, Artificial Sequence
  chemically synthesized
tgctgcagtcacagacatgg

SEQ ID NO: 516562 - DNA, 20 bp, Artificial Sequence
  chemically synthesized
attgaaagaaacagtcacag

SEQ ID NO: 516563 - DNA, 20 bp, Artificial Sequence
  chemically synthesized
gcttttgaacttcgtatagt

SEQ ID NO: 516564 - DNA, 20 bp, Artificial Sequence
  chemically synthesized
tggtggtagtggggaagcga

SEQ ID NO: 516565 - DNA, 20 bp, Artificial Sequence
  chemically synthesized
gggaagcgatggaattggag

SEQ ID NO: 516566 - DNA, 20 bp, Artificial Sequence
  chemically synthesized
aaccaaatgtgtttattact

SEQ ID NO: 516567 - DNA, 20 bp, Artificial Sequence
  chemically synthesized
agcatttccctttcagcttg

SEQ ID NO: 516568 - DNA, 20 bp, Artificial Sequence
  chemically synthesized
ggtttcttgcactaaaagat

SEQ ID NO: 516569 - DNA, 20 bp, Artificial Sequence
  chemically synthesized
aggcttcagtagggaggaga

SEQ ID NO: 516570 - DNA, 20 bp, Artificial Sequence
  chemically synthesized
attgctttaagaactattta

SEQ ID NO: 516571 - DNA, 20 bp, Artificial Sequence
  chemically synthesized
taagtacataacatcaaact

SEQ ID NO: 516572 - DNA, 20 bp, Artificial Sequence
  chemically synthesized
tgtttcatacctggtatcat

SEQ ID NO: 516573 - DNA, 20 bp, Artificial Sequence
  chemically synthesized
gtagctctagcccactgcta

SEQ ID NO: 516574 - DNA, 20 bp, Artificial Sequence
  chemically synthesized
tgtctgctacacagttccaa

SEQ ID NO: 516575 - DNA, 20 bp, Artificial Sequence
  chemically synthesized
tcaagccagaggtaaaccaa

SEQ ID NO: 516576 - DNA, 20 bp, Artificial Sequence
  chemically synthesized
gcttgatcagccctgtaatg

SEQ ID NO: 516577 - DNA, 20 bp, Artificial Sequence
  chemically synthesized
ggctgaaacacagagaagca

SEQ ID NO: 516578 - DNA, 20 bp, Artificial Sequence
  chemically synthesized
ccctcctgtgtgttggatga

SEQ ID NO: 516579 - DNA, 20 bp, Artificial Sequence
  chemically synthesized
ggtcccctcctgtgtgttgg

SEQ ID NO: 516580 - DNA, 20 bp, Artificial Sequence
  chemically synthesized
atcaggtcccctcctgtgtg

SEQ ID NO: 516581 - DNA, 20 bp, Artificial Sequence
  chemically synthesized
ctctgaagaataagaggctg

SEQ ID NO: 516582 - DNA, 20 bp, Artificial Sequence
  chemically synthesized
tactcataattgtccctctg

SEQ ID NO: 516583 - DNA, 20 bp, Artificial Sequence
  chemically synthesized
tattcttcagagggacaatt

SEQ ID NO: 516584 - DNA, 20 bp, Artificial Sequence
  chemically synthesized
gacccctctgaggaatgctg

SEQ ID NO: 516585 - DNA, 20 bp, Artificial Sequence
  chemically synthesized
cattctacagcattcctcag

SEQ ID NO: 516586 - DNA, 20 bp, Artificial Sequence
  chemically synthesized
atcctgtgaagacccctctg

SEQ ID NO: 516587 - DNA, 20 bp, Artificial Sequence
  chemically synthesized
attcctcagaggggtcttca

SEQ ID NO: 516588 - DNA, 20 bp, Artificial Sequence
  chemically synthesized
tttcccactgcagtagccag

SEQ ID NO: 516589 - DNA, 20 bp, Artificial Sequence
  chemically synthesized
aaaaacgggggaaaacaata

SEQ ID NO: 516590 - DNA, 20 bp, Artificial Sequence
  chemically synthesized
ttgtcacagtttgtcttagt

SEQ ID NO: 516591 - DNA, 20 bp, Artificial Sequence
  chemically synthesized
ctgagaggaaagaatctcgt

SEQ ID NO: 516592 - DNA, 20 bp, Artificial Sequence
  chemically synthesized
taagcatccccctgagagga

SEQ ID NO: 516593 - DNA, 20 bp, Artificial Sequence
  chemically synthesized
acgagattctttcctctcag

SEQ ID NO: 516594 - DNA, 20 bp, Artificial Sequence
  chemically synthesized
gtgtctctaacctgagggtc

SEQ ID NO: 516595 - DNA, 20 bp, Artificial Sequence
  chemically synthesized
tttctctgtgtctctaacct

SEQ ID NO: 516596 - DNA, 20 bp, Artificial Sequence
  chemically synthesized
cagagaaatgcaactaactc

SEQ ID NO: 516597 - DNA, 20 bp, Artificial Sequence
  chemically synthesized
gaaatgcaactaactctggg

SEQ ID NO: 516598 - DNA, 20 bp, Artificial Sequence
  chemically synthesized
gaatctgtacctattcaccc

SEQ ID NO: 516599 - DNA, 20 bp, Artificial Sequence
  chemically synthesized
ggggtgaataggtacagatt

SEQ ID NO: 516600 - DNA, 20 bp, Artificial Sequence
  chemically synthesized
tgttttaaagtctttccact

SEQ ID NO: 516601 - DNA, 20 bp, Artificial Sequence
  chemically synthesized
acagaccagagcttgagagc

SEQ ID NO: 516602 - DNA, 20 bp, Artificial Sequence
  chemically synthesized
gtactaagcgactcatagaa

SEQ ID NO: 516603 - DNA, 20 bp, Artificial Sequence
  chemically synthesized
tccctcctgaatccttttct

SEQ ID NO: 516604 - DNA, 20 bp, Artificial Sequence
  chemically synthesized
agtcgctgtgctggtccctc

SEQ ID NO: 516605 - DNA, 20 bp, Artificial Sequence
  chemically synthesized
gacaagcaagagataaatat

SEQ ID NO: 516606 - DNA, 20 bp, Artificial Sequence
  chemically synthesized
agagataaatatcggaatct

SEQ ID NO: 516607 - DNA, 20 bp, Artificial Sequence
  chemically synthesized
ggaatctgtgggtacagcct

SEQ ID NO: 516608 - DNA, 20 bp, Artificial Sequence
  chemically synthesized
ctctgtttttgatgttgcag

SEQ ID NO: 516609 - DNA, 20 bp, Artificial Sequence
  chemically synthesized
tttgcaaaaggaaacatgag

SEQ ID NO: 516610 - DNA, 20 bp, Artificial Sequence
  chemically synthesized
aaacaatcaagataaattct

SEQ ID NO: 516611 - DNA, 20 bp, Artificial Sequence
  chemically synthesized
atcaagataaattctaggga

SEQ ID NO: 516612 - DNA, 20 bp, Artificial Sequence
  chemically synthesized
ctcatgcatcatcccatccc

SEQ ID NO: 516613 - DNA, 20 bp, Artificial Sequence
  chemically synthesized
ggatgatgcatgaggaaaat

SEQ ID NO: 516614 - DNA, 20 bp, Artificial Sequence
  chemically synthesized
ttattgtccccatttttttt

SEQ ID NO: 516615 - DNA, 20 bp, Artificial Sequence
  chemically synthesized
attactggatatctgacctt

SEQ ID NO: 516616 - DNA, 20 bp, Artificial Sequence
  chemically synthesized
aattctgtctacactaatta

SEQ ID NO: 516617 - DNA, 20 bp, Artificial Sequence
  chemically synthesized
tatccagtaattagtgtaga

SEQ ID NO: 516618 - DNA, 20 bp, Artificial Sequence
  chemically synthesized
cagagcatttccacctggat

SEQ ID NO: 516619 - DNA, 20 bp, Artificial Sequence
  chemically synthesized
gggtttcagagcatttccac

SEQ ID NO: 516620 - DNA, 20 bp, Artificial Sequence
  chemically synthesized
ttagtgtagcaggtaagact

SEQ ID NO: 516621 - DNA, 20 bp, Artificial Sequence
  chemically synthesized
taaaacatttaaaaatatta

SEQ ID NO: 516622 - DNA, 20 bp, Artificial Sequence
  chemically synthesized
tttgggatagtaaacattgc

SEQ ID NO: 516623 - DNA, 20 bp, Artificial Sequence
  chemically synthesized
ttcccatgtccccccaactt

SEQ ID NO: 516624 - DNA, 20 bp, Artificial Sequence
  chemically synthesized
gttggtggttaagtggagat

SEQ ID NO: 516625 - DNA, 20 bp, Artificial Sequence
  chemically synthesized
taaggatgaggccagagaac

SEQ ID NO: 516626 - DNA, 20 bp, Artificial Sequence
  chemically synthesized
ggccagagaacatgagtggc

SEQ ID NO: 516627 - DNA, 20 bp, Artificial Sequence
  chemically synthesized
gcaaaatattaaaattttaa

SEQ ID NO: 516628 - DNA, 20 bp, Artificial Sequence
  chemically synthesized
aattttaatattttgctcat

SEQ ID NO: 516629 - DNA, 20 bp, Artificial Sequence
  chemically synthesized
aatataatttatcctgattt

SEQ ID NO: 516630 - DNA, 20 bp, Artificial Sequence
  chemically synthesized
tcgcctaaaaattcagaaat

SEQ ID NO: 516631 - DNA, 20 bp, Artificial Sequence
  chemically synthesized
cccagaaaagatggctatgt

SEQ ID NO: 516632 - DNA, 20 bp, Artificial Sequence
  chemically synthesized
ggaaggggaggaggtacaca

SEQ ID NO: 516633 - DNA, 20 bp, Artificial Sequence
  chemically synthesized
aggtacacacaggatttgtc

SEQ ID NO: 516634 - DNA, 20 bp, Artificial Sequence
  chemically synthesized
gtggcttggtgtgaggtctg

SEQ ID NO: 516635 - DNA, 20 bp, Artificial Sequence
  chemically synthesized
gtggtggtactaaggagaga

SEQ ID NO: 516636 - DNA, 20 bp, Artificial Sequence
  chemically synthesized
cttaagttcaaaaggggaaa

SEQ ID NO: 516637 - DNA, 20 bp, Artificial Sequence
  chemically synthesized
tcaaaaggggaaactgaatg

SEQ ID NO: 516638 - DNA, 20 bp, Artificial Sequence
  chemically synthesized
ttactttatgtagctactga

SEQ ID NO: 516639 - DNA, 20 bp, Artificial Sequence
  chemically synthesized
gtcttcttattctcatttca

SEQ ID NO: 516640 - DNA, 20 bp, Artificial Sequence
  chemically synthesized
gaatacttactccatgaaat

SEQ ID NO: 516641 - DNA, 20 bp, Artificial Sequence
  chemically synthesized
ttcttccacataatgggaat

SEQ ID NO: 516642 - DNA, 20 bp, Artificial Sequence
  chemically synthesized
gtattattcttccacataat

SEQ ID NO: 516643 - DNA, 20 bp, Artificial Sequence
  chemically synthesized
ttcttattcccattatgtgg

SEQ ID NO: 516644 - DNA, 20 bp, Artificial Sequence
  chemically synthesized
tcagtttttaatacatgaat

SEQ ID NO: 516645 - DNA, 20 bp, Artificial Sequence
  chemically synthesized
tgagcctcagtttttaatac

SEQ ID NO: 516646 - DNA, 20 bp, Artificial Sequence
  chemically synthesized
gccataaattcttaaacttc

SEQ ID NO: 516647 - DNA, 20 bp, Artificial Sequence
  chemically synthesized
acaaaatacccatgaagttt

SEQ ID NO: 516648 - DNA, 20 bp, Artificial Sequence
  chemically synthesized
taatagctgtgaccacctcc

SEQ ID NO: 516649 - DNA, 20 bp, Artificial Sequence
  chemically synthesized
gtcacagctattagggccaa

SEQ ID NO: 516650 - DNA, 20 bp, Artificial Sequence
  chemically synthesized
aatatacctttacctctctt

SEQ ID NO: 516651 - DNA, 20 bp, Artificial Sequence
  chemically synthesized
aaggtatattttgcctattt

SEQ ID NO: 516652 - DNA, 20 bp, Artificial Sequence
  chemically synthesized
ggatagtttcccaatgtgaa

SEQ ID NO: 516653 - DNA, 20 bp, Artificial Sequence
  chemically synthesized
cacattgggaaactatccat

SEQ ID NO: 516654 - DNA, 20 bp, Artificial Sequence
  chemically synthesized
gacaatgattgttgactctg

SEQ ID NO: 516655 - DNA, 20 bp, Artificial Sequence
  chemically synthesized
aacacaattaaaatgctgaa

SEQ ID NO: 516656 - DNA, 20 bp, Artificial Sequence
  chemically synthesized
aagatgtttatattctgacg

SEQ ID NO: 516657 - DNA, 20 bp, Artificial Sequence
  chemically synthesized
tatttctagttacccttcgt

SEQ ID NO: 516658 - DNA, 20 bp, Artificial Sequence
  chemically synthesized
gaaatattttctactctaaa

SEQ ID NO: 516659 - DNA, 20 bp, Artificial Sequence
  chemically synthesized
gtatcacacctgactcaatt

SEQ ID NO: 516660 - DNA, 20 bp, Artificial Sequence
  chemically synthesized
gtcaggtgtgatactgtaaa

SEQ ID NO: 516661 - DNA, 20 bp, Artificial Sequence
  chemically synthesized
tttcattcttttctggacat

SEQ ID NO: 516662 - DNA, 20 bp, Artificial Sequence
  chemically synthesized
cttgattccaatgtccagaa

SEQ ID NO: 516663 - DNA, 20 bp, Artificial Sequence
  chemically synthesized
ttacagttgcttaaattggc

SEQ ID NO: 516664 - DNA, 20 bp, Artificial Sequence
  chemically synthesized
gtaaatttaatgatgtctaa

SEQ ID NO: 516665 - DNA, 20 bp, Artificial Sequence
  chemically synthesized
gacagtaggtgataccataa

SEQ ID NO: 516666 - DNA, 20 bp, Artificial Sequence
  chemically synthesized
aatgtcaatatattgtctct

SEQ ID NO: 516667 - DNA, 20 bp, Artificial Sequence
  chemically synthesized
cacatctttaaaaagtttct

SEQ ID NO: 516668 - DNA, 20 bp, Artificial Sequence
  chemically synthesized
taattggctaaagtttaaaa

SEQ ID NO: 516669 - DNA, 20 bp, Artificial Sequence
  chemically synthesized
tagctattttgaaatataca

SEQ ID NO: 516670 - DNA, 20 bp, Artificial Sequence
  chemically synthesized
atatttcaaaatagctagaa

SEQ ID NO: 516671 - DNA, 20 bp, Artificial Sequence
  chemically synthesized
aatccttcctttctttgtga

SEQ ID NO: 516672 - DNA, 20 bp, Artificial Sequence
  chemically synthesized
gatcccatcacaaagaaagg

SEQ ID NO: 516673 - DNA, 20 bp, Artificial Sequence
  chemically synthesized
agaaaggaaggattgagatg

SEQ ID NO: 516674 - DNA, 20 bp, Artificial Sequence
  chemically synthesized
aatgatcaaatcagagtaat

SEQ ID NO: 516675 - DNA, 20 bp, Artificial Sequence
  chemically synthesized
tactgtataaatgatcaaat

SEQ ID NO: 516676 - DNA, 20 bp, Artificial Sequence
  chemically synthesized
attactatttggcattagat

SEQ ID NO: 516677 - DNA, 20 bp, Artificial Sequence
  chemically synthesized
agggacctggtgggagatga

SEQ ID NO: 516678 - DNA, 20 bp, Artificial Sequence
  chemically synthesized
ctcagacttttcttgtgata

SEQ ID NO: 516679 - DNA, 20 bp, Artificial Sequence
  chemically synthesized
gacttttcttgtgatagtga

SEQ ID NO: 516680 - DNA, 20 bp, Artificial Sequence
  chemically synthesized
ttacatggtggcaggagctg

SEQ ID NO: 516681 - DNA, 20 bp, Artificial Sequence
  chemically synthesized
ctccccagtcatgtggaact

SEQ ID NO: 516682 - DNA, 20 bp, Artificial Sequence
  chemically synthesized
ctataaagaactacctgaga

SEQ ID NO: 516683 - DNA, 20 bp, Artificial Sequence
  chemically synthesized
ttttataacatgttatgttt

SEQ ID NO: 516684 - DNA, 20 bp, Artificial Sequence
  chemically synthesized
actggtagttggggaggaaa

SEQ ID NO: 516685 - DNA, 20 bp, Artificial Sequence
  chemically synthesized
tttccccagaagtgacaata

SEQ ID NO: 516686 - DNA, 20 bp, Artificial Sequence
  chemically synthesized
accaaccattttttcttctt

SEQ ID NO: 516687 - DNA, 20 bp, Artificial Sequence
  chemically synthesized
tggttggtgatctttgttgt

SEQ ID NO: 516688 - DNA, 20 bp, Artificial Sequence
  chemically synthesized
tgttgtatggattttatctg

SEQ ID NO: 516689 - DNA, 20 bp, Artificial Sequence
  chemically synthesized
ctagtttacacttagatttg

SEQ ID NO: 516690 - DNA, 20 bp, Artificial Sequence
  chemically synthesized
attgtctttctggaaatgag

SEQ ID NO: 516691 - DNA, 20 bp, Artificial Sequence
  chemically synthesized
gaaagacaatatggctttgt

SEQ ID NO: 516692 - DNA, 20 bp, Artificial Sequence
  chemically synthesized
ctggcatgacaggatgtact

SEQ ID NO: 516693 - DNA, 20 bp, Artificial Sequence
  chemically synthesized
cccagtacatcctgtcatgc

SEQ ID NO: 516694 - DNA, 20 bp, Artificial Sequence
  chemically synthesized
cagagcaaatcctggcatga

SEQ ID NO: 516695 - DNA, 20 bp, Artificial Sequence
  chemically synthesized
aagaagcttatgatagcttt

SEQ ID NO: 516696 - DNA, 20 bp, Artificial Sequence
  chemically synthesized
tgcagagcagcttcattttt

SEQ ID NO: 516697 - DNA, 20 bp, Artificial Sequence
  chemically synthesized
tttctagcagatgaatgtta

SEQ ID NO: 516698 - DNA, 20 bp, Artificial Sequence
  chemically synthesized
tttttttttttttctagcag

SEQ ID NO: 516699 - DNA, 20 bp, Artificial Sequence
  chemically synthesized
aaaaaaaaaaaaagaaagaa

SEQ ID NO: 516700 - DNA, 20 bp, Artificial Sequence
  chemically synthesized
acaataggtcgaaccttcat

SEQ ID NO: 516701 - DNA, 20 bp, Artificial Sequence
  chemically synthesized
gctaaaatatatgtgactgt

SEQ ID NO: 516702 - DNA, 20 bp, Artificial Sequence
  chemically synthesized
gtgtatgcgtatgtccaaca

SEQ ID NO: 516703 - DNA, 20 bp, Artificial Sequence
  chemically synthesized
cacaccaacttatctattgc

SEQ ID NO: 516704 - DNA, 20 bp, Artificial Sequence
  chemically synthesized
aattttattatctgaaaaat

SEQ ID NO: 516705 - DNA, 20 bp, Artificial Sequence
  chemically synthesized
ttaaataggacttagatttc

SEQ ID NO: 516706 - DNA, 20 bp, Artificial Sequence
  chemically synthesized
ccactgcaccatctgggcga

SEQ ID NO: 516707 - DNA, 20 bp, Artificial Sequence
  chemically synthesized
acctcagcctcccaagtagc

SEQ ID NO: 516708 - DNA, 20 bp, Artificial Sequence
  chemically synthesized
accacacacagctaattttt

SEQ ID NO: 516709 - DNA, 20 bp, Artificial Sequence
  chemically synthesized
caggcagatcgcttgagccc

SEQ ID NO: 516710 - DNA, 20 bp, Artificial Sequence
  chemically synthesized
tgtttaagaatacatgttga

SEQ ID NO: 516711 - DNA, 20 bp, Artificial Sequence
  chemically synthesized
aaagcattttaaatctgttt

SEQ ID NO: 516712 - DNA, 20 bp, Artificial Sequence
  chemically synthesized
ggaaatatattaagcttcca

SEQ ID NO: 516713 - DNA, 20 bp, Artificial Sequence
  chemically synthesized
agcttaatatatttccagca

SEQ ID NO: 516714 - DNA, 20 bp, Artificial Sequence
  chemically synthesized
gtacttcaagggccaggaca

SEQ ID NO: 516715 - DNA, 20 bp, Artificial Sequence
  chemically synthesized
gcccttgaagtacacataat

SEQ ID NO: 516716 - DNA, 20 bp, Artificial Sequence
  chemically synthesized
ggttcttacaggtgctacag

SEQ ID NO: 516717 - DNA, 20 bp, Artificial Sequence
  chemically synthesized
gggagactaattccacctca

SEQ ID NO: 516718 - DNA, 20 bp, Artificial Sequence
  chemically synthesized
atttcattaattctctgagg

SEQ ID NO: 516719 - DNA, 20 bp, Artificial Sequence
  chemically synthesized
cggcaaagatcagattttgt

SEQ ID NO: 516720 - DNA, 20 bp, Artificial Sequence
  chemically synthesized
taaggcagtctccttagacc

SEQ ID NO: 516721 - DNA, 20 bp, Artificial Sequence
  chemically synthesized
aagtttaagtaggacagtca

SEQ ID NO: 516722 - DNA, 20 bp, Artificial Sequence
  chemically synthesized
ctctcagacttagtcatcta

SEQ ID NO: 516723 - DNA, 20 bp, Artificial Sequence
  chemically synthesized
agtctgagagcagtgtgtaa

SEQ ID NO: 516724 - DNA, 20 bp, Artificial Sequence
  chemically synthesized
tcaaaatcaggaagtccaga

SEQ ID NO: 516725 - DNA, 20 bp, Artificial Sequence
  chemically synthesized
aacaggttggatagtatctc

SEQ ID NO: 516726 - DNA, 20 bp, Artificial Sequence
  chemically synthesized
tcaaaaaagtataaaacagg

SEQ ID NO: 516727 - DNA, 20 bp, Artificial Sequence
  chemically synthesized
agtgaaaagtaatacttcct

SEQ ID NO: 516728 - DNA, 20 bp, Artificial Sequence
  chemically synthesized
tgcatccatttactttatag

SEQ ID NO: 516729 - DNA, 20 bp, Artificial Sequence
  chemically synthesized
actattcaactataaagtaa

SEQ ID NO: 516730 - DNA, 20 bp, Artificial Sequence
  chemically synthesized
tatgttcttacatttatggc

SEQ ID NO: 516731 - DNA, 20 bp, Artificial Sequence
  chemically synthesized
actgaattcagtagaataga

SEQ ID NO: 516732 - DNA, 20 bp, Artificial Sequence
  chemically synthesized
gtagtattcagtctattcta

SEQ ID NO: 516733 - DNA, 20 bp, Artificial Sequence
  chemically synthesized
caaatcgggactgaattcag

SEQ ID NO: 516734 - DNA, 20 bp, Artificial Sequence
  chemically synthesized
taaaatataacaaatcggga

SEQ ID NO: 516735 - DNA, 20 bp, Artificial Sequence
  chemically synthesized
catttgaaaaactttctttg

SEQ ID NO: 516736 - DNA, 20 bp, Artificial Sequence
  chemically synthesized
ggaacctaggaaataggaat

SEQ ID NO: 516737 - DNA, 20 bp, Artificial Sequence
  chemically synthesized
gaatagggaacctaggaaat

SEQ ID NO: 516738 - DNA, 20 bp, Artificial Sequence
  chemically synthesized
aatatagaaaagtagatgat

SEQ ID NO: 516739 - DNA, 20 bp, Artificial Sequence
  chemically synthesized
aggcagtcacaggcaagtgc

SEQ ID NO: 516740 - DNA, 20 bp, Artificial Sequence
  chemically synthesized
gttatatatctccagagaaa

SEQ ID NO: 516741 - DNA, 20 bp, Artificial Sequence
  chemically synthesized
taaagccctctgagggaaag

SEQ ID NO: 516742 - DNA, 20 bp, Artificial Sequence
  chemically synthesized
gagtcagtgcttttagtttt

SEQ ID NO: 516743 - DNA, 20 bp, Artificial Sequence
  chemically synthesized
aagcactgactcatggttta

SEQ ID NO: 516744 - DNA, 20 bp, Artificial Sequence
  chemically synthesized
tttaacttaccctttaaacc

SEQ ID NO: 516745 - DNA, 20 bp, Artificial Sequence
  chemically synthesized
aattaaattaattgagatct

SEQ ID NO: 516746 - DNA, 20 bp, Artificial Sequence
  chemically synthesized
cgtcctcaatcaaacactag

SEQ ID NO: 516747 - DNA, 20 bp, Artificial Sequence
  chemically synthesized
ttaaaaaatgtacataatac

SEQ ID NO: 516748 - DNA, 20 bp, Artificial Sequence
  chemically synthesized
aactcataactttcaaggaa

SEQ ID NO: 516749 - DNA, 20 bp, Artificial Sequence
  chemically synthesized
aattcacttccttgaaagtt

SEQ ID NO: 516750 - DNA, 20 bp, Artificial Sequence
  chemically synthesized
atctgaacttcaaatacact

SEQ ID NO: 516751 - DNA, 20 bp, Artificial Sequence
  chemically synthesized
tgctctgagacaaatgcatc

SEQ ID NO: 516752 - DNA, 20 bp, Artificial Sequence
  chemically synthesized
ttattcacaatttactgcaa

SEQ ID NO: 516753 - DNA, 20 bp, Artificial Sequence
  chemically synthesized
aaattcatttgcagtaaatt

SEQ ID NO: 516754 - DNA, 20 bp, Artificial Sequence
  chemically synthesized
taaaaagcctaggctccttg

SEQ ID NO: 516755 - DNA, 20 bp, Artificial Sequence
  chemically synthesized
gagaaagagatgggagggag

SEQ ID NO: 516756 - DNA, 20 bp, Artificial Sequence
  chemically synthesized
aagggacagatggaggatga

SEQ ID NO: 516757 - DNA, 20 bp, Artificial Sequence
  chemically synthesized
gatagggaaagggacagatg

SEQ ID NO: 516758 - DNA, 20 bp, Artificial Sequence
  chemically synthesized
tttttcccatgtgtgataag

SEQ ID NO: 516759 - DNA, 20 bp, Artificial Sequence
  chemically synthesized
cacacatgggaaaaactcaa

SEQ ID NO: 516760 - DNA, 20 bp, Artificial Sequence
  chemically synthesized
gtagactgaatttaattcaa

SEQ ID NO: 516761 - DNA, 20 bp, Artificial Sequence
  chemically synthesized
aattgtatacttctggtaga

SEQ ID NO: 516762 - DNA, 20 bp, Artificial Sequence
  chemically synthesized
agtctaccagaagtatacaa

SEQ ID NO: 516763 - DNA, 20 bp, Artificial Sequence
  chemically synthesized
attcaacaaatatgtgcgga

SEQ ID NO: 516764 - DNA, 20 bp, Artificial Sequence
  chemically synthesized
attccttccgcacatatttg

SEQ ID NO: 516765 - DNA, 20 bp, Artificial Sequence
  chemically synthesized
tgtttacttcatgccacact

SEQ ID NO: 516766 - DNA, 20 bp, Artificial Sequence
  chemically synthesized
caatagattggaagttccat

SEQ ID NO: 516767 - DNA, 20 bp, Artificial Sequence
  chemically synthesized
ggaacttccaatctattgta

SEQ ID NO: 516768 - DNA, 20 bp, Artificial Sequence
  chemically synthesized
cttcaataacacttattata

SEQ ID NO: 516769 - DNA, 20 bp, Artificial Sequence
  chemically synthesized
gatagaaagtacctaaaata

SEQ ID NO: 516770 - DNA, 20 bp, Artificial Sequence
  chemically synthesized
gggaaggagagagaactagt

SEQ ID NO: 516771 - DNA, 20 bp, Artificial Sequence
  chemically synthesized
tagtcaaagaaggtgttttt

SEQ ID NO: 516772 - DNA, 20 bp, Artificial Sequence
  chemically synthesized
tgtgcaattaaacagatttg

SEQ ID NO: 516773 - DNA, 20 bp, Artificial Sequence
  chemically synthesized
tgtgctattattttgcatga

SEQ ID NO: 516774 - DNA, 20 bp, Artificial Sequence
  chemically synthesized
aagagcctttgcaaattccc

SEQ ID NO: 516775 - DNA, 20 bp, Artificial Sequence
  chemically synthesized
cctttgcaaattccctggga

SEQ ID NO: 516776 - DNA, 20 bp, Artificial Sequence
  chemically synthesized
aaggcctctattccatccca

SEQ ID NO: 516777 - DNA, 20 bp, Artificial Sequence
  chemically synthesized
aggcatttttaaatatggtc

SEQ ID NO: 516778 - DNA, 20 bp, Artificial Sequence
  chemically synthesized
ttatcactatagctaattgt

SEQ ID NO: 516779 - DNA, 20 bp, Artificial Sequence
  chemically synthesized
caattagctatagtgataaa

SEQ ID NO: 516780 - DNA, 20 bp, Artificial Sequence
  chemically synthesized
aatcgaataagttggtaggt

SEQ ID NO: 516781 - DNA, 20 bp, Artificial Sequence
  chemically synthesized
agttggtaggtttgaatatg

SEQ ID NO: 516782 - DNA, 20 bp, Artificial Sequence
  chemically synthesized
ggttataaaacaattttgga

SEQ ID NO: 516783 - DNA, 20 bp, Artificial Sequence
  chemically synthesized
taacttgcaaagaaaacgaa

SEQ ID NO: 516784 - DNA, 20 bp, Artificial Sequence
  chemically synthesized
caatttttgttactttttct

SEQ ID NO: 516785 - DNA, 20 bp, Artificial Sequence
  chemically synthesized
aaatatgttcatcctcattc

SEQ ID NO: 516786 - DNA, 20 bp, Artificial Sequence
  chemically synthesized
gcacttatctactcaggaat

SEQ ID NO: 516787 - DNA, 20 bp, Artificial Sequence
  chemically synthesized
tagtttgcacttatctactc

SEQ ID NO: 516788 - DNA, 20 bp, Artificial Sequence
  chemically synthesized
tatgtacagcagatatctga

SEQ ID NO: 516789 - DNA, 20 bp, Artificial Sequence
  chemically synthesized
tatcctccttctctcttact

SEQ ID NO: 516790 - DNA, 20 bp, Artificial Sequence
  chemically synthesized
cacccccagtaagagagaag

SEQ ID NO: 516791 - DNA, 20 bp, Artificial Sequence
  chemically synthesized
gttcttttttgtttacctct

SEQ ID NO: 516792 - DNA, 20 bp, Artificial Sequence
  chemically synthesized
tggagctttaagagcacttt

SEQ ID NO: 516793 - DNA, 20 bp, Artificial Sequence
  chemically synthesized
ataaataaataaatggttgg

SEQ ID NO: 516794 - DNA, 20 bp, Artificial Sequence
  chemically synthesized
atggataaataaataaatgg

SEQ ID NO: 516795 - DNA, 20 bp, Artificial Sequence
  chemically synthesized
atgaatggatggatgggtgc

SEQ ID NO: 516796 - DNA, 20 bp, Artificial Sequence
  chemically synthesized
atggatggatgaatggatgg

SEQ ID NO: 516797 - DNA, 20 bp, Artificial Sequence
  chemically synthesized
acggatggatggatgaatgg

SEQ ID NO: 516798 - DNA, 20 bp, Artificial Sequence
  chemically synthesized
ataaacggatggatggatga

SEQ ID NO: 516799 - DNA, 20 bp, Artificial Sequence
  chemically synthesized
agagataaacggatggatgg

SEQ ID NO: 516800 - DNA, 20 bp, Artificial Sequence
  chemically synthesized
atgaagagataaacggatgg

SEQ ID NO: 516801 - DNA, 20 bp, Artificial Sequence
  chemically synthesized
atggatgaagagataaacgg

SEQ ID NO: 516802 - DNA, 20 bp, Artificial Sequence
  chemically synthesized
tgagatggatgaagagataa

SEQ ID NO: 516803 - DNA, 20 bp, Artificial Sequence
  chemically synthesized
ttatacaaattaaacatgag

SEQ ID NO: 516804 - DNA, 20 bp, Artificial Sequence
  chemically synthesized
ccatacatacatagagtcta

SEQ ID NO: 516805 - DNA, 20 bp, Artificial Sequence
  chemically synthesized
ttacatgtaccatacataca

SEQ ID NO: 516806 - DNA, 20 bp, Artificial Sequence
  chemically synthesized
ttctccttcattgtaaattt

SEQ ID NO: 516807 - DNA, 20 bp, Artificial Sequence
  chemically synthesized
acctcatgattacagatatg

SEQ ID NO: 516808 - DNA, 20 bp, Artificial Sequence
  chemically synthesized
cttacacataagcagaagga

SEQ ID NO: 516809 - DNA, 20 bp, Artificial Sequence
  chemically synthesized
ccaaaggactgaaacttgaa

SEQ ID NO: 516810 - DNA, 20 bp, Artificial Sequence
  chemically synthesized
agggctttcaaacctatctg

SEQ ID NO: 516811 - DNA, 20 bp, Artificial Sequence
  chemically synthesized
ttcatacttgaaagggacaa

SEQ ID NO: 516812 - DNA, 20 bp, Artificial Sequence
  chemically synthesized
tatacattgaaggaaattat

SEQ ID NO: 516813 - DNA, 20 bp, Artificial Sequence
  chemically synthesized
acaattgtttttattactta

SEQ ID NO: 516814 - DNA, 20 bp, Artificial Sequence
  chemically synthesized
tttcttgtttgttagctttt

SEQ ID NO: 516815 - DNA, 20 bp, Artificial Sequence
  chemically synthesized
gcttttatgtgtttacttag

SEQ ID NO: 516816 - DNA, 20 bp, Artificial Sequence
  chemically synthesized
gaccacttccctaaagctta

SEQ ID NO: 516817 - DNA, 20 bp, Artificial Sequence
  chemically synthesized
ttgggctggggagatggttt

SEQ ID NO: 516818 - DNA, 20 bp, Artificial Sequence
  chemically synthesized
tgataaatgttgtaatgtgc

SEQ ID NO: 516819 - DNA, 20 bp, Artificial Sequence
  chemically synthesized
ctaggttgtgtgctccttat

SEQ ID NO: 516820 - DNA, 20 bp, Artificial Sequence
  chemically synthesized
tattgtgacctgcgcatgcg

SEQ ID NO: 516821 - DNA, 20 bp, Artificial Sequence
  chemically synthesized
ctcgcatgcgcaggtcacaa

SEQ ID NO: 516822 - DNA, 20 bp, Artificial Sequence
  chemically synthesized
aatagggttctcgctcctat

SEQ ID NO: 516823 - DNA, 20 bp, Artificial Sequence
  chemically synthesized
ggaccgattggtctggggcc

SEQ ID NO: 516824 - DNA, 20 bp, Artificial Sequence
  chemically synthesized
aaagcaggggtccccaaagc

SEQ ID NO: 516825 - DNA, 20 bp, Artificial Sequence
  chemically synthesized
tatgctgttctccccaaagc

SEQ ID NO: 516826 - DNA, 20 bp, Artificial Sequence
  chemically synthesized
ataaatcttacactgtattg

SEQ ID NO: 516827 - DNA, 20 bp, Artificial Sequence
  chemically synthesized
agtctcaataaagttactca

SEQ ID NO: 516828 - DNA, 20 bp, Artificial Sequence
  chemically synthesized
tcaataaagttactcactga

SEQ ID NO: 516829 - DNA, 20 bp, Artificial Sequence
  chemically synthesized
ctttttaaaatattcattca

SEQ ID NO: 516830 - DNA, 20 bp, Artificial Sequence
  chemically synthesized
ttaaattacaaaagtaaaat

SEQ ID NO: 516831 - DNA, 20 bp, Artificial Sequence
  chemically synthesized
aatctacataaataccaaat

SEQ ID NO: 516832 - DNA, 20 bp, Artificial Sequence
  chemically synthesized
aattctatgtttctctcaag

SEQ ID NO: 516833 - DNA, 20 bp, Artificial Sequence
  chemically synthesized
aattcttcttgagagaaaca

SEQ ID NO: 516834 - DNA, 20 bp, Artificial Sequence
  chemically synthesized
atgtctataaataggagaca

SEQ ID NO: 516835 - DNA, 20 bp, Artificial Sequence
  chemically synthesized
taattatcaaaccccattat

SEQ ID NO: 516836 - DNA, 20 bp, Artificial Sequence
  chemically synthesized
tcttaacctcatcctcataa

SEQ ID NO: 516837 - DNA, 20 bp, Artificial Sequence
  chemically synthesized
taaagtaaaatcatctttgt

SEQ ID NO: 516838 - DNA, 20 bp, Artificial Sequence
  chemically synthesized
actttgggaggccaaggcag

SEQ ID NO: 516839 - DNA, 20 bp, Artificial Sequence
  chemically synthesized
cagggggatcacttgaggcc

SEQ ID NO: 516840 - DNA, 20 bp, Artificial Sequence
  chemically synthesized
ttttgtatttttagtagaga

SEQ ID NO: 516841 - DNA, 20 bp, Artificial Sequence
  chemically synthesized
actaaaaatacaaaaattag

SEQ ID NO: 516842 - DNA, 20 bp, Artificial Sequence
  chemically synthesized
taccgagtagctgggattac

SEQ ID NO: 516843 - DNA, 20 bp, Artificial Sequence
  chemically synthesized
acctcagcctaccgagtagc

SEQ ID NO: 516844 - DNA, 20 bp, Artificial Sequence
  chemically synthesized
gattctcccacctcagccta

SEQ ID NO: 516845 - DNA, 20 bp, Artificial Sequence
  chemically synthesized
tactcggtaggctgaggtgg

SEQ ID NO: 516846 - DNA, 20 bp, Artificial Sequence
  chemically synthesized
tcactgcaacctctggctcc

SEQ ID NO: 516847 - DNA, 20 bp, Artificial Sequence
  chemically synthesized
ctcacttctgttgcccaggc

SEQ ID NO: 516848 - DNA, 20 bp, Artificial Sequence
  chemically synthesized
ataattgcctattgtcctac

SEQ ID NO: 516849 - DNA, 20 bp, Artificial Sequence
  chemically synthesized
aaaaagatagttttcatcac

SEQ ID NO: 516850 - DNA, 20 bp, Artificial Sequence
  chemically synthesized
caatccctgaaaaacctatg

SEQ ID NO: 516851 - DNA, 20 bp, Artificial Sequence
  chemically synthesized
taattcttcataggtttttc

SEQ ID NO: 516852 - DNA, 20 bp, Artificial Sequence
  chemically synthesized
gtaacgtctcattgtaaaat

SEQ ID NO: 516853 - DNA, 20 bp, Artificial Sequence
  chemically synthesized
attttaaatgtatttctgtc

SEQ ID NO: 516854 - DNA, 20 bp, Artificial Sequence
  chemically synthesized
ttatagaaaatgaagctttc

SEQ ID NO: 516855 - DNA, 20 bp, Artificial Sequence
  chemically synthesized
aagtttaaacatttaagtac

SEQ ID NO: 516856 - DNA, 20 bp, Artificial Sequence
  chemically synthesized
ttggactatgctggcatgag

SEQ ID NO: 516857 - DNA, 20 bp, Artificial Sequence
  chemically synthesized
ggtttgtttttcaatatcaa

SEQ ID NO: 516858 - DNA, 20 bp, Artificial Sequence
  chemically synthesized
caaaaaaatggctacggcat

SEQ ID NO: 516859 - DNA, 20 bp, Artificial Sequence
  chemically synthesized
catagacttatggaaacatt

SEQ ID NO: 516860 - DNA, 20 bp, Artificial Sequence
  chemically synthesized
caaaatgtttccataagtct

SEQ ID NO: 516861 - DNA, 20 bp, Artificial Sequence
  chemically synthesized
cataagtctatggatgcaaa

SEQ ID NO: 516862 - DNA, 20 bp, Artificial Sequence
  chemically synthesized
tgttagctagaccaggcatg

SEQ ID NO: 516863 - DNA, 20 bp, Artificial Sequence
  chemically synthesized
gcctcagcctcccaaagtgc

SEQ ID NO: 516864 - DNA, 20 bp, Artificial Sequence
  chemically synthesized
actttgggaggctgaggcgg

SEQ ID NO: 516865 - DNA, 20 bp, Artificial Sequence
  chemically synthesized
cgggaggattgcttgaggcc

SEQ ID NO: 516866 - DNA, 20 bp, Artificial Sequence
  chemically synthesized
ctttttatttttcgtggaga

SEQ ID NO: 516867 - DNA, 20 bp, Artificial Sequence
  chemically synthesized
gattctcccacctgcacctc

SEQ ID NO: 516868 - DNA, 20 bp, Artificial Sequence
  chemically synthesized
tactcaggaggtgcaggtgg

SEQ ID NO: 516869 - DNA, 20 bp, Artificial Sequence
  chemically synthesized
tgggagaatcatctgagccc

SEQ ID NO: 516870 - DNA, 20 bp, Artificial Sequence
  chemically synthesized
tgagcccaggaattcaaggt

SEQ ID NO: 516871 - DNA, 20 bp, Artificial Sequence
  chemically synthesized
gatcatagctcactctaacc

SEQ ID NO: 516872 - DNA, 20 bp, Artificial Sequence
  chemically synthesized
tcatgccactgcacttcagc

SEQ ID NO: 516873 - DNA, 20 bp, Artificial Sequence
  chemically synthesized
agctaacctactagttttac

SEQ ID NO: 516874 - DNA, 20 bp, Artificial Sequence
  chemically synthesized
gttttacctgagttccttca

SEQ ID NO: 516875 - DNA, 20 bp, Artificial Sequence
  chemically synthesized
tgaagttaatttctgtgtga

SEQ ID NO: 516876 - DNA, 20 bp, Artificial Sequence
  chemically synthesized
acactgattttctcctctga

SEQ ID NO: 516877 - DNA, 20 bp, Artificial Sequence
  chemically synthesized
tgtaatgtaaactgtttcta

SEQ ID NO: 516878 - DNA, 20 bp, Artificial Sequence
  chemically synthesized
agtttacattacaaactctg

SEQ ID NO: 516879 - DNA, 20 bp, Artificial Sequence
  chemically synthesized
tacattacaaactctgatga

SEQ ID NO: 516880 - DNA, 20 bp, Artificial Sequence
  chemically synthesized
aagtattcatatccactcat

SEQ ID NO: 516881 - DNA, 20 bp, Artificial Sequence
  chemically synthesized
acaaactctgatgagtggat

SEQ ID NO: 516882 - DNA, 20 bp, Artificial Sequence
  chemically synthesized
actttgccaatgaaatgtgt

SEQ ID NO: 516883 - DNA, 20 bp, Artificial Sequence
  chemically synthesized
acttggaaattggctgggac

SEQ ID NO: 516884 - DNA, 20 bp, Artificial Sequence
  chemically synthesized
tacttcagtgtgtacagtaa

SEQ ID NO: 516885 - DNA, 20 bp, Artificial Sequence
  chemically synthesized
cttcagcagtaggtcagcag

SEQ ID NO: 516886 - DNA, 20 bp, Artificial Sequence
  chemically synthesized
tgttctttctttggggatat

SEQ ID NO: 516887 - DNA, 20 bp, Artificial Sequence
  chemically synthesized
atttataatgttctttcttt

SEQ ID NO: 516888 - DNA, 20 bp, Artificial Sequence
  chemically synthesized
tttaaaataaaatattaaga

SEQ ID NO: 516889 - DNA, 20 bp, Artificial Sequence
  chemically synthesized
gatggaatattaagtataac

SEQ ID NO: 516890 - DNA, 20 bp, Artificial Sequence
  chemically synthesized
atattaagaacagatacact

SEQ ID NO: 516891 - DNA, 20 bp, Artificial Sequence
  chemically synthesized
acagatacactcggaattag

SEQ ID NO: 516892 - DNA, 20 bp, Artificial Sequence
  chemically synthesized
tttccccaaccccactaatt

SEQ ID NO: 516893 - DNA, 20 bp, Artificial Sequence
  chemically synthesized
tggttttggtaataatgttt

SEQ ID NO: 516894 - DNA, 20 bp, Artificial Sequence
  chemically synthesized
taataatgtttagggattcc

SEQ ID NO: 516895 - DNA, 20 bp, Artificial Sequence
  chemically synthesized
gacattgaaaatcatattcc

SEQ ID NO: 516896 - DNA, 20 bp, Artificial Sequence
  chemically synthesized
aagtaggtttttcaaaaact

SEQ ID NO: 516897 - DNA, 20 bp, Artificial Sequence
  chemically synthesized
aaaaaaaaaaaaaaaaaacc

SEQ ID NO: 516898 - DNA, 20 bp, Artificial Sequence
  chemically synthesized
aggccaaaataactttcaga

SEQ ID NO: 516899 - DNA, 20 bp, Artificial Sequence
  chemically synthesized
gttctcagtatgtgacctgc

SEQ ID NO: 516900 - DNA, 20 bp, Artificial Sequence
  chemically synthesized
tcagtatgtgacctgctgga

SEQ ID NO: 516901 - DNA, 20 bp, Artificial Sequence
  chemically synthesized
gactcaaaatagaagtcttc

SEQ ID NO: 516902 - DNA, 20 bp, Artificial Sequence
  chemically synthesized
tattccggaagacttctatt

SEQ ID NO: 516903 - DNA, 20 bp, Artificial Sequence
  chemically synthesized
agttccttggaggatactat

SEQ ID NO: 516904 - DNA, 20 bp, Artificial Sequence
  chemically synthesized
ctattctttaaagttccttg

SEQ ID NO: 516905 - DNA, 20 bp, Artificial Sequence
  chemically synthesized
gtatcctccaaggaacttta

SEQ ID NO: 516906 - DNA, 20 bp, Artificial Sequence
  chemically synthesized
cagatcttgttacctgaatc

SEQ ID NO: 516907 - DNA, 20 bp, Artificial Sequence
  chemically synthesized
aaacattcagatcttgttac

SEQ ID NO: 516908 - DNA, 20 bp, Artificial Sequence
  chemically synthesized
cctgattcaggtaacaagat

SEQ ID NO: 516909 - DNA, 20 bp, Artificial Sequence
  chemically synthesized
ggtaacaagatctgaatgtt

SEQ ID NO: 516910 - DNA, 20 bp, Artificial Sequence
  chemically synthesized
tgaatgtttgggatgcatca

SEQ ID NO: 516911 - DNA, 20 bp, Artificial Sequence
  chemically synthesized
ttaaggacttctgaaagtgc

SEQ ID NO: 516912 - DNA, 20 bp, Artificial Sequence
  chemically synthesized
tcaagtaactggactgtaac

SEQ ID NO: 516913 - DNA, 20 bp, Artificial Sequence
  chemically synthesized
agtttcatgtagttcattta

SEQ ID NO: 516914 - DNA, 20 bp, Artificial Sequence
  chemically synthesized
gcaattgatgaaacagtaac

SEQ ID NO: 516915 - DNA, 20 bp, Artificial Sequence
  chemically synthesized
aaattagttaaattaattgc

SEQ ID NO: 516916 - DNA, 20 bp, Artificial Sequence
  chemically synthesized
aactatgaaaaagagcattg

SEQ ID NO: 516917 - DNA, 20 bp, Artificial Sequence
  chemically synthesized
atttggccattgattaactt

SEQ ID NO: 516918 - DNA, 20 bp, Artificial Sequence
  chemically synthesized
ttgttttctatatctttaaa

SEQ ID NO: 516919 - DNA, 20 bp, Artificial Sequence
  chemically synthesized
tctatatctttaaattgagt

SEQ ID NO: 516920 - DNA, 20 bp, Artificial Sequence
  chemically synthesized
catactcagtaatgggattg

SEQ ID NO: 516921 - DNA, 20 bp, Artificial Sequence
  chemically synthesized
tggatccagcaatcccatta

SEQ ID NO: 516922 - DNA, 20 bp, Artificial Sequence
  chemically synthesized
ttgggatacatactcagtaa

SEQ ID NO: 516923 - DNA, 20 bp, Artificial Sequence
  chemically synthesized
atataatgatttcatttctt

SEQ ID NO: 516924 - DNA, 20 bp, Artificial Sequence
  chemically synthesized
aacaatgctgcaatgaacac

SEQ ID NO: 516925 - DNA, 20 bp, Artificial Sequence
  chemically synthesized
ttgttcacaatagccaaggt

SEQ ID NO: 516926 - DNA, 20 bp, Artificial Sequence
  chemically synthesized
tttgttgatggacatttagg

SEQ ID NO: 516927 - DNA, 20 bp, Artificial Sequence
  chemically synthesized
acctaaatgtccatcaacaa

SEQ ID NO: 516928 - DNA, 20 bp, Artificial Sequence
  chemically synthesized
aaatgtccatcaacaaatga

SEQ ID NO: 516929 - DNA, 20 bp, Artificial Sequence
  chemically synthesized
gtggtcacacacacacacaa

SEQ ID NO: 516930 - DNA, 20 bp, Artificial Sequence
  chemically synthesized
tagattttcttctttcatgt

SEQ ID NO: 516931 - DNA, 20 bp, Artificial Sequence
  chemically synthesized
aatctaccatttgtgacaac

SEQ ID NO: 516932 - DNA, 20 bp, Artificial Sequence
  chemically synthesized
gcacttagcaaaacttcctc

SEQ ID NO: 516933 - DNA, 20 bp, Artificial Sequence
  chemically synthesized
aagttgggctcatagaagta

SEQ ID NO: 516934 - DNA, 20 bp, Artificial Sequence
  chemically synthesized
gggctcatagaagtagagag

SEQ ID NO: 516935 - DNA, 20 bp, Artificial Sequence
  chemically synthesized
tggttaccagagactgggag

SEQ ID NO: 516936 - DNA, 20 bp, Artificial Sequence
  chemically synthesized
gcttgcagagatattgatca

SEQ ID NO: 516937 - DNA, 20 bp, Artificial Sequence
  chemically synthesized
acattgttatgaaccacctg

SEQ ID NO: 516938 - DNA, 20 bp, Artificial Sequence
  chemically synthesized
ctactctcttagcaattttc

SEQ ID NO: 516939 - DNA, 20 bp, Artificial Sequence
  chemically synthesized
atactcttgaaaattgctaa

SEQ ID NO: 516940 - DNA, 20 bp, Artificial Sequence
  chemically synthesized
tttaagtgtttttcacttgg

SEQ ID NO: 516941 - DNA, 20 bp, Artificial Sequence
  chemically synthesized
gcttccgcctcccaaagtac

SEQ ID NO: 516942 - DNA, 20 bp, Artificial Sequence
  chemically synthesized
actttgggaggcggaagcgg

SEQ ID NO: 516943 - DNA, 20 bp, Artificial Sequence
  chemically synthesized
cgggcggattgcctgagctc

SEQ ID NO: 516944 - DNA, 20 bp, Artificial Sequence
  chemically synthesized
tttgtgtgttttagtagaga

SEQ ID NO: 516945 - DNA, 20 bp, Artificial Sequence
  chemically synthesized
taaaacacacaaaaaattag

SEQ ID NO: 516946 - DNA, 20 bp, Artificial Sequence
  chemically synthesized
gattctcctgcctcagcctc

SEQ ID NO: 516947 - DNA, 20 bp, Artificial Sequence
  chemically synthesized
tactcaggaggctgaggcag

SEQ ID NO: 516948 - DNA, 20 bp, Artificial Sequence
  chemically synthesized
tcttgctccgtctcccaggc

SEQ ID NO: 516949 - DNA, 20 bp, Artificial Sequence
  chemically synthesized
tttttttttttttttggaga

SEQ ID NO: 516950 - DNA, 20 bp, Artificial Sequence
  chemically synthesized
gttgttttgaatatatatat

SEQ ID NO: 516951 - DNA, 20 bp, Artificial Sequence
  chemically synthesized
atttcattcaacatgttgtt

SEQ ID NO: 516952 - DNA, 20 bp, Artificial Sequence
  chemically synthesized
tatatattcaaaacaacatg

SEQ ID NO: 516953 - DNA, 20 bp, Artificial Sequence
  chemically synthesized
aaattaaatagttaatttta

SEQ ID NO: 516954 - DNA, 20 bp, Artificial Sequence
  chemically synthesized
tttaatttaaataaaataaa

SEQ ID NO: 516955 - DNA, 20 bp, Artificial Sequence
  chemically synthesized
taacaacctagtaaatgtgt

SEQ ID NO: 516956 - DNA, 20 bp, Artificial Sequence
  chemically synthesized
taatgtagcgaagggtacta

SEQ ID NO: 516957 - DNA, 20 bp, Artificial Sequence
  chemically synthesized
gagatacaaataatgtagcg

SEQ ID NO: 516958 - DNA, 20 bp, Artificial Sequence
  chemically synthesized
ctggaatgatttggacagaa

SEQ ID NO: 516959 - DNA, 20 bp, Artificial Sequence
  chemically synthesized
ccaaatcattccagcccact

SEQ ID NO: 516960 - DNA, 20 bp, Artificial Sequence
  chemically synthesized
aagttagattcagagtgggc

SEQ ID NO: 516961 - DNA, 20 bp, Artificial Sequence
  chemically synthesized
ctgtcaaaacaagttagatt

SEQ ID NO: 516962 - DNA, 20 bp, Artificial Sequence
  chemically synthesized
ctgaatctaacttgttttga

SEQ ID NO: 516963 - DNA, 20 bp, Artificial Sequence
  chemically synthesized
gaaatataacttgtttactg

SEQ ID NO: 516964 - DNA, 20 bp, Artificial Sequence
  chemically synthesized
ttttttttttttttttttga

SEQ ID NO: 516965 - DNA, 20 bp, Artificial Sequence
  chemically synthesized
catactccagcctgggcaac

SEQ ID NO: 516966 - DNA, 20 bp, Artificial Sequence
  chemically synthesized
ttcactcttgttgcccaggc

SEQ ID NO: 516967 - DNA, 20 bp, Artificial Sequence
  chemically synthesized
gcagcgggtcacctgaggcc

SEQ ID NO: 516968 - DNA, 20 bp, Artificial Sequence
  chemically synthesized
gcggccgggcgtccgaggca

SEQ ID NO: 516969 - DNA, 20 bp, Artificial Sequence
  chemically synthesized
ttaagcaaatgcatactgtc

SEQ ID NO: 516970 - DNA, 20 bp, Artificial Sequence
  chemically synthesized
gtcttggattatttaagttt

SEQ ID NO: 516971 - DNA, 20 bp, Artificial Sequence
  chemically synthesized
atttaggttgatttcccaac

SEQ ID NO: 516972 - DNA, 20 bp, Artificial Sequence
  chemically synthesized
atttacattaaatctgtttc

SEQ ID NO: 516973 - DNA, 20 bp, Artificial Sequence
  chemically synthesized
atacagaatctaaagattga

SEQ ID NO: 516974 - DNA, 20 bp, Artificial Sequence
  chemically synthesized
aatttttagaaagattaata

SEQ ID NO: 516975 - DNA, 20 bp, Artificial Sequence
  chemically synthesized
ggaacatttatatccctaat

SEQ ID NO: 516976 - DNA, 20 bp, Artificial Sequence
  chemically synthesized
tcagatttaccatccctatt

SEQ ID NO: 516977 - DNA, 20 bp, Artificial Sequence
  chemically synthesized
cgtgtgtgcaccatgctacc

SEQ ID NO: 516978 - DNA, 20 bp, Artificial Sequence
  chemically synthesized
caaggtagcatggtgcacac

SEQ ID NO: 516979 - DNA, 20 bp, Artificial Sequence
  chemically synthesized
caaagtagctttcaaagaga

SEQ ID NO: 516980 - DNA, 20 bp, Artificial Sequence
  chemically synthesized
ttctagatgacattaaaaaa

SEQ ID NO: 516981 - DNA, 20 bp, Artificial Sequence
  chemically synthesized
tgtagctggaaatggagttg

SEQ ID NO: 516982 - DNA, 20 bp, Artificial Sequence
  chemically synthesized
tcaacttatgtagctggaaa

SEQ ID NO: 516983 - DNA, 20 bp, Artificial Sequence
  chemically synthesized
aagttgagataaattacttt

SEQ ID NO: 516984 - DNA, 20 bp, Artificial Sequence
  chemically synthesized
acagctttcttactagcaag

SEQ ID NO: 516985 - DNA, 20 bp, Artificial Sequence
  chemically synthesized
ttgtcttttggtgtatattt

SEQ ID NO: 516986 - DNA, 20 bp, Artificial Sequence
  chemically synthesized
aacagtaagcagtcatgcta

SEQ ID NO: 516987 - DNA, 20 bp, Artificial Sequence
  chemically synthesized
ctgcttactgttttgtatat

SEQ ID NO: 516988 - DNA, 20 bp, Artificial Sequence
  chemically synthesized
gaagatgaagtcagatacct

SEQ ID NO: 516989 - DNA, 20 bp, Artificial Sequence
  chemically synthesized
tgaaaaactgaaggcaaata

SEQ ID NO: 516990 - DNA, 20 bp, Artificial Sequence
  chemically synthesized
taagtaggttacctgatgaa

SEQ ID NO: 516991 - DNA, 20 bp, Artificial Sequence
  chemically synthesized
ctaaacagtattatcttatt

SEQ ID NO: 516992 - DNA, 20 bp, Artificial Sequence
  chemically synthesized
gaactctcaattgctttact

SEQ ID NO: 516993 - DNA, 20 bp, Artificial Sequence
  chemically synthesized
ttattcagagtaaagcaatt

SEQ ID NO: 516994 - DNA, 20 bp, Artificial Sequence
  chemically synthesized
actggtacgtctccttatag

SEQ ID NO: 516995 - DNA, 20 bp, Artificial Sequence
  chemically synthesized
tataacactgttaacttaca

SEQ ID NO: 516996 - DNA, 20 bp, Artificial Sequence
  chemically synthesized
actgttaacttacatggggt

SEQ ID NO: 516997 - DNA, 20 bp, Artificial Sequence
  chemically synthesized
acctaaagtttgtaatgtct

SEQ ID NO: 516998 - DNA, 20 bp, Artificial Sequence
  chemically synthesized
aaacaaatataatgaaaacg

SEQ ID NO: 516999 - DNA, 20 bp, Artificial Sequence
  chemically synthesized
aacaaggaattggtgaacaa

SEQ ID NO: 517000 - DNA, 20 bp, Artificial Sequence
  chemically synthesized
gaatgtgtttaaacagaaca

SEQ ID NO: 517001 - DNA, 20 bp, Artificial Sequence
  chemically synthesized
acgttatgggtaaatgtttt

SEQ ID NO: 517002 - DNA, 20 bp, Artificial Sequence
  chemically synthesized
tgcataccttcctttacgtt

SEQ ID NO: 517003 - DNA, 20 bp, Artificial Sequence
  chemically synthesized
tagtcaatagcattcagtga

SEQ ID NO: 517004 - DNA, 20 bp, Artificial Sequence
  chemically synthesized
caatagcattcagtgactga

SEQ ID NO: 517005 - DNA, 20 bp, Artificial Sequence
  chemically synthesized
tcccgaaatccattcagtca

SEQ ID NO: 517006 - DNA, 20 bp, Artificial Sequence
  chemically synthesized
ttcagtgactgaatggattt

SEQ ID NO: 517007 - DNA, 20 bp, Artificial Sequence
  chemically synthesized
atggatttcgggatggagaa

SEQ ID NO: 517008 - DNA, 20 bp, Artificial Sequence
  chemically synthesized
atacaaaaataagcgacttc

SEQ ID NO: 517009 - DNA, 20 bp, Artificial Sequence
  chemically synthesized
ggtgcttaatagaaagggga

SEQ ID NO: 517010 - DNA, 20 bp, Artificial Sequence
  chemically synthesized
catgaagagctggtttatgt

SEQ ID NO: 517011 - DNA, 20 bp, Artificial Sequence
  chemically synthesized
ggtttatgtgggagtagata

SEQ ID NO: 517012 - DNA, 20 bp, Artificial Sequence
  chemically synthesized
ataatttggtggagctctaa

SEQ ID NO: 517013 - DNA, 20 bp, Artificial Sequence
  chemically synthesized
tggtgtgcagtgtagcagag

SEQ ID NO: 517014 - DNA, 20 bp, Artificial Sequence
  chemically synthesized
ctacgttttttgatttgaag

SEQ ID NO: 517015 - DNA, 20 bp, Artificial Sequence
  chemically synthesized
ttgatttgaagaagaatatg

SEQ ID NO: 517016 - DNA, 20 bp, Artificial Sequence
  chemically synthesized
ctttgtttcctctactgcaa

SEQ ID NO: 517017 - DNA, 20 bp, Artificial Sequence
  chemically synthesized
actaattggccatagttact

SEQ ID NO: 517018 - DNA, 20 bp, Artificial Sequence
  chemically synthesized
aagaaaagtatctgtgcttg

SEQ ID NO: 517019 - DNA, 20 bp, Artificial Sequence
  chemically synthesized
tattattatattttaagttc

SEQ ID NO: 517020 - DNA, 20 bp, Artificial Sequence
  chemically synthesized
ctaatgtagatgacgggttg

SEQ ID NO: 517021 - DNA, 20 bp, Artificial Sequence
  chemically synthesized
agaaatacctaatgtagatg

SEQ ID NO: 517022 - DNA, 20 bp, Artificial Sequence
  chemically synthesized
agggggtggggggcaaaggg

SEQ ID NO: 517023 - DNA, 20 bp, Artificial Sequence
  chemically synthesized
tcacacacctgggcctgtca

SEQ ID NO: 517024 - DNA, 20 bp, Artificial Sequence
  chemically synthesized
acatgttctgtcttataagt

SEQ ID NO: 517025 - DNA, 20 bp, Artificial Sequence
  chemically synthesized
tgttcctgttttagtttgct

SEQ ID NO: 517026 - DNA, 20 bp, Artificial Sequence
  chemically synthesized
tttatgtcctttgcagggac

SEQ ID NO: 517027 - DNA, 20 bp, Artificial Sequence
  chemically synthesized
ctgtgcagccataaaaaatt

SEQ ID NO: 517028 - DNA, 20 bp, Artificial Sequence
  chemically synthesized
aatgtggcacatatacacca

SEQ ID NO: 517029 - DNA, 20 bp, Artificial Sequence
  chemically synthesized
aaatgcccatcaaagataga

SEQ ID NO: 517030 - DNA, 20 bp, Artificial Sequence
  chemically synthesized
ttcaaaatttccaaactatg

SEQ ID NO: 517031 - DNA, 20 bp, Artificial Sequence
  chemically synthesized
gcctattttataataaaatg

SEQ ID NO: 517032 - DNA, 20 bp, Artificial Sequence
  chemically synthesized
actatactgaaagtcaaaac

SEQ ID NO: 517033 - DNA, 20 bp, Artificial Sequence
  chemically synthesized
caaagtatggtttccacagc

SEQ ID NO: 517034 - DNA, 20 bp, Artificial Sequence
  chemically synthesized
acttaacaatttttcgactt

SEQ ID NO: 517035 - DNA, 20 bp, Artificial Sequence
  chemically synthesized
gaagttcctctttctctaag

SEQ ID NO: 517036 - DNA, 20 bp, Artificial Sequence
  chemically synthesized
gaggaacttccactaagtat

SEQ ID NO: 517037 - DNA, 20 bp, Artificial Sequence
  chemically synthesized
gtttctgaaatcttgaatgc

SEQ ID NO: 517038 - DNA, 20 bp, Artificial Sequence
  chemically synthesized
agctatatgtttctgaaatc

SEQ ID NO: 517039 - DNA, 20 bp, Artificial Sequence
  chemically synthesized
catagtatctgggaaggaca

SEQ ID NO: 517040 - DNA, 20 bp, Artificial Sequence
  chemically synthesized
caacatgtacaaaagcttaa

SEQ ID NO: 517041 - DNA, 20 bp, Artificial Sequence
  chemically synthesized
acatgttggtccctccctcc

SEQ ID NO: 517042 - DNA, 20 bp, Artificial Sequence
  chemically synthesized
aattggggttatggaggagt

SEQ ID NO: 517043 - DNA, 20 bp, Artificial Sequence
  chemically synthesized
atgaagaattggggttatgg

SEQ ID NO: 517044 - DNA, 20 bp, Artificial Sequence
  chemically synthesized
agatttatcaaatgaagaat

SEQ ID NO: 517045 - DNA, 20 bp, Artificial Sequence
  chemically synthesized
atgtaaagatttatcaaatg

SEQ ID NO: 517046 - DNA, 20 bp, Artificial Sequence
  chemically synthesized
tttgcttagggtaggaggaa

SEQ ID NO: 517047 - DNA, 20 bp, Artificial Sequence
  chemically synthesized
atggttttgcttagggtagg

SEQ ID NO: 517048 - DNA, 20 bp, Artificial Sequence
  chemically synthesized
aagaaatgaatggttttgct

SEQ ID NO: 517049 - DNA, 20 bp, Artificial Sequence
  chemically synthesized
atatatataatgcaaaagaa

SEQ ID NO: 517050 - DNA, 20 bp, Artificial Sequence
  chemically synthesized
acctagtatagtgtgtcata

SEQ ID NO: 517051 - DNA, 20 bp, Artificial Sequence
  chemically synthesized
attaaaaaatagtgcacttg

SEQ ID NO: 517052 - DNA, 20 bp, Artificial Sequence
  chemically synthesized
atagacttgagttaggtgta

SEQ ID NO: 517053 - DNA, 20 bp, Artificial Sequence
  chemically synthesized
agaaaaatatatgcatagac

SEQ ID NO: 517054 - DNA, 20 bp, Artificial Sequence
  chemically synthesized
aaatgtataatatataatat

SEQ ID NO: 517055 - DNA, 20 bp, Artificial Sequence
  chemically synthesized
ccatataatatatgaatcat

SEQ ID NO: 517056 - DNA, 20 bp, Artificial Sequence
  chemically synthesized
tcatatgattcatatattat

SEQ ID NO: 517057 - DNA, 20 bp, Artificial Sequence
  chemically synthesized
tatatgaatccatataatat

SEQ ID NO: 517058 - DNA, 20 bp, Artificial Sequence
  chemically synthesized
tgttaatttaacaaacctat

SEQ ID NO: 517059 - DNA, 20 bp, Artificial Sequence
  chemically synthesized
taaaataaatatgattcatt

SEQ ID NO: 517060 - DNA, 20 bp, Artificial Sequence
  chemically synthesized
ggattccatttacactctta

SEQ ID NO: 517061 - DNA, 20 bp, Artificial Sequence
  chemically synthesized
tgattcattaagagtgtaaa

SEQ ID NO: 517062 - DNA, 20 bp, Artificial Sequence
  chemically synthesized
atttagggttatctccttat

SEQ ID NO: 517063 - DNA, 20 bp, Artificial Sequence
  chemically synthesized
atgcctgactatcgtaaatt

SEQ ID NO: 517064 - DNA, 20 bp, Artificial Sequence
  chemically synthesized
cactctccccctagcaatta

SEQ ID NO: 517065 - DNA, 20 bp, Artificial Sequence
  chemically synthesized
tattctgtaattgctagggg

SEQ ID NO: 517066 - DNA, 20 bp, Artificial Sequence
  chemically synthesized
attacaaataaattagaaaa

SEQ ID NO: 517067 - DNA, 20 bp, Artificial Sequence
  chemically synthesized
aactgtgttattctgatttg

SEQ ID NO: 517068 - DNA, 20 bp, Artificial Sequence
  chemically synthesized
gaacaaaagattcagcaaat

SEQ ID NO: 517069 - DNA, 20 bp, Artificial Sequence
  chemically synthesized
taggctgaggtataaatcaa

SEQ ID NO: 517070 - DNA, 20 bp, Artificial Sequence
  chemically synthesized
ttatatgcttatacgtttgt

SEQ ID NO: 517071 - DNA, 20 bp, Artificial Sequence
  chemically synthesized
gtgagtatatgtgtgtgact

SEQ ID NO: 517072 - DNA, 20 bp, Artificial Sequence
  chemically synthesized
atcaattgatacgttagcat

SEQ ID NO: 517073 - DNA, 20 bp, Artificial Sequence
  chemically synthesized
gatttaaagttaattttata

SEQ ID NO: 517074 - DNA, 20 bp, Artificial Sequence
  chemically synthesized
tgtcacattatcaaacacta

SEQ ID NO: 517075 - DNA, 20 bp, Artificial Sequence
  chemically synthesized
tatcaaacactaaagaatgt

SEQ ID NO: 517076 - DNA, 20 bp, Artificial Sequence
  chemically synthesized
tatgagtttttaaaatgtcc

SEQ ID NO: 517077 - DNA, 20 bp, Artificial Sequence
  chemically synthesized
gaagaccaaatgccagctaa

SEQ ID NO: 517078 - DNA, 20 bp, Artificial Sequence
  chemically synthesized
ccagctaactgagtgtaaca

SEQ ID NO: 517079 - DNA, 20 bp, Artificial Sequence
  chemically synthesized
atgatgaaatataagttgat

SEQ ID NO: 517080 - DNA, 20 bp, Artificial Sequence
  chemically synthesized
tgctttgacacagtagatat

SEQ ID NO: 517081 - DNA, 20 bp, Artificial Sequence
  chemically synthesized
atctactgtgtcaaagcaga

SEQ ID NO: 517082 - DNA, 20 bp, Artificial Sequence
  chemically synthesized
agattgagtatataaaggaa

SEQ ID NO: 517083 - DNA, 20 bp, Artificial Sequence
  chemically synthesized
ctagtaacaattgtctggtt

SEQ ID NO: 517084 - DNA, 20 bp, Artificial Sequence
  chemically synthesized
attgttactagaactaaaat

SEQ ID NO: 517085 - DNA, 20 bp, Artificial Sequence
  chemically synthesized
cataatgcgtgtgtgtatat

SEQ ID NO: 517086 - DNA, 20 bp, Artificial Sequence
  chemically synthesized
taatgagcaaacatctgtgc

SEQ ID NO: 517087 - DNA, 20 bp, Artificial Sequence
  chemically synthesized
ccttattgatatggctacaa

SEQ ID NO: 517088 - DNA, 20 bp, Artificial Sequence
  chemically synthesized
atggctacaatagaatccat

SEQ ID NO: 517089 - DNA, 20 bp, Artificial Sequence
  chemically synthesized
ggttacaaaatctcattcaa

SEQ ID NO: 517090 - DNA, 20 bp, Artificial Sequence
  chemically synthesized
aatgagattttgtaaccata

SEQ ID NO: 517091 - DNA, 20 bp, Artificial Sequence
  chemically synthesized
aggaattgtattttgtaagg

SEQ ID NO: 517092 - DNA, 20 bp, Artificial Sequence
  chemically synthesized
ttaatcagtttgaaacagga

SEQ ID NO: 517093 - DNA, 20 bp, Artificial Sequence
  chemically synthesized
tagtttccgtactcccctag

SEQ ID NO: 517094 - DNA, 20 bp, Artificial Sequence
  chemically synthesized
aaatccacccaccccactag

SEQ ID NO: 517095 - DNA, 20 bp, Artificial Sequence
  chemically synthesized
ttccgtactcccctagtggg

SEQ ID NO: 517096 - DNA, 20 bp, Artificial Sequence
  chemically synthesized
gtactcccctagtggggtgg

SEQ ID NO: 517097 - DNA, 20 bp, Artificial Sequence
  chemically synthesized
catagatggaaaatgtattg

SEQ ID NO: 517098 - DNA, 20 bp, Artificial Sequence
  chemically synthesized
accaatacattttccatcta

SEQ ID NO: 517099 - DNA, 20 bp, Artificial Sequence
  chemically synthesized
cgccagacctctaaggcatt

SEQ ID NO: 517100 - DNA, 20 bp, Artificial Sequence
  chemically synthesized
aaaagggcaacatttaatat

SEQ ID NO: 517101 - DNA, 20 bp, Artificial Sequence
  chemically synthesized
aatatttgaataaatatcat

SEQ ID NO: 517102 - DNA, 20 bp, Artificial Sequence
  chemically synthesized
tatcataagggtgaagaaag

SEQ ID NO: 517103 - DNA, 20 bp, Artificial Sequence
  chemically synthesized
agggtgaagaaaggagagtc

SEQ ID NO: 517104 - DNA, 20 bp, Artificial Sequence
  chemically synthesized
ataaattggtatgactagaa

SEQ ID NO: 517105 - DNA, 20 bp, Artificial Sequence
  chemically synthesized
cgtttaaactacactataat

SEQ ID NO: 517106 - DNA, 20 bp, Artificial Sequence
  chemically synthesized
gtacaagcccgaaaaggctg

SEQ ID NO: 517107 - DNA, 20 bp, Artificial Sequence
  chemically synthesized
aatatcagatctgctggtta

SEQ ID NO: 517108 - DNA, 20 bp, Artificial Sequence
  chemically synthesized
gtgtatctgactaccagttt

SEQ ID NO: 517109 - DNA, 20 bp, Artificial Sequence
  chemically synthesized
gtaaaaagaaacttcttttc

SEQ ID NO: 517110 - DNA, 20 bp, Artificial Sequence
  chemically synthesized
gatctctgccagctggagct

SEQ ID NO: 517111 - DNA, 20 bp, Artificial Sequence
  chemically synthesized
ttgatggaaaaatagaggct

SEQ ID NO: 517112 - DNA, 20 bp, Artificial Sequence
  chemically synthesized
agcctctatttttccatcaa

SEQ ID NO: 517113 - DNA, 20 bp, Artificial Sequence
  chemically synthesized
attaagttgactcccagata

SEQ ID NO: 517114 - DNA, 20 bp, Artificial Sequence
  chemically synthesized
tatatagttattctctatct

SEQ ID NO: 517115 - DNA, 20 bp, Artificial Sequence
  chemically synthesized
tttttttcagatgtagcctc

SEQ ID NO: 517116 - DNA, 20 bp, Artificial Sequence
  chemically synthesized
tccatatcctggagatggtt

SEQ ID NO: 517117 - DNA, 20 bp, Artificial Sequence
  chemically synthesized
tgagtactcaaaaccatctc

SEQ ID NO: 517118 - DNA, 20 bp, Artificial Sequence
  chemically synthesized
gccatatacgtttggataag

SEQ ID NO: 517119 - DNA, 20 bp, Artificial Sequence
  chemically synthesized
ggaattttagccatatacgt

SEQ ID NO: 517120 - DNA, 20 bp, Artificial Sequence
  chemically synthesized
aaataggtagtgccttacaa

SEQ ID NO: 517121 - DNA, 20 bp, Artificial Sequence
  chemically synthesized
aaatattttcccgttttgat

SEQ ID NO: 517122 - DNA, 20 bp, Artificial Sequence
  chemically synthesized
cacaaaaaaatatttgtaaa

SEQ ID NO: 517123 - DNA, 20 bp, Artificial Sequence
  chemically synthesized
tacttctggctcccttccct

SEQ ID NO: 517124 - DNA, 20 bp, Artificial Sequence
  chemically synthesized
agatattaagaaaaacttta

SEQ ID NO: 517125 - DNA, 20 bp, Artificial Sequence
  chemically synthesized
gctcagagctcacctactaa

SEQ ID NO: 517126 - DNA, 20 bp, Artificial Sequence
  chemically synthesized
ccccgaccaatggcaagtgt

SEQ ID NO: 517127 - DNA, 20 bp, Artificial Sequence
  chemically synthesized
tccttacacttgccattggt

SEQ ID NO: 517128 - DNA, 20 bp, Artificial Sequence
  chemically synthesized
ccagttcagtttaatatgcc

SEQ ID NO: 517129 - DNA, 20 bp, Artificial Sequence
  chemically synthesized
tctgggcatattaaactgaa

SEQ ID NO: 517130 - DNA, 20 bp, Artificial Sequence
  chemically synthesized
cattcattttagctgttgca

SEQ ID NO: 517131 - DNA, 20 bp, Artificial Sequence
  chemically synthesized
aattcaatgcaacagctaaa

SEQ ID NO: 517132 - DNA, 20 bp, Artificial Sequence
  chemically synthesized
agagataacactaaaaataa

SEQ ID NO: 517133 - DNA, 20 bp, Artificial Sequence
  chemically synthesized
tgcaggcttcaaggcagcag

SEQ ID NO: 517134 - DNA, 20 bp, Artificial Sequence
  chemically synthesized
gcagaagagttctggcacaa

SEQ ID NO: 517135 - DNA, 20 bp, Artificial Sequence
  chemically synthesized
taattaagtctcattttttt

SEQ ID NO: 517136 - DNA, 20 bp, Artificial Sequence
  chemically synthesized
ccaagatgaaatgactgctg

SEQ ID NO: 517137 - DNA, 20 bp, Artificial Sequence
  chemically synthesized
accatcagagaggcagtgac

SEQ ID NO: 517138 - DNA, 20 bp, Artificial Sequence
  chemically synthesized
catctatctctttaggacca

SEQ ID NO: 517139 - DNA, 20 bp, Artificial Sequence
  chemically synthesized
tagatgcacatcaacttaag

SEQ ID NO: 517140 - DNA, 20 bp, Artificial Sequence
  chemically synthesized
caccactagaacacggggca

SEQ ID NO: 517141 - DNA, 20 bp, Artificial Sequence
  chemically synthesized
agaacacggggcagtgagtc

SEQ ID NO: 517142 - DNA, 20 bp, Artificial Sequence
  chemically synthesized
acggggcagtgagtcaggag

SEQ ID NO: 517143 - DNA, 20 bp, Artificial Sequence
  chemically synthesized
acctaatttatttctgcggc

SEQ ID NO: 517144 - DNA, 20 bp, Artificial Sequence
  chemically synthesized
ttctgactattctgcttcag

SEQ ID NO: 517145 - DNA, 20 bp, Artificial Sequence
  chemically synthesized
acaacgacattccactgaag

SEQ ID NO: 517146 - DNA, 20 bp, Artificial Sequence
  chemically synthesized
cattaaatctttatcaagaa

SEQ ID NO: 517147 - DNA, 20 bp, Artificial Sequence
  chemically synthesized
tttaatgtcatctaatccct

SEQ ID NO: 517148 - DNA, 20 bp, Artificial Sequence
  chemically synthesized
ttgtaatgtccttaactctt

SEQ ID NO: 517149 - DNA, 20 bp, Artificial Sequence
  chemically synthesized
ggacattacaaagattatca

SEQ ID NO: 517150 - DNA, 20 bp, Artificial Sequence
  chemically synthesized
caaagattatcagtgaatca

SEQ ID NO: 517151 - DNA, 20 bp, Artificial Sequence
  chemically synthesized
tcatcaaaaaacaataggtt

SEQ ID NO: 517152 - DNA, 20 bp, Artificial Sequence
  chemically synthesized
tgtgcttccaagatgtattt

SEQ ID NO: 517153 - DNA, 20 bp, Artificial Sequence
  chemically synthesized
ctcccacctcagcctcccag

SEQ ID NO: 517154 - DNA, 20 bp, Artificial Sequence
  chemically synthesized
cccctgggaggctgaggtgg

SEQ ID NO: 517155 - DNA, 20 bp, Artificial Sequence
  chemically synthesized
tgggagggttacctgaggcc

SEQ ID NO: 517156 - DNA, 20 bp, Artificial Sequence
  chemically synthesized
aagagagaccatatctttaa

SEQ ID NO: 517157 - DNA, 20 bp, Artificial Sequence
  chemically synthesized
ctgaatagctgggattacag

SEQ ID NO: 517158 - DNA, 20 bp, Artificial Sequence
  chemically synthesized
aagcaatcctcctgaatagc

SEQ ID NO: 517159 - DNA, 20 bp, Artificial Sequence
  chemically synthesized
ctgtaatcccagctattcag

SEQ ID NO: 517160 - DNA, 20 bp, Artificial Sequence
  chemically synthesized
cctaggttcaagcaatcctc

SEQ ID NO: 517161 - DNA, 20 bp, Artificial Sequence
  chemically synthesized
caggaggattgcttgaacct

SEQ ID NO: 517162 - DNA, 20 bp, Artificial Sequence
  chemically synthesized
ttgaacctaggggttcaagc

SEQ ID NO: 517163 - DNA, 20 bp, Artificial Sequence
  chemically synthesized
atgtgatatttgatgcataa

SEQ ID NO: 517164 - DNA, 20 bp, Artificial Sequence
  chemically synthesized
tgcataaaagaatatatgta

SEQ ID NO: 517165 - DNA, 20 bp, Artificial Sequence
  chemically synthesized
gttgctaatatttcagttat

SEQ ID NO: 517166 - DNA, 20 bp, Artificial Sequence
  chemically synthesized
aggagcacataggttcaggt

SEQ ID NO: 517167 - DNA, 20 bp, Artificial Sequence
  chemically synthesized
aaatggagggaggggtacaa

SEQ ID NO: 517168 - DNA, 20 bp, Artificial Sequence
  chemically synthesized
aatcctgggtaaatggaggg

SEQ ID NO: 517169 - DNA, 20 bp, Artificial Sequence
  chemically synthesized
tacccctccctccatttacc

SEQ ID NO: 517170 - DNA, 20 bp, Artificial Sequence
  chemically synthesized
attctggatggtagttaatc

SEQ ID NO: 517171 - DNA, 20 bp, Artificial Sequence
  chemically synthesized
acccaggattaactaccatc

SEQ ID NO: 517172 - DNA, 20 bp, Artificial Sequence
  chemically synthesized
ttaactaccatccagaatct

SEQ ID NO: 517173 - DNA, 20 bp, Artificial Sequence
  chemically synthesized
gatatgacaatccccagatt

SEQ ID NO: 517174 - DNA, 20 bp, Artificial Sequence
  chemically synthesized
gttcctatgcttgagctttc

SEQ ID NO: 517175 - DNA, 20 bp, Artificial Sequence
  chemically synthesized
tctggagtgttgtctaatac

SEQ ID NO: 517176 - DNA, 20 bp, Artificial Sequence
  chemically synthesized
gcccatgggctccccggctc

SEQ ID NO: 517177 - DNA, 20 bp, Artificial Sequence
  chemically synthesized
atgggctccccggctctgga

SEQ ID NO: 517178 - DNA, 20 bp, Artificial Sequence
  chemically synthesized
ctcactgcaagctccgcctc

SEQ ID NO: 517179 - DNA, 20 bp, Artificial Sequence
  chemically synthesized
tactcgggaggctgaggcag

SEQ ID NO: 517180 - DNA, 20 bp, Artificial Sequence
  chemically synthesized
cattctcctgcctcagcctc

SEQ ID NO: 517181 - DNA, 20 bp, Artificial Sequence
  chemically synthesized
tcttgtatttttagtagaga

SEQ ID NO: 517182 - DNA, 20 bp, Artificial Sequence
  chemically synthesized
cggggtttcaccgtgttagc

SEQ ID NO: 517183 - DNA, 20 bp, Artificial Sequence
  chemically synthesized
actttgggaggccgagatgg

SEQ ID NO: 517184 - DNA, 20 bp, Artificial Sequence
  chemically synthesized
atctcggcctcccaaagtgc

SEQ ID NO: 517185 - DNA, 20 bp, Artificial Sequence
  chemically synthesized
atatgagtgaataggtgtga

SEQ ID NO: 517186 - DNA, 20 bp, Artificial Sequence
  chemically synthesized
tattatatgagtgaataggt

SEQ ID NO: 517187 - DNA, 20 bp, Artificial Sequence
  chemically synthesized
cagccatagttattatatga

SEQ ID NO: 517188 - DNA, 20 bp, Artificial Sequence
  chemically synthesized
aaagcagccatagttattat

SEQ ID NO: 517189 - DNA, 20 bp, Artificial Sequence
  chemically synthesized
aattaactatgatcacatgt

SEQ ID NO: 517190 - DNA, 20 bp, Artificial Sequence
  chemically synthesized
attgtattatggtcatacca

SEQ ID NO: 517191 - DNA, 20 bp, Artificial Sequence
  chemically synthesized
ctattatgaacactgtagct

SEQ ID NO: 517192 - DNA, 20 bp, Artificial Sequence
  chemically synthesized
atttaggaaatcaatttaca

SEQ ID NO: 517193 - DNA, 20 bp, Artificial Sequence
  chemically synthesized
attcagcgcaaaaaggatta

SEQ ID NO: 517194 - DNA, 20 bp, Artificial Sequence
  chemically synthesized
attctttaatcctttttgcg

SEQ ID NO: 517195 - DNA, 20 bp, Artificial Sequence
  chemically synthesized
acttctatattcagcgcaaa

SEQ ID NO: 517196 - DNA, 20 bp, Artificial Sequence
  chemically synthesized
acaaagtcacacaaacatta

SEQ ID NO: 517197 - DNA, 20 bp, Artificial Sequence
  chemically synthesized
attaaagaatatttggaaat

SEQ ID NO: 517198 - DNA, 20 bp, Artificial Sequence
  chemically synthesized
agaatatttggaaataagag

SEQ ID NO: 517199 - DNA, 20 bp, Artificial Sequence
  chemically synthesized
ggttgtctaagggggagaga

SEQ ID NO: 517200 - DNA, 20 bp, Artificial Sequence
  chemically synthesized
tccttagctgttaatggata

SEQ ID NO: 517201 - DNA, 20 bp, Artificial Sequence
  chemically synthesized
tgatccttccttagctgtta

SEQ ID NO: 517202 - DNA, 20 bp, Artificial Sequence
  chemically synthesized
ttatccattaacagctaagg

SEQ ID NO: 517203 - DNA, 20 bp, Artificial Sequence
  chemically synthesized
cctttttcatcctgcctatt

SEQ ID NO: 517204 - DNA, 20 bp, Artificial Sequence
  chemically synthesized
tatggattattcataatagg

SEQ ID NO: 517205 - DNA, 20 bp, Artificial Sequence
  chemically synthesized
aaatcattaaaatgagattt

SEQ ID NO: 517206 - DNA, 20 bp, Artificial Sequence
  chemically synthesized
attaaatgtaaataatccgt

SEQ ID NO: 517207 - DNA, 20 bp, Artificial Sequence
  chemically synthesized
tacctcctatgtccaccccc

SEQ ID NO: 517208 - DNA, 20 bp, Artificial Sequence
  chemically synthesized
tgtgtgtgaaatattaagaa

SEQ ID NO: 517209 - DNA, 20 bp, Artificial Sequence
  chemically synthesized
cttttttttttttctggaga

SEQ ID NO: 517210 - DNA, 20 bp, Artificial Sequence
  chemically synthesized
tttgctcttgttgcccaggc

SEQ ID NO: 517211 - DNA, 20 bp, Artificial Sequence
  chemically synthesized
ctcaccacaacctccgcctc

SEQ ID NO: 517212 - DNA, 20 bp, Artificial Sequence
  chemically synthesized
tactccggagtctgaggcag

SEQ ID NO: 517213 - DNA, 20 bp, Artificial Sequence
  chemically synthesized
gattctcctgcctcagactc

SEQ ID NO: 517214 - DNA, 20 bp, Artificial Sequence
  chemically synthesized
gcctcagactccggagtagc

SEQ ID NO: 517215 - DNA, 20 bp, Artificial Sequence
  chemically synthesized
gcctgtaaccccagctactc

SEQ ID NO: 517216 - DNA, 20 bp, Artificial Sequence
  chemically synthesized
caggcagatcacctgaggtc

SEQ ID NO: 517217 - DNA, 20 bp, Artificial Sequence
  chemically synthesized
gcctcggcctcccaaagtgt

SEQ ID NO: 517218 - DNA, 20 bp, Artificial Sequence
  chemically synthesized
taggatatgcccctttatga

SEQ ID NO: 517219 - DNA, 20 bp, Artificial Sequence
  chemically synthesized
attgttggcttttaaagtaa

SEQ ID NO: 517220 - DNA, 20 bp, Artificial Sequence
  chemically synthesized
catggtgaatgaaaatgaga

SEQ ID NO: 517221 - DNA, 20 bp, Artificial Sequence
  chemically synthesized
ccctctcattttcattcacc

SEQ ID NO: 517222 - DNA, 20 bp, Artificial Sequence
  chemically synthesized
aggagtagtagtaactcatg

SEQ ID NO: 517223 - DNA, 20 bp, Artificial Sequence
  chemically synthesized
ggaaactttgtgaaggtttc

SEQ ID NO: 517224 - DNA, 20 bp, Artificial Sequence
  chemically synthesized
agggaagaggcccatgggct

SEQ ID NO: 517225 - DNA, 20 bp, Artificial Sequence
  chemically synthesized
aaaaaagcagggaggaagaa

SEQ ID NO: 517226 - DNA, 20 bp, Artificial Sequence
  chemically synthesized
gcaagcacatcctcagataa

SEQ ID NO: 517227 - DNA, 20 bp, Artificial Sequence
  chemically synthesized
cttcctttatccagttatct

SEQ ID NO: 517228 - DNA, 20 bp, Artificial Sequence
  chemically synthesized
aggaagataatgtggcacag

SEQ ID NO: 517229 - DNA, 20 bp, Artificial Sequence
  chemically synthesized
aatgtggcacagaggagtct

SEQ ID NO: 517230 - DNA, 20 bp, Artificial Sequence
  chemically synthesized
cataataatctttatgacag

SEQ ID NO: 517231 - DNA, 20 bp, Artificial Sequence
  chemically synthesized
aagtgttctaggtaacattt

SEQ ID NO: 517232 - DNA, 20 bp, Artificial Sequence
  chemically synthesized
tgcctagtcccaatttctgg

SEQ ID NO: 517233 - DNA, 20 bp, Artificial Sequence
  chemically synthesized
tgggataaaactgtatataa

SEQ ID NO: 517234 - DNA, 20 bp, Artificial Sequence
  chemically synthesized
tgagacacttctggctatga

SEQ ID NO: 517235 - DNA, 20 bp, Artificial Sequence
  chemically synthesized
aagtaaatgaaaatcctcaa

SEQ ID NO: 517236 - DNA, 20 bp, Artificial Sequence
  chemically synthesized
attagcatattaactccttt

SEQ ID NO: 517237 - DNA, 20 bp, Artificial Sequence
  chemically synthesized
tgtacatagtcactttataa

SEQ ID NO: 517238 - DNA, 20 bp, Artificial Sequence
  chemically synthesized
ggactctgattgagttaatg

SEQ ID NO: 517239 - DNA, 20 bp, Artificial Sequence
  chemically synthesized
ttatcccacattaactcaat

SEQ ID NO: 517240 - DNA, 20 bp, Artificial Sequence
  chemically synthesized
agtttctaccgggactctga

SEQ ID NO: 517241 - DNA, 20 bp, Artificial Sequence
  chemically synthesized
cagagtcccggtagaaactg

SEQ ID NO: 517242 - DNA, 20 bp, Artificial Sequence
  chemically synthesized
gaggattgatttctcaatct

SEQ ID NO: 517243 - DNA, 20 bp, Artificial Sequence
  chemically synthesized
atgtgaggccagtttgctaa

SEQ ID NO: 517244 - DNA, 20 bp, Artificial Sequence
  chemically synthesized
cagtgttaggaaattcaaga

SEQ ID NO: 517245 - DNA, 20 bp, Artificial Sequence
  chemically synthesized
taactctccgtcatcccttc

SEQ ID NO: 517246 - DNA, 20 bp, Artificial Sequence
  chemically synthesized
aaattcaagaagggatgacg

SEQ ID NO: 517247 - DNA, 20 bp, Artificial Sequence
  chemically synthesized
gagagttaactgtagacctc

SEQ ID NO: 517248 - DNA, 20 bp, Artificial Sequence
  chemically synthesized
agttctctcttgcatttcta

SEQ ID NO: 517249 - DNA, 20 bp, Artificial Sequence
  chemically synthesized
tttattttcatgtggcccca

SEQ ID NO: 517250 - DNA, 20 bp, Artificial Sequence
  chemically synthesized
tacagtggataagaaaaggg

SEQ ID NO: 517251 - DNA, 20 bp, Artificial Sequence
  chemically synthesized
aggagtacagtggataagaa

SEQ ID NO: 517252 - DNA, 20 bp, Artificial Sequence
  chemically synthesized
gctgcagcaggaggagtaca

SEQ ID NO: 517253 - DNA, 20 bp, Artificial Sequence
  chemically synthesized
ttgagacaggctgcagcagg

SEQ ID NO: 517254 - DNA, 20 bp, Artificial Sequence
  chemically synthesized
ctgccctttaggaatggcat

SEQ ID NO: 517255 - DNA, 20 bp, Artificial Sequence
  chemically synthesized
tgtcctggggactgcccttt

SEQ ID NO: 517256 - DNA, 20 bp, Artificial Sequence
  chemically synthesized
ggacacaaagcacagtggta

SEQ ID NO: 517257 - DNA, 20 bp, Artificial Sequence
  chemically synthesized
acagtggtaaagaatgaaaa

SEQ ID NO: 517258 - DNA, 20 bp, Artificial Sequence
  chemically synthesized
atttgaaaggacaagaggga

SEQ ID NO: 517259 - DNA, 20 bp, Artificial Sequence
  chemically synthesized
tttcaagttaatctagtatg

SEQ ID NO: 517260 - DNA, 20 bp, Artificial Sequence
  chemically synthesized
tcctcaggctttggaaacag

SEQ ID NO: 517261 - DNA, 20 bp, Artificial Sequence
  chemically synthesized
cccccctgtttccaaagcct

SEQ ID NO: 517262 - DNA, 20 bp, Artificial Sequence
  chemically synthesized
tgaggataacatactaccta

SEQ ID NO: 517263 - DNA, 20 bp, Artificial Sequence
  chemically synthesized
ctggagcctagacagagaca

SEQ ID NO: 517264 - DNA, 20 bp, Artificial Sequence
  chemically synthesized
agcctagacagagacattgg

SEQ ID NO: 517265 - DNA, 20 bp, Artificial Sequence
  chemically synthesized
cagagacattggatgagtag

SEQ ID NO: 517266 - DNA, 20 bp, Artificial Sequence
  chemically synthesized
tggaggtacacgaggtatac

SEQ ID NO: 517267 - DNA, 20 bp, Artificial Sequence
  chemically synthesized
ggtacacgaggtatacatgg

SEQ ID NO: 517268 - DNA, 20 bp, Artificial Sequence
  chemically synthesized
aggtatacatggatggatgc

SEQ ID NO: 517269 - DNA, 20 bp, Artificial Sequence
  chemically synthesized
atacatggatggatgcatgg

SEQ ID NO: 517270 - DNA, 20 bp, Artificial Sequence
  chemically synthesized
atggatgcatggatggatag

SEQ ID NO: 517271 - DNA, 20 bp, Artificial Sequence
  chemically synthesized
atgcatggatggataggtga

SEQ ID NO: 517272 - DNA, 20 bp, Artificial Sequence
  chemically synthesized
atggatggataggtgaatgg

SEQ ID NO: 517273 - DNA, 20 bp, Artificial Sequence
  chemically synthesized
acaacctgtatctgaacacg

SEQ ID NO: 517274 - DNA, 20 bp, Artificial Sequence
  chemically synthesized
accaatattatatagatttc

SEQ ID NO: 517275 - DNA, 20 bp, Artificial Sequence
  chemically synthesized
tcaaatcgttgatagtcatg

SEQ ID NO: 517276 - DNA, 20 bp, Artificial Sequence
  chemically synthesized
tcatcatgactatcaacgat

SEQ ID NO: 517277 - DNA, 20 bp, Artificial Sequence
  chemically synthesized
actatcaacgatttgaattt

SEQ ID NO: 517278 - DNA, 20 bp, Artificial Sequence
  chemically synthesized
cactacttttttcaggttct

SEQ ID NO: 517279 - DNA, 20 bp, Artificial Sequence
  chemically synthesized
gtgtatccaacgttgaaagc

SEQ ID NO: 517280 - DNA, 20 bp, Artificial Sequence
  chemically synthesized
ttttactctggctttcaacg

SEQ ID NO: 517281 - DNA, 20 bp, Artificial Sequence
  chemically synthesized
aacttttcaaactgagatgc

SEQ ID NO: 517282 - DNA, 20 bp, Artificial Sequence
  chemically synthesized
atatctgcgttctatttcca

SEQ ID NO: 517283 - DNA, 20 bp, Artificial Sequence
  chemically synthesized
cgcattttgctacacattgg

SEQ ID NO: 517284 - DNA, 20 bp, Artificial Sequence
  chemically synthesized
tcataatggtagatcttaaa

SEQ ID NO: 517285 - DNA, 20 bp, Artificial Sequence
  chemically synthesized
atgtaaattaccaagagaac

SEQ ID NO: 517286 - DNA, 20 bp, Artificial Sequence
  chemically synthesized
atattatcagcaaggcatct

SEQ ID NO: 517287 - DNA, 20 bp, Artificial Sequence
  chemically synthesized
ctgataatattatatatgaa

SEQ ID NO: 517288 - DNA, 20 bp, Artificial Sequence
  chemically synthesized
attatatatgaaaagggtta

SEQ ID NO: 517289 - DNA, 20 bp, Artificial Sequence
  chemically synthesized
gaaaagggttatcgaattta

SEQ ID NO: 517290 - DNA, 20 bp, Artificial Sequence
  chemically synthesized
gttatcgaatttatcgggtt

SEQ ID NO: 517291 - DNA, 20 bp, Artificial Sequence
  chemically synthesized
ggggaaataatacttatcaa

SEQ ID NO: 517292 - DNA, 20 bp, Artificial Sequence
  chemically synthesized
gcatattttcccttgcattt

SEQ ID NO: 517293 - DNA, 20 bp, Artificial Sequence
  chemically synthesized
tctaaaagctctacagtcct

SEQ ID NO: 517294 - DNA, 20 bp, Artificial Sequence
  chemically synthesized
acactttcatttatcaggga

SEQ ID NO: 517295 - DNA, 20 bp, Artificial Sequence
  chemically synthesized
gagccttgggaaatgaatag

SEQ ID NO: 517296 - DNA, 20 bp, Artificial Sequence
  chemically synthesized
tgcccaatgagccttgggaa

SEQ ID NO: 517297 - DNA, 20 bp, Artificial Sequence
  chemically synthesized
aaggctcattgggcatcact

SEQ ID NO: 517298 - DNA, 20 bp, Artificial Sequence
  chemically synthesized
actaccaaccccagttactg

SEQ ID NO: 517299 - DNA, 20 bp, Artificial Sequence
  chemically synthesized
ttgcctaattctacagtaac

SEQ ID NO: 517300 - DNA, 20 bp, Artificial Sequence
  chemically synthesized
gtagaattaggcaattatat

SEQ ID NO: 517301 - DNA, 20 bp, Artificial Sequence
  chemically synthesized
taagagtttaaaaaatcagt

SEQ ID NO: 517302 - DNA, 20 bp, Artificial Sequence
  chemically synthesized
atgtttttattttaaactac

SEQ ID NO: 517303 - DNA, 20 bp, Artificial Sequence
  chemically synthesized
ccagaaaacaagcccctatg

SEQ ID NO: 517304 - DNA, 20 bp, Artificial Sequence
  chemically synthesized
tacttgatctatgaactggt

SEQ ID NO: 517305 - DNA, 20 bp, Artificial Sequence
  chemically synthesized
tcaagtaataagacatttcc

SEQ ID NO: 517306 - DNA, 20 bp, Artificial Sequence
  chemically synthesized
ccacaattaagaaaagatga

SEQ ID NO: 517307 - DNA, 20 bp, Artificial Sequence
  chemically synthesized
gaaaagatgatggaatccct

SEQ ID NO: 517308 - DNA, 20 bp, Artificial Sequence
  chemically synthesized
cagtattgtcggatatcctc

SEQ ID NO: 517309 - DNA, 20 bp, Artificial Sequence
  chemically synthesized
ttataatgttgtcagtattg

SEQ ID NO: 517310 - DNA, 20 bp, Artificial Sequence
  chemically synthesized
caaatagaggtctaattata

SEQ ID NO: 517311 - DNA, 20 bp, Artificial Sequence
  chemically synthesized
cattagcaggtatcatatat

SEQ ID NO: 517312 - DNA, 20 bp, Artificial Sequence
  chemically synthesized
aagaagtattagcgaagtga

SEQ ID NO: 517313 - DNA, 20 bp, Artificial Sequence
  chemically synthesized
tatatttagaagattatttg

SEQ ID NO: 517314 - DNA, 20 bp, Artificial Sequence
  chemically synthesized
atatatatatgcaggaagaa

SEQ ID NO: 517315 - DNA, 20 bp, Artificial Sequence
  chemically synthesized
ttttggtcattagtgtttct

SEQ ID NO: 517316 - DNA, 20 bp, Artificial Sequence
  chemically synthesized
gggactaaaaggaaaggaaa

SEQ ID NO: 517317 - DNA, 20 bp, Artificial Sequence
  chemically synthesized
cacatgctttctttacttac

SEQ ID NO: 517318 - DNA, 20 bp, Artificial Sequence
  chemically synthesized
taagtaaagaaagcatgtgt

SEQ ID NO: 517319 - DNA, 20 bp, Artificial Sequence
  chemically synthesized
gagaatatttaacttatatg

SEQ ID NO: 517320 - DNA, 20 bp, Artificial Sequence
  chemically synthesized
ctatttttagatggatatat

SEQ ID NO: 517321 - DNA, 20 bp, Artificial Sequence
  chemically synthesized
gaagtcagtgctatttttag

SEQ ID NO: 517322 - DNA, 20 bp, Artificial Sequence
  chemically synthesized
ttttttatggctattataaa

SEQ ID NO: 517323 - DNA, 20 bp, Artificial Sequence
  chemically synthesized
agccataaaaaataaaagag

SEQ ID NO: 517324 - DNA, 20 bp, Artificial Sequence
  chemically synthesized
tagaaaaactttccatactc

SEQ ID NO: 517325 - DNA, 20 bp, Artificial Sequence
  chemically synthesized
tttccatactcatggattag

SEQ ID NO: 517326 - DNA, 20 bp, Artificial Sequence
  chemically synthesized
gatattgattcttctaatcc

SEQ ID NO: 517327 - DNA, 20 bp, Artificial Sequence
  chemically synthesized
catttaattcgtagattgct

SEQ ID NO: 517328 - DNA, 20 bp, Artificial Sequence
  chemically synthesized
catactacccaaagcaatct

SEQ ID NO: 517329 - DNA, 20 bp, Artificial Sequence
  chemically synthesized
aatgatgttagtggtttgat

SEQ ID NO: 517330 - DNA, 20 bp, Artificial Sequence
  chemically synthesized
gggctcctttttggttctat

SEQ ID NO: 517331 - DNA, 20 bp, Artificial Sequence
  chemically synthesized
ctggctttgttctttttcct

SEQ ID NO: 517332 - DNA, 20 bp, Artificial Sequence
  chemically synthesized
ccttatagtatagtttgaag

SEQ ID NO: 517333 - DNA, 20 bp, Artificial Sequence
  chemically synthesized
atactataaggctacagcaa

SEQ ID NO: 517334 - DNA, 20 bp, Artificial Sequence
  chemically synthesized
taacgtttcagttacataca

SEQ ID NO: 517335 - DNA, 20 bp, Artificial Sequence
  chemically synthesized
ttgtatacttgaaatttgct

SEQ ID NO: 517336 - DNA, 20 bp, Artificial Sequence
  chemically synthesized
caaaataactatgtgaagag

SEQ ID NO: 517337 - DNA, 20 bp, Artificial Sequence
  chemically synthesized
cctatatttaagatgtataa

SEQ ID NO: 517338 - DNA, 20 bp, Artificial Sequence
  chemically synthesized
gcaggtgtgtggctttattt

SEQ ID NO: 517339 - DNA, 20 bp, Artificial Sequence
  chemically synthesized
gccagtccatttattgaaca

SEQ ID NO: 517340 - DNA, 20 bp, Artificial Sequence
  chemically synthesized
gactggctagccatatgtgg

SEQ ID NO: 517341 - DNA, 20 bp, Artificial Sequence
  chemically synthesized
ccatatgtggaagaatgaaa

SEQ ID NO: 517342 - DNA, 20 bp, Artificial Sequence
  chemically synthesized
ttttatacatgtcgaaaatt

SEQ ID NO: 517343 - DNA, 20 bp, Artificial Sequence
  chemically synthesized
catttaaatctttaatcatc

SEQ ID NO: 517344 - DNA, 20 bp, Artificial Sequence
  chemically synthesized
aatgtaagacctcaaactag

SEQ ID NO: 517345 - DNA, 20 bp, Artificial Sequence
  chemically synthesized
agaaacatcattctggacat

SEQ ID NO: 517346 - DNA, 20 bp, Artificial Sequence
  chemically synthesized
gctttcctaaccccaatgtc

SEQ ID NO: 517347 - DNA, 20 bp, Artificial Sequence
  chemically synthesized
gttttgctccaattgctttt

SEQ ID NO: 517348 - DNA, 20 bp, Artificial Sequence
  chemically synthesized
acagcaaaagaaactatcaa

SEQ ID NO: 517349 - DNA, 20 bp, Artificial Sequence
  chemically synthesized
tcacacaaaggttcaatatc

SEQ ID NO: 517350 - DNA, 20 bp, Artificial Sequence
  chemically synthesized
tacaagcatatgaaaaaatg

SEQ ID NO: 517351 - DNA, 20 bp, Artificial Sequence
  chemically synthesized
tcaccagcatttgttgtttt

SEQ ID NO: 517352 - DNA, 20 bp, Artificial Sequence
  chemically synthesized
tggtgaagccgcagagaaaa

SEQ ID NO: 517353 - DNA, 20 bp, Artificial Sequence
  chemically synthesized
aatgcttatacactgttggt

SEQ ID NO: 517354 - DNA, 20 bp, Artificial Sequence
  chemically synthesized
ggcagtttggagatttccca

SEQ ID NO: 517355 - DNA, 20 bp, Artificial Sequence
  chemically synthesized
tcagtaatgggattgctgga

SEQ ID NO: 517356 - DNA, 20 bp, Artificial Sequence
  chemically synthesized
tatattcagtaatgggattg

SEQ ID NO: 517357 - DNA, 20 bp, Artificial Sequence
  chemically synthesized
tcaatccagcaatcccatta

SEQ ID NO: 517358 - DNA, 20 bp, Artificial Sequence
  chemically synthesized
tttggatatatattcagtaa

SEQ ID NO: 517359 - DNA, 20 bp, Artificial Sequence
  chemically synthesized
ttaaaacaattttatttatt

SEQ ID NO: 517360 - DNA, 20 bp, Artificial Sequence
  chemically synthesized
aatagtgctgtgatgaacac

SEQ ID NO: 517361 - DNA, 20 bp, Artificial Sequence
  chemically synthesized
aattccatgtctttgctatt

SEQ ID NO: 517362 - DNA, 20 bp, Artificial Sequence
  chemically synthesized
tattcacaatagcaaagaca

SEQ ID NO: 517363 - DNA, 20 bp, Artificial Sequence
  chemically synthesized
agatacacatcattggtgga

SEQ ID NO: 517364 - DNA, 20 bp, Artificial Sequence
  chemically synthesized
gaaaatctaaatatacccca

SEQ ID NO: 517365 - DNA, 20 bp, Artificial Sequence
  chemically synthesized
tatggctgcatagtattcca

SEQ ID NO: 517366 - DNA, 20 bp, Artificial Sequence
  chemically synthesized
aatactatgcagccataaaa

SEQ ID NO: 517367 - DNA, 20 bp, Artificial Sequence
  chemically synthesized
gatggaggccattatcctag

SEQ ID NO: 517368 - DNA, 20 bp, Artificial Sequence
  chemically synthesized
cgttgctgcatgaattcgcc

SEQ ID NO: 517369 - DNA, 20 bp, Artificial Sequence
  chemically synthesized
atttggcgttccgttgctgc

SEQ ID NO: 517370 - DNA, 20 bp, Artificial Sequence
  chemically synthesized
ttgtaagtgggagctatata

SEQ ID NO: 517371 - DNA, 20 bp, Artificial Sequence
  chemically synthesized
tcgttttcacctttatgtcc

SEQ ID NO: 517372 - DNA, 20 bp, Artificial Sequence
  chemically synthesized
aggtgaaaacgatagacact

SEQ ID NO: 517373 - DNA, 20 bp, Artificial Sequence
  chemically synthesized
ctagaaggggaaggagggag

SEQ ID NO: 517374 - DNA, 20 bp, Artificial Sequence
  chemically synthesized
ggggaaggagggagggggat

SEQ ID NO: 517375 - DNA, 20 bp, Artificial Sequence
  chemically synthesized
aagggttgaaaaactgacta

SEQ ID NO: 517376 - DNA, 20 bp, Artificial Sequence
  chemically synthesized
ttgggtactatactcagtac

SEQ ID NO: 517377 - DNA, 20 bp, Artificial Sequence
  chemically synthesized
atgatcctgtcacccaggta

SEQ ID NO: 517378 - DNA, 20 bp, Artificial Sequence
  chemically synthesized
tatactcagtacctgggtga

SEQ ID NO: 517379 - DNA, 20 bp, Artificial Sequence
  chemically synthesized
gaattccaggggtttggggt

SEQ ID NO: 517380 - DNA, 20 bp, Artificial Sequence
  chemically synthesized
tcattcgtaccccaaacccc

SEQ ID NO: 517381 - DNA, 20 bp, Artificial Sequence
  chemically synthesized
gcaagtgaattccaggggtt

SEQ ID NO: 517382 - DNA, 20 bp, Artificial Sequence
  chemically synthesized
ggagcatgcaagtgaattcc

SEQ ID NO: 517383 - DNA, 20 bp, Artificial Sequence
  chemically synthesized
ttatgggagggagcatgcaa

SEQ ID NO: 517384 - DNA, 20 bp, Artificial Sequence
  chemically synthesized
cttgcatgctccctcccata

SEQ ID NO: 517385 - DNA, 20 bp, Artificial Sequence
  chemically synthesized
gtaaatgaggcaaccctgtc

SEQ ID NO: 517386 - DNA, 20 bp, Artificial Sequence
  chemically synthesized
ccccttcccgggactcgtga

SEQ ID NO: 517387 - DNA, 20 bp, Artificial Sequence
  chemically synthesized
ccctgtcacgagtcccggga

SEQ ID NO: 517388 - DNA, 20 bp, Artificial Sequence
  chemically synthesized
ttggaaggaccttttaaaaa

SEQ ID NO: 517389 - DNA, 20 bp, Artificial Sequence
  chemically synthesized
acctgcagagtaggaaagaa

SEQ ID NO: 517390 - DNA, 20 bp, Artificial Sequence
  chemically synthesized
ttttattttctgataacctg

SEQ ID NO: 517391 - DNA, 20 bp, Artificial Sequence
  chemically synthesized
gtcttaactaatcacattgc

SEQ ID NO: 517392 - DNA, 20 bp, Artificial Sequence
  chemically synthesized
agttaagacattattaaagt

SEQ ID NO: 517393 - DNA, 20 bp, Artificial Sequence
  chemically synthesized
cttctcaaaaggtaagagaa

SEQ ID NO: 517394 - DNA, 20 bp, Artificial Sequence
  chemically synthesized
actcccttctcaaaaggtaa

SEQ ID NO: 517395 - DNA, 20 bp, Artificial Sequence
  chemically synthesized
attctcttaccttttgagaa

SEQ ID NO: 517396 - DNA, 20 bp, Artificial Sequence
  chemically synthesized
gataaagactcaatagactt

SEQ ID NO: 517397 - DNA, 20 bp, Artificial Sequence
  chemically synthesized
ataggaaattcctaagtcta

SEQ ID NO: 517398 - DNA, 20 bp, Artificial Sequence
  chemically synthesized
ggaatttcctatgtcgttat

SEQ ID NO: 517399 - DNA, 20 bp, Artificial Sequence
  chemically synthesized
tatttgaatttgagagatta

SEQ ID NO: 517400 - DNA, 20 bp, Artificial Sequence
  chemically synthesized
gagccactgctccagccaaa

SEQ ID NO: 517401 - DNA, 20 bp, Artificial Sequence
  chemically synthesized
gcctcggcctcccaaattgc

SEQ ID NO: 517402 - DNA, 20 bp, Artificial Sequence
  chemically synthesized
cagcaatttgggaggccgag

SEQ ID NO: 517403 - DNA, 20 bp, Artificial Sequence
  chemically synthesized
aatttgggaggccgaggcgg

SEQ ID NO: 517404 - DNA, 20 bp, Artificial Sequence
  chemically synthesized
cgggtggatcacctgaggtc

SEQ ID NO: 517405 - DNA, 20 bp, Artificial Sequence
  chemically synthesized
ttttgtatttttagtagaga

SEQ ID NO: 517406 - DNA, 20 bp, Artificial Sequence
  chemically synthesized
gcctcagcctcccaactagc

SEQ ID NO: 517407 - DNA, 20 bp, Artificial Sequence
  chemically synthesized
tagttgggaggctgaggcag

SEQ ID NO: 517408 - DNA, 20 bp, Artificial Sequence
  chemically synthesized
ctcactgcagcctctgcctc

SEQ ID NO: 517409 - DNA, 20 bp, Artificial Sequence
  chemically synthesized
tggcaccactgcactccagc

SEQ ID NO: 517410 - DNA, 20 bp, Artificial Sequence
  chemically synthesized
tctcactctgtcacccaggc

SEQ ID NO: 517411 - DNA, 20 bp, Artificial Sequence
  chemically synthesized
ctgcactccagcctgggtga

SEQ ID NO: 517412 - DNA, 20 bp, Artificial Sequence
  chemically synthesized
tctttttttgttttttgaga

SEQ ID NO: 517413 - DNA, 20 bp, Artificial Sequence
  chemically synthesized
aacaaaaaaagaaaaaaaaa

SEQ ID NO: 517414 - DNA, 20 bp, Artificial Sequence
  chemically synthesized
aaaagagaatccattttaac

SEQ ID NO: 517415 - DNA, 20 bp, Artificial Sequence
  chemically synthesized
atttcaagattcaagttaaa

SEQ ID NO: 517416 - DNA, 20 bp, Artificial Sequence
  chemically synthesized
accataaatatatttcattg

SEQ ID NO: 517417 - DNA, 20 bp, Artificial Sequence
  chemically synthesized
gtttatatgttttcaatttt

SEQ ID NO: 517418 - DNA, 20 bp, Artificial Sequence
  chemically synthesized
tcatagttagagaacacaga

SEQ ID NO: 517419 - DNA, 20 bp, Artificial Sequence
  chemically synthesized
agtctacttttaattttatg

SEQ ID NO: 517420 - DNA, 20 bp, Artificial Sequence
  chemically synthesized
aaaattaaaagtagacttta

SEQ ID NO: 517421 - DNA, 20 bp, Artificial Sequence
  chemically synthesized
atgtttcttcacttctccta

SEQ ID NO: 517422 - DNA, 20 bp, Artificial Sequence
  chemically synthesized
aacccttcacatgataaaat

SEQ ID NO: 517423 - DNA, 20 bp, Artificial Sequence
  chemically synthesized
aatccccattttatcatgtg

SEQ ID NO: 517424 - DNA, 20 bp, Artificial Sequence
  chemically synthesized
tagttaatagaacaaataca

SEQ ID NO: 517425 - DNA, 20 bp, Artificial Sequence
  chemically synthesized
catgaaaaaatgagaaaatc

SEQ ID NO: 517426 - DNA, 20 bp, Artificial Sequence
  chemically synthesized
tttgtcacgcattagaaaaa

SEQ ID NO: 517427 - DNA, 20 bp, Artificial Sequence
  chemically synthesized
cactcctcagaggcagatat

SEQ ID NO: 517428 - DNA, 20 bp, Artificial Sequence
  chemically synthesized
gactcaaatatctgcctctg

SEQ ID NO: 517429 - DNA, 20 bp, Artificial Sequence
  chemically synthesized
tgaggagtgagaaatgagag

SEQ ID NO: 517430 - DNA, 20 bp, Artificial Sequence
  chemically synthesized
acttatgaagtaaaaattac

SEQ ID NO: 517431 - DNA, 20 bp, Artificial Sequence
  chemically synthesized
attaatgaatataaatttgt

SEQ ID NO: 517432 - DNA, 20 bp, Artificial Sequence
  chemically synthesized
aaagtgtacaatgcttatta

SEQ ID NO: 517433 - DNA, 20 bp, Artificial Sequence
  chemically synthesized
agtctctcattttttcttat

SEQ ID NO: 517434 - DNA, 20 bp, Artificial Sequence
  chemically synthesized
tgagagacttaaaattaggt

SEQ ID NO: 517435 - DNA, 20 bp, Artificial Sequence
  chemically synthesized
aatatatatgcatatataag

SEQ ID NO: 517436 - DNA, 20 bp, Artificial Sequence
  chemically synthesized
ttattttttcatgtatgtat

SEQ ID NO: 517437 - DNA, 20 bp, Artificial Sequence
  chemically synthesized
tttttagtagcctcctactg

SEQ ID NO: 517438 - DNA, 20 bp, Artificial Sequence
  chemically synthesized
cttacatctatgtgcaaaga

SEQ ID NO: 517439 - DNA, 20 bp, Artificial Sequence
  chemically synthesized
tgtatgcttctgacagaaga

SEQ ID NO: 517440 - DNA, 20 bp, Artificial Sequence
  chemically synthesized
gaacattttttcatatacct

SEQ ID NO: 517441 - DNA, 20 bp, Artificial Sequence
  chemically synthesized
tttctttttgtccaaatata

SEQ ID NO: 517442 - DNA, 20 bp, Artificial Sequence
  chemically synthesized
aattaatgtgtatgatatat

SEQ ID NO: 517443 - DNA, 20 bp, Artificial Sequence
  chemically synthesized
ggtgagggggttggagtgga

SEQ ID NO: 517444 - DNA, 20 bp, Artificial Sequence
  chemically synthesized
gtagggtgagggggttggag

SEQ ID NO: 517445 - DNA, 20 bp, Artificial Sequence
  chemically synthesized
acttagtagggtgagggggt

SEQ ID NO: 517446 - DNA, 20 bp, Artificial Sequence
  chemically synthesized
atggaaacttagtagggtga

SEQ ID NO: 517447 - DNA, 20 bp, Artificial Sequence
  chemically synthesized
gatagacaatggaaacttag

SEQ ID NO: 517448 - DNA, 20 bp, Artificial Sequence
  chemically synthesized
gtacacatgtacacagagag

SEQ ID NO: 517449 - DNA, 20 bp, Artificial Sequence
  chemically synthesized
aatgtgtacacatgtacaca

SEQ ID NO: 517450 - DNA, 20 bp, Artificial Sequence
  chemically synthesized
acattttttagcacacaatt

SEQ ID NO: 517451 - DNA, 20 bp, Artificial Sequence
  chemically synthesized
taggcaatgcatttattttt

SEQ ID NO: 517452 - DNA, 20 bp, Artificial Sequence
  chemically synthesized
taaaaaccagtaaactgaaa

SEQ ID NO: 517453 - DNA, 20 bp, Artificial Sequence
  chemically synthesized
tgtgttttccattttaaatt

SEQ ID NO: 517454 - DNA, 20 bp, Artificial Sequence
  chemically synthesized
aagaacaggaagaacgatag

SEQ ID NO: 517455 - DNA, 20 bp, Artificial Sequence
  chemically synthesized
cttcttaagcttaattatga

SEQ ID NO: 517456 - DNA, 20 bp, Artificial Sequence
  chemically synthesized
accctgctttacacaatgca

SEQ ID NO: 517457 - DNA, 20 bp, Artificial Sequence
  chemically synthesized
attcactgcattgtgtaaag

SEQ ID NO: 517458 - DNA, 20 bp, Artificial Sequence
  chemically synthesized
aaaaatggaatttcaaatca

SEQ ID NO: 517459 - DNA, 20 bp, Artificial Sequence
  chemically synthesized
tcaagtgtatataataaaaa

SEQ ID NO: 517460 - DNA, 20 bp, Artificial Sequence
  chemically synthesized
atatacacttgagcatattt

SEQ ID NO: 517461 - DNA, 20 bp, Artificial Sequence
  chemically synthesized
attttttttttttttttata

SEQ ID NO: 517462 - DNA, 20 bp, Artificial Sequence
  chemically synthesized
tcttgctctgttgcccaggc

SEQ ID NO: 517463 - DNA, 20 bp, Artificial Sequence
  chemically synthesized
tcactgcaacctctgcctcc

SEQ ID NO: 517464 - DNA, 20 bp, Artificial Sequence
  chemically synthesized
tactcgggaggctgcggcag

SEQ ID NO: 517465 - DNA, 20 bp, Artificial Sequence
  chemically synthesized
gattctcctgccgcagcctc

SEQ ID NO: 517466 - DNA, 20 bp, Artificial Sequence
  chemically synthesized
gccgcagcctcccgagtagc

SEQ ID NO: 517467 - DNA, 20 bp, Artificial Sequence
  chemically synthesized
tttgtatttttaagtagagg

SEQ ID NO: 517468 - DNA, 20 bp, Artificial Sequence
  chemically synthesized
cgggtggatcacctgaggtc

SEQ ID NO: 517469 - DNA, 20 bp, Artificial Sequence
  chemically synthesized
actttgcgaggccgaggcgg

SEQ ID NO: 517470 - DNA, 20 bp, Artificial Sequence
  chemically synthesized
cagcactttgcgaggccgag

SEQ ID NO: 517471 - DNA, 20 bp, Artificial Sequence
  chemically synthesized
gcctcggcctcgcaaagtgc

SEQ ID NO: 517472 - DNA, 20 bp, Artificial Sequence
  chemically synthesized
tttaataaaacttctactgg

SEQ ID NO: 517473 - DNA, 20 bp, Artificial Sequence
  chemically synthesized
tcatttgcccatgtagctat

SEQ ID NO: 517474 - DNA, 20 bp, Artificial Sequence
  chemically synthesized
tatctggcagcaatatagat

SEQ ID NO: 517475 - DNA, 20 bp, Artificial Sequence
  chemically synthesized
tattgctgccagataaactt

SEQ ID NO: 517476 - DNA, 20 bp, Artificial Sequence
  chemically synthesized
aggaagacattggatgtgac

SEQ ID NO: 517477 - DNA, 20 bp, Artificial Sequence
  chemically synthesized
attggggtggcaggaagaca

SEQ ID NO: 517478 - DNA, 20 bp, Artificial Sequence
  chemically synthesized
gaaacacataaaatttaaat

SEQ ID NO: 517479 - DNA, 20 bp, Artificial Sequence
  chemically synthesized
ataattttatatttcttggt

SEQ ID NO: 517480 - DNA, 20 bp, Artificial Sequence
  chemically synthesized
atataaaattatatctgtcc

SEQ ID NO: 517481 - DNA, 20 bp, Artificial Sequence
  chemically synthesized
agcctttactggaaaaataa

SEQ ID NO: 517482 - DNA, 20 bp, Artificial Sequence
  chemically synthesized
gttcaaaatgtgaaattact

SEQ ID NO: 517483 - DNA, 20 bp, Artificial Sequence
  chemically synthesized
tgacaatatcatctattaat

SEQ ID NO: 517484 - DNA, 20 bp, Artificial Sequence
  chemically synthesized
acttggcttctttcactgac

SEQ ID NO: 517485 - DNA, 20 bp, Artificial Sequence
  chemically synthesized
attaaaattagaaatataac

SEQ ID NO: 517486 - DNA, 20 bp, Artificial Sequence
  chemically synthesized
gttatatttctaattttaat

SEQ ID NO: 517487 - DNA, 20 bp, Artificial Sequence
  chemically synthesized
caatatttcaacattgatca

SEQ ID NO: 517488 - DNA, 20 bp, Artificial Sequence
  chemically synthesized
aacaaaacttttagcaatgt

SEQ ID NO: 517489 - DNA, 20 bp, Artificial Sequence
  chemically synthesized
aaagaatctgtccctaattt

SEQ ID NO: 517490 - DNA, 20 bp, Artificial Sequence
  chemically synthesized
aaaaagtattgataaatgaa

SEQ ID NO: 517491 - DNA, 20 bp, Artificial Sequence
  chemically synthesized
tctgatctttacctacaatg

SEQ ID NO: 517492 - DNA, 20 bp, Artificial Sequence
  chemically synthesized
aacatatatgcctactataa

SEQ ID NO: 517493 - DNA, 20 bp, Artificial Sequence
  chemically synthesized
gaagaagttatcatgccaaa

SEQ ID NO: 517494 - DNA, 20 bp, Artificial Sequence
  chemically synthesized
gaaaactatcaaccaatctc

SEQ ID NO: 517495 - DNA, 20 bp, Artificial Sequence
  chemically synthesized
taaatactattttcatggtt

SEQ ID NO: 517496 - DNA, 20 bp, Artificial Sequence
  chemically synthesized
atgctttcaaacaactaagt

SEQ ID NO: 517497 - DNA, 20 bp, Artificial Sequence
  chemically synthesized
tgctttttaaaggtttctta

SEQ ID NO: 517498 - DNA, 20 bp, Artificial Sequence
  chemically synthesized
aaaatacacatgaaaacttc

SEQ ID NO: 517499 - DNA, 20 bp, Artificial Sequence
  chemically synthesized
agtaggccatttaaaaatta

SEQ ID NO: 517500 - DNA, 20 bp, Artificial Sequence
  chemically synthesized
tggtgctgcttaatgaaaaa

SEQ ID NO: 517501 - DNA, 20 bp, Artificial Sequence
  chemically synthesized
aaaacactcagagtagacaa

SEQ ID NO: 517502 - DNA, 20 bp, Artificial Sequence
  chemically synthesized
ctaacatcctgttgtctact

SEQ ID NO: 517503 - DNA, 20 bp, Artificial Sequence
  chemically synthesized
cagatatacagaaaaacact

SEQ ID NO: 517504 - DNA, 20 bp, Artificial Sequence
  chemically synthesized
gataatacaggaatcggaca

SEQ ID NO: 517505 - DNA, 20 bp, Artificial Sequence
  chemically synthesized
atataatttttagataatac

SEQ ID NO: 517506 - DNA, 20 bp, Artificial Sequence
  chemically synthesized
atgtttgcaacaacacatca

SEQ ID NO: 517507 - DNA, 20 bp, Artificial Sequence
  chemically synthesized
tttttttcttgttcatatgg

SEQ ID NO: 517508 - DNA, 20 bp, Artificial Sequence
  chemically synthesized
ttcatatggctggattttct

SEQ ID NO: 517509 - DNA, 20 bp, Artificial Sequence
  chemically synthesized
gctgatatttagaacatcac

SEQ ID NO: 517510 - DNA, 20 bp, Artificial Sequence
  chemically synthesized
cagaggaccattgagcttgt

SEQ ID NO: 517511 - DNA, 20 bp, Artificial Sequence
  chemically synthesized
gcttgttagaatatttggga

SEQ ID NO: 517512 - DNA, 20 bp, Artificial Sequence
  chemically synthesized
ctagtgttttttagagatac

SEQ ID NO: 517513 - DNA, 20 bp, Artificial Sequence
  chemically synthesized
tacagtggtttccctgcatg

SEQ ID NO: 517514 - DNA, 20 bp, Artificial Sequence
  chemically synthesized
atacaccaatacttatgagg

SEQ ID NO: 517515 - DNA, 20 bp, Artificial Sequence
  chemically synthesized
acttgcttaaggaaaactgg

SEQ ID NO: 517516 - DNA, 20 bp, Artificial Sequence
  chemically synthesized
taaaacttgcttaaggaaaa

SEQ ID NO: 517517 - DNA, 20 bp, Artificial Sequence
  chemically synthesized
tctggccttcagcctaactc

SEQ ID NO: 517518 - DNA, 20 bp, Artificial Sequence
  chemically synthesized
agattttatttttttaattc

SEQ ID NO: 517519 - DNA, 20 bp, Artificial Sequence
  chemically synthesized
aataaaagtaaggagaaaaa

SEQ ID NO: 517520 - DNA, 20 bp, Artificial Sequence
  chemically synthesized
tgagaacaagtaaatgcaat

SEQ ID NO: 517521 - DNA, 20 bp, Artificial Sequence
  chemically synthesized
taattgcatttacttgttct

SEQ ID NO: 517522 - DNA, 20 bp, Artificial Sequence
  chemically synthesized
aaaatgaaaatagtttgtac

SEQ ID NO: 517523 - DNA, 20 bp, Artificial Sequence
  chemically synthesized
agtttgtacacgagttgcca

SEQ ID NO: 517524 - DNA, 20 bp, Artificial Sequence
  chemically synthesized
agaccatctttgtcctgaca

SEQ ID NO: 517525 - DNA, 20 bp, Artificial Sequence
  chemically synthesized
agccataaagctgttcattg

SEQ ID NO: 517526 - DNA, 20 bp, Artificial Sequence
  chemically synthesized
tgggtaaaatgtttcattgt

SEQ ID NO: 517527 - DNA, 20 bp, Artificial Sequence
  chemically synthesized
tgagaatcctcattagaggc

SEQ ID NO: 517528 - DNA, 20 bp, Artificial Sequence
  chemically synthesized
attttacccaggcctctaat

SEQ ID NO: 517529 - DNA, 20 bp, Artificial Sequence
  chemically synthesized
ctctgctcctccccttaact

SEQ ID NO: 517530 - DNA, 20 bp, Artificial Sequence
  chemically synthesized
tcagttaaggggaggagcag

SEQ ID NO: 517531 - DNA, 20 bp, Artificial Sequence
  chemically synthesized
atgcataaacacatgggagg

SEQ ID NO: 517532 - DNA, 20 bp, Artificial Sequence
  chemically synthesized
ctaaaacatcttcctggaag

SEQ ID NO: 517533 - DNA, 20 bp, Artificial Sequence
  chemically synthesized
tgttgtacctcaaatagctt

SEQ ID NO: 517534 - DNA, 20 bp, Artificial Sequence
  chemically synthesized
taaacttatctgttataaaa

SEQ ID NO: 517535 - DNA, 20 bp, Artificial Sequence
  chemically synthesized
tgactttgtacaaccagctt

SEQ ID NO: 517536 - DNA, 20 bp, Artificial Sequence
  chemically synthesized
ctctcactgtcaattttgag

SEQ ID NO: 517537 - DNA, 20 bp, Artificial Sequence
  chemically synthesized
tgtttctctcactgtcaatt

SEQ ID NO: 517538 - DNA, 20 bp, Artificial Sequence
  chemically synthesized
gtttctttcccaaggccaag

SEQ ID NO: 517539 - DNA, 20 bp, Artificial Sequence
  chemically synthesized
cttcttattaacagagggta

SEQ ID NO: 517540 - DNA, 20 bp, Artificial Sequence
  chemically synthesized
tctctcacttcttattaaca

SEQ ID NO: 517541 - DNA, 20 bp, Artificial Sequence
  chemically synthesized
gtgagagagctgcctcctct

SEQ ID NO: 517542 - DNA, 20 bp, Artificial Sequence
  chemically synthesized
atcaggttctttagacaatg

SEQ ID NO: 517543 - DNA, 20 bp, Artificial Sequence
  chemically synthesized
ggcatccagagaacagggtg

SEQ ID NO: 517544 - DNA, 20 bp, Artificial Sequence
  chemically synthesized
tttactcatcaccctgttct

SEQ ID NO: 517545 - DNA, 20 bp, Artificial Sequence
  chemically synthesized
cttacatggcatccagagaa

SEQ ID NO: 517546 - DNA, 20 bp, Artificial Sequence
  chemically synthesized
tccattctctgtagtttcac

SEQ ID NO: 517547 - DNA, 20 bp, Artificial Sequence
  chemically synthesized
cagattcttgtgaaactaca

SEQ ID NO: 517548 - DNA, 20 bp, Artificial Sequence
  chemically synthesized
ttcttgtgaaactacagaga

SEQ ID NO: 517549 - DNA, 20 bp, Artificial Sequence
  chemically synthesized
acattatgaaagagaggtat

SEQ ID NO: 517550 - DNA, 20 bp, Artificial Sequence
  chemically synthesized
cagatttcctgctcacttaa

SEQ ID NO: 517551 - DNA, 20 bp, Artificial Sequence
  chemically synthesized
aattaagtgagcaggaaatc

SEQ ID NO: 517552 - DNA, 20 bp, Artificial Sequence
  chemically synthesized
caattaagcaggtagaaaga

SEQ ID NO: 517553 - DNA, 20 bp, Artificial Sequence
  chemically synthesized
cctaccttagactaggcata

SEQ ID NO: 517554 - DNA, 20 bp, Artificial Sequence
  chemically synthesized
cttagcttctcttgcttctc

SEQ ID NO: 517555 - DNA, 20 bp, Artificial Sequence
  chemically synthesized
ttcataatatttagttgata

SEQ ID NO: 517556 - DNA, 20 bp, Artificial Sequence
  chemically synthesized
aaatattttaaagagatgtt

SEQ ID NO: 517557 - DNA, 20 bp, Artificial Sequence
  chemically synthesized
ttaagtatttctatagtgcc

SEQ ID NO: 517558 - DNA, 20 bp, Artificial Sequence
  chemically synthesized
gtttcatagcaagacaatag

SEQ ID NO: 517559 - DNA, 20 bp, Artificial Sequence
  chemically synthesized
gcttgccagtttttttcagt

SEQ ID NO: 517560 - DNA, 20 bp, Artificial Sequence
  chemically synthesized
caagcttgcctaaaagtgag

SEQ ID NO: 517561 - DNA, 20 bp, Artificial Sequence
  chemically synthesized
aggaaaagaacagaatgtcc

SEQ ID NO: 517562 - DNA, 20 bp, Artificial Sequence
  chemically synthesized
tttatgtgtaaggaaaagaa

SEQ ID NO: 517563 - DNA, 20 bp, Artificial Sequence
  chemically synthesized
aacacaatggtggcatgata

SEQ ID NO: 517564 - DNA, 20 bp, Artificial Sequence
  chemically synthesized
taaatgggacaggcaacact

SEQ ID NO: 517565 - DNA, 20 bp, Artificial Sequence
  chemically synthesized
ttttaatctgaagaaatcct

SEQ ID NO: 517566 - DNA, 20 bp, Artificial Sequence
  chemically synthesized
accattgtgtttcccatccc

SEQ ID NO: 517567 - DNA, 20 bp, Artificial Sequence
  chemically synthesized
ggatgggaaacacaatggta

SEQ ID NO: 517568 - DNA, 20 bp, Artificial Sequence
  chemically synthesized
aaacacaatggtaaagaatg

SEQ ID NO: 517569 - DNA, 20 bp, Artificial Sequence
  chemically synthesized
aaattcatccaaagcttgtt

SEQ ID NO: 517570 - DNA, 20 bp, Artificial Sequence
  chemically synthesized
caatgtattcttaacaagct

SEQ ID NO: 517571 - DNA, 20 bp, Artificial Sequence
  chemically synthesized
gtattcttaacaagctttgg

SEQ ID NO: 517572 - DNA, 20 bp, Artificial Sequence
  chemically synthesized
caatcaaaaactcatccttt

SEQ ID NO: 517573 - DNA, 20 bp, Artificial Sequence
  chemically synthesized
cagggacatattcagaaagg

SEQ ID NO: 517574 - DNA, 20 bp, Artificial Sequence
  chemically synthesized
ctttcagggacatattcaga

SEQ ID NO: 517575 - DNA, 20 bp, Artificial Sequence
  chemically synthesized
atgttctgggctccatatga

SEQ ID NO: 517576 - DNA, 20 bp, Artificial Sequence
  chemically synthesized
ggagcccagaacatctcttt

SEQ ID NO: 517577 - DNA, 20 bp, Artificial Sequence
  chemically synthesized
tttgcctctgcacctttaca

SEQ ID NO: 517578 - DNA, 20 bp, Artificial Sequence
  chemically synthesized
ggcaaaaaaaaaaaaaaaaa

SEQ ID NO: 517579 - DNA, 20 bp, Artificial Sequence
  chemically synthesized
gtattgctagtagaacggtg

SEQ ID NO: 517580 - DNA, 20 bp, Artificial Sequence
  chemically synthesized
gaaaccagtatcctatactt

SEQ ID NO: 517581 - DNA, 20 bp, Artificial Sequence
  chemically synthesized
tgaaatctaacccccaagta

SEQ ID NO: 517582 - DNA, 20 bp, Artificial Sequence
  chemically synthesized
acagtagttgtggcaaccta

SEQ ID NO: 517583 - DNA, 20 bp, Artificial Sequence
  chemically synthesized
tggcaacctatgggattaag

SEQ ID NO: 517584 - DNA, 20 bp, Artificial Sequence
  chemically synthesized
gtaacagcaatgacaacatc

SEQ ID NO: 517585 - DNA, 20 bp, Artificial Sequence
  chemically synthesized
aaaatgatacttatttctat

SEQ ID NO: 517586 - DNA, 20 bp, Artificial Sequence
  chemically synthesized
attttatcatcattttacag

SEQ ID NO: 517587 - DNA, 20 bp, Artificial Sequence
  chemically synthesized
gaggtagtaagtagcaaagc

SEQ ID NO: 517588 - DNA, 20 bp, Artificial Sequence
  chemically synthesized
aaaggcacactggtttctgt

SEQ ID NO: 517589 - DNA, 20 bp, Artificial Sequence
  chemically synthesized
gagtgatctccctaagcata

SEQ ID NO: 517590 - DNA, 20 bp, Artificial Sequence
  chemically synthesized
ctccccctgcaatgtgccaa

SEQ ID NO: 517591 - DNA, 20 bp, Artificial Sequence
  chemically synthesized
tcacacaatatatggccgtg

SEQ ID NO: 517592 - DNA, 20 bp, Artificial Sequence
  chemically synthesized
ccttctctgctatggtgttc

SEQ ID NO: 517593 - DNA, 20 bp, Artificial Sequence
  chemically synthesized
tacaggttagaacatagact

SEQ ID NO: 517594 - DNA, 20 bp, Artificial Sequence
  chemically synthesized
ggccaattaatttaaacact

SEQ ID NO: 517595 - DNA, 20 bp, Artificial Sequence
  chemically synthesized
aattaattggccttaccctt

SEQ ID NO: 517596 - DNA, 20 bp, Artificial Sequence
  chemically synthesized
tgcagtgtatgaagattcag

SEQ ID NO: 517597 - DNA, 20 bp, Artificial Sequence
  chemically synthesized
acactgcactttctacccat

SEQ ID NO: 517598 - DNA, 20 bp, Artificial Sequence
  chemically synthesized
aataggaataagtaattctg

SEQ ID NO: 517599 - DNA, 20 bp, Artificial Sequence
  chemically synthesized
aatgactgatcttaggaaat

SEQ ID NO: 517600 - DNA, 20 bp, Artificial Sequence
  chemically synthesized
agaagaaagttcattttttc

SEQ ID NO: 517601 - DNA, 20 bp, Artificial Sequence
  chemically synthesized
aaatgaactttcttcttttt

SEQ ID NO: 517602 - DNA, 20 bp, Artificial Sequence
  chemically synthesized
cctacctgtctccggtcctt

SEQ ID NO: 517603 - DNA, 20 bp, Artificial Sequence
  chemically synthesized
gaataagtgaaagtgcacaa

SEQ ID NO: 517604 - DNA, 20 bp, Artificial Sequence
  chemically synthesized
tataaatgattactgaatga

SEQ ID NO: 517605 - DNA, 20 bp, Artificial Sequence
  chemically synthesized
actctataaatgattactga

SEQ ID NO: 517606 - DNA, 20 bp, Artificial Sequence
  chemically synthesized
aaagactctataaatgatta

SEQ ID NO: 517607 - DNA, 20 bp, Artificial Sequence
  chemically synthesized
attcattcagtaatcattta

SEQ ID NO: 517608 - DNA, 20 bp, Artificial Sequence
  chemically synthesized
tgtgctataagctaggtccc

SEQ ID NO: 517609 - DNA, 20 bp, Artificial Sequence
  chemically synthesized
aggtcccgggagtaaaaggc

SEQ ID NO: 517610 - DNA, 20 bp, Artificial Sequence
  chemically synthesized
attaagttttcttttgtcca

SEQ ID NO: 517611 - DNA, 20 bp, Artificial Sequence
  chemically synthesized
caaccaaccaagtaccacct

SEQ ID NO: 517612 - DNA, 20 bp, Artificial Sequence
  chemically synthesized
taggaattcttcatcgcaga

SEQ ID NO: 517613 - DNA, 20 bp, Artificial Sequence
  chemically synthesized
ggctcattccttctgcgatg

SEQ ID NO: 517614 - DNA, 20 bp, Artificial Sequence
  chemically synthesized
gctgaatattgcgacaatat

SEQ ID NO: 517615 - DNA, 20 bp, Artificial Sequence
  chemically synthesized
tttaccccatggcttgtcag

SEQ ID NO: 517616 - DNA, 20 bp, Artificial Sequence
  chemically synthesized
aatattcagctgacaagcca

SEQ ID NO: 517617 - DNA, 20 bp, Artificial Sequence
  chemically synthesized
tattccatcagaaaaaatgg

SEQ ID NO: 517618 - DNA, 20 bp, Artificial Sequence
  chemically synthesized
taccccaccattttttctga

SEQ ID NO: 517619 - DNA, 20 bp, Artificial Sequence
  chemically synthesized
attttttctgatggaataca

SEQ ID NO: 517620 - DNA, 20 bp, Artificial Sequence
  chemically synthesized
aataactgtcaaatataaag

SEQ ID NO: 517621 - DNA, 20 bp, Artificial Sequence
  chemically synthesized
tagaaaagcttttgctcgga

SEQ ID NO: 517622 - DNA, 20 bp, Artificial Sequence
  chemically synthesized
tttgaagaaaacaagtgtgc

SEQ ID NO: 517623 - DNA, 20 bp, Artificial Sequence
  chemically synthesized
gaacaccctaggaataacaa

SEQ ID NO: 517624 - DNA, 20 bp, Artificial Sequence
  chemically synthesized
tatgattcatttgttattcc

SEQ ID NO: 517625 - DNA, 20 bp, Artificial Sequence
  chemically synthesized
aacctgctgcagaacaccct

SEQ ID NO: 517626 - DNA, 20 bp, Artificial Sequence
  chemically synthesized
tattgaacaaagaaaacccc

SEQ ID NO: 517627 - DNA, 20 bp, Artificial Sequence
  chemically synthesized
atagaatatgtcagaattcc

SEQ ID NO: 517628 - DNA, 20 bp, Artificial Sequence
  chemically synthesized
tttaaggtaatagaatatgt

SEQ ID NO: 517629 - DNA, 20 bp, Artificial Sequence
  chemically synthesized
tttcgatcagtttaaggtaa

SEQ ID NO: 517630 - DNA, 20 bp, Artificial Sequence
  chemically synthesized
tcagcttttcttctgttgag

SEQ ID NO: 517631 - DNA, 20 bp, Artificial Sequence
  chemically synthesized
tcagtagaaaaattcttccc

SEQ ID NO: 517632 - DNA, 20 bp, Artificial Sequence
  chemically synthesized
agaaaggagaaacccatggg

SEQ ID NO: 517633 - DNA, 20 bp, Artificial Sequence
  chemically synthesized
aaagtatatttctgaggact

SEQ ID NO: 517634 - DNA, 20 bp, Artificial Sequence
  chemically synthesized
gtcctcagaaatatactttg

SEQ ID NO: 517635 - DNA, 20 bp, Artificial Sequence
  chemically synthesized
ggattatatgaataatgctt

SEQ ID NO: 517636 - DNA, 20 bp, Artificial Sequence
  chemically synthesized
ttcagtttttcttggattat

SEQ ID NO: 517637 - DNA, 20 bp, Artificial Sequence
  chemically synthesized
caagtctctttcagtttttc

SEQ ID NO: 517638 - DNA, 20 bp, Artificial Sequence
  chemically synthesized
caaagaaatataaaaataaa

SEQ ID NO: 517639 - DNA, 20 bp, Artificial Sequence
  chemically synthesized
ataaatacacttactatcct

SEQ ID NO: 517640 - DNA, 20 bp, Artificial Sequence
  chemically synthesized
tttaatatcagagttaccct

SEQ ID NO: 517641 - DNA, 20 bp, Artificial Sequence
  chemically synthesized
aatgtgagtctttttaatat

SEQ ID NO: 517642 - DNA, 20 bp, Artificial Sequence
  chemically synthesized
ctggtatatatgtaataaat

SEQ ID NO: 517643 - DNA, 20 bp, Artificial Sequence
  chemically synthesized
ccagagcctatatccccaaa

SEQ ID NO: 517644 - DNA, 20 bp, Artificial Sequence
  chemically synthesized
tctcataaataattctattt

SEQ ID NO: 517645 - DNA, 20 bp, Artificial Sequence
  chemically synthesized
cctctttttaaatattcatg

SEQ ID NO: 517646 - DNA, 20 bp, Artificial Sequence
  chemically synthesized
tctacttaaggctattctac

SEQ ID NO: 517647 - DNA, 20 bp, Artificial Sequence
  chemically synthesized
ctgagccactttattgttga

SEQ ID NO: 517648 - DNA, 20 bp, Artificial Sequence
  chemically synthesized
tgatggggtgttttctcaat

SEQ ID NO: 517649 - DNA, 20 bp, Artificial Sequence
  chemically synthesized
ggctatttctcaaaccatgt

SEQ ID NO: 517650 - DNA, 20 bp, Artificial Sequence
  chemically synthesized
gcctgggcgacagagtgaga

SEQ ID NO: 517651 - DNA, 20 bp, Artificial Sequence
  chemically synthesized
ctgcactccagcctgggcga

SEQ ID NO: 517652 - DNA, 20 bp, Artificial Sequence
  chemically synthesized
tctcactctgtcgcccaggc

SEQ ID NO: 517653 - DNA, 20 bp, Artificial Sequence
  chemically synthesized
ttcactgcaacctctgcctc

SEQ ID NO: 517654 - DNA, 20 bp, Artificial Sequence
  chemically synthesized
tactcggggagctgaggcgg

SEQ ID NO: 517655 - DNA, 20 bp, Artificial Sequence
  chemically synthesized
gattctcccgcctcagctcc

SEQ ID NO: 517656 - DNA, 20 bp, Artificial Sequence
  chemically synthesized
gcctcagctccccgagtagc

SEQ ID NO: 517657 - DNA, 20 bp, Artificial Sequence
  chemically synthesized
actaaaaatacaaaaattag

SEQ ID NO: 517658 - DNA, 20 bp, Artificial Sequence
  chemically synthesized
ttttgtatttttagtacaga

SEQ ID NO: 517659 - DNA, 20 bp, Artificial Sequence
  chemically synthesized
ggcgggcggatcatgaggtc

SEQ ID NO: 517660 - DNA, 20 bp, Artificial Sequence
  chemically synthesized
actttgggaagcagaggcgg

SEQ ID NO: 517661 - DNA, 20 bp, Artificial Sequence
  chemically synthesized
gcctctgcttcccaaagtgc

SEQ ID NO: 517662 - DNA, 20 bp, Artificial Sequence
  chemically synthesized
tcccacgagactgtgatttt

SEQ ID NO: 517663 - DNA, 20 bp, Artificial Sequence
  chemically synthesized
aatcacagtctcgtgggagg

SEQ ID NO: 517664 - DNA, 20 bp, Artificial Sequence
  chemically synthesized
gaagcagtaggaaatatgtt

SEQ ID NO: 517665 - DNA, 20 bp, Artificial Sequence
  chemically synthesized
tttggggaaattagtggtga

SEQ ID NO: 517666 - DNA, 20 bp, Artificial Sequence
  chemically synthesized
taaatttggggaaattagtg

SEQ ID NO: 517667 - DNA, 20 bp, Artificial Sequence
  chemically synthesized
tttccccaaatttacaagtt

SEQ ID NO: 517668 - DNA, 20 bp, Artificial Sequence
  chemically synthesized
tttaaattatagttttataa

SEQ ID NO: 517669 - DNA, 20 bp, Artificial Sequence
  chemically synthesized
tctactttatttttcaggtc

SEQ ID NO: 517670 - DNA, 20 bp, Artificial Sequence
  chemically synthesized
accttacttcatatgagagc

SEQ ID NO: 517671 - DNA, 20 bp, Artificial Sequence
  chemically synthesized
cagcccagtgaaatttcaat

SEQ ID NO: 517672 - DNA, 20 bp, Artificial Sequence
  chemically synthesized
caaattgaaatttcactggg

SEQ ID NO: 517673 - DNA, 20 bp, Artificial Sequence
  chemically synthesized
cgggcagatcacttgaggtc

SEQ ID NO: 517674 - DNA, 20 bp, Artificial Sequence
  chemically synthesized
actaaaaatacaaaaaatag

SEQ ID NO: 517675 - DNA, 20 bp, Artificial Sequence
  chemically synthesized
gcctcagcctcccgagtagc

SEQ ID NO: 517676 - DNA, 20 bp, Artificial Sequence
  chemically synthesized
gattctcctgcctcagcctc

SEQ ID NO: 517677 - DNA, 20 bp, Artificial Sequence
  chemically synthesized
tactcgggaggctgaggcag

SEQ ID NO: 517678 - DNA, 20 bp, Artificial Sequence
  chemically synthesized
ctcactacaacctccatctc

SEQ ID NO: 517679 - DNA, 20 bp, Artificial Sequence
  chemically synthesized
tcgcgtcactgcactccagc

SEQ ID NO: 517680 - DNA, 20 bp, Artificial Sequence
  chemically synthesized
tcttgctctgtcacccaggc

SEQ ID NO: 517681 - DNA, 20 bp, Artificial Sequence
  chemically synthesized
ttttttttttttttttttgg

SEQ ID NO: 517682 - DNA, 20 bp, Artificial Sequence
  chemically synthesized
aaagaaatttaagcgaagat

SEQ ID NO: 517683 - DNA, 20 bp, Artificial Sequence
  chemically synthesized
ttcatcttttacatataaaa

SEQ ID NO: 517684 - DNA, 20 bp, Artificial Sequence
  chemically synthesized
agttcatctttgcctttatt

SEQ ID NO: 517685 - DNA, 20 bp, Artificial Sequence
  chemically synthesized
cactggaagagatatacaag

SEQ ID NO: 517686 - DNA, 20 bp, Artificial Sequence
  chemically synthesized
gcttggtaattatttgctga

SEQ ID NO: 517687 - DNA, 20 bp, Artificial Sequence
  chemically synthesized
acttgcttggtaattatttg

SEQ ID NO: 517688 - DNA, 20 bp, Artificial Sequence
  chemically synthesized
tctctatgatagtgatgaaa

SEQ ID NO: 517689 - DNA, 20 bp, Artificial Sequence
  chemically synthesized
taatatttatcattttttta

SEQ ID NO: 517690 - DNA, 20 bp, Artificial Sequence
  chemically synthesized
ttatcattggtgtatataac

SEQ ID NO: 517691 - DNA, 20 bp, Artificial Sequence
  chemically synthesized
gtatataaccagaatttaag

SEQ ID NO: 517692 - DNA, 20 bp, Artificial Sequence
  chemically synthesized
attgagtttcatgatctata

SEQ ID NO: 517693 - DNA, 20 bp, Artificial Sequence
  chemically synthesized
ttaaactttattacaggtca

SEQ ID NO: 517694 - DNA, 20 bp, Artificial Sequence
  chemically synthesized
acaattttatattgccttga

SEQ ID NO: 517695 - DNA, 20 bp, Artificial Sequence
  chemically synthesized
gcccaaatcatcaaagcaga

SEQ ID NO: 517696 - DNA, 20 bp, Artificial Sequence
  chemically synthesized
actaggaagaagcttgtatt

SEQ ID NO: 517697 - DNA, 20 bp, Artificial Sequence
  chemically synthesized
taacctcttggtaacacatt

SEQ ID NO: 517698 - DNA, 20 bp, Artificial Sequence
  chemically synthesized
tgtgttaccaagaggttaca

SEQ ID NO: 517699 - DNA, 20 bp, Artificial Sequence
  chemically synthesized
agtctgaggaacgcattaac

SEQ ID NO: 517700 - DNA, 20 bp, Artificial Sequence
  chemically synthesized
actgtgccaacatgatagaa

SEQ ID NO: 517701 - DNA, 20 bp, Artificial Sequence
  chemically synthesized
actagtaaaaacaatgttta

SEQ ID NO: 517702 - DNA, 20 bp, Artificial Sequence
  chemically synthesized
cacagaactagttctctgtt

SEQ ID NO: 517703 - DNA, 20 bp, Artificial Sequence
  chemically synthesized
tggaatttttaaaatgttga

SEQ ID NO: 517704 - DNA, 20 bp, Artificial Sequence
  chemically synthesized
ggtccttggagcaatcgtat

SEQ ID NO: 517705 - DNA, 20 bp, Artificial Sequence
  chemically synthesized
aaggacctatgagagatact

SEQ ID NO: 517706 - DNA, 20 bp, Artificial Sequence
  chemically synthesized
tactttggattcaaggacct

SEQ ID NO: 517707 - DNA, 20 bp, Artificial Sequence
  chemically synthesized
tccactcgactctgaggtcc

SEQ ID NO: 517708 - DNA, 20 bp, Artificial Sequence
  chemically synthesized
tggattcaaggacctcagag

SEQ ID NO: 517709 - DNA, 20 bp, Artificial Sequence
  chemically synthesized
ggtcacattctatttaaaga

SEQ ID NO: 517710 - DNA, 20 bp, Artificial Sequence
  chemically synthesized
gtggaaactctttctttaaa

SEQ ID NO: 517711 - DNA, 20 bp, Artificial Sequence
  chemically synthesized
atctgtttcatattgggctt

SEQ ID NO: 517712 - DNA, 20 bp, Artificial Sequence
  chemically synthesized
agcccaatatgaaacagatg

SEQ ID NO: 517713 - DNA, 20 bp, Artificial Sequence
  chemically synthesized
agagtgagctattcagctaa

SEQ ID NO: 517714 - DNA, 20 bp, Artificial Sequence
  chemically synthesized
caccatcagcattcctttag

SEQ ID NO: 517715 - DNA, 20 bp, Artificial Sequence
  chemically synthesized
atgtgtagggtgagaagaca

SEQ ID NO: 517716 - DNA, 20 bp, Artificial Sequence
  chemically synthesized
agtgtttcaagggccatgtg

SEQ ID NO: 517717 - DNA, 20 bp, Artificial Sequence
  chemically synthesized
atagtctcactggagcctta

SEQ ID NO: 517718 - DNA, 20 bp, Artificial Sequence
  chemically synthesized
ctaggaactggagaatatat

SEQ ID NO: 517719 - DNA, 20 bp, Artificial Sequence
  chemically synthesized
ggtggacaaactaggaactg

SEQ ID NO: 517720 - DNA, 20 bp, Artificial Sequence
  chemically synthesized
gttaaaaacaaagaaaagct

SEQ ID NO: 517721 - DNA, 20 bp, Artificial Sequence
  chemically synthesized
tgtttttaacttttaagttc

SEQ ID NO: 517722 - DNA, 20 bp, Artificial Sequence
  chemically synthesized
tataggtaaacttatgtcat

SEQ ID NO: 517723 - DNA, 20 bp, Artificial Sequence
  chemically synthesized
gatggttagtaggcttatat

SEQ ID NO: 517724 - DNA, 20 bp, Artificial Sequence
  chemically synthesized
gtggagggtgggaggaggga

SEQ ID NO: 517725 - DNA, 20 bp, Artificial Sequence
  chemically synthesized
ttgggacctgttggagggtg

SEQ ID NO: 517726 - DNA, 20 bp, Artificial Sequence
  chemically synthesized
acatacattgggacctgttg

SEQ ID NO: 517727 - DNA, 20 bp, Artificial Sequence
  chemically synthesized
aaacacatggacacttagag

SEQ ID NO: 517728 - DNA, 20 bp, Artificial Sequence
  chemically synthesized
tgttactgtattagtttgct

SEQ ID NO: 517729 - DNA, 20 bp, Artificial Sequence
  chemically synthesized
gtactttgcaggaacatgga

SEQ ID NO: 517730 - DNA, 20 bp, Artificial Sequence
  chemically synthesized
accatgtactttgcaggaac

SEQ ID NO: 517731 - DNA, 20 bp, Artificial Sequence
  chemically synthesized
tatactgcgtagccataaga

SEQ ID NO: 517732 - DNA, 20 bp, Artificial Sequence
  chemically synthesized
aaatgcccaccaatgataga

SEQ ID NO: 517733 - DNA, 20 bp, Artificial Sequence
  chemically synthesized
tattcacaatagcaaagacg

SEQ ID NO: 517734 - DNA, 20 bp, Artificial Sequence
  chemically synthesized
gattccacgtctttgctatt

SEQ ID NO: 517735 - DNA, 20 bp, Artificial Sequence
  chemically synthesized
atagaacgatttatattcct

SEQ ID NO: 517736 - DNA, 20 bp, Artificial Sequence
  chemically synthesized
attactgcatttatacccaa

SEQ ID NO: 517737 - DNA, 20 bp, Artificial Sequence
  chemically synthesized
taaatgcagtaatgatattg

SEQ ID NO: 517738 - DNA, 20 bp, Artificial Sequence
  chemically synthesized
tttctgtctgtaggtctttg

SEQ ID NO: 517739 - DNA, 20 bp, Artificial Sequence
  chemically synthesized
ccctttgcccacttttttag

SEQ ID NO: 517740 - DNA, 20 bp, Artificial Sequence
  chemically synthesized
gtttaagttccttataaatg

SEQ ID NO: 517741 - DNA, 20 bp, Artificial Sequence
  chemically synthesized
tgctggattttagacctttg

SEQ ID NO: 517742 - DNA, 20 bp, Artificial Sequence
  chemically synthesized
cagagtgagcagacaaacta

SEQ ID NO: 517743 - DNA, 20 bp, Artificial Sequence
  chemically synthesized
acagcaaaggaaactatcaa

SEQ ID NO: 517744 - DNA, 20 bp, Artificial Sequence
  chemically synthesized
tatgtcctaaatggtattgc

SEQ ID NO: 517745 - DNA, 20 bp, Artificial Sequence
  chemically synthesized
gtattgcccgggttgtcttc

SEQ ID NO: 517746 - DNA, 20 bp, Artificial Sequence
  chemically synthesized
atttaagtctttaatctatc

SEQ ID NO: 517747 - DNA, 20 bp, Artificial Sequence
  chemically synthesized
ctttgtacatggtgtaagga

SEQ ID NO: 517748 - DNA, 20 bp, Artificial Sequence
  chemically synthesized
acctattcaataagtggtgc

SEQ ID NO: 517749 - DNA, 20 bp, Artificial Sequence
  chemically synthesized
agttatcccagcaccactta

SEQ ID NO: 517750 - DNA, 20 bp, Artificial Sequence
  chemically synthesized
actggtacaagaacagacac

SEQ ID NO: 517751 - DNA, 20 bp, Artificial Sequence
  chemically synthesized
actaagcaaaaagagaaaag

SEQ ID NO: 517752 - DNA, 20 bp, Artificial Sequence
  chemically synthesized
tagtttcttctagttctctg

SEQ ID NO: 517753 - DNA, 20 bp, Artificial Sequence
  chemically synthesized
aatctcaatggtagtttaat

SEQ ID NO: 517754 - DNA, 20 bp, Artificial Sequence
  chemically synthesized
ggcaatcctaagcaatttat

SEQ ID NO: 517755 - DNA, 20 bp, Artificial Sequence
  chemically synthesized
attgactctaataaattgct

SEQ ID NO: 517756 - DNA, 20 bp, Artificial Sequence
  chemically synthesized
tagtttcttctagttctctg

SEQ ID NO: 517757 - DNA, 20 bp, Artificial Sequence
  chemically synthesized
aatctcaatggtagtttaat

SEQ ID NO: 517758 - DNA, 20 bp, Artificial Sequence
  chemically synthesized
gtagtttaataggaatagca

SEQ ID NO: 517759 - DNA, 20 bp, Artificial Sequence
  chemically synthesized
attccatgttcatggatagg

SEQ ID NO: 517760 - DNA, 20 bp, Artificial Sequence
  chemically synthesized
attcttcctatccatgaaca

SEQ ID NO: 517761 - DNA, 20 bp, Artificial Sequence
  chemically synthesized
tggaaaaacattccatgttc

SEQ ID NO: 517762 - DNA, 20 bp, Artificial Sequence
  chemically synthesized
tgtcatctctgatttctttg

SEQ ID NO: 517763 - DNA, 20 bp, Artificial Sequence
  chemically synthesized
ctaggaatacagctaactag

SEQ ID NO: 517764 - DNA, 20 bp, Artificial Sequence
  chemically synthesized
atagaaagaataaaatacct

SEQ ID NO: 517765 - DNA, 20 bp, Artificial Sequence
  chemically synthesized
acattcacaactgccataga

SEQ ID NO: 517766 - DNA, 20 bp, Artificial Sequence
  chemically synthesized
ttattctttctatggcagtt

SEQ ID NO: 517767 - DNA, 20 bp, Artificial Sequence
  chemically synthesized
tctctctgttgttggtgtat

SEQ ID NO: 517768 - DNA, 20 bp, Artificial Sequence
  chemically synthesized
aaacaacttcagcaaagtct

SEQ ID NO: 517769 - DNA, 20 bp, Artificial Sequence
  chemically synthesized
aagcttttgggctgagacca

SEQ ID NO: 517770 - DNA, 20 bp, Artificial Sequence
  chemically synthesized
cttctaatactatgttaaat

SEQ ID NO: 517771 - DNA, 20 bp, Artificial Sequence
  chemically synthesized
atggaaaaccagcacaagac

SEQ ID NO: 517772 - DNA, 20 bp, Artificial Sequence
  chemically synthesized
aggggcttcatgtctattta

SEQ ID NO: 517773 - DNA, 20 bp, Artificial Sequence
  chemically synthesized
agtagtgagttgtttttcac

SEQ ID NO: 517774 - DNA, 20 bp, Artificial Sequence
  chemically synthesized
aaaagcttaatctggaagta

SEQ ID NO: 517775 - DNA, 20 bp, Artificial Sequence
  chemically synthesized
tcctttcttctcatcataat

SEQ ID NO: 517776 - DNA, 20 bp, Artificial Sequence
  chemically synthesized
attgcatttccactgattag

SEQ ID NO: 517777 - DNA, 20 bp, Artificial Sequence
  chemically synthesized
ttacttttagtgtcaacaaa

SEQ ID NO: 517778 - DNA, 20 bp, Artificial Sequence
  chemically synthesized
aaagtattaaataaaaaaac

SEQ ID NO: 517779 - DNA, 20 bp, Artificial Sequence
  chemically synthesized
tgtttttttatttaatactt

SEQ ID NO: 517780 - DNA, 20 bp, Artificial Sequence
  chemically synthesized
atacttttgggtggagagag

SEQ ID NO: 517781 - DNA, 20 bp, Artificial Sequence
  chemically synthesized
cttaatacatcaaaataaaa

SEQ ID NO: 517782 - DNA, 20 bp, Artificial Sequence
  chemically synthesized
gccaggcatgtgataaacag

SEQ ID NO: 517783 - DNA, 20 bp, Artificial Sequence
  chemically synthesized
aacttaagacatatgtatag

SEQ ID NO: 517784 - DNA, 20 bp, Artificial Sequence
  chemically synthesized
tctcaagaagcaaacaaacc

SEQ ID NO: 517785 - DNA, 20 bp, Artificial Sequence
  chemically synthesized
ttataatagtcatgactcct

SEQ ID NO: 517786 - DNA, 20 bp, Artificial Sequence
  chemically synthesized
aagaaagaataaatactcaa

SEQ ID NO: 517787 - DNA, 20 bp, Artificial Sequence
  chemically synthesized
tctgtcagagttccagaaga

SEQ ID NO: 517788 - DNA, 20 bp, Artificial Sequence
  chemically synthesized
ccttaaatcacaatatctgt

SEQ ID NO: 517789 - DNA, 20 bp, Artificial Sequence
  chemically synthesized
atattgtgatttaagggcgt

SEQ ID NO: 517790 - DNA, 20 bp, Artificial Sequence
  chemically synthesized
ctgatggcataggctccaga

SEQ ID NO: 517791 - DNA, 20 bp, Artificial Sequence
  chemically synthesized
gaataagaaatacacagctg

SEQ ID NO: 517792 - DNA, 20 bp, Artificial Sequence
  chemically synthesized
tggttccaaaataacagttc

SEQ ID NO: 517793 - DNA, 20 bp, Artificial Sequence
  chemically synthesized
ctcagatcaccacttggatc

SEQ ID NO: 517794 - DNA, 20 bp, Artificial Sequence
  chemically synthesized
gctaccactcagatcaccac

SEQ ID NO: 517795 - DNA, 20 bp, Artificial Sequence
  chemically synthesized
ttcttgatccaagtggtgat

SEQ ID NO: 517796 - DNA, 20 bp, Artificial Sequence
  chemically synthesized
agttttaaaaagcaaagggc

SEQ ID NO: 517797 - DNA, 20 bp, Artificial Sequence
  chemically synthesized
cgagttacagttaaattggt

SEQ ID NO: 517798 - DNA, 20 bp, Artificial Sequence
  chemically synthesized
cccaccaatttaactgtaac

SEQ ID NO: 517799 - DNA, 20 bp, Artificial Sequence
  chemically synthesized
ttgtgttaggaaatcaacat

SEQ ID NO: 517800 - DNA, 20 bp, Artificial Sequence
  chemically synthesized
cttagagatataataagtgg

SEQ ID NO: 517801 - DNA, 20 bp, Artificial Sequence
  chemically synthesized
ctttaataaattttaattga

SEQ ID NO: 517802 - DNA, 20 bp, Artificial Sequence
  chemically synthesized
ctgactttaataaattttaa

SEQ ID NO: 517803 - DNA, 20 bp, Artificial Sequence
  chemically synthesized
ggaggaaaaacacttctggg

SEQ ID NO: 517804 - DNA, 20 bp, Artificial Sequence
  chemically synthesized
ggtagggaggaaaaacactt

SEQ ID NO: 517805 - DNA, 20 bp, Artificial Sequence
  chemically synthesized
gggtaacatgtagaagttaa

SEQ ID NO: 517806 - DNA, 20 bp, Artificial Sequence
  chemically synthesized
ttctggttacaatagtttat

SEQ ID NO: 517807 - DNA, 20 bp, Artificial Sequence
  chemically synthesized
ctgctttaaaacaggcatac

SEQ ID NO: 517808 - DNA, 20 bp, Artificial Sequence
  chemically synthesized
catacaggaattttttgggg

SEQ ID NO: 517809 - DNA, 20 bp, Artificial Sequence
  chemically synthesized
gaattttttggggggggatg

SEQ ID NO: 517810 - DNA, 20 bp, Artificial Sequence
  chemically synthesized
attacaaatatgttcatttt

SEQ ID NO: 517811 - DNA, 20 bp, Artificial Sequence
  chemically synthesized
cagcaatgtggcagacacag

SEQ ID NO: 517812 - DNA, 20 bp, Artificial Sequence
  chemically synthesized
taggattgttttgaaaatta

SEQ ID NO: 517813 - DNA, 20 bp, Artificial Sequence
  chemically synthesized
tcttaagagtatatatctca

SEQ ID NO: 517814 - DNA, 20 bp, Artificial Sequence
  chemically synthesized
tcatttacaaaaggaatctt

SEQ ID NO: 517815 - DNA, 20 bp, Artificial Sequence
  chemically synthesized
tcttaagattccttttgtaa

SEQ ID NO: 517816 - DNA, 20 bp, Artificial Sequence
  chemically synthesized
tcagtctattcatttacaaa

SEQ ID NO: 517817 - DNA, 20 bp, Artificial Sequence
  chemically synthesized
ggtgccttgtactttgcgca

SEQ ID NO: 517818 - DNA, 20 bp, Artificial Sequence
  chemically synthesized
caaagtacaaggcacctaat

SEQ ID NO: 517819 - DNA, 20 bp, Artificial Sequence
  chemically synthesized
acctaatttgaatttggctt

SEQ ID NO: 517820 - DNA, 20 bp, Artificial Sequence
  chemically synthesized
cagaatgtagctattaagag

SEQ ID NO: 517821 - DNA, 20 bp, Artificial Sequence
  chemically synthesized
gtcatcagaatgtagctatt

SEQ ID NO: 517822 - DNA, 20 bp, Artificial Sequence
  chemically synthesized
gtccctggatctagggtcat

SEQ ID NO: 517823 - DNA, 20 bp, Artificial Sequence
  chemically synthesized
atgagaagagtccctggatc

SEQ ID NO: 517824 - DNA, 20 bp, Artificial Sequence
  chemically synthesized
gaattggatgagaagagtcc

SEQ ID NO: 517825 - DNA, 20 bp, Artificial Sequence
  chemically synthesized
caaaaccggaattggatgag

SEQ ID NO: 517826 - DNA, 20 bp, Artificial Sequence
  chemically synthesized
aaaacacaacaaaaccggaa

SEQ ID NO: 517827 - DNA, 20 bp, Artificial Sequence
  chemically synthesized
tacataaaacacaacaaaac

SEQ ID NO: 517828 - DNA, 20 bp, Artificial Sequence
  chemically synthesized
tttatgtaaaacacaccact

SEQ ID NO: 517829 - DNA, 20 bp, Artificial Sequence
  chemically synthesized
ctcaagacaatgaacaaaat

SEQ ID NO: 517830 - DNA, 20 bp, Artificial Sequence
  chemically synthesized
ccaattttgttcattgtctt

SEQ ID NO: 517831 - DNA, 20 bp, Artificial Sequence
  chemically synthesized
tcatttacctgtaaactaaa

SEQ ID NO: 517832 - DNA, 20 bp, Artificial Sequence
  chemically synthesized
tggcaaaatgggtgagatgg

SEQ ID NO: 517833 - DNA, 20 bp, Artificial Sequence
  chemically synthesized
tatttagtaagagtggcaaa

SEQ ID NO: 517834 - DNA, 20 bp, Artificial Sequence
  chemically synthesized
taaacaattgagtatttagt

SEQ ID NO: 517835 - DNA, 20 bp, Artificial Sequence
  chemically synthesized
attgaaggaaaactaaacaa

SEQ ID NO: 517836 - DNA, 20 bp, Artificial Sequence
  chemically synthesized
cctcttgacttgacatcact

SEQ ID NO: 517837 - DNA, 20 bp, Artificial Sequence
  chemically synthesized
taggttgtaggagtcccagt

SEQ ID NO: 517838 - DNA, 20 bp, Artificial Sequence
  chemically synthesized
cagtagaatcagtaggttgt

SEQ ID NO: 517839 - DNA, 20 bp, Artificial Sequence
  chemically synthesized
aaccttgtaggttgtcccag

SEQ ID NO: 517840 - DNA, 20 bp, Artificial Sequence
  chemically synthesized
ttgtagctgtctttctcccc

SEQ ID NO: 517841 - DNA, 20 bp, Artificial Sequence
  chemically synthesized
ctggagttccagtggacttt

SEQ ID NO: 517842 - DNA, 20 bp, Artificial Sequence
  chemically synthesized
gaacagaacacggatgatgc

SEQ ID NO: 517843 - DNA, 20 bp, Artificial Sequence
  chemically synthesized
gttatttcctggaacagaac

SEQ ID NO: 517844 - DNA, 20 bp, Artificial Sequence
  chemically synthesized
tggattttctggtttatggt

SEQ ID NO: 517845 - DNA, 20 bp, Artificial Sequence
  chemically synthesized
gatggtagagtggtaatctg

SEQ ID NO: 517846 - DNA, 20 bp, Artificial Sequence
  chemically synthesized
ttctaagcatcttcagatgg

SEQ ID NO: 517847 - DNA, 20 bp, Artificial Sequence
  chemically synthesized
ctctaccatctgaagatgct

SEQ ID NO: 517848 - DNA, 20 bp, Artificial Sequence
  chemically synthesized
gttaagaagttttctagaca

SEQ ID NO: 517849 - DNA, 20 bp, Artificial Sequence
  chemically synthesized
tgccctctagactcaacaaa

SEQ ID NO: 517850 - DNA, 20 bp, Artificial Sequence
  chemically synthesized
aagaatataaatcctatttg

SEQ ID NO: 517851 - DNA, 20 bp, Artificial Sequence
  chemically synthesized
aaaacaaaaacttgttggag

SEQ ID NO: 517852 - DNA, 20 bp, Artificial Sequence
  chemically synthesized
ttgctagtagagcatagttg

SEQ ID NO: 517853 - DNA, 20 bp, Artificial Sequence
  chemically synthesized
ccttagtaaacaaaaggcaa

SEQ ID NO: 517854 - DNA, 20 bp, Artificial Sequence
  chemically synthesized
aatggacttacactgttcag

SEQ ID NO: 517855 - DNA, 20 bp, Artificial Sequence
  chemically synthesized
gacttacactgttcagaagg

SEQ ID NO: 517856 - DNA, 20 bp, Artificial Sequence
  chemically synthesized
tgtgtcttctttacttgaac

SEQ ID NO: 517857 - DNA, 20 bp, Artificial Sequence
  chemically synthesized
acaggtcaaagccacctctc

SEQ ID NO: 517858 - DNA, 20 bp, Artificial Sequence
  chemically synthesized
aaatgcaccttaagtggggc

SEQ ID NO: 517859 - DNA, 20 bp, Artificial Sequence
  chemically synthesized
ggtaaattattttggcagct

SEQ ID NO: 517860 - DNA, 20 bp, Artificial Sequence
  chemically synthesized
ttcgggttttgactggaaca

SEQ ID NO: 517861 - DNA, 20 bp, Artificial Sequence
  chemically synthesized
ctcctgccttctcactgtct

SEQ ID NO: 517862 - DNA, 20 bp, Artificial Sequence
  chemically synthesized
aattacaaaaagtggaaagg

SEQ ID NO: 517863 - DNA, 20 bp, Artificial Sequence
  chemically synthesized
gggagaatgagagaatgagt

SEQ ID NO: 517864 - DNA, 20 bp, Artificial Sequence
  chemically synthesized
tttaaagggagaatgagaga

SEQ ID NO: 517865 - DNA, 20 bp, Artificial Sequence
  chemically synthesized
gagttttaaagggagaatga

SEQ ID NO: 517866 - DNA, 20 bp, Artificial Sequence
  chemically synthesized
gtgactgggagttttaaagg

SEQ ID NO: 517867 - DNA, 20 bp, Artificial Sequence
  chemically synthesized
tgatttgtgtagaggtgact

SEQ ID NO: 517868 - DNA, 20 bp, Artificial Sequence
  chemically synthesized
aatacactattataatagag

SEQ ID NO: 517869 - DNA, 20 bp, Artificial Sequence
  chemically synthesized
acgtccacttttgcttatct

SEQ ID NO: 517870 - DNA, 20 bp, Artificial Sequence
  chemically synthesized
agttggtttagtttcagttt

SEQ ID NO: 517871 - DNA, 20 bp, Artificial Sequence
  chemically synthesized
tgaacgtatttacgtatttg

SEQ ID NO: 517872 - DNA, 20 bp, Artificial Sequence
  chemically synthesized
tatgttaattatacaaatgt

SEQ ID NO: 517873 - DNA, 20 bp, Artificial Sequence
  chemically synthesized
atctttcaataggattttct

SEQ ID NO: 517874 - DNA, 20 bp, Artificial Sequence
  chemically synthesized
tgacataacttatctttcaa

SEQ ID NO: 517875 - DNA, 20 bp, Artificial Sequence
  chemically synthesized
ttgactaatgcaggaaataa

SEQ ID NO: 517876 - DNA, 20 bp, Artificial Sequence
  chemically synthesized
atttatttcctgcattagtc

SEQ ID NO: 517877 - DNA, 20 bp, Artificial Sequence
  chemically synthesized
tatcaacagctgaagtagga

SEQ ID NO: 517878 - DNA, 20 bp, Artificial Sequence
  chemically synthesized
ctgaagtaggaaagagtgcc

SEQ ID NO: 517879 - DNA, 20 bp, Artificial Sequence
  chemically synthesized
ataccataaaaaacttctaa

SEQ ID NO: 517880 - DNA, 20 bp, Artificial Sequence
  chemically synthesized
gctgaggttaaatagaatgg

SEQ ID NO: 517881 - DNA, 20 bp, Artificial Sequence
  chemically synthesized
gaatgctgaggttaaataga

SEQ ID NO: 517882 - DNA, 20 bp, Artificial Sequence
  chemically synthesized
aattgaatgctgaggttaaa

SEQ ID NO: 517883 - DNA, 20 bp, Artificial Sequence
  chemically synthesized
aaaaatagcagtgagagtaa

SEQ ID NO: 517884 - DNA, 20 bp, Artificial Sequence
  chemically synthesized
gtttaaaaaaaaatagcagt

SEQ ID NO: 517885 - DNA, 20 bp, Artificial Sequence
  chemically synthesized
actgctatttttttttaaac

SEQ ID NO: 517886 - DNA, 20 bp, Artificial Sequence
  chemically synthesized
aatttttaaatgtatttgca

SEQ ID NO: 517887 - DNA, 20 bp, Artificial Sequence
  chemically synthesized
ttctaaaggctctgccttat

SEQ ID NO: 517888 - DNA, 20 bp, Artificial Sequence
  chemically synthesized
taataaggcagagcctttag

SEQ ID NO: 517889 - DNA, 20 bp, Artificial Sequence
  chemically synthesized
aacaaagatttattgagttt

SEQ ID NO: 517890 - DNA, 20 bp, Artificial Sequence
  chemically synthesized
caatagttaacaaagattta

SEQ ID NO: 517891 - DNA, 20 bp, Artificial Sequence
  chemically synthesized
taattttgttgagtgggatt

SEQ ID NO: 517892 - DNA, 20 bp, Artificial Sequence
  chemically synthesized
aaatcagtaattttgttgag

SEQ ID NO: 517893 - DNA, 20 bp, Artificial Sequence
  chemically synthesized
aataaaaatcagtaattttg

SEQ ID NO: 517894 - DNA, 20 bp, Artificial Sequence
  chemically synthesized
aagtataatatgtgcaaaac

SEQ ID NO: 517895 - DNA, 20 bp, Artificial Sequence
  chemically synthesized
gaacacaactttaatttctt

SEQ ID NO: 517896 - DNA, 20 bp, Artificial Sequence
  chemically synthesized
atgacaacagcatacaataa

SEQ ID NO: 517897 - DNA, 20 bp, Artificial Sequence
  chemically synthesized
aacatgattatagtgtatac

SEQ ID NO: 517898 - DNA, 20 bp, Artificial Sequence
  chemically synthesized
atgagtttttttgcaaagat

SEQ ID NO: 517899 - DNA, 20 bp, Artificial Sequence
  chemically synthesized
attaaatggccttttataat

SEQ ID NO: 517900 - DNA, 20 bp, Artificial Sequence
  chemically synthesized
atgtgtctgccaatgttgtc

SEQ ID NO: 517901 - DNA, 20 bp, Artificial Sequence
  chemically synthesized
gacacattaaggttatgctt

SEQ ID NO: 517902 - DNA, 20 bp, Artificial Sequence
  chemically synthesized
ctatatgccctttcaccata

SEQ ID NO: 517903 - DNA, 20 bp, Artificial Sequence
  chemically synthesized
taaaatttacctatagaagc

SEQ ID NO: 517904 - DNA, 20 bp, Artificial Sequence
  chemically synthesized
ggcctgtttattactcaggt

SEQ ID NO: 517905 - DNA, 20 bp, Artificial Sequence
  chemically synthesized
tagtgtagtgctactcaaac

SEQ ID NO: 517906 - DNA, 20 bp, Artificial Sequence
  chemically synthesized
tctaccccatgtctcctgga

SEQ ID NO: 517907 - DNA, 20 bp, Artificial Sequence
  chemically synthesized
aaaactctatccaggagaca

SEQ ID NO: 517908 - DNA, 20 bp, Artificial Sequence
  chemically synthesized
attaatctaccccatgtctc

SEQ ID NO: 517909 - DNA, 20 bp, Artificial Sequence
  chemically synthesized
ccatatgtgtggaggtgtgt

SEQ ID NO: 517910 - DNA, 20 bp, Artificial Sequence
  chemically synthesized
ccacacatatgggaaggttg

SEQ ID NO: 517911 - DNA, 20 bp, Artificial Sequence
  chemically synthesized
aaatatgtctcaccacattg

SEQ ID NO: 517912 - DNA, 20 bp, Artificial Sequence
  chemically synthesized
tgatctggcttaataatata

SEQ ID NO: 517913 - DNA, 20 bp, Artificial Sequence
  chemically synthesized
aagtagcactagaggacaaa

SEQ ID NO: 517914 - DNA, 20 bp, Artificial Sequence
  chemically synthesized
agctttcatacaataccctg

SEQ ID NO: 517915 - DNA, 20 bp, Artificial Sequence
  chemically synthesized
tgtcttacactagtaccctt

SEQ ID NO: 517916 - DNA, 20 bp, Artificial Sequence
  chemically synthesized
agatccatgaaggacagtta

SEQ ID NO: 517917 - DNA, 20 bp, Artificial Sequence
  chemically synthesized
tgacccgataactgtccttc

SEQ ID NO: 517918 - DNA, 20 bp, Artificial Sequence
  chemically synthesized
aatatataaatttcgttgaa

SEQ ID NO: 517919 - DNA, 20 bp, Artificial Sequence
  chemically synthesized
atgtgaatatataaatttcg

SEQ ID NO: 517920 - DNA, 20 bp, Artificial Sequence
  chemically synthesized
gtgtatatgtgtgtatgtat

SEQ ID NO: 517921 - DNA, 20 bp, Artificial Sequence
  chemically synthesized
gcatacatgtgtattgtagt

SEQ ID NO: 517922 - DNA, 20 bp, Artificial Sequence
  chemically synthesized
catgtgaactgtcttcactt

SEQ ID NO: 517923 - DNA, 20 bp, Artificial Sequence
  chemically synthesized
tgaagacagttcacatgcac

SEQ ID NO: 517924 - DNA, 20 bp, Artificial Sequence
  chemically synthesized
acaaaaattggaaggaggta

SEQ ID NO: 517925 - DNA, 20 bp, Artificial Sequence
  chemically synthesized
tcattttgggataaagaaga

SEQ ID NO: 517926 - DNA, 20 bp, Artificial Sequence
  chemically synthesized
ttaatttattaagttcattt

SEQ ID NO: 517927 - DNA, 20 bp, Artificial Sequence
  chemically synthesized
gagattttgcttctgcaaat

SEQ ID NO: 517928 - DNA, 20 bp, Artificial Sequence
  chemically synthesized
cttttttctctgcataaatt

SEQ ID NO: 517929 - DNA, 20 bp, Artificial Sequence
  chemically synthesized
aaacatgctcatttcaatat

SEQ ID NO: 517930 - DNA, 20 bp, Artificial Sequence
  chemically synthesized
ttaattactaagtaaagttt

SEQ ID NO: 517931 - DNA, 20 bp, Artificial Sequence
  chemically synthesized
ttactaagtaaagtttctga

SEQ ID NO: 517932 - DNA, 20 bp, Artificial Sequence
  chemically synthesized
tgtgggtataacatttatct

SEQ ID NO: 517933 - DNA, 20 bp, Artificial Sequence
  chemically synthesized
aaatgttatacccacacctc

SEQ ID NO: 517934 - DNA, 20 bp, Artificial Sequence
  chemically synthesized
ccagtgggcattcctgaggt

SEQ ID NO: 517935 - DNA, 20 bp, Artificial Sequence
  chemically synthesized
tggtgatctacaagagaagt

SEQ ID NO: 517936 - DNA, 20 bp, Artificial Sequence
  chemically synthesized
gcctcctttacattgacctc

SEQ ID NO: 517937 - DNA, 20 bp, Artificial Sequence
  chemically synthesized
tttggcatcactgcgaatgc

SEQ ID NO: 517938 - DNA, 20 bp, Artificial Sequence
  chemically synthesized
ttgtttgttttggcatcact

SEQ ID NO: 517939 - DNA, 20 bp, Artificial Sequence
  chemically synthesized
agtgatgccaaaacaaacaa

SEQ ID NO: 517940 - DNA, 20 bp, Artificial Sequence
  chemically synthesized
aataaaatattcactggtgg

SEQ ID NO: 517941 - DNA, 20 bp, Artificial Sequence
  chemically synthesized
gccaccgcacccgaccacca

SEQ ID NO: 517942 - DNA, 20 bp, Artificial Sequence
  chemically synthesized
acctcagcctcccaaagtgc

SEQ ID NO: 517943 - DNA, 20 bp, Artificial Sequence
  chemically synthesized
ttttgtatttttagtagaga

SEQ ID NO: 517944 - DNA, 20 bp, Artificial Sequence
  chemically synthesized
ctgtagtcccagctattcgg

SEQ ID NO: 517945 - DNA, 20 bp, Artificial Sequence
  chemically synthesized
gattctcctgcctcatcctc

SEQ ID NO: 517946 - DNA, 20 bp, Artificial Sequence
  chemically synthesized
tattcgggaggatgaggcag

SEQ ID NO: 517947 - DNA, 20 bp, Artificial Sequence
  chemically synthesized
acctccacctctcaggttca

SEQ ID NO: 517948 - DNA, 20 bp, Artificial Sequence
  chemically synthesized
gtcttgctctgtcaccaggc

SEQ ID NO: 517949 - DNA, 20 bp, Artificial Sequence
  chemically synthesized
ttttttttttttttttgaga

SEQ ID NO: 517950 - DNA, 20 bp, Artificial Sequence
  chemically synthesized
gtctcttccaaaagttgcca

SEQ ID NO: 517951 - DNA, 20 bp, Artificial Sequence
  chemically synthesized
aaagaacaattttcaaaata

SEQ ID NO: 517952 - DNA, 20 bp, Artificial Sequence
  chemically synthesized
ataattgatacaaagcaaag

SEQ ID NO: 517953 - DNA, 20 bp, Artificial Sequence
  chemically synthesized
gaggcaaccaaatagaaatg

SEQ ID NO: 517954 - DNA, 20 bp, Artificial Sequence
  chemically synthesized
aaagtgctgggattacaggt

SEQ ID NO: 517955 - DNA, 20 bp, Artificial Sequence
  chemically synthesized
acctttgctttccaaagtgc

SEQ ID NO: 517956 - DNA, 20 bp, Artificial Sequence
  chemically synthesized
cagcactttggaaagcaaag

SEQ ID NO: 517957 - DNA, 20 bp, Artificial Sequence
  chemically synthesized
actttggaaagcaaaggtgg

SEQ ID NO: 517958 - DNA, 20 bp, Artificial Sequence
  chemically synthesized
tgggtggatcacctgaggtc

SEQ ID NO: 517959 - DNA, 20 bp, Artificial Sequence
  chemically synthesized
gaccagcctggccaacatgg

SEQ ID NO: 517960 - DNA, 20 bp, Artificial Sequence
  chemically synthesized
ttttgtatttttagtagaga

SEQ ID NO: 517961 - DNA, 20 bp, Artificial Sequence
  chemically synthesized
gcctcagcctccctagtagc

SEQ ID NO: 517962 - DNA, 20 bp, Artificial Sequence
  chemically synthesized
tactagggaggctgaggcag

SEQ ID NO: 517963 - DNA, 20 bp, Artificial Sequence
  chemically synthesized
ttatgccactgcactccagc

SEQ ID NO: 517964 - DNA, 20 bp, Artificial Sequence
  chemically synthesized
tcttgctctgtcacccaggc

SEQ ID NO: 517965 - DNA, 20 bp, Artificial Sequence
  chemically synthesized
ttgattttttgtttttgaga

SEQ ID NO: 517966 - DNA, 20 bp, Artificial Sequence
  chemically synthesized
ttttgattgattatttcatt

SEQ ID NO: 517967 - DNA, 20 bp, Artificial Sequence
  chemically synthesized
acactttctatacaatcatc

SEQ ID NO: 517968 - DNA, 20 bp, Artificial Sequence
  chemically synthesized
aacacattaaacaatatcat

SEQ ID NO: 517969 - DNA, 20 bp, Artificial Sequence
  chemically synthesized
tttcttcaaaaatgaaaagg

SEQ ID NO: 517970 - DNA, 20 bp, Artificial Sequence
  chemically synthesized
tgaaaagggagagtgagaac

SEQ ID NO: 517971 - DNA, 20 bp, Artificial Sequence
  chemically synthesized
gaacgaggatgagggaggag

SEQ ID NO: 517972 - DNA, 20 bp, Artificial Sequence
  chemically synthesized
gatgagggaggaggaggatg

SEQ ID NO: 517973 - DNA, 20 bp, Artificial Sequence
  chemically synthesized
agagacaacagagagaagag

SEQ ID NO: 517974 - DNA, 20 bp, Artificial Sequence
  chemically synthesized
gagagaagagaggagtccta

SEQ ID NO: 517975 - DNA, 20 bp, Artificial Sequence
  chemically synthesized
taagcaaatattttccgggg

SEQ ID NO: 517976 - DNA, 20 bp, Artificial Sequence
  chemically synthesized
actttgaggggccaaggtgg

SEQ ID NO: 517977 - DNA, 20 bp, Artificial Sequence
  chemically synthesized
tgggcggatcatttgaggtc

SEQ ID NO: 517978 - DNA, 20 bp, Artificial Sequence
  chemically synthesized
ttttgtatttttagtacaga

SEQ ID NO: 517979 - DNA, 20 bp, Artificial Sequence
  chemically synthesized
taaaaatacaaaaaaattat

SEQ ID NO: 517980 - DNA, 20 bp, Artificial Sequence
  chemically synthesized
acaggcatgcgccaccacac

SEQ ID NO: 517981 - DNA, 20 bp, Artificial Sequence
  chemically synthesized
gattctcctgcctcagcctc

SEQ ID NO: 517982 - DNA, 20 bp, Artificial Sequence
  chemically synthesized
tactcgggaggctgaggcag

SEQ ID NO: 517983 - DNA, 20 bp, Artificial Sequence
  chemically synthesized
tcgtgccactgcactccagc

SEQ ID NO: 517984 - DNA, 20 bp, Artificial Sequence
  chemically synthesized
tctcgctctgtcacccaggc

SEQ ID NO: 517985 - DNA, 20 bp, Artificial Sequence
  chemically synthesized
ttttttttttttttttgaga

SEQ ID NO: 517986 - DNA, 20 bp, Artificial Sequence
  chemically synthesized
aaaaaaaaaaaaaaaagaag

SEQ ID NO: 517987 - DNA, 20 bp, Artificial Sequence
  chemically synthesized
aaaaaaaagaagtggggtgg

SEQ ID NO: 517988 - DNA, 20 bp, Artificial Sequence
  chemically synthesized
gtggggtgggggggttactt

SEQ ID NO: 517989 - DNA, 20 bp, Artificial Sequence
  chemically synthesized
ggaatacagtctgaaatgtt

SEQ ID NO: 517990 - DNA, 20 bp, Artificial Sequence
  chemically synthesized
agtagaagtgatatactttc

SEQ ID NO: 517991 - DNA, 20 bp, Artificial Sequence
  chemically synthesized
cggggatttgcctcaaaaca

SEQ ID NO: 517992 - DNA, 20 bp, Artificial Sequence
  chemically synthesized
ctcaaaacagagaataggaa

SEQ ID NO: 517993 - DNA, 20 bp, Artificial Sequence
  chemically synthesized
catttattttttctcttatg

SEQ ID NO: 517994 - DNA, 20 bp, Artificial Sequence
  chemically synthesized
atgacaagatatgtcagcct

SEQ ID NO: 517995 - DNA, 20 bp, Artificial Sequence
  chemically synthesized
tgaagccaagatgaggtaaa

SEQ ID NO: 517996 - DNA, 20 bp, Artificial Sequence
  chemically synthesized
atagtttgtctaggtcccca

SEQ ID NO: 517997 - DNA, 20 bp, Artificial Sequence
  chemically synthesized
cttctgtagcaacagtgaca

SEQ ID NO: 517998 - DNA, 20 bp, Artificial Sequence
  chemically synthesized
tgaatcttagatactttgct

SEQ ID NO: 517999 - DNA, 20 bp, Artificial Sequence
  chemically synthesized
aaagcaaagtatctaagatt

SEQ ID NO: 518000 - DNA, 20 bp, Artificial Sequence
  chemically synthesized
tatctaagattcagagtaag

SEQ ID NO: 518001 - DNA, 20 bp, Artificial Sequence
  chemically synthesized
aagtgagaatcctacttact

SEQ ID NO: 518002 - DNA, 20 bp, Artificial Sequence
  chemically synthesized
aatctttgcattggacaagt

SEQ ID NO: 518003 - DNA, 20 bp, Artificial Sequence
  chemically synthesized
cctttacccaccagatgtag

SEQ ID NO: 518004 - DNA, 20 bp, Artificial Sequence
  chemically synthesized
caaagattcagctacatctg

SEQ ID NO: 518005 - DNA, 20 bp, Artificial Sequence
  chemically synthesized
cagctacatctggtgggtaa

SEQ ID NO: 518006 - DNA, 20 bp, Artificial Sequence
  chemically synthesized
atttagatctaatttgtata

SEQ ID NO: 518007 - DNA, 20 bp, Artificial Sequence
  chemically synthesized
tctaatttgtatagggggtt

SEQ ID NO: 518008 - DNA, 20 bp, Artificial Sequence
  chemically synthesized
taatatgttgtctaattatg

SEQ ID NO: 518009 - DNA, 20 bp, Artificial Sequence
  chemically synthesized
ctgcaaaaagcacagtgtca

SEQ ID NO: 518010 - DNA, 20 bp, Artificial Sequence
  chemically synthesized
aatcatcttgcagatacaga

SEQ ID NO: 518011 - DNA, 20 bp, Artificial Sequence
  chemically synthesized
taataatgaggcctaagatt

SEQ ID NO: 518012 - DNA, 20 bp, Artificial Sequence
  chemically synthesized
cctaagatttggagtggagg

SEQ ID NO: 518013 - DNA, 20 bp, Artificial Sequence
  chemically synthesized
ttcatgtcaaatgtgtgccc

SEQ ID NO: 518014 - DNA, 20 bp, Artificial Sequence
  chemically synthesized
agatctatgtatacatttta

SEQ ID NO: 518015 - DNA, 20 bp, Artificial Sequence
  chemically synthesized
ttttattacaagtcactctt

SEQ ID NO: 518016 - DNA, 20 bp, Artificial Sequence
  chemically synthesized
agtagagttgctggacccca

SEQ ID NO: 518017 - DNA, 20 bp, Artificial Sequence
  chemically synthesized
ctgttataaaggaggcatag

SEQ ID NO: 518018 - DNA, 20 bp, Artificial Sequence
  chemically synthesized
agagaacagattaaaacact

SEQ ID NO: 518019 - DNA, 20 bp, Artificial Sequence
  chemically synthesized
aagtttccccttgctgcttc

SEQ ID NO: 518020 - DNA, 20 bp, Artificial Sequence
  chemically synthesized
tgctgcttcatggatgtaag

SEQ ID NO: 518021 - DNA, 20 bp, Artificial Sequence
  chemically synthesized
ctagacagaggtttccctcc

SEQ ID NO: 518022 - DNA, 20 bp, Artificial Sequence
  chemically synthesized
tgcttgacttagctctgtga

SEQ ID NO: 518023 - DNA, 20 bp, Artificial Sequence
  chemically synthesized
tcaagcatcagtccaaattt

SEQ ID NO: 518024 - DNA, 20 bp, Artificial Sequence
  chemically synthesized
cagtccaaatttcagaatgt

SEQ ID NO: 518025 - DNA, 20 bp, Artificial Sequence
  chemically synthesized
aatttgcatcattgtccctg

SEQ ID NO: 518026 - DNA, 20 bp, Artificial Sequence
  chemically synthesized
gcagggacaatgatgcaaat

SEQ ID NO: 518027 - DNA, 20 bp, Artificial Sequence
  chemically synthesized
aattggagtagaaaacactg

SEQ ID NO: 518028 - DNA, 20 bp, Artificial Sequence
  chemically synthesized
gggtagtgttggctttatac

SEQ ID NO: 518029 - DNA, 20 bp, Artificial Sequence
  chemically synthesized
cattatgaacctgtgtaatc

SEQ ID NO: 518030 - DNA, 20 bp, Artificial Sequence
  chemically synthesized
tttaggttacaataaaattc

SEQ ID NO: 518031 - DNA, 20 bp, Artificial Sequence
  chemically synthesized
agccaagcactgaagaattc

SEQ ID NO: 518032 - DNA, 20 bp, Artificial Sequence
  chemically synthesized
tcctgcccagccaagcactg

SEQ ID NO: 518033 - DNA, 20 bp, Artificial Sequence
  chemically synthesized
ttcttcagtgcttggctggg

SEQ ID NO: 518034 - DNA, 20 bp, Artificial Sequence
  chemically synthesized
cactgcctttcagtacctac

SEQ ID NO: 518035 - DNA, 20 bp, Artificial Sequence
  chemically synthesized
atgaataacatcaccagtta

SEQ ID NO: 518036 - DNA, 20 bp, Artificial Sequence
  chemically synthesized
gttcctggttcaggaaacgg

SEQ ID NO: 518037 - DNA, 20 bp, Artificial Sequence
  chemically synthesized
ctatgttcctggttcaggaa

SEQ ID NO: 518038 - DNA, 20 bp, Artificial Sequence
  chemically synthesized
tgagcaatggactggctggg

SEQ ID NO: 518039 - DNA, 20 bp, Artificial Sequence
  chemically synthesized
ccattgctcaatgtctaaaa

SEQ ID NO: 518040 - DNA, 20 bp, Artificial Sequence
  chemically synthesized
gtcatttaagtctgatcttg

SEQ ID NO: 518041 - DNA, 20 bp, Artificial Sequence
  chemically synthesized
atcagacttaaatgacaaat

SEQ ID NO: 518042 - DNA, 20 bp, Artificial Sequence
  chemically synthesized
atagagaagaaaggaacaca

SEQ ID NO: 518043 - DNA, 20 bp, Artificial Sequence
  chemically synthesized
ttaatgagcaagttatgact

SEQ ID NO: 518044 - DNA, 20 bp, Artificial Sequence
  chemically synthesized
acatgcctcatgcatcctat

SEQ ID NO: 518045 - DNA, 20 bp, Artificial Sequence
  chemically synthesized
ctaaactttttacactcaaa

SEQ ID NO: 518046 - DNA, 20 bp, Artificial Sequence
  chemically synthesized
ctatttgagtgtaaaaagtt

SEQ ID NO: 518047 - DNA, 20 bp, Artificial Sequence
  chemically synthesized
aggttaataatagatgagaa

SEQ ID NO: 518048 - DNA, 20 bp, Artificial Sequence
  chemically synthesized
tcttcaggttaataatagat

SEQ ID NO: 518049 - DNA, 20 bp, Artificial Sequence
  chemically synthesized
tctcatctattattaacctg

SEQ ID NO: 518050 - DNA, 20 bp, Artificial Sequence
  chemically synthesized
attaacctgaagaatgctgc

SEQ ID NO: 518051 - DNA, 20 bp, Artificial Sequence
  chemically synthesized
gcggggaaggctagaagtgc

SEQ ID NO: 518052 - DNA, 20 bp, Artificial Sequence
  chemically synthesized
gcacctgaagactttctctg

SEQ ID NO: 518053 - DNA, 20 bp, Artificial Sequence
  chemically synthesized
agacaaaatgggagcgctga

SEQ ID NO: 518054 - DNA, 20 bp, Artificial Sequence
  chemically synthesized
gacagcgtccactagattta

SEQ ID NO: 518055 - DNA, 20 bp, Artificial Sequence
  chemically synthesized
tctacactataagataaatg

SEQ ID NO: 518056 - DNA, 20 bp, Artificial Sequence
  chemically synthesized
tctaaaggaaggaaaaaaag

SEQ ID NO: 518057 - DNA, 20 bp, Artificial Sequence
  chemically synthesized
gaagcatggagatagttcaa

SEQ ID NO: 518058 - DNA, 20 bp, Artificial Sequence
  chemically synthesized
gaattggaagttgctggttg

SEQ ID NO: 518059 - DNA, 20 bp, Artificial Sequence
  chemically synthesized
cttcacatggcactgtcttg

SEQ ID NO: 518060 - DNA, 20 bp, Artificial Sequence
  chemically synthesized
gtataatactgaaaagtgtg

SEQ ID NO: 518061 - DNA, 20 bp, Artificial Sequence
  chemically synthesized
gaaaatgatagtctgttaag

SEQ ID NO: 518062 - DNA, 20 bp, Artificial Sequence
  chemically synthesized
actatcattttcttgagagc

SEQ ID NO: 518063 - DNA, 20 bp, Artificial Sequence
  chemically synthesized
cattttcttgagagcaagaa

SEQ ID NO: 518064 - DNA, 20 bp, Artificial Sequence
  chemically synthesized
tcatctttgtattttaggca

SEQ ID NO: 518065 - DNA, 20 bp, Artificial Sequence
  chemically synthesized
gttcatcaaatgttcatctg

SEQ ID NO: 518066 - DNA, 20 bp, Artificial Sequence
  chemically synthesized
atcaaatgttcatctgttga

SEQ ID NO: 518067 - DNA, 20 bp, Artificial Sequence
  chemically synthesized
agattctgaagaaaatggtg

SEQ ID NO: 518068 - DNA, 20 bp, Artificial Sequence
  chemically synthesized
atattcttcaccattttctt

SEQ ID NO: 518069 - DNA, 20 bp, Artificial Sequence
  chemically synthesized
gagatagttctcacttcaat

SEQ ID NO: 518070 - DNA, 20 bp, Artificial Sequence
  chemically synthesized
cacttcaatttgagttttga

SEQ ID NO: 518071 - DNA, 20 bp, Artificial Sequence
  chemically synthesized
caatttgagttttgagagga

SEQ ID NO: 518072 - DNA, 20 bp, Artificial Sequence
  chemically synthesized
gatcgaattgcttcagccca

SEQ ID NO: 518073 - DNA, 20 bp, Artificial Sequence
  chemically synthesized
tgacatactctccagctgct

SEQ ID NO: 518074 - DNA, 20 bp, Artificial Sequence
  chemically synthesized
caggtcatccctagcagctg

SEQ ID NO: 518075 - DNA, 20 bp, Artificial Sequence
  chemically synthesized
tgaaggataaaaatatcttt

SEQ ID NO: 518076 - DNA, 20 bp, Artificial Sequence
  chemically synthesized
atttatctttgtagcaaatg

SEQ ID NO: 518077 - DNA, 20 bp, Artificial Sequence
  chemically synthesized
aaaatagtaaaatgttaaca

SEQ ID NO: 518078 - DNA, 20 bp, Artificial Sequence
  chemically synthesized
ggatagtatagtcactgtta

SEQ ID NO: 518079 - DNA, 20 bp, Artificial Sequence
  chemically synthesized
agtatagtcactgttattga

SEQ ID NO: 518080 - DNA, 20 bp, Artificial Sequence
  chemically synthesized
aggatttcaacatatgaatt

SEQ ID NO: 518081 - DNA, 20 bp, Artificial Sequence
  chemically synthesized
gggagttaggatttcaacat

SEQ ID NO: 518082 - DNA, 20 bp, Artificial Sequence
  chemically synthesized
aatactatcactttgggagt

SEQ ID NO: 518083 - DNA, 20 bp, Artificial Sequence
  chemically synthesized
tctcctaatactatcacttt

SEQ ID NO: 518084 - DNA, 20 bp, Artificial Sequence
  chemically synthesized
caaagtgatagtattaggag

SEQ ID NO: 518085 - DNA, 20 bp, Artificial Sequence
  chemically synthesized
ttgggaggtgattaggtcac

SEQ ID NO: 518086 - DNA, 20 bp, Artificial Sequence
  chemically synthesized
gaggatggagctctcattat

SEQ ID NO: 518087 - DNA, 20 bp, Artificial Sequence
  chemically synthesized
accctggcctcccaaagtgc

SEQ ID NO: 518088 - DNA, 20 bp, Artificial Sequence
  chemically synthesized
atcccagcactttgggaggc

SEQ ID NO: 518089 - DNA, 20 bp, Artificial Sequence
  chemically synthesized
cagcactttgggaggccagg

SEQ ID NO: 518090 - DNA, 20 bp, Artificial Sequence
  chemically synthesized
actttgggaggccagggtgg

SEQ ID NO: 518091 - DNA, 20 bp, Artificial Sequence
  chemically synthesized
ggtgggtggatcacgaggtc

SEQ ID NO: 518092 - DNA, 20 bp, Artificial Sequence
  chemically synthesized
ttttgtatttttagtagagg

SEQ ID NO: 518093 - DNA, 20 bp, Artificial Sequence
  chemically synthesized
aaaattagccaggcgtggtg

SEQ ID NO: 518094 - DNA, 20 bp, Artificial Sequence
  chemically synthesized
gcctcagcctcccaagtagc

SEQ ID NO: 518095 - DNA, 20 bp, Artificial Sequence
  chemically synthesized
ctacttgggaggctgaggca

SEQ ID NO: 518096 - DNA, 20 bp, Artificial Sequence
  chemically synthesized
gctcactgcaacctctgcct

SEQ ID NO: 518097 - DNA, 20 bp, Artificial Sequence
  chemically synthesized
ctgccctccagcctgggaga

SEQ ID NO: 518098 - DNA, 20 bp, Artificial Sequence
  chemically synthesized
ttttttttttttttttgaga

SEQ ID NO: 518099 - DNA, 20 bp, Artificial Sequence
  chemically synthesized
cctttcccctccaccatgtg

SEQ ID NO: 518100 - DNA, 20 bp, Artificial Sequence
  chemically synthesized
gctcctagttctagaggctg

SEQ ID NO: 518101 - DNA, 20 bp, Artificial Sequence
  chemically synthesized
tacatatagatattatattt

SEQ ID NO: 518102 - DNA, 20 bp, Artificial Sequence
  chemically synthesized
aactgtgtgtgtgtacatat

SEQ ID NO: 518103 - DNA, 20 bp, Artificial Sequence
  chemically synthesized
atgtatgtggtagcacgtga

SEQ ID NO: 518104 - DNA, 20 bp, Artificial Sequence
  chemically synthesized
aaggtagactttgatggtac

SEQ ID NO: 518105 - DNA, 20 bp, Artificial Sequence
  chemically synthesized
cctatctataaagctataaa

SEQ ID NO: 518106 - DNA, 20 bp, Artificial Sequence
  chemically synthesized
actacagttttaaacaagag

SEQ ID NO: 518107 - DNA, 20 bp, Artificial Sequence
  chemically synthesized
gagtaagggtttagatggac

SEQ ID NO: 518108 - DNA, 20 bp, Artificial Sequence
  chemically synthesized
atttatgttttcacatgagt

SEQ ID NO: 518109 - DNA, 20 bp, Artificial Sequence
  chemically synthesized
cccttcatttatgttttcac

SEQ ID NO: 518110 - DNA, 20 bp, Artificial Sequence
  chemically synthesized
gaagggcaaactccttgaag

SEQ ID NO: 518111 - DNA, 20 bp, Artificial Sequence
  chemically synthesized
tacatagcaattctacttca

SEQ ID NO: 518112 - DNA, 20 bp, Artificial Sequence
  chemically synthesized
gataatgccaaattaatctc

SEQ ID NO: 518113 - DNA, 20 bp, Artificial Sequence
  chemically synthesized
accatcgccatcattgacta

SEQ ID NO: 518114 - DNA, 20 bp, Artificial Sequence
  chemically synthesized
aatgaatgcattttggaggc

SEQ ID NO: 518115 - DNA, 20 bp, Artificial Sequence
  chemically synthesized
cctccaaaatgcattcattc

SEQ ID NO: 518116 - DNA, 20 bp, Artificial Sequence
  chemically synthesized
ctgatcaaagttattcaaga

SEQ ID NO: 518117 - DNA, 20 bp, Artificial Sequence
  chemically synthesized
tcatctgatcaaagttattc

SEQ ID NO: 518118 - DNA, 20 bp, Artificial Sequence
  chemically synthesized
ggttatccaaagagtagtag

SEQ ID NO: 518119 - DNA, 20 bp, Artificial Sequence
  chemically synthesized
gctcattctcctactactct

SEQ ID NO: 518120 - DNA, 20 bp, Artificial Sequence
  chemically synthesized
atgtcaaacaaggttatcca

SEQ ID NO: 518121 - DNA, 20 bp, Artificial Sequence
  chemically synthesized
aagcatatttgtaaagagtt

SEQ ID NO: 518122 - DNA, 20 bp, Artificial Sequence
  chemically synthesized
tttagcaaagcatatttgta

SEQ ID NO: 518123 - DNA, 20 bp, Artificial Sequence
  chemically synthesized
tttacaaatatgctttgcta

SEQ ID NO: 518124 - DNA, 20 bp, Artificial Sequence
  chemically synthesized
agacctatttgatagcacaa

SEQ ID NO: 518125 - DNA, 20 bp, Artificial Sequence
  chemically synthesized
gtaaatttaaaaataactaa

SEQ ID NO: 518126 - DNA, 20 bp, Artificial Sequence
  chemically synthesized
aaataactaaaagagtgtaa

SEQ ID NO: 518127 - DNA, 20 bp, Artificial Sequence
  chemically synthesized
attggattgcttgtaacatg

SEQ ID NO: 518128 - DNA, 20 bp, Artificial Sequence
  chemically synthesized
acatgaaggataaatgcttg

SEQ ID NO: 518129 - DNA, 20 bp, Artificial Sequence
  chemically synthesized
aataatcacatcatggagaa

SEQ ID NO: 518130 - DNA, 20 bp, Artificial Sequence
  chemically synthesized
tgtgaaataatcacatcatg

SEQ ID NO: 518131 - DNA, 20 bp, Artificial Sequence
  chemically synthesized
acaatagatatatatattta

SEQ ID NO: 518132 - DNA, 20 bp, Artificial Sequence
  chemically synthesized
atttttagtatcttattttt

SEQ ID NO: 518133 - DNA, 20 bp, Artificial Sequence
  chemically synthesized
gcctcagcctcctggggagc

SEQ ID NO: 518134 - DNA, 20 bp, Artificial Sequence
  chemically synthesized
tccccaggaggctgaggcag

SEQ ID NO: 518135 - DNA, 20 bp, Artificial Sequence
  chemically synthesized
ctcactgcaacctccgcctc

SEQ ID NO: 518136 - DNA, 20 bp, Artificial Sequence
  chemically synthesized
tggcgccactgcactccagc

SEQ ID NO: 518137 - DNA, 20 bp, Artificial Sequence
  chemically synthesized
tctcgctctgtcacccaggc

SEQ ID NO: 518138 - DNA, 20 bp, Artificial Sequence
  chemically synthesized
attatcagtattatttgaga

SEQ ID NO: 518139 - DNA, 20 bp, Artificial Sequence
  chemically synthesized
aaaaataataacgaaattca

SEQ ID NO: 518140 - DNA, 20 bp, Artificial Sequence
  chemically synthesized
ataacgaaattcagtggatt

SEQ ID NO: 518141 - DNA, 20 bp, Artificial Sequence
  chemically synthesized
tgtgccttattcagaatcca

SEQ ID NO: 518142 - DNA, 20 bp, Artificial Sequence
  chemically synthesized
tcttcttattgtgccttatt

SEQ ID NO: 518143 - DNA, 20 bp, Artificial Sequence
  chemically synthesized
tctgaataaggcacaataag

SEQ ID NO: 518144 - DNA, 20 bp, Artificial Sequence
  chemically synthesized
cttaacactgaaaagtctta

SEQ ID NO: 518145 - DNA, 20 bp, Artificial Sequence
  chemically synthesized
atctaccatgtgaaattaga

SEQ ID NO: 518146 - DNA, 20 bp, Artificial Sequence
  chemically synthesized
cagtaaataataggaaaaaa

SEQ ID NO: 518147 - DNA, 20 bp, Artificial Sequence
  chemically synthesized
cacttttttcctattattta

SEQ ID NO: 518148 - DNA, 20 bp, Artificial Sequence
  chemically synthesized
tgcactccagcctgggcaac

SEQ ID NO: 518149 - DNA, 20 bp, Artificial Sequence
  chemically synthesized
ttcactcttgttgcccaggc

SEQ ID NO: 518150 - DNA, 20 bp, Artificial Sequence
  chemically synthesized
ctcatggcaacctctgcctc

SEQ ID NO: 518151 - DNA, 20 bp, Artificial Sequence
  chemically synthesized
tactcaggaggctgaggcag

SEQ ID NO: 518152 - DNA, 20 bp, Artificial Sequence
  chemically synthesized
gattctcctgcctcagcctc

SEQ ID NO: 518153 - DNA, 20 bp, Artificial Sequence
  chemically synthesized
gcctcagcctcctgagtagc

SEQ ID NO: 518154 - DNA, 20 bp, Artificial Sequence
  chemically synthesized
ttttgtatttttagtagaga

SEQ ID NO: 518155 - DNA, 20 bp, Artificial Sequence
  chemically synthesized
caagcggatgactggaagtc

SEQ ID NO: 518156 - DNA, 20 bp, Artificial Sequence
  chemically synthesized
actttgggaggccaaggcaa

SEQ ID NO: 518157 - DNA, 20 bp, Artificial Sequence
  chemically synthesized
gccttggcctcccaaagtgc

SEQ ID NO: 518158 - DNA, 20 bp, Artificial Sequence
  chemically synthesized
ataaaaacctaacaaactgg

SEQ ID NO: 518159 - DNA, 20 bp, Artificial Sequence
  chemically synthesized
tacaacaaatgatttgactg

SEQ ID NO: 518160 - DNA, 20 bp, Artificial Sequence
  chemically synthesized
ttcagggaaaaaaaccctta

SEQ ID NO: 518161 - DNA, 20 bp, Artificial Sequence
  chemically synthesized
taaagttatttttactccat

SEQ ID NO: 518162 - DNA, 20 bp, Artificial Sequence
  chemically synthesized
aataactttatagtttattg

SEQ ID NO: 518163 - DNA, 20 bp, Artificial Sequence
  chemically synthesized
aatatgattaagaactaaca

SEQ ID NO: 518164 - DNA, 20 bp, Artificial Sequence
  chemically synthesized
gaatcatgaatagtttcatg

SEQ ID NO: 518165 - DNA, 20 bp, Artificial Sequence
  chemically synthesized
ttggtatggggagaagaatc

SEQ ID NO: 518166 - DNA, 20 bp, Artificial Sequence
  chemically synthesized
caaattattggtatggggag

SEQ ID NO: 518167 - DNA, 20 bp, Artificial Sequence
  chemically synthesized
gaaaacatgttatatgagaa

SEQ ID NO: 518168 - DNA, 20 bp, Artificial Sequence
  chemically synthesized
ataccgaaaacatgttatat

SEQ ID NO: 518169 - DNA, 20 bp, Artificial Sequence
  chemically synthesized
tatgtgtgtgtctctaggtc

SEQ ID NO: 518170 - DNA, 20 bp, Artificial Sequence
  chemically synthesized
ttctataaagttaaatatat

SEQ ID NO: 518171 - DNA, 20 bp, Artificial Sequence
  chemically synthesized
tccatatatatttaacttta

SEQ ID NO: 518172 - DNA, 20 bp, Artificial Sequence
  chemically synthesized
tatttaactttatagaattc

SEQ ID NO: 518173 - DNA, 20 bp, Artificial Sequence
  chemically synthesized
ctttctattcagtcaaattc

SEQ ID NO: 518174 - DNA, 20 bp, Artificial Sequence
  chemically synthesized
tatagaattcttgaatttga

SEQ ID NO: 518175 - DNA, 20 bp, Artificial Sequence
  chemically synthesized
ctgaatagaaagtggtggcc

SEQ ID NO: 518176 - DNA, 20 bp, Artificial Sequence
  chemically synthesized
tttgtgaatctcaaacctct

SEQ ID NO: 518177 - DNA, 20 bp, Artificial Sequence
  chemically synthesized
gccaaatcaagtgacctttt

SEQ ID NO: 518178 - DNA, 20 bp, Artificial Sequence
  chemically synthesized
gaagaaaatcataaatattt

SEQ ID NO: 518179 - DNA, 20 bp, Artificial Sequence
  chemically synthesized
tagggaaatctgacagcaaa

SEQ ID NO: 518180 - DNA, 20 bp, Artificial Sequence
  chemically synthesized
acagcaaaaggaatgagagc

SEQ ID NO: 518181 - DNA, 20 bp, Artificial Sequence
  chemically synthesized
aggatgttacattcaggggc

SEQ ID NO: 518182 - DNA, 20 bp, Artificial Sequence
  chemically synthesized
gcaaactgtaattcaggccc

SEQ ID NO: 518183 - DNA, 20 bp, Artificial Sequence
  chemically synthesized
aaatgtaatttttgctaagt

SEQ ID NO: 518184 - DNA, 20 bp, Artificial Sequence
  chemically synthesized
aaaaaccaaaaaaattataa

SEQ ID NO: 518185 - DNA, 20 bp, Artificial Sequence
  chemically synthesized
ttttttggttttttttaaga

SEQ ID NO: 518186 - DNA, 20 bp, Artificial Sequence
  chemically synthesized
tcttgctctgtagcccaggc

SEQ ID NO: 518187 - DNA, 20 bp, Artificial Sequence
  chemically synthesized
tacttgggaggctgaggtag

SEQ ID NO: 518188 - DNA, 20 bp, Artificial Sequence
  chemically synthesized
cctcagcctcccaagtagct

SEQ ID NO: 518189 - DNA, 20 bp, Artificial Sequence
  chemically synthesized
ctcaggagtttgaggcaagc

SEQ ID NO: 518190 - DNA, 20 bp, Artificial Sequence
  chemically synthesized
tgggcagatcacttgagctc

SEQ ID NO: 518191 - DNA, 20 bp, Artificial Sequence
  chemically synthesized
accttggcctcctaaagtgc

SEQ ID NO: 518192 - DNA, 20 bp, Artificial Sequence
  chemically synthesized
atgtgaatactggcatatta

SEQ ID NO: 518193 - DNA, 20 bp, Artificial Sequence
  chemically synthesized
tatgccagtattcacatagc

SEQ ID NO: 518194 - DNA, 20 bp, Artificial Sequence
  chemically synthesized
atgctcaaaactcttgctat

SEQ ID NO: 518195 - DNA, 20 bp, Artificial Sequence
  chemically synthesized
ccactaataaatgttaaagt

SEQ ID NO: 518196 - DNA, 20 bp, Artificial Sequence
  chemically synthesized
taacatttattagtgggacg

SEQ ID NO: 518197 - DNA, 20 bp, Artificial Sequence
  chemically synthesized
tttctttccatatgttaaat

SEQ ID NO: 518198 - DNA, 20 bp, Artificial Sequence
  chemically synthesized
taataatggtgtctaattca

SEQ ID NO: 518199 - DNA, 20 bp, Artificial Sequence
  chemically synthesized
taaattctcataagaatcct

SEQ ID NO: 518200 - DNA, 20 bp, Artificial Sequence
  chemically synthesized
ctaattcataggattcttat

SEQ ID NO: 518201 - DNA, 20 bp, Artificial Sequence
  chemically synthesized
atcaggcattaaattctcat

SEQ ID NO: 518202 - DNA, 20 bp, Artificial Sequence
  chemically synthesized
tgcctgattataagtgaggt

SEQ ID NO: 518203 - DNA, 20 bp, Artificial Sequence
  chemically synthesized
gtagctgttttatcattgtt

SEQ ID NO: 518204 - DNA, 20 bp, Artificial Sequence
  chemically synthesized
gcctgtaaataaagtttgtc

SEQ ID NO: 518205 - DNA, 20 bp, Artificial Sequence
  chemically synthesized
tctaggatgccatggaagac

SEQ ID NO: 518206 - DNA, 20 bp, Artificial Sequence
  chemically synthesized
ccacctttgtggagatttga

SEQ ID NO: 518207 - DNA, 20 bp, Artificial Sequence
  chemically synthesized
aaaccaaaacgtttggcacc

SEQ ID NO: 518208 - DNA, 20 bp, Artificial Sequence
  chemically synthesized
atatggctcaattggagtta

SEQ ID NO: 518209 - DNA, 20 bp, Artificial Sequence
  chemically synthesized
tgacagaaatatggctcaat

SEQ ID NO: 518210 - DNA, 20 bp, Artificial Sequence
  chemically synthesized
cacatatagttgacatttgg

SEQ ID NO: 518211 - DNA, 20 bp, Artificial Sequence
  chemically synthesized
ctaccatcttgccactaaat

SEQ ID NO: 518212 - DNA, 20 bp, Artificial Sequence
  chemically synthesized
atttagtggcaagatggtag

SEQ ID NO: 518213 - DNA, 20 bp, Artificial Sequence
  chemically synthesized
atgattaaatttaaaatcac

SEQ ID NO: 518214 - DNA, 20 bp, Artificial Sequence
  chemically synthesized
ccctacctttccatttgcca

SEQ ID NO: 518215 - DNA, 20 bp, Artificial Sequence
  chemically synthesized
ctcattggcaaatggaaagg

SEQ ID NO: 518216 - DNA, 20 bp, Artificial Sequence
  chemically synthesized
tatgtcctttcctcttcaat

SEQ ID NO: 518217 - DNA, 20 bp, Artificial Sequence
  chemically synthesized
tcctttcctcttcaatctgg

SEQ ID NO: 518218 - DNA, 20 bp, Artificial Sequence
  chemically synthesized
tgtaactacttcaacagata

SEQ ID NO: 518219 - DNA, 20 bp, Artificial Sequence
  chemically synthesized
ttcaacagatagaggatggc

SEQ ID NO: 518220 - DNA, 20 bp, Artificial Sequence
  chemically synthesized
atgttttgtgccctccatgg

SEQ ID NO: 518221 - DNA, 20 bp, Artificial Sequence
  chemically synthesized
aacagcgtttgcttggaacc

SEQ ID NO: 518222 - DNA, 20 bp, Artificial Sequence
  chemically synthesized
acacattttctatggtaact

SEQ ID NO: 518223 - DNA, 20 bp, Artificial Sequence
  chemically synthesized
tgagttaccatagaaaatgt

SEQ ID NO: 518224 - DNA, 20 bp, Artificial Sequence
  chemically synthesized
caagttcacatgtaggcctt

SEQ ID NO: 518225 - DNA, 20 bp, Artificial Sequence
  chemically synthesized
tggactcaatggctggaggg

SEQ ID NO: 518226 - DNA, 20 bp, Artificial Sequence
  chemically synthesized
agaattccaccctccagcca

SEQ ID NO: 518227 - DNA, 20 bp, Artificial Sequence
  chemically synthesized
taagttggactcaatggctg

SEQ ID NO: 518228 - DNA, 20 bp, Artificial Sequence
  chemically synthesized
aaattcagataggacacagc

SEQ ID NO: 518229 - DNA, 20 bp, Artificial Sequence
  chemically synthesized
acatccctgctgtgtcctat

SEQ ID NO: 518230 - DNA, 20 bp, Artificial Sequence
  chemically synthesized
tttattatgccgtggatgct

SEQ ID NO: 518231 - DNA, 20 bp, Artificial Sequence
  chemically synthesized
aacaattactttattatgcc

SEQ ID NO: 518232 - DNA, 20 bp, Artificial Sequence
  chemically synthesized
tgttttaaactgctaagtat

SEQ ID NO: 518233 - DNA, 20 bp, Artificial Sequence
  chemically synthesized
ttatacacagcaaaagtaag

SEQ ID NO: 518234 - DNA, 20 bp, Artificial Sequence
  chemically synthesized
gaaatatgtagacatattgg

SEQ ID NO: 518235 - DNA, 20 bp, Artificial Sequence
  chemically synthesized
ttctcattaagaaaacattt

SEQ ID NO: 518236 - DNA, 20 bp, Artificial Sequence
  chemically synthesized
caaggcacagaaataaaaaa

SEQ ID NO: 518237 - DNA, 20 bp, Artificial Sequence
  chemically synthesized
aaaaaaggcacgtccactaa

SEQ ID NO: 518238 - DNA, 20 bp, Artificial Sequence
  chemically synthesized
gataatttttattctgatta

SEQ ID NO: 518239 - DNA, 20 bp, Artificial Sequence
  chemically synthesized
atgtttctttatcccataat

SEQ ID NO: 518240 - DNA, 20 bp, Artificial Sequence
  chemically synthesized
aagtgggaaaaaaaagcctt

SEQ ID NO: 518241 - DNA, 20 bp, Artificial Sequence
  chemically synthesized
tgtccatttatcaccagttt

SEQ ID NO: 518242 - DNA, 20 bp, Artificial Sequence
  chemically synthesized
gctaaataaaatttcattgt

SEQ ID NO: 518243 - DNA, 20 bp, Artificial Sequence
  chemically synthesized
aattttatttagcaaataaa

SEQ ID NO: 518244 - DNA, 20 bp, Artificial Sequence
  chemically synthesized
agactgatacattctacaat

SEQ ID NO: 518245 - DNA, 20 bp, Artificial Sequence
  chemically synthesized
tttaaggtccattcatattg

SEQ ID NO: 518246 - DNA, 20 bp, Artificial Sequence
  chemically synthesized
ttttggacatttcatataaa

SEQ ID NO: 518247 - DNA, 20 bp, Artificial Sequence
  chemically synthesized
agatctatagagacacaaca

SEQ ID NO: 518248 - DNA, 20 bp, Artificial Sequence
  chemically synthesized
gccagaggctagagggagag

SEQ ID NO: 518249 - DNA, 20 bp, Artificial Sequence
  chemically synthesized
gctagagggagagaggaatg

SEQ ID NO: 518250 - DNA, 20 bp, Artificial Sequence
  chemically synthesized
atgggcatacagtttctttt

SEQ ID NO: 518251 - DNA, 20 bp, Artificial Sequence
  chemically synthesized
ctatcatcactatctagttg

SEQ ID NO: 518252 - DNA, 20 bp, Artificial Sequence
  chemically synthesized
gtgaacatactgaaaaaaca

SEQ ID NO: 518253 - DNA, 20 bp, Artificial Sequence
  chemically synthesized
cactgaattgtacacttcta

SEQ ID NO: 518254 - DNA, 20 bp, Artificial Sequence
  chemically synthesized
gaattgtacacttctagaga

SEQ ID NO: 518255 - DNA, 20 bp, Artificial Sequence
  chemically synthesized
gagagtgaattttacagtat

SEQ ID NO: 518256 - DNA, 20 bp, Artificial Sequence
  chemically synthesized
agctgctgtaacaaaatccc

SEQ ID NO: 518257 - DNA, 20 bp, Artificial Sequence
  chemically synthesized
atttagaaatgggatatcct

SEQ ID NO: 518258 - DNA, 20 bp, Artificial Sequence
  chemically synthesized
aaaatacgtttatttagaaa

SEQ ID NO: 518259 - DNA, 20 bp, Artificial Sequence
  chemically synthesized
ctttttggaagcagatttct

SEQ ID NO: 518260 - DNA, 20 bp, Artificial Sequence
  chemically synthesized
aaaaagacaggatatataag

SEQ ID NO: 518261 - DNA, 20 bp, Artificial Sequence
  chemically synthesized
gccttaaatttaaaaaaaga

SEQ ID NO: 518262 - DNA, 20 bp, Artificial Sequence
  chemically synthesized
agtagcaataatcccaattc

SEQ ID NO: 518263 - DNA, 20 bp, Artificial Sequence
  chemically synthesized
ttgttgaatcactcgggaat

SEQ ID NO: 518264 - DNA, 20 bp, Artificial Sequence
  chemically synthesized
taaaacttgttgaatcactc

SEQ ID NO: 518265 - DNA, 20 bp, Artificial Sequence
  chemically synthesized
catctgcacaataaaacttg

SEQ ID NO: 518266 - DNA, 20 bp, Artificial Sequence
  chemically synthesized
aaggctgtgaaatagttctt

SEQ ID NO: 518267 - DNA, 20 bp, Artificial Sequence
  chemically synthesized
aaagtaaacttaaaattagg

SEQ ID NO: 518268 - DNA, 20 bp, Artificial Sequence
  chemically synthesized
acatgtttacaggcatggga

SEQ ID NO: 518269 - DNA, 20 bp, Artificial Sequence
  chemically synthesized
ggataaatgaagctagaaaa

SEQ ID NO: 518270 - DNA, 20 bp, Artificial Sequence
  chemically synthesized
tcagtggttgtgtaagtttc

SEQ ID NO: 518271 - DNA, 20 bp, Artificial Sequence
  chemically synthesized
cactgactaaacattttatt

SEQ ID NO: 518272 - DNA, 20 bp, Artificial Sequence
  chemically synthesized
gcaaatagcagtatctgcca

SEQ ID NO: 518273 - DNA, 20 bp, Artificial Sequence
  chemically synthesized
ctatttctttgctgggttta

SEQ ID NO: 518274 - DNA, 20 bp, Artificial Sequence
  chemically synthesized
tcaagacaactatttctttg

SEQ ID NO: 518275 - DNA, 20 bp, Artificial Sequence
  chemically synthesized
ttttagaatttgtttttact

SEQ ID NO: 518276 - DNA, 20 bp, Artificial Sequence
  chemically synthesized
tactatgctttttaaatttt

SEQ ID NO: 518277 - DNA, 20 bp, Artificial Sequence
  chemically synthesized
tttaaaaagcaaaatgtgga

SEQ ID NO: 518278 - DNA, 20 bp, Artificial Sequence
  chemically synthesized
aaagtttaaaaagcaaaatg

SEQ ID NO: 518279 - DNA, 20 bp, Artificial Sequence
  chemically synthesized
tggcttactgtctacttttt

SEQ ID NO: 518280 - DNA, 20 bp, Artificial Sequence
  chemically synthesized
gacagtaagccagctcctgg

SEQ ID NO: 518281 - DNA, 20 bp, Artificial Sequence
  chemically synthesized
gaattggaaatcaactgcat

SEQ ID NO: 518282 - DNA, 20 bp, Artificial Sequence
  chemically synthesized
ctcaggacaagtagataggg

SEQ ID NO: 518283 - DNA, 20 bp, Artificial Sequence
  chemically synthesized
cagatgccaaaaggccatga

SEQ ID NO: 518284 - DNA, 20 bp, Artificial Sequence
  chemically synthesized
catctgagaggacgacagct

SEQ ID NO: 518285 - DNA, 20 bp, Artificial Sequence
  chemically synthesized
ggacgacagctagggatttc

SEQ ID NO: 518286 - DNA, 20 bp, Artificial Sequence
  chemically synthesized
gaaaccatcatcttgcaacc

SEQ ID NO: 518287 - DNA, 20 bp, Artificial Sequence
  chemically synthesized
aaccaagagttgacaagcat

SEQ ID NO: 518288 - DNA, 20 bp, Artificial Sequence
  chemically synthesized
gcaagaagatcaaaggggcc

SEQ ID NO: 518289 - DNA, 20 bp, Artificial Sequence
  chemically synthesized
tatgatggaatctgaaggaa

SEQ ID NO: 518290 - DNA, 20 bp, Artificial Sequence
  chemically synthesized
tctcatatgatggaatctga

SEQ ID NO: 518291 - DNA, 20 bp, Artificial Sequence
  chemically synthesized
attttaactttctcatatga

SEQ ID NO: 518292 - DNA, 20 bp, Artificial Sequence
  chemically synthesized
agtagcagaaactagaacca

SEQ ID NO: 518293 - DNA, 20 bp, Artificial Sequence
  chemically synthesized
atgagccaccgtgccaggcc

SEQ ID NO: 518294 - DNA, 20 bp, Artificial Sequence
  chemically synthesized
acctcggcctcccaaagtgc

SEQ ID NO: 518295 - DNA, 20 bp, Artificial Sequence
  chemically synthesized
actttgggaggccgaggtag

SEQ ID NO: 518296 - DNA, 20 bp, Artificial Sequence
  chemically synthesized
ttttgtatttttagtagaga

SEQ ID NO: 518297 - DNA, 20 bp, Artificial Sequence
  chemically synthesized
actaaaaatacaaaaattag

SEQ ID NO: 518298 - DNA, 20 bp, Artificial Sequence
  chemically synthesized
gcctcagcctcccgagtagc

SEQ ID NO: 518299 - DNA, 20 bp, Artificial Sequence
  chemically synthesized
gattctcctgcctcagcctc

SEQ ID NO: 518300 - DNA, 20 bp, Artificial Sequence
  chemically synthesized
tactcgggaggctgaggcag

SEQ ID NO: 518301 - DNA, 20 bp, Artificial Sequence
  chemically synthesized
gctgggaggcggaggttgca

SEQ ID NO: 518302 - DNA, 20 bp, Artificial Sequence
  chemically synthesized
tctcgttctattaccaaagc

SEQ ID NO: 518303 - DNA, 20 bp, Artificial Sequence
  chemically synthesized
tgtatttttttttttttgag

SEQ ID NO: 518304 - DNA, 20 bp, Artificial Sequence
  chemically synthesized
agttgagaggaactgcaagt

SEQ ID NO: 518305 - DNA, 20 bp, Artificial Sequence
  chemically synthesized
actgggcacaccaccatacc

SEQ ID NO: 518306 - DNA, 20 bp, Artificial Sequence
  chemically synthesized
tcacgtttcttaaatgtacc

SEQ ID NO: 518307 - DNA, 20 bp, Artificial Sequence
  chemically synthesized
gcactgtgattgtccccata

SEQ ID NO: 518308 - DNA, 20 bp, Artificial Sequence
  chemically synthesized
ctggactttcctgcgtgtta

SEQ ID NO: 518309 - DNA, 20 bp, Artificial Sequence
  chemically synthesized
acgcaggaaagtccaggaaa

SEQ ID NO: 518310 - DNA, 20 bp, Artificial Sequence
  chemically synthesized
tgtcccctacttttcaaaag

SEQ ID NO: 518311 - DNA, 20 bp, Artificial Sequence
  chemically synthesized
gacagcctgtttataagtat

SEQ ID NO: 518312 - DNA, 20 bp, Artificial Sequence
  chemically synthesized
ttatatgcactgcattttcc

SEQ ID NO: 518313 - DNA, 20 bp, Artificial Sequence
  chemically synthesized
attttccctttgatttattg

SEQ ID NO: 518314 - DNA, 20 bp, Artificial Sequence
  chemically synthesized
taataacatttggtaaagtt

SEQ ID NO: 518315 - DNA, 20 bp, Artificial Sequence
  chemically synthesized
aacagcatattttaaagtaa

SEQ ID NO: 518316 - DNA, 20 bp, Artificial Sequence
  chemically synthesized
gacgtatgcaggtgagtggt

SEQ ID NO: 518317 - DNA, 20 bp, Artificial Sequence
  chemically synthesized
cgaaatgctgacgtatgcag

SEQ ID NO: 518318 - DNA, 20 bp, Artificial Sequence
  chemically synthesized
gtacctttcttattttcata

SEQ ID NO: 518319 - DNA, 20 bp, Artificial Sequence
  chemically synthesized
acaataatgaattaaaaata

SEQ ID NO: 518320 - DNA, 20 bp, Artificial Sequence
  chemically synthesized
aaataaatcaaaggacaata

SEQ ID NO: 518321 - DNA, 20 bp, Artificial Sequence
  chemically synthesized
tttttacaaggtaattgttt

SEQ ID NO: 518322 - DNA, 20 bp, Artificial Sequence
  chemically synthesized
atttttggtaaattctcttt

SEQ ID NO: 518323 - DNA, 20 bp, Artificial Sequence
  chemically synthesized
ctcccattactatcctcaaa

SEQ ID NO: 518324 - DNA, 20 bp, Artificial Sequence
  chemically synthesized
ttctctttgaggatagtaat

SEQ ID NO: 518325 - DNA, 20 bp, Artificial Sequence
  chemically synthesized
acaaaatatgtcttacaaaa

SEQ ID NO: 518326 - DNA, 20 bp, Artificial Sequence
  chemically synthesized
aaagagggtgttcagtctta

SEQ ID NO: 518327 - DNA, 20 bp, Artificial Sequence
  chemically synthesized
acctgtaatcccaacacatt

SEQ ID NO: 518328 - DNA, 20 bp, Artificial Sequence
  chemically synthesized
accttggactcccaatgtgt

SEQ ID NO: 518329 - DNA, 20 bp, Artificial Sequence
  chemically synthesized
cattgggagtccaaggtggg

SEQ ID NO: 518330 - DNA, 20 bp, Artificial Sequence
  chemically synthesized
ggggcggatcgcttgaggtc

SEQ ID NO: 518331 - DNA, 20 bp, Artificial Sequence
  chemically synthesized
ttttattgtaacagtggaga

SEQ ID NO: 518332 - DNA, 20 bp, Artificial Sequence
  chemically synthesized
tcctgagcagctgggactat

SEQ ID NO: 518333 - DNA, 20 bp, Artificial Sequence
  chemically synthesized
tgctcaggaggttgagacag

SEQ ID NO: 518334 - DNA, 20 bp, Artificial Sequence
  chemically synthesized
ctcaatgcaacctccgcctc

SEQ ID NO: 518335 - DNA, 20 bp, Artificial Sequence
  chemically synthesized
tcatgccactgcactccagc

SEQ ID NO: 518336 - DNA, 20 bp, Artificial Sequence
  chemically synthesized
tcttgctctgtcactcaggc

SEQ ID NO: 518337 - DNA, 20 bp, Artificial Sequence
  chemically synthesized
tttttttcttttttgtgaga

SEQ ID NO: 518338 - DNA, 20 bp, Artificial Sequence
  chemically synthesized
gaaaatcataatttaatcaa

SEQ ID NO: 518339 - DNA, 20 bp, Artificial Sequence
  chemically synthesized
ccgacttggttctaaagaag

SEQ ID NO: 518340 - DNA, 20 bp, Artificial Sequence
  chemically synthesized
actaaatataagactcaacc

SEQ ID NO: 518341 - DNA, 20 bp, Artificial Sequence
  chemically synthesized
ttttctgaaattactctggg

SEQ ID NO: 518342 - DNA, 20 bp, Artificial Sequence
  chemically synthesized
attttttttctgaaattact

SEQ ID NO: 518343 - DNA, 20 bp, Artificial Sequence
  chemically synthesized
gcaagctgctacaaggaagg

SEQ ID NO: 518344 - DNA, 20 bp, Artificial Sequence
  chemically synthesized
tataagtctttgacctttct

SEQ ID NO: 518345 - DNA, 20 bp, Artificial Sequence
  chemically synthesized
tcagtgtgggaaggaaatgg

SEQ ID NO: 518346 - DNA, 20 bp, Artificial Sequence
  chemically synthesized
gtgggaaggaaatggaggaa

SEQ ID NO: 518347 - DNA, 20 bp, Artificial Sequence
  chemically synthesized
ttgcccatcgttatgtttag

SEQ ID NO: 518348 - DNA, 20 bp, Artificial Sequence
  chemically synthesized
tttaagtcttattttataaa

SEQ ID NO: 518349 - DNA, 20 bp, Artificial Sequence
  chemically synthesized
tttcacagccaggaaaaaca

SEQ ID NO: 518350 - DNA, 20 bp, Artificial Sequence
  chemically synthesized
ccagttatagctgaccttta

SEQ ID NO: 518351 - DNA, 20 bp, Artificial Sequence
  chemically synthesized
tgacctttactgggtaaaac

SEQ ID NO: 518352 - DNA, 20 bp, Artificial Sequence
  chemically synthesized
taagagaaaagtcttcttca

SEQ ID NO: 518353 - DNA, 20 bp, Artificial Sequence
  chemically synthesized
cgcccagttcatgaaaacca

SEQ ID NO: 518354 - DNA, 20 bp, Artificial Sequence
  chemically synthesized
gcggactgctacagggcagg

SEQ ID NO: 518355 - DNA, 20 bp, Artificial Sequence
  chemically synthesized
cacggggcctacactggccc

SEQ ID NO: 518356 - DNA, 20 bp, Artificial Sequence
  chemically synthesized
ccctgtgctaagaggcagcc

SEQ ID NO: 518357 - DNA, 20 bp, Artificial Sequence
  chemically synthesized
agcaaggcagctatatagca

SEQ ID NO: 518358 - DNA, 20 bp, Artificial Sequence
  chemically synthesized
tcctgagataaaggcagaaa

SEQ ID NO: 518359 - DNA, 20 bp, Artificial Sequence
  chemically synthesized
tttatctcaggaaattccaa

SEQ ID NO: 518360 - DNA, 20 bp, Artificial Sequence
  chemically synthesized
gcatgagcttcatactcact

SEQ ID NO: 518361 - DNA, 20 bp, Artificial Sequence
  chemically synthesized
caaaatagcaagctctttgc

SEQ ID NO: 518362 - DNA, 20 bp, Artificial Sequence
  chemically synthesized
atttatctttttttttgaga

SEQ ID NO: 518363 - DNA, 20 bp, Artificial Sequence
  chemically synthesized
ctgcactccaatctgggtga

SEQ ID NO: 518364 - DNA, 20 bp, Artificial Sequence
  chemically synthesized
tctcactctctcacccagat

SEQ ID NO: 518365 - DNA, 20 bp, Artificial Sequence
  chemically synthesized
ttgcaccactgcactccaat

SEQ ID NO: 518366 - DNA, 20 bp, Artificial Sequence
  chemically synthesized
tactcaggaggctgaggtgg

SEQ ID NO: 518367 - DNA, 20 bp, Artificial Sequence
  chemically synthesized
gattcccccacctcagcctc

SEQ ID NO: 518368 - DNA, 20 bp, Artificial Sequence
  chemically synthesized
acctcagcctcctgagtagc

SEQ ID NO: 518369 - DNA, 20 bp, Artificial Sequence
  chemically synthesized
tttttatatttttagtagag

SEQ ID NO: 518370 - DNA, 20 bp, Artificial Sequence
  chemically synthesized
caggtggatcatttgaggtc

SEQ ID NO: 518371 - DNA, 20 bp, Artificial Sequence
  chemically synthesized
actttgggaggcccagacag

SEQ ID NO: 518372 - DNA, 20 bp, Artificial Sequence
  chemically synthesized
gtctgggcctcccaaagtgc

SEQ ID NO: 518373 - DNA, 20 bp, Artificial Sequence
  chemically synthesized
agactatcagtggaaagcac

SEQ ID NO: 518374 - DNA, 20 bp, Artificial Sequence
  chemically synthesized
atagttacaatgagttcttc

SEQ ID NO: 518375 - DNA, 20 bp, Artificial Sequence
  chemically synthesized
ctcttttggccatagttaca

SEQ ID NO: 518376 - DNA, 20 bp, Artificial Sequence
  chemically synthesized
ctcattgtaactatggccaa

SEQ ID NO: 518377 - DNA, 20 bp, Artificial Sequence
  chemically synthesized
aggagaaataattttctaga

SEQ ID NO: 518378 - DNA, 20 bp, Artificial Sequence
  chemically synthesized
tttataatttacaagttctt

SEQ ID NO: 518379 - DNA, 20 bp, Artificial Sequence
  chemically synthesized
ttgtggttttgtacaaaatt

SEQ ID NO: 518380 - DNA, 20 bp, Artificial Sequence
  chemically synthesized
atgatctccaactctgacaa

SEQ ID NO: 518381 - DNA, 20 bp, Artificial Sequence
  chemically synthesized
taaaaataagaccccattgt

SEQ ID NO: 518382 - DNA, 20 bp, Artificial Sequence
  chemically synthesized
taaagaaactctctttgaac

SEQ ID NO: 518383 - DNA, 20 bp, Artificial Sequence
  chemically synthesized
tcatctgattcaggttcaaa

SEQ ID NO: 518384 - DNA, 20 bp, Artificial Sequence
  chemically synthesized
ctttgaacctgaatcagatg

SEQ ID NO: 518385 - DNA, 20 bp, Artificial Sequence
  chemically synthesized
agtcacttattttctgggct

SEQ ID NO: 518386 - DNA, 20 bp, Artificial Sequence
  chemically synthesized
ctgggcttagagttactctg

SEQ ID NO: 518387 - DNA, 20 bp, Artificial Sequence
  chemically synthesized
attaaacattggttactctc

SEQ ID NO: 518388 - DNA, 20 bp, Artificial Sequence
  chemically synthesized
ccttttgtccaaaattccat

SEQ ID NO: 518389 - DNA, 20 bp, Artificial Sequence
  chemically synthesized
aataccttccgtcattccaa

SEQ ID NO: 518390 - DNA, 20 bp, Artificial Sequence
  chemically synthesized
aattttattcctctaaacac

SEQ ID NO: 518391 - DNA, 20 bp, Artificial Sequence
  chemically synthesized
gaaggtattcatgtgtttag

SEQ ID NO: 518392 - DNA, 20 bp, Artificial Sequence
  chemically synthesized
aaaatactgaaagatgtaga

SEQ ID NO: 518393 - DNA, 20 bp, Artificial Sequence
  chemically synthesized
cactggtaaagaaaacaaag

SEQ ID NO: 518394 - DNA, 20 bp, Artificial Sequence
  chemically synthesized
tcaataaaaccacaaacacc

SEQ ID NO: 518395 - DNA, 20 bp, Artificial Sequence
  chemically synthesized
atctcctttacaacagccag

SEQ ID NO: 518396 - DNA, 20 bp, Artificial Sequence
  chemically synthesized
ggctgttgtaaaggagatta

SEQ ID NO: 518397 - DNA, 20 bp, Artificial Sequence
  chemically synthesized
agtctcatatagaagctatt

SEQ ID NO: 518398 - DNA, 20 bp, Artificial Sequence
  chemically synthesized
atatagaagctattgtgggt

SEQ ID NO: 518399 - DNA, 20 bp, Artificial Sequence
  chemically synthesized
acagtaatggacagctattg

SEQ ID NO: 518400 - DNA, 20 bp, Artificial Sequence
  chemically synthesized
cccattttcaatatggcaaa

SEQ ID NO: 518401 - DNA, 20 bp, Artificial Sequence
  chemically synthesized
tccatttgccatattgaaaa

SEQ ID NO: 518402 - DNA, 20 bp, Artificial Sequence
  chemically synthesized
gcctcggcctcccaaagtgc

SEQ ID NO: 518403 - DNA, 20 bp, Artificial Sequence
  chemically synthesized
cgggcagatcacttgaggtc

SEQ ID NO: 518404 - DNA, 20 bp, Artificial Sequence
  chemically synthesized
ttttctgtttttagtagaga

SEQ ID NO: 518405 - DNA, 20 bp, Artificial Sequence
  chemically synthesized
gcctcagcctcccgagtagc

SEQ ID NO: 518406 - DNA, 20 bp, Artificial Sequence
  chemically synthesized
attcctcgcgcctcagcctc

SEQ ID NO: 518407 - DNA, 20 bp, Artificial Sequence
  chemically synthesized
actcgggaggctgaggcgcg

SEQ ID NO: 518408 - DNA, 20 bp, Artificial Sequence
  chemically synthesized
ttcactgcaacctccgcctc

SEQ ID NO: 518409 - DNA, 20 bp, Artificial Sequence
  chemically synthesized
tctggctctgtcgcccaagc

SEQ ID NO: 518410 - DNA, 20 bp, Artificial Sequence
  chemically synthesized
ttttttttttttttttgaga

SEQ ID NO: 518411 - DNA, 20 bp, Artificial Sequence
  chemically synthesized
aaaaaaaaaaaaaaaaaaaa

SEQ ID NO: 518412 - DNA, 20 bp, Artificial Sequence
  chemically synthesized
aaaaaaaaaaaggagtaaaa

SEQ ID NO: 518413 - DNA, 20 bp, Artificial Sequence
  chemically synthesized
aaaaggagtaaaatggagta

SEQ ID NO: 518414 - DNA, 20 bp, Artificial Sequence
  chemically synthesized
atggagtacagggtattagg

SEQ ID NO: 518415 - DNA, 20 bp, Artificial Sequence
  chemically synthesized
aagggaagaagacattgtgt

SEQ ID NO: 518416 - DNA, 20 bp, Artificial Sequence
  chemically synthesized
ctaggctgaaggatgatagt

SEQ ID NO: 518417 - DNA, 20 bp, Artificial Sequence
  chemically synthesized
tggtggtagagactaggctg

SEQ ID NO: 518418 - DNA, 20 bp, Artificial Sequence
  chemically synthesized
cttgggagcaggttggagaa

SEQ ID NO: 518419 - DNA, 20 bp, Artificial Sequence
  chemically synthesized
atttgtttccttgtactatg

SEQ ID NO: 518420 - DNA, 20 bp, Artificial Sequence
  chemically synthesized
agtacaaggaaacaaatttt

SEQ ID NO: 518421 - DNA, 20 bp, Artificial Sequence
  chemically synthesized
gtcttcatattacttataga

SEQ ID NO: 518422 - DNA, 20 bp, Artificial Sequence
  chemically synthesized
attgattacgaacctaggtg

SEQ ID NO: 518423 - DNA, 20 bp, Artificial Sequence
  chemically synthesized
atcaattaagccgcacatat

SEQ ID NO: 518424 - DNA, 20 bp, Artificial Sequence
  chemically synthesized
gccgcacatataggagtcag

SEQ ID NO: 518425 - DNA, 20 bp, Artificial Sequence
  chemically synthesized
cttccatttaatgcttacta

SEQ ID NO: 518426 - DNA, 20 bp, Artificial Sequence
  chemically synthesized
cccatgatataaattatata

SEQ ID NO: 518427 - DNA, 20 bp, Artificial Sequence
  chemically synthesized
tggcttcatgctctttaaat

SEQ ID NO: 518428 - DNA, 20 bp, Artificial Sequence
  chemically synthesized
cctgatttttggaggaggaa

SEQ ID NO: 518429 - DNA, 20 bp, Artificial Sequence
  chemically synthesized
tctaccctgatttttggagg

SEQ ID NO: 518430 - DNA, 20 bp, Artificial Sequence
  chemically synthesized
tcaattcctcctccaaaaat

SEQ ID NO: 518431 - DNA, 20 bp, Artificial Sequence
  chemically synthesized
ttcatttctgctttcttaat

SEQ ID NO: 518432 - DNA, 20 bp, Artificial Sequence
  chemically synthesized
aattgtggagagaactacgc

SEQ ID NO: 518433 - DNA, 20 bp, Artificial Sequence
  chemically synthesized
tagcgtagttctctccacaa

SEQ ID NO: 518434 - DNA, 20 bp, Artificial Sequence
  chemically synthesized
tatttgaaacaacaagcaag

SEQ ID NO: 518435 - DNA, 20 bp, Artificial Sequence
  chemically synthesized
gtctcattttcaatattctt

SEQ ID NO: 518436 - DNA, 20 bp, Artificial Sequence
  chemically synthesized
gtttgaataagcaaactcta

SEQ ID NO: 518437 - DNA, 20 bp, Artificial Sequence
  chemically synthesized
gatgataattagcaagaagt

SEQ ID NO: 518438 - DNA, 20 bp, Artificial Sequence
  chemically synthesized
tcatcagtcaatcttggtac

SEQ ID NO: 518439 - DNA, 20 bp, Artificial Sequence
  chemically synthesized
aacctcggctttggaaaaga

SEQ ID NO: 518440 - DNA, 20 bp, Artificial Sequence
  chemically synthesized
gccgaggttagcatgcttag

SEQ ID NO: 518441 - DNA, 20 bp, Artificial Sequence
  chemically synthesized
aggttagcatgcttagctga

SEQ ID NO: 518442 - DNA, 20 bp, Artificial Sequence
  chemically synthesized
ccagtgctagagagacattt

SEQ ID NO: 518443 - DNA, 20 bp, Artificial Sequence
  chemically synthesized
tctgaaatgtctctctagca

SEQ ID NO: 518444 - DNA, 20 bp, Artificial Sequence
  chemically synthesized
tcctagtcttgcaaatgcta

SEQ ID NO: 518445 - DNA, 20 bp, Artificial Sequence
  chemically synthesized
ttataaatacaacaaatatg

SEQ ID NO: 518446 - DNA, 20 bp, Artificial Sequence
  chemically synthesized
ttattgagatattaatttta

SEQ ID NO: 518447 - DNA, 20 bp, Artificial Sequence
  chemically synthesized
tattttcaactgacatgttt

SEQ ID NO: 518448 - DNA, 20 bp, Artificial Sequence
  chemically synthesized
aatagtgcatatatattagt

SEQ ID NO: 518449 - DNA, 20 bp, Artificial Sequence
  chemically synthesized
atattagtgtgaatgtatgt

SEQ ID NO: 518450 - DNA, 20 bp, Artificial Sequence
  chemically synthesized
tatgtgggggtatgtcaaaa

SEQ ID NO: 518451 - DNA, 20 bp, Artificial Sequence
  chemically synthesized
ataaagaaaaaaagcagaaa

SEQ ID NO: 518452 - DNA, 20 bp, Artificial Sequence
  chemically synthesized
acaacaaatcctaatgaacc

SEQ ID NO: 518453 - DNA, 20 bp, Artificial Sequence
  chemically synthesized
ttaatcaaccctgggttcat

SEQ ID NO: 518454 - DNA, 20 bp, Artificial Sequence
  chemically synthesized
ttatctgcatttaatcaacc

SEQ ID NO: 518455 - DNA, 20 bp, Artificial Sequence
  chemically synthesized
taccgttaatactttaatta

SEQ ID NO: 518456 - DNA, 20 bp, Artificial Sequence
  chemically synthesized
agtttatctttccagtaaga

SEQ ID NO: 518457 - DNA, 20 bp, Artificial Sequence
  chemically synthesized
gatgctttgtgtgttgttgc

SEQ ID NO: 518458 - DNA, 20 bp, Artificial Sequence
  chemically synthesized
tagtcactttttatagacac

SEQ ID NO: 518459 - DNA, 20 bp, Artificial Sequence
  chemically synthesized
gtgcttctgctttacttgga

SEQ ID NO: 518460 - DNA, 20 bp, Artificial Sequence
  chemically synthesized
gtctgtgcttctgctttact

SEQ ID NO: 518461 - DNA, 20 bp, Artificial Sequence
  chemically synthesized
cactgtacatgacacgttgt

SEQ ID NO: 518462 - DNA, 20 bp, Artificial Sequence
  chemically synthesized
atttaaattaacagaactag

SEQ ID NO: 518463 - DNA, 20 bp, Artificial Sequence
  chemically synthesized
gtttttattatatctgcact

SEQ ID NO: 518464 - DNA, 20 bp, Artificial Sequence
  chemically synthesized
gtaacagcaaaaaaactacc

SEQ ID NO: 518465 - DNA, 20 bp, Artificial Sequence
  chemically synthesized
aaatagactttttcatgaga

SEQ ID NO: 518466 - DNA, 20 bp, Artificial Sequence
  chemically synthesized
tctatttaggaacttctggt

SEQ ID NO: 518467 - DNA, 20 bp, Artificial Sequence
  chemically synthesized
gtgggaagaggaagggaaaa

SEQ ID NO: 518468 - DNA, 20 bp, Artificial Sequence
  chemically synthesized
acaaatgctggtaataatgc

SEQ ID NO: 518469 - DNA, 20 bp, Artificial Sequence
  chemically synthesized
tgactaccttcagagttatc

SEQ ID NO: 518470 - DNA, 20 bp, Artificial Sequence
  chemically synthesized
cgtcttcttctgactacctt

SEQ ID NO: 518471 - DNA, 20 bp, Artificial Sequence
  chemically synthesized
aggtagtcagaagaagacga

SEQ ID NO: 518472 - DNA, 20 bp, Artificial Sequence
  chemically synthesized
gacgacggagttttggttta

SEQ ID NO: 518473 - DNA, 20 bp, Artificial Sequence
  chemically synthesized
tactgggtctggagcagaag

SEQ ID NO: 518474 - DNA, 20 bp, Artificial Sequence
  chemically synthesized
tgggtctcgaaatggtgagt

SEQ ID NO: 518475 - DNA, 20 bp, Artificial Sequence
  chemically synthesized
tggttgtgggtctcgaaatg

SEQ ID NO: 518476 - DNA, 20 bp, Artificial Sequence
  chemically synthesized
gctgctttcgactgctggtt

SEQ ID NO: 518477 - DNA, 20 bp, Artificial Sequence
  chemically synthesized
gcttatctctccacatctaa

SEQ ID NO: 518478 - DNA, 20 bp, Artificial Sequence
  chemically synthesized
gagaacctgatgttgtctca

SEQ ID NO: 518479 - DNA, 20 bp, Artificial Sequence
  chemically synthesized
tctcctgacactttctagga

SEQ ID NO: 518480 - DNA, 20 bp, Artificial Sequence
  chemically synthesized
ctgacactttctaggacagg

SEQ ID NO: 518481 - DNA, 20 bp, Artificial Sequence
  chemically synthesized
ggatgggtagatgcaatcca

SEQ ID NO: 518482 - DNA, 20 bp, Artificial Sequence
  chemically synthesized
cccttactgttggcaattct

SEQ ID NO: 518483 - DNA, 20 bp, Artificial Sequence
  chemically synthesized
aagcaggcccaccaggaaca

SEQ ID NO: 518484 - DNA, 20 bp, Artificial Sequence
  chemically synthesized
ttactccttcacaggtatct

SEQ ID NO: 518485 - DNA, 20 bp, Artificial Sequence
  chemically synthesized
tcatccacagatacctgtga

SEQ ID NO: 518486 - DNA, 20 bp, Artificial Sequence
  chemically synthesized
cagatacctgtgaaggagta

SEQ ID NO: 518487 - DNA, 20 bp, Artificial Sequence
  chemically synthesized
cataccaatctggcatattt

SEQ ID NO: 518488 - DNA, 20 bp, Artificial Sequence
  chemically synthesized
ggagaaattgtagtttcaga

SEQ ID NO: 518489 - DNA, 20 bp, Artificial Sequence
  chemically synthesized
tgtgagggtgcccctcccag

SEQ ID NO: 518490 - DNA, 20 bp, Artificial Sequence
  chemically synthesized
gaggggcaccctcacaggac

SEQ ID NO: 518491 - DNA, 20 bp, Artificial Sequence
  chemically synthesized
ttttctcactctggtcctgt

SEQ ID NO: 518492 - DNA, 20 bp, Artificial Sequence
  chemically synthesized
agcccttattaccagagact

SEQ ID NO: 518493 - DNA, 20 bp, Artificial Sequence
  chemically synthesized
aattggaggcttcaatggac

SEQ ID NO: 518494 - DNA, 20 bp, Artificial Sequence
  chemically synthesized
gtataaaactagtgaaagat

SEQ ID NO: 518495 - DNA, 20 bp, Artificial Sequence
  chemically synthesized
gagtcactaggagatagata

SEQ ID NO: 518496 - DNA, 20 bp, Artificial Sequence
  chemically synthesized
ggacagtaaattttctctag

SEQ ID NO: 518497 - DNA, 20 bp, Artificial Sequence
  chemically synthesized
gaaagcaatgacaggataaa

SEQ ID NO: 518498 - DNA, 20 bp, Artificial Sequence
  chemically synthesized
atgaatttggaaagcaatga

SEQ ID NO: 518499 - DNA, 20 bp, Artificial Sequence
  chemically synthesized
aatgatgaatgatgaatttg

SEQ ID NO: 518500 - DNA, 20 bp, Artificial Sequence
  chemically synthesized
gatgcttttaatgatgaatg

SEQ ID NO: 518501 - DNA, 20 bp, Artificial Sequence
  chemically synthesized
aaagcaagatgcttttaatg

SEQ ID NO: 518502 - DNA, 20 bp, Artificial Sequence
  chemically synthesized
tcaggcagaaaacaaaagaa

SEQ ID NO: 518503 - DNA, 20 bp, Artificial Sequence
  chemically synthesized
gttcttagtaggctcttcag

SEQ ID NO: 518504 - DNA, 20 bp, Artificial Sequence
  chemically synthesized
agcctactaagaactaaaag

SEQ ID NO: 518505 - DNA, 20 bp, Artificial Sequence
  chemically synthesized
catgtgcaggtgtaggggaa

SEQ ID NO: 518506 - DNA, 20 bp, Artificial Sequence
  chemically synthesized
catcacatgtgcaggtgtag

SEQ ID NO: 518507 - DNA, 20 bp, Artificial Sequence
  chemically synthesized
tataggaacaccgagagaaa

SEQ ID NO: 518508 - DNA, 20 bp, Artificial Sequence
  chemically synthesized
agagaaactgaataaaattg

SEQ ID NO: 518509 - DNA, 20 bp, Artificial Sequence
  chemically synthesized
ctataatataatatcacagc

SEQ ID NO: 518510 - DNA, 20 bp, Artificial Sequence
  chemically synthesized
aaaaaatggtaaagtgtaca

SEQ ID NO: 518511 - DNA, 20 bp, Artificial Sequence
  chemically synthesized
tacagttaataagaaataat

SEQ ID NO: 518512 - DNA, 20 bp, Artificial Sequence
  chemically synthesized
ttgatttttttattttctgt

SEQ ID NO: 518513 - DNA, 20 bp, Artificial Sequence
  chemically synthesized
agatgattctcaattatata

SEQ ID NO: 518514 - DNA, 20 bp, Artificial Sequence
  chemically synthesized
attttattcactatataatt

SEQ ID NO: 518515 - DNA, 20 bp, Artificial Sequence
  chemically synthesized
tgctgaaagttcagcttgct

SEQ ID NO: 518516 - DNA, 20 bp, Artificial Sequence
  chemically synthesized
tcagcaatttactaagttat

SEQ ID NO: 518517 - DNA, 20 bp, Artificial Sequence
  chemically synthesized
ttttctttagctggcaggga

SEQ ID NO: 518518 - DNA, 20 bp, Artificial Sequence
  chemically synthesized
aaccaccatttttaataaca

SEQ ID NO: 518519 - DNA, 20 bp, Artificial Sequence
  chemically synthesized
aaacacattaccaattttaa

SEQ ID NO: 518520 - DNA, 20 bp, Artificial Sequence
  chemically synthesized
aagtgatcaccagagacaca

SEQ ID NO: 518521 - DNA, 20 bp, Artificial Sequence
  chemically synthesized
accagagacacatggagtgt

SEQ ID NO: 518522 - DNA, 20 bp, Artificial Sequence
  chemically synthesized
catggagtgtgtgagtgtag

SEQ ID NO: 518523 - DNA, 20 bp, Artificial Sequence
  chemically synthesized
atttatttacttatttgaga

SEQ ID NO: 518524 - DNA, 20 bp, Artificial Sequence
  chemically synthesized
tacttgggaggctgaggcag

SEQ ID NO: 518525 - DNA, 20 bp, Artificial Sequence
  chemically synthesized
gcctcagcctcccaagtagc

SEQ ID NO: 518526 - DNA, 20 bp, Artificial Sequence
  chemically synthesized
aaaattagccgggtgtggtg

SEQ ID NO: 518527 - DNA, 20 bp, Artificial Sequence
  chemically synthesized
actaaaaatacaaaaattag

SEQ ID NO: 518528 - DNA, 20 bp, Artificial Sequence
  chemically synthesized
ttttgtatttttagtagaga

SEQ ID NO: 518529 - DNA, 20 bp, Artificial Sequence
  chemically synthesized
cgggtggatcacctgaggtc

SEQ ID NO: 518530 - DNA, 20 bp, Artificial Sequence
  chemically synthesized
actttgggcggccaaagcgg

SEQ ID NO: 518531 - DNA, 20 bp, Artificial Sequence
  chemically synthesized
cagcactttgggcggccaaa

SEQ ID NO: 518532 - DNA, 20 bp, Artificial Sequence
  chemically synthesized
gctttggccgcccaaagtgc

SEQ ID NO: 518533 - DNA, 20 bp, Artificial Sequence
  chemically synthesized
gcccaaagtgctgggattgt

SEQ ID NO: 518534 - DNA, 20 bp, Artificial Sequence
  chemically synthesized
taaaaatagtatcttctact

SEQ ID NO: 518535 - DNA, 20 bp, Artificial Sequence
  chemically synthesized
atgggaatcaattatgttcc

SEQ ID NO: 518536 - DNA, 20 bp, Artificial Sequence
  chemically synthesized
ggaacataattgattcccat

SEQ ID NO: 518537 - DNA, 20 bp, Artificial Sequence
  chemically synthesized
ttactcctacaaattctaat

SEQ ID NO: 518538 - DNA, 20 bp, Artificial Sequence
  chemically synthesized
tgattcccattagaatttgt

SEQ ID NO: 518539 - DNA, 20 bp, Artificial Sequence
  chemically synthesized
ctgcttgtgtaattaactcc

SEQ ID NO: 518540 - DNA, 20 bp, Artificial Sequence
  chemically synthesized
gaaggatatttctttatcca

SEQ ID NO: 518541 - DNA, 20 bp, Artificial Sequence
  chemically synthesized
aagctagtaaatggaagggg

SEQ ID NO: 518542 - DNA, 20 bp, Artificial Sequence
  chemically synthesized
aggtcttccactagaaatat

SEQ ID NO: 518543 - DNA, 20 bp, Artificial Sequence
  chemically synthesized
ttttcagaattagttgccct

SEQ ID NO: 518544 - DNA, 20 bp, Artificial Sequence
  chemically synthesized
tagggcaactaattctgaaa

SEQ ID NO: 518545 - DNA, 20 bp, Artificial Sequence
  chemically synthesized
attcacttatcacccgtttt

SEQ ID NO: 518546 - DNA, 20 bp, Artificial Sequence
  chemically synthesized
attctgaaaacgggtgataa

SEQ ID NO: 518547 - DNA, 20 bp, Artificial Sequence
  chemically synthesized
tcttatacagatgtagagct

SEQ ID NO: 518548 - DNA, 20 bp, Artificial Sequence
  chemically synthesized
cctaagctctacatctgtat

SEQ ID NO: 518549 - DNA, 20 bp, Artificial Sequence
  chemically synthesized
tatagatacaagtatattga

SEQ ID NO: 518550 - DNA, 20 bp, Artificial Sequence
  chemically synthesized
gcatgtgtgtatgcacacac

SEQ ID NO: 518551 - DNA, 20 bp, Artificial Sequence
  chemically synthesized
catacacacatgcacagcta

SEQ ID NO: 518552 - DNA, 20 bp, Artificial Sequence
  chemically synthesized
attttaggactttacataaa

SEQ ID NO: 518553 - DNA, 20 bp, Artificial Sequence
  chemically synthesized
aatggaaacttggtaagttt

SEQ ID NO: 518554 - DNA, 20 bp, Artificial Sequence
  chemically synthesized
aaccacaaattgctatagtt

SEQ ID NO: 518555 - DNA, 20 bp, Artificial Sequence
  chemically synthesized
aattgctatagttaagagtt

SEQ ID NO: 518556 - DNA, 20 bp, Artificial Sequence
  chemically synthesized
acaaatgagagcattcattt

SEQ ID NO: 518557 - DNA, 20 bp, Artificial Sequence
  chemically synthesized
gttatggtaggtattcagaa

SEQ ID NO: 518558 - DNA, 20 bp, Artificial Sequence
  chemically synthesized
cagaaaaaaaaaatcatatt

SEQ ID NO: 518559 - DNA, 20 bp, Artificial Sequence
  chemically synthesized
aaggttctccgggagtaaac

SEQ ID NO: 518560 - DNA, 20 bp, Artificial Sequence
  chemically synthesized
gaaataggttaaggttctcc

SEQ ID NO: 518561 - DNA, 20 bp, Artificial Sequence
  chemically synthesized
aacatctttgggaagatgtc

SEQ ID NO: 518562 - DNA, 20 bp, Artificial Sequence
  chemically synthesized
ttctattacactcttctgat

SEQ ID NO: 518563 - DNA, 20 bp, Artificial Sequence
  chemically synthesized
ttttctttgactcaaatcag

SEQ ID NO: 518564 - DNA, 20 bp, Artificial Sequence
  chemically synthesized
taataggacagcccagggag

SEQ ID NO: 518565 - DNA, 20 bp, Artificial Sequence
  chemically synthesized
tataggtttcaacaattaat

SEQ ID NO: 518566 - DNA, 20 bp, Artificial Sequence
  chemically synthesized
gtgtatttgcttttcattgt

SEQ ID NO: 518567 - DNA, 20 bp, Artificial Sequence
  chemically synthesized
catgcatctttcctctagca

SEQ ID NO: 518568 - DNA, 20 bp, Artificial Sequence
  chemically synthesized
aactaacttggtataataat

SEQ ID NO: 518569 - DNA, 20 bp, Artificial Sequence
  chemically synthesized
cattttaaagagctctctca

SEQ ID NO: 518570 - DNA, 20 bp, Artificial Sequence
  chemically synthesized
taatggcattgttttaaaat

SEQ ID NO: 518571 - DNA, 20 bp, Artificial Sequence
  chemically synthesized
ttaaaacaatgccattatag

SEQ ID NO: 518572 - DNA, 20 bp, Artificial Sequence
  chemically synthesized
gaatttcatcctattctgta

SEQ ID NO: 518573 - DNA, 20 bp, Artificial Sequence
  chemically synthesized
tgctttgatcccatacagaa

SEQ ID NO: 518574 - DNA, 20 bp, Artificial Sequence
  chemically synthesized
ctggatgctttgatcccata

SEQ ID NO: 518575 - DNA, 20 bp, Artificial Sequence
  chemically synthesized
ttttaatgttttttagacct

SEQ ID NO: 518576 - DNA, 20 bp, Artificial Sequence
  chemically synthesized
gaaaacttaaaaagcaccta

SEQ ID NO: 518577 - DNA, 20 bp, Artificial Sequence
  chemically synthesized
caaacaatctaaaacttgca

SEQ ID NO: 518578 - DNA, 20 bp, Artificial Sequence
  chemically synthesized
gtagctgttagttcaaggaa

SEQ ID NO: 518579 - DNA, 20 bp, Artificial Sequence
  chemically synthesized
aacagttcactgaaacttaa

SEQ ID NO: 518580 - DNA, 20 bp, Artificial Sequence
  chemically synthesized
gaactgtttgagaagacata

SEQ ID NO: 518581 - DNA, 20 bp, Artificial Sequence
  chemically synthesized
tttgagaagacatagggaat

SEQ ID NO: 518582 - DNA, 20 bp, Artificial Sequence
  chemically synthesized
agacatttcagaaacagcta

SEQ ID NO: 518583 - DNA, 20 bp, Artificial Sequence
  chemically synthesized
tctgtttctagaactatatt

SEQ ID NO: 518584 - DNA, 20 bp, Artificial Sequence
  chemically synthesized
ccacaatatagttctagaaa

SEQ ID NO: 518585 - DNA, 20 bp, Artificial Sequence
  chemically synthesized
tatctttctgtctactagtc

SEQ ID NO: 518586 - DNA, 20 bp, Artificial Sequence
  chemically synthesized
cccatgacttttgatagtag

SEQ ID NO: 518587 - DNA, 20 bp, Artificial Sequence
  chemically synthesized
tatcaaaagtcatgggacct

SEQ ID NO: 518588 - DNA, 20 bp, Artificial Sequence
  chemically synthesized
cacttttatttttgctccat

SEQ ID NO: 518589 - DNA, 20 bp, Artificial Sequence
  chemically synthesized
atttatgtcattggttttgc

SEQ ID NO: 518590 - DNA, 20 bp, Artificial Sequence
  chemically synthesized
agtcctgctagatcaggcat

SEQ ID NO: 518591 - DNA, 20 bp, Artificial Sequence
  chemically synthesized
gacatcaacagtaaagctag

SEQ ID NO: 518592 - DNA, 20 bp, Artificial Sequence
  chemically synthesized
tccccacttggcattcctgc

SEQ ID NO: 518593 - DNA, 20 bp, Artificial Sequence
  chemically synthesized
ggactgcaaagcactcaagc

SEQ ID NO: 518594 - DNA, 20 bp, Artificial Sequence
  chemically synthesized
acaccacttctgattgatgt

SEQ ID NO: 518595 - DNA, 20 bp, Artificial Sequence
  chemically synthesized
tgtgaatatgcaaaccttac

SEQ ID NO: 518596 - DNA, 20 bp, Artificial Sequence
  chemically synthesized
gtatgtgggccatctggctc

SEQ ID NO: 518597 - DNA, 20 bp, Artificial Sequence
  chemically synthesized
tgtaactctccaacagtttg

SEQ ID NO: 518598 - DNA, 20 bp, Artificial Sequence
  chemically synthesized
gcagattcagcaaactgttg

SEQ ID NO: 518599 - DNA, 20 bp, Artificial Sequence
  chemically synthesized
atgtatacttaggtgtctgt

SEQ ID NO: 518600 - DNA, 20 bp, Artificial Sequence
  chemically synthesized
actattgttgtgggttaaca

SEQ ID NO: 518601 - DNA, 20 bp, Artificial Sequence
  chemically synthesized
atgacagaggcactattgtt

SEQ ID NO: 518602 - DNA, 20 bp, Artificial Sequence
  chemically synthesized
aaagaattttctcctttaat

SEQ ID NO: 518603 - DNA, 20 bp, Artificial Sequence
  chemically synthesized
taaatggaaaggagaaaaga

SEQ ID NO: 518604 - DNA, 20 bp, Artificial Sequence
  chemically synthesized
agcctctacaagtagcaggg

SEQ ID NO: 518605 - DNA, 20 bp, Artificial Sequence
  chemically synthesized
atgacagcctctacaagtag

SEQ ID NO: 518606 - DNA, 20 bp, Artificial Sequence
  chemically synthesized
aaatctctttgctgcttctc

SEQ ID NO: 518607 - DNA, 20 bp, Artificial Sequence
  chemically synthesized
atttctttcattaaacttag

SEQ ID NO: 518608 - DNA, 20 bp, Artificial Sequence
  chemically synthesized
aaaagccataacttgtataa

SEQ ID NO: 518609 - DNA, 20 bp, Artificial Sequence
  chemically synthesized
gtataaaagagtgcccagat

SEQ ID NO: 518610 - DNA, 20 bp, Artificial Sequence
  chemically synthesized
cagatgagggtgtatcctcc

SEQ ID NO: 518611 - DNA, 20 bp, Artificial Sequence
  chemically synthesized
tgagggtgtatcctccctga

SEQ ID NO: 518612 - DNA, 20 bp, Artificial Sequence
  chemically synthesized
ctagatattactcactcagg

SEQ ID NO: 518613 - DNA, 20 bp, Artificial Sequence
  chemically synthesized
acatatgtaaaatatcattc

SEQ ID NO: 518614 - DNA, 20 bp, Artificial Sequence
  chemically synthesized
gcacacacacaagtacaccc

SEQ ID NO: 518615 - DNA, 20 bp, Artificial Sequence
  chemically synthesized
tgtgtgtgtgcacaaccaca

SEQ ID NO: 518616 - DNA, 20 bp, Artificial Sequence
  chemically synthesized
atatactgcttttcctattt

SEQ ID NO: 518617 - DNA, 20 bp, Artificial Sequence
  chemically synthesized
atagcaaccaaaattctttc

SEQ ID NO: 518618 - DNA, 20 bp, Artificial Sequence
  chemically synthesized
tggctgattcagattccaga

SEQ ID NO: 518619 - DNA, 20 bp, Artificial Sequence
  chemically synthesized
accaaaattctttctggaat

SEQ ID NO: 518620 - DNA, 20 bp, Artificial Sequence
  chemically synthesized
ctggaaggctgctaatctta

SEQ ID NO: 518621 - DNA, 20 bp, Artificial Sequence
  chemically synthesized
ccttccagaaatcactaaaa

SEQ ID NO: 518622 - DNA, 20 bp, Artificial Sequence
  chemically synthesized
aagtcctcagagtctatgga

SEQ ID NO: 518623 - DNA, 20 bp, Artificial Sequence
  chemically synthesized
aagacggtaaagaaagtcct

SEQ ID NO: 518624 - DNA, 20 bp, Artificial Sequence
  chemically synthesized
gtttgcttcctgagcttgaa

SEQ ID NO: 518625 - DNA, 20 bp, Artificial Sequence
  chemically synthesized
cctgaagtgatatgctcaga

SEQ ID NO: 518626 - DNA, 20 bp, Artificial Sequence
  chemically synthesized
acagcctgaagtgatatgct

SEQ ID NO: 518627 - DNA, 20 bp, Artificial Sequence
  chemically synthesized
cattgctcacaatttccctt

SEQ ID NO: 518628 - DNA, 20 bp, Artificial Sequence
  chemically synthesized
tccaaactataaaatgattt

SEQ ID NO: 518629 - DNA, 20 bp, Artificial Sequence
  chemically synthesized
tcctaaaatcattttatagt

SEQ ID NO: 518630 - DNA, 20 bp, Artificial Sequence
  chemically synthesized
acatggaagactcaagttat

SEQ ID NO: 518631 - DNA, 20 bp, Artificial Sequence
  chemically synthesized
tacatacatatccgtataac

SEQ ID NO: 518632 - DNA, 20 bp, Artificial Sequence
  chemically synthesized
agtgtgactatgtatgcatt

SEQ ID NO: 518633 - DNA, 20 bp, Artificial Sequence
  chemically synthesized
attttctttttgaattatag

SEQ ID NO: 518634 - DNA, 20 bp, Artificial Sequence
  chemically synthesized
ttcccttcattattttcttt

SEQ ID NO: 518635 - DNA, 20 bp, Artificial Sequence
  chemically synthesized
aatgaagggaaataaaagaa

SEQ ID NO: 518636 - DNA, 20 bp, Artificial Sequence
  chemically synthesized
tcacataaaacaacatatac

SEQ ID NO: 518637 - DNA, 20 bp, Artificial Sequence
  chemically synthesized
taaaacaacatataccaggg

SEQ ID NO: 518638 - DNA, 20 bp, Artificial Sequence
  chemically synthesized
catgagctacagagtcacaa

SEQ ID NO: 518639 - DNA, 20 bp, Artificial Sequence
  chemically synthesized
cacttgtgactctgtagctc

SEQ ID NO: 518640 - DNA, 20 bp, Artificial Sequence
  chemically synthesized
accacattactcatgagcta

SEQ ID NO: 518641 - DNA, 20 bp, Artificial Sequence
  chemically synthesized
gtttgacatatgttctgaac

SEQ ID NO: 518642 - DNA, 20 bp, Artificial Sequence
  chemically synthesized
gaatagtggtgtcagatgag

SEQ ID NO: 518643 - DNA, 20 bp, Artificial Sequence
  chemically synthesized
caccgattcccagacaaaac

SEQ ID NO: 518644 - DNA, 20 bp, Artificial Sequence
  chemically synthesized
ccactattctggttttgtct

SEQ ID NO: 518645 - DNA, 20 bp, Artificial Sequence
  chemically synthesized
tcattttgaaatttctgtct

SEQ ID NO: 518646 - DNA, 20 bp, Artificial Sequence
  chemically synthesized
ttagattggaatttaactgc

SEQ ID NO: 518647 - DNA, 20 bp, Artificial Sequence
  chemically synthesized
gaaggtcaaatatcttagat

SEQ ID NO: 518648 - DNA, 20 bp, Artificial Sequence
  chemically synthesized
atatttgaccttcacacgaa

SEQ ID NO: 518649 - DNA, 20 bp, Artificial Sequence
  chemically synthesized
tcttttaaaaactattttta

SEQ ID NO: 518650 - DNA, 20 bp, Artificial Sequence
  chemically synthesized
atgatgtggttatatattaa

SEQ ID NO: 518651 - DNA, 20 bp, Artificial Sequence
  chemically synthesized
taaaaagtactttgtgtaaa

SEQ ID NO: 518652 - DNA, 20 bp, Artificial Sequence
  chemically synthesized
taagaaaatggagtgacaat

SEQ ID NO: 518653 - DNA, 20 bp, Artificial Sequence
  chemically synthesized
tggccctacagctaagaaaa

SEQ ID NO: 518654 - DNA, 20 bp, Artificial Sequence
  chemically synthesized
cattttcttagctgtagggc

SEQ ID NO: 518655 - DNA, 20 bp, Artificial Sequence
  chemically synthesized
aattagacaactattaataa

SEQ ID NO: 518656 - DNA, 20 bp, Artificial Sequence
  chemically synthesized
gaaacctttaggctaaggaa

SEQ ID NO: 518657 - DNA, 20 bp, Artificial Sequence
  chemically synthesized
caggttttctcattttcata

SEQ ID NO: 518658 - DNA, 20 bp, Artificial Sequence
  chemically synthesized
ggcaatgtgctcctcaatca

SEQ ID NO: 518659 - DNA, 20 bp, Artificial Sequence
  chemically synthesized
gaggagcacattgccacaca

SEQ ID NO: 518660 - DNA, 20 bp, Artificial Sequence
  chemically synthesized
aagtgaaaatcaccactctt

SEQ ID NO: 518661 - DNA, 20 bp, Artificial Sequence
  chemically synthesized
acactctgaaataaactctt

SEQ ID NO: 518662 - DNA, 20 bp, Artificial Sequence
  chemically synthesized
ccactcttaagagtttattt

SEQ ID NO: 518663 - DNA, 20 bp, Artificial Sequence
  chemically synthesized
tttgcctataacataaactt

SEQ ID NO: 518664 - DNA, 20 bp, Artificial Sequence
  chemically synthesized
tccttttaatcaaatactta

SEQ ID NO: 518665 - DNA, 20 bp, Artificial Sequence
  chemically synthesized
caggagacaaagctttttaa

SEQ ID NO: 518666 - DNA, 20 bp, Artificial Sequence
  chemically synthesized
gtcttcttctcttagaaatg

SEQ ID NO: 518667 - DNA, 20 bp, Artificial Sequence
  chemically synthesized
gaagaagacaccgttatcaa

SEQ ID NO: 518668 - DNA, 20 bp, Artificial Sequence
  chemically synthesized
tatgattttatcaatgactg

SEQ ID NO: 518669 - DNA, 20 bp, Artificial Sequence
  chemically synthesized
gaatgaatcctggattaatc

SEQ ID NO: 518670 - DNA, 20 bp, Artificial Sequence
  chemically synthesized
aatcatattctagattaatc

SEQ ID NO: 518671 - DNA, 20 bp, Artificial Sequence
  chemically synthesized
tagaaataattgaatgaatc

SEQ ID NO: 518672 - DNA, 20 bp, Artificial Sequence
  chemically synthesized
gatttggtagaaataattga

SEQ ID NO: 518673 - DNA, 20 bp, Artificial Sequence
  chemically synthesized
aagagatttggtagaaataa

SEQ ID NO: 518674 - DNA, 20 bp, Artificial Sequence
  chemically synthesized
atctctttcccttcaagaga

SEQ ID NO: 518675 - DNA, 20 bp, Artificial Sequence
  chemically synthesized
tttcccttcaagagagggag

SEQ ID NO: 518676 - DNA, 20 bp, Artificial Sequence
  chemically synthesized
tattattttggattagcatt

SEQ ID NO: 518677 - DNA, 20 bp, Artificial Sequence
  chemically synthesized
cttaaatggcccttattatt

SEQ ID NO: 518678 - DNA, 20 bp, Artificial Sequence
  chemically synthesized
gggccatttaagagaagtta

SEQ ID NO: 518679 - DNA, 20 bp, Artificial Sequence
  chemically synthesized
cttacagtgacagcatagca

SEQ ID NO: 518680 - DNA, 20 bp, Artificial Sequence
  chemically synthesized
ttcatgttaaattaaggttt

SEQ ID NO: 518681 - DNA, 20 bp, Artificial Sequence
  chemically synthesized
tgtagtaagtactgctttac

SEQ ID NO: 518682 - DNA, 20 bp, Artificial Sequence
  chemically synthesized
cagtaaactctccaggtgag

SEQ ID NO: 518683 - DNA, 20 bp, Artificial Sequence
  chemically synthesized
tactacacccctctcacctg

SEQ ID NO: 518684 - DNA, 20 bp, Artificial Sequence
  chemically synthesized
tcaaactggggcagcactag

SEQ ID NO: 518685 - DNA, 20 bp, Artificial Sequence
  chemically synthesized
ttgtgtgacacaaaccttgt

SEQ ID NO: 518686 - DNA, 20 bp, Artificial Sequence
  chemically synthesized
cttctgttaccattactgct

SEQ ID NO: 518687 - DNA, 20 bp, Artificial Sequence
  chemically synthesized
cacagcagtaatggtaacag

SEQ ID NO: 518688 - DNA, 20 bp, Artificial Sequence
  chemically synthesized
aatggtaacagaagaataac

SEQ ID NO: 518689 - DNA, 20 bp, Artificial Sequence
  chemically synthesized
ctaggataaagcttggtata

SEQ ID NO: 518690 - DNA, 20 bp, Artificial Sequence
  chemically synthesized
ccagtaatcccaaccttttc

SEQ ID NO: 518691 - DNA, 20 bp, Artificial Sequence
  chemically synthesized
agctttatcctagaaaaggt

SEQ ID NO: 518692 - DNA, 20 bp, Artificial Sequence
  chemically synthesized
aaattaaggttgtctgatta

SEQ ID NO: 518693 - DNA, 20 bp, Artificial Sequence
  chemically synthesized
tcactgtggtaagcagtctc

SEQ ID NO: 518694 - DNA, 20 bp, Artificial Sequence
  chemically synthesized
tattattataattggaaaaa

SEQ ID NO: 518695 - DNA, 20 bp, Artificial Sequence
  chemically synthesized
ataaaaacgtggaatttaaa

SEQ ID NO: 518696 - DNA, 20 bp, Artificial Sequence
  chemically synthesized
tttttttctacataaaaacg

SEQ ID NO: 518697 - DNA, 20 bp, Artificial Sequence
  chemically synthesized
tttttatgtagaaaaaaatc

SEQ ID NO: 518698 - DNA, 20 bp, Artificial Sequence
  chemically synthesized
gaaagaaaacgattgcactt

SEQ ID NO: 518699 - DNA, 20 bp, Artificial Sequence
  chemically synthesized
gctaaaccagcattgtccat

SEQ ID NO: 518700 - DNA, 20 bp, Artificial Sequence
  chemically synthesized
gacaatggcaaaaaattatt

SEQ ID NO: 518701 - DNA, 20 bp, Artificial Sequence
  chemically synthesized
caaattggacagcacaagtc

SEQ ID NO: 518702 - DNA, 20 bp, Artificial Sequence
  chemically synthesized
gcgcagaagcatacagataa

SEQ ID NO: 518703 - DNA, 20 bp, Artificial Sequence
  chemically synthesized
tcctcacattaaagtgaagc

SEQ ID NO: 518704 - DNA, 20 bp, Artificial Sequence
  chemically synthesized
aaaattatgttaataaatat

SEQ ID NO: 518705 - DNA, 20 bp, Artificial Sequence
  chemically synthesized
tgaaatggcatattaaaaca

SEQ ID NO: 518706 - DNA, 20 bp, Artificial Sequence
  chemically synthesized
acagcttgcaattgcttatt

SEQ ID NO: 518707 - DNA, 20 bp, Artificial Sequence
  chemically synthesized
aaagccattctgaattttaa

SEQ ID NO: 518708 - DNA, 20 bp, Artificial Sequence
  chemically synthesized
tttgtcattcatttaaaatt

SEQ ID NO: 518709 - DNA, 20 bp, Artificial Sequence
  chemically synthesized
taatggcataaaaagccatt

SEQ ID NO: 518710 - DNA, 20 bp, Artificial Sequence
  chemically synthesized
gagaaaacaatcaaaagctt

SEQ ID NO: 518711 - DNA, 20 bp, Artificial Sequence
  chemically synthesized
aagaataagccctcaccaat

SEQ ID NO: 518712 - DNA, 20 bp, Artificial Sequence
  chemically synthesized
caaatagatgttacttttta

SEQ ID NO: 518713 - DNA, 20 bp, Artificial Sequence
  chemically synthesized
ttcatttgcatcactgctgc

SEQ ID NO: 518714 - DNA, 20 bp, Artificial Sequence
  chemically synthesized
tccaagcagcagtgatgcaa

SEQ ID NO: 518715 - DNA, 20 bp, Artificial Sequence
  chemically synthesized
gttgtcttacttcccattgt

SEQ ID NO: 518716 - DNA, 20 bp, Artificial Sequence
  chemically synthesized
atttcctcatgtacctggaa

SEQ ID NO: 518717 - DNA, 20 bp, Artificial Sequence
  chemically synthesized
ttaagatgcatgctttcatt

SEQ ID NO: 518718 - DNA, 20 bp, Artificial Sequence
  chemically synthesized
atttagaaatatgaagaaat

SEQ ID NO: 518719 - DNA, 20 bp, Artificial Sequence
  chemically synthesized
ttttccaggttttctgaggt

SEQ ID NO: 518720 - DNA, 20 bp, Artificial Sequence
  chemically synthesized
gttttctgaggtaagaattc

SEQ ID NO: 518721 - DNA, 20 bp, Artificial Sequence
  chemically synthesized
tacttttgtgagtatcattc

SEQ ID NO: 518722 - DNA, 20 bp, Artificial Sequence
  chemically synthesized
tcagtgtacattttactttt

SEQ ID NO: 518723 - DNA, 20 bp, Artificial Sequence
  chemically synthesized
tcacaaaagtaaaatgtaca

SEQ ID NO: 518724 - DNA, 20 bp, Artificial Sequence
  chemically synthesized
agaacagactgttggccagg

SEQ ID NO: 518725 - DNA, 20 bp, Artificial Sequence
  chemically synthesized
attttgggaggccgatgggg

SEQ ID NO: 518726 - DNA, 20 bp, Artificial Sequence
  chemically synthesized
ggggcggatcacctgaggtc

SEQ ID NO: 518727 - DNA, 20 bp, Artificial Sequence
  chemically synthesized
tttttgtattttagtagaga

SEQ ID NO: 518728 - DNA, 20 bp, Artificial Sequence
  chemically synthesized
tcctcagcctcccaagtagt

SEQ ID NO: 518729 - DNA, 20 bp, Artificial Sequence
  chemically synthesized
ctcactgcaacctctgcctc

SEQ ID NO: 518730 - DNA, 20 bp, Artificial Sequence
  chemically synthesized
ttggcttttgttgcccaggc

SEQ ID NO: 518731 - DNA, 20 bp, Artificial Sequence
  chemically synthesized
aaaaaactgtctattttata

SEQ ID NO: 518732 - DNA, 20 bp, Artificial Sequence
  chemically synthesized
ctgtctattttatattgaat

SEQ ID NO: 518733 - DNA, 20 bp, Artificial Sequence
  chemically synthesized
agtaaaatgcaaaatatgca

SEQ ID NO: 518734 - DNA, 20 bp, Artificial Sequence
  chemically synthesized
actaaaatcaatgtatttta

SEQ ID NO: 518735 - DNA, 20 bp, Artificial Sequence
  chemically synthesized
tagaccaacgcattgtagtt

SEQ ID NO: 518736 - DNA, 20 bp, Artificial Sequence
  chemically synthesized
tctccatattagctataaat

SEQ ID NO: 518737 - DNA, 20 bp, Artificial Sequence
  chemically synthesized
tggagaaaagttaggaaatg

SEQ ID NO: 518738 - DNA, 20 bp, Artificial Sequence
  chemically synthesized
aaaaaacctaactttagaac

SEQ ID NO: 518739 - DNA, 20 bp, Artificial Sequence
  chemically synthesized
taactttagaacccggattt

SEQ ID NO: 518740 - DNA, 20 bp, Artificial Sequence
  chemically synthesized
caaactacttactcacaaat

SEQ ID NO: 518741 - DNA, 20 bp, Artificial Sequence
  chemically synthesized
atggcagttatgacacataa

SEQ ID NO: 518742 - DNA, 20 bp, Artificial Sequence
  chemically synthesized
gcctcagcctcccaaagtgc

SEQ ID NO: 518743 - DNA, 20 bp, Artificial Sequence
  chemically synthesized
cgggcggactgcctgacctc

SEQ ID NO: 518744 - DNA, 20 bp, Artificial Sequence
  chemically synthesized
ttattgtattttagtagaga

SEQ ID NO: 518745 - DNA, 20 bp, Artificial Sequence
  chemically synthesized
tacttgggaggctgtggcag

SEQ ID NO: 518746 - DNA, 20 bp, Artificial Sequence
  chemically synthesized
ctcactgcaacctctgcctc

SEQ ID NO: 518747 - DNA, 20 bp, Artificial Sequence
  chemically synthesized
ggagtctctgttgctcaggc

SEQ ID NO: 518748 - DNA, 20 bp, Artificial Sequence
  chemically synthesized
tttttttcctttttttgaga

SEQ ID NO: 518749 - DNA, 20 bp, Artificial Sequence
  chemically synthesized
aaaaaaaaaaacaaatagaa

SEQ ID NO: 518750 - DNA, 20 bp, Artificial Sequence
  chemically synthesized
gcatgtgtctgtgtgttttg

SEQ ID NO: 518751 - DNA, 20 bp, Artificial Sequence
  chemically synthesized
tctgtgtgttttggggggta

SEQ ID NO: 518752 - DNA, 20 bp, Artificial Sequence
  chemically synthesized
ttggggggtactggatcatc

SEQ ID NO: 518753 - DNA, 20 bp, Artificial Sequence
  chemically synthesized
tgctcactttttctcttaaa

SEQ ID NO: 518754 - DNA, 20 bp, Artificial Sequence
  chemically synthesized
gttaacctttcttttgctat

SEQ ID NO: 518755 - DNA, 20 bp, Artificial Sequence
  chemically synthesized
ggacacaggagcattcagaa

SEQ ID NO: 518756 - DNA, 20 bp, Artificial Sequence
  chemically synthesized
ttttctttaggtattcattt

SEQ ID NO: 518757 - DNA, 20 bp, Artificial Sequence
  chemically synthesized
tttttatgctaaatttgatg

SEQ ID NO: 518758 - DNA, 20 bp, Artificial Sequence
  chemically synthesized
gaagtatgattggagaacaa

SEQ ID NO: 518759 - DNA, 20 bp, Artificial Sequence
  chemically synthesized
taatctaatggtaataaagt

SEQ ID NO: 518760 - DNA, 20 bp, Artificial Sequence
  chemically synthesized
gtaataaagttggggtgggg

SEQ ID NO: 518761 - DNA, 20 bp, Artificial Sequence
  chemically synthesized
gtgtcccatacctaaaggaa

SEQ ID NO: 518762 - DNA, 20 bp, Artificial Sequence
  chemically synthesized
ctttaggtatgggacacatg

SEQ ID NO: 518763 - DNA, 20 bp, Artificial Sequence
  chemically synthesized
tcctctgaagcagatcagaa

SEQ ID NO: 518764 - DNA, 20 bp, Artificial Sequence
  chemically synthesized
aatgccaaggtgccatattt

SEQ ID NO: 518765 - DNA, 20 bp, Artificial Sequence
  chemically synthesized
ttttttatatttgttgttag

SEQ ID NO: 518766 - DNA, 20 bp, Artificial Sequence
  chemically synthesized
ttgtttaatcatttgaactt

SEQ ID NO: 518767 - DNA, 20 bp, Artificial Sequence
  chemically synthesized
ggaatcttgaaaatattaaa

SEQ ID NO: 518768 - DNA, 20 bp, Artificial Sequence
  chemically synthesized
aggctaaacggagaaagaat

SEQ ID NO: 518769 - DNA, 20 bp, Artificial Sequence
  chemically synthesized
tgttcaaggctaaacggaga

SEQ ID NO: 518770 - DNA, 20 bp, Artificial Sequence
  chemically synthesized
catatgacagaaccaaagca

SEQ ID NO: 518771 - DNA, 20 bp, Artificial Sequence
  chemically synthesized
ggttctgtcatatgtaaaat

SEQ ID NO: 518772 - DNA, 20 bp, Artificial Sequence
  chemically synthesized
ctatctcagtacgttgcttt

SEQ ID NO: 518773 - DNA, 20 bp, Artificial Sequence
  chemically synthesized
cgttgctttaagaattaact

SEQ ID NO: 518774 - DNA, 20 bp, Artificial Sequence
  chemically synthesized
acaaatcaattaaaatacct

SEQ ID NO: 518775 - DNA, 20 bp, Artificial Sequence
  chemically synthesized
atgatccaactttcctactt

SEQ ID NO: 518776 - DNA, 20 bp, Artificial Sequence
  chemically synthesized
tatatccagaagtaggaaag

SEQ ID NO: 518777 - DNA, 20 bp, Artificial Sequence
  chemically synthesized
attcctcaaaaacctaaaaa

SEQ ID NO: 518778 - DNA, 20 bp, Artificial Sequence
  chemically synthesized
attccatttttaggtttttg

SEQ ID NO: 518779 - DNA, 20 bp, Artificial Sequence
  chemically synthesized
tactaatttacattcccacc

SEQ ID NO: 518780 - DNA, 20 bp, Artificial Sequence
  chemically synthesized
gaatgttgtctactcttggt

SEQ ID NO: 518781 - DNA, 20 bp, Artificial Sequence
  chemically synthesized
actaacttatgttttgtggt

SEQ ID NO: 518782 - DNA, 20 bp, Artificial Sequence
  chemically synthesized
agatatgttaattagcttga

SEQ ID NO: 518783 - DNA, 20 bp, Artificial Sequence
  chemically synthesized
acaatgtgatattttaatct

SEQ ID NO: 518784 - DNA, 20 bp, Artificial Sequence
  chemically synthesized
ttttaatgaacaagtaacag

SEQ ID NO: 518785 - DNA, 20 bp, Artificial Sequence
  chemically synthesized
caggtagatcacctgagcta

SEQ ID NO: 518786 - DNA, 20 bp, Artificial Sequence
  chemically synthesized
ttcctattttttgtagagat

SEQ ID NO: 518787 - DNA, 20 bp, Artificial Sequence
  chemically synthesized
acctgtagtcccagctactt

SEQ ID NO: 518788 - DNA, 20 bp, Artificial Sequence
  chemically synthesized
ctacttgggggttcaggtag

SEQ ID NO: 518789 - DNA, 20 bp, Artificial Sequence
  chemically synthesized
tcactcaggttggagtgcag

SEQ ID NO: 518790 - DNA, 20 bp, Artificial Sequence
  chemically synthesized
tgactccactgcactccaac

SEQ ID NO: 518791 - DNA, 20 bp, Artificial Sequence
  chemically synthesized
tctcacttcgtcactcaggt

SEQ ID NO: 518792 - DNA, 20 bp, Artificial Sequence
  chemically synthesized
cattgttataatggatttgc

SEQ ID NO: 518793 - DNA, 20 bp, Artificial Sequence
  chemically synthesized
aagtgtcaagcattgttata

SEQ ID NO: 518794 - DNA, 20 bp, Artificial Sequence
  chemically synthesized
tagttacttttaggtttaat

SEQ ID NO: 518795 - DNA, 20 bp, Artificial Sequence
  chemically synthesized
tttctatgtacattatttaa

SEQ ID NO: 518796 - DNA, 20 bp, Artificial Sequence
  chemically synthesized
gttagcaaaatcacataact

SEQ ID NO: 518797 - DNA, 20 bp, Artificial Sequence
  chemically synthesized
tcattgtccatttttctcat

SEQ ID NO: 518798 - DNA, 20 bp, Artificial Sequence
  chemically synthesized
gaacactcatcttgtttcta

SEQ ID NO: 518799 - DNA, 20 bp, Artificial Sequence
  chemically synthesized
ccttattcaatagaaacaag

SEQ ID NO: 518800 - DNA, 20 bp, Artificial Sequence
  chemically synthesized
atattgccacggaagaaggc

SEQ ID NO: 518801 - DNA, 20 bp, Artificial Sequence
  chemically synthesized
acttggcctatctcagggta

SEQ ID NO: 518802 - DNA, 20 bp, Artificial Sequence
  chemically synthesized
ttatttcacttggcctatct

SEQ ID NO: 518803 - DNA, 20 bp, Artificial Sequence
  chemically synthesized
tgtaactaccatacaagtct

SEQ ID NO: 518804 - DNA, 20 bp, Artificial Sequence
  chemically synthesized
gggtactaaaatgctctttc

SEQ ID NO: 518805 - DNA, 20 bp, Artificial Sequence
  chemically synthesized
aaattttcaagcattgttct

SEQ ID NO: 518806 - DNA, 20 bp, Artificial Sequence
  chemically synthesized
acttccaaatcaacacaatt

SEQ ID NO: 518807 - DNA, 20 bp, Artificial Sequence
  chemically synthesized
cagtttaccatatcaaaggc

SEQ ID NO: 518808 - DNA, 20 bp, Artificial Sequence
  chemically synthesized
gccaattatagctatctagc

SEQ ID NO: 518809 - DNA, 20 bp, Artificial Sequence
  chemically synthesized
ctatctagctcggatttaaa

SEQ ID NO: 518810 - DNA, 20 bp, Artificial Sequence
  chemically synthesized
ataagaaaccagaaaaatca

SEQ ID NO: 518811 - DNA, 20 bp, Artificial Sequence
  chemically synthesized
gagataaaaacgttaaatgt

SEQ ID NO: 518812 - DNA, 20 bp, Artificial Sequence
  chemically synthesized
cattagcctgtaattttaca

SEQ ID NO: 518813 - DNA, 20 bp, Artificial Sequence
  chemically synthesized
aggctaatgactcagtccta

SEQ ID NO: 518814 - DNA, 20 bp, Artificial Sequence
  chemically synthesized
ttgagagctactctgtagga

SEQ ID NO: 518815 - DNA, 20 bp, Artificial Sequence
  chemically synthesized
ttgtctttgcttaaatcagt

SEQ ID NO: 518816 - DNA, 20 bp, Artificial Sequence
  chemically synthesized
aaaggtctcaatagacattt

SEQ ID NO: 518817 - DNA, 20 bp, Artificial Sequence
  chemically synthesized
aaaaaaatgttcaatcaaag

SEQ ID NO: 518818 - DNA, 20 bp, Artificial Sequence
  chemically synthesized
ttcatgatactttcaaaaaa

SEQ ID NO: 518819 - DNA, 20 bp, Artificial Sequence
  chemically synthesized
tttttgaaagtatcatgaag

SEQ ID NO: 518820 - DNA, 20 bp, Artificial Sequence
  chemically synthesized
acatattttgtgacatattt

SEQ ID NO: 518821 - DNA, 20 bp, Artificial Sequence
  chemically synthesized
gcctctgcctcccaaagtgc

SEQ ID NO: 518822 - DNA, 20 bp, Artificial Sequence
  chemically synthesized
actttgggaggcagaggcgg

SEQ ID NO: 518823 - DNA, 20 bp, Artificial Sequence
  chemically synthesized
cgggcgggtcacctgaggtc

SEQ ID NO: 518824 - DNA, 20 bp, Artificial Sequence
  chemically synthesized
tacctgggaggccgaggcag

SEQ ID NO: 518825 - DNA, 20 bp, Artificial Sequence
  chemically synthesized
ctcactgcaaccttcacctc

SEQ ID NO: 518826 - DNA, 20 bp, Artificial Sequence
  chemically synthesized
tcttgctctgtcgcccaagg

SEQ ID NO: 518827 - DNA, 20 bp, Artificial Sequence
  chemically synthesized
aactagcttgcattttattg

SEQ ID NO: 518828 - DNA, 20 bp, Artificial Sequence
  chemically synthesized
cattaatctgttttatttca

SEQ ID NO: 518829 - DNA, 20 bp, Artificial Sequence
  chemically synthesized
cactgaaataaaacagatta

SEQ ID NO: 518830 - DNA, 20 bp, Artificial Sequence
  chemically synthesized
agttttgttacatgcatatg

SEQ ID NO: 518831 - DNA, 20 bp, Artificial Sequence
  chemically synthesized
ttaggtacaatgtacactat

SEQ ID NO: 518832 - DNA, 20 bp, Artificial Sequence
  chemically synthesized
gagattgtggcaggggagtg

SEQ ID NO: 518833 - DNA, 20 bp, Artificial Sequence
  chemically synthesized
aaaaggtgagattgtggcag

SEQ ID NO: 518834 - DNA, 20 bp, Artificial Sequence
  chemically synthesized
attttgtatttttaattttt

SEQ ID NO: 518835 - DNA, 20 bp, Artificial Sequence
  chemically synthesized
actgtaggtgtataaatttc

SEQ ID NO: 518836 - DNA, 20 bp, Artificial Sequence
  chemically synthesized
cattttttttttttttgaga

SEQ ID NO: 518837 - DNA, 20 bp, Artificial Sequence
  chemically synthesized
ctcgccctgtgcacccaggc

SEQ ID NO: 518838 - DNA, 20 bp, Artificial Sequence
  chemically synthesized
tcgcgccactgcactccagc

SEQ ID NO: 518839 - DNA, 20 bp, Artificial Sequence
  chemically synthesized
ctcactgcaacctccgcctc

SEQ ID NO: 518840 - DNA, 20 bp, Artificial Sequence
  chemically synthesized
tattcaggagaccgaggcag

SEQ ID NO: 518841 - DNA, 20 bp, Artificial Sequence
  chemically synthesized
aattctcctgcctcggtctc

SEQ ID NO: 518842 - DNA, 20 bp, Artificial Sequence
  chemically synthesized
gcctcggtctcctgaatagc

SEQ ID NO: 518843 - DNA, 20 bp, Artificial Sequence
  chemically synthesized
ttttgtatttttagtagaga

SEQ ID NO: 518844 - DNA, 20 bp, Artificial Sequence
  chemically synthesized
ggcaggcagatcacgaggtc

SEQ ID NO: 518845 - DNA, 20 bp, Artificial Sequence
  chemically synthesized
gcctcagcctcccaaagttc

SEQ ID NO: 518846 - DNA, 20 bp, Artificial Sequence
  chemically synthesized
acttcaaaaggtgagagggg

SEQ ID NO: 518847 - DNA, 20 bp, Artificial Sequence
  chemically synthesized
attttcatgaacatagagaa

SEQ ID NO: 518848 - DNA, 20 bp, Artificial Sequence
  chemically synthesized
ggcatattttcatgaacata

SEQ ID NO: 518849 - DNA, 20 bp, Artificial Sequence
  chemically synthesized
agaacttatatctgcttctt

SEQ ID NO: 518850 - DNA, 20 bp, Artificial Sequence
  chemically synthesized
gtcctttctgatagagagga

SEQ ID NO: 518851 - DNA, 20 bp, Artificial Sequence
  chemically synthesized
cagcccggagactgcatcag

SEQ ID NO: 518852 - DNA, 20 bp, Artificial Sequence
  chemically synthesized
attggccactcatagagact

SEQ ID NO: 518853 - DNA, 20 bp, Artificial Sequence
  chemically synthesized
gaaaaggaccctgagtctct

SEQ ID NO: 518854 - DNA, 20 bp, Artificial Sequence
  chemically synthesized
caagacaagggaaaaggacc

SEQ ID NO: 518855 - DNA, 20 bp, Artificial Sequence
  chemically synthesized
tgaaagatatataaggaaaa

SEQ ID NO: 518856 - DNA, 20 bp, Artificial Sequence
  chemically synthesized
gttgatatctcttttgttat

SEQ ID NO: 518857 - DNA, 20 bp, Artificial Sequence
  chemically synthesized
gtctcagcctcccaaagagc

SEQ ID NO: 518858 - DNA, 20 bp, Artificial Sequence
  chemically synthesized
tctttgggaggctgagactg

SEQ ID NO: 518859 - DNA, 20 bp, Artificial Sequence
  chemically synthesized
ctatgttgccaaggctggtc

SEQ ID NO: 518860 - DNA, 20 bp, Artificial Sequence
  chemically synthesized
tttttactttttggagaaat

SEQ ID NO: 518861 - DNA, 20 bp, Artificial Sequence
  chemically synthesized
taccggggaggctgaggtgg

SEQ ID NO: 518862 - DNA, 20 bp, Artificial Sequence
  chemically synthesized
ctcactatagcttcaacctc

SEQ ID NO: 518863 - DNA, 20 bp, Artificial Sequence
  chemically synthesized
tctcactttgtggcccaggc

SEQ ID NO: 518864 - DNA, 20 bp, Artificial Sequence
  chemically synthesized
ttttttttttttttttgaca

SEQ ID NO: 518865 - DNA, 20 bp, Artificial Sequence
  chemically synthesized
acctgatgaacaactaatct

SEQ ID NO: 518866 - DNA, 20 bp, Artificial Sequence
  chemically synthesized
gatgaacaactaatctgaga

SEQ ID NO: 518867 - DNA, 20 bp, Artificial Sequence
  chemically synthesized
aactttaaagtaattaaaat

SEQ ID NO: 518868 - DNA, 20 bp, Artificial Sequence
  chemically synthesized
cagaaaatgaataaaacaat

SEQ ID NO: 518869 - DNA, 20 bp, Artificial Sequence
  chemically synthesized
ttagttaaaatacacagaaa

SEQ ID NO: 518870 - DNA, 20 bp, Artificial Sequence
  chemically synthesized
tttacattgttcaactactg

SEQ ID NO: 518871 - DNA, 20 bp, Artificial Sequence
  chemically synthesized
tccagtagttgaacaatgta

SEQ ID NO: 518872 - DNA, 20 bp, Artificial Sequence
  chemically synthesized
tacccaagaaatatgaatgt

SEQ ID NO: 518873 - DNA, 20 bp, Artificial Sequence
  chemically synthesized
tattctaacattcatatttc

SEQ ID NO: 518874 - DNA, 20 bp, Artificial Sequence
  chemically synthesized
ttagtaagtacccaagaaat

SEQ ID NO: 518875 - DNA, 20 bp, Artificial Sequence
  chemically synthesized
accattttacattactagct

SEQ ID NO: 518876 - DNA, 20 bp, Artificial Sequence
  chemically synthesized
cttcgaatagtgtaaggaca

SEQ ID NO: 518877 - DNA, 20 bp, Artificial Sequence
  chemically synthesized
cagtgtccttacactattcg

SEQ ID NO: 518878 - DNA, 20 bp, Artificial Sequence
  chemically synthesized
gttctgcatgtataaatcct

SEQ ID NO: 518879 - DNA, 20 bp, Artificial Sequence
  chemically synthesized
cctcatgcagcctgtaggct

SEQ ID NO: 518880 - DNA, 20 bp, Artificial Sequence
  chemically synthesized
gcatgaggcccaggacagct

SEQ ID NO: 518881 - DNA, 20 bp, Artificial Sequence
  chemically synthesized
gcttccctgggccacactgg

SEQ ID NO: 518882 - DNA, 20 bp, Artificial Sequence
  chemically synthesized
ttaaaagggagtcttcaaag

SEQ ID NO: 518883 - DNA, 20 bp, Artificial Sequence
  chemically synthesized
cattcattgccaacttaaaa

SEQ ID NO: 518884 - DNA, 20 bp, Artificial Sequence
  chemically synthesized
gactcccttttaagttggca

SEQ ID NO: 518885 - DNA, 20 bp, Artificial Sequence
  chemically synthesized
ttaaacattgatgaccaacg

SEQ ID NO: 518886 - DNA, 20 bp, Artificial Sequence
  chemically synthesized
cggggtttcaccatgttagc

SEQ ID NO: 518887 - DNA, 20 bp, Artificial Sequence
  chemically synthesized
ttttgtatttttagtagagg

SEQ ID NO: 518888 - DNA, 20 bp, Artificial Sequence
  chemically synthesized
actaaaaatacaaaaattag

SEQ ID NO: 518889 - DNA, 20 bp, Artificial Sequence
  chemically synthesized
gattctcctgcctcagcctc

SEQ ID NO: 518890 - DNA, 20 bp, Artificial Sequence
  chemically synthesized
tactcaggaggctgaggcag

SEQ ID NO: 518891 - DNA, 20 bp, Artificial Sequence
  chemically synthesized
caggagaatcgcttgaacta

SEQ ID NO: 518892 - DNA, 20 bp, Artificial Sequence
  chemically synthesized
gtcggaggttgcagtgagcc

SEQ ID NO: 518893 - DNA, 20 bp, Artificial Sequence
  chemically synthesized
gtgtgccactgcactccagc

SEQ ID NO: 518894 - DNA, 20 bp, Artificial Sequence
  chemically synthesized
tctcgctctgtcacccaggc

SEQ ID NO: 518895 - DNA, 20 bp, Artificial Sequence
  chemically synthesized
ttttgtttttgtttttgaga

SEQ ID NO: 518896 - DNA, 20 bp, Artificial Sequence
  chemically synthesized
gacgcttcaagtatgcaaca

SEQ ID NO: 518897 - DNA, 20 bp, Artificial Sequence
  chemically synthesized
tgaagcgtcacgtacacgtg

SEQ ID NO: 518898 - DNA, 20 bp, Artificial Sequence
  chemically synthesized
ctttcaacgaagttacatgg

SEQ ID NO: 518899 - DNA, 20 bp, Artificial Sequence
  chemically synthesized
ccaggaaatgatatggaaaa

SEQ ID NO: 518900 - DNA, 20 bp, Artificial Sequence
  chemically synthesized
gtcttacataatgttcaaac

SEQ ID NO: 518901 - DNA, 20 bp, Artificial Sequence
  chemically synthesized
gttcaaacagggatcatgta

SEQ ID NO: 518902 - DNA, 20 bp, Artificial Sequence
  chemically synthesized
gtctagcttataaactgata

SEQ ID NO: 518903 - DNA, 20 bp, Artificial Sequence
  chemically synthesized
tgttttttttcttactgctt

SEQ ID NO: 518904 - DNA, 20 bp, Artificial Sequence
  chemically synthesized
tactgctttggagtattgaa

SEQ ID NO: 518905 - DNA, 20 bp, Artificial Sequence
  chemically synthesized
attgaaaggagttttagtat

SEQ ID NO: 518906 - DNA, 20 bp, Artificial Sequence
  chemically synthesized
acatactttagtttacataa

SEQ ID NO: 518907 - DNA, 20 bp, Artificial Sequence
  chemically synthesized
gatttaaaaaaaattgtgaa

SEQ ID NO: 518908 - DNA, 20 bp, Artificial Sequence
  chemically synthesized
agcaagatttaaaaaaaatt

SEQ ID NO: 518909 - DNA, 20 bp, Artificial Sequence
  chemically synthesized
ataaaatgcataaaatagag

SEQ ID NO: 518910 - DNA, 20 bp, Artificial Sequence
  chemically synthesized
acaacctaagtgtaatgtga

SEQ ID NO: 518911 - DNA, 20 bp, Artificial Sequence
  chemically synthesized
actagaaaatgtaactatag

SEQ ID NO: 518912 - DNA, 20 bp, Artificial Sequence
  chemically synthesized
aattaagtttagccatataa

SEQ ID NO: 518913 - DNA, 20 bp, Artificial Sequence
  chemically synthesized
tataactgggttctgaccca

SEQ ID NO: 518914 - DNA, 20 bp, Artificial Sequence
  chemically synthesized
gtcacctccaccaacatccc

SEQ ID NO: 518915 - DNA, 20 bp, Artificial Sequence
  chemically synthesized
aagtcccttcctgacttagt

SEQ ID NO: 518916 - DNA, 20 bp, Artificial Sequence
  chemically synthesized
gcatagctatagaggggtct

SEQ ID NO: 518917 - DNA, 20 bp, Artificial Sequence
  chemically synthesized
attacacagcatagctatag

SEQ ID NO: 518918 - DNA, 20 bp, Artificial Sequence
  chemically synthesized
cacatgtggctttggagcac

SEQ ID NO: 518919 - DNA, 20 bp, Artificial Sequence
  chemically synthesized
tccagcaaatctcagcaaca

SEQ ID NO: 518920 - DNA, 20 bp, Artificial Sequence
  chemically synthesized
tggaagtgtaaaattcacaa

SEQ ID NO: 518921 - DNA, 20 bp, Artificial Sequence
  chemically synthesized
ccacctctctaaattccgtt

SEQ ID NO: 518922 - DNA, 20 bp, Artificial Sequence
  chemically synthesized
ctttttgcaatacatttcta

SEQ ID NO: 518923 - DNA, 20 bp, Artificial Sequence
  chemically synthesized
ggatgtgctgccaaacttct

SEQ ID NO: 518924 - DNA, 20 bp, Artificial Sequence
  chemically synthesized
agtagaatagaaagatatat

SEQ ID NO: 518925 - DNA, 20 bp, Artificial Sequence
  chemically synthesized
gaaatgaatggtagatgtag

SEQ ID NO: 518926 - DNA, 20 bp, Artificial Sequence
  chemically synthesized
gaataattaatgatgaagaa

SEQ ID NO: 518927 - DNA, 20 bp, Artificial Sequence
  chemically synthesized
taaatttataataaaaaata

SEQ ID NO: 518928 - DNA, 20 bp, Artificial Sequence
  chemically synthesized
ataataaacaatggaataat

SEQ ID NO: 518929 - DNA, 20 bp, Artificial Sequence
  chemically synthesized
agtagatttataataaacaa

SEQ ID NO: 518930 - DNA, 20 bp, Artificial Sequence
  chemically synthesized
taacagtaggtgattattag

SEQ ID NO: 518931 - DNA, 20 bp, Artificial Sequence
  chemically synthesized
aatcacctactgttaagaca

SEQ ID NO: 518932 - DNA, 20 bp, Artificial Sequence
  chemically synthesized
gtaaaattcagttcctatat

SEQ ID NO: 518933 - DNA, 20 bp, Artificial Sequence
  chemically synthesized
gaaacaccctgatataggaa

SEQ ID NO: 518934 - DNA, 20 bp, Artificial Sequence
  chemically synthesized
tccctgccagaacaagcaaa

SEQ ID NO: 518935 - DNA, 20 bp, Artificial Sequence
  chemically synthesized
tgtattgaggaccacagatg

SEQ ID NO: 518936 - DNA, 20 bp, Artificial Sequence
  chemically synthesized
gctgggtcctgcctattagg

SEQ ID NO: 518937 - DNA, 20 bp, Artificial Sequence
  chemically synthesized
tattaggaagaatgggcaca

SEQ ID NO: 518938 - DNA, 20 bp, Artificial Sequence
  chemically synthesized
aaggccaaagaatgagacac

SEQ ID NO: 518939 - DNA, 20 bp, Artificial Sequence
  chemically synthesized
accacagtccctgaaggcca

SEQ ID NO: 518940 - DNA, 20 bp, Artificial Sequence
  chemically synthesized
gtggtgattttgcaatgtct

SEQ ID NO: 518941 - DNA, 20 bp, Artificial Sequence
  chemically synthesized
agcaaaagactgacaaaagc

SEQ ID NO: 518942 - DNA, 20 bp, Artificial Sequence
  chemically synthesized
tgggaaatggaggatggttc

SEQ ID NO: 518943 - DNA, 20 bp, Artificial Sequence
  chemically synthesized
ttgaataataatgggaaatg

SEQ ID NO: 518944 - DNA, 20 bp, Artificial Sequence
  chemically synthesized
actctgaatgtctaaagtcc

SEQ ID NO: 518945 - DNA, 20 bp, Artificial Sequence
  chemically synthesized
attcaaggactttagacatt

SEQ ID NO: 518946 - DNA, 20 bp, Artificial Sequence
  chemically synthesized
gaaaaaattgtctgagaact

SEQ ID NO: 518947 - DNA, 20 bp, Artificial Sequence
  chemically synthesized
ttttcttttgaagagaaaat

SEQ ID NO: 518948 - DNA, 20 bp, Artificial Sequence
  chemically synthesized
ctgtctaatgttacatagaa

SEQ ID NO: 518949 - DNA, 20 bp, Artificial Sequence
  chemically synthesized
acaagaaagacagcgtctaa

SEQ ID NO: 518950 - DNA, 20 bp, Artificial Sequence
  chemically synthesized
ttctcattcatattaattat

SEQ ID NO: 518951 - DNA, 20 bp, Artificial Sequence
  chemically synthesized
aaagcattcaaataattaat

SEQ ID NO: 518952 - DNA, 20 bp, Artificial Sequence
  chemically synthesized
taaaagtagagattttaaaa

SEQ ID NO: 518953 - DNA, 20 bp, Artificial Sequence
  chemically synthesized
caatataatttcttttaaaa

SEQ ID NO: 518954 - DNA, 20 bp, Artificial Sequence
  chemically synthesized
agaaggtaaccaaaagggga

SEQ ID NO: 518955 - DNA, 20 bp, Artificial Sequence
  chemically synthesized
agcaagaaggtaaccaaaag

SEQ ID NO: 518956 - DNA, 20 bp, Artificial Sequence
  chemically synthesized
agatgtatatatctaggtgc

SEQ ID NO: 518957 - DNA, 20 bp, Artificial Sequence
  chemically synthesized
ttcacctacacttttacctt

SEQ ID NO: 518958 - DNA, 20 bp, Artificial Sequence
  chemically synthesized
ttcagaaggtaaaagtgtag

SEQ ID NO: 518959 - DNA, 20 bp, Artificial Sequence
  chemically synthesized
ttatcagtgtgtcactagtg

SEQ ID NO: 518960 - DNA, 20 bp, Artificial Sequence
  chemically synthesized
ggttcttggtgtcttgatca

SEQ ID NO: 518961 - DNA, 20 bp, Artificial Sequence
  chemically synthesized
atgcacaaacaaagcaagga

SEQ ID NO: 518962 - DNA, 20 bp, Artificial Sequence
  chemically synthesized
acaaagcaaggaaggaatga

SEQ ID NO: 518963 - DNA, 20 bp, Artificial Sequence
  chemically synthesized
cccagataaagaaaatcttc

SEQ ID NO: 518964 - DNA, 20 bp, Artificial Sequence
  chemically synthesized
tggccaatgggaaacctgta

SEQ ID NO: 518965 - DNA, 20 bp, Artificial Sequence
  chemically synthesized
aggccaccacttcatttacg

SEQ ID NO: 518966 - DNA, 20 bp, Artificial Sequence
  chemically synthesized
caaccaatcagaggctgaag

SEQ ID NO: 518967 - DNA, 20 bp, Artificial Sequence
  chemically synthesized
ccaatcagatgtttgcacag

SEQ ID NO: 518968 - DNA, 20 bp, Artificial Sequence
  chemically synthesized
aaaggtgggaggtttgcaaa

SEQ ID NO: 518969 - DNA, 20 bp, Artificial Sequence
  chemically synthesized
ctctggtccttatgttactt

SEQ ID NO: 518970 - DNA, 20 bp, Artificial Sequence
  chemically synthesized
gttacttaggggtggaaagt

SEQ ID NO: 518971 - DNA, 20 bp, Artificial Sequence
  chemically synthesized
acacatttgaggcaggagaa

SEQ ID NO: 518972 - DNA, 20 bp, Artificial Sequence
  chemically synthesized
atatcacacatttgaggcag

SEQ ID NO: 518973 - DNA, 20 bp, Artificial Sequence
  chemically synthesized
acctggtgcagaggtccctg

SEQ ID NO: 518974 - DNA, 20 bp, Artificial Sequence
  chemically synthesized
aacaggtggtttttggttac

SEQ ID NO: 518975 - DNA, 20 bp, Artificial Sequence
  chemically synthesized
cggtgtatacttctcaggtg

SEQ ID NO: 518976 - DNA, 20 bp, Artificial Sequence
  chemically synthesized
gagagataaaagcctacata

SEQ ID NO: 518977 - DNA, 20 bp, Artificial Sequence
  chemically synthesized
agcagggggaagggtaggag

SEQ ID NO: 518978 - DNA, 20 bp, Artificial Sequence
  chemically synthesized
tagggactcagagcaggggg

SEQ ID NO: 518979 - DNA, 20 bp, Artificial Sequence
  chemically synthesized
ctcctacccttccccctgct

SEQ ID NO: 518980 - DNA, 20 bp, Artificial Sequence
  chemically synthesized
ttccccctgctctgagtccc

SEQ ID NO: 518981 - DNA, 20 bp, Artificial Sequence
  chemically synthesized
ctatgaggatgcaaaggcat

SEQ ID NO: 518982 - DNA, 20 bp, Artificial Sequence
  chemically synthesized
ataagtgggagctcaactat

SEQ ID NO: 518983 - DNA, 20 bp, Artificial Sequence
  chemically synthesized
tcatagttgagctcccactt

SEQ ID NO: 518984 - DNA, 20 bp, Artificial Sequence
  chemically synthesized
cggtgtttggttttccattc

SEQ ID NO: 518985 - DNA, 20 bp, Artificial Sequence
  chemically synthesized
tattctaagtaaagtaattc

SEQ ID NO: 518986 - DNA, 20 bp, Artificial Sequence
  chemically synthesized
cattcctgaattactttact

SEQ ID NO: 518987 - DNA, 20 bp, Artificial Sequence
  chemically synthesized
ataatgtattttgcaacaac

SEQ ID NO: 518988 - DNA, 20 bp, Artificial Sequence
  chemically synthesized
tgtggttgaaagggaagtac

SEQ ID NO: 518989 - DNA, 20 bp, Artificial Sequence
  chemically synthesized
aacaaatgttatcatttatg

SEQ ID NO: 518990 - DNA, 20 bp, Artificial Sequence
  chemically synthesized
ataaaatcttgtgtattttg

SEQ ID NO: 518991 - DNA, 20 bp, Artificial Sequence
  chemically synthesized
attctaaacagttacattat

SEQ ID NO: 518992 - DNA, 20 bp, Artificial Sequence
  chemically synthesized
attcatataatgtaactgtt

SEQ ID NO: 518993 - DNA, 20 bp, Artificial Sequence
  chemically synthesized
taagtcagtaaaccaataat

SEQ ID NO: 518994 - DNA, 20 bp, Artificial Sequence
  chemically synthesized
atgtcttatataaatagtct

SEQ ID NO: 518995 - DNA, 20 bp, Artificial Sequence
  chemically synthesized
tattaaacgagctatgtaag

SEQ ID NO: 518996 - DNA, 20 bp, Artificial Sequence
  chemically synthesized
ttcattttaaatgcttcttc

SEQ ID NO: 518997 - DNA, 20 bp, Artificial Sequence
  chemically synthesized
cataacttacttctgaaaca

SEQ ID NO: 518998 - DNA, 20 bp, Artificial Sequence
  chemically synthesized
ttttaagaataaagtcatag

SEQ ID NO: 518999 - DNA, 20 bp, Artificial Sequence
  chemically synthesized
tgatttagtttctctctttt

SEQ ID NO: 519000 - DNA, 20 bp, Artificial Sequence
  chemically synthesized
gagcgttctctatctccaca

SEQ ID NO: 519001 - DNA, 20 bp, Artificial Sequence
  chemically synthesized
ttttctctgatggtctcttc

SEQ ID NO: 519002 - DNA, 20 bp, Artificial Sequence
  chemically synthesized
tttcagtatcaggaaaatat

SEQ ID NO: 519003 - DNA, 20 bp, Artificial Sequence
  chemically synthesized
tcctgttttctttatgcttg

SEQ ID NO: 519004 - DNA, 20 bp, Artificial Sequence
  chemically synthesized
tcccaaaatttgctaacatc

SEQ ID NO: 519005 - DNA, 20 bp, Artificial Sequence
  chemically synthesized
catcctggccaaggaacata

SEQ ID NO: 519006 - DNA, 20 bp, Artificial Sequence
  chemically synthesized
cacccactatgttccttggc

SEQ ID NO: 519007 - DNA, 20 bp, Artificial Sequence
  chemically synthesized
aagaagtcacagctcattag

SEQ ID NO: 519008 - DNA, 20 bp, Artificial Sequence
  chemically synthesized
agctgtgacttctttcagtg

SEQ ID NO: 519009 - DNA, 20 bp, Artificial Sequence
  chemically synthesized
gtgtggaatgagacttacca

SEQ ID NO: 519010 - DNA, 20 bp, Artificial Sequence
  chemically synthesized
gctgggaaggtctggtagta

SEQ ID NO: 519011 - DNA, 20 bp, Artificial Sequence
  chemically synthesized
ctaaaaataaatatcgatga

SEQ ID NO: 519012 - DNA, 20 bp, Artificial Sequence
  chemically synthesized
agtagtatttttttctggag

SEQ ID NO: 519013 - DNA, 20 bp, Artificial Sequence
  chemically synthesized
taataagtagtatttttttc

SEQ ID NO: 519014 - DNA, 20 bp, Artificial Sequence
  chemically synthesized
aaaaatactacttattatat

SEQ ID NO: 519015 - DNA, 20 bp, Artificial Sequence
  chemically synthesized
tctttctccttgatttcctt

SEQ ID NO: 519016 - DNA, 20 bp, Artificial Sequence
  chemically synthesized
tttccttttgggttgttcag

SEQ ID NO: 519017 - DNA, 20 bp, Artificial Sequence
  chemically synthesized
tgttgttgctattgttgcaa

SEQ ID NO: 519018 - DNA, 20 bp, Artificial Sequence
  chemically synthesized
gtaatgagctagaagttttt

SEQ ID NO: 519019 - DNA, 20 bp, Artificial Sequence
  chemically synthesized
tctagctcattacctataaa

SEQ ID NO: 519020 - DNA, 20 bp, Artificial Sequence
  chemically synthesized
atgggatcccaatttacaga

SEQ ID NO: 519021 - DNA, 20 bp, Artificial Sequence
  chemically synthesized
aaacaattctatctgtaaat

SEQ ID NO: 519022 - DNA, 20 bp, Artificial Sequence
  chemically synthesized
acaattgcaagcagtggtaa

SEQ ID NO: 519023 - DNA, 20 bp, Artificial Sequence
  chemically synthesized
ctgcttgcaattgttttgcc

SEQ ID NO: 519024 - DNA, 20 bp, Artificial Sequence
  chemically synthesized
gataaagacaggaaaaccat

SEQ ID NO: 519025 - DNA, 20 bp, Artificial Sequence
  chemically synthesized
atggttttcctgtctttatc

SEQ ID NO: 519026 - DNA, 20 bp, Artificial Sequence
  chemically synthesized
gaagaaacatctgatgcatt

SEQ ID NO: 519027 - DNA, 20 bp, Artificial Sequence
  chemically synthesized
acatttaatataaaacagaa

SEQ ID NO: 519028 - DNA, 20 bp, Artificial Sequence
  chemically synthesized
aaagtacatttaatataaaa

SEQ ID NO: 519029 - DNA, 20 bp, Artificial Sequence
  chemically synthesized
ctaagatcacttgtaatttg

SEQ ID NO: 519030 - DNA, 20 bp, Artificial Sequence
  chemically synthesized
catgagcaatgcaagcagaa

SEQ ID NO: 519031 - DNA, 20 bp, Artificial Sequence
  chemically synthesized
ttcattttctcaccactaaa

SEQ ID NO: 519032 - DNA, 20 bp, Artificial Sequence
  chemically synthesized
cttccaatatgatgttgaaa

SEQ ID NO: 519033 - DNA, 20 bp, Artificial Sequence
  chemically synthesized
aagaaaatagacatatctat

SEQ ID NO: 519034 - DNA, 20 bp, Artificial Sequence
  chemically synthesized
catctatgtagaaaatctga

SEQ ID NO: 519035 - DNA, 20 bp, Artificial Sequence
  chemically synthesized
ctacaattgcttattatttc

SEQ ID NO: 519036 - DNA, 20 bp, Artificial Sequence
  chemically synthesized
tgctggtgtgtaagaaacaa

SEQ ID NO: 519037 - DNA, 20 bp, Artificial Sequence
  chemically synthesized
acacaccagcagtgaacaag

SEQ ID NO: 519038 - DNA, 20 bp, Artificial Sequence
  chemically synthesized
ttttcaaaaataaaatactg

SEQ ID NO: 519039 - DNA, 20 bp, Artificial Sequence
  chemically synthesized
gttcctctgataactttcat

SEQ ID NO: 519040 - DNA, 20 bp, Artificial Sequence
  chemically synthesized
aaagttatcagaggaactaa

SEQ ID NO: 519041 - DNA, 20 bp, Artificial Sequence
  chemically synthesized
tggtgaaatattcagtgttc

SEQ ID NO: 519042 - DNA, 20 bp, Artificial Sequence
  chemically synthesized
agtctttctatccatgaaca

SEQ ID NO: 519043 - DNA, 20 bp, Artificial Sequence
  chemically synthesized
gaactgacttctttacaata

SEQ ID NO: 519044 - DNA, 20 bp, Artificial Sequence
  chemically synthesized
taacttgctgtgattttgat

SEQ ID NO: 519045 - DNA, 20 bp, Artificial Sequence
  chemically synthesized
tatatgaaaggcaaaagacc

SEQ ID NO: 519046 - DNA, 20 bp, Artificial Sequence
  chemically synthesized
tcaatattgtgtgggttatt

SEQ ID NO: 519047 - DNA, 20 bp, Artificial Sequence
  chemically synthesized
ttcttctccttcaatattgt

SEQ ID NO: 519048 - DNA, 20 bp, Artificial Sequence
  chemically synthesized
agacaaatacatcaatagaa

SEQ ID NO: 519049 - DNA, 20 bp, Artificial Sequence
  chemically synthesized
tagtgtggaaatagacccac

SEQ ID NO: 519050 - DNA, 20 bp, Artificial Sequence
  chemically synthesized
gatcagtaaactgtattcat

SEQ ID NO: 519051 - DNA, 20 bp, Artificial Sequence
  chemically synthesized
tgacaaacgagcaatggcaa

SEQ ID NO: 519052 - DNA, 20 bp, Artificial Sequence
  chemically synthesized
ggacatctacatgcaaaaaa

SEQ ID NO: 519053 - DNA, 20 bp, Artificial Sequence
  chemically synthesized
ttgtctctcttctgatctga

SEQ ID NO: 519054 - DNA, 20 bp, Artificial Sequence
  chemically synthesized
caaagatcaagttactgcta

SEQ ID NO: 519055 - DNA, 20 bp, Artificial Sequence
  chemically synthesized
acaagtgcctctagcattgt

SEQ ID NO: 519056 - DNA, 20 bp, Artificial Sequence
  chemically synthesized
atgtatttattcttgttctt

SEQ ID NO: 519057 - DNA, 20 bp, Artificial Sequence
  chemically synthesized
taaaatttatcctcaagaac

SEQ ID NO: 519058 - DNA, 20 bp, Artificial Sequence
  chemically synthesized
tgttcttgaggataaatttt

SEQ ID NO: 519059 - DNA, 20 bp, Artificial Sequence
  chemically synthesized
ttttagtatgtttttatgga

SEQ ID NO: 519060 - DNA, 20 bp, Artificial Sequence
  chemically synthesized
taagaaagactattgcaaga

SEQ ID NO: 519061 - DNA, 20 bp, Artificial Sequence
  chemically synthesized
aggatgggatggttatttac

SEQ ID NO: 519062 - DNA, 20 bp, Artificial Sequence
  chemically synthesized
agcttgagcaaaaggaagga

SEQ ID NO: 519063 - DNA, 20 bp, Artificial Sequence
  chemically synthesized
gttttagcttgagcaaaagg

SEQ ID NO: 519064 - DNA, 20 bp, Artificial Sequence
  chemically synthesized
ggactaaaaatggagattga

SEQ ID NO: 519065 - DNA, 20 bp, Artificial Sequence
  chemically synthesized
cattttgaaagtagatgtaa

SEQ ID NO: 519066 - DNA, 20 bp, Artificial Sequence
  chemically synthesized
tggggagaaatgatcgaatt

SEQ ID NO: 519067 - DNA, 20 bp, Artificial Sequence
  chemically synthesized
atggatctggggagaaatga

SEQ ID NO: 519068 - DNA, 20 bp, Artificial Sequence
  chemically synthesized
ctaggattaggttgatgtcc

SEQ ID NO: 519069 - DNA, 20 bp, Artificial Sequence
  chemically synthesized
gctgggtgtgtgcgtgtggc

SEQ ID NO: 519070 - DNA, 20 bp, Artificial Sequence
  chemically synthesized
ggataatgtagtaatgaagg

SEQ ID NO: 519071 - DNA, 20 bp, Artificial Sequence
  chemically synthesized
agaagtagagagatgagtta

SEQ ID NO: 519072 - DNA, 20 bp, Artificial Sequence
  chemically synthesized
gtaaaggtagaagtagagag

SEQ ID NO: 519073 - DNA, 20 bp, Artificial Sequence
  chemically synthesized
aaataatgtaagttagaatg

SEQ ID NO: 519074 - DNA, 20 bp, Artificial Sequence
  chemically synthesized
tagccagaaataatgtaagt

SEQ ID NO: 519075 - DNA, 20 bp, Artificial Sequence
  chemically synthesized
gtgggagattaggagatttt

SEQ ID NO: 519076 - DNA, 20 bp, Artificial Sequence
  chemically synthesized
agagcggtaggatctgcaag

SEQ ID NO: 519077 - DNA, 20 bp, Artificial Sequence
  chemically synthesized
gagtgactgaggaagagcgg

SEQ ID NO: 519078 - DNA, 20 bp, Artificial Sequence
  chemically synthesized
gggagtcaagatggctggtg

SEQ ID NO: 519079 - DNA, 20 bp, Artificial Sequence
  chemically synthesized
gcgtgtttgtgggataacaa

SEQ ID NO: 519080 - DNA, 20 bp, Artificial Sequence
  chemically synthesized
gaggagggagtgcgtgtttg

SEQ ID NO: 519081 - DNA, 20 bp, Artificial Sequence
  chemically synthesized
acaaacacgcactccctcct

SEQ ID NO: 519082 - DNA, 20 bp, Artificial Sequence
  chemically synthesized
gaatatgtacactctgagga

SEQ ID NO: 519083 - DNA, 20 bp, Artificial Sequence
  chemically synthesized
agagagttctaggcagaggg

SEQ ID NO: 519084 - DNA, 20 bp, Artificial Sequence
  chemically synthesized
cttgcaggtgtcttggagaa

SEQ ID NO: 519085 - DNA, 20 bp, Artificial Sequence
  chemically synthesized
gtaggttgccattttatgta

SEQ ID NO: 519086 - DNA, 20 bp, Artificial Sequence
  chemically synthesized
ggtagaatagggatatttca

SEQ ID NO: 519087 - DNA, 20 bp, Artificial Sequence
  chemically synthesized
aagcaggataagggtagaat

SEQ ID NO: 519088 - DNA, 20 bp, Artificial Sequence
  chemically synthesized
aaaataaagcaggataaggg

SEQ ID NO: 519089 - DNA, 20 bp, Artificial Sequence
  chemically synthesized
gagaaaaaataaagcaggat

SEQ ID NO: 519090 - DNA, 20 bp, Artificial Sequence
  chemically synthesized
tgctaagagaaaaaataaag

SEQ ID NO: 519091 - DNA, 20 bp, Artificial Sequence
  chemically synthesized
aagtagaatatagaatttca

SEQ ID NO: 519092 - DNA, 20 bp, Artificial Sequence
  chemically synthesized
ttctctctgcaagtagaata

SEQ ID NO: 519093 - DNA, 20 bp, Artificial Sequence
  chemically synthesized
ttgttttttctctctgcaag

SEQ ID NO: 519094 - DNA, 20 bp, Artificial Sequence
  chemically synthesized
atatcaggtgctctagtgtt

SEQ ID NO: 519095 - DNA, 20 bp, Artificial Sequence
  chemically synthesized
cacctgatatgaaatagata

SEQ ID NO: 519096 - DNA, 20 bp, Artificial Sequence
  chemically synthesized
ttaaatataaattatttgta

SEQ ID NO: 519097 - DNA, 20 bp, Artificial Sequence
  chemically synthesized
tcagtcagagaataaatatt

SEQ ID NO: 519098 - DNA, 20 bp, Artificial Sequence
  chemically synthesized
tgcagttattatgtcagtca

SEQ ID NO: 519099 - DNA, 20 bp, Artificial Sequence
  chemically synthesized
ttcgatctacaaggtctacg

SEQ ID NO: 519100 - DNA, 20 bp, Artificial Sequence
  chemically synthesized
agaacaaatgagagttgcag

SEQ ID NO: 519101 - DNA, 20 bp, Artificial Sequence
  chemically synthesized
gtcttttaatgagaacaaat

SEQ ID NO: 519102 - DNA, 20 bp, Artificial Sequence
  chemically synthesized
agacagctaatgctaaacca

SEQ ID NO: 519103 - DNA, 20 bp, Artificial Sequence
  chemically synthesized
tccagaattgtggccaggtg

SEQ ID NO: 519104 - DNA, 20 bp, Artificial Sequence
  chemically synthesized
tgatcactttcggtcttgtc

SEQ ID NO: 519105 - DNA, 20 bp, Artificial Sequence
  chemically synthesized
catagtgaaattagctaaat

SEQ ID NO: 519106 - DNA, 20 bp, Artificial Sequence
  chemically synthesized
gtatcttggaacataaaagg

SEQ ID NO: 519107 - DNA, 20 bp, Artificial Sequence
  chemically synthesized
ttatatcagtacattactgt

SEQ ID NO: 519108 - DNA, 20 bp, Artificial Sequence
  chemically synthesized
atcatggtagccagaacaca

SEQ ID NO: 519109 - DNA, 20 bp, Artificial Sequence
  chemically synthesized
ataatttgaaatataattct

SEQ ID NO: 519110 - DNA, 20 bp, Artificial Sequence
  chemically synthesized
ccaagattcctatggattcc

SEQ ID NO: 519111 - DNA, 20 bp, Artificial Sequence
  chemically synthesized
atataattctaggaatccat

SEQ ID NO: 519112 - DNA, 20 bp, Artificial Sequence
  chemically synthesized
ttaaccttaccaagattcct

SEQ ID NO: 519113 - DNA, 20 bp, Artificial Sequence
  chemically synthesized
tcttcctctgtgcttcactt

SEQ ID NO: 519114 - DNA, 20 bp, Artificial Sequence
  chemically synthesized
gaagcacagaggaagacctt

SEQ ID NO: 519115 - DNA, 20 bp, Artificial Sequence
  chemically synthesized
gctttactttgcttcagcag

SEQ ID NO: 519116 - DNA, 20 bp, Artificial Sequence
  chemically synthesized
aaacatttccaattgaccta

SEQ ID NO: 519117 - DNA, 20 bp, Artificial Sequence
  chemically synthesized
ggctactatatatttttctt

SEQ ID NO: 519118 - DNA, 20 bp, Artificial Sequence
  chemically synthesized
aaatatatagtagcccatga

SEQ ID NO: 519119 - DNA, 20 bp, Artificial Sequence
  chemically synthesized
gattgcagtgaaagaaattt

SEQ ID NO: 519120 - DNA, 20 bp, Artificial Sequence
  chemically synthesized
tgtttcagggcagataggtg

SEQ ID NO: 519121 - DNA, 20 bp, Artificial Sequence
  chemically synthesized
gccctgaaacacaaaataac

SEQ ID NO: 519122 - DNA, 20 bp, Artificial Sequence
  chemically synthesized
atacacgtatatatacatat

SEQ ID NO: 519123 - DNA, 20 bp, Artificial Sequence
  chemically synthesized
atacatgtatatatacatat

SEQ ID NO: 519124 - DNA, 20 bp, Artificial Sequence
  chemically synthesized
aaatgtgtatatatatatat

SEQ ID NO: 519125 - DNA, 20 bp, Artificial Sequence
  chemically synthesized
gcattttggatttgggattt

SEQ ID NO: 519126 - DNA, 20 bp, Artificial Sequence
  chemically synthesized
atttgggagcattttggatt

SEQ ID NO: 519127 - DNA, 20 bp, Artificial Sequence
  chemically synthesized
gtttctgatttgggagcatt

SEQ ID NO: 519128 - DNA, 20 bp, Artificial Sequence
  chemically synthesized
gaaatgctcattggagcatt

SEQ ID NO: 519129 - DNA, 20 bp, Artificial Sequence
  chemically synthesized
aagtccaaaaatctgaaatc

SEQ ID NO: 519130 - DNA, 20 bp, Artificial Sequence
  chemically synthesized
tcaaattttggattttcgtt

SEQ ID NO: 519131 - DNA, 20 bp, Artificial Sequence
  chemically synthesized
aaatagaaatgtttcaaatt

SEQ ID NO: 519132 - DNA, 20 bp, Artificial Sequence
  chemically synthesized
attttcaaacgttttggacg

SEQ ID NO: 519133 - DNA, 20 bp, Artificial Sequence
  chemically synthesized
cagtatcagattgattgatt

SEQ ID NO: 519134 - DNA, 20 bp, Artificial Sequence
  chemically synthesized
tcttttaactcattcagttt

SEQ ID NO: 519135 - DNA, 20 bp, Artificial Sequence
  chemically synthesized
ggactatactcaaaaactga

SEQ ID NO: 519136 - DNA, 20 bp, Artificial Sequence
  chemically synthesized
gtggggactatactcaaaaa

SEQ ID NO: 519137 - DNA, 20 bp, Artificial Sequence
  chemically synthesized
tgcaagtacttgatttaaat

SEQ ID NO: 519138 - DNA, 20 bp, Artificial Sequence
  chemically synthesized
ggaatgacctttttccagtt

SEQ ID NO: 519139 - DNA, 20 bp, Artificial Sequence
  chemically synthesized
gaaaaaggtcattccccttt

SEQ ID NO: 519140 - DNA, 20 bp, Artificial Sequence
  chemically synthesized
aatttattgaaccctcaaag

SEQ ID NO: 519141 - DNA, 20 bp, Artificial Sequence
  chemically synthesized
gggttcaataaattcctcag

SEQ ID NO: 519142 - DNA, 20 bp, Artificial Sequence
  chemically synthesized
tgttggaggaaaccccactg

SEQ ID NO: 519143 - DNA, 20 bp, Artificial Sequence
  chemically synthesized
atttaatcaggtctgtagta

SEQ ID NO: 519144 - DNA, 20 bp, Artificial Sequence
  chemically synthesized
cactttgagaaccacagtgt

SEQ ID NO: 519145 - DNA, 20 bp, Artificial Sequence
  chemically synthesized
cctgaggacctgttagaaat

SEQ ID NO: 519146 - DNA, 20 bp, Artificial Sequence
  chemically synthesized
cctgttagaaatccggattc

SEQ ID NO: 519147 - DNA, 20 bp, Artificial Sequence
  chemically synthesized
ctagggtgggacccaggaat

SEQ ID NO: 519148 - DNA, 20 bp, Artificial Sequence
  chemically synthesized
ataggtctagggtgggaccc

SEQ ID NO: 519149 - DNA, 20 bp, Artificial Sequence
  chemically synthesized
tgggtcccaccctagaccta

SEQ ID NO: 519150 - DNA, 20 bp, Artificial Sequence
  chemically synthesized
agtttctaattccataggtc

SEQ ID NO: 519151 - DNA, 20 bp, Artificial Sequence
  chemically synthesized
ggattgctgaggcccatagt

SEQ ID NO: 519152 - DNA, 20 bp, Artificial Sequence
  chemically synthesized
cctagaaaatgtgttaaaac

SEQ ID NO: 519153 - DNA, 20 bp, Artificial Sequence
  chemically synthesized
aacgatgcagcaaaacgcat

SEQ ID NO: 519154 - DNA, 20 bp, Artificial Sequence
  chemically synthesized
tgcgttttgctgcatcgttt

SEQ ID NO: 519155 - DNA, 20 bp, Artificial Sequence
  chemically synthesized
caagcaggctaccatttttg

SEQ ID NO: 519156 - DNA, 20 bp, Artificial Sequence
  chemically synthesized
tatgtctattgccaaatgta

SEQ ID NO: 519157 - DNA, 20 bp, Artificial Sequence
  chemically synthesized
aaaacaacaggcaatgatag

SEQ ID NO: 519158 - DNA, 20 bp, Artificial Sequence
  chemically synthesized
ccacaacaatataattcttc

SEQ ID NO: 519159 - DNA, 20 bp, Artificial Sequence
  chemically synthesized
ggcatataatgccattcttg

SEQ ID NO: 519160 - DNA, 20 bp, Artificial Sequence
  chemically synthesized
tagtagcaagggagatcttt

SEQ ID NO: 519161 - DNA, 20 bp, Artificial Sequence
  chemically synthesized
aaagaagtatgacttgtcag

SEQ ID NO: 519162 - DNA, 20 bp, Artificial Sequence
  chemically synthesized
tcaagaaagatgaaggcaga

SEQ ID NO: 519163 - DNA, 20 bp, Artificial Sequence
  chemically synthesized
agaatgactaattgcttgga

SEQ ID NO: 519164 - DNA, 20 bp, Artificial Sequence
  chemically synthesized
tgctgtgggaacatagaaga

SEQ ID NO: 519165 - DNA, 20 bp, Artificial Sequence
  chemically synthesized
cttggagagggaaaaccatg

SEQ ID NO: 519166 - DNA, 20 bp, Artificial Sequence
  chemically synthesized
caacatttaacaaatactta

SEQ ID NO: 519167 - DNA, 20 bp, Artificial Sequence
  chemically synthesized
tagtaaacatatatctctga

SEQ ID NO: 519168 - DNA, 20 bp, Artificial Sequence
  chemically synthesized
tatctctgataggatggtac

SEQ ID NO: 519169 - DNA, 20 bp, Artificial Sequence
  chemically synthesized
aaaataaaatcagataaata

SEQ ID NO: 519170 - DNA, 20 bp, Artificial Sequence
  chemically synthesized
ggataggcccatcagccata

SEQ ID NO: 519171 - DNA, 20 bp, Artificial Sequence
  chemically synthesized
ttggcactgagaccactcca

SEQ ID NO: 519172 - DNA, 20 bp, Artificial Sequence
  chemically synthesized
ttgattacacctatattctc

SEQ ID NO: 519173 - DNA, 20 bp, Artificial Sequence
  chemically synthesized
atgtcctgatacaagaaaat

SEQ ID NO: 519174 - DNA, 20 bp, Artificial Sequence
  chemically synthesized
caaaacatttaccttctaaa

SEQ ID NO: 519175 - DNA, 20 bp, Artificial Sequence
  chemically synthesized
ttgtcaagatctcagtaaca

SEQ ID NO: 519176 - DNA, 20 bp, Artificial Sequence
  chemically synthesized
actcagttagtgagacaaaa

SEQ ID NO: 519177 - DNA, 20 bp, Artificial Sequence
  chemically synthesized
atccatttttgtctcactaa

SEQ ID NO: 519178 - DNA, 20 bp, Artificial Sequence
  chemically synthesized
tgcaaagtacctaagtaaca

SEQ ID NO: 519179 - DNA, 20 bp, Artificial Sequence
  chemically synthesized
tgtttcaggaaaacattcaa

SEQ ID NO: 519180 - DNA, 20 bp, Artificial Sequence
  chemically synthesized
atctactgagaaccattccc

SEQ ID NO: 519181 - DNA, 20 bp, Artificial Sequence
  chemically synthesized
tcgaatgatgtgtttgtgtt

SEQ ID NO: 519182 - DNA, 20 bp, Artificial Sequence
  chemically synthesized
cttggtgttaagatgacttg

SEQ ID NO: 519183 - DNA, 20 bp, Artificial Sequence
  chemically synthesized
aacaccaagtgtagatgtta

SEQ ID NO: 519184 - DNA, 20 bp, Artificial Sequence
  chemically synthesized
catgccagtaaagtggtatt

SEQ ID NO: 519185 - DNA, 20 bp, Artificial Sequence
  chemically synthesized
tattgtgtttacatgattat

SEQ ID NO: 519186 - DNA, 20 bp, Artificial Sequence
  chemically synthesized
gtaaacacaataatttgttt

SEQ ID NO: 519187 - DNA, 20 bp, Artificial Sequence
  chemically synthesized
gaagtaaacttagtttgcag

SEQ ID NO: 519188 - DNA, 20 bp, Artificial Sequence
  chemically synthesized
tttttacatactgcgttttg

SEQ ID NO: 519189 - DNA, 20 bp, Artificial Sequence
  chemically synthesized
caaaatacggtttctactaa

SEQ ID NO: 519190 - DNA, 20 bp, Artificial Sequence
  chemically synthesized
catttagtagaaaccgtatt

SEQ ID NO: 519191 - DNA, 20 bp, Artificial Sequence
  chemically synthesized
gtgaaaaacagaatgcatgt

SEQ ID NO: 519192 - DNA, 20 bp, Artificial Sequence
  chemically synthesized
actgtactgaaagtgaaaaa

SEQ ID NO: 519193 - DNA, 20 bp, Artificial Sequence
  chemically synthesized
aagctagctcatgtaattga

SEQ ID NO: 519194 - DNA, 20 bp, Artificial Sequence
  chemically synthesized
gaaatgattttgcccagctc

SEQ ID NO: 519195 - DNA, 20 bp, Artificial Sequence
  chemically synthesized
ttaagccagcacatttaaag

SEQ ID NO: 519196 - DNA, 20 bp, Artificial Sequence
  chemically synthesized
tgtgatattttcaacttatg

SEQ ID NO: 519197 - DNA, 20 bp, Artificial Sequence
  chemically synthesized
tgtattagaaatcattcaga

SEQ ID NO: 519198 - DNA, 20 bp, Artificial Sequence
  chemically synthesized
agttttttagttgattcttt

SEQ ID NO: 519199 - DNA, 20 bp, Artificial Sequence
  chemically synthesized
cctaaacaatggttgcattt

SEQ ID NO: 519200 - DNA, 20 bp, Artificial Sequence
  chemically synthesized
acagaggatttaatctacct

SEQ ID NO: 519201 - DNA, 20 bp, Artificial Sequence
  chemically synthesized
aaaggtagattaaatcctct

SEQ ID NO: 519202 - DNA, 20 bp, Artificial Sequence
  chemically synthesized
taaatgctcgcttactcaca

SEQ ID NO: 519203 - DNA, 20 bp, Artificial Sequence
  chemically synthesized
gcatttaataccacctgtta

SEQ ID NO: 519204 - DNA, 20 bp, Artificial Sequence
  chemically synthesized
gtcctatgagaagcaggcag

SEQ ID NO: 519205 - DNA, 20 bp, Artificial Sequence
  chemically synthesized
tttgtcccaaaaatgcatta

SEQ ID NO: 519206 - DNA, 20 bp, Artificial Sequence
  chemically synthesized
aaaatgcattattgggtagg

SEQ ID NO: 519207 - DNA, 20 bp, Artificial Sequence
  chemically synthesized
ataataggtatggaaatatc

SEQ ID NO: 519208 - DNA, 20 bp, Artificial Sequence
  chemically synthesized
tatggaaatatcatgagttt

SEQ ID NO: 519209 - DNA, 20 bp, Artificial Sequence
  chemically synthesized
gagttttagagtccattttc

SEQ ID NO: 519210 - DNA, 20 bp, Artificial Sequence
  chemically synthesized
gtattcaagatgagtaaaat

SEQ ID NO: 519211 - DNA, 20 bp, Artificial Sequence
  chemically synthesized
aaattcacattttactcatc

SEQ ID NO: 519212 - DNA, 20 bp, Artificial Sequence
  chemically synthesized
atatgatacaagtattcaag

SEQ ID NO: 519213 - DNA, 20 bp, Artificial Sequence
  chemically synthesized
catatacatataattttcag

SEQ ID NO: 519214 - DNA, 20 bp, Artificial Sequence
  chemically synthesized
atcctcgtttcagaaatagt

SEQ ID NO: 519215 - DNA, 20 bp, Artificial Sequence
  chemically synthesized
atcctcactatttctgaaac

SEQ ID NO: 519216 - DNA, 20 bp, Artificial Sequence
  chemically synthesized
agtgcaattattttggagag

SEQ ID NO: 519217 - DNA, 20 bp, Artificial Sequence
  chemically synthesized
gcacaagactttggtaacaa

SEQ ID NO: 519218 - DNA, 20 bp, Artificial Sequence
  chemically synthesized
acgtacagtgaactatgtct

SEQ ID NO: 519219 - DNA, 20 bp, Artificial Sequence
  chemically synthesized
tgtttttatctgataatagg

SEQ ID NO: 519220 - DNA, 20 bp, Artificial Sequence
  chemically synthesized
gtgttagctatatacagatt

SEQ ID NO: 519221 - DNA, 20 bp, Artificial Sequence
  chemically synthesized
tgtacctttccattgtgtaa

SEQ ID NO: 519222 - DNA, 20 bp, Artificial Sequence
  chemically synthesized
gagcttagaagtttttaaaa

SEQ ID NO: 519223 - DNA, 20 bp, Artificial Sequence
  chemically synthesized
ttctaagctcattttaaata

SEQ ID NO: 519224 - DNA, 20 bp, Artificial Sequence
  chemically synthesized
ttaaatatagaatatgttta

SEQ ID NO: 519225 - DNA, 20 bp, Artificial Sequence
  chemically synthesized
tgtgtgtacgtgttgaggac

SEQ ID NO: 519226 - DNA, 20 bp, Artificial Sequence
  chemically synthesized
tgaggacatgaattggcata

SEQ ID NO: 519227 - DNA, 20 bp, Artificial Sequence
  chemically synthesized
aattggcatacagagtgtaa

SEQ ID NO: 519228 - DNA, 20 bp, Artificial Sequence
  chemically synthesized
gtgtaataggatagtaacac

SEQ ID NO: 519229 - DNA, 20 bp, Artificial Sequence
  chemically synthesized
ttttgaagggtgattttcct

SEQ ID NO: 519230 - DNA, 20 bp, Artificial Sequence
  chemically synthesized
tttcagaactaaagtttttg

SEQ ID NO: 519231 - DNA, 20 bp, Artificial Sequence
  chemically synthesized
tgaaaatctagattcatgtt

SEQ ID NO: 519232 - DNA, 20 bp, Artificial Sequence
  chemically synthesized
acaatatatcaatccttaac

SEQ ID NO: 519233 - DNA, 20 bp, Artificial Sequence
  chemically synthesized
gtcccaactgaacaggctat

SEQ ID NO: 519234 - DNA, 20 bp, Artificial Sequence
  chemically synthesized
tgaacaggctattgggatat

SEQ ID NO: 519235 - DNA, 20 bp, Artificial Sequence
  chemically synthesized
attgcaaatttccactgtcc

SEQ ID NO: 519236 - DNA, 20 bp, Artificial Sequence
  chemically synthesized
gcttcctcaaacacagggaa

SEQ ID NO: 519237 - DNA, 20 bp, Artificial Sequence
  chemically synthesized
tggaaactctgtaaagggag

SEQ ID NO: 519238 - DNA, 20 bp, Artificial Sequence
  chemically synthesized
ccaacatcctactcccttta

SEQ ID NO: 519239 - DNA, 20 bp, Artificial Sequence
  chemically synthesized
acatttggaaactctgtaaa

SEQ ID NO: 519240 - DNA, 20 bp, Artificial Sequence
  chemically synthesized
ccaaagggccaggtagagtc

SEQ ID NO: 519241 - DNA, 20 bp, Artificial Sequence
  chemically synthesized
ttccattccaaagggccagg

SEQ ID NO: 519242 - DNA, 20 bp, Artificial Sequence
  chemically synthesized
ctggactctacctggccctt

SEQ ID NO: 519243 - DNA, 20 bp, Artificial Sequence
  chemically synthesized
atggaagtgggaagaagtag

SEQ ID NO: 519244 - DNA, 20 bp, Artificial Sequence
  chemically synthesized
aatgcaaaatgttacggaga

SEQ ID NO: 519245 - DNA, 20 bp, Artificial Sequence
  chemically synthesized
tttctcaccagtcagattgt

SEQ ID NO: 519246 - DNA, 20 bp, Artificial Sequence
  chemically synthesized
tccttgtttctctacattgg

SEQ ID NO: 519247 - DNA, 20 bp, Artificial Sequence
  chemically synthesized
gcttattacaaactaggtta

SEQ ID NO: 519248 - DNA, 20 bp, Artificial Sequence
  chemically synthesized
atgatgctattgaaatgcac

SEQ ID NO: 519249 - DNA, 20 bp, Artificial Sequence
  chemically synthesized
tcaatagcatcatgaaatta

SEQ ID NO: 519250 - DNA, 20 bp, Artificial Sequence
  chemically synthesized
gaccaggtaacatcatggaa

SEQ ID NO: 519251 - DNA, 20 bp, Artificial Sequence
  chemically synthesized
tatttatgaatttttttcta

SEQ ID NO: 519252 - DNA, 20 bp, Artificial Sequence
  chemically synthesized
attgaaaaatgcatatattt

SEQ ID NO: 519253 - DNA, 20 bp, Artificial Sequence
  chemically synthesized
tatgtaatgtattttctgaa

SEQ ID NO: 519254 - DNA, 20 bp, Artificial Sequence
  chemically synthesized
gtcattatgtaatgtatttt

SEQ ID NO: 519255 - DNA, 20 bp, Artificial Sequence
  chemically synthesized
cattacataatgacaaaaat

SEQ ID NO: 519256 - DNA, 20 bp, Artificial Sequence
  chemically synthesized
tataagaaaaataagactca

SEQ ID NO: 519257 - DNA, 20 bp, Artificial Sequence
  chemically synthesized
gaatataaaattgaaattct

SEQ ID NO: 519258 - DNA, 20 bp, Artificial Sequence
  chemically synthesized
taatttatttgaaaagaaag

SEQ ID NO: 519259 - DNA, 20 bp, Artificial Sequence
  chemically synthesized
cttttcaaataaattaaagt

SEQ ID NO: 519260 - DNA, 20 bp, Artificial Sequence
  chemically synthesized
taacgttttctcctaaggta

SEQ ID NO: 519261 - DNA, 20 bp, Artificial Sequence
  chemically synthesized
cacttatacactgttggtgg

SEQ ID NO: 519262 - DNA, 20 bp, Artificial Sequence
  chemically synthesized
cactgttggtgggagagtaa

SEQ ID NO: 519263 - DNA, 20 bp, Artificial Sequence
  chemically synthesized
gttctgtttttagctctttg

SEQ ID NO: 519264 - DNA, 20 bp, Artificial Sequence
  chemically synthesized
ccagtaatgggattgctagg

SEQ ID NO: 519265 - DNA, 20 bp, Artificial Sequence
  chemically synthesized
tctgggtacatgcccagtaa

SEQ ID NO: 519266 - DNA, 20 bp, Artificial Sequence
  chemically synthesized
atagaatgatttatatttct

SEQ ID NO: 519267 - DNA, 20 bp, Artificial Sequence
  chemically synthesized
tatgtatgcgtgtcttataa

SEQ ID NO: 519268 - DNA, 20 bp, Artificial Sequence
  chemically synthesized
tatttacaatagcaaagacg

SEQ ID NO: 519269 - DNA, 20 bp, Artificial Sequence
  chemically synthesized
agtctatcattgacgggcat

SEQ ID NO: 519270 - DNA, 20 bp, Artificial Sequence
  chemically synthesized
aatgtggtacatatacacca

SEQ ID NO: 519271 - DNA, 20 bp, Artificial Sequence
  chemically synthesized
aatactatgtagccataaga

SEQ ID NO: 519272 - DNA, 20 bp, Artificial Sequence
  chemically synthesized
atcatgtcctttgcagggac

SEQ ID NO: 519273 - DNA, 20 bp, Artificial Sequence
  chemically synthesized
gtcctttgcagggacatgga

SEQ ID NO: 519274 - DNA, 20 bp, Artificial Sequence
  chemically synthesized
tgttcctgcatcattttgct

SEQ ID NO: 519275 - DNA, 20 bp, Artificial Sequence
  chemically synthesized
ctggagcttatcggaaggtg

SEQ ID NO: 519276 - DNA, 20 bp, Artificial Sequence
  chemically synthesized
gtggagggtgggaggaggga

SEQ ID NO: 519277 - DNA, 20 bp, Artificial Sequence
  chemically synthesized
aggatcaggaaaaataatta

SEQ ID NO: 519278 - DNA, 20 bp, Artificial Sequence
  chemically synthesized
atgggtactaggcctaatat

SEQ ID NO: 519279 - DNA, 20 bp, Artificial Sequence
  chemically synthesized
tataggtaaacttgtgtcac

SEQ ID NO: 519280 - DNA, 20 bp, Artificial Sequence
  chemically synthesized
ttaacttttattttaagttc

SEQ ID NO: 519281 - DNA, 20 bp, Artificial Sequence
  chemically synthesized
ggtaaattaacactaaactt

SEQ ID NO: 519282 - DNA, 20 bp, Artificial Sequence
  chemically synthesized
ccagcatgataagcatgatg

SEQ ID NO: 519283 - DNA, 20 bp, Artificial Sequence
  chemically synthesized
atcacatgatattgcccaaa

SEQ ID NO: 519284 - DNA, 20 bp, Artificial Sequence
  chemically synthesized
catgatattgcccaaagagg

SEQ ID NO: 519285 - DNA, 20 bp, Artificial Sequence
  chemically synthesized
ttgcccaaagagggtgagtc

SEQ ID NO: 519286 - DNA, 20 bp, Artificial Sequence
  chemically synthesized
aacaactgtttcagcactga

SEQ ID NO: 519287 - DNA, 20 bp, Artificial Sequence
  chemically synthesized
gacggtaacaaaagcccacc

SEQ ID NO: 519288 - DNA, 20 bp, Artificial Sequence
  chemically synthesized
gaagcatgacaagataatga

SEQ ID NO: 519289 - DNA, 20 bp, Artificial Sequence
  chemically synthesized
aattctaaaagggtcctgtt

SEQ ID NO: 519290 - DNA, 20 bp, Artificial Sequence
  chemically synthesized
aattcttaacaggacccttt

SEQ ID NO: 519291 - DNA, 20 bp, Artificial Sequence
  chemically synthesized
taaagcttttttaattctaa

SEQ ID NO: 519292 - DNA, 20 bp, Artificial Sequence
  chemically synthesized
agaattaaaaaagctttatt

SEQ ID NO: 519293 - DNA, 20 bp, Artificial Sequence
  chemically synthesized
aacttgtttgtggagtcctg

SEQ ID NO: 519294 - DNA, 20 bp, Artificial Sequence
  chemically synthesized
atgcccagtaaacttgtttg

SEQ ID NO: 519295 - DNA, 20 bp, Artificial Sequence
  chemically synthesized
ggctaaatcatggagtttgg

SEQ ID NO: 519296 - DNA, 20 bp, Artificial Sequence
  chemically synthesized
tcttatctccggctaaatca

SEQ ID NO: 519297 - DNA, 20 bp, Artificial Sequence
  chemically synthesized
gatttagccggagataagat

SEQ ID NO: 519298 - DNA, 20 bp, Artificial Sequence
  chemically synthesized
atctaaatgggtccaggtgc

SEQ ID NO: 519299 - DNA, 20 bp, Artificial Sequence
  chemically synthesized
agtaaatttactttatctaa

SEQ ID NO: 519300 - DNA, 20 bp, Artificial Sequence
  chemically synthesized
taaatttactgaggctccag

SEQ ID NO: 519301 - DNA, 20 bp, Artificial Sequence
  chemically synthesized
ggctccagaggaatgtcttc

SEQ ID NO: 519302 - DNA, 20 bp, Artificial Sequence
  chemically synthesized
ttaatcatttatgtctttag

SEQ ID NO: 519303 - DNA, 20 bp, Artificial Sequence
  chemically synthesized
ctctggaaaactttatagtt

SEQ ID NO: 519304 - DNA, 20 bp, Artificial Sequence
  chemically synthesized
ttatagttttgagttggtct

SEQ ID NO: 519305 - DNA, 20 bp, Artificial Sequence
  chemically synthesized
gcagatgaacgggaaaagga

SEQ ID NO: 519306 - DNA, 20 bp, Artificial Sequence
  chemically synthesized
gcatctcgttattgggccac

SEQ ID NO: 519307 - DNA, 20 bp, Artificial Sequence
  chemically synthesized
tagtgttcctggaccaaact

SEQ ID NO: 519308 - DNA, 20 bp, Artificial Sequence
  chemically synthesized
gttggaaaaaaatcagacag

SEQ ID NO: 519309 - DNA, 20 bp, Artificial Sequence
  chemically synthesized
gaaaaaaatcagacagaaga

SEQ ID NO: 519310 - DNA, 20 bp, Artificial Sequence
  chemically synthesized
gatgattactaaattcagta

SEQ ID NO: 519311 - DNA, 20 bp, Artificial Sequence
  chemically synthesized
atgatggttttgatcctata

SEQ ID NO: 519312 - DNA, 20 bp, Artificial Sequence
  chemically synthesized
gagagataaactatctccca

SEQ ID NO: 519313 - DNA, 20 bp, Artificial Sequence
  chemically synthesized
cttccctttattaagccggc

SEQ ID NO: 519314 - DNA, 20 bp, Artificial Sequence
  chemically synthesized
atgagcaagatttttataat

SEQ ID NO: 519315 - DNA, 20 bp, Artificial Sequence
  chemically synthesized
aatgcgaatcatatttgtca

SEQ ID NO: 519316 - DNA, 20 bp, Artificial Sequence
  chemically synthesized
agtatacacgaggcttttta

SEQ ID NO: 519317 - DNA, 20 bp, Artificial Sequence
  chemically synthesized
atatcaataaattacatgga

SEQ ID NO: 519318 - DNA, 20 bp, Artificial Sequence
  chemically synthesized
acatggaaagaatatttact

SEQ ID NO: 519319 - DNA, 20 bp, Artificial Sequence
  chemically synthesized
atttctagataagattaatt

SEQ ID NO: 519320 - DNA, 20 bp, Artificial Sequence
  chemically synthesized
tgtgataaatcacattctag

SEQ ID NO: 519321 - DNA, 20 bp, Artificial Sequence
  chemically synthesized
ttgattccaaaaaattctac

SEQ ID NO: 519322 - DNA, 20 bp, Artificial Sequence
  chemically synthesized
cacattctagtagaattttt

SEQ ID NO: 519323 - DNA, 20 bp, Artificial Sequence
  chemically synthesized
tcaaatgacgccacaacaac

SEQ ID NO: 519324 - DNA, 20 bp, Artificial Sequence
  chemically synthesized
ttattttgtaaagctacgga

SEQ ID NO: 519325 - DNA, 20 bp, Artificial Sequence
  chemically synthesized
acattaatacgactataaaa

SEQ ID NO: 519326 - DNA, 20 bp, Artificial Sequence
  chemically synthesized
atacgactataaaaatgaat

SEQ ID NO: 519327 - DNA, 20 bp, Artificial Sequence
  chemically synthesized
tgaggcatttttatagttgt

SEQ ID NO: 519328 - DNA, 20 bp, Artificial Sequence
  chemically synthesized
tgtctaatttaccacacaga

SEQ ID NO: 519329 - DNA, 20 bp, Artificial Sequence
  chemically synthesized
gactttaaaaagagaaaaaa

SEQ ID NO: 519330 - DNA, 20 bp, Artificial Sequence
  chemically synthesized
ctgtagaaacagaagaaaaa

SEQ ID NO: 519331 - DNA, 20 bp, Artificial Sequence
  chemically synthesized
aatgtgagcccatcaaaggc

SEQ ID NO: 519332 - DNA, 20 bp, Artificial Sequence
  chemically synthesized
aggcagtaatctgagctaga

SEQ ID NO: 519333 - DNA, 20 bp, Artificial Sequence
  chemically synthesized
tagaactgagtgggctcagt

SEQ ID NO: 519334 - DNA, 20 bp, Artificial Sequence
  chemically synthesized
attgataaatggagttagaa

SEQ ID NO: 519335 - DNA, 20 bp, Artificial Sequence
  chemically synthesized
gtttttggttaattgataaa

SEQ ID NO: 519336 - DNA, 20 bp, Artificial Sequence
  chemically synthesized
tggaacctacacagttattt

SEQ ID NO: 519337 - DNA, 20 bp, Artificial Sequence
  chemically synthesized
caaataactgtgtaggttcc

SEQ ID NO: 519338 - DNA, 20 bp, Artificial Sequence
  chemically synthesized
gatacacagattagttgaag

SEQ ID NO: 519339 - DNA, 20 bp, Artificial Sequence
  chemically synthesized
atctgtgtatcctacagggc

SEQ ID NO: 519340 - DNA, 20 bp, Artificial Sequence
  chemically synthesized
tcagcagaattctagccctg

SEQ ID NO: 519341 - DNA, 20 bp, Artificial Sequence
  chemically synthesized
catcgctgcatgcctttcag

SEQ ID NO: 519342 - DNA, 20 bp, Artificial Sequence
  chemically synthesized
gtttcaccaagtggcttaaa

SEQ ID NO: 519343 - DNA, 20 bp, Artificial Sequence
  chemically synthesized
tagacacttttgaagaagat

SEQ ID NO: 519344 - DNA, 20 bp, Artificial Sequence
  chemically synthesized
tcttcttcaaaagtgtctaa

SEQ ID NO: 519345 - DNA, 20 bp, Artificial Sequence
  chemically synthesized
ttagctaagttttgacagaa

SEQ ID NO: 519346 - DNA, 20 bp, Artificial Sequence
  chemically synthesized
tctaattttgagaacttgca

SEQ ID NO: 519347 - DNA, 20 bp, Artificial Sequence
  chemically synthesized
ttatttctattcctgacacc

SEQ ID NO: 519348 - DNA, 20 bp, Artificial Sequence
  chemically synthesized
tcaagcatatcctaggtgtc

SEQ ID NO: 519349 - DNA, 20 bp, Artificial Sequence
  chemically synthesized
acctaggatatgcttgataa

SEQ ID NO: 519350 - DNA, 20 bp, Artificial Sequence
  chemically synthesized
aatagaatttctgtacttga

SEQ ID NO: 519351 - DNA, 20 bp, Artificial Sequence
  chemically synthesized
agtctgttataactgatcag

SEQ ID NO: 519352 - DNA, 20 bp, Artificial Sequence
  chemically synthesized
ttgtaatataaatgaaaagt

SEQ ID NO: 519353 - DNA, 20 bp, Artificial Sequence
  chemically synthesized
atataaatgaaaagtgtgag

SEQ ID NO: 519354 - DNA, 20 bp, Artificial Sequence
  chemically synthesized
gaaaagtgtgagttgagtta

SEQ ID NO: 519355 - DNA, 20 bp, Artificial Sequence
  chemically synthesized
caataaatgtgctcatatat

SEQ ID NO: 519356 - DNA, 20 bp, Artificial Sequence
  chemically synthesized
gtatatttttttctgtcctt

SEQ ID NO: 519357 - DNA, 20 bp, Artificial Sequence
  chemically synthesized
taaggacagaaaaaaatata

SEQ ID NO: 519358 - DNA, 20 bp, Artificial Sequence
  chemically synthesized
gtgctaacaatatataaata

SEQ ID NO: 519359 - DNA, 20 bp, Artificial Sequence
  chemically synthesized
taacaatatataaatagagg

SEQ ID NO: 519360 - DNA, 20 bp, Artificial Sequence
  chemically synthesized
atatataaatagaggatgga

SEQ ID NO: 519361 - DNA, 20 bp, Artificial Sequence
  chemically synthesized
tttgatttctatattaacag

SEQ ID NO: 519362 - DNA, 20 bp, Artificial Sequence
  chemically synthesized
gaagatctatttcaacttgc

SEQ ID NO: 519363 - DNA, 20 bp, Artificial Sequence
  chemically synthesized
ctatttcaacttgcgggaat

SEQ ID NO: 519364 - DNA, 20 bp, Artificial Sequence
  chemically synthesized
tctgaatctttgaattgaac

SEQ ID NO: 519365 - DNA, 20 bp, Artificial Sequence
  chemically synthesized
tctagttcaattcaaagatt

SEQ ID NO: 519366 - DNA, 20 bp, Artificial Sequence
  chemically synthesized
tgtaacaatactctgaatct

SEQ ID NO: 519367 - DNA, 20 bp, Artificial Sequence
  chemically synthesized
atagtaaatgtaacaatact

SEQ ID NO: 519368 - DNA, 20 bp, Artificial Sequence
  chemically synthesized
aaacaaacatacagacaaat

SEQ ID NO: 519369 - DNA, 20 bp, Artificial Sequence
  chemically synthesized
aatatgtctcttgtctgctt

SEQ ID NO: 519370 - DNA, 20 bp, Artificial Sequence
  chemically synthesized
tcattgacatttttaagttt

SEQ ID NO: 519371 - DNA, 20 bp, Artificial Sequence
  chemically synthesized
aaccatcttataaatattcg

SEQ ID NO: 519372 - DNA, 20 bp, Artificial Sequence
  chemically synthesized
ttataaatattcggagaatt

SEQ ID NO: 519373 - DNA, 20 bp, Artificial Sequence
  chemically synthesized
ggaaagttattcataattct

SEQ ID NO: 519374 - DNA, 20 bp, Artificial Sequence
  chemically synthesized
gaataaataaaaagtaaacc

SEQ ID NO: 519375 - DNA, 20 bp, Artificial Sequence
  chemically synthesized
atataacaacacaaatatag

SEQ ID NO: 519376 - DNA, 20 bp, Artificial Sequence
  chemically synthesized
tcacttagctaaaaaaagtt

SEQ ID NO: 519377 - DNA, 20 bp, Artificial Sequence
  chemically synthesized
aagttcattttatttacttg

SEQ ID NO: 519378 - DNA, 20 bp, Artificial Sequence
  chemically synthesized
gtactctttaatttaactta

SEQ ID NO: 519379 - DNA, 20 bp, Artificial Sequence
  chemically synthesized
aaattcagtaagttaaatta

SEQ ID NO: 519380 - DNA, 20 bp, Artificial Sequence
  chemically synthesized
ttctttgtggtatttggtag

SEQ ID NO: 519381 - DNA, 20 bp, Artificial Sequence
  chemically synthesized
ttctactaccaaataccaca

SEQ ID NO: 519382 - DNA, 20 bp, Artificial Sequence
  chemically synthesized
ttttctatgacaaacatttt

SEQ ID NO: 519383 - DNA, 20 bp, Artificial Sequence
  chemically synthesized
aaaagggagaacttttgaga

SEQ ID NO: 519384 - DNA, 20 bp, Artificial Sequence
  chemically synthesized
ttttgagattggatctccta

SEQ ID NO: 519385 - DNA, 20 bp, Artificial Sequence
  chemically synthesized
attgttttggctccattatc

SEQ ID NO: 519386 - DNA, 20 bp, Artificial Sequence
  chemically synthesized
tacaaaatcagacccataga

SEQ ID NO: 519387 - DNA, 20 bp, Artificial Sequence
  chemically synthesized
agctatgaattactccctct

SEQ ID NO: 519388 - DNA, 20 bp, Artificial Sequence
  chemically synthesized
gggagtaattcatagctatt

SEQ ID NO: 519389 - DNA, 20 bp, Artificial Sequence
  chemically synthesized
gcctgaaactcttaatagct

SEQ ID NO: 519390 - DNA, 20 bp, Artificial Sequence
  chemically synthesized
tttcttattgtaatgattta

SEQ ID NO: 519391 - DNA, 20 bp, Artificial Sequence
  chemically synthesized
agagtggcatagttttgata

SEQ ID NO: 519392 - DNA, 20 bp, Artificial Sequence
  chemically synthesized
actatgccactcttaaagcc

SEQ ID NO: 519393 - DNA, 20 bp, Artificial Sequence
  chemically synthesized
gcccttaaacccaaggcttt

SEQ ID NO: 519394 - DNA, 20 bp, Artificial Sequence
  chemically synthesized
ggttttcttatgtttccatc

SEQ ID NO: 519395 - DNA, 20 bp, Artificial Sequence
  chemically synthesized
gtaaatcaatcaaatgtttg

SEQ ID NO: 519396 - DNA, 20 bp, Artificial Sequence
  chemically synthesized
ttgattgatttacccaaatc

SEQ ID NO: 519397 - DNA, 20 bp, Artificial Sequence
  chemically synthesized
ttttaattattattctcgat

SEQ ID NO: 519398 - DNA, 20 bp, Artificial Sequence
  chemically synthesized
tgcaatatatggaggtttat

SEQ ID NO: 519399 - DNA, 20 bp, Artificial Sequence
  chemically synthesized
ttaccttgaaaactagtatt

SEQ ID NO: 519400 - DNA, 20 bp, Artificial Sequence
  chemically synthesized
ctaatactagttttcaaggt

SEQ ID NO: 519401 - DNA, 20 bp, Artificial Sequence
  chemically synthesized
tgtgtccacctataatcatc

SEQ ID NO: 519402 - DNA, 20 bp, Artificial Sequence
  chemically synthesized
gtcacgctattgattaaaaa

SEQ ID NO: 519403 - DNA, 20 bp, Artificial Sequence
  chemically synthesized
ttgcaaattaagtaaatatt

SEQ ID NO: 519404 - DNA, 20 bp, Artificial Sequence
  chemically synthesized
attaagtaaatattaagagt

SEQ ID NO: 519405 - DNA, 20 bp, Artificial Sequence
  chemically synthesized
tatgctctaaactatagtgg

SEQ ID NO: 519406 - DNA, 20 bp, Artificial Sequence
  chemically synthesized
agaaaagcaatataattgct

SEQ ID NO: 519407 - DNA, 20 bp, Artificial Sequence
  chemically synthesized
cccagcagaagaagatatga

SEQ ID NO: 519408 - DNA, 20 bp, Artificial Sequence
  chemically synthesized
ttccctcatatcttcttctg

SEQ ID NO: 519409 - DNA, 20 bp, Artificial Sequence
  chemically synthesized
gcaatcttccatcaagtagc

SEQ ID NO: 519410 - DNA, 20 bp, Artificial Sequence
  chemically synthesized
tctttaatgacatgagtcct

SEQ ID NO: 519411 - DNA, 20 bp, Artificial Sequence
  chemically synthesized
atgtgagtttctttaatgac

SEQ ID NO: 519412 - DNA, 20 bp, Artificial Sequence
  chemically synthesized
ctttgattcttcttgacaat

SEQ ID NO: 519413 - DNA, 20 bp, Artificial Sequence
  chemically synthesized
aagaaactcacattgtcaag

SEQ ID NO: 519414 - DNA, 20 bp, Artificial Sequence
  chemically synthesized
ctgctgcttactccttaaat

SEQ ID NO: 519415 - DNA, 20 bp, Artificial Sequence
  chemically synthesized
attatgttcactcttattta

SEQ ID NO: 519416 - DNA, 20 bp, Artificial Sequence
  chemically synthesized
gacactatgagagaaataaa

SEQ ID NO: 519417 - DNA, 20 bp, Artificial Sequence
  chemically synthesized
aatgcacaattttctaaggt

SEQ ID NO: 519418 - DNA, 20 bp, Artificial Sequence
  chemically synthesized
attgtgcatttacccatttt

SEQ ID NO: 519419 - DNA, 20 bp, Artificial Sequence
  chemically synthesized
caaaagaaaacattcacaaa

SEQ ID NO: 519420 - DNA, 20 bp, Artificial Sequence
  chemically synthesized
agttactttggttgtaaaat

SEQ ID NO: 519421 - DNA, 20 bp, Artificial Sequence
  chemically synthesized
gtattacattcattgataaa

SEQ ID NO: 519422 - DNA, 20 bp, Artificial Sequence
  chemically synthesized
atgtttaattccatttatca

SEQ ID NO: 519423 - DNA, 20 bp, Artificial Sequence
  chemically synthesized
attgataaatggaattaaac

SEQ ID NO: 519424 - DNA, 20 bp, Artificial Sequence
  chemically synthesized
ttttcagaagtaattttaat

SEQ ID NO: 519425 - DNA, 20 bp, Artificial Sequence
  chemically synthesized
tcactggcctcccaaactgt

SEQ ID NO: 519426 - DNA, 20 bp, Artificial Sequence
  chemically synthesized
agtttgggaggccagtgagg

SEQ ID NO: 519427 - DNA, 20 bp, Artificial Sequence
  chemically synthesized
ttttgtattttcagtagaga

SEQ ID NO: 519428 - DNA, 20 bp, Artificial Sequence
  chemically synthesized
gcctcagcctcccaagtagc

SEQ ID NO: 519429 - DNA, 20 bp, Artificial Sequence
  chemically synthesized
tacttgggaggctgaggcag

SEQ ID NO: 519430 - DNA, 20 bp, Artificial Sequence
  chemically synthesized
ggctgaggcaggagaatcat

SEQ ID NO: 519431 - DNA, 20 bp, Artificial Sequence
  chemically synthesized
ctcactgcaacctccacctc

SEQ ID NO: 519432 - DNA, 20 bp, Artificial Sequence
  chemically synthesized
tcttgctctgtcgcccacgc

SEQ ID NO: 519433 - DNA, 20 bp, Artificial Sequence
  chemically synthesized
cagatattacaaatctgagg

SEQ ID NO: 519434 - DNA, 20 bp, Artificial Sequence
  chemically synthesized
catacagtatttgaacgact

SEQ ID NO: 519435 - DNA, 20 bp, Artificial Sequence
  chemically synthesized
ttataaaaaaatagtctcct

SEQ ID NO: 519436 - DNA, 20 bp, Artificial Sequence
  chemically synthesized
acagtatttattcgccagtt

SEQ ID NO: 519437 - DNA, 20 bp, Artificial Sequence
  chemically synthesized
ggagtatctattcataactg

SEQ ID NO: 519438 - DNA, 20 bp, Artificial Sequence
  chemically synthesized
agagtttcttttaattatac

SEQ ID NO: 519439 - DNA, 20 bp, Artificial Sequence
  chemically synthesized
tttcggagtaaatgacagct

SEQ ID NO: 519440 - DNA, 20 bp, Artificial Sequence
  chemically synthesized
aaggctccgaaatagttttt

SEQ ID NO: 519441 - DNA, 20 bp, Artificial Sequence
  chemically synthesized
aatcatttctccatggttgg

SEQ ID NO: 519442 - DNA, 20 bp, Artificial Sequence
  chemically synthesized
gaataatcatttctccatgg

SEQ ID NO: 519443 - DNA, 20 bp, Artificial Sequence
  chemically synthesized
tatgtagatgctgcaaagga

SEQ ID NO: 519444 - DNA, 20 bp, Artificial Sequence
  chemically synthesized
tagtgagatcaggcccatgt

SEQ ID NO: 519445 - DNA, 20 bp, Artificial Sequence
  chemically synthesized
tcctagaaattttagagttg

SEQ ID NO: 519446 - DNA, 20 bp, Artificial Sequence
  chemically synthesized
aaaagaggtcctagaaattt

SEQ ID NO: 519447 - DNA, 20 bp, Artificial Sequence
  chemically synthesized
gtatttatatgtaaggcatg

SEQ ID NO: 519448 - DNA, 20 bp, Artificial Sequence
  chemically synthesized
atctttggggacttttttct

SEQ ID NO: 519449 - DNA, 20 bp, Artificial Sequence
  chemically synthesized
gtccccaaagatttatacta

SEQ ID NO: 519450 - DNA, 20 bp, Artificial Sequence
  chemically synthesized
attattaaaaaacagcttca

SEQ ID NO: 519451 - DNA, 20 bp, Artificial Sequence
  chemically synthesized
aaaagatcatttgtagaagc

SEQ ID NO: 519452 - DNA, 20 bp, Artificial Sequence
  chemically synthesized
tattagttaatgttcagtaa

SEQ ID NO: 519453 - DNA, 20 bp, Artificial Sequence
  chemically synthesized
aaattttatattttatctac

SEQ ID NO: 519454 - DNA, 20 bp, Artificial Sequence
  chemically synthesized
ttgcttctcttaaaaacata

SEQ ID NO: 519455 - DNA, 20 bp, Artificial Sequence
  chemically synthesized
ttatttctcatattgactaa

SEQ ID NO: 519456 - DNA, 20 bp, Artificial Sequence
  chemically synthesized
agtcaatatgagaaataaca

SEQ ID NO: 519457 - DNA, 20 bp, Artificial Sequence
  chemically synthesized
acatacatatagaagcttgt

SEQ ID NO: 519458 - DNA, 20 bp, Artificial Sequence
  chemically synthesized
taagatttatcatataccat

SEQ ID NO: 519459 - DNA, 20 bp, Artificial Sequence
  chemically synthesized
gaagtatttcctttgttgac

SEQ ID NO: 519460 - DNA, 20 bp, Artificial Sequence
  chemically synthesized
tatttcctttgttgacaagg

SEQ ID NO: 519461 - DNA, 20 bp, Artificial Sequence
  chemically synthesized
agtaaagatttgaaggaggc

SEQ ID NO: 519462 - DNA, 20 bp, Artificial Sequence
  chemically synthesized
aaataaggtcatttactttt

SEQ ID NO: 519463 - DNA, 20 bp, Artificial Sequence
  chemically synthesized
gcacatgtaggaaatataag

SEQ ID NO: 519464 - DNA, 20 bp, Artificial Sequence
  chemically synthesized
gtactttctgtcagaaagca

SEQ ID NO: 519465 - DNA, 20 bp, Artificial Sequence
  chemically synthesized
tgtcagaaagcagagagtaa

SEQ ID NO: 519466 - DNA, 20 bp, Artificial Sequence
  chemically synthesized
tgggtatgtttcaaagacat

SEQ ID NO: 519467 - DNA, 20 bp, Artificial Sequence
  chemically synthesized
tgagcttttggcagagggtt

SEQ ID NO: 519468 - DNA, 20 bp, Artificial Sequence
  chemically synthesized
ctcatattgagcttttggca

SEQ ID NO: 519469 - DNA, 20 bp, Artificial Sequence
  chemically synthesized
tttaagtgaaaaatacgtag

SEQ ID NO: 519470 - DNA, 20 bp, Artificial Sequence
  chemically synthesized
tccttgtccatataattgaa

SEQ ID NO: 519471 - DNA, 20 bp, Artificial Sequence
  chemically synthesized
tcttttcaattatatggaca

SEQ ID NO: 519472 - DNA, 20 bp, Artificial Sequence
  chemically synthesized
atacaagaaaaatgtcttca

SEQ ID NO: 519473 - DNA, 20 bp, Artificial Sequence
  chemically synthesized
cttatgaatagtaaggcact

SEQ ID NO: 519474 - DNA, 20 bp, Artificial Sequence
  chemically synthesized
gacataattaaaacaaactt

SEQ ID NO: 519475 - DNA, 20 bp, Artificial Sequence
  chemically synthesized
tacataaacacaagctgaga

SEQ ID NO: 519476 - DNA, 20 bp, Artificial Sequence
  chemically synthesized
atgaacttgatacagatttt

SEQ ID NO: 519477 - DNA, 20 bp, Artificial Sequence
  chemically synthesized
taattgcataattaacaata

SEQ ID NO: 519478 - DNA, 20 bp, Artificial Sequence
  chemically synthesized
acagaataccataagataat

SEQ ID NO: 519479 - DNA, 20 bp, Artificial Sequence
  chemically synthesized
acaacatacatggaacctcc

SEQ ID NO: 519480 - DNA, 20 bp, Artificial Sequence
  chemically synthesized
ccatgtatgttgtaacctat

SEQ ID NO: 519481 - DNA, 20 bp, Artificial Sequence
  chemically synthesized
aacctatgtgaatagcgtcc

SEQ ID NO: 519482 - DNA, 20 bp, Artificial Sequence
  chemically synthesized
ctgtatgaactgatctagaa

SEQ ID NO: 519483 - DNA, 20 bp, Artificial Sequence
  chemically synthesized
atgagccttctttaatggtg

SEQ ID NO: 519484 - DNA, 20 bp, Artificial Sequence
  chemically synthesized
acaaaaattttgattgattt

SEQ ID NO: 519485 - DNA, 20 bp, Artificial Sequence
  chemically synthesized
ataagaaatatgtatttatg

SEQ ID NO: 519486 - DNA, 20 bp, Artificial Sequence
  chemically synthesized
gataaaataagtgaaaaaga

SEQ ID NO: 519487 - DNA, 20 bp, Artificial Sequence
  chemically synthesized
attataaaaacaaaaaagaa

SEQ ID NO: 519488 - DNA, 20 bp, Artificial Sequence
  chemically synthesized
tctttctgctaccagtagaa

SEQ ID NO: 519489 - DNA, 20 bp, Artificial Sequence
  chemically synthesized
ccacttctactggtagcaga

SEQ ID NO: 519490 - DNA, 20 bp, Artificial Sequence
  chemically synthesized
gtagcagaaagaatgaggtt

SEQ ID NO: 519491 - DNA, 20 bp, Artificial Sequence
  chemically synthesized
gccgcaggtatgtcattcat

SEQ ID NO: 519492 - DNA, 20 bp, Artificial Sequence
  chemically synthesized
actaaagcaacgaaactcct

SEQ ID NO: 519493 - DNA, 20 bp, Artificial Sequence
  chemically synthesized
ttatgattaaagcaaacatc

SEQ ID NO: 519494 - DNA, 20 bp, Artificial Sequence
  chemically synthesized
ttgacaaaaataggaacata

SEQ ID NO: 519495 - DNA, 20 bp, Artificial Sequence
  chemically synthesized
tgctcaatagataaatgagc

SEQ ID NO: 519496 - DNA, 20 bp, Artificial Sequence
  chemically synthesized
tttaatattttaaaattaat

SEQ ID NO: 519497 - DNA, 20 bp, Artificial Sequence
  chemically synthesized
gcccatgacttgaaatgttt

SEQ ID NO: 519498 - DNA, 20 bp, Artificial Sequence
  chemically synthesized
catatttgcatatagtttca

SEQ ID NO: 519499 - DNA, 20 bp, Artificial Sequence
  chemically synthesized
aacttggattttatggttat

SEQ ID NO: 519500 - DNA, 20 bp, Artificial Sequence
  chemically synthesized
gcttaattttgatcgttaac

SEQ ID NO: 519501 - DNA, 20 bp, Artificial Sequence
  chemically synthesized
tgtccattcactgactaaaa

SEQ ID NO: 519502 - DNA, 20 bp, Artificial Sequence
  chemically synthesized
aagctactcacttttagtca

SEQ ID NO: 519503 - DNA, 20 bp, Artificial Sequence
  chemically synthesized
aaaattttatacgtatttac

SEQ ID NO: 519504 - DNA, 20 bp, Artificial Sequence
  chemically synthesized
atggtggctttaggttaact

SEQ ID NO: 519505 - DNA, 20 bp, Artificial Sequence
  chemically synthesized
agcaacaaagcaaatgagaa

SEQ ID NO: 519506 - DNA, 20 bp, Artificial Sequence
  chemically synthesized
aaaccctaaaggaaatgaaa

SEQ ID NO: 519507 - DNA, 20 bp, Artificial Sequence
  chemically synthesized
atattctatttcatttcctt

SEQ ID NO: 519508 - DNA, 20 bp, Artificial Sequence
  chemically synthesized
atatgggatttccccgtaga

SEQ ID NO: 519509 - DNA, 20 bp, Artificial Sequence
  chemically synthesized
gttagaaagctaattttata

SEQ ID NO: 519510 - DNA, 20 bp, Artificial Sequence
  chemically synthesized
ataaaaataactttattaga

SEQ ID NO: 519511 - DNA, 20 bp, Artificial Sequence
  chemically synthesized
aatatgaaaggccacatata

SEQ ID NO: 519512 - DNA, 20 bp, Artificial Sequence
  chemically synthesized
aggaatataaaagttaataa

SEQ ID NO: 519513 - DNA, 20 bp, Artificial Sequence
  chemically synthesized
tttatattcctgagggacta

SEQ ID NO: 519514 - DNA, 20 bp, Artificial Sequence
  chemically synthesized
tttatattccttagtccctc

SEQ ID NO: 519515 - DNA, 20 bp, Artificial Sequence
  chemically synthesized
gtccctcaggaatataaatg

SEQ ID NO: 519516 - DNA, 20 bp, Artificial Sequence
  chemically synthesized
gtaacttgctcttgtgaatc

SEQ ID NO: 519517 - DNA, 20 bp, Artificial Sequence
  chemically synthesized
ttctgcagtaacttgctctt

SEQ ID NO: 519518 - DNA, 20 bp, Artificial Sequence
  chemically synthesized
acaagagcaagttactgcag

SEQ ID NO: 519519 - DNA, 20 bp, Artificial Sequence
  chemically synthesized
agtggctttgcaggacttat

SEQ ID NO: 519520 - DNA, 20 bp, Artificial Sequence
  chemically synthesized
agcgtctttaactgtgaaat

SEQ ID NO: 519521 - DNA, 20 bp, Artificial Sequence
  chemically synthesized
tatatcctgtcaatagctcc

SEQ ID NO: 519522 - DNA, 20 bp, Artificial Sequence
  chemically synthesized
ttaactcatggagctattga

SEQ ID NO: 519523 - DNA, 20 bp, Artificial Sequence
  chemically synthesized
tttattttataaattattac

SEQ ID NO: 519524 - DNA, 20 bp, Artificial Sequence
  chemically synthesized
atttataaaataaatattta

SEQ ID NO: 519525 - DNA, 20 bp, Artificial Sequence
  chemically synthesized
aggctaagagctctcccaga

SEQ ID NO: 519526 - DNA, 20 bp, Artificial Sequence
  chemically synthesized
tattataggagcatggagaa

SEQ ID NO: 519527 - DNA, 20 bp, Artificial Sequence
  chemically synthesized
agaaaggaatatgtagccac

SEQ ID NO: 519528 - DNA, 20 bp, Artificial Sequence
  chemically synthesized
aagatattttggagaaggta

SEQ ID NO: 519529 - DNA, 20 bp, Artificial Sequence
  chemically synthesized
tggagaaggtaatgggtagg

SEQ ID NO: 519530 - DNA, 20 bp, Artificial Sequence
  chemically synthesized
aatgggtaggttgagttcag

SEQ ID NO: 519531 - DNA, 20 bp, Artificial Sequence
  chemically synthesized
aggatgagagaaagtaaaga

SEQ ID NO: 519532 - DNA, 20 bp, Artificial Sequence
  chemically synthesized
agaaggaataaaggtaggag

SEQ ID NO: 519533 - DNA, 20 bp, Artificial Sequence
  chemically synthesized
aaggtaggaggaggataaag

SEQ ID NO: 519534 - DNA, 20 bp, Artificial Sequence
  chemically synthesized
gcagacagtaaggacaagga

SEQ ID NO: 519535 - DNA, 20 bp, Artificial Sequence
  chemically synthesized
caacaaaacagaattgcata

SEQ ID NO: 519536 - DNA, 20 bp, Artificial Sequence
  chemically synthesized
cattttagagtgcaacaaaa

SEQ ID NO: 519537 - DNA, 20 bp, Artificial Sequence
  chemically synthesized
ccactccctttctcacattt

SEQ ID NO: 519538 - DNA, 20 bp, Artificial Sequence
  chemically synthesized
gcactctaaaatgtgagaaa

SEQ ID NO: 519539 - DNA, 20 bp, Artificial Sequence
  chemically synthesized
atgtgagaaagggagtggca

SEQ ID NO: 519540 - DNA, 20 bp, Artificial Sequence
  chemically synthesized
gcatggaatgaaattgcaat

SEQ ID NO: 519541 - DNA, 20 bp, Artificial Sequence
  chemically synthesized
ggttaattgctttgtgtaat

SEQ ID NO: 519542 - DNA, 20 bp, Artificial Sequence
  chemically synthesized
tctcgctctgttccccaggc

SEQ ID NO: 519543 - DNA, 20 bp, Artificial Sequence
  chemically synthesized
tgagagaattgcttgagccc

SEQ ID NO: 519544 - DNA, 20 bp, Artificial Sequence
  chemically synthesized
tactgaggaggcagaggtga

SEQ ID NO: 519545 - DNA, 20 bp, Artificial Sequence
  chemically synthesized
cagatgtggtgatgtgtgcc

SEQ ID NO: 519546 - DNA, 20 bp, Artificial Sequence
  chemically synthesized
ttttttttcttttgtaaaga

SEQ ID NO: 519547 - DNA, 20 bp, Artificial Sequence
  chemically synthesized
cagaaggattgatggagtcc

SEQ ID NO: 519548 - DNA, 20 bp, Artificial Sequence
  chemically synthesized
ggctgagacagaaggattga

SEQ ID NO: 519549 - DNA, 20 bp, Artificial Sequence
  chemically synthesized
actttgggaggctgagacag

SEQ ID NO: 519550 - DNA, 20 bp, Artificial Sequence
  chemically synthesized
ttaaaaaatgtttttctagg

SEQ ID NO: 519551 - DNA, 20 bp, Artificial Sequence
  chemically synthesized
tacattttctgtgtcacatt

SEQ ID NO: 519552 - DNA, 20 bp, Artificial Sequence
  chemically synthesized
atgtatctttaaaaggggaa

SEQ ID NO: 519553 - DNA, 20 bp, Artificial Sequence
  chemically synthesized
ccattgcatttcttcactac

SEQ ID NO: 519554 - DNA, 20 bp, Artificial Sequence
  chemically synthesized
cacgtagtgaagaaatgcaa

SEQ ID NO: 519555 - DNA, 20 bp, Artificial Sequence
  chemically synthesized
tagtgaagaaatgcaatggg

SEQ ID NO: 519556 - DNA, 20 bp, Artificial Sequence
  chemically synthesized
acctcggcctcccaaagtgc

SEQ ID NO: 519557 - DNA, 20 bp, Artificial Sequence
  chemically synthesized
actttgggaggccgaggtgg

SEQ ID NO: 519558 - DNA, 20 bp, Artificial Sequence
  chemically synthesized
cggggtttcaccgtgttagc

SEQ ID NO: 519559 - DNA, 20 bp, Artificial Sequence
  chemically synthesized
ttttgtatttttagtagaga

SEQ ID NO: 519560 - DNA, 20 bp, Artificial Sequence
  chemically synthesized
ttttttttttttttttgaga

SEQ ID NO: 519561 - DNA, 20 bp, Artificial Sequence
  chemically synthesized
tctcatgtttgatggaagca

SEQ ID NO: 519562 - DNA, 20 bp, Artificial Sequence
  chemically synthesized
atttaggacatatttagaaa

SEQ ID NO: 519563 - DNA, 20 bp, Artificial Sequence
  chemically synthesized
aatattacaaaatggcagtg

SEQ ID NO: 519564 - DNA, 20 bp, Artificial Sequence
  chemically synthesized
aaaaatgctttctattaaat

SEQ ID NO: 519565 - DNA, 20 bp, Artificial Sequence
  chemically synthesized
tgagtaatagtctttgatta

SEQ ID NO: 519566 - DNA, 20 bp, Artificial Sequence
  chemically synthesized
tgcattacattgactgtaaa

SEQ ID NO: 519567 - DNA, 20 bp, Artificial Sequence
  chemically synthesized
gttattaagaacaacttttg

SEQ ID NO: 519568 - DNA, 20 bp, Artificial Sequence
  chemically synthesized
tcactctcttggaaatgaga

SEQ ID NO: 519569 - DNA, 20 bp, Artificial Sequence
  chemically synthesized
acatcctttctcatttccaa

SEQ ID NO: 519570 - DNA, 20 bp, Artificial Sequence
  chemically synthesized
atttccaagagagtgactgt

SEQ ID NO: 519571 - DNA, 20 bp, Artificial Sequence
  chemically synthesized
acacattctatgctaagtgc

SEQ ID NO: 519572 - DNA, 20 bp, Artificial Sequence
  chemically synthesized
tgtaatcccagcacttagca

SEQ ID NO: 519573 - DNA, 20 bp, Artificial Sequence
  chemically synthesized
ttctgcctaccagagtttaa

SEQ ID NO: 519574 - DNA, 20 bp, Artificial Sequence
  chemically synthesized
ttctattaaactctggtagg

SEQ ID NO: 519575 - DNA, 20 bp, Artificial Sequence
  chemically synthesized
ggaggcattattctgcctac

SEQ ID NO: 519576 - DNA, 20 bp, Artificial Sequence
  chemically synthesized
cgtgctaatccctgacatct

SEQ ID NO: 519577 - DNA, 20 bp, Artificial Sequence
  chemically synthesized
ataatttattcacagatgtc

SEQ ID NO: 519578 - DNA, 20 bp, Artificial Sequence
  chemically synthesized
aattatgttacatggcaaag

SEQ ID NO: 519579 - DNA, 20 bp, Artificial Sequence
  chemically synthesized
caaagtggaattattgcaga

SEQ ID NO: 519580 - DNA, 20 bp, Artificial Sequence
  chemically synthesized
gggagattatcccagattat

SEQ ID NO: 519581 - DNA, 20 bp, Artificial Sequence
  chemically synthesized
tcctgcccactcagataatc

SEQ ID NO: 519582 - DNA, 20 bp, Artificial Sequence
  chemically synthesized
tcccagattatctgagtggg

SEQ ID NO: 519583 - DNA, 20 bp, Artificial Sequence
  chemically synthesized
agtgggcaggatttaatcac

SEQ ID NO: 519584 - DNA, 20 bp, Artificial Sequence
  chemically synthesized
gggaaatgttggcataaggg

SEQ ID NO: 519585 - DNA, 20 bp, Artificial Sequence
  chemically synthesized
ggccgtgagccaaataacgt

SEQ ID NO: 519586 - DNA, 20 bp, Artificial Sequence
  chemically synthesized
cttgccttttccattttcta

SEQ ID NO: 519587 - DNA, 20 bp, Artificial Sequence
  chemically synthesized
tacttttggatgctccaggg

SEQ ID NO: 519588 - DNA, 20 bp, Artificial Sequence
  chemically synthesized
gccagaagggctgtgtactt

SEQ ID NO: 519589 - DNA, 20 bp, Artificial Sequence
  chemically synthesized
agcccttctggcatcatgat

SEQ ID NO: 519590 - DNA, 20 bp, Artificial Sequence
  chemically synthesized
tgagtccagtaagttccagt

SEQ ID NO: 519591 - DNA, 20 bp, Artificial Sequence
  chemically synthesized
tctgacctgcagaactgtct

SEQ ID NO: 519592 - DNA, 20 bp, Artificial Sequence
  chemically synthesized
gagagaagcagacacaacaa

SEQ ID NO: 519593 - DNA, 20 bp, Artificial Sequence
  chemically synthesized
gtcacttcatcaaggaagct

SEQ ID NO: 519594 - DNA, 20 bp, Artificial Sequence
  chemically synthesized
ttgatgaagtgacatctcag

SEQ ID NO: 519595 - DNA, 20 bp, Artificial Sequence
  chemically synthesized
cacctgctcttttgattttc

SEQ ID NO: 519596 - DNA, 20 bp, Artificial Sequence
  chemically synthesized
aaaagagcaggtgaaagtgt

SEQ ID NO: 519597 - DNA, 20 bp, Artificial Sequence
  chemically synthesized
aagtgtcaggatgtgagaga

SEQ ID NO: 519598 - DNA, 20 bp, Artificial Sequence
  chemically synthesized
cagacctagagatggtggag

SEQ ID NO: 519599 - DNA, 20 bp, Artificial Sequence
  chemically synthesized
gatgataatttcactttttc

SEQ ID NO: 519600 - DNA, 20 bp, Artificial Sequence
  chemically synthesized
agggcagttcgaaatcaaag

SEQ ID NO: 519601 - DNA, 20 bp, Artificial Sequence
  chemically synthesized
gaaataaatttcacagtgta

SEQ ID NO: 519602 - DNA, 20 bp, Artificial Sequence
  chemically synthesized
tcacagtgtagagaatattt

SEQ ID NO: 519603 - DNA, 20 bp, Artificial Sequence
  chemically synthesized
aagtcatgcttacttctcac

SEQ ID NO: 519604 - DNA, 20 bp, Artificial Sequence
  chemically synthesized
agtaagcatgacttgcatta

SEQ ID NO: 519605 - DNA, 20 bp, Artificial Sequence
  chemically synthesized
aatggcagtggggctggaaa

SEQ ID NO: 519606 - DNA, 20 bp, Artificial Sequence
  chemically synthesized
tactaccccgtaaacacatc

SEQ ID NO: 519607 - DNA, 20 bp, Artificial Sequence
  chemically synthesized
gtgcattcaagatgtgttta

SEQ ID NO: 519608 - DNA, 20 bp, Artificial Sequence
  chemically synthesized
tactaattattaattatatg

SEQ ID NO: 519609 - DNA, 20 bp, Artificial Sequence
  chemically synthesized
ttaattatatgtggagttag

SEQ ID NO: 519610 - DNA, 20 bp, Artificial Sequence
  chemically synthesized
tatatgtggagttaggggag

SEQ ID NO: 519611 - DNA, 20 bp, Artificial Sequence
  chemically synthesized
ggagttaggggagttggatc

SEQ ID NO: 519612 - DNA, 20 bp, Artificial Sequence
  chemically synthesized
gaactgtagtttctccatca

SEQ ID NO: 519613 - DNA, 20 bp, Artificial Sequence
  chemically synthesized
gtaacctcatcagagaagct

SEQ ID NO: 519614 - DNA, 20 bp, Artificial Sequence
  chemically synthesized
aggttacaggctagattatt

SEQ ID NO: 519615 - DNA, 20 bp, Artificial Sequence
  chemically synthesized
gaaggcccttatatgccatt

SEQ ID NO: 519616 - DNA, 20 bp, Artificial Sequence
  chemically synthesized
atatgtttagaggagtacac

SEQ ID NO: 519617 - DNA, 20 bp, Artificial Sequence
  chemically synthesized
ctaatcgataatatgtttag

SEQ ID NO: 519618 - DNA, 20 bp, Artificial Sequence
  chemically synthesized
atgtatataaggtttgggat

SEQ ID NO: 519619 - DNA, 20 bp, Artificial Sequence
  chemically synthesized
tggtagatgtatataaggtt

SEQ ID NO: 519620 - DNA, 20 bp, Artificial Sequence
  chemically synthesized
tcctttgttcatgcactccc

SEQ ID NO: 519621 - DNA, 20 bp, Artificial Sequence
  chemically synthesized
tagtgagtgtcctcattcta

SEQ ID NO: 519622 - DNA, 20 bp, Artificial Sequence
  chemically synthesized
attcgacctagatcttaata

SEQ ID NO: 519623 - DNA, 20 bp, Artificial Sequence
  chemically synthesized
actcactattaagatctagg

SEQ ID NO: 519624 - DNA, 20 bp, Artificial Sequence
  chemically synthesized
ttaagatctaggtcgaatgt

SEQ ID NO: 519625 - DNA, 20 bp, Artificial Sequence
  chemically synthesized
tacacatatgtatatatcag

SEQ ID NO: 519626 - DNA, 20 bp, Artificial Sequence
  chemically synthesized
gtgtgtgtatgtgtgtatgt

SEQ ID NO: 519627 - DNA, 20 bp, Artificial Sequence
  chemically synthesized
cacatttaggaggtaatgag

SEQ ID NO: 519628 - DNA, 20 bp, Artificial Sequence
  chemically synthesized
gtggtcacatttaggaggta

SEQ ID NO: 519629 - DNA, 20 bp, Artificial Sequence
  chemically synthesized
atgtgaccacacttagatgg

SEQ ID NO: 519630 - DNA, 20 bp, Artificial Sequence
  chemically synthesized
agtataccatgtttggtgcc

SEQ ID NO: 519631 - DNA, 20 bp, Artificial Sequence
  chemically synthesized
agcagaaataggtacttagt

SEQ ID NO: 519632 - DNA, 20 bp, Artificial Sequence
  chemically synthesized
aggtacttagtaagggtttg

SEQ ID NO: 519633 - DNA, 20 bp, Artificial Sequence
  chemically synthesized
gacagaaggtctataattaa

SEQ ID NO: 519634 - DNA, 20 bp, Artificial Sequence
  chemically synthesized
ctcaatggataatttaggaa

SEQ ID NO: 519635 - DNA, 20 bp, Artificial Sequence
  chemically synthesized
ttatgtctaatgggtgctca

SEQ ID NO: 519636 - DNA, 20 bp, Artificial Sequence
  chemically synthesized
gaaagttagttttatgtcta

SEQ ID NO: 519637 - DNA, 20 bp, Artificial Sequence
  chemically synthesized
tacttattttcatcactaca

SEQ ID NO: 519638 - DNA, 20 bp, Artificial Sequence
  chemically synthesized
atgaataaaaaattaagaga

SEQ ID NO: 519639 - DNA, 20 bp, Artificial Sequence
  chemically synthesized
atctgcctttatttctctag

SEQ ID NO: 519640 - DNA, 20 bp, Artificial Sequence
  chemically synthesized
agggcaattatatcatatta

SEQ ID NO: 519641 - DNA, 20 bp, Artificial Sequence
  chemically synthesized
ctgacacaatgtaaaatgct

SEQ ID NO: 519642 - DNA, 20 bp, Artificial Sequence
  chemically synthesized
tcaattgcttttttattgta

SEQ ID NO: 519643 - DNA, 20 bp, Artificial Sequence
  chemically synthesized
atggctttccaatctggttt

SEQ ID NO: 519644 - DNA, 20 bp, Artificial Sequence
  chemically synthesized
gaaagccatgtcagctcata

SEQ ID NO: 519645 - DNA, 20 bp, Artificial Sequence
  chemically synthesized
aattctgtgattaagtggca

SEQ ID NO: 519646 - DNA, 20 bp, Artificial Sequence
  chemically synthesized
cattccctgccacttaatca

SEQ ID NO: 519647 - DNA, 20 bp, Artificial Sequence
  chemically synthesized
tttatgctccattagcaaat

SEQ ID NO: 519648 - DNA, 20 bp, Artificial Sequence
  chemically synthesized
tatagagcattgcaattttt

SEQ ID NO: 519649 - DNA, 20 bp, Artificial Sequence
  chemically synthesized
attgtagaaatatacttgtg

SEQ ID NO: 519650 - DNA, 20 bp, Artificial Sequence
  chemically synthesized
atgagattgaagaaatgtat

SEQ ID NO: 519651 - DNA, 20 bp, Artificial Sequence
  chemically synthesized
gaagaaatgtattagagtgg

SEQ ID NO: 519652 - DNA, 20 bp, Artificial Sequence
  chemically synthesized
ggaagaatgatcagaactcc

SEQ ID NO: 519653 - DNA, 20 bp, Artificial Sequence
  chemically synthesized
aacaccttttcatatactct

SEQ ID NO: 519654 - DNA, 20 bp, Artificial Sequence
  chemically synthesized
acatgcaattttaagaggat

SEQ ID NO: 519655 - DNA, 20 bp, Artificial Sequence
  chemically synthesized
tctaacacatgcaattttaa

SEQ ID NO: 519656 - DNA, 20 bp, Artificial Sequence
  chemically synthesized
gtgttagatacaatgcaggc

SEQ ID NO: 519657 - DNA, 20 bp, Artificial Sequence
  chemically synthesized
gttacatcatacactcattt

SEQ ID NO: 519658 - DNA, 20 bp, Artificial Sequence
  chemically synthesized
tcaggttatttgactctgaa

SEQ ID NO: 519659 - DNA, 20 bp, Artificial Sequence
  chemically synthesized
tcatttcagagtcaaataac

SEQ ID NO: 519660 - DNA, 20 bp, Artificial Sequence
  chemically synthesized
gagataatgagatgtgaaac

SEQ ID NO: 519661 - DNA, 20 bp, Artificial Sequence
  chemically synthesized
atctcattatctctgtggcc

SEQ ID NO: 519662 - DNA, 20 bp, Artificial Sequence
  chemically synthesized
tggtaatagtaataaagata

SEQ ID NO: 519663 - DNA, 20 bp, Artificial Sequence
  chemically synthesized
caaatatattacaacttccc

SEQ ID NO: 519664 - DNA, 20 bp, Artificial Sequence
  chemically synthesized
gcagccatgttaataattag

SEQ ID NO: 519665 - DNA, 20 bp, Artificial Sequence
  chemically synthesized
atctttcaaatcgagaagac

SEQ ID NO: 519666 - DNA, 20 bp, Artificial Sequence
  chemically synthesized
catgaggaggtataatttat

SEQ ID NO: 519667 - DNA, 20 bp, Artificial Sequence
  chemically synthesized
ttatacctcctcatgctcaa

SEQ ID NO: 519668 - DNA, 20 bp, Artificial Sequence
  chemically synthesized
ttttagtaataatggaaata

SEQ ID NO: 519669 - DNA, 20 bp, Artificial Sequence
  chemically synthesized
atatctcatcttgtttaaac

SEQ ID NO: 519670 - DNA, 20 bp, Artificial Sequence
  chemically synthesized
tcttgtttaaacatgagtat

SEQ ID NO: 519671 - DNA, 20 bp, Artificial Sequence
  chemically synthesized
tatgtgggtgtagacttgtt

SEQ ID NO: 519672 - DNA, 20 bp, Artificial Sequence
  chemically synthesized
taaccatagactaattatga

SEQ ID NO: 519673 - DNA, 20 bp, Artificial Sequence
  chemically synthesized
ttagaggtgaaattaactac

SEQ ID NO: 519674 - DNA, 20 bp, Artificial Sequence
  chemically synthesized
tgaatcttttaaaagtaata

SEQ ID NO: 519675 - DNA, 20 bp, Artificial Sequence
  chemically synthesized
ttaaattttcaggggagaat

SEQ ID NO: 519676 - DNA, 20 bp, Artificial Sequence
  chemically synthesized
atttttttaaattttcaggg

SEQ ID NO: 519677 - DNA, 20 bp, Artificial Sequence
  chemically synthesized
gtgtatatttatctattttt

SEQ ID NO: 519678 - DNA, 20 bp, Artificial Sequence
  chemically synthesized
caaatggtcaaacacagggc

SEQ ID NO: 519679 - DNA, 20 bp, Artificial Sequence
  chemically synthesized
acacagggcctggattataa

SEQ ID NO: 519680 - DNA, 20 bp, Artificial Sequence
  chemically synthesized
cctttactccatagtgtaag

SEQ ID NO: 519681 - DNA, 20 bp, Artificial Sequence
  chemically synthesized
tatttactcaacttacacta

SEQ ID NO: 519682 - DNA, 20 bp, Artificial Sequence
  chemically synthesized
aataaaatggcatagtagat

SEQ ID NO: 519683 - DNA, 20 bp, Artificial Sequence
  chemically synthesized
agggatggctcggtgaaata

SEQ ID NO: 519684 - DNA, 20 bp, Artificial Sequence
  chemically synthesized
cttatttcaccgagccatcc

SEQ ID NO: 519685 - DNA, 20 bp, Artificial Sequence
  chemically synthesized
ctatagttataggtgaactc

SEQ ID NO: 519686 - DNA, 20 bp, Artificial Sequence
  chemically synthesized
ttcacctataactatagtga

SEQ ID NO: 519687 - DNA, 20 bp, Artificial Sequence
  chemically synthesized
aactatagtgaacggattct

SEQ ID NO: 519688 - DNA, 20 bp, Artificial Sequence
  chemically synthesized
tgaggaatcttcagcatcca

SEQ ID NO: 519689 - DNA, 20 bp, Artificial Sequence
  chemically synthesized
agatgtggatgcttgtggtg

SEQ ID NO: 519690 - DNA, 20 bp, Artificial Sequence
  chemically synthesized
acacaaagaaacagagagat

SEQ ID NO: 519691 - DNA, 20 bp, Artificial Sequence
  chemically synthesized
acttctgtccctcgtttatt

SEQ ID NO: 519692 - DNA, 20 bp, Artificial Sequence
  chemically synthesized
agggctcctcaattgttgca

SEQ ID NO: 519693 - DNA, 20 bp, Artificial Sequence
  chemically synthesized
gttgcatgggatatgtaatc

SEQ ID NO: 519694 - DNA, 20 bp, Artificial Sequence
  chemically synthesized
cgatgctcctatgggccatt

SEQ ID NO: 519695 - DNA, 20 bp, Artificial Sequence
  chemically synthesized
ttattgtctgctctctgtag

SEQ ID NO: 519696 - DNA, 20 bp, Artificial Sequence
  chemically synthesized
tgttagaaaagactcatagg

SEQ ID NO: 519697 - DNA, 20 bp, Artificial Sequence
  chemically synthesized
tgagagactgcacccggcct

SEQ ID NO: 519698 - DNA, 20 bp, Artificial Sequence
  chemically synthesized
acctgggcctcccaaagtgc

SEQ ID NO: 519699 - DNA, 20 bp, Artificial Sequence
  chemically synthesized
ggtggacgcagcatgaggtc

SEQ ID NO: 519700 - DNA, 20 bp, Artificial Sequence
  chemically synthesized
gcgtcagcctcccaagtagc

SEQ ID NO: 519701 - DNA, 20 bp, Artificial Sequence
  chemically synthesized
tacttgggaggctgacgcag

SEQ ID NO: 519702 - DNA, 20 bp, Artificial Sequence
  chemically synthesized
tcttgaactcctgtcggggc

SEQ ID NO: 519703 - DNA, 20 bp, Artificial Sequence
  chemically synthesized
cactgcactccagccccgac

SEQ ID NO: 519704 - DNA, 20 bp, Artificial Sequence
  chemically synthesized
ttgtttgtttgtttttgaga

SEQ ID NO: 519705 - DNA, 20 bp, Artificial Sequence
  chemically synthesized
tcttgggtttggtgtggctt

SEQ ID NO: 519706 - DNA, 20 bp, Artificial Sequence
  chemically synthesized
ctcttttcagactggaaatc

SEQ ID NO: 519707 - DNA, 20 bp, Artificial Sequence
  chemically synthesized
tacctcatcaaagtgaagct

SEQ ID NO: 519708 - DNA, 20 bp, Artificial Sequence
  chemically synthesized
agactactttcgatgcttta

SEQ ID NO: 519709 - DNA, 20 bp, Artificial Sequence
  chemically synthesized
atgcaattaaatatatagtc

SEQ ID NO: 519710 - DNA, 20 bp, Artificial Sequence
  chemically synthesized
tccacttgccatggttcacc

SEQ ID NO: 519711 - DNA, 20 bp, Artificial Sequence
  chemically synthesized
cttgccatggttcaccatgg

SEQ ID NO: 519712 - DNA, 20 bp, Artificial Sequence
  chemically synthesized
accaaggccacatcagtgag

SEQ ID NO: 519713 - DNA, 20 bp, Artificial Sequence
  chemically synthesized
acatgaccaaggccacatca

SEQ ID NO: 519714 - DNA, 20 bp, Artificial Sequence
  chemically synthesized
agtggaacacagtcagatat

SEQ ID NO: 519715 - DNA, 20 bp, Artificial Sequence
  chemically synthesized
tgattcttaagcccctagct

SEQ ID NO: 519716 - DNA, 20 bp, Artificial Sequence
  chemically synthesized
caattctgagctaggggctt

SEQ ID NO: 519717 - DNA, 20 bp, Artificial Sequence
  chemically synthesized
atgtcaggttcaattttgta

SEQ ID NO: 519718 - DNA, 20 bp, Artificial Sequence
  chemically synthesized
tacaaaattgaacctgacat

SEQ ID NO: 519719 - DNA, 20 bp, Artificial Sequence
  chemically synthesized
ttcttataagtcattgagat

SEQ ID NO: 519720 - DNA, 20 bp, Artificial Sequence
  chemically synthesized
taaatagtaaatgtggccca

SEQ ID NO: 519721 - DNA, 20 bp, Artificial Sequence
  chemically synthesized
agaataaaattcaataatga

SEQ ID NO: 519722 - DNA, 20 bp, Artificial Sequence
  chemically synthesized
ttatatacattccatcatta

SEQ ID NO: 519723 - DNA, 20 bp, Artificial Sequence
  chemically synthesized
acctcttcatttaaaaaaga

SEQ ID NO: 519724 - DNA, 20 bp, Artificial Sequence
  chemically synthesized
gcttattttaaatttaatga

SEQ ID NO: 519725 - DNA, 20 bp, Artificial Sequence
  chemically synthesized
attaaatttaaaataagctg

SEQ ID NO: 519726 - DNA, 20 bp, Artificial Sequence
  chemically synthesized
aatttaaaataagctgaaga

SEQ ID NO: 519727 - DNA, 20 bp, Artificial Sequence
  chemically synthesized
ctttccaaaaattgcccttt

SEQ ID NO: 519728 - DNA, 20 bp, Artificial Sequence
  chemically synthesized
cttgttttaatgtttaaatt

SEQ ID NO: 519729 - DNA, 20 bp, Artificial Sequence
  chemically synthesized
ataagttttaaggaaatgca

SEQ ID NO: 519730 - DNA, 20 bp, Artificial Sequence
  chemically synthesized
ttaaaacagaaataaagttt

SEQ ID NO: 519731 - DNA, 20 bp, Artificial Sequence
  chemically synthesized
ccgtatttggtgaacaggga

SEQ ID NO: 519732 - DNA, 20 bp, Artificial Sequence
  chemically synthesized
acttccgtatttggtgaaca

SEQ ID NO: 519733 - DNA, 20 bp, Artificial Sequence
  chemically synthesized
tcaagccaaaaattataaat

SEQ ID NO: 519734 - DNA, 20 bp, Artificial Sequence
  chemically synthesized
tgcagtcagtaaaagaacat

SEQ ID NO: 519735 - DNA, 20 bp, Artificial Sequence
  chemically synthesized
ttagagtcagtcttttagaa

SEQ ID NO: 519736 - DNA, 20 bp, Artificial Sequence
  chemically synthesized
gggtttggaaaattattact

SEQ ID NO: 519737 - DNA, 20 bp, Artificial Sequence
  chemically synthesized
ctcctcttttgattagctcc

SEQ ID NO: 519738 - DNA, 20 bp, Artificial Sequence
  chemically synthesized
tcaaaagaggagacagtttt

SEQ ID NO: 519739 - DNA, 20 bp, Artificial Sequence
  chemically synthesized
gaccttctttgctctgccac

SEQ ID NO: 519740 - DNA, 20 bp, Artificial Sequence
  chemically synthesized
gtggcagagcaaagaaggtc

SEQ ID NO: 519741 - DNA, 20 bp, Artificial Sequence
  chemically synthesized
acaatcaatttttattcagc

SEQ ID NO: 519742 - DNA, 20 bp, Artificial Sequence
  chemically synthesized
atcagtattagcaactcaag

SEQ ID NO: 519743 - DNA, 20 bp, Artificial Sequence
  chemically synthesized
gaaaagagaagtctttcatt

SEQ ID NO: 519744 - DNA, 20 bp, Artificial Sequence
  chemically synthesized
ttctcaggtttattatgcca

SEQ ID NO: 519745 - DNA, 20 bp, Artificial Sequence
  chemically synthesized
tcagtgtacattgccaatag

SEQ ID NO: 519746 - DNA, 20 bp, Artificial Sequence
  chemically synthesized
tgactaatcatttaatagat

SEQ ID NO: 519747 - DNA, 20 bp, Artificial Sequence
  chemically synthesized
acctcggcctcccaaagtgc

SEQ ID NO: 519748 - DNA, 20 bp, Artificial Sequence
  chemically synthesized
actttgggaggccgaggtgg

SEQ ID NO: 519749 - DNA, 20 bp, Artificial Sequence
  chemically synthesized
ggtttcaccgtgtttgccag

SEQ ID NO: 519750 - DNA, 20 bp, Artificial Sequence
  chemically synthesized
ttttgtatttttagtagaga

SEQ ID NO: 519751 - DNA, 20 bp, Artificial Sequence
  chemically synthesized
tacttgggaggctgagacag

SEQ ID NO: 519752 - DNA, 20 bp, Artificial Sequence
  chemically synthesized
ctcactgcaagctccgcctc

SEQ ID NO: 519753 - DNA, 20 bp, Artificial Sequence
  chemically synthesized
tctcgctctgtcgcccaggc

SEQ ID NO: 519754 - DNA, 20 bp, Artificial Sequence
  chemically synthesized
agagctttttttttttgaga

SEQ ID NO: 519755 - DNA, 20 bp, Artificial Sequence
  chemically synthesized
ttgtttgcacttaggtatca

SEQ ID NO: 519756 - DNA, 20 bp, Artificial Sequence
  chemically synthesized
acttgtagaggaaaatataa

SEQ ID NO: 519757 - DNA, 20 bp, Artificial Sequence
  chemically synthesized
ttagacattgtagaaaaaat

SEQ ID NO: 519758 - DNA, 20 bp, Artificial Sequence
  chemically synthesized
aatagattttgaggttttaa

SEQ ID NO: 519759 - DNA, 20 bp, Artificial Sequence
  chemically synthesized
ttaaagtcttttgtaatgac

SEQ ID NO: 519760 - DNA, 20 bp, Artificial Sequence
  chemically synthesized
ctatagccaatttaaaatgt

SEQ ID NO: 519761 - DNA, 20 bp, Artificial Sequence
  chemically synthesized
aatatgtatatgaacacaac

SEQ ID NO: 519762 - DNA, 20 bp, Artificial Sequence
  chemically synthesized
gtataattttatattctgat

SEQ ID NO: 519763 - DNA, 20 bp, Artificial Sequence
  chemically synthesized
catgaattttatattcatat

SEQ ID NO: 519764 - DNA, 20 bp, Artificial Sequence
  chemically synthesized
ctgatatgaatataaaattc

SEQ ID NO: 519765 - DNA, 20 bp, Artificial Sequence
  chemically synthesized
ttttcagtgtgctacaattc

SEQ ID NO: 519766 - DNA, 20 bp, Artificial Sequence
  chemically synthesized
acattaaaatgattgtaaag

SEQ ID NO: 519767 - DNA, 20 bp, Artificial Sequence
  chemically synthesized
tgattgtaaagtagaatctc

SEQ ID NO: 519768 - DNA, 20 bp, Artificial Sequence
  chemically synthesized
agtttgtaaattgaagacat

SEQ ID NO: 519769 - DNA, 20 bp, Artificial Sequence
  chemically synthesized
aaatctttaaattagaaaat

SEQ ID NO: 519770 - DNA, 20 bp, Artificial Sequence
  chemically synthesized
taattcgtttagtaggcgct

SEQ ID NO: 519771 - DNA, 20 bp, Artificial Sequence
  chemically synthesized
tcattccgagcgcctactaa

SEQ ID NO: 519772 - DNA, 20 bp, Artificial Sequence
  chemically synthesized
cctactaaacgaattataaa

SEQ ID NO: 519773 - DNA, 20 bp, Artificial Sequence
  chemically synthesized
ttataaagggaatggctttc

SEQ ID NO: 519774 - DNA, 20 bp, Artificial Sequence
  chemically synthesized
ttagctttgaacctgcctat

SEQ ID NO: 519775 - DNA, 20 bp, Artificial Sequence
  chemically synthesized
tgcctctgtttcctcacctg

SEQ ID NO: 519776 - DNA, 20 bp, Artificial Sequence
  chemically synthesized
gtgtagctttgtcatgagct

SEQ ID NO: 519777 - DNA, 20 bp, Artificial Sequence
  chemically synthesized
agctttgtcatgagctttgg

SEQ ID NO: 519778 - DNA, 20 bp, Artificial Sequence
  chemically synthesized
gagcaagttagtgttagagc

SEQ ID NO: 519779 - DNA, 20 bp, Artificial Sequence
  chemically synthesized
ctgttaatcatttaattatg

SEQ ID NO: 519780 - DNA, 20 bp, Artificial Sequence
  chemically synthesized
atttcctcaactttaaaaca

SEQ ID NO: 519781 - DNA, 20 bp, Artificial Sequence
  chemically synthesized
tagaataaagaagcagatga

SEQ ID NO: 519782 - DNA, 20 bp, Artificial Sequence
  chemically synthesized
caaataaacaaacaaaaacc

SEQ ID NO: 519783 - DNA, 20 bp, Artificial Sequence
  chemically synthesized
tgtttgtttatttgtttctg

SEQ ID NO: 519784 - DNA, 20 bp, Artificial Sequence
  chemically synthesized
atgcagtttacagtccttgt

SEQ ID NO: 519785 - DNA, 20 bp, Artificial Sequence
  chemically synthesized
gtccttgttggagtatgctc

SEQ ID NO: 519786 - DNA, 20 bp, Artificial Sequence
  chemically synthesized
atgctctggaatcatacggc

SEQ ID NO: 519787 - DNA, 20 bp, Artificial Sequence
  chemically synthesized
ccagttttgccgcttactgg

SEQ ID NO: 519788 - DNA, 20 bp, Artificial Sequence
  chemically synthesized
tagaaagtgtctggccccaa

SEQ ID NO: 519789 - DNA, 20 bp, Artificial Sequence
  chemically synthesized
aagcccatagatttcaggat

SEQ ID NO: 519790 - DNA, 20 bp, Artificial Sequence
  chemically synthesized
tattgaaagcccatagattt

SEQ ID NO: 519791 - DNA, 20 bp, Artificial Sequence
  chemically synthesized
atgggctttcaatacgacta

SEQ ID NO: 519792 - DNA, 20 bp, Artificial Sequence
  chemically synthesized
aaaattttgcccacaatttt

SEQ ID NO: 519793 - DNA, 20 bp, Artificial Sequence
  chemically synthesized
aaaattgtgggcaaaatttt

SEQ ID NO: 519794 - DNA, 20 bp, Artificial Sequence
  chemically synthesized
ttttatgagtgtgtatatat

SEQ ID NO: 519795 - DNA, 20 bp, Artificial Sequence
  chemically synthesized
ttcaaaccatggagcccttt

SEQ ID NO: 519796 - DNA, 20 bp, Artificial Sequence
  chemically synthesized
gctccatggtttgaaaaatg

SEQ ID NO: 519797 - DNA, 20 bp, Artificial Sequence
  chemically synthesized
tagacattattctggctctt

SEQ ID NO: 519798 - DNA, 20 bp, Artificial Sequence
  chemically synthesized
tcattaatatccataagagc

SEQ ID NO: 519799 - DNA, 20 bp, Artificial Sequence
  chemically synthesized
accattgtaccattcttttt

SEQ ID NO: 519800 - DNA, 20 bp, Artificial Sequence
  chemically synthesized
actgtgtgtatatccataaa

SEQ ID NO: 519801 - DNA, 20 bp, Artificial Sequence
  chemically synthesized
agggctccttatctggccta

SEQ ID NO: 519802 - DNA, 20 bp, Artificial Sequence
  chemically synthesized
tctggcctagggaataaata

SEQ ID NO: 519803 - DNA, 20 bp, Artificial Sequence
  chemically synthesized
ggctgaagagtaatatctaa

SEQ ID NO: 519804 - DNA, 20 bp, Artificial Sequence
  chemically synthesized
tgcccaatcctaggtggctg

SEQ ID NO: 519805 - DNA, 20 bp, Artificial Sequence
  chemically synthesized
gatattactcttcagccacc

SEQ ID NO: 519806 - DNA, 20 bp, Artificial Sequence
  chemically synthesized
agaaagggcattgcaatata

SEQ ID NO: 519807 - DNA, 20 bp, Artificial Sequence
  chemically synthesized
caggtagcaaacaaatcttt

SEQ ID NO: 519808 - DNA, 20 bp, Artificial Sequence
  chemically synthesized
atgaaggaaccactcaaatg

SEQ ID NO: 519809 - DNA, 20 bp, Artificial Sequence
  chemically synthesized
gaaaaccatcaattccacat

SEQ ID NO: 519810 - DNA, 20 bp, Artificial Sequence
  chemically synthesized
tgtggaattgatggttttca

SEQ ID NO: 519811 - DNA, 20 bp, Artificial Sequence
  chemically synthesized
ttcactgtatctatgcagaa

SEQ ID NO: 519812 - DNA, 20 bp, Artificial Sequence
  chemically synthesized
ctcctttctgcatagataca

SEQ ID NO: 519813 - DNA, 20 bp, Artificial Sequence
  chemically synthesized
aaaatactggtttccaagct

SEQ ID NO: 519814 - DNA, 20 bp, Artificial Sequence
  chemically synthesized
agcgtggtatgaaagtgtct

SEQ ID NO: 519815 - DNA, 20 bp, Artificial Sequence
  chemically synthesized
tatttctactgatctctgct

SEQ ID NO: 519816 - DNA, 20 bp, Artificial Sequence
  chemically synthesized
acacacatcttttctctttt

SEQ ID NO: 519817 - DNA, 20 bp, Artificial Sequence
  chemically synthesized
gaattttgatttcctaatca

SEQ ID NO: 519818 - DNA, 20 bp, Artificial Sequence
  chemically synthesized
tctgaagatgtttctttatc

SEQ ID NO: 519819 - DNA, 20 bp, Artificial Sequence
  chemically synthesized
taaaagtagtctttcattgt

SEQ ID NO: 519820 - DNA, 20 bp, Artificial Sequence
  chemically synthesized
ttgtttgagtaacctagctg

SEQ ID NO: 519821 - DNA, 20 bp, Artificial Sequence
  chemically synthesized
ttgtaattagtatgatgctt

SEQ ID NO: 519822 - DNA, 20 bp, Artificial Sequence
  chemically synthesized
tatgatgctttaggataaag

SEQ ID NO: 519823 - DNA, 20 bp, Artificial Sequence
  chemically synthesized
ccttggcattgtataaacat

SEQ ID NO: 519824 - DNA, 20 bp, Artificial Sequence
  chemically synthesized
ttttagaaactagagaaaaa

SEQ ID NO: 519825 - DNA, 20 bp, Artificial Sequence
  chemically synthesized
aaagtgagtattaaaagctt

SEQ ID NO: 519826 - DNA, 20 bp, Artificial Sequence
  chemically synthesized
ataaagcctccacccaaatg

SEQ ID NO: 519827 - DNA, 20 bp, Artificial Sequence
  chemically synthesized
ctaaggtaataatcccacat

SEQ ID NO: 519828 - DNA, 20 bp, Artificial Sequence
  chemically synthesized
gtgggattattaccttagaa

SEQ ID NO: 519829 - DNA, 20 bp, Artificial Sequence
  chemically synthesized
aaagagtctcaaaaattata

SEQ ID NO: 519830 - DNA, 20 bp, Artificial Sequence
  chemically synthesized
ggtaggaatgtggtttaata

SEQ ID NO: 519831 - DNA, 20 bp, Artificial Sequence
  chemically synthesized
aaaccacattcctacctgta

SEQ ID NO: 519832 - DNA, 20 bp, Artificial Sequence
  chemically synthesized
ccttttcatccattacaggt

SEQ ID NO: 519833 - DNA, 20 bp, Artificial Sequence
  chemically synthesized
acgttgcattgtaacctaca

SEQ ID NO: 519834 - DNA, 20 bp, Artificial Sequence
  chemically synthesized
tgaattacattgaattacat

SEQ ID NO: 519835 - DNA, 20 bp, Artificial Sequence
  chemically synthesized
agacatatatgtgaattaca

SEQ ID NO: 519836 - DNA, 20 bp, Artificial Sequence
  chemically synthesized
agacatacacagacatatat

SEQ ID NO: 519837 - DNA, 20 bp, Artificial Sequence
  chemically synthesized
ctgtgtatgtctatctaaac

SEQ ID NO: 519838 - DNA, 20 bp, Artificial Sequence
  chemically synthesized
catacatacgtatgtattta

SEQ ID NO: 519839 - DNA, 20 bp, Artificial Sequence
  chemically synthesized
tgtatttaaagaatttagac

SEQ ID NO: 519840 - DNA, 20 bp, Artificial Sequence
  chemically synthesized
aagaatttagacttgggtct

SEQ ID NO: 519841 - DNA, 20 bp, Artificial Sequence
  chemically synthesized
gtcttagaatcaggctctcc

SEQ ID NO: 519842 - DNA, 20 bp, Artificial Sequence
  chemically synthesized
atatttatatctcgcagttg

SEQ ID NO: 519843 - DNA, 20 bp, Artificial Sequence
  chemically synthesized
actgcgagatataaatataa

SEQ ID NO: 519844 - DNA, 20 bp, Artificial Sequence
  chemically synthesized
agagagaaggagatgtgaca

SEQ ID NO: 519845 - DNA, 20 bp, Artificial Sequence
  chemically synthesized
ttgagaaacattttaatcct

SEQ ID NO: 519846 - DNA, 20 bp, Artificial Sequence
  chemically synthesized
ccaaaggatacgtttattct

SEQ ID NO: 519847 - DNA, 20 bp, Artificial Sequence
  chemically synthesized
cttagaataaacgtatcctt

SEQ ID NO: 519848 - DNA, 20 bp, Artificial Sequence
  chemically synthesized
caaatgtggaatttattcca

SEQ ID NO: 519849 - DNA, 20 bp, Artificial Sequence
  chemically synthesized
tgaactatctttatcaaatg

SEQ ID NO: 519850 - DNA, 20 bp, Artificial Sequence
  chemically synthesized
agcagtaaactacttattac

SEQ ID NO: 519851 - DNA, 20 bp, Artificial Sequence
  chemically synthesized
agtagtttactgcttaacag

SEQ ID NO: 519852 - DNA, 20 bp, Artificial Sequence
  chemically synthesized
gaaggagagcaacttcccat

SEQ ID NO: 519853 - DNA, 20 bp, Artificial Sequence
  chemically synthesized
gttaagagactttttctccc

SEQ ID NO: 519854 - DNA, 20 bp, Artificial Sequence
  chemically synthesized
ttaagtactagaaatgacat

SEQ ID NO: 519855 - DNA, 20 bp, Artificial Sequence
  chemically synthesized
ttaaatggccctatgcagac

SEQ ID NO: 519856 - DNA, 20 bp, Artificial Sequence
  chemically synthesized
agggccatttaaacccaaat

SEQ ID NO: 519857 - DNA, 20 bp, Artificial Sequence
  chemically synthesized
aacccagagacaattccaat

SEQ ID NO: 519858 - DNA, 20 bp, Artificial Sequence
  chemically synthesized
aacccaaattggaattgtct

SEQ ID NO: 519859 - DNA, 20 bp, Artificial Sequence
  chemically synthesized
tgtgaattcctataattggc

SEQ ID NO: 519860 - DNA, 20 bp, Artificial Sequence
  chemically synthesized
tttcaattcatgccaattat

SEQ ID NO: 519861 - DNA, 20 bp, Artificial Sequence
  chemically synthesized
ggtcacccctatctgtgttt

SEQ ID NO: 519862 - DNA, 20 bp, Artificial Sequence
  chemically synthesized
aggaattcacaaacacagat

SEQ ID NO: 519863 - DNA, 20 bp, Artificial Sequence
  chemically synthesized
aacacagataggggtgacca

SEQ ID NO: 519864 - DNA, 20 bp, Artificial Sequence
  chemically synthesized
aactaaacagaaagttctgg

SEQ ID NO: 519865 - DNA, 20 bp, Artificial Sequence
  chemically synthesized
atttttttttctcattaagt

SEQ ID NO: 519866 - DNA, 20 bp, Artificial Sequence
  chemically synthesized
gtctgtgatggaaactggta

SEQ ID NO: 519867 - DNA, 20 bp, Artificial Sequence
  chemically synthesized
ggaaactggtaaagaataaa

SEQ ID NO: 519868 - DNA, 20 bp, Artificial Sequence
  chemically synthesized
accaatttatttttccattt

SEQ ID NO: 519869 - DNA, 20 bp, Artificial Sequence
  chemically synthesized
tttgttagacatgtcatctt

SEQ ID NO: 519870 - DNA, 20 bp, Artificial Sequence
  chemically synthesized
aatgcatctaacataataaa

SEQ ID NO: 519871 - DNA, 20 bp, Artificial Sequence
  chemically synthesized
tgtcttctatggcaaaccat

SEQ ID NO: 519872 - DNA, 20 bp, Artificial Sequence
  chemically synthesized
catcattataaggagatgaa

SEQ ID NO: 519873 - DNA, 20 bp, Artificial Sequence
  chemically synthesized
aataagtttaagtcagtgca

SEQ ID NO: 519874 - DNA, 20 bp, Artificial Sequence
  chemically synthesized
aaagttcctttgcatctaat

SEQ ID NO: 519875 - DNA, 20 bp, Artificial Sequence
  chemically synthesized
ggcatttgcttattttatta

SEQ ID NO: 519876 - DNA, 20 bp, Artificial Sequence
  chemically synthesized
aacaactaacattaagtgca

SEQ ID NO: 519877 - DNA, 20 bp, Artificial Sequence
  chemically synthesized
gagctgggagtcaaggtgac

SEQ ID NO: 519878 - DNA, 20 bp, Artificial Sequence
  chemically synthesized
atccatcccaaagttgagct

SEQ ID NO: 519879 - DNA, 20 bp, Artificial Sequence
  chemically synthesized
cttgactcccagctcaactt

SEQ ID NO: 519880 - DNA, 20 bp, Artificial Sequence
  chemically synthesized
actcccagctcaactttggg

SEQ ID NO: 519881 - DNA, 20 bp, Artificial Sequence
  chemically synthesized
ttgtgtgagagcatttttga

SEQ ID NO: 519882 - DNA, 20 bp, Artificial Sequence
  chemically synthesized
gcatttttgaaggaatgtaa

SEQ ID NO: 519883 - DNA, 20 bp, Artificial Sequence
  chemically synthesized
ttgaaggaatgtaattgagt

SEQ ID NO: 519884 - DNA, 20 bp, Artificial Sequence
  chemically synthesized
aattatgtgacagtagatat

SEQ ID NO: 519885 - DNA, 20 bp, Artificial Sequence
  chemically synthesized
agagtgctgggattacagat

SEQ ID NO: 519886 - DNA, 20 bp, Artificial Sequence
  chemically synthesized
cacctcagctcctagagtgc

SEQ ID NO: 519887 - DNA, 20 bp, Artificial Sequence
  chemically synthesized
gattcacccacctcagctcc

SEQ ID NO: 519888 - DNA, 20 bp, Artificial Sequence
  chemically synthesized
ccagcactctaggagctgag

SEQ ID NO: 519889 - DNA, 20 bp, Artificial Sequence
  chemically synthesized
cactctaggagctgaggtgg

SEQ ID NO: 519890 - DNA, 20 bp, Artificial Sequence
  chemically synthesized
tgggtgaatcacttgaggtc

SEQ ID NO: 519891 - DNA, 20 bp, Artificial Sequence
  chemically synthesized
tttgtgttttttagtagaga

SEQ ID NO: 519892 - DNA, 20 bp, Artificial Sequence
  chemically synthesized
gcctgagacttgcgagtagc

SEQ ID NO: 519893 - DNA, 20 bp, Artificial Sequence
  chemically synthesized
gattctcctgcctgagactt

SEQ ID NO: 519894 - DNA, 20 bp, Artificial Sequence
  chemically synthesized
tactcgcaagtctcaggcag

SEQ ID NO: 519895 - DNA, 20 bp, Artificial Sequence
  chemically synthesized
ctcactgcaacttctgcctc

SEQ ID NO: 519896 - DNA, 20 bp, Artificial Sequence
  chemically synthesized
tcgcgtcactgcactccagc

SEQ ID NO: 519897 - DNA, 20 bp, Artificial Sequence
  chemically synthesized
cctcgctctgtcacccaggc

SEQ ID NO: 519898 - DNA, 20 bp, Artificial Sequence
  chemically synthesized
gattgacacccgtagcctat

SEQ ID NO: 519899 - DNA, 20 bp, Artificial Sequence
  chemically synthesized
atatgaaacccccataggct

SEQ ID NO: 519900 - DNA, 20 bp, Artificial Sequence
  chemically synthesized
atctccaacaacggaaaaga

SEQ ID NO: 519901 - DNA, 20 bp, Artificial Sequence
  chemically synthesized
tctcaatcattcataaaagt

SEQ ID NO: 519902 - DNA, 20 bp, Artificial Sequence
  chemically synthesized
cttagaatactcacactttt

SEQ ID NO: 519903 - DNA, 20 bp, Artificial Sequence
  chemically synthesized
tgtatctcattgaagtaact

SEQ ID NO: 519904 - DNA, 20 bp, Artificial Sequence
  chemically synthesized
attctcaagtgcagtcacca

SEQ ID NO: 519905 - DNA, 20 bp, Artificial Sequence
  chemically synthesized
actccctggtgactgcactt

SEQ ID NO: 519906 - DNA, 20 bp, Artificial Sequence
  chemically synthesized
ggaaggaaaaagaaaagata

SEQ ID NO: 519907 - DNA, 20 bp, Artificial Sequence
  chemically synthesized
gtttgtttggtggggtgggg

SEQ ID NO: 519908 - DNA, 20 bp, Artificial Sequence
  chemically synthesized
tgtttgtttgtttggtgggg

SEQ ID NO: 519909 - DNA, 20 bp, Artificial Sequence
  chemically synthesized
tgttttgtttgtttgtttgg

SEQ ID NO: 519910 - DNA, 20 bp, Artificial Sequence
  chemically synthesized
ggacagcaggttctacactt

SEQ ID NO: 519911 - DNA, 20 bp, Artificial Sequence
  chemically synthesized
tcacaaattaggtttcacaa

SEQ ID NO: 519912 - DNA, 20 bp, Artificial Sequence
  chemically synthesized
ttaggtttcacaaatggatt

SEQ ID NO: 519913 - DNA, 20 bp, Artificial Sequence
  chemically synthesized
tcaaaagcattttgtatatt

SEQ ID NO: 519914 - DNA, 20 bp, Artificial Sequence
  chemically synthesized
tctgaatatacaaaatgctt

SEQ ID NO: 519915 - DNA, 20 bp, Artificial Sequence
  chemically synthesized
gcttttcatgacttttccca

SEQ ID NO: 519916 - DNA, 20 bp, Artificial Sequence
  chemically synthesized
gtattgaggacctgttatct

SEQ ID NO: 519917 - DNA, 20 bp, Artificial Sequence
  chemically synthesized
gataagtgatattttaaaaa

SEQ ID NO: 519918 - DNA, 20 bp, Artificial Sequence
  chemically synthesized
ccttactttagatggaaaca

SEQ ID NO: 519919 - DNA, 20 bp, Artificial Sequence
  chemically synthesized
tcattgtttccatctaaagt

SEQ ID NO: 519920 - DNA, 20 bp, Artificial Sequence
  chemically synthesized
taactgtaatgattaacatg

SEQ ID NO: 519921 - DNA, 20 bp, Artificial Sequence
  chemically synthesized
taatgattaacatgtcgaat

SEQ ID NO: 519922 - DNA, 20 bp, Artificial Sequence
  chemically synthesized
gtcgaatgtggatatcccaa

SEQ ID NO: 519923 - DNA, 20 bp, Artificial Sequence
  chemically synthesized
gcgtaagtattttaccctct

SEQ ID NO: 519924 - DNA, 20 bp, Artificial Sequence
  chemically synthesized
aatcaagttcctcttctgct

SEQ ID NO: 519925 - DNA, 20 bp, Artificial Sequence
  chemically synthesized
gatcaccctgctttttctca

SEQ ID NO: 519926 - DNA, 20 bp, Artificial Sequence
  chemically synthesized
ctccacccaatgagaaaaag

SEQ ID NO: 519927 - DNA, 20 bp, Artificial Sequence
  chemically synthesized
caatctcctccaaggagaga

SEQ ID NO: 519928 - DNA, 20 bp, Artificial Sequence
  chemically synthesized
ccagcccacacctgactttt

SEQ ID NO: 519929 - DNA, 20 bp, Artificial Sequence
  chemically synthesized
ctccttcggtctgcatttcc

SEQ ID NO: 519930 - DNA, 20 bp, Artificial Sequence
  chemically synthesized
tccttggaaatgcagaccga

SEQ ID NO: 519931 - DNA, 20 bp, Artificial Sequence
  chemically synthesized
gaaggagtctgcactcattc

SEQ ID NO: 519932 - DNA, 20 bp, Artificial Sequence
  chemically synthesized
ttgtggaaaagaattccaga

SEQ ID NO: 519933 - DNA, 20 bp, Artificial Sequence
  chemically synthesized
aagtttgtggaaaagaattc

SEQ ID NO: 519934 - DNA, 20 bp, Artificial Sequence
  chemically synthesized
cccaatagaagtttgtggaa

SEQ ID NO: 519935 - DNA, 20 bp, Artificial Sequence
  chemically synthesized
agaagaggagggtctggaaa

SEQ ID NO: 519936 - DNA, 20 bp, Artificial Sequence
  chemically synthesized
tcttacgccttttagaagag

SEQ ID NO: 519937 - DNA, 20 bp, Artificial Sequence
  chemically synthesized
caggcgggtcccatgggtgg

SEQ ID NO: 519938 - DNA, 20 bp, Artificial Sequence
  chemically synthesized
cctctgaacaggcgggtccc

SEQ ID NO: 519939 - DNA, 20 bp, Artificial Sequence
  chemically synthesized
tccccaacccctctgaacag

SEQ ID NO: 519940 - DNA, 20 bp, Artificial Sequence
  chemically synthesized
catgggacccgcctgttcag

SEQ ID NO: 519941 - DNA, 20 bp, Artificial Sequence
  chemically synthesized
gaaggtagaagccactgaga

SEQ ID NO: 519942 - DNA, 20 bp, Artificial Sequence
  chemically synthesized
tatcatactgctcttccaaa

SEQ ID NO: 519943 - DNA, 20 bp, Artificial Sequence
  chemically synthesized
gtatgataacctctttggcc

SEQ ID NO: 519944 - DNA, 20 bp, Artificial Sequence
  chemically synthesized
tcattctgtttttattggtg

SEQ ID NO: 519945 - DNA, 20 bp, Artificial Sequence
  chemically synthesized
ggattctgcaccaataaaaa

SEQ ID NO: 519946 - DNA, 20 bp, Artificial Sequence
  chemically synthesized
tataaggcttgctgaaaact

SEQ ID NO: 519947 - DNA, 20 bp, Artificial Sequence
  chemically synthesized
aatagtgtctgcggtcctaa

SEQ ID NO: 519948 - DNA, 20 bp, Artificial Sequence
  chemically synthesized
agacactattacattaagca

SEQ ID NO: 519949 - DNA, 20 bp, Artificial Sequence
  chemically synthesized
ttgagctggtttggaggggc

SEQ ID NO: 519950 - DNA, 20 bp, Artificial Sequence
  chemically synthesized
tcatactgctagtatggggt

SEQ ID NO: 519951 - DNA, 20 bp, Artificial Sequence
  chemically synthesized
tttctgtcatactgctagta

SEQ ID NO: 519952 - DNA, 20 bp, Artificial Sequence
  chemically synthesized
tcatgtatagaagaaaaata

SEQ ID NO: 519953 - DNA, 20 bp, Artificial Sequence
  chemically synthesized
caagtctcattttcttttta

SEQ ID NO: 519954 - DNA, 20 bp, Artificial Sequence
  chemically synthesized
gatggctttacttcttgata

SEQ ID NO: 519955 - DNA, 20 bp, Artificial Sequence
  chemically synthesized
tatctctgactgataagata

SEQ ID NO: 519956 - DNA, 20 bp, Artificial Sequence
  chemically synthesized
atgttttctttagtatctag

SEQ ID NO: 519957 - DNA, 20 bp, Artificial Sequence
  chemically synthesized
cccatctgtttgtgaaagtt

SEQ ID NO: 519958 - DNA, 20 bp, Artificial Sequence
  chemically synthesized
ccaaaactttcacaaacaga

SEQ ID NO: 519959 - DNA, 20 bp, Artificial Sequence
  chemically synthesized
gggatgtttcagcacagtga

SEQ ID NO: 519960 - DNA, 20 bp, Artificial Sequence
  chemically synthesized
gaatctgtaaaatgatgcaa

SEQ ID NO: 519961 - DNA, 20 bp, Artificial Sequence
  chemically synthesized
gcaattgctacattaacatt

SEQ ID NO: 519962 - DNA, 20 bp, Artificial Sequence
  chemically synthesized
aaaaaatgttaaattacaaa

SEQ ID NO: 519963 - DNA, 20 bp, Artificial Sequence
  chemically synthesized
ttgtttaccaatgttcacac

SEQ ID NO: 519964 - DNA, 20 bp, Artificial Sequence
  chemically synthesized
tcataccttccatcaaagga

SEQ ID NO: 519965 - DNA, 20 bp, Artificial Sequence
  chemically synthesized
tagtgtcataccttccatca

SEQ ID NO: 519966 - DNA, 20 bp, Artificial Sequence
  chemically synthesized
gcaggctgcgcggccactta

SEQ ID NO: 519967 - DNA, 20 bp, Artificial Sequence
  chemically synthesized
gagaaggaggggcggaaagc

SEQ ID NO: 519968 - DNA, 20 bp, Artificial Sequence
  chemically synthesized
gatcttgatctgtctcacgc

SEQ ID NO: 519969 - DNA, 20 bp, Artificial Sequence
  chemically synthesized
aaagcaggcagagatcctac

SEQ ID NO: 519970 - DNA, 20 bp, Artificial Sequence
  chemically synthesized
atcatcatccgggattcttg

SEQ ID NO: 519971 - DNA, 20 bp, Artificial Sequence
  chemically synthesized
gcagagatcctacaagaatc

SEQ ID NO: 519972 - DNA, 20 bp, Artificial Sequence
  chemically synthesized
ggcaatctgggatcatcatc

SEQ ID NO: 519973 - DNA, 20 bp, Artificial Sequence
  chemically synthesized
tccaacctgcgctggcaatc

SEQ ID NO: 519974 - DNA, 20 bp, Artificial Sequence
  chemically synthesized
gcaggttggaagccgcatat

SEQ ID NO: 519975 - DNA, 20 bp, Artificial Sequence
  chemically synthesized
aaaagacttggaagaagctg

SEQ ID NO: 519976 - DNA, 20 bp, Artificial Sequence
  chemically synthesized
ataaagaagcacgtttagta

SEQ ID NO: 519977 - DNA, 20 bp, Artificial Sequence
  chemically synthesized
gtttcaggcttctaacttca

SEQ ID NO: 519978 - DNA, 20 bp, Artificial Sequence
  chemically synthesized
agcctgaaacttttctcgta

SEQ ID NO: 519979 - DNA, 20 bp, Artificial Sequence
  chemically synthesized
gtggtttttgcattaaatcc

SEQ ID NO: 519980 - DNA, 20 bp, Artificial Sequence
  chemically synthesized
atggattgtaaaatggaccc

SEQ ID NO: 519981 - DNA, 20 bp, Artificial Sequence
  chemically synthesized
caccgcagtggtcaaaaata

SEQ ID NO: 519982 - DNA, 20 bp, Artificial Sequence
  chemically synthesized
gcggtgtgttcaagtagtat

SEQ ID NO: 519983 - DNA, 20 bp, Artificial Sequence
  chemically synthesized
taatttaatatgtcaaataa

SEQ ID NO: 519984 - DNA, 20 bp, Artificial Sequence
  chemically synthesized
atataaaccacacatcacgt

SEQ ID NO: 519985 - DNA, 20 bp, Artificial Sequence
  chemically synthesized
tgatgggatggggttggggt

SEQ ID NO: 519986 - DNA, 20 bp, Artificial Sequence
  chemically synthesized
tctatatgatgggatggggt

SEQ ID NO: 519987 - DNA, 20 bp, Artificial Sequence
  chemically synthesized
ttcttatctatatgatggga

SEQ ID NO: 519988 - DNA, 20 bp, Artificial Sequence
  chemically synthesized
gcattttcttatctatatga

SEQ ID NO: 519989 - DNA, 20 bp, Artificial Sequence
  chemically synthesized
ctttgtagtcagagacatct

SEQ ID NO: 519990 - DNA, 20 bp, Artificial Sequence
  chemically synthesized
tcatcctaggctgttgagaa

SEQ ID NO: 519991 - DNA, 20 bp, Artificial Sequence
  chemically synthesized
atattcccttctcaacagcc

SEQ ID NO: 519992 - DNA, 20 bp, Artificial Sequence
  chemically synthesized
ttctcaacagcctaggatga

SEQ ID NO: 519993 - DNA, 20 bp, Artificial Sequence
  chemically synthesized
tatattgaaaatgtgacaga

SEQ ID NO: 519994 - DNA, 20 bp, Artificial Sequence
  chemically synthesized
attatatattgaaaatgtga

SEQ ID NO: 519995 - DNA, 20 bp, Artificial Sequence
  chemically synthesized
tattaatagaaagtttgaac

SEQ ID NO: 519996 - DNA, 20 bp, Artificial Sequence
  chemically synthesized
ctctacaaaaggctgcaaat

SEQ ID NO: 519997 - DNA, 20 bp, Artificial Sequence
  chemically synthesized
cttttcctattctatcattt

SEQ ID NO: 519998 - DNA, 20 bp, Artificial Sequence
  chemically synthesized
attcgccaatccagaaatga

SEQ ID NO: 519999 - DNA, 20 bp, Artificial Sequence
  chemically synthesized
attctatcatttctggattg

SEQ ID NO: 520000 - DNA, 20 bp, Artificial Sequence
  chemically synthesized
atcatttctggattggcgaa

SEQ ID NO: 520001 - DNA, 20 bp, Artificial Sequence
  chemically synthesized
aaacaaatctcaacacaaac

SEQ ID NO: 520002 - DNA, 20 bp, Artificial Sequence
  chemically synthesized
atgaaaaatcagtagcactt

SEQ ID NO: 520003 - DNA, 20 bp, Artificial Sequence
  chemically synthesized
gaatccagtaactttctcct

SEQ ID NO: 520004 - DNA, 20 bp, Artificial Sequence
  chemically synthesized
gaactcagaggagaaagtta

SEQ ID NO: 520005 - DNA, 20 bp, Artificial Sequence
  chemically synthesized
tatacccttcacttactttt

SEQ ID NO: 520006 - DNA, 20 bp, Artificial Sequence
  chemically synthesized
tggattcccaaaagtaagtg

SEQ ID NO: 520007 - DNA, 20 bp, Artificial Sequence
  chemically synthesized
aataattagagcaacaggct

SEQ ID NO: 520008 - DNA, 20 bp, Artificial Sequence
  chemically synthesized
cagtagaagaaaaatgcaga

SEQ ID NO: 520009 - DNA, 20 bp, Artificial Sequence
  chemically synthesized
gtacagttgttattcatgct

SEQ ID NO: 520010 - DNA, 20 bp, Artificial Sequence
  chemically synthesized
aactttagataactcatagc

SEQ ID NO: 520011 - DNA, 20 bp, Artificial Sequence
  chemically synthesized
ttcagagttgggatggtgca

SEQ ID NO: 520012 - DNA, 20 bp, Artificial Sequence
  chemically synthesized
caagttgtgtgtttcagagt

SEQ ID NO: 520013 - DNA, 20 bp, Artificial Sequence
  chemically synthesized
tccatccaagttgtgtgttt

SEQ ID NO: 520014 - DNA, 20 bp, Artificial Sequence
  chemically synthesized
ccaactctgaaacacacaac

SEQ ID NO: 520015 - DNA, 20 bp, Artificial Sequence
  chemically synthesized
gatgtctgcctgagtcctga

SEQ ID NO: 520016 - DNA, 20 bp, Artificial Sequence
  chemically synthesized
taaggatgtctgcctgagtc

SEQ ID NO: 520017 - DNA, 20 bp, Artificial Sequence
  chemically synthesized
tgggtactaaggatgtctgc

SEQ ID NO: 520018 - DNA, 20 bp, Artificial Sequence
  chemically synthesized
gtgttgtggttctgggtact

SEQ ID NO: 520019 - DNA, 20 bp, Artificial Sequence
  chemically synthesized
gtgtgtgctgtgttgtggtt

SEQ ID NO: 520020 - DNA, 20 bp, Artificial Sequence
  chemically synthesized
agaaccacaacacagcacac

SEQ ID NO: 520021 - DNA, 20 bp, Artificial Sequence
  chemically synthesized
aattattttatggagcatct

SEQ ID NO: 520022 - DNA, 20 bp, Artificial Sequence
  chemically synthesized
accactgtacattgacttcc

SEQ ID NO: 520023 - DNA, 20 bp, Artificial Sequence
  chemically synthesized
gcttctaaatattaatacaa

SEQ ID NO: 520024 - DNA, 20 bp, Artificial Sequence
  chemically synthesized
taacaagcttcaaattaaaa

SEQ ID NO: 520025 - DNA, 20 bp, Artificial Sequence
  chemically synthesized
aggagctatagattgtgcag

SEQ ID NO: 520026 - DNA, 20 bp, Artificial Sequence
  chemically synthesized
gcacaatctatagctcctat

SEQ ID NO: 520027 - DNA, 20 bp, Artificial Sequence
  chemically synthesized
ctgttcgtttgttactgctg

SEQ ID NO: 520028 - DNA, 20 bp, Artificial Sequence
  chemically synthesized
tgaacatgacaaaaggctgc

SEQ ID NO: 520029 - DNA, 20 bp, Artificial Sequence
  chemically synthesized
caaaaggctgccagagtaac

SEQ ID NO: 520030 - DNA, 20 bp, Artificial Sequence
  chemically synthesized
tgacaaatgtgggaacattt

SEQ ID NO: 520031 - DNA, 20 bp, Artificial Sequence
  chemically synthesized
ttttattagagtgggaaatt

SEQ ID NO: 520032 - DNA, 20 bp, Artificial Sequence
  chemically synthesized
ttttgttcatattattttat

SEQ ID NO: 520033 - DNA, 20 bp, Artificial Sequence
  chemically synthesized
tggttcagtgaaaccttcgt

SEQ ID NO: 520034 - DNA, 20 bp, Artificial Sequence
  chemically synthesized
taaacatgaaccaatctttt

SEQ ID NO: 520035 - DNA, 20 bp, Artificial Sequence
  chemically synthesized
ggtacttgtcaggtttataa

SEQ ID NO: 520036 - DNA, 20 bp, Artificial Sequence
  chemically synthesized
atgtgtgtgtgttttcctta

SEQ ID NO: 520037 - DNA, 20 bp, Artificial Sequence
  chemically synthesized
taaagtataataataaaaaa

SEQ ID NO: 520038 - DNA, 20 bp, Artificial Sequence
  chemically synthesized
tattattatactttaggttt

SEQ ID NO: 520039 - DNA, 20 bp, Artificial Sequence
  chemically synthesized
taatgttaaatgacgagtta

SEQ ID NO: 520040 - DNA, 20 bp, Artificial Sequence
  chemically synthesized
gatatacctaatgttaaatg

SEQ ID NO: 520041 - DNA, 20 bp, Artificial Sequence
  chemically synthesized
gtggggtggggggagggggg

SEQ ID NO: 520042 - DNA, 20 bp, Artificial Sequence
  chemically synthesized
tcacacaccggggcctgttg

SEQ ID NO: 520043 - DNA, 20 bp, Artificial Sequence
  chemically synthesized
caacaggccccggtgtgtga

SEQ ID NO: 520044 - DNA, 20 bp, Artificial Sequence
  chemically synthesized
gccccggtgtgtgagggaat

SEQ ID NO: 520045 - DNA, 20 bp, Artificial Sequence
  chemically synthesized
attagaattttgtaattcat

SEQ ID NO: 520046 - DNA, 20 bp, Artificial Sequence
  chemically synthesized
ccttttgctcctctacccaa

SEQ ID NO: 520047 - DNA, 20 bp, Artificial Sequence
  chemically synthesized
tggggtaggtgagagagggc

SEQ ID NO: 520048 - DNA, 20 bp, Artificial Sequence
  chemically synthesized
ttttgcagatttagattaac

SEQ ID NO: 520049 - DNA, 20 bp, Artificial Sequence
  chemically synthesized
ccactaggccagaggggctg

SEQ ID NO: 520050 - DNA, 20 bp, Artificial Sequence
  chemically synthesized
ctgcaggatgggaaaacaat

SEQ ID NO: 520051 - DNA, 20 bp, Artificial Sequence
  chemically synthesized
gcctcggcttcccaaagtac

SEQ ID NO: 520052 - DNA, 20 bp, Artificial Sequence
  chemically synthesized
actttgggaagccgaggcag

SEQ ID NO: 520053 - DNA, 20 bp, Artificial Sequence
  chemically synthesized
caggtggatcacttgaggtc

SEQ ID NO: 520054 - DNA, 20 bp, Artificial Sequence
  chemically synthesized
ttttgtatttttagtagaga

SEQ ID NO: 520055 - DNA, 20 bp, Artificial Sequence
  chemically synthesized
gcctaagcctccctagtagc

SEQ ID NO: 520056 - DNA, 20 bp, Artificial Sequence
  chemically synthesized
tactagggaggcttaggcag

SEQ ID NO: 520057 - DNA, 20 bp, Artificial Sequence
  chemically synthesized
ctcactgcaacctcctcctc

SEQ ID NO: 520058 - DNA, 20 bp, Artificial Sequence
  chemically synthesized
tcgcaccactgtactccagc

SEQ ID NO: 520059 - DNA, 20 bp, Artificial Sequence
  chemically synthesized
tcttgctctgtcacccaggc

SEQ ID NO: 520060 - DNA, 20 bp, Artificial Sequence
  chemically synthesized
tccagcctgggtgacagagc

SEQ ID NO: 520061 - DNA, 20 bp, Artificial Sequence
  chemically synthesized
tctcaaaaagaaagcaagga

SEQ ID NO: 520062 - DNA, 20 bp, Artificial Sequence
  chemically synthesized
aactgctggggcttgctttt

SEQ ID NO: 520063 - DNA, 20 bp, Artificial Sequence
  chemically synthesized
attgccttcttacctgacga

SEQ ID NO: 520064 - DNA, 20 bp, Artificial Sequence
  chemically synthesized
tcttacctgacgatggagtg

SEQ ID NO: 520065 - DNA, 20 bp, Artificial Sequence
  chemically synthesized
tcgggcataaagcatttcct

SEQ ID NO: 520066 - DNA, 20 bp, Artificial Sequence
  chemically synthesized
tccaaggaaatgctttatgc

SEQ ID NO: 520067 - DNA, 20 bp, Artificial Sequence
  chemically synthesized
tctcctttttcagtatggtt

SEQ ID NO: 520068 - DNA, 20 bp, Artificial Sequence
  chemically synthesized
tactgaaaaaggagatgcaa

SEQ ID NO: 520069 - DNA, 20 bp, Artificial Sequence
  chemically synthesized
tggattgtttaaggatggcc

SEQ ID NO: 520070 - DNA, 20 bp, Artificial Sequence
  chemically synthesized
tcttcagctctggattgttt

SEQ ID NO: 520071 - DNA, 20 bp, Artificial Sequence
  chemically synthesized
ctgaatacggctcttcagct

SEQ ID NO: 520072 - DNA, 20 bp, Artificial Sequence
  chemically synthesized
aacgcagaataaatttatct

SEQ ID NO: 520073 - DNA, 20 bp, Artificial Sequence
  chemically synthesized
aggtcaagaaacattgaacg

SEQ ID NO: 520074 - DNA, 20 bp, Artificial Sequence
  chemically synthesized
tctcgtaaggaaaattctgc

SEQ ID NO: 520075 - DNA, 20 bp, Artificial Sequence
  chemically synthesized
aattccttctggtattcagg

SEQ ID NO: 520076 - DNA, 20 bp, Artificial Sequence
  chemically synthesized
aattctgcctgaataccaga

SEQ ID NO: 520077 - DNA, 20 bp, Artificial Sequence
  chemically synthesized
atttcaagctaaagtgaaaa

SEQ ID NO: 520078 - DNA, 20 bp, Artificial Sequence
  chemically synthesized
tgcatataaagcagacccaa

SEQ ID NO: 520079 - DNA, 20 bp, Artificial Sequence
  chemically synthesized
aaagcagacccaagaggatt

SEQ ID NO: 520080 - DNA, 20 bp, Artificial Sequence
  chemically synthesized
atattttaccccaaatcctc

SEQ ID NO: 520081 - DNA, 20 bp, Artificial Sequence
  chemically synthesized
tttcataagttgtactatgc

SEQ ID NO: 520082 - DNA, 20 bp, Artificial Sequence
  chemically synthesized
atataaaaaatgagaaacaa

SEQ ID NO: 520083 - DNA, 20 bp, Artificial Sequence
  chemically synthesized
ggctgttcagtcccaaataa

SEQ ID NO: 520084 - DNA, 20 bp, Artificial Sequence
  chemically synthesized
gttgatatgctaaataaaag

SEQ ID NO: 520085 - DNA, 20 bp, Artificial Sequence
  chemically synthesized
ggaaagtcctttttttacaa

SEQ ID NO: 520086 - DNA, 20 bp, Artificial Sequence
  chemically synthesized
aaaatacagcctcaacaaat

SEQ ID NO: 520087 - DNA, 20 bp, Artificial Sequence
  chemically synthesized
tttgttctcagcctagttgt

SEQ ID NO: 520088 - DNA, 20 bp, Artificial Sequence
  chemically synthesized
agattgtaaacctgaggcaa

SEQ ID NO: 520089 - DNA, 20 bp, Artificial Sequence
  chemically synthesized
gtgataacaattcacatgtt

SEQ ID NO: 520090 - DNA, 20 bp, Artificial Sequence
  chemically synthesized
aatattatgattctcaacat

SEQ ID NO: 520091 - DNA, 20 bp, Artificial Sequence
  chemically synthesized
acttgcaaaggatggaactt

SEQ ID NO: 520092 - DNA, 20 bp, Artificial Sequence
  chemically synthesized
cctaacttaccttacttgca

SEQ ID NO: 520093 - DNA, 20 bp, Artificial Sequence
  chemically synthesized
gcactgtttcctcactgcct

SEQ ID NO: 520094 - DNA, 20 bp, Artificial Sequence
  chemically synthesized
tgtttataaatacagagctc

SEQ ID NO: 520095 - DNA, 20 bp, Artificial Sequence
  chemically synthesized
tgacctctgtcagtgaaatc

SEQ ID NO: 520096 - DNA, 20 bp, Artificial Sequence
  chemically synthesized
tcttctatatctgtttatgc

SEQ ID NO: 520097 - DNA, 20 bp, Artificial Sequence
  chemically synthesized
tctggcataaacagatatag

SEQ ID NO: 520098 - DNA, 20 bp, Artificial Sequence
  chemically synthesized
agcaggtaaaaacttttaaa

SEQ ID NO: 520099 - DNA, 20 bp, Artificial Sequence
  chemically synthesized
gaagaagagggggaagttga

SEQ ID NO: 520100 - DNA, 20 bp, Artificial Sequence
  chemically synthesized
gtgagagctagaagccgtgt

SEQ ID NO: 520101 - DNA, 20 bp, Artificial Sequence
  chemically synthesized
aagccgtgtgggggtgtggg

SEQ ID NO: 520102 - DNA, 20 bp, Artificial Sequence
  chemically synthesized
aggtgtgtgtgtgtgtgtca

SEQ ID NO: 520103 - DNA, 20 bp, Artificial Sequence
  chemically synthesized
ggcatgtagattagcctcac

SEQ ID NO: 520104 - DNA, 20 bp, Artificial Sequence
  chemically synthesized
gagcaagctggcagtctttc

SEQ ID NO: 520105 - DNA, 20 bp, Artificial Sequence
  chemically synthesized
cctattctgcctccaggatt

SEQ ID NO: 520106 - DNA, 20 bp, Artificial Sequence
  chemically synthesized
gacaccccaaatcctggagg

SEQ ID NO: 520107 - DNA, 20 bp, Artificial Sequence
  chemically synthesized
tgaactgcctattctgcctc

SEQ ID NO: 520108 - DNA, 20 bp, Artificial Sequence
  chemically synthesized
ataggcagttcaactaaggg

SEQ ID NO: 520109 - DNA, 20 bp, Artificial Sequence
  chemically synthesized
cttcttccccacagaccaca

SEQ ID NO: 520110 - DNA, 20 bp, Artificial Sequence
  chemically synthesized
atctctgtgtgtccttgacc

SEQ ID NO: 520111 - DNA, 20 bp, Artificial Sequence
  chemically synthesized
ctctaggattggaataacac

SEQ ID NO: 520112 - DNA, 20 bp, Artificial Sequence
  chemically synthesized
ctcctgtgttattccaatcc

SEQ ID NO: 520113 - DNA, 20 bp, Artificial Sequence
  chemically synthesized
tctagcctccactctaggat

SEQ ID NO: 520114 - DNA, 20 bp, Artificial Sequence
  chemically synthesized
taggactctagcctccactc

SEQ ID NO: 520115 - DNA, 20 bp, Artificial Sequence
  chemically synthesized
tccaatcctagagtggaggc

SEQ ID NO: 520116 - DNA, 20 bp, Artificial Sequence
  chemically synthesized
ggctagagtcctaacaactc

SEQ ID NO: 520117 - DNA, 20 bp, Artificial Sequence
  chemically synthesized
caggtctaccggtcacattc

SEQ ID NO: 520118 - DNA, 20 bp, Artificial Sequence
  chemically synthesized
ccggtagacctgaaaagtca

SEQ ID NO: 520119 - DNA, 20 bp, Artificial Sequence
  chemically synthesized
gaattttattaagatttcct

SEQ ID NO: 520120 - DNA, 20 bp, Artificial Sequence
  chemically synthesized
gggcccaaggcttcactgtg

SEQ ID NO: 520121 - DNA, 20 bp, Artificial Sequence
  chemically synthesized
gaaataagaaaactgaggct

SEQ ID NO: 520122 - DNA, 20 bp, Artificial Sequence
  chemically synthesized
tatcctgggcaatcaatgga

SEQ ID NO: 520123 - DNA, 20 bp, Artificial Sequence
  chemically synthesized
gatgttatcctgggcaatca

SEQ ID NO: 520124 - DNA, 20 bp, Artificial Sequence
  chemically synthesized
gactctatccattgattgcc

SEQ ID NO: 520125 - DNA, 20 bp, Artificial Sequence
  chemically synthesized
atatggacaagtataggaaa

SEQ ID NO: 520126 - DNA, 20 bp, Artificial Sequence
  chemically synthesized
ggtgctcaataacttttaga

SEQ ID NO: 520127 - DNA, 20 bp, Artificial Sequence
  chemically synthesized
ataacttttagattgagtaa

SEQ ID NO: 520128 - DNA, 20 bp, Artificial Sequence
  chemically synthesized
gaatgctatgtgagatagga

SEQ ID NO: 520129 - DNA, 20 bp, Artificial Sequence
  chemically synthesized
attttgcttactttgctgta

SEQ ID NO: 520130 - DNA, 20 bp, Artificial Sequence
  chemically synthesized
aaagtaagcaaaattgagga

SEQ ID NO: 520131 - DNA, 20 bp, Artificial Sequence
  chemically synthesized
tccatttcctcatatgtaat

SEQ ID NO: 520132 - DNA, 20 bp, Artificial Sequence
  chemically synthesized
tacatatgaggaaatggaga

SEQ ID NO: 520133 - DNA, 20 bp, Artificial Sequence
  chemically synthesized
atggccatagtccatataat

SEQ ID NO: 520134 - DNA, 20 bp, Artificial Sequence
  chemically synthesized
acttctcttgaccctattgt

SEQ ID NO: 520135 - DNA, 20 bp, Artificial Sequence
  chemically synthesized
tttgtttcctatccatacaa

SEQ ID NO: 520136 - DNA, 20 bp, Artificial Sequence
  chemically synthesized
aataatggagttagagaagc

SEQ ID NO: 520137 - DNA, 20 bp, Artificial Sequence
  chemically synthesized
acctgctattgggttaataa

SEQ ID NO: 520138 - DNA, 20 bp, Artificial Sequence
  chemically synthesized
gtgattttcagcacctgcta

SEQ ID NO: 520139 - DNA, 20 bp, Artificial Sequence
  chemically synthesized
tgatcgtgttgctgacaaag

SEQ ID NO: 520140 - DNA, 20 bp, Artificial Sequence
  chemically synthesized
ttttatttatgaaaataaaa

SEQ ID NO: 520141 - DNA, 20 bp, Artificial Sequence
  chemically synthesized
agggaagaatgaaaatacaa

SEQ ID NO: 520142 - DNA, 20 bp, Artificial Sequence
  chemically synthesized
aaagtggcacaaacagaggg

SEQ ID NO: 520143 - DNA, 20 bp, Artificial Sequence
  chemically synthesized
gtgtgacctgttttgagtat

SEQ ID NO: 520144 - DNA, 20 bp, Artificial Sequence
  chemically synthesized
atttaaatgtgtgacctgtt

SEQ ID NO: 520145 - DNA, 20 bp, Artificial Sequence
  chemically synthesized
tattttccaaaaggaaacaa

SEQ ID NO: 520146 - DNA, 20 bp, Artificial Sequence
  chemically synthesized
aagtgccttgttttaaagat

SEQ ID NO: 520147 - DNA, 20 bp, Artificial Sequence
  chemically synthesized
gctttcctccaaaacgccct

SEQ ID NO: 520148 - DNA, 20 bp, Artificial Sequence
  chemically synthesized
gccaataacttggggatact

SEQ ID NO: 520149 - DNA, 20 bp, Artificial Sequence
  chemically synthesized
ttattcactgccaataactt

SEQ ID NO: 520150 - DNA, 20 bp, Artificial Sequence
  chemically synthesized
gtatccccaagttattggca

SEQ ID NO: 520151 - DNA, 20 bp, Artificial Sequence
  chemically synthesized
tgaataaaagtgtaaaggaa

SEQ ID NO: 520152 - DNA, 20 bp, Artificial Sequence
  chemically synthesized
aatgaatcttgcaattctct

SEQ ID NO: 520153 - DNA, 20 bp, Artificial Sequence
  chemically synthesized
tttttggaatgaaattcaca

SEQ ID NO: 520154 - DNA, 20 bp, Artificial Sequence
  chemically synthesized
ctgtgaatttcattccaaaa

SEQ ID NO: 520155 - DNA, 20 bp, Artificial Sequence
  chemically synthesized
aaatgcctaaaattcttttt

SEQ ID NO: 520156 - DNA, 20 bp, Artificial Sequence
  chemically synthesized
gcattttgatgaagcgatgt

SEQ ID NO: 520157 - DNA, 20 bp, Artificial Sequence
  chemically synthesized
tgtagggattagttttaaat

SEQ ID NO: 520158 - DNA, 20 bp, Artificial Sequence
  chemically synthesized
tccattgatcttcagtgttt

SEQ ID NO: 520159 - DNA, 20 bp, Artificial Sequence
  chemically synthesized
actgaagatcaatggaagct

SEQ ID NO: 520160 - DNA, 20 bp, Artificial Sequence
  chemically synthesized
aatatttttgttaagaaaca

SEQ ID NO: 520161 - DNA, 20 bp, Artificial Sequence
  chemically synthesized
ttaagaaacatagaattctt

SEQ ID NO: 520162 - DNA, 20 bp, Artificial Sequence
  chemically synthesized
tataaaattgaattattcta

SEQ ID NO: 520163 - DNA, 20 bp, Artificial Sequence
  chemically synthesized
gtatccataattatataaaa

SEQ ID NO: 520164 - DNA, 20 bp, Artificial Sequence
  chemically synthesized
taattcaattttatataatt

SEQ ID NO: 520165 - DNA, 20 bp, Artificial Sequence
  chemically synthesized
atctgaataaacattacaat

SEQ ID NO: 520166 - DNA, 20 bp, Artificial Sequence
  chemically synthesized
tcaacaaataaacacaaaat

SEQ ID NO: 520167 - DNA, 20 bp, Artificial Sequence
  chemically synthesized
gtgtgagccaccgctcccag

SEQ ID NO: 520168 - DNA, 20 bp, Artificial Sequence
  chemically synthesized
gcctcggcctcccaaagtgc

SEQ ID NO: 520169 - DNA, 20 bp, Artificial Sequence
  chemically synthesized
cagcactttgggaggccgag

SEQ ID NO: 520170 - DNA, 20 bp, Artificial Sequence
  chemically synthesized
actttgggaggccgaggcgg

SEQ ID NO: 520171 - DNA, 20 bp, Artificial Sequence
  chemically synthesized
cgggtggatcacctgaggtc

SEQ ID NO: 520172 - DNA, 20 bp, Artificial Sequence
  chemically synthesized
tcttgtatttttagtagaga

SEQ ID NO: 520173 - DNA, 20 bp, Artificial Sequence
  chemically synthesized
attctcctgccctcagcctc

SEQ ID NO: 520174 - DNA, 20 bp, Artificial Sequence
  chemically synthesized
attcgggaggctgagggcag

SEQ ID NO: 520175 - DNA, 20 bp, Artificial Sequence
  chemically synthesized
ctcactgcaacctccacctc

SEQ ID NO: 520176 - DNA, 20 bp, Artificial Sequence
  chemically synthesized
tctcgctctgtcagccaggc

SEQ ID NO: 520177 - DNA, 20 bp, Artificial Sequence
  chemically synthesized
tttttttttttttttagatg

SEQ ID NO: 520178 - DNA, 20 bp, Artificial Sequence
  chemically synthesized
gagaaaggaaaacttgaaaa

SEQ ID NO: 520179 - DNA, 20 bp, Artificial Sequence
  chemically synthesized
tttctttagtttgccatatg

SEQ ID NO: 520180 - DNA, 20 bp, Artificial Sequence
  chemically synthesized
tattgccagagcttgaaggg

SEQ ID NO: 520181 - DNA, 20 bp, Artificial Sequence
  chemically synthesized
tgaagggcagaatgtgtaat

SEQ ID NO: 520182 - DNA, 20 bp, Artificial Sequence
  chemically synthesized
cagtggtgattccaatcatt

SEQ ID NO: 520183 - DNA, 20 bp, Artificial Sequence
  chemically synthesized
cagttttaatccccaatgat

SEQ ID NO: 520184 - DNA, 20 bp, Artificial Sequence
  chemically synthesized
tagatatcatggaagattga

SEQ ID NO: 520185 - DNA, 20 bp, Artificial Sequence
  chemically synthesized
catatagatatcatggaaga

SEQ ID NO: 520186 - DNA, 20 bp, Artificial Sequence
  chemically synthesized
aagttaagatctgaggttca

SEQ ID NO: 520187 - DNA, 20 bp, Artificial Sequence
  chemically synthesized
tacttagcctgaacactaaa

SEQ ID NO: 520188 - DNA, 20 bp, Artificial Sequence
  chemically synthesized
gagtcctttctacagttccc

SEQ ID NO: 520189 - DNA, 20 bp, Artificial Sequence
  chemically synthesized
acttatcacgattttcatcc

SEQ ID NO: 520190 - DNA, 20 bp, Artificial Sequence
  chemically synthesized
atacaaacctaaatacattc

SEQ ID NO: 520191 - DNA, 20 bp, Artificial Sequence
  chemically synthesized
caattgagtggtgcacgtcg

SEQ ID NO: 520192 - DNA, 20 bp, Artificial Sequence
  chemically synthesized
taaaaagtatgtgacgtcaa

SEQ ID NO: 520193 - DNA, 20 bp, Artificial Sequence
  chemically synthesized
agtggcagccaccatattta

SEQ ID NO: 520194 - DNA, 20 bp, Artificial Sequence
  chemically synthesized
ttcctttcctttcgagagac

SEQ ID NO: 520195 - DNA, 20 bp, Artificial Sequence
  chemically synthesized
ggggcaggtttaagatgcca

SEQ ID NO: 520196 - DNA, 20 bp, Artificial Sequence
  chemically synthesized
aaaaggaaacttggccacta

SEQ ID NO: 520197 - DNA, 20 bp, Artificial Sequence
  chemically synthesized
cactatggaatagtaccaaa

SEQ ID NO: 520198 - DNA, 20 bp, Artificial Sequence
  chemically synthesized
ttcaaaaatatagattatga

SEQ ID NO: 520199 - DNA, 20 bp, Artificial Sequence
  chemically synthesized
aattttcaaaaatatagatt

SEQ ID NO: 520200 - DNA, 20 bp, Artificial Sequence
  chemically synthesized
tcaatattaatacgaagcaa

SEQ ID NO: 520201 - DNA, 20 bp, Artificial Sequence
  chemically synthesized
gcaatagggtcaacatgaac

SEQ ID NO: 520202 - DNA, 20 bp, Artificial Sequence
  chemically synthesized
tgagaactaagtcaattata

SEQ ID NO: 520203 - DNA, 20 bp, Artificial Sequence
  chemically synthesized
tttgcaaatatattcgtctt

SEQ ID NO: 520204 - DNA, 20 bp, Artificial Sequence
  chemically synthesized
taaggaggaatattctaaag

SEQ ID NO: 520205 - DNA, 20 bp, Artificial Sequence
  chemically synthesized
tctacttaaaaaggttaagg

SEQ ID NO: 520206 - DNA, 20 bp, Artificial Sequence
  chemically synthesized
agacatttactttttcttac

SEQ ID NO: 520207 - DNA, 20 bp, Artificial Sequence
  chemically synthesized
ctcttttctacagttttttt

SEQ ID NO: 520208 - DNA, 20 bp, Artificial Sequence
  chemically synthesized
ttccaaaaaaaactgtagaa

SEQ ID NO: 520209 - DNA, 20 bp, Artificial Sequence
  chemically synthesized
aaaaaaaactgtagaaaaga

SEQ ID NO: 520210 - DNA, 20 bp, Artificial Sequence
  chemically synthesized
aagagtgaatatttattcta

SEQ ID NO: 520211 - DNA, 20 bp, Artificial Sequence
  chemically synthesized
caaacataacaaacatccaa

SEQ ID NO: 520212 - DNA, 20 bp, Artificial Sequence
  chemically synthesized
gtttgcataataactaatta

SEQ ID NO: 520213 - DNA, 20 bp, Artificial Sequence
  chemically synthesized
ctttgatcaaaatgtttgct

SEQ ID NO: 520214 - DNA, 20 bp, Artificial Sequence
  chemically synthesized
tctatgctgccttgctttga

SEQ ID NO: 520215 - DNA, 20 bp, Artificial Sequence
  chemically synthesized
tagtcatttataaatgttgt

SEQ ID NO: 520216 - DNA, 20 bp, Artificial Sequence
  chemically synthesized
atttataaatgactaattca

SEQ ID NO: 520217 - DNA, 20 bp, Artificial Sequence
  chemically synthesized
acttaagaccttttaattcc

SEQ ID NO: 520218 - DNA, 20 bp, Artificial Sequence
  chemically synthesized
ttaaaaggtcttaagtgccc

SEQ ID NO: 520219 - DNA, 20 bp, Artificial Sequence
  chemically synthesized
agtgccccagaatgtagaaa

SEQ ID NO: 520220 - DNA, 20 bp, Artificial Sequence
  chemically synthesized
aataaacatgtggtagtggt

SEQ ID NO: 520221 - DNA, 20 bp, Artificial Sequence
  chemically synthesized
accgctggaaaaaatgcacg

SEQ ID NO: 520222 - DNA, 20 bp, Artificial Sequence
  chemically synthesized
gaaaatcaagtacacacgtt

SEQ ID NO: 520223 - DNA, 20 bp, Artificial Sequence
  chemically synthesized
agcccatgacaaagcttgat

SEQ ID NO: 520224 - DNA, 20 bp, Artificial Sequence
  chemically synthesized
aaagaggaaatataaggcta

SEQ ID NO: 520225 - DNA, 20 bp, Artificial Sequence
  chemically synthesized
gaaaagaggaagaaattgct

SEQ ID NO: 520226 - DNA, 20 bp, Artificial Sequence
  chemically synthesized
tcttcctcttttctcaagag

SEQ ID NO: 520227 - DNA, 20 bp, Artificial Sequence
  chemically synthesized
tctgagaacggcctagaaga

SEQ ID NO: 520228 - DNA, 20 bp, Artificial Sequence
  chemically synthesized
tgggtctgagaacggcctag

SEQ ID NO: 520229 - DNA, 20 bp, Artificial Sequence
  chemically synthesized
gatttattgtttttttgaaa

SEQ ID NO: 520230 - DNA, 20 bp, Artificial Sequence
  chemically synthesized
aagtttattgcttttggctt

SEQ ID NO: 520231 - DNA, 20 bp, Artificial Sequence
  chemically synthesized
attatgggtgtaaagtgtaa

SEQ ID NO: 520232 - DNA, 20 bp, Artificial Sequence
  chemically synthesized
aagggtacgttacttacatt

SEQ ID NO: 520233 - DNA, 20 bp, Artificial Sequence
  chemically synthesized
agtgagcagttaaatattta

SEQ ID NO: 520234 - DNA, 20 bp, Artificial Sequence
  chemically synthesized
cacttttttagcagatatct

SEQ ID NO: 520235 - DNA, 20 bp, Artificial Sequence
  chemically synthesized
ttttttttttttttttgaga

SEQ ID NO: 520236 - DNA, 20 bp, Artificial Sequence
  chemically synthesized
tctccctctatcgcccaggc

SEQ ID NO: 520237 - DNA, 20 bp, Artificial Sequence
  chemically synthesized
ctcactgcaacctcctcctc

SEQ ID NO: 520238 - DNA, 20 bp, Artificial Sequence
  chemically synthesized
tacttaggaggctgaggcag

SEQ ID NO: 520239 - DNA, 20 bp, Artificial Sequence
  chemically synthesized
gcctcagcctcctaagtagc

SEQ ID NO: 520240 - DNA, 20 bp, Artificial Sequence
  chemically synthesized
acaattagccaggcgtggtg

SEQ ID NO: 520241 - DNA, 20 bp, Artificial Sequence
  chemically synthesized
tgttgtatttttagtagaga

SEQ ID NO: 520242 - DNA, 20 bp, Artificial Sequence
  chemically synthesized
ccagtggatcacttgaagac

SEQ ID NO: 520243 - DNA, 20 bp, Artificial Sequence
  chemically synthesized
acttcgggagttagaggcca

SEQ ID NO: 520244 - DNA, 20 bp, Artificial Sequence
  chemically synthesized
gcctctaactcccgaagtgc

SEQ ID NO: 520245 - DNA, 20 bp, Artificial Sequence
  chemically synthesized
tcctgtaatcccagcacttc

SEQ ID NO: 520246 - DNA, 20 bp, Artificial Sequence
  chemically synthesized
tcccgaagtgctgggattac

SEQ ID NO: 520247 - DNA, 20 bp, Artificial Sequence
  chemically synthesized
tactttccttattttccata

SEQ ID NO: 520248 - DNA, 20 bp, Artificial Sequence
  chemically synthesized
cccaggaagcggaggttgca

SEQ ID NO: 520249 - DNA, 20 bp, Artificial Sequence
  chemically synthesized
ctcactgcaacctccgcttc

SEQ ID NO: 520250 - DNA, 20 bp, Artificial Sequence
  chemically synthesized
ttcttgggaggctgaggcag

SEQ ID NO: 520251 - DNA, 20 bp, Artificial Sequence
  chemically synthesized
ttttgtatttttagtagaga

SEQ ID NO: 520252 - DNA, 20 bp, Artificial Sequence
  chemically synthesized
cgggcagatcacctgaggtc

SEQ ID NO: 520253 - DNA, 20 bp, Artificial Sequence
  chemically synthesized
gcctcggcctcccaaagtgc

SEQ ID NO: 520254 - DNA, 20 bp, Artificial Sequence
  chemically synthesized
aaagtgctgggattacaagt

SEQ ID NO: 520255 - DNA, 20 bp, Artificial Sequence
  chemically synthesized
acatagatacactagattta

SEQ ID NO: 520256 - DNA, 20 bp, Artificial Sequence
  chemically synthesized
tgactataatgatgagaagt

SEQ ID NO: 520257 - DNA, 20 bp, Artificial Sequence
  chemically synthesized
gaaatgtatatttggagacc

SEQ ID NO: 520258 - DNA, 20 bp, Artificial Sequence
  chemically synthesized
cattcaaataaggtgaaatt

SEQ ID NO: 520259 - DNA, 20 bp, Artificial Sequence
  chemically synthesized
gacccagaatttcaccttat

SEQ ID NO: 520260 - DNA, 20 bp, Artificial Sequence
  chemically synthesized
ttttacagcatttcgaacac

SEQ ID NO: 520261 - DNA, 20 bp, Artificial Sequence
  chemically synthesized
taaatcacctccaagtttct

SEQ ID NO: 520262 - DNA, 20 bp, Artificial Sequence
  chemically synthesized
tggctgttaatatctcaaaa

SEQ ID NO: 520263 - DNA, 20 bp, Artificial Sequence
  chemically synthesized
ctgtttttccaaatatatac

SEQ ID NO: 520264 - DNA, 20 bp, Artificial Sequence
  chemically synthesized
gaatgactttttttctcccc

SEQ ID NO: 520265 - DNA, 20 bp, Artificial Sequence
  chemically synthesized
aataaatgtttccatattat

SEQ ID NO: 520266 - DNA, 20 bp, Artificial Sequence
  chemically synthesized
cctgttttgttattagttag

SEQ ID NO: 520267 - DNA, 20 bp, Artificial Sequence
  chemically synthesized
aaattaaaactgattcaaag

SEQ ID NO: 520268 - DNA, 20 bp, Artificial Sequence
  chemically synthesized
tcagtcccttgaattcccct

SEQ ID NO: 520269 - DNA, 20 bp, Artificial Sequence
  chemically synthesized
gactatgtgtgttcagtccc

SEQ ID NO: 520270 - DNA, 20 bp, Artificial Sequence
  chemically synthesized
gcaataaaattatatatttt

SEQ ID NO: 520271 - DNA, 20 bp, Artificial Sequence
  chemically synthesized
tacatttatgtaaaatttct

SEQ ID NO: 520272 - DNA, 20 bp, Artificial Sequence
  chemically synthesized
ctaatcaatagtaaatacta

SEQ ID NO: 520273 - DNA, 20 bp, Artificial Sequence
  chemically synthesized
ttgtacatttttaaataact

SEQ ID NO: 520274 - DNA, 20 bp, Artificial Sequence
  chemically synthesized
ttaaataactaagagtataa

SEQ ID NO: 520275 - DNA, 20 bp, Artificial Sequence
  chemically synthesized
actggattgtttgtaacaca

SEQ ID NO: 520276 - DNA, 20 bp, Artificial Sequence
  chemically synthesized
acaatgcatagttatcacat

SEQ ID NO: 520277 - DNA, 20 bp, Artificial Sequence
  chemically synthesized
acttaaaagataattttttt

SEQ ID NO: 520278 - DNA, 20 bp, Artificial Sequence
  chemically synthesized
tttgccttatttccaagttt

SEQ ID NO: 520279 - DNA, 20 bp, Artificial Sequence
  chemically synthesized
agttttagagtttaacaagc

SEQ ID NO: 520280 - DNA, 20 bp, Artificial Sequence
  chemically synthesized
gtaattacgtgagtaattaa

SEQ ID NO: 520281 - DNA, 20 bp, Artificial Sequence
  chemically synthesized
cctgacacttaagtaattac

SEQ ID NO: 520282 - DNA, 20 bp, Artificial Sequence
  chemically synthesized
actagggagatgatagggaa

SEQ ID NO: 520283 - DNA, 20 bp, Artificial Sequence
  chemically synthesized
tttttagaagcttactaatg

SEQ ID NO: 520284 - DNA, 20 bp, Artificial Sequence
  chemically synthesized
gcctcagcctcccaaagtta

SEQ ID NO: 520285 - DNA, 20 bp, Artificial Sequence
  chemically synthesized
actttgggaggctgaggcgg

SEQ ID NO: 520286 - DNA, 20 bp, Artificial Sequence
  chemically synthesized
ggcgggcggatcacgaggtc

SEQ ID NO: 520287 - DNA, 20 bp, Artificial Sequence
  chemically synthesized
ttgtatttttttagtagaga

SEQ ID NO: 520288 - DNA, 20 bp, Artificial Sequence
  chemically synthesized
gattcttctgtctcagcctc

SEQ ID NO: 520289 - DNA, 20 bp, Artificial Sequence
  chemically synthesized
tactcgggaggctgagacag

SEQ ID NO: 520290 - DNA, 20 bp, Artificial Sequence
  chemically synthesized
ctcactgcaacctccgcctc

SEQ ID NO: 520291 - DNA, 20 bp, Artificial Sequence
  chemically synthesized
tcacaccactgcactccagc

SEQ ID NO: 520292 - DNA, 20 bp, Artificial Sequence
  chemically synthesized
tcttgctctgtcacccaggc

SEQ ID NO: 520293 - DNA, 20 bp, Artificial Sequence
  chemically synthesized
tttcttttctttttttgaga

SEQ ID NO: 520294 - DNA, 20 bp, Artificial Sequence
  chemically synthesized
agaaaaaaaaatagttactg

SEQ ID NO: 520295 - DNA, 20 bp, Artificial Sequence
  chemically synthesized
cctagaattgacgttacagg

SEQ ID NO: 520296 - DNA, 20 bp, Artificial Sequence
  chemically synthesized
tctcctttttggaacatacc

SEQ ID NO: 520297 - DNA, 20 bp, Artificial Sequence
  chemically synthesized
acatcacctaaatgataaac

SEQ ID NO: 520298 - DNA, 20 bp, Artificial Sequence
  chemically synthesized
aaatgataaactggagttag

SEQ ID NO: 520299 - DNA, 20 bp, Artificial Sequence
  chemically synthesized
gtgggagatgacatttccag

SEQ ID NO: 520300 - DNA, 20 bp, Artificial Sequence
  chemically synthesized
tccagaagaataacagaagc

SEQ ID NO: 520301 - DNA, 20 bp, Artificial Sequence
  chemically synthesized
tacgtacaatgtcgttcttg

SEQ ID NO: 520302 - DNA, 20 bp, Artificial Sequence
  chemically synthesized
tacaatgtcgttcttgaggg

SEQ ID NO: 520303 - DNA, 20 bp, Artificial Sequence
  chemically synthesized
atgtcgttcttgagggatgg

SEQ ID NO: 520304 - DNA, 20 bp, Artificial Sequence
  chemically synthesized
ttgagggatgggtgggttcg

SEQ ID NO: 520305 - DNA, 20 bp, Artificial Sequence
  chemically synthesized
ggtgggttcggtgggtggga

SEQ ID NO: 520306 - DNA, 20 bp, Artificial Sequence
  chemically synthesized
ggttcggtgggtgggaaggg

SEQ ID NO: 520307 - DNA, 20 bp, Artificial Sequence
  chemically synthesized
gagattggtagagcatctta

SEQ ID NO: 520308 - DNA, 20 bp, Artificial Sequence
  chemically synthesized
cattgccccaaaagtgaaat

SEQ ID NO: 520309 - DNA, 20 bp, Artificial Sequence
  chemically synthesized
gatttcacttttggggcaat

SEQ ID NO: 520310 - DNA, 20 bp, Artificial Sequence
  chemically synthesized
ggcaatgagaatttggcata

SEQ ID NO: 520311 - DNA, 20 bp, Artificial Sequence
  chemically synthesized
ctttcccaattgttatcaaa

SEQ ID NO: 520312 - DNA, 20 bp, Artificial Sequence
  chemically synthesized
ttttgataacaattgggaaa

SEQ ID NO: 520313 - DNA, 20 bp, Artificial Sequence
  chemically synthesized
acgtggcaaataaagagaca

SEQ ID NO: 520314 - DNA, 20 bp, Artificial Sequence
  chemically synthesized
agtttataccaccttttcac

SEQ ID NO: 520315 - DNA, 20 bp, Artificial Sequence
  chemically synthesized
taaggtaacagccatggaaa

SEQ ID NO: 520316 - DNA, 20 bp, Artificial Sequence
  chemically synthesized
acgtttgaaatattagttga

SEQ ID NO: 520317 - DNA, 20 bp, Artificial Sequence
  chemically synthesized
acgtgcaaaatatgtttggc

SEQ ID NO: 520318 - DNA, 20 bp, Artificial Sequence
  chemically synthesized
atgtttggcaggggtttatt

SEQ ID NO: 520319 - DNA, 20 bp, Artificial Sequence
  chemically synthesized
ccatcactttcacaaaacta

SEQ ID NO: 520320 - DNA, 20 bp, Artificial Sequence
  chemically synthesized
attgtgatcagtggatatga

SEQ ID NO: 520321 - DNA, 20 bp, Artificial Sequence
  chemically synthesized
cacaaagtctattgtgatca

SEQ ID NO: 520322 - DNA, 20 bp, Artificial Sequence
  chemically synthesized
aacataagacaaatttattc

SEQ ID NO: 520323 - DNA, 20 bp, Artificial Sequence
  chemically synthesized
atgctgagggcttaacattc

SEQ ID NO: 520324 - DNA, 20 bp, Artificial Sequence
  chemically synthesized
tagtgtgacgaaggaaaaca

SEQ ID NO: 520325 - DNA, 20 bp, Artificial Sequence
  chemically synthesized
tttcttcaaaataaatttaa

SEQ ID NO: 520326 - DNA, 20 bp, Artificial Sequence
  chemically synthesized
ctagggggaagatgacacaa

SEQ ID NO: 520327 - DNA, 20 bp, Artificial Sequence
  chemically synthesized
ttcagttttccacatgcagc

SEQ ID NO: 520328 - DNA, 20 bp, Artificial Sequence
  chemically synthesized
ttctggctgcatgtggaaaa

SEQ ID NO: 520329 - DNA, 20 bp, Artificial Sequence
  chemically synthesized
catgtggaaaactgaatcac

SEQ ID NO: 520330 - DNA, 20 bp, Artificial Sequence
  chemically synthesized
catcagccatcatgttttgc

SEQ ID NO: 520331 - DNA, 20 bp, Artificial Sequence
  chemically synthesized
ttagaacagtgatctcgagg

SEQ ID NO: 520332 - DNA, 20 bp, Artificial Sequence
  chemically synthesized
gtgatctcgagggagaatgc

SEQ ID NO: 520333 - DNA, 20 bp, Artificial Sequence
  chemically synthesized
gtgccaaacttctcaggttt

SEQ ID NO: 520334 - DNA, 20 bp, Artificial Sequence
  chemically synthesized
caatgagctagagaaggagg

SEQ ID NO: 520335 - DNA, 20 bp, Artificial Sequence
  chemically synthesized
tgatctcatatatactgatt

SEQ ID NO: 520336 - DNA, 20 bp, Artificial Sequence
  chemically synthesized
tgagcataactgatgggcag

SEQ ID NO: 520337 - DNA, 20 bp, Artificial Sequence
  chemically synthesized
gggataggtctctagctcaa

SEQ ID NO: 520338 - DNA, 20 bp, Artificial Sequence
  chemically synthesized
gctcaaaagaatgattttgg

SEQ ID NO: 520339 - DNA, 20 bp, Artificial Sequence
  chemically synthesized
ttggttggatataaaaatct

SEQ ID NO: 520340 - DNA, 20 bp, Artificial Sequence
  chemically synthesized
aaaatctgagggtcatggtt

SEQ ID NO: 520341 - DNA, 20 bp, Artificial Sequence
  chemically synthesized
ggttaagagttgttattgct

SEQ ID NO: 520342 - DNA, 20 bp, Artificial Sequence
  chemically synthesized
gcaactttatcattttcttg

SEQ ID NO: 520343 - DNA, 20 bp, Artificial Sequence
  chemically synthesized
ttgccctgagacaggaaaac

SEQ ID NO: 520344 - DNA, 20 bp, Artificial Sequence
  chemically synthesized
agacaggaaaactagaatag

SEQ ID NO: 520345 - DNA, 20 bp, Artificial Sequence
  chemically synthesized
tatcttagaagccagggaag

SEQ ID NO: 520346 - DNA, 20 bp, Artificial Sequence
  chemically synthesized
ccgatcaacaatcaatacta

SEQ ID NO: 520347 - DNA, 20 bp, Artificial Sequence
  chemically synthesized
gacaaaatcaatttcagttg

SEQ ID NO: 520348 - DNA, 20 bp, Artificial Sequence
  chemically synthesized
gttgaaggatgtggaagcag

SEQ ID NO: 520349 - DNA, 20 bp, Artificial Sequence
  chemically synthesized
ttggtgtttgaggtagctac

SEQ ID NO: 520350 - DNA, 20 bp, Artificial Sequence
  chemically synthesized
tgttaaagaagtttagcttc

SEQ ID NO: 520351 - DNA, 20 bp, Artificial Sequence
  chemically synthesized
aggagattaaaaactaatag

SEQ ID NO: 520352 - DNA, 20 bp, Artificial Sequence
  chemically synthesized
gaacgcaagaaaaaaaatta

SEQ ID NO: 520353 - DNA, 20 bp, Artificial Sequence
  chemically synthesized
taatagtagcccgcaagtcc

SEQ ID NO: 520354 - DNA, 20 bp, Artificial Sequence
  chemically synthesized
ataaaaattcattaatttcc

SEQ ID NO: 520355 - DNA, 20 bp, Artificial Sequence
  chemically synthesized
acaaatactcatggaaatta

SEQ ID NO: 520356 - DNA, 20 bp, Artificial Sequence
  chemically synthesized
agccactcctccagagccag

SEQ ID NO: 520357 - DNA, 20 bp, Artificial Sequence
  chemically synthesized
ttttatccccctggctctgg

SEQ ID NO: 520358 - DNA, 20 bp, Artificial Sequence
  chemically synthesized
tgttttatagtctgacaaat

SEQ ID NO: 520359 - DNA, 20 bp, Artificial Sequence
  chemically synthesized
gggttctattcccagtatct

SEQ ID NO: 520360 - DNA, 20 bp, Artificial Sequence
  chemically synthesized
agctggtatccagagatact

SEQ ID NO: 520361 - DNA, 20 bp, Artificial Sequence
  chemically synthesized
cagtaacaatagctctttta

SEQ ID NO: 520362 - DNA, 20 bp, Artificial Sequence
  chemically synthesized
tcttttatagaatcatggag

SEQ ID NO: 520363 - DNA, 20 bp, Artificial Sequence
  chemically synthesized
ggagaagaataaataaagta

SEQ ID NO: 520364 - DNA, 20 bp, Artificial Sequence
  chemically synthesized
gtattataagaagttcttca

SEQ ID NO: 520365 - DNA, 20 bp, Artificial Sequence
  chemically synthesized
acttcttataatacctctcc

SEQ ID NO: 520366 - DNA, 20 bp, Artificial Sequence
  chemically synthesized
gtgcggagacctactagata

SEQ ID NO: 520367 - DNA, 20 bp, Artificial Sequence
  chemically synthesized
agtaggtctccgcacagccc

SEQ ID NO: 520368 - DNA, 20 bp, Artificial Sequence
  chemically synthesized
acaaatttccaggtgatatt

SEQ ID NO: 520369 - DNA, 20 bp, Artificial Sequence
  chemically synthesized
cagtcacataacaaaaacca

SEQ ID NO: 520370 - DNA, 20 bp, Artificial Sequence
  chemically synthesized
atggtcctcatcaaagtccg

SEQ ID NO: 520371 - DNA, 20 bp, Artificial Sequence
  chemically synthesized
aaaagaggaagaggtattga

SEQ ID NO: 520372 - DNA, 20 bp, Artificial Sequence
  chemically synthesized
gagttagaaggtagaggagt

SEQ ID NO: 520373 - DNA, 20 bp, Artificial Sequence
  chemically synthesized
ataattgagttagaaggtag

SEQ ID NO: 520374 - DNA, 20 bp, Artificial Sequence
  chemically synthesized
agagcgcaggggtcagataa

SEQ ID NO: 520375 - DNA, 20 bp, Artificial Sequence
  chemically synthesized
aaagaaaaaaaaaagagcgc

SEQ ID NO: 520376 - DNA, 20 bp, Artificial Sequence
  chemically synthesized
tttttcttttcttttcgaga

SEQ ID NO: 520377 - DNA, 20 bp, Artificial Sequence
  chemically synthesized
tttgctctctttgcccaggc

SEQ ID NO: 520378 - DNA, 20 bp, Artificial Sequence
  chemically synthesized
ctcactgcaaccactgtctc

SEQ ID NO: 520379 - DNA, 20 bp, Artificial Sequence
  chemically synthesized
tacttgggaggctgaggcag

SEQ ID NO: 520380 - DNA, 20 bp, Artificial Sequence
  chemically synthesized
ttttgtatttttagtagaga

SEQ ID NO: 520381 - DNA, 20 bp, Artificial Sequence
  chemically synthesized
cagacggatcatctgaggtc

SEQ ID NO: 520382 - DNA, 20 bp, Artificial Sequence
  chemically synthesized
actttgggaggctgaggcag

SEQ ID NO: 520383 - DNA, 20 bp, Artificial Sequence
  chemically synthesized
gcctcagcctcccaaagtgc

SEQ ID NO: 520384 - DNA, 20 bp, Artificial Sequence
  chemically synthesized
atgaacgaacgaatgaatga

SEQ ID NO: 520385 - DNA, 20 bp, Artificial Sequence
  chemically synthesized
atgaatgaacgaacgaatga

SEQ ID NO: 520386 - DNA, 20 bp, Artificial Sequence
  chemically synthesized
ttgaatgaatgaacgaacga

SEQ ID NO: 520387 - DNA, 20 bp, Artificial Sequence
  chemically synthesized
tttattgaatgaatgaacga

SEQ ID NO: 520388 - DNA, 20 bp, Artificial Sequence
  chemically synthesized
actgtagcagagtttattga

SEQ ID NO: 520389 - DNA, 20 bp, Artificial Sequence
  chemically synthesized
gaatactgtagcagagttta

SEQ ID NO: 520390 - DNA, 20 bp, Artificial Sequence
  chemically synthesized
agagtctctgaatactgtag

SEQ ID NO: 520391 - DNA, 20 bp, Artificial Sequence
  chemically synthesized
aatatggcagaaaagagtct

SEQ ID NO: 520392 - DNA, 20 bp, Artificial Sequence
  chemically synthesized
tcaaagcaaatatggcagaa

SEQ ID NO: 520393 - DNA, 20 bp, Artificial Sequence
  chemically synthesized
tttgatctagttaacactta

SEQ ID NO: 520394 - DNA, 20 bp, Artificial Sequence
  chemically synthesized
tcgttacaggatactgtaaa

SEQ ID NO: 520395 - DNA, 20 bp, Artificial Sequence
  chemically synthesized
cccttttacagtatcctgta

SEQ ID NO: 520396 - DNA, 20 bp, Artificial Sequence
  chemically synthesized
aatgataaagagattcgtta

SEQ ID NO: 520397 - DNA, 20 bp, Artificial Sequence
  chemically synthesized
atcatttctagcttatatca

SEQ ID NO: 520398 - DNA, 20 bp, Artificial Sequence
  chemically synthesized
gaaccatgccctctactgat

SEQ ID NO: 520399 - DNA, 20 bp, Artificial Sequence
  chemically synthesized
tatgtatatatggaatttcc

SEQ ID NO: 520400 - DNA, 20 bp, Artificial Sequence
  chemically synthesized
tggcttatattatgtatata

SEQ ID NO: 520401 - DNA, 20 bp, Artificial Sequence
  chemically synthesized
ttatctggcatttgttctat

SEQ ID NO: 520402 - DNA, 20 bp, Artificial Sequence
  chemically synthesized
tttaaaatgataatgtgatt

SEQ ID NO: 520403 - DNA, 20 bp, Artificial Sequence
  chemically synthesized
ctaacttccattgcctatca

SEQ ID NO: 520404 - DNA, 20 bp, Artificial Sequence
  chemically synthesized
aaccagtcttttaaacagta

SEQ ID NO: 520405 - DNA, 20 bp, Artificial Sequence
  chemically synthesized
gactggttctgttttataat

SEQ ID NO: 520406 - DNA, 20 bp, Artificial Sequence
  chemically synthesized
agcttgggctaggcaaagta

SEQ ID NO: 520407 - DNA, 20 bp, Artificial Sequence
  chemically synthesized
tagaggtattttagaagaag

SEQ ID NO: 520408 - DNA, 20 bp, Artificial Sequence
  chemically synthesized
cctagttttctatgcatgcg

SEQ ID NO: 520409 - DNA, 20 bp, Artificial Sequence
  chemically synthesized
tacttgcttacagaaatgtg

SEQ ID NO: 520410 - DNA, 20 bp, Artificial Sequence
  chemically synthesized
gtaagcaagtatcaaggaaa

SEQ ID NO: 520411 - DNA, 20 bp, Artificial Sequence
  chemically synthesized
aagagcatgaaggagactta

SEQ ID NO: 520412 - DNA, 20 bp, Artificial Sequence
  chemically synthesized
gaggctggtgggaatatagt

SEQ ID NO: 520413 - DNA, 20 bp, Artificial Sequence
  chemically synthesized
tttcttcctgagaggctggt

SEQ ID NO: 520414 - DNA, 20 bp, Artificial Sequence
  chemically synthesized
gaagaaactgctctgctgac

SEQ ID NO: 520415 - DNA, 20 bp, Artificial Sequence
  chemically synthesized
gttctcaaacttcatataga

SEQ ID NO: 520416 - DNA, 20 bp, Artificial Sequence
  chemically synthesized
aataaaaacctgctacttgg

SEQ ID NO: 520417 - DNA, 20 bp, Artificial Sequence
  chemically synthesized
ttattactatataatattcc

SEQ ID NO: 520418 - DNA, 20 bp, Artificial Sequence
  chemically synthesized
acaaaaattgggtatatccg

SEQ ID NO: 520419 - DNA, 20 bp, Artificial Sequence
  chemically synthesized
aaacaaacaaaaaacaaaaa

SEQ ID NO: 520420 - DNA, 20 bp, Artificial Sequence
  chemically synthesized
tcatgccactgcacttcagc

SEQ ID NO: 520421 - DNA, 20 bp, Artificial Sequence
  chemically synthesized
ctcactacaacctctgcctc

SEQ ID NO: 520422 - DNA, 20 bp, Artificial Sequence
  chemically synthesized
tactcaggaggctaaggcag

SEQ ID NO: 520423 - DNA, 20 bp, Artificial Sequence
  chemically synthesized
gattctcctgccttagcctc

SEQ ID NO: 520424 - DNA, 20 bp, Artificial Sequence
  chemically synthesized
gccttagcctcctgagtagc

SEQ ID NO: 520425 - DNA, 20 bp, Artificial Sequence
  chemically synthesized
ttttgtatttttagtagaga

SEQ ID NO: 520426 - DNA, 20 bp, Artificial Sequence
  chemically synthesized
agggcggatcacttgagatc

SEQ ID NO: 520427 - DNA, 20 bp, Artificial Sequence
  chemically synthesized
actttgggaggcccaggagg

SEQ ID NO: 520428 - DNA, 20 bp, Artificial Sequence
  chemically synthesized
tcctgggcctcccaaagtgc

SEQ ID NO: 520429 - DNA, 20 bp, Artificial Sequence
  chemically synthesized
taacttgtgtccctcagaat

SEQ ID NO: 520430 - DNA, 20 bp, Artificial Sequence
  chemically synthesized
ctgatataacttgtgtccct

SEQ ID NO: 520431 - DNA, 20 bp, Artificial Sequence
  chemically synthesized
atttctccccttttttgaga

SEQ ID NO: 520432 - DNA, 20 bp, Artificial Sequence
  chemically synthesized
cactacactcctgcctggga

SEQ ID NO: 520433 - DNA, 20 bp, Artificial Sequence
  chemically synthesized
ggtctgactctgtcccaggc

SEQ ID NO: 520434 - DNA, 20 bp, Artificial Sequence
  chemically synthesized
tactccagaggctgagatga

SEQ ID NO: 520435 - DNA, 20 bp, Artificial Sequence
  chemically synthesized
cattctctcatctcagcctc

SEQ ID NO: 520436 - DNA, 20 bp, Artificial Sequence
  chemically synthesized
tgaggtcaaactatgttgcc

SEQ ID NO: 520437 - DNA, 20 bp, Artificial Sequence
  chemically synthesized
tgggagggtcacttgaagcc

SEQ ID NO: 520438 - DNA, 20 bp, Artificial Sequence
  chemically synthesized
actttgggaggccaaagtgg

SEQ ID NO: 520439 - DNA, 20 bp, Artificial Sequence
  chemically synthesized
actttggcctcccaaagtgc

SEQ ID NO: 520440 - DNA, 20 bp, Artificial Sequence
  chemically synthesized
aaattagtaggccaggtgta

SEQ ID NO: 520441 - DNA, 20 bp, Artificial Sequence
  chemically synthesized
tttgaacacatacatatgag

SEQ ID NO: 520442 - DNA, 20 bp, Artificial Sequence
  chemically synthesized
agacaatatcaagtattggg

SEQ ID NO: 520443 - DNA, 20 bp, Artificial Sequence
  chemically synthesized
tcttattatattttaaccat

SEQ ID NO: 520444 - DNA, 20 bp, Artificial Sequence
  chemically synthesized
gaatacccctatatatgcat

SEQ ID NO: 520445 - DNA, 20 bp, Artificial Sequence
  chemically synthesized
aaccattcggatgcatatat

SEQ ID NO: 520446 - DNA, 20 bp, Artificial Sequence
  chemically synthesized
tcattagtaatcaaagaatt

SEQ ID NO: 520447 - DNA, 20 bp, Artificial Sequence
  chemically synthesized
cctaacttcattagtaatca

SEQ ID NO: 520448 - DNA, 20 bp, Artificial Sequence
  chemically synthesized
acaaagatggtaaaaaacat

SEQ ID NO: 520449 - DNA, 20 bp, Artificial Sequence
  chemically synthesized
attttgccaacttttaaaaa

SEQ ID NO: 520450 - DNA, 20 bp, Artificial Sequence
  chemically synthesized
ttgtctttttattgatatgt

SEQ ID NO: 520451 - DNA, 20 bp, Artificial Sequence
  chemically synthesized
gtatgagtttattatatatt

SEQ ID NO: 520452 - DNA, 20 bp, Artificial Sequence
  chemically synthesized
tctaatcagatatacgtctt

SEQ ID NO: 520453 - DNA, 20 bp, Artificial Sequence
  chemically synthesized
tattagtgtattataataga

SEQ ID NO: 520454 - DNA, 20 bp, Artificial Sequence
  chemically synthesized
aattgagcttcattaaaact

SEQ ID NO: 520455 - DNA, 20 bp, Artificial Sequence
  chemically synthesized
agtcataagtaaaataatct

SEQ ID NO: 520456 - DNA, 20 bp, Artificial Sequence
  chemically synthesized
attaagtaaacatagtcaag

SEQ ID NO: 520457 - DNA, 20 bp, Artificial Sequence
  chemically synthesized
agtctctgaataagggataa

SEQ ID NO: 520458 - DNA, 20 bp, Artificial Sequence
  chemically synthesized
aatatgagagtctctgaata

SEQ ID NO: 520459 - DNA, 20 bp, Artificial Sequence
  chemically synthesized
tcacaataatatgagagtct

SEQ ID NO: 520460 - DNA, 20 bp, Artificial Sequence
  chemically synthesized
atttacagtcacaataatat

SEQ ID NO: 520461 - DNA, 20 bp, Artificial Sequence
  chemically synthesized
aatccgacttatatatcttt

SEQ ID NO: 520462 - DNA, 20 bp, Artificial Sequence
  chemically synthesized
aactcccaaagatatataag

SEQ ID NO: 520463 - DNA, 20 bp, Artificial Sequence
  chemically synthesized
tgggcacagctaccaggaaa

SEQ ID NO: 520464 - DNA, 20 bp, Artificial Sequence
  chemically synthesized
accaggaaaaggggttcaag

SEQ ID NO: 520465 - DNA, 20 bp, Artificial Sequence
  chemically synthesized
caagaagggttacagagcaa

SEQ ID NO: 520466 - DNA, 20 bp, Artificial Sequence
  chemically synthesized
ataatcttttgctagggctg

SEQ ID NO: 520467 - DNA, 20 bp, Artificial Sequence
  chemically synthesized
tcaaaaattatatcgaggcc

SEQ ID NO: 520468 - DNA, 20 bp, Artificial Sequence
  chemically synthesized
atggcctcgatataattttt

SEQ ID NO: 520469 - DNA, 20 bp, Artificial Sequence
  chemically synthesized
aatttttgagaatggaagct

SEQ ID NO: 520470 - DNA, 20 bp, Artificial Sequence
  chemically synthesized
tagaagatgtcagggaaccc

SEQ ID NO: 520471 - DNA, 20 bp, Artificial Sequence
  chemically synthesized
ttcaatactattaacaaccc

SEQ ID NO: 520472 - DNA, 20 bp, Artificial Sequence
  chemically synthesized
ctagggctcgagcttcagaa

SEQ ID NO: 520473 - DNA, 20 bp, Artificial Sequence
  chemically synthesized
gaaattcattgcttttattt

SEQ ID NO: 520474 - DNA, 20 bp, Artificial Sequence
  chemically synthesized
tcaattcacaaataaaagca

SEQ ID NO: 520475 - DNA, 20 bp, Artificial Sequence
  chemically synthesized
ttggttttgaaggtatgtta

SEQ ID NO: 520476 - DNA, 20 bp, Artificial Sequence
  chemically synthesized
tgttataaaaatatgaaatg

SEQ ID NO: 520477 - DNA, 20 bp, Artificial Sequence
  chemically synthesized
ttctacatagattgaagacc

SEQ ID NO: 520478 - DNA, 20 bp, Artificial Sequence
  chemically synthesized
taactgaaaactaatcttgg

SEQ ID NO: 520479 - DNA, 20 bp, Artificial Sequence
  chemically synthesized
aattttttctttaacagtat

SEQ ID NO: 520480 - DNA, 20 bp, Artificial Sequence
  chemically synthesized
ccgtgattcagcaagtgaca

SEQ ID NO: 520481 - DNA, 20 bp, Artificial Sequence
  chemically synthesized
aaattattcaatgtcacttg

SEQ ID NO: 520482 - DNA, 20 bp, Artificial Sequence
  chemically synthesized
ctatacctattgagatggtc

SEQ ID NO: 520483 - DNA, 20 bp, Artificial Sequence
  chemically synthesized
aggtatagggaccgtgaaaa

SEQ ID NO: 520484 - DNA, 20 bp, Artificial Sequence
  chemically synthesized
ggagagagattgagctcaat

SEQ ID NO: 520485 - DNA, 20 bp, Artificial Sequence
  chemically synthesized
tgaatacagcacaggcaaat

SEQ ID NO: 520486 - DNA, 20 bp, Artificial Sequence
  chemically synthesized
ggaattttataaccaaggaa

SEQ ID NO: 520487 - DNA, 20 bp, Artificial Sequence
  chemically synthesized
ttataaccaaggaacagggt

SEQ ID NO: 520488 - DNA, 20 bp, Artificial Sequence
  chemically synthesized
aaggaacagggtaggggtca

SEQ ID NO: 520489 - DNA, 20 bp, Artificial Sequence
  chemically synthesized
aattattaagaggaagcatc

SEQ ID NO: 520490 - DNA, 20 bp, Artificial Sequence
  chemically synthesized
atgactggactattttcagc

SEQ ID NO: 520491 - DNA, 20 bp, Artificial Sequence
  chemically synthesized
aatagtccagtcatcccctg

SEQ ID NO: 520492 - DNA, 20 bp, Artificial Sequence
  chemically synthesized
tcatcatccaccatcctcca

SEQ ID NO: 520493 - DNA, 20 bp, Artificial Sequence
  chemically synthesized
cagtcatcccctggaggatg

SEQ ID NO: 520494 - DNA, 20 bp, Artificial Sequence
  chemically synthesized
gaggaacatgatcagatatc

SEQ ID NO: 520495 - DNA, 20 bp, Artificial Sequence
  chemically synthesized
atccttggtatttgattatc

SEQ ID NO: 520496 - DNA, 20 bp, Artificial Sequence
  chemically synthesized
atccaggataatcaaatacc

SEQ ID NO: 520497 - DNA, 20 bp, Artificial Sequence
  chemically synthesized
aggataatcaaataccaagg

SEQ ID NO: 520498 - DNA, 20 bp, Artificial Sequence
  chemically synthesized
ctgctaaaactaaattttag

SEQ ID NO: 520499 - DNA, 20 bp, Artificial Sequence
  chemically synthesized
ctatgagaaggttgggaagc

SEQ ID NO: 520500 - DNA, 20 bp, Artificial Sequence
  chemically synthesized
actaacatagttaataaaca

SEQ ID NO: 520501 - DNA, 20 bp, Artificial Sequence
  chemically synthesized
cattttcataaatgaattac

SEQ ID NO: 520502 - DNA, 20 bp, Artificial Sequence
  chemically synthesized
tttgaaacacattttcataa

SEQ ID NO: 520503 - DNA, 20 bp, Artificial Sequence
  chemically synthesized
ccaccacgcctggtcgagac

SEQ ID NO: 520504 - DNA, 20 bp, Artificial Sequence
  chemically synthesized
actttaggaggcagaggcag

SEQ ID NO: 520505 - DNA, 20 bp, Artificial Sequence
  chemically synthesized
caggtggatcacctgaggtc

SEQ ID NO: 520506 - DNA, 20 bp, Artificial Sequence
  chemically synthesized
tttgtatttttagtagagaa

SEQ ID NO: 520507 - DNA, 20 bp, Artificial Sequence
  chemically synthesized
gcttcagcctcccggttagc

SEQ ID NO: 520508 - DNA, 20 bp, Artificial Sequence
  chemically synthesized
taaccgggaggctgaagcag

SEQ ID NO: 520509 - DNA, 20 bp, Artificial Sequence
  chemically synthesized
ttcactcttattgcccaggc

SEQ ID NO: 520510 - DNA, 20 bp, Artificial Sequence
  chemically synthesized
tgcattccagcctgggcaat

SEQ ID NO: 520511 - DNA, 20 bp, Artificial Sequence
  chemically synthesized
atacataactttcaaagaga

SEQ ID NO: 520512 - DNA, 20 bp, Artificial Sequence
  chemically synthesized
gtgacgtaggttcagaaaca

SEQ ID NO: 520513 - DNA, 20 bp, Artificial Sequence
  chemically synthesized
tttttaactacaaaacattt

SEQ ID NO: 520514 - DNA, 20 bp, Artificial Sequence
  chemically synthesized
aactacaaaacatttcaggg

SEQ ID NO: 520515 - DNA, 20 bp, Artificial Sequence
  chemically synthesized
taatttcatttccttcttta

SEQ ID NO: 520516 - DNA, 20 bp, Artificial Sequence
  chemically synthesized
gtttttcattcaacatctta

SEQ ID NO: 520517 - DNA, 20 bp, Artificial Sequence
  chemically synthesized
aacattgatcccgtaagatg

SEQ ID NO: 520518 - DNA, 20 bp, Artificial Sequence
  chemically synthesized
atgtataatttatataacgg

SEQ ID NO: 520519 - DNA, 20 bp, Artificial Sequence
  chemically synthesized
ttaaatgtataatttatata

SEQ ID NO: 520520 - DNA, 20 bp, Artificial Sequence
  chemically synthesized
tatataaattatacatttaa

SEQ ID NO: 520521 - DNA, 20 bp, Artificial Sequence
  chemically synthesized
tttttctcttggatataaaa

SEQ ID NO: 520522 - DNA, 20 bp, Artificial Sequence
  chemically synthesized
tcttttatatccaagagaaa

SEQ ID NO: 520523 - DNA, 20 bp, Artificial Sequence
  chemically synthesized
aacttaacattctttttctc

SEQ ID NO: 520524 - DNA, 20 bp, Artificial Sequence
  chemically synthesized
taatgtcatgcaagtgtcta

SEQ ID NO: 520525 - DNA, 20 bp, Artificial Sequence
  chemically synthesized
gcatgacattacatttgaaa

SEQ ID NO: 520526 - DNA, 20 bp, Artificial Sequence
  chemically synthesized
cagattttaagtggtggaaa

SEQ ID NO: 520527 - DNA, 20 bp, Artificial Sequence
  chemically synthesized
cttctccaaagctcatcact

SEQ ID NO: 520528 - DNA, 20 bp, Artificial Sequence
  chemically synthesized
tactaacctacaagtgtacc

SEQ ID NO: 520529 - DNA, 20 bp, Artificial Sequence
  chemically synthesized
tgatattgtaggcatattcg

SEQ ID NO: 520530 - DNA, 20 bp, Artificial Sequence
  chemically synthesized
actccatatatattgatcca

SEQ ID NO: 520531 - DNA, 20 bp, Artificial Sequence
  chemically synthesized
attcgatggatcaatatata

SEQ ID NO: 520532 - DNA, 20 bp, Artificial Sequence
  chemically synthesized
catcggggagaactgaatat

SEQ ID NO: 520533 - DNA, 20 bp, Artificial Sequence
  chemically synthesized
gattaaggcatcggggagaa

SEQ ID NO: 520534 - DNA, 20 bp, Artificial Sequence
  chemically synthesized
gttctccccgatgccttaat

SEQ ID NO: 520535 - DNA, 20 bp, Artificial Sequence
  chemically synthesized
ataatcctcttctgcagtgt

SEQ ID NO: 520536 - DNA, 20 bp, Artificial Sequence
  chemically synthesized
aagattcagacactgcagaa

SEQ ID NO: 520537 - DNA, 20 bp, Artificial Sequence
  chemically synthesized
acaggtacaaaaccgcatca

SEQ ID NO: 520538 - DNA, 20 bp, Artificial Sequence
  chemically synthesized
gctgacacaactttgtcccc

SEQ ID NO: 520539 - DNA, 20 bp, Artificial Sequence
  chemically synthesized
cagctatcgtctaaccatta

SEQ ID NO: 520540 - DNA, 20 bp, Artificial Sequence
  chemically synthesized
agaggtgtgtgggaaaccct

SEQ ID NO: 520541 - DNA, 20 bp, Artificial Sequence
  chemically synthesized
tgtgtgggaaaccctgagaa

SEQ ID NO: 520542 - DNA, 20 bp, Artificial Sequence
  chemically synthesized
gcaaatgcacaccccattct

SEQ ID NO: 520543 - DNA, 20 bp, Artificial Sequence
  chemically synthesized
gtgtgcatttgcccctagtt

SEQ ID NO: 520544 - DNA, 20 bp, Artificial Sequence
  chemically synthesized
agggtcaacgaaatctaagg

SEQ ID NO: 520545 - DNA, 20 bp, Artificial Sequence
  chemically synthesized
ctatagctctaaacctgtag

SEQ ID NO: 520546 - DNA, 20 bp, Artificial Sequence
  chemically synthesized
gtttagagctatagtctctt

SEQ ID NO: 520547 - DNA, 20 bp, Artificial Sequence
  chemically synthesized
tttaaaatgtcagggaaaaa

SEQ ID NO: 520548 - DNA, 20 bp, Artificial Sequence
  chemically synthesized
tattaactaagctttgcaaa

SEQ ID NO: 520549 - DNA, 20 bp, Artificial Sequence
  chemically synthesized
aagagacatgctcaagtgta

SEQ ID NO: 520550 - DNA, 20 bp, Artificial Sequence
  chemically synthesized
agaagagttgctatctaaag

SEQ ID NO: 520551 - DNA, 20 bp, Artificial Sequence
  chemically synthesized
aatacttacagatctatgag

SEQ ID NO: 520552 - DNA, 20 bp, Artificial Sequence
  chemically synthesized
gaaaatacacattttcagta

SEQ ID NO: 520553 - DNA, 20 bp, Artificial Sequence
  chemically synthesized
ggaaggattctttccttttc

SEQ ID NO: 520554 - DNA, 20 bp, Artificial Sequence
  chemically synthesized
gattgtattccagaaaagga

SEQ ID NO: 520555 - DNA, 20 bp, Artificial Sequence
  chemically synthesized
taatttgcccttatgaaagg

SEQ ID NO: 520556 - DNA, 20 bp, Artificial Sequence
  chemically synthesized
caaattaaaatgcaggaact

SEQ ID NO: 520557 - DNA, 20 bp, Artificial Sequence
  chemically synthesized
aatgcaggaactctgaattt

SEQ ID NO: 520558 - DNA, 20 bp, Artificial Sequence
  chemically synthesized
gaaaaacagactcccaaatt

SEQ ID NO: 520559 - DNA, 20 bp, Artificial Sequence
  chemically synthesized
ttgggagtctgtttttcaag

SEQ ID NO: 520560 - DNA, 20 bp, Artificial Sequence
  chemically synthesized
tgaataatcatctttggcaa

SEQ ID NO: 520561 - DNA, 20 bp, Artificial Sequence
  chemically synthesized
aattccttctgttgtgccat

SEQ ID NO: 520562 - DNA, 20 bp, Artificial Sequence
  chemically synthesized
gattcaaatggcacaacaga

SEQ ID NO: 520563 - DNA, 20 bp, Artificial Sequence
  chemically synthesized
aaatggcacaacagaaggaa

SEQ ID NO: 520564 - DNA, 20 bp, Artificial Sequence
  chemically synthesized
cagaaggaattgaattgata

SEQ ID NO: 520565 - DNA, 20 bp, Artificial Sequence
  chemically synthesized
ttgaattgatattgaataat

SEQ ID NO: 520566 - DNA, 20 bp, Artificial Sequence
  chemically synthesized
tcaaaaatagaggttggatc

SEQ ID NO: 520567 - DNA, 20 bp, Artificial Sequence
  chemically synthesized
tacatattcaaaaatagagg

SEQ ID NO: 520568 - DNA, 20 bp, Artificial Sequence
  chemically synthesized
tcttgatccaacctctattt

SEQ ID NO: 520569 - DNA, 20 bp, Artificial Sequence
  chemically synthesized
gttatgcaattatgcataat

SEQ ID NO: 520570 - DNA, 20 bp, Artificial Sequence
  chemically synthesized
caacaatatttgtttcttcc

SEQ ID NO: 520571 - DNA, 20 bp, Artificial Sequence
  chemically synthesized
ttgtttcttcctggaattca

SEQ ID NO: 520572 - DNA, 20 bp, Artificial Sequence
  chemically synthesized
aaaattgtagaataaactcc

SEQ ID NO: 520573 - DNA, 20 bp, Artificial Sequence
  chemically synthesized
ataaataaaaacaaaaattg

SEQ ID NO: 520574 - DNA, 20 bp, Artificial Sequence
  chemically synthesized
atctatttatttttgaaaga

SEQ ID NO: 520575 - DNA, 20 bp, Artificial Sequence
  chemically synthesized
tctcgttctgttgcccaggc

SEQ ID NO: 520576 - DNA, 20 bp, Artificial Sequence
  chemically synthesized
ctcactgcaacctccacctc

SEQ ID NO: 520577 - DNA, 20 bp, Artificial Sequence
  chemically synthesized
tactcgggaggctgaggcag

SEQ ID NO: 520578 - DNA, 20 bp, Artificial Sequence
  chemically synthesized
aattctcctgcctcagcctc

SEQ ID NO: 520579 - DNA, 20 bp, Artificial Sequence
  chemically synthesized
gcctcagcctcccgagtagc

SEQ ID NO: 520580 - DNA, 20 bp, Artificial Sequence
  chemically synthesized
ttttgtatttttagtagaga

SEQ ID NO: 520581 - DNA, 20 bp, Artificial Sequence
  chemically synthesized
cgggtggatcaccggaggcc

SEQ ID NO: 520582 - DNA, 20 bp, Artificial Sequence
  chemically synthesized
actttgggaggccgaggcgg

SEQ ID NO: 520583 - DNA, 20 bp, Artificial Sequence
  chemically synthesized
cagcactttgggaggccgag

SEQ ID NO: 520584 - DNA, 20 bp, Artificial Sequence
  chemically synthesized
gcctcggcctcccaaagtgc

SEQ ID NO: 520585 - DNA, 20 bp, Artificial Sequence
  chemically synthesized
tgctacctttctaaaaattg

SEQ ID NO: 520586 - DNA, 20 bp, Artificial Sequence
  chemically synthesized
gagtctgtgtggcacagatg

SEQ ID NO: 520587 - DNA, 20 bp, Artificial Sequence
  chemically synthesized
tcaaataagagtttcaaaac

SEQ ID NO: 520588 - DNA, 20 bp, Artificial Sequence
  chemically synthesized
tataactttctgtttcaaat

SEQ ID NO: 520589 - DNA, 20 bp, Artificial Sequence
  chemically synthesized
gcataagaggacactgcaca

SEQ ID NO: 520590 - DNA, 20 bp, Artificial Sequence
  chemically synthesized
atgtgtaaatttctacttaa

SEQ ID NO: 520591 - DNA, 20 bp, Artificial Sequence
  chemically synthesized
aatattgacctacaaataat

SEQ ID NO: 520592 - DNA, 20 bp, Artificial Sequence
  chemically synthesized
ctgtacttcatttttggaac

SEQ ID NO: 520593 - DNA, 20 bp, Artificial Sequence
  chemically synthesized
aattatcattgaaaatttgg

SEQ ID NO: 520594 - DNA, 20 bp, Artificial Sequence
  chemically synthesized
agtaaaatatgcatgtattt

SEQ ID NO: 520595 - DNA, 20 bp, Artificial Sequence
  chemically synthesized
tttgttgcaggtaagtcctg

SEQ ID NO: 520596 - DNA, 20 bp, Artificial Sequence
  chemically synthesized
ttaacattttaagggattta

SEQ ID NO: 520597 - DNA, 20 bp, Artificial Sequence
  chemically synthesized
cctcagtacttaacatttta

SEQ ID NO: 520598 - DNA, 20 bp, Artificial Sequence
  chemically synthesized
cccttaaaatgttaagtact

SEQ ID NO: 520599 - DNA, 20 bp, Artificial Sequence
  chemically synthesized
ataataattataatttttcc

SEQ ID NO: 520600 - DNA, 20 bp, Artificial Sequence
  chemically synthesized
attataatttttcctagaat

SEQ ID NO: 520601 - DNA, 20 bp, Artificial Sequence
  chemically synthesized
tcctagaatgagggtaaggc

SEQ ID NO: 520602 - DNA, 20 bp, Artificial Sequence
  chemically synthesized
tatgaaaacactaacaccgt

SEQ ID NO: 520603 - DNA, 20 bp, Artificial Sequence
  chemically synthesized
tcttaagggagaaccacttc

SEQ ID NO: 520604 - DNA, 20 bp, Artificial Sequence
  chemically synthesized
tcagccggggagcaaaacca

SEQ ID NO: 520605 - DNA, 20 bp, Artificial Sequence
  chemically synthesized
tacagaacatatgtctctag

SEQ ID NO: 520606 - DNA, 20 bp, Artificial Sequence
  chemically synthesized
taactatcagcaattagtga

SEQ ID NO: 520607 - DNA, 20 bp, Artificial Sequence
  chemically synthesized
aggggcaaagaactgcctct

SEQ ID NO: 520608 - DNA, 20 bp, Artificial Sequence
  chemically synthesized
gtgattcagttggtctgggg

SEQ ID NO: 520609 - DNA, 20 bp, Artificial Sequence
  chemically synthesized
cataccccaccccagaccaa

SEQ ID NO: 520610 - DNA, 20 bp, Artificial Sequence
  chemically synthesized
agatagtgattcagttggtc

SEQ ID NO: 520611 - DNA, 20 bp, Artificial Sequence
  chemically synthesized
gtgcgtgaagtggaaagtat

SEQ ID NO: 520612 - DNA, 20 bp, Artificial Sequence
  chemically synthesized
tcgtgtgtgcattttaatga

SEQ ID NO: 520613 - DNA, 20 bp, Artificial Sequence
  chemically synthesized
atatatatgtatatatgggc

SEQ ID NO: 520614 - DNA, 20 bp, Artificial Sequence
  chemically synthesized
cactactgtgccctatcaaa

SEQ ID NO: 520615 - DNA, 20 bp, Artificial Sequence
  chemically synthesized
caatgttacatgaaaaatga

SEQ ID NO: 520616 - DNA, 20 bp, Artificial Sequence
  chemically synthesized
tttattatactttttataca

SEQ ID NO: 520617 - DNA, 20 bp, Artificial Sequence
  chemically synthesized
ggtggcatttttgctataga

SEQ ID NO: 520618 - DNA, 20 bp, Artificial Sequence
  chemically synthesized
tagaggtggcatttttgcta

SEQ ID NO: 520619 - DNA, 20 bp, Artificial Sequence
  chemically synthesized
agagaaagaagtaacaatta

SEQ ID NO: 520620 - DNA, 20 bp, Artificial Sequence
  chemically synthesized
ttttcttggatgaaacaaaa

SEQ ID NO: 520621 - DNA, 20 bp, Artificial Sequence
  chemically synthesized
ataatagttaaatagttttc

SEQ ID NO: 520622 - DNA, 20 bp, Artificial Sequence
  chemically synthesized
attatatagtgatatgtaat

SEQ ID NO: 520623 - DNA, 20 bp, Artificial Sequence
  chemically synthesized
gctacagattgttgacacca

SEQ ID NO: 520624 - DNA, 20 bp, Artificial Sequence
  chemically synthesized
tagatgtaaacaaatgtaaa

SEQ ID NO: 520625 - DNA, 20 bp, Artificial Sequence
  chemically synthesized
ttaaataaatgaactaaata

SEQ ID NO: 520626 - DNA, 20 bp, Artificial Sequence
  chemically synthesized
acctcagcctcccaaagtgt

SEQ ID NO: 520627 - DNA, 20 bp, Artificial Sequence
  chemically synthesized
caacactttgggaggctgag

SEQ ID NO: 520628 - DNA, 20 bp, Artificial Sequence
  chemically synthesized
actttgggaggctgaggtgg

SEQ ID NO: 520629 - DNA, 20 bp, Artificial Sequence
  chemically synthesized
tgggtggatcacctgaagtc

SEQ ID NO: 520630 - DNA, 20 bp, Artificial Sequence
  chemically synthesized
ttttgtgtttttagtagaga

SEQ ID NO: 520631 - DNA, 20 bp, Artificial Sequence
  chemically synthesized
tacttgggagactgaggtgg

SEQ ID NO: 520632 - DNA, 20 bp, Artificial Sequence
  chemically synthesized
gcgccactgcacttcagcct

SEQ ID NO: 520633 - DNA, 20 bp, Artificial Sequence
  chemically synthesized
ataaaataaaataaaatgta

SEQ ID NO: 520634 - DNA, 20 bp, Artificial Sequence
  chemically synthesized
gactttcagttcttacttcg

SEQ ID NO: 520635 - DNA, 20 bp, Artificial Sequence
  chemically synthesized
tctacttctcagaagctctg

SEQ ID NO: 520636 - DNA, 20 bp, Artificial Sequence
  chemically synthesized
aattacattttatactaact

SEQ ID NO: 520637 - DNA, 20 bp, Artificial Sequence
  chemically synthesized
tattacagccaatcacaata

SEQ ID NO: 520638 - DNA, 20 bp, Artificial Sequence
  chemically synthesized
gttttccttgtaaatagact

SEQ ID NO: 520639 - DNA, 20 bp, Artificial Sequence
  chemically synthesized
tatttatggtcatatttggc

SEQ ID NO: 520640 - DNA, 20 bp, Artificial Sequence
  chemically synthesized
atgttaaatatttttatttg

SEQ ID NO: 520641 - DNA, 20 bp, Artificial Sequence
  chemically synthesized
taaagtgatattgtccctta

SEQ ID NO: 520642 - DNA, 20 bp, Artificial Sequence
  chemically synthesized
ttttgtatcacttaaaacat

SEQ ID NO: 520643 - DNA, 20 bp, Artificial Sequence
  chemically synthesized
ataggaattccaagcatata

SEQ ID NO: 520644 - DNA, 20 bp, Artificial Sequence
  chemically synthesized
aagaacacccattatatgct

SEQ ID NO: 520645 - DNA, 20 bp, Artificial Sequence
  chemically synthesized
tgctgtatgcctgctggcat

SEQ ID NO: 520646 - DNA, 20 bp, Artificial Sequence
  chemically synthesized
catctgtcatatagtgagat

SEQ ID NO: 520647 - DNA, 20 bp, Artificial Sequence
  chemically synthesized
cgacctggtgtaaaattcct

SEQ ID NO: 520648 - DNA, 20 bp, Artificial Sequence
  chemically synthesized
aacacacagttgtaattcta

SEQ ID NO: 520649 - DNA, 20 bp, Artificial Sequence
  chemically synthesized
gtgtttagacaataaaaccg

SEQ ID NO: 520650 - DNA, 20 bp, Artificial Sequence
  chemically synthesized
catttctcactctcctctaa

SEQ ID NO: 520651 - DNA, 20 bp, Artificial Sequence
  chemically synthesized
atattagcattcacttagag

SEQ ID NO: 520652 - DNA, 20 bp, Artificial Sequence
  chemically synthesized
gtgaatgctaatatgatttc

SEQ ID NO: 520653 - DNA, 20 bp, Artificial Sequence
  chemically synthesized
tataagaacatacatagcca

SEQ ID NO: 520654 - DNA, 20 bp, Artificial Sequence
  chemically synthesized
ccaccttaaaacaagttaca

SEQ ID NO: 520655 - DNA, 20 bp, Artificial Sequence
  chemically synthesized
gtaggtagctaagtattagg

SEQ ID NO: 520656 - DNA, 20 bp, Artificial Sequence
  chemically synthesized
tagctaagtattaggaaggg

SEQ ID NO: 520657 - DNA, 20 bp, Artificial Sequence
  chemically synthesized
tggaataatgtctaggaaac

SEQ ID NO: 520658 - DNA, 20 bp, Artificial Sequence
  chemically synthesized
gcctcggcctcccaaagtgc

SEQ ID NO: 520659 - DNA, 20 bp, Artificial Sequence
  chemically synthesized
cgggcagatcacttgaggtc

SEQ ID NO: 520660 - DNA, 20 bp, Artificial Sequence
  chemically synthesized
gcctcaccctcctgagtagc

SEQ ID NO: 520661 - DNA, 20 bp, Artificial Sequence
  chemically synthesized
ctgtaatcccagctactcag

SEQ ID NO: 520662 - DNA, 20 bp, Artificial Sequence
  chemically synthesized
gattctcatgcctcaccctc

SEQ ID NO: 520663 - DNA, 20 bp, Artificial Sequence
  chemically synthesized
tactcaggagggtgaggcat

SEQ ID NO: 520664 - DNA, 20 bp, Artificial Sequence
  chemically synthesized
tctcactgttttgtccaggc

SEQ ID NO: 520665 - DNA, 20 bp, Artificial Sequence
  chemically synthesized
ctttttttttttttttttga

SEQ ID NO: 520666 - DNA, 20 bp, Artificial Sequence
  chemically synthesized
actaatcttaggaagctggc

SEQ ID NO: 520667 - DNA, 20 bp, Artificial Sequence
  chemically synthesized
tcttaggaagctggctggag

SEQ ID NO: 520668 - DNA, 20 bp, Artificial Sequence
  chemically synthesized
ccccaacggtaccagcaatg

SEQ ID NO: 520669 - DNA, 20 bp, Artificial Sequence
  chemically synthesized
accataagaagatctaggag

SEQ ID NO: 520670 - DNA, 20 bp, Artificial Sequence
  chemically synthesized
agcacactaaaaggcctata

SEQ ID NO: 520671 - DNA, 20 bp, Artificial Sequence
  chemically synthesized
aaacctggcagaactttagg

SEQ ID NO: 520672 - DNA, 20 bp, Artificial Sequence
  chemically synthesized
agtgcacataaagcatgcat

SEQ ID NO: 520673 - DNA, 20 bp, Artificial Sequence
  chemically synthesized
attaacaccaacgattatgt

SEQ ID NO: 520674 - DNA, 20 bp, Artificial Sequence
  chemically synthesized
attctttagggggcctatgc

SEQ ID NO: 520675 - DNA, 20 bp, Artificial Sequence
  chemically synthesized
atccaagcataggcccccta

SEQ ID NO: 520676 - DNA, 20 bp, Artificial Sequence
  chemically synthesized
tccttctggttgtatcaggc

SEQ ID NO: 520677 - DNA, 20 bp, Artificial Sequence
  chemically synthesized
caatacaacatgaaaagtca

SEQ ID NO: 520678 - DNA, 20 bp, Artificial Sequence
  chemically synthesized
aagtggagaaattattttca

SEQ ID NO: 520679 - DNA, 20 bp, Artificial Sequence
  chemically synthesized
ctgtgaatagctgtcggtct

SEQ ID NO: 520680 - DNA, 20 bp, Artificial Sequence
  chemically synthesized
ttatgggtgtttgatggcct

SEQ ID NO: 520681 - DNA, 20 bp, Artificial Sequence
  chemically synthesized
gaaggatgacaaaggtcctt

SEQ ID NO: 520682 - DNA, 20 bp, Artificial Sequence
  chemically synthesized
tctctctactgaagtgattg

SEQ ID NO: 520683 - DNA, 20 bp, Artificial Sequence
  chemically synthesized
cctgcagacacttactgaac

SEQ ID NO: 520684 - DNA, 20 bp, Artificial Sequence
  chemically synthesized
ctgttcagtaagtgtctgca

SEQ ID NO: 520685 - DNA, 20 bp, Artificial Sequence
  chemically synthesized
agtgtctgcagggagttttt

SEQ ID NO: 520686 - DNA, 20 bp, Artificial Sequence
  chemically synthesized
gggagtttttcagagtgtgt

SEQ ID NO: 520687 - DNA, 20 bp, Artificial Sequence
  chemically synthesized
agaaccacgcacttgtagga

SEQ ID NO: 520688 - DNA, 20 bp, Artificial Sequence
  chemically synthesized
tgttcagaaccacgcacttg

SEQ ID NO: 520689 - DNA, 20 bp, Artificial Sequence
  chemically synthesized
aataacaatgaagatggaaa

SEQ ID NO: 520690 - DNA, 20 bp, Artificial Sequence
  chemically synthesized
tgttgaaaattctgtattta

SEQ ID NO: 520691 - DNA, 20 bp, Artificial Sequence
  chemically synthesized
ctgagttcactcattaaata

SEQ ID NO: 520692 - DNA, 20 bp, Artificial Sequence
  chemically synthesized
actctttgtgtctgcagtcg

SEQ ID NO: 520693 - DNA, 20 bp, Artificial Sequence
  chemically synthesized
actcagcgactgcagacaca

SEQ ID NO: 520694 - DNA, 20 bp, Artificial Sequence
  chemically synthesized
cgactgcagacacaaagagt

SEQ ID NO: 520695 - DNA, 20 bp, Artificial Sequence
  chemically synthesized
acacaaagagtgtggattct

SEQ ID NO: 520696 - DNA, 20 bp, Artificial Sequence
  chemically synthesized
aaggcttttataatcattcg

SEQ ID NO: 520697 - DNA, 20 bp, Artificial Sequence
  chemically synthesized
agaaataaatgattactaat

SEQ ID NO: 520698 - DNA, 20 bp, Artificial Sequence
  chemically synthesized
ccatctcttctttctttgcc

SEQ ID NO: 520699 - DNA, 20 bp, Artificial Sequence
  chemically synthesized
aatcaaagaggtgattttct

SEQ ID NO: 520700 - DNA, 20 bp, Artificial Sequence
  chemically synthesized
taaaaaaatgaatgaaacaa

SEQ ID NO: 520701 - DNA, 20 bp, Artificial Sequence
  chemically synthesized
ccaaacactgcactaaaaaa

SEQ ID NO: 520702 - DNA, 20 bp, Artificial Sequence
  chemically synthesized
caccgctcctggcctcgcta

SEQ ID NO: 520703 - DNA, 20 bp, Artificial Sequence
  chemically synthesized
gccttggcctcccaaagtgc

SEQ ID NO: 520704 - DNA, 20 bp, Artificial Sequence
  chemically synthesized
cagcactttgggaggccaag

SEQ ID NO: 520705 - DNA, 20 bp, Artificial Sequence
  chemically synthesized
actttgggaggccaaggcgg

SEQ ID NO: 520706 - DNA, 20 bp, Artificial Sequence
  chemically synthesized
cgggtggatcacctgagatc

SEQ ID NO: 520707 - DNA, 20 bp, Artificial Sequence
  chemically synthesized
ttttgtatttttagtagaga

SEQ ID NO: 520708 - DNA, 20 bp, Artificial Sequence
  chemically synthesized
aaaatacaaaaaaaaattat

SEQ ID NO: 520709 - DNA, 20 bp, Artificial Sequence
  chemically synthesized
acagctgcccgtcaccacac

SEQ ID NO: 520710 - DNA, 20 bp, Artificial Sequence
  chemically synthesized
gcctcagcttcccaagtagc

SEQ ID NO: 520711 - DNA, 20 bp, Artificial Sequence
  chemically synthesized
tacttgggaagctgaggcaa

SEQ ID NO: 520712 - DNA, 20 bp, Artificial Sequence
  chemically synthesized
ctcactgcaacctccacctc

SEQ ID NO: 520713 - DNA, 20 bp, Artificial Sequence
  chemically synthesized
tctggctctgtcgcccaggc

SEQ ID NO: 520714 - DNA, 20 bp, Artificial Sequence
  chemically synthesized
ttacttacttatttttgaga

SEQ ID NO: 520715 - DNA, 20 bp, Artificial Sequence
  chemically synthesized
attaacagttcatctcacta

SEQ ID NO: 520716 - DNA, 20 bp, Artificial Sequence
  chemically synthesized
tataatgagaatcagtatta

SEQ ID NO: 520717 - DNA, 20 bp, Artificial Sequence
  chemically synthesized
aagttacagtaatttataat

SEQ ID NO: 520718 - DNA, 20 bp, Artificial Sequence
  chemically synthesized
attttgttacaatttcgaga

SEQ ID NO: 520719 - DNA, 20 bp, Artificial Sequence
  chemically synthesized
tcgagaaagaattcaaaacc

SEQ ID NO: 520720 - DNA, 20 bp, Artificial Sequence
  chemically synthesized
tgttattcccattctgggtt

SEQ ID NO: 520721 - DNA, 20 bp, Artificial Sequence
  chemically synthesized
aagaattcaaaacccagaat

SEQ ID NO: 520722 - DNA, 20 bp, Artificial Sequence
  chemically synthesized
aggtctttgttattcccatt

SEQ ID NO: 520723 - DNA, 20 bp, Artificial Sequence
  chemically synthesized
tgggaataacaaagaccttt

SEQ ID NO: 520724 - DNA, 20 bp, Artificial Sequence
  chemically synthesized
gtttctcaaagaaagacccc

SEQ ID NO: 520725 - DNA, 20 bp, Artificial Sequence
  chemically synthesized
ctttacaagtcatgtattcc

SEQ ID NO: 520726 - DNA, 20 bp, Artificial Sequence
  chemically synthesized
gacttgtaaagacctaccag

SEQ ID NO: 520727 - DNA, 20 bp, Artificial Sequence
  chemically synthesized
cctaccagaagaatatcatt

SEQ ID NO: 520728 - DNA, 20 bp, Artificial Sequence
  chemically synthesized
tatcatttagaatggggctt

SEQ ID NO: 520729 - DNA, 20 bp, Artificial Sequence
  chemically synthesized
catttttaataagcattcta

SEQ ID NO: 520730 - DNA, 20 bp, Artificial Sequence
  chemically synthesized
tagaatacagcagaatcccc

SEQ ID NO: 520731 - DNA, 20 bp, Artificial Sequence
  chemically synthesized
tcccaaactctagaatacag

SEQ ID NO: 520732 - DNA, 20 bp, Artificial Sequence
  chemically synthesized
taggggattctgctgtattc

SEQ ID NO: 520733 - DNA, 20 bp, Artificial Sequence
  chemically synthesized
aggcagtccttcccaaactc

SEQ ID NO: 520734 - DNA, 20 bp, Artificial Sequence
  chemically synthesized
agtgattaattgatctaggc

SEQ ID NO: 520735 - DNA, 20 bp, Artificial Sequence
  chemically synthesized
tatttttctaagttctccca

SEQ ID NO: 520736 - DNA, 20 bp, Artificial Sequence
  chemically synthesized
ctttgccaaggaagtatgca

SEQ ID NO: 520737 - DNA, 20 bp, Artificial Sequence
  chemically synthesized
aatttaagagtgaaatgaaa

SEQ ID NO: 520738 - DNA, 20 bp, Artificial Sequence
  chemically synthesized
tgtattttttttctgaattt

SEQ ID NO: 520739 - DNA, 20 bp, Artificial Sequence
  chemically synthesized
gaattacatgtatttttttt

SEQ ID NO: 520740 - DNA, 20 bp, Artificial Sequence
  chemically synthesized
atccagtgataacgtttatt

SEQ ID NO: 520741 - DNA, 20 bp, Artificial Sequence
  chemically synthesized
attcaaaataaacgttatca

SEQ ID NO: 520742 - DNA, 20 bp, Artificial Sequence
  chemically synthesized
atatgtgcttatgtttccgt

SEQ ID NO: 520743 - DNA, 20 bp, Artificial Sequence
  chemically synthesized
catacctaagtaaaccatat

SEQ ID NO: 520744 - DNA, 20 bp, Artificial Sequence
  chemically synthesized
tcagtgaagctttttccctt

SEQ ID NO: 520745 - DNA, 20 bp, Artificial Sequence
  chemically synthesized
tgaagctttttcccttaagg

SEQ ID NO: 520746 - DNA, 20 bp, Artificial Sequence
  chemically synthesized
tggaggtctacaagtcaagg

SEQ ID NO: 520747 - DNA, 20 bp, Artificial Sequence
  chemically synthesized
tccatttcctctctagttat

SEQ ID NO: 520748 - DNA, 20 bp, Artificial Sequence
  chemically synthesized
aaagcaagccatttttgcag

SEQ ID NO: 520749 - DNA, 20 bp, Artificial Sequence
  chemically synthesized
ttaaaaaaatacaatggtaa

SEQ ID NO: 520750 - DNA, 20 bp, Artificial Sequence
  chemically synthesized
aagaaggagactgatttccc

SEQ ID NO: 520751 - DNA, 20 bp, Artificial Sequence
  chemically synthesized
aggaatagtatgtaaattgg

SEQ ID NO: 520752 - DNA, 20 bp, Artificial Sequence
  chemically synthesized
aaaattgaaagaatgacact

SEQ ID NO: 520753 - DNA, 20 bp, Artificial Sequence
  chemically synthesized
aattctggttgaaaaattga

SEQ ID NO: 520754 - DNA, 20 bp, Artificial Sequence
  chemically synthesized
cattctttcaatttttcaac

SEQ ID NO: 520755 - DNA, 20 bp, Artificial Sequence
  chemically synthesized
aaagcatgttttctgtgtat

SEQ ID NO: 520756 - DNA, 20 bp, Artificial Sequence
  chemically synthesized
aaacatgcttttcttgtttc

SEQ ID NO: 520757 - DNA, 20 bp, Artificial Sequence
  chemically synthesized
taggctataattgctcatta

SEQ ID NO: 520758 - DNA, 20 bp, Artificial Sequence
  chemically synthesized
tgctcattttcccaaaatca

SEQ ID NO: 520759 - DNA, 20 bp, Artificial Sequence
  chemically synthesized
taccttggaatacattgcct

SEQ ID NO: 520760 - DNA, 20 bp, Artificial Sequence
  chemically synthesized
gattattctgtgagctacct

SEQ ID NO: 520761 - DNA, 20 bp, Artificial Sequence
  chemically synthesized
atgtattccaaggtagctca

SEQ ID NO: 520762 - DNA, 20 bp, Artificial Sequence
  chemically synthesized
aaggtagctcacagaataat

SEQ ID NO: 520763 - DNA, 20 bp, Artificial Sequence
  chemically synthesized
acagaataatcaggatttaa

SEQ ID NO: 520764 - DNA, 20 bp, Artificial Sequence
  chemically synthesized
tgggctaagtattatggtta

SEQ ID NO: 520765 - DNA, 20 bp, Artificial Sequence
  chemically synthesized
caggaattttagtgtttttc

SEQ ID NO: 520766 - DNA, 20 bp, Artificial Sequence
  chemically synthesized
caagaaaaacactaaaattc

SEQ ID NO: 520767 - DNA, 20 bp, Artificial Sequence
  chemically synthesized
atattgcctgtaagggatcc

SEQ ID NO: 520768 - DNA, 20 bp, Artificial Sequence
  chemically synthesized
ttaagtaaatattgcctgta

SEQ ID NO: 520769 - DNA, 20 bp, Artificial Sequence
  chemically synthesized
tatagtagagaaggactttt

SEQ ID NO: 520770 - DNA, 20 bp, Artificial Sequence
  chemically synthesized
tgtttacctttcagcttgag

SEQ ID NO: 520771 - DNA, 20 bp, Artificial Sequence
  chemically synthesized
caagctgaaaggtaaacaaa

SEQ ID NO: 520772 - DNA, 20 bp, Artificial Sequence
  chemically synthesized
caagccatatcaacaatctt

SEQ ID NO: 520773 - DNA, 20 bp, Artificial Sequence
  chemically synthesized
atcttttttcaaaattatgc

SEQ ID NO: 520774 - DNA, 20 bp, Artificial Sequence
  chemically synthesized
taatatcaaaaagatggggg

SEQ ID NO: 520775 - DNA, 20 bp, Artificial Sequence
  chemically synthesized
tagatgagattttaacatat

SEQ ID NO: 520776 - DNA, 20 bp, Artificial Sequence
  chemically synthesized
aataaatgattattcactta

SEQ ID NO: 520777 - DNA, 20 bp, Artificial Sequence
  chemically synthesized
catatctgtttactctgtaa

SEQ ID NO: 520778 - DNA, 20 bp, Artificial Sequence
  chemically synthesized
gtgcaataaaaaatgttgtc

SEQ ID NO: 520779 - DNA, 20 bp, Artificial Sequence
  chemically synthesized
gagctgtcagtcatagtgct

SEQ ID NO: 520780 - DNA, 20 bp, Artificial Sequence
  chemically synthesized
agctcttactgcatcaatag

SEQ ID NO: 520781 - DNA, 20 bp, Artificial Sequence
  chemically synthesized
tgtctattaagcatcaacct

SEQ ID NO: 520782 - DNA, 20 bp, Artificial Sequence
  chemically synthesized
tgttctttacataagatcaa

SEQ ID NO: 520783 - DNA, 20 bp, Artificial Sequence
  chemically synthesized
gtaaaagaaaaaaattaaaa

SEQ ID NO: 520784 - DNA, 20 bp, Artificial Sequence
  chemically synthesized
aaaaatctagttccttcttc

SEQ ID NO: 520785 - DNA, 20 bp, Artificial Sequence
  chemically synthesized
agagagagagagagagagag

SEQ ID NO: 520786 - DNA, 20 bp, Artificial Sequence
  chemically synthesized
gtttctttacttcttaaata

SEQ ID NO: 520787 - DNA, 20 bp, Artificial Sequence
  chemically synthesized
aagcatcttttttcaagcgg

SEQ ID NO: 520788 - DNA, 20 bp, Artificial Sequence
  chemically synthesized
aacacaattattctaagatg

SEQ ID NO: 520789 - DNA, 20 bp, Artificial Sequence
  chemically synthesized
cttgtcaatattcgccatct

SEQ ID NO: 520790 - DNA, 20 bp, Artificial Sequence
  chemically synthesized
aagatggcgaatattgacaa

SEQ ID NO: 520791 - DNA, 20 bp, Artificial Sequence
  chemically synthesized
gaaaaaagggcccccttagc

SEQ ID NO: 520792 - DNA, 20 bp, Artificial Sequence
  chemically synthesized
aaagggcccccttagcctga

SEQ ID NO: 520793 - DNA, 20 bp, Artificial Sequence
  chemically synthesized
tagcctgaatgaatagacca

SEQ ID NO: 520794 - DNA, 20 bp, Artificial Sequence
  chemically synthesized
caatgagtatgtaggaaggg

SEQ ID NO: 520795 - DNA, 20 bp, Artificial Sequence
  chemically synthesized
tctttgtataatagagagca

SEQ ID NO: 520796 - DNA, 20 bp, Artificial Sequence
  chemically synthesized
aagaacattatacttgaagt

SEQ ID NO: 520797 - DNA, 20 bp, Artificial Sequence
  chemically synthesized
tatacttgaagttagaatac

SEQ ID NO: 520798 - DNA, 20 bp, Artificial Sequence
  chemically synthesized
tgaagttagaatacctgggt

SEQ ID NO: 520799 - DNA, 20 bp, Artificial Sequence
  chemically synthesized
ggaaactgagcacaaagagg

SEQ ID NO: 520800 - DNA, 20 bp, Artificial Sequence
  chemically synthesized
acctcggcctcccaaagtgc

SEQ ID NO: 520801 - DNA, 20 bp, Artificial Sequence
  chemically synthesized
gtggcagatgacttgaggcc

SEQ ID NO: 520802 - DNA, 20 bp, Artificial Sequence
  chemically synthesized
ttttgtatttttagtggaaa

SEQ ID NO: 520803 - DNA, 20 bp, Artificial Sequence
  chemically synthesized
tctcactctgttgcccaggc

SEQ ID NO: 520804 - DNA, 20 bp, Artificial Sequence
  chemically synthesized
cttcactccagcctgggcaa

SEQ ID NO: 520805 - DNA, 20 bp, Artificial Sequence
  chemically synthesized
ttttttttttttaatcagga

SEQ ID NO: 520806 - DNA, 20 bp, Artificial Sequence
  chemically synthesized
ttaaaaaaaaaaaaaaaaaa

SEQ ID NO: 520807 - DNA, 20 bp, Artificial Sequence
  chemically synthesized
atctgaatctccaattagcc

SEQ ID NO: 520808 - DNA, 20 bp, Artificial Sequence
  chemically synthesized
tttcctatgcattatcaaat

SEQ ID NO: 520809 - DNA, 20 bp, Artificial Sequence
  chemically synthesized
taaggtgtcttatagtgtac

SEQ ID NO: 520810 - DNA, 20 bp, Artificial Sequence
  chemically synthesized
tgatgtaataataatggtat

SEQ ID NO: 520811 - DNA, 20 bp, Artificial Sequence
  chemically synthesized
agtgaaaaaatacaacttac

SEQ ID NO: 520812 - DNA, 20 bp, Artificial Sequence
  chemically synthesized
caagagttcagctgagctta

SEQ ID NO: 520813 - DNA, 20 bp, Artificial Sequence
  chemically synthesized
caacaatgattgggcttcaa

SEQ ID NO: 520814 - DNA, 20 bp, Artificial Sequence
  chemically synthesized
agtaaaactggatatataat

SEQ ID NO: 520815 - DNA, 20 bp, Artificial Sequence
  chemically synthesized
atttaatggcgtaagtaaaa

SEQ ID NO: 520816 - DNA, 20 bp, Artificial Sequence
  chemically synthesized
agttttacttacgccattaa

SEQ ID NO: 520817 - DNA, 20 bp, Artificial Sequence
  chemically synthesized
gccattaaatgaattttaaa

SEQ ID NO: 520818 - DNA, 20 bp, Artificial Sequence
  chemically synthesized
tttaaattttttatgagata

SEQ ID NO: 520819 - DNA, 20 bp, Artificial Sequence
  chemically synthesized
ctgtaccgggtaagatgcaa

SEQ ID NO: 520820 - DNA, 20 bp, Artificial Sequence
  chemically synthesized
gttaattgagtttgactgta

SEQ ID NO: 520821 - DNA, 20 bp, Artificial Sequence
  chemically synthesized
ttgccagtctgaatagttaa

SEQ ID NO: 520822 - DNA, 20 bp, Artificial Sequence
  chemically synthesized
gtaaaagatgctttgccagt

SEQ ID NO: 520823 - DNA, 20 bp, Artificial Sequence
  chemically synthesized
aatagtacaatcttttcact

SEQ ID NO: 520824 - DNA, 20 bp, Artificial Sequence
  chemically synthesized
gtcctctaaatggcactaaa

SEQ ID NO: 520825 - DNA, 20 bp, Artificial Sequence
  chemically synthesized
aaaatctactaaatggaaca

SEQ ID NO: 520826 - DNA, 20 bp, Artificial Sequence
  chemically synthesized
gccttggcctcccaaagtgc

SEQ ID NO: 520827 - DNA, 20 bp, Artificial Sequence
  chemically synthesized
actttgggaggccaaggcag

SEQ ID NO: 520828 - DNA, 20 bp, Artificial Sequence
  chemically synthesized
caggcggatcacctgaggtc

SEQ ID NO: 520829 - DNA, 20 bp, Artificial Sequence
  chemically synthesized
ttttgtatttttagtagaga

SEQ ID NO: 520830 - DNA, 20 bp, Artificial Sequence
  chemically synthesized
acctcagcctcccgagtagc

SEQ ID NO: 520831 - DNA, 20 bp, Artificial Sequence
  chemically synthesized
gattctcctacctcagcctc

SEQ ID NO: 520832 - DNA, 20 bp, Artificial Sequence
  chemically synthesized
tactcgggaggctgaggtag

SEQ ID NO: 520833 - DNA, 20 bp, Artificial Sequence
  chemically synthesized
ttcactcttatcgcccaggc

SEQ ID NO: 520834 - DNA, 20 bp, Artificial Sequence
  chemically synthesized
tgcactccagcctgggcgat

SEQ ID NO: 520835 - DNA, 20 bp, Artificial Sequence
  chemically synthesized
tttgtttttggtttttgaaa

SEQ ID NO: 520836 - DNA, 20 bp, Artificial Sequence
  chemically synthesized
ctgggcacagataattacac

SEQ ID NO: 520837 - DNA, 20 bp, Artificial Sequence
  chemically synthesized
ttacttttagacatctctaa

SEQ ID NO: 520838 - DNA, 20 bp, Artificial Sequence
  chemically synthesized
ataaaaattccaaatttctc

SEQ ID NO: 520839 - DNA, 20 bp, Artificial Sequence
  chemically synthesized
aaagtaattcctgagaaatt

SEQ ID NO: 520840 - DNA, 20 bp, Artificial Sequence
  chemically synthesized
ggaatttttattgaacatgt

SEQ ID NO: 520841 - DNA, 20 bp, Artificial Sequence
  chemically synthesized
gaatcttctctaaataactt

SEQ ID NO: 520842 - DNA, 20 bp, Artificial Sequence
  chemically synthesized
cctgtaaatgcaccattgat

SEQ ID NO: 520843 - DNA, 20 bp, Artificial Sequence
  chemically synthesized
accattgatttggataatgg

SEQ ID NO: 520844 - DNA, 20 bp, Artificial Sequence
  chemically synthesized
ataatggtggaatctagctg

SEQ ID NO: 520845 - DNA, 20 bp, Artificial Sequence
  chemically synthesized
taaaaggtcataaggcctcc

SEQ ID NO: 520846 - DNA, 20 bp, Artificial Sequence
  chemically synthesized
cggtgagcatttcatcagtt

SEQ ID NO: 520847 - DNA, 20 bp, Artificial Sequence
  chemically synthesized
agcatttcatcagtttggag

SEQ ID NO: 520848 - DNA, 20 bp, Artificial Sequence
  chemically synthesized
cttttctcaactcaggtaaa

SEQ ID NO: 520849 - DNA, 20 bp, Artificial Sequence
  chemically synthesized
cttggtcaaattctttttac

SEQ ID NO: 520850 - DNA, 20 bp, Artificial Sequence
  chemically synthesized
acctcaaaggaaaatggccg

SEQ ID NO: 520851 - DNA, 20 bp, Artificial Sequence
  chemically synthesized
tctaaattttctggccaaat

SEQ ID NO: 520852 - DNA, 20 bp, Artificial Sequence
  chemically synthesized
ataacattaaaaagaaattt

SEQ ID NO: 520853 - DNA, 20 bp, Artificial Sequence
  chemically synthesized
tttttattcagtagatatca

SEQ ID NO: 520854 - DNA, 20 bp, Artificial Sequence
  chemically synthesized
aaattatccagtgatatcta

SEQ ID NO: 520855 - DNA, 20 bp, Artificial Sequence
  chemically synthesized
aactgaacaattggtatact

SEQ ID NO: 520856 - DNA, 20 bp, Artificial Sequence
  chemically synthesized
aatatgtcacagctctaggt

SEQ ID NO: 520857 - DNA, 20 bp, Artificial Sequence
  chemically synthesized
acaattaaacatgtccctct

SEQ ID NO: 520858 - DNA, 20 bp, Artificial Sequence
  chemically synthesized
aaattttgcctatttttaaa

SEQ ID NO: 520859 - DNA, 20 bp, Artificial Sequence
  chemically synthesized
ttctccactttgtatgtaag

SEQ ID NO: 520860 - DNA, 20 bp, Artificial Sequence
  chemically synthesized
ccactttgtatgtaaggaga

SEQ ID NO: 520861 - DNA, 20 bp, Artificial Sequence
  chemically synthesized
actgccaataagtttgaaga

SEQ ID NO: 520862 - DNA, 20 bp, Artificial Sequence
  chemically synthesized
ttggagaggcaaactgaggt

SEQ ID NO: 520863 - DNA, 20 bp, Artificial Sequence
  chemically synthesized
ctcaggaactataccaagcc

SEQ ID NO: 520864 - DNA, 20 bp, Artificial Sequence
  chemically synthesized
acctcagcctcccaaagtgc

SEQ ID NO: 520865 - DNA, 20 bp, Artificial Sequence
  chemically synthesized
cagcactttgggaggctgag

SEQ ID NO: 520866 - DNA, 20 bp, Artificial Sequence
  chemically synthesized
actttgggaggctgaggtgg

SEQ ID NO: 520867 - DNA, 20 bp, Artificial Sequence
  chemically synthesized
tgggtgggtcacctgaggtc

SEQ ID NO: 520868 - DNA, 20 bp, Artificial Sequence
  chemically synthesized
ttttgtgtttttagtagaga

SEQ ID NO: 520869 - DNA, 20 bp, Artificial Sequence
  chemically synthesized
aaaattagccgggcttggtg

SEQ ID NO: 520870 - DNA, 20 bp, Artificial Sequence
  chemically synthesized
gcctcagcctctcgagtagc

SEQ ID NO: 520871 - DNA, 20 bp, Artificial Sequence
  chemically synthesized
gattctcctgcctcagcctc

SEQ ID NO: 520872 - DNA, 20 bp, Artificial Sequence
  chemically synthesized
tactcgagaggctgaggcag

SEQ ID NO: 520873 - DNA, 20 bp, Artificial Sequence
  chemically synthesized
tttgctctcgttgtccagga

SEQ ID NO: 520874 - DNA, 20 bp, Artificial Sequence
  chemically synthesized
agagttttgctctcgttgtc

SEQ ID NO: 520875 - DNA, 20 bp, Artificial Sequence
  chemically synthesized
atttatttatttatttgaga

SEQ ID NO: 520876 - DNA, 20 bp, Artificial Sequence
  chemically synthesized
gggactcaaatatagaagta

SEQ ID NO: 520877 - DNA, 20 bp, Artificial Sequence
  chemically synthesized
aggactccgtacttctatat

SEQ ID NO: 520878 - DNA, 20 bp, Artificial Sequence
  chemically synthesized
acttctatatttgagtccct

SEQ ID NO: 520879 - DNA, 20 bp, Artificial Sequence
  chemically synthesized
caagattgaaaaactaactt

SEQ ID NO: 520880 - DNA, 20 bp, Artificial Sequence
  chemically synthesized
gcggctgggattggccaaga

SEQ ID NO: 520881 - DNA, 20 bp, Artificial Sequence
  chemically synthesized
actggctgaagaatggcggc

SEQ ID NO: 520882 - DNA, 20 bp, Artificial Sequence
  chemically synthesized
cagcagtgtataactggctg

SEQ ID NO: 520883 - DNA, 20 bp, Artificial Sequence
  chemically synthesized
gaagtgagatgcagaaacag

SEQ ID NO: 520884 - DNA, 20 bp, Artificial Sequence
  chemically synthesized
ctccaggggtgccttgtggt

SEQ ID NO: 520885 - DNA, 20 bp, Artificial Sequence
  chemically synthesized
ttctgaccacaaggcacccc

SEQ ID NO: 520886 - DNA, 20 bp, Artificial Sequence
  chemically synthesized
agcagattcagagagactcc

SEQ ID NO: 520887 - DNA, 20 bp, Artificial Sequence
  chemically synthesized
aaggcacccctggagtctct

SEQ ID NO: 520888 - DNA, 20 bp, Artificial Sequence
  chemically synthesized
tttgcgaatcaggcagccct

SEQ ID NO: 520889 - DNA, 20 bp, Artificial Sequence
  chemically synthesized
aattgagcaatgaacgattt

SEQ ID NO: 520890 - DNA, 20 bp, Artificial Sequence
  chemically synthesized
ttgagccaaattaaagttaa

SEQ ID NO: 520891 - DNA, 20 bp, Artificial Sequence
  chemically synthesized
catagcaaccactgaatcaa

SEQ ID NO: 520892 - DNA, 20 bp, Artificial Sequence
  chemically synthesized
tagtgaaaccatagcaacca

SEQ ID NO: 520893 - DNA, 20 bp, Artificial Sequence
  chemically synthesized
actgggggttaaattttgga

SEQ ID NO: 520894 - DNA, 20 bp, Artificial Sequence
  chemically synthesized
cctctcaatactgccacact

SEQ ID NO: 520895 - DNA, 20 bp, Artificial Sequence
  chemically synthesized
gggaggcctttaagaggcac

SEQ ID NO: 520896 - DNA, 20 bp, Artificial Sequence
  chemically synthesized
atcatgaaagttctgcccta

SEQ ID NO: 520897 - DNA, 20 bp, Artificial Sequence
  chemically synthesized
agttctgccctaatggatta

SEQ ID NO: 520898 - DNA, 20 bp, Artificial Sequence
  chemically synthesized
cctaatggattaatgagtta

SEQ ID NO: 520899 - DNA, 20 bp, Artificial Sequence
  chemically synthesized
atggattaatgcattatcat

SEQ ID NO: 520900 - DNA, 20 bp, Artificial Sequence
  chemically synthesized
caggccattgggaccctgta

SEQ ID NO: 520901 - DNA, 20 bp, Artificial Sequence
  chemically synthesized
ttgctggtgggaactctcta

SEQ ID NO: 520902 - DNA, 20 bp, Artificial Sequence
  chemically synthesized
gagaaaatgatggaagtgaa

SEQ ID NO: 520903 - DNA, 20 bp, Artificial Sequence
  chemically synthesized
ttgaaggctaaaggcaagag

SEQ ID NO: 520904 - DNA, 20 bp, Artificial Sequence
  chemically synthesized
agttagcttggcataagccc

SEQ ID NO: 520905 - DNA, 20 bp, Artificial Sequence
  chemically synthesized
cattagctctacaaacgcgg

SEQ ID NO: 520906 - DNA, 20 bp, Artificial Sequence
  chemically synthesized
atgagagaccaccaggctag

SEQ ID NO: 520907 - DNA, 20 bp, Artificial Sequence
  chemically synthesized
cctgtatgtctacaccgcag

SEQ ID NO: 520908 - DNA, 20 bp, Artificial Sequence
  chemically synthesized
tctgctgcggtgtagacata

SEQ ID NO: 520909 - DNA, 20 bp, Artificial Sequence
  chemically synthesized
gtcgcgtgtcttgtgacctc

SEQ ID NO: 520910 - DNA, 20 bp, Artificial Sequence
  chemically synthesized
acaatagtgatgttgtctgc

SEQ ID NO: 520911 - DNA, 20 bp, Artificial Sequence
  chemically synthesized
ggcaagggtcctcctgtgca

SEQ ID NO: 520912 - DNA, 20 bp, Artificial Sequence
  chemically synthesized
gcaatcataggactgtgggc

SEQ ID NO: 520913 - DNA, 20 bp, Artificial Sequence
  chemically synthesized
ggtgcttgctgctgactggt

SEQ ID NO: 520914 - DNA, 20 bp, Artificial Sequence
  chemically synthesized
ctcctcaagaagtctgaggc

SEQ ID NO: 520915 - DNA, 20 bp, Artificial Sequence
  chemically synthesized
gacttcttgaggagactgat

SEQ ID NO: 520916 - DNA, 20 bp, Artificial Sequence
  chemically synthesized
ccaccagctaagcagaagat

SEQ ID NO: 520917 - DNA, 20 bp, Artificial Sequence
  chemically synthesized
aagacaagggaattgcaatg

SEQ ID NO: 520918 - DNA, 20 bp, Artificial Sequence
  chemically synthesized
gagctgatttatcaagacaa

SEQ ID NO: 520919 - DNA, 20 bp, Artificial Sequence
  chemically synthesized
ttcttacagttatggaggct

SEQ ID NO: 520920 - DNA, 20 bp, Artificial Sequence
  chemically synthesized
catttgctgttgctataaaa

SEQ ID NO: 520921 - DNA, 20 bp, Artificial Sequence
  chemically synthesized
ctgttttatagcaacagcaa

SEQ ID NO: 520922 - DNA, 20 bp, Artificial Sequence
  chemically synthesized
aatgaattaataccgagcaa

SEQ ID NO: 520923 - DNA, 20 bp, Artificial Sequence
  chemically synthesized
caaatgaattaataccgtat

SEQ ID NO: 520924 - DNA, 20 bp, Artificial Sequence
  chemically synthesized
tgcaatggtggtttcaatac

SEQ ID NO: 520925 - DNA, 20 bp, Artificial Sequence
  chemically synthesized
cctggggcttagatgcaaga

SEQ ID NO: 520926 - DNA, 20 bp, Artificial Sequence
  chemically synthesized
ggctgtccttgctcattcct

SEQ ID NO: 520927 - DNA, 20 bp, Artificial Sequence
  chemically synthesized
agttatttcagcttaccccc

SEQ ID NO: 520928 - DNA, 20 bp, Artificial Sequence
  chemically synthesized
gaaggaggttggttttgggg

SEQ ID NO: 520929 - DNA, 20 bp, Artificial Sequence
  chemically synthesized
ttttgcagaccctgcactcg

SEQ ID NO: 520930 - DNA, 20 bp, Artificial Sequence
  chemically synthesized
accagttgatccatcgagtg

SEQ ID NO: 520931 - DNA, 20 bp, Artificial Sequence
  chemically synthesized
gtgtggtaccagttgatcca

SEQ ID NO: 520932 - DNA, 20 bp, Artificial Sequence
  chemically synthesized
agttcctgagtggggggtca

SEQ ID NO: 520933 - DNA, 20 bp, Artificial Sequence
  chemically synthesized
cctgagtcagttcctgagtg

SEQ ID NO: 520934 - DNA, 20 bp, Artificial Sequence
  chemically synthesized
gtcttgccctgagtcagttc

SEQ ID NO: 520935 - DNA, 20 bp, Artificial Sequence
  chemically synthesized
ggagtcaaagctgtcttgcc

SEQ ID NO: 520936 - DNA, 20 bp, Artificial Sequence
  chemically synthesized
ggatcagagatgaaatcata

SEQ ID NO: 520937 - DNA, 20 bp, Artificial Sequence
  chemically synthesized
tggtcagaagtaatgattgg

SEQ ID NO: 520938 - DNA, 20 bp, Artificial Sequence
  chemically synthesized
gggtttttaaggacaatttg

SEQ ID NO: 520939 - DNA, 20 bp, Artificial Sequence
  chemically synthesized
ctccctgagcatttggggac

SEQ ID NO: 520940 - DNA, 20 bp, Artificial Sequence
  chemically synthesized
aaatgctcagggagactgat

SEQ ID NO: 520941 - DNA, 20 bp, Artificial Sequence
  chemically synthesized
gagcaggctgtatgggagac

SEQ ID NO: 520942 - DNA, 20 bp, Artificial Sequence
  chemically synthesized
tcccatacagcctgctctgc

SEQ ID NO: 520943 - DNA, 20 bp, Artificial Sequence
  chemically synthesized
cagggaaattgcaatagaga

SEQ ID NO: 520944 - DNA, 20 bp, Artificial Sequence
  chemically synthesized
tgataaatcaactctgtcta

SEQ ID NO: 520945 - DNA, 20 bp, Artificial Sequence
  chemically synthesized
caccttgcccactctctaga

SEQ ID NO: 520946 - DNA, 20 bp, Artificial Sequence
  chemically synthesized
ttaaaattacatacaagatg

SEQ ID NO: 520947 - DNA, 20 bp, Artificial Sequence
  chemically synthesized
acatcttgtatgtaatttta

SEQ ID NO: 520948 - DNA, 20 bp, Artificial Sequence
  chemically synthesized
tatgtaattttaagggatgc

SEQ ID NO: 520949 - DNA, 20 bp, Artificial Sequence
  chemically synthesized
cctaaagttctagtttattt

SEQ ID NO: 520950 - DNA, 20 bp, Artificial Sequence
  chemically synthesized
cccaaaataaactagaactt

SEQ ID NO: 520951 - DNA, 20 bp, Artificial Sequence
  chemically synthesized
aaactagaactttagggtga

SEQ ID NO: 520952 - DNA, 20 bp, Artificial Sequence
  chemically synthesized
ctgggggctaagcaggtttg

SEQ ID NO: 520953 - DNA, 20 bp, Artificial Sequence
  chemically synthesized
tttgtttgtttttgtttttc

SEQ ID NO: 520954 - DNA, 20 bp, Artificial Sequence
  chemically synthesized
gctatataaacgttacattt

SEQ ID NO: 520955 - DNA, 20 bp, Artificial Sequence
  chemically synthesized
cggctctgtccaggcagcag

SEQ ID NO: 520956 - DNA, 20 bp, Artificial Sequence
  chemically synthesized
attgcaattcccctgtcttg

SEQ ID NO: 520957 - DNA, 20 bp, Artificial Sequence
  chemically synthesized
gagccgattcatcaagacag

SEQ ID NO: 520958 - DNA, 20 bp, Artificial Sequence
  chemically synthesized
caggggaattgcaatagaga

SEQ ID NO: 520959 - DNA, 20 bp, Artificial Sequence
  chemically synthesized
tcccgcacagctggctctga

SEQ ID NO: 520960 - DNA, 20 bp, Artificial Sequence
  chemically synthesized
gaatgcttggggagactgat

SEQ ID NO: 520961 - DNA, 20 bp, Artificial Sequence
  chemically synthesized
ctccccaagcattcggggag

SEQ ID NO: 520962 - DNA, 20 bp, Artificial Sequence
  chemically synthesized
atccttaaaaactctgctcc

SEQ ID NO: 520963 - DNA, 20 bp, Artificial Sequence
  chemically synthesized
attcggggagcagagttttt

SEQ ID NO: 520964 - DNA, 20 bp, Artificial Sequence
  chemically synthesized
gagtttttaaggataacttg

SEQ ID NO: 520965 - DNA, 20 bp, Artificial Sequence
  chemically synthesized
tggggggaagccagtgagcc

SEQ ID NO: 520966 - DNA, 20 bp, Artificial Sequence
  chemically synthesized
tggtcagagatgaaatcaca

SEQ ID NO: 520967 - DNA, 20 bp, Artificial Sequence
  chemically synthesized
gtcggagctgtcttcttgcg

SEQ ID NO: 520968 - DNA, 20 bp, Artificial Sequence
  chemically synthesized
ttcttgcgctgagtcagttc

SEQ ID NO: 520969 - DNA, 20 bp, Artificial Sequence
  chemically synthesized
agatgagccagtttattgat

SEQ ID NO: 520970 - DNA, 20 bp, Artificial Sequence
  chemically synthesized
gccagctgatccatcaagtg

SEQ ID NO: 520971 - DNA, 20 bp, Artificial Sequence
  chemically synthesized
ttttgcagaccctgcacttg

SEQ ID NO: 520972 - DNA, 20 bp, Artificial Sequence
  chemically synthesized
gatcttaggagcagtttggt

SEQ ID NO: 520973 - DNA, 20 bp, Artificial Sequence
  chemically synthesized
aggagcagtttggtgggggt

SEQ ID NO: 520974 - DNA, 20 bp, Artificial Sequence
  chemically synthesized
agtgttagaaattatggttt

SEQ ID NO: 520975 - DNA, 20 bp, Artificial Sequence
  chemically synthesized
aacgcaagtcccaggcaaga

SEQ ID NO: 520976 - DNA, 20 bp, Artificial Sequence
  chemically synthesized
agttagttcagcctatgccc

SEQ ID NO: 520977 - DNA, 20 bp, Artificial Sequence
  chemically synthesized
cttggaggttagaagcaaga

SEQ ID NO: 520978 - DNA, 20 bp, Artificial Sequence
  chemically synthesized
ggtggtttcaatcccttcct

SEQ ID NO: 520979 - DNA, 20 bp, Artificial Sequence
  chemically synthesized
gtgttagaaaacccaaagga

SEQ ID NO: 520980 - DNA, 20 bp, Artificial Sequence
  chemically synthesized
catctttatagcctatacct

SEQ ID NO: 520981 - DNA, 20 bp, Artificial Sequence
  chemically synthesized
ctgctgatgggggaagtagc

SEQ ID NO: 520982 - DNA, 20 bp, Artificial Sequence
  chemically synthesized
ggaacgaactccaaggtgag

SEQ ID NO: 520983 - DNA, 20 bp, Artificial Sequence
  chemically synthesized
cagttccactcttctcacct

SEQ ID NO: 520984 - DNA, 20 bp, Artificial Sequence
  chemically synthesized
tggaactgctttgcaactgt

SEQ ID NO: 520985 - DNA, 20 bp, Artificial Sequence
  chemically synthesized
actgctttgcaactgtttga

SEQ ID NO: 520986 - DNA, 20 bp, Artificial Sequence
  chemically synthesized
ggaagcccaattaggcctgc

SEQ ID NO: 520987 - DNA, 20 bp, Artificial Sequence
  chemically synthesized
actgtagtaaaactatagat

SEQ ID NO: 520988 - DNA, 20 bp, Artificial Sequence
  chemically synthesized
agttttactacagtgtttat

SEQ ID NO: 520989 - DNA, 20 bp, Artificial Sequence
  chemically synthesized
atagcctactataaggtata

SEQ ID NO: 520990 - DNA, 20 bp, Artificial Sequence
  chemically synthesized
ctataaggtataatgagtcc

SEQ ID NO: 520991 - DNA, 20 bp, Artificial Sequence
  chemically synthesized
aaatgtttgcttttaaaatt

SEQ ID NO: 520992 - DNA, 20 bp, Artificial Sequence
  chemically synthesized
gactaaattctaaattgttt

SEQ ID NO: 520993 - DNA, 20 bp, Artificial Sequence
  chemically synthesized
cttctaacccacaaacaatt

SEQ ID NO: 520994 - DNA, 20 bp, Artificial Sequence
  chemically synthesized
ttagaatttagtctaaactg

SEQ ID NO: 520995 - DNA, 20 bp, Artificial Sequence
  chemically synthesized
taaactgaagaattaacctc

SEQ ID NO: 520996 - DNA, 20 bp, Artificial Sequence
  chemically synthesized
ttatttgcatgaagtgcagc

SEQ ID NO: 520997 - DNA, 20 bp, Artificial Sequence
  chemically synthesized
tgatggaactctgttccatg

SEQ ID NO: 520998 - DNA, 20 bp, Artificial Sequence
  chemically synthesized
atctgagattcttcatggaa

SEQ ID NO: 520999 - DNA, 20 bp, Artificial Sequence
  chemically synthesized
tttgaaagccgagcccagcc

SEQ ID NO: 521000 - DNA, 20 bp, Artificial Sequence
  chemically synthesized
tggtcaactcataggtattt

SEQ ID NO: 521001 - DNA, 20 bp, Artificial Sequence
  chemically synthesized
gtttgtaccctcaaatacct

SEQ ID NO: 521002 - DNA, 20 bp, Artificial Sequence
  chemically synthesized
cttgaggtcccaagataact

SEQ ID NO: 521003 - DNA, 20 bp, Artificial Sequence
  chemically synthesized
ttcctgacctgtggtaagta

SEQ ID NO: 521004 - DNA, 20 bp, Artificial Sequence
  chemically synthesized
ggcctcataccttgtccaca

SEQ ID NO: 521005 - DNA, 20 bp, Artificial Sequence
  chemically synthesized
gagccatttaaagcccgttg

SEQ ID NO: 521006 - DNA, 20 bp, Artificial Sequence
  chemically synthesized
ggaatggcatgcttccttta

SEQ ID NO: 521007 - DNA, 20 bp, Artificial Sequence
  chemically synthesized
cattttaccaaggctttgac

SEQ ID NO: 521008 - DNA, 20 bp, Artificial Sequence
  chemically synthesized
gttaattgcatacgtgcaat

SEQ ID NO: 521009 - DNA, 20 bp, Artificial Sequence
  chemically synthesized
taactatactgtcataaatt

SEQ ID NO: 521010 - DNA, 20 bp, Artificial Sequence
  chemically synthesized
ctagaatttggaaaccattt

SEQ ID NO: 521011 - DNA, 20 bp, Artificial Sequence
  chemically synthesized
ttctctctacctgatttctc

SEQ ID NO: 521012 - DNA, 20 bp, Artificial Sequence
  chemically synthesized
atttgctccaaaatttgtca

SEQ ID NO: 521013 - DNA, 20 bp, Artificial Sequence
  chemically synthesized
ctatttgccacttttaccga

SEQ ID NO: 521014 - DNA, 20 bp, Artificial Sequence
  chemically synthesized
agagctatttgccactttta

SEQ ID NO: 521015 - DNA, 20 bp, Artificial Sequence
  chemically synthesized
tatgttgactctgaaaacaa

SEQ ID NO: 521016 - DNA, 20 bp, Artificial Sequence
  chemically synthesized
attgctaatccttttgtttt

SEQ ID NO: 521017 - DNA, 20 bp, Artificial Sequence
  chemically synthesized
aactttaaaaattatgctct

SEQ ID NO: 521018 - DNA, 20 bp, Artificial Sequence
  chemically synthesized
agttatctaagacctgcact

SEQ ID NO: 521019 - DNA, 20 bp, Artificial Sequence
  chemically synthesized
ttataatcggatataatact

SEQ ID NO: 521020 - DNA, 20 bp, Artificial Sequence
  chemically synthesized
tttcaaaaggcagtttataa

SEQ ID NO: 521021 - DNA, 20 bp, Artificial Sequence
  chemically synthesized
caaagcaagataaaatgtct

SEQ ID NO: 521022 - DNA, 20 bp, Artificial Sequence
  chemically synthesized
tattaaagctacaattgact

SEQ ID NO: 521023 - DNA, 20 bp, Artificial Sequence
  chemically synthesized
tattaatagtgaaatcatat

SEQ ID NO: 521024 - DNA, 20 bp, Artificial Sequence
  chemically synthesized
gaaaactttcaaatagaaga

SEQ ID NO: 521025 - DNA, 20 bp, Artificial Sequence
  chemically synthesized
gaaggaaaactttcaaatag

SEQ ID NO: 521026 - DNA, 20 bp, Artificial Sequence
  chemically synthesized
aactctggagattgtgacgt

SEQ ID NO: 521027 - DNA, 20 bp, Artificial Sequence
  chemically synthesized
tattctaacgtcacaatctc

SEQ ID NO: 521028 - DNA, 20 bp, Artificial Sequence
  chemically synthesized
aaaaccatttttttttgaga

SEQ ID NO: 521029 - DNA, 20 bp, Artificial Sequence
  chemically synthesized
ttctctcttgttgcccaggc

SEQ ID NO: 521030 - DNA, 20 bp, Artificial Sequence
  chemically synthesized
tactcgggagaccgaggcag

SEQ ID NO: 521031 - DNA, 20 bp, Artificial Sequence
  chemically synthesized
gattctcctgcctcggtctc

SEQ ID NO: 521032 - DNA, 20 bp, Artificial Sequence
  chemically synthesized
gcctcggtctcccgagtagc

SEQ ID NO: 521033 - DNA, 20 bp, Artificial Sequence
  chemically synthesized
tcccgagtagctgggattac

SEQ ID NO: 521034 - DNA, 20 bp, Artificial Sequence
  chemically synthesized
ttttgtatttttagtagaga

SEQ ID NO: 521035 - DNA, 20 bp, Artificial Sequence
  chemically synthesized
tgggcagatcacctgaggtc

SEQ ID NO: 521036 - DNA, 20 bp, Artificial Sequence
  chemically synthesized
acctcggcctcctaacgtgc

SEQ ID NO: 521037 - DNA, 20 bp, Artificial Sequence
  chemically synthesized
tgtggacgacacaaacattg

SEQ ID NO: 521038 - DNA, 20 bp, Artificial Sequence
  chemically synthesized
cacaaacattgtagagtagc

SEQ ID NO: 521039 - DNA, 20 bp, Artificial Sequence
  chemically synthesized
taacatatactaagtcatat

SEQ ID NO: 521040 - DNA, 20 bp, Artificial Sequence
  chemically synthesized
ctaagtcatattagaattat

SEQ ID NO: 521041 - DNA, 20 bp, Artificial Sequence
  chemically synthesized
aatatcaaaggtttaaaaca

SEQ ID NO: 521042 - DNA, 20 bp, Artificial Sequence
  chemically synthesized
aaacactggatatcacaaaa

SEQ ID NO: 521043 - DNA, 20 bp, Artificial Sequence
  chemically synthesized
atgaatgacttatggtgacc

SEQ ID NO: 521044 - DNA, 20 bp, Artificial Sequence
  chemically synthesized
ggagttatcgttttggtcaa

SEQ ID NO: 521045 - DNA, 20 bp, Artificial Sequence
  chemically synthesized
aggtttttcttttaagattt

SEQ ID NO: 521046 - DNA, 20 bp, Artificial Sequence
  chemically synthesized
gaaagctaagtctcctctgt

SEQ ID NO: 521047 - DNA, 20 bp, Artificial Sequence
  chemically synthesized
ttatcctcatgctgtcttta

SEQ ID NO: 521048 - DNA, 20 bp, Artificial Sequence
  chemically synthesized
agacccaataaagacagcat

SEQ ID NO: 521049 - DNA, 20 bp, Artificial Sequence
  chemically synthesized
taaagacagcatgaggataa

SEQ ID NO: 521050 - DNA, 20 bp, Artificial Sequence
  chemically synthesized
aaagggtttggctttctcct

SEQ ID NO: 521051 - DNA, 20 bp, Artificial Sequence
  chemically synthesized
gtaacgttaaaagataatga

SEQ ID NO: 521052 - DNA, 20 bp, Artificial Sequence
  chemically synthesized
tgtggtcaaactaattaaaa

SEQ ID NO: 521053 - DNA, 20 bp, Artificial Sequence
  chemically synthesized
aagcgttctaaaaagtttat

SEQ ID NO: 521054 - DNA, 20 bp, Artificial Sequence
  chemically synthesized
gggcccatgtgtccaaataa

SEQ ID NO: 521055 - DNA, 20 bp, Artificial Sequence
  chemically synthesized
ttaaagtcatactgtggggc

SEQ ID NO: 521056 - DNA, 20 bp, Artificial Sequence
  chemically synthesized
agccaacttgtttataccca

SEQ ID NO: 521057 - DNA, 20 bp, Artificial Sequence
  chemically synthesized
atcctgaaaaaaaaaattct

SEQ ID NO: 521058 - DNA, 20 bp, Artificial Sequence
  chemically synthesized
acccacagaatttttttttt

SEQ ID NO: 521059 - DNA, 20 bp, Artificial Sequence
  chemically synthesized
caaagtgaaaagggtttata

SEQ ID NO: 521060 - DNA, 20 bp, Artificial Sequence
  chemically synthesized
gagggtttaagcaaagtgaa

SEQ ID NO: 521061 - DNA, 20 bp, Artificial Sequence
  chemically synthesized
aagagtaacggaacgaaact

SEQ ID NO: 521062 - DNA, 20 bp, Artificial Sequence
  chemically synthesized
taaagactgtcttaaactaa

SEQ ID NO: 521063 - DNA, 20 bp, Artificial Sequence
  chemically synthesized
ggaatatggcttttgttgaa

SEQ ID NO: 521064 - DNA, 20 bp, Artificial Sequence
  chemically synthesized
ggtgaaagataataaggcat

SEQ ID NO: 521065 - DNA, 20 bp, Artificial Sequence
  chemically synthesized
ttttacatacaaggtgtgta

SEQ ID NO: 521066 - DNA, 20 bp, Artificial Sequence
  chemically synthesized
cactaaaaatcaaagttgct

SEQ ID NO: 521067 - DNA, 20 bp, Artificial Sequence
  chemically synthesized
agctattttaattatatgct

SEQ ID NO: 521068 - DNA, 20 bp, Artificial Sequence
  chemically synthesized
atgcccctagctatgctgaa

SEQ ID NO: 521069 - DNA, 20 bp, Artificial Sequence
  chemically synthesized
aaggaaacagtttgacctta

SEQ ID NO: 521070 - DNA, 20 bp, Artificial Sequence
  chemically synthesized
cttaatcagattactggctt

SEQ ID NO: 521071 - DNA, 20 bp, Artificial Sequence
  chemically synthesized
taaaatggtgcccttaattt

SEQ ID NO: 521072 - DNA, 20 bp, Artificial Sequence
  chemically synthesized
cccgtagtatttctctcctt

SEQ ID NO: 521073 - DNA, 20 bp, Artificial Sequence
  chemically synthesized
caaaaataagaaaagaaatg

SEQ ID NO: 521074 - DNA, 20 bp, Artificial Sequence
  chemically synthesized
ttctttctttctttttaaga

SEQ ID NO: 521075 - DNA, 20 bp, Artificial Sequence
  chemically synthesized
tctcgctctgtcacccaggc

SEQ ID NO: 521076 - DNA, 20 bp, Artificial Sequence
  chemically synthesized
tagcaccactgcactccagc

SEQ ID NO: 521077 - DNA, 20 bp, Artificial Sequence
  chemically synthesized
ctcactgcaacctccgcctc

SEQ ID NO: 521078 - DNA, 20 bp, Artificial Sequence
  chemically synthesized
acctccgcctcctgggttca

SEQ ID NO: 521079 - DNA, 20 bp, Artificial Sequence
  chemically synthesized
tacttgagaggctaaggcag

SEQ ID NO: 521080 - DNA, 20 bp, Artificial Sequence
  chemically synthesized
gccttagcctctcaagtagc

SEQ ID NO: 521081 - DNA, 20 bp, Artificial Sequence
  chemically synthesized
ttttgtatttttcttagaga

SEQ ID NO: 521082 - DNA, 20 bp, Artificial Sequence
  chemically synthesized
actttgggaggccgaggagg

SEQ ID NO: 521083 - DNA, 20 bp, Artificial Sequence
  chemically synthesized
agtgcagcctcccaaagtgc

SEQ ID NO: 521084 - DNA, 20 bp, Artificial Sequence
  chemically synthesized
caatgaaatgcagggtatgg

SEQ ID NO: 521085 - DNA, 20 bp, Artificial Sequence
  chemically synthesized
ggttgccttgcaatgaaatg

SEQ ID NO: 521086 - DNA, 20 bp, Artificial Sequence
  chemically synthesized
acaaaatgggctgattgact

SEQ ID NO: 521087 - DNA, 20 bp, Artificial Sequence
  chemically synthesized
gtaatcagcccgtccttcat

SEQ ID NO: 521088 - DNA, 20 bp, Artificial Sequence
  chemically synthesized
gggagtctgatctcccagtg

SEQ ID NO: 521089 - DNA, 20 bp, Artificial Sequence
  chemically synthesized
tgatctcccagtggagggtg

SEQ ID NO: 521090 - DNA, 20 bp, Artificial Sequence
  chemically synthesized
gaggaatgtttccttatctt

SEQ ID NO: 521091 - DNA, 20 bp, Artificial Sequence
  chemically synthesized
gtgaccaaaagcatgcttct

SEQ ID NO: 521092 - DNA, 20 bp, Artificial Sequence
  chemically synthesized
tctctggatccaagtgtgca

SEQ ID NO: 521093 - DNA, 20 bp, Artificial Sequence
  chemically synthesized
atacttgactctttgcacac

SEQ ID NO: 521094 - DNA, 20 bp, Artificial Sequence
  chemically synthesized
atggctaatggtagttatac

SEQ ID NO: 521095 - DNA, 20 bp, Artificial Sequence
  chemically synthesized
tagataggaaatatacttta

SEQ ID NO: 521096 - DNA, 20 bp, Artificial Sequence
  chemically synthesized
atctgatggttttgagtttt

SEQ ID NO: 521097 - DNA, 20 bp, Artificial Sequence
  chemically synthesized
cattgtgttatctgatggtt

SEQ ID NO: 521098 - DNA, 20 bp, Artificial Sequence
  chemically synthesized
taacacaatgaaaaacagag

SEQ ID NO: 521099 - DNA, 20 bp, Artificial Sequence
  chemically synthesized
gcagagtctttgattttgag

SEQ ID NO: 521100 - DNA, 20 bp, Artificial Sequence
  chemically synthesized
accccaggaattaaaaacag

SEQ ID NO: 521101 - DNA, 20 bp, Artificial Sequence
  chemically synthesized
atccatctgtttttaattcc

SEQ ID NO: 521102 - DNA, 20 bp, Artificial Sequence
  chemically synthesized
tgttttccacatgaaacccc

SEQ ID NO: 521103 - DNA, 20 bp, Artificial Sequence
  chemically synthesized
tttttttttttttccctaaa

SEQ ID NO: 521104 - DNA, 20 bp, Artificial Sequence
  chemically synthesized
tgcctcctctgtttttccca

SEQ ID NO: 521105 - DNA, 20 bp, Artificial Sequence
  chemically synthesized
ttgccactcttaacgcacac

SEQ ID NO: 521106 - DNA, 20 bp, Artificial Sequence
  chemically synthesized
tagggactcacgtgtgcgtt

SEQ ID NO: 521107 - DNA, 20 bp, Artificial Sequence
  chemically synthesized
agttttttcttctcagccga

SEQ ID NO: 521108 - DNA, 20 bp, Artificial Sequence
  chemically synthesized
aaaagtcagcttaattaaga

SEQ ID NO: 521109 - DNA, 20 bp, Artificial Sequence
  chemically synthesized
ggttaaaagtcagcttaatt

SEQ ID NO: 521110 - DNA, 20 bp, Artificial Sequence
  chemically synthesized
ttaggtaataagagatctaa

SEQ ID NO: 521111 - DNA, 20 bp, Artificial Sequence
  chemically synthesized
aagtttctttttacaagatt

SEQ ID NO: 521112 - DNA, 20 bp, Artificial Sequence
  chemically synthesized
ttcttttctgatttcctctc

SEQ ID NO: 521113 - DNA, 20 bp, Artificial Sequence
  chemically synthesized
acacaaataacaaatcagaa

SEQ ID NO: 521114 - DNA, 20 bp, Artificial Sequence
  chemically synthesized
tgggttcaattgttggcttc

SEQ ID NO: 521115 - DNA, 20 bp, Artificial Sequence
  chemically synthesized
tgtcttttgacagtggtggc

SEQ ID NO: 521116 - DNA, 20 bp, Artificial Sequence
  chemically synthesized
aactgctcaagaaaaatctt

SEQ ID NO: 521117 - DNA, 20 bp, Artificial Sequence
  chemically synthesized
catccagaggacaggaattt

SEQ ID NO: 521118 - DNA, 20 bp, Artificial Sequence
  chemically synthesized
aaccccaaaattcctgtcct

SEQ ID NO: 521119 - DNA, 20 bp, Artificial Sequence
  chemically synthesized
gtttctaccatccagaggac

SEQ ID NO: 521120 - DNA, 20 bp, Artificial Sequence
  chemically synthesized
gcttaaccttgtgaccatgt

SEQ ID NO: 521121 - DNA, 20 bp, Artificial Sequence
  chemically synthesized
aacaagacagagaaatttca

SEQ ID NO: 521122 - DNA, 20 bp, Artificial Sequence
  chemically synthesized
ctgacttgaaaagcagactt

SEQ ID NO: 521123 - DNA, 20 bp, Artificial Sequence
  chemically synthesized
gggatatcacgtgatagaac

SEQ ID NO: 521124 - DNA, 20 bp, Artificial Sequence
  chemically synthesized
ctgtgttatgtaatggagag

SEQ ID NO: 521125 - DNA, 20 bp, Artificial Sequence
  chemically synthesized
catctgatgtagtttgtgct

SEQ ID NO: 521126 - DNA, 20 bp, Artificial Sequence
  chemically synthesized
agggtttggttaatagaaag

SEQ ID NO: 521127 - DNA, 20 bp, Artificial Sequence
  chemically synthesized
aaactatttgtctcctctgc

SEQ ID NO: 521128 - DNA, 20 bp, Artificial Sequence
  chemically synthesized
agaccagaaacttgactgat

SEQ ID NO: 521129 - DNA, 20 bp, Artificial Sequence
  chemically synthesized
gaatttcttacccttattgc

SEQ ID NO: 521130 - DNA, 20 bp, Artificial Sequence
  chemically synthesized
aaacctggcatcccagcaat

SEQ ID NO: 521131 - DNA, 20 bp, Artificial Sequence
  chemically synthesized
attgctgggatgccaggttt

SEQ ID NO: 521132 - DNA, 20 bp, Artificial Sequence
  chemically synthesized
ctctgcagcttccagaagaa

SEQ ID NO: 521133 - DNA, 20 bp, Artificial Sequence
  chemically synthesized
acagctatagcacaagcaag

SEQ ID NO: 521134 - DNA, 20 bp, Artificial Sequence
  chemically synthesized
gcttgcttgtgctatagctg

SEQ ID NO: 521135 - DNA, 20 bp, Artificial Sequence
  chemically synthesized
tatggttccataaaatggta

SEQ ID NO: 521136 - DNA, 20 bp, Artificial Sequence
  chemically synthesized
tgggcagaatcttgcaaatt

SEQ ID NO: 521137 - DNA, 20 bp, Artificial Sequence
  chemically synthesized
tccccatgcagcccgttggg

SEQ ID NO: 521138 - DNA, 20 bp, Artificial Sequence
  chemically synthesized
ccaacgggctgcatggggaa

SEQ ID NO: 521139 - DNA, 20 bp, Artificial Sequence
  chemically synthesized
gttttgttatgtgtattttg

SEQ ID NO: 521140 - DNA, 20 bp, Artificial Sequence
  chemically synthesized
tgagctttgccaggctgata

SEQ ID NO: 521141 - DNA, 20 bp, Artificial Sequence
  chemically synthesized
gtcatccgtccccacctggt

SEQ ID NO: 521142 - DNA, 20 bp, Artificial Sequence
  chemically synthesized
ttgatccacaccaggtgggg

SEQ ID NO: 521143 - DNA, 20 bp, Artificial Sequence
  chemically synthesized
ccttgcccagagacctcatt

SEQ ID NO: 521144 - DNA, 20 bp, Artificial Sequence
  chemically synthesized
ggctcaacagtcctgtctct

SEQ ID NO: 521145 - DNA, 20 bp, Artificial Sequence
  chemically synthesized
tgagccttctttagagctca

SEQ ID NO: 521146 - DNA, 20 bp, Artificial Sequence
  chemically synthesized
aatgtgaccagacaaataag

SEQ ID NO: 521147 - DNA, 20 bp, Artificial Sequence
  chemically synthesized
agacaaataaggagggttct

SEQ ID NO: 521148 - DNA, 20 bp, Artificial Sequence
  chemically synthesized
tatgtgaaagggatctcaga

SEQ ID NO: 521149 - DNA, 20 bp, Artificial Sequence
  chemically synthesized
catgtgtttaaatatgtgaa

SEQ ID NO: 521150 - DNA, 20 bp, Artificial Sequence
  chemically synthesized
tactcttggacttcttggtt

SEQ ID NO: 521151 - DNA, 20 bp, Artificial Sequence
  chemically synthesized
gatccctaaccaagaagtcc

SEQ ID NO: 521152 - DNA, 20 bp, Artificial Sequence
  chemically synthesized
aaataggaggatagtttgga

SEQ ID NO: 521153 - DNA, 20 bp, Artificial Sequence
  chemically synthesized
gtttctcatacagaaaatag

SEQ ID NO: 521154 - DNA, 20 bp, Artificial Sequence
  chemically synthesized
gctgaacagacaccccacaa

SEQ ID NO: 521155 - DNA, 20 bp, Artificial Sequence
  chemically synthesized
ctctgtctgttactccattg

SEQ ID NO: 521156 - DNA, 20 bp, Artificial Sequence
  chemically synthesized
acagacagagacaccccatg

SEQ ID NO: 521157 - DNA, 20 bp, Artificial Sequence
  chemically synthesized
gggtgtctgtagatccagca

SEQ ID NO: 521158 - DNA, 20 bp, Artificial Sequence
  chemically synthesized
gggtgtctgtagccccattg

SEQ ID NO: 521159 - DNA, 20 bp, Artificial Sequence
  chemically synthesized
ctggttctgtagccctatgg

SEQ ID NO: 521160 - DNA, 20 bp, Artificial Sequence
  chemically synthesized
agggctacagaaccagtcag

SEQ ID NO: 521161 - DNA, 20 bp, Artificial Sequence
  chemically synthesized
aagcaggcattggcagcacc

SEQ ID NO: 521162 - DNA, 20 bp, Artificial Sequence
  chemically synthesized
gttttggggtgtctggattg

SEQ ID NO: 521163 - DNA, 20 bp, Artificial Sequence
  chemically synthesized
gtagctccgttttggggtgt

SEQ ID NO: 521164 - DNA, 20 bp, Artificial Sequence
  chemically synthesized
gtctatctgtagctccgttt

SEQ ID NO: 521165 - DNA, 20 bp, Artificial Sequence
  chemically synthesized
gggtatctgtagcctcatgg

SEQ ID NO: 521166 - DNA, 20 bp, Artificial Sequence
  chemically synthesized
ccttaactgtagccctatta

SEQ ID NO: 521167 - DNA, 20 bp, Artificial Sequence
  chemically synthesized
tgcaattaagtccacgcaca

SEQ ID NO: 521168 - DNA, 20 bp, Artificial Sequence
  chemically synthesized
taagtccacgcacattgggt

SEQ ID NO: 521169 - DNA, 20 bp, Artificial Sequence
  chemically synthesized
tctgttactctgtctactgg

SEQ ID NO: 521170 - DNA, 20 bp, Artificial Sequence
  chemically synthesized
tggaataccccaccagtaga

SEQ ID NO: 521171 - DNA, 20 bp, Artificial Sequence
  chemically synthesized
cccaccagtagacagagtaa

SEQ ID NO: 521172 - DNA, 20 bp, Artificial Sequence
  chemically synthesized
agagtcagcccccagtccaa

SEQ ID NO: 521173 - DNA, 20 bp, Artificial Sequence
  chemically synthesized
gcagccacttgggctgcctt

SEQ ID NO: 521174 - DNA, 20 bp, Artificial Sequence
  chemically synthesized
ttggtggccccctttcagtg

SEQ ID NO: 521175 - DNA, 20 bp, Artificial Sequence
  chemically synthesized
aggtagccacaggggcaatc

SEQ ID NO: 521176 - DNA, 20 bp, Artificial Sequence
  chemically synthesized
tacaaatttgggggctcacc

SEQ ID NO: 521177 - DNA, 20 bp, Artificial Sequence
  chemically synthesized
cccaaatttgtaaccaccca

SEQ ID NO: 521178 - DNA, 20 bp, Artificial Sequence
  chemically synthesized
cagtgggcaaggtgaacccc

SEQ ID NO: 521179 - DNA, 20 bp, Artificial Sequence
  chemically synthesized
attgcaattcccctgtcttg

SEQ ID NO: 521180 - DNA, 20 bp, Artificial Sequence
  chemically synthesized
gagctgactcagcaagacag

SEQ ID NO: 521181 - DNA, 20 bp, Artificial Sequence
  chemically synthesized
caggggaattgcaatgaaga

SEQ ID NO: 521182 - DNA, 20 bp, Artificial Sequence
  chemically synthesized
tcccacacagccagctctgc

SEQ ID NO: 521183 - DNA, 20 bp, Artificial Sequence
  chemically synthesized
gagctggctgtgtgggacac

SEQ ID NO: 521184 - DNA, 20 bp, Artificial Sequence
  chemically synthesized
ggggagaccgatttgctgat

SEQ ID NO: 521185 - DNA, 20 bp, Artificial Sequence
  chemically synthesized
ctccccaggcattcggggaa

SEQ ID NO: 521186 - DNA, 20 bp, Artificial Sequence
  chemically synthesized
atccttaaaaactctgttcc

SEQ ID NO: 521187 - DNA, 20 bp, Artificial Sequence
  chemically synthesized
attcggggaacagagttttt

SEQ ID NO: 521188 - DNA, 20 bp, Artificial Sequence
  chemically synthesized
gagtttttaaggataacttg

SEQ ID NO: 521189 - DNA, 20 bp, Artificial Sequence
  chemically synthesized
tcgggggaagccagtgagcc

SEQ ID NO: 521190 - DNA, 20 bp, Artificial Sequence
  chemically synthesized
tggtcagagatgaaatcaca

SEQ ID NO: 521191 - DNA, 20 bp, Artificial Sequence
  chemically synthesized
gttggagctgtcttcttgcg

SEQ ID NO: 521192 - DNA, 20 bp, Artificial Sequence
  chemically synthesized
ttcttgcgctgagtcagttc

SEQ ID NO: 521193 - DNA, 20 bp, Artificial Sequence
  chemically synthesized
agatgagccagtttattgat

SEQ ID NO: 521194 - DNA, 20 bp, Artificial Sequence
  chemically synthesized
gccagctgatccatcaagtg

SEQ ID NO: 521195 - DNA, 20 bp, Artificial Sequence
  chemically synthesized
atttgcagaccctgcacttg

SEQ ID NO: 521196 - DNA, 20 bp, Artificial Sequence
  chemically synthesized
gatcttaggagcagtttggt

SEQ ID NO: 521197 - DNA, 20 bp, Artificial Sequence
  chemically synthesized
aggagcagtttggtgggggt

SEQ ID NO: 521198 - DNA, 20 bp, Artificial Sequence
  chemically synthesized
agtattagaaattatggttt

SEQ ID NO: 521199 - DNA, 20 bp, Artificial Sequence
  chemically synthesized
agtggaggttagaagcaaga

SEQ ID NO: 521200 - DNA, 20 bp, Artificial Sequence
  chemically synthesized
tttatggtaaaataaagtat

SEQ ID NO: 521201 - DNA, 20 bp, Artificial Sequence
  chemically synthesized
aaacaaatgagcttttagta

SEQ ID NO: 521202 - DNA, 20 bp, Artificial Sequence
  chemically synthesized
ccccaccccattgcagtcat

SEQ ID NO: 521203 - DNA, 20 bp, Artificial Sequence
  chemically synthesized
atgaattctaatgactgcaa

SEQ ID NO: 521204 - DNA, 20 bp, Artificial Sequence
  chemically synthesized
tctaatgactgcaatggggt

SEQ ID NO: 521205 - DNA, 20 bp, Artificial Sequence
  chemically synthesized
actgcaatggggtgggggtg

SEQ ID NO: 521206 - DNA, 20 bp, Artificial Sequence
  chemically synthesized
attaaactaagataggcttt

SEQ ID NO: 521207 - DNA, 20 bp, Artificial Sequence
  chemically synthesized
atgtattactgatgatttaa

SEQ ID NO: 521208 - DNA, 20 bp, Artificial Sequence
  chemically synthesized
ataacttgtttggtgaaaaa

SEQ ID NO: 521209 - DNA, 20 bp, Artificial Sequence
  chemically synthesized
ctttgtaaggcctttagaaa

SEQ ID NO: 521210 - DNA, 20 bp, Artificial Sequence
  chemically synthesized
aaaataattaccataaaata

SEQ ID NO: 521211 - DNA, 20 bp, Artificial Sequence
  chemically synthesized
ggtgtcttctagatgggaac

SEQ ID NO: 521212 - DNA, 20 bp, Artificial Sequence
  chemically synthesized
aacacataacctcccatttc

SEQ ID NO: 521213 - DNA, 20 bp, Artificial Sequence
  chemically synthesized
cttgattaatgaaacataaa

SEQ ID NO: 521214 - DNA, 20 bp, Artificial Sequence
  chemically synthesized
cagtttatgtttcattaatc

SEQ ID NO: 521215 - DNA, 20 bp, Artificial Sequence
  chemically synthesized
atttacaaaatgaggttgtt

SEQ ID NO: 521216 - DNA, 20 bp, Artificial Sequence
  chemically synthesized
tgtagccaagtttgcatatt

SEQ ID NO: 521217 - DNA, 20 bp, Artificial Sequence
  chemically synthesized
aggaaaatctgacttgaaag

SEQ ID NO: 521218 - DNA, 20 bp, Artificial Sequence
  chemically synthesized
ggtaagatagtgtaagtaaa

SEQ ID NO: 521219 - DNA, 20 bp, Artificial Sequence
  chemically synthesized
gtggtgagtgataagagata

SEQ ID NO: 521220 - DNA, 20 bp, Artificial Sequence
  chemically synthesized
tccctgagagtatatgagtg

SEQ ID NO: 521221 - DNA, 20 bp, Artificial Sequence
  chemically synthesized
aattttatccctgagagtat

SEQ ID NO: 521222 - DNA, 20 bp, Artificial Sequence
  chemically synthesized
ctcaccactcatatactctc

SEQ ID NO: 521223 - DNA, 20 bp, Artificial Sequence
  chemically synthesized
ctctacagaattttatccct

SEQ ID NO: 521224 - DNA, 20 bp, Artificial Sequence
  chemically synthesized
atgcgaattgagtgcctcta

SEQ ID NO: 521225 - DNA, 20 bp, Artificial Sequence
  chemically synthesized
tatggttgtttctatgcgaa

SEQ ID NO: 521226 - DNA, 20 bp, Artificial Sequence
  chemically synthesized
ggttttatggttgtttctat

SEQ ID NO: 521227 - DNA, 20 bp, Artificial Sequence
  chemically synthesized
ctaacttaatatttgcaaaa

SEQ ID NO: 521228 - DNA, 20 bp, Artificial Sequence
  chemically synthesized
taagatcaacactaaatttt

SEQ ID NO: 521229 - DNA, 20 bp, Artificial Sequence
  chemically synthesized
atgtgataacattcacaagc

SEQ ID NO: 521230 - DNA, 20 bp, Artificial Sequence
  chemically synthesized
gctctactcaattctggctt

SEQ ID NO: 521231 - DNA, 20 bp, Artificial Sequence
  chemically synthesized
ataacattcacaagccagaa

SEQ ID NO: 521232 - DNA, 20 bp, Artificial Sequence
  chemically synthesized
ggttcaatcctatgataatc

SEQ ID NO: 521233 - DNA, 20 bp, Artificial Sequence
  chemically synthesized
gaaaatatccctgattatca

SEQ ID NO: 521234 - DNA, 20 bp, Artificial Sequence
  chemically synthesized
ttcacagtgaagaaaatgat

SEQ ID NO: 521235 - DNA, 20 bp, Artificial Sequence
  chemically synthesized
ttctgatcattttcttcact

SEQ ID NO: 521236 - DNA, 20 bp, Artificial Sequence
  chemically synthesized
acctttgaatgatagtctgt

SEQ ID NO: 521237 - DNA, 20 bp, Artificial Sequence
  chemically synthesized
tctttctgtatagcaaacct

SEQ ID NO: 521238 - DNA, 20 bp, Artificial Sequence
  chemically synthesized
cccatgaaaatcagataatt

SEQ ID NO: 521239 - DNA, 20 bp, Artificial Sequence
  chemically synthesized
tggaaccccattatataact

SEQ ID NO: 521240 - DNA, 20 bp, Artificial Sequence
  chemically synthesized
aataactcatagttatataa

SEQ ID NO: 521241 - DNA, 20 bp, Artificial Sequence
  chemically synthesized
aaaaggtttggtatttatta

SEQ ID NO: 521242 - DNA, 20 bp, Artificial Sequence
  chemically synthesized
gcacttttaattactcattc

SEQ ID NO: 521243 - DNA, 20 bp, Artificial Sequence
  chemically synthesized
tattaattagcaattcatga

SEQ ID NO: 521244 - DNA, 20 bp, Artificial Sequence
  chemically synthesized
gaagtattaattagcaattc

SEQ ID NO: 521245 - DNA, 20 bp, Artificial Sequence
  chemically synthesized
taacagcttggattttaata

SEQ ID NO: 521246 - DNA, 20 bp, Artificial Sequence
  chemically synthesized
acactttaaaatctaacagc

SEQ ID NO: 521247 - DNA, 20 bp, Artificial Sequence
  chemically synthesized
gatagagggagataaaggaa

SEQ ID NO: 521248 - DNA, 20 bp, Artificial Sequence
  chemically synthesized
tttttttatttaaagggcca

SEQ ID NO: 521249 - DNA, 20 bp, Artificial Sequence
  chemically synthesized
aaagggccaaggaataaaat

SEQ ID NO: 521250 - DNA, 20 bp, Artificial Sequence
  chemically synthesized
ataaaataagaatgcgaagg

SEQ ID NO: 521251 - DNA, 20 bp, Artificial Sequence
  chemically synthesized
tcctctgcatttttctaatt

SEQ ID NO: 521252 - DNA, 20 bp, Artificial Sequence
  chemically synthesized
cctcaattagaaaaatgcag

SEQ ID NO: 521253 - DNA, 20 bp, Artificial Sequence
  chemically synthesized
attttgcatggcctaaagca

SEQ ID NO: 521254 - DNA, 20 bp, Artificial Sequence
  chemically synthesized
aagtttcctccctagaggag

SEQ ID NO: 521255 - DNA, 20 bp, Artificial Sequence
  chemically synthesized
gccccagaagtaaactggct

SEQ ID NO: 521256 - DNA, 20 bp, Artificial Sequence
  chemically synthesized
gggctggttaaaagctttca

SEQ ID NO: 521257 - DNA, 20 bp, Artificial Sequence
  chemically synthesized
acaatatttagcaattacac

SEQ ID NO: 521258 - DNA, 20 bp, Artificial Sequence
  chemically synthesized
tgcttttttataccaagagc

SEQ ID NO: 521259 - DNA, 20 bp, Artificial Sequence
  chemically synthesized
ttacttgcttaatgctacca

SEQ ID NO: 521260 - DNA, 20 bp, Artificial Sequence
  chemically synthesized
ataacctctcaaacagtagc

SEQ ID NO: 521261 - DNA, 20 bp, Artificial Sequence
  chemically synthesized
gttatattgccctcttcccc

SEQ ID NO: 521262 - DNA, 20 bp, Artificial Sequence
  chemically synthesized
actgaacagaatgaatgaat

SEQ ID NO: 521263 - DNA, 20 bp, Artificial Sequence
  chemically synthesized
tattgtactgaacagaatga

SEQ ID NO: 521264 - DNA, 20 bp, Artificial Sequence
  chemically synthesized
acagtattgtactgaacaga

SEQ ID NO: 521265 - DNA, 20 bp, Artificial Sequence
  chemically synthesized
gaacacagtattgtactgaa

SEQ ID NO: 521266 - DNA, 20 bp, Artificial Sequence
  chemically synthesized
gctttaaaattagaaactgt

SEQ ID NO: 521267 - DNA, 20 bp, Artificial Sequence
  chemically synthesized
aaattagaaactgtgggggt

SEQ ID NO: 521268 - DNA, 20 bp, Artificial Sequence
  chemically synthesized
aattatttcaagcattcaat

SEQ ID NO: 521269 - DNA, 20 bp, Artificial Sequence
  chemically synthesized
tctgtattttaatatcctca

SEQ ID NO: 521270 - DNA, 20 bp, Artificial Sequence
  chemically synthesized
aattataagagccaacttta

SEQ ID NO: 521271 - DNA, 20 bp, Artificial Sequence
  chemically synthesized
tcagaaataatcaagaaggt

SEQ ID NO: 521272 - DNA, 20 bp, Artificial Sequence
  chemically synthesized
cctcaccttcttgattattt

SEQ ID NO: 521273 - DNA, 20 bp, Artificial Sequence
  chemically synthesized
tgattatttctgagttcttt

SEQ ID NO: 521274 - DNA, 20 bp, Artificial Sequence
  chemically synthesized
catcgtaagcagagggacta

SEQ ID NO: 521275 - DNA, 20 bp, Artificial Sequence
  chemically synthesized
cactagtccctctgcttacg

SEQ ID NO: 521276 - DNA, 20 bp, Artificial Sequence
  chemically synthesized
ggtgacatcttgaagacatc

SEQ ID NO: 521277 - DNA, 20 bp, Artificial Sequence
  chemically synthesized
ctaatcttagctcccccaaa

SEQ ID NO: 521278 - DNA, 20 bp, Artificial Sequence
  chemically synthesized
aagctatgggccgcaaagca

SEQ ID NO: 521279 - DNA, 20 bp, Artificial Sequence
  chemically synthesized
attgagttgaatactgaaat

SEQ ID NO: 521280 - DNA, 20 bp, Artificial Sequence
  chemically synthesized
ataaaataaaatatattgag

SEQ ID NO: 521281 - DNA, 20 bp, Artificial Sequence
  chemically synthesized
taaaaataaaataaaatata

SEQ ID NO: 521282 - DNA, 20 bp, Artificial Sequence
  chemically synthesized
atttttattgctttttgaga

SEQ ID NO: 521283 - DNA, 20 bp, Artificial Sequence
  chemically synthesized
ggagtctctgtcactcaggc

SEQ ID NO: 521284 - DNA, 20 bp, Artificial Sequence
  chemically synthesized
tttcaccactgcactccagc

SEQ ID NO: 521285 - DNA, 20 bp, Artificial Sequence
  chemically synthesized
actgcaacctttacctcccg

SEQ ID NO: 521286 - DNA, 20 bp, Artificial Sequence
  chemically synthesized
ggctgagacaggagaattgc

SEQ ID NO: 521287 - DNA, 20 bp, Artificial Sequence
  chemically synthesized
tagtctggaggctgagacag

SEQ ID NO: 521288 - DNA, 20 bp, Artificial Sequence
  chemically synthesized
tttctatttttagtagagac

SEQ ID NO: 521289 - DNA, 20 bp, Artificial Sequence
  chemically synthesized
cggatggatcatttgaagtc

SEQ ID NO: 521290 - DNA, 20 bp, Artificial Sequence
  chemically synthesized
actttgggaggcggaggcgg

SEQ ID NO: 521291 - DNA, 20 bp, Artificial Sequence
  chemically synthesized
cagaactttgggaggcggag

SEQ ID NO: 521292 - DNA, 20 bp, Artificial Sequence
  chemically synthesized
gcctccgcctcccaaagttc

SEQ ID NO: 521293 - DNA, 20 bp, Artificial Sequence
  chemically synthesized
tttgactaaatatattttaa

SEQ ID NO: 521294 - DNA, 20 bp, Artificial Sequence
  chemically synthesized
atattttaattgagttaata

SEQ ID NO: 521295 - DNA, 20 bp, Artificial Sequence
  chemically synthesized
aatatgggatctgccttact

SEQ ID NO: 521296 - DNA, 20 bp, Artificial Sequence
  chemically synthesized
aaataacttcacagccttca

SEQ ID NO: 521297 - DNA, 20 bp, Artificial Sequence
  chemically synthesized
tggctttggacaaagtacag

SEQ ID NO: 521298 - DNA, 20 bp, Artificial Sequence
  chemically synthesized
tggaagcaccttgcaattgg

SEQ ID NO: 521299 - DNA, 20 bp, Artificial Sequence
  chemically synthesized
tttaagatcctcccccagtg

SEQ ID NO: 521300 - DNA, 20 bp, Artificial Sequence
  chemically synthesized
ggtagaattcaacactgggg

SEQ ID NO: 521301 - DNA, 20 bp, Artificial Sequence
  chemically synthesized
tgggggaggatcttaaagta

SEQ ID NO: 521302 - DNA, 20 bp, Artificial Sequence
  chemically synthesized
cgtatgtgcattagagagct

SEQ ID NO: 521303 - DNA, 20 bp, Artificial Sequence
  chemically synthesized
tcttagcagcttcttaatta

SEQ ID NO: 521304 - DNA, 20 bp, Artificial Sequence
  chemically synthesized
cattctcctgcctcagcctc

SEQ ID NO: 521305 - DNA, 20 bp, Artificial Sequence
  chemically synthesized
tactcgggaggctgaggcag

SEQ ID NO: 521306 - DNA, 20 bp, Artificial Sequence
  chemically synthesized
ctcactgcaagctccgcctc

SEQ ID NO: 521307 - DNA, 20 bp, Artificial Sequence
  chemically synthesized
tctcgctctgtcgcccaggc

SEQ ID NO: 521308 - DNA, 20 bp, Artificial Sequence
  chemically synthesized
atttattcttttttttgaga

SEQ ID NO: 521309 - DNA, 20 bp, Artificial Sequence
  chemically synthesized
cgagactccatctcaaaaaa

SEQ ID NO: 521310 - DNA, 20 bp, Artificial Sequence
  chemically synthesized
tttattataagttttaatat

SEQ ID NO: 521311 - DNA, 20 bp, Artificial Sequence
  chemically synthesized
cttataataaaataacttta

SEQ ID NO: 521312 - DNA, 20 bp, Artificial Sequence
  chemically synthesized
ggtaaaagtgacacaaaaag

SEQ ID NO: 521313 - DNA, 20 bp, Artificial Sequence
  chemically synthesized
tgttatggaaaaagatgaaa

SEQ ID NO: 521314 - DNA, 20 bp, Artificial Sequence
  chemically synthesized
agatatatgtgtctacgttg

SEQ ID NO: 521315 - DNA, 20 bp, Artificial Sequence
  chemically synthesized
tatatctaaatgtgaagttg

SEQ ID NO: 521316 - DNA, 20 bp, Artificial Sequence
  chemically synthesized
tgtgaagttggcgggttcaa

SEQ ID NO: 521317 - DNA, 20 bp, Artificial Sequence
  chemically synthesized
aaaaaaaaaaaaaaaatgaa

SEQ ID NO: 521318 - DNA, 20 bp, Artificial Sequence
  chemically synthesized
tcaaaaaaaaaaaaaaaaaa

SEQ ID NO: 521319 - DNA, 20 bp, Artificial Sequence
  chemically synthesized
ttttttttttttttttgaga

SEQ ID NO: 521320 - DNA, 20 bp, Artificial Sequence
  chemically synthesized
tcttgctctgtcacccaggc

SEQ ID NO: 521321 - DNA, 20 bp, Artificial Sequence
  chemically synthesized
tcgtgacactgcactccagc

SEQ ID NO: 521322 - DNA, 20 bp, Artificial Sequence
  chemically synthesized
actaaaaatagaaaaattag

SEQ ID NO: 521323 - DNA, 20 bp, Artificial Sequence
  chemically synthesized
ttttctatttttagtagaga

SEQ ID NO: 521324 - DNA, 20 bp, Artificial Sequence
  chemically synthesized
cggggtttcaccatgttggc

SEQ ID NO: 521325 - DNA, 20 bp, Artificial Sequence
  chemically synthesized
actttgggaggccgaggctg

SEQ ID NO: 521326 - DNA, 20 bp, Artificial Sequence
  chemically synthesized
gcctcggcctcccaaagtgt

SEQ ID NO: 521327 - DNA, 20 bp, Artificial Sequence
  chemically synthesized
taaagctggagcaatcagtt

SEQ ID NO: 521328 - DNA, 20 bp, Artificial Sequence
  chemically synthesized
ctttacaaaatgataaaccc

SEQ ID NO: 521329 - DNA, 20 bp, Artificial Sequence
  chemically synthesized
ataggcgtgagacacaattc

SEQ ID NO: 521330 - DNA, 20 bp, Artificial Sequence
  chemically synthesized
acttcagtcccccaggtagc

SEQ ID NO: 521331 - DNA, 20 bp, Artificial Sequence
  chemically synthesized
tacctgggggactgaagtgg

SEQ ID NO: 521332 - DNA, 20 bp, Artificial Sequence
  chemically synthesized
tgggagaataacttgagccc

SEQ ID NO: 521333 - DNA, 20 bp, Artificial Sequence
  chemically synthesized
acttttttaaaaatttttcc

SEQ ID NO: 521334 - DNA, 20 bp, Artificial Sequence
  chemically synthesized
gaaaaatttttaaaaaagtt

SEQ ID NO: 521335 - DNA, 20 bp, Artificial Sequence
  chemically synthesized
aagttatgaattaaaaaact

SEQ ID NO: 521336 - DNA, 20 bp, Artificial Sequence
  chemically synthesized
taaaagaacctaaagtacac

SEQ ID NO: 521337 - DNA, 20 bp, Artificial Sequence
  chemically synthesized
tacttctgtatcttaccgtg

SEQ ID NO: 521338 - DNA, 20 bp, Artificial Sequence
  chemically synthesized
ttcacggtaagatacagaag

SEQ ID NO: 521339 - DNA, 20 bp, Artificial Sequence
  chemically synthesized
agatacagaagtagagttca

SEQ ID NO: 521340 - DNA, 20 bp, Artificial Sequence
  chemically synthesized
gagttactgcaaatttaaac

SEQ ID NO: 521341 - DNA, 20 bp, Artificial Sequence
  chemically synthesized
taatttgtgaaatcaagaga

SEQ ID NO: 521342 - DNA, 20 bp, Artificial Sequence
  chemically synthesized
ggaacttcatagttgtatga

SEQ ID NO: 521343 - DNA, 20 bp, Artificial Sequence
  chemically synthesized
ctcacatgattgagtatctt

SEQ ID NO: 521344 - DNA, 20 bp, Artificial Sequence
  chemically synthesized
gtaactttgtgctcacatga

SEQ ID NO: 521345 - DNA, 20 bp, Artificial Sequence
  chemically synthesized
gaaatggcttcggagataca

SEQ ID NO: 521346 - DNA, 20 bp, Artificial Sequence
  chemically synthesized
atgagggtttttatggagac

SEQ ID NO: 521347 - DNA, 20 bp, Artificial Sequence
  chemically synthesized
ggtatatatacgtggcttat

SEQ ID NO: 521348 - DNA, 20 bp, Artificial Sequence
  chemically synthesized
catagactatatttgtagct

SEQ ID NO: 521349 - DNA, 20 bp, Artificial Sequence
  chemically synthesized
cagctacaaatatagtctat

SEQ ID NO: 521350 - DNA, 20 bp, Artificial Sequence
  chemically synthesized
tttcatattaaatgatagta

SEQ ID NO: 521351 - DNA, 20 bp, Artificial Sequence
  chemically synthesized
tataataatatagtatagaa

SEQ ID NO: 521352 - DNA, 20 bp, Artificial Sequence
  chemically synthesized
tattctataataatatagta

SEQ ID NO: 521353 - DNA, 20 bp, Artificial Sequence
  chemically synthesized
tattctatactatattatta

SEQ ID NO: 521354 - DNA, 20 bp, Artificial Sequence
  chemically synthesized
atatatgttataatatagaa

SEQ ID NO: 521355 - DNA, 20 bp, Artificial Sequence
  chemically synthesized
ataatatatatgttataata

SEQ ID NO: 521356 - DNA, 20 bp, Artificial Sequence
  chemically synthesized
agaaatgtatatatataata

SEQ ID NO: 521357 - DNA, 20 bp, Artificial Sequence
  chemically synthesized
tagttggacacagagcagcc

SEQ ID NO: 521358 - DNA, 20 bp, Artificial Sequence
  chemically synthesized
ctctgtgtccaactacattt

SEQ ID NO: 521359 - DNA, 20 bp, Artificial Sequence
  chemically synthesized
catttgggagtcacctctta

SEQ ID NO: 521360 - DNA, 20 bp, Artificial Sequence
  chemically synthesized
ttactgaatccttttatata

SEQ ID NO: 521361 - DNA, 20 bp, Artificial Sequence
  chemically synthesized
gcaagtgacccagtatataa

SEQ ID NO: 521362 - DNA, 20 bp, Artificial Sequence
  chemically synthesized
catttgactatcatatgcca

SEQ ID NO: 521363 - DNA, 20 bp, Artificial Sequence
  chemically synthesized
tgactatcatatgccacaga

SEQ ID NO: 521364 - DNA, 20 bp, Artificial Sequence
  chemically synthesized
actataaataaaacacaaaa

SEQ ID NO: 521365 - DNA, 20 bp, Artificial Sequence
  chemically synthesized
tgagaaaaggctatctataa

SEQ ID NO: 521366 - DNA, 20 bp, Artificial Sequence
  chemically synthesized
ctaacacaaattgttcttat

SEQ ID NO: 521367 - DNA, 20 bp, Artificial Sequence
  chemically synthesized
ttatctactttaaaatagaa

SEQ ID NO: 521368 - DNA, 20 bp, Artificial Sequence
  chemically synthesized
tcatagaaccaaaataatag

SEQ ID NO: 521369 - DNA, 20 bp, Artificial Sequence
  chemically synthesized
ctattattttggttctatga

SEQ ID NO: 521370 - DNA, 20 bp, Artificial Sequence
  chemically synthesized
agatttctcagtcctggact

SEQ ID NO: 521371 - DNA, 20 bp, Artificial Sequence
  chemically synthesized
aaatctcaaacactaagcat

SEQ ID NO: 521372 - DNA, 20 bp, Artificial Sequence
  chemically synthesized
atgtatatactcacatttat

SEQ ID NO: 521373 - DNA, 20 bp, Artificial Sequence
  chemically synthesized
gatcatatattcccataaat

SEQ ID NO: 521374 - DNA, 20 bp, Artificial Sequence
  chemically synthesized
gaagtgtgtgtctgctttac

SEQ ID NO: 521375 - DNA, 20 bp, Artificial Sequence
  chemically synthesized
ttatcaagatacttgaaagc

SEQ ID NO: 521376 - DNA, 20 bp, Artificial Sequence
  chemically synthesized
acttaaccaaaagctggttt

SEQ ID NO: 521377 - DNA, 20 bp, Artificial Sequence
  chemically synthesized
aaccaaaagctggtttagga

SEQ ID NO: 521378 - DNA, 20 bp, Artificial Sequence
  chemically synthesized
agctggtttaggaatggatt

SEQ ID NO: 521379 - DNA, 20 bp, Artificial Sequence
  chemically synthesized
gaatggattatgaatggctt

SEQ ID NO: 521380 - DNA, 20 bp, Artificial Sequence
  chemically synthesized
ggattatgaatggcttatga

SEQ ID NO: 521381 - DNA, 20 bp, Artificial Sequence
  chemically synthesized
ttgcaggagcatttgaactg

SEQ ID NO: 521382 - DNA, 20 bp, Artificial Sequence
  chemically synthesized
tatgtaaaaggttgtatgta

SEQ ID NO: 521383 - DNA, 20 bp, Artificial Sequence
  chemically synthesized
actcctcagaaaaatacaca

SEQ ID NO: 521384 - DNA, 20 bp, Artificial Sequence
  chemically synthesized
attcactgtgtatttttctg

SEQ ID NO: 521385 - DNA, 20 bp, Artificial Sequence
  chemically synthesized
cagcttttatcagactgaca

SEQ ID NO: 521386 - DNA, 20 bp, Artificial Sequence
  chemically synthesized
aataaattgtgaacaaagtg

SEQ ID NO: 521387 - DNA, 20 bp, Artificial Sequence
  chemically synthesized
tagtcatgaaggctgcttta

SEQ ID NO: 521388 - DNA, 20 bp, Artificial Sequence
  chemically synthesized
gaatatttatctaaaatgta

SEQ ID NO: 521389 - DNA, 20 bp, Artificial Sequence
  chemically synthesized
ggatcaggaaggtctcactg

SEQ ID NO: 521390 - DNA, 20 bp, Artificial Sequence
  chemically synthesized
agaccttcctgatcccaaac

SEQ ID NO: 521391 - DNA, 20 bp, Artificial Sequence
  chemically synthesized
gtatttatttaattcaggtt

SEQ ID NO: 521392 - DNA, 20 bp, Artificial Sequence
  chemically synthesized
ataagtgcatgagagagcgt

SEQ ID NO: 521393 - DNA, 20 bp, Artificial Sequence
  chemically synthesized
acaagcatatgtaagtagtc

SEQ ID NO: 521394 - DNA, 20 bp, Artificial Sequence
  chemically synthesized
actataaataaaacacaaaa

SEQ ID NO: 521395 - DNA, 20 bp, Artificial Sequence
  chemically synthesized
tgactgtcatatgccacaga

SEQ ID NO: 521396 - DNA, 20 bp, Artificial Sequence
  chemically synthesized
catttgactgtcatatgcca

SEQ ID NO: 521397 - DNA, 20 bp, Artificial Sequence
  chemically synthesized
gcaagtgacccagtatataa

SEQ ID NO: 521398 - DNA, 20 bp, Artificial Sequence
  chemically synthesized
atactgaatccttttatata

SEQ ID NO: 521399 - DNA, 20 bp, Artificial Sequence
  chemically synthesized
catttgggagtcacctcata

SEQ ID NO: 521400 - DNA, 20 bp, Artificial Sequence
  chemically synthesized
ctctgtgtccaactacattt

SEQ ID NO: 521401 - DNA, 20 bp, Artificial Sequence
  chemically synthesized
tagttggacacagagcagcc

SEQ ID NO: 521402 - DNA, 20 bp, Artificial Sequence
  chemically synthesized
ctttaaagtgaaattaattt

SEQ ID NO: 521403 - DNA, 20 bp, Artificial Sequence
  chemically synthesized
aagaaatgccttcaggaaaa

SEQ ID NO: 521404 - DNA, 20 bp, Artificial Sequence
  chemically synthesized
catttcttgtctctgaaaat

SEQ ID NO: 521405 - DNA, 20 bp, Artificial Sequence
  chemically synthesized
ttccgttttctttggcttct

SEQ ID NO: 521406 - DNA, 20 bp, Artificial Sequence
  chemically synthesized
tctttggcttctaggggtcc

SEQ ID NO: 521407 - DNA, 20 bp, Artificial Sequence
  chemically synthesized
taggggtcccagaataacat

SEQ ID NO: 521408 - DNA, 20 bp, Artificial Sequence
  chemically synthesized
agaggtcagttgcttggatt

SEQ ID NO: 521409 - DNA, 20 bp, Artificial Sequence
  chemically synthesized
aagcaaaagaggtcagttgc

SEQ ID NO: 521410 - DNA, 20 bp, Artificial Sequence
  chemically synthesized
ctctttattggtgaggttat

SEQ ID NO: 521411 - DNA, 20 bp, Artificial Sequence
  chemically synthesized
aataaagagctatttgacag

SEQ ID NO: 521412 - DNA, 20 bp, Artificial Sequence
  chemically synthesized
ctattgaagaattgtaagca

SEQ ID NO: 521413 - DNA, 20 bp, Artificial Sequence
  chemically synthesized
aaagcagtagtatgctattg

SEQ ID NO: 521414 - DNA, 20 bp, Artificial Sequence
  chemically synthesized
agaaatgaaagctcctgagt

SEQ ID NO: 521415 - DNA, 20 bp, Artificial Sequence
  chemically synthesized
cattcaagaaatgaaagctc

SEQ ID NO: 521416 - DNA, 20 bp, Artificial Sequence
  chemically synthesized
aactcaggagctttcatttc

SEQ ID NO: 521417 - DNA, 20 bp, Artificial Sequence
  chemically synthesized
ttatttatttatttttgaga

SEQ ID NO: 521418 - DNA, 20 bp, Artificial Sequence
  chemically synthesized
tcttgctctgtcgcccaggc

SEQ ID NO: 521419 - DNA, 20 bp, Artificial Sequence
  chemically synthesized
ctcactgcaacctccacctc

SEQ ID NO: 521420 - DNA, 20 bp, Artificial Sequence
  chemically synthesized
tacttgggaggctgaggctg

SEQ ID NO: 521421 - DNA, 20 bp, Artificial Sequence
  chemically synthesized
gcctcagcctcccaagtagc

SEQ ID NO: 521422 - DNA, 20 bp, Artificial Sequence
  chemically synthesized
agagatgaagtttcactatg

SEQ ID NO: 521423 - DNA, 20 bp, Artificial Sequence
  chemically synthesized
cgggtggatcacctgaggtc

SEQ ID NO: 521424 - DNA, 20 bp, Artificial Sequence
  chemically synthesized
actttgggaggccgaggcgg

SEQ ID NO: 521425 - DNA, 20 bp, Artificial Sequence
  chemically synthesized
caacactttgggaggccgag

SEQ ID NO: 521426 - DNA, 20 bp, Artificial Sequence
  chemically synthesized
gcctcggcctcccaaagtgt

SEQ ID NO: 521427 - DNA, 20 bp, Artificial Sequence
  chemically synthesized
gtgggaaggaacagaaaggc

SEQ ID NO: 521428 - DNA, 20 bp, Artificial Sequence
  chemically synthesized
gcataagctctttactccaa

SEQ ID NO: 521429 - DNA, 20 bp, Artificial Sequence
  chemically synthesized
atcaaggaagcctattctgt

SEQ ID NO: 521430 - DNA, 20 bp, Artificial Sequence
  chemically synthesized
gcttccttgatattctcttt

SEQ ID NO: 521431 - DNA, 20 bp, Artificial Sequence
  chemically synthesized
acattatctgtattcagaaa

SEQ ID NO: 521432 - DNA, 20 bp, Artificial Sequence
  chemically synthesized
aaatattaacatttctctga

SEQ ID NO: 521433 - DNA, 20 bp, Artificial Sequence
  chemically synthesized
ccattgacagtaagtttcac

SEQ ID NO: 521434 - DNA, 20 bp, Artificial Sequence
  chemically synthesized
acataaaaggtgctagttgc

SEQ ID NO: 521435 - DNA, 20 bp, Artificial Sequence
  chemically synthesized
gtactgtttttaattaaaat

SEQ ID NO: 521436 - DNA, 20 bp, Artificial Sequence
  chemically synthesized
tgtttttaattaaaatttga

SEQ ID NO: 521437 - DNA, 20 bp, Artificial Sequence
  chemically synthesized
ctgacaaattagtacaatct

SEQ ID NO: 521438 - DNA, 20 bp, Artificial Sequence
  chemically synthesized
gaaccagccttttataatac

SEQ ID NO: 521439 - DNA, 20 bp, Artificial Sequence
  chemically synthesized
tcaatcaaaacatgttacaa

SEQ ID NO: 521440 - DNA, 20 bp, Artificial Sequence
  chemically synthesized
tcaactaggccataatcttg

SEQ ID NO: 521441 - DNA, 20 bp, Artificial Sequence
  chemically synthesized
tatatatagatataaaataa

SEQ ID NO: 521442 - DNA, 20 bp, Artificial Sequence
  chemically synthesized
taatgcaacataaatttgcc

SEQ ID NO: 521443 - DNA, 20 bp, Artificial Sequence
  chemically synthesized
gcaacccatcatgatacaag

SEQ ID NO: 521444 - DNA, 20 bp, Artificial Sequence
  chemically synthesized
cagattctacttgtatcatg

SEQ ID NO: 521445 - DNA, 20 bp, Artificial Sequence
  chemically synthesized
ggctaagattacaattaaat

SEQ ID NO: 521446 - DNA, 20 bp, Artificial Sequence
  chemically synthesized
tagccaacttttgctcatag

SEQ ID NO: 521447 - DNA, 20 bp, Artificial Sequence
  chemically synthesized
tgaatgaatgaagaaatgaa

SEQ ID NO: 521448 - DNA, 20 bp, Artificial Sequence
  chemically synthesized
gttgttgaatgaatgaagaa

SEQ ID NO: 521449 - DNA, 20 bp, Artificial Sequence
  chemically synthesized
ataaaagtcagtgttgttga

SEQ ID NO: 521450 - DNA, 20 bp, Artificial Sequence
  chemically synthesized
tagcataaaagtcagtgttg

SEQ ID NO: 521451 - DNA, 20 bp, Artificial Sequence
  chemically synthesized
aactcactcagggcctggca

SEQ ID NO: 521452 - DNA, 20 bp, Artificial Sequence
  chemically synthesized
atgctactctatgccaggcc

SEQ ID NO: 521453 - DNA, 20 bp, Artificial Sequence
  chemically synthesized
tactctatgccaggccctga

SEQ ID NO: 521454 - DNA, 20 bp, Artificial Sequence
  chemically synthesized
agccagagaaacatagaaag

SEQ ID NO: 521455 - DNA, 20 bp, Artificial Sequence
  chemically synthesized
ttaggctagaagaaatagca

SEQ ID NO: 521456 - DNA, 20 bp, Artificial Sequence
  chemically synthesized
aaggagtagatacagggagg

SEQ ID NO: 521457 - DNA, 20 bp, Artificial Sequence
  chemically synthesized
gcctgtaatcccagcacttt

SEQ ID NO: 521458 - DNA, 20 bp, Artificial Sequence
  chemically synthesized
gccatggactcccaaagtgc

SEQ ID NO: 521459 - DNA, 20 bp, Artificial Sequence
  chemically synthesized
actttgggagtccatggcag

SEQ ID NO: 521460 - DNA, 20 bp, Artificial Sequence
  chemically synthesized
caggtggatcacctgaggtc

SEQ ID NO: 521461 - DNA, 20 bp, Artificial Sequence
  chemically synthesized
ttttgtatttttaggagaga

SEQ ID NO: 521462 - DNA, 20 bp, Artificial Sequence
  chemically synthesized
tcctcagcctcccgagtagc

SEQ ID NO: 521463 - DNA, 20 bp, Artificial Sequence
  chemically synthesized
gattctccctcctcagcctc

SEQ ID NO: 521464 - DNA, 20 bp, Artificial Sequence
  chemically synthesized
tactcgggaggctgaggagg

SEQ ID NO: 521465 - DNA, 20 bp, Artificial Sequence
  chemically synthesized
tcttgctctgtcgccctgcc

SEQ ID NO: 521466 - DNA, 20 bp, Artificial Sequence
  chemically synthesized
ctttttttttttttttgaga

SEQ ID NO: 521467 - DNA, 20 bp, Artificial Sequence
  chemically synthesized
agcaagaaatttcatgtagt

SEQ ID NO: 521468 - DNA, 20 bp, Artificial Sequence
  chemically synthesized
taagacagattttaggttaa

SEQ ID NO: 521469 - DNA, 20 bp, Artificial Sequence
  chemically synthesized
tttttcctttcaaatatgtt

SEQ ID NO: 521470 - DNA, 20 bp, Artificial Sequence
  chemically synthesized
ccaaatttgtttttgtaata

SEQ ID NO: 521471 - DNA, 20 bp, Artificial Sequence
  chemically synthesized
aacacacatatgacaacgtt

SEQ ID NO: 521472 - DNA, 20 bp, Artificial Sequence
  chemically synthesized
gcttgatttggcagaagtaa

SEQ ID NO: 521473 - DNA, 20 bp, Artificial Sequence
  chemically synthesized
ccaaatcaagcaacactcac

SEQ ID NO: 521474 - DNA, 20 bp, Artificial Sequence
  chemically synthesized
tgtgtacttataccacccgt

SEQ ID NO: 521475 - DNA, 20 bp, Artificial Sequence
  chemically synthesized
ttcccataaaaggctgatct

SEQ ID NO: 521476 - DNA, 20 bp, Artificial Sequence
  chemically synthesized
ttcatagatcagccttttat

SEQ ID NO: 521477 - DNA, 20 bp, Artificial Sequence
  chemically synthesized
agattgttttaatatgttga

SEQ ID NO: 521478 - DNA, 20 bp, Artificial Sequence
  chemically synthesized
aaaaagattgttttaatatg

SEQ ID NO: 521479 - DNA, 20 bp, Artificial Sequence
  chemically synthesized
gaacaatttcaagggaacct

SEQ ID NO: 521480 - DNA, 20 bp, Artificial Sequence
  chemically synthesized
ctcttgattattaatataaa

SEQ ID NO: 521481 - DNA, 20 bp, Artificial Sequence
  chemically synthesized
ttcgatttatattaataatc

SEQ ID NO: 521482 - DNA, 20 bp, Artificial Sequence
  chemically synthesized
agtttgtacactacagaaaa

SEQ ID NO: 521483 - DNA, 20 bp, Artificial Sequence
  chemically synthesized
gcccccaaagctactgatac

SEQ ID NO: 521484 - DNA, 20 bp, Artificial Sequence
  chemically synthesized
ggggctattagcactacctc

SEQ ID NO: 521485 - DNA, 20 bp, Artificial Sequence
  chemically synthesized
ctcataccaagcatgctcct

SEQ ID NO: 521486 - DNA, 20 bp, Artificial Sequence
  chemically synthesized
ttcaaaggagcatgcttggt

SEQ ID NO: 521487 - DNA, 20 bp, Artificial Sequence
  chemically synthesized
tcacagtatcaacttctgca

SEQ ID NO: 521488 - DNA, 20 bp, Artificial Sequence
  chemically synthesized
tatctatcctgtcttcattt

SEQ ID NO: 521489 - DNA, 20 bp, Artificial Sequence
  chemically synthesized
atgatatccaaaaatgaaga

SEQ ID NO: 521490 - DNA, 20 bp, Artificial Sequence
  chemically synthesized
tcaaatgtatggtgtccctt

SEQ ID NO: 521491 - DNA, 20 bp, Artificial Sequence
  chemically synthesized
aaatcaaacactacttcttc

SEQ ID NO: 521492 - DNA, 20 bp, Artificial Sequence
  chemically synthesized
ttttttttttttttttgaga

SEQ ID NO: 521493 - DNA, 20 bp, Artificial Sequence
  chemically synthesized
tctcgctctgtcacccaggc

SEQ ID NO: 521494 - DNA, 20 bp, Artificial Sequence
  chemically synthesized
tcgcaccactgcactccagc

SEQ ID NO: 521495 - DNA, 20 bp, Artificial Sequence
  chemically synthesized
tactctggaggctgaggcag

SEQ ID NO: 521496 - DNA, 20 bp, Artificial Sequence
  chemically synthesized
cattctcctgcctcagcctc

SEQ ID NO: 521497 - DNA, 20 bp, Artificial Sequence
  chemically synthesized
tgcctcagcctccagagtag

SEQ ID NO: 521498 - DNA, 20 bp, Artificial Sequence
  chemically synthesized
ttttgtatttttagtagaga

SEQ ID NO: 521499 - DNA, 20 bp, Artificial Sequence
  chemically synthesized
cggggtttcaccatgttagc

SEQ ID NO: 521500 - DNA, 20 bp, Artificial Sequence
  chemically synthesized
actttgggaggccaaggtgg

SEQ ID NO: 521501 - DNA, 20 bp, Artificial Sequence
  chemically synthesized
cagcactttgggaggccaag

SEQ ID NO: 521502 - DNA, 20 bp, Artificial Sequence
  chemically synthesized
accttggcctcccaaagtgc

SEQ ID NO: 521503 - DNA, 20 bp, Artificial Sequence
  chemically synthesized
caccgcgcccggccttcttc

SEQ ID NO: 521504 - DNA, 20 bp, Artificial Sequence
  chemically synthesized
gatgatttaaaaagctcttt

SEQ ID NO: 521505 - DNA, 20 bp, Artificial Sequence
  chemically synthesized
ctctataaaatctccagagc

SEQ ID NO: 521506 - DNA, 20 bp, Artificial Sequence
  chemically synthesized
ttttttttatttttttgaga

SEQ ID NO: 521507 - DNA, 20 bp, Artificial Sequence
  chemically synthesized
tttgctcttgtcacccaggc

SEQ ID NO: 521508 - DNA, 20 bp, Artificial Sequence
  chemically synthesized
tggtgccattgcactccagc

SEQ ID NO: 521509 - DNA, 20 bp, Artificial Sequence
  chemically synthesized
aggctgaggcaggagaatct

SEQ ID NO: 521510 - DNA, 20 bp, Artificial Sequence
  chemically synthesized
tacttgggaggctgaggcag

SEQ ID NO: 521511 - DNA, 20 bp, Artificial Sequence
  chemically synthesized
gcctcagcctcccaagtagc

SEQ ID NO: 521512 - DNA, 20 bp, Artificial Sequence
  chemically synthesized
gtttgtatttttagtagaga

SEQ ID NO: 521513 - DNA, 20 bp, Artificial Sequence
  chemically synthesized
cgagtaaatcgcttgaggcc

SEQ ID NO: 521514 - DNA, 20 bp, Artificial Sequence
  chemically synthesized
cagcactttgggaggctgag

SEQ ID NO: 521515 - DNA, 20 bp, Artificial Sequence
  chemically synthesized
gcctcagcctcccaaagtgc

SEQ ID NO: 521516 - DNA, 20 bp, Artificial Sequence
  chemically synthesized
ccttctgagctgccttagca

SEQ ID NO: 521517 - DNA, 20 bp, Artificial Sequence
  chemically synthesized
tgccttagcaaagggtatct

SEQ ID NO: 521518 - DNA, 20 bp, Artificial Sequence
  chemically synthesized
gggtatctgggaatatcaaa

SEQ ID NO: 521519 - DNA, 20 bp, Artificial Sequence
  chemically synthesized
ctggacattataatttgctt

SEQ ID NO: 521520 - DNA, 20 bp, Artificial Sequence
  chemically synthesized
cataagcaaattataatgtc

SEQ ID NO: 521521 - DNA, 20 bp, Artificial Sequence
  chemically synthesized
acaaacttgatattgaaaat

SEQ ID NO: 521522 - DNA, 20 bp, Artificial Sequence
  chemically synthesized
tcaagtttgtgttttaccag

SEQ ID NO: 521523 - DNA, 20 bp, Artificial Sequence
  chemically synthesized
atcaaaattataagaaatta

SEQ ID NO: 521524 - DNA, 20 bp, Artificial Sequence
  chemically synthesized
agtatagttctatgtgctat

SEQ ID NO: 521525 - DNA, 20 bp, Artificial Sequence
  chemically synthesized
tatgtgctataaggatcctc

SEQ ID NO: 521526 - DNA, 20 bp, Artificial Sequence
  chemically synthesized
gtattattttttacattctg

SEQ ID NO: 521527 - DNA, 20 bp, Artificial Sequence
  chemically synthesized
aaaaaataatacctgttctc

SEQ ID NO: 521528 - DNA, 20 bp, Artificial Sequence
  chemically synthesized
gaatcttatttaacagttga

SEQ ID NO: 521529 - DNA, 20 bp, Artificial Sequence
  chemically synthesized
ttaacagttgagagaatgag

SEQ ID NO: 521530 - DNA, 20 bp, Artificial Sequence
  chemically synthesized
gttgagagaatgagctggat

SEQ ID NO: 521531 - DNA, 20 bp, Artificial Sequence
  chemically synthesized
ctctgaggtgataaaagtct

SEQ ID NO: 521532 - DNA, 20 bp, Artificial Sequence
  chemically synthesized
aggaaaatactgtatttttt

SEQ ID NO: 521533 - DNA, 20 bp, Artificial Sequence
  chemically synthesized
gctttaaggaaagtttttaa

SEQ ID NO: 521534 - DNA, 20 bp, Artificial Sequence
  chemically synthesized
tgcttctatgtggaaccatc

SEQ ID NO: 521535 - DNA, 20 bp, Artificial Sequence
  chemically synthesized
ttgtttcacaattttaaatc

SEQ ID NO: 521536 - DNA, 20 bp, Artificial Sequence
  chemically synthesized
aacatctacaagtttatgct

SEQ ID NO: 521537 - DNA, 20 bp, Artificial Sequence
  chemically synthesized
tcctccctaataccagtgaa

SEQ ID NO: 521538 - DNA, 20 bp, Artificial Sequence
  chemically synthesized
tgttgatacagatgttactg

SEQ ID NO: 521539 - DNA, 20 bp, Artificial Sequence
  chemically synthesized
gtgatcagtgaaatttacat

SEQ ID NO: 521540 - DNA, 20 bp, Artificial Sequence
  chemically synthesized
aaaaaaaaaaaaaaaaaaaa

SEQ ID NO: 521541 - DNA, 20 bp, Artificial Sequence
  chemically synthesized
ttttttttttttttttgaga

SEQ ID NO: 521542 - DNA, 20 bp, Artificial Sequence
  chemically synthesized
cctccaggctgggcgacaga

SEQ ID NO: 521543 - DNA, 20 bp, Artificial Sequence
  chemically synthesized
ctgccctccaggctgggcga

SEQ ID NO: 521544 - DNA, 20 bp, Artificial Sequence
  chemically synthesized
tgcttgggaggctgaggcag

SEQ ID NO: 521545 - DNA, 20 bp, Artificial Sequence
  chemically synthesized
ttttgtatttttagtagaga

SEQ ID NO: 521546 - DNA, 20 bp, Artificial Sequence
  chemically synthesized
gggatgaattacctgaggtc

SEQ ID NO: 521547 - DNA, 20 bp, Artificial Sequence
  chemically synthesized
cactttgggaggctgagggg

SEQ ID NO: 521548 - DNA, 20 bp, Artificial Sequence
  chemically synthesized
ccagcactttgggaggctga

SEQ ID NO: 521549 - DNA, 20 bp, Artificial Sequence
  chemically synthesized
ccctcagcctcccaaagtgc

SEQ ID NO: 521550 - DNA, 20 bp, Artificial Sequence
  chemically synthesized
gtaaaatcatactagcagac

SEQ ID NO: 521551 - DNA, 20 bp, Artificial Sequence
  chemically synthesized
atttggactgcaacacataa

SEQ ID NO: 521552 - DNA, 20 bp, Artificial Sequence
  chemically synthesized
tgaatctttcccagatagga

SEQ ID NO: 521553 - DNA, 20 bp, Artificial Sequence
  chemically synthesized
ttctcttccgctaaactggg

SEQ ID NO: 521554 - DNA, 20 bp, Artificial Sequence
  chemically synthesized
cgttttctcttccgctaaac

SEQ ID NO: 521555 - DNA, 20 bp, Artificial Sequence
  chemically synthesized
aaactggtgcttatctatca

SEQ ID NO: 521556 - DNA, 20 bp, Artificial Sequence
  chemically synthesized
ctgcgctgtatataaatata

SEQ ID NO: 521557 - DNA, 20 bp, Artificial Sequence
  chemically synthesized
actgaataatattggttaat

SEQ ID NO: 521558 - DNA, 20 bp, Artificial Sequence
  chemically synthesized
gagcaagttgctaactttct

SEQ ID NO: 521559 - DNA, 20 bp, Artificial Sequence
  chemically synthesized
atggtgtaaaccaattctgc

SEQ ID NO: 521560 - DNA, 20 bp, Artificial Sequence
  chemically synthesized
tgtaaaccaattctgcttga

SEQ ID NO: 521561 - DNA, 20 bp, Artificial Sequence
  chemically synthesized
tgacagcagacccattcaag

SEQ ID NO: 521562 - DNA, 20 bp, Artificial Sequence
  chemically synthesized
cttgaatgggtctgctgtca

SEQ ID NO: 521563 - DNA, 20 bp, Artificial Sequence
  chemically synthesized
gtgctacttaagagaagggc

SEQ ID NO: 521564 - DNA, 20 bp, Artificial Sequence
  chemically synthesized
cggcactaaagacttataac

SEQ ID NO: 521565 - DNA, 20 bp, Artificial Sequence
  chemically synthesized
cacagggaaggagcagtaaa

SEQ ID NO: 521566 - DNA, 20 bp, Artificial Sequence
  chemically synthesized
aaacaatgtttatttagaaa

SEQ ID NO: 521567 - DNA, 20 bp, Artificial Sequence
  chemically synthesized
tgagagagttaaatttatgt

SEQ ID NO: 521568 - DNA, 20 bp, Artificial Sequence
  chemically synthesized
agtaaaaatgaccttgctga

SEQ ID NO: 521569 - DNA, 20 bp, Artificial Sequence
  chemically synthesized
tcatttttactttttgcaga

SEQ ID NO: 521570 - DNA, 20 bp, Artificial Sequence
  chemically synthesized
ctctcgtggcaaaactgctg

SEQ ID NO: 521571 - DNA, 20 bp, Artificial Sequence
  chemically synthesized
ctcgccagcagttttgccac

SEQ ID NO: 521572 - DNA, 20 bp, Artificial Sequence
  chemically synthesized
agtacaccgaacaaaggaga

SEQ ID NO: 521573 - DNA, 20 bp, Artificial Sequence
  chemically synthesized
atggaaaccggacacagcag

SEQ ID NO: 521574 - DNA, 20 bp, Artificial Sequence
  chemically synthesized
ctagccaatcgggacaaata

SEQ ID NO: 521575 - DNA, 20 bp, Artificial Sequence
  chemically synthesized
attacggctagtagatattt

SEQ ID NO: 521576 - DNA, 20 bp, Artificial Sequence
  chemically synthesized
tactatttattcccatttag

SEQ ID NO: 521577 - DNA, 20 bp, Artificial Sequence
  chemically synthesized
actttcctacccatctaaat

SEQ ID NO: 521578 - DNA, 20 bp, Artificial Sequence
  chemically synthesized
ctcctcagctcctccatttc

SEQ ID NO: 521579 - DNA, 20 bp, Artificial Sequence
  chemically synthesized
taccttttttaggcctagtg

SEQ ID NO: 521580 - DNA, 20 bp, Artificial Sequence
  chemically synthesized
ggtagggttaagggaaacta

SEQ ID NO: 521581 - DNA, 20 bp, Artificial Sequence
  chemically synthesized
acaatattcaaagttgtggg

SEQ ID NO: 521582 - DNA, 20 bp, Artificial Sequence
  chemically synthesized
ccttaaccctacccacaact

SEQ ID NO: 521583 - DNA, 20 bp, Artificial Sequence
  chemically synthesized
aagaaacaatattcaaagtt

SEQ ID NO: 521584 - DNA, 20 bp, Artificial Sequence
  chemically synthesized
caaacacacggcatgctaaa

SEQ ID NO: 521585 - DNA, 20 bp, Artificial Sequence
  chemically synthesized
tagcagacatatcatcatct

SEQ ID NO: 521586 - DNA, 20 bp, Artificial Sequence
  chemically synthesized
tgatatgtctgctattaatt

SEQ ID NO: 521587 - DNA, 20 bp, Artificial Sequence
  chemically synthesized
ggatttgttcgtcactccat

SEQ ID NO: 521588 - DNA, 20 bp, Artificial Sequence
  chemically synthesized
tggacttttattaactcata

SEQ ID NO: 521589 - DNA, 20 bp, Artificial Sequence
  chemically synthesized
tctatctagaaacatatctc

SEQ ID NO: 521590 - DNA, 20 bp, Artificial Sequence
  chemically synthesized
tgcctttaatgggcaagatg

SEQ ID NO: 521591 - DNA, 20 bp, Artificial Sequence
  chemically synthesized
cttggctgtaaaaaacagta

SEQ ID NO: 521592 - DNA, 20 bp, Artificial Sequence
  chemically synthesized
actcttgtccattaatctgt

SEQ ID NO: 521593 - DNA, 20 bp, Artificial Sequence
  chemically synthesized
acccaaacagattaatggac

SEQ ID NO: 521594 - DNA, 20 bp, Artificial Sequence
  chemically synthesized
acacgcaacataagaagata

SEQ ID NO: 521595 - DNA, 20 bp, Artificial Sequence
  chemically synthesized
cagcatctcttccagtgtcc

SEQ ID NO: 521596 - DNA, 20 bp, Artificial Sequence
  chemically synthesized
cattttaaaccagcatctgt

SEQ ID NO: 521597 - DNA, 20 bp, Artificial Sequence
  chemically synthesized
tgagttggtgtgccccttgt

SEQ ID NO: 521598 - DNA, 20 bp, Artificial Sequence
  chemically synthesized
gttttgctgtagaactgata

SEQ ID NO: 521599 - DNA, 20 bp, Artificial Sequence
  chemically synthesized
tctacagcaaaaccatatga

SEQ ID NO: 521600 - DNA, 20 bp, Artificial Sequence
  chemically synthesized
aaaaataaactgtttagaga

SEQ ID NO: 521601 - DNA, 20 bp, Artificial Sequence
  chemically synthesized
agagaaaggatgttttagct

SEQ ID NO: 521602 - DNA, 20 bp, Artificial Sequence
  chemically synthesized
gcctctgcctcccaaagtgc

SEQ ID NO: 521603 - DNA, 20 bp, Artificial Sequence
  chemically synthesized
actttgggaggcagaggcag

SEQ ID NO: 521604 - DNA, 20 bp, Artificial Sequence
  chemically synthesized
caggtggatcacctgaggcc

SEQ ID NO: 521605 - DNA, 20 bp, Artificial Sequence
  chemically synthesized
ttttatattagtagtacaga

SEQ ID NO: 521606 - DNA, 20 bp, Artificial Sequence
  chemically synthesized
ctactaatataaaattagtc

SEQ ID NO: 521607 - DNA, 20 bp, Artificial Sequence
  chemically synthesized
gcctcagcttcccgagtatc

SEQ ID NO: 521608 - DNA, 20 bp, Artificial Sequence
  chemically synthesized
gattctcctgcctcagcttc

SEQ ID NO: 521609 - DNA, 20 bp, Artificial Sequence
  chemically synthesized
tactcgggaagctgaggcag

SEQ ID NO: 521610 - DNA, 20 bp, Artificial Sequence
  chemically synthesized
ctcactgcaatctccgcctc

SEQ ID NO: 521611 - DNA, 20 bp, Artificial Sequence
  chemically synthesized
ttgcacagttgccctctagc

SEQ ID NO: 521612 - DNA, 20 bp, Artificial Sequence
  chemically synthesized
ttgttttttgttttttgaga

SEQ ID NO: 521613 - DNA, 20 bp, Artificial Sequence
  chemically synthesized
aaaaacaaaaaatgaaaacc

SEQ ID NO: 521614 - DNA, 20 bp, Artificial Sequence
  chemically synthesized
taaatgaaaatcaattaact

SEQ ID NO: 521615 - DNA, 20 bp, Artificial Sequence
  chemically synthesized
tataattccattaatacact

SEQ ID NO: 521616 - DNA, 20 bp, Artificial Sequence
  chemically synthesized
attaactcagagtgtattaa

SEQ ID NO: 521617 - DNA, 20 bp, Artificial Sequence
  chemically synthesized
aaattataattgtaaaactc

SEQ ID NO: 521618 - DNA, 20 bp, Artificial Sequence
  chemically synthesized
taattgtaaaactcctgaat

SEQ ID NO: 521619 - DNA, 20 bp, Artificial Sequence
  chemically synthesized
gagatattctatccaaattc

SEQ ID NO: 521620 - DNA, 20 bp, Artificial Sequence
  chemically synthesized
gtaaaactcctgaatttgga

SEQ ID NO: 521621 - DNA, 20 bp, Artificial Sequence
  chemically synthesized
attaacatgaaaaaattggt

SEQ ID NO: 521622 - DNA, 20 bp, Artificial Sequence
  chemically synthesized
ttaaaaagcaactataacct

SEQ ID NO: 521623 - DNA, 20 bp, Artificial Sequence
  chemically synthesized
aagcaactataacctatgga

SEQ ID NO: 521624 - DNA, 20 bp, Artificial Sequence
  chemically synthesized
ccacacttgtcacatggcta

SEQ ID NO: 521625 - DNA, 20 bp, Artificial Sequence
  chemically synthesized
ggaccagaagagcagttagt

SEQ ID NO: 521626 - DNA, 20 bp, Artificial Sequence
  chemically synthesized
caacaaagtatctttaatgt

SEQ ID NO: 521627 - DNA, 20 bp, Artificial Sequence
  chemically synthesized
agtgcctctttaatatgctt

SEQ ID NO: 521628 - DNA, 20 bp, Artificial Sequence
  chemically synthesized
aagctaggaaaatacagttt

SEQ ID NO: 521629 - DNA, 20 bp, Artificial Sequence
  chemically synthesized
attttacagctcctaggtgg

SEQ ID NO: 521630 - DNA, 20 bp, Artificial Sequence
  chemically synthesized
ccattcatcaatatagataa

SEQ ID NO: 521631 - DNA, 20 bp, Artificial Sequence
  chemically synthesized
gaaccctattatctatattg

SEQ ID NO: 521632 - DNA, 20 bp, Artificial Sequence
  chemically synthesized
actttgggaggccgaggcac

SEQ ID NO: 521633 - DNA, 20 bp, Artificial Sequence
  chemically synthesized
cacgcggatcacctgaggtc

SEQ ID NO: 521634 - DNA, 20 bp, Artificial Sequence
  chemically synthesized
tctgtattttttagtagaga

SEQ ID NO: 521635 - DNA, 20 bp, Artificial Sequence
  chemically synthesized
tacttgggaagctaaggcag

SEQ ID NO: 521636 - DNA, 20 bp, Artificial Sequence
  chemically synthesized
tcttgctctgttgcccaggc

SEQ ID NO: 521637 - DNA, 20 bp, Artificial Sequence
  chemically synthesized
tcttttctttttttgagaga

SEQ ID NO: 521638 - DNA, 20 bp, Artificial Sequence
  chemically synthesized
aactaatgtgatagtgtgtg

SEQ ID NO: 521639 - DNA, 20 bp, Artificial Sequence
  chemically synthesized
tacttcctcattttagaaaa

SEQ ID NO: 521640 - DNA, 20 bp, Artificial Sequence
  chemically synthesized
gagggaaacaagtctacctt

SEQ ID NO: 521641 - DNA, 20 bp, Artificial Sequence
  chemically synthesized
agaaagaatttgaataccaa

SEQ ID NO: 521642 - DNA, 20 bp, Artificial Sequence
  chemically synthesized
tttatcaaaggagaaagaat

SEQ ID NO: 521643 - DNA, 20 bp, Artificial Sequence
  chemically synthesized
gaaagttttatcaaaggaga

SEQ ID NO: 521644 - DNA, 20 bp, Artificial Sequence
  chemically synthesized
aacgtcaacttgaaatcatt

SEQ ID NO: 521645 - DNA, 20 bp, Artificial Sequence
  chemically synthesized
ttataagttcaaattaaagt

SEQ ID NO: 521646 - DNA, 20 bp, Artificial Sequence
  chemically synthesized
aaagtttaggaagtttggat

SEQ ID NO: 521647 - DNA, 20 bp, Artificial Sequence
  chemically synthesized
cttagaaaagtttaggaagt

SEQ ID NO: 521648 - DNA, 20 bp, Artificial Sequence
  chemically synthesized
tattattttatttcaaagag

SEQ ID NO: 521649 - DNA, 20 bp, Artificial Sequence
  chemically synthesized
taaattttagagttatctca

SEQ ID NO: 521650 - DNA, 20 bp, Artificial Sequence
  chemically synthesized
ttcttttaatgaataaattt

SEQ ID NO: 521651 - DNA, 20 bp, Artificial Sequence
  chemically synthesized
ctctaaaatttattcattaa

SEQ ID NO: 521652 - DNA, 20 bp, Artificial Sequence
  chemically synthesized
cttaaaggacgattctttta

SEQ ID NO: 521653 - DNA, 20 bp, Artificial Sequence
  chemically synthesized
aacaaaaaaaaccagccttc

SEQ ID NO: 521654 - DNA, 20 bp, Artificial Sequence
  chemically synthesized
taacacctgagtttttaaag

SEQ ID NO: 521655 - DNA, 20 bp, Artificial Sequence
  chemically synthesized
tgctcagtgaactgtaacac

SEQ ID NO: 521656 - DNA, 20 bp, Artificial Sequence
  chemically synthesized
agttcactgagcataatgta

SEQ ID NO: 521657 - DNA, 20 bp, Artificial Sequence
  chemically synthesized
gcataatgtattggatttct

SEQ ID NO: 521658 - DNA, 20 bp, Artificial Sequence
  chemically synthesized
gacagtgttacatttaatgc

SEQ ID NO: 521659 - DNA, 20 bp, Artificial Sequence
  chemically synthesized
ttgaaatcttcctaaagtgg

SEQ ID NO: 521660 - DNA, 20 bp, Artificial Sequence
  chemically synthesized
aataataatgatgtatttct

SEQ ID NO: 521661 - DNA, 20 bp, Artificial Sequence
  chemically synthesized
aacacatggacaaattgtag

SEQ ID NO: 521662 - DNA, 20 bp, Artificial Sequence
  chemically synthesized
ttggtatattatttcatatc

SEQ ID NO: 521663 - DNA, 20 bp, Artificial Sequence
  chemically synthesized
cttataagactgaatggact

SEQ ID NO: 521664 - DNA, 20 bp, Artificial Sequence
  chemically synthesized
tttaataagctcttataaga

SEQ ID NO: 521665 - DNA, 20 bp, Artificial Sequence
  chemically synthesized
taatacatatcaaattataa

SEQ ID NO: 521666 - DNA, 20 bp, Artificial Sequence
  chemically synthesized
catatatacgatgtaaaatg

SEQ ID NO: 521667 - DNA, 20 bp, Artificial Sequence
  chemically synthesized
ttccataccacttgccattt

SEQ ID NO: 521668 - DNA, 20 bp, Artificial Sequence
  chemically synthesized
agtggtatggaagcatataa

SEQ ID NO: 521669 - DNA, 20 bp, Artificial Sequence
  chemically synthesized
actaccccttgtcacagaaa

SEQ ID NO: 521670 - DNA, 20 bp, Artificial Sequence
  chemically synthesized
atgattcattttctgtgaca

SEQ ID NO: 521671 - DNA, 20 bp, Artificial Sequence
  chemically synthesized
gaagactactgtgaaattgt

SEQ ID NO: 521672 - DNA, 20 bp, Artificial Sequence
  chemically synthesized
gatggagatctgagcaaaat

SEQ ID NO: 521673 - DNA, 20 bp, Artificial Sequence
  chemically synthesized
gagcaaaatcagagttctat

SEQ ID NO: 521674 - DNA, 20 bp, Artificial Sequence
  chemically synthesized
agttctattggaatggacac

SEQ ID NO: 521675 - DNA, 20 bp, Artificial Sequence
  chemically synthesized
tgtcttaccaattaatatta

SEQ ID NO: 521676 - DNA, 20 bp, Artificial Sequence
  chemically synthesized
atttaatatcgtgatgctag

SEQ ID NO: 521677 - DNA, 20 bp, Artificial Sequence
  chemically synthesized
atcacgatattaaatacgtc

SEQ ID NO: 521678 - DNA, 20 bp, Artificial Sequence
  chemically synthesized
acttaatgtacagattttat

SEQ ID NO: 521679 - DNA, 20 bp, Artificial Sequence
  chemically synthesized
caaaaattaacttttggttc

SEQ ID NO: 521680 - DNA, 20 bp, Artificial Sequence
  chemically synthesized
gcgtatacatgcaggtcaca

SEQ ID NO: 521681 - DNA, 20 bp, Artificial Sequence
  chemically synthesized
cagatggcctgaagtaactg

SEQ ID NO: 521682 - DNA, 20 bp, Artificial Sequence
  chemically synthesized
catttccacttcttttgtgg

SEQ ID NO: 521683 - DNA, 20 bp, Artificial Sequence
  chemically synthesized
agccaggatgagccaggaga

SEQ ID NO: 521684 - DNA, 20 bp, Artificial Sequence
  chemically synthesized
agtgggggagctttttgagc

SEQ ID NO: 521685 - DNA, 20 bp, Artificial Sequence
  chemically synthesized
gttctctggtgggcaggagt

SEQ ID NO: 521686 - DNA, 20 bp, Artificial Sequence
  chemically synthesized
ggggttgttctctggtgggc

SEQ ID NO: 521687 - DNA, 20 bp, Artificial Sequence
  chemically synthesized
ggtaaaggaaaattacaaag

SEQ ID NO: 521688 - DNA, 20 bp, Artificial Sequence
  chemically synthesized
gagagtcagggaagggagat

SEQ ID NO: 521689 - DNA, 20 bp, Artificial Sequence
  chemically synthesized
aggcgggctgagtccgaaaa

SEQ ID NO: 521690 - DNA, 20 bp, Artificial Sequence
  chemically synthesized
atcacctgggtgcaggcggg

SEQ ID NO: 521691 - DNA, 20 bp, Artificial Sequence
  chemically synthesized
caataaagctttttaatcac

SEQ ID NO: 521692 - DNA, 20 bp, Artificial Sequence
  chemically synthesized
taagtaagtatgcttttcta

SEQ ID NO: 521693 - DNA, 20 bp, Artificial Sequence
  chemically synthesized
aatgtaaactcagaaatgta

SEQ ID NO: 521694 - DNA, 20 bp, Artificial Sequence
  chemically synthesized
tttagtgattccatacattt

SEQ ID NO: 521695 - DNA, 20 bp, Artificial Sequence
  chemically synthesized
actaaaaaaattatagaaaa

SEQ ID NO: 521696 - DNA, 20 bp, Artificial Sequence
  chemically synthesized
tgggattgcttttaatgtgc

SEQ ID NO: 521697 - DNA, 20 bp, Artificial Sequence
  chemically synthesized
gatttatcattatttttatt

SEQ ID NO: 521698 - DNA, 20 bp, Artificial Sequence
  chemically synthesized
tcagtttggaacacttaaat

SEQ ID NO: 521699 - DNA, 20 bp, Artificial Sequence
  chemically synthesized
ctcaggggaacactaaaagt

SEQ ID NO: 521700 - DNA, 20 bp, Artificial Sequence
  chemically synthesized
aagtgagagtaatttaaaag

SEQ ID NO: 521701 - DNA, 20 bp, Artificial Sequence
  chemically synthesized
aaaaattgatagtgctcatt

SEQ ID NO: 521702 - DNA, 20 bp, Artificial Sequence
  chemically synthesized
ttaggaatttatataattta

SEQ ID NO: 521703 - DNA, 20 bp, Artificial Sequence
  chemically synthesized
ggagaaagtttacctgtgaa

SEQ ID NO: 521704 - DNA, 20 bp, Artificial Sequence
  chemically synthesized
ttcacaggtaaactttctcc

SEQ ID NO: 521705 - DNA, 20 bp, Artificial Sequence
  chemically synthesized
tcatattttacaaattctaa

SEQ ID NO: 521706 - DNA, 20 bp, Artificial Sequence
  chemically synthesized
tttaagtgggctaactcatt

SEQ ID NO: 521707 - DNA, 20 bp, Artificial Sequence
  chemically synthesized
aataatgtagtgtgtttctt

SEQ ID NO: 521708 - DNA, 20 bp, Artificial Sequence
  chemically synthesized
atgtgtacgtgcagatcaca

SEQ ID NO: 521709 - DNA, 20 bp, Artificial Sequence
  chemically synthesized
ttaaggcaggaaccggcaat

SEQ ID NO: 521710 - DNA, 20 bp, Artificial Sequence
  chemically synthesized
cattttcacttcttttgtgg

SEQ ID NO: 521711 - DNA, 20 bp, Artificial Sequence
  chemically synthesized
agccaggatgagccaggaga

SEQ ID NO: 521712 - DNA, 20 bp, Artificial Sequence
  chemically synthesized
cagtgggggagcttttgagc

SEQ ID NO: 521713 - DNA, 20 bp, Artificial Sequence
  chemically synthesized
ctggctcaaaagctccccca

SEQ ID NO: 521714 - DNA, 20 bp, Artificial Sequence
  chemically synthesized
gttctctggcaggcaggagt

SEQ ID NO: 521715 - DNA, 20 bp, Artificial Sequence
  chemically synthesized
ggggttgttctctggcaggc

SEQ ID NO: 521716 - DNA, 20 bp, Artificial Sequence
  chemically synthesized
tgggtagataaaggaaaaag

SEQ ID NO: 521717 - DNA, 20 bp, Artificial Sequence
  chemically synthesized
gtggggccgttttataggat

SEQ ID NO: 521718 - DNA, 20 bp, Artificial Sequence
  chemically synthesized
ataggggtggggccgtttta

SEQ ID NO: 521719 - DNA, 20 bp, Artificial Sequence
  chemically synthesized
gagagtcagcgaagggagat

SEQ ID NO: 521720 - DNA, 20 bp, Artificial Sequence
  chemically synthesized
aggtgggctgagtccgaaaa

SEQ ID NO: 521721 - DNA, 20 bp, Artificial Sequence
  chemically synthesized
ttcacctgggtgcaggtggg

SEQ ID NO: 521722 - DNA, 20 bp, Artificial Sequence
  chemically synthesized
cataaagctgtttatttcac

SEQ ID NO: 521723 - DNA, 20 bp, Artificial Sequence
  chemically synthesized
tgggcgtctgtgtttgaatt

SEQ ID NO: 521724 - DNA, 20 bp, Artificial Sequence
  chemically synthesized
tcttacttgggcgtctgtgt

SEQ ID NO: 521725 - DNA, 20 bp, Artificial Sequence
  chemically synthesized
cagacgcccaagtaagaaaa

SEQ ID NO: 521726 - DNA, 20 bp, Artificial Sequence
  chemically synthesized
agaaaagtgaatttataaaa

SEQ ID NO: 521727 - DNA, 20 bp, Artificial Sequence
  chemically synthesized
aattgggtaaaattcacaag

SEQ ID NO: 521728 - DNA, 20 bp, Artificial Sequence
  chemically synthesized
gtgaactaataattcagctt

SEQ ID NO: 521729 - DNA, 20 bp, Artificial Sequence
  chemically synthesized
agagttttcacattgtcttt

SEQ ID NO: 521730 - DNA, 20 bp, Artificial Sequence
  chemically synthesized
agtagattctaatgcctaat

SEQ ID NO: 521731 - DNA, 20 bp, Artificial Sequence
  chemically synthesized
tgaaaactctcattaggcat

SEQ ID NO: 521732 - DNA, 20 bp, Artificial Sequence
  chemically synthesized
tctacttttcaaactcaaaa

SEQ ID NO: 521733 - DNA, 20 bp, Artificial Sequence
  chemically synthesized
aattacaaggagattcactt

SEQ ID NO: 521734 - DNA, 20 bp, Artificial Sequence
  chemically synthesized
actgttcattttaactgggg

SEQ ID NO: 521735 - DNA, 20 bp, Artificial Sequence
  chemically synthesized
aaaatgttgcaattggaact

SEQ ID NO: 521736 - DNA, 20 bp, Artificial Sequence
  chemically synthesized
tctattccaatggtctatgt

SEQ ID NO: 521737 - DNA, 20 bp, Artificial Sequence
  chemically synthesized
tctattcctacatagaccat

SEQ ID NO: 521738 - DNA, 20 bp, Artificial Sequence
  chemically synthesized
tcctacatagaccattggaa

SEQ ID NO: 521739 - DNA, 20 bp, Artificial Sequence
  chemically synthesized
cattttcccagcaccattta

SEQ ID NO: 521740 - DNA, 20 bp, Artificial Sequence
  chemically synthesized
aatgggacaaccacatgtgg

SEQ ID NO: 521741 - DNA, 20 bp, Artificial Sequence
  chemically synthesized
ccacatgtggaagaatgaaa

SEQ ID NO: 521742 - DNA, 20 bp, Artificial Sequence
  chemically synthesized
ttttgtatatggtaggagat

SEQ ID NO: 521743 - DNA, 20 bp, Artificial Sequence
  chemically synthesized
tatacaaaaattagctcaag

SEQ ID NO: 521744 - DNA, 20 bp, Artificial Sequence
  chemically synthesized
tttttcctaggttttctttg

SEQ ID NO: 521745 - DNA, 20 bp, Artificial Sequence
  chemically synthesized
ttacctaggccaatgtccag

SEQ ID NO: 521746 - DNA, 20 bp, Artificial Sequence
  chemically synthesized
cctggacattggcctaggta

SEQ ID NO: 521747 - DNA, 20 bp, Artificial Sequence
  chemically synthesized
caaaaataaaaataaacaaa

SEQ ID NO: 521748 - DNA, 20 bp, Artificial Sequence
  chemically synthesized
caacgtaaacagaaaaccga

SEQ ID NO: 521749 - DNA, 20 bp, Artificial Sequence
  chemically synthesized
ttttcttcttgctgatttgc

SEQ ID NO: 521750 - DNA, 20 bp, Artificial Sequence
  chemically synthesized
ttaaaaagcttggaaacgac

SEQ ID NO: 521751 - DNA, 20 bp, Artificial Sequence
  chemically synthesized
ttaacatcactaatcatcag

SEQ ID NO: 521752 - DNA, 20 bp, Artificial Sequence
  chemically synthesized
agatacttccttatcttagc

SEQ ID NO: 521753 - DNA, 20 bp, Artificial Sequence
  chemically synthesized
gtaggtataccattcaatcc

SEQ ID NO: 521754 - DNA, 20 bp, Artificial Sequence
  chemically synthesized
gcagtattaggattcgtgga

SEQ ID NO: 521755 - DNA, 20 bp, Artificial Sequence
  chemically synthesized
gatatgcagtattaggattc

SEQ ID NO: 521756 - DNA, 20 bp, Artificial Sequence
  chemically synthesized
ttttggtagatatgcagtat

SEQ ID NO: 521757 - DNA, 20 bp, Artificial Sequence
  chemically synthesized
gattctatatctttgcgatt

SEQ ID NO: 521758 - DNA, 20 bp, Artificial Sequence
  chemically synthesized
aattcacaatcgcaaagata

SEQ ID NO: 521759 - DNA, 20 bp, Artificial Sequence
  chemically synthesized
caaagatatagaatccacct

SEQ ID NO: 521760 - DNA, 20 bp, Artificial Sequence
  chemically synthesized
gatatagaatccaccttaga

SEQ ID NO: 521761 - DNA, 20 bp, Artificial Sequence
  chemically synthesized
ttttctttatccactctaag

SEQ ID NO: 521762 - DNA, 20 bp, Artificial Sequence
  chemically synthesized
acacacacacacacacacca

SEQ ID NO: 521763 - DNA, 20 bp, Artificial Sequence
  chemically synthesized
ttatttcattgtttatatgg

SEQ ID NO: 521764 - DNA, 20 bp, Artificial Sequence
  chemically synthesized
ataacgtcttctgcagcaac

SEQ ID NO: 521765 - DNA, 20 bp, Artificial Sequence
  chemically synthesized
catttctgagttacttcact

SEQ ID NO: 521766 - DNA, 20 bp, Artificial Sequence
  chemically synthesized
cagtatttgattttccattt

SEQ ID NO: 521767 - DNA, 20 bp, Artificial Sequence
  chemically synthesized
cttataatgggaactaactt

SEQ ID NO: 521768 - DNA, 20 bp, Artificial Sequence
  chemically synthesized
tatgagtatgcaaaggcata

SEQ ID NO: 521769 - DNA, 20 bp, Artificial Sequence
  chemically synthesized
ttcagagactcagaagtgga

SEQ ID NO: 521770 - DNA, 20 bp, Artificial Sequence
  chemically synthesized
cattcccaccccctccactt

SEQ ID NO: 521771 - DNA, 20 bp, Artificial Sequence
  chemically synthesized
gactcagaagtggagggggt

SEQ ID NO: 521772 - DNA, 20 bp, Artificial Sequence
  chemically synthesized
aagtggagggggtgggaatg

SEQ ID NO: 521773 - DNA, 20 bp, Artificial Sequence
  chemically synthesized
gagggataaaaaactacata

SEQ ID NO: 521774 - DNA, 20 bp, Artificial Sequence
  chemically synthesized
ttgggtacaacgtacactac

SEQ ID NO: 521775 - DNA, 20 bp, Artificial Sequence
  chemically synthesized
ggattttattgagccgtcac

SEQ ID NO: 521776 - DNA, 20 bp, Artificial Sequence
  chemically synthesized
aattgtataatggtgaagtc

SEQ ID NO: 521777 - DNA, 20 bp, Artificial Sequence
  chemically synthesized
agtggtttttgcttacgtgt

SEQ ID NO: 521778 - DNA, 20 bp, Artificial Sequence
  chemically synthesized
ttgttgtacttcaatagctt

SEQ ID NO: 521779 - DNA, 20 bp, Artificial Sequence
  chemically synthesized
gactacaaacttcctcttat

SEQ ID NO: 521780 - DNA, 20 bp, Artificial Sequence
  chemically synthesized
tgtacaatttgctgagcaat

SEQ ID NO: 521781 - DNA, 20 bp, Artificial Sequence
  chemically synthesized
aattgtacattaagggcata

SEQ ID NO: 521782 - DNA, 20 bp, Artificial Sequence
  chemically synthesized
aattagtgaaaaatatttta

SEQ ID NO: 521783 - DNA, 20 bp, Artificial Sequence
  chemically synthesized
atagatcaccaggaagccct

SEQ ID NO: 521784 - DNA, 20 bp, Artificial Sequence
  chemically synthesized
agggaagcttattgaagaca

SEQ ID NO: 521785 - DNA, 20 bp, Artificial Sequence
  chemically synthesized
aactaaaatctctgttggaa

SEQ ID NO: 521786 - DNA, 20 bp, Artificial Sequence
  chemically synthesized
ctaatgcctgtcagccacaa

SEQ ID NO: 521787 - DNA, 20 bp, Artificial Sequence
  chemically synthesized
ggaaaactgccctagcatga

SEQ ID NO: 521788 - DNA, 20 bp, Artificial Sequence
  chemically synthesized
gtagatgtcacagcgcaaac

SEQ ID NO: 521789 - DNA, 20 bp, Artificial Sequence
  chemically synthesized
agctttctcttttatacgta

SEQ ID NO: 521790 - DNA, 20 bp, Artificial Sequence
  chemically synthesized
tttcgaaaagaagtttaagg

SEQ ID NO: 521791 - DNA, 20 bp, Artificial Sequence
  chemically synthesized
aagtgctgggattacaggcg

SEQ ID NO: 521792 - DNA, 20 bp, Artificial Sequence
  chemically synthesized
acctctgcctccgaaagtgc

SEQ ID NO: 521793 - DNA, 20 bp, Artificial Sequence
  chemically synthesized
actttcggaggcagaggtgg

SEQ ID NO: 521794 - DNA, 20 bp, Artificial Sequence
  chemically synthesized
tgggcggatcacctgaggtc

SEQ ID NO: 521795 - DNA, 20 bp, Artificial Sequence
  chemically synthesized
ttttgtatttttagtagaga

SEQ ID NO: 521796 - DNA, 20 bp, Artificial Sequence
  chemically synthesized
aaaattagctggctgtggtg

SEQ ID NO: 521797 - DNA, 20 bp, Artificial Sequence
  chemically synthesized
gcctcagcctcccgagtagc

SEQ ID NO: 521798 - DNA, 20 bp, Artificial Sequence
  chemically synthesized
gattcttctgcctcagcctc

SEQ ID NO: 521799 - DNA, 20 bp, Artificial Sequence
  chemically synthesized
tactcgggaggctgaggcag

SEQ ID NO: 521800 - DNA, 20 bp, Artificial Sequence
  chemically synthesized
ctcactgcaacctccgcctc

SEQ ID NO: 521801 - DNA, 20 bp, Artificial Sequence
  chemically synthesized
ttcgctcttgttgccgaggc

SEQ ID NO: 521802 - DNA, 20 bp, Artificial Sequence
  chemically synthesized
ttgtgtataatacatgccaa

SEQ ID NO: 521803 - DNA, 20 bp, Artificial Sequence
  chemically synthesized
ataatacatgccaagagggt

SEQ ID NO: 521804 - DNA, 20 bp, Artificial Sequence
  chemically synthesized
tagcagatatgaaaaaaaaa

SEQ ID NO: 521805 - DNA, 20 bp, Artificial Sequence
  chemically synthesized
agttctgttggttggagatt

SEQ ID NO: 521806 - DNA, 20 bp, Artificial Sequence
  chemically synthesized
ctataaattcatagtcaata

SEQ ID NO: 521807 - DNA, 20 bp, Artificial Sequence
  chemically synthesized
tttaaaaccccatattgact

SEQ ID NO: 521808 - DNA, 20 bp, Artificial Sequence
  chemically synthesized
caagtttgcttttttgcata

SEQ ID NO: 521809 - DNA, 20 bp, Artificial Sequence
  chemically synthesized
tagaaatgagaacaaagcaa

SEQ ID NO: 521810 - DNA, 20 bp, Artificial Sequence
  chemically synthesized
cagaatgtgtaatatgttga

SEQ ID NO: 521811 - DNA, 20 bp, Artificial Sequence
  chemically synthesized
ctgaatgaatgaataaataa

SEQ ID NO: 521812 - DNA, 20 bp, Artificial Sequence
  chemically synthesized
tctatttttttgctgaatga

SEQ ID NO: 521813 - DNA, 20 bp, Artificial Sequence
  chemically synthesized
taattctatttttttgctga

SEQ ID NO: 521814 - DNA, 20 bp, Artificial Sequence
  chemically synthesized
taaataattctatttttttg

SEQ ID NO: 521815 - DNA, 20 bp, Artificial Sequence
  chemically synthesized
tcattcattcagcaaaaaaa

SEQ ID NO: 521816 - DNA, 20 bp, Artificial Sequence
  chemically synthesized
ttattaatttataaagaatc

SEQ ID NO: 521817 - DNA, 20 bp, Artificial Sequence
  chemically synthesized
aaagtcattattaatttata

SEQ ID NO: 521818 - DNA, 20 bp, Artificial Sequence
  chemically synthesized
aataatgactttaaatgcat

SEQ ID NO: 521819 - DNA, 20 bp, Artificial Sequence
  chemically synthesized
tactgtatatttttttatct

SEQ ID NO: 521820 - DNA, 20 bp, Artificial Sequence
  chemically synthesized
tccttaaatgatactattct

SEQ ID NO: 521821 - DNA, 20 bp, Artificial Sequence
  chemically synthesized
atggtactttattaaattcg

SEQ ID NO: 521822 - DNA, 20 bp, Artificial Sequence
  chemically synthesized
ggtttataattaaggaaaat

SEQ ID NO: 521823 - DNA, 20 bp, Artificial Sequence
  chemically synthesized
tagcataattttgcctctta

SEQ ID NO: 521824 - DNA, 20 bp, Artificial Sequence
  chemically synthesized
cattaactaaaataaataat

SEQ ID NO: 521825 - DNA, 20 bp, Artificial Sequence
  chemically synthesized
aaacctaataaaattaaaat

SEQ ID NO: 521826 - DNA, 20 bp, Artificial Sequence
  chemically synthesized
gcctaggtgacaggtgacag

SEQ ID NO: 521827 - DNA, 20 bp, Artificial Sequence
  chemically synthesized
acctctgcctctcggtttca

SEQ ID NO: 521828 - DNA, 20 bp, Artificial Sequence
  chemically synthesized
actcgggggtgctgaggcaa

SEQ ID NO: 521829 - DNA, 20 bp, Artificial Sequence
  chemically synthesized
attcttttgcctcagcaccc

SEQ ID NO: 521830 - DNA, 20 bp, Artificial Sequence
  chemically synthesized
cctcagcacccccgagtagc

SEQ ID NO: 521831 - DNA, 20 bp, Artificial Sequence
  chemically synthesized
gcctttaatcccagctactc

SEQ ID NO: 521832 - DNA, 20 bp, Artificial Sequence
  chemically synthesized
ttttgtatttttagtacaga

SEQ ID NO: 521833 - DNA, 20 bp, Artificial Sequence
  chemically synthesized
cggtccgatcacctgagatc

SEQ ID NO: 521834 - DNA, 20 bp, Artificial Sequence
  chemically synthesized
gcctcagcctgccaaagtgc

SEQ ID NO: 521835 - DNA, 20 bp, Artificial Sequence
  chemically synthesized
gttattctgggcccagcacg

SEQ ID NO: 521836 - DNA, 20 bp, Artificial Sequence
  chemically synthesized
atgatccaccgtgctgggcc

SEQ ID NO: 521837 - DNA, 20 bp, Artificial Sequence
  chemically synthesized
tcacaaagggctgggattac

SEQ ID NO: 521838 - DNA, 20 bp, Artificial Sequence
  chemically synthesized
tcctgggcctcacaaagggc

SEQ ID NO: 521839 - DNA, 20 bp, Artificial Sequence
  chemically synthesized
cctttgtgaggcccaggagg

SEQ ID NO: 521840 - DNA, 20 bp, Artificial Sequence
  chemically synthesized
agggcggattacctgaggtc

SEQ ID NO: 521841 - DNA, 20 bp, Artificial Sequence
  chemically synthesized
tagttggccctccaccatgc

SEQ ID NO: 521842 - DNA, 20 bp, Artificial Sequence
  chemically synthesized
aattctcctgcctcagcctc

SEQ ID NO: 521843 - DNA, 20 bp, Artificial Sequence
  chemically synthesized
tactcatgaggctgaggcag

SEQ ID NO: 521844 - DNA, 20 bp, Artificial Sequence
  chemically synthesized
ttcactcttgttgcccaggc

SEQ ID NO: 521845 - DNA, 20 bp, Artificial Sequence
  chemically synthesized
tgcactccagcctgggcaac

SEQ ID NO: 521846 - DNA, 20 bp, Artificial Sequence
  chemically synthesized
ttttttttttttttccgaaa

SEQ ID NO: 521847 - DNA, 20 bp, Artificial Sequence
  chemically synthesized
tcttaaataaaaattatatt

SEQ ID NO: 521848 - DNA, 20 bp, Artificial Sequence
  chemically synthesized
tcatttagtatagttcatcc

SEQ ID NO: 521849 - DNA, 20 bp, Artificial Sequence
  chemically synthesized
atctagggaacttaatattc

SEQ ID NO: 521850 - DNA, 20 bp, Artificial Sequence
  chemically synthesized
ctaattttcaaaacaatagc

SEQ ID NO: 521851 - DNA, 20 bp, Artificial Sequence
  chemically synthesized
aaacagaaaccagcagggac

SEQ ID NO: 521852 - DNA, 20 bp, Artificial Sequence
  chemically synthesized
ccaataataacggtcttaaa

SEQ ID NO: 521853 - DNA, 20 bp, Artificial Sequence
  chemically synthesized
gtgaaccttcttgctcaaca

SEQ ID NO: 521854 - DNA, 20 bp, Artificial Sequence
  chemically synthesized
tttaaatcatagttgttttt

SEQ ID NO: 521855 - DNA, 20 bp, Artificial Sequence
  chemically synthesized
tttctgggagaaatgtcaat

SEQ ID NO: 521856 - DNA, 20 bp, Artificial Sequence
  chemically synthesized
agcttccttgaccattataa

SEQ ID NO: 521857 - DNA, 20 bp, Artificial Sequence
  chemically synthesized
aagagactgaaccatgtaac

SEQ ID NO: 521858 - DNA, 20 bp, Artificial Sequence
  chemically synthesized
tcagttaaaataaaaagcca

SEQ ID NO: 521859 - DNA, 20 bp, Artificial Sequence
  chemically synthesized
gcagtttttattaatcatta

SEQ ID NO: 521860 - DNA, 20 bp, Artificial Sequence
  chemically synthesized
tgcacattgacaaatgaaaa

SEQ ID NO: 521861 - DNA, 20 bp, Artificial Sequence
  chemically synthesized
attgacaaatgaaaacagaa

SEQ ID NO: 521862 - DNA, 20 bp, Artificial Sequence
  chemically synthesized
agtcacccggtgagagcttg

SEQ ID NO: 521863 - DNA, 20 bp, Artificial Sequence
  chemically synthesized
cctgaccctgcaagctctca

SEQ ID NO: 521864 - DNA, 20 bp, Artificial Sequence
  chemically synthesized
gcacctacttttctcttttt

SEQ ID NO: 521865 - DNA, 20 bp, Artificial Sequence
  chemically synthesized
tcttcagtcctttggactga

SEQ ID NO: 521866 - DNA, 20 bp, Artificial Sequence
  chemically synthesized
gcctgtgtctcttctagata

SEQ ID NO: 521867 - DNA, 20 bp, Artificial Sequence
  chemically synthesized
tccttaactatttttgtgct

SEQ ID NO: 521868 - DNA, 20 bp, Artificial Sequence
  chemically synthesized
tatgcttcaccagatgccaa

SEQ ID NO: 521869 - DNA, 20 bp, Artificial Sequence
  chemically synthesized
tatattgcaattgtaaaata

SEQ ID NO: 521870 - DNA, 20 bp, Artificial Sequence
  chemically synthesized
ttcaagatatccaaaacaac

SEQ ID NO: 521871 - DNA, 20 bp, Artificial Sequence
  chemically synthesized
tatatcaaatcctagttgtt

SEQ ID NO: 521872 - DNA, 20 bp, Artificial Sequence
  chemically synthesized
gaacggtattagcaatatct

SEQ ID NO: 521873 - DNA, 20 bp, Artificial Sequence
  chemically synthesized
aaaatacagtgtccttaatc

SEQ ID NO: 521874 - DNA, 20 bp, Artificial Sequence
  chemically synthesized
tgactgtatggcttcaaggg

SEQ ID NO: 521875 - DNA, 20 bp, Artificial Sequence
  chemically synthesized
atgggcacaatccaagccta

SEQ ID NO: 521876 - DNA, 20 bp, Artificial Sequence
  chemically synthesized
tcggccaccattcaataggc

SEQ ID NO: 521877 - DNA, 20 bp, Artificial Sequence
  chemically synthesized
ccaagcctattgaatggtgg

SEQ ID NO: 521878 - DNA, 20 bp, Artificial Sequence
  chemically synthesized
aaaatctgataaacttgtca

SEQ ID NO: 521879 - DNA, 20 bp, Artificial Sequence
  chemically synthesized
aagcatctgtgtataagcaa

SEQ ID NO: 521880 - DNA, 20 bp, Artificial Sequence
  chemically synthesized
ggagaaaaatatgacaattg

SEQ ID NO: 521881 - DNA, 20 bp, Artificial Sequence
  chemically synthesized
aagctttgtgggaaatgatg

SEQ ID NO: 521882 - DNA, 20 bp, Artificial Sequence
  chemically synthesized
aggatgtgttgtagggactg

SEQ ID NO: 521883 - DNA, 20 bp, Artificial Sequence
  chemically synthesized
gtccctacaacacatccttg

SEQ ID NO: 521884 - DNA, 20 bp, Artificial Sequence
  chemically synthesized
tgacacccctctcattcttc

SEQ ID NO: 521885 - DNA, 20 bp, Artificial Sequence
  chemically synthesized
acacatccttgaagaatgag

SEQ ID NO: 521886 - DNA, 20 bp, Artificial Sequence
  chemically synthesized
aatggaaggctctgacatca

SEQ ID NO: 521887 - DNA, 20 bp, Artificial Sequence
  chemically synthesized
atattaagtggcacattgaa

SEQ ID NO: 521888 - DNA, 20 bp, Artificial Sequence
  chemically synthesized
tcaccttcattacttaatag

SEQ ID NO: 521889 - DNA, 20 bp, Artificial Sequence
  chemically synthesized
agtataacaaagaaataacc

SEQ ID NO: 521890 - DNA, 20 bp, Artificial Sequence
  chemically synthesized
tataaaccaataatctgtga

SEQ ID NO: 521891 - DNA, 20 bp, Artificial Sequence
  chemically synthesized
tctaatttgattaaattgaa

SEQ ID NO: 521892 - DNA, 20 bp, Artificial Sequence
  chemically synthesized
tgttcaatttaatcaaatta

SEQ ID NO: 521893 - DNA, 20 bp, Artificial Sequence
  chemically synthesized
tcgaatcgagcctgggcaac

SEQ ID NO: 521894 - DNA, 20 bp, Artificial Sequence
  chemically synthesized
tcttgttgcccaggctcgat

SEQ ID NO: 521895 - DNA, 20 bp, Artificial Sequence
  chemically synthesized
ccaacactatgccatcgcac

SEQ ID NO: 521896 - DNA, 20 bp, Artificial Sequence
  chemically synthesized
ctcactgcaacctctgcctc

SEQ ID NO: 521897 - DNA, 20 bp, Artificial Sequence
  chemically synthesized
acctctgcctctggggttca

SEQ ID NO: 521898 - DNA, 20 bp, Artificial Sequence
  chemically synthesized
tacttgggaggctgagtcag

SEQ ID NO: 521899 - DNA, 20 bp, Artificial Sequence
  chemically synthesized
aatcccagttacttgggagg

SEQ ID NO: 521900 - DNA, 20 bp, Artificial Sequence
  chemically synthesized
gactcagcctcccaagtaac

SEQ ID NO: 521901 - DNA, 20 bp, Artificial Sequence
  chemically synthesized
tttctatttttagtagagac

SEQ ID NO: 521902 - DNA, 20 bp, Artificial Sequence
  chemically synthesized
caggtgaatcacttgaggtc

SEQ ID NO: 521903 - DNA, 20 bp, Artificial Sequence
  chemically synthesized
actttgggaggccgaggcag

SEQ ID NO: 521904 - DNA, 20 bp, Artificial Sequence
  chemically synthesized
gcctcggcctcccaaagtgc

SEQ ID NO: 521905 - DNA, 20 bp, Artificial Sequence
  chemically synthesized
taatatagttatatggttgt

SEQ ID NO: 521906 - DNA, 20 bp, Artificial Sequence
  chemically synthesized
aaatctcaattgtttgccaa

SEQ ID NO: 521907 - DNA, 20 bp, Artificial Sequence
  chemically synthesized
gatcatgggtaaccaaaacc

SEQ ID NO: 521908 - DNA, 20 bp, Artificial Sequence
  chemically synthesized
tttttggactgcagttgatc

SEQ ID NO: 521909 - DNA, 20 bp, Artificial Sequence
  chemically synthesized
caactgcagtccaaaaatag

SEQ ID NO: 521910 - DNA, 20 bp, Artificial Sequence
  chemically synthesized
tatactgtgataaaagttat

SEQ ID NO: 521911 - DNA, 20 bp, Artificial Sequence
  chemically synthesized
cctggtggatgcctgaaact

SEQ ID NO: 521912 - DNA, 20 bp, Artificial Sequence
  chemically synthesized
cacagtttcaggcatccacc

SEQ ID NO: 521913 - DNA, 20 bp, Artificial Sequence
  chemically synthesized
tacgtgttctaagacccctg

SEQ ID NO: 521914 - DNA, 20 bp, Artificial Sequence
  chemically synthesized
attaatctccccttatctgt

SEQ ID NO: 521915 - DNA, 20 bp, Artificial Sequence
  chemically synthesized
attaattatttctaccatta

SEQ ID NO: 521916 - DNA, 20 bp, Artificial Sequence
  chemically synthesized
tctaccattacagaattaaa

SEQ ID NO: 521917 - DNA, 20 bp, Artificial Sequence
  chemically synthesized
ctctgaattagaaataattt

SEQ ID NO: 521918 - DNA, 20 bp, Artificial Sequence
  chemically synthesized
tagactctctttgaatttct

SEQ ID NO: 521919 - DNA, 20 bp, Artificial Sequence
  chemically synthesized
ctaattcagagaaattcaaa

SEQ ID NO: 521920 - DNA, 20 bp, Artificial Sequence
  chemically synthesized
catagcgttatagactctct

SEQ ID NO: 521921 - DNA, 20 bp, Artificial Sequence
  chemically synthesized
tattattttatagttcaaag

SEQ ID NO: 521922 - DNA, 20 bp, Artificial Sequence
  chemically synthesized
tattttggtaaaatatggtg

SEQ ID NO: 521923 - DNA, 20 bp, Artificial Sequence
  chemically synthesized
ctatgatcaagatacactgt

SEQ ID NO: 521924 - DNA, 20 bp, Artificial Sequence
  chemically synthesized
gtatcttgatcatagtcctc

SEQ ID NO: 521925 - DNA, 20 bp, Artificial Sequence
  chemically synthesized
caattagttaatttcatata

SEQ ID NO: 521926 - DNA, 20 bp, Artificial Sequence
  chemically synthesized
cgatattcttactttaacag

SEQ ID NO: 521927 - DNA, 20 bp, Artificial Sequence
  chemically synthesized
acttattcaactgttaaagt

SEQ ID NO: 521928 - DNA, 20 bp, Artificial Sequence
  chemically synthesized
gtgtcagcctcccaaagtgc

SEQ ID NO: 521929 - DNA, 20 bp, Artificial Sequence
  chemically synthesized
actttgggaggctgacacag

SEQ ID NO: 521930 - DNA, 20 bp, Artificial Sequence
  chemically synthesized
agtctcactgttgcccaaac

SEQ ID NO: 521931 - DNA, 20 bp, Artificial Sequence
  chemically synthesized
ttttatttatttttttgaga

SEQ ID NO: 521932 - DNA, 20 bp, Artificial Sequence
  chemically synthesized
gcatacaaaaaagaaatatg

SEQ ID NO: 521933 - DNA, 20 bp, Artificial Sequence
  chemically synthesized
ttttttttttttttttgaga

SEQ ID NO: 521934 - DNA, 20 bp, Artificial Sequence
  chemically synthesized
tttgctcttgtcgcccaggc

SEQ ID NO: 521935 - DNA, 20 bp, Artificial Sequence
  chemically synthesized
tactagggaggctgaggcag

SEQ ID NO: 521936 - DNA, 20 bp, Artificial Sequence
  chemically synthesized
gcctcagcctccctagtagc

SEQ ID NO: 521937 - DNA, 20 bp, Artificial Sequence
  chemically synthesized
ctttgtatttttagtagaga

SEQ ID NO: 521938 - DNA, 20 bp, Artificial Sequence
  chemically synthesized
cgtgcggatcacctgaggtc

SEQ ID NO: 521939 - DNA, 20 bp, Artificial Sequence
  chemically synthesized
actttgggcggctgaggcgt

SEQ ID NO: 521940 - DNA, 20 bp, Artificial Sequence
  chemically synthesized
gcctcagccgcccaaagtgc

SEQ ID NO: 521941 - DNA, 20 bp, Artificial Sequence
  chemically synthesized
ttttttccccaattactttg

SEQ ID NO: 521942 - DNA, 20 bp, Artificial Sequence
  chemically synthesized
agtttttgatgtaaaaattt

SEQ ID NO: 521943 - DNA, 20 bp, Artificial Sequence
  chemically synthesized
aattttagagttcttgatct

SEQ ID NO: 521944 - DNA, 20 bp, Artificial Sequence
  chemically synthesized
ggtctcccaataaatttcaa

SEQ ID NO: 521945 - DNA, 20 bp, Artificial Sequence
  chemically synthesized
gatgattttgcctcatattt

SEQ ID NO: 521946 - DNA, 20 bp, Artificial Sequence
  chemically synthesized
atttttttgggggggggggc

SEQ ID NO: 521947 - DNA, 20 bp, Artificial Sequence
  chemically synthesized
gcatgatattattttggtta

SEQ ID NO: 521948 - DNA, 20 bp, Artificial Sequence
  chemically synthesized
tgaatcactcctgtaacatt

SEQ ID NO: 521949 - DNA, 20 bp, Artificial Sequence
  chemically synthesized
aatttaattccaaatgttac

SEQ ID NO: 521950 - DNA, 20 bp, Artificial Sequence
  chemically synthesized
ttttgggaaaaaaaaagtcc

SEQ ID NO: 521951 - DNA, 20 bp, Artificial Sequence
  chemically synthesized
cgaaacatctaatattacat

SEQ ID NO: 521952 - DNA, 20 bp, Artificial Sequence
  chemically synthesized
gtaatattagatgtttcgaa

SEQ ID NO: 521953 - DNA, 20 bp, Artificial Sequence
  chemically synthesized
gataaactgcagacacttcc

SEQ ID NO: 521954 - DNA, 20 bp, Artificial Sequence
  chemically synthesized
gcagacacttccacgggtag

SEQ ID NO: 521955 - DNA, 20 bp, Artificial Sequence
  chemically synthesized
agattaacttatcactattg

SEQ ID NO: 521956 - DNA, 20 bp, Artificial Sequence
  chemically synthesized
cctaactcttaaccattttg

SEQ ID NO: 521957 - DNA, 20 bp, Artificial Sequence
  chemically synthesized
acttacccctcaaaatggtt

SEQ ID NO: 521958 - DNA, 20 bp, Artificial Sequence
  chemically synthesized
ttttgtcttggttattttta

SEQ ID NO: 521959 - DNA, 20 bp, Artificial Sequence
  chemically synthesized
ttacacaataataccagatt

SEQ ID NO: 521960 - DNA, 20 bp, Artificial Sequence
  chemically synthesized
atctggtattattgtgtaat

SEQ ID NO: 521961 - DNA, 20 bp, Artificial Sequence
  chemically synthesized
ataataatattgccatatat

SEQ ID NO: 521962 - DNA, 20 bp, Artificial Sequence
  chemically synthesized
atttttttttttttttgaga

SEQ ID NO: 521963 - DNA, 20 bp, Artificial Sequence
  chemically synthesized
tctcacttttttgcccaggc

SEQ ID NO: 521964 - DNA, 20 bp, Artificial Sequence
  chemically synthesized
cttactgcagcctccacctc

SEQ ID NO: 521965 - DNA, 20 bp, Artificial Sequence
  chemically synthesized
tactcgggaggctgagacag

SEQ ID NO: 521966 - DNA, 20 bp, Artificial Sequence
  chemically synthesized
gattctcctgtctcagcctc

SEQ ID NO: 521967 - DNA, 20 bp, Artificial Sequence
  chemically synthesized
ttttgtatttttagtagaga

SEQ ID NO: 521968 - DNA, 20 bp, Artificial Sequence
  chemically synthesized
caggcggatcacctgaggtc

SEQ ID NO: 521969 - DNA, 20 bp, Artificial Sequence
  chemically synthesized
actttgggagtctgaggcag

SEQ ID NO: 521970 - DNA, 20 bp, Artificial Sequence
  chemically synthesized
acctgtaatatcagcacttt

SEQ ID NO: 521971 - DNA, 20 bp, Artificial Sequence
  chemically synthesized
taatttttaagttgaatttt

SEQ ID NO: 521972 - DNA, 20 bp, Artificial Sequence
  chemically synthesized
ttcttggagtaatttttaag

SEQ ID NO: 521973 - DNA, 20 bp, Artificial Sequence
  chemically synthesized
acttttacctacacatttct

SEQ ID NO: 521974 - DNA, 20 bp, Artificial Sequence
  chemically synthesized
tataaatggaaatacaaaat

SEQ ID NO: 521975 - DNA, 20 bp, Artificial Sequence
  chemically synthesized
tatatttattttcaactttt

SEQ ID NO: 521976 - DNA, 20 bp, Artificial Sequence
  chemically synthesized
cactagctttactctgaaag

SEQ ID NO: 521977 - DNA, 20 bp, Artificial Sequence
  chemically synthesized
tgaagcacagattctacttt

SEQ ID NO: 521978 - DNA, 20 bp, Artificial Sequence
  chemically synthesized
tgaggctatacttctgtatg

SEQ ID NO: 521979 - DNA, 20 bp, Artificial Sequence
  chemically synthesized
gttcccagattcctgttcct

SEQ ID NO: 521980 - DNA, 20 bp, Artificial Sequence
  chemically synthesized
gatcattcatccctaggaac

SEQ ID NO: 521981 - DNA, 20 bp, Artificial Sequence
  chemically synthesized
ccagattcctgttcctaggg

SEQ ID NO: 521982 - DNA, 20 bp, Artificial Sequence
  chemically synthesized
gcagatttagccaaattaac

SEQ ID NO: 521983 - DNA, 20 bp, Artificial Sequence
  chemically synthesized
tgaagtggaaggatcaattt

SEQ ID NO: 521984 - DNA, 20 bp, Artificial Sequence
  chemically synthesized
taactgaaagtatgaagtgg

SEQ ID NO: 521985 - DNA, 20 bp, Artificial Sequence
  chemically synthesized
ttccacttcatactttcagt

SEQ ID NO: 521986 - DNA, 20 bp, Artificial Sequence
  chemically synthesized
gcacaacctcagcattcata

SEQ ID NO: 521987 - DNA, 20 bp, Artificial Sequence
  chemically synthesized
ttgttcttatcatattcatt

SEQ ID NO: 521988 - DNA, 20 bp, Artificial Sequence
  chemically synthesized
acagatgtttggtagtaaac

SEQ ID NO: 521989 - DNA, 20 bp, Artificial Sequence
  chemically synthesized
tgtttactaccaaacatctg

SEQ ID NO: 521990 - DNA, 20 bp, Artificial Sequence
  chemically synthesized
aataatctggttatgtttgt

SEQ ID NO: 521991 - DNA, 20 bp, Artificial Sequence
  chemically synthesized
aggaccagctgttatcacta

SEQ ID NO: 521992 - DNA, 20 bp, Artificial Sequence
  chemically synthesized
gctggtcctttactttcttc

SEQ ID NO: 521993 - DNA, 20 bp, Artificial Sequence
  chemically synthesized
gagaagaaatgaaatatatg

SEQ ID NO: 521994 - DNA, 20 bp, Artificial Sequence
  chemically synthesized
ttaagtgacaaaaagctaaa

SEQ ID NO: 521995 - DNA, 20 bp, Artificial Sequence
  chemically synthesized
attgtgatgcagtcaaagcc

SEQ ID NO: 521996 - DNA, 20 bp, Artificial Sequence
  chemically synthesized
cagttttctaccatagacaa

SEQ ID NO: 521997 - DNA, 20 bp, Artificial Sequence
  chemically synthesized
gtaagccacaagtgtaatgg

SEQ ID NO: 521998 - DNA, 20 bp, Artificial Sequence
  chemically synthesized
tctttttttttttttcgaga

SEQ ID NO: 521999 - DNA, 20 bp, Artificial Sequence
  chemically synthesized
ctcactgcaagctccgcctc

SEQ ID NO: 522000 - DNA, 20 bp, Artificial Sequence
  chemically synthesized
tactcaggaggctgaggcag

SEQ ID NO: 522001 - DNA, 20 bp, Artificial Sequence
  chemically synthesized
cattctcctgcctcagcctc

SEQ ID NO: 522002 - DNA, 20 bp, Artificial Sequence
  chemically synthesized
ttttgtatttttagtagata

SEQ ID NO: 522003 - DNA, 20 bp, Artificial Sequence
  chemically synthesized
gtttgtatcactgtgttagc

SEQ ID NO: 522004 - DNA, 20 bp, Artificial Sequence
  chemically synthesized
cccagcactttgggaggccg

SEQ ID NO: 522005 - DNA, 20 bp, Artificial Sequence
  chemically synthesized
ccgccggcctcccaaagtgc

SEQ ID NO: 522006 - DNA, 20 bp, Artificial Sequence
  chemically synthesized
gctcacccagctctgcattt

SEQ ID NO: 522007 - DNA, 20 bp, Artificial Sequence
  chemically synthesized
aatgattcaaaaatgcagag

SEQ ID NO: 522008 - DNA, 20 bp, Artificial Sequence
  chemically synthesized
tcctcggcctcccaaagtgc

SEQ ID NO: 522009 - DNA, 20 bp, Artificial Sequence
  chemically synthesized
actttgggaggccgaggaca

SEQ ID NO: 522010 - DNA, 20 bp, Artificial Sequence
  chemically synthesized
tttttgtatttttagtagag

SEQ ID NO: 522011 - DNA, 20 bp, Artificial Sequence
  chemically synthesized
gcctcagcctcccgaatagc

SEQ ID NO: 522012 - DNA, 20 bp, Artificial Sequence
  chemically synthesized
gatttttctgcctcagcctc

SEQ ID NO: 522013 - DNA, 20 bp, Artificial Sequence
  chemically synthesized
ctcactgcaacctctgcctc

SEQ ID NO: 522014 - DNA, 20 bp, Artificial Sequence
  chemically synthesized
ctgcactgcagcctgcgaga

SEQ ID NO: 522015 - DNA, 20 bp, Artificial Sequence
  chemically synthesized
ttgttttggtttttttgaga

SEQ ID NO: 522016 - DNA, 20 bp, Artificial Sequence
  chemically synthesized
gcctcagcttcccaaagtgc

SEQ ID NO: 522017 - DNA, 20 bp, Artificial Sequence
  chemically synthesized
actttgggaagctgaggcag

SEQ ID NO: 522018 - DNA, 20 bp, Artificial Sequence
  chemically synthesized
caggtgggtcacctgagctc

SEQ ID NO: 522019 - DNA, 20 bp, Artificial Sequence
  chemically synthesized
ctcgggagtttgagatcagc

SEQ ID NO: 522020 - DNA, 20 bp, Artificial Sequence
  chemically synthesized
tttcgtactttttgtagaga

SEQ ID NO: 522021 - DNA, 20 bp, Artificial Sequence
  chemically synthesized
acaaaaagtacgaaaattag

SEQ ID NO: 522022 - DNA, 20 bp, Artificial Sequence
  chemically synthesized
gatcctcccacctcagcctc

SEQ ID NO: 522023 - DNA, 20 bp, Artificial Sequence
  chemically synthesized
tactcgggaggctgaggtgg

SEQ ID NO: 522024 - DNA, 20 bp, Artificial Sequence
  chemically synthesized
tcacttgaactcaggaggtc

SEQ ID NO: 522025 - DNA, 20 bp, Artificial Sequence
  chemically synthesized
ctgactgaacccttgacctc

SEQ ID NO: 522026 - DNA, 20 bp, Artificial Sequence
  chemically synthesized
atcgaccactgcactccatc

SEQ ID NO: 522027 - DNA, 20 bp, Artificial Sequence
  chemically synthesized
tttttctctgtcatccagga

SEQ ID NO: 522028 - DNA, 20 bp, Artificial Sequence
  chemically synthesized
cattttttttctctgtcatc

SEQ ID NO: 522029 - DNA, 20 bp, Artificial Sequence
  chemically synthesized
ataaaaaagttaaaaagtta

SEQ ID NO: 522030 - DNA, 20 bp, Artificial Sequence
  chemically synthesized
ttgcttgctaattatttcct

SEQ ID NO: 522031 - DNA, 20 bp, Artificial Sequence
  chemically synthesized
gcaagcaattatgtcgataa

SEQ ID NO: 522032 - DNA, 20 bp, Artificial Sequence
  chemically synthesized
agtgttgtggtaactaggac

SEQ ID NO: 522033 - DNA, 20 bp, Artificial Sequence
  chemically synthesized
tgtggtaactaggacttgaa

SEQ ID NO: 522034 - DNA, 20 bp, Artificial Sequence
  chemically synthesized
tgaattgaatttttgaagat

SEQ ID NO: 522035 - DNA, 20 bp, Artificial Sequence
  chemically synthesized
ggaaaaagattccagaaagg

SEQ ID NO: 522036 - DNA, 20 bp, Artificial Sequence
  chemically synthesized
ctagtctgattccccctttc

SEQ ID NO: 522037 - DNA, 20 bp, Artificial Sequence
  chemically synthesized
gggaatcagactagaaaagc

SEQ ID NO: 522038 - DNA, 20 bp, Artificial Sequence
  chemically synthesized
gagctggcctgtataggaga

SEQ ID NO: 522039 - DNA, 20 bp, Artificial Sequence
  chemically synthesized
aggagagagaatattttatg

SEQ ID NO: 522040 - DNA, 20 bp, Artificial Sequence
  chemically synthesized
tatgctggctatacactttt

SEQ ID NO: 522041 - DNA, 20 bp, Artificial Sequence
  chemically synthesized
tagccagcatagttttctgc

SEQ ID NO: 522042 - DNA, 20 bp, Artificial Sequence
  chemically synthesized
tcttctgatttgagagcagt

SEQ ID NO: 522043 - DNA, 20 bp, Artificial Sequence
  chemically synthesized
tatgtaattcttaaatctag

SEQ ID NO: 522044 - DNA, 20 bp, Artificial Sequence
  chemically synthesized
gaagatactctactagattt

SEQ ID NO: 522045 - DNA, 20 bp, Artificial Sequence
  chemically synthesized
gcttaacttctttagataaa

SEQ ID NO: 522046 - DNA, 20 bp, Artificial Sequence
  chemically synthesized
aacagtggtagccagtaact

SEQ ID NO: 522047 - DNA, 20 bp, Artificial Sequence
  chemically synthesized
aaatggggaaatgctggtcg

SEQ ID NO: 522048 - DNA, 20 bp, Artificial Sequence
  chemically synthesized
agcttactcatcttataact

SEQ ID NO: 522049 - DNA, 20 bp, Artificial Sequence
  chemically synthesized
tagaaactctcagttataag

SEQ ID NO: 522050 - DNA, 20 bp, Artificial Sequence
  chemically synthesized
ttataagatgagtaagctct

SEQ ID NO: 522051 - DNA, 20 bp, Artificial Sequence
  chemically synthesized
tagcaaatttcaagtaacaa

SEQ ID NO: 522052 - DNA, 20 bp, Artificial Sequence
  chemically synthesized
aatggcaactatgtgaggtg

SEQ ID NO: 522053 - DNA, 20 bp, Artificial Sequence
  chemically synthesized
cttgattgtgataatcattt

SEQ ID NO: 522054 - DNA, 20 bp, Artificial Sequence
  chemically synthesized
aaatcatcatattgtacacc

SEQ ID NO: 522055 - DNA, 20 bp, Artificial Sequence
  chemically synthesized
gtataattgacaaatggcga

SEQ ID NO: 522056 - DNA, 20 bp, Artificial Sequence
  chemically synthesized
tttttaggttcagttacttc

SEQ ID NO: 522057 - DNA, 20 bp, Artificial Sequence
  chemically synthesized
tatgaaaactgaggcccatt

SEQ ID NO: 522058 - DNA, 20 bp, Artificial Sequence
  chemically synthesized
attaatgattctcaaagcca

SEQ ID NO: 522059 - DNA, 20 bp, Artificial Sequence
  chemically synthesized
actgcttaccctgtggcttt

SEQ ID NO: 522060 - DNA, 20 bp, Artificial Sequence
  chemically synthesized
ttgtaatcaggacacatgag

SEQ ID NO: 522061 - DNA, 20 bp, Artificial Sequence
  chemically synthesized
gaaagaaaatccatttttaa

SEQ ID NO: 522062 - DNA, 20 bp, Artificial Sequence
  chemically synthesized
gttgagatactcctttaaaa

SEQ ID NO: 522063 - DNA, 20 bp, Artificial Sequence
  chemically synthesized
gtcccgtagtatatgagaca

SEQ ID NO: 522064 - DNA, 20 bp, Artificial Sequence
  chemically synthesized
aggactccatgactaatgac

SEQ ID NO: 522065 - DNA, 20 bp, Artificial Sequence
  chemically synthesized
acaattcaggtcattagtca

SEQ ID NO: 522066 - DNA, 20 bp, Artificial Sequence
  chemically synthesized
agcttctggctttactagtg

SEQ ID NO: 522067 - DNA, 20 bp, Artificial Sequence
  chemically synthesized
ctgatatcctcagccaagta

SEQ ID NO: 522068 - DNA, 20 bp, Artificial Sequence
  chemically synthesized
tttacatcctatacttggct

SEQ ID NO: 522069 - DNA, 20 bp, Artificial Sequence
  chemically synthesized
cgtctcaaaaaaaaaaaaaa

SEQ ID NO: 522070 - DNA, 20 bp, Artificial Sequence
  chemically synthesized
ttttttttttttttttgaga

SEQ ID NO: 522071 - DNA, 20 bp, Artificial Sequence
  chemically synthesized
tctcgctctgtcgcccaggc

SEQ ID NO: 522072 - DNA, 20 bp, Artificial Sequence
  chemically synthesized
ctcactgcaagctccgcctc

SEQ ID NO: 522073 - DNA, 20 bp, Artificial Sequence
  chemically synthesized
tactcgggaggctgaggcag

SEQ ID NO: 522074 - DNA, 20 bp, Artificial Sequence
  chemically synthesized
cattctcctgcctcagcctc

SEQ ID NO: 522075 - DNA, 20 bp, Artificial Sequence
  chemically synthesized
ttttgtatttttagtggaga

SEQ ID NO: 522076 - DNA, 20 bp, Artificial Sequence
  chemically synthesized
cggggtttcaccgtgttagc

SEQ ID NO: 522077 - DNA, 20 bp, Artificial Sequence
  chemically synthesized
actttgggaggccgaggcgg

SEQ ID NO: 522078 - DNA, 20 bp, Artificial Sequence
  chemically synthesized
gcctcggcctcccaaagtgc

SEQ ID NO: 522079 - DNA, 20 bp, Artificial Sequence
  chemically synthesized
cgcccggccaagactcttgc

SEQ ID NO: 522080 - DNA, 20 bp, Artificial Sequence
  chemically synthesized
tccctttaaattactcaagc

SEQ ID NO: 522081 - DNA, 20 bp, Artificial Sequence
  chemically synthesized
ctcttgcttgagtaatttaa

SEQ ID NO: 522082 - DNA, 20 bp, Artificial Sequence
  chemically synthesized
ttaaagggatgtgacacagt

SEQ ID NO: 522083 - DNA, 20 bp, Artificial Sequence
  chemically synthesized
gcttatgttgccactgcagg

SEQ ID NO: 522084 - DNA, 20 bp, Artificial Sequence
  chemically synthesized
gcttgctttactcttaagca

SEQ ID NO: 522085 - DNA, 20 bp, Artificial Sequence
  chemically synthesized
gtttgtcctatccagtgctt

SEQ ID NO: 522086 - DNA, 20 bp, Artificial Sequence
  chemically synthesized
gaacgtttcttttcctagga

SEQ ID NO: 522087 - DNA, 20 bp, Artificial Sequence
  chemically synthesized
ttcattttcaaaatgtattt

SEQ ID NO: 522088 - DNA, 20 bp, Artificial Sequence
  chemically synthesized
tcctgaaatacattttgaaa

SEQ ID NO: 522089 - DNA, 20 bp, Artificial Sequence
  chemically synthesized
gaaatacattttgaaaatga

SEQ ID NO: 522090 - DNA, 20 bp, Artificial Sequence
  chemically synthesized
tgctcccctcaaaagtccct

SEQ ID NO: 522091 - DNA, 20 bp, Artificial Sequence
  chemically synthesized
agcatagcttttcttacatc

SEQ ID NO: 522092 - DNA, 20 bp, Artificial Sequence
  chemically synthesized
gcataaatggagtaaaagtt

SEQ ID NO: 522093 - DNA, 20 bp, Artificial Sequence
  chemically synthesized
gataaggagattggcataaa

SEQ ID NO: 522094 - DNA, 20 bp, Artificial Sequence
  chemically synthesized
agtcaaagtagcatcttgct

SEQ ID NO: 522095 - DNA, 20 bp, Artificial Sequence
  chemically synthesized
taatgagcagtttagtaggc

SEQ ID NO: 522096 - DNA, 20 bp, Artificial Sequence
  chemically synthesized
agtggatgtgtgaagtagaa

SEQ ID NO: 522097 - DNA, 20 bp, Artificial Sequence
  chemically synthesized
gcttggctggatatcgaaca

SEQ ID NO: 522098 - DNA, 20 bp, Artificial Sequence
  chemically synthesized
cagtcagagtccaggcttgg

SEQ ID NO: 522099 - DNA, 20 bp, Artificial Sequence
  chemically synthesized
gtagcactgaagtgatcagt

SEQ ID NO: 522100 - DNA, 20 bp, Artificial Sequence
  chemically synthesized
aaaatgagctcaaggaagta

SEQ ID NO: 522101 - DNA, 20 bp, Artificial Sequence
  chemically synthesized
catctgatgccttagcaaag

SEQ ID NO: 522102 - DNA, 20 bp, Artificial Sequence
  chemically synthesized
tggtggataatagtgattta

SEQ ID NO: 522103 - DNA, 20 bp, Artificial Sequence
  chemically synthesized
acagcatggttcagttgatg

SEQ ID NO: 522104 - DNA, 20 bp, Artificial Sequence
  chemically synthesized
tgcggaataaactaatggga

SEQ ID NO: 522105 - DNA, 20 bp, Artificial Sequence
  chemically synthesized
agtagcttaatatgtatttg

SEQ ID NO: 522106 - DNA, 20 bp, Artificial Sequence
  chemically synthesized
tctaactgccttgatcgcca

SEQ ID NO: 522107 - DNA, 20 bp, Artificial Sequence
  chemically synthesized
agtggcgatcaaggcagtta

SEQ ID NO: 522108 - DNA, 20 bp, Artificial Sequence
  chemically synthesized
gcgatcaaggcagttagagg

SEQ ID NO: 522109 - DNA, 20 bp, Artificial Sequence
  chemically synthesized
gtactgctattgcctcttcc

SEQ ID NO: 522110 - DNA, 20 bp, Artificial Sequence
  chemically synthesized
ttggacgcatcagagcagta

SEQ ID NO: 522111 - DNA, 20 bp, Artificial Sequence
  chemically synthesized
agctcaacctttaggccatg

SEQ ID NO: 522112 - DNA, 20 bp, Artificial Sequence
  chemically synthesized
cctttaggccatgtagagta

SEQ ID NO: 522113 - DNA, 20 bp, Artificial Sequence
  chemically synthesized
taggccatgtagagtatgga

SEQ ID NO: 522114 - DNA, 20 bp, Artificial Sequence
  chemically synthesized
caaaagcacaagtggcaaag

SEQ ID NO: 522115 - DNA, 20 bp, Artificial Sequence
  chemically synthesized
caagtggcaaagatgagttg

SEQ ID NO: 522116 - DNA, 20 bp, Artificial Sequence
  chemically synthesized
gggggattattgtagtatct

SEQ ID NO: 522117 - DNA, 20 bp, Artificial Sequence
  chemically synthesized
tatctaagggtaaattagac

SEQ ID NO: 522118 - DNA, 20 bp, Artificial Sequence
  chemically synthesized
ctaggatggaaacaaaatat

SEQ ID NO: 522119 - DNA, 20 bp, Artificial Sequence
  chemically synthesized
tgaacctgcaaatcaatagg

SEQ ID NO: 522120 - DNA, 20 bp, Artificial Sequence
  chemically synthesized
tacctaaaagtgaacaggag

SEQ ID NO: 522121 - DNA, 20 bp, Artificial Sequence
  chemically synthesized
gttcacttttaggtactaaa

SEQ ID NO: 522122 - DNA, 20 bp, Artificial Sequence
  chemically synthesized
acagagtgaagtcatcccgt

SEQ ID NO: 522123 - DNA, 20 bp, Artificial Sequence
  chemically synthesized
ggagggtgaggaaactcaca

SEQ ID NO: 522124 - DNA, 20 bp, Artificial Sequence
  chemically synthesized
cttaagatgttagagggagg

SEQ ID NO: 522125 - DNA, 20 bp, Artificial Sequence
  chemically synthesized
tgcctcagtgtctgtctggg

SEQ ID NO: 522126 - DNA, 20 bp, Artificial Sequence
  chemically synthesized
ccccagacagacactgaggc

SEQ ID NO: 522127 - DNA, 20 bp, Artificial Sequence
  chemically synthesized
tcaccagcaggactgagccc

SEQ ID NO: 522128 - DNA, 20 bp, Artificial Sequence
  chemically synthesized
tctggggctcagtcctgctg

SEQ ID NO: 522129 - DNA, 20 bp, Artificial Sequence
  chemically synthesized
aagctgtgaggaacatgcct

SEQ ID NO: 522130 - DNA, 20 bp, Artificial Sequence
  chemically synthesized
gaagcgacctttaactacga

SEQ ID NO: 522131 - DNA, 20 bp, Artificial Sequence
  chemically synthesized
aggagtaagccagaaatatg

SEQ ID NO: 522132 - DNA, 20 bp, Artificial Sequence
  chemically synthesized
tatcttgctttgctataaac

SEQ ID NO: 522133 - DNA, 20 bp, Artificial Sequence
  chemically synthesized
agcaagatactgcatggaac

SEQ ID NO: 522134 - DNA, 20 bp, Artificial Sequence
  chemically synthesized
ccgcatatttctttccccac

SEQ ID NO: 522135 - DNA, 20 bp, Artificial Sequence
  chemically synthesized
tttacatcttcttatccctt

SEQ ID NO: 522136 - DNA, 20 bp, Artificial Sequence
  chemically synthesized
agaaataaacaagatcctga

SEQ ID NO: 522137 - DNA, 20 bp, Artificial Sequence
  chemically synthesized
gcctcggcctcccaaagtgc

SEQ ID NO: 522138 - DNA, 20 bp, Artificial Sequence
  chemically synthesized
actttgggaggccgaggcag

SEQ ID NO: 522139 - DNA, 20 bp, Artificial Sequence
  chemically synthesized
caggcggatcacctgaggtc

SEQ ID NO: 522140 - DNA, 20 bp, Artificial Sequence
  chemically synthesized
ttttgtatttttagtagaga

SEQ ID NO: 522141 - DNA, 20 bp, Artificial Sequence
  chemically synthesized
gcctcagcctcccgagtagc

SEQ ID NO: 522142 - DNA, 20 bp, Artificial Sequence
  chemically synthesized
gattctcctgcctcagcctc

SEQ ID NO: 522143 - DNA, 20 bp, Artificial Sequence
  chemically synthesized
tactcgggaggctgaggcag

SEQ ID NO: 522144 - DNA, 20 bp, Artificial Sequence
  chemically synthesized
tcgtgccactgcactccagc

SEQ ID NO: 522145 - DNA, 20 bp, Artificial Sequence
  chemically synthesized
tcatgctctgtcacccaggc

SEQ ID NO: 522146 - DNA, 20 bp, Artificial Sequence
  chemically synthesized
ttttttttttttttttttga

SEQ ID NO: 522147 - DNA, 20 bp, Artificial Sequence
  chemically synthesized
aaaaaaaaaagactttttaa

SEQ ID NO: 522148 - DNA, 20 bp, Artificial Sequence
  chemically synthesized
ttattattaggggctatata

SEQ ID NO: 522149 - DNA, 20 bp, Artificial Sequence
  chemically synthesized
gttttctaatcttcacataa

SEQ ID NO: 522150 - DNA, 20 bp, Artificial Sequence
  chemically synthesized
ccaaaaatcgatagaataat

SEQ ID NO: 522151 - DNA, 20 bp, Artificial Sequence
  chemically synthesized
aatagcattccaaaaatcga

SEQ ID NO: 522152 - DNA, 20 bp, Artificial Sequence
  chemically synthesized
cacattattctatcgatttt

SEQ ID NO: 522153 - DNA, 20 bp, Artificial Sequence
  chemically synthesized
caaatctgtgccagcgtctg

SEQ ID NO: 522154 - DNA, 20 bp, Artificial Sequence
  chemically synthesized
aaaaaaaaaagaatgataaa

SEQ ID NO: 522155 - DNA, 20 bp, Artificial Sequence
  chemically synthesized
gtctcaataaaaaaaaaaaa

SEQ ID NO: 522156 - DNA, 20 bp, Artificial Sequence
  chemically synthesized
tttttttttttttattgaga

SEQ ID NO: 522157 - DNA, 20 bp, Artificial Sequence
  chemically synthesized
tcttcctctgtctctcaggc

SEQ ID NO: 522158 - DNA, 20 bp, Artificial Sequence
  chemically synthesized
tactagggaggctgaggcag

SEQ ID NO: 522159 - DNA, 20 bp, Artificial Sequence
  chemically synthesized
ttttgtatttttggtagaga

SEQ ID NO: 522160 - DNA, 20 bp, Artificial Sequence
  chemically synthesized
gtgggcggattacttgaggt

SEQ ID NO: 522161 - DNA, 20 bp, Artificial Sequence
  chemically synthesized
attttgagaggccaaggtgg

SEQ ID NO: 522162 - DNA, 20 bp, Artificial Sequence
  chemically synthesized
accttggcctctcaaaatgt

SEQ ID NO: 522163 - DNA, 20 bp, Artificial Sequence
  chemically synthesized
taaaagtctgcaaattaaaa

SEQ ID NO: 522164 - DNA, 20 bp, Artificial Sequence
  chemically synthesized
ttacgttccaaaatgctctg

SEQ ID NO: 522165 - DNA, 20 bp, Artificial Sequence
  chemically synthesized
tgtttagaaattgtgcttct

SEQ ID NO: 522166 - DNA, 20 bp, Artificial Sequence
  chemically synthesized
acagaaatgattttattcat

SEQ ID NO: 522167 - DNA, 20 bp, Artificial Sequence
  chemically synthesized
ccacatgtgagaacattcca

SEQ ID NO: 522168 - DNA, 20 bp, Artificial Sequence
  chemically synthesized
ccggctgatttaagcacctt

SEQ ID NO: 522169 - DNA, 20 bp, Artificial Sequence
  chemically synthesized
tgggcagatcacttgaggtc

SEQ ID NO: 522170 - DNA, 20 bp, Artificial Sequence
  chemically synthesized
ttcgagaccagcctggccaa

SEQ ID NO: 522171 - DNA, 20 bp, Artificial Sequence
  chemically synthesized
ttttatatttttaggagaga

SEQ ID NO: 522172 - DNA, 20 bp, Artificial Sequence
  chemically synthesized
gcctgagcctcctcagtaac

SEQ ID NO: 522173 - DNA, 20 bp, Artificial Sequence
  chemically synthesized
tactgaggaggctcaggcag

SEQ ID NO: 522174 - DNA, 20 bp, Artificial Sequence
  chemically synthesized
ttgcaccagtgagctccagc

SEQ ID NO: 522175 - DNA, 20 bp, Artificial Sequence
  chemically synthesized
gtgagctccagcctgggtga

SEQ ID NO: 522176 - DNA, 20 bp, Artificial Sequence
  chemically synthesized
ttgtttgtttgtttttgaga

SEQ ID NO: 522177 - DNA, 20 bp, Artificial Sequence
  chemically synthesized
aaggtggtgaaataattttg

SEQ ID NO: 522178 - DNA, 20 bp, Artificial Sequence
  chemically synthesized
attaagttaaaatatataca

SEQ ID NO: 522179 - DNA, 20 bp, Artificial Sequence
  chemically synthesized
cattatctttaattacatgg

SEQ ID NO: 522180 - DNA, 20 bp, Artificial Sequence
  chemically synthesized
ctaccacagccttttggtta

SEQ ID NO: 522181 - DNA, 20 bp, Artificial Sequence
  chemically synthesized
ttttctagatttcctgataa

SEQ ID NO: 522182 - DNA, 20 bp, Artificial Sequence
  chemically synthesized
tgcataatgaaaagtgacta

SEQ ID NO: 522183 - DNA, 20 bp, Artificial Sequence
  chemically synthesized
aagatatttttttgaaagtt

SEQ ID NO: 522184 - DNA, 20 bp, Artificial Sequence
  chemically synthesized
ataatgtattttcaaataac

SEQ ID NO: 522185 - DNA, 20 bp, Artificial Sequence
  chemically synthesized
ggttcatgtttaatcttggt

SEQ ID NO: 522186 - DNA, 20 bp, Artificial Sequence
  chemically synthesized
gtttaatcttggtttgagtc

SEQ ID NO: 522187 - DNA, 20 bp, Artificial Sequence
  chemically synthesized
cttggtttgagtcttgaata

SEQ ID NO: 522188 - DNA, 20 bp, Artificial Sequence
  chemically synthesized
ctccctctctcaactgtgtt

SEQ ID NO: 522189 - DNA, 20 bp, Artificial Sequence
  chemically synthesized
ctttctctaaaacacagagg

SEQ ID NO: 522190 - DNA, 20 bp, Artificial Sequence
  chemically synthesized
cttttcttttgggccacact

SEQ ID NO: 522191 - DNA, 20 bp, Artificial Sequence
  chemically synthesized
agaaaagataggaactgcat

SEQ ID NO: 522192 - DNA, 20 bp, Artificial Sequence
  chemically synthesized
ggtcccatttgattataaca

SEQ ID NO: 522193 - DNA, 20 bp, Artificial Sequence
  chemically synthesized
ctgtacagcatgtgactgta

SEQ ID NO: 522194 - DNA, 20 bp, Artificial Sequence
  chemically synthesized
ggtttgtagccaaacagaaa

SEQ ID NO: 522195 - DNA, 20 bp, Artificial Sequence
  chemically synthesized
tcatcgttgtgtgaatgtca

SEQ ID NO: 522196 - DNA, 20 bp, Artificial Sequence
  chemically synthesized
taaggtaatttcatcgttgt

SEQ ID NO: 522197 - DNA, 20 bp, Artificial Sequence
  chemically synthesized
aacgatgaaattaccttagt

SEQ ID NO: 522198 - DNA, 20 bp, Artificial Sequence
  chemically synthesized
ttaccttagtatggattgat

SEQ ID NO: 522199 - DNA, 20 bp, Artificial Sequence
  chemically synthesized
tacagttatgtgttaacacc

SEQ ID NO: 522200 - DNA, 20 bp, Artificial Sequence
  chemically synthesized
cagtgacacacaaacacaca

SEQ ID NO: 522201 - DNA, 20 bp, Artificial Sequence
  chemically synthesized
tttctgattcctcatggtga

SEQ ID NO: 522202 - DNA, 20 bp, Artificial Sequence
  chemically synthesized
gatatgattccttcaccatg

SEQ ID NO: 522203 - DNA, 20 bp, Artificial Sequence
  chemically synthesized
aaaaactcatttgagacttt

SEQ ID NO: 522204 - DNA, 20 bp, Artificial Sequence
  chemically synthesized
ttgtatcctgaaagtctcaa

SEQ ID NO: 522205 - DNA, 20 bp, Artificial Sequence
  chemically synthesized
tcttttgtttttttttgaga

SEQ ID NO: 522206 - DNA, 20 bp, Artificial Sequence
  chemically synthesized
tctacctctgtcgcccaggc

SEQ ID NO: 522207 - DNA, 20 bp, Artificial Sequence
  chemically synthesized
tgtcgcccaggctggagtgc

SEQ ID NO: 522208 - DNA, 20 bp, Artificial Sequence
  chemically synthesized
ttcaatgcaacctccgcctc

SEQ ID NO: 522209 - DNA, 20 bp, Artificial Sequence
  chemically synthesized
tactcgggaggctgaggcag

SEQ ID NO: 522210 - DNA, 20 bp, Artificial Sequence
  chemically synthesized
aattctcctgcctcagcctc

SEQ ID NO: 522211 - DNA, 20 bp, Artificial Sequence
  chemically synthesized
gcctcagcctcccgagtagc

SEQ ID NO: 522212 - DNA, 20 bp, Artificial Sequence
  chemically synthesized
ttttgtatttttaggagaga

SEQ ID NO: 522213 - DNA, 20 bp, Artificial Sequence
  chemically synthesized
tgtacagatcacttgaggtc

SEQ ID NO: 522214 - DNA, 20 bp, Artificial Sequence
  chemically synthesized
acctcagcctcccaaattgc

SEQ ID NO: 522215 - DNA, 20 bp, Artificial Sequence
  chemically synthesized
agccaccacgcccggttcaa

SEQ ID NO: 522216 - DNA, 20 bp, Artificial Sequence
  chemically synthesized
atattaaaacaaacgaaaac

SEQ ID NO: 522217 - DNA, 20 bp, Artificial Sequence
  chemically synthesized
gatagctattagattatgaa

SEQ ID NO: 522218 - DNA, 20 bp, Artificial Sequence
  chemically synthesized
attctgatagctattagatt

SEQ ID NO: 522219 - DNA, 20 bp, Artificial Sequence
  chemically synthesized
attcataatctaatagctat

SEQ ID NO: 522220 - DNA, 20 bp, Artificial Sequence
  chemically synthesized
tgctgtttgttttcttccaa

SEQ ID NO: 522221 - DNA, 20 bp, Artificial Sequence
  chemically synthesized
gaaataaaaggctgggcgtt

SEQ ID NO: 522222 - DNA, 20 bp, Artificial Sequence
  chemically synthesized
tcccaaagtgttgggattat

SEQ ID NO: 522223 - DNA, 20 bp, Artificial Sequence
  chemically synthesized
acctcggcctcccaaagtgt

SEQ ID NO: 522224 - DNA, 20 bp, Artificial Sequence
  chemically synthesized
actttgggaggccgaggtgg

SEQ ID NO: 522225 - DNA, 20 bp, Artificial Sequence
  chemically synthesized
tgggcggatcacttgaggac

SEQ ID NO: 522226 - DNA, 20 bp, Artificial Sequence
  chemically synthesized
ttttgtatttttattagaga

SEQ ID NO: 522227 - DNA, 20 bp, Artificial Sequence
  chemically synthesized
aaaattagctgggcgtagtg

SEQ ID NO: 522228 - DNA, 20 bp, Artificial Sequence
  chemically synthesized
gcctcagcctcccaagtaac

SEQ ID NO: 522229 - DNA, 20 bp, Artificial Sequence
  chemically synthesized
tacttgggaggctgaggcag

SEQ ID NO: 522230 - DNA, 20 bp, Artificial Sequence
  chemically synthesized
ctcactgcaacctccgcctc

SEQ ID NO: 522231 - DNA, 20 bp, Artificial Sequence
  chemically synthesized
cgtgagccaccgtgcctggc

SEQ ID NO: 522232 - DNA, 20 bp, Artificial Sequence
  chemically synthesized
gccttggcctcccaaagtgc

SEQ ID NO: 522233 - DNA, 20 bp, Artificial Sequence
  chemically synthesized
actttgggaggccaaggcat

SEQ ID NO: 522234 - DNA, 20 bp, Artificial Sequence
  chemically synthesized
ggcatgcgaatcacgaggtc

SEQ ID NO: 522235 - DNA, 20 bp, Artificial Sequence
  chemically synthesized
gattctcctgcgtcagcctc

SEQ ID NO: 522236 - DNA, 20 bp, Artificial Sequence
  chemically synthesized
tattcgggaggctgacgcag

SEQ ID NO: 522237 - DNA, 20 bp, Artificial Sequence
  chemically synthesized
gccactgcactccagcctgg

SEQ ID NO: 522238 - DNA, 20 bp, Artificial Sequence
  chemically synthesized
ctccctctattcgcccaggc

SEQ ID NO: 522239 - DNA, 20 bp, Artificial Sequence
  chemically synthesized
ttttttttttttttttcaga

SEQ ID NO: 522240 - DNA, 20 bp, Artificial Sequence
  chemically synthesized
gccaaggaagaaaataaaga

SEQ ID NO: 522241 - DNA, 20 bp, Artificial Sequence
  chemically synthesized
ttccttggcaaaattgtctg

SEQ ID NO: 522242 - DNA, 20 bp, Artificial Sequence
  chemically synthesized
ttaattaaataaatggatga

SEQ ID NO: 522243 - DNA, 20 bp, Artificial Sequence
  chemically synthesized
taaattaattaaataaatgg

SEQ ID NO: 522244 - DNA, 20 bp, Artificial Sequence
  chemically synthesized
tcaataaattaattaaataa

SEQ ID NO: 522245 - DNA, 20 bp, Artificial Sequence
  chemically synthesized
ccatttatttaattaattta

SEQ ID NO: 522246 - DNA, 20 bp, Artificial Sequence
  chemically synthesized
atacctgcttggaatgtaat

SEQ ID NO: 522247 - DNA, 20 bp, Artificial Sequence
  chemically synthesized
cttagtagttaatacctgct

SEQ ID NO: 522248 - DNA, 20 bp, Artificial Sequence
  chemically synthesized
ccaagcaggtattaactact

SEQ ID NO: 522249 - DNA, 20 bp, Artificial Sequence
  chemically synthesized
atacaccttgtctttcatca

SEQ ID NO: 522250 - DNA, 20 bp, Artificial Sequence
  chemically synthesized
ttatgctctaaaattccgtt

SEQ ID NO: 522251 - DNA, 20 bp, Artificial Sequence
  chemically synthesized
gctctaaaattccgttaaga

SEQ ID NO: 522252 - DNA, 20 bp, Artificial Sequence
  chemically synthesized
gccaataaatccattcttaa

SEQ ID NO: 522253 - DNA, 20 bp, Artificial Sequence
  chemically synthesized
gttaagaatggatttattgg

SEQ ID NO: 522254 - DNA, 20 bp, Artificial Sequence
  chemically synthesized
gcctctgcctcccaaagtgc

SEQ ID NO: 522255 - DNA, 20 bp, Artificial Sequence
  chemically synthesized
caggtggctcacctgaggtc

SEQ ID NO: 522256 - DNA, 20 bp, Artificial Sequence
  chemically synthesized
ttttgtatttttaggagaga

SEQ ID NO: 522257 - DNA, 20 bp, Artificial Sequence
  chemically synthesized
gcctcagcctcccgagtagc

SEQ ID NO: 522258 - DNA, 20 bp, Artificial Sequence
  chemically synthesized
aattctcctgcctcagcctc

SEQ ID NO: 522259 - DNA, 20 bp, Artificial Sequence
  chemically synthesized
tactcgggaggctgaggcag

SEQ ID NO: 522260 - DNA, 20 bp, Artificial Sequence
  chemically synthesized
ctcaccgcaacctccgcctc

SEQ ID NO: 522261 - DNA, 20 bp, Artificial Sequence
  chemically synthesized
ttcgctcttgttgcccaggc

SEQ ID NO: 522262 - DNA, 20 bp, Artificial Sequence
  chemically synthesized
tctaatctttaaatattata

SEQ ID NO: 522263 - DNA, 20 bp, Artificial Sequence
  chemically synthesized
tcagctccatcttatcaaac

SEQ ID NO: 522264 - DNA, 20 bp, Artificial Sequence
  chemically synthesized
ttatcaaactggaataacat

SEQ ID NO: 522265 - DNA, 20 bp, Artificial Sequence
  chemically synthesized
ttaggggtgaacatgccttt

SEQ ID NO: 522266 - DNA, 20 bp, Artificial Sequence
  chemically synthesized
gatgttcgtaactgagagtt

SEQ ID NO: 522267 - DNA, 20 bp, Artificial Sequence
  chemically synthesized
taatctagatgttcgtaact

SEQ ID NO: 522268 - DNA, 20 bp, Artificial Sequence
  chemically synthesized
gtttagattaaatgtttaat

SEQ ID NO: 522269 - DNA, 20 bp, Artificial Sequence
  chemically synthesized
atctaaacgttgcgccccat

SEQ ID NO: 522270 - DNA, 20 bp, Artificial Sequence
  chemically synthesized
actaaaagaaagtgactaca

SEQ ID NO: 522271 - DNA, 20 bp, Artificial Sequence
  chemically synthesized
tatagcaaaggttataattt

SEQ ID NO: 522272 - DNA, 20 bp, Artificial Sequence
  chemically synthesized
aaactgaaactatgaaaaaa

SEQ ID NO: 522273 - DNA, 20 bp, Artificial Sequence
  chemically synthesized
atgatccatgagataagcac

SEQ ID NO: 522274 - DNA, 20 bp, Artificial Sequence
  chemically synthesized
tagattcaagtgcttatctc

SEQ ID NO: 522275 - DNA, 20 bp, Artificial Sequence
  chemically synthesized
ttacatagggagaaatcgca

SEQ ID NO: 522276 - DNA, 20 bp, Artificial Sequence
  chemically synthesized
agggagaaatcgcagagaat

SEQ ID NO: 522277 - DNA, 20 bp, Artificial Sequence
  chemically synthesized
tcgcagagaataagaatcaa

SEQ ID NO: 522278 - DNA, 20 bp, Artificial Sequence
  chemically synthesized
caaaggagtaattaaaaatt

SEQ ID NO: 522279 - DNA, 20 bp, Artificial Sequence
  chemically synthesized
gttttgggaggctgaggcag

SEQ ID NO: 522280 - DNA, 20 bp, Artificial Sequence
  chemically synthesized
tagagtgcaatggcacgatc

SEQ ID NO: 522281 - DNA, 20 bp, Artificial Sequence
  chemically synthesized
tcgtgccattgcactctagc

SEQ ID NO: 522282 - DNA, 20 bp, Artificial Sequence
  chemically synthesized
tctcgctctgtcacccaggc

SEQ ID NO: 522283 - DNA, 20 bp, Artificial Sequence
  chemically synthesized
tttttttttttttcttgaga

SEQ ID NO: 522284 - DNA, 20 bp, Artificial Sequence
  chemically synthesized
attttactgccagtttcagc

SEQ ID NO: 522285 - DNA, 20 bp, Artificial Sequence
  chemically synthesized
aagattaatatattaaaata

SEQ ID NO: 522286 - DNA, 20 bp, Artificial Sequence
  chemically synthesized
tttaatatattaatctttag

SEQ ID NO: 522287 - DNA, 20 bp, Artificial Sequence
  chemically synthesized
aatatatgcttcaattttgt

SEQ ID NO: 522288 - DNA, 20 bp, Artificial Sequence
  chemically synthesized
tagattactaagaacagaaa

SEQ ID NO: 522289 - DNA, 20 bp, Artificial Sequence
  chemically synthesized
ggggccccacttcagaagga

SEQ ID NO: 522290 - DNA, 20 bp, Artificial Sequence
  chemically synthesized
aggactgaatcagaaactct

SEQ ID NO: 522291 - DNA, 20 bp, Artificial Sequence
  chemically synthesized
agcttgctggatgccacccc

SEQ ID NO: 522292 - DNA, 20 bp, Artificial Sequence
  chemically synthesized
gctggttaaaccacagcttg

SEQ ID NO: 522293 - DNA, 20 bp, Artificial Sequence
  chemically synthesized
tggtttaaccagccctccag

SEQ ID NO: 522294 - DNA, 20 bp, Artificial Sequence
  chemically synthesized
aatctgatgcccactcaagg

SEQ ID NO: 522295 - DNA, 20 bp, Artificial Sequence
  chemically synthesized
acagtggttctcactcttcc

SEQ ID NO: 522296 - DNA, 20 bp, Artificial Sequence
  chemically synthesized
gttctaatctatcgtcttcc

SEQ ID NO: 522297 - DNA, 20 bp, Artificial Sequence
  chemically synthesized
tatttattaaattatgctta

SEQ ID NO: 522298 - DNA, 20 bp, Artificial Sequence
  chemically synthesized
aagcataatttaataaatag

SEQ ID NO: 522299 - DNA, 20 bp, Artificial Sequence
  chemically synthesized
gtttatgagttcaagctgag

SEQ ID NO: 522300 - DNA, 20 bp, Artificial Sequence
  chemically synthesized
cagaggccagttgatggttt

SEQ ID NO: 522301 - DNA, 20 bp, Artificial Sequence
  chemically synthesized
tgtacttccaggacaatctg

SEQ ID NO: 522302 - DNA, 20 bp, Artificial Sequence
  chemically synthesized
atgagagagaagacttgcaa

SEQ ID NO: 522303 - DNA, 20 bp, Artificial Sequence
  chemically synthesized
atccaaagttaaaagtctat

SEQ ID NO: 522304 - DNA, 20 bp, Artificial Sequence
  chemically synthesized
atccaaatagacttttaact

SEQ ID NO: 522305 - DNA, 20 bp, Artificial Sequence
  chemically synthesized
ttaaattaaaaacgtgtgtt

SEQ ID NO: 522306 - DNA, 20 bp, Artificial Sequence
  chemically synthesized
ggggggtgagctaaaagagt

SEQ ID NO: 522307 - DNA, 20 bp, Artificial Sequence
  chemically synthesized
ttttcaggggggtgagctaa

SEQ ID NO: 522308 - DNA, 20 bp, Artificial Sequence
  chemically synthesized
acagctagtttttttttcag

SEQ ID NO: 522309 - DNA, 20 bp, Artificial Sequence
  chemically synthesized
tgtccaagtcagaaactctt

SEQ ID NO: 522310 - DNA, 20 bp, Artificial Sequence
  chemically synthesized
ttacttttattaaaattcca

SEQ ID NO: 522311 - DNA, 20 bp, Artificial Sequence
  chemically synthesized
ctgacagtatatattggcaa

SEQ ID NO: 522312 - DNA, 20 bp, Artificial Sequence
  chemically synthesized
caacagaatatatgctaatt

SEQ ID NO: 522313 - DNA, 20 bp, Artificial Sequence
  chemically synthesized
tatatgctaatttagaattt

SEQ ID NO: 522314 - DNA, 20 bp, Artificial Sequence
  chemically synthesized
atcaggtttttttttaatta

SEQ ID NO: 522315 - DNA, 20 bp, Artificial Sequence
  chemically synthesized
cctaattatctgaaatatct

SEQ ID NO: 522316 - DNA, 20 bp, Artificial Sequence
  chemically synthesized
tttcagataattaggcagcc

SEQ ID NO: 522317 - DNA, 20 bp, Artificial Sequence
  chemically synthesized
atgtctaaattactattcac

SEQ ID NO: 522318 - DNA, 20 bp, Artificial Sequence
  chemically synthesized
cggaaataacaaggatcctt

SEQ ID NO: 522319 - DNA, 20 bp, Artificial Sequence
  chemically synthesized
tcaaagaagacggaaataac

SEQ ID NO: 522320 - DNA, 20 bp, Artificial Sequence
  chemically synthesized
attaaaaacttcttaaaaat

SEQ ID NO: 522321 - DNA, 20 bp, Artificial Sequence
  chemically synthesized
atttatgcatatatgtacat

SEQ ID NO: 522322 - DNA, 20 bp, Artificial Sequence
  chemically synthesized
aactcattagaaaactaatg

SEQ ID NO: 522323 - DNA, 20 bp, Artificial Sequence
  chemically synthesized
aatccctcattagttttcta

SEQ ID NO: 522324 - DNA, 20 bp, Artificial Sequence
  chemically synthesized
attagttttctaatgagttt

SEQ ID NO: 522325 - DNA, 20 bp, Artificial Sequence
  chemically synthesized
tatcgtttatagattaaggt

SEQ ID NO: 522326 - DNA, 20 bp, Artificial Sequence
  chemically synthesized
taaagccacaacccaaaaag

SEQ ID NO: 522327 - DNA, 20 bp, Artificial Sequence
  chemically synthesized
aggaacccatattctacttt

SEQ ID NO: 522328 - DNA, 20 bp, Artificial Sequence
  chemically synthesized
cacaacccaaaaagtagaat

SEQ ID NO: 522329 - DNA, 20 bp, Artificial Sequence
  chemically synthesized
ggtttgacaccaataaccta

SEQ ID NO: 522330 - DNA, 20 bp, Artificial Sequence
  chemically synthesized
tgttgtgaggaagggaagaa

SEQ ID NO: 522331 - DNA, 20 bp, Artificial Sequence
  chemically synthesized
tatagaaaggcatatggaac

SEQ ID NO: 522332 - DNA, 20 bp, Artificial Sequence
  chemically synthesized
ttgcaacccctgggatatat

SEQ ID NO: 522333 - DNA, 20 bp, Artificial Sequence
  chemically synthesized
gagtcatccaaatatatccc

SEQ ID NO: 522334 - DNA, 20 bp, Artificial Sequence
  chemically synthesized
tttggtcaatttgcaacccc

SEQ ID NO: 522335 - DNA, 20 bp, Artificial Sequence
  chemically synthesized
aggggttgcaaattgaccaa

SEQ ID NO: 522336 - DNA, 20 bp, Artificial Sequence
  chemically synthesized
acctttagggaagcctgctt

SEQ ID NO: 522337 - DNA, 20 bp, Artificial Sequence
  chemically synthesized
agcctgcttctgaatgcttg

SEQ ID NO: 522338 - DNA, 20 bp, Artificial Sequence
  chemically synthesized
ttgtggaatttatcattctt

SEQ ID NO: 522339 - DNA, 20 bp, Artificial Sequence
  chemically synthesized
taaatgcaacagccattcag

SEQ ID NO: 522340 - DNA, 20 bp, Artificial Sequence
  chemically synthesized
aatgtctgaggtctcatctg

SEQ ID NO: 522341 - DNA, 20 bp, Artificial Sequence
  chemically synthesized
aggtgtgtagccagcctccg

SEQ ID NO: 522342 - DNA, 20 bp, Artificial Sequence
  chemically synthesized
cttttctcttacacattcta

SEQ ID NO: 522343 - DNA, 20 bp, Artificial Sequence
  chemically synthesized
tccaggtttaccatacccca

SEQ ID NO: 522344 - DNA, 20 bp, Artificial Sequence
  chemically synthesized
gggtatggtaaacctggagg

SEQ ID NO: 522345 - DNA, 20 bp, Artificial Sequence
  chemically synthesized
aagcacagataaagcaggca

SEQ ID NO: 522346 - DNA, 20 bp, Artificial Sequence
  chemically synthesized
tttcttccactccggttgcc

SEQ ID NO: 522347 - DNA, 20 bp, Artificial Sequence
  chemically synthesized
acctcactattcacggcaac

SEQ ID NO: 522348 - DNA, 20 bp, Artificial Sequence
  chemically synthesized
gcaaaatgctgtctgtgaag

SEQ ID NO: 522349 - DNA, 20 bp, Artificial Sequence
  chemically synthesized
agaaaccattgctgtgagag

SEQ ID NO: 522350 - DNA, 20 bp, Artificial Sequence
  chemically synthesized
actgtgtcgtctgctttata

SEQ ID NO: 522351 - DNA, 20 bp, Artificial Sequence
  chemically synthesized
ctgctttatataggatttat

SEQ ID NO: 522352 - DNA, 20 bp, Artificial Sequence
  chemically synthesized
gagtgcactgtcgagttcac

SEQ ID NO: 522353 - DNA, 20 bp, Artificial Sequence
  chemically synthesized
ttgcataaatgagtgcactg

SEQ ID NO: 522354 - DNA, 20 bp, Artificial Sequence
  chemically synthesized
actaacaccagtttgcataa

SEQ ID NO: 522355 - DNA, 20 bp, Artificial Sequence
  chemically synthesized
tcagcagcactggacgtttt

SEQ ID NO: 522356 - DNA, 20 bp, Artificial Sequence
  chemically synthesized
cttctgcattgtggtttaga

SEQ ID NO: 522357 - DNA, 20 bp, Artificial Sequence
  chemically synthesized
tcttaatctccatttgcctt

SEQ ID NO: 522358 - DNA, 20 bp, Artificial Sequence
  chemically synthesized
ttttaaaacacagggtttat

SEQ ID NO: 522359 - DNA, 20 bp, Artificial Sequence
  chemically synthesized
ttaattctttttttaaaaca

SEQ ID NO: 522360 - DNA, 20 bp, Artificial Sequence
  chemically synthesized
taaaccctgtgttttaaaaa

SEQ ID NO: 522361 - DNA, 20 bp, Artificial Sequence
  chemically synthesized
gttttaaaaaaagaattaaa

SEQ ID NO: 522362 - DNA, 20 bp, Artificial Sequence
  chemically synthesized
tacaaatttgagtaagttat

SEQ ID NO: 522363 - DNA, 20 bp, Artificial Sequence
  chemically synthesized
gtttaacttcaaatacaaat

SEQ ID NO: 522364 - DNA, 20 bp, Artificial Sequence
  chemically synthesized
tttgtatttgaagttaaacc

SEQ ID NO: 522365 - DNA, 20 bp, Artificial Sequence
  chemically synthesized
aattctgttttttcaagaag

SEQ ID NO: 522366 - DNA, 20 bp, Artificial Sequence
  chemically synthesized
aatcctgcttcttgaaaaaa

SEQ ID NO: 522367 - DNA, 20 bp, Artificial Sequence
  chemically synthesized
atccacttcaatcttatgct

SEQ ID NO: 522368 - DNA, 20 bp, Artificial Sequence
  chemically synthesized
acccagagcataagattgaa

SEQ ID NO: 522369 - DNA, 20 bp, Artificial Sequence
  chemically synthesized
agatggggattgacatactt

SEQ ID NO: 522370 - DNA, 20 bp, Artificial Sequence
  chemically synthesized
tttatatgctttgatcagat

SEQ ID NO: 522371 - DNA, 20 bp, Artificial Sequence
  chemically synthesized
ctgcagttcttggttttctt

SEQ ID NO: 522372 - DNA, 20 bp, Artificial Sequence
  chemically synthesized
aagttcatgtaaaagaaatc

SEQ ID NO: 522373 - DNA, 20 bp, Artificial Sequence
  chemically synthesized
agcaaaccttaactgtaact

SEQ ID NO: 522374 - DNA, 20 bp, Artificial Sequence
  chemically synthesized
cacatactgtttgccgggca

SEQ ID NO: 522375 - DNA, 20 bp, Artificial Sequence
  chemically synthesized
tatattaaagaaaacaaggt

SEQ ID NO: 522376 - DNA, 20 bp, Artificial Sequence
  chemically synthesized
aatttccgcatctgaaaatt

SEQ ID NO: 522377 - DNA, 20 bp, Artificial Sequence
  chemically synthesized
gcagtactctttgtagacaa

SEQ ID NO: 522378 - DNA, 20 bp, Artificial Sequence
  chemically synthesized
accgtattcccttgtctaca

SEQ ID NO: 522379 - DNA, 20 bp, Artificial Sequence
  chemically synthesized
ttctttagttcttctgtaat

SEQ ID NO: 522380 - DNA, 20 bp, Artificial Sequence
  chemically synthesized
aactaaagaaaccttgtagc

SEQ ID NO: 522381 - DNA, 20 bp, Artificial Sequence
  chemically synthesized
ataattagcagtgctactaa

SEQ ID NO: 522382 - DNA, 20 bp, Artificial Sequence
  chemically synthesized
tctttctaagcagtacgaca

SEQ ID NO: 522383 - DNA, 20 bp, Artificial Sequence
  chemically synthesized
actgcttagaaagattagtt

SEQ ID NO: 522384 - DNA, 20 bp, Artificial Sequence
  chemically synthesized
aaacaattacactataaaga

SEQ ID NO: 522385 - DNA, 20 bp, Artificial Sequence
  chemically synthesized
tagctcgagggcggcaaaac

SEQ ID NO: 522386 - DNA, 20 bp, Artificial Sequence
  chemically synthesized
ggaaaaaaggaaccctatat

SEQ ID NO: 522387 - DNA, 20 bp, Artificial Sequence
  chemically synthesized
tctttacagaaactcatata

SEQ ID NO: 522388 - DNA, 20 bp, Artificial Sequence
  chemically synthesized
aagatctaaagggaaaaatt

SEQ ID NO: 522389 - DNA, 20 bp, Artificial Sequence
  chemically synthesized
gtgtccttgaaggtgcattg

SEQ ID NO: 522390 - DNA, 20 bp, Artificial Sequence
  chemically synthesized
ccttcaaggacactgtagct

SEQ ID NO: 522391 - DNA, 20 bp, Artificial Sequence
  chemically synthesized
tgccaagtgtcttccgctaa

SEQ ID NO: 522392 - DNA, 20 bp, Artificial Sequence
  chemically synthesized
atctgggaacatttgttctt

SEQ ID NO: 522393 - DNA, 20 bp, Artificial Sequence
  chemically synthesized
tttataaatatcagaaaaac

SEQ ID NO: 522394 - DNA, 20 bp, Artificial Sequence
  chemically synthesized
atatatagtccctactagaa

SEQ ID NO: 522395 - DNA, 20 bp, Artificial Sequence
  chemically synthesized
ataaatatatatatatatga

SEQ ID NO: 522396 - DNA, 20 bp, Artificial Sequence
  chemically synthesized
tttgctcttgttgcccaggt

SEQ ID NO: 522397 - DNA, 20 bp, Artificial Sequence
  chemically synthesized
ctcaccgcaacctctgcctc

SEQ ID NO: 522398 - DNA, 20 bp, Artificial Sequence
  chemically synthesized
tgctccggaggctgaggcag

SEQ ID NO: 522399 - DNA, 20 bp, Artificial Sequence
  chemically synthesized
ttttgtatttttagtagaga

SEQ ID NO: 522400 - DNA, 20 bp, Artificial Sequence
  chemically synthesized
caggcggatcacctgaggtc

SEQ ID NO: 522401 - DNA, 20 bp, Artificial Sequence
  chemically synthesized
actttgggaggccgaggcag

SEQ ID NO: 522402 - DNA, 20 bp, Artificial Sequence
  chemically synthesized
gcctcggcctcccaaagtgc

SEQ ID NO: 522403 - DNA, 20 bp, Artificial Sequence
  chemically synthesized
atgaggcttttcactgttct

SEQ ID NO: 522404 - DNA, 20 bp, Artificial Sequence
  chemically synthesized
tcactgttctaggaattaaa

SEQ ID NO: 522405 - DNA, 20 bp, Artificial Sequence
  chemically synthesized
gagtttcaggtattgcattc

SEQ ID NO: 522406 - DNA, 20 bp, Artificial Sequence
  chemically synthesized
caggtttgctgagaagattc

SEQ ID NO: 522407 - DNA, 20 bp, Artificial Sequence
  chemically synthesized
tcacctgtaaaacgagttta

SEQ ID NO: 522408 - DNA, 20 bp, Artificial Sequence
  chemically synthesized
ccaatctcctcacctgtaaa

SEQ ID NO: 522409 - DNA, 20 bp, Artificial Sequence
  chemically synthesized
tcttaagcacttccggttag

SEQ ID NO: 522410 - DNA, 20 bp, Artificial Sequence
  chemically synthesized
ccaactaaccggaagtgctt

SEQ ID NO: 522411 - DNA, 20 bp, Artificial Sequence
  chemically synthesized
gtttagggagtcaggtagag

SEQ ID NO: 522412 - DNA, 20 bp, Artificial Sequence
  chemically synthesized
tcttgacacacacttgttta

SEQ ID NO: 522413 - DNA, 20 bp, Artificial Sequence
  chemically synthesized
tccctaaacaagtgtgtgtc

SEQ ID NO: 522414 - DNA, 20 bp, Artificial Sequence
  chemically synthesized
ttaatgggcatacaaaccac

SEQ ID NO: 522415 - DNA, 20 bp, Artificial Sequence
  chemically synthesized
cctgggtatcttggtaaaat

SEQ ID NO: 522416 - DNA, 20 bp, Artificial Sequence
  chemically synthesized
tcaggtcccacctaaaatta

SEQ ID NO: 522417 - DNA, 20 bp, Artificial Sequence
  chemically synthesized
cagggaacttattggaaatg

SEQ ID NO: 522418 - DNA, 20 bp, Artificial Sequence
  chemically synthesized
ggtggtctttggacaacaca

SEQ ID NO: 522419 - DNA, 20 bp, Artificial Sequence
  chemically synthesized
atcagcaaagttggagaacc

SEQ ID NO: 522420 - DNA, 20 bp, Artificial Sequence
  chemically synthesized
ttctccaactttgctgatat

SEQ ID NO: 522421 - DNA, 20 bp, Artificial Sequence
  chemically synthesized
tttcttaaagaagttcttca

SEQ ID NO: 522422 - DNA, 20 bp, Artificial Sequence
  chemically synthesized
tatgaagtgcagtttgggca

SEQ ID NO: 522423 - DNA, 20 bp, Artificial Sequence
  chemically synthesized
gcacttcatatcaatgaaat

SEQ ID NO: 522424 - DNA, 20 bp, Artificial Sequence
  chemically synthesized
tggctgttcattagaattgc

SEQ ID NO: 522425 - DNA, 20 bp, Artificial Sequence
  chemically synthesized
tctcaaacttggctgttcat

SEQ ID NO: 522426 - DNA, 20 bp, Artificial Sequence
  chemically synthesized
tctaatgaacagccaagttt

SEQ ID NO: 522427 - DNA, 20 bp, Artificial Sequence
  chemically synthesized
aatttgataacaacatgtca

SEQ ID NO: 522428 - DNA, 20 bp, Artificial Sequence
  chemically synthesized
ttatcaaattaggtgctcat

SEQ ID NO: 522429 - DNA, 20 bp, Artificial Sequence
  chemically synthesized
gctttaatgaatgtaggtct

SEQ ID NO: 522430 - DNA, 20 bp, Artificial Sequence
  chemically synthesized
taagtcttatcactgcttta

SEQ ID NO: 522431 - DNA, 20 bp, Artificial Sequence
  chemically synthesized
ttggataacagaatcacctg

SEQ ID NO: 522432 - DNA, 20 bp, Artificial Sequence
  chemically synthesized
gttctcaaactgttggataa

SEQ ID NO: 522433 - DNA, 20 bp, Artificial Sequence
  chemically synthesized
agaaagtggttctcaaactg

SEQ ID NO: 522434 - DNA, 20 bp, Artificial Sequence
  chemically synthesized
ctactcacaactttttttgc

SEQ ID NO: 522435 - DNA, 20 bp, Artificial Sequence
  chemically synthesized
ccattcaggcaaaaaaagtt

SEQ ID NO: 522436 - DNA, 20 bp, Artificial Sequence
  chemically synthesized
cttgttttcatgcatatcct

SEQ ID NO: 522437 - DNA, 20 bp, Artificial Sequence
  chemically synthesized
ttatcgtaccgatgaaccct

SEQ ID NO: 522438 - DNA, 20 bp, Artificial Sequence
  chemically synthesized
ccccatgaatttttagcttg

SEQ ID NO: 522439 - DNA, 20 bp, Artificial Sequence
  chemically synthesized
tgtggtggtgtgagggcccc

SEQ ID NO: 522440 - DNA, 20 bp, Artificial Sequence
  chemically synthesized
ttaaaaaaatgtctgtaact

SEQ ID NO: 522441 - DNA, 20 bp, Artificial Sequence
  chemically synthesized
catttttttaaacctctttt

SEQ ID NO: 522442 - DNA, 20 bp, Artificial Sequence
  chemically synthesized
acacacagtgtaagcataca

SEQ ID NO: 522443 - DNA, 20 bp, Artificial Sequence
  chemically synthesized
attgtatgcttacactgtgt

SEQ ID NO: 522444 - DNA, 20 bp, Artificial Sequence
  chemically synthesized
taagacatttaatatatgcc

SEQ ID NO: 522445 - DNA, 20 bp, Artificial Sequence
  chemically synthesized
agggtagctgtataattaaa

SEQ ID NO: 522446 - DNA, 20 bp, Artificial Sequence
  chemically synthesized
gaacctaatggtaacctgaa

SEQ ID NO: 522447 - DNA, 20 bp, Artificial Sequence
  chemically synthesized
ctgcagttgttactgagctt

SEQ ID NO: 522448 - DNA, 20 bp, Artificial Sequence
  chemically synthesized
caagcccttgaagaggagtt

SEQ ID NO: 522449 - DNA, 20 bp, Artificial Sequence
  chemically synthesized
atcttcacaagcccttgaag

SEQ ID NO: 522450 - DNA, 20 bp, Artificial Sequence
  chemically synthesized
cttcaagggcttgtgaagat

SEQ ID NO: 522451 - DNA, 20 bp, Artificial Sequence
  chemically synthesized
gtgacacattttggcttcag

SEQ ID NO: 522452 - DNA, 20 bp, Artificial Sequence
  chemically synthesized
catgttagaaatgtaactaa

SEQ ID NO: 522453 - DNA, 20 bp, Artificial Sequence
  chemically synthesized
catacttataggaaactctt

SEQ ID NO: 522454 - DNA, 20 bp, Artificial Sequence
  chemically synthesized
atattaagggagatatccaa

SEQ ID NO: 522455 - DNA, 20 bp, Artificial Sequence
  chemically synthesized
atatctcccttaatattatc

SEQ ID NO: 522456 - DNA, 20 bp, Artificial Sequence
  chemically synthesized
ccccagttgtgctcatttaa

SEQ ID NO: 522457 - DNA, 20 bp, Artificial Sequence
  chemically synthesized
gtgcaatgcccagagccata

SEQ ID NO: 522458 - DNA, 20 bp, Artificial Sequence
  chemically synthesized
tgcaccttgcacaaaggtgc

SEQ ID NO: 522459 - DNA, 20 bp, Artificial Sequence
  chemically synthesized
cagggatggctggggggaat

SEQ ID NO: 522460 - DNA, 20 bp, Artificial Sequence
  chemically synthesized
ggatcacagggatggctggg

SEQ ID NO: 522461 - DNA, 20 bp, Artificial Sequence
  chemically synthesized
ctgctttattggaggatcac

SEQ ID NO: 522462 - DNA, 20 bp, Artificial Sequence
  chemically synthesized
agtatgactctgctttattg

SEQ ID NO: 522463 - DNA, 20 bp, Artificial Sequence
  chemically synthesized
cctgtgatcctccaataaag

SEQ ID NO: 522464 - DNA, 20 bp, Artificial Sequence
  chemically synthesized
ctttcaaaattggctattct

SEQ ID NO: 522465 - DNA, 20 bp, Artificial Sequence
  chemically synthesized
ctccccacttcccaaatcca

SEQ ID NO: 522466 - DNA, 20 bp, Artificial Sequence
  chemically synthesized
ctgtggatttgggaagtggg

SEQ ID NO: 522467 - DNA, 20 bp, Artificial Sequence
  chemically synthesized
gcctctttgtttaattttca

SEQ ID NO: 522468 - DNA, 20 bp, Artificial Sequence
  chemically synthesized
tttcaaagagtaccatataa

SEQ ID NO: 522469 - DNA, 20 bp, Artificial Sequence
  chemically synthesized
aaagtgtaataaaaaatgtt

SEQ ID NO: 522470 - DNA, 20 bp, Artificial Sequence
  chemically synthesized
aattgctttgacttcggagc

SEQ ID NO: 522471 - DNA, 20 bp, Artificial Sequence
  chemically synthesized
caaagcaatttaactagggc

SEQ ID NO: 522472 - DNA, 20 bp, Artificial Sequence
  chemically synthesized
cagctagtacataggagaac

SEQ ID NO: 522473 - DNA, 20 bp, Artificial Sequence
  chemically synthesized
catttcgttgtctgtaaaat

SEQ ID NO: 522474 - DNA, 20 bp, Artificial Sequence
  chemically synthesized
taacaatagcctcaggaggc

SEQ ID NO: 522475 - DNA, 20 bp, Artificial Sequence
  chemically synthesized
gtttaccacagttccagata

SEQ ID NO: 522476 - DNA, 20 bp, Artificial Sequence
  chemically synthesized
cctccaaagccttgggaaat

SEQ ID NO: 522477 - DNA, 20 bp, Artificial Sequence
  chemically synthesized
acaccataatgttgttgaag

SEQ ID NO: 522478 - DNA, 20 bp, Artificial Sequence
  chemically synthesized
tgagaggttaggctcctgct

SEQ ID NO: 522479 - DNA, 20 bp, Artificial Sequence
  chemically synthesized
atcagggaacaacgtagact

SEQ ID NO: 522480 - DNA, 20 bp, Artificial Sequence
  chemically synthesized
tgcaataacctggtgacata

SEQ ID NO: 522481 - DNA, 20 bp, Artificial Sequence
  chemically synthesized
agtccattaaatcttgtctc

SEQ ID NO: 522482 - DNA, 20 bp, Artificial Sequence
  chemically synthesized
tttaaaaaattgtgattatt

SEQ ID NO: 522483 - DNA, 20 bp, Artificial Sequence
  chemically synthesized
atcttgaaaatcatgtttcc

SEQ ID NO: 522484 - DNA, 20 bp, Artificial Sequence
  chemically synthesized
ttttctttttgtaataggag

SEQ ID NO: 522485 - DNA, 20 bp, Artificial Sequence
  chemically synthesized
ttgcactgtaaggtacttta

SEQ ID NO: 522486 - DNA, 20 bp, Artificial Sequence
  chemically synthesized
ggttaccgagctttctcaat

SEQ ID NO: 522487 - DNA, 20 bp, Artificial Sequence
  chemically synthesized
gagctttctcaataagagta

SEQ ID NO: 522488 - DNA, 20 bp, Artificial Sequence
  chemically synthesized
tactgcagaacaattatggc

SEQ ID NO: 522489 - DNA, 20 bp, Artificial Sequence
  chemically synthesized
agccaaaatcatagcacggt

SEQ ID NO: 522490 - DNA, 20 bp, Artificial Sequence
  chemically synthesized
ctgccagctgaagagctgca

SEQ ID NO: 522491 - DNA, 20 bp, Artificial Sequence
  chemically synthesized
ccaaaaataaatgggtcatg

SEQ ID NO: 522492 - DNA, 20 bp, Artificial Sequence
  chemically synthesized
tcttcatgacccatttattt

SEQ ID NO: 522493 - DNA, 20 bp, Artificial Sequence
  chemically synthesized
agaacagtatccaaaaataa

SEQ ID NO: 522494 - DNA, 20 bp, Artificial Sequence
  chemically synthesized
ttgattgcatatctttccca

SEQ ID NO: 522495 - DNA, 20 bp, Artificial Sequence
  chemically synthesized
aaatacccctatgatattga

SEQ ID NO: 522496 - DNA, 20 bp, Artificial Sequence
  chemically synthesized
aaacactcactcaatatcat

SEQ ID NO: 522497 - DNA, 20 bp, Artificial Sequence
  chemically synthesized
aagcaaatacccctatgata

SEQ ID NO: 522498 - DNA, 20 bp, Artificial Sequence
  chemically synthesized
atttgctttcaaaagtcaaa

SEQ ID NO: 522499 - DNA, 20 bp, Artificial Sequence
  chemically synthesized
ctgatgaccaaaaatcattt

SEQ ID NO: 522500 - DNA, 20 bp, Artificial Sequence
  chemically synthesized
tgcacagacatcttacaaca

SEQ ID NO: 522501 - DNA, 20 bp, Artificial Sequence
  chemically synthesized
gctctgtttgatgaaggagg

SEQ ID NO: 522502 - DNA, 20 bp, Artificial Sequence
  chemically synthesized
aaagcttaaagctaacggag

SEQ ID NO: 522503 - DNA, 20 bp, Artificial Sequence
  chemically synthesized
tttaagcttttctcaatgaa

SEQ ID NO: 522504 - DNA, 20 bp, Artificial Sequence
  chemically synthesized
tttctcaatgaactgagtaa

SEQ ID NO: 522505 - DNA, 20 bp, Artificial Sequence
  chemically synthesized
gaaggtttttgcttctactg

SEQ ID NO: 522506 - DNA, 20 bp, Artificial Sequence
  chemically synthesized
ccttccccactgataagcaa

SEQ ID NO: 522507 - DNA, 20 bp, Artificial Sequence
  chemically synthesized
atatataccgcctatagttg

SEQ ID NO: 522508 - DNA, 20 bp, Artificial Sequence
  chemically synthesized
tatatctaactcagtcagcc

SEQ ID NO: 522509 - DNA, 20 bp, Artificial Sequence
  chemically synthesized
cacgtttaactcaaggctga

SEQ ID NO: 522510 - DNA, 20 bp, Artificial Sequence
  chemically synthesized
cagtcagccttgagttaaac

SEQ ID NO: 522511 - DNA, 20 bp, Artificial Sequence
  chemically synthesized
aagcctttgttgttgccttc

SEQ ID NO: 522512 - DNA, 20 bp, Artificial Sequence
  chemically synthesized
tgaaggcaacaacaaaggct

SEQ ID NO: 522513 - DNA, 20 bp, Artificial Sequence
  chemically synthesized
ctgcagaagatccagtctca

SEQ ID NO: 522514 - DNA, 20 bp, Artificial Sequence
  chemically synthesized
aagcagatcattctctgaga

SEQ ID NO: 522515 - DNA, 20 bp, Artificial Sequence
  chemically synthesized
acttggccctgagattatct

SEQ ID NO: 522516 - DNA, 20 bp, Artificial Sequence
  chemically synthesized
actgtggtcactgtgaggtg

SEQ ID NO: 522517 - DNA, 20 bp, Artificial Sequence
  chemically synthesized
ataggtttcaaaattgctaa

SEQ ID NO: 522518 - DNA, 20 bp, Artificial Sequence
  chemically synthesized
atctatgtgtatgttgtaga

SEQ ID NO: 522519 - DNA, 20 bp, Artificial Sequence
  chemically synthesized
ataatagttgtacatattta

SEQ ID NO: 522520 - DNA, 20 bp, Artificial Sequence
  chemically synthesized
tgggactgtaaaccaacaga

SEQ ID NO: 522521 - DNA, 20 bp, Artificial Sequence
  chemically synthesized
caaaggctgattttaagtgg

SEQ ID NO: 522522 - DNA, 20 bp, Artificial Sequence
  chemically synthesized
tcatataggagacgtaatat

SEQ ID NO: 522523 - DNA, 20 bp, Artificial Sequence
  chemically synthesized
agacatatggggatttagaa

SEQ ID NO: 522524 - DNA, 20 bp, Artificial Sequence
  chemically synthesized
tggcagcattatagacatat

SEQ ID NO: 522525 - DNA, 20 bp, Artificial Sequence
  chemically synthesized
ttatcaagagttggggttat

SEQ ID NO: 522526 - DNA, 20 bp, Artificial Sequence
  chemically synthesized
gaaactatcttatcaagagt

SEQ ID NO: 522527 - DNA, 20 bp, Artificial Sequence
  chemically synthesized
tggatggaaactatcttatc

SEQ ID NO: 522528 - DNA, 20 bp, Artificial Sequence
  chemically synthesized
cagatgatgaagtttggaca

SEQ ID NO: 522529 - DNA, 20 bp, Artificial Sequence
  chemically synthesized
ctaatggagagagaaacctg

SEQ ID NO: 522530 - DNA, 20 bp, Artificial Sequence
  chemically synthesized
taacacgtgttggacgttag

SEQ ID NO: 522531 - DNA, 20 bp, Artificial Sequence
  chemically synthesized
attgttttcatttctatttc

SEQ ID NO: 522532 - DNA, 20 bp, Artificial Sequence
  chemically synthesized
aatatattaataggatgtac

SEQ ID NO: 522533 - DNA, 20 bp, Artificial Sequence
  chemically synthesized
tctgcatataaatatattaa

SEQ ID NO: 522534 - DNA, 20 bp, Artificial Sequence
  chemically synthesized
ataaaaaaatcacattctta

SEQ ID NO: 522535 - DNA, 20 bp, Artificial Sequence
  chemically synthesized
aacgtagttaaatattccat

SEQ ID NO: 522536 - DNA, 20 bp, Artificial Sequence
  chemically synthesized
aaaaccatatgatatattaa

SEQ ID NO: 522537 - DNA, 20 bp, Artificial Sequence
  chemically synthesized
agcctaggtttttaaccact

SEQ ID NO: 522538 - DNA, 20 bp, Artificial Sequence
  chemically synthesized
aaaaacctaggctctggagc

SEQ ID NO: 522539 - DNA, 20 bp, Artificial Sequence
  chemically synthesized
tggagcctgaatgcctggtt

SEQ ID NO: 522540 - DNA, 20 bp, Artificial Sequence
  chemically synthesized
atgccattataaaatggagc

SEQ ID NO: 522541 - DNA, 20 bp, Artificial Sequence
  chemically synthesized
acaagatgcattaacttgtt

SEQ ID NO: 522542 - DNA, 20 bp, Artificial Sequence
  chemically synthesized
aaaattattttcaggcataa

SEQ ID NO: 522543 - DNA, 20 bp, Artificial Sequence
  chemically synthesized
acatataaggtaattgaaac

SEQ ID NO: 522544 - DNA, 20 bp, Artificial Sequence
  chemically synthesized
atcattatatagttctcaat

SEQ ID NO: 522545 - DNA, 20 bp, Artificial Sequence
  chemically synthesized
acaggtaacactggttattc

SEQ ID NO: 522546 - DNA, 20 bp, Artificial Sequence
  chemically synthesized
tgcctataattttgctattc

SEQ ID NO: 522547 - DNA, 20 bp, Artificial Sequence
  chemically synthesized
tatacactcactgccaaaag

SEQ ID NO: 522548 - DNA, 20 bp, Artificial Sequence
  chemically synthesized
tctgtattctacttttggca

SEQ ID NO: 522549 - DNA, 20 bp, Artificial Sequence
  chemically synthesized
ttgtattataaaaaatcagg

SEQ ID NO: 522550 - DNA, 20 bp, Artificial Sequence
  chemically synthesized
gccttggccttccaaagtgc

SEQ ID NO: 522551 - DNA, 20 bp, Artificial Sequence
  chemically synthesized
ctttggaaggccaaggccag

SEQ ID NO: 522552 - DNA, 20 bp, Artificial Sequence
  chemically synthesized
ttaagccaatgcacttcagc

SEQ ID NO: 522553 - DNA, 20 bp, Artificial Sequence
  chemically synthesized
atgcacttcagcctgggtgg

SEQ ID NO: 522554 - DNA, 20 bp, Artificial Sequence
  chemically synthesized
ttttttttttttttttgaga

SEQ ID NO: 522555 - DNA, 20 bp, Artificial Sequence
  chemically synthesized
aatattttgcatattttaag

SEQ ID NO: 522556 - DNA, 20 bp, Artificial Sequence
  chemically synthesized
cattgttaatggaacaatgc

SEQ ID NO: 522557 - DNA, 20 bp, Artificial Sequence
  chemically synthesized
atcgaagaagtattgtcatc

SEQ ID NO: 522558 - DNA, 20 bp, Artificial Sequence
  chemically synthesized
tgctgtatttcattagtgct

SEQ ID NO: 522559 - DNA, 20 bp, Artificial Sequence
  chemically synthesized
tatttcattagtgctatggg

SEQ ID NO: 522560 - DNA, 20 bp, Artificial Sequence
  chemically synthesized
tggggattatgtttctacat

SEQ ID NO: 522561 - DNA, 20 bp, Artificial Sequence
  chemically synthesized
cctcttaatactgtggcatt

SEQ ID NO: 522562 - DNA, 20 bp, Artificial Sequence
  chemically synthesized
aatgccacagtattaagagg

SEQ ID NO: 522563 - DNA, 20 bp, Artificial Sequence
  chemically synthesized
gtcatataagcggagccctc

SEQ ID NO: 522564 - DNA, 20 bp, Artificial Sequence
  chemically synthesized
ataagcggagccctcatgaa

SEQ ID NO: 522565 - DNA, 20 bp, Artificial Sequence
  chemically synthesized
tgtttgcccttccagtatgt

SEQ ID NO: 522566 - DNA, 20 bp, Artificial Sequence
  chemically synthesized
tggcagatttggtgtctggt

SEQ ID NO: 522567 - DNA, 20 bp, Artificial Sequence
  chemically synthesized
aatctgccaacattttgatc

SEQ ID NO: 522568 - DNA, 20 bp, Artificial Sequence
  chemically synthesized
ccaattgaactaagacaatt

SEQ ID NO: 522569 - DNA, 20 bp, Artificial Sequence
  chemically synthesized
aattaggagtaagaagtacg

SEQ ID NO: 522570 - DNA, 20 bp, Artificial Sequence
  chemically synthesized
tagaaaagatatttctacag

SEQ ID NO: 522571 - DNA, 20 bp, Artificial Sequence
  chemically synthesized
tatgtatatagtttttaaac

SEQ ID NO: 522572 - DNA, 20 bp, Artificial Sequence
  chemically synthesized
atgaggttaaaaattataga

SEQ ID NO: 522573 - DNA, 20 bp, Artificial Sequence
  chemically synthesized
tttttaacctcatcatttat

SEQ ID NO: 522574 - DNA, 20 bp, Artificial Sequence
  chemically synthesized
ccaagactattacaataaaa

SEQ ID NO: 522575 - DNA, 20 bp, Artificial Sequence
  chemically synthesized
cacacttaggcaaggtgtgc

SEQ ID NO: 522576 - DNA, 20 bp, Artificial Sequence
  chemically synthesized
catgaggactattagtctaa

SEQ ID NO: 522577 - DNA, 20 bp, Artificial Sequence
  chemically synthesized
tctttttatagtggtggggg

SEQ ID NO: 522578 - DNA, 20 bp, Artificial Sequence
  chemically synthesized
gggggaggataacgggagaa

SEQ ID NO: 522579 - DNA, 20 bp, Artificial Sequence
  chemically synthesized
aattgatggttgcagtgctg

SEQ ID NO: 522580 - DNA, 20 bp, Artificial Sequence
  chemically synthesized
ggtgatttcacttggtcctc

SEQ ID NO: 522581 - DNA, 20 bp, Artificial Sequence
  chemically synthesized
aaaaataaaaaagaaatgct

SEQ ID NO: 522582 - DNA, 20 bp, Artificial Sequence
  chemically synthesized
tttatgagctccttcttttg

SEQ ID NO: 522583 - DNA, 20 bp, Artificial Sequence
  chemically synthesized
tgagctccttcttttgctga

SEQ ID NO: 522584 - DNA, 20 bp, Artificial Sequence
  chemically synthesized
tttcttttttgcctcaactg

SEQ ID NO: 522585 - DNA, 20 bp, Artificial Sequence
  chemically synthesized
aaaaagaaatgacccttttt

SEQ ID NO: 522586 - DNA, 20 bp, Artificial Sequence
  chemically synthesized
tctcttggttcattccaaaa

SEQ ID NO: 522587 - DNA, 20 bp, Artificial Sequence
  chemically synthesized
tatcacattcattaatatat

SEQ ID NO: 522588 - DNA, 20 bp, Artificial Sequence
  chemically synthesized
aatataattcctatatatta

SEQ ID NO: 522589 - DNA, 20 bp, Artificial Sequence
  chemically synthesized
tttgttaataaacttttaat

SEQ ID NO: 522590 - DNA, 20 bp, Artificial Sequence
  chemically synthesized
attaacaaaacatcaccaca

SEQ ID NO: 522591 - DNA, 20 bp, Artificial Sequence
  chemically synthesized
taataatagcacctacctca

SEQ ID NO: 522592 - DNA, 20 bp, Artificial Sequence
  chemically synthesized
tagtttcttcatctgaaaaa

SEQ ID NO: 522593 - DNA, 20 bp, Artificial Sequence
  chemically synthesized
tgaagaaactaaggaaaaaa

SEQ ID NO: 522594 - DNA, 20 bp, Artificial Sequence
  chemically synthesized
acaaaaaaagtgtataaaaa

SEQ ID NO: 522595 - DNA, 20 bp, Artificial Sequence
  chemically synthesized
acagtactgagagaaaatga

SEQ ID NO: 522596 - DNA, 20 bp, Artificial Sequence
  chemically synthesized
actgagagaaaatgaaagag

SEQ ID NO: 522597 - DNA, 20 bp, Artificial Sequence
  chemically synthesized
cagactcaaagccaaacttt

SEQ ID NO: 522598 - DNA, 20 bp, Artificial Sequence
  chemically synthesized
ccaacccagaaagtttggct

SEQ ID NO: 522599 - DNA, 20 bp, Artificial Sequence
  chemically synthesized
gacaatatagacagatgttt

SEQ ID NO: 522600 - DNA, 20 bp, Artificial Sequence
  chemically synthesized
tccatttatatatacattaa

SEQ ID NO: 522601 - DNA, 20 bp, Artificial Sequence
  chemically synthesized
gaatatttttttaatgtccc

SEQ ID NO: 522602 - DNA, 20 bp, Artificial Sequence
  chemically synthesized
ctgtctgatgtttcttcctg

SEQ ID NO: 522603 - DNA, 20 bp, Artificial Sequence
  chemically synthesized
ctttgctgccaatataatag

SEQ ID NO: 522604 - DNA, 20 bp, Artificial Sequence
  chemically synthesized
aatgctgttactgtgagaat

SEQ ID NO: 522605 - DNA, 20 bp, Artificial Sequence
  chemically synthesized
taggagaatgctgttactgt

SEQ ID NO: 522606 - DNA, 20 bp, Artificial Sequence
  chemically synthesized
gcactgagaattagggatag

SEQ ID NO: 522607 - DNA, 20 bp, Artificial Sequence
  chemically synthesized
agcctaaagcactgagaatt

SEQ ID NO: 522608 - DNA, 20 bp, Artificial Sequence
  chemically synthesized
gggaaatagcctaaagcact

SEQ ID NO: 522609 - DNA, 20 bp, Artificial Sequence
  chemically synthesized
aatttgccagcattaataat

SEQ ID NO: 522610 - DNA, 20 bp, Artificial Sequence
  chemically synthesized
caatggagatagagtgttta

SEQ ID NO: 522611 - DNA, 20 bp, Artificial Sequence
  chemically synthesized
aaaaatcagcacaatggaga

SEQ ID NO: 522612 - DNA, 20 bp, Artificial Sequence
  chemically synthesized
agtaaggaaaatcaagatag

SEQ ID NO: 522613 - DNA, 20 bp, Artificial Sequence
  chemically synthesized
tttttattttctttttgcct

SEQ ID NO: 522614 - DNA, 20 bp, Artificial Sequence
  chemically synthesized
gtttccttttcttttcatcc

SEQ ID NO: 522615 - DNA, 20 bp, Artificial Sequence
  chemically synthesized
gaaatgacaataatctattc

SEQ ID NO: 522616 - DNA, 20 bp, Artificial Sequence
  chemically synthesized
gtcatttcaaggcctccctt

SEQ ID NO: 522617 - DNA, 20 bp, Artificial Sequence
  chemically synthesized
aagtaccagtaaaaatgctg

SEQ ID NO: 522618 - DNA, 20 bp, Artificial Sequence
  chemically synthesized
ttttcttgctggcttctggc

SEQ ID NO: 522619 - DNA, 20 bp, Artificial Sequence
  chemically synthesized
aggtaaacgtggcagaaagc

SEQ ID NO: 522620 - DNA, 20 bp, Artificial Sequence
  chemically synthesized
taagctggagaaacacatta

SEQ ID NO: 522621 - DNA, 20 bp, Artificial Sequence
  chemically synthesized
aggaggctgctgctgatttc

SEQ ID NO: 522622 - DNA, 20 bp, Artificial Sequence
  chemically synthesized
ggagtgctgggattacagac

SEQ ID NO: 522623 - DNA, 20 bp, Artificial Sequence
  chemically synthesized
atctcggcctctcggagtgc

SEQ ID NO: 522624 - DNA, 20 bp, Artificial Sequence
  chemically synthesized
atccgcccatctcggcctct

SEQ ID NO: 522625 - DNA, 20 bp, Artificial Sequence
  chemically synthesized
actccgagaggccgagatgg

SEQ ID NO: 522626 - DNA, 20 bp, Artificial Sequence
  chemically synthesized
tgggcggatcacttaaggcc

SEQ ID NO: 522627 - DNA, 20 bp, Artificial Sequence
  chemically synthesized
ctggctcatttttgtagaaa

SEQ ID NO: 522628 - DNA, 20 bp, Artificial Sequence
  chemically synthesized
tactggggaagctgaggtgg

SEQ ID NO: 522629 - DNA, 20 bp, Artificial Sequence
  chemically synthesized
agctgaggtgggaggatcgc

SEQ ID NO: 522630 - DNA, 20 bp, Artificial Sequence
  chemically synthesized
tgggaggatcgccggaatac

SEQ ID NO: 522631 - DNA, 20 bp, Artificial Sequence
  chemically synthesized
tacaggagttccaggctgca

SEQ ID NO: 522632 - DNA, 20 bp, Artificial Sequence
  chemically synthesized
acaaatattcaaactatatc

SEQ ID NO: 522633 - DNA, 20 bp, Artificial Sequence
  chemically synthesized
agcgagacccctgatatagt

SEQ ID NO: 522634 - DNA, 20 bp, Artificial Sequence
  chemically synthesized
aaaacaaacaaacaaacatt

SEQ ID NO: 522635 - DNA, 20 bp, Artificial Sequence
  chemically synthesized
ttgtttgtttgtttttgaga

SEQ ID NO: 522636 - DNA, 20 bp, Artificial Sequence
  chemically synthesized
tgcactccagcctgggtgac

SEQ ID NO: 522637 - DNA, 20 bp, Artificial Sequence
  chemically synthesized
ttcactcttgtcacccaggc

SEQ ID NO: 522638 - DNA, 20 bp, Artificial Sequence
  chemically synthesized
tcgttccactgcactccagc

SEQ ID NO: 522639 - DNA, 20 bp, Artificial Sequence
  chemically synthesized
caggccccaccttcaacact

SEQ ID NO: 522640 - DNA, 20 bp, Artificial Sequence
  chemically synthesized
gtgggaggtgatcggagcat

SEQ ID NO: 522641 - DNA, 20 bp, Artificial Sequence
  chemically synthesized
gaggtgatcggagcatgcgg

SEQ ID NO: 522642 - DNA, 20 bp, Artificial Sequence
  chemically synthesized
agcatgcgggtggatttctc

SEQ ID NO: 522643 - DNA, 20 bp, Artificial Sequence
  chemically synthesized
ccatctgaagacagcaccaa

SEQ ID NO: 522644 - DNA, 20 bp, Artificial Sequence
  chemically synthesized
attggtgctgtcttcagatg

SEQ ID NO: 522645 - DNA, 20 bp, Artificial Sequence
  chemically synthesized
tttaagcaaccgtatctcat

SEQ ID NO: 522646 - DNA, 20 bp, Artificial Sequence
  chemically synthesized
cagggcaggaacatgagaga

SEQ ID NO: 522647 - DNA, 20 bp, Artificial Sequence
  chemically synthesized
atgaggtaatttttaaagaa

SEQ ID NO: 522648 - DNA, 20 bp, Artificial Sequence
  chemically synthesized
gtatttctttatggcagtgt

SEQ ID NO: 522649 - DNA, 20 bp, Artificial Sequence
  chemically synthesized
aggaagaagctgggagtcca

SEQ ID NO: 522650 - DNA, 20 bp, Artificial Sequence
  chemically synthesized
gatcggcaaaggaagaagct

SEQ ID NO: 522651 - DNA, 20 bp, Artificial Sequence
  chemically synthesized
atagcagaaatgtgatatat

SEQ ID NO: 522652 - DNA, 20 bp, Artificial Sequence
  chemically synthesized
catttctgctatcaatagtt

SEQ ID NO: 522653 - DNA, 20 bp, Artificial Sequence
  chemically synthesized
cagggagtgactgctgacta

SEQ ID NO: 522654 - DNA, 20 bp, Artificial Sequence
  chemically synthesized
ccaacacctaattaatgaca

SEQ ID NO: 522655 - DNA, 20 bp, Artificial Sequence
  chemically synthesized
ccctgtcattaattaggtgt

SEQ ID NO: 522656 - DNA, 20 bp, Artificial Sequence
  chemically synthesized
tgaaatgctgtttaatttct

SEQ ID NO: 522657 - DNA, 20 bp, Artificial Sequence
  chemically synthesized
taatttctatgaatttcaag

SEQ ID NO: 522658 - DNA, 20 bp, Artificial Sequence
  chemically synthesized
ggtaattttcttttaagatt

SEQ ID NO: 522659 - DNA, 20 bp, Artificial Sequence
  chemically synthesized
taaaaacaacctaaaatttt

SEQ ID NO: 522660 - DNA, 20 bp, Artificial Sequence
  chemically synthesized
tggaggttgacaagggaaaa

SEQ ID NO: 522661 - DNA, 20 bp, Artificial Sequence
  chemically synthesized
gaaaatattgctattttaaa

SEQ ID NO: 522662 - DNA, 20 bp, Artificial Sequence
  chemically synthesized
ctcagtatttaagcagacat

SEQ ID NO: 522663 - DNA, 20 bp, Artificial Sequence
  chemically synthesized
aactgagaatcagaaaatgg

SEQ ID NO: 522664 - DNA, 20 bp, Artificial Sequence
  chemically synthesized
attttatagatgagaaaact

SEQ ID NO: 522665 - DNA, 20 bp, Artificial Sequence
  chemically synthesized
ttttctcatctataaaatat

SEQ ID NO: 522666 - DNA, 20 bp, Artificial Sequence
  chemically synthesized
aagtaaatggataaaagtca

SEQ ID NO: 522667 - DNA, 20 bp, Artificial Sequence
  chemically synthesized
gagtagtgttgtgtaagtaa

SEQ ID NO: 522668 - DNA, 20 bp, Artificial Sequence
  chemically synthesized
tgcataaatgtatgtttctc

SEQ ID NO: 522669 - DNA, 20 bp, Artificial Sequence
  chemically synthesized
acatacatttatgcaattat

SEQ ID NO: 522670 - DNA, 20 bp, Artificial Sequence
  chemically synthesized
aaaatctattaaatgaagtc

SEQ ID NO: 522671 - DNA, 20 bp, Artificial Sequence
  chemically synthesized
ggtcaccccattagcatctg

SEQ ID NO: 522672 - DNA, 20 bp, Artificial Sequence
  chemically synthesized
agctatcctgcagatgctaa

SEQ ID NO: 522673 - DNA, 20 bp, Artificial Sequence
  chemically synthesized
tttaatttctgttggccttt

SEQ ID NO: 522674 - DNA, 20 bp, Artificial Sequence
  chemically synthesized
tatacagcatgtaacaatta

SEQ ID NO: 522675 - DNA, 20 bp, Artificial Sequence
  chemically synthesized
atttccaaaattaagagagg

SEQ ID NO: 522676 - DNA, 20 bp, Artificial Sequence
  chemically synthesized
agccaggctgtttgctgagt

SEQ ID NO: 522677 - DNA, 20 bp, Artificial Sequence
  chemically synthesized
ttctggagccaggctgtttg

SEQ ID NO: 522678 - DNA, 20 bp, Artificial Sequence
  chemically synthesized
aagaagcagttatcagacgc

SEQ ID NO: 522679 - DNA, 20 bp, Artificial Sequence
  chemically synthesized
cacaatagatgaacaagaaa

SEQ ID NO: 522680 - DNA, 20 bp, Artificial Sequence
  chemically synthesized
tgatttcttcaaaggcctgc

SEQ ID NO: 522681 - DNA, 20 bp, Artificial Sequence
  chemically synthesized
ttcaaaggcctgctggagtc

SEQ ID NO: 522682 - DNA, 20 bp, Artificial Sequence
  chemically synthesized
gagagtaccgctcaggagaa

SEQ ID NO: 522683 - DNA, 20 bp, Artificial Sequence
  chemically synthesized
acactgagagtaccgctcag

SEQ ID NO: 522684 - DNA, 20 bp, Artificial Sequence
  chemically synthesized
accagtagcgaggtcacact

SEQ ID NO: 522685 - DNA, 20 bp, Artificial Sequence
  chemically synthesized
gtcttgctatgtatggccaa

SEQ ID NO: 522686 - DNA, 20 bp, Artificial Sequence
  chemically synthesized
ttatagtacttttttgcatt

SEQ ID NO: 522687 - DNA, 20 bp, Artificial Sequence
  chemically synthesized
gcaaaaaagtactataaata

SEQ ID NO: 522688 - DNA, 20 bp, Artificial Sequence
  chemically synthesized
attcaaactctccaatcata

SEQ ID NO: 522689 - DNA, 20 bp, Artificial Sequence
  chemically synthesized
agtgatattcagtatgattg

SEQ ID NO: 522690 - DNA, 20 bp, Artificial Sequence
  chemically synthesized
attcagtatgattggagagt

SEQ ID NO: 522691 - DNA, 20 bp, Artificial Sequence
  chemically synthesized
gagactagctagaaactcag

SEQ ID NO: 522692 - DNA, 20 bp, Artificial Sequence
  chemically synthesized
tgcaatccatgaaaactctg

SEQ ID NO: 522693 - DNA, 20 bp, Artificial Sequence
  chemically synthesized
agaaactcagcagagttttc

SEQ ID NO: 522694 - DNA, 20 bp, Artificial Sequence
  chemically synthesized
agagagcaattaggtgtatg

SEQ ID NO: 522695 - DNA, 20 bp, Artificial Sequence
  chemically synthesized
acatacacctaattgctctc

SEQ ID NO: 522696 - DNA, 20 bp, Artificial Sequence
  chemically synthesized
ggtagtaaaacaaccaagca

SEQ ID NO: 522697 - DNA, 20 bp, Artificial Sequence
  chemically synthesized
aaactcactgaactgttttt

SEQ ID NO: 522698 - DNA, 20 bp, Artificial Sequence
  chemically synthesized
gaatccacaaaaacagttca

SEQ ID NO: 522699 - DNA, 20 bp, Artificial Sequence
  chemically synthesized
gtaaattaatttcctctgct

SEQ ID NO: 522700 - DNA, 20 bp, Artificial Sequence
  chemically synthesized
ttaagaattgtgttttcatg

SEQ ID NO: 522701 - DNA, 20 bp, Artificial Sequence
  chemically synthesized
gtcatagtgttgggatcatt

SEQ ID NO: 522702 - DNA, 20 bp, Artificial Sequence
  chemically synthesized
tttaggtactgtcatagtgt

SEQ ID NO: 522703 - DNA, 20 bp, Artificial Sequence
  chemically synthesized
gcttgacaaaagctatcttt

SEQ ID NO: 522704 - DNA, 20 bp, Artificial Sequence
  chemically synthesized
ttttattttattttttgaga

SEQ ID NO: 522705 - DNA, 20 bp, Artificial Sequence
  chemically synthesized
tgcactccagcctgggcaac

SEQ ID NO: 522706 - DNA, 20 bp, Artificial Sequence
  chemically synthesized
ttcactcttgttgcccaggc

SEQ ID NO: 522707 - DNA, 20 bp, Artificial Sequence
  chemically synthesized
gtctcagcctcccaagtagc

SEQ ID NO: 522708 - DNA, 20 bp, Artificial Sequence
  chemically synthesized
ttttgcgtttttagtagaga

SEQ ID NO: 522709 - DNA, 20 bp, Artificial Sequence
  chemically synthesized
cgggtggatcacctgaggtc

SEQ ID NO: 522710 - DNA, 20 bp, Artificial Sequence
  chemically synthesized
actttgggaggccaaggcgg

SEQ ID NO: 522711 - DNA, 20 bp, Artificial Sequence
  chemically synthesized
cagtactttgggaggccaag

SEQ ID NO: 522712 - DNA, 20 bp, Artificial Sequence
  chemically synthesized
gccttggcctcccaaagtac

SEQ ID NO: 522713 - DNA, 20 bp, Artificial Sequence
  chemically synthesized
ttgattattcaaagtaaaaa

SEQ ID NO: 522714 - DNA, 20 bp, Artificial Sequence
  chemically synthesized
ccaaccattcaatttttact

SEQ ID NO: 522715 - DNA, 20 bp, Artificial Sequence
  chemically synthesized
actggatgatgaatcactac

SEQ ID NO: 522716 - DNA, 20 bp, Artificial Sequence
  chemically synthesized
gtgctagattacactggatg

SEQ ID NO: 522717 - DNA, 20 bp, Artificial Sequence
  chemically synthesized
cattgctgtgctagattaca

SEQ ID NO: 522718 - DNA, 20 bp, Artificial Sequence
  chemically synthesized
aacataccaaaggaaaggtt

SEQ ID NO: 522719 - DNA, 20 bp, Artificial Sequence
  chemically synthesized
attgagggaaggaggtgccc

SEQ ID NO: 522720 - DNA, 20 bp, Artificial Sequence
  chemically synthesized
ctcaatcaaagatacatcat

SEQ ID NO: 522721 - DNA, 20 bp, Artificial Sequence
  chemically synthesized
tgaatagttcacagcctccc

SEQ ID NO: 522722 - DNA, 20 bp, Artificial Sequence
  chemically synthesized
cctttcaaagataaggttaa

SEQ ID NO: 522723 - DNA, 20 bp, Artificial Sequence
  chemically synthesized
aatgttatatccttagatgt

SEQ ID NO: 522724 - DNA, 20 bp, Artificial Sequence
  chemically synthesized
ttaaattaactcagacatct

SEQ ID NO: 522725 - DNA, 20 bp, Artificial Sequence
  chemically synthesized
tcttccctgcaacaatattt

SEQ ID NO: 522726 - DNA, 20 bp, Artificial Sequence
  chemically synthesized
tagaggtcccaagttgtctt

SEQ ID NO: 522727 - DNA, 20 bp, Artificial Sequence
  chemically synthesized
cccaagttgtcttaagaata

SEQ ID NO: 522728 - DNA, 20 bp, Artificial Sequence
  chemically synthesized
ttgttaaacatcaatagagg

SEQ ID NO: 522729 - DNA, 20 bp, Artificial Sequence
  chemically synthesized
tgcttttctatgttggttta

SEQ ID NO: 522730 - DNA, 20 bp, Artificial Sequence
  chemically synthesized
tacaaacttcactttggtac

SEQ ID NO: 522731 - DNA, 20 bp, Artificial Sequence
  chemically synthesized
tcattttatttataaggcaa

SEQ ID NO: 522732 - DNA, 20 bp, Artificial Sequence
  chemically synthesized
taaggtcatccttctagaaa

SEQ ID NO: 522733 - DNA, 20 bp, Artificial Sequence
  chemically synthesized
atttgtcactcattttctag

SEQ ID NO: 522734 - DNA, 20 bp, Artificial Sequence
  chemically synthesized
taatataatgctacagtcaa

SEQ ID NO: 522735 - DNA, 20 bp, Artificial Sequence
  chemically synthesized
atattatgttcctgtagtta

SEQ ID NO: 522736 - DNA, 20 bp, Artificial Sequence
  chemically synthesized
aatcattttattcccttatt

SEQ ID NO: 522737 - DNA, 20 bp, Artificial Sequence
  chemically synthesized
cagccctctaccctaaataa

SEQ ID NO: 522738 - DNA, 20 bp, Artificial Sequence
  chemically synthesized
aagaactgtgacagtaggtt

SEQ ID NO: 522739 - DNA, 20 bp, Artificial Sequence
  chemically synthesized
aaagaggctgtaaatagatc

SEQ ID NO: 522740 - DNA, 20 bp, Artificial Sequence
  chemically synthesized
acagcctctttgaaaattaa

SEQ ID NO: 522741 - DNA, 20 bp, Artificial Sequence
  chemically synthesized
gaaatgtgtacaaagttagg

SEQ ID NO: 522742 - DNA, 20 bp, Artificial Sequence
  chemically synthesized
acatttctctgcataatttg

SEQ ID NO: 522743 - DNA, 20 bp, Artificial Sequence
  chemically synthesized
aaaatctgatatccaaagac

SEQ ID NO: 522744 - DNA, 20 bp, Artificial Sequence
  chemically synthesized
tttactttagattccagtct

SEQ ID NO: 522745 - DNA, 20 bp, Artificial Sequence
  chemically synthesized
agcaatctgttttctgttaa

SEQ ID NO: 522746 - DNA, 20 bp, Artificial Sequence
  chemically synthesized
tgtgtgcaaaggtaacaaag

SEQ ID NO: 522747 - DNA, 20 bp, Artificial Sequence
  chemically synthesized
cttgatttttttctaatatt

SEQ ID NO: 522748 - DNA, 20 bp, Artificial Sequence
  chemically synthesized
gctttattggcagtaatgtg

SEQ ID NO: 522749 - DNA, 20 bp, Artificial Sequence
  chemically synthesized
ctaaaatttgcttaaattat

SEQ ID NO: 522750 - DNA, 20 bp, Artificial Sequence
  chemically synthesized
gatctcatggaggtagaaag

SEQ ID NO: 522751 - DNA, 20 bp, Artificial Sequence
  chemically synthesized
gattgttaccagaggctggg

SEQ ID NO: 522752 - DNA, 20 bp, Artificial Sequence
  chemically synthesized
gctgggaagggtagtgggga

SEQ ID NO: 522753 - DNA, 20 bp, Artificial Sequence
  chemically synthesized
gatgaagaggggcttgttta

SEQ ID NO: 522754 - DNA, 20 bp, Artificial Sequence
  chemically synthesized
taaaaatacagttagctagt

SEQ ID NO: 522755 - DNA, 20 bp, Artificial Sequence
  chemically synthesized
tctagtgttctgtaccacaa

SEQ ID NO: 522756 - DNA, 20 bp, Artificial Sequence
  chemically synthesized
gtttatttcaaattaactgg

SEQ ID NO: 522757 - DNA, 20 bp, Artificial Sequence
  chemically synthesized
attaactggaggagtagact

SEQ ID NO: 522758 - DNA, 20 bp, Artificial Sequence
  chemically synthesized
aatgataaatgtttgaggta

SEQ ID NO: 522759 - DNA, 20 bp, Artificial Sequence
  chemically synthesized
aataatcaaatcaggataat

SEQ ID NO: 522760 - DNA, 20 bp, Artificial Sequence
  chemically synthesized
acaatctgtaataatcaaat

SEQ ID NO: 522761 - DNA, 20 bp, Artificial Sequence
  chemically synthesized
tttaattattgtgggtacgt

SEQ ID NO: 522762 - DNA, 20 bp, Artificial Sequence
  chemically synthesized
ctttcttctttttaattatt

SEQ ID NO: 522763 - DNA, 20 bp, Artificial Sequence
  chemically synthesized
gaaaaacaaaacatatcaca

SEQ ID NO: 522764 - DNA, 20 bp, Artificial Sequence
  chemically synthesized
aggatgacgtagcttgattg

SEQ ID NO: 522765 - DNA, 20 bp, Artificial Sequence
  chemically synthesized
gtatgcaactaagatgattg

SEQ ID NO: 522766 - DNA, 20 bp, Artificial Sequence
  chemically synthesized
ttagtccatgaaaggaaaat

SEQ ID NO: 522767 - DNA, 20 bp, Artificial Sequence
  chemically synthesized
agagttttcacagagagcaa

SEQ ID NO: 522768 - DNA, 20 bp, Artificial Sequence
  chemically synthesized
agagaaatccaaagacaaga

SEQ ID NO: 522769 - DNA, 20 bp, Artificial Sequence
  chemically synthesized
agggtgattctatcttgtct

SEQ ID NO: 522770 - DNA, 20 bp, Artificial Sequence
  chemically synthesized
aaaggaaactttttagatgg

SEQ ID NO: 522771 - DNA, 20 bp, Artificial Sequence
  chemically synthesized
aatctatgatgaaggaaatg

SEQ ID NO: 522772 - DNA, 20 bp, Artificial Sequence
  chemically synthesized
tccttcatcatagattaaga

SEQ ID NO: 522773 - DNA, 20 bp, Artificial Sequence
  chemically synthesized
tcatcatagattaagaaaga

SEQ ID NO: 522774 - DNA, 20 bp, Artificial Sequence
  chemically synthesized
tgaacgtatttcaacttggt

SEQ ID NO: 522775 - DNA, 20 bp, Artificial Sequence
  chemically synthesized
ttttttgcataagacctgta

SEQ ID NO: 522776 - DNA, 20 bp, Artificial Sequence
  chemically synthesized
tatagaatagctatatattg

SEQ ID NO: 522777 - DNA, 20 bp, Artificial Sequence
  chemically synthesized
atattttttatataccaacc

SEQ ID NO: 522778 - DNA, 20 bp, Artificial Sequence
  chemically synthesized
ttgtgaagttacaaaaatac

SEQ ID NO: 522779 - DNA, 20 bp, Artificial Sequence
  chemically synthesized
tatatgaaataactaacatg

SEQ ID NO: 522780 - DNA, 20 bp, Artificial Sequence
  chemically synthesized
tattttgtgtttagaaatgc

SEQ ID NO: 522781 - DNA, 20 bp, Artificial Sequence
  chemically synthesized
gaatagccagtgctaagaca

SEQ ID NO: 522782 - DNA, 20 bp, Artificial Sequence
  chemically synthesized
ggaagaaccttccagaagga

SEQ ID NO: 522783 - DNA, 20 bp, Artificial Sequence
  chemically synthesized
attccagcttcagtagtaaa

SEQ ID NO: 522784 - DNA, 20 bp, Artificial Sequence
  chemically synthesized
attctctttactactgaagc

SEQ ID NO: 522785 - DNA, 20 bp, Artificial Sequence
  chemically synthesized
tgagttgagatagtgagtga

SEQ ID NO: 522786 - DNA, 20 bp, Artificial Sequence
  chemically synthesized
gaacaaactgagttgagata

SEQ ID NO: 522787 - DNA, 20 bp, Artificial Sequence
  chemically synthesized
agtgttgcattgagaacaaa

SEQ ID NO: 522788 - DNA, 20 bp, Artificial Sequence
  chemically synthesized
tatctattgttgagttgtaa

SEQ ID NO: 522789 - DNA, 20 bp, Artificial Sequence
  chemically synthesized
tggaagtgacttatctattg

SEQ ID NO: 522790 - DNA, 20 bp, Artificial Sequence
  chemically synthesized
tcacttccatcattgaagat

SEQ ID NO: 522791 - DNA, 20 bp, Artificial Sequence
  chemically synthesized
gatgagagaccggtatattt

SEQ ID NO: 522792 - DNA, 20 bp, Artificial Sequence
  chemically synthesized
attttaaaaaataaaatgag

SEQ ID NO: 522793 - DNA, 20 bp, Artificial Sequence
  chemically synthesized
aagagtgaattttgtggtgt

SEQ ID NO: 522794 - DNA, 20 bp, Artificial Sequence
  chemically synthesized
gaattgtgcactttaaaaga

SEQ ID NO: 522795 - DNA, 20 bp, Artificial Sequence
  chemically synthesized
cactgaattgtgcactttaa

SEQ ID NO: 522796 - DNA, 20 bp, Artificial Sequence
  chemically synthesized
tgtgaatatactatatatca

SEQ ID NO: 522797 - DNA, 20 bp, Artificial Sequence
  chemically synthesized
ggtgacagttgcataactat

SEQ ID NO: 522798 - DNA, 20 bp, Artificial Sequence
  chemically synthesized
atttatttatttttttgaga

SEQ ID NO: 522799 - DNA, 20 bp, Artificial Sequence
  chemically synthesized
gtctcgctctgtcgccaggc

SEQ ID NO: 522800 - DNA, 20 bp, Artificial Sequence
  chemically synthesized
ctcactgcaacctccacctc

SEQ ID NO: 522801 - DNA, 20 bp, Artificial Sequence
  chemically synthesized
tgctcgggagactgaggcag

SEQ ID NO: 522802 - DNA, 20 bp, Artificial Sequence
  chemically synthesized
atatatttaaaaaaaatgag

SEQ ID NO: 522803 - DNA, 20 bp, Artificial Sequence
  chemically synthesized
atatatattttcagtagaga

SEQ ID NO: 522804 - DNA, 20 bp, Artificial Sequence
  chemically synthesized
cgggatttcaccatattggc

SEQ ID NO: 522805 - DNA, 20 bp, Artificial Sequence
  chemically synthesized
actttgggaggccaaggcag

SEQ ID NO: 522806 - DNA, 20 bp, Artificial Sequence
  chemically synthesized
gccttggcctcccaaagtgc

SEQ ID NO: 522807 - DNA, 20 bp, Artificial Sequence
  chemically synthesized
agagtgattcctaatgagta

SEQ ID NO: 522808 - DNA, 20 bp, Artificial Sequence
  chemically synthesized
aaagaaaccccatactcatt

SEQ ID NO: 522809 - DNA, 20 bp, Artificial Sequence
  chemically synthesized
agaaaggagagtgattccta

SEQ ID NO: 522810 - DNA, 20 bp, Artificial Sequence
  chemically synthesized
gcctggggacgtggagaaag

SEQ ID NO: 522811 - DNA, 20 bp, Artificial Sequence
  chemically synthesized
tgagatttacataaagtttt

SEQ ID NO: 522812 - DNA, 20 bp, Artificial Sequence
  chemically synthesized
atacttcttgagagctaact

SEQ ID NO: 522813 - DNA, 20 bp, Artificial Sequence
  chemically synthesized
gaaatataaagcagctaacc

SEQ ID NO: 522814 - DNA, 20 bp, Artificial Sequence
  chemically synthesized
aaatggaaaaactgaggcac

SEQ ID NO: 522815 - DNA, 20 bp, Artificial Sequence
  chemically synthesized
ttttttaactgtgtagttct

SEQ ID NO: 522816 - DNA, 20 bp, Artificial Sequence
  chemically synthesized
cagttaaaaaatgtagaagt

SEQ ID NO: 522817 - DNA, 20 bp, Artificial Sequence
  chemically synthesized
gaagactgaaaagcccgact

SEQ ID NO: 522818 - DNA, 20 bp, Artificial Sequence
  chemically synthesized
ctgtgtttgccagctctcac

SEQ ID NO: 522819 - DNA, 20 bp, Artificial Sequence
  chemically synthesized
tgctcacagtcgcccctatg

SEQ ID NO: 522820 - DNA, 20 bp, Artificial Sequence
  chemically synthesized
gtcgcccctatgaggggtat

SEQ ID NO: 522821 - DNA, 20 bp, Artificial Sequence
  chemically synthesized
tgaggactaagcctattttt

SEQ ID NO: 522822 - DNA, 20 bp, Artificial Sequence
  chemically synthesized
ggcttagtcctcaataagta

SEQ ID NO: 522823 - DNA, 20 bp, Artificial Sequence
  chemically synthesized
gaatcaaggtgagggcactg

SEQ ID NO: 522824 - DNA, 20 bp, Artificial Sequence
  chemically synthesized
cttttttttttctttttgag

SEQ ID NO: 522825 - DNA, 20 bp, Artificial Sequence
  chemically synthesized
ttgagccactgcactgcagc

SEQ ID NO: 522826 - DNA, 20 bp, Artificial Sequence
  chemically synthesized
tactcgggaggctgaggcag

SEQ ID NO: 522827 - DNA, 20 bp, Artificial Sequence
  chemically synthesized
gattctcctgcctcagcctc

SEQ ID NO: 522828 - DNA, 20 bp, Artificial Sequence
  chemically synthesized
tttttattttttagtagaga

SEQ ID NO: 522829 - DNA, 20 bp, Artificial Sequence
  chemically synthesized
cggggtttcaccgtgtcagc

SEQ ID NO: 522830 - DNA, 20 bp, Artificial Sequence
  chemically synthesized
aggcgggtggatcacaaggt

SEQ ID NO: 522831 - DNA, 20 bp, Artificial Sequence
  chemically synthesized
actttgggaggctgaggcgg

SEQ ID NO: 522832 - DNA, 20 bp, Artificial Sequence
  chemically synthesized
cagcactttgggaggctgag

SEQ ID NO: 522833 - DNA, 20 bp, Artificial Sequence
  chemically synthesized
gcctcagcctcccaaagtgc

SEQ ID NO: 522834 - DNA, 20 bp, Artificial Sequence
  chemically synthesized
acaaaagaaaggagagcagg

SEQ ID NO: 522835 - DNA, 20 bp, Artificial Sequence
  chemically synthesized
ttcttttgtctgttatttcc

SEQ ID NO: 522836 - DNA, 20 bp, Artificial Sequence
  chemically synthesized
atacagaacttctaataaaa

SEQ ID NO: 522837 - DNA, 20 bp, Artificial Sequence
  chemically synthesized
gagttattttaaatgtatag

SEQ ID NO: 522838 - DNA, 20 bp, Artificial Sequence
  chemically synthesized
aaatgcatgcaatgaataca

SEQ ID NO: 522839 - DNA, 20 bp, Artificial Sequence
  chemically synthesized
agcagaataaaatgcatgca

SEQ ID NO: 522840 - DNA, 20 bp, Artificial Sequence
  chemically synthesized
gaactaattttgattgccag

SEQ ID NO: 522841 - DNA, 20 bp, Artificial Sequence
  chemically synthesized
attagttccagaagaaggtc

SEQ ID NO: 522842 - DNA, 20 bp, Artificial Sequence
  chemically synthesized
atatcagggctattgagcag

SEQ ID NO: 522843 - DNA, 20 bp, Artificial Sequence
  chemically synthesized
ctgatatttataattatgat

SEQ ID NO: 522844 - DNA, 20 bp, Artificial Sequence
  chemically synthesized
caaacatgcaattttctaag

SEQ ID NO: 522845 - DNA, 20 bp, Artificial Sequence
  chemically synthesized
aagtagaataacacacacca

SEQ ID NO: 522846 - DNA, 20 bp, Artificial Sequence
  chemically synthesized
taatgatatttgaaatgact

SEQ ID NO: 522847 - DNA, 20 bp, Artificial Sequence
  chemically synthesized
atgactgtgaattttggtct

SEQ ID NO: 522848 - DNA, 20 bp, Artificial Sequence
  chemically synthesized
ttacatgcctagaaggtgta

SEQ ID NO: 522849 - DNA, 20 bp, Artificial Sequence
  chemically synthesized
aggaatggcatactgtatga

SEQ ID NO: 522850 - DNA, 20 bp, Artificial Sequence
  chemically synthesized
cagtatgccattccttaaat

SEQ ID NO: 522851 - DNA, 20 bp, Artificial Sequence
  chemically synthesized
tcgagaccaattctcattta

SEQ ID NO: 522852 - DNA, 20 bp, Artificial Sequence
  chemically synthesized
tccttaaatgagaattggtc

SEQ ID NO: 522853 - DNA, 20 bp, Artificial Sequence
  chemically synthesized
aggatcattctaggtctgaa

SEQ ID NO: 522854 - DNA, 20 bp, Artificial Sequence
  chemically synthesized
cttaaaattctattcagacc

SEQ ID NO: 522855 - DNA, 20 bp, Artificial Sequence
  chemically synthesized
cttaaaggatcattctaggt

SEQ ID NO: 522856 - DNA, 20 bp, Artificial Sequence
  chemically synthesized
ataggagttaaatgatctta

SEQ ID NO: 522857 - DNA, 20 bp, Artificial Sequence
  chemically synthesized
aaattttgcaatttaattat

SEQ ID NO: 522858 - DNA, 20 bp, Artificial Sequence
  chemically synthesized
atacagctttgagttttagg

SEQ ID NO: 522859 - DNA, 20 bp, Artificial Sequence
  chemically synthesized
atgaactttaaaatacagct

SEQ ID NO: 522860 - DNA, 20 bp, Artificial Sequence
  chemically synthesized
ttgttttactgcatctgcca

SEQ ID NO: 522861 - DNA, 20 bp, Artificial Sequence
  chemically synthesized
gattcatctgaatatctata

SEQ ID NO: 522862 - DNA, 20 bp, Artificial Sequence
  chemically synthesized
aatcctttatagatattcag

SEQ ID NO: 522863 - DNA, 20 bp, Artificial Sequence
  chemically synthesized
tttctggtagagagattcat

SEQ ID NO: 522864 - DNA, 20 bp, Artificial Sequence
  chemically synthesized
ctaattatcatgcagccatt

SEQ ID NO: 522865 - DNA, 20 bp, Artificial Sequence
  chemically synthesized
aaatggctgcatgataatta

SEQ ID NO: 522866 - DNA, 20 bp, Artificial Sequence
  chemically synthesized
tgcatgataattagtgggtg

SEQ ID NO: 522867 - DNA, 20 bp, Artificial Sequence
  chemically synthesized
agattgaattgattgtctct

SEQ ID NO: 522868 - DNA, 20 bp, Artificial Sequence
  chemically synthesized
tggcagggaggtgtgtaaga

SEQ ID NO: 522869 - DNA, 20 bp, Artificial Sequence
  chemically synthesized
agaagacggttgatatttct

SEQ ID NO: 522870 - DNA, 20 bp, Artificial Sequence
  chemically synthesized
tcttagggttcaaacagaaa

SEQ ID NO: 522871 - DNA, 20 bp, Artificial Sequence
  chemically synthesized
aaaatatgggcagtcaagtg

SEQ ID NO: 522872 - DNA, 20 bp, Artificial Sequence
  chemically synthesized
aggtttttaaagccttaaag

SEQ ID NO: 522873 - DNA, 20 bp, Artificial Sequence
  chemically synthesized
gagttaaattaaataaaaga

SEQ ID NO: 522874 - DNA, 20 bp, Artificial Sequence
  chemically synthesized
ctaaaagttagagaacgaac

SEQ ID NO: 522875 - DNA, 20 bp, Artificial Sequence
  chemically synthesized
tgaatatggcataattataa

SEQ ID NO: 522876 - DNA, 20 bp, Artificial Sequence
  chemically synthesized
tataattatgccatattcag

SEQ ID NO: 522877 - DNA, 20 bp, Artificial Sequence
  chemically synthesized
tatataggaatggcatccat

SEQ ID NO: 522878 - DNA, 20 bp, Artificial Sequence
  chemically synthesized
atcatgaacatttaatatat

SEQ ID NO: 522879 - DNA, 20 bp, Artificial Sequence
  chemically synthesized
ggtcattggacaaaaacact

SEQ ID NO: 522880 - DNA, 20 bp, Artificial Sequence
  chemically synthesized
tagaaaaaatgtgaaaaata

SEQ ID NO: 522881 - DNA, 20 bp, Artificial Sequence
  chemically synthesized
aaaatgtgaaaaataatgaa

SEQ ID NO: 522882 - DNA, 20 bp, Artificial Sequence
  chemically synthesized
aataatgaatggaattatag

SEQ ID NO: 522883 - DNA, 20 bp, Artificial Sequence
  chemically synthesized
ttatagtagaatctatttta

SEQ ID NO: 522884 - DNA, 20 bp, Artificial Sequence
  chemically synthesized
tttaatggatctccatttaa

SEQ ID NO: 522885 - DNA, 20 bp, Artificial Sequence
  chemically synthesized
tccatagtaaatctaacaaa

SEQ ID NO: 522886 - DNA, 20 bp, Artificial Sequence
  chemically synthesized
ttccctttgttagatttact

SEQ ID NO: 522887 - DNA, 20 bp, Artificial Sequence
  chemically synthesized
gagataaatcgtatgctttg

SEQ ID NO: 522888 - DNA, 20 bp, Artificial Sequence
  chemically synthesized
ttggcggattaaagatagct

SEQ ID NO: 522889 - DNA, 20 bp, Artificial Sequence
  chemically synthesized
taaagtctttgtttcctccc

SEQ ID NO: 522890 - DNA, 20 bp, Artificial Sequence
  chemically synthesized
ctttgtttcctcccttgaat

SEQ ID NO: 522891 - DNA, 20 bp, Artificial Sequence
  chemically synthesized
gtttcctcccttgaatttgg

SEQ ID NO: 522892 - DNA, 20 bp, Artificial Sequence
  chemically synthesized
gggttctgtggctgctctaa

SEQ ID NO: 522893 - DNA, 20 bp, Artificial Sequence
  chemically synthesized
gctgctctaatagaatgcag

SEQ ID NO: 522894 - DNA, 20 bp, Artificial Sequence
  chemically synthesized
gcctttttggcaccagagac

SEQ ID NO: 522895 - DNA, 20 bp, Artificial Sequence
  chemically synthesized
gcaccagagactggggtttg

SEQ ID NO: 522896 - DNA, 20 bp, Artificial Sequence
  chemically synthesized
atgacaattttcccacagac

SEQ ID NO: 522897 - DNA, 20 bp, Artificial Sequence
  chemically synthesized
gggttagtgggggggaggtg

SEQ ID NO: 522898 - DNA, 20 bp, Artificial Sequence
  chemically synthesized
ttatgtaactcaccatatca

SEQ ID NO: 522899 - DNA, 20 bp, Artificial Sequence
  chemically synthesized
cccactgattctatgatatg

SEQ ID NO: 522900 - DNA, 20 bp, Artificial Sequence
  chemically synthesized
attgcctgatactcctcata

SEQ ID NO: 522901 - DNA, 20 bp, Artificial Sequence
  chemically synthesized
taggtcgcatactctttatg

SEQ ID NO: 522902 - DNA, 20 bp, Artificial Sequence
  chemically synthesized
ctcacatgtgcagttcacaa

SEQ ID NO: 522903 - DNA, 20 bp, Artificial Sequence
  chemically synthesized
tgtcagatcagcaatggctt

SEQ ID NO: 522904 - DNA, 20 bp, Artificial Sequence
  chemically synthesized
attgctgatctgacaggagg

SEQ ID NO: 522905 - DNA, 20 bp, Artificial Sequence
  chemically synthesized
gctcgcctcctgctgtgcag

SEQ ID NO: 522906 - DNA, 20 bp, Artificial Sequence
  chemically synthesized
gggttcctcacaggccacag

SEQ ID NO: 522907 - DNA, 20 bp, Artificial Sequence
  chemically synthesized
tgggtaccggtgtgtggccc

SEQ ID NO: 522908 - DNA, 20 bp, Artificial Sequence
  chemically synthesized
aacagcagctctttcactgc

SEQ ID NO: 522909 - DNA, 20 bp, Artificial Sequence
  chemically synthesized
agagctgctgttctagtttc

SEQ ID NO: 522910 - DNA, 20 bp, Artificial Sequence
  chemically synthesized
tgggagctcagggttctaga

SEQ ID NO: 522911 - DNA, 20 bp, Artificial Sequence
  chemically synthesized
cacatgggagctcagggttc

SEQ ID NO: 522912 - DNA, 20 bp, Artificial Sequence
  chemically synthesized
gaacttatcacatgggagct

SEQ ID NO: 522913 - DNA, 20 bp, Artificial Sequence
  chemically synthesized
atgtgataagttcaacaatc

SEQ ID NO: 522914 - DNA, 20 bp, Artificial Sequence
  chemically synthesized
cctcttcagcatggtagacc

SEQ ID NO: 522915 - DNA, 20 bp, Artificial Sequence
  chemically synthesized
aagaggccacatgtaggtac

SEQ ID NO: 522916 - DNA, 20 bp, Artificial Sequence
  chemically synthesized
ggtggagacgacagggagac

SEQ ID NO: 522917 - DNA, 20 bp, Artificial Sequence
  chemically synthesized
tccaccaaagcaacatacat

SEQ ID NO: 522918 - DNA, 20 bp, Artificial Sequence
  chemically synthesized
tacatatgagtacagctgtc

SEQ ID NO: 522919 - DNA, 20 bp, Artificial Sequence
  chemically synthesized
ctggcagatgagctggtcag

SEQ ID NO: 522920 - DNA, 20 bp, Artificial Sequence
  chemically synthesized
ctgaccagctcatctgccag

SEQ ID NO: 522921 - DNA, 20 bp, Artificial Sequence
  chemically synthesized
ctgccagctgagtatcattt

SEQ ID NO: 522922 - DNA, 20 bp, Artificial Sequence
  chemically synthesized
gggatcaagttgataccaca

SEQ ID NO: 522923 - DNA, 20 bp, Artificial Sequence
  chemically synthesized
taaatttgagcgtgggtcaa

SEQ ID NO: 522924 - DNA, 20 bp, Artificial Sequence
  chemically synthesized
tgtgggtcataaatttgagc

SEQ ID NO: 522925 - DNA, 20 bp, Artificial Sequence
  chemically synthesized
tttttatagctcatgatttt

SEQ ID NO: 522926 - DNA, 20 bp, Artificial Sequence
  chemically synthesized
tatgttccggttatctattg

SEQ ID NO: 522927 - DNA, 20 bp, Artificial Sequence
  chemically synthesized
atagataaccggaacatagc

SEQ ID NO: 522928 - DNA, 20 bp, Artificial Sequence
  chemically synthesized
tattagatcattacatgagc

SEQ ID NO: 522929 - DNA, 20 bp, Artificial Sequence
  chemically synthesized
ttatcagtaaaaattagctg

SEQ ID NO: 522930 - DNA, 20 bp, Artificial Sequence
  chemically synthesized
aataaacaggcctttgggag

SEQ ID NO: 522931 - DNA, 20 bp, Artificial Sequence
  chemically synthesized
ggatattagaaaagtattga

SEQ ID NO: 522932 - DNA, 20 bp, Artificial Sequence
  chemically synthesized
atttgcaaaacaatttaaga

SEQ ID NO: 522933 - DNA, 20 bp, Artificial Sequence
  chemically synthesized
gtaagagatcataaaatcaa

SEQ ID NO: 522934 - DNA, 20 bp, Artificial Sequence
  chemically synthesized
ttttttttttttttttgaga

SEQ ID NO: 522935 - DNA, 20 bp, Artificial Sequence
  chemically synthesized
ctgcactccagcctgggcaa

SEQ ID NO: 522936 - DNA, 20 bp, Artificial Sequence
  chemically synthesized
tctcactctgttgcccaggc

SEQ ID NO: 522937 - DNA, 20 bp, Artificial Sequence
  chemically synthesized
aacctctgccttcagtttca

SEQ ID NO: 522938 - DNA, 20 bp, Artificial Sequence
  chemically synthesized
tactcaggaggctgaggcag

SEQ ID NO: 522939 - DNA, 20 bp, Artificial Sequence
  chemically synthesized
gattctcctgcctcagcctc

SEQ ID NO: 522940 - DNA, 20 bp, Artificial Sequence
  chemically synthesized
gcctcagcctcctgagtagc

SEQ ID NO: 522941 - DNA, 20 bp, Artificial Sequence
  chemically synthesized
gctaatctttgtatgtttag

SEQ ID NO: 522942 - DNA, 20 bp, Artificial Sequence
  chemically synthesized
ctttgtatgtttagtagagt

SEQ ID NO: 522943 - DNA, 20 bp, Artificial Sequence
  chemically synthesized
cgggcggatcacttgaggtc

SEQ ID NO: 522944 - DNA, 20 bp, Artificial Sequence
  chemically synthesized
tttttgggaggccgaggcgg

SEQ ID NO: 522945 - DNA, 20 bp, Artificial Sequence
  chemically synthesized
cctcggcctcccaaaaatgc

SEQ ID NO: 522946 - DNA, 20 bp, Artificial Sequence
  chemically synthesized
ctcaggtgagagtgtgttca

SEQ ID NO: 522947 - DNA, 20 bp, Artificial Sequence
  chemically synthesized
tggaaaaaaggctctcaggt

SEQ ID NO: 522948 - DNA, 20 bp, Artificial Sequence
  chemically synthesized
gattgttccaggttaaggga

SEQ ID NO: 522949 - DNA, 20 bp, Artificial Sequence
  chemically synthesized
agaagattgttccaggttaa

SEQ ID NO: 522950 - DNA, 20 bp, Artificial Sequence
  chemically synthesized
gcatgaaataatgtgttatg

SEQ ID NO: 522951 - DNA, 20 bp, Artificial Sequence
  chemically synthesized
gtagtagggcaagggaaatc

SEQ ID NO: 522952 - DNA, 20 bp, Artificial Sequence
  chemically synthesized
ttctctgttgtggtttgctt

SEQ ID NO: 522953 - DNA, 20 bp, Artificial Sequence
  chemically synthesized
cactgcccttgttgaaaacc

SEQ ID NO: 522954 - DNA, 20 bp, Artificial Sequence
  chemically synthesized
tgttatgctgccctctggca

SEQ ID NO: 522955 - DNA, 20 bp, Artificial Sequence
  chemically synthesized
aaagccctgttcatgtattt

SEQ ID NO: 522956 - DNA, 20 bp, Artificial Sequence
  chemically synthesized
ccctgttcatgtatttttga

SEQ ID NO: 522957 - DNA, 20 bp, Artificial Sequence
  chemically synthesized
gataaacaaagtccctctag

SEQ ID NO: 522958 - DNA, 20 bp, Artificial Sequence
  chemically synthesized
tgtttcagacaagaaaagct

SEQ ID NO: 522959 - DNA, 20 bp, Artificial Sequence
  chemically synthesized
aacaagttatatctaaatgc

SEQ ID NO: 522960 - DNA, 20 bp, Artificial Sequence
  chemically synthesized
gtttggtgacacaagtaaaa

SEQ ID NO: 522961 - DNA, 20 bp, Artificial Sequence
  chemically synthesized
ttttcactaatgtattaata

SEQ ID NO: 522962 - DNA, 20 bp, Artificial Sequence
  chemically synthesized
tcttcaatttaactaaagaa

SEQ ID NO: 522963 - DNA, 20 bp, Artificial Sequence
  chemically synthesized
attgaaaatatcaattaaat

SEQ ID NO: 522964 - DNA, 20 bp, Artificial Sequence
  chemically synthesized
atgagagatacataaatact

SEQ ID NO: 522965 - DNA, 20 bp, Artificial Sequence
  chemically synthesized
acttgtatgtgaagcctgtc

SEQ ID NO: 522966 - DNA, 20 bp, Artificial Sequence
  chemically synthesized
ctacaagtaagtggcagagc

SEQ ID NO: 522967 - DNA, 20 bp, Artificial Sequence
  chemically synthesized
aaattggagatcagaaaaaa

SEQ ID NO: 522968 - DNA, 20 bp, Artificial Sequence
  chemically synthesized
caatttcattgcctataaaa

SEQ ID NO: 522969 - DNA, 20 bp, Artificial Sequence
  chemically synthesized
taaagcagtttaaaaaactg

SEQ ID NO: 522970 - DNA, 20 bp, Artificial Sequence
  chemically synthesized
aattatttctgaagaaaaaa

SEQ ID NO: 522971 - DNA, 20 bp, Artificial Sequence
  chemically synthesized
ttaattatcacacactataa

SEQ ID NO: 522972 - DNA, 20 bp, Artificial Sequence
  chemically synthesized
gtgagagaaaacttttagct

SEQ ID NO: 522973 - DNA, 20 bp, Artificial Sequence
  chemically synthesized
gtatttctagaagatacaat

SEQ ID NO: 522974 - DNA, 20 bp, Artificial Sequence
  chemically synthesized
aattagcaaaaaaattaaaa

SEQ ID NO: 522975 - DNA, 20 bp, Artificial Sequence
  chemically synthesized
ttattattattattattaga

SEQ ID NO: 522976 - DNA, 20 bp, Artificial Sequence
  chemically synthesized
tagagtctccctctgtcgcc

SEQ ID NO: 522977 - DNA, 20 bp, Artificial Sequence
  chemically synthesized
tctccctctgtcgcccagga

SEQ ID NO: 522978 - DNA, 20 bp, Artificial Sequence
  chemically synthesized
tacctgggaggctgaggcag

SEQ ID NO: 522979 - DNA, 20 bp, Artificial Sequence
  chemically synthesized
gcctcagcctcccaggtagc

SEQ ID NO: 522980 - DNA, 20 bp, Artificial Sequence
  chemically synthesized
aaaattagccagtcttggtg

SEQ ID NO: 522981 - DNA, 20 bp, Artificial Sequence
  chemically synthesized
ttttgtatttttagtagaga

SEQ ID NO: 522982 - DNA, 20 bp, Artificial Sequence
  chemically synthesized
caggcagattacctcaggtg

SEQ ID NO: 522983 - DNA, 20 bp, Artificial Sequence
  chemically synthesized
gccttggcctcccaaaatgc

SEQ ID NO: 522984 - DNA, 20 bp, Artificial Sequence
  chemically synthesized
agcttgttgagagccacaca

SEQ ID NO: 522985 - DNA, 20 bp, Artificial Sequence
  chemically synthesized
ttgtgatttttttttttctt

SEQ ID NO: 522986 - DNA, 20 bp, Artificial Sequence
  chemically synthesized
cctctggagatttttacatg

SEQ ID NO: 522987 - DNA, 20 bp, Artificial Sequence
  chemically synthesized
aacttagccgcttgcctaca

SEQ ID NO: 522988 - DNA, 20 bp, Artificial Sequence
  chemically synthesized
cccttgtctgtgttacagca

SEQ ID NO: 522989 - DNA, 20 bp, Artificial Sequence
  chemically synthesized
cccattgctgtaacacagac

SEQ ID NO: 522990 - DNA, 20 bp, Artificial Sequence
  chemically synthesized
atgaagcagcttttctcgtt

SEQ ID NO: 522991 - DNA, 20 bp, Artificial Sequence
  chemically synthesized
gagaaaagctgcttcattcc

SEQ ID NO: 522992 - DNA, 20 bp, Artificial Sequence
  chemically synthesized
tataatagcaatatgattcc

SEQ ID NO: 522993 - DNA, 20 bp, Artificial Sequence
  chemically synthesized
aagaaagtgtaggttttctg

SEQ ID NO: 522994 - DNA, 20 bp, Artificial Sequence
  chemically synthesized
aatgtacaaaaaaaatacaa

SEQ ID NO: 522995 - DNA, 20 bp, Artificial Sequence
  chemically synthesized
aatacaatggaatatggttt

SEQ ID NO: 522996 - DNA, 20 bp, Artificial Sequence
  chemically synthesized
attgccttctgtcttctcaa

SEQ ID NO: 522997 - DNA, 20 bp, Artificial Sequence
  chemically synthesized
tgtagcccaaaagtttaagt

SEQ ID NO: 522998 - DNA, 20 bp, Artificial Sequence
  chemically synthesized
gcctcggcctcccaaagttc

SEQ ID NO: 522999 - DNA, 20 bp, Artificial Sequence
  chemically synthesized
actttgggaggccgaggcag

SEQ ID NO: 523000 - DNA, 20 bp, Artificial Sequence
  chemically synthesized
caggcggatcacctaaggtt

SEQ ID NO: 523001 - DNA, 20 bp, Artificial Sequence
  chemically synthesized
ctttgtatttttaatagaaa

SEQ ID NO: 523002 - DNA, 20 bp, Artificial Sequence
  chemically synthesized
gcctcagcctcccaagtagc

SEQ ID NO: 523003 - DNA, 20 bp, Artificial Sequence
  chemically synthesized
tacttgggaggctgaggcag

SEQ ID NO: 523004 - DNA, 20 bp, Artificial Sequence
  chemically synthesized
ctctccgcaacctccacctc

SEQ ID NO: 523005 - DNA, 20 bp, Artificial Sequence
  chemically synthesized
ttcactcttgttgcccaggc

SEQ ID NO: 523006 - DNA, 20 bp, Artificial Sequence
  chemically synthesized
tgcactccagcctgggcaac

SEQ ID NO: 523007 - DNA, 20 bp, Artificial Sequence
  chemically synthesized
tttgtttgtttgttttgaga

SEQ ID NO: 523008 - DNA, 20 bp, Artificial Sequence
  chemically synthesized
aatttaaaacgtatgaaaac

SEQ ID NO: 523009 - DNA, 20 bp, Artificial Sequence
  chemically synthesized
ttaaatcttaagtatgtttc

SEQ ID NO: 523010 - DNA, 20 bp, Artificial Sequence
  chemically synthesized
atgtgccccacagcttttaa

SEQ ID NO: 523011 - DNA, 20 bp, Artificial Sequence
  chemically synthesized
tttataacaaaggtaaagaa

SEQ ID NO: 523012 - DNA, 20 bp, Artificial Sequence
  chemically synthesized
acttgaaaattcaaatccac

SEQ ID NO: 523013 - DNA, 20 bp, Artificial Sequence
  chemically synthesized
ttttcaagatccctgtggat

SEQ ID NO: 523014 - DNA, 20 bp, Artificial Sequence
  chemically synthesized
gctatcttttcaagatccct

SEQ ID NO: 523015 - DNA, 20 bp, Artificial Sequence
  chemically synthesized
ttatttctaaagctatatcc

SEQ ID NO: 523016 - DNA, 20 bp, Artificial Sequence
  chemically synthesized
tgatatttttagcaagattc

SEQ ID NO: 523017 - DNA, 20 bp, Artificial Sequence
  chemically synthesized
gaatgtttgaaagaaataga

SEQ ID NO: 523018 - DNA, 20 bp, Artificial Sequence
  chemically synthesized
tgaaacctaattttgaaaaa

SEQ ID NO: 523019 - DNA, 20 bp, Artificial Sequence
  chemically synthesized
gcctcggcctcccaaagtgc

SEQ ID NO: 523020 - DNA, 20 bp, Artificial Sequence
  chemically synthesized
ttttgtatttttagtagaga

SEQ ID NO: 523021 - DNA, 20 bp, Artificial Sequence
  chemically synthesized
gcctcagcctcctaagtagc

SEQ ID NO: 523022 - DNA, 20 bp, Artificial Sequence
  chemically synthesized
tacttaggaggctgaggcag

SEQ ID NO: 523023 - DNA, 20 bp, Artificial Sequence
  chemically synthesized
gctcgttttgctgcccaggc

SEQ ID NO: 523024 - DNA, 20 bp, Artificial Sequence
  chemically synthesized
taggtgtatctcctcagtct

SEQ ID NO: 523025 - DNA, 20 bp, Artificial Sequence
  chemically synthesized
ttggtttataaataataatc

SEQ ID NO: 523026 - DNA, 20 bp, Artificial Sequence
  chemically synthesized
ggcagggagctagaaagatt

SEQ ID NO: 523027 - DNA, 20 bp, Artificial Sequence
  chemically synthesized
tctagctccctgccacaaag

SEQ ID NO: 523028 - DNA, 20 bp, Artificial Sequence
  chemically synthesized
atggatatttagatatacta

SEQ ID NO: 523029 - DNA, 20 bp, Artificial Sequence
  chemically synthesized
ttttaatctagaaataaaac

SEQ ID NO: 523030 - DNA, 20 bp, Artificial Sequence
  chemically synthesized
aagatttcaaggggaaaaat

SEQ ID NO: 523031 - DNA, 20 bp, Artificial Sequence
  chemically synthesized
ttctacataaactctattca

SEQ ID NO: 523032 - DNA, 20 bp, Artificial Sequence
  chemically synthesized
ttggcaaaagaccccatgaa

SEQ ID NO: 523033 - DNA, 20 bp, Artificial Sequence
  chemically synthesized
atgagttggcaaaagacccc

SEQ ID NO: 523034 - DNA, 20 bp, Artificial Sequence
  chemically synthesized
tattctgaaaggataatata

SEQ ID NO: 523035 - DNA, 20 bp, Artificial Sequence
  chemically synthesized
aactcattatattatccttt

SEQ ID NO: 523036 - DNA, 20 bp, Artificial Sequence
  chemically synthesized
tgcctttgaccatattctga

SEQ ID NO: 523037 - DNA, 20 bp, Artificial Sequence
  chemically synthesized
tatcctcttagaaatgacaa

SEQ ID NO: 523038 - DNA, 20 bp, Artificial Sequence
  chemically synthesized
aatccaattgtcatttctaa

SEQ ID NO: 523039 - DNA, 20 bp, Artificial Sequence
  chemically synthesized
tgtcatttctaagaggatat

SEQ ID NO: 523040 - DNA, 20 bp, Artificial Sequence
  chemically synthesized
atattggaattactcatgta

SEQ ID NO: 523041 - DNA, 20 bp, Artificial Sequence
  chemically synthesized
aataaccttttactctgtac

SEQ ID NO: 523042 - DNA, 20 bp, Artificial Sequence
  chemically synthesized
gtaattaaatcactaaaaat

SEQ ID NO: 523043 - DNA, 20 bp, Artificial Sequence
  chemically synthesized
aattagatgaagaaaatcac

SEQ ID NO: 523044 - DNA, 20 bp, Artificial Sequence
  chemically synthesized
ttagttttgtcttgtacttc

SEQ ID NO: 523045 - DNA, 20 bp, Artificial Sequence
  chemically synthesized
tataatcttacattctcccc

SEQ ID NO: 523046 - DNA, 20 bp, Artificial Sequence
  chemically synthesized
gagctgtgtgaatccatggg

SEQ ID NO: 523047 - DNA, 20 bp, Artificial Sequence
  chemically synthesized
acaaatcagggtagagctgt

SEQ ID NO: 523048 - DNA, 20 bp, Artificial Sequence
  chemically synthesized
tgttgttattagccacaaat

SEQ ID NO: 523049 - DNA, 20 bp, Artificial Sequence
  chemically synthesized
aggaatattactttcattaa

SEQ ID NO: 523050 - DNA, 20 bp, Artificial Sequence
  chemically synthesized
catttttcagagaagaagag

SEQ ID NO: 523051 - DNA, 20 bp, Artificial Sequence
  chemically synthesized
cctctcttcttctctgaaaa

SEQ ID NO: 523052 - DNA, 20 bp, Artificial Sequence
  chemically synthesized
ggggaaggaaaacaccaaag

SEQ ID NO: 523053 - DNA, 20 bp, Artificial Sequence
  chemically synthesized
ttgtgaagattattaatagt

SEQ ID NO: 523054 - DNA, 20 bp, Artificial Sequence
  chemically synthesized
tctttttttttttttttaga

SEQ ID NO: 523055 - DNA, 20 bp, Artificial Sequence
  chemically synthesized
tcttgctctgtcacccaggc

SEQ ID NO: 523056 - DNA, 20 bp, Artificial Sequence
  chemically synthesized
ttgagccactgcactccagc

SEQ ID NO: 523057 - DNA, 20 bp, Artificial Sequence
  chemically synthesized
ggccaaggcaggagaatcgc

SEQ ID NO: 523058 - DNA, 20 bp, Artificial Sequence
  chemically synthesized
tactcaggaggccaaggcag

SEQ ID NO: 523059 - DNA, 20 bp, Artificial Sequence
  chemically synthesized
gattctcctgccttggcctc

SEQ ID NO: 523060 - DNA, 20 bp, Artificial Sequence
  chemically synthesized
attaaaaatacaaaaattag

SEQ ID NO: 523061 - DNA, 20 bp, Artificial Sequence
  chemically synthesized
ttttgtatttttaatagaga

SEQ ID NO: 523062 - DNA, 20 bp, Artificial Sequence
  chemically synthesized
caggtggatcacctgaggtc

SEQ ID NO: 523063 - DNA, 20 bp, Artificial Sequence
  chemically synthesized
actttgggaggccaaagcag

SEQ ID NO: 523064 - DNA, 20 bp, Artificial Sequence
  chemically synthesized
gctttggcctcccaaagtgc

SEQ ID NO: 523065 - DNA, 20 bp, Artificial Sequence
  chemically synthesized
atctggatttgaaatgctgg

SEQ ID NO: 523066 - DNA, 20 bp, Artificial Sequence
  chemically synthesized
agagcctcctgtggtagcat

SEQ ID NO: 523067 - DNA, 20 bp, Artificial Sequence
  chemically synthesized
ccttggccttccaaaatgct

SEQ ID NO: 523068 - DNA, 20 bp, Artificial Sequence
  chemically synthesized
tgggaagatcacttgaggcc

SEQ ID NO: 523069 - DNA, 20 bp, Artificial Sequence
  chemically synthesized
ccaggcatgggctgaaacag

SEQ ID NO: 523070 - DNA, 20 bp, Artificial Sequence
  chemically synthesized
caggaggatcactttagccc

SEQ ID NO: 523071 - DNA, 20 bp, Artificial Sequence
  chemically synthesized
catttctaaaaaataaataa

SEQ ID NO: 523072 - DNA, 20 bp, Artificial Sequence
  chemically synthesized
tggttagtatatttatttac

SEQ ID NO: 523073 - DNA, 20 bp, Artificial Sequence
  chemically synthesized
taaatatactaaccagtggc

SEQ ID NO: 523074 - DNA, 20 bp, Artificial Sequence
  chemically synthesized
gaataattgactgcaaatgg

SEQ ID NO: 523075 - DNA, 20 bp, Artificial Sequence
  chemically synthesized
aacataaaggccttacccaa

SEQ ID NO: 523076 - DNA, 20 bp, Artificial Sequence
  chemically synthesized
tcattattattgttattcct

SEQ ID NO: 523077 - DNA, 20 bp, Artificial Sequence
  chemically synthesized
tctgtgattttgtgaacaca

SEQ ID NO: 523078 - DNA, 20 bp, Artificial Sequence
  chemically synthesized
ccattgtgttcacaaaatca

SEQ ID NO: 523079 - DNA, 20 bp, Artificial Sequence
  chemically synthesized
gagtattctcagagatgaaa

SEQ ID NO: 523080 - DNA, 20 bp, Artificial Sequence
  chemically synthesized
aataatcctttttcatctct

SEQ ID NO: 523081 - DNA, 20 bp, Artificial Sequence
  chemically synthesized
atactcagatggacaagttt

SEQ ID NO: 523082 - DNA, 20 bp, Artificial Sequence
  chemically synthesized
atactccaaaacttgtccat

SEQ ID NO: 523083 - DNA, 20 bp, Artificial Sequence
  chemically synthesized
aaatcttgctctttattaaa

SEQ ID NO: 523084 - DNA, 20 bp, Artificial Sequence
  chemically synthesized
agcttttctgaacattagtg

SEQ ID NO: 523085 - DNA, 20 bp, Artificial Sequence
  chemically synthesized
actaatgttcagaaaagctg

SEQ ID NO: 523086 - DNA, 20 bp, Artificial Sequence
  chemically synthesized
tacatcactaccgtcactac

SEQ ID NO: 523087 - DNA, 20 bp, Artificial Sequence
  chemically synthesized
ggctcaaatattttagggct

SEQ ID NO: 523088 - DNA, 20 bp, Artificial Sequence
  chemically synthesized
agactctattttacacatct

SEQ ID NO: 523089 - DNA, 20 bp, Artificial Sequence
  chemically synthesized
gaattcaaagatgtgtaaaa

SEQ ID NO: 523090 - DNA, 20 bp, Artificial Sequence
  chemically synthesized
tgcatatggtatgtgctagc

SEQ ID NO: 523091 - DNA, 20 bp, Artificial Sequence
  chemically synthesized
tgtgctagcgtggatgatgg

SEQ ID NO: 523092 - DNA, 20 bp, Artificial Sequence
  chemically synthesized
aaaacaaagtagaaggagga

SEQ ID NO: 523093 - DNA, 20 bp, Artificial Sequence
  chemically synthesized
caaagtagaaggaggaaaga

SEQ ID NO: 523094 - DNA, 20 bp, Artificial Sequence
  chemically synthesized
aatataatgtgctcttgctg

SEQ ID NO: 523095 - DNA, 20 bp, Artificial Sequence
  chemically synthesized
taggagtatgaaaatacaca

SEQ ID NO: 523096 - DNA, 20 bp, Artificial Sequence
  chemically synthesized
aaaataggtacacactaaat

SEQ ID NO: 523097 - DNA, 20 bp, Artificial Sequence
  chemically synthesized
tacgctattatctgacttcc

SEQ ID NO: 523098 - DNA, 20 bp, Artificial Sequence
  chemically synthesized
atatcagcaagggcatttga

SEQ ID NO: 523099 - DNA, 20 bp, Artificial Sequence
  chemically synthesized
ggtacccaaacgtttgaatt

SEQ ID NO: 523100 - DNA, 20 bp, Artificial Sequence
  chemically synthesized
ctgacccacaattcaaacgt

SEQ ID NO: 523101 - DNA, 20 bp, Artificial Sequence
  chemically synthesized
tcttgaaggtacccaaacgt

SEQ ID NO: 523102 - DNA, 20 bp, Artificial Sequence
  chemically synthesized
tttatcgtataatgcatgac

SEQ ID NO: 523103 - DNA, 20 bp, Artificial Sequence
  chemically synthesized
taaacatcttattatctata

SEQ ID NO: 523104 - DNA, 20 bp, Artificial Sequence
  chemically synthesized
gaaactaatacatcatggaa

SEQ ID NO: 523105 - DNA, 20 bp, Artificial Sequence
  chemically synthesized
ctgttaaaaagtactacaaa

SEQ ID NO: 523106 - DNA, 20 bp, Artificial Sequence
  chemically synthesized
aaaaagtactacaaactggg

SEQ ID NO: 523107 - DNA, 20 bp, Artificial Sequence
  chemically synthesized
ttagcagggccatgctctca

SEQ ID NO: 523108 - DNA, 20 bp, Artificial Sequence
  chemically synthesized
tctcactgaatactctagga

SEQ ID NO: 523109 - DNA, 20 bp, Artificial Sequence
  chemically synthesized
gcacggaacagactctctcc

SEQ ID NO: 523110 - DNA, 20 bp, Artificial Sequence
  chemically synthesized
tctataagccaaagaatggc

SEQ ID NO: 523111 - DNA, 20 bp, Artificial Sequence
  chemically synthesized
agtgacgtgtctataagcca

SEQ ID NO: 523112 - DNA, 20 bp, Artificial Sequence
  chemically synthesized
tggcttatagacacgtcact

SEQ ID NO: 523113 - DNA, 20 bp, Artificial Sequence
  chemically synthesized
cccatatgacagaggctatc

SEQ ID NO: 523114 - DNA, 20 bp, Artificial Sequence
  chemically synthesized
tcgggatagcctctgtcata

SEQ ID NO: 523115 - DNA, 20 bp, Artificial Sequence
  chemically synthesized
atacagagaagacacacagg

SEQ ID NO: 523116 - DNA, 20 bp, Artificial Sequence
  chemically synthesized
aagatgatgtcatattggag

SEQ ID NO: 523117 - DNA, 20 bp, Artificial Sequence
  chemically synthesized
tagttaagatgatgtcatat

SEQ ID NO: 523118 - DNA, 20 bp, Artificial Sequence
  chemically synthesized
atgtggtttttgtttgcaaa

SEQ ID NO: 523119 - DNA, 20 bp, Artificial Sequence
  chemically synthesized
tttgaagttccagaaaagac

SEQ ID NO: 523120 - DNA, 20 bp, Artificial Sequence
  chemically synthesized
ccagaaaagacatgaatttt

SEQ ID NO: 523121 - DNA, 20 bp, Artificial Sequence
  chemically synthesized
ggattgtgttatcacgtgca

SEQ ID NO: 523122 - DNA, 20 bp, Artificial Sequence
  chemically synthesized
ttgacagcagtcagttcatt

SEQ ID NO: 523123 - DNA, 20 bp, Artificial Sequence
  chemically synthesized
tggatgtagtagttgagtag

SEQ ID NO: 523124 - DNA, 20 bp, Artificial Sequence
  chemically synthesized
tgctaagttggatgtagtag

SEQ ID NO: 523125 - DNA, 20 bp, Artificial Sequence
  chemically synthesized
atatttgtttgtctgctaag

SEQ ID NO: 523126 - DNA, 20 bp, Artificial Sequence
  chemically synthesized
cagacaaacaaatatatgta

SEQ ID NO: 523127 - DNA, 20 bp, Artificial Sequence
  chemically synthesized
acctcagcctcccaaagtgc

SEQ ID NO: 523128 - DNA, 20 bp, Artificial Sequence
  chemically synthesized
cagcactttgggaggctgag

SEQ ID NO: 523129 - DNA, 20 bp, Artificial Sequence
  chemically synthesized
actttgggaggctgaggtgg

SEQ ID NO: 523130 - DNA, 20 bp, Artificial Sequence
  chemically synthesized
gtgggtggatcacctgaggt

SEQ ID NO: 523131 - DNA, 20 bp, Artificial Sequence
  chemically synthesized
tcagggttggagaccacagc

SEQ ID NO: 523132 - DNA, 20 bp, Artificial Sequence
  chemically synthesized
ttttgtatttttagtagaga

SEQ ID NO: 523133 - DNA, 20 bp, Artificial Sequence
  chemically synthesized
tccagggtagctgggattac

SEQ ID NO: 523134 - DNA, 20 bp, Artificial Sequence
  chemically synthesized
gcctcagcctccagggtagc

SEQ ID NO: 523135 - DNA, 20 bp, Artificial Sequence
  chemically synthesized
gattctcccgcctcagcctc

SEQ ID NO: 523136 - DNA, 20 bp, Artificial Sequence
  chemically synthesized
taccctggaggctgaggcgg

SEQ ID NO: 523137 - DNA, 20 bp, Artificial Sequence
  chemically synthesized
ctcactgcaacctccacctc

SEQ ID NO: 523138 - DNA, 20 bp, Artificial Sequence
  chemically synthesized
ttcactcttgtctcccaggc

SEQ ID NO: 523139 - DNA, 20 bp, Artificial Sequence
  chemically synthesized
tgcactccagcctgggagac

SEQ ID NO: 523140 - DNA, 20 bp, Artificial Sequence
  chemically synthesized
tttactttctttttttgaga

SEQ ID NO: 523141 - DNA, 20 bp, Artificial Sequence
  chemically synthesized
agtaaattagagagaagcta

SEQ ID NO: 523142 - DNA, 20 bp, Artificial Sequence
  chemically synthesized
aagctaaagagtaaatcagg

SEQ ID NO: 523143 - DNA, 20 bp, Artificial Sequence
  chemically synthesized
gtgttggtccttcataatac

SEQ ID NO: 523144 - DNA, 20 bp, Artificial Sequence
  chemically synthesized
ataatacttggatttacatg

SEQ ID NO: 523145 - DNA, 20 bp, Artificial Sequence
  chemically synthesized
atgccaacctgaagaacgtg

SEQ ID NO: 523146 - DNA, 20 bp, Artificial Sequence
  chemically synthesized
tgaagaacgtgagggattga

SEQ ID NO: 523147 - DNA, 20 bp, Artificial Sequence
  chemically synthesized
tagacaatgcaaggcagaga

SEQ ID NO: 523148 - DNA, 20 bp, Artificial Sequence
  chemically synthesized
cgaatagacaatgcaaggca

SEQ ID NO: 523149 - DNA, 20 bp, Artificial Sequence
  chemically synthesized
ctaggacaggcctgagggga

SEQ ID NO: 523150 - DNA, 20 bp, Artificial Sequence
  chemically synthesized
aggggaggtcaaggaacaga

SEQ ID NO: 523151 - DNA, 20 bp, Artificial Sequence
  chemically synthesized
tattctgagcatgcccagtg

SEQ ID NO: 523152 - DNA, 20 bp, Artificial Sequence
  chemically synthesized
gacccaccactgggcatgct

SEQ ID NO: 523153 - DNA, 20 bp, Artificial Sequence
  chemically synthesized
gaagaaatggaacagagtgt

SEQ ID NO: 523154 - DNA, 20 bp, Artificial Sequence
  chemically synthesized
actaacatgaagaaatggaa

SEQ ID NO: 523155 - DNA, 20 bp, Artificial Sequence
  chemically synthesized
ttaatgtaggcctcaagacc

SEQ ID NO: 523156 - DNA, 20 bp, Artificial Sequence
  chemically synthesized
ctagggctagggcaattaat

SEQ ID NO: 523157 - DNA, 20 bp, Artificial Sequence
  chemically synthesized
agtctagccagtcttcagaa

SEQ ID NO: 523158 - DNA, 20 bp, Artificial Sequence
  chemically synthesized
gtagatgaatgtgatttaaa

SEQ ID NO: 523159 - DNA, 20 bp, Artificial Sequence
  chemically synthesized
taaatgagagtcctgggtag

SEQ ID NO: 523160 - DNA, 20 bp, Artificial Sequence
  chemically synthesized
ttgattgataaatgagagtc

SEQ ID NO: 523161 - DNA, 20 bp, Artificial Sequence
  chemically synthesized
tgtcagtttgattgataaat

SEQ ID NO: 523162 - DNA, 20 bp, Artificial Sequence
  chemically synthesized
actgacattttaaatgtcag

SEQ ID NO: 523163 - DNA, 20 bp, Artificial Sequence
  chemically synthesized
gatgagttatggtatatcct

SEQ ID NO: 523164 - DNA, 20 bp, Artificial Sequence
  chemically synthesized
aatgttatcatgatcactca

SEQ ID NO: 523165 - DNA, 20 bp, Artificial Sequence
  chemically synthesized
agtttatctcctaaatatga

SEQ ID NO: 523166 - DNA, 20 bp, Artificial Sequence
  chemically synthesized
actcctatcttttaagcatg

SEQ ID NO: 523167 - DNA, 20 bp, Artificial Sequence
  chemically synthesized
attctgcatgcttaaaagat

SEQ ID NO: 523168 - DNA, 20 bp, Artificial Sequence
  chemically synthesized
tgtatgatagatacctagtt

SEQ ID NO: 523169 - DNA, 20 bp, Artificial Sequence
  chemically synthesized
agtgggaaaataacagtgat

SEQ ID NO: 523170 - DNA, 20 bp, Artificial Sequence
  chemically synthesized
aacattacaatgaaaaatat

SEQ ID NO: 523171 - DNA, 20 bp, Artificial Sequence
  chemically synthesized
ttttattatactttaaattc

SEQ ID NO: 523172 - DNA, 20 bp, Artificial Sequence
  chemically synthesized
catgttctgcacatgtatcc

SEQ ID NO: 523173 - DNA, 20 bp, Artificial Sequence
  chemically synthesized
ctaatgtagatgatgagttg

SEQ ID NO: 523174 - DNA, 20 bp, Artificial Sequence
  chemically synthesized
agaaatacctaatgtagatg

SEQ ID NO: 523175 - DNA, 20 bp, Artificial Sequence
  chemically synthesized
ggtgggtgaggggctatggg

SEQ ID NO: 523176 - DNA, 20 bp, Artificial Sequence
  chemically synthesized
tcacacactggggcctgttg

SEQ ID NO: 523177 - DNA, 20 bp, Artificial Sequence
  chemically synthesized
tcattgttcaactcccactt

SEQ ID NO: 523178 - DNA, 20 bp, Artificial Sequence
  chemically synthesized
gcatgttctcactcataagt

SEQ ID NO: 523179 - DNA, 20 bp, Artificial Sequence
  chemically synthesized
tgttcctgtgttagtctgat

SEQ ID NO: 523180 - DNA, 20 bp, Artificial Sequence
  chemically synthesized
ttcgtgtcctttgcaggaaa

SEQ ID NO: 523181 - DNA, 20 bp, Artificial Sequence
  chemically synthesized
aatgtggcacatatacacca

SEQ ID NO: 523182 - DNA, 20 bp, Artificial Sequence
  chemically synthesized
aaatgcccatcagtgataga

SEQ ID NO: 523183 - DNA, 20 bp, Artificial Sequence
  chemically synthesized
agtctatcactgatgggcat

SEQ ID NO: 523184 - DNA, 20 bp, Artificial Sequence
  chemically synthesized
ggttctaagtctttgctctt

SEQ ID NO: 523185 - DNA, 20 bp, Artificial Sequence
  chemically synthesized
gtgtacatgtgtctttatag

SEQ ID NO: 523186 - DNA, 20 bp, Artificial Sequence
  chemically synthesized
gtagaatgatttataatcct

SEQ ID NO: 523187 - DNA, 20 bp, Artificial Sequence
  chemically synthesized
cattactgggtgtatactca

SEQ ID NO: 523188 - DNA, 20 bp, Artificial Sequence
  chemically synthesized
tttgagtatacacccagtaa

SEQ ID NO: 523189 - DNA, 20 bp, Artificial Sequence
  chemically synthesized
ttgacccagcaatcccatta

SEQ ID NO: 523190 - DNA, 20 bp, Artificial Sequence
  chemically synthesized
tacacccagtaatgggattg

SEQ ID NO: 523191 - DNA, 20 bp, Artificial Sequence
  chemically synthesized
tttctggttctagatccttg

SEQ ID NO: 523192 - DNA, 20 bp, Artificial Sequence
  chemically synthesized
attgaggtatgcaattcctc

SEQ ID NO: 523193 - DNA, 20 bp, Artificial Sequence
  chemically synthesized
tatatactttagaggtaggc

SEQ ID NO: 523194 - DNA, 20 bp, Artificial Sequence
  chemically synthesized
aagtggaaccattgtaaatc

SEQ ID NO: 523195 - DNA, 20 bp, Artificial Sequence
  chemically synthesized
tacttgaagtgtggtttcta

SEQ ID NO: 523196 - DNA, 20 bp, Artificial Sequence
  chemically synthesized
gtgaaaaccagaatggttgt

SEQ ID NO: 523197 - DNA, 20 bp, Artificial Sequence
  chemically synthesized
actgtacttaaagtgaaaac

SEQ ID NO: 523198 - DNA, 20 bp, Artificial Sequence
  chemically synthesized
ttttcactttaagtacagta

SEQ ID NO: 523199 - DNA, 20 bp, Artificial Sequence
  chemically synthesized
ttctattttataataaagtg

SEQ ID NO: 523200 - DNA, 20 bp, Artificial Sequence
  chemically synthesized
ctcaacactttattataaaa

SEQ ID NO: 523201 - DNA, 20 bp, Artificial Sequence
  chemically synthesized
actttattataaaatagaat

SEQ ID NO: 523202 - DNA, 20 bp, Artificial Sequence
  chemically synthesized
tataatattttcaaattatg

SEQ ID NO: 523203 - DNA, 20 bp, Artificial Sequence
  chemically synthesized
tgatatccctcgacttacag

SEQ ID NO: 523204 - DNA, 20 bp, Artificial Sequence
  chemically synthesized
cataaccccactgtaagtcg

SEQ ID NO: 523205 - DNA, 20 bp, Artificial Sequence
  chemically synthesized
aatagaggcaaagtgtcctc

SEQ ID NO: 523206 - DNA, 20 bp, Artificial Sequence
  chemically synthesized
ctaggctgtggccctggtag

SEQ ID NO: 523207 - DNA, 20 bp, Artificial Sequence
  chemically synthesized
ctcagggcagacacaatccc

SEQ ID NO: 523208 - DNA, 20 bp, Artificial Sequence
  chemically synthesized
aggcatccaagacacactca

SEQ ID NO: 523209 - DNA, 20 bp, Artificial Sequence
  chemically synthesized
cacaatcccatgagtgtgtc

SEQ ID NO: 523210 - DNA, 20 bp, Artificial Sequence
  chemically synthesized
ttggatgcctttacaaaggg

SEQ ID NO: 523211 - DNA, 20 bp, Artificial Sequence
  chemically synthesized
tgttttaatggaatgtattt

SEQ ID NO: 523212 - DNA, 20 bp, Artificial Sequence
  chemically synthesized
aatttatgtatttgttttaa

SEQ ID NO: 523213 - DNA, 20 bp, Artificial Sequence
  chemically synthesized
tttagaatccttgctggctt

SEQ ID NO: 523214 - DNA, 20 bp, Artificial Sequence
  chemically synthesized
tctattattcaaaagccagc

SEQ ID NO: 523215 - DNA, 20 bp, Artificial Sequence
  chemically synthesized
ctaagatcactgaaggactt

SEQ ID NO: 523216 - DNA, 20 bp, Artificial Sequence
  chemically synthesized
ctcatttatcaagaggaaat

SEQ ID NO: 523217 - DNA, 20 bp, Artificial Sequence
  chemically synthesized
ggaaatgtgagtttctctca

SEQ ID NO: 523218 - DNA, 20 bp, Artificial Sequence
  chemically synthesized
tgagtttctctcaaagggtg

SEQ ID NO: 523219 - DNA, 20 bp, Artificial Sequence
  chemically synthesized
agaccaagattatcatctgg

SEQ ID NO: 523220 - DNA, 20 bp, Artificial Sequence
  chemically synthesized
ggcaagaccaagattatcat

SEQ ID NO: 523221 - DNA, 20 bp, Artificial Sequence
  chemically synthesized
caaaatttaaagacaaaact

SEQ ID NO: 523222 - DNA, 20 bp, Artificial Sequence
  chemically synthesized
tttaaattagaactctatca

SEQ ID NO: 523223 - DNA, 20 bp, Artificial Sequence
  chemically synthesized
ttggacatttaattcattga

SEQ ID NO: 523224 - DNA, 20 bp, Artificial Sequence
  chemically synthesized
gagaaattattagagtaata

SEQ ID NO: 523225 - DNA, 20 bp, Artificial Sequence
  chemically synthesized
aaaatttggggagaaattat

SEQ ID NO: 523226 - DNA, 20 bp, Artificial Sequence
  chemically synthesized
atgcaaagagttctggaata

SEQ ID NO: 523227 - DNA, 20 bp, Artificial Sequence
  chemically synthesized
tattacaatgcaaagagttc

SEQ ID NO: 523228 - DNA, 20 bp, Artificial Sequence
  chemically synthesized
caaaatgctattacaatgca

SEQ ID NO: 523229 - DNA, 20 bp, Artificial Sequence
  chemically synthesized
agactcaatttcctcatctg

SEQ ID NO: 523230 - DNA, 20 bp, Artificial Sequence
  chemically synthesized
caatcctacagatgaggaaa

SEQ ID NO: 523231 - DNA, 20 bp, Artificial Sequence
  chemically synthesized
catttattgagcactgttct

SEQ ID NO: 523232 - DNA, 20 bp, Artificial Sequence
  chemically synthesized
tcacaaatggcggctgctct

SEQ ID NO: 523233 - DNA, 20 bp, Artificial Sequence
  chemically synthesized
cccaaggtcaaatgctggta

SEQ ID NO: 523234 - DNA, 20 bp, Artificial Sequence
  chemically synthesized
aataaaaccattttttatgt

SEQ ID NO: 523235 - DNA, 20 bp, Artificial Sequence
  chemically synthesized
tactgaacataatatatata

SEQ ID NO: 523236 - DNA, 20 bp, Artificial Sequence
  chemically synthesized
tcagtattttaggaaccaga

SEQ ID NO: 523237 - DNA, 20 bp, Artificial Sequence
  chemically synthesized
agatttatcaataataaaat

SEQ ID NO: 523238 - DNA, 20 bp, Artificial Sequence
  chemically synthesized
caaccaaatttacgtgacta

SEQ ID NO: 523239 - DNA, 20 bp, Artificial Sequence
  chemically synthesized
gtgactaatgagtgacaacc

SEQ ID NO: 523240 - DNA, 20 bp, Artificial Sequence
  chemically synthesized
tctgaaacatgtattcttcc

SEQ ID NO: 523241 - DNA, 20 bp, Artificial Sequence
  chemically synthesized
agattaaaggttattctggg

SEQ ID NO: 523242 - DNA, 20 bp, Artificial Sequence
  chemically synthesized
ggttttgtgagatgggaagg

SEQ ID NO: 523243 - DNA, 20 bp, Artificial Sequence
  chemically synthesized
ttcgtggtagacatagagct

SEQ ID NO: 523244 - DNA, 20 bp, Artificial Sequence
  chemically synthesized
ttctgagctctatgtctacc

SEQ ID NO: 523245 - DNA, 20 bp, Artificial Sequence
  chemically synthesized
tgtctaccacgaataagccc

SEQ ID NO: 523246 - DNA, 20 bp, Artificial Sequence
  chemically synthesized
cgaataagcccaagagtaga

SEQ ID NO: 523247 - DNA, 20 bp, Artificial Sequence
  chemically synthesized
tgtgataaaaattattgaaa

SEQ ID NO: 523248 - DNA, 20 bp, Artificial Sequence
  chemically synthesized
attagtgtagggatagtttc

SEQ ID NO: 523249 - DNA, 20 bp, Artificial Sequence
  chemically synthesized
taacaacttcagattagtgt

SEQ ID NO: 523250 - DNA, 20 bp, Artificial Sequence
  chemically synthesized
ggacaattaattttggaaat

SEQ ID NO: 523251 - DNA, 20 bp, Artificial Sequence
  chemically synthesized
agctgtggcacagtaagcct

SEQ ID NO: 523252 - DNA, 20 bp, Artificial Sequence
  chemically synthesized
tccagatcatgttccataac

SEQ ID NO: 523253 - DNA, 20 bp, Artificial Sequence
  chemically synthesized
tggaacatgatctggacagt

SEQ ID NO: 523254 - DNA, 20 bp, Artificial Sequence
  chemically synthesized
catgatctggacagtgagag

SEQ ID NO: 523255 - DNA, 20 bp, Artificial Sequence
  chemically synthesized
ggatagagagggaagccact

SEQ ID NO: 523256 - DNA, 20 bp, Artificial Sequence
  chemically synthesized
gtgtgactaagacactgttt

SEQ ID NO: 523257 - DNA, 20 bp, Artificial Sequence
  chemically synthesized
aagacactgttttagaatct

SEQ ID NO: 523258 - DNA, 20 bp, Artificial Sequence
  chemically synthesized
ctgttttagaatctgaggat

SEQ ID NO: 523259 - DNA, 20 bp, Artificial Sequence
  chemically synthesized
ctgtaagttgtcaaatttca

SEQ ID NO: 523260 - DNA, 20 bp, Artificial Sequence
  chemically synthesized
caaagaatcttatattcctc

SEQ ID NO: 523261 - DNA, 20 bp, Artificial Sequence
  chemically synthesized
ttacctatctcttatccaag

SEQ ID NO: 523262 - DNA, 20 bp, Artificial Sequence
  chemically synthesized
aagtttccacagttatttta

SEQ ID NO: 523263 - DNA, 20 bp, Artificial Sequence
  chemically synthesized
aaagcctatactgcattgat

SEQ ID NO: 523264 - DNA, 20 bp, Artificial Sequence
  chemically synthesized
ttttaataagtgtacacttc

SEQ ID NO: 523265 - DNA, 20 bp, Artificial Sequence
  chemically synthesized
aattattttttcaactttca

SEQ ID NO: 523266 - DNA, 20 bp, Artificial Sequence
  chemically synthesized
atggagatgaagccctacac

SEQ ID NO: 523267 - DNA, 20 bp, Artificial Sequence
  chemically synthesized
gcacttagaaaaagataaaa

SEQ ID NO: 523268 - DNA, 20 bp, Artificial Sequence
  chemically synthesized
gtgtcaaaagcagatttaat

SEQ ID NO: 523269 - DNA, 20 bp, Artificial Sequence
  chemically synthesized
atgggaattgacaaaaaggg

SEQ ID NO: 523270 - DNA, 20 bp, Artificial Sequence
  chemically synthesized
ttgaaactgactcaaagatt

SEQ ID NO: 523271 - DNA, 20 bp, Artificial Sequence
  chemically synthesized
atccctcagactcaaaatct

SEQ ID NO: 523272 - DNA, 20 bp, Artificial Sequence
  chemically synthesized
actcaaagattttgagtctg

SEQ ID NO: 523273 - DNA, 20 bp, Artificial Sequence
  chemically synthesized
ttttgagtctgagggattgg

SEQ ID NO: 523274 - DNA, 20 bp, Artificial Sequence
  chemically synthesized
agtcaggggactgctgttgg

SEQ ID NO: 523275 - DNA, 20 bp, Artificial Sequence
  chemically synthesized
gttggaagagtgggagcaaa

SEQ ID NO: 523276 - DNA, 20 bp, Artificial Sequence
  chemically synthesized
cacaccaaaaataactggtt

SEQ ID NO: 523277 - DNA, 20 bp, Artificial Sequence
  chemically synthesized
aagctaaaggctgttctatg

SEQ ID NO: 523278 - DNA, 20 bp, Artificial Sequence
  chemically synthesized
tataagcaataaaaatttta

SEQ ID NO: 523279 - DNA, 20 bp, Artificial Sequence
  chemically synthesized
ttggagcacaatcacatgat

SEQ ID NO: 523280 - DNA, 20 bp, Artificial Sequence
  chemically synthesized
tgtgctccaaaaatttttag

SEQ ID NO: 523281 - DNA, 20 bp, Artificial Sequence
  chemically synthesized
gactttcctccagtttatta

SEQ ID NO: 523282 - DNA, 20 bp, Artificial Sequence
  chemically synthesized
tatttgccttctgtgcactg

SEQ ID NO: 523283 - DNA, 20 bp, Artificial Sequence
  chemically synthesized
tgtattaagcgaagccatgg

SEQ ID NO: 523284 - DNA, 20 bp, Artificial Sequence
  chemically synthesized
acaatatatacaatttaaaa

SEQ ID NO: 523285 - DNA, 20 bp, Artificial Sequence
  chemically synthesized
tatgagaaaatagaaatgtt

SEQ ID NO: 523286 - DNA, 20 bp, Artificial Sequence
  chemically synthesized
agtaacaggtgtgaaaatga

SEQ ID NO: 523287 - DNA, 20 bp, Artificial Sequence
  chemically synthesized
atgatggaatcaaatcctca

SEQ ID NO: 523288 - DNA, 20 bp, Artificial Sequence
  chemically synthesized
gttctaaacacgtattctgt

SEQ ID NO: 523289 - DNA, 20 bp, Artificial Sequence
  chemically synthesized
gcctcggcctcgcaaagtgc

SEQ ID NO: 523290 - DNA, 20 bp, Artificial Sequence
  chemically synthesized
actttgcgaggccgaggcag

SEQ ID NO: 523291 - DNA, 20 bp, Artificial Sequence
  chemically synthesized
caggtggatcacccgagatc

SEQ ID NO: 523292 - DNA, 20 bp, Artificial Sequence
  chemically synthesized
ctggtctcgaactcctgatc

SEQ ID NO: 523293 - DNA, 20 bp, Artificial Sequence
  chemically synthesized
ttttgtatttttagtagtga

SEQ ID NO: 523294 - DNA, 20 bp, Artificial Sequence
  chemically synthesized
tacctgggaggctgaagcag

SEQ ID NO: 523295 - DNA, 20 bp, Artificial Sequence
  chemically synthesized
ctcactgcaacctccgcctc

SEQ ID NO: 523296 - DNA, 20 bp, Artificial Sequence
  chemically synthesized
tctcactctgttgcccaggc

SEQ ID NO: 523297 - DNA, 20 bp, Artificial Sequence
  chemically synthesized
cggcactccagcctgggcaa

SEQ ID NO: 523298 - DNA, 20 bp, Artificial Sequence
  chemically synthesized
acacatatatatttttgaga

SEQ ID NO: 523299 - DNA, 20 bp, Artificial Sequence
  chemically synthesized
agttttaggagaaatctgct

SEQ ID NO: 523300 - DNA, 20 bp, Artificial Sequence
  chemically synthesized
cttatcactatgagtaagag

SEQ ID NO: 523301 - DNA, 20 bp, Artificial Sequence
  chemically synthesized
tacgaggtccccttatcact

SEQ ID NO: 523302 - DNA, 20 bp, Artificial Sequence
  chemically synthesized
acatgttgttttctggagtt

SEQ ID NO: 523303 - DNA, 20 bp, Artificial Sequence
  chemically synthesized
ttgacttacatgttgttttc

SEQ ID NO: 523304 - DNA, 20 bp, Artificial Sequence
  chemically synthesized
tattggcttagaaaacatga

SEQ ID NO: 523305 - DNA, 20 bp, Artificial Sequence
  chemically synthesized
aagatattggcttagaaaac

SEQ ID NO: 523306 - DNA, 20 bp, Artificial Sequence
  chemically synthesized
gtgggtagcagaggctcatg

SEQ ID NO: 523307 - DNA, 20 bp, Artificial Sequence
  chemically synthesized
catttagcaacagattggct

SEQ ID NO: 523308 - DNA, 20 bp, Artificial Sequence
  chemically synthesized
ccaatctgttgctaaatgtt

SEQ ID NO: 523309 - DNA, 20 bp, Artificial Sequence
  chemically synthesized
agacatacaatacaataaaa

SEQ ID NO: 523310 - DNA, 20 bp, Artificial Sequence
  chemically synthesized
cagtagggtggggggagcat

SEQ ID NO: 523311 - DNA, 20 bp, Artificial Sequence
  chemically synthesized
tttactggagaaccatgcag

SEQ ID NO: 523312 - DNA, 20 bp, Artificial Sequence
  chemically synthesized
cataaaggttgtttaattaa

SEQ ID NO: 523313 - DNA, 20 bp, Artificial Sequence
  chemically synthesized
attaatcgaatttgatatga

SEQ ID NO: 523314 - DNA, 20 bp, Artificial Sequence
  chemically synthesized
attacacacaaaatagtgga

SEQ ID NO: 523315 - DNA, 20 bp, Artificial Sequence
  chemically synthesized
ttatttctagtgttacacag

SEQ ID NO: 523316 - DNA, 20 bp, Artificial Sequence
  chemically synthesized
ttggctaaggagccaaggct

SEQ ID NO: 523317 - DNA, 20 bp, Artificial Sequence
  chemically synthesized
ttattattgataatctaaag

SEQ ID NO: 523318 - DNA, 20 bp, Artificial Sequence
  chemically synthesized
actttctaaaagcagataag

SEQ ID NO: 523319 - DNA, 20 bp, Artificial Sequence
  chemically synthesized
gataagcagagttattgaag

SEQ ID NO: 523320 - DNA, 20 bp, Artificial Sequence
  chemically synthesized
cagaggcataaactcatttt

SEQ ID NO: 523321 - DNA, 20 bp, Artificial Sequence
  chemically synthesized
tagtaataatgactcctaaa

SEQ ID NO: 523322 - DNA, 20 bp, Artificial Sequence
  chemically synthesized
cgaaaaatgttctagcacaa

SEQ ID NO: 523323 - DNA, 20 bp, Artificial Sequence
  chemically synthesized
gcccaggagaaggaagagaa

SEQ ID NO: 523324 - DNA, 20 bp, Artificial Sequence
  chemically synthesized
gtcccatctggcctctgtag

SEQ ID NO: 523325 - DNA, 20 bp, Artificial Sequence
  chemically synthesized
agaagatactaccaattaat

SEQ ID NO: 523326 - DNA, 20 bp, Artificial Sequence
  chemically synthesized
acatttctagaagtgtttac

SEQ ID NO: 523327 - DNA, 20 bp, Artificial Sequence
  chemically synthesized
gattttgagctataagggac

SEQ ID NO: 523328 - DNA, 20 bp, Artificial Sequence
  chemically synthesized
gctataagggacttgagttt

SEQ ID NO: 523329 - DNA, 20 bp, Artificial Sequence
  chemically synthesized
caaattcgttattagagtca

SEQ ID NO: 523330 - DNA, 20 bp, Artificial Sequence
  chemically synthesized
taaactcactgactctaata

SEQ ID NO: 523331 - DNA, 20 bp, Artificial Sequence
  chemically synthesized
ttgtttttcaaattcgttat

SEQ ID NO: 523332 - DNA, 20 bp, Artificial Sequence
  chemically synthesized
cagcagttctgtgggtttgt

SEQ ID NO: 523333 - DNA, 20 bp, Artificial Sequence
  chemically synthesized
gaggaaggagcagcagttct

SEQ ID NO: 523334 - DNA, 20 bp, Artificial Sequence
  chemically synthesized
ccttcctcctacatgtcagt

SEQ ID NO: 523335 - DNA, 20 bp, Artificial Sequence
  chemically synthesized
agaagttcataattggaagt

SEQ ID NO: 523336 - DNA, 20 bp, Artificial Sequence
  chemically synthesized
ttgatggatgttcttgttta

SEQ ID NO: 523337 - DNA, 20 bp, Artificial Sequence
  chemically synthesized
agccaccaaagagttttttg

SEQ ID NO: 523338 - DNA, 20 bp, Artificial Sequence
  chemically synthesized
cacatttcctcaagccacca

SEQ ID NO: 523339 - DNA, 20 bp, Artificial Sequence
  chemically synthesized
tggtggcttgaggaaatgtg

SEQ ID NO: 523340 - DNA, 20 bp, Artificial Sequence
  chemically synthesized
tgaggaaatgtggggagtgc

SEQ ID NO: 523341 - DNA, 20 bp, Artificial Sequence
  chemically synthesized
attatcaaaaatttcacaag

SEQ ID NO: 523342 - DNA, 20 bp, Artificial Sequence
  chemically synthesized
aaattgtttagttagtagtt

SEQ ID NO: 523343 - DNA, 20 bp, Artificial Sequence
  chemically synthesized
tgtaatttaggtgaaattgt

SEQ ID NO: 523344 - DNA, 20 bp, Artificial Sequence
  chemically synthesized
aaattacacaaaggtgtgtt

SEQ ID NO: 523345 - DNA, 20 bp, Artificial Sequence
  chemically synthesized
ggtgtgtttagaatatacag

SEQ ID NO: 523346 - DNA, 20 bp, Artificial Sequence
  chemically synthesized
ctgtattatttgtcttttct

SEQ ID NO: 523347 - DNA, 20 bp, Artificial Sequence
  chemically synthesized
aaagacaaataatacagctc

SEQ ID NO: 523348 - DNA, 20 bp, Artificial Sequence
  chemically synthesized
ttctcagctaagggacgaca

SEQ ID NO: 523349 - DNA, 20 bp, Artificial Sequence
  chemically synthesized
actgcggaaaaaacacctag

SEQ ID NO: 523350 - DNA, 20 bp, Artificial Sequence
  chemically synthesized
tcagtacatatttatacaaa

SEQ ID NO: 523351 - DNA, 20 bp, Artificial Sequence
  chemically synthesized
gctctagtggagcagtaact

SEQ ID NO: 523352 - DNA, 20 bp, Artificial Sequence
  chemically synthesized
taatgatgttgttttggcaa

SEQ ID NO: 523353 - DNA, 20 bp, Artificial Sequence
  chemically synthesized
agctttctgaactgattgga

SEQ ID NO: 523354 - DNA, 20 bp, Artificial Sequence
  chemically synthesized
gtgtgggaaatcggagatgg

SEQ ID NO: 523355 - DNA, 20 bp, Artificial Sequence
  chemically synthesized
aatcggagatggcaggatac

SEQ ID NO: 523356 - DNA, 20 bp, Artificial Sequence
  chemically synthesized
tccattatatttttaaaacc

SEQ ID NO: 523357 - DNA, 20 bp, Artificial Sequence
  chemically synthesized
tctaggttttaaaaatataa

SEQ ID NO: 523358 - DNA, 20 bp, Artificial Sequence
  chemically synthesized
aatggagtgattgatatagt

SEQ ID NO: 523359 - DNA, 20 bp, Artificial Sequence
  chemically synthesized
atcatcgctgagaaaaggca

SEQ ID NO: 523360 - DNA, 20 bp, Artificial Sequence
  chemically synthesized
aaggcaaggagtaatttaac

SEQ ID NO: 523361 - DNA, 20 bp, Artificial Sequence
  chemically synthesized
agatgtgagaaagagattaa

SEQ ID NO: 523362 - DNA, 20 bp, Artificial Sequence
  chemically synthesized
aaatttacttccatgtttta

SEQ ID NO: 523363 - DNA, 20 bp, Artificial Sequence
  chemically synthesized
ataagttttaatttaggagt

SEQ ID NO: 523364 - DNA, 20 bp, Artificial Sequence
  chemically synthesized
ttcaccataagttttaattt

SEQ ID NO: 523365 - DNA, 20 bp, Artificial Sequence
  chemically synthesized
tacagcataattttctacat

SEQ ID NO: 523366 - DNA, 20 bp, Artificial Sequence
  chemically synthesized
gcataattttctacatacgg

SEQ ID NO: 523367 - DNA, 20 bp, Artificial Sequence
  chemically synthesized
aaattaagtatttctcctta

SEQ ID NO: 523368 - DNA, 20 bp, Artificial Sequence
  chemically synthesized
aagtcactgatatttaatag

SEQ ID NO: 523369 - DNA, 20 bp, Artificial Sequence
  chemically synthesized
tactactttttcaggtattg

SEQ ID NO: 523370 - DNA, 20 bp, Artificial Sequence
  chemically synthesized
aaatcaggtaacacactttt

SEQ ID NO: 523371 - DNA, 20 bp, Artificial Sequence
  chemically synthesized
tttctcctcttttcagttca

SEQ ID NO: 523372 - DNA, 20 bp, Artificial Sequence
  chemically synthesized
cctcttttcagttcaaagaa

SEQ ID NO: 523373 - DNA, 20 bp, Artificial Sequence
  chemically synthesized
gtcatggctgggctttattt

SEQ ID NO: 523374 - DNA, 20 bp, Artificial Sequence
  chemically synthesized
ttttcctcagtgtgtattca

SEQ ID NO: 523375 - DNA, 20 bp, Artificial Sequence
  chemically synthesized
tgctcattcaggttcactca

SEQ ID NO: 523376 - DNA, 20 bp, Artificial Sequence
  chemically synthesized
tgtgtattcattgagtgaac

SEQ ID NO: 523377 - DNA, 20 bp, Artificial Sequence
  chemically synthesized
tttactagtctatcaaataa

SEQ ID NO: 523378 - DNA, 20 bp, Artificial Sequence
  chemically synthesized
taatagccttctagatttat

SEQ ID NO: 523379 - DNA, 20 bp, Artificial Sequence
  chemically synthesized
taaatctagaaggctattaa

SEQ ID NO: 523380 - DNA, 20 bp, Artificial Sequence
  chemically synthesized
gtaggtacttaatttgtgga

SEQ ID NO: 523381 - DNA, 20 bp, Artificial Sequence
  chemically synthesized
catagtaggtacttaatttg

SEQ ID NO: 523382 - DNA, 20 bp, Artificial Sequence
  chemically synthesized
ttggttctgggacaacatct

SEQ ID NO: 523383 - DNA, 20 bp, Artificial Sequence
  chemically synthesized
acgtatttctgagaagtcct

SEQ ID NO: 523384 - DNA, 20 bp, Artificial Sequence
  chemically synthesized
gcgttgtttcctactacaga

SEQ ID NO: 523385 - DNA, 20 bp, Artificial Sequence
  chemically synthesized
tctgtagtaggaaacaacgc

SEQ ID NO: 523386 - DNA, 20 bp, Artificial Sequence
  chemically synthesized
aaacacagttatgaaagctg

SEQ ID NO: 523387 - DNA, 20 bp, Artificial Sequence
  chemically synthesized
actgaagcaaggacaataat

SEQ ID NO: 523388 - DNA, 20 bp, Artificial Sequence
  chemically synthesized
ataacttgaaaattgtgtcc

SEQ ID NO: 523389 - DNA, 20 bp, Artificial Sequence
  chemically synthesized
tactagtcgaattgaagaat

SEQ ID NO: 523390 - DNA, 20 bp, Artificial Sequence
  chemically synthesized
aataattactagtcgaattg

SEQ ID NO: 523391 - DNA, 20 bp, Artificial Sequence
  chemically synthesized
atctttcaaataattactag

SEQ ID NO: 523392 - DNA, 20 bp, Artificial Sequence
  chemically synthesized
ttatatgaaagttgtaaaaa

SEQ ID NO: 523393 - DNA, 20 bp, Artificial Sequence
  chemically synthesized
attctgggtgaaggatacat

SEQ ID NO: 523394 - DNA, 20 bp, Artificial Sequence
  chemically synthesized
attctaatgtatccttcacc

SEQ ID NO: 523395 - DNA, 20 bp, Artificial Sequence
  chemically synthesized
gtaaaaaaaaattctgggtg

SEQ ID NO: 523396 - DNA, 20 bp, Artificial Sequence
  chemically synthesized
agataaagtaaaaaaaaatt

SEQ ID NO: 523397 - DNA, 20 bp, Artificial Sequence
  chemically synthesized
atttctttttgtctgtattt

SEQ ID NO: 523398 - DNA, 20 bp, Artificial Sequence
  chemically synthesized
ttcattatatacttgttctt

SEQ ID NO: 523399 - DNA, 20 bp, Artificial Sequence
  chemically synthesized
tggcacagaaaaatgatttt

SEQ ID NO: 523400 - DNA, 20 bp, Artificial Sequence
  chemically synthesized
aaagttttggtcccctgtgc

SEQ ID NO: 523401 - DNA, 20 bp, Artificial Sequence
  chemically synthesized
gacttgggaacaaaatggcc

SEQ ID NO: 523402 - DNA, 20 bp, Artificial Sequence
  chemically synthesized
tcacttcccatttaccactt

SEQ ID NO: 523403 - DNA, 20 bp, Artificial Sequence
  chemically synthesized
cacaaaaggaatttaagaca

SEQ ID NO: 523404 - DNA, 20 bp, Artificial Sequence
  chemically synthesized
atattctctctttacacaaa

SEQ ID NO: 523405 - DNA, 20 bp, Artificial Sequence
  chemically synthesized
aaattccttttgtgtaaaga

SEQ ID NO: 523406 - DNA, 20 bp, Artificial Sequence
  chemically synthesized
aaaggctttataaagattaa

SEQ ID NO: 523407 - DNA, 20 bp, Artificial Sequence
  chemically synthesized
atttgacattacaaaataga

SEQ ID NO: 523408 - DNA, 20 bp, Artificial Sequence
  chemically synthesized
cccaatctttctctttatct

SEQ ID NO: 523409 - DNA, 20 bp, Artificial Sequence
  chemically synthesized
gagaaagattgggggcatgg

SEQ ID NO: 523410 - DNA, 20 bp, Artificial Sequence
  chemically synthesized
aaatattttatctaagtttc

SEQ ID NO: 523411 - DNA, 20 bp, Artificial Sequence
  chemically synthesized
tttattttcactacattgtg

SEQ ID NO: 523412 - DNA, 20 bp, Artificial Sequence
  chemically synthesized
tttaacatcagaaagaacgt

SEQ ID NO: 523413 - DNA, 20 bp, Artificial Sequence
  chemically synthesized
atcaagatttggcaggattg

SEQ ID NO: 523414 - DNA, 20 bp, Artificial Sequence
  chemically synthesized
aggtcaaaatcaagatttgg

SEQ ID NO: 523415 - DNA, 20 bp, Artificial Sequence
  chemically synthesized
gattttgacctgtatggtac

SEQ ID NO: 523416 - DNA, 20 bp, Artificial Sequence
  chemically synthesized
ctcaggtgttttgttgacct

SEQ ID NO: 523417 - DNA, 20 bp, Artificial Sequence
  chemically synthesized
tcaatttcaaaaacaacttt

SEQ ID NO: 523418 - DNA, 20 bp, Artificial Sequence
  chemically synthesized
tctgaaagttgtttttgaaa

SEQ ID NO: 523419 - DNA, 20 bp, Artificial Sequence
  chemically synthesized
gctatatatcaggaattttc

SEQ ID NO: 523420 - DNA, 20 bp, Artificial Sequence
  chemically synthesized
aaaaaaaaaagctatatatc

SEQ ID NO: 523421 - DNA, 20 bp, Artificial Sequence
  chemically synthesized
gaaacttgcattcagataat

SEQ ID NO: 523422 - DNA, 20 bp, Artificial Sequence
  chemically synthesized
taccttaagacccaaattat

SEQ ID NO: 523423 - DNA, 20 bp, Artificial Sequence
  chemically synthesized
atttccttgacgtttctaaa

SEQ ID NO: 523424 - DNA, 20 bp, Artificial Sequence
  chemically synthesized
aaatgaaaattagaaaaata

SEQ ID NO: 523425 - DNA, 20 bp, Artificial Sequence
  chemically synthesized
aatgatctcagagtactaca

SEQ ID NO: 523426 - DNA, 20 bp, Artificial Sequence
  chemically synthesized
caaggcatcatcaatgatct

SEQ ID NO: 523427 - DNA, 20 bp, Artificial Sequence
  chemically synthesized
ctgagatcattgatgatgcc

SEQ ID NO: 523428 - DNA, 20 bp, Artificial Sequence
  chemically synthesized
atgatgccttgagtgtggct

SEQ ID NO: 523429 - DNA, 20 bp, Artificial Sequence
  chemically synthesized
gagtgtggctgggagtctac

SEQ ID NO: 523430 - DNA, 20 bp, Artificial Sequence
  chemically synthesized
aaaatcaaagagaaggcgta

SEQ ID NO: 523431 - DNA, 20 bp, Artificial Sequence
  chemically synthesized
ataactaattattttactta

SEQ ID NO: 523432 - DNA, 20 bp, Artificial Sequence
  chemically synthesized
ctaagtaaaataattagtta

SEQ ID NO: 523433 - DNA, 20 bp, Artificial Sequence
  chemically synthesized
aaataattagttataggatt

SEQ ID NO: 523434 - DNA, 20 bp, Artificial Sequence
  chemically synthesized
ggcacagaacacagaaatgc

SEQ ID NO: 523435 - DNA, 20 bp, Artificial Sequence
  chemically synthesized
cagaaatgcatgaatacctt

SEQ ID NO: 523436 - DNA, 20 bp, Artificial Sequence
  chemically synthesized
ctatcttctagagagttgac

SEQ ID NO: 523437 - DNA, 20 bp, Artificial Sequence
  chemically synthesized
aaaaaaaaacctatcttcta

SEQ ID NO: 523438 - DNA, 20 bp, Artificial Sequence
  chemically synthesized
caaagactttgtgcatgcaa

SEQ ID NO: 523439 - DNA, 20 bp, Artificial Sequence
  chemically synthesized
ctcttgcatgcacaaagtct

SEQ ID NO: 523440 - DNA, 20 bp, Artificial Sequence
  chemically synthesized
aattgttttttttctgttca

SEQ ID NO: 523441 - DNA, 20 bp, Artificial Sequence
  chemically synthesized
gatctttatgccctagggct

SEQ ID NO: 523442 - DNA, 20 bp, Artificial Sequence
  chemically synthesized
attgataaggttaacaatcc

SEQ ID NO: 523443 - DNA, 20 bp, Artificial Sequence
  chemically synthesized
gaagtaagctgtcattaccc

SEQ ID NO: 523444 - DNA, 20 bp, Artificial Sequence
  chemically synthesized
aatgacagcttacttctctt

SEQ ID NO: 523445 - DNA, 20 bp, Artificial Sequence
  chemically synthesized
ttgtttagaaatatatttaa

SEQ ID NO: 523446 - DNA, 20 bp, Artificial Sequence
  chemically synthesized
aacaacaaaaatgtctagat

SEQ ID NO: 523447 - DNA, 20 bp, Artificial Sequence
  chemically synthesized
cattgacttcaatctttaat

SEQ ID NO: 523448 - DNA, 20 bp, Artificial Sequence
  chemically synthesized
actaggttgggcaatctggc

SEQ ID NO: 523449 - DNA, 20 bp, Artificial Sequence
  chemically synthesized
gacattgactggtttaaatt

SEQ ID NO: 523450 - DNA, 20 bp, Artificial Sequence
  chemically synthesized
aagtgtaaataaaccaactg

SEQ ID NO: 523451 - DNA, 20 bp, Artificial Sequence
  chemically synthesized
tttttaattttaatagcttt

SEQ ID NO: 523452 - DNA, 20 bp, Artificial Sequence
  chemically synthesized
agtggttttttgttacacaa

SEQ ID NO: 523453 - DNA, 20 bp, Artificial Sequence
  chemically synthesized
cacaaatgagttctatagtg

SEQ ID NO: 523454 - DNA, 20 bp, Artificial Sequence
  chemically synthesized
tgacaggtgcactaaaatct

SEQ ID NO: 523455 - DNA, 20 bp, Artificial Sequence
  chemically synthesized
gattttagtgcacctgtcac

SEQ ID NO: 523456 - DNA, 20 bp, Artificial Sequence
  chemically synthesized
tagtgcacctgtcacctgag

SEQ ID NO: 523457 - DNA, 20 bp, Artificial Sequence
  chemically synthesized
cccccctcctagaactcttg

SEQ ID NO: 523458 - DNA, 20 bp, Artificial Sequence
  chemically synthesized
ccctagattctgaattcatc

SEQ ID NO: 523459 - DNA, 20 bp, Artificial Sequence
  chemically synthesized
cctagaactcttgatgaatt

SEQ ID NO: 523460 - DNA, 20 bp, Artificial Sequence
  chemically synthesized
tctgactttctccctagatt

SEQ ID NO: 523461 - DNA, 20 bp, Artificial Sequence
  chemically synthesized
cgtagtacagaggaaaatct

SEQ ID NO: 523462 - DNA, 20 bp, Artificial Sequence
  chemically synthesized
ttgttaatctggcaaattac

SEQ ID NO: 523463 - DNA, 20 bp, Artificial Sequence
  chemically synthesized
tgtacttttcagaggaaatg

SEQ ID NO: 523464 - DNA, 20 bp, Artificial Sequence
  chemically synthesized
tggctaatgcccagggcaag

SEQ ID NO: 523465 - DNA, 20 bp, Artificial Sequence
  chemically synthesized
ctcatgggtctaccaatgag

SEQ ID NO: 523466 - DNA, 20 bp, Artificial Sequence
  chemically synthesized
ggaacctcatgggtctacca

SEQ ID NO: 523467 - DNA, 20 bp, Artificial Sequence
  chemically synthesized
acttgtgagagcggaacctc

SEQ ID NO: 523468 - DNA, 20 bp, Artificial Sequence
  chemically synthesized
tgaggttccgctctcacaag

SEQ ID NO: 523469 - DNA, 20 bp, Artificial Sequence
  chemically synthesized
tggcttaactaagttagctt

SEQ ID NO: 523470 - DNA, 20 bp, Artificial Sequence
  chemically synthesized
aagccagttataattatttc

SEQ ID NO: 523471 - DNA, 20 bp, Artificial Sequence
  chemically synthesized
atgacttaataaatattaag

SEQ ID NO: 523472 - DNA, 20 bp, Artificial Sequence
  chemically synthesized
ttatttatgcaaaatctaaa

SEQ ID NO: 523473 - DNA, 20 bp, Artificial Sequence
  chemically synthesized
acatttgtctgtccaagcat

SEQ ID NO: 523474 - DNA, 20 bp, Artificial Sequence
  chemically synthesized
cagtttcagtttctttatat

SEQ ID NO: 523475 - DNA, 20 bp, Artificial Sequence
  chemically synthesized
attaaaattacctatgtggc

SEQ ID NO: 523476 - DNA, 20 bp, Artificial Sequence
  chemically synthesized
catttctcattatttgtaat

SEQ ID NO: 523477 - DNA, 20 bp, Artificial Sequence
  chemically synthesized
cacattacaaataatgagaa

SEQ ID NO: 523478 - DNA, 20 bp, Artificial Sequence
  chemically synthesized
ttggttaagtaaaatacagt

SEQ ID NO: 523479 - DNA, 20 bp, Artificial Sequence
  chemically synthesized
catcttgaaatgatagtatt

SEQ ID NO: 523480 - DNA, 20 bp, Artificial Sequence
  chemically synthesized
gccattggaatgtagctagc

SEQ ID NO: 523481 - DNA, 20 bp, Artificial Sequence
  chemically synthesized
cacttgccatctatggccat

SEQ ID NO: 523482 - DNA, 20 bp, Artificial Sequence
  chemically synthesized
acttcacagaagtagacaat

SEQ ID NO: 523483 - DNA, 20 bp, Artificial Sequence
  chemically synthesized
aaataatctcactctaatct

SEQ ID NO: 523484 - DNA, 20 bp, Artificial Sequence
  chemically synthesized
tactacagaaattcacagat

SEQ ID NO: 523485 - DNA, 20 bp, Artificial Sequence
  chemically synthesized
tatgtacattttgtttgtcc

SEQ ID NO: 523486 - DNA, 20 bp, Artificial Sequence
  chemically synthesized
agtgttttcaacaaatggtg

SEQ ID NO: 523487 - DNA, 20 bp, Artificial Sequence
  chemically synthesized
aaaacactactcttcctcca

SEQ ID NO: 523488 - DNA, 20 bp, Artificial Sequence
  chemically synthesized
caaaataaattcagtggagg

SEQ ID NO: 523489 - DNA, 20 bp, Artificial Sequence
  chemically synthesized
aatatgttgggcatatttgt

SEQ ID NO: 523490 - DNA, 20 bp, Artificial Sequence
  chemically synthesized
tagatcaattgaacagaata

SEQ ID NO: 523491 - DNA, 20 bp, Artificial Sequence
  chemically synthesized
tgacacatagatcaattgaa

SEQ ID NO: 523492 - DNA, 20 bp, Artificial Sequence
  chemically synthesized
atattgtgttatattgtcag

SEQ ID NO: 523493 - DNA, 20 bp, Artificial Sequence
  chemically synthesized
ttggggaaaaaacagaccag

SEQ ID NO: 523494 - DNA, 20 bp, Artificial Sequence
  chemically synthesized
gagagagagagagagtttaa

SEQ ID NO: 523495 - DNA, 20 bp, Artificial Sequence
  chemically synthesized
agacagctgagagagagaga

SEQ ID NO: 523496 - DNA, 20 bp, Artificial Sequence
  chemically synthesized
caataagaagctctcatctg

SEQ ID NO: 523497 - DNA, 20 bp, Artificial Sequence
  chemically synthesized
tgagaaaggggaagtagtag

SEQ ID NO: 523498 - DNA, 20 bp, Artificial Sequence
  chemically synthesized
ctctctggtttgaaacctct

SEQ ID NO: 523499 - DNA, 20 bp, Artificial Sequence
  chemically synthesized
cattaaaactaagccatatc

SEQ ID NO: 523500 - DNA, 20 bp, Artificial Sequence
  chemically synthesized
aggatctagttttcgtaaat

SEQ ID NO: 523501 - DNA, 20 bp, Artificial Sequence
  chemically synthesized
caaatctgctttcagaatgc

SEQ ID NO: 523502 - DNA, 20 bp, Artificial Sequence
  chemically synthesized
agaggtctcaaatctgcttt

SEQ ID NO: 523503 - DNA, 20 bp, Artificial Sequence
  chemically synthesized
acctacgagtaggtgaaaaa

SEQ ID NO: 523504 - DNA, 20 bp, Artificial Sequence
  chemically synthesized
caagtgattaagaataacct

SEQ ID NO: 523505 - DNA, 20 bp, Artificial Sequence
  chemically synthesized
gtggttggtttcaagtgatt

SEQ ID NO: 523506 - DNA, 20 bp, Artificial Sequence
  chemically synthesized
agtataagacagggtacctg

SEQ ID NO: 523507 - DNA, 20 bp, Artificial Sequence
  chemically synthesized
gacttactaaaagtataaga

SEQ ID NO: 523508 - DNA, 20 bp, Artificial Sequence
  chemically synthesized
tcatgcaaaataattgagaa

SEQ ID NO: 523509 - DNA, 20 bp, Artificial Sequence
  chemically synthesized
attgctgcattttattaaat

SEQ ID NO: 523510 - DNA, 20 bp, Artificial Sequence
  chemically synthesized
atacttttactgacagagat

SEQ ID NO: 523511 - DNA, 20 bp, Artificial Sequence
  chemically synthesized
ggatcacaaaatatctctca

SEQ ID NO: 523512 - DNA, 20 bp, Artificial Sequence
  chemically synthesized
tccttttcctatctataaaa

SEQ ID NO: 523513 - DNA, 20 bp, Artificial Sequence
  chemically synthesized
tccaattttatagataggaa

SEQ ID NO: 523514 - DNA, 20 bp, Artificial Sequence
  chemically synthesized
ttagaacatcagttccaaaa

SEQ ID NO: 523515 - DNA, 20 bp, Artificial Sequence
  chemically synthesized
aatcacctgaaatttcaagt

SEQ ID NO: 523516 - DNA, 20 bp, Artificial Sequence
  chemically synthesized
tgcgtcaagatgcatcatga

SEQ ID NO: 523517 - DNA, 20 bp, Artificial Sequence
  chemically synthesized
tgacgcaaacaaaaaatgta

SEQ ID NO: 523518 - DNA, 20 bp, Artificial Sequence
  chemically synthesized
ctgaatatattattataaat

SEQ ID NO: 523519 - DNA, 20 bp, Artificial Sequence
  chemically synthesized
gggaaagaagaggggaggaa

SEQ ID NO: 523520 - DNA, 20 bp, Artificial Sequence
  chemically synthesized
aggggaggaaaagagtaaaa

SEQ ID NO: 523521 - DNA, 20 bp, Artificial Sequence
  chemically synthesized
agacactcaataaaggtttg

SEQ ID NO: 523522 - DNA, 20 bp, Artificial Sequence
  chemically synthesized
atgtattcaacaaaccttta

SEQ ID NO: 523523 - DNA, 20 bp, Artificial Sequence
  chemically synthesized
aaggaaataaaagtatggcg

SEQ ID NO: 523524 - DNA, 20 bp, Artificial Sequence
  chemically synthesized
ccgccatacttttatttcct

SEQ ID NO: 523525 - DNA, 20 bp, Artificial Sequence
  chemically synthesized
aaattattttaatggaaact

SEQ ID NO: 523526 - DNA, 20 bp, Artificial Sequence
  chemically synthesized
gtttccattaaaataattta

SEQ ID NO: 523527 - DNA, 20 bp, Artificial Sequence
  chemically synthesized
gactagtccttctttcaaaa

SEQ ID NO: 523528 - DNA, 20 bp, Artificial Sequence
  chemically synthesized
atttttgaaagaaggactag

SEQ ID NO: 523529 - DNA, 20 bp, Artificial Sequence
  chemically synthesized
ccattggtggaaatggaaag

SEQ ID NO: 523530 - DNA, 20 bp, Artificial Sequence
  chemically synthesized
catttccaccaatggaggtg

SEQ ID NO: 523531 - DNA, 20 bp, Artificial Sequence
  chemically synthesized
caccaatggaggtgtagagt

SEQ ID NO: 523532 - DNA, 20 bp, Artificial Sequence
  chemically synthesized
caagcctcttgagagaggtg

SEQ ID NO: 523533 - DNA, 20 bp, Artificial Sequence
  chemically synthesized
agagaggtgaaggatatctc

SEQ ID NO: 523534 - DNA, 20 bp, Artificial Sequence
  chemically synthesized
gaaaaatcgaaacagagaga

SEQ ID NO: 523535 - DNA, 20 bp, Artificial Sequence
  chemically synthesized
atgtttggcagtggtggatg

SEQ ID NO: 523536 - DNA, 20 bp, Artificial Sequence
  chemically synthesized
tataagtatgtttggcagtg

SEQ ID NO: 523537 - DNA, 20 bp, Artificial Sequence
  chemically synthesized
atttaggtagtttgagtggc

SEQ ID NO: 523538 - DNA, 20 bp, Artificial Sequence
  chemically synthesized
agttggctcatttaggtagt

SEQ ID NO: 523539 - DNA, 20 bp, Artificial Sequence
  chemically synthesized
atcttacttgatactaccac

SEQ ID NO: 523540 - DNA, 20 bp, Artificial Sequence
  chemically synthesized
tcctcctaatgcgttaaatg

SEQ ID NO: 523541 - DNA, 20 bp, Artificial Sequence
  chemically synthesized
acattaactgtttctatcaa

SEQ ID NO: 523542 - DNA, 20 bp, Artificial Sequence
  chemically synthesized
actgatcaacatccttcttc

SEQ ID NO: 523543 - DNA, 20 bp, Artificial Sequence
  chemically synthesized
aaatttttatatccttgaag

SEQ ID NO: 523544 - DNA, 20 bp, Artificial Sequence
  chemically synthesized
aaaaatttaatttacttaga

SEQ ID NO: 523545 - DNA, 20 bp, Artificial Sequence
  chemically synthesized
gattttactaatagtgacaa

SEQ ID NO: 523546 - DNA, 20 bp, Artificial Sequence
  chemically synthesized
tctctaaataaacttagtga

SEQ ID NO: 523547 - DNA, 20 bp, Artificial Sequence
  chemically synthesized
agagaaaaatatccttaact

SEQ ID NO: 523548 - DNA, 20 bp, Artificial Sequence
  chemically synthesized
agaccactggactccaagtt

SEQ ID NO: 523549 - DNA, 20 bp, Artificial Sequence
  chemically synthesized
aacttggagtccagtggtct

SEQ ID NO: 523550 - DNA, 20 bp, Artificial Sequence
  chemically synthesized
tatgtccatgtgtgtacatc

SEQ ID NO: 523551 - DNA, 20 bp, Artificial Sequence
  chemically synthesized
ttaaaaatcaaatgtaaaca

SEQ ID NO: 523552 - DNA, 20 bp, Artificial Sequence
  chemically synthesized
taaattcatgattttagttg

SEQ ID NO: 523553 - DNA, 20 bp, Artificial Sequence
  chemically synthesized
tttaccctccaactaaaatc

SEQ ID NO: 523554 - DNA, 20 bp, Artificial Sequence
  chemically synthesized
tgtttatgtattttcatcaa

SEQ ID NO: 523555 - DNA, 20 bp, Artificial Sequence
  chemically synthesized
tttgaatctgagtatgtttt

SEQ ID NO: 523556 - DNA, 20 bp, Artificial Sequence
  chemically synthesized
aattcctctctcttttgaat

SEQ ID NO: 523557 - DNA, 20 bp, Artificial Sequence
  chemically synthesized
tactcagattcaaaagagag

SEQ ID NO: 523558 - DNA, 20 bp, Artificial Sequence
  chemically synthesized
ttttctaattcctctctctt

SEQ ID NO: 523559 - DNA, 20 bp, Artificial Sequence
  chemically synthesized
aagcaaaagtaatgaataca

SEQ ID NO: 523560 - DNA, 20 bp, Artificial Sequence
  chemically synthesized
ctctagaagaagcaaaagta

SEQ ID NO: 523561 - DNA, 20 bp, Artificial Sequence
  chemically synthesized
tgatcttctattaagccagt

SEQ ID NO: 523562 - DNA, 20 bp, Artificial Sequence
  chemically synthesized
ggcttaatagaagatcagtt

SEQ ID NO: 523563 - DNA, 20 bp, Artificial Sequence
  chemically synthesized
gttgggaataataagctcga

SEQ ID NO: 523564 - DNA, 20 bp, Artificial Sequence
  chemically synthesized
tagaatgataacattattac

SEQ ID NO: 523565 - DNA, 20 bp, Artificial Sequence
  chemically synthesized
ttggattgccaagttcttct

SEQ ID NO: 523566 - DNA, 20 bp, Artificial Sequence
  chemically synthesized
aacttggcaatccaagcaag

SEQ ID NO: 523567 - DNA, 20 bp, Artificial Sequence
  chemically synthesized
attagtcttatccatcttgc

SEQ ID NO: 523568 - DNA, 20 bp, Artificial Sequence
  chemically synthesized
aagactaataaaatattaca

SEQ ID NO: 523569 - DNA, 20 bp, Artificial Sequence
  chemically synthesized
tgaaatgtagaacagactat

SEQ ID NO: 523570 - DNA, 20 bp, Artificial Sequence
  chemically synthesized
cactttatcgtttagttatt

SEQ ID NO: 523571 - DNA, 20 bp, Artificial Sequence
  chemically synthesized
ttattttccaacacagtgtc

SEQ ID NO: 523572 - DNA, 20 bp, Artificial Sequence
  chemically synthesized
gagggcagagggaaaggagc

SEQ ID NO: 523573 - DNA, 20 bp, Artificial Sequence
  chemically synthesized
attttaaggtccttagaaat

SEQ ID NO: 523574 - DNA, 20 bp, Artificial Sequence
  chemically synthesized
acaaaaaaaaaaaaaaaaaa

SEQ ID NO: 523575 - DNA, 20 bp, Artificial Sequence
  chemically synthesized
aaaaaaaaaaaaagaatccc

SEQ ID NO: 523576 - DNA, 20 bp, Artificial Sequence
  chemically synthesized
ctgcagggtctggggattct

SEQ ID NO: 523577 - DNA, 20 bp, Artificial Sequence
  chemically synthesized
atcccaattctgcagggtct

SEQ ID NO: 523578 - DNA, 20 bp, Artificial Sequence
  chemically synthesized
cccagaatccccagaccctg

SEQ ID NO: 523579 - DNA, 20 bp, Artificial Sequence
  chemically synthesized
atccccagaccctgcagaat

SEQ ID NO: 523580 - DNA, 20 bp, Artificial Sequence
  chemically synthesized
taccctcaatcccaattctg

SEQ ID NO: 523581 - DNA, 20 bp, Artificial Sequence
  chemically synthesized
gaccctgcagaattgggatt

SEQ ID NO: 523582 - DNA, 20 bp, Artificial Sequence
  chemically synthesized
tgcagaattgggattgaggg

SEQ ID NO: 523583 - DNA, 20 bp, Artificial Sequence
  chemically synthesized
gggattgagggtagaatgac

SEQ ID NO: 523584 - DNA, 20 bp, Artificial Sequence
  chemically synthesized
aagagattactacctgtttt

SEQ ID NO: 523585 - DNA, 20 bp, Artificial Sequence
  chemically synthesized
tgttttgaggatcacttgtc

SEQ ID NO: 523586 - DNA, 20 bp, Artificial Sequence
  chemically synthesized
gtgcatcttctgtgactatg

SEQ ID NO: 523587 - DNA, 20 bp, Artificial Sequence
  chemically synthesized
aaaaggaagttactacagta

SEQ ID NO: 523588 - DNA, 20 bp, Artificial Sequence
  chemically synthesized
tacagtaaaggatggtgatg

SEQ ID NO: 523589 - DNA, 20 bp, Artificial Sequence
  chemically synthesized
aaggatggtgatgaggaatg

SEQ ID NO: 523590 - DNA, 20 bp, Artificial Sequence
  chemically synthesized
ttccttggttttgcggcttc

SEQ ID NO: 523591 - DNA, 20 bp, Artificial Sequence
  chemically synthesized
ccgcaaaaccaaggaagaga

SEQ ID NO: 523592 - DNA, 20 bp, Artificial Sequence
  chemically synthesized
attttataataaatgttgct

SEQ ID NO: 523593 - DNA, 20 bp, Artificial Sequence
  chemically synthesized
tcatatctgttttaacactt

SEQ ID NO: 523594 - DNA, 20 bp, Artificial Sequence
  chemically synthesized
taatttttgttattgttgtt

SEQ ID NO: 523595 - DNA, 20 bp, Artificial Sequence
  chemically synthesized
gagaccaatgcagtccaatt

SEQ ID NO: 523596 - DNA, 20 bp, Artificial Sequence
  chemically synthesized
gtaatcactttcccctatat

SEQ ID NO: 523597 - DNA, 20 bp, Artificial Sequence
  chemically synthesized
aaagtgattacaccttgtac

SEQ ID NO: 523598 - DNA, 20 bp, Artificial Sequence
  chemically synthesized
ggacaaggaggacttaatta

SEQ ID NO: 523599 - DNA, 20 bp, Artificial Sequence
  chemically synthesized
gagaagctcagtcatgaaat

SEQ ID NO: 523600 - DNA, 20 bp, Artificial Sequence
  chemically synthesized
caaacaagaaaaaaataaaa

SEQ ID NO: 523601 - DNA, 20 bp, Artificial Sequence
  chemically synthesized
caagaaaaaaataaaaaagg

SEQ ID NO: 523602 - DNA, 20 bp, Artificial Sequence
  chemically synthesized
aaaaaaggatgggttgaaac

SEQ ID NO: 523603 - DNA, 20 bp, Artificial Sequence
  chemically synthesized
aggatgggttgaaactaggg

SEQ ID NO: 523604 - DNA, 20 bp, Artificial Sequence
  chemically synthesized
ttaagtgaaaacataaaatt

SEQ ID NO: 523605 - DNA, 20 bp, Artificial Sequence
  chemically synthesized
ggcatgacagaatttcatgc

SEQ ID NO: 523606 - DNA, 20 bp, Artificial Sequence
  chemically synthesized
aaacagatcaacaggcatga

SEQ ID NO: 523607 - DNA, 20 bp, Artificial Sequence
  chemically synthesized
gattcgatgcatgatcattt

SEQ ID NO: 523608 - DNA, 20 bp, Artificial Sequence
  chemically synthesized
tattctcaaatgatcatgca

SEQ ID NO: 523609 - DNA, 20 bp, Artificial Sequence
  chemically synthesized
catcgaatcttgtggacccc

SEQ ID NO: 523610 - DNA, 20 bp, Artificial Sequence
  chemically synthesized
cttagggatatgattactct

SEQ ID NO: 523611 - DNA, 20 bp, Artificial Sequence
  chemically synthesized
atacgttatttagctccctt

SEQ ID NO: 523612 - DNA, 20 bp, Artificial Sequence
  chemically synthesized
ctaagggagctaaataacgt

SEQ ID NO: 523613 - DNA, 20 bp, Artificial Sequence
  chemically synthesized
tgatcgatctatgttttggg

SEQ ID NO: 523614 - DNA, 20 bp, Artificial Sequence
  chemically synthesized
atagccaccttctgtatcag

SEQ ID NO: 523615 - DNA, 20 bp, Artificial Sequence
  chemically synthesized
tgtatcagaaggattccctc

SEQ ID NO: 523616 - DNA, 20 bp, Artificial Sequence
  chemically synthesized
attgttctgataacccaaga

SEQ ID NO: 523617 - DNA, 20 bp, Artificial Sequence
  chemically synthesized
gagagcttgacactgcatgc

SEQ ID NO: 523618 - DNA, 20 bp, Artificial Sequence
  chemically synthesized
ggctttgaaatcaccccatg

SEQ ID NO: 523619 - DNA, 20 bp, Artificial Sequence
  chemically synthesized
ggccttgtagttatcccaca

SEQ ID NO: 523620 - DNA, 20 bp, Artificial Sequence
  chemically synthesized
acgtaaataggcctagtatg

SEQ ID NO: 523621 - DNA, 20 bp, Artificial Sequence
  chemically synthesized
ttgcctagggaaggaggaaa

SEQ ID NO: 523622 - DNA, 20 bp, Artificial Sequence
  chemically synthesized
ggaggaaaaggaataattta

SEQ ID NO: 523623 - DNA, 20 bp, Artificial Sequence
  chemically synthesized
tcataataaagctttgtgca

SEQ ID NO: 523624 - DNA, 20 bp, Artificial Sequence
  chemically synthesized
tggtgcttttttcctgtaaa

SEQ ID NO: 523625 - DNA, 20 bp, Artificial Sequence
  chemically synthesized
agtgaaaagaacattgacta

SEQ ID NO: 523626 - DNA, 20 bp, Artificial Sequence
  chemically synthesized
gactacagagtcagacacac

SEQ ID NO: 523627 - DNA, 20 bp, Artificial Sequence
  chemically synthesized
cctcttaatagttctaagaa

SEQ ID NO: 523628 - DNA, 20 bp, Artificial Sequence
  chemically synthesized
tattatcttatacctttcat

SEQ ID NO: 523629 - DNA, 20 bp, Artificial Sequence
  chemically synthesized
caaccaggtgaggaggggcc

SEQ ID NO: 523630 - DNA, 20 bp, Artificial Sequence
  chemically synthesized
aagctcagatttaaagaaac

SEQ ID NO: 523631 - DNA, 20 bp, Artificial Sequence
  chemically synthesized
tagacatctgaggaggaaca

SEQ ID NO: 523632 - DNA, 20 bp, Artificial Sequence
  chemically synthesized
ggggctggcttgaaaatcag

SEQ ID NO: 523633 - DNA, 20 bp, Artificial Sequence
  chemically synthesized
tcatacacaagaatcttggc

SEQ ID NO: 523634 - DNA, 20 bp, Artificial Sequence
  chemically synthesized
ccttgccaagattcttgtgt

SEQ ID NO: 523635 - DNA, 20 bp, Artificial Sequence
  chemically synthesized
taacagagttactcatacac

SEQ ID NO: 523636 - DNA, 20 bp, Artificial Sequence
  chemically synthesized
tgcaaaactagactaggtaa

SEQ ID NO: 523637 - DNA, 20 bp, Artificial Sequence
  chemically synthesized
gttacctagtctagttttgc

SEQ ID NO: 523638 - DNA, 20 bp, Artificial Sequence
  chemically synthesized
agaagtgcttgaagaggaac

SEQ ID NO: 523639 - DNA, 20 bp, Artificial Sequence
  chemically synthesized
taatctggaaacttctgttt

SEQ ID NO: 523640 - DNA, 20 bp, Artificial Sequence
  chemically synthesized
tttgtgtcttgaaacttccc

SEQ ID NO: 523641 - DNA, 20 bp, Artificial Sequence
  chemically synthesized
aactcttctccttatttcag

SEQ ID NO: 523642 - DNA, 20 bp, Artificial Sequence
  chemically synthesized
aactcagctgaaataaggag

SEQ ID NO: 523643 - DNA, 20 bp, Artificial Sequence
  chemically synthesized
taaaagcttcggcttcatac

SEQ ID NO: 523644 - DNA, 20 bp, Artificial Sequence
  chemically synthesized
tcggcttcatacgtggattc

SEQ ID NO: 523645 - DNA, 20 bp, Artificial Sequence
  chemically synthesized
acctgctctcttgtgaatcc

SEQ ID NO: 523646 - DNA, 20 bp, Artificial Sequence
  chemically synthesized
ggctgcaaacctgctctctt

SEQ ID NO: 523647 - DNA, 20 bp, Artificial Sequence
  chemically synthesized
tgctatgttccatcaacagc

SEQ ID NO: 523648 - DNA, 20 bp, Artificial Sequence
  chemically synthesized
gttgatggaacatagcattt

SEQ ID NO: 523649 - DNA, 20 bp, Artificial Sequence
  chemically synthesized
aacatagcatttgtgagtga

SEQ ID NO: 523650 - DNA, 20 bp, Artificial Sequence
  chemically synthesized
gtgagtgaagggatgaaaat

SEQ ID NO: 523651 - DNA, 20 bp, Artificial Sequence
  chemically synthesized
gccttggcttcccaaagtgc

SEQ ID NO: 523652 - DNA, 20 bp, Artificial Sequence
  chemically synthesized
cagcactttgggaagccaag

SEQ ID NO: 523653 - DNA, 20 bp, Artificial Sequence
  chemically synthesized
actttgggaagccaaggcgg

SEQ ID NO: 523654 - DNA, 20 bp, Artificial Sequence
  chemically synthesized
cgggtggatcatttgacgtc

SEQ ID NO: 523655 - DNA, 20 bp, Artificial Sequence
  chemically synthesized
ttttgtatttttagtagaga

SEQ ID NO: 523656 - DNA, 20 bp, Artificial Sequence
  chemically synthesized
gcctcagcctcccgagtagc

SEQ ID NO: 523657 - DNA, 20 bp, Artificial Sequence
  chemically synthesized
aattgtcctgcctcagcctc

SEQ ID NO: 523658 - DNA, 20 bp, Artificial Sequence
  chemically synthesized
ggctgaggcaggacaattgc

SEQ ID NO: 523659 - DNA, 20 bp, Artificial Sequence
  chemically synthesized
ctcactgcaacctccgcctg

SEQ ID NO: 523660 - DNA, 20 bp, Artificial Sequence
  chemically synthesized
gggcttggggaaaacaaaac

SEQ ID NO: 523661 - DNA, 20 bp, Artificial Sequence
  chemically synthesized
ttgccctccagagctccctg

SEQ ID NO: 523662 - DNA, 20 bp, Artificial Sequence
  chemically synthesized
ccacaaggtgagatcagctc

SEQ ID NO: 523663 - DNA, 20 bp, Artificial Sequence
  chemically synthesized
ctgatctcaccttgtggcaa

SEQ ID NO: 523664 - DNA, 20 bp, Artificial Sequence
  chemically synthesized
caaccaacgactgaaagtac

SEQ ID NO: 523665 - DNA, 20 bp, Artificial Sequence
  chemically synthesized
ttcaggctcctggctttctt

SEQ ID NO: 523666 - DNA, 20 bp, Artificial Sequence
  chemically synthesized
acacccatcccctagctgct

SEQ ID NO: 523667 - DNA, 20 bp, Artificial Sequence
  chemically synthesized
acaagcactcccagcagcta

SEQ ID NO: 523668 - DNA, 20 bp, Artificial Sequence
  chemically synthesized
gcactcccagcagctagggg

SEQ ID NO: 523669 - DNA, 20 bp, Artificial Sequence
  chemically synthesized
tagaacatatcagtgcccac

SEQ ID NO: 523670 - DNA, 20 bp, Artificial Sequence
  chemically synthesized
cagtgcccactagagtcaga

SEQ ID NO: 523671 - DNA, 20 bp, Artificial Sequence
  chemically synthesized
tagagtcagagagaattgat

SEQ ID NO: 523672 - DNA, 20 bp, Artificial Sequence
  chemically synthesized
ttttatttatttttttgaga

SEQ ID NO: 523673 - DNA, 20 bp, Artificial Sequence
  chemically synthesized
ctgcactccagcctgagtga

SEQ ID NO: 523674 - DNA, 20 bp, Artificial Sequence
  chemically synthesized
tctcactctgtcactcaggc

SEQ ID NO: 523675 - DNA, 20 bp, Artificial Sequence
  chemically synthesized
ttgcaccactgcactccagc

SEQ ID NO: 523676 - DNA, 20 bp, Artificial Sequence
  chemically synthesized
gcctcagcctccctagtagc

SEQ ID NO: 523677 - DNA, 20 bp, Artificial Sequence
  chemically synthesized
ttttgtatttttagtagaga

SEQ ID NO: 523678 - DNA, 20 bp, Artificial Sequence
  chemically synthesized
cgggtggatcatttgaggcc

SEQ ID NO: 523679 - DNA, 20 bp, Artificial Sequence
  chemically synthesized
actttgggagtctgaggcgg

SEQ ID NO: 523680 - DNA, 20 bp, Artificial Sequence
  chemically synthesized
caggactttgggagtctgag

SEQ ID NO: 523681 - DNA, 20 bp, Artificial Sequence
  chemically synthesized
gcctcagactcccaaagtcc

SEQ ID NO: 523682 - DNA, 20 bp, Artificial Sequence
  chemically synthesized
gcctgtaatcccaggacttt

SEQ ID NO: 523683 - DNA, 20 bp, Artificial Sequence
  chemically synthesized
tatacttaaacatttgttaa

SEQ ID NO: 523684 - DNA, 20 bp, Artificial Sequence
  chemically synthesized
ttataaaaaatgagtaggtt

SEQ ID NO: 523685 - DNA, 20 bp, Artificial Sequence
  chemically synthesized
tcaagtttcagttataaaaa

SEQ ID NO: 523686 - DNA, 20 bp, Artificial Sequence
  chemically synthesized
tcatgatattaaaaatgtat

SEQ ID NO: 523687 - DNA, 20 bp, Artificial Sequence
  chemically synthesized
tattttgcccaatagtctct

SEQ ID NO: 523688 - DNA, 20 bp, Artificial Sequence
  chemically synthesized
acagatgtattgatttctcc

SEQ ID NO: 523689 - DNA, 20 bp, Artificial Sequence
  chemically synthesized
tttctccaagggttccaaac

SEQ ID NO: 523690 - DNA, 20 bp, Artificial Sequence
  chemically synthesized
aaactggaattttaaaaaac

SEQ ID NO: 523691 - DNA, 20 bp, Artificial Sequence
  chemically synthesized
taggttgttactaaatatgc

SEQ ID NO: 523692 - DNA, 20 bp, Artificial Sequence
  chemically synthesized
tttagtaacaacctagtaac

SEQ ID NO: 523693 - DNA, 20 bp, Artificial Sequence
  chemically synthesized
aacacggatgtatgccctca

SEQ ID NO: 523694 - DNA, 20 bp, Artificial Sequence
  chemically synthesized
gatgtatgccctcagagaat

SEQ ID NO: 523695 - DNA, 20 bp, Artificial Sequence
  chemically synthesized
tgccctcagagaatgggaat

SEQ ID NO: 523696 - DNA, 20 bp, Artificial Sequence
  chemically synthesized
attccttcttttataacaat

SEQ ID NO: 523697 - DNA, 20 bp, Artificial Sequence
  chemically synthesized
actccaattgttataaaaga

SEQ ID NO: 523698 - DNA, 20 bp, Artificial Sequence
  chemically synthesized
tctgcttactttcccttgca

SEQ ID NO: 523699 - DNA, 20 bp, Artificial Sequence
  chemically synthesized
aagtaagcagaaatatccag

SEQ ID NO: 523700 - DNA, 20 bp, Artificial Sequence
  chemically synthesized
cagctttcctccaaatccca

SEQ ID NO: 523701 - DNA, 20 bp, Artificial Sequence
  chemically synthesized
gaaggactccagcagagtga

SEQ ID NO: 523702 - DNA, 20 bp, Artificial Sequence
  chemically synthesized
gacaaaccctttcactctgc

SEQ ID NO: 523703 - DNA, 20 bp, Artificial Sequence
  chemically synthesized
ggtgtcaggaaggactccag

SEQ ID NO: 523704 - DNA, 20 bp, Artificial Sequence
  chemically synthesized
cacagaaagatggaaggttc

SEQ ID NO: 523705 - DNA, 20 bp, Artificial Sequence
  chemically synthesized
gagatttgttgccttgccac

SEQ ID NO: 523706 - DNA, 20 bp, Artificial Sequence
  chemically synthesized
tacttaacacacttctattt

SEQ ID NO: 523707 - DNA, 20 bp, Artificial Sequence
  chemically synthesized
aatgagtgcatcaggtagga

SEQ ID NO: 523708 - DNA, 20 bp, Artificial Sequence
  chemically synthesized
taaaaaatgagtgcatcagg

SEQ ID NO: 523709 - DNA, 20 bp, Artificial Sequence
  chemically synthesized
cccattttgagtattaaaaa

SEQ ID NO: 523710 - DNA, 20 bp, Artificial Sequence
  chemically synthesized
atggtaagatagttcccatt

SEQ ID NO: 523711 - DNA, 20 bp, Artificial Sequence
  chemically synthesized
atatcattatttttaaaaca

SEQ ID NO: 523712 - DNA, 20 bp, Artificial Sequence
  chemically synthesized
cataaattaatgcaaacgtg

SEQ ID NO: 523713 - DNA, 20 bp, Artificial Sequence
  chemically synthesized
aaaagtaccaaatctctctt

SEQ ID NO: 523714 - DNA, 20 bp, Artificial Sequence
  chemically synthesized
tctgagttgctcttgtcttt

SEQ ID NO: 523715 - DNA, 20 bp, Artificial Sequence
  chemically synthesized
tataaggtatttattaccac

SEQ ID NO: 523716 - DNA, 20 bp, Artificial Sequence
  chemically synthesized
tattaccactgggataaaaa

SEQ ID NO: 523717 - DNA, 20 bp, Artificial Sequence
  chemically synthesized
ggtcacatgatgcaggcagc

SEQ ID NO: 523718 - DNA, 20 bp, Artificial Sequence
  chemically synthesized
tgagggtccagtgactgacc

SEQ ID NO: 523719 - DNA, 20 bp, Artificial Sequence
  chemically synthesized
acaacactatctggctgcct

SEQ ID NO: 523720 - DNA, 20 bp, Artificial Sequence
  chemically synthesized
atatttcacactctaataca

SEQ ID NO: 523721 - DNA, 20 bp, Artificial Sequence
  chemically synthesized
atgagatacattctatgtat

SEQ ID NO: 523722 - DNA, 20 bp, Artificial Sequence
  chemically synthesized
gtatctcattaaaattgtaa

SEQ ID NO: 523723 - DNA, 20 bp, Artificial Sequence
  chemically synthesized
gagatctctcagaaaaaaat

SEQ ID NO: 523724 - DNA, 20 bp, Artificial Sequence
  chemically synthesized
cttgcatcagtttctaaacg

SEQ ID NO: 523725 - DNA, 20 bp, Artificial Sequence
  chemically synthesized
gagggatttaatgtaactat

SEQ ID NO: 523726 - DNA, 20 bp, Artificial Sequence
  chemically synthesized
tgagatactgaaatataaaa

SEQ ID NO: 523727 - DNA, 20 bp, Artificial Sequence
  chemically synthesized
actgaaatataaaattgaat

SEQ ID NO: 523728 - DNA, 20 bp, Artificial Sequence
  chemically synthesized
taaaattgaatttgggtctt

SEQ ID NO: 523729 - DNA, 20 bp, Artificial Sequence
  chemically synthesized
ttttatgcctaatttagaaa

SEQ ID NO: 523730 - DNA, 20 bp, Artificial Sequence
  chemically synthesized
taatttagaaattgaatggg

SEQ ID NO: 523731 - DNA, 20 bp, Artificial Sequence
  chemically synthesized
actttgggaggccgaggcgg

SEQ ID NO: 523732 - DNA, 20 bp, Artificial Sequence
  chemically synthesized
cggggtttcactgcgttagc

SEQ ID NO: 523733 - DNA, 20 bp, Artificial Sequence
  chemically synthesized
ttttgtatttttagtagaaa

SEQ ID NO: 523734 - DNA, 20 bp, Artificial Sequence
  chemically synthesized
cattctcctgcctcaggctc

SEQ ID NO: 523735 - DNA, 20 bp, Artificial Sequence
  chemically synthesized
tactcgggagcctgaggcag

SEQ ID NO: 523736 - DNA, 20 bp, Artificial Sequence
  chemically synthesized
tcgcgccactgcactctagc

SEQ ID NO: 523737 - DNA, 20 bp, Artificial Sequence
  chemically synthesized
tctcgctctgtcacccaggc

SEQ ID NO: 523738 - DNA, 20 bp, Artificial Sequence
  chemically synthesized
ttctttttttttttttgaga

SEQ ID NO: 523739 - DNA, 20 bp, Artificial Sequence
  chemically synthesized
aaaaaaagaaagaaaagaaa

SEQ ID NO: 523740 - DNA, 20 bp, Artificial Sequence
  chemically synthesized
atttttggctacatttattt

SEQ ID NO: 523741 - DNA, 20 bp, Artificial Sequence
  chemically synthesized
agcactttttaaaaatcata

SEQ ID NO: 523742 - DNA, 20 bp, Artificial Sequence
  chemically synthesized
tttttttttttcctctgaga

SEQ ID NO: 523743 - DNA, 20 bp, Artificial Sequence
  chemically synthesized
ctcacctcaacctccgtctc

SEQ ID NO: 523744 - DNA, 20 bp, Artificial Sequence
  chemically synthesized
tactcaggaagctgaggcag

SEQ ID NO: 523745 - DNA, 20 bp, Artificial Sequence
  chemically synthesized
aattctcctgcctcagcttc

SEQ ID NO: 523746 - DNA, 20 bp, Artificial Sequence
  chemically synthesized
gcctcagcttcctgagtagc

SEQ ID NO: 523747 - DNA, 20 bp, Artificial Sequence
  chemically synthesized
ttttgtatttttagtagaga

SEQ ID NO: 523748 - DNA, 20 bp, Artificial Sequence
  chemically synthesized
tgggcagatcacttcagatc

SEQ ID NO: 523749 - DNA, 20 bp, Artificial Sequence
  chemically synthesized
accttggcctcccaaagtgc

SEQ ID NO: 523750 - DNA, 20 bp, Artificial Sequence
  chemically synthesized
tttcagaataataaatagta

SEQ ID NO: 523751 - DNA, 20 bp, Artificial Sequence
  chemically synthesized
aacatgtgatatgtctcttt

SEQ ID NO: 523752 - DNA, 20 bp, Artificial Sequence
  chemically synthesized
taaataacgaacaaacctcc

SEQ ID NO: 523753 - DNA, 20 bp, Artificial Sequence
  chemically synthesized
gtaaaataaatatttagaat

SEQ ID NO: 523754 - DNA, 20 bp, Artificial Sequence
  chemically synthesized
ctgtttgtaaaataaatatt

SEQ ID NO: 523755 - DNA, 20 bp, Artificial Sequence
  chemically synthesized
ctaaatatttattttacaaa

SEQ ID NO: 523756 - DNA, 20 bp, Artificial Sequence
  chemically synthesized
ttcttatattcttgggctac

SEQ ID NO: 523757 - DNA, 20 bp, Artificial Sequence
  chemically synthesized
aataatgattcatgtagccc

SEQ ID NO: 523758 - DNA, 20 bp, Artificial Sequence
  chemically synthesized
tgaatcattattatcaacag

SEQ ID NO: 523759 - DNA, 20 bp, Artificial Sequence
  chemically synthesized
cacaatacttgtatactttt

SEQ ID NO: 523760 - DNA, 20 bp, Artificial Sequence
  chemically synthesized
atgtgtgtgtgcgcgtgtgt

SEQ ID NO: 523761 - DNA, 20 bp, Artificial Sequence
  chemically synthesized
cacatgcacacacatacaca

SEQ ID NO: 523762 - DNA, 20 bp, Artificial Sequence
  chemically synthesized
acagtgaagaagaagatgaa

SEQ ID NO: 523763 - DNA, 20 bp, Artificial Sequence
  chemically synthesized
actgtcagagaggagcaggg

SEQ ID NO: 523764 - DNA, 20 bp, Artificial Sequence
  chemically synthesized
caaaactgtcagagaggagc

SEQ ID NO: 523765 - DNA, 20 bp, Artificial Sequence
  chemically synthesized
cctgctcctctctgacagtt

SEQ ID NO: 523766 - DNA, 20 bp, Artificial Sequence
  chemically synthesized
acttacctggctctggttcc

SEQ ID NO: 523767 - DNA, 20 bp, Artificial Sequence
  chemically synthesized
acctggctctggttccagga

SEQ ID NO: 523768 - DNA, 20 bp, Artificial Sequence
  chemically synthesized
tgaatcaatcaacctagttc

SEQ ID NO: 523769 - DNA, 20 bp, Artificial Sequence
  chemically synthesized
tgaactaggttgattgattc

SEQ ID NO: 523770 - DNA, 20 bp, Artificial Sequence
  chemically synthesized
aagaaatcacctacacattc

SEQ ID NO: 523771 - DNA, 20 bp, Artificial Sequence
  chemically synthesized
gaatgtgtaggtgatttctt

SEQ ID NO: 523772 - DNA, 20 bp, Artificial Sequence
  chemically synthesized
attctctccaacagaagacc

SEQ ID NO: 523773 - DNA, 20 bp, Artificial Sequence
  chemically synthesized
atcctaggtcttctgttgga

SEQ ID NO: 523774 - DNA, 20 bp, Artificial Sequence
  chemically synthesized
atggtgttttcattttctat

SEQ ID NO: 523775 - DNA, 20 bp, Artificial Sequence
  chemically synthesized
atataagtctaagactaata

SEQ ID NO: 523776 - DNA, 20 bp, Artificial Sequence
  chemically synthesized
ctttgaaaacacagtggaga

SEQ ID NO: 523777 - DNA, 20 bp, Artificial Sequence
  chemically synthesized
acttcagatacagttagttt

SEQ ID NO: 523778 - DNA, 20 bp, Artificial Sequence
  chemically synthesized
ggtgctgaaactttcaataa

SEQ ID NO: 523779 - DNA, 20 bp, Artificial Sequence
  chemically synthesized
ctcagttgcctctttaaaca

SEQ ID NO: 523780 - DNA, 20 bp, Artificial Sequence
  chemically synthesized
gttgtctagatctaaaatca

SEQ ID NO: 523781 - DNA, 20 bp, Artificial Sequence
  chemically synthesized
cattcatgaaaatcaattga

SEQ ID NO: 523782 - DNA, 20 bp, Artificial Sequence
  chemically synthesized
gatccaatcaattgattttc

SEQ ID NO: 523783 - DNA, 20 bp, Artificial Sequence
  chemically synthesized
ttttatagttttatctggcc

SEQ ID NO: 523784 - DNA, 20 bp, Artificial Sequence
  chemically synthesized
cagggaggtagcatgatgtg

SEQ ID NO: 523785 - DNA, 20 bp, Artificial Sequence
  chemically synthesized
tgatgtggtggataacagca

SEQ ID NO: 523786 - DNA, 20 bp, Artificial Sequence
  chemically synthesized
ttcaaagtctaattctaact

SEQ ID NO: 523787 - DNA, 20 bp, Artificial Sequence
  chemically synthesized
acagatgaagaattctgagt

SEQ ID NO: 523788 - DNA, 20 bp, Artificial Sequence
  chemically synthesized
cattttacagatgaagaatt

SEQ ID NO: 523789 - DNA, 20 bp, Artificial Sequence
  chemically synthesized
ttgttcccattttacagatg

SEQ ID NO: 523790 - DNA, 20 bp, Artificial Sequence
  chemically synthesized
aagagctttgtgtatattat

SEQ ID NO: 523791 - DNA, 20 bp, Artificial Sequence
  chemically synthesized
ataatgacatatggcaaatt

SEQ ID NO: 523792 - DNA, 20 bp, Artificial Sequence
  chemically synthesized
aacaaatcatttcctttggc

SEQ ID NO: 523793 - DNA, 20 bp, Artificial Sequence
  chemically synthesized
actgggttggccgtcaaaag

SEQ ID NO: 523794 - DNA, 20 bp, Artificial Sequence
  chemically synthesized
gtgagaaagtgtggaaagca

SEQ ID NO: 523795 - DNA, 20 bp, Artificial Sequence
  chemically synthesized
gaggataagtattgcatctg

SEQ ID NO: 523796 - DNA, 20 bp, Artificial Sequence
  chemically synthesized
cagtggcttagctgtaaata

SEQ ID NO: 523797 - DNA, 20 bp, Artificial Sequence
  chemically synthesized
cctttcacagcaatacattt

SEQ ID NO: 523798 - DNA, 20 bp, Artificial Sequence
  chemically synthesized
ttacaaaacaaaaccctaaa

SEQ ID NO: 523799 - DNA, 20 bp, Artificial Sequence
  chemically synthesized
gtgctgttatcgattcggtt

SEQ ID NO: 523800 - DNA, 20 bp, Artificial Sequence
  chemically synthesized
tcgataacagcactcatgtc

SEQ ID NO: 523801 - DNA, 20 bp, Artificial Sequence
  chemically synthesized
tctgtaaatctatccaagac

SEQ ID NO: 523802 - DNA, 20 bp, Artificial Sequence
  chemically synthesized
tcttgctctgttgcccaagt

SEQ ID NO: 523803 - DNA, 20 bp, Artificial Sequence
  chemically synthesized
cctaggaggtcaaggctaca

SEQ ID NO: 523804 - DNA, 20 bp, Artificial Sequence
  chemically synthesized
tactcaggaggctgaggcag

SEQ ID NO: 523805 - DNA, 20 bp, Artificial Sequence
  chemically synthesized
gatcctcctgcctcagcctc

SEQ ID NO: 523806 - DNA, 20 bp, Artificial Sequence
  chemically synthesized
tgaggtctcactctgttgtc

SEQ ID NO: 523807 - DNA, 20 bp, Artificial Sequence
  chemically synthesized
ttcaagaccaccctggacaa

SEQ ID NO: 523808 - DNA, 20 bp, Artificial Sequence
  chemically synthesized
gtcttgaactcctgggctca

SEQ ID NO: 523809 - DNA, 20 bp, Artificial Sequence
  chemically synthesized
agagaggatcccttgagccc

SEQ ID NO: 523810 - DNA, 20 bp, Artificial Sequence
  chemically synthesized
tttgggaggccaaggagaga

SEQ ID NO: 523811 - DNA, 20 bp, Artificial Sequence
  chemically synthesized
agactcagaaatcagagtgg

SEQ ID NO: 523812 - DNA, 20 bp, Artificial Sequence
  chemically synthesized
acacccagccactctgattt

SEQ ID NO: 523813 - DNA, 20 bp, Artificial Sequence
  chemically synthesized
tttgattaagactcagaaat

SEQ ID NO: 523814 - DNA, 20 bp, Artificial Sequence
  chemically synthesized
aatattaacaaagaaaaagg

SEQ ID NO: 523815 - DNA, 20 bp, Artificial Sequence
  chemically synthesized
atattttacagtatcagtta

SEQ ID NO: 523816 - DNA, 20 bp, Artificial Sequence
  chemically synthesized
gtcatatcttgtaaatatac

SEQ ID NO: 523817 - DNA, 20 bp, Artificial Sequence
  chemically synthesized
gaattaaaatgtaaatgtta

SEQ ID NO: 523818 - DNA, 20 bp, Artificial Sequence
  chemically synthesized
ttctcttacaaactggttat

SEQ ID NO: 523819 - DNA, 20 bp, Artificial Sequence
  chemically synthesized
tataaccagtttgtaagaga

SEQ ID NO: 523820 - DNA, 20 bp, Artificial Sequence
  chemically synthesized
tgtaggcttattttccttga

SEQ ID NO: 523821 - DNA, 20 bp, Artificial Sequence
  chemically synthesized
attttttctaaaacagtaga

SEQ ID NO: 523822 - DNA, 20 bp, Artificial Sequence
  chemically synthesized
ctactgttttagaaaaaatt

SEQ ID NO: 523823 - DNA, 20 bp, Artificial Sequence
  chemically synthesized
tgttttagaaaaaattaaga

SEQ ID NO: 523824 - DNA, 20 bp, Artificial Sequence
  chemically synthesized
caggatattccgctttaaac

SEQ ID NO: 523825 - DNA, 20 bp, Artificial Sequence
  chemically synthesized
acgcaaattctagtttaaag

SEQ ID NO: 523826 - DNA, 20 bp, Artificial Sequence
  chemically synthesized
tctccatatttattagatta

SEQ ID NO: 523827 - DNA, 20 bp, Artificial Sequence
  chemically synthesized
gattgtacctttagacttat

SEQ ID NO: 523828 - DNA, 20 bp, Artificial Sequence
  chemically synthesized
tattttcttatttaatttag

SEQ ID NO: 523829 - DNA, 20 bp, Artificial Sequence
  chemically synthesized
attaaataagaaaataaaat

SEQ ID NO: 523830 - DNA, 20 bp, Artificial Sequence
  chemically synthesized
cagaataacaaatctcctgt

SEQ ID NO: 523831 - DNA, 20 bp, Artificial Sequence
  chemically synthesized
aaaggcaattgtttttaaat

SEQ ID NO: 523832 - DNA, 20 bp, Artificial Sequence
  chemically synthesized
atatttttctcgaactgttt

SEQ ID NO: 523833 - DNA, 20 bp, Artificial Sequence
  chemically synthesized
ctaaatccttctccttgccc

SEQ ID NO: 523834 - DNA, 20 bp, Artificial Sequence
  chemically synthesized
atatattcatgggcaaggag

SEQ ID NO: 523835 - DNA, 20 bp, Artificial Sequence
  chemically synthesized
tctaagtttcggtgatcaat

SEQ ID NO: 523836 - DNA, 20 bp, Artificial Sequence
  chemically synthesized
acctgttgagacagaaagtg

SEQ ID NO: 523837 - DNA, 20 bp, Artificial Sequence
  chemically synthesized
atagctgagagttggtgggc

SEQ ID NO: 523838 - DNA, 20 bp, Artificial Sequence
  chemically synthesized
cttagctttgacaaatagct

SEQ ID NO: 523839 - DNA, 20 bp, Artificial Sequence
  chemically synthesized
gcctctggctgccactacaa

SEQ ID NO: 523840 - DNA, 20 bp, Artificial Sequence
  chemically synthesized
ggctcggctatttttaggtt

SEQ ID NO: 523841 - DNA, 20 bp, Artificial Sequence
  chemically synthesized
tgctgagataactgagactt

SEQ ID NO: 523842 - DNA, 20 bp, Artificial Sequence
  chemically synthesized
gcaggaagttgggaggctgg

SEQ ID NO: 523843 - DNA, 20 bp, Artificial Sequence
  chemically synthesized
acagaaatgagaacacaggg

SEQ ID NO: 523844 - DNA, 20 bp, Artificial Sequence
  chemically synthesized
tgaccacagaaatgagaaca

SEQ ID NO: 523845 - DNA, 20 bp, Artificial Sequence
  chemically synthesized
agcacagaaatgtagatttc

SEQ ID NO: 523846 - DNA, 20 bp, Artificial Sequence
  chemically synthesized
gaggtttttttttttccttg

SEQ ID NO: 523847 - DNA, 20 bp, Artificial Sequence
  chemically synthesized
tttctttatagaagcagctg

SEQ ID NO: 523848 - DNA, 20 bp, Artificial Sequence
  chemically synthesized
gcttctataaagaaagcagt

SEQ ID NO: 523849 - DNA, 20 bp, Artificial Sequence
  chemically synthesized
tgcttaaaaacaagagaaaa

SEQ ID NO: 523850 - DNA, 20 bp, Artificial Sequence
  chemically synthesized
gagaaaagtgaatgcttata

SEQ ID NO: 523851 - DNA, 20 bp, Artificial Sequence
  chemically synthesized
tttgatagttaaaagggagc

SEQ ID NO: 523852 - DNA, 20 bp, Artificial Sequence
  chemically synthesized
ggagccagaatagggagcta

SEQ ID NO: 523853 - DNA, 20 bp, Artificial Sequence
  chemically synthesized
cgtacattattttacctttg

SEQ ID NO: 523854 - DNA, 20 bp, Artificial Sequence
  chemically synthesized
ttcttagacatattaacctt

SEQ ID NO: 523855 - DNA, 20 bp, Artificial Sequence
  chemically synthesized
tccagaaggttaatatgtct

SEQ ID NO: 523856 - DNA, 20 bp, Artificial Sequence
  chemically synthesized
catgatttccatgaggaaag

SEQ ID NO: 523857 - DNA, 20 bp, Artificial Sequence
  chemically synthesized
tgaggaaagctgggttttag

SEQ ID NO: 523858 - DNA, 20 bp, Artificial Sequence
  chemically synthesized
gaagacaaaaaaatctaatg

SEQ ID NO: 523859 - DNA, 20 bp, Artificial Sequence
  chemically synthesized
ctgttttgatagcaatacct

SEQ ID NO: 523860 - DNA, 20 bp, Artificial Sequence
  chemically synthesized
acaaaaaaaaatcattaaaa

SEQ ID NO: 523861 - DNA, 20 bp, Artificial Sequence
  chemically synthesized
atgtgccttatatttcaaaa

SEQ ID NO: 523862 - DNA, 20 bp, Artificial Sequence
  chemically synthesized
catttattttgaaattaata

SEQ ID NO: 523863 - DNA, 20 bp, Artificial Sequence
  chemically synthesized
acacaatttaaacaattgtt

SEQ ID NO: 523864 - DNA, 20 bp, Artificial Sequence
  chemically synthesized
ttattttcatcttagtcata

SEQ ID NO: 523865 - DNA, 20 bp, Artificial Sequence
  chemically synthesized
aataataaataaaataatag

SEQ ID NO: 523866 - DNA, 20 bp, Artificial Sequence
  chemically synthesized
tgaatttgttctggaataat

SEQ ID NO: 523867 - DNA, 20 bp, Artificial Sequence
  chemically synthesized
ctgccatattgaatttgttc

SEQ ID NO: 523868 - DNA, 20 bp, Artificial Sequence
  chemically synthesized
cttgcaatttatctgccata

SEQ ID NO: 523869 - DNA, 20 bp, Artificial Sequence
  chemically synthesized
caatatggcagataaattgc

SEQ ID NO: 523870 - DNA, 20 bp, Artificial Sequence
  chemically synthesized
ttttttttttttttttgaga

SEQ ID NO: 523871 - DNA, 20 bp, Artificial Sequence
  chemically synthesized
tctcgctctgtcgcccaggc

SEQ ID NO: 523872 - DNA, 20 bp, Artificial Sequence
  chemically synthesized
ctcaccgcaacctccacctc

SEQ ID NO: 523873 - DNA, 20 bp, Artificial Sequence
  chemically synthesized
tactcaggaggctgaggcag

SEQ ID NO: 523874 - DNA, 20 bp, Artificial Sequence
  chemically synthesized
gattctcctgcctcagcctc

SEQ ID NO: 523875 - DNA, 20 bp, Artificial Sequence
  chemically synthesized
gcctcagcctcctgagtagc

SEQ ID NO: 523876 - DNA, 20 bp, Artificial Sequence
  chemically synthesized
ttttgtatttttactagaga

SEQ ID NO: 523877 - DNA, 20 bp, Artificial Sequence
  chemically synthesized
ggtgggagcatcacgaggtc

SEQ ID NO: 523878 - DNA, 20 bp, Artificial Sequence
  chemically synthesized
acctcggcctcccaaagtgc

SEQ ID NO: 523879 - DNA, 20 bp, Artificial Sequence
  chemically synthesized
gccaccgcgcccggcccagc

SEQ ID NO: 523880 - DNA, 20 bp, Artificial Sequence
  chemically synthesized
tagaaaatacagtgtctctc

SEQ ID NO: 523881 - DNA, 20 bp, Artificial Sequence
  chemically synthesized
aaatacagtgtctctcatga

SEQ ID NO: 523882 - DNA, 20 bp, Artificial Sequence
  chemically synthesized
tttttatttacgtttttctt

SEQ ID NO: 523883 - DNA, 20 bp, Artificial Sequence
  chemically synthesized
acaataaccatataatttta

SEQ ID NO: 523884 - DNA, 20 bp, Artificial Sequence
  chemically synthesized
tctaaaacttgctcctcaat

SEQ ID NO: 523885 - DNA, 20 bp, Artificial Sequence
  chemically synthesized
tcaaattgaggagcaagttt

SEQ ID NO: 523886 - DNA, 20 bp, Artificial Sequence
  chemically synthesized
tcagaaccagatcatgagga

SEQ ID NO: 523887 - DNA, 20 bp, Artificial Sequence
  chemically synthesized
cacaaatattcacactcccc

SEQ ID NO: 523888 - DNA, 20 bp, Artificial Sequence
  chemically synthesized
ttagagaaccctgggggagt

SEQ ID NO: 523889 - DNA, 20 bp, Artificial Sequence
  chemically synthesized
aaaggattagagaaccctgg

SEQ ID NO: 523890 - DNA, 20 bp, Artificial Sequence
  chemically synthesized
agggaatacactatcaagga

SEQ ID NO: 523891 - DNA, 20 bp, Artificial Sequence
  chemically synthesized
agaacgagatttctaacgga

SEQ ID NO: 523892 - DNA, 20 bp, Artificial Sequence
  chemically synthesized
gacttaagagagaaatactt

SEQ ID NO: 523893 - DNA, 20 bp, Artificial Sequence
  chemically synthesized
gtgggggaggactaaaacta

SEQ ID NO: 523894 - DNA, 20 bp, Artificial Sequence
  chemically synthesized
aacttttattatctacccac

SEQ ID NO: 523895 - DNA, 20 bp, Artificial Sequence
  chemically synthesized
attgttgatgggctatccag

SEQ ID NO: 523896 - DNA, 20 bp, Artificial Sequence
  chemically synthesized
tttgttttgagacatcaact

SEQ ID NO: 523897 - DNA, 20 bp, Artificial Sequence
  chemically synthesized
agaagtagagaaaccaggaa

SEQ ID NO: 523898 - DNA, 20 bp, Artificial Sequence
  chemically synthesized
ttaacagaagtagagaaacc

SEQ ID NO: 523899 - DNA, 20 bp, Artificial Sequence
  chemically synthesized
gattagctattaacaatttt

SEQ ID NO: 523900 - DNA, 20 bp, Artificial Sequence
  chemically synthesized
atgtttaatgaagcatatgt

SEQ ID NO: 523901 - DNA, 20 bp, Artificial Sequence
  chemically synthesized
taaagaagttccatggtgaa

SEQ ID NO: 523902 - DNA, 20 bp, Artificial Sequence
  chemically synthesized
ttaaacagctgtctttcctg

SEQ ID NO: 523903 - DNA, 20 bp, Artificial Sequence
  chemically synthesized
atgcatatgcaaagatgctc

SEQ ID NO: 523904 - DNA, 20 bp, Artificial Sequence
  chemically synthesized
attacattgagaaactctaa

SEQ ID NO: 523905 - DNA, 20 bp, Artificial Sequence
  chemically synthesized
tactacatactaaatcccct

SEQ ID NO: 523906 - DNA, 20 bp, Artificial Sequence
  chemically synthesized
tctttagtcataaaactgag

SEQ ID NO: 523907 - DNA, 20 bp, Artificial Sequence
  chemically synthesized
ccaaacagagggggcccata

SEQ ID NO: 523908 - DNA, 20 bp, Artificial Sequence
  chemically synthesized
tgtgccatagagcactcttg

SEQ ID NO: 523909 - DNA, 20 bp, Artificial Sequence
  chemically synthesized
ctccctgatattaatccccc

SEQ ID NO: 523910 - DNA, 20 bp, Artificial Sequence
  chemically synthesized
ctcttgggggattaatatca

SEQ ID NO: 523911 - DNA, 20 bp, Artificial Sequence
  chemically synthesized
attgtgggagatgaggaaaa

SEQ ID NO: 523912 - DNA, 20 bp, Artificial Sequence
  chemically synthesized
aaataatttggttctccttg

SEQ ID NO: 523913 - DNA, 20 bp, Artificial Sequence
  chemically synthesized
gcagtagctcagaatgagat

SEQ ID NO: 523914 - DNA, 20 bp, Artificial Sequence
  chemically synthesized
gatttacaaaagcagtagct

SEQ ID NO: 523915 - DNA, 20 bp, Artificial Sequence
  chemically synthesized
gaattgagagtttgagatgt

SEQ ID NO: 523916 - DNA, 20 bp, Artificial Sequence
  chemically synthesized
tctacagaagatattgaatt

SEQ ID NO: 523917 - DNA, 20 bp, Artificial Sequence
  chemically synthesized
ctcaaattctacagaagata

SEQ ID NO: 523918 - DNA, 20 bp, Artificial Sequence
  chemically synthesized
tctcaattcaatatcttctg

SEQ ID NO: 523919 - DNA, 20 bp, Artificial Sequence
  chemically synthesized
tttctgtaagagatacaaag

SEQ ID NO: 523920 - DNA, 20 bp, Artificial Sequence
  chemically synthesized
agacatgatctctattgtct

SEQ ID NO: 523921 - DNA, 20 bp, Artificial Sequence
  chemically synthesized
tcttgggatctgtgagagat

SEQ ID NO: 523922 - DNA, 20 bp, Artificial Sequence
  chemically synthesized
gagagatgggaataggccag

SEQ ID NO: 523923 - DNA, 20 bp, Artificial Sequence
  chemically synthesized
gtatgtctatgcctatggta

SEQ ID NO: 523924 - DNA, 20 bp, Artificial Sequence
  chemically synthesized
tttttttaaggaagtgggac

SEQ ID NO: 523925 - DNA, 20 bp, Artificial Sequence
  chemically synthesized
taagatgagaagatagtctt

SEQ ID NO: 523926 - DNA, 20 bp, Artificial Sequence
  chemically synthesized
aaaaataaaaatgtaaatat

SEQ ID NO: 523927 - DNA, 20 bp, Artificial Sequence
  chemically synthesized
atctagggtgaaattacacg

SEQ ID NO: 523928 - DNA, 20 bp, Artificial Sequence
  chemically synthesized
tcattagcagtagatgtatc

SEQ ID NO: 523929 - DNA, 20 bp, Artificial Sequence
  chemically synthesized
agatacatctactgctaatg

SEQ ID NO: 523930 - DNA, 20 bp, Artificial Sequence
  chemically synthesized
atgatgggtgaaattttatt

SEQ ID NO: 523931 - DNA, 20 bp, Artificial Sequence
  chemically synthesized
agctctggaagctaaatctt

SEQ ID NO: 523932 - DNA, 20 bp, Artificial Sequence
  chemically synthesized
ttggggaaaactcattaaaa

SEQ ID NO: 523933 - DNA, 20 bp, Artificial Sequence
  chemically synthesized
aagaaatggatcccatttta

SEQ ID NO: 523934 - DNA, 20 bp, Artificial Sequence
  chemically synthesized
attcttttggaaattaagaa

SEQ ID NO: 523935 - DNA, 20 bp, Artificial Sequence
  chemically synthesized
atccatttcttaatttccaa

SEQ ID NO: 523936 - DNA, 20 bp, Artificial Sequence
  chemically synthesized
tttccaaaagaatcatctat

SEQ ID NO: 523937 - DNA, 20 bp, Artificial Sequence
  chemically synthesized
tgaacattgatttaatatca

SEQ ID NO: 523938 - DNA, 20 bp, Artificial Sequence
  chemically synthesized
ttctaatgtgtatatgggta

SEQ ID NO: 523939 - DNA, 20 bp, Artificial Sequence
  chemically synthesized
aaaaacattctaatgtgtat

SEQ ID NO: 523940 - DNA, 20 bp, Artificial Sequence
  chemically synthesized
ttcaatacccatatacacat

SEQ ID NO: 523941 - DNA, 20 bp, Artificial Sequence
  chemically synthesized
gatttacattgcttacagca

SEQ ID NO: 523942 - DNA, 20 bp, Artificial Sequence
  chemically synthesized
tactcttagcaataatattg

SEQ ID NO: 523943 - DNA, 20 bp, Artificial Sequence
  chemically synthesized
tattcaccaatattattgct

SEQ ID NO: 523944 - DNA, 20 bp, Artificial Sequence
  chemically synthesized
tggattaaatattgatactt

SEQ ID NO: 523945 - DNA, 20 bp, Artificial Sequence
  chemically synthesized
aacatagagcttcatactta

SEQ ID NO: 523946 - DNA, 20 bp, Artificial Sequence
  chemically synthesized
caatgttgggcaaattgttt

SEQ ID NO: 523947 - DNA, 20 bp, Artificial Sequence
  chemically synthesized
ctaaacatttcttgccattc

SEQ ID NO: 523948 - DNA, 20 bp, Artificial Sequence
  chemically synthesized
agaaggcaaaaaataaaccc

SEQ ID NO: 523949 - DNA, 20 bp, Artificial Sequence
  chemically synthesized
gggtttattttttgccttct

SEQ ID NO: 523950 - DNA, 20 bp, Artificial Sequence
  chemically synthesized
attttttgccttctgtgaat

SEQ ID NO: 523951 - DNA, 20 bp, Artificial Sequence
  chemically synthesized
taaataagtaatttctataa

SEQ ID NO: 523952 - DNA, 20 bp, Artificial Sequence
  chemically synthesized
gtggcctgctttggatacag

SEQ ID NO: 523953 - DNA, 20 bp, Artificial Sequence
  chemically synthesized
ttaaggatctgtggcctgct

SEQ ID NO: 523954 - DNA, 20 bp, Artificial Sequence
  chemically synthesized
aattcctaagttttctcttt

SEQ ID NO: 523955 - DNA, 20 bp, Artificial Sequence
  chemically synthesized
gatccttaaagagaaaactt

SEQ ID NO: 523956 - DNA, 20 bp, Artificial Sequence
  chemically synthesized
tgtacaaatgtaggtatgag

SEQ ID NO: 523957 - DNA, 20 bp, Artificial Sequence
  chemically synthesized
atagttgcaatgtgtggtat

SEQ ID NO: 523958 - DNA, 20 bp, Artificial Sequence
  chemically synthesized
ttgaaatttatttcaggtct

SEQ ID NO: 523959 - DNA, 20 bp, Artificial Sequence
  chemically synthesized
aacagtattagagaaaacca

SEQ ID NO: 523960 - DNA, 20 bp, Artificial Sequence
  chemically synthesized
cgtatatacatatacaattg

SEQ ID NO: 523961 - DNA, 20 bp, Artificial Sequence
  chemically synthesized
gtaatacccacagcatcata

SEQ ID NO: 523962 - DNA, 20 bp, Artificial Sequence
  chemically synthesized
ttattactctttatgatgct

SEQ ID NO: 523963 - DNA, 20 bp, Artificial Sequence
  chemically synthesized
aatcactggctgagaactag

SEQ ID NO: 523964 - DNA, 20 bp, Artificial Sequence
  chemically synthesized
atctaactgtttctgagaac

SEQ ID NO: 523965 - DNA, 20 bp, Artificial Sequence
  chemically synthesized
tcacaactgcagaaaacctg

SEQ ID NO: 523966 - DNA, 20 bp, Artificial Sequence
  chemically synthesized
tatgaccttgttattcactg

SEQ ID NO: 523967 - DNA, 20 bp, Artificial Sequence
  chemically synthesized
caccagcttaacaccctaca

SEQ ID NO: 523968 - DNA, 20 bp, Artificial Sequence
  chemically synthesized
cgaaaagagcaaagggctgg

SEQ ID NO: 523969 - DNA, 20 bp, Artificial Sequence
  chemically synthesized
agagggcaaaagaactgtag

SEQ ID NO: 523970 - DNA, 20 bp, Artificial Sequence
  chemically synthesized
ttgctattgtacttcccaca

SEQ ID NO: 523971 - DNA, 20 bp, Artificial Sequence
  chemically synthesized
aagagtctgttttttttccc

SEQ ID NO: 523972 - DNA, 20 bp, Artificial Sequence
  chemically synthesized
ttggatccccactgctgctt

SEQ ID NO: 523973 - DNA, 20 bp, Artificial Sequence
  chemically synthesized
acagactcttaagcagcagt

SEQ ID NO: 523974 - DNA, 20 bp, Artificial Sequence
  chemically synthesized
ggttccctgggaaatggtct

SEQ ID NO: 523975 - DNA, 20 bp, Artificial Sequence
  chemically synthesized
accatttcccagggaaccag

SEQ ID NO: 523976 - DNA, 20 bp, Artificial Sequence
  chemically synthesized
ggaaccagtcgggtcacagg

SEQ ID NO: 523977 - DNA, 20 bp, Artificial Sequence
  chemically synthesized
gagcaaacaaaaattggcat

SEQ ID NO: 523978 - DNA, 20 bp, Artificial Sequence
  chemically synthesized
gggggttaggacttcaacag

SEQ ID NO: 523979 - DNA, 20 bp, Artificial Sequence
  chemically synthesized
agtcctaacccccattgtct

SEQ ID NO: 523980 - DNA, 20 bp, Artificial Sequence
  chemically synthesized
cagtcacattctgagacaat

SEQ ID NO: 523981 - DNA, 20 bp, Artificial Sequence
  chemically synthesized
aatgtgactgtagttggaga

SEQ ID NO: 523982 - DNA, 20 bp, Artificial Sequence
  chemically synthesized
ttataaggatactaatcaga

SEQ ID NO: 523983 - DNA, 20 bp, Artificial Sequence
  chemically synthesized
ttctaatctcatctttttat

SEQ ID NO: 523984 - DNA, 20 bp, Artificial Sequence
  chemically synthesized
taacaaaataccacagtaga

SEQ ID NO: 523985 - DNA, 20 bp, Artificial Sequence
  chemically synthesized
taaaacattacaaatgaata

SEQ ID NO: 523986 - DNA, 20 bp, Artificial Sequence
  chemically synthesized
tcaaatataaaacattacaa

SEQ ID NO: 523987 - DNA, 20 bp, Artificial Sequence
  chemically synthesized
tcatttgtaatgttttatat

SEQ ID NO: 523988 - DNA, 20 bp, Artificial Sequence
  chemically synthesized
aaggggagaatgagaatgat

SEQ ID NO: 523989 - DNA, 20 bp, Artificial Sequence
  chemically synthesized
atatatacaaaggggagaat

SEQ ID NO: 523990 - DNA, 20 bp, Artificial Sequence
  chemically synthesized
ctatatatatatacaaaggg

SEQ ID NO: 523991 - DNA, 20 bp, Artificial Sequence
  chemically synthesized
gttattgttctagcagcaag

SEQ ID NO: 523992 - DNA, 20 bp, Artificial Sequence
  chemically synthesized
atctaagggcatgtgagcaa

SEQ ID NO: 523993 - DNA, 20 bp, Artificial Sequence
  chemically synthesized
ttatttggttaatgcttttt

SEQ ID NO: 523994 - DNA, 20 bp, Artificial Sequence
  chemically synthesized
ggcatgtttatcagtgttac

SEQ ID NO: 523995 - DNA, 20 bp, Artificial Sequence
  chemically synthesized
caatttatttactttaatat

SEQ ID NO: 523996 - DNA, 20 bp, Artificial Sequence
  chemically synthesized
ccatacctaacctccattgg

SEQ ID NO: 523997 - DNA, 20 bp, Artificial Sequence
  chemically synthesized
agtcaatggagattggtgag

SEQ ID NO: 523998 - DNA, 20 bp, Artificial Sequence
  chemically synthesized
aagtgattggtaaggagaag

SEQ ID NO: 523999 - DNA, 20 bp, Artificial Sequence
  chemically synthesized
taccatgctttcgtgttgtc

SEQ ID NO: 524000 - DNA, 20 bp, Artificial Sequence
  chemically synthesized
cacataggagcctttggcta

SEQ ID NO: 524001 - DNA, 20 bp, Artificial Sequence
  chemically synthesized
gagcctttggctaaagggtt

SEQ ID NO: 524002 - DNA, 20 bp, Artificial Sequence
  chemically synthesized
taggagtaagagatgaggag

SEQ ID NO: 524003 - DNA, 20 bp, Artificial Sequence
  chemically synthesized
gaggaggtagcagcaataag

SEQ ID NO: 524004 - DNA, 20 bp, Artificial Sequence
  chemically synthesized
acatgaccttacatacatca

SEQ ID NO: 524005 - DNA, 20 bp, Artificial Sequence
  chemically synthesized
acctgtagtaatctctttaa

SEQ ID NO: 524006 - DNA, 20 bp, Artificial Sequence
  chemically synthesized
cactgcaaggaaatttctaa

SEQ ID NO: 524007 - DNA, 20 bp, Artificial Sequence
  chemically synthesized
ttcctaaaggaaattagaag

SEQ ID NO: 524008 - DNA, 20 bp, Artificial Sequence
  chemically synthesized
ctcaacttctaatttccttt

SEQ ID NO: 524009 - DNA, 20 bp, Artificial Sequence
  chemically synthesized
tcattttgtgaaaatattga

SEQ ID NO: 524010 - DNA, 20 bp, Artificial Sequence
  chemically synthesized
gttatcattttgtgaaaata

SEQ ID NO: 524011 - DNA, 20 bp, Artificial Sequence
  chemically synthesized
gagctttatttcagctaaca

SEQ ID NO: 524012 - DNA, 20 bp, Artificial Sequence
  chemically synthesized
caaagaatagccctacacaa

SEQ ID NO: 524013 - DNA, 20 bp, Artificial Sequence
  chemically synthesized
aaattataacagtcattatt

SEQ ID NO: 524014 - DNA, 20 bp, Artificial Sequence
  chemically synthesized
ataatttatcttctctgttg

SEQ ID NO: 524015 - DNA, 20 bp, Artificial Sequence
  chemically synthesized
cagtccatttcctggactat

SEQ ID NO: 524016 - DNA, 20 bp, Artificial Sequence
  chemically synthesized
atcctgtcctaggctgggtt

SEQ ID NO: 524017 - DNA, 20 bp, Artificial Sequence
  chemically synthesized
attccaaacccagcctagga

SEQ ID NO: 524018 - DNA, 20 bp, Artificial Sequence
  chemically synthesized
atcataaatcctgtcctagg

SEQ ID NO: 524019 - DNA, 20 bp, Artificial Sequence
  chemically synthesized
ataactgccccccatctatg

SEQ ID NO: 524020 - DNA, 20 bp, Artificial Sequence
  chemically synthesized
ttcaggagagttgcatagtt

SEQ ID NO: 524021 - DNA, 20 bp, Artificial Sequence
  chemically synthesized
tagccaagtttatgcttcag

SEQ ID NO: 524022 - DNA, 20 bp, Artificial Sequence
  chemically synthesized
ttttttttttttttttgaga

SEQ ID NO: 524023 - DNA, 20 bp, Artificial Sequence
  chemically synthesized
ctcactgcaagctccgcttc

SEQ ID NO: 524024 - DNA, 20 bp, Artificial Sequence
  chemically synthesized
tactcgggaggctgaggcag

SEQ ID NO: 524025 - DNA, 20 bp, Artificial Sequence
  chemically synthesized
cattctcctgcctcagcctc

SEQ ID NO: 524026 - DNA, 20 bp, Artificial Sequence
  chemically synthesized
ttttgtatttttagtagaga

SEQ ID NO: 524027 - DNA, 20 bp, Artificial Sequence
  chemically synthesized
cggggtttcaccttgttagc

SEQ ID NO: 524028 - DNA, 20 bp, Artificial Sequence
  chemically synthesized
actttgggaggccgaggcgg

SEQ ID NO: 524029 - DNA, 20 bp, Artificial Sequence
  chemically synthesized
cagcactttgggaggccgag

SEQ ID NO: 524030 - DNA, 20 bp, Artificial Sequence
  chemically synthesized
gcctcggcctcccaaagtgc

SEQ ID NO: 524031 - DNA, 20 bp, Artificial Sequence
  chemically synthesized
aattagtaaaacttatttgc

SEQ ID NO: 524032 - DNA, 20 bp, Artificial Sequence
  chemically synthesized
gataagagccttagggcatt

SEQ ID NO: 524033 - DNA, 20 bp, Artificial Sequence
  chemically synthesized
aatgccctaaggctcttatc

SEQ ID NO: 524034 - DNA, 20 bp, Artificial Sequence
  chemically synthesized
tgttctaaaagcaggtgtaa

SEQ ID NO: 524035 - DNA, 20 bp, Artificial Sequence
  chemically synthesized
ttctgatttcattggtctgc

SEQ ID NO: 524036 - DNA, 20 bp, Artificial Sequence
  chemically synthesized
gatctatttgttagatgaca

SEQ ID NO: 524037 - DNA, 20 bp, Artificial Sequence
  chemically synthesized
gaagtgtttatttttgcatc

SEQ ID NO: 524038 - DNA, 20 bp, Artificial Sequence
  chemically synthesized
ttttttcgttttttttgaga

SEQ ID NO: 524039 - DNA, 20 bp, Artificial Sequence
  chemically synthesized
tctcgctctgtcacctaggc

SEQ ID NO: 524040 - DNA, 20 bp, Artificial Sequence
  chemically synthesized
ctcactgcaacctctgcctc

SEQ ID NO: 524041 - DNA, 20 bp, Artificial Sequence
  chemically synthesized
acctctgcctcctgggttca

SEQ ID NO: 524042 - DNA, 20 bp, Artificial Sequence
  chemically synthesized
tgcttgggaggctgaggcag

SEQ ID NO: 524043 - DNA, 20 bp, Artificial Sequence
  chemically synthesized
gcctcagcctcccaagcagc

SEQ ID NO: 524044 - DNA, 20 bp, Artificial Sequence
  chemically synthesized
gtttgtctttttagtagaga

SEQ ID NO: 524045 - DNA, 20 bp, Artificial Sequence
  chemically synthesized
cgggaagatcacttgaggcc

SEQ ID NO: 524046 - DNA, 20 bp, Artificial Sequence
  chemically synthesized
gccttggcctcccaaagtgt

SEQ ID NO: 524047 - DNA, 20 bp, Artificial Sequence
  chemically synthesized
gtctaagctagtactaggtg

SEQ ID NO: 524048 - DNA, 20 bp, Artificial Sequence
  chemically synthesized
gctctgagcaacatattaca

SEQ ID NO: 524049 - DNA, 20 bp, Artificial Sequence
  chemically synthesized
tgtttggtttgggtttgggt

SEQ ID NO: 524050 - DNA, 20 bp, Artificial Sequence
  chemically synthesized
tattcttgtttggtttgggt

SEQ ID NO: 524051 - DNA, 20 bp, Artificial Sequence
  chemically synthesized
tacccaaacccaaaccaaac

SEQ ID NO: 524052 - DNA, 20 bp, Artificial Sequence
  chemically synthesized
tcacattattcttgtttggt

SEQ ID NO: 524053 - DNA, 20 bp, Artificial Sequence
  chemically synthesized
tgattgttgcttaacgatga

SEQ ID NO: 524054 - DNA, 20 bp, Artificial Sequence
  chemically synthesized
tctgtttctcacaataggcg

SEQ ID NO: 524055 - DNA, 20 bp, Artificial Sequence
  chemically synthesized
gagaaacagacctgtaaaca

SEQ ID NO: 524056 - DNA, 20 bp, Artificial Sequence
  chemically synthesized
gtaaacagtggataaaggac

SEQ ID NO: 524057 - DNA, 20 bp, Artificial Sequence
  chemically synthesized
aaaaacaggcaaaataccct

SEQ ID NO: 524058 - DNA, 20 bp, Artificial Sequence
  chemically synthesized
cattccttcctctgaattcc

SEQ ID NO: 524059 - DNA, 20 bp, Artificial Sequence
  chemically synthesized
taccctgggaattcagagga

SEQ ID NO: 524060 - DNA, 20 bp, Artificial Sequence
  chemically synthesized
gtgatttggcattccttcct

SEQ ID NO: 524061 - DNA, 20 bp, Artificial Sequence
  chemically synthesized
cttctttagatgtaggtgaa

SEQ ID NO: 524062 - DNA, 20 bp, Artificial Sequence
  chemically synthesized
ctcttcatgctagttccaac

SEQ ID NO: 524063 - DNA, 20 bp, Artificial Sequence
  chemically synthesized
ctcgtgttggaactagcatg

SEQ ID NO: 524064 - DNA, 20 bp, Artificial Sequence
  chemically synthesized
aagaatcttcttttacacaa

SEQ ID NO: 524065 - DNA, 20 bp, Artificial Sequence
  chemically synthesized
actgttatgctttgaagatc

SEQ ID NO: 524066 - DNA, 20 bp, Artificial Sequence
  chemically synthesized
attcttaatgaatctgctca

SEQ ID NO: 524067 - DNA, 20 bp, Artificial Sequence
  chemically synthesized
actctatgagcagattcatt

SEQ ID NO: 524068 - DNA, 20 bp, Artificial Sequence
  chemically synthesized
ggaatactttcacattctta

SEQ ID NO: 524069 - DNA, 20 bp, Artificial Sequence
  chemically synthesized
taatgttaatttgaatgaat

SEQ ID NO: 524070 - DNA, 20 bp, Artificial Sequence
  chemically synthesized
gtcttttaatgttaatttga

SEQ ID NO: 524071 - DNA, 20 bp, Artificial Sequence
  chemically synthesized
gagtgtcttttaatgttaat

SEQ ID NO: 524072 - DNA, 20 bp, Artificial Sequence
  chemically synthesized
cattaaaagacactctccca

SEQ ID NO: 524073 - DNA, 20 bp, Artificial Sequence
  chemically synthesized
tttgacatcttattcattgg

SEQ ID NO: 524074 - DNA, 20 bp, Artificial Sequence
  chemically synthesized
tagtaattgcagtcaatgaa

SEQ ID NO: 524075 - DNA, 20 bp, Artificial Sequence
  chemically synthesized
ttctcgttagtgctcagtcg

SEQ ID NO: 524076 - DNA, 20 bp, Artificial Sequence
  chemically synthesized
tatacaggttttgcagtcaa

SEQ ID NO: 524077 - DNA, 20 bp, Artificial Sequence
  chemically synthesized
attgagggtttttgaaccat

SEQ ID NO: 524078 - DNA, 20 bp, Artificial Sequence
  chemically synthesized
tataaaccagaatttaaatt

SEQ ID NO: 524079 - DNA, 20 bp, Artificial Sequence
  chemically synthesized
aagatcattgctatataaac

SEQ ID NO: 524080 - DNA, 20 bp, Artificial Sequence
  chemically synthesized
tattacaataataaattcaa

SEQ ID NO: 524081 - DNA, 20 bp, Artificial Sequence
  chemically synthesized
ggtatgattttaacattccc

SEQ ID NO: 524082 - DNA, 20 bp, Artificial Sequence
  chemically synthesized
gtatgaattactttttgttg

SEQ ID NO: 524083 - DNA, 20 bp, Artificial Sequence
  chemically synthesized
aaatagctaacttcagaggt

SEQ ID NO: 524084 - DNA, 20 bp, Artificial Sequence
  chemically synthesized
aatagcataagtcgcaaggt

SEQ ID NO: 524085 - DNA, 20 bp, Artificial Sequence
  chemically synthesized
tgctataaaaagatgaacac

SEQ ID NO: 524086 - DNA, 20 bp, Artificial Sequence
  chemically synthesized
gtgtacgtgaatgcatctgt

SEQ ID NO: 524087 - DNA, 20 bp, Artificial Sequence
  chemically synthesized
tcaagtttcatagtgtgtac

SEQ ID NO: 524088 - DNA, 20 bp, Artificial Sequence
  chemically synthesized
tcacgtacacactatgaaac

SEQ ID NO: 524089 - DNA, 20 bp, Artificial Sequence
  chemically synthesized
gagagaagaaattttacagt

SEQ ID NO: 524090 - DNA, 20 bp, Artificial Sequence
  chemically synthesized
tgtaaaatttcttctctcgg

SEQ ID NO: 524091 - DNA, 20 bp, Artificial Sequence
  chemically synthesized
cacctcagcctcccaaagtg

SEQ ID NO: 524092 - DNA, 20 bp, Artificial Sequence
  chemically synthesized
ttttatatttttagtagaga

SEQ ID NO: 524093 - DNA, 20 bp, Artificial Sequence
  chemically synthesized
ctgagtaactgggattacag

SEQ ID NO: 524094 - DNA, 20 bp, Artificial Sequence
  chemically synthesized
gtctcagcctcctgagtaac

SEQ ID NO: 524095 - DNA, 20 bp, Artificial Sequence
  chemically synthesized
gattctcctgtctcagcctc

SEQ ID NO: 524096 - DNA, 20 bp, Artificial Sequence
  chemically synthesized
tactcaggaggctgagacag

SEQ ID NO: 524097 - DNA, 20 bp, Artificial Sequence
  chemically synthesized
ctcactgcaaccttcacctc

SEQ ID NO: 524098 - DNA, 20 bp, Artificial Sequence
  chemically synthesized
tctcgctctgttgcccaggc

SEQ ID NO: 524099 - DNA, 20 bp, Artificial Sequence
  chemically synthesized
atgttttcttttttttgaga

SEQ ID NO: 524100 - DNA, 20 bp, Artificial Sequence
  chemically synthesized
aaattcccattggagaaaaa

SEQ ID NO: 524101 - DNA, 20 bp, Artificial Sequence
  chemically synthesized
tcactccatttttctccaat

SEQ ID NO: 524102 - DNA, 20 bp, Artificial Sequence
  chemically synthesized
tggtatgattacattagctt

SEQ ID NO: 524103 - DNA, 20 bp, Artificial Sequence
  chemically synthesized
tataaaaaggatactaattg

SEQ ID NO: 524104 - DNA, 20 bp, Artificial Sequence
  chemically synthesized
ctttctaatagaagtataaa

SEQ ID NO: 524105 - DNA, 20 bp, Artificial Sequence
  chemically synthesized
acaaattcacttttggaatc

SEQ ID NO: 524106 - DNA, 20 bp, Artificial Sequence
  chemically synthesized
aagtacccaagattccaaaa

SEQ ID NO: 524107 - DNA, 20 bp, Artificial Sequence
  chemically synthesized
catagatacaaattcacttt

SEQ ID NO: 524108 - DNA, 20 bp, Artificial Sequence
  chemically synthesized
ccaaaagtgaatttgtatct

SEQ ID NO: 524109 - DNA, 20 bp, Artificial Sequence
  chemically synthesized
aacgcgcatgcaaaactcaa

SEQ ID NO: 524110 - DNA, 20 bp, Artificial Sequence
  chemically synthesized
ctgccaggtatacaattcat

SEQ ID NO: 524111 - DNA, 20 bp, Artificial Sequence
  chemically synthesized
tgaattgtatacctggcagg

SEQ ID NO: 524112 - DNA, 20 bp, Artificial Sequence
  chemically synthesized
ttgtatacctggcaggcagg

SEQ ID NO: 524113 - DNA, 20 bp, Artificial Sequence
  chemically synthesized
agcatgttatttttagaaat

SEQ ID NO: 524114 - DNA, 20 bp, Artificial Sequence
  chemically synthesized
tctcagataacttcaaaaac

SEQ ID NO: 524115 - DNA, 20 bp, Artificial Sequence
  chemically synthesized
tctagtttttgaagttatct

SEQ ID NO: 524116 - DNA, 20 bp, Artificial Sequence
  chemically synthesized
agatgatgacacttaatttt

SEQ ID NO: 524117 - DNA, 20 bp, Artificial Sequence
  chemically synthesized
taatatccaaaagtgatgga

SEQ ID NO: 524118 - DNA, 20 bp, Artificial Sequence
  chemically synthesized
tataattctttccatcactt

SEQ ID NO: 524119 - DNA, 20 bp, Artificial Sequence
  chemically synthesized
agaagttttataaatgtgtt

SEQ ID NO: 524120 - DNA, 20 bp, Artificial Sequence
  chemically synthesized
gtttatattctcatagagtt

SEQ ID NO: 524121 - DNA, 20 bp, Artificial Sequence
  chemically synthesized
ggaaatattcaaaactctat

SEQ ID NO: 524122 - DNA, 20 bp, Artificial Sequence
  chemically synthesized
tctatgtgtttatattctca

SEQ ID NO: 524123 - DNA, 20 bp, Artificial Sequence
  chemically synthesized
agatgtggtttgcggcatcc

SEQ ID NO: 524124 - DNA, 20 bp, Artificial Sequence
  chemically synthesized
cgctactagattatatactc

SEQ ID NO: 524125 - DNA, 20 bp, Artificial Sequence
  chemically synthesized
tcacttgtcagatgaggtaa

SEQ ID NO: 524126 - DNA, 20 bp, Artificial Sequence
  chemically synthesized
agttacctcatctgacaagt

SEQ ID NO: 524127 - DNA, 20 bp, Artificial Sequence
  chemically synthesized
tatattcattatcttttata

SEQ ID NO: 524128 - DNA, 20 bp, Artificial Sequence
  chemically synthesized
atcattcactataaaagata

SEQ ID NO: 524129 - DNA, 20 bp, Artificial Sequence
  chemically synthesized
gaacttgatttctagatgtc

SEQ ID NO: 524130 - DNA, 20 bp, Artificial Sequence
  chemically synthesized
gattgagaaatggaaaagag

SEQ ID NO: 524131 - DNA, 20 bp, Artificial Sequence
  chemically synthesized
actctgattgagaaatggaa

SEQ ID NO: 524132 - DNA, 20 bp, Artificial Sequence
  chemically synthesized
actcttttccatttctcaat

SEQ ID NO: 524133 - DNA, 20 bp, Artificial Sequence
  chemically synthesized
acaatgtgagccccaggcag

SEQ ID NO: 524134 - DNA, 20 bp, Artificial Sequence
  chemically synthesized
cacaatatattatataaggc

SEQ ID NO: 524135 - DNA, 20 bp, Artificial Sequence
  chemically synthesized
atctccgtatgccaaaagca

SEQ ID NO: 524136 - DNA, 20 bp, Artificial Sequence
  chemically synthesized
ttggcatacggagatcaaaa

SEQ ID NO: 524137 - DNA, 20 bp, Artificial Sequence
  chemically synthesized
attttatgagaaaacttagc

SEQ ID NO: 524138 - DNA, 20 bp, Artificial Sequence
  chemically synthesized
tgcctgtgcataccagatct

SEQ ID NO: 524139 - DNA, 20 bp, Artificial Sequence
  chemically synthesized
tgtaatactttggaaattga

SEQ ID NO: 524140 - DNA, 20 bp, Artificial Sequence
  chemically synthesized
ttttaaaaattcattattac

SEQ ID NO: 524141 - DNA, 20 bp, Artificial Sequence
  chemically synthesized
aacatattattcatgtaata

SEQ ID NO: 524142 - DNA, 20 bp, Artificial Sequence
  chemically synthesized
ttgtaatattttattgacca

SEQ ID NO: 524143 - DNA, 20 bp, Artificial Sequence
  chemically synthesized
taagtgcaaaaataataaat

SEQ ID NO: 524144 - DNA, 20 bp, Artificial Sequence
  chemically synthesized
atggactctgaaaacaaaaa

SEQ ID NO: 524145 - DNA, 20 bp, Artificial Sequence
  chemically synthesized
gtagatcctatttttgtttt

SEQ ID NO: 524146 - DNA, 20 bp, Artificial Sequence
  chemically synthesized
catgactcaaatacatggaa

SEQ ID NO: 524147 - DNA, 20 bp, Artificial Sequence
  chemically synthesized
gtccattcaattccatgtat

SEQ ID NO: 524148 - DNA, 20 bp, Artificial Sequence
  chemically synthesized
tattgcatgactcaaataca

SEQ ID NO: 524149 - DNA, 20 bp, Artificial Sequence
  chemically synthesized
tgcaataaacatttctcacc

SEQ ID NO: 524150 - DNA, 20 bp, Artificial Sequence
  chemically synthesized
tataaaaggaaacttagtgt

SEQ ID NO: 524151 - DNA, 20 bp, Artificial Sequence
  chemically synthesized
atctttcatctgttttaatc

SEQ ID NO: 524152 - DNA, 20 bp, Artificial Sequence
  chemically synthesized
caatcattgtggccagctcc

SEQ ID NO: 524153 - DNA, 20 bp, Artificial Sequence
  chemically synthesized
ccagggtggaaaataagctt

SEQ ID NO: 524154 - DNA, 20 bp, Artificial Sequence
  chemically synthesized
aggaatgcagcaaactgaaa

SEQ ID NO: 524155 - DNA, 20 bp, Artificial Sequence
  chemically synthesized
aactgaaactgaatactctc

SEQ ID NO: 524156 - DNA, 20 bp, Artificial Sequence
  chemically synthesized
agaacggaatgtccattcca

SEQ ID NO: 524157 - DNA, 20 bp, Artificial Sequence
  chemically synthesized
ttcctgaaggagacttagaa

SEQ ID NO: 524158 - DNA, 20 bp, Artificial Sequence
  chemically synthesized
gaggacagattactgagaaa

SEQ ID NO: 524159 - DNA, 20 bp, Artificial Sequence
  chemically synthesized
gcacaggagctctaagtcca

SEQ ID NO: 524160 - DNA, 20 bp, Artificial Sequence
  chemically synthesized
gtgagcagagtagaaatttg

SEQ ID NO: 524161 - DNA, 20 bp, Artificial Sequence
  chemically synthesized
caaagtggtggagaggtgag

SEQ ID NO: 524162 - DNA, 20 bp, Artificial Sequence
  chemically synthesized
tcagctttgtaactcctcaa

SEQ ID NO: 524163 - DNA, 20 bp, Artificial Sequence
  chemically synthesized
aatttgtggggattcctttg

SEQ ID NO: 524164 - DNA, 20 bp, Artificial Sequence
  chemically synthesized
aaaaaagagccccaatttgt

SEQ ID NO: 524165 - DNA, 20 bp, Artificial Sequence
  chemically synthesized
ccaaaaacacgacagattat

SEQ ID NO: 524166 - DNA, 20 bp, Artificial Sequence
  chemically synthesized
taaaatgttggttgcttaat

SEQ ID NO: 524167 - DNA, 20 bp, Artificial Sequence
  chemically synthesized
tttataatttttacaatata

SEQ ID NO: 524168 - DNA, 20 bp, Artificial Sequence
  chemically synthesized
tggacaaaaaagtatctact

SEQ ID NO: 524169 - DNA, 20 bp, Artificial Sequence
  chemically synthesized
acacacaaaatagaacagga

SEQ ID NO: 524170 - DNA, 20 bp, Artificial Sequence
  chemically synthesized
cacacacacacaaaatagaa

SEQ ID NO: 524171 - DNA, 20 bp, Artificial Sequence
  chemically synthesized
attcagattggaaaagcctt

SEQ ID NO: 524172 - DNA, 20 bp, Artificial Sequence
  chemically synthesized
attcataaggcttttccaat

SEQ ID NO: 524173 - DNA, 20 bp, Artificial Sequence
  chemically synthesized
ttttccaatctgaatgatgc

SEQ ID NO: 524174 - DNA, 20 bp, Artificial Sequence
  chemically synthesized
aacagcttgtaggtacacaa

SEQ ID NO: 524175 - DNA, 20 bp, Artificial Sequence
  chemically synthesized
atagcctgtgcttattatat

SEQ ID NO: 524176 - DNA, 20 bp, Artificial Sequence
  chemically synthesized
gctatctcctcaaggagcaa

SEQ ID NO: 524177 - DNA, 20 bp, Artificial Sequence
  chemically synthesized
tctcctcaaggagcaagaga

SEQ ID NO: 524178 - DNA, 20 bp, Artificial Sequence
  chemically synthesized
gcaaactgacagctaaaata

SEQ ID NO: 524179 - DNA, 20 bp, Artificial Sequence
  chemically synthesized
aggggatataattgcttgtc

SEQ ID NO: 524180 - DNA, 20 bp, Artificial Sequence
  chemically synthesized
cttgtctagaattatccata

SEQ ID NO: 524181 - DNA, 20 bp, Artificial Sequence
  chemically synthesized
attcttattgtaaactcact

SEQ ID NO: 524182 - DNA, 20 bp, Artificial Sequence
  chemically synthesized
atccatagtgagtttacaat

SEQ ID NO: 524183 - DNA, 20 bp, Artificial Sequence
  chemically synthesized
tggggccccattttctgacc

SEQ ID NO: 524184 - DNA, 20 bp, Artificial Sequence
  chemically synthesized
ttttctgacctagggtagta

SEQ ID NO: 524185 - DNA, 20 bp, Artificial Sequence
  chemically synthesized
ccttatagaatattgtttaa

SEQ ID NO: 524186 - DNA, 20 bp, Artificial Sequence
  chemically synthesized
attatttttatctttcctta

SEQ ID NO: 524187 - DNA, 20 bp, Artificial Sequence
  chemically synthesized
tatgacttgttcccacttct

SEQ ID NO: 524188 - DNA, 20 bp, Artificial Sequence
  chemically synthesized
agaccttgtacgttaggacc

SEQ ID NO: 524189 - DNA, 20 bp, Artificial Sequence
  chemically synthesized
tttagagaatcttctagctt

SEQ ID NO: 524190 - DNA, 20 bp, Artificial Sequence
  chemically synthesized
ctccagcttaacgtccttta

SEQ ID NO: 524191 - DNA, 20 bp, Artificial Sequence
  chemically synthesized
ccttgtaattgctgcccccg

SEQ ID NO: 524192 - DNA, 20 bp, Artificial Sequence
  chemically synthesized
cgggggcagcaattacaagg

SEQ ID NO: 524193 - DNA, 20 bp, Artificial Sequence
  chemically synthesized
gattttatgtttgtgcgtgt

SEQ ID NO: 524194 - DNA, 20 bp, Artificial Sequence
  chemically synthesized
tctaaaagataaatgtacat

SEQ ID NO: 524195 - DNA, 20 bp, Artificial Sequence
  chemically synthesized
ccaaatgtacatttatcttt

SEQ ID NO: 524196 - DNA, 20 bp, Artificial Sequence
  chemically synthesized
ttggtgagggtcaaagtgtt

SEQ ID NO: 524197 - DNA, 20 bp, Artificial Sequence
  chemically synthesized
gatatataaagtttcttggt

SEQ ID NO: 524198 - DNA, 20 bp, Artificial Sequence
  chemically synthesized
cttattgttggctttaaaag

SEQ ID NO: 524199 - DNA, 20 bp, Artificial Sequence
  chemically synthesized
taaataaatattggcttgtc

SEQ ID NO: 524200 - DNA, 20 bp, Artificial Sequence
  chemically synthesized
ttgacaatgcctgagactac

SEQ ID NO: 524201 - DNA, 20 bp, Artificial Sequence
  chemically synthesized
aacttctagcgcttgtcata

SEQ ID NO: 524202 - DNA, 20 bp, Artificial Sequence
  chemically synthesized
accttacaaagtaggacata

SEQ ID NO: 524203 - DNA, 20 bp, Artificial Sequence
  chemically synthesized
atgggaacgtgcatcactga

SEQ ID NO: 524204 - DNA, 20 bp, Artificial Sequence
  chemically synthesized
cacgttcccatataatagaa

SEQ ID NO: 524205 - DNA, 20 bp, Artificial Sequence
  chemically synthesized
atggtttaatgctaatctgc

SEQ ID NO: 524206 - DNA, 20 bp, Artificial Sequence
  chemically synthesized
attaaaccatcctttgtacc

SEQ ID NO: 524207 - DNA, 20 bp, Artificial Sequence
  chemically synthesized
agtctatcactcaaggtaca

SEQ ID NO: 524208 - DNA, 20 bp, Artificial Sequence
  chemically synthesized
tatcatcaccaaacctaatc

SEQ ID NO: 524209 - DNA, 20 bp, Artificial Sequence
  chemically synthesized
gctcttggttttctgaaggc

SEQ ID NO: 524210 - DNA, 20 bp, Artificial Sequence
  chemically synthesized
atatttctttgcgacttcct

SEQ ID NO: 524211 - DNA, 20 bp, Artificial Sequence
  chemically synthesized
gtaaagcccgaataagctct

SEQ ID NO: 524212 - DNA, 20 bp, Artificial Sequence
  chemically synthesized
acttgtctatctggtaaagc

SEQ ID NO: 524213 - DNA, 20 bp, Artificial Sequence
  chemically synthesized
aaacacacacacacacacac

SEQ ID NO: 524214 - DNA, 20 bp, Artificial Sequence
  chemically synthesized
caaagctacacttgataatg

SEQ ID NO: 524215 - DNA, 20 bp, Artificial Sequence
  chemically synthesized
cagaggtcaggaataaggca

SEQ ID NO: 524216 - DNA, 20 bp, Artificial Sequence
  chemically synthesized
gatattggttgccagaggtc

SEQ ID NO: 524217 - DNA, 20 bp, Artificial Sequence
  chemically synthesized
atggtgctcttgacatccat

SEQ ID NO: 524218 - DNA, 20 bp, Artificial Sequence
  chemically synthesized
tcttgacatccattggagtt

SEQ ID NO: 524219 - DNA, 20 bp, Artificial Sequence
  chemically synthesized
actcaatattcacaactcca

SEQ ID NO: 524220 - DNA, 20 bp, Artificial Sequence
  chemically synthesized
atccattggagttgtgaata

SEQ ID NO: 524221 - DNA, 20 bp, Artificial Sequence
  chemically synthesized
aatactacacaacaatttaa

SEQ ID NO: 524222 - DNA, 20 bp, Artificial Sequence
  chemically synthesized
gttgtgtagtatttagtggt

SEQ ID NO: 524223 - DNA, 20 bp, Artificial Sequence
  chemically synthesized
tgtttaacagtcactcattg

SEQ ID NO: 524224 - DNA, 20 bp, Artificial Sequence
  chemically synthesized
aacagctcaagtatccatca

SEQ ID NO: 524225 - DNA, 20 bp, Artificial Sequence
  chemically synthesized
gttcacccaaaaaccttgac

SEQ ID NO: 524226 - DNA, 20 bp, Artificial Sequence
  chemically synthesized
ctgcattcatgtcaaggttt

SEQ ID NO: 524227 - DNA, 20 bp, Artificial Sequence
  chemically synthesized
gaacataaacatcaattttc

SEQ ID NO: 524228 - DNA, 20 bp, Artificial Sequence
  chemically synthesized
aattttctgggataaatatc

SEQ ID NO: 524229 - DNA, 20 bp, Artificial Sequence
  chemically synthesized
accattctagaaaacagttt

SEQ ID NO: 524230 - DNA, 20 bp, Artificial Sequence
  chemically synthesized
gaaactcctaaactgttttc

SEQ ID NO: 524231 - DNA, 20 bp, Artificial Sequence
  chemically synthesized
gtctttctaatattgctgat

SEQ ID NO: 524232 - DNA, 20 bp, Artificial Sequence
  chemically synthesized
ctaacagggatgcaaaggaa

SEQ ID NO: 524233 - DNA, 20 bp, Artificial Sequence
  chemically synthesized
tgacaacactgaaagctaac

SEQ ID NO: 524234 - DNA, 20 bp, Artificial Sequence
  chemically synthesized
agttatcactatacacctat

SEQ ID NO: 524235 - DNA, 20 bp, Artificial Sequence
  chemically synthesized
aaatgcaaattaacactaca

SEQ ID NO: 524236 - DNA, 20 bp, Artificial Sequence
  chemically synthesized
ttaatagacatttcactgaa

SEQ ID NO: 524237 - DNA, 20 bp, Artificial Sequence
  chemically synthesized
tgtggttttagtgctcagtt

SEQ ID NO: 524238 - DNA, 20 bp, Artificial Sequence
  chemically synthesized
agtctcaaagaactagtatc

SEQ ID NO: 524239 - DNA, 20 bp, Artificial Sequence
  chemically synthesized
attaaggaaagaaaaaggac

SEQ ID NO: 524240 - DNA, 20 bp, Artificial Sequence
  chemically synthesized
taaagatttgctttttgtca

SEQ ID NO: 524241 - DNA, 20 bp, Artificial Sequence
  chemically synthesized
gactaattaatacttgccag

SEQ ID NO: 524242 - DNA, 20 bp, Artificial Sequence
  chemically synthesized
attagtcacgtacatacata

SEQ ID NO: 524243 - DNA, 20 bp, Artificial Sequence
  chemically synthesized
gaacagatgttacgtggtag

SEQ ID NO: 524244 - DNA, 20 bp, Artificial Sequence
  chemically synthesized
agaggaatttgatgtactta

SEQ ID NO: 524245 - DNA, 20 bp, Artificial Sequence
  chemically synthesized
ttccacctacaagcttacct

SEQ ID NO: 524246 - DNA, 20 bp, Artificial Sequence
  chemically synthesized
tttaacaagtggtggtatct

SEQ ID NO: 524247 - DNA, 20 bp, Artificial Sequence
  chemically synthesized
aattggctgcatgaagttta

SEQ ID NO: 524248 - DNA, 20 bp, Artificial Sequence
  chemically synthesized
ggctgcatgaagtttagaga

SEQ ID NO: 524249 - DNA, 20 bp, Artificial Sequence
  chemically synthesized
agtttagagagtggattatc

SEQ ID NO: 524250 - DNA, 20 bp, Artificial Sequence
  chemically synthesized
ggattatcaagaatacgaaa

SEQ ID NO: 524251 - DNA, 20 bp, Artificial Sequence
  chemically synthesized
gcaatatattttctctcact

SEQ ID NO: 524252 - DNA, 20 bp, Artificial Sequence
  chemically synthesized
tgagagaaaatatattgcgc

SEQ ID NO: 524253 - DNA, 20 bp, Artificial Sequence
  chemically synthesized
ggtagaggagataaagagaa

SEQ ID NO: 524254 - DNA, 20 bp, Artificial Sequence
  chemically synthesized
aagtggatgaaaatatatta

SEQ ID NO: 524255 - DNA, 20 bp, Artificial Sequence
  chemically synthesized
ctaagtcattgccagtcact

SEQ ID NO: 524256 - DNA, 20 bp, Artificial Sequence
  chemically synthesized
tggcaatgacttagaaataa

SEQ ID NO: 524257 - DNA, 20 bp, Artificial Sequence
  chemically synthesized
aataactgggtaaaaaagat

SEQ ID NO: 524258 - DNA, 20 bp, Artificial Sequence
  chemically synthesized
gtaaaaaagatcagagtttc

SEQ ID NO: 524259 - DNA, 20 bp, Artificial Sequence
  chemically synthesized
tatgtttctggcttgtgaaa

SEQ ID NO: 524260 - DNA, 20 bp, Artificial Sequence
  chemically synthesized
tttctggcttgtgaaactgg

SEQ ID NO: 524261 - DNA, 20 bp, Artificial Sequence
  chemically synthesized
tctcattgtttttcttatca

SEQ ID NO: 524262 - DNA, 20 bp, Artificial Sequence
  chemically synthesized
gagggaggtgactatcacat

SEQ ID NO: 524263 - DNA, 20 bp, Artificial Sequence
  chemically synthesized
agaactgtgatttcaactgc

SEQ ID NO: 524264 - DNA, 20 bp, Artificial Sequence
  chemically synthesized
ggcagttgaaatcacagttc

SEQ ID NO: 524265 - DNA, 20 bp, Artificial Sequence
  chemically synthesized
ctctagcttagatttctcca

SEQ ID NO: 524266 - DNA, 20 bp, Artificial Sequence
  chemically synthesized
ggaagagatcattatgagaa

SEQ ID NO: 524267 - DNA, 20 bp, Artificial Sequence
  chemically synthesized
ctttaaaaattaggtttcct

SEQ ID NO: 524268 - DNA, 20 bp, Artificial Sequence
  chemically synthesized
atttttaaaggctgagaaga

SEQ ID NO: 524269 - DNA, 20 bp, Artificial Sequence
  chemically synthesized
ggatcagcctgcaatgcaga

SEQ ID NO: 524270 - DNA, 20 bp, Artificial Sequence
  chemically synthesized
atggcttcactactactttg

SEQ ID NO: 524271 - DNA, 20 bp, Artificial Sequence
  chemically synthesized
tctacttcacttgaacttag

SEQ ID NO: 524272 - DNA, 20 bp, Artificial Sequence
  chemically synthesized
tgaacttagcagggtgaagc

SEQ ID NO: 524273 - DNA, 20 bp, Artificial Sequence
  chemically synthesized
agcatgcaattaaaagaaaa

SEQ ID NO: 524274 - DNA, 20 bp, Artificial Sequence
  chemically synthesized
tttttgtatttttaccataa

SEQ ID NO: 524275 - DNA, 20 bp, Artificial Sequence
  chemically synthesized
caacaaagttactgctaatg

SEQ ID NO: 524276 - DNA, 20 bp, Artificial Sequence
  chemically synthesized
attatatgtttgttacaatt

SEQ ID NO: 524277 - DNA, 20 bp, Artificial Sequence
  chemically synthesized
gttacaattgggaatgacat

SEQ ID NO: 524278 - DNA, 20 bp, Artificial Sequence
  chemically synthesized
acatgataaataatacaaca

SEQ ID NO: 524279 - DNA, 20 bp, Artificial Sequence
  chemically synthesized
aaagtctttatgacagtgtg

SEQ ID NO: 524280 - DNA, 20 bp, Artificial Sequence
  chemically synthesized
taatctcatacactagaaaa

SEQ ID NO: 524281 - DNA, 20 bp, Artificial Sequence
  chemically synthesized
atataaaaataagaaattgt

SEQ ID NO: 524282 - DNA, 20 bp, Artificial Sequence
  chemically synthesized
tatttgtatatttaatatta

SEQ ID NO: 524283 - DNA, 20 bp, Artificial Sequence
  chemically synthesized
tagtgctacaaattaaccta

SEQ ID NO: 524284 - DNA, 20 bp, Artificial Sequence
  chemically synthesized
tgggtctccgaaatatattt

SEQ ID NO: 524285 - DNA, 20 bp, Artificial Sequence
  chemically synthesized
aactgtaaggttattgatct

SEQ ID NO: 524286 - DNA, 20 bp, Artificial Sequence
  chemically synthesized
taactagtatataaaactat

SEQ ID NO: 524287 - DNA, 20 bp, Artificial Sequence
  chemically synthesized
ttttttttttttttttgaga

SEQ ID NO: 524288 - DNA, 20 bp, Artificial Sequence
  chemically synthesized
ctgtactccagcctgggtga

SEQ ID NO: 524289 - DNA, 20 bp, Artificial Sequence
  chemically synthesized
tctcactctttcacccaggc

SEQ ID NO: 524290 - DNA, 20 bp, Artificial Sequence
  chemically synthesized
tctcgccactgtactccagc

SEQ ID NO: 524291 - DNA, 20 bp, Artificial Sequence
  chemically synthesized
tactcaggaggctgtggcag

SEQ ID NO: 524292 - DNA, 20 bp, Artificial Sequence
  chemically synthesized
gattctcctgccacagcctc

SEQ ID NO: 524293 - DNA, 20 bp, Artificial Sequence
  chemically synthesized
gccacagcctcctgagtagc

SEQ ID NO: 524294 - DNA, 20 bp, Artificial Sequence
  chemically synthesized
ccatgttggccaggctggtc

SEQ ID NO: 524295 - DNA, 20 bp, Artificial Sequence
  chemically synthesized
cgggcagatcacctgaggtc

SEQ ID NO: 524296 - DNA, 20 bp, Artificial Sequence
  chemically synthesized
gccttggcctcccaaagtgt

SEQ ID NO: 524297 - DNA, 20 bp, Artificial Sequence
  chemically synthesized
taatttgaaataaattattg

SEQ ID NO: 524298 - DNA, 20 bp, Artificial Sequence
  chemically synthesized
attattcaagatgtataaat

SEQ ID NO: 524299 - DNA, 20 bp, Artificial Sequence
  chemically synthesized
cccaccctcatttatacatc

SEQ ID NO: 524300 - DNA, 20 bp, Artificial Sequence
  chemically synthesized
tgtcagagatcgtgatggaa

SEQ ID NO: 524301 - DNA, 20 bp, Artificial Sequence
  chemically synthesized
tctcatctcataaagaggta

SEQ ID NO: 524302 - DNA, 20 bp, Artificial Sequence
  chemically synthesized
attacctctttatgagatga

SEQ ID NO: 524303 - DNA, 20 bp, Artificial Sequence
  chemically synthesized
atatatgattagaaataata

SEQ ID NO: 524304 - DNA, 20 bp, Artificial Sequence
  chemically synthesized
ttatttctaatcatatatat

SEQ ID NO: 524305 - DNA, 20 bp, Artificial Sequence
  chemically synthesized
ccaatgttgacgttatcgta

SEQ ID NO: 524306 - DNA, 20 bp, Artificial Sequence
  chemically synthesized
agtgcacattgcttaactcc

SEQ ID NO: 524307 - DNA, 20 bp, Artificial Sequence
  chemically synthesized
tatgaggtaaatgacacccc

SEQ ID NO: 524308 - DNA, 20 bp, Artificial Sequence
  chemically synthesized
tccacgttactggtacactc

SEQ ID NO: 524309 - DNA, 20 bp, Artificial Sequence
  chemically synthesized
tagtgtacactgtacaattc

SEQ ID NO: 524310 - DNA, 20 bp, Artificial Sequence
  chemically synthesized
aattgtacagtgtacactat

SEQ ID NO: 524311 - DNA, 20 bp, Artificial Sequence
  chemically synthesized
atgcaactaaatatcacact

SEQ ID NO: 524312 - DNA, 20 bp, Artificial Sequence
  chemically synthesized
tgtttatgccaagtactatt

SEQ ID NO: 524313 - DNA, 20 bp, Artificial Sequence
  chemically synthesized
gattaacgtgccatactatt

SEQ ID NO: 524314 - DNA, 20 bp, Artificial Sequence
  chemically synthesized
ggtctcactagttgttcttt

SEQ ID NO: 524315 - DNA, 20 bp, Artificial Sequence
  chemically synthesized
acaactagtgagaccactct

SEQ ID NO: 524316 - DNA, 20 bp, Artificial Sequence
  chemically synthesized
catctacagttagccatcct

SEQ ID NO: 524317 - DNA, 20 bp, Artificial Sequence
  chemically synthesized
tttcatcttcacaaagtaag

SEQ ID NO: 524318 - DNA, 20 bp, Artificial Sequence
  chemically synthesized
tgtgaaacaagataactgtt

SEQ ID NO: 524319 - DNA, 20 bp, Artificial Sequence
  chemically synthesized
cagctccctatgcaagtcta

SEQ ID NO: 524320 - DNA, 20 bp, Artificial Sequence
  chemically synthesized
tgcaagtctagagaatgggc

SEQ ID NO: 524321 - DNA, 20 bp, Artificial Sequence
  chemically synthesized
gagaatgggcatgagttatt

SEQ ID NO: 524322 - DNA, 20 bp, Artificial Sequence
  chemically synthesized
tatgccaatgtctataggct

SEQ ID NO: 524323 - DNA, 20 bp, Artificial Sequence
  chemically synthesized
gtaaacaacccaaaatttta

SEQ ID NO: 524324 - DNA, 20 bp, Artificial Sequence
  chemically synthesized
aaataaaacccattaaaatt

SEQ ID NO: 524325 - DNA, 20 bp, Artificial Sequence
  chemically synthesized
agaactagacatgtcccatt

SEQ ID NO: 524326 - DNA, 20 bp, Artificial Sequence
  chemically synthesized
agaacaaaatataaaatggc

SEQ ID NO: 524327 - DNA, 20 bp, Artificial Sequence
  chemically synthesized
atattttgttctatcctttt

SEQ ID NO: 524328 - DNA, 20 bp, Artificial Sequence
  chemically synthesized
gattttaatagaattctaaa

SEQ ID NO: 524329 - DNA, 20 bp, Artificial Sequence
  chemically synthesized
cacgatctctcagattttaa

SEQ ID NO: 524330 - DNA, 20 bp, Artificial Sequence
  chemically synthesized
atcgtgacaactgactggtt

SEQ ID NO: 524331 - DNA, 20 bp, Artificial Sequence
  chemically synthesized
taatggtggcagcatgacag

SEQ ID NO: 524332 - DNA, 20 bp, Artificial Sequence
  chemically synthesized
cagctggtacgtggtagagt

SEQ ID NO: 524333 - DNA, 20 bp, Artificial Sequence
  chemically synthesized
gtagctcagctggtacgtgg

SEQ ID NO: 524334 - DNA, 20 bp, Artificial Sequence
  chemically synthesized
taatcatctaaatttaccag

SEQ ID NO: 524335 - DNA, 20 bp, Artificial Sequence
  chemically synthesized
gattatgtttccccaccttc

SEQ ID NO: 524336 - DNA, 20 bp, Artificial Sequence
  chemically synthesized
gtattatcattgaagattag

SEQ ID NO: 524337 - DNA, 20 bp, Artificial Sequence
  chemically synthesized
cattgaagattaggtgaatc

SEQ ID NO: 524338 - DNA, 20 bp, Artificial Sequence
  chemically synthesized
gcaagaagcagtgaggcaaa

SEQ ID NO: 524339 - DNA, 20 bp, Artificial Sequence
  chemically synthesized
acatacagagatgtgaatta

SEQ ID NO: 524340 - DNA, 20 bp, Artificial Sequence
  chemically synthesized
gagtatggacatacagagat

SEQ ID NO: 524341 - DNA, 20 bp, Artificial Sequence
  chemically synthesized
ccatttttataaataggcat

SEQ ID NO: 524342 - DNA, 20 bp, Artificial Sequence
  chemically synthesized
tcttatgcctatttataaaa

SEQ ID NO: 524343 - DNA, 20 bp, Artificial Sequence
  chemically synthesized
ataaaaatggattcttcaat

SEQ ID NO: 524344 - DNA, 20 bp, Artificial Sequence
  chemically synthesized
gattatggacattctcattg

SEQ ID NO: 524345 - DNA, 20 bp, Artificial Sequence
  chemically synthesized
tcaatcataaatgattactt

SEQ ID NO: 524346 - DNA, 20 bp, Artificial Sequence
  chemically synthesized
tgtgtatctgttctctgact

SEQ ID NO: 524347 - DNA, 20 bp, Artificial Sequence
  chemically synthesized
aacataggtgttcaacaatg

SEQ ID NO: 524348 - DNA, 20 bp, Artificial Sequence
  chemically synthesized
aatatcatattactattcta

SEQ ID NO: 524349 - DNA, 20 bp, Artificial Sequence
  chemically synthesized
ttggaggaagtaagactcga

SEQ ID NO: 524350 - DNA, 20 bp, Artificial Sequence
  chemically synthesized
gtaattcaatctaatcatgg

SEQ ID NO: 524351 - DNA, 20 bp, Artificial Sequence
  chemically synthesized
tacattcatccatgattaga

SEQ ID NO: 524352 - DNA, 20 bp, Artificial Sequence
  chemically synthesized
ttgagtaattcaatctaatc

SEQ ID NO: 524353 - DNA, 20 bp, Artificial Sequence
  chemically synthesized
aataaagagatagaaggcat

SEQ ID NO: 524354 - DNA, 20 bp, Artificial Sequence
  chemically synthesized
catttcagtttaaataaagc

SEQ ID NO: 524355 - DNA, 20 bp, Artificial Sequence
  chemically synthesized
tttaccatttttgcagatat

SEQ ID NO: 524356 - DNA, 20 bp, Artificial Sequence
  chemically synthesized
cactttcactaacggtcctc

SEQ ID NO: 524357 - DNA, 20 bp, Artificial Sequence
  chemically synthesized
aaatcatcctttagagaata

SEQ ID NO: 524358 - DNA, 20 bp, Artificial Sequence
  chemically synthesized
atgcaattctgtattctcta

SEQ ID NO: 524359 - DNA, 20 bp, Artificial Sequence
  chemically synthesized
atatgaaaaatcatccttta

SEQ ID NO: 524360 - DNA, 20 bp, Artificial Sequence
  chemically synthesized
caattgctcagtcagaattg

SEQ ID NO: 524361 - DNA, 20 bp, Artificial Sequence
  chemically synthesized
ctcaatttcaattgctcagt

SEQ ID NO: 524362 - DNA, 20 bp, Artificial Sequence
  chemically synthesized
tatacagtagtcagttgaaa

SEQ ID NO: 524363 - DNA, 20 bp, Artificial Sequence
  chemically synthesized
gaaggtatttttaggaagtg

SEQ ID NO: 524364 - DNA, 20 bp, Artificial Sequence
  chemically synthesized
gtgcagagtacaggaaaaag

SEQ ID NO: 524365 - DNA, 20 bp, Artificial Sequence
  chemically synthesized
cctcccatattgctatttct

SEQ ID NO: 524366 - DNA, 20 bp, Artificial Sequence
  chemically synthesized
tagcaatatgggaggaaatt

SEQ ID NO: 524367 - DNA, 20 bp, Artificial Sequence
  chemically synthesized
aagacacctaatgctaaaag

SEQ ID NO: 524368 - DNA, 20 bp, Artificial Sequence
  chemically synthesized
aatttaatgacttcatgaat

SEQ ID NO: 524369 - DNA, 20 bp, Artificial Sequence
  chemically synthesized
atctccaatttaatgacttc

SEQ ID NO: 524370 - DNA, 20 bp, Artificial Sequence
  chemically synthesized
tatggaaatattattttcct

SEQ ID NO: 524371 - DNA, 20 bp, Artificial Sequence
  chemically synthesized
tagtgcttttgtcttcttta

SEQ ID NO: 524372 - DNA, 20 bp, Artificial Sequence
  chemically synthesized
gagaccagctagaaagataa

SEQ ID NO: 524373 - DNA, 20 bp, Artificial Sequence
  chemically synthesized
tagctggtctcatccactcc

SEQ ID NO: 524374 - DNA, 20 bp, Artificial Sequence
  chemically synthesized
ttaaatatgcaactcatgga

SEQ ID NO: 524375 - DNA, 20 bp, Artificial Sequence
  chemically synthesized
ggatttaaatatgcaactca

SEQ ID NO: 524376 - DNA, 20 bp, Artificial Sequence
  chemically synthesized
ctagaaatgaagtcattatt

SEQ ID NO: 524377 - DNA, 20 bp, Artificial Sequence
  chemically synthesized
tttgtatttttatgtagcgc

SEQ ID NO: 524378 - DNA, 20 bp, Artificial Sequence
  chemically synthesized
caacaggaaggattaggggt

SEQ ID NO: 524379 - DNA, 20 bp, Artificial Sequence
  chemically synthesized
ttggaacaacaggaaggatt

SEQ ID NO: 524380 - DNA, 20 bp, Artificial Sequence
  chemically synthesized
agggaaattggaacaacagg

SEQ ID NO: 524381 - DNA, 20 bp, Artificial Sequence
  chemically synthesized
tccatgaaatgcacacctgg

SEQ ID NO: 524382 - DNA, 20 bp, Artificial Sequence
  chemically synthesized
gtgctccatgaaatgcacac

SEQ ID NO: 524383 - DNA, 20 bp, Artificial Sequence
  chemically synthesized
gtatatgagatagaatcaat

SEQ ID NO: 524384 - DNA, 20 bp, Artificial Sequence
  chemically synthesized
ttcaagatttgtatatgaga

SEQ ID NO: 524385 - DNA, 20 bp, Artificial Sequence
  chemically synthesized
ttctatctcatatacaaatc

SEQ ID NO: 524386 - DNA, 20 bp, Artificial Sequence
  chemically synthesized
caaaagaaggtgatttggac

SEQ ID NO: 524387 - DNA, 20 bp, Artificial Sequence
  chemically synthesized
ctagtccaaatcaccttctt

SEQ ID NO: 524388 - DNA, 20 bp, Artificial Sequence
  chemically synthesized
gaaagagattggcaagtgcc

SEQ ID NO: 524389 - DNA, 20 bp, Artificial Sequence
  chemically synthesized
ccaatctctttcacacaaaa

SEQ ID NO: 524390 - DNA, 20 bp, Artificial Sequence
  chemically synthesized
taagatcaatggacagcctt

SEQ ID NO: 524391 - DNA, 20 bp, Artificial Sequence
  chemically synthesized
tttctataaccttcaaggct

SEQ ID NO: 524392 - DNA, 20 bp, Artificial Sequence
  chemically synthesized
cttgcatctgaatggccgac

SEQ ID NO: 524393 - DNA, 20 bp, Artificial Sequence
  chemically synthesized
agtgtggaacaagcttgcat

SEQ ID NO: 524394 - DNA, 20 bp, Artificial Sequence
  chemically synthesized
taaaacaagtacagctttcc

SEQ ID NO: 524395 - DNA, 20 bp, Artificial Sequence
  chemically synthesized
tgtcagagggagcaatgttt

SEQ ID NO: 524396 - DNA, 20 bp, Artificial Sequence
  chemically synthesized
aaggcaaagaagaatgaggt

SEQ ID NO: 524397 - DNA, 20 bp, Artificial Sequence
  chemically synthesized
atattcaaagcaaggcaaag

SEQ ID NO: 524398 - DNA, 20 bp, Artificial Sequence
  chemically synthesized
tcattcttctttgccttgct

SEQ ID NO: 524399 - DNA, 20 bp, Artificial Sequence
  chemically synthesized
taataagaatgtataatagg

SEQ ID NO: 524400 - DNA, 20 bp, Artificial Sequence
  chemically synthesized
aataaagcacacattgtaat

SEQ ID NO: 524401 - DNA, 20 bp, Artificial Sequence
  chemically synthesized
tgcattggagataagggcta

SEQ ID NO: 524402 - DNA, 20 bp, Artificial Sequence
  chemically synthesized
agagagactagcatttcaag

SEQ ID NO: 524403 - DNA, 20 bp, Artificial Sequence
  chemically synthesized
cttgaaatgctagtctctct

SEQ ID NO: 524404 - DNA, 20 bp, Artificial Sequence
  chemically synthesized
tctctttgagttcacttgtt

SEQ ID NO: 524405 - DNA, 20 bp, Artificial Sequence
  chemically synthesized
ccatgtaacaaatacacata

SEQ ID NO: 524406 - DNA, 20 bp, Artificial Sequence
  chemically synthesized
tgtatttgttacatggacaa

SEQ ID NO: 524407 - DNA, 20 bp, Artificial Sequence
  chemically synthesized
atggacaaatgaatcaataa

SEQ ID NO: 524408 - DNA, 20 bp, Artificial Sequence
  chemically synthesized
aaaacttgtattgtgtggtt

SEQ ID NO: 524409 - DNA, 20 bp, Artificial Sequence
  chemically synthesized
accacacaatacaagtttta

SEQ ID NO: 524410 - DNA, 20 bp, Artificial Sequence
  chemically synthesized
ttattttgatacttttattt

SEQ ID NO: 524411 - DNA, 20 bp, Artificial Sequence
  chemically synthesized
tttactttaaatgtctgaaa

SEQ ID NO: 524412 - DNA, 20 bp, Artificial Sequence
  chemically synthesized
ctctgacagcccattagaga

SEQ ID NO: 524413 - DNA, 20 bp, Artificial Sequence
  chemically synthesized
ggtgtgtacacctaatccaa

SEQ ID NO: 524414 - DNA, 20 bp, Artificial Sequence
  chemically synthesized
tgaagagctagaggattcct

SEQ ID NO: 524415 - DNA, 20 bp, Artificial Sequence
  chemically synthesized
gaacagctgctgaagagcta

SEQ ID NO: 524416 - DNA, 20 bp, Artificial Sequence
  chemically synthesized
cccttcagcgtctactaaat

SEQ ID NO: 524417 - DNA, 20 bp, Artificial Sequence
  chemically synthesized
acgggaagctcagacagctg

SEQ ID NO: 524418 - DNA, 20 bp, Artificial Sequence
  chemically synthesized
tcctagttattttgcaacat

SEQ ID NO: 524419 - DNA, 20 bp, Artificial Sequence
  chemically synthesized
ttttgcaacatgtgagtcat

SEQ ID NO: 524420 - DNA, 20 bp, Artificial Sequence
  chemically synthesized
aataataatctgtaaaaatg

SEQ ID NO: 524421 - DNA, 20 bp, Artificial Sequence
  chemically synthesized
acaaaatattaataaactag

SEQ ID NO: 524422 - DNA, 20 bp, Artificial Sequence
  chemically synthesized
tcttaagcaccaacataaaa

SEQ ID NO: 524423 - DNA, 20 bp, Artificial Sequence
  chemically synthesized
gtattttcatcaaaggcaaa

SEQ ID NO: 524424 - DNA, 20 bp, Artificial Sequence
  chemically synthesized
agaaagaaaaatcacaaaat

SEQ ID NO: 524425 - DNA, 20 bp, Artificial Sequence
  chemically synthesized
agtgctgacttaaagggcaa

SEQ ID NO: 524426 - DNA, 20 bp, Artificial Sequence
  chemically synthesized
ctgataaaggaagagacaag

SEQ ID NO: 524427 - DNA, 20 bp, Artificial Sequence
  chemically synthesized
caagttgagtgcaaataaag

SEQ ID NO: 524428 - DNA, 20 bp, Artificial Sequence
  chemically synthesized
tgcaaataaagatgagtgcc

SEQ ID NO: 524429 - DNA, 20 bp, Artificial Sequence
  chemically synthesized
gcttttggctaagactgtca

SEQ ID NO: 524430 - DNA, 20 bp, Artificial Sequence
  chemically synthesized
atgacagtcttagccaaaag

SEQ ID NO: 524431 - DNA, 20 bp, Artificial Sequence
  chemically synthesized
aacaaaacaaaagccaagaa

SEQ ID NO: 524432 - DNA, 20 bp, Artificial Sequence
  chemically synthesized
gaagagggtaaaaacattta

SEQ ID NO: 524433 - DNA, 20 bp, Artificial Sequence
  chemically synthesized
agagacttcgtgatatatat

SEQ ID NO: 524434 - DNA, 20 bp, Artificial Sequence
  chemically synthesized
acatgggcatatcaacaatg

SEQ ID NO: 524435 - DNA, 20 bp, Artificial Sequence
  chemically synthesized
aacttcaaaaaatcagatgc

SEQ ID NO: 524436 - DNA, 20 bp, Artificial Sequence
  chemically synthesized
atggcttaatgggttttgga

SEQ ID NO: 524437 - DNA, 20 bp, Artificial Sequence
  chemically synthesized
atgagaatgtagatggctta

SEQ ID NO: 524438 - DNA, 20 bp, Artificial Sequence
  chemically synthesized
gcttatccatgtaatgaaat

SEQ ID NO: 524439 - DNA, 20 bp, Artificial Sequence
  chemically synthesized
ctacattctcatttcattac

SEQ ID NO: 524440 - DNA, 20 bp, Artificial Sequence
  chemically synthesized
aaataaataactaaactaaa

SEQ ID NO: 524441 - DNA, 20 bp, Artificial Sequence
  chemically synthesized
tctaattgccatttgaataa

SEQ ID NO: 524442 - DNA, 20 bp, Artificial Sequence
  chemically synthesized
tatgtaggtctaattgccat

SEQ ID NO: 524443 - DNA, 20 bp, Artificial Sequence
  chemically synthesized
ctgaaatatatctaagactg

SEQ ID NO: 524444 - DNA, 20 bp, Artificial Sequence
  chemically synthesized
ttaaaaatgctagcaaattg

SEQ ID NO: 524445 - DNA, 20 bp, Artificial Sequence
  chemically synthesized
aatggtatgtaatcaaaata

SEQ ID NO: 524446 - DNA, 20 bp, Artificial Sequence
  chemically synthesized
tactgagttaaaaattctga

SEQ ID NO: 524447 - DNA, 20 bp, Artificial Sequence
  chemically synthesized
ttgttcttaaatgactcttt

SEQ ID NO: 524448 - DNA, 20 bp, Artificial Sequence
  chemically synthesized
caatgatcctttaattgaaa

SEQ ID NO: 524449 - DNA, 20 bp, Artificial Sequence
  chemically synthesized
tgacaactccatttcaatta

SEQ ID NO: 524450 - DNA, 20 bp, Artificial Sequence
  chemically synthesized
ctcactaatgggaactgggg

SEQ ID NO: 524451 - DNA, 20 bp, Artificial Sequence
  chemically synthesized
tcccccagttcccattagtg

SEQ ID NO: 524452 - DNA, 20 bp, Artificial Sequence
  chemically synthesized
cagttcccattagtgaggaa

SEQ ID NO: 524453 - DNA, 20 bp, Artificial Sequence
  chemically synthesized
aggaatggggttcataatga

SEQ ID NO: 524454 - DNA, 20 bp, Artificial Sequence
  chemically synthesized
aaaagatcacaaaagaaagc

SEQ ID NO: 524455 - DNA, 20 bp, Artificial Sequence
  chemically synthesized
aaaccaatgttcttagtagt

SEQ ID NO: 524456 - DNA, 20 bp, Artificial Sequence
  chemically synthesized
atcactcgttcaaaatactt

SEQ ID NO: 524457 - DNA, 20 bp, Artificial Sequence
  chemically synthesized
gaaattcccaagtattttga

SEQ ID NO: 524458 - DNA, 20 bp, Artificial Sequence
  chemically synthesized
attaaaataaagatcgagct

SEQ ID NO: 524459 - DNA, 20 bp, Artificial Sequence
  chemically synthesized
aataaagatcgagctcagag

SEQ ID NO: 524460 - DNA, 20 bp, Artificial Sequence
  chemically synthesized
ctgtttaggctgccatttta

SEQ ID NO: 524461 - DNA, 20 bp, Artificial Sequence
  chemically synthesized
aagatgtgagctataaaaga

SEQ ID NO: 524462 - DNA, 20 bp, Artificial Sequence
  chemically synthesized
ctgatctttgtgtttttaat

SEQ ID NO: 524463 - DNA, 20 bp, Artificial Sequence
  chemically synthesized
ttaaaaaaaaataaaataaa

SEQ ID NO: 524464 - DNA, 20 bp, Artificial Sequence
  chemically synthesized
cataggtaaacttgtgccat

SEQ ID NO: 524465 - DNA, 20 bp, Artificial Sequence
  chemically synthesized
atgggtactaggcttgatac

SEQ ID NO: 524466 - DNA, 20 bp, Artificial Sequence
  chemically synthesized
aggatcaggaaaagcaacta

SEQ ID NO: 524467 - DNA, 20 bp, Artificial Sequence
  chemically synthesized
gtagagggttggaggaggaa

SEQ ID NO: 524468 - DNA, 20 bp, Artificial Sequence
  chemically synthesized
ctggggcctttcggagggta

SEQ ID NO: 524469 - DNA, 20 bp, Artificial Sequence
  chemically synthesized
acacaccctggggcctttcg

SEQ ID NO: 524470 - DNA, 20 bp, Artificial Sequence
  chemically synthesized
ctctaccctccgaaaggccc

SEQ ID NO: 524471 - DNA, 20 bp, Artificial Sequence
  chemically synthesized
ctgataggcagcagacaaat

SEQ ID NO: 524472 - DNA, 20 bp, Artificial Sequence
  chemically synthesized
ctcatttgtctgctgcctat

SEQ ID NO: 524473 - DNA, 20 bp, Artificial Sequence
  chemically synthesized
ccccattcaagattacttcc

SEQ ID NO: 524474 - DNA, 20 bp, Artificial Sequence
  chemically synthesized
ccatattcaaggaagtaatc

SEQ ID NO: 524475 - DNA, 20 bp, Artificial Sequence
  chemically synthesized
ggaaacagaaaggctatgcc

SEQ ID NO: 524476 - DNA, 20 bp, Artificial Sequence
  chemically synthesized
atctggtttaagaaggcaca

SEQ ID NO: 524477 - DNA, 20 bp, Artificial Sequence
  chemically synthesized
cttggaactatatttagtat

SEQ ID NO: 524478 - DNA, 20 bp, Artificial Sequence
  chemically synthesized
taggagtgattcacaaatag

SEQ ID NO: 524479 - DNA, 20 bp, Artificial Sequence
  chemically synthesized
ggagagtaactctgctattt

SEQ ID NO: 524480 - DNA, 20 bp, Artificial Sequence
  chemically synthesized
ctgataaccccttcgaatgg

SEQ ID NO: 524481 - DNA, 20 bp, Artificial Sequence
  chemically synthesized
agagttactctcccattcga

SEQ ID NO: 524482 - DNA, 20 bp, Artificial Sequence
  chemically synthesized
cagagattctgataacccct

SEQ ID NO: 524483 - DNA, 20 bp, Artificial Sequence
  chemically synthesized
ctcccattcgaaggggttat

SEQ ID NO: 524484 - DNA, 20 bp, Artificial Sequence
  chemically synthesized
ccctctacttaatactaaaa

SEQ ID NO: 524485 - DNA, 20 bp, Artificial Sequence
  chemically synthesized
gagggagcttgaaattttgc

SEQ ID NO: 524486 - DNA, 20 bp, Artificial Sequence
  chemically synthesized
ttttctatttatgtcactta

SEQ ID NO: 524487 - DNA, 20 bp, Artificial Sequence
  chemically synthesized
ttattattttaccaagtttg

SEQ ID NO: 524488 - DNA, 20 bp, Artificial Sequence
  chemically synthesized
aagttaaaatggcaacacca

SEQ ID NO: 524489 - DNA, 20 bp, Artificial Sequence
  chemically synthesized
ataaaatattgacatatgtt

SEQ ID NO: 524490 - DNA, 20 bp, Artificial Sequence
  chemically synthesized
atctattagttagacttcct

SEQ ID NO: 524491 - DNA, 20 bp, Artificial Sequence
  chemically synthesized
catgaaaatatttccccttg

SEQ ID NO: 524492 - DNA, 20 bp, Artificial Sequence
  chemically synthesized
tcaaggcagttggttcgtat

SEQ ID NO: 524493 - DNA, 20 bp, Artificial Sequence
  chemically synthesized
aagaaaaccattgcctctct

SEQ ID NO: 524494 - DNA, 20 bp, Artificial Sequence
  chemically synthesized
tctctgaatccaatcaaaac

SEQ ID NO: 524495 - DNA, 20 bp, Artificial Sequence
  chemically synthesized
acagtacattcaggttttga

SEQ ID NO: 524496 - DNA, 20 bp, Artificial Sequence
  chemically synthesized
cacgccaaatcacaatgaca

SEQ ID NO: 524497 - DNA, 20 bp, Artificial Sequence
  chemically synthesized
gtgcagttatttgaaatata

SEQ ID NO: 524498 - DNA, 20 bp, Artificial Sequence
  chemically synthesized
aactgcaccgcctccattaa

SEQ ID NO: 524499 - DNA, 20 bp, Artificial Sequence
  chemically synthesized
ctttaatcaatgtatctttt

SEQ ID NO: 524500 - DNA, 20 bp, Artificial Sequence
  chemically synthesized
ttaaaagaatttataatggt

SEQ ID NO: 524501 - DNA, 20 bp, Artificial Sequence
  chemically synthesized
aatgcagattagagagttaa

SEQ ID NO: 524502 - DNA, 20 bp, Artificial Sequence
  chemically synthesized
cttttatttaatgcagatta

SEQ ID NO: 524503 - DNA, 20 bp, Artificial Sequence
  chemically synthesized
ttaagaaaaataatagaaaa

SEQ ID NO: 524504 - DNA, 20 bp, Artificial Sequence
  chemically synthesized
gggcctgaggttatacaatt

SEQ ID NO: 524505 - DNA, 20 bp, Artificial Sequence
  chemically synthesized
cacagaacgaaccaggaaga

SEQ ID NO: 524506 - DNA, 20 bp, Artificial Sequence
  chemically synthesized
tcgttctgtgttgtcagaca

SEQ ID NO: 524507 - DNA, 20 bp, Artificial Sequence
  chemically synthesized
taaacacacatcatttttta

SEQ ID NO: 524508 - DNA, 20 bp, Artificial Sequence
  chemically synthesized
cagggtataaagtttcctaa

SEQ ID NO: 524509 - DNA, 20 bp, Artificial Sequence
  chemically synthesized
gaaactttataccctgtgat

SEQ ID NO: 524510 - DNA, 20 bp, Artificial Sequence
  chemically synthesized
atttatatgcattcaaatca

SEQ ID NO: 524511 - DNA, 20 bp, Artificial Sequence
  chemically synthesized
aagaaacacagtattttggt

SEQ ID NO: 524512 - DNA, 20 bp, Artificial Sequence
  chemically synthesized
cttgtatgtgtgatgaaata

SEQ ID NO: 524513 - DNA, 20 bp, Artificial Sequence
  chemically synthesized
tttcatcaaaattttatctc

SEQ ID NO: 524514 - DNA, 20 bp, Artificial Sequence
  chemically synthesized
tttgatgaaagataataaaa

SEQ ID NO: 524515 - DNA, 20 bp, Artificial Sequence
  chemically synthesized
ttcatatgtagcaaatgaca

SEQ ID NO: 524516 - DNA, 20 bp, Artificial Sequence
  chemically synthesized
tagcaaatgacatggagtac

SEQ ID NO: 524517 - DNA, 20 bp, Artificial Sequence
  chemically synthesized
atggagtacagggatttcaa

SEQ ID NO: 524518 - DNA, 20 bp, Artificial Sequence
  chemically synthesized
ggatttcaaatgaatgctat

SEQ ID NO: 524519 - DNA, 20 bp, Artificial Sequence
  chemically synthesized
ttaatatctgtgcccaaatg

SEQ ID NO: 524520 - DNA, 20 bp, Artificial Sequence
  chemically synthesized
actattccagctagacagta

SEQ ID NO: 524521 - DNA, 20 bp, Artificial Sequence
  chemically synthesized
gcaattcagtactgtctagc

SEQ ID NO: 524522 - DNA, 20 bp, Artificial Sequence
  chemically synthesized
tgtagtctttttttaaagtt

SEQ ID NO: 524523 - DNA, 20 bp, Artificial Sequence
  chemically synthesized
taacattatgaaaaatacaa

SEQ ID NO: 524524 - DNA, 20 bp, Artificial Sequence
  chemically synthesized
accttttagaatttcatctg

SEQ ID NO: 524525 - DNA, 20 bp, Artificial Sequence
  chemically synthesized
ggtctaataaaatcaccttt

SEQ ID NO: 524526 - DNA, 20 bp, Artificial Sequence
  chemically synthesized
actgcaaatagacatttcat

SEQ ID NO: 524527 - DNA, 20 bp, Artificial Sequence
  chemically synthesized
gtctatttgcagtacactat

SEQ ID NO: 524528 - DNA, 20 bp, Artificial Sequence
  chemically synthesized
tactcaaataatgcattgta

SEQ ID NO: 524529 - DNA, 20 bp, Artificial Sequence
  chemically synthesized
aattctttacaatgcattat

SEQ ID NO: 524530 - DNA, 20 bp, Artificial Sequence
  chemically synthesized
catattgtattgttcacttt

SEQ ID NO: 524531 - DNA, 20 bp, Artificial Sequence
  chemically synthesized
caatacagtgatctctttta

SEQ ID NO: 524532 - DNA, 20 bp, Artificial Sequence
  chemically synthesized
aactacggcaaatttacaaa

SEQ ID NO: 524533 - DNA, 20 bp, Artificial Sequence
  chemically synthesized
gctacttggatgtttgacat

SEQ ID NO: 524534 - DNA, 20 bp, Artificial Sequence
  chemically synthesized
gtttgacaacatactgctac

SEQ ID NO: 524535 - DNA, 20 bp, Artificial Sequence
  chemically synthesized
atttaatgtataatatagcc

SEQ ID NO: 524536 - DNA, 20 bp, Artificial Sequence
  chemically synthesized
aatgcctatgcaacatgaca

SEQ ID NO: 524537 - DNA, 20 bp, Artificial Sequence
  chemically synthesized
tctttttgggacatgccctg

SEQ ID NO: 524538 - DNA, 20 bp, Artificial Sequence
  chemically synthesized
attacctttcttcgcattct

SEQ ID NO: 524539 - DNA, 20 bp, Artificial Sequence
  chemically synthesized
ttcaaataactttcaattct

SEQ ID NO: 524540 - DNA, 20 bp, Artificial Sequence
  chemically synthesized
ttctaagaattgaaagttat

SEQ ID NO: 524541 - DNA, 20 bp, Artificial Sequence
  chemically synthesized
tttgaatatctatgacaaag

SEQ ID NO: 524542 - DNA, 20 bp, Artificial Sequence
  chemically synthesized
tttaccttgcttaatttcag

SEQ ID NO: 524543 - DNA, 20 bp, Artificial Sequence
  chemically synthesized
agtatatagagcaattttga

SEQ ID NO: 524544 - DNA, 20 bp, Artificial Sequence
  chemically synthesized
tgtatatgatgttaattatg

SEQ ID NO: 524545 - DNA, 20 bp, Artificial Sequence
  chemically synthesized
aagttaacattgtccatgta

SEQ ID NO: 524546 - DNA, 20 bp, Artificial Sequence
  chemically synthesized
tgagggcaatgcctataatt

SEQ ID NO: 524547 - DNA, 20 bp, Artificial Sequence
  chemically synthesized
cattgccctcatatctattt

SEQ ID NO: 524548 - DNA, 20 bp, Artificial Sequence
  chemically synthesized
ccccacccatctttgacttg

SEQ ID NO: 524549 - DNA, 20 bp, Artificial Sequence
  chemically synthesized
ctacactccacaagtcaaag

SEQ ID NO: 524550 - DNA, 20 bp, Artificial Sequence
  chemically synthesized
actgtgtgtcccgaagagat

SEQ ID NO: 524551 - DNA, 20 bp, Artificial Sequence
  chemically synthesized
gaaagtcatgatgactaatg

SEQ ID NO: 524552 - DNA, 20 bp, Artificial Sequence
  chemically synthesized
ctttactactaaatataatt

SEQ ID NO: 524553 - DNA, 20 bp, Artificial Sequence
  chemically synthesized
tcaaatgatcagatgatttc

SEQ ID NO: 524554 - DNA, 20 bp, Artificial Sequence
  chemically synthesized
gagcatttgaaatagtaaat

SEQ ID NO: 524555 - DNA, 20 bp, Artificial Sequence
  chemically synthesized
tgagttgggacggataattg

SEQ ID NO: 524556 - DNA, 20 bp, Artificial Sequence
  chemically synthesized
aaagaataaaatgagttggg

SEQ ID NO: 524557 - DNA, 20 bp, Artificial Sequence
  chemically synthesized
tggataaaataaagaataaa

SEQ ID NO: 524558 - DNA, 20 bp, Artificial Sequence
  chemically synthesized
gacacatcatggataaaata

SEQ ID NO: 524559 - DNA, 20 bp, Artificial Sequence
  chemically synthesized
aaaagtttctctgacacatc

SEQ ID NO: 524560 - DNA, 20 bp, Artificial Sequence
  chemically synthesized
atacagtagttagttcaatt

SEQ ID NO: 524561 - DNA, 20 bp, Artificial Sequence
  chemically synthesized
ctgtgagatagtttgtatat

SEQ ID NO: 524562 - DNA, 20 bp, Artificial Sequence
  chemically synthesized
cactgcagtaatagaatatg

SEQ ID NO: 524563 - DNA, 20 bp, Artificial Sequence
  chemically synthesized
ttaacaaaccactgcagtaa

SEQ ID NO: 524564 - DNA, 20 bp, Artificial Sequence
  chemically synthesized
ggaaaacttttcaacagaaa

SEQ ID NO: 524565 - DNA, 20 bp, Artificial Sequence
  chemically synthesized
ccaatgaaaaatatatattc

SEQ ID NO: 524566 - DNA, 20 bp, Artificial Sequence
  chemically synthesized
atatatatatgtatttattc

SEQ ID NO: 524567 - DNA, 20 bp, Artificial Sequence
  chemically synthesized
gcaattaccttcggagaaaa

SEQ ID NO: 524568 - DNA, 20 bp, Artificial Sequence
  chemically synthesized
aaggtaattgcctcccagat

SEQ ID NO: 524569 - DNA, 20 bp, Artificial Sequence
  chemically synthesized
ctgagtcctgtagggggaaa

SEQ ID NO: 524570 - DNA, 20 bp, Artificial Sequence
  chemically synthesized
gaaagtgagtgatcccaaca

SEQ ID NO: 524571 - DNA, 20 bp, Artificial Sequence
  chemically synthesized
gtgagtgatcccaacactga

SEQ ID NO: 524572 - DNA, 20 bp, Artificial Sequence
  chemically synthesized
tgtgttgactcactcagtgt

SEQ ID NO: 524573 - DNA, 20 bp, Artificial Sequence
  chemically synthesized
gtcaacacagtaactgatgc

SEQ ID NO: 524574 - DNA, 20 bp, Artificial Sequence
  chemically synthesized
gaaatatccgggggcctcta

SEQ ID NO: 524575 - DNA, 20 bp, Artificial Sequence
  chemically synthesized
ccaggattctgtagaggccc

SEQ ID NO: 524576 - DNA, 20 bp, Artificial Sequence
  chemically synthesized
acttgcttgtgcgcaggtcc

SEQ ID NO: 524577 - DNA, 20 bp, Artificial Sequence
  chemically synthesized
aaaccaacttgagagagaag

SEQ ID NO: 524578 - DNA, 20 bp, Artificial Sequence
  chemically synthesized
cttccagcatggcaagctct

SEQ ID NO: 524579 - DNA, 20 bp, Artificial Sequence
  chemically synthesized
agaacacagttgagcattgt

SEQ ID NO: 524580 - DNA, 20 bp, Artificial Sequence
  chemically synthesized
gttctgattaatatccaaac

SEQ ID NO: 524581 - DNA, 20 bp, Artificial Sequence
  chemically synthesized
gtccactgtgctattctggt

SEQ ID NO: 524582 - DNA, 20 bp, Artificial Sequence
  chemically synthesized
agtattgttatgcttttgta

SEQ ID NO: 524583 - DNA, 20 bp, Artificial Sequence
  chemically synthesized
atactttctgtaactttcat

SEQ ID NO: 524584 - DNA, 20 bp, Artificial Sequence
  chemically synthesized
ttattaacagagcagaaaat

SEQ ID NO: 524585 - DNA, 20 bp, Artificial Sequence
  chemically synthesized
tttaaaagtcaattttgaat

SEQ ID NO: 524586 - DNA, 20 bp, Artificial Sequence
  chemically synthesized
aaggcatttaaaagtcaatt

SEQ ID NO: 524587 - DNA, 20 bp, Artificial Sequence
  chemically synthesized
gaaatttttggtgttgttga

SEQ ID NO: 524588 - DNA, 20 bp, Artificial Sequence
  chemically synthesized
gggcattcctttttatttgg

SEQ ID NO: 524589 - DNA, 20 bp, Artificial Sequence
  chemically synthesized
tttcactctaccaaataaaa

SEQ ID NO: 524590 - DNA, 20 bp, Artificial Sequence
  chemically synthesized
accaaataaaaaggaatgcc

SEQ ID NO: 524591 - DNA, 20 bp, Artificial Sequence
  chemically synthesized
agtggatacataacaaatgc

SEQ ID NO: 524592 - DNA, 20 bp, Artificial Sequence
  chemically synthesized
aaaaataactttggtagaca

SEQ ID NO: 524593 - DNA, 20 bp, Artificial Sequence
  chemically synthesized
ccaaagttattttttcccct

SEQ ID NO: 524594 - DNA, 20 bp, Artificial Sequence
  chemically synthesized
catcaatacataacttttga

SEQ ID NO: 524595 - DNA, 20 bp, Artificial Sequence
  chemically synthesized
gtattgatgatgccaacagt

SEQ ID NO: 524596 - DNA, 20 bp, Artificial Sequence
  chemically synthesized
ctgaataagagaagcagcag

SEQ ID NO: 524597 - DNA, 20 bp, Artificial Sequence
  chemically synthesized
gcagcagcagaatgcagcag

SEQ ID NO: 524598 - DNA, 20 bp, Artificial Sequence
  chemically synthesized
cagcagctgaattctgaagg

SEQ ID NO: 524599 - DNA, 20 bp, Artificial Sequence
  chemically synthesized
acacacacacattctgcctt

SEQ ID NO: 524600 - DNA, 20 bp, Artificial Sequence
  chemically synthesized
catgttttcctgctaaaata

SEQ ID NO: 524601 - DNA, 20 bp, Artificial Sequence
  chemically synthesized
aaatttctttcctgcattat

SEQ ID NO: 524602 - DNA, 20 bp, Artificial Sequence
  chemically synthesized
cataattcacaactgaaatt

SEQ ID NO: 524603 - DNA, 20 bp, Artificial Sequence
  chemically synthesized
tcaaatcctaaatttcagtt

SEQ ID NO: 524604 - DNA, 20 bp, Artificial Sequence
  chemically synthesized
ggcaccagagaaatggaaga

SEQ ID NO: 524605 - DNA, 20 bp, Artificial Sequence
  chemically synthesized
gtctaaaaaaatggtgtttt

SEQ ID NO: 524606 - DNA, 20 bp, Artificial Sequence
  chemically synthesized
aaacaccatttttttagaca

SEQ ID NO: 524607 - DNA, 20 bp, Artificial Sequence
  chemically synthesized
ttaatgatcatttaatggtt

SEQ ID NO: 524608 - DNA, 20 bp, Artificial Sequence
  chemically synthesized
aggcttgttttctgtattaa

SEQ ID NO: 524609 - DNA, 20 bp, Artificial Sequence
  chemically synthesized
ggcaaagaatgatttacatg

SEQ ID NO: 524610 - DNA, 20 bp, Artificial Sequence
  chemically synthesized
gaagaagctttctattggca

SEQ ID NO: 524611 - DNA, 20 bp, Artificial Sequence
  chemically synthesized
gggattattataactataaa

SEQ ID NO: 524612 - DNA, 20 bp, Artificial Sequence
  chemically synthesized
actcaaacaaaaattttagt

SEQ ID NO: 524613 - DNA, 20 bp, Artificial Sequence
  chemically synthesized
atccctactaaaatttttgt

SEQ ID NO: 524614 - DNA, 20 bp, Artificial Sequence
  chemically synthesized
tgaatgtttgacatagaaaa

SEQ ID NO: 524615 - DNA, 20 bp, Artificial Sequence
  chemically synthesized
ctcattgcagtcgcaagcag

SEQ ID NO: 524616 - DNA, 20 bp, Artificial Sequence
  chemically synthesized
ttcaactgcttgcgactgca

SEQ ID NO: 524617 - DNA, 20 bp, Artificial Sequence
  chemically synthesized
agataaaaattaaaaaaata

SEQ ID NO: 524618 - DNA, 20 bp, Artificial Sequence
  chemically synthesized
taattgtacattttgtgttt

SEQ ID NO: 524619 - DNA, 20 bp, Artificial Sequence
  chemically synthesized
aaaggaggtgacctagggaa

SEQ ID NO: 524620 - DNA, 20 bp, Artificial Sequence
  chemically synthesized
ctgtgaggtacaatattgcc

SEQ ID NO: 524621 - DNA, 20 bp, Artificial Sequence
  chemically synthesized
tgccctttgtatcttgcact

SEQ ID NO: 524622 - DNA, 20 bp, Artificial Sequence
  chemically synthesized
attcacgccttggcctaaac

SEQ ID NO: 524623 - DNA, 20 bp, Artificial Sequence
  chemically synthesized
acccttgtttaggccaaggc

SEQ ID NO: 524624 - DNA, 20 bp, Artificial Sequence
  chemically synthesized
acctcaaaagtcagaaattc

SEQ ID NO: 524625 - DNA, 20 bp, Artificial Sequence
  chemically synthesized
agagtgctgtgtcccaaccc

SEQ ID NO: 524626 - DNA, 20 bp, Artificial Sequence
  chemically synthesized
ttagaatcaccggtaaaaca

SEQ ID NO: 524627 - DNA, 20 bp, Artificial Sequence
  chemically synthesized
tctcaaagttgaccatgcat

SEQ ID NO: 524628 - DNA, 20 bp, Artificial Sequence
  chemically synthesized
gtttttagaaacatacactt

SEQ ID NO: 524629 - DNA, 20 bp, Artificial Sequence
  chemically synthesized
aaatgtaacaaagatgtgtc

SEQ ID NO: 524630 - DNA, 20 bp, Artificial Sequence
  chemically synthesized
agcaccaaatcctgatagat

SEQ ID NO: 524631 - DNA, 20 bp, Artificial Sequence
  chemically synthesized
ctcagggcattcagatctat

SEQ ID NO: 524632 - DNA, 20 bp, Artificial Sequence
  chemically synthesized
attctgattatcaactaagg

SEQ ID NO: 524633 - DNA, 20 bp, Artificial Sequence
  chemically synthesized
attcagccttagttgataat

SEQ ID NO: 524634 - DNA, 20 bp, Artificial Sequence
  chemically synthesized
ataatgatttctgcattgtg

SEQ ID NO: 524635 - DNA, 20 bp, Artificial Sequence
  chemically synthesized
ttgtaagcatatatttgcac

SEQ ID NO: 524636 - DNA, 20 bp, Artificial Sequence
  chemically synthesized
tgtggtgacacagtctgaac

SEQ ID NO: 524637 - DNA, 20 bp, Artificial Sequence
  chemically synthesized
tatctttctcctttagtcct

SEQ ID NO: 524638 - DNA, 20 bp, Artificial Sequence
  chemically synthesized
tccatttttaataactgtca

SEQ ID NO: 524639 - DNA, 20 bp, Artificial Sequence
  chemically synthesized
tcaaatacttatagattcac

SEQ ID NO: 524640 - DNA, 20 bp, Artificial Sequence
  chemically synthesized
tactatccccgcaaattcct

SEQ ID NO: 524641 - DNA, 20 bp, Artificial Sequence
  chemically synthesized
atagattcacaggaatttgc

SEQ ID NO: 524642 - DNA, 20 bp, Artificial Sequence
  chemically synthesized
gaaactgggtgaagggtaca

SEQ ID NO: 524643 - DNA, 20 bp, Artificial Sequence
  chemically synthesized
tctttgggagaaactgggtg

SEQ ID NO: 524644 - DNA, 20 bp, Artificial Sequence
  chemically synthesized
tagttaatctttgggagaaa

SEQ ID NO: 524645 - DNA, 20 bp, Artificial Sequence
  chemically synthesized
attgtagttattgtaggata

SEQ ID NO: 524646 - DNA, 20 bp, Artificial Sequence
  chemically synthesized
atactgaattgtagttattg

SEQ ID NO: 524647 - DNA, 20 bp, Artificial Sequence
  chemically synthesized
tcagtttcctggttttgata

SEQ ID NO: 524648 - DNA, 20 bp, Artificial Sequence
  chemically synthesized
ggtgactgttgtgactgtaa

SEQ ID NO: 524649 - DNA, 20 bp, Artificial Sequence
  chemically synthesized
aggctttagggatatttagg

SEQ ID NO: 524650 - DNA, 20 bp, Artificial Sequence
  chemically synthesized
attgattggtaccaggcttt

SEQ ID NO: 524651 - DNA, 20 bp, Artificial Sequence
  chemically synthesized
cactgtaattttgtcatttt

SEQ ID NO: 524652 - DNA, 20 bp, Artificial Sequence
  chemically synthesized
caatctcaaaaggttacata

SEQ ID NO: 524653 - DNA, 20 bp, Artificial Sequence
  chemically synthesized
acttaaatggatctcaagta

SEQ ID NO: 524654 - DNA, 20 bp, Artificial Sequence
  chemically synthesized
agctattgatgacaacttaa

SEQ ID NO: 524655 - DNA, 20 bp, Artificial Sequence
  chemically synthesized
tagcttatttccttttattg

SEQ ID NO: 524656 - DNA, 20 bp, Artificial Sequence
  chemically synthesized
gctgagtagtagttcatggc

SEQ ID NO: 524657 - DNA, 20 bp, Artificial Sequence
  chemically synthesized
gttactttattcacatactg

SEQ ID NO: 524658 - DNA, 20 bp, Artificial Sequence
  chemically synthesized
acgaaaatatcccacagtat

SEQ ID NO: 524659 - DNA, 20 bp, Artificial Sequence
  chemically synthesized
tgggatattttcgttgtttc

SEQ ID NO: 524660 - DNA, 20 bp, Artificial Sequence
  chemically synthesized
actctgggacatgaatctag

SEQ ID NO: 524661 - DNA, 20 bp, Artificial Sequence
  chemically synthesized
attcctctagattcatgtcc

SEQ ID NO: 524662 - DNA, 20 bp, Artificial Sequence
  chemically synthesized
ttataaccacactctgggac

SEQ ID NO: 524663 - DNA, 20 bp, Artificial Sequence
  chemically synthesized
ataatttaccatataaattt

SEQ ID NO: 524664 - DNA, 20 bp, Artificial Sequence
  chemically synthesized
tagatctacagatctatcta

SEQ ID NO: 524665 - DNA, 20 bp, Artificial Sequence
  chemically synthesized
tctacagaatatctttcagg

SEQ ID NO: 524666 - DNA, 20 bp, Artificial Sequence
  chemically synthesized
ctttcaggtagaattttgat

SEQ ID NO: 524667 - DNA, 20 bp, Artificial Sequence
  chemically synthesized
ataggaattgcattaaaatt

SEQ ID NO: 524668 - DNA, 20 bp, Artificial Sequence
  chemically synthesized
aaattatgaatacattttgg

SEQ ID NO: 524669 - DNA, 20 bp, Artificial Sequence
  chemically synthesized
gtactatgttaatgaattgg

SEQ ID NO: 524670 - DNA, 20 bp, Artificial Sequence
  chemically synthesized
tggacatatgtactatgtta

SEQ ID NO: 524671 - DNA, 20 bp, Artificial Sequence
  chemically synthesized
caaagcactgtgtaaaaaag

SEQ ID NO: 524672 - DNA, 20 bp, Artificial Sequence
  chemically synthesized
gcacaaaaaaaggaaaacag

SEQ ID NO: 524673 - DNA, 20 bp, Artificial Sequence
  chemically synthesized
caaaaacaaacaggaaaaga

SEQ ID NO: 524674 - DNA, 20 bp, Artificial Sequence
  chemically synthesized
gcttgctctgtcatccaggc

SEQ ID NO: 524675 - DNA, 20 bp, Artificial Sequence
  chemically synthesized
ttgtgtcgctacactccagc

SEQ ID NO: 524676 - DNA, 20 bp, Artificial Sequence
  chemically synthesized
caggaggatcacttgagccc

SEQ ID NO: 524677 - DNA, 20 bp, Artificial Sequence
  chemically synthesized
tactcagaagattgaggcag

SEQ ID NO: 524678 - DNA, 20 bp, Artificial Sequence
  chemically synthesized
gatcctcctgcctcaatctt

SEQ ID NO: 524679 - DNA, 20 bp, Artificial Sequence
  chemically synthesized
tgcctcaatcttctgagtag

SEQ ID NO: 524680 - DNA, 20 bp, Artificial Sequence
  chemically synthesized
ctgagtagctgggtctacag

SEQ ID NO: 524681 - DNA, 20 bp, Artificial Sequence
  chemically synthesized
taaaaaaaatattaaattag

SEQ ID NO: 524682 - DNA, 20 bp, Artificial Sequence
  chemically synthesized
tttaatattttttttagaga

SEQ ID NO: 524683 - DNA, 20 bp, Artificial Sequence
  chemically synthesized
tcctggggaggctgaggcag

SEQ ID NO: 524684 - DNA, 20 bp, Artificial Sequence
  chemically synthesized
gcctcagcctccccaggagc

SEQ ID NO: 524685 - DNA, 20 bp, Artificial Sequence
  chemically synthesized
tgcttctttttacaaactgg

SEQ ID NO: 524686 - DNA, 20 bp, Artificial Sequence
  chemically synthesized
tcaagaagtgtctgttcagg

SEQ ID NO: 524687 - DNA, 20 bp, Artificial Sequence
  chemically synthesized
gcctcaacttctcaaagtaa

SEQ ID NO: 524688 - DNA, 20 bp, Artificial Sequence
  chemically synthesized
aggcagatcgctttgagctc

SEQ ID NO: 524689 - DNA, 20 bp, Artificial Sequence
  chemically synthesized
ggctgtattttttttagaga

SEQ ID NO: 524690 - DNA, 20 bp, Artificial Sequence
  chemically synthesized
gattctccagcctcagcctc

SEQ ID NO: 524691 - DNA, 20 bp, Artificial Sequence
  chemically synthesized
cactcaggaggctgaggctg

SEQ ID NO: 524692 - DNA, 20 bp, Artificial Sequence
  chemically synthesized
ttttttttttttttttgaga

SEQ ID NO: 524693 - DNA, 20 bp, Artificial Sequence
  chemically synthesized
atatactttgcccattttta

SEQ ID NO: 524694 - DNA, 20 bp, Artificial Sequence
  chemically synthesized
atttaagtttcttatagatt

SEQ ID NO: 524695 - DNA, 20 bp, Artificial Sequence
  chemically synthesized
tctgacaaaggcctagtatc

SEQ ID NO: 524696 - DNA, 20 bp, Artificial Sequence
  chemically synthesized
ctttgtcagatgcatatttt

SEQ ID NO: 524697 - DNA, 20 bp, Artificial Sequence
  chemically synthesized
atcaacaaagtaaacagacg

SEQ ID NO: 524698 - DNA, 20 bp, Artificial Sequence
  chemically synthesized
tttttacattggtcttggca

SEQ ID NO: 524699 - DNA, 20 bp, Artificial Sequence
  chemically synthesized
ttgccaagaccaatgtaaaa

SEQ ID NO: 524700 - DNA, 20 bp, Artificial Sequence
  chemically synthesized
gtacttcctaggttttcttc

SEQ ID NO: 524701 - DNA, 20 bp, Artificial Sequence
  chemically synthesized
agttttcccagcaccatcta

SEQ ID NO: 524702 - DNA, 20 bp, Artificial Sequence
  chemically synthesized
ataggtgtgtcgctttgttt

SEQ ID NO: 524703 - DNA, 20 bp, Artificial Sequence
  chemically synthesized
cagaccatagaccaatggaa

SEQ ID NO: 524704 - DNA, 20 bp, Artificial Sequence
  chemically synthesized
ttgtaccagtaccatgctgt

SEQ ID NO: 524705 - DNA, 20 bp, Artificial Sequence
  chemically synthesized
ccaaagcaatcttaagctaa

SEQ ID NO: 524706 - DNA, 20 bp, Artificial Sequence
  chemically synthesized
tcttttggttccatacaaat

SEQ ID NO: 524707 - DNA, 20 bp, Artificial Sequence
  chemically synthesized
gtagtttgataagattagca

SEQ ID NO: 524708 - DNA, 20 bp, Artificial Sequence
  chemically synthesized
atttcatgctcttggattgg

SEQ ID NO: 524709 - DNA, 20 bp, Artificial Sequence
  chemically synthesized
atgcaaaacatttcatgctc

SEQ ID NO: 524710 - DNA, 20 bp, Artificial Sequence
  chemically synthesized
ttagctgcatggtcatgaaa

SEQ ID NO: 524711 - DNA, 20 bp, Artificial Sequence
  chemically synthesized
atcatgtactttgcagcaag

SEQ ID NO: 524712 - DNA, 20 bp, Artificial Sequence
  chemically synthesized
tgttcctgtgttaatttgca

SEQ ID NO: 524713 - DNA, 20 bp, Artificial Sequence
  chemically synthesized
ttataaatgggagcaaaaca

SEQ ID NO: 524714 - DNA, 20 bp, Artificial Sequence
  chemically synthesized
atactggggactactagagg

SEQ ID NO: 524715 - DNA, 20 bp, Artificial Sequence
  chemically synthesized
tagagggggaatggagggaa

SEQ ID NO: 524716 - DNA, 20 bp, Artificial Sequence
  chemically synthesized
gtgagctgaaaaactaccta

SEQ ID NO: 524717 - DNA, 20 bp, Artificial Sequence
  chemically synthesized
ctgggtacaatgctcactac

SEQ ID NO: 524718 - DNA, 20 bp, Artificial Sequence
  chemically synthesized
aatgctcactacctgggtga

SEQ ID NO: 524719 - DNA, 20 bp, Artificial Sequence
  chemically synthesized
tattgtgtgatgtggaggtt

SEQ ID NO: 524720 - DNA, 20 bp, Artificial Sequence
  chemically synthesized
tgaatcgggggtacatgttc

SEQ ID NO: 524721 - DNA, 20 bp, Artificial Sequence
  chemically synthesized
ttcaactttcattttgaatc

SEQ ID NO: 524722 - DNA, 20 bp, Artificial Sequence
  chemically synthesized
aaataatttcaactttcatt

SEQ ID NO: 524723 - DNA, 20 bp, Artificial Sequence
  chemically synthesized
gaaattacaattgtttacag

SEQ ID NO: 524724 - DNA, 20 bp, Artificial Sequence
  chemically synthesized
agtaatttaaaaaaatgtgt

SEQ ID NO: 524725 - DNA, 20 bp, Artificial Sequence
  chemically synthesized
caaggatgactggttaatat

SEQ ID NO: 524726 - DNA, 20 bp, Artificial Sequence
  chemically synthesized
tgccatctatttaataacac

SEQ ID NO: 524727 - DNA, 20 bp, Artificial Sequence
  chemically synthesized
ggcatattaattagaaagaa

SEQ ID NO: 524728 - DNA, 20 bp, Artificial Sequence
  chemically synthesized
tggtaaacgtaaagtgaaca

SEQ ID NO: 524729 - DNA, 20 bp, Artificial Sequence
  chemically synthesized
tttagggtttccaattattt

SEQ ID NO: 524730 - DNA, 20 bp, Artificial Sequence
  chemically synthesized
gtaatataaaataatgcctt

SEQ ID NO: 524731 - DNA, 20 bp, Artificial Sequence
  chemically synthesized
tttatattactttggaagtg

SEQ ID NO: 524732 - DNA, 20 bp, Artificial Sequence
  chemically synthesized
gctgcattaatcataatgct

SEQ ID NO: 524733 - DNA, 20 bp, Artificial Sequence
  chemically synthesized
tttccctaatcaataaattt

SEQ ID NO: 524734 - DNA, 20 bp, Artificial Sequence
  chemically synthesized
tgattagggaaaaaatcatt

SEQ ID NO: 524735 - DNA, 20 bp, Artificial Sequence
  chemically synthesized
tgggtaacatttcaaccaat

SEQ ID NO: 524736 - DNA, 20 bp, Artificial Sequence
  chemically synthesized
agaaatatatgccttataat

SEQ ID NO: 524737 - DNA, 20 bp, Artificial Sequence
  chemically synthesized
atgggaaaatatgctagttt

SEQ ID NO: 524738 - DNA, 20 bp, Artificial Sequence
  chemically synthesized
gaaaatatgctagtttgtga

SEQ ID NO: 524739 - DNA, 20 bp, Artificial Sequence
  chemically synthesized
accagaaaaaataagacaaa

SEQ ID NO: 524740 - DNA, 20 bp, Artificial Sequence
  chemically synthesized
ttggacaccctccaaattgc

SEQ ID NO: 524741 - DNA, 20 bp, Artificial Sequence
  chemically synthesized
aatagaattcaagcaatttg

SEQ ID NO: 524742 - DNA, 20 bp, Artificial Sequence
  chemically synthesized
tgtttcactgatgttttgat

SEQ ID NO: 524743 - DNA, 20 bp, Artificial Sequence
  chemically synthesized
ttccaaaactaatctatagt

SEQ ID NO: 524744 - DNA, 20 bp, Artificial Sequence
  chemically synthesized
aaactatagattagttttgg

SEQ ID NO: 524745 - DNA, 20 bp, Artificial Sequence
  chemically synthesized
atactgtattaatggaattg

SEQ ID NO: 524746 - DNA, 20 bp, Artificial Sequence
  chemically synthesized
ggagatatatactgtattaa

SEQ ID NO: 524747 - DNA, 20 bp, Artificial Sequence
  chemically synthesized
tctgaaacaatgaaatactt

SEQ ID NO: 524748 - DNA, 20 bp, Artificial Sequence
  chemically synthesized
tcataagtatttcattgttt

SEQ ID NO: 524749 - DNA, 20 bp, Artificial Sequence
  chemically synthesized
aagatactatgtgaaaaatt

SEQ ID NO: 524750 - DNA, 20 bp, Artificial Sequence
  chemically synthesized
ataatttaagaatctgttcg

SEQ ID NO: 524751 - DNA, 20 bp, Artificial Sequence
  chemically synthesized
acaatacagcattataattt

SEQ ID NO: 524752 - DNA, 20 bp, Artificial Sequence
  chemically synthesized
tgaagtttcatttatataag

SEQ ID NO: 524753 - DNA, 20 bp, Artificial Sequence
  chemically synthesized
taaaagtcaattgctaatca

SEQ ID NO: 524754 - DNA, 20 bp, Artificial Sequence
  chemically synthesized
tgatgagtttgttaaggtct

SEQ ID NO: 524755 - DNA, 20 bp, Artificial Sequence
  chemically synthesized
ttaacaaactcatcatttct

SEQ ID NO: 524756 - DNA, 20 bp, Artificial Sequence
  chemically synthesized
caaagttactcttagaaatg

SEQ ID NO: 524757 - DNA, 20 bp, Artificial Sequence
  chemically synthesized
catttctaagagtaactttg

SEQ ID NO: 524758 - DNA, 20 bp, Artificial Sequence
  chemically synthesized
gagtaactttgtagaatacc

SEQ ID NO: 524759 - DNA, 20 bp, Artificial Sequence
  chemically synthesized
agtgtaaaaatgcaagaaaa

SEQ ID NO: 524760 - DNA, 20 bp, Artificial Sequence
  chemically synthesized
tagctagaacttccagtact

SEQ ID NO: 524761 - DNA, 20 bp, Artificial Sequence
  chemically synthesized
tacacctttcttcctaatat

SEQ ID NO: 524762 - DNA, 20 bp, Artificial Sequence
  chemically synthesized
taacattgtaataataatga

SEQ ID NO: 524763 - DNA, 20 bp, Artificial Sequence
  chemically synthesized
agaacgtcctcaacttggaa

SEQ ID NO: 524764 - DNA, 20 bp, Artificial Sequence
  chemically synthesized
cttttatcataaatggggca

SEQ ID NO: 524765 - DNA, 20 bp, Artificial Sequence
  chemically synthesized
attatattaagaagctaaag

SEQ ID NO: 524766 - DNA, 20 bp, Artificial Sequence
  chemically synthesized
ggctttttgtctctatatcc

SEQ ID NO: 524767 - DNA, 20 bp, Artificial Sequence
  chemically synthesized
attacagaccaataaaactc

SEQ ID NO: 524768 - DNA, 20 bp, Artificial Sequence
  chemically synthesized
aaaccaggtaagcacagtag

SEQ ID NO: 524769 - DNA, 20 bp, Artificial Sequence
  chemically synthesized
gcaaaaaagttcaaatggca

SEQ ID NO: 524770 - DNA, 20 bp, Artificial Sequence
  chemically synthesized
tgactatgatgcgtctaagc

SEQ ID NO: 524771 - DNA, 20 bp, Artificial Sequence
  chemically synthesized
gcgtctaagcatgagtttct

SEQ ID NO: 524772 - DNA, 20 bp, Artificial Sequence
  chemically synthesized
gattcaaggagctgagtata

SEQ ID NO: 524773 - DNA, 20 bp, Artificial Sequence
  chemically synthesized
tatcctgtatactcagctcc

SEQ ID NO: 524774 - DNA, 20 bp, Artificial Sequence
  chemically synthesized
aaccctacagattcaaggag

SEQ ID NO: 524775 - DNA, 20 bp, Artificial Sequence
  chemically synthesized
tactcagctccttgaatctg

SEQ ID NO: 524776 - DNA, 20 bp, Artificial Sequence
  chemically synthesized
atttttcaatcattatgtgc

SEQ ID NO: 524777 - DNA, 20 bp, Artificial Sequence
  chemically synthesized
ccatcagagtttcaaaaagg

SEQ ID NO: 524778 - DNA, 20 bp, Artificial Sequence
  chemically synthesized
agatctacggtttatgccat

SEQ ID NO: 524779 - DNA, 20 bp, Artificial Sequence
  chemically synthesized
aaatattctcagttgtccta

SEQ ID NO: 524780 - DNA, 20 bp, Artificial Sequence
  chemically synthesized
tataatcccataggacaact

SEQ ID NO: 524781 - DNA, 20 bp, Artificial Sequence
  chemically synthesized
tcaataaatggtctcaacag

SEQ ID NO: 524782 - DNA, 20 bp, Artificial Sequence
  chemically synthesized
aaagcttactcaacaatttt

SEQ ID NO: 524783 - DNA, 20 bp, Artificial Sequence
  chemically synthesized
agtagccatcccgaaaattg

SEQ ID NO: 524784 - DNA, 20 bp, Artificial Sequence
  chemically synthesized
agatgacagaattatctagc

SEQ ID NO: 524785 - DNA, 20 bp, Artificial Sequence
  chemically synthesized
tactgacatgacaaagatga

SEQ ID NO: 524786 - DNA, 20 bp, Artificial Sequence
  chemically synthesized
ccaaaaaagaaaatctcaac

SEQ ID NO: 524787 - DNA, 20 bp, Artificial Sequence
  chemically synthesized
agattttcttttttggcatt

SEQ ID NO: 524788 - DNA, 20 bp, Artificial Sequence
  chemically synthesized
ggatattacattatcagact

SEQ ID NO: 524789 - DNA, 20 bp, Artificial Sequence
  chemically synthesized
aaatagatttaaataagatc

SEQ ID NO: 524790 - DNA, 20 bp, Artificial Sequence
  chemically synthesized
gtgctgccttattgccaggt

SEQ ID NO: 524791 - DNA, 20 bp, Artificial Sequence
  chemically synthesized
tctaaagtatcaaccataga

SEQ ID NO: 524792 - DNA, 20 bp, Artificial Sequence
  chemically synthesized
atctacttactaattttaaa

SEQ ID NO: 524793 - DNA, 20 bp, Artificial Sequence
  chemically synthesized
aagtagatatctggaacctt

SEQ ID NO: 524794 - DNA, 20 bp, Artificial Sequence
  chemically synthesized
gcttcattgtctatggaaat

SEQ ID NO: 524795 - DNA, 20 bp, Artificial Sequence
  chemically synthesized
tcctgaaatcacatcgttat

SEQ ID NO: 524796 - DNA, 20 bp, Artificial Sequence
  chemically synthesized
ctacatatcagtactatcta

SEQ ID NO: 524797 - DNA, 20 bp, Artificial Sequence
  chemically synthesized
acaacacaggcaaattagtt

SEQ ID NO: 524798 - DNA, 20 bp, Artificial Sequence
  chemically synthesized
aaataatgactcctcacttt

SEQ ID NO: 524799 - DNA, 20 bp, Artificial Sequence
  chemically synthesized
gggaatcaatccacaaagtg

SEQ ID NO: 524800 - DNA, 20 bp, Artificial Sequence
  chemically synthesized
atttacctcataaaacagtt

SEQ ID NO: 524801 - DNA, 20 bp, Artificial Sequence
  chemically synthesized
gttttatgaggtaaatgtac

SEQ ID NO: 524802 - DNA, 20 bp, Artificial Sequence
  chemically synthesized
atgaagatttttaaagattt

SEQ ID NO: 524803 - DNA, 20 bp, Artificial Sequence
  chemically synthesized
ctgaatgtaagaaaggtatt

SEQ ID NO: 524804 - DNA, 20 bp, Artificial Sequence
  chemically synthesized
tgcattgatgctagtgagct

SEQ ID NO: 524805 - DNA, 20 bp, Artificial Sequence
  chemically synthesized
tttaatagttgtatctctta

SEQ ID NO: 524806 - DNA, 20 bp, Artificial Sequence
  chemically synthesized
ctgctacctatatttcctac

SEQ ID NO: 524807 - DNA, 20 bp, Artificial Sequence
  chemically synthesized
ttattatctgttaaatgctt

SEQ ID NO: 524808 - DNA, 20 bp, Artificial Sequence
  chemically synthesized
gtttgtccatagttctttca

SEQ ID NO: 524809 - DNA, 20 bp, Artificial Sequence
  chemically synthesized
caggctgatgagaacaaata

SEQ ID NO: 524810 - DNA, 20 bp, Artificial Sequence
  chemically synthesized
atgagaacaaataagggatg

SEQ ID NO: 524811 - DNA, 20 bp, Artificial Sequence
  chemically synthesized
ggcctaatatgtcaaggtaa

SEQ ID NO: 524812 - DNA, 20 bp, Artificial Sequence
  chemically synthesized
tcaaggtaaaggaataatgt

SEQ ID NO: 524813 - DNA, 20 bp, Artificial Sequence
  chemically synthesized
agggcaagggaaaaaaaggt

SEQ ID NO: 524814 - DNA, 20 bp, Artificial Sequence
  chemically synthesized
ccagggcaaaaaacagggca

SEQ ID NO: 524815 - DNA, 20 bp, Artificial Sequence
  chemically synthesized
acagggcagagaattgcaaa

SEQ ID NO: 524816 - DNA, 20 bp, Artificial Sequence
  chemically synthesized
gcaaaatgggtgtggtagcg

SEQ ID NO: 524817 - DNA, 20 bp, Artificial Sequence
  chemically synthesized
cactgccactaatacaactg

SEQ ID NO: 524818 - DNA, 20 bp, Artificial Sequence
  chemically synthesized
ccatccaagactgaaatggt

SEQ ID NO: 524819 - DNA, 20 bp, Artificial Sequence
  chemically synthesized
tcacccctaccatttcagtc

SEQ ID NO: 524820 - DNA, 20 bp, Artificial Sequence
  chemically synthesized
ccctaccatttcagtcttgg

SEQ ID NO: 524821 - DNA, 20 bp, Artificial Sequence
  chemically synthesized
tacaaggtatcacactagta

SEQ ID NO: 524822 - DNA, 20 bp, Artificial Sequence
  chemically synthesized
accttgtagaaaatatgatc

SEQ ID NO: 524823 - DNA, 20 bp, Artificial Sequence
  chemically synthesized
tgtagaaaatatgatcaagg

SEQ ID NO: 524824 - DNA, 20 bp, Artificial Sequence
  chemically synthesized
aaggcaaaggctacattgcg

SEQ ID NO: 524825 - DNA, 20 bp, Artificial Sequence
  chemically synthesized
ctcaaggaagttcagagatg

SEQ ID NO: 524826 - DNA, 20 bp, Artificial Sequence
  chemically synthesized
ccctacatctctgaacttcc

SEQ ID NO: 524827 - DNA, 20 bp, Artificial Sequence
  chemically synthesized
atgctcagaaaacatgtatg

SEQ ID NO: 524828 - DNA, 20 bp, Artificial Sequence
  chemically synthesized
atttatcacacatgcaaaaa

SEQ ID NO: 524829 - DNA, 20 bp, Artificial Sequence
  chemically synthesized
ttgcatgtgtgataaataaa

SEQ ID NO: 524830 - DNA, 20 bp, Artificial Sequence
  chemically synthesized
attgcttgtcattttgttgt

SEQ ID NO: 524831 - DNA, 20 bp, Artificial Sequence
  chemically synthesized
gagggagcatataatacaca

SEQ ID NO: 524832 - DNA, 20 bp, Artificial Sequence
  chemically synthesized
taaatttaaacaaagcccag

SEQ ID NO: 524833 - DNA, 20 bp, Artificial Sequence
  chemically synthesized
tgttagacccatctatgagt

SEQ ID NO: 524834 - DNA, 20 bp, Artificial Sequence
  chemically synthesized
ctcctcactcccactcatag

SEQ ID NO: 524835 - DNA, 20 bp, Artificial Sequence
  chemically synthesized
tcatattgttagacccatct

SEQ ID NO: 524836 - DNA, 20 bp, Artificial Sequence
  chemically synthesized
tcatagatgggtctaacaat

SEQ ID NO: 524837 - DNA, 20 bp, Artificial Sequence
  chemically synthesized
taatatcaagaagtttacag

SEQ ID NO: 524838 - DNA, 20 bp, Artificial Sequence
  chemically synthesized
gctgtaaacttcttgatatt

SEQ ID NO: 524839 - DNA, 20 bp, Artificial Sequence
  chemically synthesized
ctttagctctcaaaagcaca

SEQ ID NO: 524840 - DNA, 20 bp, Artificial Sequence
  chemically synthesized
aaaagcacattgggtgtaat

SEQ ID NO: 524841 - DNA, 20 bp, Artificial Sequence
  chemically synthesized
attttaaattttatgatgat

SEQ ID NO: 524842 - DNA, 20 bp, Artificial Sequence
  chemically synthesized
cataaaatttaaaataaact

SEQ ID NO: 524843 - DNA, 20 bp, Artificial Sequence
  chemically synthesized
aaaataaactttgaatgttt

SEQ ID NO: 524844 - DNA, 20 bp, Artificial Sequence
  chemically synthesized
gtagcaaaccaaatctcttt

SEQ ID NO: 524845 - DNA, 20 bp, Artificial Sequence
  chemically synthesized
aattatgaaccttggtacta

SEQ ID NO: 524846 - DNA, 20 bp, Artificial Sequence
  chemically synthesized
ccagttccattgttttaaat

SEQ ID NO: 524847 - DNA, 20 bp, Artificial Sequence
  chemically synthesized
aaaacaatggaactgggccg

SEQ ID NO: 524848 - DNA, 20 bp, Artificial Sequence
  chemically synthesized
gccctcaaatagattatacc

SEQ ID NO: 524849 - DNA, 20 bp, Artificial Sequence
  chemically synthesized
atctcaagaagaaaataata

SEQ ID NO: 524850 - DNA, 20 bp, Artificial Sequence
  chemically synthesized
gaaaaaatagctctttgtta

SEQ ID NO: 524851 - DNA, 20 bp, Artificial Sequence
  chemically synthesized
ttccctacttcatttctgat

SEQ ID NO: 524852 - DNA, 20 bp, Artificial Sequence
  chemically synthesized
cccgtatcagaaatgaagta

SEQ ID NO: 524853 - DNA, 20 bp, Artificial Sequence
  chemically synthesized
caaagaaaaaaaaagacagt

SEQ ID NO: 524854 - DNA, 20 bp, Artificial Sequence
  chemically synthesized
aattattaaatacttatgtg

SEQ ID NO: 524855 - DNA, 20 bp, Artificial Sequence
  chemically synthesized
acagtagtttgtgccttttg

SEQ ID NO: 524856 - DNA, 20 bp, Artificial Sequence
  chemically synthesized
gcacaaactactgtaaatca

SEQ ID NO: 524857 - DNA, 20 bp, Artificial Sequence
  chemically synthesized
tgtaaatcaatgaatataaa

SEQ ID NO: 524858 - DNA, 20 bp, Artificial Sequence
  chemically synthesized
atgaatataaaatggataat

SEQ ID NO: 524859 - DNA, 20 bp, Artificial Sequence
  chemically synthesized
tttggctatttaatagtaat

SEQ ID NO: 524860 - DNA, 20 bp, Artificial Sequence
  chemically synthesized
taatttggatatactagata

SEQ ID NO: 524861 - DNA, 20 bp, Artificial Sequence
  chemically synthesized
tttgtagaagtttttaaatt

SEQ ID NO: 524862 - DNA, 20 bp, Artificial Sequence
  chemically synthesized
aaaagtatgccaatcttgtg

SEQ ID NO: 524863 - DNA, 20 bp, Artificial Sequence
  chemically synthesized
atgttctggaaaagaatgtg

SEQ ID NO: 524864 - DNA, 20 bp, Artificial Sequence
  chemically synthesized
ttcccttccatgttctggaa

SEQ ID NO: 524865 - DNA, 20 bp, Artificial Sequence
  chemically synthesized
tggaagggaagaaaacaatt

SEQ ID NO: 524866 - DNA, 20 bp, Artificial Sequence
  chemically synthesized
ctggactcaacacatatact

SEQ ID NO: 524867 - DNA, 20 bp, Artificial Sequence
  chemically synthesized
aacaattctgagtatatgtg

SEQ ID NO: 524868 - DNA, 20 bp, Artificial Sequence
  chemically synthesized
ttttgtactgtttttctggt

SEQ ID NO: 524869 - DNA, 20 bp, Artificial Sequence
  chemically synthesized
cattaatatttgtaaggaat

SEQ ID NO: 524870 - DNA, 20 bp, Artificial Sequence
  chemically synthesized
attttccattaatatttgta

SEQ ID NO: 524871 - DNA, 20 bp, Artificial Sequence
  chemically synthesized
agtgatccattagtacattg

SEQ ID NO: 524872 - DNA, 20 bp, Artificial Sequence
  chemically synthesized
taaaattcagcaatgtacta

SEQ ID NO: 524873 - DNA, 20 bp, Artificial Sequence
  chemically synthesized
caatgtactaatggatcact

SEQ ID NO: 524874 - DNA, 20 bp, Artificial Sequence
  chemically synthesized
gatcacttggggtttatttc

SEQ ID NO: 524875 - DNA, 20 bp, Artificial Sequence
  chemically synthesized
tctgaaaaataggactaaag

SEQ ID NO: 524876 - DNA, 20 bp, Artificial Sequence
  chemically synthesized
cttaatattgtgaacaaggc

SEQ ID NO: 524877 - DNA, 20 bp, Artificial Sequence
  chemically synthesized
acttgtagcagtacgtgaat

SEQ ID NO: 524878 - DNA, 20 bp, Artificial Sequence
  chemically synthesized
gctagaacttgtagcagtac

SEQ ID NO: 524879 - DNA, 20 bp, Artificial Sequence
  chemically synthesized
tgtcttcctttcccatctgt

SEQ ID NO: 524880 - DNA, 20 bp, Artificial Sequence
  chemically synthesized
ctcctagaaattattgataa

SEQ ID NO: 524881 - DNA, 20 bp, Artificial Sequence
  chemically synthesized
tcttgcatcctgctaccttg

SEQ ID NO: 524882 - DNA, 20 bp, Artificial Sequence
  chemically synthesized
aagtgaattcatcaaggtag

SEQ ID NO: 524883 - DNA, 20 bp, Artificial Sequence
  chemically synthesized
attttgctagttttagatct

SEQ ID NO: 524884 - DNA, 20 bp, Artificial Sequence
  chemically synthesized
ttctatgatttctttcatca

SEQ ID NO: 524885 - DNA, 20 bp, Artificial Sequence
  chemically synthesized
atagaagataatccatattc

SEQ ID NO: 524886 - DNA, 20 bp, Artificial Sequence
  chemically synthesized
gagccttcccatccatgaat

SEQ ID NO: 524887 - DNA, 20 bp, Artificial Sequence
  chemically synthesized
aatattgagccttcccatcc

SEQ ID NO: 524888 - DNA, 20 bp, Artificial Sequence
  chemically synthesized
ttgagtctatagatcaattt

SEQ ID NO: 524889 - DNA, 20 bp, Artificial Sequence
  chemically synthesized
agattttgattgggattaca

SEQ ID NO: 524890 - DNA, 20 bp, Artificial Sequence
  chemically synthesized
gtaactactgagattttgat

SEQ ID NO: 524891 - DNA, 20 bp, Artificial Sequence
  chemically synthesized
ttgcctttccatatcatttt

SEQ ID NO: 524892 - DNA, 20 bp, Artificial Sequence
  chemically synthesized
atatggaaaggcaagaaacc

SEQ ID NO: 524893 - DNA, 20 bp, Artificial Sequence
  chemically synthesized
accttggcctcccaaagtgc

SEQ ID NO: 524894 - DNA, 20 bp, Artificial Sequence
  chemically synthesized
tgggcagatcacttgaggtc

SEQ ID NO: 524895 - DNA, 20 bp, Artificial Sequence
  chemically synthesized
aaaaacaacaaaaattagct

SEQ ID NO: 524896 - DNA, 20 bp, Artificial Sequence
  chemically synthesized
atttcagcctctcaagtagc

SEQ ID NO: 524897 - DNA, 20 bp, Artificial Sequence
  chemically synthesized
tacttgagaggctgaaatga

SEQ ID NO: 524898 - DNA, 20 bp, Artificial Sequence
  chemically synthesized
ctcactgcaatctccgcctc

SEQ ID NO: 524899 - DNA, 20 bp, Artificial Sequence
  chemically synthesized
tcatgccattgcactccagc

SEQ ID NO: 524900 - DNA, 20 bp, Artificial Sequence
  chemically synthesized
cctctctctgtcacccaggc

SEQ ID NO: 524901 - DNA, 20 bp, Artificial Sequence
  chemically synthesized
gtttgtttgtttgtttgaga

SEQ ID NO: 524902 - DNA, 20 bp, Artificial Sequence
  chemically synthesized
aaaagaagagatcaatggaa

SEQ ID NO: 524903 - DNA, 20 bp, Artificial Sequence
  chemically synthesized
tggaacagaatagagagccc

SEQ ID NO: 524904 - DNA, 20 bp, Artificial Sequence
  chemically synthesized
agtcagttgactatatttat

SEQ ID NO: 524905 - DNA, 20 bp, Artificial Sequence
  chemically synthesized
tttgtgaaaggtgtttgcat

SEQ ID NO: 524906 - DNA, 20 bp, Artificial Sequence
  chemically synthesized
ttcacaaacattaactcaaa

SEQ ID NO: 524907 - DNA, 20 bp, Artificial Sequence
  chemically synthesized
atttaagtttctgatccatt

SEQ ID NO: 524908 - DNA, 20 bp, Artificial Sequence
  chemically synthesized
taacataggagaaaatctat

SEQ ID NO: 524909 - DNA, 20 bp, Artificial Sequence
  chemically synthesized
tgacaatgtcttttgcagca

SEQ ID NO: 524910 - DNA, 20 bp, Artificial Sequence
  chemically synthesized
gctgcaaaagacattgtcaa

SEQ ID NO: 524911 - DNA, 20 bp, Artificial Sequence
  chemically synthesized
aagaatgtaaagacaagcca

SEQ ID NO: 524912 - DNA, 20 bp, Artificial Sequence
  chemically synthesized
agacaagccacagaatagga

SEQ ID NO: 524913 - DNA, 20 bp, Artificial Sequence
  chemically synthesized
ttaacagttctttgtatatt

SEQ ID NO: 524914 - DNA, 20 bp, Artificial Sequence
  chemically synthesized
tgttttgcccatttttaaaa

SEQ ID NO: 524915 - DNA, 20 bp, Artificial Sequence
  chemically synthesized
ccatctgtatatcttctttg

SEQ ID NO: 524916 - DNA, 20 bp, Artificial Sequence
  chemically synthesized
tgatgctactacatacctct

SEQ ID NO: 524917 - DNA, 20 bp, Artificial Sequence
  chemically synthesized
cattgggtggtgtcactgtt

SEQ ID NO: 524918 - DNA, 20 bp, Artificial Sequence
  chemically synthesized
tgacaccacccaatgctggt

SEQ ID NO: 524919 - DNA, 20 bp, Artificial Sequence
  chemically synthesized
actccatatcctcaccagca

SEQ ID NO: 524920 - DNA, 20 bp, Artificial Sequence
  chemically synthesized
acccaatgctggtgaggata

SEQ ID NO: 524921 - DNA, 20 bp, Artificial Sequence
  chemically synthesized
cattctcacaagcaatgaac

SEQ ID NO: 524922 - DNA, 20 bp, Artificial Sequence
  chemically synthesized
aactcttgttcattgcttgt

SEQ ID NO: 524923 - DNA, 20 bp, Artificial Sequence
  chemically synthesized
caaccactgaaaatcagttt

SEQ ID NO: 524924 - DNA, 20 bp, Artificial Sequence
  chemically synthesized
taattacttgatcatatagc

SEQ ID NO: 524925 - DNA, 20 bp, Artificial Sequence
  chemically synthesized
gcttatttgggtaaatacca

SEQ ID NO: 524926 - DNA, 20 bp, Artificial Sequence
  chemically synthesized
gacataagttttcagcttat

SEQ ID NO: 524927 - DNA, 20 bp, Artificial Sequence
  chemically synthesized
gtccgcacaaaaacctgcag

SEQ ID NO: 524928 - DNA, 20 bp, Artificial Sequence
  chemically synthesized
gtttccaagttcaggcaatt

SEQ ID NO: 524929 - DNA, 20 bp, Artificial Sequence
  chemically synthesized
aacaagatgttcttcagtag

SEQ ID NO: 524930 - DNA, 20 bp, Artificial Sequence
  chemically synthesized
agatgttcttcagtaggtga

SEQ ID NO: 524931 - DNA, 20 bp, Artificial Sequence
  chemically synthesized
ttctttttagcatctatagt

SEQ ID NO: 524932 - DNA, 20 bp, Artificial Sequence
  chemically synthesized
gaaaatgcttctatatactg

SEQ ID NO: 524933 - DNA, 20 bp, Artificial Sequence
  chemically synthesized
tttcctggatgtcatatagt

SEQ ID NO: 524934 - DNA, 20 bp, Artificial Sequence
  chemically synthesized
tcttcataattttacctttc

SEQ ID NO: 524935 - DNA, 20 bp, Artificial Sequence
  chemically synthesized
taaaaatatcagtggttgcc

SEQ ID NO: 524936 - DNA, 20 bp, Artificial Sequence
  chemically synthesized
tctactatgataatatcata

SEQ ID NO: 524937 - DNA, 20 bp, Artificial Sequence
  chemically synthesized
cacacagaaaacacaacaac

SEQ ID NO: 524938 - DNA, 20 bp, Artificial Sequence
  chemically synthesized
ctcagatccataggttccat

SEQ ID NO: 524939 - DNA, 20 bp, Artificial Sequence
  chemically synthesized
agtaaactctaatggaacct

SEQ ID NO: 524940 - DNA, 20 bp, Artificial Sequence
  chemically synthesized
ctctaatggaacctatggat

SEQ ID NO: 524941 - DNA, 20 bp, Artificial Sequence
  chemically synthesized
acgtaggttcatttattgta

SEQ ID NO: 524942 - DNA, 20 bp, Artificial Sequence
  chemically synthesized
aacgaatgtaccactctggt

SEQ ID NO: 524943 - DNA, 20 bp, Artificial Sequence
  chemically synthesized
tcattattaataactctcac

SEQ ID NO: 524944 - DNA, 20 bp, Artificial Sequence
  chemically synthesized
gccatgctcgtgcgggcaca

SEQ ID NO: 524945 - DNA, 20 bp, Artificial Sequence
  chemically synthesized
ttaacaatcacttgcattct

SEQ ID NO: 524946 - DNA, 20 bp, Artificial Sequence
  chemically synthesized
atatgttcattattaattca

SEQ ID NO: 524947 - DNA, 20 bp, Artificial Sequence
  chemically synthesized
tgaagaaatatattgtgctc

SEQ ID NO: 524948 - DNA, 20 bp, Artificial Sequence
  chemically synthesized
gtaaaattgacattactgtg

SEQ ID NO: 524949 - DNA, 20 bp, Artificial Sequence
  chemically synthesized
tgtgtaaactgtgtaacagt

SEQ ID NO: 524950 - DNA, 20 bp, Artificial Sequence
  chemically synthesized
caaaatctcagcaatatttt

SEQ ID NO: 524951 - DNA, 20 bp, Artificial Sequence
  chemically synthesized
ttgccttttcacataaattt

SEQ ID NO: 524952 - DNA, 20 bp, Artificial Sequence
  chemically synthesized
aaaatttatgtgaaaaggca

SEQ ID NO: 524953 - DNA, 20 bp, Artificial Sequence
  chemically synthesized
atgtgaaaaggcaatggatt

SEQ ID NO: 524954 - DNA, 20 bp, Artificial Sequence
  chemically synthesized
ctaaaacaatgttgaaaagg

SEQ ID NO: 524955 - DNA, 20 bp, Artificial Sequence
  chemically synthesized
aaaaggaagaatgaagtaag

SEQ ID NO: 524956 - DNA, 20 bp, Artificial Sequence
  chemically synthesized
agatagtgtggtgttggtgt

SEQ ID NO: 524957 - DNA, 20 bp, Artificial Sequence
  chemically synthesized
agacacgcagattaatggaa

SEQ ID NO: 524958 - DNA, 20 bp, Artificial Sequence
  chemically synthesized
aaatcagttgagcaatttgt

SEQ ID NO: 524959 - DNA, 20 bp, Artificial Sequence
  chemically synthesized
aaaagactatctttgctcca

SEQ ID NO: 524960 - DNA, 20 bp, Artificial Sequence
  chemically synthesized
aaagatagtcttttcaacac

SEQ ID NO: 524961 - DNA, 20 bp, Artificial Sequence
  chemically synthesized
aaataaaatgcaaatagatg

SEQ ID NO: 524962 - DNA, 20 bp, Artificial Sequence
  chemically synthesized
tattttacaaaaacatacag

SEQ ID NO: 524963 - DNA, 20 bp, Artificial Sequence
  chemically synthesized
aaaacatacaggagagtctt

SEQ ID NO: 524964 - DNA, 20 bp, Artificial Sequence
  chemically synthesized
cttcaggatgaaaggctagg

SEQ ID NO: 524965 - DNA, 20 bp, Artificial Sequence
  chemically synthesized
tctgagaaagatgctgccaa

SEQ ID NO: 524966 - DNA, 20 bp, Artificial Sequence
  chemically synthesized
actagtatctagactaaatg

SEQ ID NO: 524967 - DNA, 20 bp, Artificial Sequence
  chemically synthesized
tgtttttacttttgggttac

SEQ ID NO: 524968 - DNA, 20 bp, Artificial Sequence
  chemically synthesized
tgtctattttgtttttactt

SEQ ID NO: 524969 - DNA, 20 bp, Artificial Sequence
  chemically synthesized
gtcttttgcccatttttcta

SEQ ID NO: 524970 - DNA, 20 bp, Artificial Sequence
  chemically synthesized
ccaaagacaacacatagatg

SEQ ID NO: 524971 - DNA, 20 bp, Artificial Sequence
  chemically synthesized
tcattggctcttagggaaat

SEQ ID NO: 524972 - DNA, 20 bp, Artificial Sequence
  chemically synthesized
tatcgtattgaggttttaat

SEQ ID NO: 524973 - DNA, 20 bp, Artificial Sequence
  chemically synthesized
cgatataactctgtgcatat

SEQ ID NO: 524974 - DNA, 20 bp, Artificial Sequence
  chemically synthesized
cttagccattctaatatgca

SEQ ID NO: 524975 - DNA, 20 bp, Artificial Sequence
  chemically synthesized
tgacaacatcaaacactggc

SEQ ID NO: 524976 - DNA, 20 bp, Artificial Sequence
  chemically synthesized
tacaatgcaccaaactttta

SEQ ID NO: 524977 - DNA, 20 bp, Artificial Sequence
  chemically synthesized
tttatctgggattaatgcca

SEQ ID NO: 524978 - DNA, 20 bp, Artificial Sequence
  chemically synthesized
tgagcaaattttcatttatc

SEQ ID NO: 524979 - DNA, 20 bp, Artificial Sequence
  chemically synthesized
tgctcataaaaaaactgtac

SEQ ID NO: 524980 - DNA, 20 bp, Artificial Sequence
  chemically synthesized
atttgcctgttgaaggacat

SEQ ID NO: 524981 - DNA, 20 bp, Artificial Sequence
  chemically synthesized
aaactggcatattcatacca

SEQ ID NO: 524982 - DNA, 20 bp, Artificial Sequence
  chemically synthesized
gctgagtagtattccatggt

SEQ ID NO: 524983 - DNA, 20 bp, Artificial Sequence
  chemically synthesized
caatgtgttcctttgtactg

SEQ ID NO: 524984 - DNA, 20 bp, Artificial Sequence
  chemically synthesized
gatgcacattacaaatctgg

SEQ ID NO: 524985 - DNA, 20 bp, Artificial Sequence
  chemically synthesized
caaatctggaagaatctcca

SEQ ID NO: 524986 - DNA, 20 bp, Artificial Sequence
  chemically synthesized
agaatctccagagaattatg

SEQ ID NO: 524987 - DNA, 20 bp, Artificial Sequence
  chemically synthesized
tcctaaatagctacataata

SEQ ID NO: 524988 - DNA, 20 bp, Artificial Sequence
  chemically synthesized
ttagtagttgctagagatta

SEQ ID NO: 524989 - DNA, 20 bp, Artificial Sequence
  chemically synthesized
tgcctgagggcaggaaaaaa

SEQ ID NO: 524990 - DNA, 20 bp, Artificial Sequence
  chemically synthesized
tctgaccatgaaagggcaac

SEQ ID NO: 524991 - DNA, 20 bp, Artificial Sequence
  chemically synthesized
caggatatttccatcaccac

SEQ ID NO: 524992 - DNA, 20 bp, Artificial Sequence
  chemically synthesized
acatcagcacagataaaata

SEQ ID NO: 524993 - DNA, 20 bp, Artificial Sequence
  chemically synthesized
gactttaccttaaggaggga

SEQ ID NO: 524994 - DNA, 20 bp, Artificial Sequence
  chemically synthesized
ggactgggtaaaatggcaca

SEQ ID NO: 524995 - DNA, 20 bp, Artificial Sequence
  chemically synthesized
attatttcttacaactgcat

SEQ ID NO: 524996 - DNA, 20 bp, Artificial Sequence
  chemically synthesized
tttttttaaaagacagtggg

SEQ ID NO: 524997 - DNA, 20 bp, Artificial Sequence
  chemically synthesized
gaatgtcagtgtcgtatggc

SEQ ID NO: 524998 - DNA, 20 bp, Artificial Sequence
  chemically synthesized
tcttatatttatttgtatgc

SEQ ID NO: 524999 - DNA, 20 bp, Artificial Sequence
  chemically synthesized
cacttgcttttttttgttaa

SEQ ID NO: 525000 - DNA, 20 bp, Artificial Sequence
  chemically synthesized
atataacgtaacacacttaa

SEQ ID NO: 525001 - DNA, 20 bp, Artificial Sequence
  chemically synthesized
tttgcatatttaaaattttc

SEQ ID NO: 525002 - DNA, 20 bp, Artificial Sequence
  chemically synthesized
aaaattttaaatatgcaaat

SEQ ID NO: 525003 - DNA, 20 bp, Artificial Sequence
  chemically synthesized
taaatatgcaaatcagaatt

SEQ ID NO: 525004 - DNA, 20 bp, Artificial Sequence
  chemically synthesized
tattttatttaaacgatacc

SEQ ID NO: 525005 - DNA, 20 bp, Artificial Sequence
  chemically synthesized
tatcgtttaaataaaatatt

SEQ ID NO: 525006 - DNA, 20 bp, Artificial Sequence
  chemically synthesized
aataaacttatgaaacagtt

SEQ ID NO: 525007 - DNA, 20 bp, Artificial Sequence
  chemically synthesized
caagttattactacacaaga

SEQ ID NO: 525008 - DNA, 20 bp, Artificial Sequence
  chemically synthesized
agaaaacaatataaatctat

SEQ ID NO: 525009 - DNA, 20 bp, Artificial Sequence
  chemically synthesized
aatctatgtggatgacattt

SEQ ID NO: 525010 - DNA, 20 bp, Artificial Sequence
  chemically synthesized
tttaaagaaagaaattagga

SEQ ID NO: 525011 - DNA, 20 bp, Artificial Sequence
  chemically synthesized
gaaaaaaatcccctccctgt

SEQ ID NO: 525012 - DNA, 20 bp, Artificial Sequence
  chemically synthesized
aaaaataattctaacaggga

SEQ ID NO: 525013 - DNA, 20 bp, Artificial Sequence
  chemically synthesized
aaaaatggtggttttaagaa

SEQ ID NO: 525014 - DNA, 20 bp, Artificial Sequence
  chemically synthesized
aaccttcagaaaaaccttat

SEQ ID NO: 525015 - DNA, 20 bp, Artificial Sequence
  chemically synthesized
aattcttaccaattgtttct

SEQ ID NO: 525016 - DNA, 20 bp, Artificial Sequence
  chemically synthesized
catcctaagaaacaattggt

SEQ ID NO: 525017 - DNA, 20 bp, Artificial Sequence
  chemically synthesized
agctttaggcaccgcaatcg

SEQ ID NO: 525018 - DNA, 20 bp, Artificial Sequence
  chemically synthesized
ctcgaaaaatatgcacaact

SEQ ID NO: 525019 - DNA, 20 bp, Artificial Sequence
  chemically synthesized
ttctctcctttccagatgat

SEQ ID NO: 525020 - DNA, 20 bp, Artificial Sequence
  chemically synthesized
ggaaaggagagaagctttga

SEQ ID NO: 525021 - DNA, 20 bp, Artificial Sequence
  chemically synthesized
aagagagagagagagagaga

SEQ ID NO: 525022 - DNA, 20 bp, Artificial Sequence
  chemically synthesized
gagagagagagagagagtct

SEQ ID NO: 525023 - DNA, 20 bp, Artificial Sequence
  chemically synthesized
tctttgagtggcatcctgtt

SEQ ID NO: 525024 - DNA, 20 bp, Artificial Sequence
  chemically synthesized
ctgtagtgaggtattcaaaa

SEQ ID NO: 525025 - DNA, 20 bp, Artificial Sequence
  chemically synthesized
ctgttttgaatacctcacta

SEQ ID NO: 525026 - DNA, 20 bp, Artificial Sequence
  chemically synthesized
aaaattttctgagccccaca

SEQ ID NO: 525027 - DNA, 20 bp, Artificial Sequence
  chemically synthesized
gctctgactctcaggcttca

SEQ ID NO: 525028 - DNA, 20 bp, Artificial Sequence
  chemically synthesized
atacttactcactgaagcct

SEQ ID NO: 525029 - DNA, 20 bp, Artificial Sequence
  chemically synthesized
aatcagagaaaatatttgat

SEQ ID NO: 525030 - DNA, 20 bp, Artificial Sequence
  chemically synthesized
ttgtgaaacctcatttaaat

SEQ ID NO: 525031 - DNA, 20 bp, Artificial Sequence
  chemically synthesized
atttaaatgaggtttcacaa

SEQ ID NO: 525032 - DNA, 20 bp, Artificial Sequence
  chemically synthesized
aatgaggtttcacaaatgga

SEQ ID NO: 525033 - DNA, 20 bp, Artificial Sequence
  chemically synthesized
caaatggattgaatttagag

SEQ ID NO: 525034 - DNA, 20 bp, Artificial Sequence
  chemically synthesized
aaacattttataaaactgaa

SEQ ID NO: 525035 - DNA, 20 bp, Artificial Sequence
  chemically synthesized
attagtgcttaaagtatatt

SEQ ID NO: 525036 - DNA, 20 bp, Artificial Sequence
  chemically synthesized
gtttagacatctattaaacc

SEQ ID NO: 525037 - DNA, 20 bp, Artificial Sequence
  chemically synthesized
aaaatattgaaaatcttatg

SEQ ID NO: 525038 - DNA, 20 bp, Artificial Sequence
  chemically synthesized
aaaatcttatggtgaatctt

SEQ ID NO: 525039 - DNA, 20 bp, Artificial Sequence
  chemically synthesized
tctttagagttaactttatt

SEQ ID NO: 525040 - DNA, 20 bp, Artificial Sequence
  chemically synthesized
ggttcaataacatattaaac

SEQ ID NO: 525041 - DNA, 20 bp, Artificial Sequence
  chemically synthesized
acacacacacacacttaaac

SEQ ID NO: 525042 - DNA, 20 bp, Artificial Sequence
  chemically synthesized
ttagcaaatgaggtacattt

SEQ ID NO: 525043 - DNA, 20 bp, Artificial Sequence
  chemically synthesized
agttcctgaaggtattacct

SEQ ID NO: 525044 - DNA, 20 bp, Artificial Sequence
  chemically synthesized
accttcaggaacttggagaa

SEQ ID NO: 525045 - DNA, 20 bp, Artificial Sequence
  chemically synthesized
gtatgaaaacggggaaatct

SEQ ID NO: 525046 - DNA, 20 bp, Artificial Sequence
  chemically synthesized
aagaaaaatttttttaaatg

SEQ ID NO: 525047 - DNA, 20 bp, Artificial Sequence
  chemically synthesized
agctttttttttttttgaga

SEQ ID NO: 525048 - DNA, 20 bp, Artificial Sequence
  chemically synthesized
taccactccagcctgggcaa

SEQ ID NO: 525049 - DNA, 20 bp, Artificial Sequence
  chemically synthesized
tctcactctgttgcccaggc

SEQ ID NO: 525050 - DNA, 20 bp, Artificial Sequence
  chemically synthesized
atcactcgtacattactgaa

SEQ ID NO: 525051 - DNA, 20 bp, Artificial Sequence
  chemically synthesized
gatattcttttcagtaatgt

SEQ ID NO: 525052 - DNA, 20 bp, Artificial Sequence
  chemically synthesized
ctagcaaaaatgtggagaaa

SEQ ID NO: 525053 - DNA, 20 bp, Artificial Sequence
  chemically synthesized
agataaaactacacattttt

SEQ ID NO: 525054 - DNA, 20 bp, Artificial Sequence
  chemically synthesized
aggcacgaagagacatttta

SEQ ID NO: 525055 - DNA, 20 bp, Artificial Sequence
  chemically synthesized
atttcctaattaatttattt

SEQ ID NO: 525056 - DNA, 20 bp, Artificial Sequence
  chemically synthesized
ttatttttggatttttgctt

SEQ ID NO: 525057 - DNA, 20 bp, Artificial Sequence
  chemically synthesized
aagaagtgaaatacaaggta

SEQ ID NO: 525058 - DNA, 20 bp, Artificial Sequence
  chemically synthesized
ccttgtatttcacttcttaa

SEQ ID NO: 525059 - DNA, 20 bp, Artificial Sequence
  chemically synthesized
attaaaacttttgatctgaa

SEQ ID NO: 525060 - DNA, 20 bp, Artificial Sequence
  chemically synthesized
tttatcagtttttctttttt

SEQ ID NO: 525061 - DNA, 20 bp, Artificial Sequence
  chemically synthesized
atttatttacttatatattt

SEQ ID NO: 525062 - DNA, 20 bp, Artificial Sequence
  chemically synthesized
atagtgtgcgttttttctaa

SEQ ID NO: 525063 - DNA, 20 bp, Artificial Sequence
  chemically synthesized
aggctgttaaaattcctcct

SEQ ID NO: 525064 - DNA, 20 bp, Artificial Sequence
  chemically synthesized
ttgtgaaagcaattccaagg

SEQ ID NO: 525065 - DNA, 20 bp, Artificial Sequence
  chemically synthesized
ctttcacaactttttaaaaa

SEQ ID NO: 525066 - DNA, 20 bp, Artificial Sequence
  chemically synthesized
atgagtttgcacatatttgt

SEQ ID NO: 525067 - DNA, 20 bp, Artificial Sequence
  chemically synthesized
tatttgtgcgggtctatttc

SEQ ID NO: 525068 - DNA, 20 bp, Artificial Sequence
  chemically synthesized
agacgcatagttcaatgcaa

SEQ ID NO: 525069 - DNA, 20 bp, Artificial Sequence
  chemically synthesized
ctacagtaatcaagacagtg

SEQ ID NO: 525070 - DNA, 20 bp, Artificial Sequence
  chemically synthesized
taataagccttaatatttag

SEQ ID NO: 525071 - DNA, 20 bp, Artificial Sequence
  chemically synthesized
acaaagaagaataaagtgga

SEQ ID NO: 525072 - DNA, 20 bp, Artificial Sequence
  chemically synthesized
ctaatacaatcttgacaaag

SEQ ID NO: 525073 - DNA, 20 bp, Artificial Sequence
  chemically synthesized
tgtacttttccgtataaatt

SEQ ID NO: 525074 - DNA, 20 bp, Artificial Sequence
  chemically synthesized
gcaaggtctttttagtagac

SEQ ID NO: 525075 - DNA, 20 bp, Artificial Sequence
  chemically synthesized
taattgacatctttaccatg

SEQ ID NO: 525076 - DNA, 20 bp, Artificial Sequence
  chemically synthesized
gatatactctgctaatggat

SEQ ID NO: 525077 - DNA, 20 bp, Artificial Sequence
  chemically synthesized
tgagtattccaatccattag

SEQ ID NO: 525078 - DNA, 20 bp, Artificial Sequence
  chemically synthesized
tggagagatatactctgcta

SEQ ID NO: 525079 - DNA, 20 bp, Artificial Sequence
  chemically synthesized
aagattataattgtttatag

SEQ ID NO: 525080 - DNA, 20 bp, Artificial Sequence
  chemically synthesized
atagagacctgtaatttttc

SEQ ID NO: 525081 - DNA, 20 bp, Artificial Sequence
  chemically synthesized
attacattaaagtcatgcat

SEQ ID NO: 525082 - DNA, 20 bp, Artificial Sequence
  chemically synthesized
aatttagtgctcttagttct

SEQ ID NO: 525083 - DNA, 20 bp, Artificial Sequence
  chemically synthesized
aatttaaaagtgaacaagaa

SEQ ID NO: 525084 - DNA, 20 bp, Artificial Sequence
  chemically synthesized
tttagggttttaagatactt

SEQ ID NO: 525085 - DNA, 20 bp, Artificial Sequence
  chemically synthesized
tttatttttaaaaatgcctt

SEQ ID NO: 525086 - DNA, 20 bp, Artificial Sequence
  chemically synthesized
attttatttcatcatacatt

SEQ ID NO: 525087 - DNA, 20 bp, Artificial Sequence
  chemically synthesized
ttcatcatacattgtggatg

SEQ ID NO: 525088 - DNA, 20 bp, Artificial Sequence
  chemically synthesized
aattatattgttataatgca

SEQ ID NO: 525089 - DNA, 20 bp, Artificial Sequence
  chemically synthesized
catgttgaattagatattaa

SEQ ID NO: 525090 - DNA, 20 bp, Artificial Sequence
  chemically synthesized
ttttaatatctaattcaaca

SEQ ID NO: 525091 - DNA, 20 bp, Artificial Sequence
  chemically synthesized
tgaaaatctattattccatg

SEQ ID NO: 525092 - DNA, 20 bp, Artificial Sequence
  chemically synthesized
atagattttcagcaaaagga

SEQ ID NO: 525093 - DNA, 20 bp, Artificial Sequence
  chemically synthesized
aacactgaatcgcatagaga

SEQ ID NO: 525094 - DNA, 20 bp, Artificial Sequence
  chemically synthesized
gttggatttccttaagaaca

SEQ ID NO: 525095 - DNA, 20 bp, Artificial Sequence
  chemically synthesized
ataattaagagcaagaaaag

SEQ ID NO: 525096 - DNA, 20 bp, Artificial Sequence
  chemically synthesized
aaccaacgtgctaagttttc

SEQ ID NO: 525097 - DNA, 20 bp, Artificial Sequence
  chemically synthesized
acctcttaaactgatttgtt

SEQ ID NO: 525098 - DNA, 20 bp, Artificial Sequence
  chemically synthesized
ttttaaaatctagagtatta

SEQ ID NO: 525099 - DNA, 20 bp, Artificial Sequence
  chemically synthesized
aaggatacttttttaaaatc

SEQ ID NO: 525100 - DNA, 20 bp, Artificial Sequence
  chemically synthesized
ttttctcatggtacttaact

SEQ ID NO: 525101 - DNA, 20 bp, Artificial Sequence
  chemically synthesized
aaaaaaaaataaataacagt

SEQ ID NO: 525102 - DNA, 20 bp, Artificial Sequence
  chemically synthesized
atcaggcaccttggtacttc

SEQ ID NO: 525103 - DNA, 20 bp, Artificial Sequence
  chemically synthesized
aaatttgatatttttagtaa

SEQ ID NO: 525104 - DNA, 20 bp, Artificial Sequence
  chemically synthesized
gttttgtaaactcagaactc

SEQ ID NO: 525105 - DNA, 20 bp, Artificial Sequence
  chemically synthesized
atgcacgtcacccttgagtt

SEQ ID NO: 525106 - DNA, 20 bp, Artificial Sequence
  chemically synthesized
cgcacatatgcacgtcaccc

SEQ ID NO: 525107 - DNA, 20 bp, Artificial Sequence
  chemically synthesized
gggtgacgtgcatatgtgcg

SEQ ID NO: 525108 - DNA, 20 bp, Artificial Sequence
  chemically synthesized
gtagggcacattgtcaccag

SEQ ID NO: 525109 - DNA, 20 bp, Artificial Sequence
  chemically synthesized
aacgacttatcatttaaatc

SEQ ID NO: 525110 - DNA, 20 bp, Artificial Sequence
  chemically synthesized
ggactgttcgctcaagaagt

SEQ ID NO: 525111 - DNA, 20 bp, Artificial Sequence
  chemically synthesized
agtccatatgcaaatcagta

SEQ ID NO: 525112 - DNA, 20 bp, Artificial Sequence
  chemically synthesized
aactttaatctcacgttcta

SEQ ID NO: 525113 - DNA, 20 bp, Artificial Sequence
  chemically synthesized
ttatactaaaaaccaccaga

SEQ ID NO: 525114 - DNA, 20 bp, Artificial Sequence
  chemically synthesized
cgcattttcttaaagtaact

SEQ ID NO: 525115 - DNA, 20 bp, Artificial Sequence
  chemically synthesized
gccatgtccctggcaagaaa

SEQ ID NO: 525116 - DNA, 20 bp, Artificial Sequence
  chemically synthesized
ggcaagaaatagaattcaac

SEQ ID NO: 525117 - DNA, 20 bp, Artificial Sequence
  chemically synthesized
gttttattgaaccatccatg

SEQ ID NO: 525118 - DNA, 20 bp, Artificial Sequence
  chemically synthesized
aaggaactactttcagaggt

SEQ ID NO: 525119 - DNA, 20 bp, Artificial Sequence
  chemically synthesized
tcccagccttaccatgcctg

SEQ ID NO: 525120 - DNA, 20 bp, Artificial Sequence
  chemically synthesized
gaagagtcaagtgaaggaag

SEQ ID NO: 525121 - DNA, 20 bp, Artificial Sequence
  chemically synthesized
ctctatggctctatctctta

SEQ ID NO: 525122 - DNA, 20 bp, Artificial Sequence
  chemically synthesized
gccatagaggagattcttaa

SEQ ID NO: 525123 - DNA, 20 bp, Artificial Sequence
  chemically synthesized
atatctctaactatcctgtt

SEQ ID NO: 525124 - DNA, 20 bp, Artificial Sequence
  chemically synthesized
ggtgggaaataaggcacaaa

SEQ ID NO: 525125 - DNA, 20 bp, Artificial Sequence
  chemically synthesized
agagtggaggtcaatgtaaa

SEQ ID NO: 525126 - DNA, 20 bp, Artificial Sequence
  chemically synthesized
gcatttccttagctcccttg

SEQ ID NO: 525127 - DNA, 20 bp, Artificial Sequence
  chemically synthesized
gctaaggaaatgcaatttat

SEQ ID NO: 525128 - DNA, 20 bp, Artificial Sequence
  chemically synthesized
agaacaaaaaagagcataaa

SEQ ID NO: 525129 - DNA, 20 bp, Artificial Sequence
  chemically synthesized
ttgggccaagccagcaagaa

SEQ ID NO: 525130 - DNA, 20 bp, Artificial Sequence
  chemically synthesized
caatacagcattttaggttg

SEQ ID NO: 525131 - DNA, 20 bp, Artificial Sequence
  chemically synthesized
tcatttctcttttacttttg

SEQ ID NO: 525132 - DNA, 20 bp, Artificial Sequence
  chemically synthesized
ccttcaaaagtaaaagagaa

SEQ ID NO: 525133 - DNA, 20 bp, Artificial Sequence
  chemically synthesized
ttatcagacaaacacgctga

SEQ ID NO: 525134 - DNA, 20 bp, Artificial Sequence
  chemically synthesized
ttagatcaatcaggaatagg

SEQ ID NO: 525135 - DNA, 20 bp, Artificial Sequence
  chemically synthesized
aaatatttattagatcaatc

SEQ ID NO: 525136 - DNA, 20 bp, Artificial Sequence
  chemically synthesized
aataacagcaagaagaaaca

SEQ ID NO: 525137 - DNA, 20 bp, Artificial Sequence
  chemically synthesized
acattggatgattagagctt

SEQ ID NO: 525138 - DNA, 20 bp, Artificial Sequence
  chemically synthesized
agagcttatggataagagaa

SEQ ID NO: 525139 - DNA, 20 bp, Artificial Sequence
  chemically synthesized
gttacaaaggttcaagaagg

SEQ ID NO: 525140 - DNA, 20 bp, Artificial Sequence
  chemically synthesized
aggttcaagaaggaagagtt

SEQ ID NO: 525141 - DNA, 20 bp, Artificial Sequence
  chemically synthesized
ccaatccgttttttcccaca

SEQ ID NO: 525142 - DNA, 20 bp, Artificial Sequence
  chemically synthesized
aatattctgtgtgggaaaaa

SEQ ID NO: 525143 - DNA, 20 bp, Artificial Sequence
  chemically synthesized
ctgtgtgggaaaaaacggat

SEQ ID NO: 525144 - DNA, 20 bp, Artificial Sequence
  chemically synthesized
tctgatgttaatttacgtaa

SEQ ID NO: 525145 - DNA, 20 bp, Artificial Sequence
  chemically synthesized
atcagaaccatcctctaatt

SEQ ID NO: 525146 - DNA, 20 bp, Artificial Sequence
  chemically synthesized
tgaacttgaactcctaatta

SEQ ID NO: 525147 - DNA, 20 bp, Artificial Sequence
  chemically synthesized
ctttagcttttaagaagaga

SEQ ID NO: 525148 - DNA, 20 bp, Artificial Sequence
  chemically synthesized
aaagctaaaggagccaggtg

SEQ ID NO: 525149 - DNA, 20 bp, Artificial Sequence
  chemically synthesized
ctctcggcctcccaaagtgc

SEQ ID NO: 525150 - DNA, 20 bp, Artificial Sequence
  chemically synthesized
ggggcagatcacttgaggtc

SEQ ID NO: 525151 - DNA, 20 bp, Artificial Sequence
  chemically synthesized
ttttgtatttttagtagaga

SEQ ID NO: 525152 - DNA, 20 bp, Artificial Sequence
  chemically synthesized
gattctcatgcctcagtctc

SEQ ID NO: 525153 - DNA, 20 bp, Artificial Sequence
  chemically synthesized
tactcaagagactgaggcat

SEQ ID NO: 525154 - DNA, 20 bp, Artificial Sequence
  chemically synthesized
taaaatgcagcctccacctg

SEQ ID NO: 525155 - DNA, 20 bp, Artificial Sequence
  chemically synthesized
tagattctgtccatcatcag

SEQ ID NO: 525156 - DNA, 20 bp, Artificial Sequence
  chemically synthesized
tttattcatctgatgatgga

SEQ ID NO: 525157 - DNA, 20 bp, Artificial Sequence
  chemically synthesized
tcattctaatctgtatttct

SEQ ID NO: 525158 - DNA, 20 bp, Artificial Sequence
  chemically synthesized
gaactcatagaaatacagat

SEQ ID NO: 525159 - DNA, 20 bp, Artificial Sequence
  chemically synthesized
gattaccacagaaatggcgg

SEQ ID NO: 525160 - DNA, 20 bp, Artificial Sequence
  chemically synthesized
gaaaagaaagatgttgatca

SEQ ID NO: 525161 - DNA, 20 bp, Artificial Sequence
  chemically synthesized
aaagatgttgatcaaagggt

SEQ ID NO: 525162 - DNA, 20 bp, Artificial Sequence
  chemically synthesized
atttcaaaattgctgaaata

SEQ ID NO: 525163 - DNA, 20 bp, Artificial Sequence
  chemically synthesized
agagtgattaaatcaggtta

SEQ ID NO: 525164 - DNA, 20 bp, Artificial Sequence
  chemically synthesized
tttgatatatgcttacaatg

SEQ ID NO: 525165 - DNA, 20 bp, Artificial Sequence
  chemically synthesized
tttctctgggataaatgccc

SEQ ID NO: 525166 - DNA, 20 bp, Artificial Sequence
  chemically synthesized
aacataagtcttcatttctc

SEQ ID NO: 525167 - DNA, 20 bp, Artificial Sequence
  chemically synthesized
ttcacacaaatcctgtacat

SEQ ID NO: 525168 - DNA, 20 bp, Artificial Sequence
  chemically synthesized
ttgctgtgaaccctaatgta

SEQ ID NO: 525169 - DNA, 20 bp, Artificial Sequence
  chemically synthesized
acaacaatatctctcagtca

SEQ ID NO: 525170 - DNA, 20 bp, Artificial Sequence
  chemically synthesized
gtcagtgaatggtgaaactg

SEQ ID NO: 525171 - DNA, 20 bp, Artificial Sequence
  chemically synthesized
tgcaatatgcaacaatttag

SEQ ID NO: 525172 - DNA, 20 bp, Artificial Sequence
  chemically synthesized
gctgaaaaaagctagttcga

SEQ ID NO: 525173 - DNA, 20 bp, Artificial Sequence
  chemically synthesized
tttcaagaatattatgcaaa

SEQ ID NO: 525174 - DNA, 20 bp, Artificial Sequence
  chemically synthesized
gtctataattttgtcatttc

SEQ ID NO: 525175 - DNA, 20 bp, Artificial Sequence
  chemically synthesized
gccacatgttaggcatggga

SEQ ID NO: 525176 - DNA, 20 bp, Artificial Sequence
  chemically synthesized
tccaccacgacagtcaaaat

SEQ ID NO: 525177 - DNA, 20 bp, Artificial Sequence
  chemically synthesized
aactaaatatatacacacac

SEQ ID NO: 525178 - DNA, 20 bp, Artificial Sequence
  chemically synthesized
ataggtaaaactgggaaaat

SEQ ID NO: 525179 - DNA, 20 bp, Artificial Sequence
  chemically synthesized
ttatattcaaacattataat

SEQ ID NO: 525180 - DNA, 20 bp, Artificial Sequence
  chemically synthesized
caaaatcctcattataatgt

SEQ ID NO: 525181 - DNA, 20 bp, Artificial Sequence
  chemically synthesized
atttgcaagatattacaatt

SEQ ID NO: 525182 - DNA, 20 bp, Artificial Sequence
  chemically synthesized
ataaccgagcaaaagccaca

SEQ ID NO: 525183 - DNA, 20 bp, Artificial Sequence
  chemically synthesized
gccacacaggatatttcaca

SEQ ID NO: 525184 - DNA, 20 bp, Artificial Sequence
  chemically synthesized
attttattttcaaagagttg

SEQ ID NO: 525185 - DNA, 20 bp, Artificial Sequence
  chemically synthesized
agttaaacattttattttca

SEQ ID NO: 525186 - DNA, 20 bp, Artificial Sequence
  chemically synthesized
tgcttagcttgtgtcagagc

SEQ ID NO: 525187 - DNA, 20 bp, Artificial Sequence
  chemically synthesized
ctctggcttcatatctgcat

SEQ ID NO: 525188 - DNA, 20 bp, Artificial Sequence
  chemically synthesized
cattgctctataccggtcct

SEQ ID NO: 525189 - DNA, 20 bp, Artificial Sequence
  chemically synthesized
caggacgcaggaaggtagat

SEQ ID NO: 525190 - DNA, 20 bp, Artificial Sequence
  chemically synthesized
ttaaaaataaaaaaataatt

SEQ ID NO: 525191 - DNA, 20 bp, Artificial Sequence
  chemically synthesized
tttttttatttttaattttt

SEQ ID NO: 525192 - DNA, 20 bp, Artificial Sequence
  chemically synthesized
tctaaaatctattggtagct

SEQ ID NO: 525193 - DNA, 20 bp, Artificial Sequence
  chemically synthesized
tagtatgagcatgcaacggt

SEQ ID NO: 525194 - DNA, 20 bp, Artificial Sequence
  chemically synthesized
caacctctaccacttaatag

SEQ ID NO: 525195 - DNA, 20 bp, Artificial Sequence
  chemically synthesized
gtgtgtgtctgtgtgtattt

SEQ ID NO: 525196 - DNA, 20 bp, Artificial Sequence
  chemically synthesized
gtttccccaattgttaaatg

SEQ ID NO: 525197 - DNA, 20 bp, Artificial Sequence
  chemically synthesized
taacaactgttgctaactca

SEQ ID NO: 525198 - DNA, 20 bp, Artificial Sequence
  chemically synthesized
attaagtcatttgtaactca

SEQ ID NO: 525199 - DNA, 20 bp, Artificial Sequence
  chemically synthesized
cttaatatcgacaatgcact

SEQ ID NO: 525200 - DNA, 20 bp, Artificial Sequence
  chemically synthesized
cacatacaacttagtatgtt

SEQ ID NO: 525201 - DNA, 20 bp, Artificial Sequence
  chemically synthesized
ataatctagactgctgttca

SEQ ID NO: 525202 - DNA, 20 bp, Artificial Sequence
  chemically synthesized
ttagccaccgctgccattcc

SEQ ID NO: 525203 - DNA, 20 bp, Artificial Sequence
  chemically synthesized
ttttacaaaaaatcgactct

SEQ ID NO: 525204 - DNA, 20 bp, Artificial Sequence
  chemically synthesized
agaagcaaaatctcttttcc

SEQ ID NO: 525205 - DNA, 20 bp, Artificial Sequence
  chemically synthesized
acccaatagacttctgactt

SEQ ID NO: 525206 - DNA, 20 bp, Artificial Sequence
  chemically synthesized
actcctaagtcagaagtcta

SEQ ID NO: 525207 - DNA, 20 bp, Artificial Sequence
  chemically synthesized
tctattgggtaatcacttct

SEQ ID NO: 525208 - DNA, 20 bp, Artificial Sequence
  chemically synthesized
aatcactgagagtggccagg

SEQ ID NO: 525209 - DNA, 20 bp, Artificial Sequence
  chemically synthesized
gcctgggcgaaagaatcact

SEQ ID NO: 525210 - DNA, 20 bp, Artificial Sequence
  chemically synthesized
gcgaacagtggcctgggcga

SEQ ID NO: 525211 - DNA, 20 bp, Artificial Sequence
  chemically synthesized
ttcgctaagcttgtcaccac

SEQ ID NO: 525212 - DNA, 20 bp, Artificial Sequence
  chemically synthesized
gagttgtggggactataagg

SEQ ID NO: 525213 - DNA, 20 bp, Artificial Sequence
  chemically synthesized
gatggagttgtggggactat

SEQ ID NO: 525214 - DNA, 20 bp, Artificial Sequence
  chemically synthesized
tagtccccacaactccatca

SEQ ID NO: 525215 - DNA, 20 bp, Artificial Sequence
  chemically synthesized
attcctacagaactctctga

SEQ ID NO: 525216 - DNA, 20 bp, Artificial Sequence
  chemically synthesized
actccatcagagagttctgt

SEQ ID NO: 525217 - DNA, 20 bp, Artificial Sequence
  chemically synthesized
aggaatactggcctttactg

SEQ ID NO: 525218 - DNA, 20 bp, Artificial Sequence
  chemically synthesized
actggcctttactggagggt

SEQ ID NO: 525219 - DNA, 20 bp, Artificial Sequence
  chemically synthesized
tttactggagggttgggatt

SEQ ID NO: 525220 - DNA, 20 bp, Artificial Sequence
  chemically synthesized
ttgggattgggggtaactaa

SEQ ID NO: 525221 - DNA, 20 bp, Artificial Sequence
  chemically synthesized
taactaagagaattacgtta

SEQ ID NO: 525222 - DNA, 20 bp, Artificial Sequence
  chemically synthesized
agaccaagccattgttagta

SEQ ID NO: 525223 - DNA, 20 bp, Artificial Sequence
  chemically synthesized
gctcacaaaaaacgttgtgt

SEQ ID NO: 525224 - DNA, 20 bp, Artificial Sequence
  chemically synthesized
agccttcaataggaaagagt

SEQ ID NO: 525225 - DNA, 20 bp, Artificial Sequence
  chemically synthesized
gcccatagccttcaatagga

SEQ ID NO: 525226 - DNA, 20 bp, Artificial Sequence
  chemically synthesized
caatgtttcctattatgggg

SEQ ID NO: 525227 - DNA, 20 bp, Artificial Sequence
  chemically synthesized
atgatcaatgtttcctatta

SEQ ID NO: 525228 - DNA, 20 bp, Artificial Sequence
  chemically synthesized
tattgatctaagcaactcat

SEQ ID NO: 525229 - DNA, 20 bp, Artificial Sequence
  chemically synthesized
aaatacagtagttaattctg

SEQ ID NO: 525230 - DNA, 20 bp, Artificial Sequence
  chemically synthesized
taaaatgtgaaatgtcatct

SEQ ID NO: 525231 - DNA, 20 bp, Artificial Sequence
  chemically synthesized
atcattagtgtatagcgttt

SEQ ID NO: 525232 - DNA, 20 bp, Artificial Sequence
  chemically synthesized
aggactaacaaattaaaaaa

SEQ ID NO: 525233 - DNA, 20 bp, Artificial Sequence
  chemically synthesized
aactatattgctgtatgtca

SEQ ID NO: 525234 - DNA, 20 bp, Artificial Sequence
  chemically synthesized
acattttatagatgtcacaa

SEQ ID NO: 525235 - DNA, 20 bp, Artificial Sequence
  chemically synthesized
ggctcttggatcaggctatc

SEQ ID NO: 525236 - DNA, 20 bp, Artificial Sequence
  chemically synthesized
tattctaagggtacaggctc

SEQ ID NO: 525237 - DNA, 20 bp, Artificial Sequence
  chemically synthesized
gatccaagagcctgtaccct

SEQ ID NO: 525238 - DNA, 20 bp, Artificial Sequence
  chemically synthesized
ggaggagcagattatattct

SEQ ID NO: 525239 - DNA, 20 bp, Artificial Sequence
  chemically synthesized
ccagattagcgccatctccc

SEQ ID NO: 525240 - DNA, 20 bp, Artificial Sequence
  chemically synthesized
aaatgtttctcttcctcact

SEQ ID NO: 525241 - DNA, 20 bp, Artificial Sequence
  chemically synthesized
ttttttttttttttatgaga

SEQ ID NO: 525242 - DNA, 20 bp, Artificial Sequence
  chemically synthesized
tctggctcagtcgtccaggc

SEQ ID NO: 525243 - DNA, 20 bp, Artificial Sequence
  chemically synthesized
ctcactgcaagctccgcctc

SEQ ID NO: 525244 - DNA, 20 bp, Artificial Sequence
  chemically synthesized
tactcaggaggcagaggcag

SEQ ID NO: 525245 - DNA, 20 bp, Artificial Sequence
  chemically synthesized
cattctcctgcctctgcctc

SEQ ID NO: 525246 - DNA, 20 bp, Artificial Sequence
  chemically synthesized
ttttgtatttttagtagaga

SEQ ID NO: 525247 - DNA, 20 bp, Artificial Sequence
  chemically synthesized
tggggtttcaccttgttagc

SEQ ID NO: 525248 - DNA, 20 bp, Artificial Sequence
  chemically synthesized
actttgggaggccgaggcgg

SEQ ID NO: 525249 - DNA, 20 bp, Artificial Sequence
  chemically synthesized
gcctcggcctcccaaagtgc

SEQ ID NO: 525250 - DNA, 20 bp, Artificial Sequence
  chemically synthesized
ccgttatagtattaagcaaa

SEQ ID NO: 525251 - DNA, 20 bp, Artificial Sequence
  chemically synthesized
ttccctcttgtcacctaggc

SEQ ID NO: 525252 - DNA, 20 bp, Artificial Sequence
  chemically synthesized
tacttgagaggctgaggcag

SEQ ID NO: 525253 - DNA, 20 bp, Artificial Sequence
  chemically synthesized
gcctcagcctctcaagtagc

SEQ ID NO: 525254 - DNA, 20 bp, Artificial Sequence
  chemically synthesized
actaaaaatacaacaattag

SEQ ID NO: 525255 - DNA, 20 bp, Artificial Sequence
  chemically synthesized
tgttgtatttttagtacaga

SEQ ID NO: 525256 - DNA, 20 bp, Artificial Sequence
  chemically synthesized
tgggtgggtcacttgagatc

SEQ ID NO: 525257 - DNA, 20 bp, Artificial Sequence
  chemically synthesized
agtttgggaggccaagttgg

SEQ ID NO: 525258 - DNA, 20 bp, Artificial Sequence
  chemically synthesized
cagaagtttgggaggccaag

SEQ ID NO: 525259 - DNA, 20 bp, Artificial Sequence
  chemically synthesized
aacttggcctcccaaacttc

SEQ ID NO: 525260 - DNA, 20 bp, Artificial Sequence
  chemically synthesized
aaacaacttgaaagaggaag

SEQ ID NO: 525261 - DNA, 20 bp, Artificial Sequence
  chemically synthesized
ttcctctttcaagttgtttc

SEQ ID NO: 525262 - DNA, 20 bp, Artificial Sequence
  chemically synthesized
ttcaagttgtttcctgggtg

SEQ ID NO: 525263 - DNA, 20 bp, Artificial Sequence
  chemically synthesized
ggccttatcaaacaccaggg

SEQ ID NO: 525264 - DNA, 20 bp, Artificial Sequence
  chemically synthesized
ctctgaggtgagaagctagt

SEQ ID NO: 525265 - DNA, 20 bp, Artificial Sequence
  chemically synthesized
ccccactagcctcaccattt

SEQ ID NO: 525266 - DNA, 20 bp, Artificial Sequence
  chemically synthesized
gtgaggctagtggggaagga

SEQ ID NO: 525267 - DNA, 20 bp, Artificial Sequence
  chemically synthesized
taattaatagataaggtaca

SEQ ID NO: 525268 - DNA, 20 bp, Artificial Sequence
  chemically synthesized
ccctctgtcacagttggatg

SEQ ID NO: 525269 - DNA, 20 bp, Artificial Sequence
  chemically synthesized
cacacttccctctgtcacag

SEQ ID NO: 525270 - DNA, 20 bp, Artificial Sequence
  chemically synthesized
gtagtctgggtttttgctcg

SEQ ID NO: 525271 - DNA, 20 bp, Artificial Sequence
  chemically synthesized
tatccttacttcaaagtagt

SEQ ID NO: 525272 - DNA, 20 bp, Artificial Sequence
  chemically synthesized
aacccagactactttgaagt

SEQ ID NO: 525273 - DNA, 20 bp, Artificial Sequence
  chemically synthesized
tgtacaatataaaaccattt

SEQ ID NO: 525274 - DNA, 20 bp, Artificial Sequence
  chemically synthesized
aaaccatttctgaattttag

SEQ ID NO: 525275 - DNA, 20 bp, Artificial Sequence
  chemically synthesized
tctctcttttttttttgaaa

SEQ ID NO: 525276 - DNA, 20 bp, Artificial Sequence
  chemically synthesized
tgtactccagcctgggcaac

SEQ ID NO: 525277 - DNA, 20 bp, Artificial Sequence
  chemically synthesized
ttcactcttgttgcccaggc

SEQ ID NO: 525278 - DNA, 20 bp, Artificial Sequence
  chemically synthesized
tacttgggaggctgaggcag

SEQ ID NO: 525279 - DNA, 20 bp, Artificial Sequence
  chemically synthesized
ttgtatttttttagtagaga

SEQ ID NO: 525280 - DNA, 20 bp, Artificial Sequence
  chemically synthesized
tgagtggatcacttgaggtc

SEQ ID NO: 525281 - DNA, 20 bp, Artificial Sequence
  chemically synthesized
attttgggaagccaaggtga

SEQ ID NO: 525282 - DNA, 20 bp, Artificial Sequence
  chemically synthesized
cagcattttgggaagccaag

SEQ ID NO: 525283 - DNA, 20 bp, Artificial Sequence
  chemically synthesized
accttggcttcccaaaatgc

SEQ ID NO: 525284 - DNA, 20 bp, Artificial Sequence
  chemically synthesized
ataccactgggcaatagcaa

SEQ ID NO: 525285 - DNA, 20 bp, Artificial Sequence
  chemically synthesized
gggcaatagcaactgaatat

SEQ ID NO: 525286 - DNA, 20 bp, Artificial Sequence
  chemically synthesized
tttctatttgtgaagtgggc

SEQ ID NO: 525287 - DNA, 20 bp, Artificial Sequence
  chemically synthesized
gtacttgattgtcaattaaa

SEQ ID NO: 525288 - DNA, 20 bp, Artificial Sequence
  chemically synthesized
aaaatttagtaataaaaact

SEQ ID NO: 525289 - DNA, 20 bp, Artificial Sequence
  chemically synthesized
agcttttgttgtgcacgtat

SEQ ID NO: 525290 - DNA, 20 bp, Artificial Sequence
  chemically synthesized
tggtatctataataagccta

SEQ ID NO: 525291 - DNA, 20 bp, Artificial Sequence
  chemically synthesized
taaacataatagttgccaaa

SEQ ID NO: 525292 - DNA, 20 bp, Artificial Sequence
  chemically synthesized
ccaaaagggattcatagctt

SEQ ID NO: 525293 - DNA, 20 bp, Artificial Sequence
  chemically synthesized
tttaaatcaattcaaaagct

SEQ ID NO: 525294 - DNA, 20 bp, Artificial Sequence
  chemically synthesized
aacctccctgtcacttccaa

SEQ ID NO: 525295 - DNA, 20 bp, Artificial Sequence
  chemically synthesized
cccatgacaaaactttcagc

SEQ ID NO: 525296 - DNA, 20 bp, Artificial Sequence
  chemically synthesized
cggaatacatttattccttc

SEQ ID NO: 525297 - DNA, 20 bp, Artificial Sequence
  chemically synthesized
tgcaaatgatagactcaaga

SEQ ID NO: 525298 - DNA, 20 bp, Artificial Sequence
  chemically synthesized
ctatggtgtgccacttggaa

SEQ ID NO: 525299 - DNA, 20 bp, Artificial Sequence
  chemically synthesized
acttggaaagggatctaaat

SEQ ID NO: 525300 - DNA, 20 bp, Artificial Sequence
  chemically synthesized
atatgacatgcagcatttta

SEQ ID NO: 525301 - DNA, 20 bp, Artificial Sequence
  chemically synthesized
cagcattttaaagggtactc

SEQ ID NO: 525302 - DNA, 20 bp, Artificial Sequence
  chemically synthesized
acaggcatcaaaatgaattc

SEQ ID NO: 525303 - DNA, 20 bp, Artificial Sequence
  chemically synthesized
aagtgagtacaggcatcaaa

SEQ ID NO: 525304 - DNA, 20 bp, Artificial Sequence
  chemically synthesized
tgtaaaacatatgtgctcaa

SEQ ID NO: 525305 - DNA, 20 bp, Artificial Sequence
  chemically synthesized
tgaagacctccctctcttag

SEQ ID NO: 525306 - DNA, 20 bp, Artificial Sequence
  chemically synthesized
gatgttgaaaaaagatgtgt

SEQ ID NO: 525307 - DNA, 20 bp, Artificial Sequence
  chemically synthesized
gtattatcacttgtgtgtgt

SEQ ID NO: 525308 - DNA, 20 bp, Artificial Sequence
  chemically synthesized
gtgataatacctacataata

SEQ ID NO: 525309 - DNA, 20 bp, Artificial Sequence
  chemically synthesized
gaatccacaagatatgcaaa

SEQ ID NO: 525310 - DNA, 20 bp, Artificial Sequence
  chemically synthesized
agattcattttgcatatctt

SEQ ID NO: 525311 - DNA, 20 bp, Artificial Sequence
  chemically synthesized
gggagagagggtgctgtata

SEQ ID NO: 525312 - DNA, 20 bp, Artificial Sequence
  chemically synthesized
acacacaaacaggggggaga

SEQ ID NO: 525313 - DNA, 20 bp, Artificial Sequence
  chemically synthesized
tctgtgtgtagatgtgtaga

SEQ ID NO: 525314 - DNA, 20 bp, Artificial Sequence
  chemically synthesized
aaatgccccacaattatcat

SEQ ID NO: 525315 - DNA, 20 bp, Artificial Sequence
  chemically synthesized
attttagatgctttttgtga

SEQ ID NO: 525316 - DNA, 20 bp, Artificial Sequence
  chemically synthesized
ttaacacagtattgtgtaag

SEQ ID NO: 525317 - DNA, 20 bp, Artificial Sequence
  chemically synthesized
agttttcttatctgcaaaat

SEQ ID NO: 525318 - DNA, 20 bp, Artificial Sequence
  chemically synthesized
gatactaaaagcatatgttt

SEQ ID NO: 525319 - DNA, 20 bp, Artificial Sequence
  chemically synthesized
tgttaaaaatctgctaagta

SEQ ID NO: 525320 - DNA, 20 bp, Artificial Sequence
  chemically synthesized
cctagatagcatttaataat

SEQ ID NO: 525321 - DNA, 20 bp, Artificial Sequence
  chemically synthesized
gctgttaattggtaagtagc

SEQ ID NO: 525322 - DNA, 20 bp, Artificial Sequence
  chemically synthesized
tgagcttgttaagtaagatg

SEQ ID NO: 525323 - DNA, 20 bp, Artificial Sequence
  chemically synthesized
agtaagatgttgaatactgg

SEQ ID NO: 525324 - DNA, 20 bp, Artificial Sequence
  chemically synthesized
ccctcagcctcccaaagttc

SEQ ID NO: 525325 - DNA, 20 bp, Artificial Sequence
  chemically synthesized
ccagaactttgggaggctga

SEQ ID NO: 525326 - DNA, 20 bp, Artificial Sequence
  chemically synthesized
gggttagatcacttgaggtc

SEQ ID NO: 525327 - DNA, 20 bp, Artificial Sequence
  chemically synthesized
actaaaaatacaaaaattag

SEQ ID NO: 525328 - DNA, 20 bp, Artificial Sequence
  chemically synthesized
gcctcagcccccagagtagc

SEQ ID NO: 525329 - DNA, 20 bp, Artificial Sequence
  chemically synthesized
gattctcctgcctcagcccc

SEQ ID NO: 525330 - DNA, 20 bp, Artificial Sequence
  chemically synthesized
tactctgggggctgaggcag

SEQ ID NO: 525331 - DNA, 20 bp, Artificial Sequence
  chemically synthesized
ctcactgcaacctccacctc

SEQ ID NO: 525332 - DNA, 20 bp, Artificial Sequence
  chemically synthesized
tggtggctggagtgcagtgg

SEQ ID NO: 525333 - DNA, 20 bp, Artificial Sequence
  chemically synthesized
ggctggagttcagtggtggc

SEQ ID NO: 525334 - DNA, 20 bp, Artificial Sequence
  chemically synthesized
agccaccactgaactccagc

SEQ ID NO: 525335 - DNA, 20 bp, Artificial Sequence
  chemically synthesized
tcttgctctgtcacccaggc

SEQ ID NO: 525336 - DNA, 20 bp, Artificial Sequence
  chemically synthesized
tttttttttttttttggaga

SEQ ID NO: 525337 - DNA, 20 bp, Artificial Sequence
  chemically synthesized
aaaaaaaaaaaaaaaaaatg

SEQ ID NO: 525338 - DNA, 20 bp, Artificial Sequence
  chemically synthesized
agagtctgtttcagtaggtt

SEQ ID NO: 525339 - DNA, 20 bp, Artificial Sequence
  chemically synthesized
ctggggttcttgttaaattt

SEQ ID NO: 525340 - DNA, 20 bp, Artificial Sequence
  chemically synthesized
ataactgtgtctaaataatc

SEQ ID NO: 525341 - DNA, 20 bp, Artificial Sequence
  chemically synthesized
tttgtttcttgttacacctg

SEQ ID NO: 525342 - DNA, 20 bp, Artificial Sequence
  chemically synthesized
aatctttttgaaagtaataa

SEQ ID NO: 525343 - DNA, 20 bp, Artificial Sequence
  chemically synthesized
tattatctgatcagggcgaa

SEQ ID NO: 525344 - DNA, 20 bp, Artificial Sequence
  chemically synthesized
gcatctaagttaaaaaaatc

SEQ ID NO: 525345 - DNA, 20 bp, Artificial Sequence
  chemically synthesized
ttacaagtttgattttgatt

SEQ ID NO: 525346 - DNA, 20 bp, Artificial Sequence
  chemically synthesized
taaaaaataagcttgaaaac

SEQ ID NO: 525347 - DNA, 20 bp, Artificial Sequence
  chemically synthesized
ttattttttaaatgaacata

SEQ ID NO: 525348 - DNA, 20 bp, Artificial Sequence
  chemically synthesized
tgttaaatgataacatgtga

SEQ ID NO: 525349 - DNA, 20 bp, Artificial Sequence
  chemically synthesized
aaatgaaaaatactaagaga

SEQ ID NO: 525350 - DNA, 20 bp, Artificial Sequence
  chemically synthesized
tttcaaatgaaaaatactaa

SEQ ID NO: 525351 - DNA, 20 bp, Artificial Sequence
  chemically synthesized
agagtgtgtatttttggatt

SEQ ID NO: 525352 - DNA, 20 bp, Artificial Sequence
  chemically synthesized
gcatttcagagtgtgtattt

SEQ ID NO: 525353 - DNA, 20 bp, Artificial Sequence
  chemically synthesized
tttcagattttggagcattt

SEQ ID NO: 525354 - DNA, 20 bp, Artificial Sequence
  chemically synthesized
taaagtgcaggaaaacataa

SEQ ID NO: 525355 - DNA, 20 bp, Artificial Sequence
  chemically synthesized
aagtgaatttgtgtttagtc

SEQ ID NO: 525356 - DNA, 20 bp, Artificial Sequence
  chemically synthesized
gtttcagatttgggatttta

SEQ ID NO: 525357 - DNA, 20 bp, Artificial Sequence
  chemically synthesized
gacctgaagtgtttcagatt

SEQ ID NO: 525358 - DNA, 20 bp, Artificial Sequence
  chemically synthesized
cacttcaggtcccaagcatt

SEQ ID NO: 525359 - DNA, 20 bp, Artificial Sequence
  chemically synthesized
ggtcccaagcattttggata

SEQ ID NO: 525360 - DNA, 20 bp, Artificial Sequence
  chemically synthesized
atagttaatgatgatacgga

SEQ ID NO: 525361 - DNA, 20 bp, Artificial Sequence
  chemically synthesized
tgactatagttaatgatgat

SEQ ID NO: 525362 - DNA, 20 bp, Artificial Sequence
  chemically synthesized
tgaggtagttaagagagagg

SEQ ID NO: 525363 - DNA, 20 bp, Artificial Sequence
  chemically synthesized
aaaaggttgattttaaagta

SEQ ID NO: 525364 - DNA, 20 bp, Artificial Sequence
  chemically synthesized
ccacgttatcttactttatg

SEQ ID NO: 525365 - DNA, 20 bp, Artificial Sequence
  chemically synthesized
cagcaacatgaatgaacctg

SEQ ID NO: 525366 - DNA, 20 bp, Artificial Sequence
  chemically synthesized
aacctgccatttgcagcaac

SEQ ID NO: 525367 - DNA, 20 bp, Artificial Sequence
  chemically synthesized
tggcaggtttcattctcttc

SEQ ID NO: 525368 - DNA, 20 bp, Artificial Sequence
  chemically synthesized
gaatactgttcatccatgaa

SEQ ID NO: 525369 - DNA, 20 bp, Artificial Sequence
  chemically synthesized
aatgtggtatacgtacacaa

SEQ ID NO: 525370 - DNA, 20 bp, Artificial Sequence
  chemically synthesized
aagggtccatcaactggtga

SEQ ID NO: 525371 - DNA, 20 bp, Artificial Sequence
  chemically synthesized
acctaagggtccatcaactg

SEQ ID NO: 525372 - DNA, 20 bp, Artificial Sequence
  chemically synthesized
ctgagatatggaatcaacct

SEQ ID NO: 525373 - DNA, 20 bp, Artificial Sequence
  chemically synthesized
cattcacaattgctgagata

SEQ ID NO: 525374 - DNA, 20 bp, Artificial Sequence
  chemically synthesized
gattccatatctcagcaatt

SEQ ID NO: 525375 - DNA, 20 bp, Artificial Sequence
  chemically synthesized
gtgaatgtgctgcaataaac

SEQ ID NO: 525376 - DNA, 20 bp, Artificial Sequence
  chemically synthesized
tatagccagtagtgggactg

SEQ ID NO: 525377 - DNA, 20 bp, Artificial Sequence
  chemically synthesized
tgcacaccgttggtgggaat

SEQ ID NO: 525378 - DNA, 20 bp, Artificial Sequence
  chemically synthesized
aacccttgcacaccgttggt

SEQ ID NO: 525379 - DNA, 20 bp, Artificial Sequence
  chemically synthesized
cattcccaccaacggtgtgc

SEQ ID NO: 525380 - DNA, 20 bp, Artificial Sequence
  chemically synthesized
ttgatgtcattctaacaggt

SEQ ID NO: 525381 - DNA, 20 bp, Artificial Sequence
  chemically synthesized
agatatcaactcaaacctgt

SEQ ID NO: 525382 - DNA, 20 bp, Artificial Sequence
  chemically synthesized
gtttgagttgatatctcact

SEQ ID NO: 525383 - DNA, 20 bp, Artificial Sequence
  chemically synthesized
aagacattcacatagccaac

SEQ ID NO: 525384 - DNA, 20 bp, Artificial Sequence
  chemically synthesized
ttcgtattcctgttggctat

SEQ ID NO: 525385 - DNA, 20 bp, Artificial Sequence
  chemically synthesized
gatcttttgctcatttttaa

SEQ ID NO: 525386 - DNA, 20 bp, Artificial Sequence
  chemically synthesized
ttttcttgctatttatttgt

SEQ ID NO: 525387 - DNA, 20 bp, Artificial Sequence
  chemically synthesized
tgtacaccatacatcttata

SEQ ID NO: 525388 - DNA, 20 bp, Artificial Sequence
  chemically synthesized
tgaagagaaaacctacagaa

SEQ ID NO: 525389 - DNA, 20 bp, Artificial Sequence
  chemically synthesized
cagagtgaagagaaaaccta

SEQ ID NO: 525390 - DNA, 20 bp, Artificial Sequence
  chemically synthesized
acagtaaaggaaagaatcaa

SEQ ID NO: 525391 - DNA, 20 bp, Artificial Sequence
  chemically synthesized
aagttctgcacagtaaagga

SEQ ID NO: 525392 - DNA, 20 bp, Artificial Sequence
  chemically synthesized
cctttactgtgcagaacttt

SEQ ID NO: 525393 - DNA, 20 bp, Artificial Sequence
  chemically synthesized
caaaaccaaatatagacaaa

SEQ ID NO: 525394 - DNA, 20 bp, Artificial Sequence
  chemically synthesized
atgatctgggcaaaaatttt

SEQ ID NO: 525395 - DNA, 20 bp, Artificial Sequence
  chemically synthesized
gtttatgcctttaatccatt

SEQ ID NO: 525396 - DNA, 20 bp, Artificial Sequence
  chemically synthesized
tgtacaaaaattaactcata

SEQ ID NO: 525397 - DNA, 20 bp, Artificial Sequence
  chemically synthesized
ttttgtacatggtctgatat

SEQ ID NO: 525398 - DNA, 20 bp, Artificial Sequence
  chemically synthesized
gggtctaattttttctgcat

SEQ ID NO: 525399 - DNA, 20 bp, Artificial Sequence
  chemically synthesized
agaagattgttcttttcgca

SEQ ID NO: 525400 - DNA, 20 bp, Artificial Sequence
  chemically synthesized
aatcagctggctataattct

SEQ ID NO: 525401 - DNA, 20 bp, Artificial Sequence
  chemically synthesized
agaggccagaaataaatcca

SEQ ID NO: 525402 - DNA, 20 bp, Artificial Sequence
  chemically synthesized
aaaacagacacatagaccaa

SEQ ID NO: 525403 - DNA, 20 bp, Artificial Sequence
  chemically synthesized
tctttttgctcaacattatt

SEQ ID NO: 525404 - DNA, 20 bp, Artificial Sequence
  chemically synthesized
tgcattgactgtagaaagct

SEQ ID NO: 525405 - DNA, 20 bp, Artificial Sequence
  chemically synthesized
tagaaagctttgggtagtgt

SEQ ID NO: 525406 - DNA, 20 bp, Artificial Sequence
  chemically synthesized
attctgtgttcatgtattgg

SEQ ID NO: 525407 - DNA, 20 bp, Artificial Sequence
  chemically synthesized
attcttccaatacatgaaca

SEQ ID NO: 525408 - DNA, 20 bp, Artificial Sequence
  chemically synthesized
ccacccgcccccacaaaaaa

SEQ ID NO: 525409 - DNA, 20 bp, Artificial Sequence
  chemically synthesized
ttattcctttttttgtgggg

SEQ ID NO: 525410 - DNA, 20 bp, Artificial Sequence
  chemically synthesized
gggggcgggtggacagagga

SEQ ID NO: 525411 - DNA, 20 bp, Artificial Sequence
  chemically synthesized
tcttgctctgtcgcccagtc

SEQ ID NO: 525412 - DNA, 20 bp, Artificial Sequence
  chemically synthesized
ctcactgcaacctctgcctc

SEQ ID NO: 525413 - DNA, 20 bp, Artificial Sequence
  chemically synthesized
ggccgaggcatgagaatcgc

SEQ ID NO: 525414 - DNA, 20 bp, Artificial Sequence
  chemically synthesized
tacctgggtggccgaggcat

SEQ ID NO: 525415 - DNA, 20 bp, Artificial Sequence
  chemically synthesized
gcctcggccacccaggtagc

SEQ ID NO: 525416 - DNA, 20 bp, Artificial Sequence
  chemically synthesized
acacctgtaatcccagctac

SEQ ID NO: 525417 - DNA, 20 bp, Artificial Sequence
  chemically synthesized
ttggcggatcacctgaggtc

SEQ ID NO: 525418 - DNA, 20 bp, Artificial Sequence
  chemically synthesized
actttgggaggccgaggttg

SEQ ID NO: 525419 - DNA, 20 bp, Artificial Sequence
  chemically synthesized
acctcggcctcccaaagtga

SEQ ID NO: 525420 - DNA, 20 bp, Artificial Sequence
  chemically synthesized
ttttttgtagctattgtaaa

SEQ ID NO: 525421 - DNA, 20 bp, Artificial Sequence
  chemically synthesized
ttttattttccctaagttat

SEQ ID NO: 525422 - DNA, 20 bp, Artificial Sequence
  chemically synthesized
ctgtgtatactgcttgggtg

SEQ ID NO: 525423 - DNA, 20 bp, Artificial Sequence
  chemically synthesized
tacggtgctgtgtatactgc

SEQ ID NO: 525424 - DNA, 20 bp, Artificial Sequence
  chemically synthesized
gagaagagttgggggaggca

SEQ ID NO: 525425 - DNA, 20 bp, Artificial Sequence
  chemically synthesized
gactttggggacttggggag

SEQ ID NO: 525426 - DNA, 20 bp, Artificial Sequence
  chemically synthesized
ctataagaacacaaaggcat

SEQ ID NO: 525427 - DNA, 20 bp, Artificial Sequence
  chemically synthesized
cgatgtttggttttccattc

SEQ ID NO: 525428 - DNA, 20 bp, Artificial Sequence
  chemically synthesized
tattctaagtgaagtaactc

SEQ ID NO: 525429 - DNA, 20 bp, Artificial Sequence
  chemically synthesized
cattcctgagttacttcact

SEQ ID NO: 525430 - DNA, 20 bp, Artificial Sequence
  chemically synthesized
ttaacagcatttgcagtgac

SEQ ID NO: 525431 - DNA, 20 bp, Artificial Sequence
  chemically synthesized
aaaggcccatcaatcaacga

SEQ ID NO: 525432 - DNA, 20 bp, Artificial Sequence
  chemically synthesized
acccaaaggcccatcaatca

SEQ ID NO: 525433 - DNA, 20 bp, Artificial Sequence
  chemically synthesized
actcgttgattgatgggcct

SEQ ID NO: 525434 - DNA, 20 bp, Artificial Sequence
  chemically synthesized
atataataacttatttttgt

SEQ ID NO: 525435 - DNA, 20 bp, Artificial Sequence
  chemically synthesized
tctgggtagatatctggtag

SEQ ID NO: 525436 - DNA, 20 bp, Artificial Sequence
  chemically synthesized
gatatctggtagtgggattg

SEQ ID NO: 525437 - DNA, 20 bp, Artificial Sequence
  chemically synthesized
gttctacttttagttattta

SEQ ID NO: 525438 - DNA, 20 bp, Artificial Sequence
  chemically synthesized
aacacttctacactgctggt

SEQ ID NO: 525439 - DNA, 20 bp, Artificial Sequence
  chemically synthesized
aaaaaacggtagatgttggc

SEQ ID NO: 525440 - DNA, 20 bp, Artificial Sequence
  chemically synthesized
ttgattatggccattcttgc

SEQ ID NO: 525441 - DNA, 20 bp, Artificial Sequence
  chemically synthesized
tgataccaccttactcctgc

SEQ ID NO: 525442 - DNA, 20 bp, Artificial Sequence
  chemically synthesized
ccatctgtagatcttcttta

SEQ ID NO: 525443 - DNA, 20 bp, Artificial Sequence
  chemically synthesized
tcaaaaagtgttctaaggat

SEQ ID NO: 525444 - DNA, 20 bp, Artificial Sequence
  chemically synthesized
atcccatcaaaaagtgttct

SEQ ID NO: 525445 - DNA, 20 bp, Artificial Sequence
  chemically synthesized
atccttagaacactttttga

SEQ ID NO: 525446 - DNA, 20 bp, Artificial Sequence
  chemically synthesized
gtttgtgttcattgtagatt

SEQ ID NO: 525447 - DNA, 20 bp, Artificial Sequence
  chemically synthesized
tctgacagaggactaatatc

SEQ ID NO: 525448 - DNA, 20 bp, Artificial Sequence
  chemically synthesized
agggcaaaaggaacagtcag

SEQ ID NO: 525449 - DNA, 20 bp, Artificial Sequence
  chemically synthesized
tgtttttactgcatttgctt

SEQ ID NO: 525450 - DNA, 20 bp, Artificial Sequence
  chemically synthesized
ttctagacattggcttaggc

SEQ ID NO: 525451 - DNA, 20 bp, Artificial Sequence
  chemically synthesized
ttgcctaagccaatgtctag

SEQ ID NO: 525452 - DNA, 20 bp, Artificial Sequence
  chemically synthesized
gtttttccaatgttatcttc

SEQ ID NO: 525453 - DNA, 20 bp, Artificial Sequence
  chemically synthesized
gaatttttatagtttcaggt

SEQ ID NO: 525454 - DNA, 20 bp, Artificial Sequence
  chemically synthesized
tttttcagatagattgctat

SEQ ID NO: 525455 - DNA, 20 bp, Artificial Sequence
  chemically synthesized
aaacaaattcagtaaaattg

SEQ ID NO: 525456 - DNA, 20 bp, Artificial Sequence
  chemically synthesized
ttttgtatcctgcaatttta

SEQ ID NO: 525457 - DNA, 20 bp, Artificial Sequence
  chemically synthesized
ttatttctaacagtttttgg

SEQ ID NO: 525458 - DNA, 20 bp, Artificial Sequence
  chemically synthesized
aaaaatctccacatgttggc

SEQ ID NO: 525459 - DNA, 20 bp, Artificial Sequence
  chemically synthesized
attagtacatctatgaaaaa

SEQ ID NO: 525460 - DNA, 20 bp, Artificial Sequence
  chemically synthesized
aatagaatggagatttctct

SEQ ID NO: 525461 - DNA, 20 bp, Artificial Sequence
  chemically synthesized
ttgatatagtattctcacaa

SEQ ID NO: 525462 - DNA, 20 bp, Artificial Sequence
  chemically synthesized
ttgggtagatacccagttgt

SEQ ID NO: 525463 - DNA, 20 bp, Artificial Sequence
  chemically synthesized
atataattatttcttttcat

SEQ ID NO: 525464 - DNA, 20 bp, Artificial Sequence
  chemically synthesized
aatagtgctgcagtaaacat

SEQ ID NO: 525465 - DNA, 20 bp, Artificial Sequence
  chemically synthesized
aattctatatatttgctatt

SEQ ID NO: 525466 - DNA, 20 bp, Artificial Sequence
  chemically synthesized
tattcacaatagcaaatata

SEQ ID NO: 525467 - DNA, 20 bp, Artificial Sequence
  chemically synthesized
atagaatttacttaagttga

SEQ ID NO: 525468 - DNA, 20 bp, Artificial Sequence
  chemically synthesized
aaacattatttagccacaaa

SEQ ID NO: 525469 - DNA, 20 bp, Artificial Sequence
  chemically synthesized
atcatgtcttttgcaacaac

SEQ ID NO: 525470 - DNA, 20 bp, Artificial Sequence
  chemically synthesized
cagtatttgtctttcagtgt

SEQ ID NO: 525471 - DNA, 20 bp, Artificial Sequence
  chemically synthesized
ataatgtgtacatttgaaag

SEQ ID NO: 525472 - DNA, 20 bp, Artificial Sequence
  chemically synthesized
gtacatttgaaagtagagtg

SEQ ID NO: 525473 - DNA, 20 bp, Artificial Sequence
  chemically synthesized
gtgtggaatgattgacaatg

SEQ ID NO: 525474 - DNA, 20 bp, Artificial Sequence
  chemically synthesized
gattgacaatggggaatcag

SEQ ID NO: 525475 - DNA, 20 bp, Artificial Sequence
  chemically synthesized
agaagggtggaggcatggga

SEQ ID NO: 525476 - DNA, 20 bp, Artificial Sequence
  chemically synthesized
caatgcatattattcaggtg

SEQ ID NO: 525477 - DNA, 20 bp, Artificial Sequence
  chemically synthesized
tattttagggcattcatcac

SEQ ID NO: 525478 - DNA, 20 bp, Artificial Sequence
  chemically synthesized
atgttatttgtatatattta

SEQ ID NO: 525479 - DNA, 20 bp, Artificial Sequence
  chemically synthesized
acatttttaaaaataaaaat

SEQ ID NO: 525480 - DNA, 20 bp, Artificial Sequence
  chemically synthesized
acattatgtcatcggcacac

SEQ ID NO: 525481 - DNA, 20 bp, Artificial Sequence
  chemically synthesized
ttaacttctttttttcctat

SEQ ID NO: 525482 - DNA, 20 bp, Artificial Sequence
  chemically synthesized
cctggaagtaattaggcaag

SEQ ID NO: 525483 - DNA, 20 bp, Artificial Sequence
  chemically synthesized
taattacttccaggactgtg

SEQ ID NO: 525484 - DNA, 20 bp, Artificial Sequence
  chemically synthesized
gttgaatagaagtggagaca

SEQ ID NO: 525485 - DNA, 20 bp, Artificial Sequence
  chemically synthesized
tctaagatctggcacaagac

SEQ ID NO: 525486 - DNA, 20 bp, Artificial Sequence
  chemically synthesized
tcaataaagcaagaattata

SEQ ID NO: 525487 - DNA, 20 bp, Artificial Sequence
  chemically synthesized
ggcattttcttcaataaagc

SEQ ID NO: 525488 - DNA, 20 bp, Artificial Sequence
  chemically synthesized
tagacagctgattatataag

SEQ ID NO: 525489 - DNA, 20 bp, Artificial Sequence
  chemically synthesized
ctgctttttatataatttta

SEQ ID NO: 525490 - DNA, 20 bp, Artificial Sequence
  chemically synthesized
tatcgtaatcatattgtttt

SEQ ID NO: 525491 - DNA, 20 bp, Artificial Sequence
  chemically synthesized
ataaaatctgaaaaaagtaa

SEQ ID NO: 525492 - DNA, 20 bp, Artificial Sequence
  chemically synthesized
cagtttgctcagaactatat

SEQ ID NO: 525493 - DNA, 20 bp, Artificial Sequence
  chemically synthesized
taaaataaatatttttaagg

SEQ ID NO: 525494 - DNA, 20 bp, Artificial Sequence
  chemically synthesized
aaactcagagtagaaatagc

SEQ ID NO: 525495 - DNA, 20 bp, Artificial Sequence
  chemically synthesized
caactcaagctatttctact

SEQ ID NO: 525496 - DNA, 20 bp, Artificial Sequence
  chemically synthesized
aataactaaacttgcaaact

SEQ ID NO: 525497 - DNA, 20 bp, Artificial Sequence
  chemically synthesized
gggaaaatcaaaccaagcaa

SEQ ID NO: 525498 - DNA, 20 bp, Artificial Sequence
  chemically synthesized
tttccccgaaatggtcaatt

SEQ ID NO: 525499 - DNA, 20 bp, Artificial Sequence
  chemically synthesized
gcctactcagttaaaaaact

SEQ ID NO: 525500 - DNA, 20 bp, Artificial Sequence
  chemically synthesized
tttgattcgtagttttttaa

SEQ ID NO: 525501 - DNA, 20 bp, Artificial Sequence
  chemically synthesized
atctaacctgtttacaggaa

SEQ ID NO: 525502 - DNA, 20 bp, Artificial Sequence
  chemically synthesized
atagaaacaaaacgaaatgg

SEQ ID NO: 525503 - DNA, 20 bp, Artificial Sequence
  chemically synthesized
aatggaagaatttatctggt

SEQ ID NO: 525504 - DNA, 20 bp, Artificial Sequence
  chemically synthesized
tgtattttgatgtgacctaa

SEQ ID NO: 525505 - DNA, 20 bp, Artificial Sequence
  chemically synthesized
agttataaaatgaagcttca

SEQ ID NO: 525506 - DNA, 20 bp, Artificial Sequence
  chemically synthesized
caaattatcagcatttattt

SEQ ID NO: 525507 - DNA, 20 bp, Artificial Sequence
  chemically synthesized
ttctaagtgtatcatgagaa

SEQ ID NO: 525508 - DNA, 20 bp, Artificial Sequence
  chemically synthesized
cttttttaagtggtagcagg

SEQ ID NO: 525509 - DNA, 20 bp, Artificial Sequence
  chemically synthesized
cttattttatgtttaaaaat

SEQ ID NO: 525510 - DNA, 20 bp, Artificial Sequence
  chemically synthesized
acaacagaagtctgtttatc

SEQ ID NO: 525511 - DNA, 20 bp, Artificial Sequence
  chemically synthesized
tttttcctaagaatgatatt

SEQ ID NO: 525512 - DNA, 20 bp, Artificial Sequence
  chemically synthesized
ttaactcccagctttttcct

SEQ ID NO: 525513 - DNA, 20 bp, Artificial Sequence
  chemically synthesized
atcattcttaggaaaaagct

SEQ ID NO: 525514 - DNA, 20 bp, Artificial Sequence
  chemically synthesized
agctgggagttaattggaaa

SEQ ID NO: 525515 - DNA, 20 bp, Artificial Sequence
  chemically synthesized
agtgaatagaaacactcact

SEQ ID NO: 525516 - DNA, 20 bp, Artificial Sequence
  chemically synthesized
atcagttttgactattcaga

SEQ ID NO: 525517 - DNA, 20 bp, Artificial Sequence
  chemically synthesized
tttcatcagttttgactatt

SEQ ID NO: 525518 - DNA, 20 bp, Artificial Sequence
  chemically synthesized
ttccttttattttttggtaa

SEQ ID NO: 525519 - DNA, 20 bp, Artificial Sequence
  chemically synthesized
agcagaacaagacaacaaca

SEQ ID NO: 525520 - DNA, 20 bp, Artificial Sequence
  chemically synthesized
tgtcttgttctgctgaagtt

SEQ ID NO: 525521 - DNA, 20 bp, Artificial Sequence
  chemically synthesized
actggctggccaaaacaact

SEQ ID NO: 525522 - DNA, 20 bp, Artificial Sequence
  chemically synthesized
aaaacaactatgaattttaa

SEQ ID NO: 525523 - DNA, 20 bp, Artificial Sequence
  chemically synthesized
aacagaattgcatgaagtgc

SEQ ID NO: 525524 - DNA, 20 bp, Artificial Sequence
  chemically synthesized
gtgctagaatctcagtttaa

SEQ ID NO: 525525 - DNA, 20 bp, Artificial Sequence
  chemically synthesized
attacttctatgatacaaag

SEQ ID NO: 525526 - DNA, 20 bp, Artificial Sequence
  chemically synthesized
gtaaatttacaactttgttg

SEQ ID NO: 525527 - DNA, 20 bp, Artificial Sequence
  chemically synthesized
caaatttttctttaaaaatg

SEQ ID NO: 525528 - DNA, 20 bp, Artificial Sequence
  chemically synthesized
tttttgtaatccattaagaa

SEQ ID NO: 525529 - DNA, 20 bp, Artificial Sequence
  chemically synthesized
cagttttcattctgttctta

SEQ ID NO: 525530 - DNA, 20 bp, Artificial Sequence
  chemically synthesized
cattaagaacagaatgaaaa

SEQ ID NO: 525531 - DNA, 20 bp, Artificial Sequence
  chemically synthesized
acaggaaaatacattaggtt

SEQ ID NO: 525532 - DNA, 20 bp, Artificial Sequence
  chemically synthesized
aactgtagactctttaattt

SEQ ID NO: 525533 - DNA, 20 bp, Artificial Sequence
  chemically synthesized
cttcatgaaccctgaaatta

SEQ ID NO: 525534 - DNA, 20 bp, Artificial Sequence
  chemically synthesized
tttaatttcagggttcatga

SEQ ID NO: 525535 - DNA, 20 bp, Artificial Sequence
  chemically synthesized
acatgttacattaatactct

SEQ ID NO: 525536 - DNA, 20 bp, Artificial Sequence
  chemically synthesized
atacttctaacattaattcc

SEQ ID NO: 525537 - DNA, 20 bp, Artificial Sequence
  chemically synthesized
ctacatttcattaacatata

SEQ ID NO: 525538 - DNA, 20 bp, Artificial Sequence
  chemically synthesized
acgattaggtcacaaccaat

SEQ ID NO: 525539 - DNA, 20 bp, Artificial Sequence
  chemically synthesized
catttgatagatgctcaatt

SEQ ID NO: 525540 - DNA, 20 bp, Artificial Sequence
  chemically synthesized
gatattccaccttgaaaaag

SEQ ID NO: 525541 - DNA, 20 bp, Artificial Sequence
  chemically synthesized
tgaatcctgctttttcaagg

SEQ ID NO: 525542 - DNA, 20 bp, Artificial Sequence
  chemically synthesized
agaacacacctgggcctccc

SEQ ID NO: 525543 - DNA, 20 bp, Artificial Sequence
  chemically synthesized
tgatgctgaggactagatgg

SEQ ID NO: 525544 - DNA, 20 bp, Artificial Sequence
  chemically synthesized
catctagtcctcagcatcat

SEQ ID NO: 525545 - DNA, 20 bp, Artificial Sequence
  chemically synthesized
caacaagctaacagtggcaa

SEQ ID NO: 525546 - DNA, 20 bp, Artificial Sequence
  chemically synthesized
caaagactcttggggagcag

SEQ ID NO: 525547 - DNA, 20 bp, Artificial Sequence
  chemically synthesized
ttctaattcttctgctcccc

SEQ ID NO: 525548 - DNA, 20 bp, Artificial Sequence
  chemically synthesized
tactgtttaccctagagata

SEQ ID NO: 525549 - DNA, 20 bp, Artificial Sequence
  chemically synthesized
gtaacagaattcactatctc

SEQ ID NO: 525550 - DNA, 20 bp, Artificial Sequence
  chemically synthesized
tgtcctaaattgtcaagtaa

SEQ ID NO: 525551 - DNA, 20 bp, Artificial Sequence
  chemically synthesized
caatttaggacactgatgaa

SEQ ID NO: 525552 - DNA, 20 bp, Artificial Sequence
  chemically synthesized
ccatttaaaaatttatacat

SEQ ID NO: 525553 - DNA, 20 bp, Artificial Sequence
  chemically synthesized
taatttcatttaatgcctga

SEQ ID NO: 525554 - DNA, 20 bp, Artificial Sequence
  chemically synthesized
tttgttttgtttttttgaga

SEQ ID NO: 525555 - DNA, 20 bp, Artificial Sequence
  chemically synthesized
tctcgctctgttgcccaggc

SEQ ID NO: 525556 - DNA, 20 bp, Artificial Sequence
  chemically synthesized
ctcactgcaacgtccacctt

SEQ ID NO: 525557 - DNA, 20 bp, Artificial Sequence
  chemically synthesized
tattcaggaggctgaggcag

SEQ ID NO: 525558 - DNA, 20 bp, Artificial Sequence
  chemically synthesized
gactctcctgcctcagcctc

SEQ ID NO: 525559 - DNA, 20 bp, Artificial Sequence
  chemically synthesized
gcctcagcctcctgaatagc

SEQ ID NO: 525560 - DNA, 20 bp, Artificial Sequence
  chemically synthesized
taaaactacaaaaattagct

SEQ ID NO: 525561 - DNA, 20 bp, Artificial Sequence
  chemically synthesized
ggtgggcagatcatgaggtc

SEQ ID NO: 525562 - DNA, 20 bp, Artificial Sequence
  chemically synthesized
gctttgtttaagtactaaaa

SEQ ID NO: 525563 - DNA, 20 bp, Artificial Sequence
  chemically synthesized
cttaaactgcttcaagaaca

SEQ ID NO: 525564 - DNA, 20 bp, Artificial Sequence
  chemically synthesized
tcaagaacactgaatgataa

SEQ ID NO: 525565 - DNA, 20 bp, Artificial Sequence
  chemically synthesized
ataaaagttcattttcaatg

SEQ ID NO: 525566 - DNA, 20 bp, Artificial Sequence
  chemically synthesized
tgaacttttatcaattttag

SEQ ID NO: 525567 - DNA, 20 bp, Artificial Sequence
  chemically synthesized
tgaatatggtttcttcttcc

SEQ ID NO: 525568 - DNA, 20 bp, Artificial Sequence
  chemically synthesized
ttaactacatgtgatgtgac

SEQ ID NO: 525569 - DNA, 20 bp, Artificial Sequence
  chemically synthesized
tgtagttaaacttttatatt

SEQ ID NO: 525570 - DNA, 20 bp, Artificial Sequence
  chemically synthesized
tcttacttaaaggactgatt

SEQ ID NO: 525571 - DNA, 20 bp, Artificial Sequence
  chemically synthesized
gtcctttaagtaagacagcc

SEQ ID NO: 525572 - DNA, 20 bp, Artificial Sequence
  chemically synthesized
cttgtaatggatgtgacgga

SEQ ID NO: 525573 - DNA, 20 bp, Artificial Sequence
  chemically synthesized
taatgcttgtaatggatgtg

SEQ ID NO: 525574 - DNA, 20 bp, Artificial Sequence
  chemically synthesized
gttacattgtaatgcttgta

SEQ ID NO: 525575 - DNA, 20 bp, Artificial Sequence
  chemically synthesized
attacaatgtaacagataac

SEQ ID NO: 525576 - DNA, 20 bp, Artificial Sequence
  chemically synthesized
tgtatttgctactaaatttt

SEQ ID NO: 525577 - DNA, 20 bp, Artificial Sequence
  chemically synthesized
ataaattttcaataggcaaa

SEQ ID NO: 525578 - DNA, 20 bp, Artificial Sequence
  chemically synthesized
tattctaggaattgtactaa

SEQ ID NO: 525579 - DNA, 20 bp, Artificial Sequence
  chemically synthesized
tactctgttagtacaattcc

SEQ ID NO: 525580 - DNA, 20 bp, Artificial Sequence
  chemically synthesized
acagaagttaaatatattct

SEQ ID NO: 525581 - DNA, 20 bp, Artificial Sequence
  chemically synthesized
ttctcattcttctaaacata

SEQ ID NO: 525582 - DNA, 20 bp, Artificial Sequence
  chemically synthesized
tctgtactccatatgtttag

SEQ ID NO: 525583 - DNA, 20 bp, Artificial Sequence
  chemically synthesized
ccaattgtaaatatcattca

SEQ ID NO: 525584 - DNA, 20 bp, Artificial Sequence
  chemically synthesized
tgataataataatttatcca

SEQ ID NO: 525585 - DNA, 20 bp, Artificial Sequence
  chemically synthesized
ccacattaagtagaccaatt

SEQ ID NO: 525586 - DNA, 20 bp, Artificial Sequence
  chemically synthesized
acaaaatatattttctgaat

SEQ ID NO: 525587 - DNA, 20 bp, Artificial Sequence
  chemically synthesized
cttaaaacaaaatatatttt

SEQ ID NO: 525588 - DNA, 20 bp, Artificial Sequence
  chemically synthesized
aaaaatatatgtgactcatc

SEQ ID NO: 525589 - DNA, 20 bp, Artificial Sequence
  chemically synthesized
gcataaaatcactattcagg

SEQ ID NO: 525590 - DNA, 20 bp, Artificial Sequence
  chemically synthesized
ctgtgcataaaatcactatt

SEQ ID NO: 525591 - DNA, 20 bp, Artificial Sequence
  chemically synthesized
tttatgttggtaaattaaga

SEQ ID NO: 525592 - DNA, 20 bp, Artificial Sequence
  chemically synthesized
aagactgggttgcatgatag

SEQ ID NO: 525593 - DNA, 20 bp, Artificial Sequence
  chemically synthesized
gtagttgataattgtgttct

SEQ ID NO: 525594 - DNA, 20 bp, Artificial Sequence
  chemically synthesized
catagttatgtaaattattt

SEQ ID NO: 525595 - DNA, 20 bp, Artificial Sequence
  chemically synthesized
ttgaataaccaacttaattt

SEQ ID NO: 525596 - DNA, 20 bp, Artificial Sequence
  chemically synthesized
tggacataaaaatgaatatt

SEQ ID NO: 525597 - DNA, 20 bp, Artificial Sequence
  chemically synthesized
tatacagaatggacataaaa

SEQ ID NO: 525598 - DNA, 20 bp, Artificial Sequence
  chemically synthesized
ggcaatcacttgtatttata

SEQ ID NO: 525599 - DNA, 20 bp, Artificial Sequence
  chemically synthesized
atttattctccattatgagc

SEQ ID NO: 525600 - DNA, 20 bp, Artificial Sequence
  chemically synthesized
taagactcatgctcataatg

SEQ ID NO: 525601 - DNA, 20 bp, Artificial Sequence
  chemically synthesized
cctcgctctgtggcccaggc

SEQ ID NO: 525602 - DNA, 20 bp, Artificial Sequence
  chemically synthesized
ctcactgtaagctccgcctc

SEQ ID NO: 525603 - DNA, 20 bp, Artificial Sequence
  chemically synthesized
tactggggaggctgaggcag

SEQ ID NO: 525604 - DNA, 20 bp, Artificial Sequence
  chemically synthesized
aaaattagtcaggcgtggtg

SEQ ID NO: 525605 - DNA, 20 bp, Artificial Sequence
  chemically synthesized
cgtggtttcaccgtgttagc

SEQ ID NO: 525606 - DNA, 20 bp, Artificial Sequence
  chemically synthesized
actttgggaggctgaggtgg

SEQ ID NO: 525607 - DNA, 20 bp, Artificial Sequence
  chemically synthesized
acctcagcctcccaaagtgc

SEQ ID NO: 525608 - DNA, 20 bp, Artificial Sequence
  chemically synthesized
gagccactgcgcctggccgc

SEQ ID NO: 525609 - DNA, 20 bp, Artificial Sequence
  chemically synthesized
catagaaaaaaatggaaaat

SEQ ID NO: 525610 - DNA, 20 bp, Artificial Sequence
  chemically synthesized
taaaaacaagtttcacagat

SEQ ID NO: 525611 - DNA, 20 bp, Artificial Sequence
  chemically synthesized
aataaaatgtgagaataaaa

SEQ ID NO: 525612 - DNA, 20 bp, Artificial Sequence
  chemically synthesized
ttttactaaaaataaaatgt

SEQ ID NO: 525613 - DNA, 20 bp, Artificial Sequence
  chemically synthesized
gaatgtcactttctaatttt

SEQ ID NO: 525614 - DNA, 20 bp, Artificial Sequence
  chemically synthesized
aaaattagaaagtgacattc

SEQ ID NO: 525615 - DNA, 20 bp, Artificial Sequence
  chemically synthesized
attttttaataactacattc

SEQ ID NO: 525616 - DNA, 20 bp, Artificial Sequence
  chemically synthesized
atttattcctgtgaaagatg

SEQ ID NO: 525617 - DNA, 20 bp, Artificial Sequence
  chemically synthesized
aaatactctccatctttcac

SEQ ID NO: 525618 - DNA, 20 bp, Artificial Sequence
  chemically synthesized
agagaaaattatcctatcaa

SEQ ID NO: 525619 - DNA, 20 bp, Artificial Sequence
  chemically synthesized
tctagataaaattcaattga

SEQ ID NO: 525620 - DNA, 20 bp, Artificial Sequence
  chemically synthesized
tatagctgtatcatttactg

SEQ ID NO: 525621 - DNA, 20 bp, Artificial Sequence
  chemically synthesized
cgttaagaacatatctaaat

SEQ ID NO: 525622 - DNA, 20 bp, Artificial Sequence
  chemically synthesized
tgattctggatcaatcattt

SEQ ID NO: 525623 - DNA, 20 bp, Artificial Sequence
  chemically synthesized
caacccagaaatgattgatc

SEQ ID NO: 525624 - DNA, 20 bp, Artificial Sequence
  chemically synthesized
tatctaatttgctcatgatt

SEQ ID NO: 525625 - DNA, 20 bp, Artificial Sequence
  chemically synthesized
caaagttacattttcacatg

SEQ ID NO: 525626 - DNA, 20 bp, Artificial Sequence
  chemically synthesized
cagcatgtgaaaatgtaact

SEQ ID NO: 525627 - DNA, 20 bp, Artificial Sequence
  chemically synthesized
actttgaattaggaaaattg

SEQ ID NO: 525628 - DNA, 20 bp, Artificial Sequence
  chemically synthesized
taggaaaattgcagaatgca

SEQ ID NO: 525629 - DNA, 20 bp, Artificial Sequence
  chemically synthesized
ataacaagattgaagaaaca

SEQ ID NO: 525630 - DNA, 20 bp, Artificial Sequence
  chemically synthesized
aataaatttgagcgataata

SEQ ID NO: 525631 - DNA, 20 bp, Artificial Sequence
  chemically synthesized
ttatttatttatttttgaga

SEQ ID NO: 525632 - DNA, 20 bp, Artificial Sequence
  chemically synthesized
tttgctcttgttgcccaggc

SEQ ID NO: 525633 - DNA, 20 bp, Artificial Sequence
  chemically synthesized
ctcattgcgacctccacctc

SEQ ID NO: 525634 - DNA, 20 bp, Artificial Sequence
  chemically synthesized
tactagggaggctgaggcag

SEQ ID NO: 525635 - DNA, 20 bp, Artificial Sequence
  chemically synthesized
gcctcagcctccctagtagc

SEQ ID NO: 525636 - DNA, 20 bp, Artificial Sequence
  chemically synthesized
ttttgtattttcagtagaga

SEQ ID NO: 525637 - DNA, 20 bp, Artificial Sequence
  chemically synthesized
tgggcagatcacctaaggtc

SEQ ID NO: 525638 - DNA, 20 bp, Artificial Sequence
  chemically synthesized
gagcataaatgctacataat

SEQ ID NO: 525639 - DNA, 20 bp, Artificial Sequence
  chemically synthesized
ttacataaatttgatttgat

SEQ ID NO: 525640 - DNA, 20 bp, Artificial Sequence
  chemically synthesized
ttgttaaaaatgggcaggcc

SEQ ID NO: 525641 - DNA, 20 bp, Artificial Sequence
  chemically synthesized
cttgcatttttgcaggagta

SEQ ID NO: 525642 - DNA, 20 bp, Artificial Sequence
  chemically synthesized
tcaattccttgcatttttgc

SEQ ID NO: 525643 - DNA, 20 bp, Artificial Sequence
  chemically synthesized
cttactcctgcaaaaatgca

SEQ ID NO: 525644 - DNA, 20 bp, Artificial Sequence
  chemically synthesized
acttcatttggggagaggta

SEQ ID NO: 525645 - DNA, 20 bp, Artificial Sequence
  chemically synthesized
ccaaatgaagtaacacagtt

SEQ ID NO: 525646 - DNA, 20 bp, Artificial Sequence
  chemically synthesized
aaaataaaattttagtcttt

SEQ ID NO: 525647 - DNA, 20 bp, Artificial Sequence
  chemically synthesized
tatgttccattcaggtatca

SEQ ID NO: 525648 - DNA, 20 bp, Artificial Sequence
  chemically synthesized
agtacagtatcccttgatac

SEQ ID NO: 525649 - DNA, 20 bp, Artificial Sequence
  chemically synthesized
atcaagggatactgtactca

SEQ ID NO: 525650 - DNA, 20 bp, Artificial Sequence
  chemically synthesized
aatgtcagatggtgcattct

SEQ ID NO: 525651 - DNA, 20 bp, Artificial Sequence
  chemically synthesized
tgacatttttattaaattta

SEQ ID NO: 525652 - DNA, 20 bp, Artificial Sequence
  chemically synthesized
taaatttattggatttaata

SEQ ID NO: 525653 - DNA, 20 bp, Artificial Sequence
  chemically synthesized
tggatttaatattgggtttt

SEQ ID NO: 525654 - DNA, 20 bp, Artificial Sequence
  chemically synthesized
gggttttttgaattataatg

SEQ ID NO: 525655 - DNA, 20 bp, Artificial Sequence
  chemically synthesized
tgttggatttatttttttct

SEQ ID NO: 525656 - DNA, 20 bp, Artificial Sequence
  chemically synthesized
aacaacacaaaacaatatcg

SEQ ID NO: 525657 - DNA, 20 bp, Artificial Sequence
  chemically synthesized
tatatatatatatatatata

SEQ ID NO: 525658 - DNA, 20 bp, Artificial Sequence
  chemically synthesized
aagacaattattccacagac

SEQ ID NO: 525659 - DNA, 20 bp, Artificial Sequence
  chemically synthesized
ctcccccaaacccctgtctg

SEQ ID NO: 525660 - DNA, 20 bp, Artificial Sequence
  chemically synthesized
tttgggggaggtgaaaatct

SEQ ID NO: 525661 - DNA, 20 bp, Artificial Sequence
  chemically synthesized
aggtgaaaatctgggggtat

SEQ ID NO: 525662 - DNA, 20 bp, Artificial Sequence
  chemically synthesized
ggggtataggggttgtggtt

SEQ ID NO: 525663 - DNA, 20 bp, Artificial Sequence
  chemically synthesized
ataagttgcaggctccttat

SEQ ID NO: 525664 - DNA, 20 bp, Artificial Sequence
  chemically synthesized
ctcacatgcgcagttcacag

SEQ ID NO: 525665 - DNA, 20 bp, Artificial Sequence
  chemically synthesized
agtagggttggctctcctat

SEQ ID NO: 525666 - DNA, 20 bp, Artificial Sequence
  chemically synthesized
gctcacctcctgctgtgcag

SEQ ID NO: 525667 - DNA, 20 bp, Artificial Sequence
  chemically synthesized
ccagtaccggtccttggccc

SEQ ID NO: 525668 - DNA, 20 bp, Artificial Sequence
  chemically synthesized
atatgtgtgtcttctaatac

SEQ ID NO: 525669 - DNA, 20 bp, Artificial Sequence
  chemically synthesized
tctatttgccaaaacttacc

SEQ ID NO: 525670 - DNA, 20 bp, Artificial Sequence
  chemically synthesized
ggaggcaaatttccatatat

SEQ ID NO: 525671 - DNA, 20 bp, Artificial Sequence
  chemically synthesized
tcaaatttgttaaacaggtg

SEQ ID NO: 525672 - DNA, 20 bp, Artificial Sequence
  chemically synthesized
atattttaaatggttttgat

SEQ ID NO: 525673 - DNA, 20 bp, Artificial Sequence
  chemically synthesized
atataatttagaatatatag

SEQ ID NO: 525674 - DNA, 20 bp, Artificial Sequence
  chemically synthesized
caaataaaaaatatataatt

SEQ ID NO: 525675 - DNA, 20 bp, Artificial Sequence
  chemically synthesized
tatattttttatttgtgcag

SEQ ID NO: 525676 - DNA, 20 bp, Artificial Sequence
  chemically synthesized
aaagatgcatagataaccct

SEQ ID NO: 525677 - DNA, 20 bp, Artificial Sequence
  chemically synthesized
gcatagataaccctaagaat

SEQ ID NO: 525678 - DNA, 20 bp, Artificial Sequence
  chemically synthesized
taaaatgtgattctcattct

SEQ ID NO: 525679 - DNA, 20 bp, Artificial Sequence
  chemically synthesized
tacttgctgagcccgtactt

SEQ ID NO: 525680 - DNA, 20 bp, Artificial Sequence
  chemically synthesized
atattttattgtgtgccctc

SEQ ID NO: 525681 - DNA, 20 bp, Artificial Sequence
  chemically synthesized
ttaatttttatttttgctac

SEQ ID NO: 525682 - DNA, 20 bp, Artificial Sequence
  chemically synthesized
gtctagagtttatctggaat

SEQ ID NO: 525683 - DNA, 20 bp, Artificial Sequence
  chemically synthesized
gggcaggtctagagtttatc

SEQ ID NO: 525684 - DNA, 20 bp, Artificial Sequence
  chemically synthesized
ggaaactggatgggcaggtc

SEQ ID NO: 525685 - DNA, 20 bp, Artificial Sequence
  chemically synthesized
tgttgacaaagaggaggaaa

SEQ ID NO: 525686 - DNA, 20 bp, Artificial Sequence
  chemically synthesized
caacagaactccaattccat

SEQ ID NO: 525687 - DNA, 20 bp, Artificial Sequence
  chemically synthesized
ccttgatacccgaatggaat

SEQ ID NO: 525688 - DNA, 20 bp, Artificial Sequence
  chemically synthesized
agtctcccttgatacccgaa

SEQ ID NO: 525689 - DNA, 20 bp, Artificial Sequence
  chemically synthesized
tgcacagtctcccttgatac

SEQ ID NO: 525690 - DNA, 20 bp, Artificial Sequence
  chemically synthesized
atcatgatttgttctttggg

SEQ ID NO: 525691 - DNA, 20 bp, Artificial Sequence
  chemically synthesized
gccaatcatgatttgttctt

SEQ ID NO: 525692 - DNA, 20 bp, Artificial Sequence
  chemically synthesized
agtccctggcagaaaaagaa

SEQ ID NO: 525693 - DNA, 20 bp, Artificial Sequence
  chemically synthesized
tttttctgccagggactgcc

SEQ ID NO: 525694 - DNA, 20 bp, Artificial Sequence
  chemically synthesized
ctgccagggactgcctggaa

SEQ ID NO: 525695 - DNA, 20 bp, Artificial Sequence
  chemically synthesized
gtgaattatttcatgtagca

SEQ ID NO: 525696 - DNA, 20 bp, Artificial Sequence
  chemically synthesized
aatgtagctcgggaaaaaag

SEQ ID NO: 525697 - DNA, 20 bp, Artificial Sequence
  chemically synthesized
ttgcatgtaacactatatac

SEQ ID NO: 525698 - DNA, 20 bp, Artificial Sequence
  chemically synthesized
ttttttaatataatggtata

SEQ ID NO: 525699 - DNA, 20 bp, Artificial Sequence
  chemically synthesized
ggatattttttatactatca

SEQ ID NO: 525700 - DNA, 20 bp, Artificial Sequence
  chemically synthesized
cagttggtatctctggggag

SEQ ID NO: 525701 - DNA, 20 bp, Artificial Sequence
  chemically synthesized
ttgagaaaataatgtcttaa

SEQ ID NO: 525702 - DNA, 20 bp, Artificial Sequence
  chemically synthesized
tccttatttatttatttcac

SEQ ID NO: 525703 - DNA, 20 bp, Artificial Sequence
  chemically synthesized
gaaataagaactttctagtt

SEQ ID NO: 525704 - DNA, 20 bp, Artificial Sequence
  chemically synthesized
atgtaaactattgtagctct

SEQ ID NO: 525705 - DNA, 20 bp, Artificial Sequence
  chemically synthesized
tacaatagtttacatttact

SEQ ID NO: 525706 - DNA, 20 bp, Artificial Sequence
  chemically synthesized
tctatttcagttggaattgt

SEQ ID NO: 525707 - DNA, 20 bp, Artificial Sequence
  chemically synthesized
aaattgctttctatttcagt

SEQ ID NO: 525708 - DNA, 20 bp, Artificial Sequence
  chemically synthesized
tagtaacatgttctaaatgc

SEQ ID NO: 525709 - DNA, 20 bp, Artificial Sequence
  chemically synthesized
tggtattgagaaacaattta

SEQ ID NO: 525710 - DNA, 20 bp, Artificial Sequence
  chemically synthesized
gaaacaatttacagaatgaa

SEQ ID NO: 525711 - DNA, 20 bp, Artificial Sequence
  chemically synthesized
tatctccttttgtcttttag

SEQ ID NO: 525712 - DNA, 20 bp, Artificial Sequence
  chemically synthesized
agctaaaggaagtgagtgag

SEQ ID NO: 525713 - DNA, 20 bp, Artificial Sequence
  chemically synthesized
ggcaacttaagctaaaggaa

SEQ ID NO: 525714 - DNA, 20 bp, Artificial Sequence
  chemically synthesized
atgccacatgttttaaagca

SEQ ID NO: 525715 - DNA, 20 bp, Artificial Sequence
  chemically synthesized
tagttcttcctaaggctaac

SEQ ID NO: 525716 - DNA, 20 bp, Artificial Sequence
  chemically synthesized
aggaagaactagtcctccct

SEQ ID NO: 525717 - DNA, 20 bp, Artificial Sequence
  chemically synthesized
tagtcctccctgagaatgta

SEQ ID NO: 525718 - DNA, 20 bp, Artificial Sequence
  chemically synthesized
ccctgagaatgtaggggatt

SEQ ID NO: 525719 - DNA, 20 bp, Artificial Sequence
  chemically synthesized
agaatgtaggggatttgggg

SEQ ID NO: 525720 - DNA, 20 bp, Artificial Sequence
  chemically synthesized
gggatttggggttgaatggg

SEQ ID NO: 525721 - DNA, 20 bp, Artificial Sequence
  chemically synthesized
tggatcctctccaggatgtg

SEQ ID NO: 525722 - DNA, 20 bp, Artificial Sequence
  chemically synthesized
gtgactcatcacatcctgga

SEQ ID NO: 525723 - DNA, 20 bp, Artificial Sequence
  chemically synthesized
atgtggcattggatcctctc

SEQ ID NO: 525724 - DNA, 20 bp, Artificial Sequence
  chemically synthesized
aaatgcaaaccaatgtggca

SEQ ID NO: 525725 - DNA, 20 bp, Artificial Sequence
  chemically synthesized
cgaaattatcatagtgactt

SEQ ID NO: 525726 - DNA, 20 bp, Artificial Sequence
  chemically synthesized
ttcctcataagggaaaaacc

SEQ ID NO: 525727 - DNA, 20 bp, Artificial Sequence
  chemically synthesized
ataaatataaatgactgatt

SEQ ID NO: 525728 - DNA, 20 bp, Artificial Sequence
  chemically synthesized
agaaagtattattggctaaa

SEQ ID NO: 525729 - DNA, 20 bp, Artificial Sequence
  chemically synthesized
tactttctgttatgatttag

SEQ ID NO: 525730 - DNA, 20 bp, Artificial Sequence
  chemically synthesized
tatgatttagttggataatt

SEQ ID NO: 525731 - DNA, 20 bp, Artificial Sequence
  chemically synthesized
tagttggataattctggatt

SEQ ID NO: 525732 - DNA, 20 bp, Artificial Sequence
  chemically synthesized
tttcaaactgactcataatc

SEQ ID NO: 525733 - DNA, 20 bp, Artificial Sequence
  chemically synthesized
ctaaaaatatcgaacatcaa

SEQ ID NO: 525734 - DNA, 20 bp, Artificial Sequence
  chemically synthesized
caagagagtatccatctcct

SEQ ID NO: 525735 - DNA, 20 bp, Artificial Sequence
  chemically synthesized
tcacctcaaacccttaggag

SEQ ID NO: 525736 - DNA, 20 bp, Artificial Sequence
  chemically synthesized
tctcctaagggtttgaggtg

SEQ ID NO: 525737 - DNA, 20 bp, Artificial Sequence
  chemically synthesized
aatgatcaaatcaggataat

SEQ ID NO: 525738 - DNA, 20 bp, Artificial Sequence
  chemically synthesized
gtaatgtataatgatcaaat

SEQ ID NO: 525739 - DNA, 20 bp, Artificial Sequence
  chemically synthesized
caactattatgtatcaataa

SEQ ID NO: 525740 - DNA, 20 bp, Artificial Sequence
  chemically synthesized
gtatagtttctcaataggag

SEQ ID NO: 525741 - DNA, 20 bp, Artificial Sequence
  chemically synthesized
cctgacatatacatactaaa

SEQ ID NO: 525742 - DNA, 20 bp, Artificial Sequence
  chemically synthesized
ttggaactttggtatggacc

SEQ ID NO: 525743 - DNA, 20 bp, Artificial Sequence
  chemically synthesized
tttggtatggaccaagaata

SEQ ID NO: 525744 - DNA, 20 bp, Artificial Sequence
  chemically synthesized
ctactaatttaatagaacta

SEQ ID NO: 525745 - DNA, 20 bp, Artificial Sequence
  chemically synthesized
tcagggaaagacaagctgta

SEQ ID NO: 525746 - DNA, 20 bp, Artificial Sequence
  chemically synthesized
ctgtatagaatttaaagtgg

SEQ ID NO: 525747 - DNA, 20 bp, Artificial Sequence
  chemically synthesized
taaagtggaagaatttatta

SEQ ID NO: 525748 - DNA, 20 bp, Artificial Sequence
  chemically synthesized
ctatttttagcattaataaa

SEQ ID NO: 525749 - DNA, 20 bp, Artificial Sequence
  chemically synthesized
aatagatacatttatcatta

SEQ ID NO: 525750 - DNA, 20 bp, Artificial Sequence
  chemically synthesized
agtcaaacaaaaaaatttca

SEQ ID NO: 525751 - DNA, 20 bp, Artificial Sequence
  chemically synthesized
aaacaaaaaaatttcaatga

SEQ ID NO: 525752 - DNA, 20 bp, Artificial Sequence
  chemically synthesized
aagcatacttgctctattta

SEQ ID NO: 525753 - DNA, 20 bp, Artificial Sequence
  chemically synthesized
agagcaagtatgcttggcaa

SEQ ID NO: 525754 - DNA, 20 bp, Artificial Sequence
  chemically synthesized
gtaaaatatcgagaggccat

SEQ ID NO: 525755 - DNA, 20 bp, Artificial Sequence
  chemically synthesized
gaaaaatttcattagtattt

SEQ ID NO: 525756 - DNA, 20 bp, Artificial Sequence
  chemically synthesized
tgataactaagaatggggat

SEQ ID NO: 525757 - DNA, 20 bp, Artificial Sequence
  chemically synthesized
aaaaattgataactaagaat

SEQ ID NO: 525758 - DNA, 20 bp, Artificial Sequence
  chemically synthesized
aataacaaaaattgataact

SEQ ID NO: 525759 - DNA, 20 bp, Artificial Sequence
  chemically synthesized
gggattttccagttttatac

SEQ ID NO: 525760 - DNA, 20 bp, Artificial Sequence
  chemically synthesized
gagctattgctaattaatga

SEQ ID NO: 525761 - DNA, 20 bp, Artificial Sequence
  chemically synthesized
atcatgacattaggcatatt

SEQ ID NO: 525762 - DNA, 20 bp, Artificial Sequence
  chemically synthesized
aatggctagtttctcattaa

SEQ ID NO: 525763 - DNA, 20 bp, Artificial Sequence
  chemically synthesized
atatgtacttatatatagaa

SEQ ID NO: 525764 - DNA, 20 bp, Artificial Sequence
  chemically synthesized
aatattttccatttttgcat

SEQ ID NO: 525765 - DNA, 20 bp, Artificial Sequence
  chemically synthesized
atttttgcatttgaatatct

SEQ ID NO: 525766 - DNA, 20 bp, Artificial Sequence
  chemically synthesized
atataggtttataaactggc

SEQ ID NO: 525767 - DNA, 20 bp, Artificial Sequence
  chemically synthesized
acagttctttttgttacgat

SEQ ID NO: 525768 - DNA, 20 bp, Artificial Sequence
  chemically synthesized
tgttaatacaatttttataa

SEQ ID NO: 525769 - DNA, 20 bp, Artificial Sequence
  chemically synthesized
ttaggataatgataaacttt

SEQ ID NO: 525770 - DNA, 20 bp, Artificial Sequence
  chemically synthesized
tttatcattatcctaaaatt

SEQ ID NO: 525771 - DNA, 20 bp, Artificial Sequence
  chemically synthesized
ttgccccagaccccaaattt

SEQ ID NO: 525772 - DNA, 20 bp, Artificial Sequence
  chemically synthesized
caaaaatggttagcaaattt

SEQ ID NO: 525773 - DNA, 20 bp, Artificial Sequence
  chemically synthesized
ttttctctgatttatttctt

SEQ ID NO: 525774 - DNA, 20 bp, Artificial Sequence
  chemically synthesized
tggtaaatatataaaataat

SEQ ID NO: 525775 - DNA, 20 bp, Artificial Sequence
  chemically synthesized
tcctcaatcttgtccaaatt

SEQ ID NO: 525776 - DNA, 20 bp, Artificial Sequence
  chemically synthesized
attgaggaacaaaggtggtt

SEQ ID NO: 525777 - DNA, 20 bp, Artificial Sequence
  chemically synthesized
tggataaaggttttgatttc

SEQ ID NO: 525778 - DNA, 20 bp, Artificial Sequence
  chemically synthesized
ttttgtcatatgaaaatcat

SEQ ID NO: 525779 - DNA, 20 bp, Artificial Sequence
  chemically synthesized
tttagtaacctaaaagatat

SEQ ID NO: 525780 - DNA, 20 bp, Artificial Sequence
  chemically synthesized
aataatgcacaaatataaag

SEQ ID NO: 525781 - DNA, 20 bp, Artificial Sequence
  chemically synthesized
gtggagaggttatattactt

SEQ ID NO: 525782 - DNA, 20 bp, Artificial Sequence
  chemically synthesized
tatgtttacacataaacaca

SEQ ID NO: 525783 - DNA, 20 bp, Artificial Sequence
  chemically synthesized
caccaagaatttactttcaa

SEQ ID NO: 525784 - DNA, 20 bp, Artificial Sequence
  chemically synthesized
atgatcaagagtgttacacc

SEQ ID NO: 525785 - DNA, 20 bp, Artificial Sequence
  chemically synthesized
gtaaatatctgttcatgatc

SEQ ID NO: 525786 - DNA, 20 bp, Artificial Sequence
  chemically synthesized
tttgttaaatatgaggtgat

SEQ ID NO: 525787 - DNA, 20 bp, Artificial Sequence
  chemically synthesized
aatctaagtggaagtccaag

SEQ ID NO: 525788 - DNA, 20 bp, Artificial Sequence
  chemically synthesized
gtataacagtgatgtttatt

SEQ ID NO: 525789 - DNA, 20 bp, Artificial Sequence
  chemically synthesized
aaataaacatcactgttata

SEQ ID NO: 525790 - DNA, 20 bp, Artificial Sequence
  chemically synthesized
tatactgaatgtagtcaata

SEQ ID NO: 525791 - DNA, 20 bp, Artificial Sequence
  chemically synthesized
atagagaattattatatcat

SEQ ID NO: 525792 - DNA, 20 bp, Artificial Sequence
  chemically synthesized
cacatttatttagaaatgta

SEQ ID NO: 525793 - DNA, 20 bp, Artificial Sequence
  chemically synthesized
gaagtgctttttatcccaga

SEQ ID NO: 525794 - DNA, 20 bp, Artificial Sequence
  chemically synthesized
tttagcattgttattccgtc

SEQ ID NO: 525795 - DNA, 20 bp, Artificial Sequence
  chemically synthesized
gagtacctttcctataaaat

SEQ ID NO: 525796 - DNA, 20 bp, Artificial Sequence
  chemically synthesized
gttagcaacataaacatttc

SEQ ID NO: 525797 - DNA, 20 bp, Artificial Sequence
  chemically synthesized
gtcaaacttgaccatataaa

SEQ ID NO: 525798 - DNA, 20 bp, Artificial Sequence
  chemically synthesized
agaagttagaattttaagat

SEQ ID NO: 525799 - DNA, 20 bp, Artificial Sequence
  chemically synthesized
agtggtatttgttaagaagt

SEQ ID NO: 525800 - DNA, 20 bp, Artificial Sequence
  chemically synthesized
ctgagagggaggtttagaag

SEQ ID NO: 525801 - DNA, 20 bp, Artificial Sequence
  chemically synthesized
aaatctggggaaacacagag

SEQ ID NO: 525802 - DNA, 20 bp, Artificial Sequence
  chemically synthesized
cagactagatgatctctcaa

SEQ ID NO: 525803 - DNA, 20 bp, Artificial Sequence
  chemically synthesized
gaaaaagagagttttagatg

SEQ ID NO: 525804 - DNA, 20 bp, Artificial Sequence
  chemically synthesized
aaaggcaggacacagaaaaa

SEQ ID NO: 525805 - DNA, 20 bp, Artificial Sequence
  chemically synthesized
tttcagtatttttcctttaa

SEQ ID NO: 525806 - DNA, 20 bp, Artificial Sequence
  chemically synthesized
gataacaaaaatcactaata

SEQ ID NO: 525807 - DNA, 20 bp, Artificial Sequence
  chemically synthesized
ctgagctgttacaaaagtgg

SEQ ID NO: 525808 - DNA, 20 bp, Artificial Sequence
  chemically synthesized
ggtatggatggcctaatttg

SEQ ID NO: 525809 - DNA, 20 bp, Artificial Sequence
  chemically synthesized
atgattacagaaaggcaggt

SEQ ID NO: 525810 - DNA, 20 bp, Artificial Sequence
  chemically synthesized
aaaaacttcacaacttgtgt

SEQ ID NO: 525811 - DNA, 20 bp, Artificial Sequence
  chemically synthesized
ttagtattgacagtctgacc

SEQ ID NO: 525812 - DNA, 20 bp, Artificial Sequence
  chemically synthesized
ttgacagtctgaccatgggt

SEQ ID NO: 525813 - DNA, 20 bp, Artificial Sequence
  chemically synthesized
tataaatattatcaccttct

SEQ ID NO: 525814 - DNA, 20 bp, Artificial Sequence
  chemically synthesized
gctagcatgctatacatcat

SEQ ID NO: 525815 - DNA, 20 bp, Artificial Sequence
  chemically synthesized
gacaatttcatgtcaaaaca

SEQ ID NO: 525816 - DNA, 20 bp, Artificial Sequence
  chemically synthesized
aatactaatttttaaacatt

SEQ ID NO: 525817 - DNA, 20 bp, Artificial Sequence
  chemically synthesized
atttcctctttctgtgactg

SEQ ID NO: 525818 - DNA, 20 bp, Artificial Sequence
  chemically synthesized
aatgtaaccatgcttgacgc

SEQ ID NO: 525819 - DNA, 20 bp, Artificial Sequence
  chemically synthesized
aacagaataaaaagattttg

SEQ ID NO: 525820 - DNA, 20 bp, Artificial Sequence
  chemically synthesized
aaaatctttttattctgttc

SEQ ID NO: 525821 - DNA, 20 bp, Artificial Sequence
  chemically synthesized
tatttcctctcatcctagaa

SEQ ID NO: 525822 - DNA, 20 bp, Artificial Sequence
  chemically synthesized
tagaaacctacttttcaacc

SEQ ID NO: 525823 - DNA, 20 bp, Artificial Sequence
  chemically synthesized
gttcaggtgaaacaaaaaat

SEQ ID NO: 525824 - DNA, 20 bp, Artificial Sequence
  chemically synthesized
aaaatctagagtgaattatt

SEQ ID NO: 525825 - DNA, 20 bp, Artificial Sequence
  chemically synthesized
aataattgagaaaatctaga

SEQ ID NO: 525826 - DNA, 20 bp, Artificial Sequence
  chemically synthesized
atttaataattgagaaaatc

SEQ ID NO: 525827 - DNA, 20 bp, Artificial Sequence
  chemically synthesized
tataggaagtaacaggaaaa

SEQ ID NO: 525828 - DNA, 20 bp, Artificial Sequence
  chemically synthesized
tttcctgttacttcctataa

SEQ ID NO: 525829 - DNA, 20 bp, Artificial Sequence
  chemically synthesized
gcccctttgtaaacgtgtaa

SEQ ID NO: 525830 - DNA, 20 bp, Artificial Sequence
  chemically synthesized
acatatcgtaaaatggtgac

SEQ ID NO: 525831 - DNA, 20 bp, Artificial Sequence
  chemically synthesized
gtaggttatacttacagtcc

SEQ ID NO: 525832 - DNA, 20 bp, Artificial Sequence
  chemically synthesized
ttgctcttttggtgtgatca

SEQ ID NO: 525833 - DNA, 20 bp, Artificial Sequence
  chemically synthesized
atagcaccttctttcctaca

SEQ ID NO: 525834 - DNA, 20 bp, Artificial Sequence
  chemically synthesized
tttttatgtttagaatatag

SEQ ID NO: 525835 - DNA, 20 bp, Artificial Sequence
  chemically synthesized
aaacttttattttttatgtt

SEQ ID NO: 525836 - DNA, 20 bp, Artificial Sequence
  chemically synthesized
gggaggaccatctctacata

SEQ ID NO: 525837 - DNA, 20 bp, Artificial Sequence
  chemically synthesized
ttttcatttagaaaggtcac

SEQ ID NO: 525838 - DNA, 20 bp, Artificial Sequence
  chemically synthesized
caccatgctaagtgatccaa

SEQ ID NO: 525839 - DNA, 20 bp, Artificial Sequence
  chemically synthesized
taacaaacagagcaattctg

SEQ ID NO: 525840 - DNA, 20 bp, Artificial Sequence
  chemically synthesized
ttgctctgtttgttaataag

SEQ ID NO: 525841 - DNA, 20 bp, Artificial Sequence
  chemically synthesized
gtaaggatgaattaatctct

SEQ ID NO: 525842 - DNA, 20 bp, Artificial Sequence
  chemically synthesized
gtgacactggacaagtaagg

SEQ ID NO: 525843 - DNA, 20 bp, Artificial Sequence
  chemically synthesized
atatgtgacactggacaagt

SEQ ID NO: 525844 - DNA, 20 bp, Artificial Sequence
  chemically synthesized
aattatcataattgaataag

SEQ ID NO: 525845 - DNA, 20 bp, Artificial Sequence
  chemically synthesized
aaaacagcaaattatcataa

SEQ ID NO: 525846 - DNA, 20 bp, Artificial Sequence
  chemically synthesized
tcaccgtgattactaatgga

SEQ ID NO: 525847 - DNA, 20 bp, Artificial Sequence
  chemically synthesized
tttcatcaccgtgattacta

SEQ ID NO: 525848 - DNA, 20 bp, Artificial Sequence
  chemically synthesized
ccattttatagaagttgaac

SEQ ID NO: 525849 - DNA, 20 bp, Artificial Sequence
  chemically synthesized
agtggtcaattcactattag

SEQ ID NO: 525850 - DNA, 20 bp, Artificial Sequence
  chemically synthesized
ataattacattcctctaata

SEQ ID NO: 525851 - DNA, 20 bp, Artificial Sequence
  chemically synthesized
attattttctggttggcact

SEQ ID NO: 525852 - DNA, 20 bp, Artificial Sequence
  chemically synthesized
ttttctggttggcactgagg

SEQ ID NO: 525853 - DNA, 20 bp, Artificial Sequence
  chemically synthesized
ggctatggcaccttcagtga

SEQ ID NO: 525854 - DNA, 20 bp, Artificial Sequence
  chemically synthesized
ataaatgcagctggagtgag

SEQ ID NO: 525855 - DNA, 20 bp, Artificial Sequence
  chemically synthesized
tctatataaatgcagctgga

SEQ ID NO: 525856 - DNA, 20 bp, Artificial Sequence
  chemically synthesized
agcctctatataaatgcagc

SEQ ID NO: 525857 - DNA, 20 bp, Artificial Sequence
  chemically synthesized
gttgtatctaaagatcaagc

SEQ ID NO: 525858 - DNA, 20 bp, Artificial Sequence
  chemically synthesized
acacaaagaattgctttggg

SEQ ID NO: 525859 - DNA, 20 bp, Artificial Sequence
  chemically synthesized
ttttggaaactggttacaca

SEQ ID NO: 525860 - DNA, 20 bp, Artificial Sequence
  chemically synthesized
ttcctatcgttattagactg

SEQ ID NO: 525861 - DNA, 20 bp, Artificial Sequence
  chemically synthesized
aatgctattatttttcactt

SEQ ID NO: 525862 - DNA, 20 bp, Artificial Sequence
  chemically synthesized
cagttcaaactaccacaata

SEQ ID NO: 525863 - DNA, 20 bp, Artificial Sequence
  chemically synthesized
atattgtggtagtttgaact

SEQ ID NO: 525864 - DNA, 20 bp, Artificial Sequence
  chemically synthesized
gatcttttaaagtgagttga

SEQ ID NO: 525865 - DNA, 20 bp, Artificial Sequence
  chemically synthesized
aatatagcggatcttttaaa

SEQ ID NO: 525866 - DNA, 20 bp, Artificial Sequence
  chemically synthesized
acattgtgtaaaacaatata

SEQ ID NO: 525867 - DNA, 20 bp, Artificial Sequence
  chemically synthesized
aaacaacgtactaaacattt

SEQ ID NO: 525868 - DNA, 20 bp, Artificial Sequence
  chemically synthesized
catcatttaccaatatttta

SEQ ID NO: 525869 - DNA, 20 bp, Artificial Sequence
  chemically synthesized
tcagggctctaaagacatac

SEQ ID NO: 525870 - DNA, 20 bp, Artificial Sequence
  chemically synthesized
atgatgaaagcaaagggtct

SEQ ID NO: 525871 - DNA, 20 bp, Artificial Sequence
  chemically synthesized
tgtgtaaaatgatgaaagca

SEQ ID NO: 525872 - DNA, 20 bp, Artificial Sequence
  chemically synthesized
gttatgaggaaagcttctgt

SEQ ID NO: 525873 - DNA, 20 bp, Artificial Sequence
  chemically synthesized
agaagctttcctcataactg

SEQ ID NO: 525874 - DNA, 20 bp, Artificial Sequence
  chemically synthesized
atctgccgctgatggtttgt

SEQ ID NO: 525875 - DNA, 20 bp, Artificial Sequence
  chemically synthesized
tgctccagcatgagttttaa

SEQ ID NO: 525876 - DNA, 20 bp, Artificial Sequence
  chemically synthesized
ctagacagtcctgctccagc

SEQ ID NO: 525877 - DNA, 20 bp, Artificial Sequence
  chemically synthesized
tagcaaacatatatgaggct

SEQ ID NO: 525878 - DNA, 20 bp, Artificial Sequence
  chemically synthesized
atgaggctttgaataacagc

SEQ ID NO: 525879 - DNA, 20 bp, Artificial Sequence
  chemically synthesized
acagccagagtaataccagg

SEQ ID NO: 525880 - DNA, 20 bp, Artificial Sequence
  chemically synthesized
attaccatgttaaatatatg

SEQ ID NO: 525881 - DNA, 20 bp, Artificial Sequence
  chemically synthesized
aaatagactttgttttttag

SEQ ID NO: 525882 - DNA, 20 bp, Artificial Sequence
  chemically synthesized
aacctatagcatgtacaaca

SEQ ID NO: 525883 - DNA, 20 bp, Artificial Sequence
  chemically synthesized
ctatagtggtggacacatcg

SEQ ID NO: 525884 - DNA, 20 bp, Artificial Sequence
  chemically synthesized
caacgatgtgtccaccacta

SEQ ID NO: 525885 - DNA, 20 bp, Artificial Sequence
  chemically synthesized
agttttgaattttggagcat

SEQ ID NO: 525886 - DNA, 20 bp, Artificial Sequence
  chemically synthesized
ttatcagcacttcaaaagtt

SEQ ID NO: 525887 - DNA, 20 bp, Artificial Sequence
  chemically synthesized
caaatgctcattggagcatt

SEQ ID NO: 525888 - DNA, 20 bp, Artificial Sequence
  chemically synthesized
ggatttcaaattttcagatt

SEQ ID NO: 525889 - DNA, 20 bp, Artificial Sequence
  chemically synthesized
cacttctggtcgcaagcatt

SEQ ID NO: 525890 - DNA, 20 bp, Artificial Sequence
  chemically synthesized
ccaggggttgcggcaggagg

SEQ ID NO: 525891 - DNA, 20 bp, Artificial Sequence
  chemically synthesized
gagtggtttcagtggttgcc

SEQ ID NO: 525892 - DNA, 20 bp, Artificial Sequence
  chemically synthesized
actatgatcacagtaaacag

SEQ ID NO: 525893 - DNA, 20 bp, Artificial Sequence
  chemically synthesized
gatcatagttttgccatttc

SEQ ID NO: 525894 - DNA, 20 bp, Artificial Sequence
  chemically synthesized
tttgaaagggttacatactg

SEQ ID NO: 525895 - DNA, 20 bp, Artificial Sequence
  chemically synthesized
agtgaaagaagctaatttga

SEQ ID NO: 525896 - DNA, 20 bp, Artificial Sequence
  chemically synthesized
tatagctcatttcaaaggtc

SEQ ID NO: 525897 - DNA, 20 bp, Artificial Sequence
  chemically synthesized
gaacaggtacatgcagccaa

SEQ ID NO: 525898 - DNA, 20 bp, Artificial Sequence
  chemically synthesized
ttccataggtgagtgaatga

SEQ ID NO: 525899 - DNA, 20 bp, Artificial Sequence
  chemically synthesized
ctccttccataggtgagtga

SEQ ID NO: 525900 - DNA, 20 bp, Artificial Sequence
  chemically synthesized
agctctccttccataggtga

SEQ ID NO: 525901 - DNA, 20 bp, Artificial Sequence
  chemically synthesized
atcaagctctccttccatag

SEQ ID NO: 525902 - DNA, 20 bp, Artificial Sequence
  chemically synthesized
gtttacaagtttggtcaatt

SEQ ID NO: 525903 - DNA, 20 bp, Artificial Sequence
  chemically synthesized
aaacatatccacacaaaaac

SEQ ID NO: 525904 - DNA, 20 bp, Artificial Sequence
  chemically synthesized
atttgcactcaggtttttgt

SEQ ID NO: 525905 - DNA, 20 bp, Artificial Sequence
  chemically synthesized
tggatatgttttaagcttat

SEQ ID NO: 525906 - DNA, 20 bp, Artificial Sequence
  chemically synthesized
gcttatctgggtaaatacca

SEQ ID NO: 525907 - DNA, 20 bp, Artificial Sequence
  chemically synthesized
cattgctggtgggaatgcaa

SEQ ID NO: 525908 - DNA, 20 bp, Artificial Sequence
  chemically synthesized
aaatctctttcattgctggt

SEQ ID NO: 525909 - DNA, 20 bp, Artificial Sequence
  chemically synthesized
catttgatgttgtcagtgtt

SEQ ID NO: 525910 - DNA, 20 bp, Artificial Sequence
  chemically synthesized
tttacctgttaagcacctct

SEQ ID NO: 525911 - DNA, 20 bp, Artificial Sequence
  chemically synthesized
agattttaaaaaaattcttc

SEQ ID NO: 525912 - DNA, 20 bp, Artificial Sequence
  chemically synthesized
gagtgtgtcgctgattcttg

SEQ ID NO: 525913 - DNA, 20 bp, Artificial Sequence
  chemically synthesized
ctgttcagtatttggatttt

SEQ ID NO: 525914 - DNA, 20 bp, Artificial Sequence
  chemically synthesized
catgcactcctgttcagtat

SEQ ID NO: 525915 - DNA, 20 bp, Artificial Sequence
  chemically synthesized
ctaaaatccaaatactgaac

SEQ ID NO: 525916 - DNA, 20 bp, Artificial Sequence
  chemically synthesized
actgaaaagtaactggactg

SEQ ID NO: 525917 - DNA, 20 bp, Artificial Sequence
  chemically synthesized
gtgttctcaaaacatcatca

SEQ ID NO: 525918 - DNA, 20 bp, Artificial Sequence
  chemically synthesized
caagagaaaaataataacct

SEQ ID NO: 525919 - DNA, 20 bp, Artificial Sequence
  chemically synthesized
atcaaatagataccttttaa

SEQ ID NO: 525920 - DNA, 20 bp, Artificial Sequence
  chemically synthesized
aattctcagtgaggcatttg

SEQ ID NO: 525921 - DNA, 20 bp, Artificial Sequence
  chemically synthesized
aactcatcaaatgcctcact

SEQ ID NO: 525922 - DNA, 20 bp, Artificial Sequence
  chemically synthesized
aaagcctatcaaaagtgaaa

SEQ ID NO: 525923 - DNA, 20 bp, Artificial Sequence
  chemically synthesized
agcaagaaaacagaatgaat

SEQ ID NO: 525924 - DNA, 20 bp, Artificial Sequence
  chemically synthesized
gtgatgagcaagaaaacaga

SEQ ID NO: 525925 - DNA, 20 bp, Artificial Sequence
  chemically synthesized
taaagtgatgagcaagaaaa

SEQ ID NO: 525926 - DNA, 20 bp, Artificial Sequence
  chemically synthesized
aacaggtccacaaatattaa

SEQ ID NO: 525927 - DNA, 20 bp, Artificial Sequence
  chemically synthesized
ctgctgttgtgtgtgtaagt

SEQ ID NO: 525928 - DNA, 20 bp, Artificial Sequence
  chemically synthesized
tgtctataatacaggttctt

SEQ ID NO: 525929 - DNA, 20 bp, Artificial Sequence
  chemically synthesized
agaggtttctcttattaaag

SEQ ID NO: 525930 - DNA, 20 bp, Artificial Sequence
  chemically synthesized
aatactaatagaagacaaac

SEQ ID NO: 525931 - DNA, 20 bp, Artificial Sequence
  chemically synthesized
agtattttagtagtatatgc

SEQ ID NO: 525932 - DNA, 20 bp, Artificial Sequence
  chemically synthesized
ttagtagtatatgcctgaat

SEQ ID NO: 525933 - DNA, 20 bp, Artificial Sequence
  chemically synthesized
gacacttatttaatatatag

SEQ ID NO: 525934 - DNA, 20 bp, Artificial Sequence
  chemically synthesized
aaagaaaatataaaaaaaga

SEQ ID NO: 525935 - DNA, 20 bp, Artificial Sequence
  chemically synthesized
tgacagactattttcccccc

SEQ ID NO: 525936 - DNA, 20 bp, Artificial Sequence
  chemically synthesized
cgcatttagattccttcact

SEQ ID NO: 525937 - DNA, 20 bp, Artificial Sequence
  chemically synthesized
tacatgtggactcttagtga

SEQ ID NO: 525938 - DNA, 20 bp, Artificial Sequence
  chemically synthesized
tcactaagagtccacatgta

SEQ ID NO: 525939 - DNA, 20 bp, Artificial Sequence
  chemically synthesized
tccacatgtacaggataaac

SEQ ID NO: 525940 - DNA, 20 bp, Artificial Sequence
  chemically synthesized
tttcttttcaagaatgattg

SEQ ID NO: 525941 - DNA, 20 bp, Artificial Sequence
  chemically synthesized
tttaagacatttttcttttc

SEQ ID NO: 525942 - DNA, 20 bp, Artificial Sequence
  chemically synthesized
gcctgagagcctattatgtt

SEQ ID NO: 525943 - DNA, 20 bp, Artificial Sequence
  chemically synthesized
gcagaagcagcccaaaacaa

SEQ ID NO: 525944 - DNA, 20 bp, Artificial Sequence
  chemically synthesized
gcagcccaaaacaaatgaat

SEQ ID NO: 525945 - DNA, 20 bp, Artificial Sequence
  chemically synthesized
aaaacaaatgaatttgagta

SEQ ID NO: 525946 - DNA, 20 bp, Artificial Sequence
  chemically synthesized
tcagatagtctactaccacg

SEQ ID NO: 525947 - DNA, 20 bp, Artificial Sequence
  chemically synthesized
tccacgtggtagtagactat

SEQ ID NO: 525948 - DNA, 20 bp, Artificial Sequence
  chemically synthesized
tgttgtccccatctggcccc

SEQ ID NO: 525949 - DNA, 20 bp, Artificial Sequence
  chemically synthesized
ttctggagcatttagagtaa

SEQ ID NO: 525950 - DNA, 20 bp, Artificial Sequence
  chemically synthesized
tcacagatttctggagcatt

SEQ ID NO: 525951 - DNA, 20 bp, Artificial Sequence
  chemically synthesized
tctaaatgctccagaaatct

SEQ ID NO: 525952 - DNA, 20 bp, Artificial Sequence
  chemically synthesized
acaaccacaatgattcaacc

SEQ ID NO: 525953 - DNA, 20 bp, Artificial Sequence
  chemically synthesized
catctagactgaactcatgg

SEQ ID NO: 525954 - DNA, 20 bp, Artificial Sequence
  chemically synthesized
tgttcttcagacatctatat

SEQ ID NO: 525955 - DNA, 20 bp, Artificial Sequence
  chemically synthesized
acatttttaaataatatgtt

SEQ ID NO: 525956 - DNA, 20 bp, Artificial Sequence
  chemically synthesized
tatcttttaattttattgtt

SEQ ID NO: 525957 - DNA, 20 bp, Artificial Sequence
  chemically synthesized
ataactacttgttcttttta

SEQ ID NO: 525958 - DNA, 20 bp, Artificial Sequence
  chemically synthesized
ggaaatgaaaaatgtagtaa

SEQ ID NO: 525959 - DNA, 20 bp, Artificial Sequence
  chemically synthesized
gaaataaacagcttaagtat

SEQ ID NO: 525960 - DNA, 20 bp, Artificial Sequence
  chemically synthesized
tgaacaagaagataaaatta

SEQ ID NO: 525961 - DNA, 20 bp, Artificial Sequence
  chemically synthesized
tgaattagaagatactaatg

SEQ ID NO: 525962 - DNA, 20 bp, Artificial Sequence
  chemically synthesized
ctccctgtgttacgttctgg

SEQ ID NO: 525963 - DNA, 20 bp, Artificial Sequence
  chemically synthesized
ttgcctccctgtgttacgtt

SEQ ID NO: 525964 - DNA, 20 bp, Artificial Sequence
  chemically synthesized
ggacaatattatacgacaat

SEQ ID NO: 525965 - DNA, 20 bp, Artificial Sequence
  chemically synthesized
caataagagttcctaaagaa

SEQ ID NO: 525966 - DNA, 20 bp, Artificial Sequence
  chemically synthesized
aagagttcctaaagaagaga

SEQ ID NO: 525967 - DNA, 20 bp, Artificial Sequence
  chemically synthesized
ttcctaaagaagagaatgaa

SEQ ID NO: 525968 - DNA, 20 bp, Artificial Sequence
  chemically synthesized
agttttgaagaaaaacaagt

SEQ ID NO: 525969 - DNA, 20 bp, Artificial Sequence
  chemically synthesized
acatattatagtactggcac

SEQ ID NO: 525970 - DNA, 20 bp, Artificial Sequence
  chemically synthesized
aaacagaggtgacactacag

SEQ ID NO: 525971 - DNA, 20 bp, Artificial Sequence
  chemically synthesized
aataattttgtgaattattt

SEQ ID NO: 525972 - DNA, 20 bp, Artificial Sequence
  chemically synthesized
tgtgaatagtgaataatttt

SEQ ID NO: 525973 - DNA, 20 bp, Artificial Sequence
  chemically synthesized
taggggtttttttgtgaata

SEQ ID NO: 525974 - DNA, 20 bp, Artificial Sequence
  chemically synthesized
taatttttaggggttttttt

SEQ ID NO: 525975 - DNA, 20 bp, Artificial Sequence
  chemically synthesized
taaacttggaaataattttt

SEQ ID NO: 525976 - DNA, 20 bp, Artificial Sequence
  chemically synthesized
ccaagtttatttagagaccg

SEQ ID NO: 525977 - DNA, 20 bp, Artificial Sequence
  chemically synthesized
gggaaaaactgtaataccta

SEQ ID NO: 525978 - DNA, 20 bp, Artificial Sequence
  chemically synthesized
accctttattatttcctgct

SEQ ID NO: 525979 - DNA, 20 bp, Artificial Sequence
  chemically synthesized
attcagagcaggaaataata

SEQ ID NO: 525980 - DNA, 20 bp, Artificial Sequence
  chemically synthesized
caggaaataataaagggtca

SEQ ID NO: 525981 - DNA, 20 bp, Artificial Sequence
  chemically synthesized
ttataatttttatcaatttg

SEQ ID NO: 525982 - DNA, 20 bp, Artificial Sequence
  chemically synthesized
agtgtcaatatctagttgat

SEQ ID NO: 525983 - DNA, 20 bp, Artificial Sequence
  chemically synthesized
tgataagaatttgaaaaatg

SEQ ID NO: 525984 - DNA, 20 bp, Artificial Sequence
  chemically synthesized
cattttgccgtacttgattt

SEQ ID NO: 525985 - DNA, 20 bp, Artificial Sequence
  chemically synthesized
tgaaatatgtcaaacaactg

SEQ ID NO: 525986 - DNA, 20 bp, Artificial Sequence
  chemically synthesized
agctcaatttaaattagaaa

SEQ ID NO: 525987 - DNA, 20 bp, Artificial Sequence
  chemically synthesized
atataggatctataagagaa

SEQ ID NO: 525988 - DNA, 20 bp, Artificial Sequence
  chemically synthesized
gcaagaacacattaaatata

SEQ ID NO: 525989 - DNA, 20 bp, Artificial Sequence
  chemically synthesized
gactctggttaaggatgctt

SEQ ID NO: 525990 - DNA, 20 bp, Artificial Sequence
  chemically synthesized
gattcacaagcatccttaac

SEQ ID NO: 525991 - DNA, 20 bp, Artificial Sequence
  chemically synthesized
aaagctctctgactctggtt

SEQ ID NO: 525992 - DNA, 20 bp, Artificial Sequence
  chemically synthesized
ccttttactttctgtgttat

SEQ ID NO: 525993 - DNA, 20 bp, Artificial Sequence
  chemically synthesized
ctttctgtgttatatggatt

SEQ ID NO: 525994 - DNA, 20 bp, Artificial Sequence
  chemically synthesized
agtttcttagttttgagcta

SEQ ID NO: 525995 - DNA, 20 bp, Artificial Sequence
  chemically synthesized
agctatggaattttctttct

SEQ ID NO: 525996 - DNA, 20 bp, Artificial Sequence
  chemically synthesized
taaatagcactacttttaaa

SEQ ID NO: 525997 - DNA, 20 bp, Artificial Sequence
  chemically synthesized
taatatgtaataatagtatt

SEQ ID NO: 525998 - DNA, 20 bp, Artificial Sequence
  chemically synthesized
agtcaaatatctataaaaag

SEQ ID NO: 525999 - DNA, 20 bp, Artificial Sequence
  chemically synthesized
atgaatatgacaccaagtga

SEQ ID NO: 526000 - DNA, 20 bp, Artificial Sequence
  chemically synthesized
aatttataccctgaaataat

SEQ ID NO: 526001 - DNA, 20 bp, Artificial Sequence
  chemically synthesized
caatataattcttattattt

SEQ ID NO: 526002 - DNA, 20 bp, Artificial Sequence
  chemically synthesized
ttttaaaatataagtacttt

SEQ ID NO: 526003 - DNA, 20 bp, Artificial Sequence
  chemically synthesized
gtgcaatttgttgaacaaat

SEQ ID NO: 526004 - DNA, 20 bp, Artificial Sequence
  chemically synthesized
aacaagtctactggaagact

SEQ ID NO: 526005 - DNA, 20 bp, Artificial Sequence
  chemically synthesized
atgttagtactttgcctctg

SEQ ID NO: 526006 - DNA, 20 bp, Artificial Sequence
  chemically synthesized
catattggaacttactctgc

SEQ ID NO: 526007 - DNA, 20 bp, Artificial Sequence
  chemically synthesized
atttgtgcaatttatcctag

SEQ ID NO: 526008 - DNA, 20 bp, Artificial Sequence
  chemically synthesized
tttctaaaataaatgcactg

SEQ ID NO: 526009 - DNA, 20 bp, Artificial Sequence
  chemically synthesized
ataaatgcactgtcgagtcc

SEQ ID NO: 526010 - DNA, 20 bp, Artificial Sequence
  chemically synthesized
ttttagaattattatctggc

SEQ ID NO: 526011 - DNA, 20 bp, Artificial Sequence
  chemically synthesized
tatttttggtttcttgtttt

SEQ ID NO: 526012 - DNA, 20 bp, Artificial Sequence
  chemically synthesized
aaacttcatgtacctttcaa

SEQ ID NO: 526013 - DNA, 20 bp, Artificial Sequence
  chemically synthesized
gtaggtgacgaagatggtgc

SEQ ID NO: 526014 - DNA, 20 bp, Artificial Sequence
  chemically synthesized
tgctagaatgactctcagcc

SEQ ID NO: 526015 - DNA, 20 bp, Artificial Sequence
  chemically synthesized
atgacacaccaccctaggct

SEQ ID NO: 526016 - DNA, 20 bp, Artificial Sequence
  chemically synthesized
aactgaaagagaaataaacc

SEQ ID NO: 526017 - DNA, 20 bp, Artificial Sequence
  chemically synthesized
aggcaggtcctagtttaccc

SEQ ID NO: 526018 - DNA, 20 bp, Artificial Sequence
  chemically synthesized
gtcctagtttaccctaggat

SEQ ID NO: 526019 - DNA, 20 bp, Artificial Sequence
  chemically synthesized
gtggcttaacattctaatcc

SEQ ID NO: 526020 - DNA, 20 bp, Artificial Sequence
  chemically synthesized
aactgactttattttgtccc

SEQ ID NO: 526021 - DNA, 20 bp, Artificial Sequence
  chemically synthesized
tagggacaaaataaagtcag

SEQ ID NO: 526022 - DNA, 20 bp, Artificial Sequence
  chemically synthesized
caaaataaagtcagttggat

SEQ ID NO: 526023 - DNA, 20 bp, Artificial Sequence
  chemically synthesized
ttggatcagaattgaaactg

SEQ ID NO: 526024 - DNA, 20 bp, Artificial Sequence
  chemically synthesized
agaaaattctttggggaaag

SEQ ID NO: 526025 - DNA, 20 bp, Artificial Sequence
  chemically synthesized
tctccactcttctttcccca

SEQ ID NO: 526026 - DNA, 20 bp, Artificial Sequence
  chemically synthesized
aaagaattttctccttcgtt

SEQ ID NO: 526027 - DNA, 20 bp, Artificial Sequence
  chemically synthesized
tctccttcgttatgaatctg

SEQ ID NO: 526028 - DNA, 20 bp, Artificial Sequence
  chemically synthesized
aatttctttgaaaattgatt

SEQ ID NO: 526029 - DNA, 20 bp, Artificial Sequence
  chemically synthesized
ggataacaagctcagaatat

SEQ ID NO: 526030 - DNA, 20 bp, Artificial Sequence
  chemically synthesized
ctgtgccaggataacaagct

SEQ ID NO: 526031 - DNA, 20 bp, Artificial Sequence
  chemically synthesized
tgtcatcataatttctgtgc

SEQ ID NO: 526032 - DNA, 20 bp, Artificial Sequence
  chemically synthesized
tcttatgtgaccataaacct

SEQ ID NO: 526033 - DNA, 20 bp, Artificial Sequence
  chemically synthesized
tcagaggtttatggtcacat

SEQ ID NO: 526034 - DNA, 20 bp, Artificial Sequence
  chemically synthesized
taagagtgaaagggcaatca

SEQ ID NO: 526035 - DNA, 20 bp, Artificial Sequence
  chemically synthesized
aaacttagggggactttagg

SEQ ID NO: 526036 - DNA, 20 bp, Artificial Sequence
  chemically synthesized
ggggactttaggctgagtcc

SEQ ID NO: 526037 - DNA, 20 bp, Artificial Sequence
  chemically synthesized
ttagtgtactcactgttttt

SEQ ID NO: 526038 - DNA, 20 bp, Artificial Sequence
  chemically synthesized
aggcaaaattcagaaaaaca

SEQ ID NO: 526039 - DNA, 20 bp, Artificial Sequence
  chemically synthesized
tcatctgtacctgtgacagt

SEQ ID NO: 526040 - DNA, 20 bp, Artificial Sequence
  chemically synthesized
cctgactgtcacaggtacag

SEQ ID NO: 526041 - DNA, 20 bp, Artificial Sequence
  chemically synthesized
acaagagccctccgggtgtg

SEQ ID NO: 526042 - DNA, 20 bp, Artificial Sequence
  chemically synthesized
aggtttccaacaagagccct

SEQ ID NO: 526043 - DNA, 20 bp, Artificial Sequence
  chemically synthesized
gggctcttgttggaaacctg

SEQ ID NO: 526044 - DNA, 20 bp, Artificial Sequence
  chemically synthesized
aaaggtagtttgccaacctc

SEQ ID NO: 526045 - DNA, 20 bp, Artificial Sequence
  chemically synthesized
atttatttgtataaactgct

SEQ ID NO: 526046 - DNA, 20 bp, Artificial Sequence
  chemically synthesized
cttttattgccaaagtttcc

SEQ ID NO: 526047 - DNA, 20 bp, Artificial Sequence
  chemically synthesized
tttaaattatcaataactta

SEQ ID NO: 526048 - DNA, 20 bp, Artificial Sequence
  chemically synthesized
aatatagtttgttgatgcta

SEQ ID NO: 526049 - DNA, 20 bp, Artificial Sequence
  chemically synthesized
tgaatcatagaatgggatat

SEQ ID NO: 526050 - DNA, 20 bp, Artificial Sequence
  chemically synthesized
gccaagactgaatcatagaa

SEQ ID NO: 526051 - DNA, 20 bp, Artificial Sequence
  chemically synthesized
catgggccaagactgaatca

SEQ ID NO: 526052 - DNA, 20 bp, Artificial Sequence
  chemically synthesized
cagatttacatgggccaaga

SEQ ID NO: 526053 - DNA, 20 bp, Artificial Sequence
  chemically synthesized
aatttttatatcatacgttc

SEQ ID NO: 526054 - DNA, 20 bp, Artificial Sequence
  chemically synthesized
gatatttaatgaaaaacact

SEQ ID NO: 526055 - DNA, 20 bp, Artificial Sequence
  chemically synthesized
tgaaaaacactttgagtcct

SEQ ID NO: 526056 - DNA, 20 bp, Artificial Sequence
  chemically synthesized
gtcctaagagtccatattaa

SEQ ID NO: 526057 - DNA, 20 bp, Artificial Sequence
  chemically synthesized
taagttcaggagttttaacg

SEQ ID NO: 526058 - DNA, 20 bp, Artificial Sequence
  chemically synthesized
ataaagcttatattaagttc

SEQ ID NO: 526059 - DNA, 20 bp, Artificial Sequence
  chemically synthesized
aatccaagggtcttcttatc

SEQ ID NO: 526060 - DNA, 20 bp, Artificial Sequence
  chemically synthesized
tattccagataagaagaccc

SEQ ID NO: 526061 - DNA, 20 bp, Artificial Sequence
  chemically synthesized
atctataatttaataaatcc

SEQ ID NO: 526062 - DNA, 20 bp, Artificial Sequence
  chemically synthesized
gtggggcttcggtgtttctc

SEQ ID NO: 526063 - DNA, 20 bp, Artificial Sequence
  chemically synthesized
caccgaagccccactatgtc

SEQ ID NO: 526064 - DNA, 20 bp, Artificial Sequence
  chemically synthesized
gagaaagctagagtttcatc

SEQ ID NO: 526065 - DNA, 20 bp, Artificial Sequence
  chemically synthesized
tgatttaataaagagaaagc

SEQ ID NO: 526066 - DNA, 20 bp, Artificial Sequence
  chemically synthesized
gtgggagagatggtaaagca

SEQ ID NO: 526067 - DNA, 20 bp, Artificial Sequence
  chemically synthesized
ccagccttgtcagctatctt

SEQ ID NO: 526068 - DNA, 20 bp, Artificial Sequence
  chemically synthesized
ataaaaaggtagaaaaagta

SEQ ID NO: 526069 - DNA, 20 bp, Artificial Sequence
  chemically synthesized
ttatattaaacttgtacttc

SEQ ID NO: 526070 - DNA, 20 bp, Artificial Sequence
  chemically synthesized
agtgcaatgttgaaatcagc

SEQ ID NO: 526071 - DNA, 20 bp, Artificial Sequence
  chemically synthesized
atcagcaagagtttgtattt

SEQ ID NO: 526072 - DNA, 20 bp, Artificial Sequence
  chemically synthesized
ctatagagaacataatgggg

SEQ ID NO: 526073 - DNA, 20 bp, Artificial Sequence
  chemically synthesized
gttttctatagagaacataa

SEQ ID NO: 526074 - DNA, 20 bp, Artificial Sequence
  chemically synthesized
gaagctgcaaaagtgtttca

SEQ ID NO: 526075 - DNA, 20 bp, Artificial Sequence
  chemically synthesized
cgttcaatacctcgtcaaat

SEQ ID NO: 526076 - DNA, 20 bp, Artificial Sequence
  chemically synthesized
aaagatttagtgaaagttga

SEQ ID NO: 526077 - DNA, 20 bp, Artificial Sequence
  chemically synthesized
tagttggaggcaatacaaat

SEQ ID NO: 526078 - DNA, 20 bp, Artificial Sequence
  chemically synthesized
gcaggttttagaagaaagtc

SEQ ID NO: 526079 - DNA, 20 bp, Artificial Sequence
  chemically synthesized
ttatttctgtaataaaaagt

SEQ ID NO: 526080 - DNA, 20 bp, Artificial Sequence
  chemically synthesized
tcatcaagtaaaaagtagat

SEQ ID NO: 526081 - DNA, 20 bp, Artificial Sequence
  chemically synthesized
gtttttatcatgaagggatg

SEQ ID NO: 526082 - DNA, 20 bp, Artificial Sequence
  chemically synthesized
gttgagggtttttatcatga

SEQ ID NO: 526083 - DNA, 20 bp, Artificial Sequence
  chemically synthesized
ccttcagtgcctagtctgtt

SEQ ID NO: 526084 - DNA, 20 bp, Artificial Sequence
  chemically synthesized
cattcggtatgatgttggct

SEQ ID NO: 526085 - DNA, 20 bp, Artificial Sequence
  chemically synthesized
aatccatagccaacatcata

SEQ ID NO: 526086 - DNA, 20 bp, Artificial Sequence
  chemically synthesized
gttttgttccagttctcagt

SEQ ID NO: 526087 - DNA, 20 bp, Artificial Sequence
  chemically synthesized
actgagaactggaacaaaac

SEQ ID NO: 526088 - DNA, 20 bp, Artificial Sequence
  chemically synthesized
ctatgtttaataaaactggt

SEQ ID NO: 526089 - DNA, 20 bp, Artificial Sequence
  chemically synthesized
agtttgacttctttttctat

SEQ ID NO: 526090 - DNA, 20 bp, Artificial Sequence
  chemically synthesized
gtctttgggttttctaagta

SEQ ID NO: 526091 - DNA, 20 bp, Artificial Sequence
  chemically synthesized
gtagccttttggtggagtct

SEQ ID NO: 526092 - DNA, 20 bp, Artificial Sequence
  chemically synthesized
cagttctagtagccttttgg

SEQ ID NO: 526093 - DNA, 20 bp, Artificial Sequence
  chemically synthesized
acaacaataatgaccaagct

SEQ ID NO: 526094 - DNA, 20 bp, Artificial Sequence
  chemically synthesized
ttttctttggctattgtaaa

SEQ ID NO: 526095 - DNA, 20 bp, Artificial Sequence
  chemically synthesized
ccaaagaaaatgaaatacct

SEQ ID NO: 526096 - DNA, 20 bp, Artificial Sequence
  chemically synthesized
gatgctgaaagatctctgta

SEQ ID NO: 526097 - DNA, 20 bp, Artificial Sequence
  chemically synthesized
attgtttcttccaatgagca

SEQ ID NO: 526098 - DNA, 20 bp, Artificial Sequence
  chemically synthesized
gtagtttgataaggacagca

SEQ ID NO: 526099 - DNA, 20 bp, Artificial Sequence
  chemically synthesized
actaccaaggtcattcctca

SEQ ID NO: 526100 - DNA, 20 bp, Artificial Sequence
  chemically synthesized
ttgttttttctaattctgtg

SEQ ID NO: 526101 - DNA, 20 bp, Artificial Sequence
  chemically synthesized
ttttggttgcatatgaattt

SEQ ID NO: 526102 - DNA, 20 bp, Artificial Sequence
  chemically synthesized
atttttttttttggttgcat

SEQ ID NO: 526103 - DNA, 20 bp, Artificial Sequence
  chemically synthesized
ccaattttgttcttgctgct

SEQ ID NO: 526104 - DNA, 20 bp, Artificial Sequence
  chemically synthesized
tactgtggtgtgaattattg

SEQ ID NO: 526105 - DNA, 20 bp, Artificial Sequence
  chemically synthesized
atagtgtgatgtactgtggt

SEQ ID NO: 526106 - DNA, 20 bp, Artificial Sequence
  chemically synthesized
agacatatagaccaatggaa

SEQ ID NO: 526107 - DNA, 20 bp, Artificial Sequence
  chemically synthesized
agtgatcctggcatcattta

SEQ ID NO: 526108 - DNA, 20 bp, Artificial Sequence
  chemically synthesized
tcctattcaataaatgatgc

SEQ ID NO: 526109 - DNA, 20 bp, Artificial Sequence
  chemically synthesized
cactggctagccatatgcag

SEQ ID NO: 526110 - DNA, 20 bp, Artificial Sequence
  chemically synthesized
ttttgtatatggcaaaaggt

SEQ ID NO: 526111 - DNA, 20 bp, Artificial Sequence
  chemically synthesized
tatacaaaaataaactcatg

SEQ ID NO: 526112 - DNA, 20 bp, Artificial Sequence
  chemically synthesized
attaatatctttaatccacc

SEQ ID NO: 526113 - DNA, 20 bp, Artificial Sequence
  chemically synthesized
acatttcctaggtttgtttc

SEQ ID NO: 526114 - DNA, 20 bp, Artificial Sequence
  chemically synthesized
aattttttttttttttttga

SEQ ID NO: 526115 - DNA, 20 bp, Artificial Sequence
  chemically synthesized
ctgtactccagcctgggcga

SEQ ID NO: 526116 - DNA, 20 bp, Artificial Sequence
  chemically synthesized
tctcactctgtcgcccaggc

SEQ ID NO: 526117 - DNA, 20 bp, Artificial Sequence
  chemically synthesized
cccaggaggcagaggttgca

SEQ ID NO: 526118 - DNA, 20 bp, Artificial Sequence
  chemically synthesized
tcattgcaacctctgcctcc

SEQ ID NO: 526119 - DNA, 20 bp, Artificial Sequence
  chemically synthesized
gcctcagcctcccaagtagc

SEQ ID NO: 526120 - DNA, 20 bp, Artificial Sequence
  chemically synthesized
accaaaaatacaaaaattag

SEQ ID NO: 526121 - DNA, 20 bp, Artificial Sequence
  chemically synthesized
ttttgtatttttggtagaga

SEQ ID NO: 526122 - DNA, 20 bp, Artificial Sequence
  chemically synthesized
ctgctttcgaactcctggct

SEQ ID NO: 526123 - DNA, 20 bp, Artificial Sequence
  chemically synthesized
tgggtggattacccgaagcc

SEQ ID NO: 526124 - DNA, 20 bp, Artificial Sequence
  chemically synthesized
actttgggagaccaaggtgg

SEQ ID NO: 526125 - DNA, 20 bp, Artificial Sequence
  chemically synthesized
cagcactttgggagaccaag

SEQ ID NO: 526126 - DNA, 20 bp, Artificial Sequence
  chemically synthesized
accttggtctcccaaagtgc

SEQ ID NO: 526127 - DNA, 20 bp, Artificial Sequence
  chemically synthesized
ggcactgcgcccggccggca

SEQ ID NO: 526128 - DNA, 20 bp, Artificial Sequence
  chemically synthesized
caaagtaaacagataatcta

SEQ ID NO: 526129 - DNA, 20 bp, Artificial Sequence
  chemically synthesized
ttttgtcaggtgcacagttt

SEQ ID NO: 526130 - DNA, 20 bp, Artificial Sequence
  chemically synthesized
agataccatctcacaccaaa

SEQ ID NO: 526131 - DNA, 20 bp, Artificial Sequence
  chemically synthesized
tatttaaaagtcaagaaagg

SEQ ID NO: 526132 - DNA, 20 bp, Artificial Sequence
  chemically synthesized
gcctaagcctcctacagtgc

SEQ ID NO: 526133 - DNA, 20 bp, Artificial Sequence
  chemically synthesized
actgtaggaggcttaggcag

SEQ ID NO: 526134 - DNA, 20 bp, Artificial Sequence
  chemically synthesized
caggaggatcatatgaggcc

SEQ ID NO: 526135 - DNA, 20 bp, Artificial Sequence
  chemically synthesized
ttttgtatttttactagagt

SEQ ID NO: 526136 - DNA, 20 bp, Artificial Sequence
  chemically synthesized
gctaatttttgtatttttac

SEQ ID NO: 526137 - DNA, 20 bp, Artificial Sequence
  chemically synthesized
agtaaaaatacaaaaattag

SEQ ID NO: 526138 - DNA, 20 bp, Artificial Sequence
  chemically synthesized
gctgcagcctccctagcagc

SEQ ID NO: 526139 - DNA, 20 bp, Artificial Sequence
  chemically synthesized
tgctagggaggctgcagcat

SEQ ID NO: 526140 - DNA, 20 bp, Artificial Sequence
  chemically synthesized
gctcactgcacctcaacctc

SEQ ID NO: 526141 - DNA, 20 bp, Artificial Sequence
  chemically synthesized
gaggttgaggtgcagtgagc

SEQ ID NO: 526142 - DNA, 20 bp, Artificial Sequence
  chemically synthesized
ttgccccattgcactccagc

SEQ ID NO: 526143 - DNA, 20 bp, Artificial Sequence
  chemically synthesized
tttttttttgtcacccaggc

SEQ ID NO: 526144 - DNA, 20 bp, Artificial Sequence
  chemically synthesized
tggtgaggctgtagataaaa

SEQ ID NO: 526145 - DNA, 20 bp, Artificial Sequence
  chemically synthesized
agtgcttatacactgttggt

SEQ ID NO: 526146 - DNA, 20 bp, Artificial Sequence
  chemically synthesized
tcagtaatgggattgctgaa

SEQ ID NO: 526147 - DNA, 20 bp, Artificial Sequence
  chemically synthesized
tatactcagtaatgggattg

SEQ ID NO: 526148 - DNA, 20 bp, Artificial Sequence
  chemically synthesized
tcaattcagcaatcccatta

SEQ ID NO: 526149 - DNA, 20 bp, Artificial Sequence
  chemically synthesized
tttgggtatatactcagtaa

SEQ ID NO: 526150 - DNA, 20 bp, Artificial Sequence
  chemically synthesized
ataaaatgatctattttcct

SEQ ID NO: 526151 - DNA, 20 bp, Artificial Sequence
  chemically synthesized
gattcgatatttttgctatt

SEQ ID NO: 526152 - DNA, 20 bp, Artificial Sequence
  chemically synthesized
aattcacaatagcaaaaata

SEQ ID NO: 526153 - DNA, 20 bp, Artificial Sequence
  chemically synthesized
aaaagctcatcaatggttga

SEQ ID NO: 526154 - DNA, 20 bp, Artificial Sequence
  chemically synthesized
aatgtagtacatacacacca

SEQ ID NO: 526155 - DNA, 20 bp, Artificial Sequence
  chemically synthesized
tgttcttttttatggctgca

SEQ ID NO: 526156 - DNA, 20 bp, Artificial Sequence
  chemically synthesized
atcatgtcctttgcagcgac

SEQ ID NO: 526157 - DNA, 20 bp, Artificial Sequence
  chemically synthesized
caacagacactgtggactac

SEQ ID NO: 526158 - DNA, 20 bp, Artificial Sequence
  chemically synthesized
tggggagggaccggcgggga

SEQ ID NO: 526159 - DNA, 20 bp, Artificial Sequence
  chemically synthesized
aaggagttaaaagctaccta

SEQ ID NO: 526160 - DNA, 20 bp, Artificial Sequence
  chemically synthesized
ttgggtactatgcttactat

SEQ ID NO: 526161 - DNA, 20 bp, Artificial Sequence
  chemically synthesized
caacttttattttacataca

SEQ ID NO: 526162 - DNA, 20 bp, Artificial Sequence
  chemically synthesized
tctgaaaataattgtagtga

SEQ ID NO: 526163 - DNA, 20 bp, Artificial Sequence
  chemically synthesized
ttcatagttaaaaatttaat

SEQ ID NO: 526164 - DNA, 20 bp, Artificial Sequence
  chemically synthesized
cttaagtttatacaatcatc

SEQ ID NO: 526165 - DNA, 20 bp, Artificial Sequence
  chemically synthesized
tacaatcatcaagagtctga

SEQ ID NO: 526166 - DNA, 20 bp, Artificial Sequence
  chemically synthesized
gccatactttactgcatttt

SEQ ID NO: 526167 - DNA, 20 bp, Artificial Sequence
  chemically synthesized
actttactgcattttatgag

SEQ ID NO: 526168 - DNA, 20 bp, Artificial Sequence
  chemically synthesized
cttagtgatgtttgcaaatt

SEQ ID NO: 526169 - DNA, 20 bp, Artificial Sequence
  chemically synthesized
cccaagatctttgcaaaact

SEQ ID NO: 526170 - DNA, 20 bp, Artificial Sequence
  chemically synthesized
tattagactctgaagagccc

SEQ ID NO: 526171 - DNA, 20 bp, Artificial Sequence
  chemically synthesized
acaaataccctggggctctt

SEQ ID NO: 526172 - DNA, 20 bp, Artificial Sequence
  chemically synthesized
agatttataatgattaccaa

SEQ ID NO: 526173 - DNA, 20 bp, Artificial Sequence
  chemically synthesized
aaatattgtgttgatcaggg

SEQ ID NO: 526174 - DNA, 20 bp, Artificial Sequence
  chemically synthesized
aacccaaatattgtgttgat

SEQ ID NO: 526175 - DNA, 20 bp, Artificial Sequence
  chemically synthesized
taccctgatcaacacaatat

SEQ ID NO: 526176 - DNA, 20 bp, Artificial Sequence
  chemically synthesized
taaggaccagaaggtgaagt

SEQ ID NO: 526177 - DNA, 20 bp, Artificial Sequence
  chemically synthesized
atttttttcatatatcatca

SEQ ID NO: 526178 - DNA, 20 bp, Artificial Sequence
  chemically synthesized
atacaataattttcttttcc

SEQ ID NO: 526179 - DNA, 20 bp, Artificial Sequence
  chemically synthesized
ggaaaagaaaattattgtat

SEQ ID NO: 526180 - DNA, 20 bp, Artificial Sequence
  chemically synthesized
tgagagccaaaattgtagct

SEQ ID NO: 526181 - DNA, 20 bp, Artificial Sequence
  chemically synthesized
tagctgtgagtaaagtaagg

SEQ ID NO: 526182 - DNA, 20 bp, Artificial Sequence
  chemically synthesized
tttttccttgtctattgctt

SEQ ID NO: 526183 - DNA, 20 bp, Artificial Sequence
  chemically synthesized
ggaaaaaaaaaaatcagaca

SEQ ID NO: 526184 - DNA, 20 bp, Artificial Sequence
  chemically synthesized
tgtctcagggtagagaggta

SEQ ID NO: 526185 - DNA, 20 bp, Artificial Sequence
  chemically synthesized
gggtggtctcaggtgtgtct

SEQ ID NO: 526186 - DNA, 20 bp, Artificial Sequence
  chemically synthesized
ttctcagccctggtgatttt

SEQ ID NO: 526187 - DNA, 20 bp, Artificial Sequence
  chemically synthesized
ccctaaaaatcaccagggct

SEQ ID NO: 526188 - DNA, 20 bp, Artificial Sequence
  chemically synthesized
tgggtagatacattttatga

SEQ ID NO: 526189 - DNA, 20 bp, Artificial Sequence
  chemically synthesized
agagtgggtagatacatttt

SEQ ID NO: 526190 - DNA, 20 bp, Artificial Sequence
  chemically synthesized
gtagagccatgcaaatgaga

SEQ ID NO: 526191 - DNA, 20 bp, Artificial Sequence
  chemically synthesized
ccacgtagagccatgcaaat

SEQ ID NO: 526192 - DNA, 20 bp, Artificial Sequence
  chemically synthesized
tctcatttgcatggctctac

SEQ ID NO: 526193 - DNA, 20 bp, Artificial Sequence
  chemically synthesized
cacttaactctctgttgtga

SEQ ID NO: 526194 - DNA, 20 bp, Artificial Sequence
  chemically synthesized
caatcaaccccctcacaaca

SEQ ID NO: 526195 - DNA, 20 bp, Artificial Sequence
  chemically synthesized
gccttgatttccagacagtg

SEQ ID NO: 526196 - DNA, 20 bp, Artificial Sequence
  chemically synthesized
ttgaggacgtgtgcaacggg

SEQ ID NO: 526197 - DNA, 20 bp, Artificial Sequence
  chemically synthesized
ctagttgaggacgtgtgcaa

SEQ ID NO: 526198 - DNA, 20 bp, Artificial Sequence
  chemically synthesized
caaatataagcaaaatataa

SEQ ID NO: 526199 - DNA, 20 bp, Artificial Sequence
  chemically synthesized
aacaatttcaacacaggaag

SEQ ID NO: 526200 - DNA, 20 bp, Artificial Sequence
  chemically synthesized
aaactattaatttttagaga

SEQ ID NO: 526201 - DNA, 20 bp, Artificial Sequence
  chemically synthesized
tatatggcccccaaacataa

SEQ ID NO: 526202 - DNA, 20 bp, Artificial Sequence
  chemically synthesized
ttatttttattgctttaaaa

SEQ ID NO: 526203 - DNA, 20 bp, Artificial Sequence
  chemically synthesized
ggttataaatagttctttgt

SEQ ID NO: 526204 - DNA, 20 bp, Artificial Sequence
  chemically synthesized
ttaaatacaccttggaatat

SEQ ID NO: 526205 - DNA, 20 bp, Artificial Sequence
  chemically synthesized
acacctttttaaatacacct

SEQ ID NO: 526206 - DNA, 20 bp, Artificial Sequence
  chemically synthesized
ttactatcaatgaacattta

SEQ ID NO: 526207 - DNA, 20 bp, Artificial Sequence
  chemically synthesized
ttttagttttaggtaaaatt

SEQ ID NO: 526208 - DNA, 20 bp, Artificial Sequence
  chemically synthesized
aagcaaatatttatcaaatg

SEQ ID NO: 526209 - DNA, 20 bp, Artificial Sequence
  chemically synthesized
aattatctatctgtctatcc

SEQ ID NO: 526210 - DNA, 20 bp, Artificial Sequence
  chemically synthesized
agtgttcagagtggagattc

SEQ ID NO: 526211 - DNA, 20 bp, Artificial Sequence
  chemically synthesized
atcacatggaatgcagtgtt

SEQ ID NO: 526212 - DNA, 20 bp, Artificial Sequence
  chemically synthesized
atatctaatgtttcatcaca

SEQ ID NO: 526213 - DNA, 20 bp, Artificial Sequence
  chemically synthesized
gccttggcctcccaaagtgc

SEQ ID NO: 526214 - DNA, 20 bp, Artificial Sequence
  chemically synthesized
caggcagatcacctgaggtc

SEQ ID NO: 526215 - DNA, 20 bp, Artificial Sequence
  chemically synthesized
actaaaaatataaaaattag

SEQ ID NO: 526216 - DNA, 20 bp, Artificial Sequence
  chemically synthesized
aaaaattagccgggtgtgtg

SEQ ID NO: 526217 - DNA, 20 bp, Artificial Sequence
  chemically synthesized
gcctcagcctcccaagtagc

SEQ ID NO: 526218 - DNA, 20 bp, Artificial Sequence
  chemically synthesized
tacttgggaggctgaggcag

SEQ ID NO: 526219 - DNA, 20 bp, Artificial Sequence
  chemically synthesized
ctcaccacaacctccgcctc

SEQ ID NO: 526220 - DNA, 20 bp, Artificial Sequence
  chemically synthesized
tctcgctttgtcgcccaggc

SEQ ID NO: 526221 - DNA, 20 bp, Artificial Sequence
  chemically synthesized
ttttggttttttttttgaga

SEQ ID NO: 526222 - DNA, 20 bp, Artificial Sequence
  chemically synthesized
tcatgttttaacttaaatca

SEQ ID NO: 526223 - DNA, 20 bp, Artificial Sequence
  chemically synthesized
tcaatgatttaagttaaaac

SEQ ID NO: 526224 - DNA, 20 bp, Artificial Sequence
  chemically synthesized
aaaacatgaatagtgaccat

SEQ ID NO: 526225 - DNA, 20 bp, Artificial Sequence
  chemically synthesized
catttttattttttttgaga

SEQ ID NO: 526226 - DNA, 20 bp, Artificial Sequence
  chemically synthesized
ctgcactccagcctgggcaa

SEQ ID NO: 526227 - DNA, 20 bp, Artificial Sequence
  chemically synthesized
tctcactctgttgcccaggc

SEQ ID NO: 526228 - DNA, 20 bp, Artificial Sequence
  chemically synthesized
ctcactgcaacctctgcctc

SEQ ID NO: 526229 - DNA, 20 bp, Artificial Sequence
  chemically synthesized
tactagggaggctgaggcag

SEQ ID NO: 526230 - DNA, 20 bp, Artificial Sequence
  chemically synthesized
gcctcagcctccctagtagc

SEQ ID NO: 526231 - DNA, 20 bp, Artificial Sequence
  chemically synthesized
ttttgtatttttagtagaga

SEQ ID NO: 526232 - DNA, 20 bp, Artificial Sequence
  chemically synthesized
caggcggatcacctgaggtc

SEQ ID NO: 526233 - DNA, 20 bp, Artificial Sequence
  chemically synthesized
actttgggagactgaggcag

SEQ ID NO: 526234 - DNA, 20 bp, Artificial Sequence
  chemically synthesized
gcctcagtctcccaaagtgc

SEQ ID NO: 526235 - DNA, 20 bp, Artificial Sequence
  chemically synthesized
tcttaaagggatcagggagg

SEQ ID NO: 526236 - DNA, 20 bp, Artificial Sequence
  chemically synthesized
aatgggggaaaagatcttaa

SEQ ID NO: 526237 - DNA, 20 bp, Artificial Sequence
  chemically synthesized
ttatatgcatatacatgaga

SEQ ID NO: 526238 - DNA, 20 bp, Artificial Sequence
  chemically synthesized
tgttctaaattcaaagaagg

SEQ ID NO: 526239 - DNA, 20 bp, Artificial Sequence
  chemically synthesized
tccaatgaactcttccttct

SEQ ID NO: 526240 - DNA, 20 bp, Artificial Sequence
  chemically synthesized
ttcaaagaaggaagagttca

SEQ ID NO: 526241 - DNA, 20 bp, Artificial Sequence
  chemically synthesized
tggggagaacttggacgatg

SEQ ID NO: 526242 - DNA, 20 bp, Artificial Sequence
  chemically synthesized
tatttatagagaaatccatg

SEQ ID NO: 526243 - DNA, 20 bp, Artificial Sequence
  chemically synthesized
tgataattacttcactctac

SEQ ID NO: 526244 - DNA, 20 bp, Artificial Sequence
  chemically synthesized
aaggttattttgtgactgat

SEQ ID NO: 526245 - DNA, 20 bp, Artificial Sequence
  chemically synthesized
actgaattataaactgcccc

SEQ ID NO: 526246 - DNA, 20 bp, Artificial Sequence
  chemically synthesized
ttttgttctttaacatgtga

SEQ ID NO: 526247 - DNA, 20 bp, Artificial Sequence
  chemically synthesized
aagaacaaaaaggacgaaag

SEQ ID NO: 526248 - DNA, 20 bp, Artificial Sequence
  chemically synthesized
cgaaagaagaataaagcaga

SEQ ID NO: 526249 - DNA, 20 bp, Artificial Sequence
  chemically synthesized
aaagcagatagaatcgtgaa

SEQ ID NO: 526250 - DNA, 20 bp, Artificial Sequence
  chemically synthesized
tttaagtaaatcaaattatt

SEQ ID NO: 526251 - DNA, 20 bp, Artificial Sequence
  chemically synthesized
gaaagactttagctctatct

SEQ ID NO: 526252 - DNA, 20 bp, Artificial Sequence
  chemically synthesized
atagagctaaagtctttctc

SEQ ID NO: 526253 - DNA, 20 bp, Artificial Sequence
  chemically synthesized
tggtgattgttgccccattg

SEQ ID NO: 526254 - DNA, 20 bp, Artificial Sequence
  chemically synthesized
ttgatgtcattaccataggg

SEQ ID NO: 526255 - DNA, 20 bp, Artificial Sequence
  chemically synthesized
atctccacattgttctggga

SEQ ID NO: 526256 - DNA, 20 bp, Artificial Sequence
  chemically synthesized
gggaaagaattgagacatta

SEQ ID NO: 526257 - DNA, 20 bp, Artificial Sequence
  chemically synthesized
caaaatgaaaggtaaaaata

SEQ ID NO: 526258 - DNA, 20 bp, Artificial Sequence
  chemically synthesized
tcttccttgcggtaggccct

SEQ ID NO: 526259 - DNA, 20 bp, Artificial Sequence
  chemically synthesized
tgtttttttttaaattattt

SEQ ID NO: 526260 - DNA, 20 bp, Artificial Sequence
  chemically synthesized
aaataatttaaaaaaaaaca

SEQ ID NO: 526261 - DNA, 20 bp, Artificial Sequence
  chemically synthesized
cagtggattttaatcaccat

SEQ ID NO: 526262 - DNA, 20 bp, Artificial Sequence
  chemically synthesized
taattcaataattatttagg

SEQ ID NO: 526263 - DNA, 20 bp, Artificial Sequence
  chemically synthesized
tgaccctccctaaataatta

SEQ ID NO: 526264 - DNA, 20 bp, Artificial Sequence
  chemically synthesized
ctcagggtaatgcttagagg

SEQ ID NO: 526265 - DNA, 20 bp, Artificial Sequence
  chemically synthesized
tgtattgcacagttacatct

SEQ ID NO: 526266 - DNA, 20 bp, Artificial Sequence
  chemically synthesized
aactgtgcaatacagcaata

SEQ ID NO: 526267 - DNA, 20 bp, Artificial Sequence
  chemically synthesized
aagtccagaacatgttacaa

SEQ ID NO: 526268 - DNA, 20 bp, Artificial Sequence
  chemically synthesized
catcattcagagattataac

SEQ ID NO: 526269 - DNA, 20 bp, Artificial Sequence
  chemically synthesized
tccaaccctggttataatct

SEQ ID NO: 526270 - DNA, 20 bp, Artificial Sequence
  chemically synthesized
aaaaaggacaacattgcttc

SEQ ID NO: 526271 - DNA, 20 bp, Artificial Sequence
  chemically synthesized
atgtaaatcctctcattaag

SEQ ID NO: 526272 - DNA, 20 bp, Artificial Sequence
  chemically synthesized
agtggcacccatcttaatga

SEQ ID NO: 526273 - DNA, 20 bp, Artificial Sequence
  chemically synthesized
gacatttaaaatgaaaacaa

SEQ ID NO: 526274 - DNA, 20 bp, Artificial Sequence
  chemically synthesized
attagattagttagagatgc

SEQ ID NO: 526275 - DNA, 20 bp, Artificial Sequence
  chemically synthesized
ttgatatttgaagtcaagaa

SEQ ID NO: 526276 - DNA, 20 bp, Artificial Sequence
  chemically synthesized
caaaattctgggtggcagta

SEQ ID NO: 526277 - DNA, 20 bp, Artificial Sequence
  chemically synthesized
tgatatcccttactgccacc

SEQ ID NO: 526278 - DNA, 20 bp, Artificial Sequence
  chemically synthesized
ccttactgccacccagaatt

SEQ ID NO: 526279 - DNA, 20 bp, Artificial Sequence
  chemically synthesized
aataccagacattcaaaatt

SEQ ID NO: 526280 - DNA, 20 bp, Artificial Sequence
  chemically synthesized
agaattttgaatgtctggta

SEQ ID NO: 526281 - DNA, 20 bp, Artificial Sequence
  chemically synthesized
ttgaggaagaacactaactg

SEQ ID NO: 526282 - DNA, 20 bp, Artificial Sequence
  chemically synthesized
tccacattttattttgcttt

SEQ ID NO: 526283 - DNA, 20 bp, Artificial Sequence
  chemically synthesized
ctggcactggtgctaagatt

SEQ ID NO: 526284 - DNA, 20 bp, Artificial Sequence
  chemically synthesized
cttagcaccagtgccaggag

SEQ ID NO: 526285 - DNA, 20 bp, Artificial Sequence
  chemically synthesized
tgtgaatccgtatacaatca

SEQ ID NO: 526286 - DNA, 20 bp, Artificial Sequence
  chemically synthesized
tgataattcagtgattgtat

SEQ ID NO: 526287 - DNA, 20 bp, Artificial Sequence
  chemically synthesized
tcttatgtatgctgggaaat

SEQ ID NO: 526288 - DNA, 20 bp, Artificial Sequence
  chemically synthesized
acatttcccagcatacataa

SEQ ID NO: 526289 - DNA, 20 bp, Artificial Sequence
  chemically synthesized
gaatacaaaacaaacacaag

SEQ ID NO: 526290 - DNA, 20 bp, Artificial Sequence
  chemically synthesized
tttttttgtcaaagatatta

SEQ ID NO: 526291 - DNA, 20 bp, Artificial Sequence
  chemically synthesized
aagatattaaagagtatgtt

SEQ ID NO: 526292 - DNA, 20 bp, Artificial Sequence
  chemically synthesized
tactggaaaaaatggaagct

SEQ ID NO: 526293 - DNA, 20 bp, Artificial Sequence
  chemically synthesized
tagtttgatggtaaatccta

SEQ ID NO: 526294 - DNA, 20 bp, Artificial Sequence
  chemically synthesized
atatgaacagtagaattctc

SEQ ID NO: 526295 - DNA, 20 bp, Artificial Sequence
  chemically synthesized
tgtttaagaaatatgaacag

SEQ ID NO: 526296 - DNA, 20 bp, Artificial Sequence
  chemically synthesized
atatttagaaaattcatgtt

SEQ ID NO: 526297 - DNA, 20 bp, Artificial Sequence
  chemically synthesized
tatttctcaatattctcaac

SEQ ID NO: 526298 - DNA, 20 bp, Artificial Sequence
  chemically synthesized
gagaatattgagaaataagg

SEQ ID NO: 526299 - DNA, 20 bp, Artificial Sequence
  chemically synthesized
ctctgacctttcatgccacc

SEQ ID NO: 526300 - DNA, 20 bp, Artificial Sequence
  chemically synthesized
tccaaggtggcatgaaaggt

SEQ ID NO: 526301 - DNA, 20 bp, Artificial Sequence
  chemically synthesized
gtcagagtcttagtctgaac

SEQ ID NO: 526302 - DNA, 20 bp, Artificial Sequence
  chemically synthesized
aaggaagaagtgagaaaaaa

SEQ ID NO: 526303 - DNA, 20 bp, Artificial Sequence
  chemically synthesized
gttaatttgtaattagtcta

SEQ ID NO: 526304 - DNA, 20 bp, Artificial Sequence
  chemically synthesized
aattagtctataggataagg

SEQ ID NO: 526305 - DNA, 20 bp, Artificial Sequence
  chemically synthesized
cctaattttcatctccctgg

SEQ ID NO: 526306 - DNA, 20 bp, Artificial Sequence
  chemically synthesized
tgccagggagatgaaaatta

SEQ ID NO: 526307 - DNA, 20 bp, Artificial Sequence
  chemically synthesized
acagaaccttattttagcta

SEQ ID NO: 526308 - DNA, 20 bp, Artificial Sequence
  chemically synthesized
ctaaaataaggttctgttgt

SEQ ID NO: 526309 - DNA, 20 bp, Artificial Sequence
  chemically synthesized
tgtgtttcaaacactactga

SEQ ID NO: 526310 - DNA, 20 bp, Artificial Sequence
  chemically synthesized
atacagatatagcacatacc

SEQ ID NO: 526311 - DNA, 20 bp, Artificial Sequence
  chemically synthesized
tttttccaaacgtttataac

SEQ ID NO: 526312 - DNA, 20 bp, Artificial Sequence
  chemically synthesized
cgctatgaaggcaatagtct

SEQ ID NO: 526313 - DNA, 20 bp, Artificial Sequence
  chemically synthesized
gcgaggaagccagcaatgag

SEQ ID NO: 526314 - DNA, 20 bp, Artificial Sequence
  chemically synthesized
tcaggggccagcatgctgtc

SEQ ID NO: 526315 - DNA, 20 bp, Artificial Sequence
  chemically synthesized
cgggagagcataaacctgtg

SEQ ID NO: 526316 - DNA, 20 bp, Artificial Sequence
  chemically synthesized
tctctaagatttcatgcagc

SEQ ID NO: 526317 - DNA, 20 bp, Artificial Sequence
  chemically synthesized
gtgcaaattagttggtttga

SEQ ID NO: 526318 - DNA, 20 bp, Artificial Sequence
  chemically synthesized
gtattcttttgaatgaatat

SEQ ID NO: 526319 - DNA, 20 bp, Artificial Sequence
  chemically synthesized
tcattcttatattcattcaa

SEQ ID NO: 526320 - DNA, 20 bp, Artificial Sequence
  chemically synthesized
agaagcatgtattcttttga

SEQ ID NO: 526321 - DNA, 20 bp, Artificial Sequence
  chemically synthesized
ttgtagaagcatgtattctt

SEQ ID NO: 526322 - DNA, 20 bp, Artificial Sequence
  chemically synthesized
atttgctcataaaattagca

SEQ ID NO: 526323 - DNA, 20 bp, Artificial Sequence
  chemically synthesized
attagcaatgaatactggtg

SEQ ID NO: 526324 - DNA, 20 bp, Artificial Sequence
  chemically synthesized
tcagctctaccactgactag

SEQ ID NO: 526325 - DNA, 20 bp, Artificial Sequence
  chemically synthesized
tgaaaaatgggcagaaaatg

SEQ ID NO: 526326 - DNA, 20 bp, Artificial Sequence
  chemically synthesized
agaaaatgtgggattttgtg

SEQ ID NO: 526327 - DNA, 20 bp, Artificial Sequence
  chemically synthesized
atgtgggattttgtgaggaa

SEQ ID NO: 526328 - DNA, 20 bp, Artificial Sequence
  chemically synthesized
aataattgctgacatttaaa

SEQ ID NO: 526329 - DNA, 20 bp, Artificial Sequence
  chemically synthesized
gaagtgttccaaagaaaaag

SEQ ID NO: 526330 - DNA, 20 bp, Artificial Sequence
  chemically synthesized
ttagtccaagtcttactaat

SEQ ID NO: 526331 - DNA, 20 bp, Artificial Sequence
  chemically synthesized
ttttagtcctgttgaatcat

SEQ ID NO: 526332 - DNA, 20 bp, Artificial Sequence
  chemically synthesized
catatttaattttagtcctg

SEQ ID NO: 526333 - DNA, 20 bp, Artificial Sequence
  chemically synthesized
aacaggactaaaattaaata

SEQ ID NO: 526334 - DNA, 20 bp, Artificial Sequence
  chemically synthesized
atggaattgagcaaaagaga

SEQ ID NO: 526335 - DNA, 20 bp, Artificial Sequence
  chemically synthesized
ccaatattttcccaattttc

SEQ ID NO: 526336 - DNA, 20 bp, Artificial Sequence
  chemically synthesized
cacagagatgcatgcatata

SEQ ID NO: 526337 - DNA, 20 bp, Artificial Sequence
  chemically synthesized
agtgttagtaatagtgtttt

SEQ ID NO: 526338 - DNA, 20 bp, Artificial Sequence
  chemically synthesized
catatgcatacctcttaaaa

SEQ ID NO: 526339 - DNA, 20 bp, Artificial Sequence
  chemically synthesized
aaaatttcatctttattaga

SEQ ID NO: 526340 - DNA, 20 bp, Artificial Sequence
  chemically synthesized
gatgaaatttttgtcaggct

SEQ ID NO: 526341 - DNA, 20 bp, Artificial Sequence
  chemically synthesized
atacataaaaggaagatctc

SEQ ID NO: 526342 - DNA, 20 bp, Artificial Sequence
  chemically synthesized
cttaactagcagtggtccat

SEQ ID NO: 526343 - DNA, 20 bp, Artificial Sequence
  chemically synthesized
aactcctcaaatggcattta

SEQ ID NO: 526344 - DNA, 20 bp, Artificial Sequence
  chemically synthesized
gattcggtaaatgccatttg

SEQ ID NO: 526345 - DNA, 20 bp, Artificial Sequence
  chemically synthesized
ccgtcatcatgcactggaac

SEQ ID NO: 526346 - DNA, 20 bp, Artificial Sequence
  chemically synthesized
caggaaacacatgaagaggc

SEQ ID NO: 526347 - DNA, 20 bp, Artificial Sequence
  chemically synthesized
aacttggaaggacctgatca

SEQ ID NO: 526348 - DNA, 20 bp, Artificial Sequence
  chemically synthesized
cttccaagttttggtgctga

SEQ ID NO: 526349 - DNA, 20 bp, Artificial Sequence
  chemically synthesized
aaacaaaccagagatcaacc

SEQ ID NO: 526350 - DNA, 20 bp, Artificial Sequence
  chemically synthesized
ctaacttgttttaaatttag

SEQ ID NO: 526351 - DNA, 20 bp, Artificial Sequence
  chemically synthesized
aatttaattggggagctcta

SEQ ID NO: 526352 - DNA, 20 bp, Artificial Sequence
  chemically synthesized
acaataccagtatcattttg

SEQ ID NO: 526353 - DNA, 20 bp, Artificial Sequence
  chemically synthesized
ttgtcaaaaatatgtaatct

SEQ ID NO: 526354 - DNA, 20 bp, Artificial Sequence
  chemically synthesized
atatgtaatctacgaatcat

SEQ ID NO: 526355 - DNA, 20 bp, Artificial Sequence
  chemically synthesized
gagcatcaatattatataca

SEQ ID NO: 526356 - DNA, 20 bp, Artificial Sequence
  chemically synthesized
attatatacatgggatgaaa

SEQ ID NO: 526357 - DNA, 20 bp, Artificial Sequence
  chemically synthesized
gaaaatgaatttaatttcat

SEQ ID NO: 526358 - DNA, 20 bp, Artificial Sequence
  chemically synthesized
aagatctaaactaaggctgt

SEQ ID NO: 526359 - DNA, 20 bp, Artificial Sequence
  chemically synthesized
atattgagtgagcctccgtg

SEQ ID NO: 526360 - DNA, 20 bp, Artificial Sequence
  chemically synthesized
agttttgcaagatgtaaata

SEQ ID NO: 526361 - DNA, 20 bp, Artificial Sequence
  chemically synthesized
aaactgcggtataatatcaa

SEQ ID NO: 526362 - DNA, 20 bp, Artificial Sequence
  chemically synthesized
gtgaaatcagaagaaggttt

SEQ ID NO: 526363 - DNA, 20 bp, Artificial Sequence
  chemically synthesized
aagtgatctatgtggtaaaa

SEQ ID NO: 526364 - DNA, 20 bp, Artificial Sequence
  chemically synthesized
tggcctataaaaggataaca

SEQ ID NO: 526365 - DNA, 20 bp, Artificial Sequence
  chemically synthesized
aggtggcaggtggcctataa

SEQ ID NO: 526366 - DNA, 20 bp, Artificial Sequence
  chemically synthesized
ttcactcagcataatgtgat

SEQ ID NO: 526367 - DNA, 20 bp, Artificial Sequence
  chemically synthesized
ccaatccatatcacattatg

SEQ ID NO: 526368 - DNA, 20 bp, Artificial Sequence
  chemically synthesized
tgacctggtcttcatgtcaa

SEQ ID NO: 526369 - DNA, 20 bp, Artificial Sequence
  chemically synthesized
cactttctgtctctaaggat

SEQ ID NO: 526370 - DNA, 20 bp, Artificial Sequence
  chemically synthesized
cgaaaccactttctgtctct

SEQ ID NO: 526371 - DNA, 20 bp, Artificial Sequence
  chemically synthesized
ggtttcgtggttgccaacag

SEQ ID NO: 526372 - DNA, 20 bp, Artificial Sequence
  chemically synthesized
tgccaacagctgggtgaggg

SEQ ID NO: 526373 - DNA, 20 bp, Artificial Sequence
  chemically synthesized
gagtgtggactaactgataa

SEQ ID NO: 526374 - DNA, 20 bp, Artificial Sequence
  chemically synthesized
aatggatacagtggtgcctt

SEQ ID NO: 526375 - DNA, 20 bp, Artificial Sequence
  chemically synthesized
gatgatggttgcacaccatc

SEQ ID NO: 526376 - DNA, 20 bp, Artificial Sequence
  chemically synthesized
cgtgaatgtacgaaatgcta

SEQ ID NO: 526377 - DNA, 20 bp, Artificial Sequence
  chemically synthesized
aatggttacttttatgttat

SEQ ID NO: 526378 - DNA, 20 bp, Artificial Sequence
  chemically synthesized
gagaggccagacttgcaggg

SEQ ID NO: 526379 - DNA, 20 bp, Artificial Sequence
  chemically synthesized
tcataaggacgtgtctgctt

SEQ ID NO: 526380 - DNA, 20 bp, Artificial Sequence
  chemically synthesized
ctgttcagcccaaaatgtcc

SEQ ID NO: 526381 - DNA, 20 bp, Artificial Sequence
  chemically synthesized
atgaaaaggagtaggaggct

SEQ ID NO: 526382 - DNA, 20 bp, Artificial Sequence
  chemically synthesized
ttgtgtgtgtgtctatgaaa

SEQ ID NO: 526383 - DNA, 20 bp, Artificial Sequence
  chemically synthesized
ggctggatccatagatatag

SEQ ID NO: 526384 - DNA, 20 bp, Artificial Sequence
  chemically synthesized
aaacacattctgctatatct

SEQ ID NO: 526385 - DNA, 20 bp, Artificial Sequence
  chemically synthesized
ccaccttgagggctcagagg

SEQ ID NO: 526386 - DNA, 20 bp, Artificial Sequence
  chemically synthesized
cctctgagccctcaaggtgg

SEQ ID NO: 526387 - DNA, 20 bp, Artificial Sequence
  chemically synthesized
aacattattatggcaaatag

SEQ ID NO: 526388 - DNA, 20 bp, Artificial Sequence
  chemically synthesized
atttcgagaagtcaaggcgg

SEQ ID NO: 526389 - DNA, 20 bp, Artificial Sequence
  chemically synthesized
cgggaggatcgctggagacc

SEQ ID NO: 526390 - DNA, 20 bp, Artificial Sequence
  chemically synthesized
gtctcactatggtgacagac

SEQ ID NO: 526391 - DNA, 20 bp, Artificial Sequence
  chemically synthesized
taaaaattgttttgtgtaga

SEQ ID NO: 526392 - DNA, 20 bp, Artificial Sequence
  chemically synthesized
aatactcctgcctcagcttt

SEQ ID NO: 526393 - DNA, 20 bp, Artificial Sequence
  chemically synthesized
gctattcagaaagctgaggc

SEQ ID NO: 526394 - DNA, 20 bp, Artificial Sequence
  chemically synthesized
gttctcactcttgcccaggc

SEQ ID NO: 526395 - DNA, 20 bp, Artificial Sequence
  chemically synthesized
cactgcactctagcctgggc

SEQ ID NO: 526396 - DNA, 20 bp, Artificial Sequence
  chemically synthesized
aggaaaagcaacaatctaaa

SEQ ID NO: 526397 - DNA, 20 bp, Artificial Sequence
  chemically synthesized
caacttttattttacatcca

SEQ ID NO: 526398 - DNA, 20 bp, Artificial Sequence
  chemically synthesized
caaacctgcatatatacccc

SEQ ID NO: 526399 - DNA, 20 bp, Artificial Sequence
  chemically synthesized
tatatatgcaggtttgttac

SEQ ID NO: 526400 - DNA, 20 bp, Artificial Sequence
  chemically synthesized
tattgtgtgatatttaagtc

SEQ ID NO: 526401 - DNA, 20 bp, Artificial Sequence
  chemically synthesized
ttgggtactatgctcactac

SEQ ID NO: 526402 - DNA, 20 bp, Artificial Sequence
  chemically synthesized
aaaggctgaaaagctaccta

SEQ ID NO: 526403 - DNA, 20 bp, Artificial Sequence
  chemically synthesized
ctcccctcgattgtagtccc

SEQ ID NO: 526404 - DNA, 20 bp, Artificial Sequence
  chemically synthesized
ttataagtgggagctaaaca

SEQ ID NO: 526405 - DNA, 20 bp, Artificial Sequence
  chemically synthesized
tgtttctgtgttaattcgct

SEQ ID NO: 526406 - DNA, 20 bp, Artificial Sequence
  chemically synthesized
gctggaggacattatcctaa

SEQ ID NO: 526407 - DNA, 20 bp, Artificial Sequence
  chemically synthesized
gctccatcaatgttgttgca

SEQ ID NO: 526408 - DNA, 20 bp, Artificial Sequence
  chemically synthesized
tttctttttttattgctgca

SEQ ID NO: 526409 - DNA, 20 bp, Artificial Sequence
  chemically synthesized
ctaccaaaaatcatatgcac

SEQ ID NO: 526410 - DNA, 20 bp, Artificial Sequence
  chemically synthesized
ccagtgcatatgatttttgg

SEQ ID NO: 526411 - DNA, 20 bp, Artificial Sequence
  chemically synthesized
gtagaataatctattttcct

SEQ ID NO: 526412 - DNA, 20 bp, Artificial Sequence
  chemically synthesized
ttgacccagcaatctcatta

SEQ ID NO: 526413 - DNA, 20 bp, Artificial Sequence
  chemically synthesized
taaacccagtaatgagattg

SEQ ID NO: 526414 - DNA, 20 bp, Artificial Sequence
  chemically synthesized
ttttttactttactgtttgt

SEQ ID NO: 526415 - DNA, 20 bp, Artificial Sequence
  chemically synthesized
aaggtcactacataatgata

SEQ ID NO: 526416 - DNA, 20 bp, Artificial Sequence
  chemically synthesized
atgatagttaaattttcttg

SEQ ID NO: 526417 - DNA, 20 bp, Artificial Sequence
  chemically synthesized
aggacattggtgtgccaatg

SEQ ID NO: 526418 - DNA, 20 bp, Artificial Sequence
  chemically synthesized
agaaaactaacaaagaaatt

SEQ ID NO: 526419 - DNA, 20 bp, Artificial Sequence
  chemically synthesized
gtcaagagtcaaatttaatc

SEQ ID NO: 526420 - DNA, 20 bp, Artificial Sequence
  chemically synthesized
tctattaggtctagttggtc

SEQ ID NO: 526421 - DNA, 20 bp, Artificial Sequence
  chemically synthesized
tactactttacccaaaacca

SEQ ID NO: 526422 - DNA, 20 bp, Artificial Sequence
  chemically synthesized
agaatgtatattctgtggtt

SEQ ID NO: 526423 - DNA, 20 bp, Artificial Sequence
  chemically synthesized
acattctgtgtgcagatgag

SEQ ID NO: 526424 - DNA, 20 bp, Artificial Sequence
  chemically synthesized
acattcttctcatctgcaca

SEQ ID NO: 526425 - DNA, 20 bp, Artificial Sequence
  chemically synthesized
accacatgctcagccataaa

SEQ ID NO: 526426 - DNA, 20 bp, Artificial Sequence
  chemically synthesized
tttttattccactgtggtcc

SEQ ID NO: 526427 - DNA, 20 bp, Artificial Sequence
  chemically synthesized
aacaaattcttggaccacag

SEQ ID NO: 526428 - DNA, 20 bp, Artificial Sequence
  chemically synthesized
ggaaaccaaacaacttgctc

SEQ ID NO: 526429 - DNA, 20 bp, Artificial Sequence
  chemically synthesized
aacttgctcctgaatgactt

SEQ ID NO: 526430 - DNA, 20 bp, Artificial Sequence
  chemically synthesized
taaacctggtgtaatttata

SEQ ID NO: 526431 - DNA, 20 bp, Artificial Sequence
  chemically synthesized
caataaaaaggaattaacta

SEQ ID NO: 526432 - DNA, 20 bp, Artificial Sequence
  chemically synthesized
aatattacccagcaataaaa

SEQ ID NO: 526433 - DNA, 20 bp, Artificial Sequence
  chemically synthesized
tagttaattcctttttattg

SEQ ID NO: 526434 - DNA, 20 bp, Artificial Sequence
  chemically synthesized
cctgtggtacatgcatacca

SEQ ID NO: 526435 - DNA, 20 bp, Artificial Sequence
  chemically synthesized
tccatggtatgcatgtacca

SEQ ID NO: 526436 - DNA, 20 bp, Artificial Sequence
  chemically synthesized
tttggtactataaggctgct

SEQ ID NO: 526437 - DNA, 20 bp, Artificial Sequence
  chemically synthesized
taaggctgctatgaatattt

SEQ ID NO: 526438 - DNA, 20 bp, Artificial Sequence
  chemically synthesized
aaacaagttttcattttttt

SEQ ID NO: 526439 - DNA, 20 bp, Artificial Sequence
  chemically synthesized
ctggcaaggaagcggagaaa

SEQ ID NO: 526440 - DNA, 20 bp, Artificial Sequence
  chemically synthesized
gtcttttgtccattttctta

SEQ ID NO: 526441 - DNA, 20 bp, Artificial Sequence
  chemically synthesized
cttattggatttttaaaatg

SEQ ID NO: 526442 - DNA, 20 bp, Artificial Sequence
  chemically synthesized
tttcatttttttcttttttt

SEQ ID NO: 526443 - DNA, 20 bp, Artificial Sequence
  chemically synthesized
cccaggaggcagaggttgca

SEQ ID NO: 526444 - DNA, 20 bp, Artificial Sequence
  chemically synthesized
tacttgggaagctgaggcat

SEQ ID NO: 526445 - DNA, 20 bp, Artificial Sequence
  chemically synthesized
ttttgtatttttactagaga

SEQ ID NO: 526446 - DNA, 20 bp, Artificial Sequence
  chemically synthesized
caagctggtcgcttacgctc

SEQ ID NO: 526447 - DNA, 20 bp, Artificial Sequence
  chemically synthesized
ccggttatatttcttcttaa

SEQ ID NO: 526448 - DNA, 20 bp, Artificial Sequence
  chemically synthesized
ctttatcaaaatttcctttt

SEQ ID NO: 526449 - DNA, 20 bp, Artificial Sequence
  chemically synthesized
actcaaaaatagaacatatt

SEQ ID NO: 526450 - DNA, 20 bp, Artificial Sequence
  chemically synthesized
atcccaaatatgttctattt

SEQ ID NO: 526451 - DNA, 20 bp, Artificial Sequence
  chemically synthesized
tttttgtttgttttttgcct

SEQ ID NO: 526452 - DNA, 20 bp, Artificial Sequence
  chemically synthesized
ttgttttttgcctatgggtg

SEQ ID NO: 526453 - DNA, 20 bp, Artificial Sequence
  chemically synthesized
aaaaaggctaaccctcctta

SEQ ID NO: 526454 - DNA, 20 bp, Artificial Sequence
  chemically synthesized
cgaagcaggaatccagtaag

SEQ ID NO: 526455 - DNA, 20 bp, Artificial Sequence
  chemically synthesized
ccctttgttttggacgaagc

SEQ ID NO: 526456 - DNA, 20 bp, Artificial Sequence
  chemically synthesized
gacacaaggaaacttttcca

SEQ ID NO: 526457 - DNA, 20 bp, Artificial Sequence
  chemically synthesized
ggtgatggtttcacaggtat

SEQ ID NO: 526458 - DNA, 20 bp, Artificial Sequence
  chemically synthesized
tatttaatgtatacaatttg

SEQ ID NO: 526459 - DNA, 20 bp, Artificial Sequence
  chemically synthesized
taaataaattgggcatattt

SEQ ID NO: 526460 - DNA, 20 bp, Artificial Sequence
  chemically synthesized
agactcatatatcagtgaaa

SEQ ID NO: 526461 - DNA, 20 bp, Artificial Sequence
  chemically synthesized
ctattctgtttcactgatat

SEQ ID NO: 526462 - DNA, 20 bp, Artificial Sequence
  chemically synthesized
accaccagtatcagactgtc

SEQ ID NO: 526463 - DNA, 20 bp, Artificial Sequence
  chemically synthesized
taattaactttaacaacagt

SEQ ID NO: 526464 - DNA, 20 bp, Artificial Sequence
  chemically synthesized
acctatactagccaaaacta

SEQ ID NO: 526465 - DNA, 20 bp, Artificial Sequence
  chemically synthesized
taaaaattatataggatgta

SEQ ID NO: 526466 - DNA, 20 bp, Artificial Sequence
  chemically synthesized
ggcttattataaaaattata

SEQ ID NO: 526467 - DNA, 20 bp, Artificial Sequence
  chemically synthesized
aacattgctaaaattttcgt

SEQ ID NO: 526468 - DNA, 20 bp, Artificial Sequence
  chemically synthesized
taaaaatagatcaacttaga

SEQ ID NO: 526469 - DNA, 20 bp, Artificial Sequence
  chemically synthesized
aaactcaccatagtaaagat

SEQ ID NO: 526470 - DNA, 20 bp, Artificial Sequence
  chemically synthesized
gaattcacatctttactatg

SEQ ID NO: 526471 - DNA, 20 bp, Artificial Sequence
  chemically synthesized
tatggagatacattatgttc

SEQ ID NO: 526472 - DNA, 20 bp, Artificial Sequence
  chemically synthesized
taaaactaacaaaacatgca

SEQ ID NO: 526473 - DNA, 20 bp, Artificial Sequence
  chemically synthesized
gttttgttagttttatatgt

SEQ ID NO: 526474 - DNA, 20 bp, Artificial Sequence
  chemically synthesized
ttttttttttttttttgaga

SEQ ID NO: 526475 - DNA, 20 bp, Artificial Sequence
  chemically synthesized
ctgcactccagcctggacca

SEQ ID NO: 526476 - DNA, 20 bp, Artificial Sequence
  chemically synthesized
tctcactctgtggtccaggc

SEQ ID NO: 526477 - DNA, 20 bp, Artificial Sequence
  chemically synthesized
ttcactgcaacctctctctc

SEQ ID NO: 526478 - DNA, 20 bp, Artificial Sequence
  chemically synthesized
tactcaggaggctgaggcat

SEQ ID NO: 526479 - DNA, 20 bp, Artificial Sequence
  chemically synthesized
gaccctcatgcctcagcctc

SEQ ID NO: 526480 - DNA, 20 bp, Artificial Sequence
  chemically synthesized
gcctcagcctcctgagtagc

SEQ ID NO: 526481 - DNA, 20 bp, Artificial Sequence
  chemically synthesized
ttttatatttttagtcgaga

SEQ ID NO: 526482 - DNA, 20 bp, Artificial Sequence
  chemically synthesized
cgaccggatcacctgaggtc

SEQ ID NO: 526483 - DNA, 20 bp, Artificial Sequence
  chemically synthesized
acctcaggtgatccggtcgc

SEQ ID NO: 526484 - DNA, 20 bp, Artificial Sequence
  chemically synthesized
actttgggagaccccggcga

SEQ ID NO: 526485 - DNA, 20 bp, Artificial Sequence
  chemically synthesized
gccggggtctcccaaagtgc

SEQ ID NO: 526486 - DNA, 20 bp, Artificial Sequence
  chemically synthesized
agatgttgaaattatctgac

SEQ ID NO: 526487 - DNA, 20 bp, Artificial Sequence
  chemically synthesized
ccaaaacaaacaaacaaaac

SEQ ID NO: 526488 - DNA, 20 bp, Artificial Sequence
  chemically synthesized
tatataatggacaaaatgtc

SEQ ID NO: 526489 - DNA, 20 bp, Artificial Sequence
  chemically synthesized
cattttgtccattatatatg

SEQ ID NO: 526490 - DNA, 20 bp, Artificial Sequence
  chemically synthesized
gtccattatatatgcagaat

SEQ ID NO: 526491 - DNA, 20 bp, Artificial Sequence
  chemically synthesized
gggaccacagcccataaaag

SEQ ID NO: 526492 - DNA, 20 bp, Artificial Sequence
  chemically synthesized
cccaaagacagttttatttt

SEQ ID NO: 526493 - DNA, 20 bp, Artificial Sequence
  chemically synthesized
atgtaccatcaaggattttt

SEQ ID NO: 526494 - DNA, 20 bp, Artificial Sequence
  chemically synthesized
cccactcagaatgtaccatc

SEQ ID NO: 526495 - DNA, 20 bp, Artificial Sequence
  chemically synthesized
aaaatccttgatggtacatt

SEQ ID NO: 526496 - DNA, 20 bp, Artificial Sequence
  chemically synthesized
gggaactccttctgcccact

SEQ ID NO: 526497 - DNA, 20 bp, Artificial Sequence
  chemically synthesized
gtacattctgagtgggcaga

SEQ ID NO: 526498 - DNA, 20 bp, Artificial Sequence
  chemically synthesized
gcagaaggagttccccagac

SEQ ID NO: 526499 - DNA, 20 bp, Artificial Sequence
  chemically synthesized
agggtgctggtgctgctagg

SEQ ID NO: 526500 - DNA, 20 bp, Artificial Sequence
  chemically synthesized
ctggtgctgctaggtagagt

SEQ ID NO: 526501 - DNA, 20 bp, Artificial Sequence
  chemically synthesized
agataaaagtgtttcctaga

SEQ ID NO: 526502 - DNA, 20 bp, Artificial Sequence
  chemically synthesized
cctagataggattattgtgt

SEQ ID NO: 526503 - DNA, 20 bp, Artificial Sequence
  chemically synthesized
cagctggagggtaccagtat

SEQ ID NO: 526504 - DNA, 20 bp, Artificial Sequence
  chemically synthesized
cagagacattggagcagctg

SEQ ID NO: 526505 - DNA, 20 bp, Artificial Sequence
  chemically synthesized
ctccagctgctccaatgtct

SEQ ID NO: 526506 - DNA, 20 bp, Artificial Sequence
  chemically synthesized
atgtctctgggtaaaagtgg

SEQ ID NO: 526507 - DNA, 20 bp, Artificial Sequence
  chemically synthesized
ccgttggacgctatggccat

SEQ ID NO: 526508 - DNA, 20 bp, Artificial Sequence
  chemically synthesized
caggctagtcactctttgtg

SEQ ID NO: 526509 - DNA, 20 bp, Artificial Sequence
  chemically synthesized
tggtaaggctatccaccaca

SEQ ID NO: 526510 - DNA, 20 bp, Artificial Sequence
  chemically synthesized
ctgtgtttgcccaggtatct

SEQ ID NO: 526511 - DNA, 20 bp, Artificial Sequence
  chemically synthesized
ttgggaacagacagtgcttt

SEQ ID NO: 526512 - DNA, 20 bp, Artificial Sequence
  chemically synthesized
aacagacagtgctttctgga

SEQ ID NO: 526513 - DNA, 20 bp, Artificial Sequence
  chemically synthesized
tggatgggattttgttcttg

SEQ ID NO: 526514 - DNA, 20 bp, Artificial Sequence
  chemically synthesized
cagccacagggtactagaag

SEQ ID NO: 526515 - DNA, 20 bp, Artificial Sequence
  chemically synthesized
cagagatactggggcagcca

SEQ ID NO: 526516 - DNA, 20 bp, Artificial Sequence
  chemically synthesized
caggaagcctctttgttcct

SEQ ID NO: 526517 - DNA, 20 bp, Artificial Sequence
  chemically synthesized
gcttcctgcactaggccact

SEQ ID NO: 526518 - DNA, 20 bp, Artificial Sequence
  chemically synthesized
ggctgggtgcaactgccaca

SEQ ID NO: 526519 - DNA, 20 bp, Artificial Sequence
  chemically synthesized
aacaggaaatacttaggtgg

SEQ ID NO: 526520 - DNA, 20 bp, Artificial Sequence
  chemically synthesized
ccacctaagtatttcctgtt

SEQ ID NO: 526521 - DNA, 20 bp, Artificial Sequence
  chemically synthesized
aagtatttcctgttgtgagt

SEQ ID NO: 526522 - DNA, 20 bp, Artificial Sequence
  chemically synthesized
atttcctgttgtgagtgaga

SEQ ID NO: 526523 - DNA, 20 bp, Artificial Sequence
  chemically synthesized
tgttgtgagtgagagtgagt

SEQ ID NO: 526524 - DNA, 20 bp, Artificial Sequence
  chemically synthesized
caagtggcagtattgtttag

SEQ ID NO: 526525 - DNA, 20 bp, Artificial Sequence
  chemically synthesized
gtaagtgcctctcctttccc

SEQ ID NO: 526526 - DNA, 20 bp, Artificial Sequence
  chemically synthesized
cccatctaacattaagcagc

SEQ ID NO: 526527 - DNA, 20 bp, Artificial Sequence
  chemically synthesized
ggtataactggcaagggcta

SEQ ID NO: 526528 - DNA, 20 bp, Artificial Sequence
  chemically synthesized
gtttcctctctgaattgaat

SEQ ID NO: 526529 - DNA, 20 bp, Artificial Sequence
  chemically synthesized
cagctagtttcctctctgaa

SEQ ID NO: 526530 - DNA, 20 bp, Artificial Sequence
  chemically synthesized
cagcccagctagtttcctct

SEQ ID NO: 526531 - DNA, 20 bp, Artificial Sequence
  chemically synthesized
aaagttggaaaatgacaggt

SEQ ID NO: 526532 - DNA, 20 bp, Artificial Sequence
  chemically synthesized
gtgggggtccccatcttctg

SEQ ID NO: 526533 - DNA, 20 bp, Artificial Sequence
  chemically synthesized
tgttggataggggcacatat

SEQ ID NO: 526534 - DNA, 20 bp, Artificial Sequence
  chemically synthesized
gccatcaaaagaaaattgta

SEQ ID NO: 526535 - DNA, 20 bp, Artificial Sequence
  chemically synthesized
ttatgccatcttgtccgaaa

SEQ ID NO: 526536 - DNA, 20 bp, Artificial Sequence
  chemically synthesized
aaacatattaaaacaagact

SEQ ID NO: 526537 - DNA, 20 bp, Artificial Sequence
  chemically synthesized
cattttaaaaaccaagttat

SEQ ID NO: 526538 - DNA, 20 bp, Artificial Sequence
  chemically synthesized
taattgtaccatgctgcgtg

SEQ ID NO: 526539 - DNA, 20 bp, Artificial Sequence
  chemically synthesized
acgttggcctcccaaagtgc

SEQ ID NO: 526540 - DNA, 20 bp, Artificial Sequence
  chemically synthesized
cagcactttgggaggccaac

SEQ ID NO: 526541 - DNA, 20 bp, Artificial Sequence
  chemically synthesized
actttgggaggccaacgtgg

SEQ ID NO: 526542 - DNA, 20 bp, Artificial Sequence
  chemically synthesized
tgggtggatcacctgaggtc

SEQ ID NO: 526543 - DNA, 20 bp, Artificial Sequence
  chemically synthesized
ttttgtatttttagtagaga

SEQ ID NO: 526544 - DNA, 20 bp, Artificial Sequence
  chemically synthesized
aattctcctgcctcagcctc

SEQ ID NO: 526545 - DNA, 20 bp, Artificial Sequence
  chemically synthesized
cactcgggaggctgaggcag

SEQ ID NO: 526546 - DNA, 20 bp, Artificial Sequence
  chemically synthesized
ctcactgcaacctccacctc

SEQ ID NO: 526547 - DNA, 20 bp, Artificial Sequence
  chemically synthesized
tcgcaccattgtactccagc

SEQ ID NO: 526548 - DNA, 20 bp, Artificial Sequence
  chemically synthesized
ttgctctttgtcacccaggc

SEQ ID NO: 526549 - DNA, 20 bp, Artificial Sequence
  chemically synthesized
aacatcaactataccaagtg

SEQ ID NO: 526550 - DNA, 20 bp, Artificial Sequence
  chemically synthesized
caactataccaagtgatgag

SEQ ID NO: 526551 - DNA, 20 bp, Artificial Sequence
  chemically synthesized
gcctcggcctcccaaagtac

SEQ ID NO: 526552 - DNA, 20 bp, Artificial Sequence
  chemically synthesized
cagtactttgggaggccgag

SEQ ID NO: 526553 - DNA, 20 bp, Artificial Sequence
  chemically synthesized
actttgggaggccgaggcgg

SEQ ID NO: 526554 - DNA, 20 bp, Artificial Sequence
  chemically synthesized
tgaggtttcaccatgttagc

SEQ ID NO: 526555 - DNA, 20 bp, Artificial Sequence
  chemically synthesized
cattctcctgcctcagcctc

SEQ ID NO: 526556 - DNA, 20 bp, Artificial Sequence
  chemically synthesized
tactcaggaggctgaggcag

SEQ ID NO: 526557 - DNA, 20 bp, Artificial Sequence
  chemically synthesized
ctcactgcaacctccgcctc

SEQ ID NO: 526558 - DNA, 20 bp, Artificial Sequence
  chemically synthesized
tctttctctgtcgcccaggc

SEQ ID NO: 526559 - DNA, 20 bp, Artificial Sequence
  chemically synthesized
ctaccaacttgaaattacag

SEQ ID NO: 526560 - DNA, 20 bp, Artificial Sequence
  chemically synthesized
actagagacataaatgatta

SEQ ID NO: 526561 - DNA, 20 bp, Artificial Sequence
  chemically synthesized
tctctagtttgaacaacaca

SEQ ID NO: 526562 - DNA, 20 bp, Artificial Sequence
  chemically synthesized
tttaatcaagcacatttggt

SEQ ID NO: 526563 - DNA, 20 bp, Artificial Sequence
  chemically synthesized
ttatcttgtgtttaatgaag

SEQ ID NO: 526564 - DNA, 20 bp, Artificial Sequence
  chemically synthesized
tacttaactttttaagacag

SEQ ID NO: 526565 - DNA, 20 bp, Artificial Sequence
  chemically synthesized
gtaagccatgataaaaagca

SEQ ID NO: 526566 - DNA, 20 bp, Artificial Sequence
  chemically synthesized
aaagtcttttcttttgaatt

SEQ ID NO: 526567 - DNA, 20 bp, Artificial Sequence
  chemically synthesized
gatttttaaagtcttttctt

SEQ ID NO: 526568 - DNA, 20 bp, Artificial Sequence
  chemically synthesized
acctttaatgagaacatatt

SEQ ID NO: 526569 - DNA, 20 bp, Artificial Sequence
  chemically synthesized
actgtggtttaaatgcagtg

SEQ ID NO: 526570 - DNA, 20 bp, Artificial Sequence
  chemically synthesized
acagatgttgctttgaagag

SEQ ID NO: 526571 - DNA, 20 bp, Artificial Sequence
  chemically synthesized
caataagtgataaataacaa

SEQ ID NO: 526572 - DNA, 20 bp, Artificial Sequence
  chemically synthesized
cacgtaaggacctaaaacag

SEQ ID NO: 526573 - DNA, 20 bp, Artificial Sequence
  chemically synthesized
ccaattacaaagcaacatgt

SEQ ID NO: 526574 - DNA, 20 bp, Artificial Sequence
  chemically synthesized
gatttaaatagagagataag

SEQ ID NO: 526575 - DNA, 20 bp, Artificial Sequence
  chemically synthesized
tagatttcaaaaagtttaat

SEQ ID NO: 526576 - DNA, 20 bp, Artificial Sequence
  chemically synthesized
acacacacacacacacacaa

SEQ ID NO: 526577 - DNA, 20 bp, Artificial Sequence
  chemically synthesized
ctatcatgttactttgaatt

SEQ ID NO: 526578 - DNA, 20 bp, Artificial Sequence
  chemically synthesized
tttctttctatcatgttact

SEQ ID NO: 526579 - DNA, 20 bp, Artificial Sequence
  chemically synthesized
ttaaaaacatttttgtttgt

SEQ ID NO: 526580 - DNA, 20 bp, Artificial Sequence
  chemically synthesized
tgtaaggattttgaaacttg

SEQ ID NO: 526581 - DNA, 20 bp, Artificial Sequence
  chemically synthesized
gaggatcaaataatataact

SEQ ID NO: 526582 - DNA, 20 bp, Artificial Sequence
  chemically synthesized
ttattttgacagaaagaatt

SEQ ID NO: 526583 - DNA, 20 bp, Artificial Sequence
  chemically synthesized
ttccacattattttgacaga

SEQ ID NO: 526584 - DNA, 20 bp, Artificial Sequence
  chemically synthesized
gaagggagaaaaattatgga

SEQ ID NO: 526585 - DNA, 20 bp, Artificial Sequence
  chemically synthesized
gcttatggattgtttgactg

SEQ ID NO: 526586 - DNA, 20 bp, Artificial Sequence
  chemically synthesized
ccagtcaaacaatccataag

SEQ ID NO: 526587 - DNA, 20 bp, Artificial Sequence
  chemically synthesized
tgatatcaaggactctgctt

SEQ ID NO: 526588 - DNA, 20 bp, Artificial Sequence
  chemically synthesized
gtgcatctgtttgttccaag

SEQ ID NO: 526589 - DNA, 20 bp, Artificial Sequence
  chemically synthesized
ttacctgagactcataaaat

SEQ ID NO: 526590 - DNA, 20 bp, Artificial Sequence
  chemically synthesized
attgcacaaattctcatttt

SEQ ID NO: 526591 - DNA, 20 bp, Artificial Sequence
  chemically synthesized
ataaaatgagaatttgtgca

SEQ ID NO: 526592 - DNA, 20 bp, Artificial Sequence
  chemically synthesized
ctccatagtggtatgctact

SEQ ID NO: 526593 - DNA, 20 bp, Artificial Sequence
  chemically synthesized
aaatttaacctacaggccat

SEQ ID NO: 526594 - DNA, 20 bp, Artificial Sequence
  chemically synthesized
gcctgtaggttaaatttttc

SEQ ID NO: 526595 - DNA, 20 bp, Artificial Sequence
  chemically synthesized
ggttctaccagtagataatc

SEQ ID NO: 526596 - DNA, 20 bp, Artificial Sequence
  chemically synthesized
aaggtgtatttgtgcatact

SEQ ID NO: 526597 - DNA, 20 bp, Artificial Sequence
  chemically synthesized
agagtatgcacaaatacacc

SEQ ID NO: 526598 - DNA, 20 bp, Artificial Sequence
  chemically synthesized
gcacaaatacaccttgaatt

SEQ ID NO: 526599 - DNA, 20 bp, Artificial Sequence
  chemically synthesized
aattttgaattgtattttgt

SEQ ID NO: 526600 - DNA, 20 bp, Artificial Sequence
  chemically synthesized
agtagtctcatcttttcttt

SEQ ID NO: 526601 - DNA, 20 bp, Artificial Sequence
  chemically synthesized
acatattatcgtgatgtaga

SEQ ID NO: 526602 - DNA, 20 bp, Artificial Sequence
  chemically synthesized
tattgcatttggtacataat

SEQ ID NO: 526603 - DNA, 20 bp, Artificial Sequence
  chemically synthesized
aaattctagatatataaaac

SEQ ID NO: 526604 - DNA, 20 bp, Artificial Sequence
  chemically synthesized
aaattcttgttttatatatc

SEQ ID NO: 526605 - DNA, 20 bp, Artificial Sequence
  chemically synthesized
aaataaataagttgagtaag

SEQ ID NO: 526606 - DNA, 20 bp, Artificial Sequence
  chemically synthesized
ctcaaaagaaaataaataag

SEQ ID NO: 526607 - DNA, 20 bp, Artificial Sequence
  chemically synthesized
gaagtccagagacttataca

SEQ ID NO: 526608 - DNA, 20 bp, Artificial Sequence
  chemically synthesized
atctccaggaaatcataatt

SEQ ID NO: 526609 - DNA, 20 bp, Artificial Sequence
  chemically synthesized
taaagtgttttcacatgtat

SEQ ID NO: 526610 - DNA, 20 bp, Artificial Sequence
  chemically synthesized
tttataagaggccatgatat

SEQ ID NO: 526611 - DNA, 20 bp, Artificial Sequence
  chemically synthesized
tatgtattgtttatggatat

SEQ ID NO: 526612 - DNA, 20 bp, Artificial Sequence
  chemically synthesized
aacaacattatgtattgttt

SEQ ID NO: 526613 - DNA, 20 bp, Artificial Sequence
  chemically synthesized
tatgttctttacaaatttac

SEQ ID NO: 526614 - DNA, 20 bp, Artificial Sequence
  chemically synthesized
gatagctcattagctcaatg

SEQ ID NO: 526615 - DNA, 20 bp, Artificial Sequence
  chemically synthesized
tgagctaatgagctatccat

SEQ ID NO: 526616 - DNA, 20 bp, Artificial Sequence
  chemically synthesized
gtggatcaacatggattctt

SEQ ID NO: 526617 - DNA, 20 bp, Artificial Sequence
  chemically synthesized
tgggtatggagtggatcaac

SEQ ID NO: 526618 - DNA, 20 bp, Artificial Sequence
  chemically synthesized
cgatactacctgggtatgga

SEQ ID NO: 526619 - DNA, 20 bp, Artificial Sequence
  chemically synthesized
tcagcgatactacctgggta

SEQ ID NO: 526620 - DNA, 20 bp, Artificial Sequence
  chemically synthesized
cagcctgtcagcgatactac

SEQ ID NO: 526621 - DNA, 20 bp, Artificial Sequence
  chemically synthesized
atttgatttgtttctcccag

SEQ ID NO: 526622 - DNA, 20 bp, Artificial Sequence
  chemically synthesized
tttgtttctcccagtagaat

SEQ ID NO: 526623 - DNA, 20 bp, Artificial Sequence
  chemically synthesized
gctttttaaaatctgaagct

SEQ ID NO: 526624 - DNA, 20 bp, Artificial Sequence
  chemically synthesized
tgctgtttctttcccattct

SEQ ID NO: 526625 - DNA, 20 bp, Artificial Sequence
  chemically synthesized
gagtcatctgcatacatcca

SEQ ID NO: 526626 - DNA, 20 bp, Artificial Sequence
  chemically synthesized
cccccgcatctcttcaacct

SEQ ID NO: 526627 - DNA, 20 bp, Artificial Sequence
  chemically synthesized
agcaacaaaatggaagacgt

SEQ ID NO: 526628 - DNA, 20 bp, Artificial Sequence
  chemically synthesized
tttcctgcatgtgacgatgc

SEQ ID NO: 526629 - DNA, 20 bp, Artificial Sequence
  chemically synthesized
aggaaagcaacacgctgcca

SEQ ID NO: 526630 - DNA, 20 bp, Artificial Sequence
  chemically synthesized
tgtgttaaggcactgaaatt

SEQ ID NO: 526631 - DNA, 20 bp, Artificial Sequence
  chemically synthesized
gctatgctagctagcattaa

SEQ ID NO: 526632 - DNA, 20 bp, Artificial Sequence
  chemically synthesized
tgctagctagcattaaaaga

SEQ ID NO: 526633 - DNA, 20 bp, Artificial Sequence
  chemically synthesized
tgtaacccaaatatataata

SEQ ID NO: 526634 - DNA, 20 bp, Artificial Sequence
  chemically synthesized
tttcactcaatattatatat

SEQ ID NO: 526635 - DNA, 20 bp, Artificial Sequence
  chemically synthesized
ttacataattattgtgagat

SEQ ID NO: 526636 - DNA, 20 bp, Artificial Sequence
  chemically synthesized
agatatggatctaattaata

SEQ ID NO: 526637 - DNA, 20 bp, Artificial Sequence
  chemically synthesized
ggaggccgtcctttgcattg

SEQ ID NO: 526638 - DNA, 20 bp, Artificial Sequence
  chemically synthesized
ttgcattgtaggatgtttgc

SEQ ID NO: 526639 - DNA, 20 bp, Artificial Sequence
  chemically synthesized
aaccaggcatgagtttggcc

SEQ ID NO: 526640 - DNA, 20 bp, Artificial Sequence
  chemically synthesized
taagtggttctcaaccaggc

SEQ ID NO: 526641 - DNA, 20 bp, Artificial Sequence
  chemically synthesized
aatactatcaagcagctaaa

SEQ ID NO: 526642 - DNA, 20 bp, Artificial Sequence
  chemically synthesized
agtatttcaccacaggcatc

SEQ ID NO: 526643 - DNA, 20 bp, Artificial Sequence
  chemically synthesized
ttcagctcaaaatcagttac

SEQ ID NO: 526644 - DNA, 20 bp, Artificial Sequence
  chemically synthesized
tccttgtaactgattttgag

SEQ ID NO: 526645 - DNA, 20 bp, Artificial Sequence
  chemically synthesized
cttcttcttaagcagctagt

SEQ ID NO: 526646 - DNA, 20 bp, Artificial Sequence
  chemically synthesized
taaggaacggttaaaaagac

SEQ ID NO: 526647 - DNA, 20 bp, Artificial Sequence
  chemically synthesized
aacggttaaaaagacaggag

SEQ ID NO: 526648 - DNA, 20 bp, Artificial Sequence
  chemically synthesized
ggtgtgattgtgtcccagtt

SEQ ID NO: 526649 - DNA, 20 bp, Artificial Sequence
  chemically synthesized
cttagttgttaatttaagta

SEQ ID NO: 526650 - DNA, 20 bp, Artificial Sequence
  chemically synthesized
aatttaagtaatggatgctt

SEQ ID NO: 526651 - DNA, 20 bp, Artificial Sequence
  chemically synthesized
gtaatggatgcttctgagtt

SEQ ID NO: 526652 - DNA, 20 bp, Artificial Sequence
  chemically synthesized
gcctgatgatggattgtggt

SEQ ID NO: 526653 - DNA, 20 bp, Artificial Sequence
  chemically synthesized
tcataaaggattgcctgatg

SEQ ID NO: 526654 - DNA, 20 bp, Artificial Sequence
  chemically synthesized
tggagaaggtaagaatcata

SEQ ID NO: 526655 - DNA, 20 bp, Artificial Sequence
  chemically synthesized
ggaattgttttggagaaggt

SEQ ID NO: 526656 - DNA, 20 bp, Artificial Sequence
  chemically synthesized
ttgcagatgagttgaatggt

SEQ ID NO: 526657 - DNA, 20 bp, Artificial Sequence
  chemically synthesized
tgacaggctttgcagatgag

SEQ ID NO: 526658 - DNA, 20 bp, Artificial Sequence
  chemically synthesized
agcactgacaggctttgcag

SEQ ID NO: 526659 - DNA, 20 bp, Artificial Sequence
  chemically synthesized
ttttgcggggtggctttgac

SEQ ID NO: 526660 - DNA, 20 bp, Artificial Sequence
  chemically synthesized
aggaggctctttcacttttg

SEQ ID NO: 526661 - DNA, 20 bp, Artificial Sequence
  chemically synthesized
agtgaaagagcctcctcgag

SEQ ID NO: 526662 - DNA, 20 bp, Artificial Sequence
  chemically synthesized
tataatccttaaactaaacc

SEQ ID NO: 526663 - DNA, 20 bp, Artificial Sequence
  chemically synthesized
ttttattctaggtttagttt

SEQ ID NO: 526664 - DNA, 20 bp, Artificial Sequence
  chemically synthesized
atatttatataaatattctc

SEQ ID NO: 526665 - DNA, 20 bp, Artificial Sequence
  chemically synthesized
atctatgtgcttccattcaa

SEQ ID NO: 526666 - DNA, 20 bp, Artificial Sequence
  chemically synthesized
atattacatcaccacttcga

SEQ ID NO: 526667 - DNA, 20 bp, Artificial Sequence
  chemically synthesized
gatgtaatatcccagttgaa

SEQ ID NO: 526668 - DNA, 20 bp, Artificial Sequence
  chemically synthesized
tttaccttaccctgttcaac

SEQ ID NO: 526669 - DNA, 20 bp, Artificial Sequence
  chemically synthesized
cacattgggcctttagtgtc

SEQ ID NO: 526670 - DNA, 20 bp, Artificial Sequence
  chemically synthesized
cggtccatcagatttcccag

SEQ ID NO: 526671 - DNA, 20 bp, Artificial Sequence
  chemically synthesized
ggaccggggaagccatattt

SEQ ID NO: 526672 - DNA, 20 bp, Artificial Sequence
  chemically synthesized
tagttaaaaaatttcaaaaa

SEQ ID NO: 526673 - DNA, 20 bp, Artificial Sequence
  chemically synthesized
aggagatacagagttttatg

SEQ ID NO: 526674 - DNA, 20 bp, Artificial Sequence
  chemically synthesized
gggcaagatctcaggagata

SEQ ID NO: 526675 - DNA, 20 bp, Artificial Sequence
  chemically synthesized
ctgatgctgtttgcagtgag

SEQ ID NO: 526676 - DNA, 20 bp, Artificial Sequence
  chemically synthesized
cttctcactgcaaacagcat

SEQ ID NO: 526677 - DNA, 20 bp, Artificial Sequence
  chemically synthesized
aatttgaggggatgtcacaa

SEQ ID NO: 526678 - DNA, 20 bp, Artificial Sequence
  chemically synthesized
gaggccattgaacaatttga

SEQ ID NO: 526679 - DNA, 20 bp, Artificial Sequence
  chemically synthesized
caatggcctcctattgacct

SEQ ID NO: 526680 - DNA, 20 bp, Artificial Sequence
  chemically synthesized
tgacgggacacctgtgaatc

SEQ ID NO: 526681 - DNA, 20 bp, Artificial Sequence
  chemically synthesized
gaaagtttgacgggacacct

SEQ ID NO: 526682 - DNA, 20 bp, Artificial Sequence
  chemically synthesized
acaatggctcttaagcttcg

SEQ ID NO: 526683 - DNA, 20 bp, Artificial Sequence
  chemically synthesized
gtacatgttatttctctgta

SEQ ID NO: 526684 - DNA, 20 bp, Artificial Sequence
  chemically synthesized
cctccaatttttatagttca

SEQ ID NO: 526685 - DNA, 20 bp, Artificial Sequence
  chemically synthesized
agaaaggtcattagaacatt

SEQ ID NO: 526686 - DNA, 20 bp, Artificial Sequence
  chemically synthesized
agttagttggcatatgccac

SEQ ID NO: 526687 - DNA, 20 bp, Artificial Sequence
  chemically synthesized
gtctcgtcttcctgttgtct

SEQ ID NO: 526688 - DNA, 20 bp, Artificial Sequence
  chemically synthesized
attgctgcaggaaaataact

SEQ ID NO: 526689 - DNA, 20 bp, Artificial Sequence
  chemically synthesized
gcatgacttagggctcttct

SEQ ID NO: 526690 - DNA, 20 bp, Artificial Sequence
  chemically synthesized
tgctacaataaagatgtaag

SEQ ID NO: 526691 - DNA, 20 bp, Artificial Sequence
  chemically synthesized
ataaagatgtaagtagaata

SEQ ID NO: 526692 - DNA, 20 bp, Artificial Sequence
  chemically synthesized
atgtaagtagaatatgggat

SEQ ID NO: 526693 - DNA, 20 bp, Artificial Sequence
  chemically synthesized
attttgttctgaaattttcc

SEQ ID NO: 526694 - DNA, 20 bp, Artificial Sequence
  chemically synthesized
tgtacagtttttaaaatata

SEQ ID NO: 526695 - DNA, 20 bp, Artificial Sequence
  chemically synthesized
taaaaaatagtttttgaaaa

SEQ ID NO: 526696 - DNA, 20 bp, Artificial Sequence
  chemically synthesized
ttccttgaaacaccacctaa

SEQ ID NO: 526697 - DNA, 20 bp, Artificial Sequence
  chemically synthesized
taacataattctaagttgag

SEQ ID NO: 526698 - DNA, 20 bp, Artificial Sequence
  chemically synthesized
attatgaattcacctcaact

SEQ ID NO: 526699 - DNA, 20 bp, Artificial Sequence
  chemically synthesized
atatcaaaatgtcttatatt

SEQ ID NO: 526700 - DNA, 20 bp, Artificial Sequence
  chemically synthesized
gaatgactgttcttcaagta

SEQ ID NO: 526701 - DNA, 20 bp, Artificial Sequence
  chemically synthesized
tatatttaaggacacagacc

SEQ ID NO: 526702 - DNA, 20 bp, Artificial Sequence
  chemically synthesized
acttgaaattaaaagctatc

SEQ ID NO: 526703 - DNA, 20 bp, Artificial Sequence
  chemically synthesized
ttatttccaaaagattttct

SEQ ID NO: 526704 - DNA, 20 bp, Artificial Sequence
  chemically synthesized
ccaggatataattgcctggt

SEQ ID NO: 526705 - DNA, 20 bp, Artificial Sequence
  chemically synthesized
atccaagttttatcaaatac

SEQ ID NO: 526706 - DNA, 20 bp, Artificial Sequence
  chemically synthesized
atcctggtatttgataaaac

SEQ ID NO: 526707 - DNA, 20 bp, Artificial Sequence
  chemically synthesized
acttggatgtttaccatttc

SEQ ID NO: 526708 - DNA, 20 bp, Artificial Sequence
  chemically synthesized
tctgcagaaaatggctgact

SEQ ID NO: 526709 - DNA, 20 bp, Artificial Sequence
  chemically synthesized
tcaaagtcagccattttctg

SEQ ID NO: 526710 - DNA, 20 bp, Artificial Sequence
  chemically synthesized
agcagcagaaaatatgtgcc

SEQ ID NO: 526711 - DNA, 20 bp, Artificial Sequence
  chemically synthesized
cacttcaaacataacatgac

SEQ ID NO: 526712 - DNA, 20 bp, Artificial Sequence
  chemically synthesized
aaaaaacaaaagaaaacaaa

SEQ ID NO: 526713 - DNA, 20 bp, Artificial Sequence
  chemically synthesized
aaggaggagcacatttgggg

SEQ ID NO: 526714 - DNA, 20 bp, Artificial Sequence
  chemically synthesized
tatataaggaggagcacatt

SEQ ID NO: 526715 - DNA, 20 bp, Artificial Sequence
  chemically synthesized
ttaaaaacactttttagtgg

SEQ ID NO: 526716 - DNA, 20 bp, Artificial Sequence
  chemically synthesized
aagtgtaatatgattttgat

SEQ ID NO: 526717 - DNA, 20 bp, Artificial Sequence
  chemically synthesized
aggtacttatatagggattg

SEQ ID NO: 526718 - DNA, 20 bp, Artificial Sequence
  chemically synthesized
gggaatagaggtacttatat

SEQ ID NO: 526719 - DNA, 20 bp, Artificial Sequence
  chemically synthesized
tgtggcagagagactttatt

SEQ ID NO: 526720 - DNA, 20 bp, Artificial Sequence
  chemically synthesized
ttatctttttaaagctcatt

SEQ ID NO: 526721 - DNA, 20 bp, Artificial Sequence
  chemically synthesized
gcttatgagatttagtcaaa

SEQ ID NO: 526722 - DNA, 20 bp, Artificial Sequence
  chemically synthesized
atttttttggttataaaatc

SEQ ID NO: 526723 - DNA, 20 bp, Artificial Sequence
  chemically synthesized
tatagttcgtgtttagcatt

SEQ ID NO: 526724 - DNA, 20 bp, Artificial Sequence
  chemically synthesized
agaatgctaaacacgaacta

SEQ ID NO: 526725 - DNA, 20 bp, Artificial Sequence
  chemically synthesized
gttgggggagatatgtaaac

SEQ ID NO: 526726 - DNA, 20 bp, Artificial Sequence
  chemically synthesized
ggaaagatgaatgaatcaac

SEQ ID NO: 526727 - DNA, 20 bp, Artificial Sequence
  chemically synthesized
gctagaatgaggaaagatga

SEQ ID NO: 526728 - DNA, 20 bp, Artificial Sequence
  chemically synthesized
cacagctagaatgaggaaag

SEQ ID NO: 526729 - DNA, 20 bp, Artificial Sequence
  chemically synthesized
gaactaaagtcaagcacagc

SEQ ID NO: 526730 - DNA, 20 bp, Artificial Sequence
  chemically synthesized
ttgtctagtttatattactt

SEQ ID NO: 526731 - DNA, 20 bp, Artificial Sequence
  chemically synthesized
cttgaagataaaaattgacc

SEQ ID NO: 526732 - DNA, 20 bp, Artificial Sequence
  chemically synthesized
caaaataagctgccagaaag

SEQ ID NO: 526733 - DNA, 20 bp, Artificial Sequence
  chemically synthesized
ttcttttttaaggatgaagg

SEQ ID NO: 526734 - DNA, 20 bp, Artificial Sequence
  chemically synthesized
gaagatgcattttctttttt

SEQ ID NO: 526735 - DNA, 20 bp, Artificial Sequence
  chemically synthesized
tcataaaaagattacaactt

SEQ ID NO: 526736 - DNA, 20 bp, Artificial Sequence
  chemically synthesized
aaagtcatgtttttcaaaca

SEQ ID NO: 526737 - DNA, 20 bp, Artificial Sequence
  chemically synthesized
gtgggaaatacatatatgtt

SEQ ID NO: 526738 - DNA, 20 bp, Artificial Sequence
  chemically synthesized
tttttgcattgatgttcatc

SEQ ID NO: 526739 - DNA, 20 bp, Artificial Sequence
  chemically synthesized
cagtttgccagtattttatt

SEQ ID NO: 526740 - DNA, 20 bp, Artificial Sequence
  chemically synthesized
ctcaataaaatactggcaaa

SEQ ID NO: 526741 - DNA, 20 bp, Artificial Sequence
  chemically synthesized
gtaagctttttgatgtgctg

SEQ ID NO: 526742 - DNA, 20 bp, Artificial Sequence
  chemically synthesized
atgaagtcgacttaatcgtg

SEQ ID NO: 526743 - DNA, 20 bp, Artificial Sequence
  chemically synthesized
ttgaaccagccttgcttccc

SEQ ID NO: 526744 - DNA, 20 bp, Artificial Sequence
  chemically synthesized
tcattggtgctgtttatgtg

SEQ ID NO: 526745 - DNA, 20 bp, Artificial Sequence
  chemically synthesized
gtttttagcatgaaggggtg

SEQ ID NO: 526746 - DNA, 20 bp, Artificial Sequence
  chemically synthesized
attaagagtttttagcatga

SEQ ID NO: 526747 - DNA, 20 bp, Artificial Sequence
  chemically synthesized
ccaacaatacctagtttatt

SEQ ID NO: 526748 - DNA, 20 bp, Artificial Sequence
  chemically synthesized
cttaataaactaggtattgt

SEQ ID NO: 526749 - DNA, 20 bp, Artificial Sequence
  chemically synthesized
cattcactatgatattgtct

SEQ ID NO: 526750 - DNA, 20 bp, Artificial Sequence
  chemically synthesized
aacccacagacaatatcata

SEQ ID NO: 526751 - DNA, 20 bp, Artificial Sequence
  chemically synthesized
gtcttgtgcgggttttcaaa

SEQ ID NO: 526752 - DNA, 20 bp, Artificial Sequence
  chemically synthesized
tttgaaaacccgcacaagac

SEQ ID NO: 526753 - DNA, 20 bp, Artificial Sequence
  chemically synthesized
cgagggcatccttgtcttgt

SEQ ID NO: 526754 - DNA, 20 bp, Artificial Sequence
  chemically synthesized
cttccaatactatgttgaat

SEQ ID NO: 526755 - DNA, 20 bp, Artificial Sequence
  chemically synthesized
ccagaacttccaatactatg

SEQ ID NO: 526756 - DNA, 20 bp, Artificial Sequence
  chemically synthesized
tcaggcaagagaaagaaata

SEQ ID NO: 526757 - DNA, 20 bp, Artificial Sequence
  chemically synthesized
gagacaatttgacttcctat

SEQ ID NO: 526758 - DNA, 20 bp, Artificial Sequence
  chemically synthesized
gtgattagaaggcattacat

SEQ ID NO: 526759 - DNA, 20 bp, Artificial Sequence
  chemically synthesized
gatgttctcgttattttgtc

SEQ ID NO: 526760 - DNA, 20 bp, Artificial Sequence
  chemically synthesized
ggaaatagtcttcaaataaa

SEQ ID NO: 526761 - DNA, 20 bp, Artificial Sequence
  chemically synthesized
tagggtaacatatatcgaag

SEQ ID NO: 526762 - DNA, 20 bp, Artificial Sequence
  chemically synthesized
aatatatgtagtaggatttt

SEQ ID NO: 526763 - DNA, 20 bp, Artificial Sequence
  chemically synthesized
ttacaaaacaatatatgtag

SEQ ID NO: 526764 - DNA, 20 bp, Artificial Sequence
  chemically synthesized
actattgaaaaatattacaa

SEQ ID NO: 526765 - DNA, 20 bp, Artificial Sequence
  chemically synthesized
attatgcagccatcaaatta

SEQ ID NO: 526766 - DNA, 20 bp, Artificial Sequence
  chemically synthesized
atttgaccacacttgtatta

SEQ ID NO: 526767 - DNA, 20 bp, Artificial Sequence
  chemically synthesized
taatttgcatgaatatacaa

SEQ ID NO: 526768 - DNA, 20 bp, Artificial Sequence
  chemically synthesized
aattggcatatataatttgc

SEQ ID NO: 526769 - DNA, 20 bp, Artificial Sequence
  chemically synthesized
attatctcaagcaaatttat

SEQ ID NO: 526770 - DNA, 20 bp, Artificial Sequence
  chemically synthesized
gtcttgtgcagtattagtag

SEQ ID NO: 526771 - DNA, 20 bp, Artificial Sequence
  chemically synthesized
tttctattttcatcaatctt

SEQ ID NO: 526772 - DNA, 20 bp, Artificial Sequence
  chemically synthesized
tcttaggagtaattaccacg

SEQ ID NO: 526773 - DNA, 20 bp, Artificial Sequence
  chemically synthesized
gttacggaagttttggggaa

SEQ ID NO: 526774 - DNA, 20 bp, Artificial Sequence
  chemically synthesized
aaaacttccgtaacaatctt

SEQ ID NO: 526775 - DNA, 20 bp, Artificial Sequence
  chemically synthesized
cctacatcacctttaaaacc

SEQ ID NO: 526776 - DNA, 20 bp, Artificial Sequence
  chemically synthesized
ccaagagttaggactcattt

SEQ ID NO: 526777 - DNA, 20 bp, Artificial Sequence
  chemically synthesized
tataaaaaaatgattccaaa

SEQ ID NO: 526778 - DNA, 20 bp, Artificial Sequence
  chemically synthesized
caaattttcctcaacacttt

SEQ ID NO: 526779 - DNA, 20 bp, Artificial Sequence
  chemically synthesized
gaacctcaaaactattttaa

SEQ ID NO: 526780 - DNA, 20 bp, Artificial Sequence
  chemically synthesized
aagataatatctatgttgaa

SEQ ID NO: 526781 - DNA, 20 bp, Artificial Sequence
  chemically synthesized
atgaataaaatagatctatc

SEQ ID NO: 526782 - DNA, 20 bp, Artificial Sequence
  chemically synthesized
tgtactactttgaagatctt

SEQ ID NO: 526783 - DNA, 20 bp, Artificial Sequence
  chemically synthesized
ctctcaaatcaaatttggat

SEQ ID NO: 526784 - DNA, 20 bp, Artificial Sequence
  chemically synthesized
cagtagctctcaaatcaaat

SEQ ID NO: 526785 - DNA, 20 bp, Artificial Sequence
  chemically synthesized
atttgtaatacaaattacga

SEQ ID NO: 526786 - DNA, 20 bp, Artificial Sequence
  chemically synthesized
aatacaaattacgatggggt

SEQ ID NO: 526787 - DNA, 20 bp, Artificial Sequence
  chemically synthesized
ggccagttttttatgtacaa

SEQ ID NO: 526788 - DNA, 20 bp, Artificial Sequence
  chemically synthesized
gaaaatctacaaaaaaatag

SEQ ID NO: 526789 - DNA, 20 bp, Artificial Sequence
  chemically synthesized
aaaaatagtaggatacaatc

SEQ ID NO: 526790 - DNA, 20 bp, Artificial Sequence
  chemically synthesized
gtaggatacaatcctggatt

SEQ ID NO: 526791 - DNA, 20 bp, Artificial Sequence
  chemically synthesized
tgtctccagaatccaaaatc

SEQ ID NO: 526792 - DNA, 20 bp, Artificial Sequence
  chemically synthesized
acaatgtggtccactgtctc

SEQ ID NO: 526793 - DNA, 20 bp, Artificial Sequence
  chemically synthesized
ggaccacattgtataggtga

SEQ ID NO: 526794 - DNA, 20 bp, Artificial Sequence
  chemically synthesized
cacattgtataggtgattga

SEQ ID NO: 526795 - DNA, 20 bp, Artificial Sequence
  chemically synthesized
aaaaccaaaaatatatactt

SEQ ID NO: 526796 - DNA, 20 bp, Artificial Sequence
  chemically synthesized
gaaacagggtttaataggtg

SEQ ID NO: 526797 - DNA, 20 bp, Artificial Sequence
  chemically synthesized
agagtaggagtcaaatgaaa

SEQ ID NO: 526798 - DNA, 20 bp, Artificial Sequence
  chemically synthesized
atgaggttagaaaatagagt

SEQ ID NO: 526799 - DNA, 20 bp, Artificial Sequence
  chemically synthesized
tgggagatgaggttagaaaa

SEQ ID NO: 526800 - DNA, 20 bp, Artificial Sequence
  chemically synthesized
gaaaaattgacttgtgtggt

SEQ ID NO: 526801 - DNA, 20 bp, Artificial Sequence
  chemically synthesized
gaaacaggaagcacaaaggg

SEQ ID NO: 526802 - DNA, 20 bp, Artificial Sequence
  chemically synthesized
gtgcttcctgtttccctata

SEQ ID NO: 526803 - DNA, 20 bp, Artificial Sequence
  chemically synthesized
acatgtgatgatctggataa

SEQ ID NO: 526804 - DNA, 20 bp, Artificial Sequence
  chemically synthesized
agacctatacatgtgatgat

SEQ ID NO: 526805 - DNA, 20 bp, Artificial Sequence
  chemically synthesized
atagtggccttcccttttct

SEQ ID NO: 526806 - DNA, 20 bp, Artificial Sequence
  chemically synthesized
ataacctatagtgagtgaat

SEQ ID NO: 526807 - DNA, 20 bp, Artificial Sequence
  chemically synthesized
aatcacataacctatagtga

SEQ ID NO: 526808 - DNA, 20 bp, Artificial Sequence
  chemically synthesized
ggataatcacataacctata

SEQ ID NO: 526809 - DNA, 20 bp, Artificial Sequence
  chemically synthesized
atttaaagaatatgattttg

SEQ ID NO: 526810 - DNA, 20 bp, Artificial Sequence
  chemically synthesized
agataaaaatcaaatattta

SEQ ID NO: 526811 - DNA, 20 bp, Artificial Sequence
  chemically synthesized
atattaggcactgacaggtc

SEQ ID NO: 526812 - DNA, 20 bp, Artificial Sequence
  chemically synthesized
gttctaatctcaatgaatgc

SEQ ID NO: 526813 - DNA, 20 bp, Artificial Sequence
  chemically synthesized
gtagctcagttctaatctca

SEQ ID NO: 526814 - DNA, 20 bp, Artificial Sequence
  chemically synthesized
tgttcctgatattggttatt

SEQ ID NO: 526815 - DNA, 20 bp, Artificial Sequence
  chemically synthesized
ggcaatgtgatgattggagc

SEQ ID NO: 526816 - DNA, 20 bp, Artificial Sequence
  chemically synthesized
ttgttatttctcactgttac

SEQ ID NO: 526817 - DNA, 20 bp, Artificial Sequence
  chemically synthesized
tggttctgataggacataat

SEQ ID NO: 526818 - DNA, 20 bp, Artificial Sequence
  chemically synthesized
gatcatacctagctgcaatg

SEQ ID NO: 526819 - DNA, 20 bp, Artificial Sequence
  chemically synthesized
gaaaaatttaaactttattg

SEQ ID NO: 526820 - DNA, 20 bp, Artificial Sequence
  chemically synthesized
ttggggtgagttagtgagaa

SEQ ID NO: 526821 - DNA, 20 bp, Artificial Sequence
  chemically synthesized
ctatgaattattggtttggg

SEQ ID NO: 526822 - DNA, 20 bp, Artificial Sequence
  chemically synthesized
tacactatgaattattggtt

SEQ ID NO: 526823 - DNA, 20 bp, Artificial Sequence
  chemically synthesized
tacttaatattagctacact

SEQ ID NO: 526824 - DNA, 20 bp, Artificial Sequence
  chemically synthesized
ccctttacctcttggtgagg

SEQ ID NO: 526825 - DNA, 20 bp, Artificial Sequence
  chemically synthesized
ttcttcctcaccaagaggta

SEQ ID NO: 526826 - DNA, 20 bp, Artificial Sequence
  chemically synthesized
tcaacttcattcttctgcat

SEQ ID NO: 526827 - DNA, 20 bp, Artificial Sequence
  chemically synthesized
aacttgagattcacatgcag

SEQ ID NO: 526828 - DNA, 20 bp, Artificial Sequence
  chemically synthesized
ctaagaccatgaaaatgaga

SEQ ID NO: 526829 - DNA, 20 bp, Artificial Sequence
  chemically synthesized
tctccctcatttatgagagg

SEQ ID NO: 526830 - DNA, 20 bp, Artificial Sequence
  chemically synthesized
ctgataagtaaaaagaagaa

SEQ ID NO: 526831 - DNA, 20 bp, Artificial Sequence
  chemically synthesized
tggatagacatggccaaaaa

SEQ ID NO: 526832 - DNA, 20 bp, Artificial Sequence
  chemically synthesized
tgtttttggccatgtctatc

SEQ ID NO: 526833 - DNA, 20 bp, Artificial Sequence
  chemically synthesized
tgtgtgacagaaactttact

SEQ ID NO: 526834 - DNA, 20 bp, Artificial Sequence
  chemically synthesized
ttctgtcacacagagctaga

SEQ ID NO: 526835 - DNA, 20 bp, Artificial Sequence
  chemically synthesized
tcacacagagctagagagag

SEQ ID NO: 526836 - DNA, 20 bp, Artificial Sequence
  chemically synthesized
agagctagagagagtggggt

SEQ ID NO: 526837 - DNA, 20 bp, Artificial Sequence
  chemically synthesized
agagagagtggggttggggt

SEQ ID NO: 526838 - DNA, 20 bp, Artificial Sequence
  chemically synthesized
attttgcaggtttttttgtt

SEQ ID NO: 526839 - DNA, 20 bp, Artificial Sequence
  chemically synthesized
ggggctccatggatgctgtc

SEQ ID NO: 526840 - DNA, 20 bp, Artificial Sequence
  chemically synthesized
tgtgtagtgtcaggggctcc

SEQ ID NO: 526841 - DNA, 20 bp, Artificial Sequence
  chemically synthesized
atttcacaaacttgtaaaat

SEQ ID NO: 526842 - DNA, 20 bp, Artificial Sequence
  chemically synthesized
gccactgcagtcctgaaggt

SEQ ID NO: 526843 - DNA, 20 bp, Artificial Sequence
  chemically synthesized
ggactgcagtggcagaggcc

SEQ ID NO: 526844 - DNA, 20 bp, Artificial Sequence
  chemically synthesized
cagaggccatgaataggagg

SEQ ID NO: 526845 - DNA, 20 bp, Artificial Sequence
  chemically synthesized
tacctgcaattgttacttat

SEQ ID NO: 526846 - DNA, 20 bp, Artificial Sequence
  chemically synthesized
taacaattgcaggtaaaaat

SEQ ID NO: 526847 - DNA, 20 bp, Artificial Sequence
  chemically synthesized
ataaaatatatgttaactag

SEQ ID NO: 526848 - DNA, 20 bp, Artificial Sequence
  chemically synthesized
tcattaagagaaaaaaaaaa

SEQ ID NO: 526849 - DNA, 20 bp, Artificial Sequence
  chemically synthesized
agaaaaaaaaaagggaatca

SEQ ID NO: 526850 - DNA, 20 bp, Artificial Sequence
  chemically synthesized
gatttctataatctattgcc

SEQ ID NO: 526851 - DNA, 20 bp, Artificial Sequence
  chemically synthesized
tcacacacaaaagtatattc

SEQ ID NO: 526852 - DNA, 20 bp, Artificial Sequence
  chemically synthesized
tgaaactttttaaataattc

SEQ ID NO: 526853 - DNA, 20 bp, Artificial Sequence
  chemically synthesized
tgtttctacagtgaatattt

SEQ ID NO: 526854 - DNA, 20 bp, Artificial Sequence
  chemically synthesized
atgttttgtatgtttctaca

SEQ ID NO: 526855 - DNA, 20 bp, Artificial Sequence
  chemically synthesized
gtagaaacatacaaaacatc

SEQ ID NO: 526856 - DNA, 20 bp, Artificial Sequence
  chemically synthesized
acatatgaaaacaaccagaa

SEQ ID NO: 526857 - DNA, 20 bp, Artificial Sequence
  chemically synthesized
aaccagaaaagagttaaagc

SEQ ID NO: 526858 - DNA, 20 bp, Artificial Sequence
  chemically synthesized
tttgaaattaaagatttact

SEQ ID NO: 526859 - DNA, 20 bp, Artificial Sequence
  chemically synthesized
tttactatggattgtgaaag

SEQ ID NO: 526860 - DNA, 20 bp, Artificial Sequence
  chemically synthesized
aagctgaatgctaaatctta

SEQ ID NO: 526861 - DNA, 20 bp, Artificial Sequence
  chemically synthesized
agtaaaataattaagaagtg

SEQ ID NO: 526862 - DNA, 20 bp, Artificial Sequence
  chemically synthesized
cattttcaccatacagataa

SEQ ID NO: 526863 - DNA, 20 bp, Artificial Sequence
  chemically synthesized
gatgttgctgagtgtggagc

SEQ ID NO: 526864 - DNA, 20 bp, Artificial Sequence
  chemically synthesized
aagctatcaacatgatgttg

SEQ ID NO: 526865 - DNA, 20 bp, Artificial Sequence
  chemically synthesized
atcatgttgatagcttgaaa

SEQ ID NO: 526866 - DNA, 20 bp, Artificial Sequence
  chemically synthesized
cacagaaataagcaaacact

SEQ ID NO: 526867 - DNA, 20 bp, Artificial Sequence
  chemically synthesized
caaacactaagaatcatagc

SEQ ID NO: 526868 - DNA, 20 bp, Artificial Sequence
  chemically synthesized
ctctctatatatgtctcttt

SEQ ID NO: 526869 - DNA, 20 bp, Artificial Sequence
  chemically synthesized
taccttgctgatatagctag

SEQ ID NO: 526870 - DNA, 20 bp, Artificial Sequence
  chemically synthesized
tagctatatcagcaaggtaa

SEQ ID NO: 526871 - DNA, 20 bp, Artificial Sequence
  chemically synthesized
aaatataacttgagttgctg

SEQ ID NO: 526872 - DNA, 20 bp, Artificial Sequence
  chemically synthesized
atttttactaaaaatataac

SEQ ID NO: 526873 - DNA, 20 bp, Artificial Sequence
  chemically synthesized
gttagtctctgtgtttgttt

SEQ ID NO: 526874 - DNA, 20 bp, Artificial Sequence
  chemically synthesized
ttattgcacaccgcaattgt

SEQ ID NO: 526875 - DNA, 20 bp, Artificial Sequence
  chemically synthesized
ctgtggaaataatggtagat

SEQ ID NO: 526876 - DNA, 20 bp, Artificial Sequence
  chemically synthesized
acatctaccattatttccac

SEQ ID NO: 526877 - DNA, 20 bp, Artificial Sequence
  chemically synthesized
agtaaatgtttggccagtga

SEQ ID NO: 526878 - DNA, 20 bp, Artificial Sequence
  chemically synthesized
actcagtaaatgtttggcca

SEQ ID NO: 526879 - DNA, 20 bp, Artificial Sequence
  chemically synthesized
attcactggccaaacattta

SEQ ID NO: 526880 - DNA, 20 bp, Artificial Sequence
  chemically synthesized
agatagcacagaaactgata

SEQ ID NO: 526881 - DNA, 20 bp, Artificial Sequence
  chemically synthesized
tgtgctatctagataaaaca

SEQ ID NO: 526882 - DNA, 20 bp, Artificial Sequence
  chemically synthesized
ttgtgtaattttagctccct

SEQ ID NO: 526883 - DNA, 20 bp, Artificial Sequence
  chemically synthesized
taaaattacacaaatggaca

SEQ ID NO: 526884 - DNA, 20 bp, Artificial Sequence
  chemically synthesized
gtctcttgtcatacggttga

SEQ ID NO: 526885 - DNA, 20 bp, Artificial Sequence
  chemically synthesized
tatgacaagagacatccatg

SEQ ID NO: 526886 - DNA, 20 bp, Artificial Sequence
  chemically synthesized
cacatattagctcatccccc

SEQ ID NO: 526887 - DNA, 20 bp, Artificial Sequence
  chemically synthesized
ttatctcacatatattctat

SEQ ID NO: 526888 - DNA, 20 bp, Artificial Sequence
  chemically synthesized
gttacatatcagaattcata

SEQ ID NO: 526889 - DNA, 20 bp, Artificial Sequence
  chemically synthesized
aagaaatgatagttacatat

SEQ ID NO: 526890 - DNA, 20 bp, Artificial Sequence
  chemically synthesized
tgtgatatgatttaacttac

SEQ ID NO: 526891 - DNA, 20 bp, Artificial Sequence
  chemically synthesized
agtcaacagctgattggata

SEQ ID NO: 526892 - DNA, 20 bp, Artificial Sequence
  chemically synthesized
ggataaaagtcaacagctga

SEQ ID NO: 526893 - DNA, 20 bp, Artificial Sequence
  chemically synthesized
ccaataaagctatgaaagac

SEQ ID NO: 526894 - DNA, 20 bp, Artificial Sequence
  chemically synthesized
accttgctttaataattata

SEQ ID NO: 526895 - DNA, 20 bp, Artificial Sequence
  chemically synthesized
cacaatggattactttaact

SEQ ID NO: 526896 - DNA, 20 bp, Artificial Sequence
  chemically synthesized
atgtgggagacatcaccaca

SEQ ID NO: 526897 - DNA, 20 bp, Artificial Sequence
  chemically synthesized
cccacatgaaacatcactgt

SEQ ID NO: 526898 - DNA, 20 bp, Artificial Sequence
  chemically synthesized
tatgaaactgctataattta

SEQ ID NO: 526899 - DNA, 20 bp, Artificial Sequence
  chemically synthesized
atagttctgagaggttttct

SEQ ID NO: 526900 - DNA, 20 bp, Artificial Sequence
  chemically synthesized
tctcagaactattcacattt

SEQ ID NO: 526901 - DNA, 20 bp, Artificial Sequence
  chemically synthesized
gaagacataaattcaaaaat

SEQ ID NO: 526902 - DNA, 20 bp, Artificial Sequence
  chemically synthesized
atttttgaatttatgtcttc

SEQ ID NO: 526903 - DNA, 20 bp, Artificial Sequence
  chemically synthesized
atgtcttctagggtacactg

SEQ ID NO: 526904 - DNA, 20 bp, Artificial Sequence
  chemically synthesized
aagaggtttttcaatataat

SEQ ID NO: 526905 - DNA, 20 bp, Artificial Sequence
  chemically synthesized
ttctcctatcatgataaaac

SEQ ID NO: 526906 - DNA, 20 bp, Artificial Sequence
  chemically synthesized
ttccagttttatcatgatag

SEQ ID NO: 526907 - DNA, 20 bp, Artificial Sequence
  chemically synthesized
aaaaagaaaaattctagttt

SEQ ID NO: 526908 - DNA, 20 bp, Artificial Sequence
  chemically synthesized
agtctggaagactcaaaaac

SEQ ID NO: 526909 - DNA, 20 bp, Artificial Sequence
  chemically synthesized
taagttaaattgtatgtcaa

SEQ ID NO: 526910 - DNA, 20 bp, Artificial Sequence
  chemically synthesized
tgttatataaaaccaaataa

SEQ ID NO: 526911 - DNA, 20 bp, Artificial Sequence
  chemically synthesized
tagattcagttaaatttctc

SEQ ID NO: 526912 - DNA, 20 bp, Artificial Sequence
  chemically synthesized
ctgatccttgagaaatttaa

SEQ ID NO: 526913 - DNA, 20 bp, Artificial Sequence
  chemically synthesized
caaagtgaatgtaagctttt

SEQ ID NO: 526914 - DNA, 20 bp, Artificial Sequence
  chemically synthesized
taaacatcaaataagccaaa

SEQ ID NO: 526915 - DNA, 20 bp, Artificial Sequence
  chemically synthesized
cactattcagcaaatgctgc

SEQ ID NO: 526916 - DNA, 20 bp, Artificial Sequence
  chemically synthesized
ttttattcttgcagcatttg

SEQ ID NO: 526917 - DNA, 20 bp, Artificial Sequence
  chemically synthesized
tgctgaatagtgttattgtt

SEQ ID NO: 526918 - DNA, 20 bp, Artificial Sequence
  chemically synthesized
tatctaaaacagtaagtgta

SEQ ID NO: 526919 - DNA, 20 bp, Artificial Sequence
  chemically synthesized
tttcatctctgtagatgagg

SEQ ID NO: 526920 - DNA, 20 bp, Artificial Sequence
  chemically synthesized
caagcagtctgacaagtttt

SEQ ID NO: 526921 - DNA, 20 bp, Artificial Sequence
  chemically synthesized
ttaatagtatatgccaaatt

SEQ ID NO: 526922 - DNA, 20 bp, Artificial Sequence
  chemically synthesized
gtagacagactttttttttg

SEQ ID NO: 526923 - DNA, 20 bp, Artificial Sequence
  chemically synthesized
tttaaaattatagaacaaga

SEQ ID NO: 526924 - DNA, 20 bp, Artificial Sequence
  chemically synthesized
tttatttaaaattatagaac

SEQ ID NO: 526925 - DNA, 20 bp, Artificial Sequence
  chemically synthesized
ctttaaaaatacgtgttggt

SEQ ID NO: 526926 - DNA, 20 bp, Artificial Sequence
  chemically synthesized
cattcccacaaacagtgcat

SEQ ID NO: 526927 - DNA, 20 bp, Artificial Sequence
  chemically synthesized
aaccctcatgcactgtttgt

SEQ ID NO: 526928 - DNA, 20 bp, Artificial Sequence
  chemically synthesized
gtttctcaaactattaaaaa

SEQ ID NO: 526929 - DNA, 20 bp, Artificial Sequence
  chemically synthesized
aataatgcagcaataaatgt

SEQ ID NO: 526930 - DNA, 20 bp, Artificial Sequence
  chemically synthesized
gtggctatatcttggctatt

SEQ ID NO: 526931 - DNA, 20 bp, Artificial Sequence
  chemically synthesized
tatagccacaacctgtgttt

SEQ ID NO: 526932 - DNA, 20 bp, Artificial Sequence
  chemically synthesized
caacctgtgtttgtggatgt

SEQ ID NO: 526933 - DNA, 20 bp, Artificial Sequence
  chemically synthesized
ctgtgtttgtggatgtatgg

SEQ ID NO: 526934 - DNA, 20 bp, Artificial Sequence
  chemically synthesized
agatttccttctttttatgg

SEQ ID NO: 526935 - DNA, 20 bp, Artificial Sequence
  chemically synthesized
atgttgcatgatattatgtg

SEQ ID NO: 526936 - DNA, 20 bp, Artificial Sequence
  chemically synthesized
atgttgaacttatagaagta

SEQ ID NO: 526937 - DNA, 20 bp, Artificial Sequence
  chemically synthesized
gaacttatagaagtagggag

SEQ ID NO: 526938 - DNA, 20 bp, Artificial Sequence
  chemically synthesized
ggagtagaatagcggttgcc

SEQ ID NO: 526939 - DNA, 20 bp, Artificial Sequence
  chemically synthesized
tgccaggagtggtataaatg

SEQ ID NO: 526940 - DNA, 20 bp, Artificial Sequence
  chemically synthesized
aaatggggagttgttggtca

SEQ ID NO: 526941 - DNA, 20 bp, Artificial Sequence
  chemically synthesized
ttatacttgaaacttgctga

SEQ ID NO: 526942 - DNA, 20 bp, Artificial Sequence
  chemically synthesized
agagactactatgcccggtg

SEQ ID NO: 526943 - DNA, 20 bp, Artificial Sequence
  chemically synthesized
tgttgtatatcttaaatata

SEQ ID NO: 526944 - DNA, 20 bp, Artificial Sequence
  chemically synthesized
atatgttattgaaatcattt

SEQ ID NO: 526945 - DNA, 20 bp, Artificial Sequence
  chemically synthesized
ctctgtgtttctggatgaaa

SEQ ID NO: 526946 - DNA, 20 bp, Artificial Sequence
  chemically synthesized
agggaattatctctgtgttt

SEQ ID NO: 526947 - DNA, 20 bp, Artificial Sequence
  chemically synthesized
agatatgtgcggctaacaca

SEQ ID NO: 526948 - DNA, 20 bp, Artificial Sequence
  chemically synthesized
agattaattaaattttgagt

SEQ ID NO: 526949 - DNA, 20 bp, Artificial Sequence
  chemically synthesized
cactgaagattaattaaatt

SEQ ID NO: 526950 - DNA, 20 bp, Artificial Sequence
  chemically synthesized
attttaccatcacaacaaat

SEQ ID NO: 526951 - DNA, 20 bp, Artificial Sequence
  chemically synthesized
atgtgtttaagaatcacata

SEQ ID NO: 526952 - DNA, 20 bp, Artificial Sequence
  chemically synthesized
catatttaagaaatgtgttt

SEQ ID NO: 526953 - DNA, 20 bp, Artificial Sequence
  chemically synthesized
gaaataagatactaagagaa

SEQ ID NO: 526954 - DNA, 20 bp, Artificial Sequence
  chemically synthesized
agcaagaaataagatactaa

SEQ ID NO: 526955 - DNA, 20 bp, Artificial Sequence
  chemically synthesized
cctgcttattaggataggca

SEQ ID NO: 526956 - DNA, 20 bp, Artificial Sequence
  chemically synthesized
tgtgcctatcctaataagca

SEQ ID NO: 526957 - DNA, 20 bp, Artificial Sequence
  chemically synthesized
tgtagccatcccctgcttat

SEQ ID NO: 526958 - DNA, 20 bp, Artificial Sequence
  chemically synthesized
atgttggctgttttatcttc

SEQ ID NO: 526959 - DNA, 20 bp, Artificial Sequence
  chemically synthesized
aagataaaacagccaacatt

SEQ ID NO: 526960 - DNA, 20 bp, Artificial Sequence
  chemically synthesized
gaagataaagcagccaactt

SEQ ID NO: 526961 - DNA, 20 bp, Artificial Sequence
  chemically synthesized
gacagatgttctaagagcca

SEQ ID NO: 526962 - DNA, 20 bp, Artificial Sequence
  chemically synthesized
gagtctggctgtgtgacatg

SEQ ID NO: 526963 - DNA, 20 bp, Artificial Sequence
  chemically synthesized
acagccagactcaacttcaa

SEQ ID NO: 526964 - DNA, 20 bp, Artificial Sequence
  chemically synthesized
acttccgcactcacttgaag

SEQ ID NO: 526965 - DNA, 20 bp, Artificial Sequence
  chemically synthesized
tctgtcccctttctggtacg

SEQ ID NO: 526966 - DNA, 20 bp, Artificial Sequence
  chemically synthesized
acagaagcggaacagctatc

SEQ ID NO: 526967 - DNA, 20 bp, Artificial Sequence
  chemically synthesized
atcagataaccacaacttca

SEQ ID NO: 526968 - DNA, 20 bp, Artificial Sequence
  chemically synthesized
tatatttcataataggtaca

SEQ ID NO: 526969 - DNA, 20 bp, Artificial Sequence
  chemically synthesized
aaagtttatttttaataatg

SEQ ID NO: 526970 - DNA, 20 bp, Artificial Sequence
  chemically synthesized
tactctcaggaaaaaaaaat

SEQ ID NO: 526971 - DNA, 20 bp, Artificial Sequence
  chemically synthesized
tattctaatttttttttcct

SEQ ID NO: 526972 - DNA, 20 bp, Artificial Sequence
  chemically synthesized
ctcattttggttttcaacta

SEQ ID NO: 526973 - DNA, 20 bp, Artificial Sequence
  chemically synthesized
gaaaagaaaaatgacataat

SEQ ID NO: 526974 - DNA, 20 bp, Artificial Sequence
  chemically synthesized
caagtaccaaaagaaaaagt

SEQ ID NO: 526975 - DNA, 20 bp, Artificial Sequence
  chemically synthesized
ctttgcagaagacttttgat

SEQ ID NO: 526976 - DNA, 20 bp, Artificial Sequence
  chemically synthesized
aaatagaagctaagaaggga

SEQ ID NO: 526977 - DNA, 20 bp, Artificial Sequence
  chemically synthesized
ggccttccttagaatctgca

SEQ ID NO: 526978 - DNA, 20 bp, Artificial Sequence
  chemically synthesized
tttcctcactaggccttcct

SEQ ID NO: 526979 - DNA, 20 bp, Artificial Sequence
  chemically synthesized
cagttctctaaattatgtgc

SEQ ID NO: 526980 - DNA, 20 bp, Artificial Sequence
  chemically synthesized
atgcaagaaagatacagtct

SEQ ID NO: 526981 - DNA, 20 bp, Artificial Sequence
  chemically synthesized
gaacagggagaggtaaaggc

SEQ ID NO: 526982 - DNA, 20 bp, Artificial Sequence
  chemically synthesized
gtaaaggcaagaatatttgg

SEQ ID NO: 526983 - DNA, 20 bp, Artificial Sequence
  chemically synthesized
aagaatatttggctgaataa

SEQ ID NO: 526984 - DNA, 20 bp, Artificial Sequence
  chemically synthesized
gtaaaacatctaccaattgt

SEQ ID NO: 526985 - DNA, 20 bp, Artificial Sequence
  chemically synthesized
gccatttttacaattacagt

SEQ ID NO: 526986 - DNA, 20 bp, Artificial Sequence
  chemically synthesized
aataatataaaagtctcttc

SEQ ID NO: 526987 - DNA, 20 bp, Artificial Sequence
  chemically synthesized
aaggtgaatgggaaagtgga

SEQ ID NO: 526988 - DNA, 20 bp, Artificial Sequence
  chemically synthesized
ggatcatcggaaacatcaag

SEQ ID NO: 526989 - DNA, 20 bp, Artificial Sequence
  chemically synthesized
tgcaactgctaccacagtta

SEQ ID NO: 526990 - DNA, 20 bp, Artificial Sequence
  chemically synthesized
aagaaagagctctcacactg

SEQ ID NO: 526991 - DNA, 20 bp, Artificial Sequence
  chemically synthesized
tctcttctgagctgtctcta

SEQ ID NO: 526992 - DNA, 20 bp, Artificial Sequence
  chemically synthesized
gagacagctcagaagagaca

SEQ ID NO: 526993 - DNA, 20 bp, Artificial Sequence
  chemically synthesized
tgaatactaatcaaaagaga

SEQ ID NO: 526994 - DNA, 20 bp, Artificial Sequence
  chemically synthesized
acagttgtcttttctggtaa

SEQ ID NO: 526995 - DNA, 20 bp, Artificial Sequence
  chemically synthesized
gtgaagtggctgtttccact

SEQ ID NO: 526996 - DNA, 20 bp, Artificial Sequence
  chemically synthesized
acaacgactttaaagtgaag

SEQ ID NO: 526997 - DNA, 20 bp, Artificial Sequence
  chemically synthesized
cgactttaaagtgaagatga

SEQ ID NO: 526998 - DNA, 20 bp, Artificial Sequence
  chemically synthesized
aatgcaacaatcataaaata

SEQ ID NO: 526999 - DNA, 20 bp, Artificial Sequence
  chemically synthesized
tcaaataccacagccacacc

SEQ ID NO: 527000 - DNA, 20 bp, Artificial Sequence
  chemically synthesized
tttaaactagtacaagcatt

SEQ ID NO: 527001 - DNA, 20 bp, Artificial Sequence
  chemically synthesized
aagccatcattggcaaaggc

SEQ ID NO: 527002 - DNA, 20 bp, Artificial Sequence
  chemically synthesized
tatgttcttcattaaaaaca

SEQ ID NO: 527003 - DNA, 20 bp, Artificial Sequence
  chemically synthesized
tgataatctcatgcctttat

SEQ ID NO: 527004 - DNA, 20 bp, Artificial Sequence
  chemically synthesized
tttcacctgatcatattgac

SEQ ID NO: 527005 - DNA, 20 bp, Artificial Sequence
  chemically synthesized
aagataggaaaaggttagtt

SEQ ID NO: 527006 - DNA, 20 bp, Artificial Sequence
  chemically synthesized
tatggcatccaaacattaca

SEQ ID NO: 527007 - DNA, 20 bp, Artificial Sequence
  chemically synthesized
actataactctttgtaatgt

SEQ ID NO: 527008 - DNA, 20 bp, Artificial Sequence
  chemically synthesized
gtcttctcaaacttcatatg

SEQ ID NO: 527009 - DNA, 20 bp, Artificial Sequence
  chemically synthesized
aatatagtcatcttggtgat

SEQ ID NO: 527010 - DNA, 20 bp, Artificial Sequence
  chemically synthesized
tattataaggtagtgccttt

SEQ ID NO: 527011 - DNA, 20 bp, Artificial Sequence
  chemically synthesized
gtagtgcctttgggaattta

SEQ ID NO: 527012 - DNA, 20 bp, Artificial Sequence
  chemically synthesized
gtcatgagggctctaccttc

SEQ ID NO: 527013 - DNA, 20 bp, Artificial Sequence
  chemically synthesized
gagggctctaccttcatgaa

SEQ ID NO: 527014 - DNA, 20 bp, Artificial Sequence
  chemically synthesized
tgtaacaaaaataccataaa

SEQ ID NO: 527015 - DNA, 20 bp, Artificial Sequence
  chemically synthesized
tatagaagtttacattgggg

SEQ ID NO: 527016 - DNA, 20 bp, Artificial Sequence
  chemically synthesized
aacttctataatctaatcaa

SEQ ID NO: 527017 - DNA, 20 bp, Artificial Sequence
  chemically synthesized
tactgaaggacagcgagtgc

SEQ ID NO: 527018 - DNA, 20 bp, Artificial Sequence
  chemically synthesized
atgcaaaatactgaaggaca

SEQ ID NO: 527019 - DNA, 20 bp, Artificial Sequence
  chemically synthesized
attttgcatgaagccaaagg

SEQ ID NO: 527020 - DNA, 20 bp, Artificial Sequence
  chemically synthesized
tgcctggccttgagtggtgt

SEQ ID NO: 527021 - DNA, 20 bp, Artificial Sequence
  chemically synthesized
aaatcagacaatgcctggcc

SEQ ID NO: 527022 - DNA, 20 bp, Artificial Sequence
  chemically synthesized
tgtctgatttagggagaagc

SEQ ID NO: 527023 - DNA, 20 bp, Artificial Sequence
  chemically synthesized
cctaaggccttacctggaga

SEQ ID NO: 527024 - DNA, 20 bp, Artificial Sequence
  chemically synthesized
agttcctaaggccttacctg

SEQ ID NO: 527025 - DNA, 20 bp, Artificial Sequence
  chemically synthesized
gcacctcttcaaaatagtgt

SEQ ID NO: 527026 - DNA, 20 bp, Artificial Sequence
  chemically synthesized
ttctgtctgtttggagtggg

SEQ ID NO: 527027 - DNA, 20 bp, Artificial Sequence
  chemically synthesized
gccacctatttctgtctgtt

SEQ ID NO: 527028 - DNA, 20 bp, Artificial Sequence
  chemically synthesized
ataattttgtaaaatcgaat

SEQ ID NO: 527029 - DNA, 20 bp, Artificial Sequence
  chemically synthesized
tactgcataattttgtaaaa

SEQ ID NO: 527030 - DNA, 20 bp, Artificial Sequence
  chemically synthesized
catcatcttcgaagcagaga

SEQ ID NO: 527031 - DNA, 20 bp, Artificial Sequence
  chemically synthesized
cacagcatcccttctctctg

SEQ ID NO: 527032 - DNA, 20 bp, Artificial Sequence
  chemically synthesized
cgttgcatcctccagagaga

SEQ ID NO: 527033 - DNA, 20 bp, Artificial Sequence
  chemically synthesized
gagggcagagccctaatgaa

SEQ ID NO: 527034 - DNA, 20 bp, Artificial Sequence
  chemically synthesized
atcatgagggcagagcccta

SEQ ID NO: 527035 - DNA, 20 bp, Artificial Sequence
  chemically synthesized
tggcaattaagtttcaacat

SEQ ID NO: 527036 - DNA, 20 bp, Artificial Sequence
  chemically synthesized
atcttacaaactgctatgat

SEQ ID NO: 527037 - DNA, 20 bp, Artificial Sequence
  chemically synthesized
tgaaatatgtgtgtagaaaa

SEQ ID NO: 527038 - DNA, 20 bp, Artificial Sequence
  chemically synthesized
tttcaagaatatttagtaag

SEQ ID NO: 527039 - DNA, 20 bp, Artificial Sequence
  chemically synthesized
cttattaaaattatgttttc

SEQ ID NO: 527040 - DNA, 20 bp, Artificial Sequence
  chemically synthesized
aacctaagtagctgaaaaat

SEQ ID NO: 527041 - DNA, 20 bp, Artificial Sequence
  chemically synthesized
ttcttaaaagtaacatagca

SEQ ID NO: 527042 - DNA, 20 bp, Artificial Sequence
  chemically synthesized
atttaatcatgtctttaggg

SEQ ID NO: 527043 - DNA, 20 bp, Artificial Sequence
  chemically synthesized
gagtctcagaagacaaattg

SEQ ID NO: 527044 - DNA, 20 bp, Artificial Sequence
  chemically synthesized
gaagacaaattgctgggtca

SEQ ID NO: 527045 - DNA, 20 bp, Artificial Sequence
  chemically synthesized
gcattttggcaatatgcata

SEQ ID NO: 527046 - DNA, 20 bp, Artificial Sequence
  chemically synthesized
agaaatggtgaatacagtag

SEQ ID NO: 527047 - DNA, 20 bp, Artificial Sequence
  chemically synthesized
tacctatcaacctagaaatg

SEQ ID NO: 527048 - DNA, 20 bp, Artificial Sequence
  chemically synthesized
agatatgctcacggaattag

SEQ ID NO: 527049 - DNA, 20 bp, Artificial Sequence
  chemically synthesized
gaaatatgaagatatgctca

SEQ ID NO: 527050 - DNA, 20 bp, Artificial Sequence
  chemically synthesized
taccactatagaaaaatgga

SEQ ID NO: 527051 - DNA, 20 bp, Artificial Sequence
  chemically synthesized
tttaaagaacttaatttttc

SEQ ID NO: 527052 - DNA, 20 bp, Artificial Sequence
  chemically synthesized
gctgtacgtgtgtggaggca

SEQ ID NO: 527053 - DNA, 20 bp, Artificial Sequence
  chemically synthesized
tggtgggagatgtagatagc

SEQ ID NO: 527054 - DNA, 20 bp, Artificial Sequence
  chemically synthesized
ctatctacatctcccaccag

SEQ ID NO: 527055 - DNA, 20 bp, Artificial Sequence
  chemically synthesized
atcaccaaaattccatagtt

SEQ ID NO: 527056 - DNA, 20 bp, Artificial Sequence
  chemically synthesized
tgaacctttactcttaacta

SEQ ID NO: 527057 - DNA, 20 bp, Artificial Sequence
  chemically synthesized
ttaagagtaaaggttcattc

SEQ ID NO: 527058 - DNA, 20 bp, Artificial Sequence
  chemically synthesized
ccatagaatgcacaacaccc

SEQ ID NO: 527059 - DNA, 20 bp, Artificial Sequence
  chemically synthesized
tcttgggtgttgtgcattct

SEQ ID NO: 527060 - DNA, 20 bp, Artificial Sequence
  chemically synthesized
tatatatttgtccaaatcca

SEQ ID NO: 527061 - DNA, 20 bp, Artificial Sequence
  chemically synthesized
tctgtaatgatgctataatt

SEQ ID NO: 527062 - DNA, 20 bp, Artificial Sequence
  chemically synthesized
acaattatagcatcattaca

SEQ ID NO: 527063 - DNA, 20 bp, Artificial Sequence
  chemically synthesized
tatgaatacgtagagtccag

SEQ ID NO: 527064 - DNA, 20 bp, Artificial Sequence
  chemically synthesized
gagggaaatgtatgaatacg

SEQ ID NO: 527065 - DNA, 20 bp, Artificial Sequence
  chemically synthesized
aggggctgtgagggaaatgt

SEQ ID NO: 527066 - DNA, 20 bp, Artificial Sequence
  chemically synthesized
ctacatagtttttgctttcc

SEQ ID NO: 527067 - DNA, 20 bp, Artificial Sequence
  chemically synthesized
tagctcatttctttttagca

SEQ ID NO: 527068 - DNA, 20 bp, Artificial Sequence
  chemically synthesized
aatgaataacatcttattgt

SEQ ID NO: 527069 - DNA, 20 bp, Artificial Sequence
  chemically synthesized
agatgtccttcagtaggtga

SEQ ID NO: 527070 - DNA, 20 bp, Artificial Sequence
  chemically synthesized
accaagatgtccttcagtag

SEQ ID NO: 527071 - DNA, 20 bp, Artificial Sequence
  chemically synthesized
gcttccaaattttggcaatg

SEQ ID NO: 527072 - DNA, 20 bp, Artificial Sequence
  chemically synthesized
ctgtcataaacatccatgtg

SEQ ID NO: 527073 - DNA, 20 bp, Artificial Sequence
  chemically synthesized
gtccacacaaaaccctgcac

SEQ ID NO: 527074 - DNA, 20 bp, Artificial Sequence
  chemically synthesized
tttaaaatgtaaaataccaa

SEQ ID NO: 527075 - DNA, 20 bp, Artificial Sequence
  chemically synthesized
aaataagcttagtttcagtt

SEQ ID NO: 527076 - DNA, 20 bp, Artificial Sequence
  chemically synthesized
taagtctcttcggtggaaag

SEQ ID NO: 527077 - DNA, 20 bp, Artificial Sequence
  chemically synthesized
atctaggagacataaaactt

SEQ ID NO: 527078 - DNA, 20 bp, Artificial Sequence
  chemically synthesized
tctcctagattacacaaatc

SEQ ID NO: 527079 - DNA, 20 bp, Artificial Sequence
  chemically synthesized
ttacacaaatcctgggtaat

SEQ ID NO: 527080 - DNA, 20 bp, Artificial Sequence
  chemically synthesized
catcccatattcctattacc

SEQ ID NO: 527081 - DNA, 20 bp, Artificial Sequence
  chemically synthesized
aatcctgggtaataggaata

SEQ ID NO: 527082 - DNA, 20 bp, Artificial Sequence
  chemically synthesized
taataggaatatgggatggg

SEQ ID NO: 527083 - DNA, 20 bp, Artificial Sequence
  chemically synthesized
tgggatgggaagaattacaa

SEQ ID NO: 527084 - DNA, 20 bp, Artificial Sequence
  chemically synthesized
tgggaactacaagatgaaat

SEQ ID NO: 527085 - DNA, 20 bp, Artificial Sequence
  chemically synthesized
gggtctctcccaccacacag

SEQ ID NO: 527086 - DNA, 20 bp, Artificial Sequence
  chemically synthesized
catgattcagttatctccca

SEQ ID NO: 527087 - DNA, 20 bp, Artificial Sequence
  chemically synthesized
agagacccagtgggagataa

SEQ ID NO: 527088 - DNA, 20 bp, Artificial Sequence
  chemically synthesized
gtgggagataactgaatcat

SEQ ID NO: 527089 - DNA, 20 bp, Artificial Sequence
  chemically synthesized
gagaacttacttgctatcac

SEQ ID NO: 527090 - DNA, 20 bp, Artificial Sequence
  chemically synthesized
cacatggcggcagcaaggag

SEQ ID NO: 527091 - DNA, 20 bp, Artificial Sequence
  chemically synthesized
ccttgctgccgccatgtgat

SEQ ID NO: 527092 - DNA, 20 bp, Artificial Sequence
  chemically synthesized
ctccccagccaggctgaact

SEQ ID NO: 527093 - DNA, 20 bp, Artificial Sequence
  chemically synthesized
caattaaacctctttccttt

SEQ ID NO: 527094 - DNA, 20 bp, Artificial Sequence
  chemically synthesized
cctttatgaattatgcatta

SEQ ID NO: 527095 - DNA, 20 bp, Artificial Sequence
  chemically synthesized
gtatttctttatagcagtgt

SEQ ID NO: 527096 - DNA, 20 bp, Artificial Sequence
  chemically synthesized
acacttaattttttaaatgt

SEQ ID NO: 527097 - DNA, 20 bp, Artificial Sequence
  chemically synthesized
caaatttttccattaaatca

SEQ ID NO: 527098 - DNA, 20 bp, Artificial Sequence
  chemically synthesized
tgaagttatttattataaat

SEQ ID NO: 527099 - DNA, 20 bp, Artificial Sequence
  chemically synthesized
aattcattaataaatttgaa

SEQ ID NO: 527100 - DNA, 20 bp, Artificial Sequence
  chemically synthesized
aattcctttcaaatttatta

SEQ ID NO: 527101 - DNA, 20 bp, Artificial Sequence
  chemically synthesized
agatttctaattgttggaga

SEQ ID NO: 527102 - DNA, 20 bp, Artificial Sequence
  chemically synthesized
agaaaaacaagcaatgggga

SEQ ID NO: 527103 - DNA, 20 bp, Artificial Sequence
  chemically synthesized
ccagcaccatttattaaata

SEQ ID NO: 527104 - DNA, 20 bp, Artificial Sequence
  chemically synthesized
ccatatggagaaagctgaaa

SEQ ID NO: 527105 - DNA, 20 bp, Artificial Sequence
  chemically synthesized
ttttgtataaggtgtgagga

SEQ ID NO: 527106 - DNA, 20 bp, Artificial Sequence
  chemically synthesized
tatacaaaaattaattcaag

SEQ ID NO: 527107 - DNA, 20 bp, Artificial Sequence
  chemically synthesized
gtttaagtctttaatccatc

SEQ ID NO: 527108 - DNA, 20 bp, Artificial Sequence
  chemically synthesized
gtaatgcctaggttttcttc

SEQ ID NO: 527109 - DNA, 20 bp, Artificial Sequence
  chemically synthesized
tccttgcctatgcctatgtc

SEQ ID NO: 527110 - DNA, 20 bp, Artificial Sequence
  chemically synthesized
caaaagccaaaattgacaaa

SEQ ID NO: 527111 - DNA, 20 bp, Artificial Sequence
  chemically synthesized
acagcaaaagaaactaccat

SEQ ID NO: 527112 - DNA, 20 bp, Artificial Sequence
  chemically synthesized
ggatattagccctttgtcag

SEQ ID NO: 527113 - DNA, 20 bp, Artificial Sequence
  chemically synthesized
tctgacaaagggctaatatc

SEQ ID NO: 527114 - DNA, 20 bp, Artificial Sequence
  chemically synthesized
gtttgagttcattgtagatt

SEQ ID NO: 527115 - DNA, 20 bp, Artificial Sequence
  chemically synthesized
tttttttcttgtaaatttgt

SEQ ID NO: 527116 - DNA, 20 bp, Artificial Sequence
  chemically synthesized
gtccttcgcccactttttga

SEQ ID NO: 527117 - DNA, 20 bp, Artificial Sequence
  chemically synthesized
agataccatctcacaccagt

SEQ ID NO: 527118 - DNA, 20 bp, Artificial Sequence
  chemically synthesized
aggaaacaacaggtgctgga

SEQ ID NO: 527119 - DNA, 20 bp, Artificial Sequence
  chemically synthesized
agtcagtgtggcgattcctc

SEQ ID NO: 527120 - DNA, 20 bp, Artificial Sequence
  chemically synthesized
tttctagttctagatccctg

SEQ ID NO: 527121 - DNA, 20 bp, Artificial Sequence
  chemically synthesized
ttgacacagccatcccatta

SEQ ID NO: 527122 - DNA, 20 bp, Artificial Sequence
  chemically synthesized
tttgggtatatacccagtaa

SEQ ID NO: 527123 - DNA, 20 bp, Artificial Sequence
  chemically synthesized
gcagcatgatttatagtcct

SEQ ID NO: 527124 - DNA, 20 bp, Artificial Sequence
  chemically synthesized
ggttccaagtctttgctatt

SEQ ID NO: 527125 - DNA, 20 bp, Artificial Sequence
  chemically synthesized
agtctatcattgttggacat

SEQ ID NO: 527126 - DNA, 20 bp, Artificial Sequence
  chemically synthesized
aaatgtccaacaatgataga

SEQ ID NO: 527127 - DNA, 20 bp, Artificial Sequence
  chemically synthesized
aatgtggcacatatacacca

SEQ ID NO: 527128 - DNA, 20 bp, Artificial Sequence
  chemically synthesized
ctatgcagccataaaaaatg

SEQ ID NO: 527129 - DNA, 20 bp, Artificial Sequence
  chemically synthesized
ttcatgtcctttgtagggac

SEQ ID NO: 527130 - DNA, 20 bp, Artificial Sequence
  chemically synthesized
tgtccttgcaatggtttgct

SEQ ID NO: 527131 - DNA, 20 bp, Artificial Sequence
  chemically synthesized
tcattgttcagttcccacct

SEQ ID NO: 527132 - DNA, 20 bp, Artificial Sequence
  chemically synthesized
ccccaccccacaacagtccc

SEQ ID NO: 527133 - DNA, 20 bp, Artificial Sequence
  chemically synthesized
tcacactccggggactgttg

SEQ ID NO: 527134 - DNA, 20 bp, Artificial Sequence
  chemically synthesized
gtggggtggggggagggggg

SEQ ID NO: 527135 - DNA, 20 bp, Artificial Sequence
  chemically synthesized
gatatacctaatgctaaatg

SEQ ID NO: 527136 - DNA, 20 bp, Artificial Sequence
  chemically synthesized
taatgctaaatgacgagtta

SEQ ID NO: 527137 - DNA, 20 bp, Artificial Sequence
  chemically synthesized
tgcacatgtaccctaaaact

SEQ ID NO: 527138 - DNA, 20 bp, Artificial Sequence
  chemically synthesized
tattattatactctaagttt

SEQ ID NO: 527139 - DNA, 20 bp, Artificial Sequence
  chemically synthesized
ttaactacaaacatatattc

SEQ ID NO: 527140 - DNA, 20 bp, Artificial Sequence
  chemically synthesized
gaaatgataagagaatactc

SEQ ID NO: 527141 - DNA, 20 bp, Artificial Sequence
  chemically synthesized
aacatagaatgaaatgataa

SEQ ID NO: 527142 - DNA, 20 bp, Artificial Sequence
  chemically synthesized
actgaaggttttttataaca

SEQ ID NO: 527143 - DNA, 20 bp, Artificial Sequence
  chemically synthesized
cgttttcctcccatggtgaa

SEQ ID NO: 527144 - DNA, 20 bp, Artificial Sequence
  chemically synthesized
atcttttgtcagtgtctctg

SEQ ID NO: 527145 - DNA, 20 bp, Artificial Sequence
  chemically synthesized
gagggataaatatttcctgg

SEQ ID NO: 527146 - DNA, 20 bp, Artificial Sequence
  chemically synthesized
taaacttgaaaaatataaaa

SEQ ID NO: 527147 - DNA, 20 bp, Artificial Sequence
  chemically synthesized
tttagtgaggaaaggagaca

SEQ ID NO: 527148 - DNA, 20 bp, Artificial Sequence
  chemically synthesized
ttttctaagaactaggcctt

SEQ ID NO: 527149 - DNA, 20 bp, Artificial Sequence
  chemically synthesized
actagcctgagccacacaca

SEQ ID NO: 527150 - DNA, 20 bp, Artificial Sequence
  chemically synthesized
gcatagggagaaaggttaag

SEQ ID NO: 527151 - DNA, 20 bp, Artificial Sequence
  chemically synthesized
ctggtcaatttagctcctgc

SEQ ID NO: 527152 - DNA, 20 bp, Artificial Sequence
  chemically synthesized
atgcacatgtaacataaagc

SEQ ID NO: 527153 - DNA, 20 bp, Artificial Sequence
  chemically synthesized
tgcattaaaaatttgtctaa

SEQ ID NO: 527154 - DNA, 20 bp, Artificial Sequence
  chemically synthesized
agctttggctaaaatgagga

SEQ ID NO: 527155 - DNA, 20 bp, Artificial Sequence
  chemically synthesized
aagtaggagatttccactga

SEQ ID NO: 527156 - DNA, 20 bp, Artificial Sequence
  chemically synthesized
atggtagaagtagggctgtg

SEQ ID NO: 527157 - DNA, 20 bp, Artificial Sequence
  chemically synthesized
cttgaaaactcctggcatgt

SEQ ID NO: 527158 - DNA, 20 bp, Artificial Sequence
  chemically synthesized
acctctcacccaaacatgcc

SEQ ID NO: 527159 - DNA, 20 bp, Artificial Sequence
  chemically synthesized
attgctgtgatgtagccaca

SEQ ID NO: 527160 - DNA, 20 bp, Artificial Sequence
  chemically synthesized
tataaatgtcatgttggaaa

SEQ ID NO: 527161 - DNA, 20 bp, Artificial Sequence
  chemically synthesized
gctttgtactaattgagact

SEQ ID NO: 527162 - DNA, 20 bp, Artificial Sequence
  chemically synthesized
cagtattacagagacagagt

SEQ ID NO: 527163 - DNA, 20 bp, Artificial Sequence
  chemically synthesized
tgtcctcagtattacagaga

SEQ ID NO: 527164 - DNA, 20 bp, Artificial Sequence
  chemically synthesized
tactgaggacagatgcagca

SEQ ID NO: 527165 - DNA, 20 bp, Artificial Sequence
  chemically synthesized
agagcacattgaaacttagg

SEQ ID NO: 527166 - DNA, 20 bp, Artificial Sequence
  chemically synthesized
gagcatgtattagtcagggt

SEQ ID NO: 527167 - DNA, 20 bp, Artificial Sequence
  chemically synthesized
ggcatagagcatgtattagt

SEQ ID NO: 527168 - DNA, 20 bp, Artificial Sequence
  chemically synthesized
agtttacttatctgcaaaat

SEQ ID NO: 527169 - DNA, 20 bp, Artificial Sequence
  chemically synthesized
ggatattaatatttagctca

SEQ ID NO: 527170 - DNA, 20 bp, Artificial Sequence
  chemically synthesized
tagctcattggattgttttg

SEQ ID NO: 527171 - DNA, 20 bp, Artificial Sequence
  chemically synthesized
tataattttacatactttaa

SEQ ID NO: 527172 - DNA, 20 bp, Artificial Sequence
  chemically synthesized
ttaatcaatgttgttattaa

SEQ ID NO: 527173 - DNA, 20 bp, Artificial Sequence
  chemically synthesized
tctctgctccaatacatact

SEQ ID NO: 527174 - DNA, 20 bp, Artificial Sequence
  chemically synthesized
caagtatgtattggagcaga

SEQ ID NO: 527175 - DNA, 20 bp, Artificial Sequence
  chemically synthesized
tttggccactgctggatttc

SEQ ID NO: 527176 - DNA, 20 bp, Artificial Sequence
  chemically synthesized
tcttttatttttggccactg

SEQ ID NO: 527177 - DNA, 20 bp, Artificial Sequence
  chemically synthesized
ccaaaaataaaagaggagag

SEQ ID NO: 527178 - DNA, 20 bp, Artificial Sequence
  chemically synthesized
ttctaatagctaaatctgtc

SEQ ID NO: 527179 - DNA, 20 bp, Artificial Sequence
  chemically synthesized
aatttgctctccttcatgca

SEQ ID NO: 527180 - DNA, 20 bp, Artificial Sequence
  chemically synthesized
atagggccagccagtagaaa

SEQ ID NO: 527181 - DNA, 20 bp, Artificial Sequence
  chemically synthesized
atctgggaaaaatataacat

SEQ ID NO: 527182 - DNA, 20 bp, Artificial Sequence
  chemically synthesized
aaaaataaataaataaataa

SEQ ID NO: 527183 - DNA, 20 bp, Artificial Sequence
  chemically synthesized
aagagtttgacatttcactc

SEQ ID NO: 527184 - DNA, 20 bp, Artificial Sequence
  chemically synthesized
actctttctaaggatgactc

SEQ ID NO: 527185 - DNA, 20 bp, Artificial Sequence
  chemically synthesized
actcacgagtcatccttaga

SEQ ID NO: 527186 - DNA, 20 bp, Artificial Sequence
  chemically synthesized
tctgatcttttactctttct

SEQ ID NO: 527187 - DNA, 20 bp, Artificial Sequence
  chemically synthesized
gccttggcctcccaaagttc

SEQ ID NO: 527188 - DNA, 20 bp, Artificial Sequence
  chemically synthesized
actttgggaggccaaggcgg

SEQ ID NO: 527189 - DNA, 20 bp, Artificial Sequence
  chemically synthesized
cgggcggatcacctgaggtc

SEQ ID NO: 527190 - DNA, 20 bp, Artificial Sequence
  chemically synthesized
cggggtttcactgtgttagc

SEQ ID NO: 527191 - DNA, 20 bp, Artificial Sequence
  chemically synthesized
ttttgtatttttagtagaga

SEQ ID NO: 527192 - DNA, 20 bp, Artificial Sequence
  chemically synthesized
ctaaaaatacaaaaaattag

SEQ ID NO: 527193 - DNA, 20 bp, Artificial Sequence
  chemically synthesized
tacttgggaggctgaggcag

SEQ ID NO: 527194 - DNA, 20 bp, Artificial Sequence
  chemically synthesized
ctcactgtaacttctgcctc

SEQ ID NO: 527195 - DNA, 20 bp, Artificial Sequence
  chemically synthesized
atgcgccactgcactccggc

SEQ ID NO: 527196 - DNA, 20 bp, Artificial Sequence
  chemically synthesized
tctcgctctgtcacccaggc

SEQ ID NO: 527197 - DNA, 20 bp, Artificial Sequence
  chemically synthesized
tatttatattttttctgaga

SEQ ID NO: 527198 - DNA, 20 bp, Artificial Sequence
  chemically synthesized
gtaagcagcgcctctattgt

SEQ ID NO: 527199 - DNA, 20 bp, Artificial Sequence
  chemically synthesized
tatttttcttcttattttta

SEQ ID NO: 527200 - DNA, 20 bp, Artificial Sequence
  chemically synthesized
aaataagaagaaaaatattt

SEQ ID NO: 527201 - DNA, 20 bp, Artificial Sequence
  chemically synthesized
tgagtaacttttgaaggagg

SEQ ID NO: 527202 - DNA, 20 bp, Artificial Sequence
  chemically synthesized
cagtttaaaaaggattttgg

SEQ ID NO: 527203 - DNA, 20 bp, Artificial Sequence
  chemically synthesized
gttacagtttaaaaaggatt

SEQ ID NO: 527204 - DNA, 20 bp, Artificial Sequence
  chemically synthesized
acagaatgttacagtttaaa

SEQ ID NO: 527205 - DNA, 20 bp, Artificial Sequence
  chemically synthesized
ttgaaaaactggtgtctgta

SEQ ID NO: 527206 - DNA, 20 bp, Artificial Sequence
  chemically synthesized
aaacataaatctaaatttca

SEQ ID NO: 527207 - DNA, 20 bp, Artificial Sequence
  chemically synthesized
attatcatacttggaaacac

SEQ ID NO: 527208 - DNA, 20 bp, Artificial Sequence
  chemically synthesized
cttggaaacacatggataaa

SEQ ID NO: 527209 - DNA, 20 bp, Artificial Sequence
  chemically synthesized
ctgcgcattggtagacatac

SEQ ID NO: 527210 - DNA, 20 bp, Artificial Sequence
  chemically synthesized
gatttatactgtcatttatt

SEQ ID NO: 527211 - DNA, 20 bp, Artificial Sequence
  chemically synthesized
atgacaagctacttatgaca

SEQ ID NO: 527212 - DNA, 20 bp, Artificial Sequence
  chemically synthesized
ctggcatagagacttccaaa

SEQ ID NO: 527213 - DNA, 20 bp, Artificial Sequence
  chemically synthesized
cagacattgttctaaaggct

SEQ ID NO: 527214 - DNA, 20 bp, Artificial Sequence
  chemically synthesized
actagggaactattgtgttt

SEQ ID NO: 527215 - DNA, 20 bp, Artificial Sequence
  chemically synthesized
agttgggcaaagactggggt

SEQ ID NO: 527216 - DNA, 20 bp, Artificial Sequence
  chemically synthesized
tgccaaagttgggcaaagac

SEQ ID NO: 527217 - DNA, 20 bp, Artificial Sequence
  chemically synthesized
cccaagaaagattgcattcc

SEQ ID NO: 527218 - DNA, 20 bp, Artificial Sequence
  chemically synthesized
ccaaataccactgtgattct

SEQ ID NO: 527219 - DNA, 20 bp, Artificial Sequence
  chemically synthesized
aaattatttgttttaaaagg

SEQ ID NO: 527220 - DNA, 20 bp, Artificial Sequence
  chemically synthesized
ttaaaacaaataatttttct

SEQ ID NO: 527221 - DNA, 20 bp, Artificial Sequence
  chemically synthesized
taactttaaataaagtaaaa

SEQ ID NO: 527222 - DNA, 20 bp, Artificial Sequence
  chemically synthesized
taaataaagtaaaaatggat

SEQ ID NO: 527223 - DNA, 20 bp, Artificial Sequence
  chemically synthesized
gactgtttgcctcaatatat

SEQ ID NO: 527224 - DNA, 20 bp, Artificial Sequence
  chemically synthesized
tatttgtggaaacctttaaa

SEQ ID NO: 527225 - DNA, 20 bp, Artificial Sequence
  chemically synthesized
aatattagccctttccttta

SEQ ID NO: 527226 - DNA, 20 bp, Artificial Sequence
  chemically synthesized
gaaaacactcaattggggag

SEQ ID NO: 527227 - DNA, 20 bp, Artificial Sequence
  chemically synthesized
ttaccaattcctctccccaa

SEQ ID NO: 527228 - DNA, 20 bp, Artificial Sequence
  chemically synthesized
tgttttccaaaggtccaatt

SEQ ID NO: 527229 - DNA, 20 bp, Artificial Sequence
  chemically synthesized
aggaaaaaaagaaaaagaaa

SEQ ID NO: 527230 - DNA, 20 bp, Artificial Sequence
  chemically synthesized
ttctttttttcctttctgta

SEQ ID NO: 527231 - DNA, 20 bp, Artificial Sequence
  chemically synthesized
aattagttaaaattactcca

SEQ ID NO: 527232 - DNA, 20 bp, Artificial Sequence
  chemically synthesized
aggaacaacagagcattcaa

SEQ ID NO: 527233 - DNA, 20 bp, Artificial Sequence
  chemically synthesized
gttcaacatatgttaatttt

SEQ ID NO: 527234 - DNA, 20 bp, Artificial Sequence
  chemically synthesized
atgtagcttagtctcacagc

SEQ ID NO: 527235 - DNA, 20 bp, Artificial Sequence
  chemically synthesized
acttgctaatagcacgttgt

SEQ ID NO: 527236 - DNA, 20 bp, Artificial Sequence
  chemically synthesized
cacaacgtgctattagcaag

SEQ ID NO: 527237 - DNA, 20 bp, Artificial Sequence
  chemically synthesized
acagaccagtattagcctaa

SEQ ID NO: 527238 - DNA, 20 bp, Artificial Sequence
  chemically synthesized
aaaggccaaatgaatgtcat

SEQ ID NO: 527239 - DNA, 20 bp, Artificial Sequence
  chemically synthesized
gcatcctctccaaaggccaa

SEQ ID NO: 527240 - DNA, 20 bp, Artificial Sequence
  chemically synthesized
acattcatttggcctttgga

SEQ ID NO: 527241 - DNA, 20 bp, Artificial Sequence
  chemically synthesized
tttataacatgaaaaatgcc

SEQ ID NO: 527242 - DNA, 20 bp, Artificial Sequence
  chemically synthesized
ggggcatttttcatgttata

SEQ ID NO: 527243 - DNA, 20 bp, Artificial Sequence
  chemically synthesized
tttcatgttataaaggataa

SEQ ID NO: 527244 - DNA, 20 bp, Artificial Sequence
  chemically synthesized
tgttcccatatgaacactgt

SEQ ID NO: 527245 - DNA, 20 bp, Artificial Sequence
  chemically synthesized
cctgttaattatttaacacc

SEQ ID NO: 527246 - DNA, 20 bp, Artificial Sequence
  chemically synthesized
tcacggtgttaaataattaa

SEQ ID NO: 527247 - DNA, 20 bp, Artificial Sequence
  chemically synthesized
acttcaattgataaagaatt

SEQ ID NO: 527248 - DNA, 20 bp, Artificial Sequence
  chemically synthesized
gttattaacttcaattgata

SEQ ID NO: 527249 - DNA, 20 bp, Artificial Sequence
  chemically synthesized
tatgtgttgctaatattaac

SEQ ID NO: 527250 - DNA, 20 bp, Artificial Sequence
  chemically synthesized
caatttgtcaaagctgactg

SEQ ID NO: 527251 - DNA, 20 bp, Artificial Sequence
  chemically synthesized
ccccagtcagctttgacaaa

SEQ ID NO: 527252 - DNA, 20 bp, Artificial Sequence
  chemically synthesized
ttaaaatgcatttcttctca

SEQ ID NO: 527253 - DNA, 20 bp, Artificial Sequence
  chemically synthesized
agatagtaaactttttattt

SEQ ID NO: 527254 - DNA, 20 bp, Artificial Sequence
  chemically synthesized
tgcataaaatctaccagtag

SEQ ID NO: 527255 - DNA, 20 bp, Artificial Sequence
  chemically synthesized
tatctcttcacaaaaggcca

SEQ ID NO: 527256 - DNA, 20 bp, Artificial Sequence
  chemically synthesized
gacctgaccaattagcctag

SEQ ID NO: 527257 - DNA, 20 bp, Artificial Sequence
  chemically synthesized
ttttgatggaagtatgagta

SEQ ID NO: 527258 - DNA, 20 bp, Artificial Sequence
  chemically synthesized
gcttcatttttgatggaagt

SEQ ID NO: 527259 - DNA, 20 bp, Artificial Sequence
  chemically synthesized
aaatgaagcatagaagtatt

SEQ ID NO: 527260 - DNA, 20 bp, Artificial Sequence
  chemically synthesized
ggataagaccatgatagcta

SEQ ID NO: 527261 - DNA, 20 bp, Artificial Sequence
  chemically synthesized
cttgcatttgattttcagac

SEQ ID NO: 527262 - DNA, 20 bp, Artificial Sequence
  chemically synthesized
atgcaagatgtactttagtg

SEQ ID NO: 527263 - DNA, 20 bp, Artificial Sequence
  chemically synthesized
aaaattaatatctgtgcttg

SEQ ID NO: 527264 - DNA, 20 bp, Artificial Sequence
  chemically synthesized
tttttctactgaaaaggtgt

SEQ ID NO: 527265 - DNA, 20 bp, Artificial Sequence
  chemically synthesized
ataagttatttgaatggaga

SEQ ID NO: 527266 - DNA, 20 bp, Artificial Sequence
  chemically synthesized
caagctattttataagttat

SEQ ID NO: 527267 - DNA, 20 bp, Artificial Sequence
  chemically synthesized
caaataacttataaaatagc

SEQ ID NO: 527268 - DNA, 20 bp, Artificial Sequence
  chemically synthesized
agaataaattatttctgtat

SEQ ID NO: 527269 - DNA, 20 bp, Artificial Sequence
  chemically synthesized
atttttaagtacggtttata

SEQ ID NO: 527270 - DNA, 20 bp, Artificial Sequence
  chemically synthesized
agactaaatattttatatca

SEQ ID NO: 527271 - DNA, 20 bp, Artificial Sequence
  chemically synthesized
gccattaccacaatagtcca

SEQ ID NO: 527272 - DNA, 20 bp, Artificial Sequence
  chemically synthesized
tccagtgggttgcagataat

SEQ ID NO: 527273 - DNA, 20 bp, Artificial Sequence
  chemically synthesized
tgggcagaatctcttgataa

SEQ ID NO: 527274 - DNA, 20 bp, Artificial Sequence
  chemically synthesized
atggttgctaattttctggg

SEQ ID NO: 527275 - DNA, 20 bp, Artificial Sequence
  chemically synthesized
gaagttcgcttctttaaaat

SEQ ID NO: 527276 - DNA, 20 bp, Artificial Sequence
  chemically synthesized
aaaatttggattacaatata

SEQ ID NO: 527277 - DNA, 20 bp, Artificial Sequence
  chemically synthesized
caggaaatgacttaattaaa

SEQ ID NO: 527278 - DNA, 20 bp, Artificial Sequence
  chemically synthesized
acttatgatgcaaggctaat

SEQ ID NO: 527279 - DNA, 20 bp, Artificial Sequence
  chemically synthesized
aagccctaattctgcaaaaa

SEQ ID NO: 527280 - DNA, 20 bp, Artificial Sequence
  chemically synthesized
gaaacaatactcaatttttg

SEQ ID NO: 527281 - DNA, 20 bp, Artificial Sequence
  chemically synthesized
ctttctgtggcttgcaaatt

SEQ ID NO: 527282 - DNA, 20 bp, Artificial Sequence
  chemically synthesized
tcagatcaaaaataaagatt

SEQ ID NO: 527283 - DNA, 20 bp, Artificial Sequence
  chemically synthesized
aggcttatgatgttaattta

SEQ ID NO: 527284 - DNA, 20 bp, Artificial Sequence
  chemically synthesized
cattacagctataaaaattt

SEQ ID NO: 527285 - DNA, 20 bp, Artificial Sequence
  chemically synthesized
aatgttgacaatatctggca

SEQ ID NO: 527286 - DNA, 20 bp, Artificial Sequence
  chemically synthesized
aagagattaatggcaagaag

SEQ ID NO: 527287 - DNA, 20 bp, Artificial Sequence
  chemically synthesized
accagagaaaatgaagctaa

SEQ ID NO: 527288 - DNA, 20 bp, Artificial Sequence
  chemically synthesized
gctaaagggattttgaaaac

SEQ ID NO: 527289 - DNA, 20 bp, Artificial Sequence
  chemically synthesized
aagggattttgaaaacaaga

SEQ ID NO: 527290 - DNA, 20 bp, Artificial Sequence
  chemically synthesized
tttgaaaacaagaatgaatc

SEQ ID NO: 527291 - DNA, 20 bp, Artificial Sequence
  chemically synthesized
tatgaagttctacattgaac

SEQ ID NO: 527292 - DNA, 20 bp, Artificial Sequence
  chemically synthesized
gtatatatgcatatatatgc

SEQ ID NO: 527293 - DNA, 20 bp, Artificial Sequence
  chemically synthesized
gtatatatgcatatatatgc

SEQ ID NO: 527294 - DNA, 20 bp, Artificial Sequence
  chemically synthesized
taccacagatatattcctag

SEQ ID NO: 527295 - DNA, 20 bp, Artificial Sequence
  chemically synthesized
accttaactaccaccctcct

SEQ ID NO: 527296 - DNA, 20 bp, Artificial Sequence
  chemically synthesized
tggtagttaaggtactaaag

SEQ ID NO: 527297 - DNA, 20 bp, Artificial Sequence
  chemically synthesized
agattatttccaaagtcttt

SEQ ID NO: 527298 - DNA, 20 bp, Artificial Sequence
  chemically synthesized
atattgtattgacattactt

SEQ ID NO: 527299 - DNA, 20 bp, Artificial Sequence
  chemically synthesized
ttacttacgaatactaaagt

SEQ ID NO: 527300 - DNA, 20 bp, Artificial Sequence
  chemically synthesized
atacacgatgatctagtaca

SEQ ID NO: 527301 - DNA, 20 bp, Artificial Sequence
  chemically synthesized
tggccacctgctcttatgcg

SEQ ID NO: 527302 - DNA, 20 bp, Artificial Sequence
  chemically synthesized
cttatgcgtagggttctgtt

SEQ ID NO: 527303 - DNA, 20 bp, Artificial Sequence
  chemically synthesized
gccaagtgccaaatggtgca

SEQ ID NO: 527304 - DNA, 20 bp, Artificial Sequence
  chemically synthesized
caaaacagatgggcaagaaa

SEQ ID NO: 527305 - DNA, 20 bp, Artificial Sequence
  chemically synthesized
caagtttttttttttagcaa

SEQ ID NO: 527306 - DNA, 20 bp, Artificial Sequence
  chemically synthesized
aatgtcatacaggttctatg

SEQ ID NO: 527307 - DNA, 20 bp, Artificial Sequence
  chemically synthesized
tgacatttatttaagaaaca

SEQ ID NO: 527308 - DNA, 20 bp, Artificial Sequence
  chemically synthesized
aaaattgtaccaccagtaca

SEQ ID NO: 527309 - DNA, 20 bp, Artificial Sequence
  chemically synthesized
tggtacaattttttatacac

SEQ ID NO: 527310 - DNA, 20 bp, Artificial Sequence
  chemically synthesized
tttatacacaggaataaaaa

SEQ ID NO: 527311 - DNA, 20 bp, Artificial Sequence
  chemically synthesized
aaaaaggaataaaaaagtaa

SEQ ID NO: 527312 - DNA, 20 bp, Artificial Sequence
  chemically synthesized
taaaaggataaataacatag

SEQ ID NO: 527313 - DNA, 20 bp, Artificial Sequence
  chemically synthesized
tagttgagtcctgagaaaac

SEQ ID NO: 527314 - DNA, 20 bp, Artificial Sequence
  chemically synthesized
aaaacacgggtttgaactgc

SEQ ID NO: 527315 - DNA, 20 bp, Artificial Sequence
  chemically synthesized
gcgaatactgtatttttgat

SEQ ID NO: 527316 - DNA, 20 bp, Artificial Sequence
  chemically synthesized
gatcaaaaatacagtattcg

SEQ ID NO: 527317 - DNA, 20 bp, Artificial Sequence
  chemically synthesized
atacgtaggtttcacattct

SEQ ID NO: 527318 - DNA, 20 bp, Artificial Sequence
  chemically synthesized
agggccaattttgcctgtgt

SEQ ID NO: 527319 - DNA, 20 bp, Artificial Sequence
  chemically synthesized
ttgcctgtgtgcgggttctg

SEQ ID NO: 527320 - DNA, 20 bp, Artificial Sequence
  chemically synthesized
tgcagagttggctgtgaaat

SEQ ID NO: 527321 - DNA, 20 bp, Artificial Sequence
  chemically synthesized
gttcagattttggtatacat

SEQ ID NO: 527322 - DNA, 20 bp, Artificial Sequence
  chemically synthesized
ctgtatttgggttctaagac

SEQ ID NO: 527323 - DNA, 20 bp, Artificial Sequence
  chemically synthesized
ggtgtattatttagctgtat

SEQ ID NO: 527324 - DNA, 20 bp, Artificial Sequence
  chemically synthesized
aaataatacacctgcataac

SEQ ID NO: 527325 - DNA, 20 bp, Artificial Sequence
  chemically synthesized
tgcataacttgaatgtcgtt

SEQ ID NO: 527326 - DNA, 20 bp, Artificial Sequence
  chemically synthesized
tccaacccacttgcatagtg

SEQ ID NO: 527327 - DNA, 20 bp, Artificial Sequence
  chemically synthesized
gtagaccctacactatgcaa

SEQ ID NO: 527328 - DNA, 20 bp, Artificial Sequence
  chemically synthesized
ccctacactatgcaagtggg

SEQ ID NO: 527329 - DNA, 20 bp, Artificial Sequence
  chemically synthesized
ctatgcaagtgggttggatg

SEQ ID NO: 527330 - DNA, 20 bp, Artificial Sequence
  chemically synthesized
agtgactttatagaaacaca

SEQ ID NO: 527331 - DNA, 20 bp, Artificial Sequence
  chemically synthesized
ctataaagtcactgtgaaca

SEQ ID NO: 527332 - DNA, 20 bp, Artificial Sequence
  chemically synthesized
tcactgtgaacactgaatta

SEQ ID NO: 527333 - DNA, 20 bp, Artificial Sequence
  chemically synthesized
atcattgtatttctcctggg

SEQ ID NO: 527334 - DNA, 20 bp, Artificial Sequence
  chemically synthesized
aaacagaaaaacaggcaaaa

SEQ ID NO: 527335 - DNA, 20 bp, Artificial Sequence
  chemically synthesized
ttctgtttaaaaacatctta

SEQ ID NO: 527336 - DNA, 20 bp, Artificial Sequence
  chemically synthesized
tggctgtgtattgaatgtta

SEQ ID NO: 527337 - DNA, 20 bp, Artificial Sequence
  chemically synthesized
acagtgctgttggctgtgta

SEQ ID NO: 527338 - DNA, 20 bp, Artificial Sequence
  chemically synthesized
taggtaagtttccttcaggc

SEQ ID NO: 527339 - DNA, 20 bp, Artificial Sequence
  chemically synthesized
aaatggccccaagcatgatg

SEQ ID NO: 527340 - DNA, 20 bp, Artificial Sequence
  chemically synthesized
taccgtatgagacctgaagc

SEQ ID NO: 527341 - DNA, 20 bp, Artificial Sequence
  chemically synthesized
tgagacctgaagcaagaatg

SEQ ID NO: 527342 - DNA, 20 bp, Artificial Sequence
  chemically synthesized
ctcagctgggaacatgtgtg

SEQ ID NO: 527343 - DNA, 20 bp, Artificial Sequence
  chemically synthesized
cagccatttgtgtgtatgca

SEQ ID NO: 527344 - DNA, 20 bp, Artificial Sequence
  chemically synthesized
atgctatgagcattgatttt

SEQ ID NO: 527345 - DNA, 20 bp, Artificial Sequence
  chemically synthesized
gttttgagaactcccaaaca

SEQ ID NO: 527346 - DNA, 20 bp, Artificial Sequence
  chemically synthesized
tattcacacattctgtgttt

SEQ ID NO: 527347 - DNA, 20 bp, Artificial Sequence
  chemically synthesized
aactcccaaacacagaatgt

SEQ ID NO: 527348 - DNA, 20 bp, Artificial Sequence
  chemically synthesized
accataaccaaatgggatga

SEQ ID NO: 527349 - DNA, 20 bp, Artificial Sequence
  chemically synthesized
gtacaaacaccataaccaaa

SEQ ID NO: 527350 - DNA, 20 bp, Artificial Sequence
  chemically synthesized
gactttctctaattgccctt

SEQ ID NO: 527351 - DNA, 20 bp, Artificial Sequence
  chemically synthesized
accatagtgcctgacaaaac

SEQ ID NO: 527352 - DNA, 20 bp, Artificial Sequence
  chemically synthesized
acagttcttcagttggtaac

SEQ ID NO: 527353 - DNA, 20 bp, Artificial Sequence
  chemically synthesized
ctaagtagcactgtatagga

SEQ ID NO: 527354 - DNA, 20 bp, Artificial Sequence
  chemically synthesized
gtgtcttcttgttaagcgaa

SEQ ID NO: 527355 - DNA, 20 bp, Artificial Sequence
  chemically synthesized
taaaaaaaaaaaaaatgcaa

SEQ ID NO: 527356 - DNA, 20 bp, Artificial Sequence
  chemically synthesized
aaaggaatgtcataaatgca

SEQ ID NO: 527357 - DNA, 20 bp, Artificial Sequence
  chemically synthesized
taaatgcagtgaatacaaag

SEQ ID NO: 527358 - DNA, 20 bp, Artificial Sequence
  chemically synthesized
ggtaaacatcatcaaggcag

SEQ ID NO: 527359 - DNA, 20 bp, Artificial Sequence
  chemically synthesized
ctgccttgatgatgtttacc

SEQ ID NO: 527360 - DNA, 20 bp, Artificial Sequence
  chemically synthesized
agaatacactgggtttgact

SEQ ID NO: 527361 - DNA, 20 bp, Artificial Sequence
  chemically synthesized
aaatatgtgagtagaataca

SEQ ID NO: 527362 - DNA, 20 bp, Artificial Sequence
  chemically synthesized
acagctcacaaatatgtgag

SEQ ID NO: 527363 - DNA, 20 bp, Artificial Sequence
  chemically synthesized
taatgacagctcacaaatat

SEQ ID NO: 527364 - DNA, 20 bp, Artificial Sequence
  chemically synthesized
gtcattaaaggaagctagaa

SEQ ID NO: 527365 - DNA, 20 bp, Artificial Sequence
  chemically synthesized
tgtgtgtgtgtgtgtaatgt

SEQ ID NO: 527366 - DNA, 20 bp, Artificial Sequence
  chemically synthesized
gagaatgtgcatttatgcaa

SEQ ID NO: 527367 - DNA, 20 bp, Artificial Sequence
  chemically synthesized
gtgtagatatatacataaat

SEQ ID NO: 527368 - DNA, 20 bp, Artificial Sequence
  chemically synthesized
tatgagcaataggaaactag

SEQ ID NO: 527369 - DNA, 20 bp, Artificial Sequence
  chemically synthesized
tatcttttatttttttgaga

SEQ ID NO: 527370 - DNA, 20 bp, Artificial Sequence
  chemically synthesized
ccacactccagcctgggcga

SEQ ID NO: 527371 - DNA, 20 bp, Artificial Sequence
  chemically synthesized
agtcactctgtcgcccaggc

SEQ ID NO: 527372 - DNA, 20 bp, Artificial Sequence
  chemically synthesized
gacttgggaagctgaggcat

SEQ ID NO: 527373 - DNA, 20 bp, Artificial Sequence
  chemically synthesized
taaaaatacaaaaatttgct

SEQ ID NO: 527374 - DNA, 20 bp, Artificial Sequence
  chemically synthesized
tggacggatcacatgaggtc

SEQ ID NO: 527375 - DNA, 20 bp, Artificial Sequence
  chemically synthesized
actttgcgaggccaaggtgg

SEQ ID NO: 527376 - DNA, 20 bp, Artificial Sequence
  chemically synthesized
accttggcctcgcaaagtgt

SEQ ID NO: 527377 - DNA, 20 bp, Artificial Sequence
  chemically synthesized
aaaaaaacaggctgggcaca

SEQ ID NO: 527378 - DNA, 20 bp, Artificial Sequence
  chemically synthesized
ttttttttttttatctttct

SEQ ID NO: 527379 - DNA, 20 bp, Artificial Sequence
  chemically synthesized
ggattctcccctagagtctc

SEQ ID NO: 527380 - DNA, 20 bp, Artificial Sequence
  chemically synthesized
tcattctggagactctaggg

SEQ ID NO: 527381 - DNA, 20 bp, Artificial Sequence
  chemically synthesized
ctaggaaatggattctcccc

SEQ ID NO: 527382 - DNA, 20 bp, Artificial Sequence
  chemically synthesized
cagcctctagaagctaggaa

SEQ ID NO: 527383 - DNA, 20 bp, Artificial Sequence
  chemically synthesized
aggaaaggggccatgaatca

SEQ ID NO: 527384 - DNA, 20 bp, Artificial Sequence
  chemically synthesized
gaaaatggaggaaaggggcc

SEQ ID NO: 527385 - DNA, 20 bp, Artificial Sequence
  chemically synthesized
tggaatgaaaagcagtgtgt

SEQ ID NO: 527386 - DNA, 20 bp, Artificial Sequence
  chemically synthesized
caaggagtcaaaggagatgt

SEQ ID NO: 527387 - DNA, 20 bp, Artificial Sequence
  chemically synthesized
acatctcctttgactccttg

SEQ ID NO: 527388 - DNA, 20 bp, Artificial Sequence
  chemically synthesized
aggaagaaaaaaatccttca

SEQ ID NO: 527389 - DNA, 20 bp, Artificial Sequence
  chemically synthesized
tttcttccttttttttgata

SEQ ID NO: 527390 - DNA, 20 bp, Artificial Sequence
  chemically synthesized
tgcactccagcctgggcaac

SEQ ID NO: 527391 - DNA, 20 bp, Artificial Sequence
  chemically synthesized
ttcactcttgttgcccaggc

SEQ ID NO: 527392 - DNA, 20 bp, Artificial Sequence
  chemically synthesized
ctcactacaacttccgcctc

SEQ ID NO: 527393 - DNA, 20 bp, Artificial Sequence
  chemically synthesized
tacttgggaggctgaggcag

SEQ ID NO: 527394 - DNA, 20 bp, Artificial Sequence
  chemically synthesized
gcctcagcctcccaagtagc

SEQ ID NO: 527395 - DNA, 20 bp, Artificial Sequence
  chemically synthesized
tttgtattttgtagtagaga

SEQ ID NO: 527396 - DNA, 20 bp, Artificial Sequence
  chemically synthesized
cgggtggatcacctgaggtc

SEQ ID NO: 527397 - DNA, 20 bp, Artificial Sequence
  chemically synthesized
actttgggaggctgaggcgg

SEQ ID NO: 527398 - DNA, 20 bp, Artificial Sequence
  chemically synthesized
cagcactttgggaggctgag

SEQ ID NO: 527399 - DNA, 20 bp, Artificial Sequence
  chemically synthesized
gcctcagcctcccaaagtgc

SEQ ID NO: 527400 - DNA, 20 bp, Artificial Sequence
  chemically synthesized
caccgcacctagccaccttg

SEQ ID NO: 527401 - DNA, 20 bp, Artificial Sequence
  chemically synthesized
ttggttccatccacataatc

SEQ ID NO: 527402 - DNA, 20 bp, Artificial Sequence
  chemically synthesized
gtaagattatcctggattat

SEQ ID NO: 527403 - DNA, 20 bp, Artificial Sequence
  chemically synthesized
tttgagatggtaagattatc

SEQ ID NO: 527404 - DNA, 20 bp, Artificial Sequence
  chemically synthesized
aaaatattaacttaacggga

SEQ ID NO: 527405 - DNA, 20 bp, Artificial Sequence
  chemically synthesized
agatatttctttggaatgta

SEQ ID NO: 527406 - DNA, 20 bp, Artificial Sequence
  chemically synthesized
tcaagagccagatatttctt

SEQ ID NO: 527407 - DNA, 20 bp, Artificial Sequence
  chemically synthesized
ttagtcatctccagcctctc

SEQ ID NO: 527408 - DNA, 20 bp, Artificial Sequence
  chemically synthesized
agatgactaaagtcagccat

SEQ ID NO: 527409 - DNA, 20 bp, Artificial Sequence
  chemically synthesized
cttggtgtctagaattgtat

SEQ ID NO: 527410 - DNA, 20 bp, Artificial Sequence
  chemically synthesized
gttgcctaagtcttggtgtc

SEQ ID NO: 527411 - DNA, 20 bp, Artificial Sequence
  chemically synthesized
gtgttgtcacacatcactgt

SEQ ID NO: 527412 - DNA, 20 bp, Artificial Sequence
  chemically synthesized
aagaaaaaagttgcatacaa

SEQ ID NO: 527413 - DNA, 20 bp, Artificial Sequence
  chemically synthesized
tgttgtaataaactgtaatc

SEQ ID NO: 527414 - DNA, 20 bp, Artificial Sequence
  chemically synthesized
tcatgagtgtaactgctttt

SEQ ID NO: 527415 - DNA, 20 bp, Artificial Sequence
  chemically synthesized
taactgcttttaagaattat

SEQ ID NO: 527416 - DNA, 20 bp, Artificial Sequence
  chemically synthesized
gaattatatgagtcctccta

SEQ ID NO: 527417 - DNA, 20 bp, Artificial Sequence
  chemically synthesized
cctaaggaataattgaacct

SEQ ID NO: 527418 - DNA, 20 bp, Artificial Sequence
  chemically synthesized
tgccttatatggcgaaattt

SEQ ID NO: 527419 - DNA, 20 bp, Artificial Sequence
  chemically synthesized
tgttctaatcttaggaagct

SEQ ID NO: 527420 - DNA, 20 bp, Artificial Sequence
  chemically synthesized
ttagaacatgtatgtctttg

SEQ ID NO: 527421 - DNA, 20 bp, Artificial Sequence
  chemically synthesized
aattgaagaagtttctacac

SEQ ID NO: 527422 - DNA, 20 bp, Artificial Sequence
  chemically synthesized
tggaaacatatgttccttta

SEQ ID NO: 527423 - DNA, 20 bp, Artificial Sequence
  chemically synthesized
ataaaaatctcttaagaaaa

SEQ ID NO: 527424 - DNA, 20 bp, Artificial Sequence
  chemically synthesized
tttttattctacatatagga

SEQ ID NO: 527425 - DNA, 20 bp, Artificial Sequence
  chemically synthesized
aaactaccctttcctatatg

SEQ ID NO: 527426 - DNA, 20 bp, Artificial Sequence
  chemically synthesized
tgctaggaaatagttgatta

SEQ ID NO: 527427 - DNA, 20 bp, Artificial Sequence
  chemically synthesized
cttgtactcttagatgaaag

SEQ ID NO: 527428 - DNA, 20 bp, Artificial Sequence
  chemically synthesized
aacatactcaactttcatct

SEQ ID NO: 527429 - DNA, 20 bp, Artificial Sequence
  chemically synthesized
agagtacaagaagtaatcaa

SEQ ID NO: 527430 - DNA, 20 bp, Artificial Sequence
  chemically synthesized
ttacagtctctggtagctaa

SEQ ID NO: 527431 - DNA, 20 bp, Artificial Sequence
  chemically synthesized
agatattgatattgaattgt

SEQ ID NO: 527432 - DNA, 20 bp, Artificial Sequence
  chemically synthesized
tccctttaaagatattgata

SEQ ID NO: 527433 - DNA, 20 bp, Artificial Sequence
  chemically synthesized
ttcaatatcaatatctttaa

SEQ ID NO: 527434 - DNA, 20 bp, Artificial Sequence
  chemically synthesized
atataattgagaattagtgc

SEQ ID NO: 527435 - DNA, 20 bp, Artificial Sequence
  chemically synthesized
tgcactaattctcaattata

SEQ ID NO: 527436 - DNA, 20 bp, Artificial Sequence
  chemically synthesized
cctttaaacccaatataatt

SEQ ID NO: 527437 - DNA, 20 bp, Artificial Sequence
  chemically synthesized
attgggtttaaaggaaaggc

SEQ ID NO: 527438 - DNA, 20 bp, Artificial Sequence
  chemically synthesized
tacctggattatttccatct

SEQ ID NO: 527439 - DNA, 20 bp, Artificial Sequence
  chemically synthesized
atgtgtgtgtgtatgtatac

SEQ ID NO: 527440 - DNA, 20 bp, Artificial Sequence
  chemically synthesized
acattaactcaaaatagatc

SEQ ID NO: 527441 - DNA, 20 bp, Artificial Sequence
  chemically synthesized
attagtatccatgatctatt

SEQ ID NO: 527442 - DNA, 20 bp, Artificial Sequence
  chemically synthesized
gatctattttgagttaatgt

SEQ ID NO: 527443 - DNA, 20 bp, Artificial Sequence
  chemically synthesized
aacaaatgatgctagggtat

SEQ ID NO: 527444 - DNA, 20 bp, Artificial Sequence
  chemically synthesized
tcattttcaacaaatgatgc

SEQ ID NO: 527445 - DNA, 20 bp, Artificial Sequence
  chemically synthesized
gaaaatgatagtttccttca

SEQ ID NO: 527446 - DNA, 20 bp, Artificial Sequence
  chemically synthesized
attgcttttacacctttgca

SEQ ID NO: 527447 - DNA, 20 bp, Artificial Sequence
  chemically synthesized
ataataatttccttctattt

SEQ ID NO: 527448 - DNA, 20 bp, Artificial Sequence
  chemically synthesized
tatatactaaggtcttcatg

SEQ ID NO: 527449 - DNA, 20 bp, Artificial Sequence
  chemically synthesized
ctgaaaacgattaatgtggg

SEQ ID NO: 527450 - DNA, 20 bp, Artificial Sequence
  chemically synthesized
aatctatagatcgatttggg

SEQ ID NO: 527451 - DNA, 20 bp, Artificial Sequence
  chemically synthesized
gaattgacatctttactatg

SEQ ID NO: 527452 - DNA, 20 bp, Artificial Sequence
  chemically synthesized
tatgctgagtcttccaatcc

SEQ ID NO: 527453 - DNA, 20 bp, Artificial Sequence
  chemically synthesized
ttcagggatatattgcattc

SEQ ID NO: 527454 - DNA, 20 bp, Artificial Sequence
  chemically synthesized
atcaagacctaaataatttc

SEQ ID NO: 527455 - DNA, 20 bp, Artificial Sequence
  chemically synthesized
tatcagcattttgtaatttt

SEQ ID NO: 527456 - DNA, 20 bp, Artificial Sequence
  chemically synthesized
atcttactatttcatttttg

SEQ ID NO: 527457 - DNA, 20 bp, Artificial Sequence
  chemically synthesized
aaaatttctttttaaaaatt

SEQ ID NO: 527458 - DNA, 20 bp, Artificial Sequence
  chemically synthesized
aatttttaaaaagaaatttt

SEQ ID NO: 527459 - DNA, 20 bp, Artificial Sequence
  chemically synthesized
ttcttatctgacaagtgatg

SEQ ID NO: 527460 - DNA, 20 bp, Artificial Sequence
  chemically synthesized
agattatattgctcatttgc

SEQ ID NO: 527461 - DNA, 20 bp, Artificial Sequence
  chemically synthesized
ggtcagccttctttgaaagc

SEQ ID NO: 527462 - DNA, 20 bp, Artificial Sequence
  chemically synthesized
atatttctgcaatatcaact

SEQ ID NO: 527463 - DNA, 20 bp, Artificial Sequence
  chemically synthesized
ctaaaatgtaagcatagaaa

SEQ ID NO: 527464 - DNA, 20 bp, Artificial Sequence
  chemically synthesized
gttttaagtcaacaacatac

SEQ ID NO: 527465 - DNA, 20 bp, Artificial Sequence
  chemically synthesized
tatatgggaatctaaataaa

SEQ ID NO: 527466 - DNA, 20 bp, Artificial Sequence
  chemically synthesized
tgtaagtttttatagtatat

SEQ ID NO: 527467 - DNA, 20 bp, Artificial Sequence
  chemically synthesized
ttatcaaacaatactataaa

SEQ ID NO: 527468 - DNA, 20 bp, Artificial Sequence
  chemically synthesized
agcataattctcaaaaagag

SEQ ID NO: 527469 - DNA, 20 bp, Artificial Sequence
  chemically synthesized
ggttttacccccctcttttt

SEQ ID NO: 527470 - DNA, 20 bp, Artificial Sequence
  chemically synthesized
gcccactgtctcaatagaaa

SEQ ID NO: 527471 - DNA, 20 bp, Artificial Sequence
  chemically synthesized
tagtttcagccaaatttatt

SEQ ID NO: 527472 - DNA, 20 bp, Artificial Sequence
  chemically synthesized
aggtaactgaggtgttcaat

SEQ ID NO: 527473 - DNA, 20 bp, Artificial Sequence
  chemically synthesized
taataatggactagactgta

SEQ ID NO: 527474 - DNA, 20 bp, Artificial Sequence
  chemically synthesized
ttaacagtattaagatcata

SEQ ID NO: 527475 - DNA, 20 bp, Artificial Sequence
  chemically synthesized
cccaagaaacataaaacata

SEQ ID NO: 527476 - DNA, 20 bp, Artificial Sequence
  chemically synthesized
ggcttactgtgctgattaag

SEQ ID NO: 527477 - DNA, 20 bp, Artificial Sequence
  chemically synthesized
ctattactgtattgattaag

SEQ ID NO: 527478 - DNA, 20 bp, Artificial Sequence
  chemically synthesized
acagtaatagagctattagt

SEQ ID NO: 527479 - DNA, 20 bp, Artificial Sequence
  chemically synthesized
accaaaaaatgataagtttt

SEQ ID NO: 527480 - DNA, 20 bp, Artificial Sequence
  chemically synthesized
agatacatagattgaatcat

SEQ ID NO: 527481 - DNA, 20 bp, Artificial Sequence
  chemically synthesized
acctaagatagatacataga

SEQ ID NO: 527482 - DNA, 20 bp, Artificial Sequence
  chemically synthesized
gtatctatcttaggtatata

SEQ ID NO: 527483 - DNA, 20 bp, Artificial Sequence
  chemically synthesized
aggtatatatggagtggcgt

SEQ ID NO: 527484 - DNA, 20 bp, Artificial Sequence
  chemically synthesized
acagatatatatatgatttg

SEQ ID NO: 527485 - DNA, 20 bp, Artificial Sequence
  chemically synthesized
tatatatgatttgatgagtt

SEQ ID NO: 527486 - DNA, 20 bp, Artificial Sequence
  chemically synthesized
atttgatgagttaagaataa

SEQ ID NO: 527487 - DNA, 20 bp, Artificial Sequence
  chemically synthesized
cgaaaaaaaaaaaaaataca

SEQ ID NO: 527488 - DNA, 20 bp, Artificial Sequence
  chemically synthesized
attttttttttttttcgaga

SEQ ID NO: 527489 - DNA, 20 bp, Artificial Sequence
  chemically synthesized
cagagtcttgctctgtcacc

SEQ ID NO: 527490 - DNA, 20 bp, Artificial Sequence
  chemically synthesized
tggtgtcactgcacttcacc

SEQ ID NO: 527491 - DNA, 20 bp, Artificial Sequence
  chemically synthesized
atcactcgaacctgggaggt

SEQ ID NO: 527492 - DNA, 20 bp, Artificial Sequence
  chemically synthesized
gcaacccccacctcccaggt

SEQ ID NO: 527493 - DNA, 20 bp, Artificial Sequence
  chemically synthesized
ctttagggtggctgaggctg

SEQ ID NO: 527494 - DNA, 20 bp, Artificial Sequence
  chemically synthesized
ctgggcatggtggcacactt

SEQ ID NO: 527495 - DNA, 20 bp, Artificial Sequence
  chemically synthesized
tttgtatttcttagtagaga

SEQ ID NO: 527496 - DNA, 20 bp, Artificial Sequence
  chemically synthesized
caggtggatcatttgaggtc

SEQ ID NO: 527497 - DNA, 20 bp, Artificial Sequence
  chemically synthesized
actttgggaggctgaggcag

SEQ ID NO: 527498 - DNA, 20 bp, Artificial Sequence
  chemically synthesized
gcctcagcctcccaaagtgc

SEQ ID NO: 527499 - DNA, 20 bp, Artificial Sequence
  chemically synthesized
aaagtgctggggttacaggc

SEQ ID NO: 527500 - DNA, 20 bp, Artificial Sequence
  chemically synthesized
ggcctacttcctcagtctta

SEQ ID NO: 527501 - DNA, 20 bp, Artificial Sequence
  chemically synthesized
cttactgagtattttcccct

SEQ ID NO: 527502 - DNA, 20 bp, Artificial Sequence
  chemically synthesized
agaagagaatcactggattt

SEQ ID NO: 527503 - DNA, 20 bp, Artificial Sequence
  chemically synthesized
gcatgttaagaagagaatca

SEQ ID NO: 527504 - DNA, 20 bp, Artificial Sequence
  chemically synthesized
taacatgagcatgttaagaa

SEQ ID NO: 527505 - DNA, 20 bp, Artificial Sequence
  chemically synthesized
aatgtattagtactgttgtg

SEQ ID NO: 527506 - DNA, 20 bp, Artificial Sequence
  chemically synthesized
agcaacattgcaagcaaaat

SEQ ID NO: 527507 - DNA, 20 bp, Artificial Sequence
  chemically synthesized
gcttgcaatgttgctatagt

SEQ ID NO: 527508 - DNA, 20 bp, Artificial Sequence
  chemically synthesized
ccccctaataccaacctctt

SEQ ID NO: 527509 - DNA, 20 bp, Artificial Sequence
  chemically synthesized
tccccaagaggttggtatta

SEQ ID NO: 527510 - DNA, 20 bp, Artificial Sequence
  chemically synthesized
ctttaggttgtgattaggtt

SEQ ID NO: 527511 - DNA, 20 bp, Artificial Sequence
  chemically synthesized
gagtacagagccttcttgtt

SEQ ID NO: 527512 - DNA, 20 bp, Artificial Sequence
  chemically synthesized
ctctctagggtctcttttat

SEQ ID NO: 527513 - DNA, 20 bp, Artificial Sequence
  chemically synthesized
gaagaggcgagctggctctc

SEQ ID NO: 527514 - DNA, 20 bp, Artificial Sequence
  chemically synthesized
aaacggtctgtcatcaggca

SEQ ID NO: 527515 - DNA, 20 bp, Artificial Sequence
  chemically synthesized
agcctccagaactttgagca

SEQ ID NO: 527516 - DNA, 20 bp, Artificial Sequence
  chemically synthesized
taaactaaaaaaataataaa

SEQ ID NO: 527517 - DNA, 20 bp, Artificial Sequence
  chemically synthesized
aaaaaaaaataaataataaa

SEQ ID NO: 527518 - DNA, 20 bp, Artificial Sequence
  chemically synthesized
ttttttttatagaagcccaa

SEQ ID NO: 527519 - DNA, 20 bp, Artificial Sequence
  chemically synthesized
tatagaagcccaaatggatg

SEQ ID NO: 527520 - DNA, 20 bp, Artificial Sequence
  chemically synthesized
atgatagttatttcatagtg

SEQ ID NO: 527521 - DNA, 20 bp, Artificial Sequence
  chemically synthesized
cacccctcccttctctgatt

SEQ ID NO: 527522 - DNA, 20 bp, Artificial Sequence
  chemically synthesized
catccataatcagagaaggg

SEQ ID NO: 527523 - DNA, 20 bp, Artificial Sequence
  chemically synthesized
ataatcagagaagggagggg

SEQ ID NO: 527524 - DNA, 20 bp, Artificial Sequence
  chemically synthesized
gggaggggtgggataatgaa

SEQ ID NO: 527525 - DNA, 20 bp, Artificial Sequence
  chemically synthesized
gtataatgtatttagaaatc

SEQ ID NO: 527526 - DNA, 20 bp, Artificial Sequence
  chemically synthesized
ctgggatgaaatcccataaa

SEQ ID NO: 527527 - DNA, 20 bp, Artificial Sequence
  chemically synthesized
actcaactcaattcagttta

SEQ ID NO: 527528 - DNA, 20 bp, Artificial Sequence
  chemically synthesized
atgaaatcccataaactgaa

SEQ ID NO: 527529 - DNA, 20 bp, Artificial Sequence
  chemically synthesized
atcccataaactgaattgag

SEQ ID NO: 527530 - DNA, 20 bp, Artificial Sequence
  chemically synthesized
gagtgccctcctcccccatg

SEQ ID NO: 527531 - DNA, 20 bp, Artificial Sequence
  chemically synthesized
ataggagttcagagcatggt

SEQ ID NO: 527532 - DNA, 20 bp, Artificial Sequence
  chemically synthesized
agatgacaagtgaatctcat

SEQ ID NO: 527533 - DNA, 20 bp, Artificial Sequence
  chemically synthesized
ctttaaaagaaagatgacaa

SEQ ID NO: 527534 - DNA, 20 bp, Artificial Sequence
  chemically synthesized
tattacagttacccattatg

SEQ ID NO: 527535 - DNA, 20 bp, Artificial Sequence
  chemically synthesized
gcttatgataattcctcata

SEQ ID NO: 527536 - DNA, 20 bp, Artificial Sequence
  chemically synthesized
atagacagatgtaaatctag

SEQ ID NO: 527537 - DNA, 20 bp, Artificial Sequence
  chemically synthesized
aactttcaaagtcttcttac

SEQ ID NO: 527538 - DNA, 20 bp, Artificial Sequence
  chemically synthesized
ttgtaatactccattaaggt

SEQ ID NO: 527539 - DNA, 20 bp, Artificial Sequence
  chemically synthesized
atgctatatccttaccttaa

SEQ ID NO: 527540 - DNA, 20 bp, Artificial Sequence
  chemically synthesized
aatctaaattattgctcatg

SEQ ID NO: 527541 - DNA, 20 bp, Artificial Sequence
  chemically synthesized
cacagtttactttatgcaaa

SEQ ID NO: 527542 - DNA, 20 bp, Artificial Sequence
  chemically synthesized
gtttactttatgcaaatgga

SEQ ID NO: 527543 - DNA, 20 bp, Artificial Sequence
  chemically synthesized
ggagtgagttgtaatttttg

SEQ ID NO: 527544 - DNA, 20 bp, Artificial Sequence
  chemically synthesized
tgagttgtaatttttggtga

SEQ ID NO: 527545 - DNA, 20 bp, Artificial Sequence
  chemically synthesized
aggtcagttagatgactgta

SEQ ID NO: 527546 - DNA, 20 bp, Artificial Sequence
  chemically synthesized
tgatgctgccatatatgtaa

SEQ ID NO: 527547 - DNA, 20 bp, Artificial Sequence
  chemically synthesized
ttatctctatacaatattgt

SEQ ID NO: 527548 - DNA, 20 bp, Artificial Sequence
  chemically synthesized
ttttcattgagattttataa

SEQ ID NO: 527549 - DNA, 20 bp, Artificial Sequence
  chemically synthesized
aatctcaatgaaaattttct

SEQ ID NO: 527550 - DNA, 20 bp, Artificial Sequence
  chemically synthesized
tgaattaagcgttaacaaag

SEQ ID NO: 527551 - DNA, 20 bp, Artificial Sequence
  chemically synthesized
agccacagggacagaagtaa

SEQ ID NO: 527552 - DNA, 20 bp, Artificial Sequence
  chemically synthesized
ggacagaagtaagcgggtta

SEQ ID NO: 527553 - DNA, 20 bp, Artificial Sequence
  chemically synthesized
agcgggttagagggtaaaag

SEQ ID NO: 527554 - DNA, 20 bp, Artificial Sequence
  chemically synthesized
ggttagagggtaaaagttga

SEQ ID NO: 527555 - DNA, 20 bp, Artificial Sequence
  chemically synthesized
ttccagatcaccaaaataaa

SEQ ID NO: 527556 - DNA, 20 bp, Artificial Sequence
  chemically synthesized
accaaaataaagtgagtcac

SEQ ID NO: 527557 - DNA, 20 bp, Artificial Sequence
  chemically synthesized
cttttatatacactgggaaa

SEQ ID NO: 527558 - DNA, 20 bp, Artificial Sequence
  chemically synthesized
agcaatcatctgagccttta

SEQ ID NO: 527559 - DNA, 20 bp, Artificial Sequence
  chemically synthesized
gtggaggctcttgcctcaat

SEQ ID NO: 527560 - DNA, 20 bp, Artificial Sequence
  chemically synthesized
gtggatggctgctgattgat

SEQ ID NO: 527561 - DNA, 20 bp, Artificial Sequence
  chemically synthesized
tggctgctgattgatcaggg

SEQ ID NO: 527562 - DNA, 20 bp, Artificial Sequence
  chemically synthesized
agggtggggttgctgaaggt

SEQ ID NO: 527563 - DNA, 20 bp, Artificial Sequence
  chemically synthesized
ctttgtaaaataagacaaca

SEQ ID NO: 527564 - DNA, 20 bp, Artificial Sequence
  chemically synthesized
aagaaatgttttgtgaaaga

SEQ ID NO: 527565 - DNA, 20 bp, Artificial Sequence
  chemically synthesized
attttgaaagaagttctact

SEQ ID NO: 527566 - DNA, 20 bp, Artificial Sequence
  chemically synthesized
agtagaacttctttcaaaat

SEQ ID NO: 527567 - DNA, 20 bp, Artificial Sequence
  chemically synthesized
cttagctgataaagtagtgg

SEQ ID NO: 527568 - DNA, 20 bp, Artificial Sequence
  chemically synthesized
tgagatgacaacaaaggatt

SEQ ID NO: 527569 - DNA, 20 bp, Artificial Sequence
  chemically synthesized
acattgttgagatgacaaca

SEQ ID NO: 527570 - DNA, 20 bp, Artificial Sequence
  chemically synthesized
tggatgaggaattgcatctg

SEQ ID NO: 527571 - DNA, 20 bp, Artificial Sequence
  chemically synthesized
taataaagcgtgaatggatg

SEQ ID NO: 527572 - DNA, 20 bp, Artificial Sequence
  chemically synthesized
aatctcataataaagcgtga

SEQ ID NO: 527573 - DNA, 20 bp, Artificial Sequence
  chemically synthesized
ctaaaatctcataataaagc

SEQ ID NO: 527574 - DNA, 20 bp, Artificial Sequence
  chemically synthesized
acgctttattatgagatttt

SEQ ID NO: 527575 - DNA, 20 bp, Artificial Sequence
  chemically synthesized
agtggagcctgaagatgttg

SEQ ID NO: 527576 - DNA, 20 bp, Artificial Sequence
  chemically synthesized
agatatggtgacaatagcaa

SEQ ID NO: 527577 - DNA, 20 bp, Artificial Sequence
  chemically synthesized
agctccttaaagtcatccat

SEQ ID NO: 527578 - DNA, 20 bp, Artificial Sequence
  chemically synthesized
agaagctgatttcaaccctc

SEQ ID NO: 527579 - DNA, 20 bp, Artificial Sequence
  chemically synthesized
gtcaaaatatcacatttaac

SEQ ID NO: 527580 - DNA, 20 bp, Artificial Sequence
  chemically synthesized
tgatattttgacctcctccg

SEQ ID NO: 527581 - DNA, 20 bp, Artificial Sequence
  chemically synthesized
ttgacctcctccgatgaatc

SEQ ID NO: 527582 - DNA, 20 bp, Artificial Sequence
  chemically synthesized
tgaatgttattaatggcatc

SEQ ID NO: 527583 - DNA, 20 bp, Artificial Sequence
  chemically synthesized
tattaatggcatctagaatg

SEQ ID NO: 527584 - DNA, 20 bp, Artificial Sequence
  chemically synthesized
gaaattgaaagccttctgta

SEQ ID NO: 527585 - DNA, 20 bp, Artificial Sequence
  chemically synthesized
tgtaaataataaatcttctg

SEQ ID NO: 527586 - DNA, 20 bp, Artificial Sequence
  chemically synthesized
attctgtagcccatgggtca

SEQ ID NO: 527587 - DNA, 20 bp, Artificial Sequence
  chemically synthesized
actctttgacccatgggcta

SEQ ID NO: 527588 - DNA, 20 bp, Artificial Sequence
  chemically synthesized
taacatccattctgtagccc

SEQ ID NO: 527589 - DNA, 20 bp, Artificial Sequence
  chemically synthesized
tttgacccatgggctacaga

SEQ ID NO: 527590 - DNA, 20 bp, Artificial Sequence
  chemically synthesized
ttagcaggtatgaaaacaac

SEQ ID NO: 527591 - DNA, 20 bp, Artificial Sequence
  chemically synthesized
gtacatctccaaatgagctc

SEQ ID NO: 527592 - DNA, 20 bp, Artificial Sequence
  chemically synthesized
tttactgaatattttaagcc

SEQ ID NO: 527593 - DNA, 20 bp, Artificial Sequence
  chemically synthesized
tctgtttacagcatgattta

SEQ ID NO: 527594 - DNA, 20 bp, Artificial Sequence
  chemically synthesized
tataaaagtaacaataaagc

SEQ ID NO: 527595 - DNA, 20 bp, Artificial Sequence
  chemically synthesized
ctgaaaatcctagggccctt

SEQ ID NO: 527596 - DNA, 20 bp, Artificial Sequence
  chemically synthesized
agcataattcttaagggccc

SEQ ID NO: 527597 - DNA, 20 bp, Artificial Sequence
  chemically synthesized
cttaagggccctaggatttt

SEQ ID NO: 527598 - DNA, 20 bp, Artificial Sequence
  chemically synthesized
gctgcattagactctagcaa

SEQ ID NO: 527599 - DNA, 20 bp, Artificial Sequence
  chemically synthesized
ggacagggtgattcttttgc

SEQ ID NO: 527600 - DNA, 20 bp, Artificial Sequence
  chemically synthesized
ggcttcaaagcttcaaagga

SEQ ID NO: 527601 - DNA, 20 bp, Artificial Sequence
  chemically synthesized
tatttgaagaagatgccatc

SEQ ID NO: 527602 - DNA, 20 bp, Artificial Sequence
  chemically synthesized
aatgatcttagctagaactt

SEQ ID NO: 527603 - DNA, 20 bp, Artificial Sequence
  chemically synthesized
tccttacctctcagccttcg

SEQ ID NO: 527604 - DNA, 20 bp, Artificial Sequence
  chemically synthesized
tcagccttcgtagaattgaa

SEQ ID NO: 527605 - DNA, 20 bp, Artificial Sequence
  chemically synthesized
ttcgtagaattgaagagagt

SEQ ID NO: 527606 - DNA, 20 bp, Artificial Sequence
  chemically synthesized
aagagagttgggatcttcct

SEQ ID NO: 527607 - DNA, 20 bp, Artificial Sequence
  chemically synthesized
ctggattagctcttggttaa

SEQ ID NO: 527608 - DNA, 20 bp, Artificial Sequence
  chemically synthesized
aaagcagtcttactgctgat

SEQ ID NO: 527609 - DNA, 20 bp, Artificial Sequence
  chemically synthesized
agtgttacccccatgcacac

SEQ ID NO: 527610 - DNA, 20 bp, Artificial Sequence
  chemically synthesized
cttttcattcatgtgtgcat

SEQ ID NO: 527611 - DNA, 20 bp, Artificial Sequence
  chemically synthesized
accagacagttagtcaaggt

SEQ ID NO: 527612 - DNA, 20 bp, Artificial Sequence
  chemically synthesized
tgaggagggcatgtcaaaag

SEQ ID NO: 527613 - DNA, 20 bp, Artificial Sequence
  chemically synthesized
ctaagtgttcaagtgaaagg

SEQ ID NO: 527614 - DNA, 20 bp, Artificial Sequence
  chemically synthesized
tgaacacttagagaccactg

SEQ ID NO: 527615 - DNA, 20 bp, Artificial Sequence
  chemically synthesized
atttcaatattggtttgtct

SEQ ID NO: 527616 - DNA, 20 bp, Artificial Sequence
  chemically synthesized
ggagagggagacagatgtgg

SEQ ID NO: 527617 - DNA, 20 bp, Artificial Sequence
  chemically synthesized
ggagacagatgtgggggggt

SEQ ID NO: 527618 - DNA, 20 bp, Artificial Sequence
  chemically synthesized
taatcaatgttgtgtgtgtt

SEQ ID NO: 527619 - DNA, 20 bp, Artificial Sequence
  chemically synthesized
ttgtcatttttgggggcaac

SEQ ID NO: 527620 - DNA, 20 bp, Artificial Sequence
  chemically synthesized
gagtacaaaagccacactga

SEQ ID NO: 527621 - DNA, 20 bp, Artificial Sequence
  chemically synthesized
ctcaacaagctgacactggt

SEQ ID NO: 527622 - DNA, 20 bp, Artificial Sequence
  chemically synthesized
tatgctttcagtgttactaa

SEQ ID NO: 527623 - DNA, 20 bp, Artificial Sequence
  chemically synthesized
tgaaatgtgaagatatgaca

SEQ ID NO: 527624 - DNA, 20 bp, Artificial Sequence
  chemically synthesized
atttatatctctgctgtttc

SEQ ID NO: 527625 - DNA, 20 bp, Artificial Sequence
  chemically synthesized
aaagcaaaatccctatgcta

SEQ ID NO: 527626 - DNA, 20 bp, Artificial Sequence
  chemically synthesized
gtattataactctttagcat

SEQ ID NO: 527627 - DNA, 20 bp, Artificial Sequence
  chemically synthesized
ttgtgatgtaaatatgatag

SEQ ID NO: 527628 - DNA, 20 bp, Artificial Sequence
  chemically synthesized
ttgccattgaaaaatttctt

SEQ ID NO: 527629 - DNA, 20 bp, Artificial Sequence
  chemically synthesized
acataaagtaatacttaaga

SEQ ID NO: 527630 - DNA, 20 bp, Artificial Sequence
  chemically synthesized
tgtttgaggccactttcagg

SEQ ID NO: 527631 - DNA, 20 bp, Artificial Sequence
  chemically synthesized
aaggataatgttgatgaaga

SEQ ID NO: 527632 - DNA, 20 bp, Artificial Sequence
  chemically synthesized
tgtgtaagtagcactgtggt

SEQ ID NO: 527633 - DNA, 20 bp, Artificial Sequence
  chemically synthesized
tttggctaagtggctttgtt

SEQ ID NO: 527634 - DNA, 20 bp, Artificial Sequence
  chemically synthesized
gccaaagcacatgtttgact

SEQ ID NO: 527635 - DNA, 20 bp, Artificial Sequence
  chemically synthesized
tttgttacatctaatactgg

SEQ ID NO: 527636 - DNA, 20 bp, Artificial Sequence
  chemically synthesized
acaagttttcacaaacagta

SEQ ID NO: 527637 - DNA, 20 bp, Artificial Sequence
  chemically synthesized
ctttcacaaattaagcaaga

SEQ ID NO: 527638 - DNA, 20 bp, Artificial Sequence
  chemically synthesized
ccattagctgctttctagct

SEQ ID NO: 527639 - DNA, 20 bp, Artificial Sequence
  chemically synthesized
tagctgctttctagctgagg

SEQ ID NO: 527640 - DNA, 20 bp, Artificial Sequence
  chemically synthesized
tgagatcttgaagaaagcca

SEQ ID NO: 527641 - DNA, 20 bp, Artificial Sequence
  chemically synthesized
gttttctacagctgtgtcta

SEQ ID NO: 527642 - DNA, 20 bp, Artificial Sequence
  chemically synthesized
cagctgtgtctatggggtta

SEQ ID NO: 527643 - DNA, 20 bp, Artificial Sequence
  chemically synthesized
tggggttatagggtgaaagt

SEQ ID NO: 527644 - DNA, 20 bp, Artificial Sequence
  chemically synthesized
aaagttggaataaatggcag

SEQ ID NO: 527645 - DNA, 20 bp, Artificial Sequence
  chemically synthesized
gaattgaaggtgtagacatc

SEQ ID NO: 527646 - DNA, 20 bp, Artificial Sequence
  chemically synthesized
gaaagcccagcaaagaaaag

SEQ ID NO: 527647 - DNA, 20 bp, Artificial Sequence
  chemically synthesized
tttcatatatttgccaactg

SEQ ID NO: 527648 - DNA, 20 bp, Artificial Sequence
  chemically synthesized
ctcggcatgaatgcagtggg

SEQ ID NO: 527649 - DNA, 20 bp, Artificial Sequence
  chemically synthesized
tgatgccgtatgtgctcggc

SEQ ID NO: 527650 - DNA, 20 bp, Artificial Sequence
  chemically synthesized
aaataatggtattttatccc

SEQ ID NO: 527651 - DNA, 20 bp, Artificial Sequence
  chemically synthesized
ctgtatctacttggaactcg

SEQ ID NO: 527652 - DNA, 20 bp, Artificial Sequence
  chemically synthesized
attgcttgatagtagtttcc

SEQ ID NO: 527653 - DNA, 20 bp, Artificial Sequence
  chemically synthesized
cattcgattacaaatcatta

SEQ ID NO: 527654 - DNA, 20 bp, Artificial Sequence
  chemically synthesized
tattctttaatgatttgtaa

SEQ ID NO: 527655 - DNA, 20 bp, Artificial Sequence
  chemically synthesized
atgcttccattttttcagaa

SEQ ID NO: 527656 - DNA, 20 bp, Artificial Sequence
  chemically synthesized
tcagaagagaataaaaggcc

SEQ ID NO: 527657 - DNA, 20 bp, Artificial Sequence
  chemically synthesized
atcaaaatatgcattggttt

SEQ ID NO: 527658 - DNA, 20 bp, Artificial Sequence
  chemically synthesized
taataaaatatcatgttgtc

SEQ ID NO: 527659 - DNA, 20 bp, Artificial Sequence
  chemically synthesized
tggcactcaaataatttgct

SEQ ID NO: 527660 - DNA, 20 bp, Artificial Sequence
  chemically synthesized
gtagaccctgagcaaattat

SEQ ID NO: 527661 - DNA, 20 bp, Artificial Sequence
  chemically synthesized
cacttctttgctgtgcttcc

SEQ ID NO: 527662 - DNA, 20 bp, Artificial Sequence
  chemically synthesized
ccaggaagcacagcaaagaa

SEQ ID NO: 527663 - DNA, 20 bp, Artificial Sequence
  chemically synthesized
gaaaagaacaccagtacagt

SEQ ID NO: 527664 - DNA, 20 bp, Artificial Sequence
  chemically synthesized
gtaccacttgagaccactag

SEQ ID NO: 527665 - DNA, 20 bp, Artificial Sequence
  chemically synthesized
cacctgagaagcaagaaagg

SEQ ID NO: 527666 - DNA, 20 bp, Artificial Sequence
  chemically synthesized
gttcttaacacattacacat

SEQ ID NO: 527667 - DNA, 20 bp, Artificial Sequence
  chemically synthesized
ataatcattataattaaata

SEQ ID NO: 527668 - DNA, 20 bp, Artificial Sequence
  chemically synthesized
aagaatcattttccaagcag

SEQ ID NO: 527669 - DNA, 20 bp, Artificial Sequence
  chemically synthesized
ggatggaagccagcatcagg

SEQ ID NO: 527670 - DNA, 20 bp, Artificial Sequence
  chemically synthesized
aacgtaatgatgtcaaccag

SEQ ID NO: 527671 - DNA, 20 bp, Artificial Sequence
  chemically synthesized
tactggttgacatcattacg

SEQ ID NO: 527672 - DNA, 20 bp, Artificial Sequence
  chemically synthesized
acgttgggttaagcagtgac

SEQ ID NO: 527673 - DNA, 20 bp, Artificial Sequence
  chemically synthesized
aaaagtgtgtgggagaataa

SEQ ID NO: 527674 - DNA, 20 bp, Artificial Sequence
  chemically synthesized
tgcaggtcaaaagtgtgtgg

SEQ ID NO: 527675 - DNA, 20 bp, Artificial Sequence
  chemically synthesized
tctttaatataacaaagata

SEQ ID NO: 527676 - DNA, 20 bp, Artificial Sequence
  chemically synthesized
cccttaatttgacagcacaa

SEQ ID NO: 527677 - DNA, 20 bp, Artificial Sequence
  chemically synthesized
gaaaaggcaaaaaagcaatc

SEQ ID NO: 527678 - DNA, 20 bp, Artificial Sequence
  chemically synthesized
ttaatatacagttacagatt

SEQ ID NO: 527679 - DNA, 20 bp, Artificial Sequence
  chemically synthesized
ggcttatattagccaaagca

SEQ ID NO: 527680 - DNA, 20 bp, Artificial Sequence
  chemically synthesized
taaaagtataatgtatacaa

SEQ ID NO: 527681 - DNA, 20 bp, Artificial Sequence
  chemically synthesized
aaaagacacatcaagcctga

SEQ ID NO: 527682 - DNA, 20 bp, Artificial Sequence
  chemically synthesized
acagtcctttttatacatag

SEQ ID NO: 527683 - DNA, 20 bp, Artificial Sequence
  chemically synthesized
gactgtatataatgtcaata

SEQ ID NO: 527684 - DNA, 20 bp, Artificial Sequence
  chemically synthesized
taatgtcaatagagaataaa

SEQ ID NO: 527685 - DNA, 20 bp, Artificial Sequence
  chemically synthesized
gcatgtggcttcctgttaca

SEQ ID NO: 527686 - DNA, 20 bp, Artificial Sequence
  chemically synthesized
cagaattgtgctttttaata

SEQ ID NO: 527687 - DNA, 20 bp, Artificial Sequence
  chemically synthesized
ataatttcaaaaccaatttg

SEQ ID NO: 527688 - DNA, 20 bp, Artificial Sequence
  chemically synthesized
catatcatttgatacatcca

SEQ ID NO: 527689 - DNA, 20 bp, Artificial Sequence
  chemically synthesized
gcaaagagcgtaggaattca

SEQ ID NO: 527690 - DNA, 20 bp, Artificial Sequence
  chemically synthesized
cttgaggctgcaaagagcgt

SEQ ID NO: 527691 - DNA, 20 bp, Artificial Sequence
  chemically synthesized
ctgtgtgctggcagactttg

SEQ ID NO: 527692 - DNA, 20 bp, Artificial Sequence
  chemically synthesized
tactgaaggatttggggttg

SEQ ID NO: 527693 - DNA, 20 bp, Artificial Sequence
  chemically synthesized
gaactacatactgaaggatt

SEQ ID NO: 527694 - DNA, 20 bp, Artificial Sequence
  chemically synthesized
aaaatgagaactacatactg

SEQ ID NO: 527695 - DNA, 20 bp, Artificial Sequence
  chemically synthesized
atctacttccattttttcca

SEQ ID NO: 527696 - DNA, 20 bp, Artificial Sequence
  chemically synthesized
aaccatgctgcacagtacaa

SEQ ID NO: 527697 - DNA, 20 bp, Artificial Sequence
  chemically synthesized
tcatcactaatagaaaatga

SEQ ID NO: 527698 - DNA, 20 bp, Artificial Sequence
  chemically synthesized
gtgttactttaccaatatgc

SEQ ID NO: 527699 - DNA, 20 bp, Artificial Sequence
  chemically synthesized
cagtttcgtttataaggtac

SEQ ID NO: 527700 - DNA, 20 bp, Artificial Sequence
  chemically synthesized
atcatcacctaaaataatag

SEQ ID NO: 527701 - DNA, 20 bp, Artificial Sequence
  chemically synthesized
ccccagaggtcttaatttaa

SEQ ID NO: 527702 - DNA, 20 bp, Artificial Sequence
  chemically synthesized
agagcctttaaaataccatg

SEQ ID NO: 527703 - DNA, 20 bp, Artificial Sequence
  chemically synthesized
ctatttcacaccgtaaaagt

SEQ ID NO: 527704 - DNA, 20 bp, Artificial Sequence
  chemically synthesized
aaatagacaaaaatggtaac

SEQ ID NO: 527705 - DNA, 20 bp, Artificial Sequence
  chemically synthesized
ggtcaacgcatttccctaaa

SEQ ID NO: 527706 - DNA, 20 bp, Artificial Sequence
  chemically synthesized
tttccctaaactgaatgagg

SEQ ID NO: 527707 - DNA, 20 bp, Artificial Sequence
  chemically synthesized
ttagtaatattagagggaag

SEQ ID NO: 527708 - DNA, 20 bp, Artificial Sequence
  chemically synthesized
acagccagtaagacatttgt

SEQ ID NO: 527709 - DNA, 20 bp, Artificial Sequence
  chemically synthesized
aagtttaacttaaagtagta

SEQ ID NO: 527710 - DNA, 20 bp, Artificial Sequence
  chemically synthesized
attactactttaagttaaac

SEQ ID NO: 527711 - DNA, 20 bp, Artificial Sequence
  chemically synthesized
ccctccagaagagctaagca

SEQ ID NO: 527712 - DNA, 20 bp, Artificial Sequence
  chemically synthesized
gcaaagggtaaaaaaaaaaa

SEQ ID NO: 527713 - DNA, 20 bp, Artificial Sequence
  chemically synthesized
gtaaaaaaaaaaaaagaata

SEQ ID NO: 527714 - DNA, 20 bp, Artificial Sequence
  chemically synthesized
actattagtgcctgagggcc

SEQ ID NO: 527715 - DNA, 20 bp, Artificial Sequence
  chemically synthesized
ccctcaggcactaatagttt

SEQ ID NO: 527716 - DNA, 20 bp, Artificial Sequence
  chemically synthesized
attaggaagattctatgcac

SEQ ID NO: 527717 - DNA, 20 bp, Artificial Sequence
  chemically synthesized
gaatcatgcacccctgtgca

SEQ ID NO: 527718 - DNA, 20 bp, Artificial Sequence
  chemically synthesized
tgcctcttctttacttttgg

SEQ ID NO: 527719 - DNA, 20 bp, Artificial Sequence
  chemically synthesized
gcactagctacactattttg

SEQ ID NO: 527720 - DNA, 20 bp, Artificial Sequence
  chemically synthesized
catgtaccaagtaaatatat

SEQ ID NO: 527721 - DNA, 20 bp, Artificial Sequence
  chemically synthesized
ccaagtaaatatatgtgaat

SEQ ID NO: 527722 - DNA, 20 bp, Artificial Sequence
  chemically synthesized
ataagaattgtttatgactg

SEQ ID NO: 527723 - DNA, 20 bp, Artificial Sequence
  chemically synthesized
aattgtttatgactgtggga

SEQ ID NO: 527724 - DNA, 20 bp, Artificial Sequence
  chemically synthesized
cagagaactgtttgtatggc

SEQ ID NO: 527725 - DNA, 20 bp, Artificial Sequence
  chemically synthesized
tagggtgaggcattcacatg

SEQ ID NO: 527726 - DNA, 20 bp, Artificial Sequence
  chemically synthesized
tctaatcttatatccaccat

SEQ ID NO: 527727 - DNA, 20 bp, Artificial Sequence
  chemically synthesized
cttctcttcatgcaagttat

SEQ ID NO: 527728 - DNA, 20 bp, Artificial Sequence
  chemically synthesized
cacctgtggactttaagcag

SEQ ID NO: 527729 - DNA, 20 bp, Artificial Sequence
  chemically synthesized
ataagcctagcagccttgtg

SEQ ID NO: 527730 - DNA, 20 bp, Artificial Sequence
  chemically synthesized
ttagatccccatatctgact

SEQ ID NO: 527731 - DNA, 20 bp, Artificial Sequence
  chemically synthesized
gtgtattcgaagtcagatat

SEQ ID NO: 527732 - DNA, 20 bp, Artificial Sequence
  chemically synthesized
actgtcaggagatatggagg

SEQ ID NO: 527733 - DNA, 20 bp, Artificial Sequence
  chemically synthesized
tggcagagctaaaagaaatt

SEQ ID NO: 527734 - DNA, 20 bp, Artificial Sequence
  chemically synthesized
ttacctcatatggttcctat

SEQ ID NO: 527735 - DNA, 20 bp, Artificial Sequence
  chemically synthesized
tttaaagctttatacattta

SEQ ID NO: 527736 - DNA, 20 bp, Artificial Sequence
  chemically synthesized
attaagattatcaagtactt

SEQ ID NO: 527737 - DNA, 20 bp, Artificial Sequence
  chemically synthesized
ttcactgtatgtgaacaaat

SEQ ID NO: 527738 - DNA, 20 bp, Artificial Sequence
  chemically synthesized
agcatgctactttcctctta

SEQ ID NO: 527739 - DNA, 20 bp, Artificial Sequence
  chemically synthesized
tagcatgctaggtaactcat

SEQ ID NO: 527740 - DNA, 20 bp, Artificial Sequence
  chemically synthesized
acttagaaatttaaatccag

SEQ ID NO: 527741 - DNA, 20 bp, Artificial Sequence
  chemically synthesized
atttctaagtggaagtacta

SEQ ID NO: 527742 - DNA, 20 bp, Artificial Sequence
  chemically synthesized
cacacttccctagcttcatg

SEQ ID NO: 527743 - DNA, 20 bp, Artificial Sequence
  chemically synthesized
tctatcttctagtccttggc

SEQ ID NO: 527744 - DNA, 20 bp, Artificial Sequence
  chemically synthesized
agttgtttctcaggcatctg

SEQ ID NO: 527745 - DNA, 20 bp, Artificial Sequence
  chemically synthesized
gcatgagaagtaatcaacct

SEQ ID NO: 527746 - DNA, 20 bp, Artificial Sequence
  chemically synthesized
ccttggaataggttgctaaa

SEQ ID NO: 527747 - DNA, 20 bp, Artificial Sequence
  chemically synthesized
ttagagactgaacttattat

SEQ ID NO: 527748 - DNA, 20 bp, Artificial Sequence
  chemically synthesized
gtttagtaataatctggtct

SEQ ID NO: 527749 - DNA, 20 bp, Artificial Sequence
  chemically synthesized
gcaacctaaatacggattag

SEQ ID NO: 527750 - DNA, 20 bp, Artificial Sequence
  chemically synthesized
tattcatgtgcaacctaaat

SEQ ID NO: 527751 - DNA, 20 bp, Artificial Sequence
  chemically synthesized
aatccgtatttaggttgcac

SEQ ID NO: 527752 - DNA, 20 bp, Artificial Sequence
  chemically synthesized
tatttaggttgcacatgaat

SEQ ID NO: 527753 - DNA, 20 bp, Artificial Sequence
  chemically synthesized
aattgtatttattcaataca

SEQ ID NO: 527754 - DNA, 20 bp, Artificial Sequence
  chemically synthesized
ccttgattttattcattgta

SEQ ID NO: 527755 - DNA, 20 bp, Artificial Sequence
  chemically synthesized
ggaaaaaaaagatacagaaa

SEQ ID NO: 527756 - DNA, 20 bp, Artificial Sequence
  chemically synthesized
ttctgccatacataggtctt

SEQ ID NO: 527757 - DNA, 20 bp, Artificial Sequence
  chemically synthesized
attgagttagtgatacagat

SEQ ID NO: 527758 - DNA, 20 bp, Artificial Sequence
  chemically synthesized
tgtacctgcttggaaggaaa

SEQ ID NO: 527759 - DNA, 20 bp, Artificial Sequence
  chemically synthesized
gtacagaagtagatcatgga

SEQ ID NO: 527760 - DNA, 20 bp, Artificial Sequence
  chemically synthesized
catggaaggagtgaaatgca

SEQ ID NO: 527761 - DNA, 20 bp, Artificial Sequence
  chemically synthesized
gcataataaaacattttggc

SEQ ID NO: 527762 - DNA, 20 bp, Artificial Sequence
  chemically synthesized
aaaagttttcattttctata

SEQ ID NO: 527763 - DNA, 20 bp, Artificial Sequence
  chemically synthesized
ctatagaaaatgaaaacttt

SEQ ID NO: 527764 - DNA, 20 bp, Artificial Sequence
  chemically synthesized
ttttgaattagaaccaaatt

SEQ ID NO: 527765 - DNA, 20 bp, Artificial Sequence
  chemically synthesized
aatgggaacatccaagtaat

SEQ ID NO: 527766 - DNA, 20 bp, Artificial Sequence
  chemically synthesized
ttcacatttattcttattac

SEQ ID NO: 527767 - DNA, 20 bp, Artificial Sequence
  chemically synthesized
agaataaatgtgaaaagaaa

SEQ ID NO: 527768 - DNA, 20 bp, Artificial Sequence
  chemically synthesized
ttttcctttgttttttgaga

SEQ ID NO: 527769 - DNA, 20 bp, Artificial Sequence
  chemically synthesized
gtgcactccaacctgggtga

SEQ ID NO: 527770 - DNA, 20 bp, Artificial Sequence
  chemically synthesized
tctcactctgtcacccaggt

SEQ ID NO: 527771 - DNA, 20 bp, Artificial Sequence
  chemically synthesized
tcgtgccagtgcactccaac

SEQ ID NO: 527772 - DNA, 20 bp, Artificial Sequence
  chemically synthesized
cccaggaggctgaggttgca

SEQ ID NO: 527773 - DNA, 20 bp, Artificial Sequence
  chemically synthesized
ctcattgcaacctcagcctc

SEQ ID NO: 527774 - DNA, 20 bp, Artificial Sequence
  chemically synthesized
tactcgggaggctgaggcag

SEQ ID NO: 527775 - DNA, 20 bp, Artificial Sequence
  chemically synthesized
gattcttctgcctcagcctc

SEQ ID NO: 527776 - DNA, 20 bp, Artificial Sequence
  chemically synthesized
ttttgtgtttttagtagaga

SEQ ID NO: 527777 - DNA, 20 bp, Artificial Sequence
  chemically synthesized
ggtgggtgtatcatgaggtc

SEQ ID NO: 527778 - DNA, 20 bp, Artificial Sequence
  chemically synthesized
cagcattttgggaggtcgag

SEQ ID NO: 527779 - DNA, 20 bp, Artificial Sequence
  chemically synthesized
acctcgacctcccaaaatgc

SEQ ID NO: 527780 - DNA, 20 bp, Artificial Sequence
  chemically synthesized
agtaattttaatagcaagta

SEQ ID NO: 527781 - DNA, 20 bp, Artificial Sequence
  chemically synthesized
gtggccttccaaaagagaca

SEQ ID NO: 527782 - DNA, 20 bp, Artificial Sequence
  chemically synthesized
ttccaaaagagacaaggagt

SEQ ID NO: 527783 - DNA, 20 bp, Artificial Sequence
  chemically synthesized
tttttttctagtaaaccatg

SEQ ID NO: 527784 - DNA, 20 bp, Artificial Sequence
  chemically synthesized
agtctcctgacactgaagta

SEQ ID NO: 527785 - DNA, 20 bp, Artificial Sequence
  chemically synthesized
tcaaaacccggagaccatta

SEQ ID NO: 527786 - DNA, 20 bp, Artificial Sequence
  chemically synthesized
taaatattctttaatggtct

SEQ ID NO: 527787 - DNA, 20 bp, Artificial Sequence
  chemically synthesized
agatatcttttataggaact

SEQ ID NO: 527788 - DNA, 20 bp, Artificial Sequence
  chemically synthesized
cattttaaaaatcaagttga

SEQ ID NO: 527789 - DNA, 20 bp, Artificial Sequence
  chemically synthesized
atgtggatgttatctatagt

SEQ ID NO: 527790 - DNA, 20 bp, Artificial Sequence
  chemically synthesized
tttttgtgtttattgctcat

SEQ ID NO: 527791 - DNA, 20 bp, Artificial Sequence
  chemically synthesized
cgtggcattttcaactaaag

SEQ ID NO: 527792 - DNA, 20 bp, Artificial Sequence
  chemically synthesized
gaagtagaattattaggtca

SEQ ID NO: 527793 - DNA, 20 bp, Artificial Sequence
  chemically synthesized
ttctgttatgtgccaagaag

SEQ ID NO: 527794 - DNA, 20 bp, Artificial Sequence
  chemically synthesized
catatgtgcagtaaatttgc

SEQ ID NO: 527795 - DNA, 20 bp, Artificial Sequence
  chemically synthesized
atttgcaagaatattcaaag

SEQ ID NO: 527796 - DNA, 20 bp, Artificial Sequence
  chemically synthesized
ctcttaaaaataattccact

SEQ ID NO: 527797 - DNA, 20 bp, Artificial Sequence
  chemically synthesized
ttcaaagtggaattattttt

SEQ ID NO: 527798 - DNA, 20 bp, Artificial Sequence
  chemically synthesized
tatttttaagagttcacaaa

SEQ ID NO: 527799 - DNA, 20 bp, Artificial Sequence
  chemically synthesized
aatcaatttaaatgttcatc

SEQ ID NO: 527800 - DNA, 20 bp, Artificial Sequence
  chemically synthesized
aaatgttcatccagagtaga

SEQ ID NO: 527801 - DNA, 20 bp, Artificial Sequence
  chemically synthesized
atttacttattccatctact

SEQ ID NO: 527802 - DNA, 20 bp, Artificial Sequence
  chemically synthesized
aattagatagatctcacaaa

SEQ ID NO: 527803 - DNA, 20 bp, Artificial Sequence
  chemically synthesized
gatttaggagccagaaacaa

SEQ ID NO: 527804 - DNA, 20 bp, Artificial Sequence
  chemically synthesized
aatactctcccagaggtaag

SEQ ID NO: 527805 - DNA, 20 bp, Artificial Sequence
  chemically synthesized
agtattccacttacctctgg

SEQ ID NO: 527806 - DNA, 20 bp, Artificial Sequence
  chemically synthesized
gaagtggtaagacaaagttt

SEQ ID NO: 527807 - DNA, 20 bp, Artificial Sequence
  chemically synthesized
gtaattactcaaggcaagaa

SEQ ID NO: 527808 - DNA, 20 bp, Artificial Sequence
  chemically synthesized
ggtaatattcttttcttgcc

SEQ ID NO: 527809 - DNA, 20 bp, Artificial Sequence
  chemically synthesized
ttcttgccttgagtaattac

SEQ ID NO: 527810 - DNA, 20 bp, Artificial Sequence
  chemically synthesized
atcaataggtgtccagcttc

SEQ ID NO: 527811 - DNA, 20 bp, Artificial Sequence
  chemically synthesized
acattttactgaactataac

SEQ ID NO: 527812 - DNA, 20 bp, Artificial Sequence
  chemically synthesized
tctataaagggaaattacta

SEQ ID NO: 527813 - DNA, 20 bp, Artificial Sequence
  chemically synthesized
aattactaatgaatgttggg

SEQ ID NO: 527814 - DNA, 20 bp, Artificial Sequence
  chemically synthesized
tatatatctaagttacttca

SEQ ID NO: 527815 - DNA, 20 bp, Artificial Sequence
  chemically synthesized
ctcaagcagtacattttcta

SEQ ID NO: 527816 - DNA, 20 bp, Artificial Sequence
  chemically synthesized
agaaaatgtactgcttgaga

SEQ ID NO: 527817 - DNA, 20 bp, Artificial Sequence
  chemically synthesized
gcttgagagagaatgacttt

SEQ ID NO: 527818 - DNA, 20 bp, Artificial Sequence
  chemically synthesized
acaagatattttctgaagaa

SEQ ID NO: 527819 - DNA, 20 bp, Artificial Sequence
  chemically synthesized
ggtaaacaagatattttctg

SEQ ID NO: 527820 - DNA, 20 bp, Artificial Sequence
  chemically synthesized
tctctttttaatttcctagg

SEQ ID NO: 527821 - DNA, 20 bp, Artificial Sequence
  chemically synthesized
ttttaatttcctaggaggag

SEQ ID NO: 527822 - DNA, 20 bp, Artificial Sequence
  chemically synthesized
taaattggaagatgttgaaa

SEQ ID NO: 527823 - DNA, 20 bp, Artificial Sequence
  chemically synthesized
ttgaaattggataaaacctt

SEQ ID NO: 527824 - DNA, 20 bp, Artificial Sequence
  chemically synthesized
tgaaaggataacatctcaga

SEQ ID NO: 527825 - DNA, 20 bp, Artificial Sequence
  chemically synthesized
aggttacaaaggagggctga

SEQ ID NO: 527826 - DNA, 20 bp, Artificial Sequence
  chemically synthesized
gtataaagttaaattaatca

SEQ ID NO: 527827 - DNA, 20 bp, Artificial Sequence
  chemically synthesized
tgattaatttaactttatac

SEQ ID NO: 527828 - DNA, 20 bp, Artificial Sequence
  chemically synthesized
tttcaggtagcttctaatta

SEQ ID NO: 527829 - DNA, 20 bp, Artificial Sequence
  chemically synthesized
tagcataggaaaaagtttcc

SEQ ID NO: 527830 - DNA, 20 bp, Artificial Sequence
  chemically synthesized
atgaccatgcaaactttcag

SEQ ID NO: 527831 - DNA, 20 bp, Artificial Sequence
  chemically synthesized
cacctgttgctcatcttcac

SEQ ID NO: 527832 - DNA, 20 bp, Artificial Sequence
  chemically synthesized
atgtcgctttaccctttact

SEQ ID NO: 527833 - DNA, 20 bp, Artificial Sequence
  chemically synthesized
aaaaatagtaattcaaagta

SEQ ID NO: 527834 - DNA, 20 bp, Artificial Sequence
  chemically synthesized
ctttgaattactatttttca

SEQ ID NO: 527835 - DNA, 20 bp, Artificial Sequence
  chemically synthesized
aggtttccggagttcctagt

SEQ ID NO: 527836 - DNA, 20 bp, Artificial Sequence
  chemically synthesized
aggactgagctagaggtttc

SEQ ID NO: 527837 - DNA, 20 bp, Artificial Sequence
  chemically synthesized
tcctaagtcagctttactgt

SEQ ID NO: 527838 - DNA, 20 bp, Artificial Sequence
  chemically synthesized
agaagagaaaaatatttaca

SEQ ID NO: 527839 - DNA, 20 bp, Artificial Sequence
  chemically synthesized
tagagacgaacgtggtttat

SEQ ID NO: 527840 - DNA, 20 bp, Artificial Sequence
  chemically synthesized
tgactaagatacagtccctg

SEQ ID NO: 527841 - DNA, 20 bp, Artificial Sequence
  chemically synthesized
ctagcacagagcctggcagt

SEQ ID NO: 527842 - DNA, 20 bp, Artificial Sequence
  chemically synthesized
aatttatcaataaatatttg

SEQ ID NO: 527843 - DNA, 20 bp, Artificial Sequence
  chemically synthesized
tatcaataaatatttgttgg

SEQ ID NO: 527844 - DNA, 20 bp, Artificial Sequence
  chemically synthesized
ttggtgggctctaatcctgt

SEQ ID NO: 527845 - DNA, 20 bp, Artificial Sequence
  chemically synthesized
tctccattaggtcatccaga

SEQ ID NO: 527846 - DNA, 20 bp, Artificial Sequence
  chemically synthesized
gtggccacagtggcaggaaa

SEQ ID NO: 527847 - DNA, 20 bp, Artificial Sequence
  chemically synthesized
gtggccaccaaaaccagccc

SEQ ID NO: 527848 - DNA, 20 bp, Artificial Sequence
  chemically synthesized
ccaccaaaaccagcccatga

SEQ ID NO: 527849 - DNA, 20 bp, Artificial Sequence
  chemically synthesized
tgatggacacattagtgagt

SEQ ID NO: 527850 - DNA, 20 bp, Artificial Sequence
  chemically synthesized
tgcatgtgatggacacatta

SEQ ID NO: 527851 - DNA, 20 bp, Artificial Sequence
  chemically synthesized
acacttgtcatagaacataa

SEQ ID NO: 527852 - DNA, 20 bp, Artificial Sequence
  chemically synthesized
taatgctaacctgaaattgt

SEQ ID NO: 527853 - DNA, 20 bp, Artificial Sequence
  chemically synthesized
ttcggtccagcaacaataag

SEQ ID NO: 527854 - DNA, 20 bp, Artificial Sequence
  chemically synthesized
tcttttatacatgctataag

SEQ ID NO: 527855 - DNA, 20 bp, Artificial Sequence
  chemically synthesized
tccttatcacattttatcct

SEQ ID NO: 527856 - DNA, 20 bp, Artificial Sequence
  chemically synthesized
acaactgattataacactcc

SEQ ID NO: 527857 - DNA, 20 bp, Artificial Sequence
  chemically synthesized
taacaatgtcatgaccagag

SEQ ID NO: 527858 - DNA, 20 bp, Artificial Sequence
  chemically synthesized
tgcaatttgaagacagggtt

SEQ ID NO: 527859 - DNA, 20 bp, Artificial Sequence
  chemically synthesized
attatgttgcaatttgaaga

SEQ ID NO: 527860 - DNA, 20 bp, Artificial Sequence
  chemically synthesized
caatgtacacctgaaggtaa

SEQ ID NO: 527861 - DNA, 20 bp, Artificial Sequence
  chemically synthesized
aaacgtttatagaggaggta

SEQ ID NO: 527862 - DNA, 20 bp, Artificial Sequence
  chemically synthesized
gcactgcagtaaataagcaa

SEQ ID NO: 527863 - DNA, 20 bp, Artificial Sequence
  chemically synthesized
aaacttattttcttgagctt

SEQ ID NO: 527864 - DNA, 20 bp, Artificial Sequence
  chemically synthesized
tttcaaaagtagtatatata

SEQ ID NO: 527865 - DNA, 20 bp, Artificial Sequence
  chemically synthesized
atgtgacatctgaataaaac

SEQ ID NO: 527866 - DNA, 20 bp, Artificial Sequence
  chemically synthesized
tgcaatataaaatgtgacat

SEQ ID NO: 527867 - DNA, 20 bp, Artificial Sequence
  chemically synthesized
tatctataggtcaaaatgta

SEQ ID NO: 527868 - DNA, 20 bp, Artificial Sequence
  chemically synthesized
actgaaacattacagctaac

SEQ ID NO: 527869 - DNA, 20 bp, Artificial Sequence
  chemically synthesized
acattttactaatatctata

SEQ ID NO: 527870 - DNA, 20 bp, Artificial Sequence
  chemically synthesized
tttactaatatctatataga

SEQ ID NO: 527871 - DNA, 20 bp, Artificial Sequence
  chemically synthesized
tgtgaaaacatatatctgca

SEQ ID NO: 527872 - DNA, 20 bp, Artificial Sequence
  chemically synthesized
tagcatgcttaaagctttag

SEQ ID NO: 527873 - DNA, 20 bp, Artificial Sequence
  chemically synthesized
tgtcttcatttgttatatgt

SEQ ID NO: 527874 - DNA, 20 bp, Artificial Sequence
  chemically synthesized
tgtgtatttgcagtgttaac

SEQ ID NO: 527875 - DNA, 20 bp, Artificial Sequence
  chemically synthesized
tgacaccttgaacatatact

SEQ ID NO: 527876 - DNA, 20 bp, Artificial Sequence
  chemically synthesized
actttgaatctaagggaaag

SEQ ID NO: 527877 - DNA, 20 bp, Artificial Sequence
  chemically synthesized
caaatagggacacatcacat

SEQ ID NO: 527878 - DNA, 20 bp, Artificial Sequence
  chemically synthesized
ttcgtaagaggatgctgggt

SEQ ID NO: 527879 - DNA, 20 bp, Artificial Sequence
  chemically synthesized
gggtatttcgtaagaggatg

SEQ ID NO: 527880 - DNA, 20 bp, Artificial Sequence
  chemically synthesized
gaaaattgggtatttcgtaa

SEQ ID NO: 527881 - DNA, 20 bp, Artificial Sequence
  chemically synthesized
tagtactgcttatttgaaaa

SEQ ID NO: 527882 - DNA, 20 bp, Artificial Sequence
  chemically synthesized
cataatcactgagcttctca

SEQ ID NO: 527883 - DNA, 20 bp, Artificial Sequence
  chemically synthesized
ccctgagaagctcagtgatt

SEQ ID NO: 527884 - DNA, 20 bp, Artificial Sequence
  chemically synthesized
tgattatgagtaatgtgaac

SEQ ID NO: 527885 - DNA, 20 bp, Artificial Sequence
  chemically synthesized
gagttcaatattcttaccct

SEQ ID NO: 527886 - DNA, 20 bp, Artificial Sequence
  chemically synthesized
tttttcctgattccaagggt

SEQ ID NO: 527887 - DNA, 20 bp, Artificial Sequence
  chemically synthesized
actttctttttcctgattcc

SEQ ID NO: 527888 - DNA, 20 bp, Artificial Sequence
  chemically synthesized
taacaagaactaaatttgcc

SEQ ID NO: 527889 - DNA, 20 bp, Artificial Sequence
  chemically synthesized
aggcaagaagcaatcttttc

SEQ ID NO: 527890 - DNA, 20 bp, Artificial Sequence
  chemically synthesized
gttaaaaaacaatactttca

SEQ ID NO: 527891 - DNA, 20 bp, Artificial Sequence
  chemically synthesized
catttgctcttaatatatct

SEQ ID NO: 527892 - DNA, 20 bp, Artificial Sequence
  chemically synthesized
cctcagttttatagtcttca

SEQ ID NO: 527893 - DNA, 20 bp, Artificial Sequence
  chemically synthesized
gaaattcttcctgttggctt

SEQ ID NO: 527894 - DNA, 20 bp, Artificial Sequence
  chemically synthesized
catattcctaagccaacagg

SEQ ID NO: 527895 - DNA, 20 bp, Artificial Sequence
  chemically synthesized
tggtaacagacacaaggctt

SEQ ID NO: 527896 - DNA, 20 bp, Artificial Sequence
  chemically synthesized
gattcttattgtatttccat

SEQ ID NO: 527897 - DNA, 20 bp, Artificial Sequence
  chemically synthesized
catcctcatggaaatacaat

SEQ ID NO: 527898 - DNA, 20 bp, Artificial Sequence
  chemically synthesized
ggaaatacaataagaatcct

SEQ ID NO: 527899 - DNA, 20 bp, Artificial Sequence
  chemically synthesized
ggaaattcctgtaaaaccca

SEQ ID NO: 527900 - DNA, 20 bp, Artificial Sequence
  chemically synthesized
aagaatcctatgggttttac

SEQ ID NO: 527901 - DNA, 20 bp, Artificial Sequence
  chemically synthesized
tttccctagaaaaaaaatgt

SEQ ID NO: 527902 - DNA, 20 bp, Artificial Sequence
  chemically synthesized
gtaatatttggtggtaaatt

SEQ ID NO: 527903 - DNA, 20 bp, Artificial Sequence
  chemically synthesized
aagcataaagctgagggatt

SEQ ID NO: 527904 - DNA, 20 bp, Artificial Sequence
  chemically synthesized
aaattctaagcataaagctg

SEQ ID NO: 527905 - DNA, 20 bp, Artificial Sequence
  chemically synthesized
gaatccctcagctttatgct

SEQ ID NO: 527906 - DNA, 20 bp, Artificial Sequence
  chemically synthesized
ctgaacatagggatatgaga

SEQ ID NO: 527907 - DNA, 20 bp, Artificial Sequence
  chemically synthesized
atttatattttcctgaacat

SEQ ID NO: 527908 - DNA, 20 bp, Artificial Sequence
  chemically synthesized
gctaaatttaagaattagca

SEQ ID NO: 527909 - DNA, 20 bp, Artificial Sequence
  chemically synthesized
tgataagacatgctaaattt

SEQ ID NO: 527910 - DNA, 20 bp, Artificial Sequence
  chemically synthesized
tgcactataaaagaacagtt

SEQ ID NO: 527911 - DNA, 20 bp, Artificial Sequence
  chemically synthesized
ttgatcaaatatgttctaga

SEQ ID NO: 527912 - DNA, 20 bp, Artificial Sequence
  chemically synthesized
agacttacttttataacatt

SEQ ID NO: 527913 - DNA, 20 bp, Artificial Sequence
  chemically synthesized
atagactctctcagcagctt

SEQ ID NO: 527914 - DNA, 20 bp, Artificial Sequence
  chemically synthesized
tgcaattccaaagctgctga

SEQ ID NO: 527915 - DNA, 20 bp, Artificial Sequence
  chemically synthesized
agctaccctcttctctcttc

SEQ ID NO: 527916 - DNA, 20 bp, Artificial Sequence
  chemically synthesized
ataaacccacgaagagagaa

SEQ ID NO: 527917 - DNA, 20 bp, Artificial Sequence
  chemically synthesized
ggaaaacaaggtaaagtgag

SEQ ID NO: 527918 - DNA, 20 bp, Artificial Sequence
  chemically synthesized
tcaatggaaaacaaggtaaa

SEQ ID NO: 527919 - DNA, 20 bp, Artificial Sequence
  chemically synthesized
gatttcagtagacttacaga

SEQ ID NO: 527920 - DNA, 20 bp, Artificial Sequence
  chemically synthesized
aaaagcagcaataaaaataa

SEQ ID NO: 527921 - DNA, 20 bp, Artificial Sequence
  chemically synthesized
tgctgaatttacctatttgg

SEQ ID NO: 527922 - DNA, 20 bp, Artificial Sequence
  chemically synthesized
gtttgactccattaatcttg

SEQ ID NO: 527923 - DNA, 20 bp, Artificial Sequence
  chemically synthesized
ggtaaattcagcaagattaa

SEQ ID NO: 527924 - DNA, 20 bp, Artificial Sequence
  chemically synthesized
ttgagataatttacttgttg

SEQ ID NO: 527925 - DNA, 20 bp, Artificial Sequence
  chemically synthesized
gtctctagtacttaagtagt

SEQ ID NO: 527926 - DNA, 20 bp, Artificial Sequence
  chemically synthesized
tacattgcttgtttagatac

SEQ ID NO: 527927 - DNA, 20 bp, Artificial Sequence
  chemically synthesized
gaccatgtgggccacaaagc

SEQ ID NO: 527928 - DNA, 20 bp, Artificial Sequence
  chemically synthesized
cctttcatgctaaaacacag

SEQ ID NO: 527929 - DNA, 20 bp, Artificial Sequence
  chemically synthesized
caactgtgttttagcatgaa

SEQ ID NO: 527930 - DNA, 20 bp, Artificial Sequence
  chemically synthesized
tatagcatataaacaaataa

SEQ ID NO: 527931 - DNA, 20 bp, Artificial Sequence
  chemically synthesized
attatataaaatttcaattt

SEQ ID NO: 527932 - DNA, 20 bp, Artificial Sequence
  chemically synthesized
tttctgaattgtttcatttc

SEQ ID NO: 527933 - DNA, 20 bp, Artificial Sequence
  chemically synthesized
ttaaaatggttttcacgttt

SEQ ID NO: 527934 - DNA, 20 bp, Artificial Sequence
  chemically synthesized
atcatttactgacccctagc

SEQ ID NO: 527935 - DNA, 20 bp, Artificial Sequence
  chemically synthesized
ccactcgcatcatccaggct

SEQ ID NO: 527936 - DNA, 20 bp, Artificial Sequence
  chemically synthesized
tgacccctagcctggatgat

SEQ ID NO: 527937 - DNA, 20 bp, Artificial Sequence
  chemically synthesized
cctagcctggatgatgcgag

SEQ ID NO: 527938 - DNA, 20 bp, Artificial Sequence
  chemically synthesized
ttttagacatttatttctct

SEQ ID NO: 527939 - DNA, 20 bp, Artificial Sequence
  chemically synthesized
taatttttaactaagaatct

SEQ ID NO: 527940 - DNA, 20 bp, Artificial Sequence
  chemically synthesized
gtctgagataatttttaact

SEQ ID NO: 527941 - DNA, 20 bp, Artificial Sequence
  chemically synthesized
aaagtgttcagtgctaagaa

SEQ ID NO: 527942 - DNA, 20 bp, Artificial Sequence
  chemically synthesized
ttcctaaagtgttcagtgct

SEQ ID NO: 527943 - DNA, 20 bp, Artificial Sequence
  chemically synthesized
ttcttagcactgaacacttt

SEQ ID NO: 527944 - DNA, 20 bp, Artificial Sequence
  chemically synthesized
cactgaacactttaggaata

SEQ ID NO: 527945 - DNA, 20 bp, Artificial Sequence
  chemically synthesized
tccagttaatgttgtgagca

SEQ ID NO: 527946 - DNA, 20 bp, Artificial Sequence
  chemically synthesized
ctgctcacaacattaactgg

SEQ ID NO: 527947 - DNA, 20 bp, Artificial Sequence
  chemically synthesized
ttgctaccaaagaggtgcaa

SEQ ID NO: 527948 - DNA, 20 bp, Artificial Sequence
  chemically synthesized
cgatgtgctataatgcagaa

SEQ ID NO: 527949 - DNA, 20 bp, Artificial Sequence
  chemically synthesized
ctcttctgcattatagcaca

SEQ ID NO: 527950 - DNA, 20 bp, Artificial Sequence
  chemically synthesized
actagaaaagtgaaaagttg

SEQ ID NO: 527951 - DNA, 20 bp, Artificial Sequence
  chemically synthesized
gtatgttcagtgaaaagtgt

SEQ ID NO: 527952 - DNA, 20 bp, Artificial Sequence
  chemically synthesized
taagaggaaccttaacattt

SEQ ID NO: 527953 - DNA, 20 bp, Artificial Sequence
  chemically synthesized
aaaatgagaacgaattttag

SEQ ID NO: 527954 - DNA, 20 bp, Artificial Sequence
  chemically synthesized
aggaaatgaaaaaaatgaga

SEQ ID NO: 527955 - DNA, 20 bp, Artificial Sequence
  chemically synthesized
atttttttcatttccttttt

SEQ ID NO: 527956 - DNA, 20 bp, Artificial Sequence
  chemically synthesized
tcattgtattttgatgtcat

SEQ ID NO: 527957 - DNA, 20 bp, Artificial Sequence
  chemically synthesized
taaagcttagtaataattaa

SEQ ID NO: 527958 - DNA, 20 bp, Artificial Sequence
  chemically synthesized
ctggcaagtacaggacatga

SEQ ID NO: 527959 - DNA, 20 bp, Artificial Sequence
  chemically synthesized
tgattttatgaaccttagct

SEQ ID NO: 527960 - DNA, 20 bp, Artificial Sequence
  chemically synthesized
tcaaagagaataattgtaat

SEQ ID NO: 527961 - DNA, 20 bp, Artificial Sequence
  chemically synthesized
aaaactgtggtgaggtcaaa

SEQ ID NO: 527962 - DNA, 20 bp, Artificial Sequence
  chemically synthesized
attgaactattagggtacca

SEQ ID NO: 527963 - DNA, 20 bp, Artificial Sequence
  chemically synthesized
gaacaaatacattgaactat

SEQ ID NO: 527964 - DNA, 20 bp, Artificial Sequence
  chemically synthesized
ttcccagatagacaggctat

SEQ ID NO: 527965 - DNA, 20 bp, Artificial Sequence
  chemically synthesized
tgcctgtgatgtatcaatta

SEQ ID NO: 527966 - DNA, 20 bp, Artificial Sequence
  chemically synthesized
attaattgatacatcacagg

SEQ ID NO: 527967 - DNA, 20 bp, Artificial Sequence
  chemically synthesized
aaatatttgctgtttgacat

SEQ ID NO: 527968 - DNA, 20 bp, Artificial Sequence
  chemically synthesized
atacttttcagataacattg

SEQ ID NO: 527969 - DNA, 20 bp, Artificial Sequence
  chemically synthesized
agaaggtgagatggtttaga

SEQ ID NO: 527970 - DNA, 20 bp, Artificial Sequence
  chemically synthesized
taaaccatctcaccttcttc

SEQ ID NO: 527971 - DNA, 20 bp, Artificial Sequence
  chemically synthesized
tgcaatattttttcttcact

SEQ ID NO: 527972 - DNA, 20 bp, Artificial Sequence
  chemically synthesized
aagtccataattagattgtg

SEQ ID NO: 527973 - DNA, 20 bp, Artificial Sequence
  chemically synthesized
gacaatattttagttggtcc

SEQ ID NO: 527974 - DNA, 20 bp, Artificial Sequence
  chemically synthesized
tgctttttccttcttaaaag

SEQ ID NO: 527975 - DNA, 20 bp, Artificial Sequence
  chemically synthesized
tcttaaaagatggattatat

SEQ ID NO: 527976 - DNA, 20 bp, Artificial Sequence
  chemically synthesized
gatggattatatgagaatgg

SEQ ID NO: 527977 - DNA, 20 bp, Artificial Sequence
  chemically synthesized
atatgagaatgggaggataa

SEQ ID NO: 527978 - DNA, 20 bp, Artificial Sequence
  chemically synthesized
gtgaaatttcccacatgagc

SEQ ID NO: 527979 - DNA, 20 bp, Artificial Sequence
  chemically synthesized
aaagagataaataattgttt

SEQ ID NO: 527980 - DNA, 20 bp, Artificial Sequence
  chemically synthesized
aatgccttagagaaaacaat

SEQ ID NO: 527981 - DNA, 20 bp, Artificial Sequence
  chemically synthesized
agaaaacaatctgagtttga

SEQ ID NO: 527982 - DNA, 20 bp, Artificial Sequence
  chemically synthesized
agtgacttttataaatctat

SEQ ID NO: 527983 - DNA, 20 bp, Artificial Sequence
  chemically synthesized
atttataaaagtcactaatt

SEQ ID NO: 527984 - DNA, 20 bp, Artificial Sequence
  chemically synthesized
ttttaatatatttttaaatc

SEQ ID NO: 527985 - DNA, 20 bp, Artificial Sequence
  chemically synthesized
ttaaagcacttcagaagaca

SEQ ID NO: 527986 - DNA, 20 bp, Artificial Sequence
  chemically synthesized
aagacacaggattaagcaat

SEQ ID NO: 527987 - DNA, 20 bp, Artificial Sequence
  chemically synthesized
tctaaaacagggtcagcctg

SEQ ID NO: 527988 - DNA, 20 bp, Artificial Sequence
  chemically synthesized
caatatttcttgctctaaaa

SEQ ID NO: 527989 - DNA, 20 bp, Artificial Sequence
  chemically synthesized
cttacaatgcatttatcaat

SEQ ID NO: 527990 - DNA, 20 bp, Artificial Sequence
  chemically synthesized
gtatttggtcccactgatga

SEQ ID NO: 527991 - DNA, 20 bp, Artificial Sequence
  chemically synthesized
ctctgtatttggtcccactg

SEQ ID NO: 527992 - DNA, 20 bp, Artificial Sequence
  chemically synthesized
aaaatacaaaaacacagttt

SEQ ID NO: 527993 - DNA, 20 bp, Artificial Sequence
  chemically synthesized
gcgtactttaaatcagccac

SEQ ID NO: 527994 - DNA, 20 bp, Artificial Sequence
  chemically synthesized
aaaagtaactatggtaacaa

SEQ ID NO: 527995 - DNA, 20 bp, Artificial Sequence
  chemically synthesized
aaggagacaattcacaaaag

SEQ ID NO: 527996 - DNA, 20 bp, Artificial Sequence
  chemically synthesized
tttagtaggactctcctttt

SEQ ID NO: 527997 - DNA, 20 bp, Artificial Sequence
  chemically synthesized
ctactaaagatgcagtgtaa

SEQ ID NO: 527998 - DNA, 20 bp, Artificial Sequence
  chemically synthesized
gtaaaagagtttttacagtc

SEQ ID NO: 527999 - DNA, 20 bp, Artificial Sequence
  chemically synthesized
aaacaacagtatagacagag

SEQ ID NO: 528000 - DNA, 20 bp, Artificial Sequence
  chemically synthesized
acaaaataaccctgtagcat

SEQ ID NO: 528001 - DNA, 20 bp, Artificial Sequence
  chemically synthesized
aattttgcatccaaatgcta

SEQ ID NO: 528002 - DNA, 20 bp, Artificial Sequence
  chemically synthesized
ttgggaagctcaaagactga

SEQ ID NO: 528003 - DNA, 20 bp, Artificial Sequence
  chemically synthesized
aagtattaaacggaaataat

SEQ ID NO: 528004 - DNA, 20 bp, Artificial Sequence
  chemically synthesized
gatgtatcattttagcagca

SEQ ID NO: 528005 - DNA, 20 bp, Artificial Sequence
  chemically synthesized
ttttctttcctgctgtatat

SEQ ID NO: 528006 - DNA, 20 bp, Artificial Sequence
  chemically synthesized
tcctgctgtatatatgaatt

SEQ ID NO: 528007 - DNA, 20 bp, Artificial Sequence
  chemically synthesized
tgaagcatacattaccgtgg

SEQ ID NO: 528008 - DNA, 20 bp, Artificial Sequence
  chemically synthesized
tttgaaaaatagtcaaggat

SEQ ID NO: 528009 - DNA, 20 bp, Artificial Sequence
  chemically synthesized
ttctgttttgaaaaatagtc

SEQ ID NO: 528010 - DNA, 20 bp, Artificial Sequence
  chemically synthesized
aagtggtgggctaattacac

SEQ ID NO: 528011 - DNA, 20 bp, Artificial Sequence
  chemically synthesized
acgtattcctcttagaaagg

SEQ ID NO: 528012 - DNA, 20 bp, Artificial Sequence
  chemically synthesized
tttaactcaccctttctaag

SEQ ID NO: 528013 - DNA, 20 bp, Artificial Sequence
  chemically synthesized
aattacgtattcctcttaga

SEQ ID NO: 528014 - DNA, 20 bp, Artificial Sequence
  chemically synthesized
gctgttatgtaacttttttt

SEQ ID NO: 528015 - DNA, 20 bp, Artificial Sequence
  chemically synthesized
tgttccttaaccagactgac

SEQ ID NO: 528016 - DNA, 20 bp, Artificial Sequence
  chemically synthesized
acagaaaaggcacagcacat

SEQ ID NO: 528017 - DNA, 20 bp, Artificial Sequence
  chemically synthesized
atatatgatagtctattaac

SEQ ID NO: 528018 - DNA, 20 bp, Artificial Sequence
  chemically synthesized
tcctcaggctatggaggaga

SEQ ID NO: 528019 - DNA, 20 bp, Artificial Sequence
  chemically synthesized
tattaactgtctatgtaata

SEQ ID NO: 528020 - DNA, 20 bp, Artificial Sequence
  chemically synthesized
aacaatcacttgttaaatgt

SEQ ID NO: 528021 - DNA, 20 bp, Artificial Sequence
  chemically synthesized
gaaataatctttatcaccac

SEQ ID NO: 528022 - DNA, 20 bp, Artificial Sequence
  chemically synthesized
ctatcttcacatgctgtcat

SEQ ID NO: 528023 - DNA, 20 bp, Artificial Sequence
  chemically synthesized
atttctttcccctacaatca

SEQ ID NO: 528024 - DNA, 20 bp, Artificial Sequence
  chemically synthesized
gaaatattgcaaaacagaga

SEQ ID NO: 528025 - DNA, 20 bp, Artificial Sequence
  chemically synthesized
aaaatcgtacgcaggcaaga

SEQ ID NO: 528026 - DNA, 20 bp, Artificial Sequence
  chemically synthesized
tttatttattttgcccttta

SEQ ID NO: 528027 - DNA, 20 bp, Artificial Sequence
  chemically synthesized
agcgagaaatcatagaccag

SEQ ID NO: 528028 - DNA, 20 bp, Artificial Sequence
  chemically synthesized
cgacatcaacttggcaaaac

SEQ ID NO: 528029 - DNA, 20 bp, Artificial Sequence
  chemically synthesized
tcaatagctgaaacagatgc

SEQ ID NO: 528030 - DNA, 20 bp, Artificial Sequence
  chemically synthesized
aaatatatcaatatctcctg

SEQ ID NO: 528031 - DNA, 20 bp, Artificial Sequence
  chemically synthesized
tatattttcttcatataatg

SEQ ID NO: 528032 - DNA, 20 bp, Artificial Sequence
  chemically synthesized
cttcatataatgcagaatga

SEQ ID NO: 528033 - DNA, 20 bp, Artificial Sequence
  chemically synthesized
tacttggtttctattttata

SEQ ID NO: 528034 - DNA, 20 bp, Artificial Sequence
  chemically synthesized
aatgagaatgtacagaatgt

SEQ ID NO: 528035 - DNA, 20 bp, Artificial Sequence
  chemically synthesized
gtgagagaaatgagaatgta

SEQ ID NO: 528036 - DNA, 20 bp, Artificial Sequence
  chemically synthesized
attcagacagtgagagaaat

SEQ ID NO: 528037 - DNA, 20 bp, Artificial Sequence
  chemically synthesized
attctcatttctctcactgt

SEQ ID NO: 528038 - DNA, 20 bp, Artificial Sequence
  chemically synthesized
taaattgcatataactaatc

SEQ ID NO: 528039 - DNA, 20 bp, Artificial Sequence
  chemically synthesized
tttagaataaagtattgttc

SEQ ID NO: 528040 - DNA, 20 bp, Artificial Sequence
  chemically synthesized
aaatcagtgttagaagattt

SEQ ID NO: 528041 - DNA, 20 bp, Artificial Sequence
  chemically synthesized
caacctcaggaaaacacttc

SEQ ID NO: 528042 - DNA, 20 bp, Artificial Sequence
  chemically synthesized
gctgcgttagattttgggga

SEQ ID NO: 528043 - DNA, 20 bp, Artificial Sequence
  chemically synthesized
aacagtgttgcttttacaga

SEQ ID NO: 528044 - DNA, 20 bp, Artificial Sequence
  chemically synthesized
tgcaaacagtgttgctttta

SEQ ID NO: 528045 - DNA, 20 bp, Artificial Sequence
  chemically synthesized
tgtaaaagcaacactgtttg

SEQ ID NO: 528046 - DNA, 20 bp, Artificial Sequence
  chemically synthesized
aacaagcagctgttggtagc

SEQ ID NO: 528047 - DNA, 20 bp, Artificial Sequence
  chemically synthesized
aaaacagctggcatggaagg

SEQ ID NO: 528048 - DNA, 20 bp, Artificial Sequence
  chemically synthesized
cagccaacttattggcatga

SEQ ID NO: 528049 - DNA, 20 bp, Artificial Sequence
  chemically synthesized
gaatgctttcaggaagatga

SEQ ID NO: 528050 - DNA, 20 bp, Artificial Sequence
  chemically synthesized
ttcccagcagtcggcagtaa

SEQ ID NO: 528051 - DNA, 20 bp, Artificial Sequence
  chemically synthesized
ctgggaaccagaaagtctat

SEQ ID NO: 528052 - DNA, 20 bp, Artificial Sequence
  chemically synthesized
tcatgcgaaaggggagctgt

SEQ ID NO: 528053 - DNA, 20 bp, Artificial Sequence
  chemically synthesized
gcatgcccacctaacctaac

SEQ ID NO: 528054 - DNA, 20 bp, Artificial Sequence
  chemically synthesized
gctgcataataaatgactga

SEQ ID NO: 528055 - DNA, 20 bp, Artificial Sequence
  chemically synthesized
cgactgacgtatcagatagt

SEQ ID NO: 528056 - DNA, 20 bp, Artificial Sequence
  chemically synthesized
tccactgttttttaggcagg

SEQ ID NO: 528057 - DNA, 20 bp, Artificial Sequence
  chemically synthesized
ttcttcctgcctaaaaaaca

SEQ ID NO: 528058 - DNA, 20 bp, Artificial Sequence
  chemically synthesized
ctttgcatctgtacagaaga

SEQ ID NO: 528059 - DNA, 20 bp, Artificial Sequence
  chemically synthesized
tctgtacagatgcaaagcct

SEQ ID NO: 528060 - DNA, 20 bp, Artificial Sequence
  chemically synthesized
tttcctaagtgtaacaatag

SEQ ID NO: 528061 - DNA, 20 bp, Artificial Sequence
  chemically synthesized
aaatcagccaaaatttcagt

SEQ ID NO: 528062 - DNA, 20 bp, Artificial Sequence
  chemically synthesized
acttatcttcacagcctttt

SEQ ID NO: 528063 - DNA, 20 bp, Artificial Sequence
  chemically synthesized
ttaagggtaaaaactctctt

SEQ ID NO: 528064 - DNA, 20 bp, Artificial Sequence
  chemically synthesized
tgcaaaagtacaattcagaa

SEQ ID NO: 528065 - DNA, 20 bp, Artificial Sequence
  chemically synthesized
atagcatgcactttctcaaa

SEQ ID NO: 528066 - DNA, 20 bp, Artificial Sequence
  chemically synthesized
tcttatttgaaaatttgcta

SEQ ID NO: 528067 - DNA, 20 bp, Artificial Sequence
  chemically synthesized
tatagcaaattttcaaataa

SEQ ID NO: 528068 - DNA, 20 bp, Artificial Sequence
  chemically synthesized
ctacccttgggagaagcata

SEQ ID NO: 528069 - DNA, 20 bp, Artificial Sequence
  chemically synthesized
gcaccctgtatgcttctccc

SEQ ID NO: 528070 - DNA, 20 bp, Artificial Sequence
  chemically synthesized
acttgatattttgactttag

SEQ ID NO: 528071 - DNA, 20 bp, Artificial Sequence
  chemically synthesized
aaagtaagaaattagattag

SEQ ID NO: 528072 - DNA, 20 bp, Artificial Sequence
  chemically synthesized
aaaatacaaaatgcattttc

SEQ ID NO: 528073 - DNA, 20 bp, Artificial Sequence
  chemically synthesized
gtattttaaaaatactaatc

SEQ ID NO: 528074 - DNA, 20 bp, Artificial Sequence
  chemically synthesized
tgtttactttttgtggtagg

SEQ ID NO: 528075 - DNA, 20 bp, Artificial Sequence
  chemically synthesized
agttacattatgaaactata

SEQ ID NO: 528076 - DNA, 20 bp, Artificial Sequence
  chemically synthesized
gcatatttcacatatgctaa

SEQ ID NO: 528077 - DNA, 20 bp, Artificial Sequence
  chemically synthesized
cccttaggaaaacactattt

SEQ ID NO: 528078 - DNA, 20 bp, Artificial Sequence
  chemically synthesized
tctgaaatagtgttttccta

SEQ ID NO: 528079 - DNA, 20 bp, Artificial Sequence
  chemically synthesized
aagtagaatagctaaaatgt

SEQ ID NO: 528080 - DNA, 20 bp, Artificial Sequence
  chemically synthesized
atacaaaaatcaaatggaag

SEQ ID NO: 528081 - DNA, 20 bp, Artificial Sequence
  chemically synthesized
ttgtgtatatcttgatatat

SEQ ID NO: 528082 - DNA, 20 bp, Artificial Sequence
  chemically synthesized
aaataaacctgaaagataag

SEQ ID NO: 528083 - DNA, 20 bp, Artificial Sequence
  chemically synthesized
gaaagataagttgagtccat

SEQ ID NO: 528084 - DNA, 20 bp, Artificial Sequence
  chemically synthesized
attattttagagaaatcttg

SEQ ID NO: 528085 - DNA, 20 bp, Artificial Sequence
  chemically synthesized
ccagtattttcagagttgtg

SEQ ID NO: 528086 - DNA, 20 bp, Artificial Sequence
  chemically synthesized
aattgatataccagtatttt

SEQ ID NO: 528087 - DNA, 20 bp, Artificial Sequence
  chemically synthesized
gcatatctattttagagatt

SEQ ID NO: 528088 - DNA, 20 bp, Artificial Sequence
  chemically synthesized
tggagaggctagtagaagcc

SEQ ID NO: 528089 - DNA, 20 bp, Artificial Sequence
  chemically synthesized
gtataaagaggaagagaggc

SEQ ID NO: 528090 - DNA, 20 bp, Artificial Sequence
  chemically synthesized
aaatagaagtccattgtggc

SEQ ID NO: 528091 - DNA, 20 bp, Artificial Sequence
  chemically synthesized
ggaaaatatctgaaacagga

SEQ ID NO: 528092 - DNA, 20 bp, Artificial Sequence
  chemically synthesized
agacttatgaatagatgaaa

SEQ ID NO: 528093 - DNA, 20 bp, Artificial Sequence
  chemically synthesized
acaagcctcaagacagactt

SEQ ID NO: 528094 - DNA, 20 bp, Artificial Sequence
  chemically synthesized
aagggtaaccatgtaagagg

SEQ ID NO: 528095 - DNA, 20 bp, Artificial Sequence
  chemically synthesized
aaaaaagggtaaccatgtaa

SEQ ID NO: 528096 - DNA, 20 bp, Artificial Sequence
  chemically synthesized
tatcaccaaatacacaaaaa

SEQ ID NO: 528097 - DNA, 20 bp, Artificial Sequence
  chemically synthesized
tatgcactaagagagtaatc

SEQ ID NO: 528098 - DNA, 20 bp, Artificial Sequence
  chemically synthesized
aacactacagtatgcactaa

SEQ ID NO: 528099 - DNA, 20 bp, Artificial Sequence
  chemically synthesized
agttctagagatctaatgtg

SEQ ID NO: 528100 - DNA, 20 bp, Artificial Sequence
  chemically synthesized
acagagttttcattatcagg

SEQ ID NO: 528101 - DNA, 20 bp, Artificial Sequence
  chemically synthesized
ggacacagagttttcattat

SEQ ID NO: 528102 - DNA, 20 bp, Artificial Sequence
  chemically synthesized
aagatattggtcaaaggaca

SEQ ID NO: 528103 - DNA, 20 bp, Artificial Sequence
  chemically synthesized
accaagggcagagggagggg

SEQ ID NO: 528104 - DNA, 20 bp, Artificial Sequence
  chemically synthesized
cagtcagctataaagaagca

SEQ ID NO: 528105 - DNA, 20 bp, Artificial Sequence
  chemically synthesized
tgaaataagccaggcatagg

SEQ ID NO: 528106 - DNA, 20 bp, Artificial Sequence
  chemically synthesized
atcctgctatttgtgataat

SEQ ID NO: 528107 - DNA, 20 bp, Artificial Sequence
  chemically synthesized
acccacattatcacaaatag

SEQ ID NO: 528108 - DNA, 20 bp, Artificial Sequence
  chemically synthesized
agccaaggcatgaaaacaac

SEQ ID NO: 528109 - DNA, 20 bp, Artificial Sequence
  chemically synthesized
gttttcatgccttggctatt

SEQ ID NO: 528110 - DNA, 20 bp, Artificial Sequence
  chemically synthesized
ctgcactcccatgttcagtg

SEQ ID NO: 528111 - DNA, 20 bp, Artificial Sequence
  chemically synthesized
aataactctgcactgaacat

SEQ ID NO: 528112 - DNA, 20 bp, Artificial Sequence
  chemically synthesized
tcctttttatatatacccaa

SEQ ID NO: 528113 - DNA, 20 bp, Artificial Sequence
  chemically synthesized
aggatcaaattaccactctt

SEQ ID NO: 528114 - DNA, 20 bp, Artificial Sequence
  chemically synthesized
aagttaaaatacgaatgccc

SEQ ID NO: 528115 - DNA, 20 bp, Artificial Sequence
  chemically synthesized
attcctcaaaaagttaaaat

SEQ ID NO: 528116 - DNA, 20 bp, Artificial Sequence
  chemically synthesized
attcgtattttaactttttg

SEQ ID NO: 528117 - DNA, 20 bp, Artificial Sequence
  chemically synthesized
aatccttatacattgttggc

SEQ ID NO: 528118 - DNA, 20 bp, Artificial Sequence
  chemically synthesized
cattcccgccaacaatgtat

SEQ ID NO: 528119 - DNA, 20 bp, Artificial Sequence
  chemically synthesized
tggcaagaatgtggataaaa

SEQ ID NO: 528120 - DNA, 20 bp, Artificial Sequence
  chemically synthesized
taacaagttttggcaagaat

SEQ ID NO: 528121 - DNA, 20 bp, Artificial Sequence
  chemically synthesized
aaaaaataacaagttttggc

SEQ ID NO: 528122 - DNA, 20 bp, Artificial Sequence
  chemically synthesized
aaatatcacctcaaacttgt

SEQ ID NO: 528123 - DNA, 20 bp, Artificial Sequence
  chemically synthesized
ccttgatgattagcgctttt

SEQ ID NO: 528124 - DNA, 20 bp, Artificial Sequence
  chemically synthesized
attaaaaatggtcaaagccc

SEQ ID NO: 528125 - DNA, 20 bp, Artificial Sequence
  chemically synthesized
ttgtgtgttttgcttgagct

SEQ ID NO: 528126 - DNA, 20 bp, Artificial Sequence
  chemically synthesized
ctctgagttcctcatatatt

SEQ ID NO: 528127 - DNA, 20 bp, Artificial Sequence
  chemically synthesized
aagagacaactgtggaatgg

SEQ ID NO: 528128 - DNA, 20 bp, Artificial Sequence
  chemically synthesized
acagagtgaagagacaactg

SEQ ID NO: 528129 - DNA, 20 bp, Artificial Sequence
  chemically synthesized
acagcataggaaacaattaa

SEQ ID NO: 528130 - DNA, 20 bp, Artificial Sequence
  chemically synthesized
tcattgccaagaccaatttc

SEQ ID NO: 528131 - DNA, 20 bp, Artificial Sequence
  chemically synthesized
tttttcatgcactttcttct

SEQ ID NO: 528132 - DNA, 20 bp, Artificial Sequence
  chemically synthesized
agtcagctaaaaattgatta

SEQ ID NO: 528133 - DNA, 20 bp, Artificial Sequence
  chemically synthesized
tgacttttgttgtgtgatgt

SEQ ID NO: 528134 - DNA, 20 bp, Artificial Sequence
  chemically synthesized
aactggatatacacatgcta

SEQ ID NO: 528135 - DNA, 20 bp, Artificial Sequence
  chemically synthesized
aataaatggtgtttgaaaaa

SEQ ID NO: 528136 - DNA, 20 bp, Artificial Sequence
  chemically synthesized
ttcaaacaccatttattaaa

SEQ ID NO: 528137 - DNA, 20 bp, Artificial Sequence
  chemically synthesized
acaagagtacactatgagga

SEQ ID NO: 528138 - DNA, 20 bp, Artificial Sequence
  chemically synthesized
taaattttgagaagggcaac

SEQ ID NO: 528139 - DNA, 20 bp, Artificial Sequence
  chemically synthesized
caaaatttagttgaccatat

SEQ ID NO: 528140 - DNA, 20 bp, Artificial Sequence
  chemically synthesized
atttagttgaccatatatga

SEQ ID NO: 528141 - DNA, 20 bp, Artificial Sequence
  chemically synthesized
agacatatagaccaatgcaa

SEQ ID NO: 528142 - DNA, 20 bp, Artificial Sequence
  chemically synthesized
aggtatcacacttcctgatt

SEQ ID NO: 528143 - DNA, 20 bp, Artificial Sequence
  chemically synthesized
atagccaaagcaatcttgag

SEQ ID NO: 528144 - DNA, 20 bp, Artificial Sequence
  chemically synthesized
aaatgaaacaacaaaagaaa

SEQ ID NO: 528145 - DNA, 20 bp, Artificial Sequence
  chemically synthesized
tctttcttttgttgtttcat

SEQ ID NO: 528146 - DNA, 20 bp, Artificial Sequence
  chemically synthesized
gcattttgatagaggttgtg

SEQ ID NO: 528147 - DNA, 20 bp, Artificial Sequence
  chemically synthesized
tgctgaatctgtaaattgct

SEQ ID NO: 528148 - DNA, 20 bp, Artificial Sequence
  chemically synthesized
gttctgtgttcatggactag

SEQ ID NO: 528149 - DNA, 20 bp, Artificial Sequence
  chemically synthesized
attttaaaagacgcaaataa

SEQ ID NO: 528150 - DNA, 20 bp, Artificial Sequence
  chemically synthesized
gcctcggcctcacaaagtgc

SEQ ID NO: 528151 - DNA, 20 bp, Artificial Sequence
  chemically synthesized
actttgtgaggccgaggcag

SEQ ID NO: 528152 - DNA, 20 bp, Artificial Sequence
  chemically synthesized
caggtgaatcaccttaggtg

SEQ ID NO: 528153 - DNA, 20 bp, Artificial Sequence
  chemically synthesized
ttctgtatttttagtagaga

SEQ ID NO: 528154 - DNA, 20 bp, Artificial Sequence
  chemically synthesized
gcctcagcctcccgagtagc

SEQ ID NO: 528155 - DNA, 20 bp, Artificial Sequence
  chemically synthesized
gattctcctgcctcagcctc

SEQ ID NO: 528156 - DNA, 20 bp, Artificial Sequence
  chemically synthesized
tactcgggaggctgaggcag

SEQ ID NO: 528157 - DNA, 20 bp, Artificial Sequence
  chemically synthesized
ctcactgcaacctccatctt

SEQ ID NO: 528158 - DNA, 20 bp, Artificial Sequence
  chemically synthesized
cccaggctggagtgcaatga

SEQ ID NO: 528159 - DNA, 20 bp, Artificial Sequence
  chemically synthesized
tctggctctgtcgcccaggc

SEQ ID NO: 528160 - DNA, 20 bp, Artificial Sequence
  chemically synthesized
ttttttttttttttttgaga

SEQ ID NO: 528161 - DNA, 20 bp, Artificial Sequence
  chemically synthesized
atcatcaggaagaataaaag

SEQ ID NO: 528162 - DNA, 20 bp, Artificial Sequence
  chemically synthesized
tcatttacagtatcatcagg

SEQ ID NO: 528163 - DNA, 20 bp, Artificial Sequence
  chemically synthesized
taagtgccattaacagataa

SEQ ID NO: 528164 - DNA, 20 bp, Artificial Sequence
  chemically synthesized
acacacaacggaacacacaa

SEQ ID NO: 528165 - DNA, 20 bp, Artificial Sequence
  chemically synthesized
ggtaagttttttttatataa

SEQ ID NO: 528166 - DNA, 20 bp, Artificial Sequence
  chemically synthesized
aacttaccatttgcaacaac

SEQ ID NO: 528167 - DNA, 20 bp, Artificial Sequence
  chemically synthesized
aattattttagctcccacat

SEQ ID NO: 528168 - DNA, 20 bp, Artificial Sequence
  chemically synthesized
taattgatctcatggaggta

SEQ ID NO: 528169 - DNA, 20 bp, Artificial Sequence
  chemically synthesized
gagaagggaagtgaagagaa

SEQ ID NO: 528170 - DNA, 20 bp, Artificial Sequence
  chemically synthesized
tgaagagaaggggatgaaga

SEQ ID NO: 528171 - DNA, 20 bp, Artificial Sequence
  chemically synthesized
ggatgaagagaggatagtta

SEQ ID NO: 528172 - DNA, 20 bp, Artificial Sequence
  chemically synthesized
cctactatgctctcaaacac

SEQ ID NO: 528173 - DNA, 20 bp, Artificial Sequence
  chemically synthesized
gtagggcagctatagttaac

SEQ ID NO: 528174 - DNA, 20 bp, Artificial Sequence
  chemically synthesized
aattgccagaagagaagatt

SEQ ID NO: 528175 - DNA, 20 bp, Artificial Sequence
  chemically synthesized
aatgatcgaatcaaggtgat

SEQ ID NO: 528176 - DNA, 20 bp, Artificial Sequence
  chemically synthesized
atacatacaatgtgtaatga

SEQ ID NO: 528177 - DNA, 20 bp, Artificial Sequence
  chemically synthesized
tacacattgtatgtatatat

SEQ ID NO: 528178 - DNA, 20 bp, Artificial Sequence
  chemically synthesized
attgatacattacacattta

SEQ ID NO: 528179 - DNA, 20 bp, Artificial Sequence
  chemically synthesized
ttttgtatctagcaatttta

SEQ ID NO: 528180 - DNA, 20 bp, Artificial Sequence
  chemically synthesized
aaatttgtcagaactaatca

SEQ ID NO: 528181 - DNA, 20 bp, Artificial Sequence
  chemically synthesized
tcattagggctttctacata

SEQ ID NO: 528182 - DNA, 20 bp, Artificial Sequence
  chemically synthesized
gagaaagaaataaaaggcag

SEQ ID NO: 528183 - DNA, 20 bp, Artificial Sequence
  chemically synthesized
tgaacagaagtgttgatcat

SEQ ID NO: 528184 - DNA, 20 bp, Artificial Sequence
  chemically synthesized
tctaagatctggtacaatgc

SEQ ID NO: 528185 - DNA, 20 bp, Artificial Sequence
  chemically synthesized
cgttggttacaatgttagct

SEQ ID NO: 528186 - DNA, 20 bp, Artificial Sequence
  chemically synthesized
aactgtcaacaaaataagtg

SEQ ID NO: 528187 - DNA, 20 bp, Artificial Sequence
  chemically synthesized
tgacagttttcaatttaccc

SEQ ID NO: 528188 - DNA, 20 bp, Artificial Sequence
  chemically synthesized
aaaaagttcaacatgtattc

SEQ ID NO: 528189 - DNA, 20 bp, Artificial Sequence
  chemically synthesized
aatgtgatatatcacataaa

SEQ ID NO: 528190 - DNA, 20 bp, Artificial Sequence
  chemically synthesized
gattatataccatgatcagg

SEQ ID NO: 528191 - DNA, 20 bp, Artificial Sequence
  chemically synthesized
caaattcaacagtacatcaa

SEQ ID NO: 528192 - DNA, 20 bp, Artificial Sequence
  chemically synthesized
ataatccttttgatgtactg

SEQ ID NO: 528193 - DNA, 20 bp, Artificial Sequence
  chemically synthesized
tgttttgctagtattttatt

SEQ ID NO: 528194 - DNA, 20 bp, Artificial Sequence
  chemically synthesized
tagtattttattgaggattt

SEQ ID NO: 528195 - DNA, 20 bp, Artificial Sequence
  chemically synthesized
atttttggatctatacacat

SEQ ID NO: 528196 - DNA, 20 bp, Artificial Sequence
  chemically synthesized
acaataaaagaacactacag

SEQ ID NO: 528197 - DNA, 20 bp, Artificial Sequence
  chemically synthesized
tttgagagtagcttttgtgt

SEQ ID NO: 528198 - DNA, 20 bp, Artificial Sequence
  chemically synthesized
aatggctttgctactgtggg

SEQ ID NO: 528199 - DNA, 20 bp, Artificial Sequence
  chemically synthesized
gcaaaatgtgtgtttgtttg

SEQ ID NO: 528200 - DNA, 20 bp, Artificial Sequence
  chemically synthesized
cttggcacacactagaagag

SEQ ID NO: 528201 - DNA, 20 bp, Artificial Sequence
  chemically synthesized
cccttgacatccacacatac

SEQ ID NO: 528202 - DNA, 20 bp, Artificial Sequence
  chemically synthesized
agatgagatgatccatctca

SEQ ID NO: 528203 - DNA, 20 bp, Artificial Sequence
  chemically synthesized
gccctagctgcaaaggaagc

SEQ ID NO: 528204 - DNA, 20 bp, Artificial Sequence
  chemically synthesized
agcttcctttgcagctaggg

SEQ ID NO: 528205 - DNA, 20 bp, Artificial Sequence
  chemically synthesized
tcacaactggttctggggaa

SEQ ID NO: 528206 - DNA, 20 bp, Artificial Sequence
  chemically synthesized
gaggatgcatgagtgagtag

SEQ ID NO: 528207 - DNA, 20 bp, Artificial Sequence
  chemically synthesized
atcctcttagatggtgacat

SEQ ID NO: 528208 - DNA, 20 bp, Artificial Sequence
  chemically synthesized
agttcatactttgcttctca

SEQ ID NO: 528209 - DNA, 20 bp, Artificial Sequence
  chemically synthesized
gcacaaatgaaatgatgtaa

SEQ ID NO: 528210 - DNA, 20 bp, Artificial Sequence
  chemically synthesized
caatattgtttgttatagca

SEQ ID NO: 528211 - DNA, 20 bp, Artificial Sequence
  chemically synthesized
aaatattatacagctataaa

SEQ ID NO: 528212 - DNA, 20 bp, Artificial Sequence
  chemically synthesized
tatacagctataaaaaagaa

SEQ ID NO: 528213 - DNA, 20 bp, Artificial Sequence
  chemically synthesized
tttaaatttaaatatggact

SEQ ID NO: 528214 - DNA, 20 bp, Artificial Sequence
  chemically synthesized
taaggtgcataactgggtgc

SEQ ID NO: 528215 - DNA, 20 bp, Artificial Sequence
  chemically synthesized
ctgcttatataataattaat

SEQ ID NO: 528216 - DNA, 20 bp, Artificial Sequence
  chemically synthesized
agaccctctggaagactaaa

SEQ ID NO: 528217 - DNA, 20 bp, Artificial Sequence
  chemically synthesized
tatgagtaaaaaactataat

SEQ ID NO: 528218 - DNA, 20 bp, Artificial Sequence
  chemically synthesized
ctccagagctaatgtgtcta

SEQ ID NO: 528219 - DNA, 20 bp, Artificial Sequence
  chemically synthesized
cactctatttacctctgatt

SEQ ID NO: 528220 - DNA, 20 bp, Artificial Sequence
  chemically synthesized
agttttaaaaatccttgggt

SEQ ID NO: 528221 - DNA, 20 bp, Artificial Sequence
  chemically synthesized
tttttccttcataattttca

SEQ ID NO: 528222 - DNA, 20 bp, Artificial Sequence
  chemically synthesized
ttttgaaaattatgaaggaa

SEQ ID NO: 528223 - DNA, 20 bp, Artificial Sequence
  chemically synthesized
gaaaattatgaaggaaaaag

SEQ ID NO: 528224 - DNA, 20 bp, Artificial Sequence
  chemically synthesized
aagaaagaattataaaggaa

SEQ ID NO: 528225 - DNA, 20 bp, Artificial Sequence
  chemically synthesized
caccccaaaaccaaagtgag

SEQ ID NO: 528226 - DNA, 20 bp, Artificial Sequence
  chemically synthesized
atgaatgatttaaaaatcaa

SEQ ID NO: 528227 - DNA, 20 bp, Artificial Sequence
  chemically synthesized
caaaaattgctcaaaaaaga

SEQ ID NO: 528228 - DNA, 20 bp, Artificial Sequence
  chemically synthesized
cacacaggtttgtaagtaag

SEQ ID NO: 528229 - DNA, 20 bp, Artificial Sequence
  chemically synthesized
acctgtgtggaactactcgc

SEQ ID NO: 528230 - DNA, 20 bp, Artificial Sequence
  chemically synthesized
accttctgatgttcacaagg

SEQ ID NO: 528231 - DNA, 20 bp, Artificial Sequence
  chemically synthesized
cagtggaaagttgtttaaaa

SEQ ID NO: 528232 - DNA, 20 bp, Artificial Sequence
  chemically synthesized
tccaggcttacctgcttggt

SEQ ID NO: 528233 - DNA, 20 bp, Artificial Sequence
  chemically synthesized
ttcatgtcacatcctaatag

SEQ ID NO: 528234 - DNA, 20 bp, Artificial Sequence
  chemically synthesized
aatgttcatgtcacatccta

SEQ ID NO: 528235 - DNA, 20 bp, Artificial Sequence
  chemically synthesized
aaaatggaaaaagtcagtct

SEQ ID NO: 528236 - DNA, 20 bp, Artificial Sequence
  chemically synthesized
cttatctttaatatgcaaaa

SEQ ID NO: 528237 - DNA, 20 bp, Artificial Sequence
  chemically synthesized
taaaaatttataacagttat

SEQ ID NO: 528238 - DNA, 20 bp, Artificial Sequence
  chemically synthesized
acccaaaatgcgttccatat

SEQ ID NO: 528239 - DNA, 20 bp, Artificial Sequence
  chemically synthesized
gcaattgtacaaaaaagtta

SEQ ID NO: 528240 - DNA, 20 bp, Artificial Sequence
  chemically synthesized
ttaacaaaacaataacagac

SEQ ID NO: 528241 - DNA, 20 bp, Artificial Sequence
  chemically synthesized
gattagacagtaagagttta

SEQ ID NO: 528242 - DNA, 20 bp, Artificial Sequence
  chemically synthesized
tcatgacagatgaagaagga

SEQ ID NO: 528243 - DNA, 20 bp, Artificial Sequence
  chemically synthesized
cattgtgtcctggaaaacaa

SEQ ID NO: 528244 - DNA, 20 bp, Artificial Sequence
  chemically synthesized
gtgtcctggaaaacaaagag

SEQ ID NO: 528245 - DNA, 20 bp, Artificial Sequence
  chemically synthesized
ggaatgatttcccaaatggc

SEQ ID NO: 528246 - DNA, 20 bp, Artificial Sequence
  chemically synthesized
agcttctgtgttgtcttcac

SEQ ID NO: 528247 - DNA, 20 bp, Artificial Sequence
  chemically synthesized
cccaatgtaaatatatatca

SEQ ID NO: 528248 - DNA, 20 bp, Artificial Sequence
  chemically synthesized
catggaatattcctgttctg

SEQ ID NO: 528249 - DNA, 20 bp, Artificial Sequence
  chemically synthesized
ttcaacccaagtaaaagcag

SEQ ID NO: 528250 - DNA, 20 bp, Artificial Sequence
  chemically synthesized
aacatttgaattaggaaacc

SEQ ID NO: 528251 - DNA, 20 bp, Artificial Sequence
  chemically synthesized
tagcacgaatctcccagcac

SEQ ID NO: 528252 - DNA, 20 bp, Artificial Sequence
  chemically synthesized
atacaaacttggtcacctta

SEQ ID NO: 528253 - DNA, 20 bp, Artificial Sequence
  chemically synthesized
tttttgtgctttattagtgc

SEQ ID NO: 528254 - DNA, 20 bp, Artificial Sequence
  chemically synthesized
catggagtattaattatatt

SEQ ID NO: 528255 - DNA, 20 bp, Artificial Sequence
  chemically synthesized
cttcctgtggtttttatggc

SEQ ID NO: 528256 - DNA, 20 bp, Artificial Sequence
  chemically synthesized
ctatagtcacatgtgggcca

SEQ ID NO: 528257 - DNA, 20 bp, Artificial Sequence
  chemically synthesized
gtatgtagtccacctagtag

SEQ ID NO: 528258 - DNA, 20 bp, Artificial Sequence
  chemically synthesized
acaaaacatcaacgaaaagg

SEQ ID NO: 528259 - DNA, 20 bp, Artificial Sequence
  chemically synthesized
tcccctagcacacagcctaa

SEQ ID NO: 528260 - DNA, 20 bp, Artificial Sequence
  chemically synthesized
cttatgcttcttgagagact

SEQ ID NO: 528261 - DNA, 20 bp, Artificial Sequence
  chemically synthesized
tcggagtgtgcatggcacat

SEQ ID NO: 528262 - DNA, 20 bp, Artificial Sequence
  chemically synthesized
ttcactaaatacctgcttta

SEQ ID NO: 528263 - DNA, 20 bp, Artificial Sequence
  chemically synthesized
aaaaactccatggaaagaaa

SEQ ID NO: 528264 - DNA, 20 bp, Artificial Sequence
  chemically synthesized
tctaatgaaaaactccatgg

SEQ ID NO: 528265 - DNA, 20 bp, Artificial Sequence
  chemically synthesized
catggagtttttcattagat

SEQ ID NO: 528266 - DNA, 20 bp, Artificial Sequence
  chemically synthesized
tttttacaaactactgccct

SEQ ID NO: 528267 - DNA, 20 bp, Artificial Sequence
  chemically synthesized
gactgcactgtgacatgact

SEQ ID NO: 528268 - DNA, 20 bp, Artificial Sequence
  chemically synthesized
atgagattgtaattttgact

SEQ ID NO: 528269 - DNA, 20 bp, Artificial Sequence
  chemically synthesized
tcaccttcaggcacaaggtg

SEQ ID NO: 528270 - DNA, 20 bp, Artificial Sequence
  chemically synthesized
ggtgacagaaaactatgtct

SEQ ID NO: 528271 - DNA, 20 bp, Artificial Sequence
  chemically synthesized
cctttgtgttcaataatcct

SEQ ID NO: 528272 - DNA, 20 bp, Artificial Sequence
  chemically synthesized
attgaggtcttggatctttg

SEQ ID NO: 528273 - DNA, 20 bp, Artificial Sequence
  chemically synthesized
ttcagagattaaattataga

SEQ ID NO: 528274 - DNA, 20 bp, Artificial Sequence
  chemically synthesized
cagacaagtttccagaagcc

SEQ ID NO: 528275 - DNA, 20 bp, Artificial Sequence
  chemically synthesized
gtttcactcacaaatgaatt

SEQ ID NO: 528276 - DNA, 20 bp, Artificial Sequence
  chemically synthesized
tttattcattttaacttttt

SEQ ID NO: 528277 - DNA, 20 bp, Artificial Sequence
  chemically synthesized
attttaaggggcacttacca

SEQ ID NO: 528278 - DNA, 20 bp, Artificial Sequence
  chemically synthesized
gagggaatggtaggctggga

SEQ ID NO: 528279 - DNA, 20 bp, Artificial Sequence
  chemically synthesized
ggcactggcacagacacact

SEQ ID NO: 528280 - DNA, 20 bp, Artificial Sequence
  chemically synthesized
ccatcctgttgctaaggaat

SEQ ID NO: 528281 - DNA, 20 bp, Artificial Sequence
  chemically synthesized
aaaatcaaggttgtctttac

SEQ ID NO: 528282 - DNA, 20 bp, Artificial Sequence
  chemically synthesized
aaaatgttcgctaaaatggg

SEQ ID NO: 528283 - DNA, 20 bp, Artificial Sequence
  chemically synthesized
gagagaaagagcgtaggaac

SEQ ID NO: 528284 - DNA, 20 bp, Artificial Sequence
  chemically synthesized
agcaaaatgaagtcatccca

SEQ ID NO: 528285 - DNA, 20 bp, Artificial Sequence
  chemically synthesized
aataaaaactaagggcgctg

SEQ ID NO: 528286 - DNA, 20 bp, Artificial Sequence
  chemically synthesized
atgctaaggtcctggaagtg

SEQ ID NO: 528287 - DNA, 20 bp, Artificial Sequence
  chemically synthesized
gacaagactggggttgggag

SEQ ID NO: 528288 - DNA, 20 bp, Artificial Sequence
  chemically synthesized
ttttatgtttggcgtttgtg

SEQ ID NO: 528289 - DNA, 20 bp, Artificial Sequence
  chemically synthesized
tcctctctctattattaaag

SEQ ID NO: 528290 - DNA, 20 bp, Artificial Sequence
  chemically synthesized
gagaggaagaggcagagata

SEQ ID NO: 528291 - DNA, 20 bp, Artificial Sequence
  chemically synthesized
tttttttttttttttccagc

SEQ ID NO: 528292 - DNA, 20 bp, Artificial Sequence
  chemically synthesized
aaaaaaaaaaaaaaaaaaaa

SEQ ID NO: 528293 - DNA, 20 bp, Artificial Sequence
  chemically synthesized
taaactggatgaaaactggc

SEQ ID NO: 528294 - DNA, 20 bp, Artificial Sequence
  chemically synthesized
tggatgaaaactggcacaga

SEQ ID NO: 528295 - DNA, 20 bp, Artificial Sequence
  chemically synthesized
acttaatgttaaaaaaagtc

SEQ ID NO: 528296 - DNA, 20 bp, Artificial Sequence
  chemically synthesized
ggctggactccatcctcttg

SEQ ID NO: 528297 - DNA, 20 bp, Artificial Sequence
  chemically synthesized
atgatgaaattggaggcatt

SEQ ID NO: 528298 - DNA, 20 bp, Artificial Sequence
  chemically synthesized
aattggaggcatttgagaaa

SEQ ID NO: 528299 - DNA, 20 bp, Artificial Sequence
  chemically synthesized
atttcaaaagtagactctga

SEQ ID NO: 528300 - DNA, 20 bp, Artificial Sequence
  chemically synthesized
ctatgataagtcataattgg

SEQ ID NO: 528301 - DNA, 20 bp, Artificial Sequence
  chemically synthesized
tttagtcttcttggagccac

SEQ ID NO: 528302 - DNA, 20 bp, Artificial Sequence
  chemically synthesized
ggtatggagctacgacacca

SEQ ID NO: 528303 - DNA, 20 bp, Artificial Sequence
  chemically synthesized
aggagagagggaagaaaaac

SEQ ID NO: 528304 - DNA, 20 bp, Artificial Sequence
  chemically synthesized
aagaaagagaaggagagagg

SEQ ID NO: 528305 - DNA, 20 bp, Artificial Sequence
  chemically synthesized
gagagaaggagaaagggagg

SEQ ID NO: 528306 - DNA, 20 bp, Artificial Sequence
  chemically synthesized
gaagagaggaagggagagaa

SEQ ID NO: 528307 - DNA, 20 bp, Artificial Sequence
  chemically synthesized
agctgaaaatctgatactcc

SEQ ID NO: 528308 - DNA, 20 bp, Artificial Sequence
  chemically synthesized
cctcaagccagggaaaagag

SEQ ID NO: 528309 - DNA, 20 bp, Artificial Sequence
  chemically synthesized
tgggatttcagccatcaagg

SEQ ID NO: 528310 - DNA, 20 bp, Artificial Sequence
  chemically synthesized
tttcataatactgtctggtg

SEQ ID NO: 528311 - DNA, 20 bp, Artificial Sequence
  chemically synthesized
ctttaggaaggacagtgttg

SEQ ID NO: 528312 - DNA, 20 bp, Artificial Sequence
  chemically synthesized
ttgttagaaagccatgtgat

SEQ ID NO: 528313 - DNA, 20 bp, Artificial Sequence
  chemically synthesized
tgtaattatggttatgtact

SEQ ID NO: 528314 - DNA, 20 bp, Artificial Sequence
  chemically synthesized
atatgtatcattaagcattc

SEQ ID NO: 528315 - DNA, 20 bp, Artificial Sequence
  chemically synthesized
agttctgaatatggcttagt

SEQ ID NO: 528316 - DNA, 20 bp, Artificial Sequence
  chemically synthesized
agtcatttgctgctacatat

SEQ ID NO: 528317 - DNA, 20 bp, Artificial Sequence
  chemically synthesized
gttatgttccagatccttct

SEQ ID NO: 528318 - DNA, 20 bp, Artificial Sequence
  chemically synthesized
ggaaggtcctttttttcact

SEQ ID NO: 528319 - DNA, 20 bp, Artificial Sequence
  chemically synthesized
gtagaactagtccttttaca

SEQ ID NO: 528320 - DNA, 20 bp, Artificial Sequence
  chemically synthesized
ttccaaaaaaaaataaatgt

SEQ ID NO: 528321 - DNA, 20 bp, Artificial Sequence
  chemically synthesized
gacactgtaactgaaggtct

SEQ ID NO: 528322 - DNA, 20 bp, Artificial Sequence
  chemically synthesized
ataaaagaggctaaaagcac

SEQ ID NO: 528323 - DNA, 20 bp, Artificial Sequence
  chemically synthesized
gactatttaaaatacttaag

SEQ ID NO: 528324 - DNA, 20 bp, Artificial Sequence
  chemically synthesized
tttttttgacttataaaata

SEQ ID NO: 528325 - DNA, 20 bp, Artificial Sequence
  chemically synthesized
gactctatacatgtaatgag

SEQ ID NO: 528326 - DNA, 20 bp, Artificial Sequence
  chemically synthesized
caactactctgccctggtaa

SEQ ID NO: 528327 - DNA, 20 bp, Artificial Sequence
  chemically synthesized
tttgtgggagcatacaggaa

SEQ ID NO: 528328 - DNA, 20 bp, Artificial Sequence
  chemically synthesized
aacataaagaacaaaggcag

SEQ ID NO: 528329 - DNA, 20 bp, Artificial Sequence
  chemically synthesized
tgctcttccataaaagaacc

SEQ ID NO: 528330 - DNA, 20 bp, Artificial Sequence
  chemically synthesized
tggtaatttaggggtatttg

SEQ ID NO: 528331 - DNA, 20 bp, Artificial Sequence
  chemically synthesized
ggcaagagattgtacaggta

SEQ ID NO: 528332 - DNA, 20 bp, Artificial Sequence
  chemically synthesized
tcttaatgcagtaaaacaat

SEQ ID NO: 528333 - DNA, 20 bp, Artificial Sequence
  chemically synthesized
tatatgtatgtgcattgatg

SEQ ID NO: 528334 - DNA, 20 bp, Artificial Sequence
  chemically synthesized
tgtacccatgtagttttcct

SEQ ID NO: 528335 - DNA, 20 bp, Artificial Sequence
  chemically synthesized
cttcctttgtaagtatatgt

SEQ ID NO: 528336 - DNA, 20 bp, Artificial Sequence
  chemically synthesized
attagagatagacagattag

SEQ ID NO: 528337 - DNA, 20 bp, Artificial Sequence
  chemically synthesized
taagtatatctagagaccaa

SEQ ID NO: 528338 - DNA, 20 bp, Artificial Sequence
  chemically synthesized
cacaaagagtacctggaagc

SEQ ID NO: 528339 - DNA, 20 bp, Artificial Sequence
  chemically synthesized
tctttgtgaaaataaaagat

SEQ ID NO: 528340 - DNA, 20 bp, Artificial Sequence
  chemically synthesized
caactctgtggcaaggggca

SEQ ID NO: 528341 - DNA, 20 bp, Artificial Sequence
  chemically synthesized
tgagaacatggatggtagtg

SEQ ID NO: 528342 - DNA, 20 bp, Artificial Sequence
  chemically synthesized
gagacattagcaacgtcttg

SEQ ID NO: 528343 - DNA, 20 bp, Artificial Sequence
  chemically synthesized
tgaaagataattcaaccagg

SEQ ID NO: 528344 - DNA, 20 bp, Artificial Sequence
  chemically synthesized
agtatttttaaaccactggt

SEQ ID NO: 528345 - DNA, 20 bp, Artificial Sequence
  chemically synthesized
tttgtttttaaataaataaa

SEQ ID NO: 528346 - DNA, 20 bp, Artificial Sequence
  chemically synthesized
gtgtcatatgcatacaaaga

SEQ ID NO: 528347 - DNA, 20 bp, Artificial Sequence
  chemically synthesized
ggataaccatcaaaacagag

SEQ ID NO: 528348 - DNA, 20 bp, Artificial Sequence
  chemically synthesized
tcccaagatgttaagattct

SEQ ID NO: 528349 - DNA, 20 bp, Artificial Sequence
  chemically synthesized
tgatattaagcagaaattct

SEQ ID NO: 528350 - DNA, 20 bp, Artificial Sequence
  chemically synthesized
atgtgttcagctgatattaa

SEQ ID NO: 528351 - DNA, 20 bp, Artificial Sequence
  chemically synthesized
acaaaagtgcttttagttgg

SEQ ID NO: 528352 - DNA, 20 bp, Artificial Sequence
  chemically synthesized
ttttatccacttgaatttgg

SEQ ID NO: 528353 - DNA, 20 bp, Artificial Sequence
  chemically synthesized
tttggggagaaaaaggcctg

SEQ ID NO: 528354 - DNA, 20 bp, Artificial Sequence
  chemically synthesized
aatgccaagatcatggtatt

SEQ ID NO: 528355 - DNA, 20 bp, Artificial Sequence
  chemically synthesized
tatttaattgttttgttttt

SEQ ID NO: 528356 - DNA, 20 bp, Artificial Sequence
  chemically synthesized
tcagtggtacccttgtggcc

SEQ ID NO: 528357 - DNA, 20 bp, Artificial Sequence
  chemically synthesized
ttactaaattagtgcttacg

SEQ ID NO: 528358 - DNA, 20 bp, Artificial Sequence
  chemically synthesized
tgtagaagcttcctggaaga

SEQ ID NO: 528359 - DNA, 20 bp, Artificial Sequence
  chemically synthesized
ttacagctaattagggtgga

SEQ ID NO: 528360 - DNA, 20 bp, Artificial Sequence
  chemically synthesized
taacctcttgtttagatgtg

SEQ ID NO: 528361 - DNA, 20 bp, Artificial Sequence
  chemically synthesized
aattgcagatacagaactcc

SEQ ID NO: 528362 - DNA, 20 bp, Artificial Sequence
  chemically synthesized
ggaggtagtagggatggaaa

SEQ ID NO: 528363 - DNA, 20 bp, Artificial Sequence
  chemically synthesized
gaagatcatacacaggcttg

SEQ ID NO: 528364 - DNA, 20 bp, Artificial Sequence
  chemically synthesized
gaaggagatacctaagatag

SEQ ID NO: 528365 - DNA, 20 bp, Artificial Sequence
  chemically synthesized
aaagcctagagaaacaaaag

SEQ ID NO: 528366 - DNA, 20 bp, Artificial Sequence
  chemically synthesized
atcaaatagaagaaaagcct

SEQ ID NO: 528367 - DNA, 20 bp, Artificial Sequence
  chemically synthesized
cagtcacctgtgatcaaata

SEQ ID NO: 528368 - DNA, 20 bp, Artificial Sequence
  chemically synthesized
aataaaccaaataaatgccc

SEQ ID NO: 528369 - DNA, 20 bp, Artificial Sequence
  chemically synthesized
caaaaacagcattttaccct

SEQ ID NO: 528370 - DNA, 20 bp, Artificial Sequence
  chemically synthesized
atacgcaaggccaaagtgat

SEQ ID NO: 528371 - DNA, 20 bp, Artificial Sequence
  chemically synthesized
aaggccaaagtgatgaagaa

SEQ ID NO: 528372 - DNA, 20 bp, Artificial Sequence
  chemically synthesized
agaggaaatacaggcttagc

SEQ ID NO: 528373 - DNA, 20 bp, Artificial Sequence
  chemically synthesized
aaagggcatcagatggcaag

SEQ ID NO: 528374 - DNA, 20 bp, Artificial Sequence
  chemically synthesized
gggcaacatgtttccaaaaa

SEQ ID NO: 528375 - DNA, 20 bp, Artificial Sequence
  chemically synthesized
atggaagccaacacgcagta

SEQ ID NO: 528376 - DNA, 20 bp, Artificial Sequence
  chemically synthesized
aataatggaaaattacattt

SEQ ID NO: 528377 - DNA, 20 bp, Artificial Sequence
  chemically synthesized
ttcacttgctcataaataac

SEQ ID NO: 528378 - DNA, 20 bp, Artificial Sequence
  chemically synthesized
atggatttcttcttcccttt

SEQ ID NO: 528379 - DNA, 20 bp, Artificial Sequence
  chemically synthesized
aagtaattctttaaagggaa

SEQ ID NO: 528380 - DNA, 20 bp, Artificial Sequence
  chemically synthesized
ttatctatatcattaccctt

SEQ ID NO: 528381 - DNA, 20 bp, Artificial Sequence
  chemically synthesized
ctactcgggaggctgaggca

SEQ ID NO: 528382 - DNA, 20 bp, Artificial Sequence
  chemically synthesized
acttgaaatgtgccccgcac

SEQ ID NO: 528383 - DNA, 20 bp, Artificial Sequence
  chemically synthesized
tttgatattttgttgcatac

SEQ ID NO: 528384 - DNA, 20 bp, Artificial Sequence
  chemically synthesized
aaaataaatttaaaagttaa

SEQ ID NO: 528385 - DNA, 20 bp, Artificial Sequence
  chemically synthesized
tttaaaagttaaaaagaata

SEQ ID NO: 528386 - DNA, 20 bp, Artificial Sequence
  chemically synthesized
gtctcctcaacacaaaagag

SEQ ID NO: 528387 - DNA, 20 bp, Artificial Sequence
  chemically synthesized
tacctttaaactccaatgta

SEQ ID NO: 528388 - DNA, 20 bp, Artificial Sequence
  chemically synthesized
atatgccatatctacagttt

SEQ ID NO: 528389 - DNA, 20 bp, Artificial Sequence
  chemically synthesized
ttttgactgtttatgtgagg

SEQ ID NO: 528390 - DNA, 20 bp, Artificial Sequence
  chemically synthesized
gagaatgatgatctggaagc

SEQ ID NO: 528391 - DNA, 20 bp, Artificial Sequence
  chemically synthesized
gtattgtttgttcatgtgtt

SEQ ID NO: 528392 - DNA, 20 bp, Artificial Sequence
  chemically synthesized
agtttaattttgtttgcacc

SEQ ID NO: 528393 - DNA, 20 bp, Artificial Sequence
  chemically synthesized
acttggattttcatgtttga

SEQ ID NO: 528394 - DNA, 20 bp, Artificial Sequence
  chemically synthesized
ttttttaacagcagaagcta

SEQ ID NO: 528395 - DNA, 20 bp, Artificial Sequence
  chemically synthesized
atatgaagcctcacatccac

SEQ ID NO: 528396 - DNA, 20 bp, Artificial Sequence
  chemically synthesized
tgtgaggcttcatattttta

SEQ ID NO: 528397 - DNA, 20 bp, Artificial Sequence
  chemically synthesized
aagtacaggaaatgggtgct

SEQ ID NO: 528398 - DNA, 20 bp, Artificial Sequence
  chemically synthesized
tgaagaattaaggtcacaaa

SEQ ID NO: 528399 - DNA, 20 bp, Artificial Sequence
  chemically synthesized
gtgaggggggaggaagagag

SEQ ID NO: 528400 - DNA, 20 bp, Artificial Sequence
  chemically synthesized
atttgcttaagtttatgcct

SEQ ID NO: 528401 - DNA, 20 bp, Artificial Sequence
  chemically synthesized
ataatggtagtttaaaaccg

SEQ ID NO: 528402 - DNA, 20 bp, Artificial Sequence
  chemically synthesized
aatatgatgtaattaaactg

SEQ ID NO: 528403 - DNA, 20 bp, Artificial Sequence
  chemically synthesized
tctacttgtttttatactac

SEQ ID NO: 528404 - DNA, 20 bp, Artificial Sequence
  chemically synthesized
tcatgaaaatatggagaaaa

SEQ ID NO: 528405 - DNA, 20 bp, Artificial Sequence
  chemically synthesized
ttgagaaatcatgaaaatat

SEQ ID NO: 528406 - DNA, 20 bp, Artificial Sequence
  chemically synthesized
gcaatgcattaaaaccatct

SEQ ID NO: 528407 - DNA, 20 bp, Artificial Sequence
  chemically synthesized
catctcaaaaaaaaagaaaa

SEQ ID NO: 528408 - DNA, 20 bp, Artificial Sequence
  chemically synthesized
caagactccatctcaaaaaa

SEQ ID NO: 528409 - DNA, 20 bp, Artificial Sequence
  chemically synthesized
ctactcaggaggctgaggca

SEQ ID NO: 528410 - DNA, 20 bp, Artificial Sequence
  chemically synthesized
acagggtttcaccgtgttag

SEQ ID NO: 528411 - DNA, 20 bp, Artificial Sequence
  chemically synthesized
cgcccaggctcatctctttt

SEQ ID NO: 528412 - DNA, 20 bp, Artificial Sequence
  chemically synthesized
aatgcctaatattttctgtg

SEQ ID NO: 528413 - DNA, 20 bp, Artificial Sequence
  chemically synthesized
cttttacaatatattctgac

SEQ ID NO: 528414 - DNA, 20 bp, Artificial Sequence
  chemically synthesized
gcaagggacaatgagagtca

SEQ ID NO: 528415 - DNA, 20 bp, Artificial Sequence
  chemically synthesized
ggcatgacaaaagtagaggc

SEQ ID NO: 528416 - DNA, 20 bp, Artificial Sequence
  chemically synthesized
ccaaacaacagatgcgtgaa

SEQ ID NO: 528417 - DNA, 20 bp, Artificial Sequence
  chemically synthesized
tgaatgagaaatatgcaact

SEQ ID NO: 528418 - DNA, 20 bp, Artificial Sequence
  chemically synthesized
gaggcctcatgattataagt

SEQ ID NO: 528419 - DNA, 20 bp, Artificial Sequence
  chemically synthesized
gacaggtattattgttagag

SEQ ID NO: 528420 - DNA, 20 bp, Artificial Sequence
  chemically synthesized
cacttttttcacttattcaa

SEQ ID NO: 528421 - DNA, 20 bp, Artificial Sequence
  chemically synthesized
tagcagcgcaattcataatt

SEQ ID NO: 528422 - DNA, 20 bp, Artificial Sequence
  chemically synthesized
ccatcaaccaacgagtggat

SEQ ID NO: 528423 - DNA, 20 bp, Artificial Sequence
  chemically synthesized
gcttagctcccacttataag

SEQ ID NO: 528424 - DNA, 20 bp, Artificial Sequence
  chemically synthesized
gctatgcggatgcaaaggca

SEQ ID NO: 528425 - DNA, 20 bp, Artificial Sequence
  chemically synthesized
gtgatggatgcacccaaatg

SEQ ID NO: 528426 - DNA, 20 bp, Artificial Sequence
  chemically synthesized
aaactactgaaataataaaa

SEQ ID NO: 528427 - DNA, 20 bp, Artificial Sequence
  chemically synthesized
cctttaatcactgctgaagt

SEQ ID NO: 528428 - DNA, 20 bp, Artificial Sequence
  chemically synthesized
tgggatgactcaatttaatc

SEQ ID NO: 528429 - DNA, 20 bp, Artificial Sequence
  chemically synthesized
actcaatttaatccgagaaa

SEQ ID NO: 528430 - DNA, 20 bp, Artificial Sequence
  chemically synthesized
tcgttatatttcagaagact

SEQ ID NO: 528431 - DNA, 20 bp, Artificial Sequence
  chemically synthesized
cagatgggatatcttccctt

SEQ ID NO: 528432 - DNA, 20 bp, Artificial Sequence
  chemically synthesized
ccagaacctacgcagcctat

SEQ ID NO: 528433 - DNA, 20 bp, Artificial Sequence
  chemically synthesized
cagcctatgcagaatagaca

SEQ ID NO: 528434 - DNA, 20 bp, Artificial Sequence
  chemically synthesized
acagctcctttttaaaaaaa

SEQ ID NO: 528435 - DNA, 20 bp, Artificial Sequence
  chemically synthesized
ttttaaaaaggagctgtgta

SEQ ID NO: 528436 - DNA, 20 bp, Artificial Sequence
  chemically synthesized
ttcatacacagcccccttta

SEQ ID NO: 528437 - DNA, 20 bp, Artificial Sequence
  chemically synthesized
tcggaaactggttaaaatcc

SEQ ID NO: 528438 - DNA, 20 bp, Artificial Sequence
  chemically synthesized
tttttcttctaaaaaatact

SEQ ID NO: 528439 - DNA, 20 bp, Artificial Sequence
  chemically synthesized
cctttctccagtatttttta

SEQ ID NO: 528440 - DNA, 20 bp, Artificial Sequence
  chemically synthesized
atatgttaaaggtgttacac

SEQ ID NO: 528441 - DNA, 20 bp, Artificial Sequence
  chemically synthesized
tgggctgttccatgtgtaca

SEQ ID NO: 528442 - DNA, 20 bp, Artificial Sequence
  chemically synthesized
gtgcttgttgagttaatatt

SEQ ID NO: 528443 - DNA, 20 bp, Artificial Sequence
  chemically synthesized
gttctagggagttgtaggca

SEQ ID NO: 528444 - DNA, 20 bp, Artificial Sequence
  chemically synthesized
ccctgtctctactaaaaata

SEQ ID NO: 528445 - DNA, 20 bp, Artificial Sequence
  chemically synthesized
ctactcaggagggtgaggca

SEQ ID NO: 528446 - DNA, 20 bp, Artificial Sequence
  chemically synthesized
gcgagactccgtctcacaca

SEQ ID NO: 528447 - DNA, 20 bp, Artificial Sequence
  chemically synthesized
caacaacaacaacaacaaaa

SEQ ID NO: 528448 - DNA, 20 bp, Artificial Sequence
  chemically synthesized
taatgcatgattaagttcca

SEQ ID NO: 528449 - DNA, 20 bp, Artificial Sequence
  chemically synthesized
aaagaaaactcactgagtga

SEQ ID NO: 528450 - DNA, 20 bp, Artificial Sequence
  chemically synthesized
tttatgccttctgtttgaca

SEQ ID NO: 528451 - DNA, 20 bp, Artificial Sequence
  chemically synthesized
ctccctttctaagctatctt

SEQ ID NO: 528452 - DNA, 20 bp, Artificial Sequence
  chemically synthesized
tgaagtttctggaagatagc

SEQ ID NO: 528453 - DNA, 20 bp, Artificial Sequence
  chemically synthesized
tgggcagaagtagctgaatt

SEQ ID NO: 528454 - DNA, 20 bp, Artificial Sequence
  chemically synthesized
ggcaggtaaaggaagaaggg

SEQ ID NO: 528455 - DNA, 20 bp, Artificial Sequence
  chemically synthesized
tgaagaacggtgaaggggat

SEQ ID NO: 528456 - DNA, 20 bp, Artificial Sequence
  chemically synthesized
gaggtcgggctagatgtttt

SEQ ID NO: 528457 - DNA, 20 bp, Artificial Sequence
  chemically synthesized
tgaatgtaaaatatcgctat

SEQ ID NO: 528458 - DNA, 20 bp, Artificial Sequence
  chemically synthesized
gctatgaagaatattaattg

SEQ ID NO: 528459 - DNA, 20 bp, Artificial Sequence
  chemically synthesized
gaacaatactgttatataat

SEQ ID NO: 528460 - DNA, 20 bp, Artificial Sequence
  chemically synthesized
gcatgataattgtgcttatg

SEQ ID NO: 528461 - DNA, 20 bp, Artificial Sequence
  chemically synthesized
ttctgtatttgcttcctcca

SEQ ID NO: 528462 - DNA, 20 bp, Artificial Sequence
  chemically synthesized
attgtctcagtaagaactgt

SEQ ID NO: 528463 - DNA, 20 bp, Artificial Sequence
  chemically synthesized
cttgtctcatgtttcactta

SEQ ID NO: 528464 - DNA, 20 bp, Artificial Sequence
  chemically synthesized
gtcatcggggttgcatattt

SEQ ID NO: 528465 - DNA, 20 bp, Artificial Sequence
  chemically synthesized
tttaaagaatgcagctctat

SEQ ID NO: 528466 - DNA, 20 bp, Artificial Sequence
  chemically synthesized
gtgctacatagcggcaggag

SEQ ID NO: 528467 - DNA, 20 bp, Artificial Sequence
  chemically synthesized
cctgagactgggtaatttat

SEQ ID NO: 528468 - DNA, 20 bp, Artificial Sequence
  chemically synthesized
aaacagattaatacacagtt

SEQ ID NO: 528469 - DNA, 20 bp, Artificial Sequence
  chemically synthesized
tgtgttaaatttgtcctctg

SEQ ID NO: 528470 - DNA, 20 bp, Artificial Sequence
  chemically synthesized
aaaagggggaaaatcctgaa

SEQ ID NO: 528471 - DNA, 20 bp, Artificial Sequence
  chemically synthesized
gtactaaagctcagttgttt

SEQ ID NO: 528472 - DNA, 20 bp, Artificial Sequence
  chemically synthesized
caactaccctgtctctttcc

SEQ ID NO: 528473 - DNA, 20 bp, Artificial Sequence
  chemically synthesized
tgggaggcaccatgttagat

SEQ ID NO: 528474 - DNA, 20 bp, Artificial Sequence
  chemically synthesized
ccttaaccaaaatggatagg

SEQ ID NO: 528475 - DNA, 20 bp, Artificial Sequence
  chemically synthesized
acttgagctcttccatgagg

SEQ ID NO: 528476 - DNA, 20 bp, Artificial Sequence
  chemically synthesized
ctcaaatcttacctcacaga

SEQ ID NO: 528477 - DNA, 20 bp, Artificial Sequence
  chemically synthesized
gtcctctcaaatcttacctc

SEQ ID NO: 528478 - DNA, 20 bp, Artificial Sequence
  chemically synthesized
gactcctactgggcctttac

SEQ ID NO: 528479 - DNA, 20 bp, Artificial Sequence
  chemically synthesized
tactgggcctttacagagaa

SEQ ID NO: 528480 - DNA, 20 bp, Artificial Sequence
  chemically synthesized
ctctgcctaggactaggttc

SEQ ID NO: 528481 - DNA, 20 bp, Artificial Sequence
  chemically synthesized
tcctaggcagagaacattgc

SEQ ID NO: 528482 - DNA, 20 bp, Artificial Sequence
  chemically synthesized
ataaatgcattgggtaattt

SEQ ID NO: 528483 - DNA, 20 bp, Artificial Sequence
  chemically synthesized
gattgctgaagggtgtgaga

SEQ ID NO: 528484 - DNA, 20 bp, Artificial Sequence
  chemically synthesized
gagatttgagaatgagtttc

SEQ ID NO: 528485 - DNA, 20 bp, Artificial Sequence
  chemically synthesized
gtgggcaaactggagagatt

SEQ ID NO: 528486 - DNA, 20 bp, Artificial Sequence
  chemically synthesized
gtcttctaagtcatgtccca

SEQ ID NO: 528487 - DNA, 20 bp, Artificial Sequence
  chemically synthesized
gattgtggacataatgtgtt

SEQ ID NO: 528488 - DNA, 20 bp, Artificial Sequence
  chemically synthesized
ctactcgggaggatgaggca

SEQ ID NO: 528489 - DNA, 20 bp, Artificial Sequence
  chemically synthesized
aaaccctgtctctactaaaa

SEQ ID NO: 528490 - DNA, 20 bp, Artificial Sequence
  chemically synthesized
cccctggcaagtctattttt

SEQ ID NO: 528491 - DNA, 20 bp, Artificial Sequence
  chemically synthesized
ctggcagctctatctggccc

SEQ ID NO: 528492 - DNA, 20 bp, Artificial Sequence
  chemically synthesized
ctgtgggccagatagagctg

SEQ ID NO: 528493 - DNA, 20 bp, Artificial Sequence
  chemically synthesized
agctgccagaatacaccttt

SEQ ID NO: 528494 - DNA, 20 bp, Artificial Sequence
  chemically synthesized
accaggcgaaaaaagtctaa

SEQ ID NO: 528495 - DNA, 20 bp, Artificial Sequence
  chemically synthesized
actctcagattttgttgtct

SEQ ID NO: 528496 - DNA, 20 bp, Artificial Sequence
  chemically synthesized
gcctggggctaagtcatcca

SEQ ID NO: 528497 - DNA, 20 bp, Artificial Sequence
  chemically synthesized
gctaagtcatccaaaagaaa

SEQ ID NO: 528498 - DNA, 20 bp, Artificial Sequence
  chemically synthesized
tttcactgttgatataatcc

SEQ ID NO: 528499 - DNA, 20 bp, Artificial Sequence
  chemically synthesized
attgtgctcccttataaatt

SEQ ID NO: 528500 - DNA, 20 bp, Artificial Sequence
  chemically synthesized
aattgaaaaatttaaaattc

SEQ ID NO: 528501 - DNA, 20 bp, Artificial Sequence
  chemically synthesized
gaactatgtgttagggatta

SEQ ID NO: 528502 - DNA, 20 bp, Artificial Sequence
  chemically synthesized
aaaaaaaacacaaaggtata

SEQ ID NO: 528503 - DNA, 20 bp, Artificial Sequence
  chemically synthesized
aagatgtatttcaaattggt

SEQ ID NO: 528504 - DNA, 20 bp, Artificial Sequence
  chemically synthesized
aaaggatagaagtagaggag

SEQ ID NO: 528505 - DNA, 20 bp, Artificial Sequence
  chemically synthesized
gcaggcacataccaagcact

SEQ ID NO: 528506 - DNA, 20 bp, Artificial Sequence
  chemically synthesized
atgccaataggaatctgcaa

SEQ ID NO: 528507 - DNA, 20 bp, Artificial Sequence
  chemically synthesized
attggcatcaaaaaagtaaa

SEQ ID NO: 528508 - DNA, 20 bp, Artificial Sequence
  chemically synthesized
aaaaagtaaaaaagaaaaaa

SEQ ID NO: 528509 - DNA, 20 bp, Artificial Sequence
  chemically synthesized
agtaaaaaagaaaaaaaaag

SEQ ID NO: 528510 - DNA, 20 bp, Artificial Sequence
  chemically synthesized
aaagaaaaaaaaagaaagaa

SEQ ID NO: 528511 - DNA, 20 bp, Artificial Sequence
  chemically synthesized
aaaagaaagaaaaagaaaaa

SEQ ID NO: 528512 - DNA, 20 bp, Artificial Sequence
  chemically synthesized
ttttaatctcatgacattat

SEQ ID NO: 528513 - DNA, 20 bp, Artificial Sequence
  chemically synthesized
aacattagcaaatattttca

SEQ ID NO: 528514 - DNA, 20 bp, Artificial Sequence
  chemically synthesized
atattttcaacagaaatgta

SEQ ID NO: 528515 - DNA, 20 bp, Artificial Sequence
  chemically synthesized
tctttcttcaaaaaactttt

SEQ ID NO: 528516 - DNA, 20 bp, Artificial Sequence
  chemically synthesized
attttcttcaaaagtttttt

SEQ ID NO: 528517 - DNA, 20 bp, Artificial Sequence
  chemically synthesized
tcttcaaaagttttttgaag

SEQ ID NO: 528518 - DNA, 20 bp, Artificial Sequence
  chemically synthesized
ccttgagggcagcggggagg

SEQ ID NO: 528519 - DNA, 20 bp, Artificial Sequence
  chemically synthesized
aatgggtgtttttgtaggtg

SEQ ID NO: 528520 - DNA, 20 bp, Artificial Sequence
  chemically synthesized
aaatttaagaacttcacatt

SEQ ID NO: 528521 - DNA, 20 bp, Artificial Sequence
  chemically synthesized
ttgaaggcaaaaagcaactc

SEQ ID NO: 528522 - DNA, 20 bp, Artificial Sequence
  chemically synthesized
aaactattatgtatcgacct

SEQ ID NO: 528523 - DNA, 20 bp, Artificial Sequence
  chemically synthesized
aatgttggcatattcaagca

SEQ ID NO: 528524 - DNA, 20 bp, Artificial Sequence
  chemically synthesized
tccaaggagataggtataaa

SEQ ID NO: 528525 - DNA, 20 bp, Artificial Sequence
  chemically synthesized
acctgttgaagagattcttt

SEQ ID NO: 528526 - DNA, 20 bp, Artificial Sequence
  chemically synthesized
cacatcaaactatattctgt

SEQ ID NO: 528527 - DNA, 20 bp, Artificial Sequence
  chemically synthesized
gaacatatccaaaggtttaa

SEQ ID NO: 528528 - DNA, 20 bp, Artificial Sequence
  chemically synthesized
taaactttaaaatgtaggtg

SEQ ID NO: 528529 - DNA, 20 bp, Artificial Sequence
  chemically synthesized
catttaggacttgaatttac

SEQ ID NO: 528530 - DNA, 20 bp, Artificial Sequence
  chemically synthesized
tatgcagatagaaccacaga

SEQ ID NO: 528531 - DNA, 20 bp, Artificial Sequence
  chemically synthesized
catggagaagatcaaagggg

SEQ ID NO: 528532 - DNA, 20 bp, Artificial Sequence
  chemically synthesized
caacaagcattttcataaaa

SEQ ID NO: 528533 - DNA, 20 bp, Artificial Sequence
  chemically synthesized
aataattgagtcttcacatc

SEQ ID NO: 528534 - DNA, 20 bp, Artificial Sequence
  chemically synthesized
taagttaaaagaaatcacag

SEQ ID NO: 528535 - DNA, 20 bp, Artificial Sequence
  chemically synthesized
aatgactatgggttaagtta

SEQ ID NO: 528536 - DNA, 20 bp, Artificial Sequence
  chemically synthesized
ctgattgaaacgcaattaaa

SEQ ID NO: 528537 - DNA, 20 bp, Artificial Sequence
  chemically synthesized
caagtactcaatgaacattt

SEQ ID NO: 528538 - DNA, 20 bp, Artificial Sequence
  chemically synthesized
gaattatgatagaattaaaa

SEQ ID NO: 528539 - DNA, 20 bp, Artificial Sequence
  chemically synthesized
aatatataaagtgaattatg

SEQ ID NO: 528540 - DNA, 20 bp, Artificial Sequence
  chemically synthesized
gtgcatctaactatataggt

SEQ ID NO: 528541 - DNA, 20 bp, Artificial Sequence
  chemically synthesized
aggaagaaaaagtatactac

SEQ ID NO: 528542 - DNA, 20 bp, Artificial Sequence
  chemically synthesized
atggcaatcaacattattag

SEQ ID NO: 528543 - DNA, 20 bp, Artificial Sequence
  chemically synthesized
caaaagacagtggaataacc

SEQ ID NO: 528544 - DNA, 20 bp, Artificial Sequence
  chemically synthesized
ccaaatgctttaggatttac

SEQ ID NO: 528545 - DNA, 20 bp, Artificial Sequence
  chemically synthesized
cagtcactggatatcaaata

SEQ ID NO: 528546 - DNA, 20 bp, Artificial Sequence
  chemically synthesized
tttggtatttatcacaagta

SEQ ID NO: 528547 - DNA, 20 bp, Artificial Sequence
  chemically synthesized
tgaaatatcatctgtgaaca

SEQ ID NO: 528548 - DNA, 20 bp, Artificial Sequence
  chemically synthesized
agatgatatttcatcaggtg

SEQ ID NO: 528549 - DNA, 20 bp, Artificial Sequence
  chemically synthesized
atgtgggagatctatatcaa

SEQ ID NO: 528550 - DNA, 20 bp, Artificial Sequence
  chemically synthesized
agttttcccattgtccagtt

SEQ ID NO: 528551 - DNA, 20 bp, Artificial Sequence
  chemically synthesized
ttcattccgagtatgggaca

SEQ ID NO: 528552 - DNA, 20 bp, Artificial Sequence
  chemically synthesized
ggctagatctccacatggaa

SEQ ID NO: 528553 - DNA, 20 bp, Artificial Sequence
  chemically synthesized
agatctccacatggaagcag

SEQ ID NO: 528554 - DNA, 20 bp, Artificial Sequence
  chemically synthesized
aaaatgaagcaaaacaaaac

SEQ ID NO: 528555 - DNA, 20 bp, Artificial Sequence
  chemically synthesized
cttgtaatgttaggtactag

SEQ ID NO: 528556 - DNA, 20 bp, Artificial Sequence
  chemically synthesized
aggaatttatttaaagtcac

SEQ ID NO: 528557 - DNA, 20 bp, Artificial Sequence
  chemically synthesized
atgtatgatctttttcatct

SEQ ID NO: 528558 - DNA, 20 bp, Artificial Sequence
  chemically synthesized
gatctttttcatctacagaa

SEQ ID NO: 528559 - DNA, 20 bp, Artificial Sequence
  chemically synthesized
cacacccagaagacccgtgt

SEQ ID NO: 528560 - DNA, 20 bp, Artificial Sequence
  chemically synthesized
actgattgccagttaagttc

SEQ ID NO: 528561 - DNA, 20 bp, Artificial Sequence
  chemically synthesized
ttggatactgcttcaagttc

SEQ ID NO: 528562 - DNA, 20 bp, Artificial Sequence
  chemically synthesized
cttttaatgaagagggaaaa

SEQ ID NO: 528563 - DNA, 20 bp, Artificial Sequence
  chemically synthesized
ctatttttccctcttcatta

SEQ ID NO: 528564 - DNA, 20 bp, Artificial Sequence
  chemically synthesized
taactggcaacactttttat

SEQ ID NO: 528565 - DNA, 20 bp, Artificial Sequence
  chemically synthesized
tggctgccccaatctggtag

SEQ ID NO: 528566 - DNA, 20 bp, Artificial Sequence
  chemically synthesized
accatggctgccccaatctg

SEQ ID NO: 528567 - DNA, 20 bp, Artificial Sequence
  chemically synthesized
agataccaaggaagatctct

SEQ ID NO: 528568 - DNA, 20 bp, Artificial Sequence
  chemically synthesized
tttcactggaaaccaccaaa

SEQ ID NO: 528569 - DNA, 20 bp, Artificial Sequence
  chemically synthesized
tttggtggtttccagtgaaa

SEQ ID NO: 528570 - DNA, 20 bp, Artificial Sequence
  chemically synthesized
atcagccaaagctgagctgt

SEQ ID NO: 528571 - DNA, 20 bp, Artificial Sequence
  chemically synthesized
atttcaaacatctgggaagg

SEQ ID NO: 528572 - DNA, 20 bp, Artificial Sequence
  chemically synthesized
ttgaaggaaatgtgctccca

SEQ ID NO: 528573 - DNA, 20 bp, Artificial Sequence
  chemically synthesized
ctgtcatagctgagaatctt

SEQ ID NO: 528574 - DNA, 20 bp, Artificial Sequence
  chemically synthesized
atatttgaagctgtcatagc

SEQ ID NO: 528575 - DNA, 20 bp, Artificial Sequence
  chemically synthesized
agtgtatttgagaggtttca

SEQ ID NO: 528576 - DNA, 20 bp, Artificial Sequence
  chemically synthesized
aggctctacaatatacctta

SEQ ID NO: 528577 - DNA, 20 bp, Artificial Sequence
  chemically synthesized
aatgagcaattaggagaaat

SEQ ID NO: 528578 - DNA, 20 bp, Artificial Sequence
  chemically synthesized
gaaatataaatgagcaatta

SEQ ID NO: 528579 - DNA, 20 bp, Artificial Sequence
  chemically synthesized
acaacactcacagaaaaaga

SEQ ID NO: 528580 - DNA, 20 bp, Artificial Sequence
  chemically synthesized
tgttactgtgtacaacactc

SEQ ID NO: 528581 - DNA, 20 bp, Artificial Sequence
  chemically synthesized
agggaattagaagatgatgc

SEQ ID NO: 528582 - DNA, 20 bp, Artificial Sequence
  chemically synthesized
cttctctgacaggacaaagt

SEQ ID NO: 528583 - DNA, 20 bp, Artificial Sequence
  chemically synthesized
tcgctaaaataacaagaaac

SEQ ID NO: 528584 - DNA, 20 bp, Artificial Sequence
  chemically synthesized
ggtaccactcgctaaaataa

SEQ ID NO: 528585 - DNA, 20 bp, Artificial Sequence
  chemically synthesized
gtgtattattttgctttctt

SEQ ID NO: 528586 - DNA, 20 bp, Artificial Sequence
  chemically synthesized
aaaaagatgaattaattcta

SEQ ID NO: 528587 - DNA, 20 bp, Artificial Sequence
  chemically synthesized
aatcacgatccaaaatacat

SEQ ID NO: 528588 - DNA, 20 bp, Artificial Sequence
  chemically synthesized
agtacacacacatgagaata

SEQ ID NO: 528589 - DNA, 20 bp, Artificial Sequence
  chemically synthesized
aatattaaagtacacacaca

SEQ ID NO: 528590 - DNA, 20 bp, Artificial Sequence
  chemically synthesized
tacacttaaaagcaacatga

SEQ ID NO: 528591 - DNA, 20 bp, Artificial Sequence
  chemically synthesized
tttgggccactaccttgtaa

SEQ ID NO: 528592 - DNA, 20 bp, Artificial Sequence
  chemically synthesized
ctctgtgaaccagaaatgtg

SEQ ID NO: 528593 - DNA, 20 bp, Artificial Sequence
  chemically synthesized
aagatgaacatctctgtgaa

SEQ ID NO: 528594 - DNA, 20 bp, Artificial Sequence
  chemically synthesized
actggataaatggtaggagc

SEQ ID NO: 528595 - DNA, 20 bp, Artificial Sequence
  chemically synthesized
gtatgtcatatgtttgttta

SEQ ID NO: 528596 - DNA, 20 bp, Artificial Sequence
  chemically synthesized
tctaaacaaacatatgacat

SEQ ID NO: 528597 - DNA, 20 bp, Artificial Sequence
  chemically synthesized
catgataaggattctaaaag

SEQ ID NO: 528598 - DNA, 20 bp, Artificial Sequence
  chemically synthesized
cttttaaccatttctggctt

SEQ ID NO: 528599 - DNA, 20 bp, Artificial Sequence
  chemically synthesized
acatttagaaataccttaaa

SEQ ID NO: 528600 - DNA, 20 bp, Artificial Sequence
  chemically synthesized
aaggtatttctaaatgttca

SEQ ID NO: 528601 - DNA, 20 bp, Artificial Sequence
  chemically synthesized
ttgataattctcatgaacat

SEQ ID NO: 528602 - DNA, 20 bp, Artificial Sequence
  chemically synthesized
tgtgactatgactgcattta

SEQ ID NO: 528603 - DNA, 20 bp, Artificial Sequence
  chemically synthesized
ggcatagatgtttttaaata

SEQ ID NO: 528604 - DNA, 20 bp, Artificial Sequence
  chemically synthesized
gagggaaccttgatcattta

SEQ ID NO: 528605 - DNA, 20 bp, Artificial Sequence
  chemically synthesized
aaaaaaataaaaaaaaaaca

SEQ ID NO: 528606 - DNA, 20 bp, Artificial Sequence
  chemically synthesized
tgactctggaggctgaggca

SEQ ID NO: 528607 - DNA, 20 bp, Artificial Sequence
  chemically synthesized
gagatgtacgtgtatacctt

SEQ ID NO: 528608 - DNA, 20 bp, Artificial Sequence
  chemically synthesized
ccctaatgattctctaattg

SEQ ID NO: 528609 - DNA, 20 bp, Artificial Sequence
  chemically synthesized
atgactacattctaacaatt

SEQ ID NO: 528610 - DNA, 20 bp, Artificial Sequence
  chemically synthesized
tgatcagacaacgactccac

SEQ ID NO: 528611 - DNA, 20 bp, Artificial Sequence
  chemically synthesized
atgttccttagggagctacc

SEQ ID NO: 528612 - DNA, 20 bp, Artificial Sequence
  chemically synthesized
tttaggatgactggctacag

SEQ ID NO: 528613 - DNA, 20 bp, Artificial Sequence
  chemically synthesized
attcttagctctatagagaa

SEQ ID NO: 528614 - DNA, 20 bp, Artificial Sequence
  chemically synthesized
tttcttattctctatagagc

SEQ ID NO: 528615 - DNA, 20 bp, Artificial Sequence
  chemically synthesized
ggggggattcttagctctat

SEQ ID NO: 528616 - DNA, 20 bp, Artificial Sequence
  chemically synthesized
tcagatatatctacatattt

SEQ ID NO: 528617 - DNA, 20 bp, Artificial Sequence
  chemically synthesized
tctgattaattttatgtcat

SEQ ID NO: 528618 - DNA, 20 bp, Artificial Sequence
  chemically synthesized
tataatgatatttatgaaat

SEQ ID NO: 528619 - DNA, 20 bp, Artificial Sequence
  chemically synthesized
agttaaatgtatgatactgt

SEQ ID NO: 528620 - DNA, 20 bp, Artificial Sequence
  chemically synthesized
catctaaaaggaatagatcc

SEQ ID NO: 528621 - DNA, 20 bp, Artificial Sequence
  chemically synthesized
ttttaaagttcatcttgctt

SEQ ID NO: 528622 - DNA, 20 bp, Artificial Sequence
  chemically synthesized
gggacagtgctaagaaatga

SEQ ID NO: 528623 - DNA, 20 bp, Artificial Sequence
  chemically synthesized
gttttaaagggggacagtgc

SEQ ID NO: 528624 - DNA, 20 bp, Artificial Sequence
  chemically synthesized
ttaaaatgcagatatcacta

SEQ ID NO: 528625 - DNA, 20 bp, Artificial Sequence
  chemically synthesized
ttcaccatccatggctgagg

SEQ ID NO: 528626 - DNA, 20 bp, Artificial Sequence
  chemically synthesized
gttcaaagaaagtttgacat

SEQ ID NO: 528627 - DNA, 20 bp, Artificial Sequence
  chemically synthesized
gtatgggctgggcatggttc

SEQ ID NO: 528628 - DNA, 20 bp, Artificial Sequence
  chemically synthesized
ccaaaaagtaaataatatat

SEQ ID NO: 528629 - DNA, 20 bp, Artificial Sequence
  chemically synthesized
gtgctaaaaacttcctataa

SEQ ID NO: 528630 - DNA, 20 bp, Artificial Sequence
  chemically synthesized
aacatatgcatatctagcgc

SEQ ID NO: 528631 - DNA, 20 bp, Artificial Sequence
  chemically synthesized
tctacgtgtcaatgacatat

SEQ ID NO: 528632 - DNA, 20 bp, Artificial Sequence
  chemically synthesized
acatctcagtcattaaagat

SEQ ID NO: 528633 - DNA, 20 bp, Artificial Sequence
  chemically synthesized
taatcaaaagttcaacacaa

SEQ ID NO: 528634 - DNA, 20 bp, Artificial Sequence
  chemically synthesized
ttcaacacaagaagaattca

SEQ ID NO: 528635 - DNA, 20 bp, Artificial Sequence
  chemically synthesized
aaaagccgtaacagtctcta

SEQ ID NO: 528636 - DNA, 20 bp, Artificial Sequence
  chemically synthesized
tggcctcctctattacaatg

SEQ ID NO: 528637 - DNA, 20 bp, Artificial Sequence
  chemically synthesized
ctattacaatgacagaaact

SEQ ID NO: 528638 - DNA, 20 bp, Artificial Sequence
  chemically synthesized
agcaaggccctgtctcaaaa

SEQ ID NO: 528639 - DNA, 20 bp, Artificial Sequence
  chemically synthesized
gtgggaggatcacttgagac

SEQ ID NO: 528640 - DNA, 20 bp, Artificial Sequence
  chemically synthesized
tgtgagccaccatgcccagc

SEQ ID NO: 528641 - DNA, 20 bp, Artificial Sequence
  chemically synthesized
ttatccataacagacaataa

SEQ ID NO: 528642 - DNA, 20 bp, Artificial Sequence
  chemically synthesized
atgaaatgttactcagcatt

SEQ ID NO: 528643 - DNA, 20 bp, Artificial Sequence
  chemically synthesized
aatgttactcagcattaaag

SEQ ID NO: 528644 - DNA, 20 bp, Artificial Sequence
  chemically synthesized
atttcatttacattaacagt

SEQ ID NO: 528645 - DNA, 20 bp, Artificial Sequence
  chemically synthesized
gaataagcaaatccatagag

SEQ ID NO: 528646 - DNA, 20 bp, Artificial Sequence
  chemically synthesized
ggctgaaaagagtagttgca

SEQ ID NO: 528647 - DNA, 20 bp, Artificial Sequence
  chemically synthesized
aacatttttatcacccccca

SEQ ID NO: 528648 - DNA, 20 bp, Artificial Sequence
  chemically synthesized
aatgggtaactcctatggta

SEQ ID NO: 528649 - DNA, 20 bp, Artificial Sequence
  chemically synthesized
gggtaatatcttttgtgcta

SEQ ID NO: 528650 - DNA, 20 bp, Artificial Sequence
  chemically synthesized
accttgatttttccatagta

SEQ ID NO: 528651 - DNA, 20 bp, Artificial Sequence
  chemically synthesized
aggtttaacccatgtacata

SEQ ID NO: 528652 - DNA, 20 bp, Artificial Sequence
  chemically synthesized
aaaatggtatgcacatgtct

SEQ ID NO: 528653 - DNA, 20 bp, Artificial Sequence
  chemically synthesized
aaaagagtccaaaaataagc

SEQ ID NO: 528654 - DNA, 20 bp, Artificial Sequence
  chemically synthesized
gtatattaagggattttggg

SEQ ID NO: 528655 - DNA, 20 bp, Artificial Sequence
  chemically synthesized
ttttgggaaagaaaataatg

SEQ ID NO: 528656 - DNA, 20 bp, Artificial Sequence
  chemically synthesized
aaagaaaataatgtaagaaa

SEQ ID NO: 528657 - DNA, 20 bp, Artificial Sequence
  chemically synthesized
ccccaaaaacccatcaagta

SEQ ID NO: 528658 - DNA, 20 bp, Artificial Sequence
  chemically synthesized
agtaaacaatatcccacact

SEQ ID NO: 528659 - DNA, 20 bp, Artificial Sequence
  chemically synthesized
tttaccaggaaattacagga

SEQ ID NO: 528660 - DNA, 20 bp, Artificial Sequence
  chemically synthesized
gactagcaccataaggtaac

SEQ ID NO: 528661 - DNA, 20 bp, Artificial Sequence
  chemically synthesized
taactcagaatttggagaca

SEQ ID NO: 528662 - DNA, 20 bp, Artificial Sequence
  chemically synthesized
attgggcatgagcagcccag

SEQ ID NO: 528663 - DNA, 20 bp, Artificial Sequence
  chemically synthesized
atggctaatggagccatcca

SEQ ID NO: 528664 - DNA, 20 bp, Artificial Sequence
  chemically synthesized
ttctccctctttatcttatg

SEQ ID NO: 528665 - DNA, 20 bp, Artificial Sequence
  chemically synthesized
ttctgtcataagataaagag

SEQ ID NO: 528666 - DNA, 20 bp, Artificial Sequence
  chemically synthesized
ctttgcatctaactacttac

SEQ ID NO: 528667 - DNA, 20 bp, Artificial Sequence
  chemically synthesized
ttcaaagttcaatcatttca

SEQ ID NO: 528668 - DNA, 20 bp, Artificial Sequence
  chemically synthesized
tggcttttcacccaaaccac

SEQ ID NO: 528669 - DNA, 20 bp, Artificial Sequence
  chemically synthesized
aaattctttgcaccattttt

SEQ ID NO: 528670 - DNA, 20 bp, Artificial Sequence
  chemically synthesized
atattctacaaaaatggtgc

SEQ ID NO: 528671 - DNA, 20 bp, Artificial Sequence
  chemically synthesized
ttaaattaactctcatgatc

SEQ ID NO: 528672 - DNA, 20 bp, Artificial Sequence
  chemically synthesized
ttaccctgtagacccagaag

SEQ ID NO: 528673 - DNA, 20 bp, Artificial Sequence
  chemically synthesized
tatatggaacacactttggt

SEQ ID NO: 528674 - DNA, 20 bp, Artificial Sequence
  chemically synthesized
gcactgaggagtttggaagt

SEQ ID NO: 528675 - DNA, 20 bp, Artificial Sequence
  chemically synthesized
agaataccactgagatactc

SEQ ID NO: 528676 - DNA, 20 bp, Artificial Sequence
  chemically synthesized
gagtatctcagtggtattct

SEQ ID NO: 528677 - DNA, 20 bp, Artificial Sequence
  chemically synthesized
tgttgcctaaaatgtattct

SEQ ID NO: 528678 - DNA, 20 bp, Artificial Sequence
  chemically synthesized
tccacaattatcaaaggcca

SEQ ID NO: 528679 - DNA, 20 bp, Artificial Sequence
  chemically synthesized
aaagaagcacgcagcatcct

SEQ ID NO: 528680 - DNA, 20 bp, Artificial Sequence
  chemically synthesized
ttgtattgctatgacttttt

SEQ ID NO: 528681 - DNA, 20 bp, Artificial Sequence
  chemically synthesized
tgattttacgtattcagttt

SEQ ID NO: 528682 - DNA, 20 bp, Artificial Sequence
  chemically synthesized
cttgaaatgtccttgggcaa

SEQ ID NO: 528683 - DNA, 20 bp, Artificial Sequence
  chemically synthesized
tgcaaagggttagtgcatgg

SEQ ID NO: 528684 - DNA, 20 bp, Artificial Sequence
  chemically synthesized
aggcaagtgaagaaggggat

SEQ ID NO: 528685 - DNA, 20 bp, Artificial Sequence
  chemically synthesized
tgagaaaaataactgacctg

SEQ ID NO: 528686 - DNA, 20 bp, Artificial Sequence
  chemically synthesized
tttttgacgggggggaggat

SEQ ID NO: 528687 - DNA, 20 bp, Artificial Sequence
  chemically synthesized
taatgtgtggcttggaatga

SEQ ID NO: 528688 - DNA, 20 bp, Artificial Sequence
  chemically synthesized
aggcctctctactccctctg

SEQ ID NO: 528689 - DNA, 20 bp, Artificial Sequence
  chemically synthesized
tttattttaaaaaagttaaa

SEQ ID NO: 528690 - DNA, 20 bp, Artificial Sequence
  chemically synthesized
taagcactcagtaactatct

SEQ ID NO: 528691 - DNA, 20 bp, Artificial Sequence
  chemically synthesized
gtaactatctgcagaattga

SEQ ID NO: 528692 - DNA, 20 bp, Artificial Sequence
  chemically synthesized
ctcaggcctggaaagtagct

SEQ ID NO: 528693 - DNA, 20 bp, Artificial Sequence
  chemically synthesized
ttgccaattgtccctctaca

SEQ ID NO: 528694 - DNA, 20 bp, Artificial Sequence
  chemically synthesized
ttgaagcacccctctggcga

SEQ ID NO: 528695 - DNA, 20 bp, Artificial Sequence
  chemically synthesized
caaattgtgttctggtgagc

SEQ ID NO: 528696 - DNA, 20 bp, Artificial Sequence
  chemically synthesized
ggcacacagcatcctgtgtc

SEQ ID NO: 528697 - DNA, 20 bp, Artificial Sequence
  chemically synthesized
gagagataattaggataaag

SEQ ID NO: 528698 - DNA, 20 bp, Artificial Sequence
  chemically synthesized
catggcagtgaatggataac

SEQ ID NO: 528699 - DNA, 20 bp, Artificial Sequence
  chemically synthesized
agttacactggccctgctag

SEQ ID NO: 528700 - DNA, 20 bp, Artificial Sequence
  chemically synthesized
gccacatttaagaagctgtg

SEQ ID NO: 528701 - DNA, 20 bp, Artificial Sequence
  chemically synthesized
agctagtttgatcacagaaa

SEQ ID NO: 528702 - DNA, 20 bp, Artificial Sequence
  chemically synthesized
caaagggagctagtttgatc

SEQ ID NO: 528703 - DNA, 20 bp, Artificial Sequence
  chemically synthesized
tttcatacggggcaatttac

SEQ ID NO: 528704 - DNA, 20 bp, Artificial Sequence
  chemically synthesized
atctctaattttcacatgct

SEQ ID NO: 528705 - DNA, 20 bp, Artificial Sequence
  chemically synthesized
ttagagatttttaagtaaaa

SEQ ID NO: 528706 - DNA, 20 bp, Artificial Sequence
  chemically synthesized
agcatgtttggaaggaaaca

SEQ ID NO: 528707 - DNA, 20 bp, Artificial Sequence
  chemically synthesized
tggaaggaaacacaagaaac

SEQ ID NO: 528708 - DNA, 20 bp, Artificial Sequence
  chemically synthesized
aagggttcaaaaagacatat

SEQ ID NO: 528709 - DNA, 20 bp, Artificial Sequence
  chemically synthesized
taattacttttatttttagt

SEQ ID NO: 528710 - DNA, 20 bp, Artificial Sequence
  chemically synthesized
acaggtggtagttgaaaccg

SEQ ID NO: 528711 - DNA, 20 bp, Artificial Sequence
  chemically synthesized
gagatagaactctgatgctt

SEQ ID NO: 528712 - DNA, 20 bp, Artificial Sequence
  chemically synthesized
ttagagccttaagtaaggtg

SEQ ID NO: 528713 - DNA, 20 bp, Artificial Sequence
  chemically synthesized
attaccttttttaagaaggc

SEQ ID NO: 528714 - DNA, 20 bp, Artificial Sequence
  chemically synthesized
tggaggaatttaaaggaaaa

SEQ ID NO: 528715 - DNA, 20 bp, Artificial Sequence
  chemically synthesized
gaaaggtcctgagtaggtat

SEQ ID NO: 528716 - DNA, 20 bp, Artificial Sequence
  chemically synthesized
aacgacaatgtctttgtctc

SEQ ID NO: 528717 - DNA, 20 bp, Artificial Sequence
  chemically synthesized
actgaaggctttaatcaacg

SEQ ID NO: 528718 - DNA, 20 bp, Artificial Sequence
  chemically synthesized
gaattatatgtggtaatgag

SEQ ID NO: 528719 - DNA, 20 bp, Artificial Sequence
  chemically synthesized
cttatctctgtggcatcaac

SEQ ID NO: 528720 - DNA, 20 bp, Artificial Sequence
  chemically synthesized
ggcatggctttgtcataaat

SEQ ID NO: 528721 - DNA, 20 bp, Artificial Sequence
  chemically synthesized
tcaaggcagtttgaaaaagg

SEQ ID NO: 528722 - DNA, 20 bp, Artificial Sequence
  chemically synthesized
gggagaattttgaaaagcaa

SEQ ID NO: 528723 - DNA, 20 bp, Artificial Sequence
  chemically synthesized
ttttacaaacctaatttcgt

SEQ ID NO: 528724 - DNA, 20 bp, Artificial Sequence
  chemically synthesized
aatactatgtgcaacaacca

SEQ ID NO: 528725 - DNA, 20 bp, Artificial Sequence
  chemically synthesized
gaggtatcttatctctgcct

SEQ ID NO: 528726 - DNA, 20 bp, Artificial Sequence
  chemically synthesized
tgacacctccctacaacccc

SEQ ID NO: 528727 - DNA, 20 bp, Artificial Sequence
  chemically synthesized
gagcatacttttagagaaaa

SEQ ID NO: 528728 - DNA, 20 bp, Artificial Sequence
  chemically synthesized
acaaatacgagcatactttt

SEQ ID NO: 528729 - DNA, 20 bp, Artificial Sequence
  chemically synthesized
catgcacagagagggcatct

SEQ ID NO: 528730 - DNA, 20 bp, Artificial Sequence
  chemically synthesized
tttaatttgccatttcctgt

SEQ ID NO: 528731 - DNA, 20 bp, Artificial Sequence
  chemically synthesized
aagacaggacagggcagatc

SEQ ID NO: 528732 - DNA, 20 bp, Artificial Sequence
  chemically synthesized
ttgaccttctaccaaattcc

SEQ ID NO: 528733 - DNA, 20 bp, Artificial Sequence
  chemically synthesized
gaacaaaccatcccattctt

SEQ ID NO: 528734 - DNA, 20 bp, Artificial Sequence
  chemically synthesized
agatatccaagaccattctc

SEQ ID NO: 528735 - DNA, 20 bp, Artificial Sequence
  chemically synthesized
atagaattgcggcatattcc

SEQ ID NO: 528736 - DNA, 20 bp, Artificial Sequence
  chemically synthesized
tctctgtgaatgtcatttac

SEQ ID NO: 528737 - DNA, 20 bp, Artificial Sequence
  chemically synthesized
gcagagttgcctatttagag

SEQ ID NO: 528738 - DNA, 20 bp, Artificial Sequence
  chemically synthesized
taagaacctgtgtctcattc

SEQ ID NO: 528739 - DNA, 20 bp, Artificial Sequence
  chemically synthesized
cgtaccattgcacccgggtc

SEQ ID NO: 528740 - DNA, 20 bp, Artificial Sequence
  chemically synthesized
tgacccgggtgcaatggtac

SEQ ID NO: 528741 - DNA, 20 bp, Artificial Sequence
  chemically synthesized
agttggaactgacactgtaa

SEQ ID NO: 528742 - DNA, 20 bp, Artificial Sequence
  chemically synthesized
tactgattattctcaataaa

SEQ ID NO: 528743 - DNA, 20 bp, Artificial Sequence
  chemically synthesized
agaaaacatttctactttat

SEQ ID NO: 528744 - DNA, 20 bp, Artificial Sequence
  chemically synthesized
ttgtcagtgaagaccatggt

SEQ ID NO: 528745 - DNA, 20 bp, Artificial Sequence
  chemically synthesized
aaaactgtcaaggaattttc

SEQ ID NO: 528746 - DNA, 20 bp, Artificial Sequence
  chemically synthesized
cagagcactttggacctttc

SEQ ID NO: 528747 - DNA, 20 bp, Artificial Sequence
  chemically synthesized
ctgctagatccctgcagttg

SEQ ID NO: 528748 - DNA, 20 bp, Artificial Sequence
  chemically synthesized
tagatgagagcaggatgtat

SEQ ID NO: 528749 - DNA, 20 bp, Artificial Sequence
  chemically synthesized
ggagaacaaaagaagatggc

SEQ ID NO: 528750 - DNA, 20 bp, Artificial Sequence
  chemically synthesized
ggcatagaaaaagcaagtca

SEQ ID NO: 528751 - DNA, 20 bp, Artificial Sequence
  chemically synthesized
agcttgatttttttctacat

SEQ ID NO: 528752 - DNA, 20 bp, Artificial Sequence
  chemically synthesized
ctttcactggatttctgcat

SEQ ID NO: 528753 - DNA, 20 bp, Artificial Sequence
  chemically synthesized
aaaatagcagaaattgtaga

SEQ ID NO: 528754 - DNA, 20 bp, Artificial Sequence
  chemically synthesized
aagacagtcatgtaaaaata

SEQ ID NO: 528755 - DNA, 20 bp, Artificial Sequence
  chemically synthesized
cttatttttcatcatcaaat

SEQ ID NO: 528756 - DNA, 20 bp, Artificial Sequence
  chemically synthesized
tattatctacctcaaacatt

SEQ ID NO: 528757 - DNA, 20 bp, Artificial Sequence
  chemically synthesized
ttatatttcagaatagaatt

SEQ ID NO: 528758 - DNA, 20 bp, Artificial Sequence
  chemically synthesized
ctttgattttatatttcaga

SEQ ID NO: 528759 - DNA, 20 bp, Artificial Sequence
  chemically synthesized
caaggctttgattttatatt

SEQ ID NO: 528760 - DNA, 20 bp, Artificial Sequence
  chemically synthesized
aacaaaaaaaaaaaagagag

SEQ ID NO: 528761 - DNA, 20 bp, Artificial Sequence
  chemically synthesized
atggagctaaacagattatt

SEQ ID NO: 528762 - DNA, 20 bp, Artificial Sequence
  chemically synthesized
gagtgcatacacttgcacac

SEQ ID NO: 528763 - DNA, 20 bp, Artificial Sequence
  chemically synthesized
tctgcataccaatgacaaag

SEQ ID NO: 528764 - DNA, 20 bp, Artificial Sequence
  chemically synthesized
cataccaatgacaaagctag

SEQ ID NO: 528765 - DNA, 20 bp, Artificial Sequence
  chemically synthesized
gaatcctagcagatcttgag

SEQ ID NO: 528766 - DNA, 20 bp, Artificial Sequence
  chemically synthesized
tgaggaaagaggggagctag

SEQ ID NO: 528767 - DNA, 20 bp, Artificial Sequence
  chemically synthesized
actcaggagtgtatttgaaa

SEQ ID NO: 528768 - DNA, 20 bp, Artificial Sequence
  chemically synthesized
aacactttgaattggtacca

SEQ ID NO: 528769 - DNA, 20 bp, Artificial Sequence
  chemically synthesized
atttcatttgaaaatctgag

SEQ ID NO: 528770 - DNA, 20 bp, Artificial Sequence
  chemically synthesized
tttacacggataaatgaaag

SEQ ID NO: 528771 - DNA, 20 bp, Artificial Sequence
  chemically synthesized
gataaatgaaaggcagaatt

SEQ ID NO: 528772 - DNA, 20 bp, Artificial Sequence
  chemically synthesized
aacttatataagtcattgag

SEQ ID NO: 528773 - DNA, 20 bp, Artificial Sequence
  chemically synthesized
cggagcttggagcaatgcat

SEQ ID NO: 528774 - DNA, 20 bp, Artificial Sequence
  chemically synthesized
gcctgtttacctccaagtta

SEQ ID NO: 528775 - DNA, 20 bp, Artificial Sequence
  chemically synthesized
ttagcctgtcattacggaca

SEQ ID NO: 528776 - DNA, 20 bp, Artificial Sequence
  chemically synthesized
atcatcttaatgatatctaa

SEQ ID NO: 528777 - DNA, 20 bp, Artificial Sequence
  chemically synthesized
aacttaagtgggtatggaga

SEQ ID NO: 528778 - DNA, 20 bp, Artificial Sequence
  chemically synthesized
cccacttaagttgaaaaata

SEQ ID NO: 528779 - DNA, 20 bp, Artificial Sequence
  chemically synthesized
tcaaaatggattttatgtcc

SEQ ID NO: 528780 - DNA, 20 bp, Artificial Sequence
  chemically synthesized
gaagttctagcagtacaact

SEQ ID NO: 528781 - DNA, 20 bp, Artificial Sequence
  chemically synthesized
ttgactgcctaagagaacag

SEQ ID NO: 528782 - DNA, 20 bp, Artificial Sequence
  chemically synthesized
caacagtaaaatgtgtggcc

SEQ ID NO: 528783 - DNA, 20 bp, Artificial Sequence
  chemically synthesized
ttaatactttttcccatagc

SEQ ID NO: 528784 - DNA, 20 bp, Artificial Sequence
  chemically synthesized
taaacgatcaagctaataat

SEQ ID NO: 528785 - DNA, 20 bp, Artificial Sequence
  chemically synthesized
ataactagttattgaagaca

SEQ ID NO: 528786 - DNA, 20 bp, Artificial Sequence
  chemically synthesized
ccttcataaggattaggcca

SEQ ID NO: 528787 - DNA, 20 bp, Artificial Sequence
  chemically synthesized
aacacaaagtcatgctcaga

SEQ ID NO: 528788 - DNA, 20 bp, Artificial Sequence
  chemically synthesized
ttggagaatatagacaaagg

SEQ ID NO: 528789 - DNA, 20 bp, Artificial Sequence
  chemically synthesized
aaggatatctcacccatctt

SEQ ID NO: 528790 - DNA, 20 bp, Artificial Sequence
  chemically synthesized
gtgaataaataacataaaga

SEQ ID NO: 528791 - DNA, 20 bp, Artificial Sequence
  chemically synthesized
ggttagttgggcattttcct

SEQ ID NO: 528792 - DNA, 20 bp, Artificial Sequence
  chemically synthesized
cgtttccactccccatgagt

SEQ ID NO: 528793 - DNA, 20 bp, Artificial Sequence
  chemically synthesized
tactctgaatactaataatg

SEQ ID NO: 528794 - DNA, 20 bp, Artificial Sequence
  chemically synthesized
ctcattccatgccagggcat

SEQ ID NO: 528795 - DNA, 20 bp, Artificial Sequence
  chemically synthesized
ttacgttttttatcaggcta

SEQ ID NO: 528796 - DNA, 20 bp, Artificial Sequence
  chemically synthesized
attaaaacttatgtgacgtc

SEQ ID NO: 528797 - DNA, 20 bp, Artificial Sequence
  chemically synthesized
aaggataaatcatggcaaga

SEQ ID NO: 528798 - DNA, 20 bp, Artificial Sequence
  chemically synthesized
ttagtagcactacatttatg

SEQ ID NO: 528799 - DNA, 20 bp, Artificial Sequence
  chemically synthesized
acagtgaaatataactttcc

SEQ ID NO: 528800 - DNA, 20 bp, Artificial Sequence
  chemically synthesized
agaacaggtctttgttttca

SEQ ID NO: 528801 - DNA, 20 bp, Artificial Sequence
  chemically synthesized
ttggtaaacatgtccagcag

SEQ ID NO: 528802 - DNA, 20 bp, Artificial Sequence
  chemically synthesized
tttaaaggtaaaaattggtg

SEQ ID NO: 528803 - DNA, 20 bp, Artificial Sequence
  chemically synthesized
tcaaacacaaagaaggtgag

SEQ ID NO: 528804 - DNA, 20 bp, Artificial Sequence
  chemically synthesized
tacatgatatgctgtaaaga

SEQ ID NO: 528805 - DNA, 20 bp, Artificial Sequence
  chemically synthesized
aaaatgatactatattatat

SEQ ID NO: 528806 - DNA, 20 bp, Artificial Sequence
  chemically synthesized
ttacaaatagtttaacctcc

SEQ ID NO: 528807 - DNA, 20 bp, Artificial Sequence
  chemically synthesized
tcaccaacaagagcattagt

SEQ ID NO: 528808 - DNA, 20 bp, Artificial Sequence
  chemically synthesized
tcagacaagtttggggaaaa

SEQ ID NO: 528809 - DNA, 20 bp, Artificial Sequence
  chemically synthesized
ggacgaggcaggcctataag

SEQ ID NO: 528810 - DNA, 20 bp, Artificial Sequence
  chemically synthesized
cacagataccatccattaat

SEQ ID NO: 528811 - DNA, 20 bp, Artificial Sequence
  chemically synthesized
agttatgttatacacatggc

SEQ ID NO: 528812 - DNA, 20 bp, Artificial Sequence
  chemically synthesized
tgtatacattatccatagaa

SEQ ID NO: 528813 - DNA, 20 bp, Artificial Sequence
  chemically synthesized
actaaatgtatacattatcc

SEQ ID NO: 528814 - DNA, 20 bp, Artificial Sequence
  chemically synthesized
ttttaataaaagcagaagta

SEQ ID NO: 528815 - DNA, 20 bp, Artificial Sequence
  chemically synthesized
ttctctggaaaattcccatc

SEQ ID NO: 528816 - DNA, 20 bp, Artificial Sequence
  chemically synthesized
gtaggaggacaaaatgcttc

SEQ ID NO: 528817 - DNA, 20 bp, Artificial Sequence
  chemically synthesized
aatttcggaattataggatg

SEQ ID NO: 528818 - DNA, 20 bp, Artificial Sequence
  chemically synthesized
gatctatgcaattttgtaaa

SEQ ID NO: 528819 - DNA, 20 bp, Artificial Sequence
  chemically synthesized
ccactaatttctagcacaaa

SEQ ID NO: 528820 - DNA, 20 bp, Artificial Sequence
  chemically synthesized
cagggtcattctattttgtg

SEQ ID NO: 528821 - DNA, 20 bp, Artificial Sequence
  chemically synthesized
ttatattgtgaggttttaaa

SEQ ID NO: 528822 - DNA, 20 bp, Artificial Sequence
  chemically synthesized
gttttagcacacagtatctc

SEQ ID NO: 528823 - DNA, 20 bp, Artificial Sequence
  chemically synthesized
actgtgtgctaaaacatagg

SEQ ID NO: 528824 - DNA, 20 bp, Artificial Sequence
  chemically synthesized
agaattctagcctatggaga

SEQ ID NO: 528825 - DNA, 20 bp, Artificial Sequence
  chemically synthesized
tcttttcttatctccatagg

SEQ ID NO: 528826 - DNA, 20 bp, Artificial Sequence
  chemically synthesized
atgaaaaaatgttaacccta

SEQ ID NO: 528827 - DNA, 20 bp, Artificial Sequence
  chemically synthesized
cttttgtgctattccaatta

SEQ ID NO: 528828 - DNA, 20 bp, Artificial Sequence
  chemically synthesized
tcttccatttctctgctgac

SEQ ID NO: 528829 - DNA, 20 bp, Artificial Sequence
  chemically synthesized
taagggctttctgtgtcagc

SEQ ID NO: 528830 - DNA, 20 bp, Artificial Sequence
  chemically synthesized
ggacttggttgaaacactaa

SEQ ID NO: 528831 - DNA, 20 bp, Artificial Sequence
  chemically synthesized
ctttttcttttttaatgtaa

SEQ ID NO: 528832 - DNA, 20 bp, Artificial Sequence
  chemically synthesized
ttgtttcttcttacattaaa

SEQ ID NO: 528833 - DNA, 20 bp, Artificial Sequence
  chemically synthesized
taccagtagctaagcttgca

SEQ ID NO: 528834 - DNA, 20 bp, Artificial Sequence
  chemically synthesized
agcttgcattagaaaatgtg

SEQ ID NO: 528835 - DNA, 20 bp, Artificial Sequence
  chemically synthesized
attatcttactgtagtatat

SEQ ID NO: 528836 - DNA, 20 bp, Artificial Sequence
  chemically synthesized
aaatggaattcttccctgag

SEQ ID NO: 528837 - DNA, 20 bp, Artificial Sequence
  chemically synthesized
taagacctttctctctcagg

SEQ ID NO: 528838 - DNA, 20 bp, Artificial Sequence
  chemically synthesized
aaccctggcatagcccatta

SEQ ID NO: 528839 - DNA, 20 bp, Artificial Sequence
  chemically synthesized
tgctatcctggaagtgtgta

SEQ ID NO: 528840 - DNA, 20 bp, Artificial Sequence
  chemically synthesized
accttggagcataagtacac

SEQ ID NO: 528841 - DNA, 20 bp, Artificial Sequence
  chemically synthesized
atactttaataccattttat

SEQ ID NO: 528842 - DNA, 20 bp, Artificial Sequence
  chemically synthesized
catggaattatccttgaggc

SEQ ID NO: 528843 - DNA, 20 bp, Artificial Sequence
  chemically synthesized
ataggcgccactgatattaa

SEQ ID NO: 528844 - DNA, 20 bp, Artificial Sequence
  chemically synthesized
agcacaagaacttacaataa

SEQ ID NO: 528845 - DNA, 20 bp, Artificial Sequence
  chemically synthesized
taaaagagacatttattaaa

SEQ ID NO: 528846 - DNA, 20 bp, Artificial Sequence
  chemically synthesized
gagatgaatcatttaaaaac

SEQ ID NO: 528847 - DNA, 20 bp, Artificial Sequence
  chemically synthesized
acattcatttaggtttcaat

SEQ ID NO: 528848 - DNA, 20 bp, Artificial Sequence
  chemically synthesized
gtttcaatgcagaatcgctc

SEQ ID NO: 528849 - DNA, 20 bp, Artificial Sequence
  chemically synthesized
tgatccatttgatatggatc

SEQ ID NO: 528850 - DNA, 20 bp, Artificial Sequence
  chemically synthesized
taaatacaattactgctatt

SEQ ID NO: 528851 - DNA, 20 bp, Artificial Sequence
  chemically synthesized
tgggaagttttaattttgag

SEQ ID NO: 528852 - DNA, 20 bp, Artificial Sequence
  chemically synthesized
tgaagagttggttagattat

SEQ ID NO: 528853 - DNA, 20 bp, Artificial Sequence
  chemically synthesized
tgggaggtgtgttttagttg

SEQ ID NO: 528854 - DNA, 20 bp, Artificial Sequence
  chemically synthesized
aggagctacacgtaagctaa

SEQ ID NO: 528855 - DNA, 20 bp, Artificial Sequence
  chemically synthesized
tggaaataagtttaaccgag

SEQ ID NO: 528856 - DNA, 20 bp, Artificial Sequence
  chemically synthesized
aagttacaaccgttcataaa

SEQ ID NO: 528857 - DNA, 20 bp, Artificial Sequence
  chemically synthesized
caataaaaaagatttaataa

SEQ ID NO: 528858 - DNA, 20 bp, Artificial Sequence
  chemically synthesized
attcggaagataagcttgtg

SEQ ID NO: 528859 - DNA, 20 bp, Artificial Sequence
  chemically synthesized
taggcactttgtttgctaat

SEQ ID NO: 528860 - DNA, 20 bp, Artificial Sequence
  chemically synthesized
ttatctcagagtttataatg

SEQ ID NO: 528861 - DNA, 20 bp, Artificial Sequence
  chemically synthesized
tacacaccaatagtaataac

SEQ ID NO: 528862 - DNA, 20 bp, Artificial Sequence
  chemically synthesized
aagtgagtttagttcaaaat

SEQ ID NO: 528863 - DNA, 20 bp, Artificial Sequence
  chemically synthesized
aagtggactattaaaaatca

SEQ ID NO: 528864 - DNA, 20 bp, Artificial Sequence
  chemically synthesized
ttcttgagattcgatgcttt

SEQ ID NO: 528865 - DNA, 20 bp, Artificial Sequence
  chemically synthesized
ttctaaaaagcatcgaatct

SEQ ID NO: 528866 - DNA, 20 bp, Artificial Sequence
  chemically synthesized
gaatctcaagaaatatggct

SEQ ID NO: 528867 - DNA, 20 bp, Artificial Sequence
  chemically synthesized
cttcttccttgcttttatat

SEQ ID NO: 528868 - DNA, 20 bp, Artificial Sequence
  chemically synthesized
accaggtgaaattcaaacca

SEQ ID NO: 528869 - DNA, 20 bp, Artificial Sequence
  chemically synthesized
agtaccatctacacagatca

SEQ ID NO: 528870 - DNA, 20 bp, Artificial Sequence
  chemically synthesized
tggtactttcaaagtctcat

SEQ ID NO: 528871 - DNA, 20 bp, Artificial Sequence
  chemically synthesized
ctttcaaagtctcatcaaga

SEQ ID NO: 528872 - DNA, 20 bp, Artificial Sequence
  chemically synthesized
ccataaaacaaaacaaaaca

SEQ ID NO: 528873 - DNA, 20 bp, Artificial Sequence
  chemically synthesized
tcagcaaaaaaagtactcac

SEQ ID NO: 528874 - DNA, 20 bp, Artificial Sequence
  chemically synthesized
ccaaggtgtaaagtgaatta

SEQ ID NO: 528875 - DNA, 20 bp, Artificial Sequence
  chemically synthesized
gaagacgtcccctttgatct

SEQ ID NO: 528876 - DNA, 20 bp, Artificial Sequence
  chemically synthesized
gtgactatattttcttttga

SEQ ID NO: 528877 - DNA, 20 bp, Artificial Sequence
  chemically synthesized
tagtcacttgtttctactca

SEQ ID NO: 528878 - DNA, 20 bp, Artificial Sequence
  chemically synthesized
taattgccttacaagcctta

SEQ ID NO: 528879 - DNA, 20 bp, Artificial Sequence
  chemically synthesized
ataaagtttaacttttggaa

SEQ ID NO: 528880 - DNA, 20 bp, Artificial Sequence
  chemically synthesized
tttatttacattagctgaaa

SEQ ID NO: 528881 - DNA, 20 bp, Artificial Sequence
  chemically synthesized
ttttcagctaatgtaaataa

SEQ ID NO: 528882 - DNA, 20 bp, Artificial Sequence
  chemically synthesized
cagctaatgtaaataaaaag

SEQ ID NO: 528883 - DNA, 20 bp, Artificial Sequence
  chemically synthesized
acacgttgttatgataaata

SEQ ID NO: 528884 - DNA, 20 bp, Artificial Sequence
  chemically synthesized
ttatagagatggtcagtgat

SEQ ID NO: 528885 - DNA, 20 bp, Artificial Sequence
  chemically synthesized
tggcattaccttggtcttta

SEQ ID NO: 528886 - DNA, 20 bp, Artificial Sequence
  chemically synthesized
gtttagagaagaggagactg

SEQ ID NO: 528887 - DNA, 20 bp, Artificial Sequence
  chemically synthesized
aagaggagactgtaagaatt

SEQ ID NO: 528888 - DNA, 20 bp, Artificial Sequence
  chemically synthesized
gtaagaattaaagaaagaga

SEQ ID NO: 528889 - DNA, 20 bp, Artificial Sequence
  chemically synthesized
tcaacagggacaggtttatt

SEQ ID NO: 528890 - DNA, 20 bp, Artificial Sequence
  chemically synthesized
gacctgagtacaaatctgcc

SEQ ID NO: 528891 - DNA, 20 bp, Artificial Sequence
  chemically synthesized
tcttcaatacaaccatgcac

SEQ ID NO: 528892 - DNA, 20 bp, Artificial Sequence
  chemically synthesized
tatggccttttgcaactcga

SEQ ID NO: 528893 - DNA, 20 bp, Artificial Sequence
  chemically synthesized
gttctttgggaatttgattc

SEQ ID NO: 528894 - DNA, 20 bp, Artificial Sequence
  chemically synthesized
ccttctaccacgttctaatt

SEQ ID NO: 528895 - DNA, 20 bp, Artificial Sequence
  chemically synthesized
accacgttctaatttgagaa

SEQ ID NO: 528896 - DNA, 20 bp, Artificial Sequence
  chemically synthesized
ggcaccggaaaaatctggag

SEQ ID NO: 528897 - DNA, 20 bp, Artificial Sequence
  chemically synthesized
tacagtaccaaaacattttg

SEQ ID NO: 528898 - DNA, 20 bp, Artificial Sequence
  chemically synthesized
tataaacatatggaaggagg

SEQ ID NO: 528899 - DNA, 20 bp, Artificial Sequence
  chemically synthesized
atgttttgaaaataattgct

SEQ ID NO: 528900 - DNA, 20 bp, Artificial Sequence
  chemically synthesized
taaagcaatttcacaagaca

SEQ ID NO: 528901 - DNA, 20 bp, Artificial Sequence
  chemically synthesized
agatgaatcgtatcagtcaa

SEQ ID NO: 528902 - DNA, 20 bp, Artificial Sequence
  chemically synthesized
actcttttatctctatctct

SEQ ID NO: 528903 - DNA, 20 bp, Artificial Sequence
  chemically synthesized
catgaaatttggattagatg

SEQ ID NO: 528904 - DNA, 20 bp, Artificial Sequence
  chemically synthesized
ttggtacatttcctccatta

SEQ ID NO: 528905 - DNA, 20 bp, Artificial Sequence
  chemically synthesized
aaggcaggagagtatgaaac

SEQ ID NO: 528906 - DNA, 20 bp, Artificial Sequence
  chemically synthesized
aattggctaaggttcttatc

SEQ ID NO: 528907 - DNA, 20 bp, Artificial Sequence
  chemically synthesized
ccacttccccatatgtgaca

SEQ ID NO: 528908 - DNA, 20 bp, Artificial Sequence
  chemically synthesized
aatataatatgataagggca

SEQ ID NO: 528909 - DNA, 20 bp, Artificial Sequence
  chemically synthesized
aatttttataaaataaagaa

SEQ ID NO: 528910 - DNA, 20 bp, Artificial Sequence
  chemically synthesized
agcccactagctaaggaagc

SEQ ID NO: 528911 - DNA, 20 bp, Artificial Sequence
  chemically synthesized
ggaagcagagaaaaggtagc

SEQ ID NO: 528912 - DNA, 20 bp, Artificial Sequence
  chemically synthesized
atggtatcatttttacctgc

SEQ ID NO: 528913 - DNA, 20 bp, Artificial Sequence
  chemically synthesized
cactgttgtctatctaggct

SEQ ID NO: 528914 - DNA, 20 bp, Artificial Sequence
  chemically synthesized
gcaacagtacaaggtagtta

SEQ ID NO: 528915 - DNA, 20 bp, Artificial Sequence
  chemically synthesized
gctctatggtctatgcctgt

SEQ ID NO: 528916 - DNA, 20 bp, Artificial Sequence
  chemically synthesized
tttgtggcttattcatcact

SEQ ID NO: 528917 - DNA, 20 bp, Artificial Sequence
  chemically synthesized
catttaaggacatcgcagtt

SEQ ID NO: 528918 - DNA, 20 bp, Artificial Sequence
  chemically synthesized
tccatgatattttaagacta

SEQ ID NO: 528919 - DNA, 20 bp, Artificial Sequence
  chemically synthesized
agttcactgggatactatac

SEQ ID NO: 528920 - DNA, 20 bp, Artificial Sequence
  chemically synthesized
tttttttctcccttaagtaa

SEQ ID NO: 528921 - DNA, 20 bp, Artificial Sequence
  chemically synthesized
aacaattcttgttacttaag

SEQ ID NO: 528922 - DNA, 20 bp, Artificial Sequence
  chemically synthesized
agctactattatggttcctc

SEQ ID NO: 528923 - DNA, 20 bp, Artificial Sequence
  chemically synthesized
ctattatggttcctcccaga

SEQ ID NO: 528924 - DNA, 20 bp, Artificial Sequence
  chemically synthesized
tcctgtttatagaaacttcc

SEQ ID NO: 528925 - DNA, 20 bp, Artificial Sequence
  chemically synthesized
tttcacggtctttcctgttt

SEQ ID NO: 528926 - DNA, 20 bp, Artificial Sequence
  chemically synthesized
cataaaaaggtgaaaaatga

SEQ ID NO: 528927 - DNA, 20 bp, Artificial Sequence
  chemically synthesized
tcctgcacagagtggctgct

SEQ ID NO: 528928 - DNA, 20 bp, Artificial Sequence
  chemically synthesized
cagttcgattaataagttaa

SEQ ID NO: 528929 - DNA, 20 bp, Artificial Sequence
  chemically synthesized
taataagttaaacagaaaag

SEQ ID NO: 528930 - DNA, 20 bp, Artificial Sequence
  chemically synthesized
ttggatatcagggagcattt

SEQ ID NO: 528931 - DNA, 20 bp, Artificial Sequence
  chemically synthesized
tctttttggctactagatga

SEQ ID NO: 528932 - DNA, 20 bp, Artificial Sequence
  chemically synthesized
ttggctactagatgacaaga

SEQ ID NO: 528933 - DNA, 20 bp, Artificial Sequence
  chemically synthesized
aagaaaacaaaaccaacaaa

SEQ ID NO: 528934 - DNA, 20 bp, Artificial Sequence
  chemically synthesized
gacaactgatttttttttct

SEQ ID NO: 528935 - DNA, 20 bp, Artificial Sequence
  chemically synthesized
ttctatgagaaacagattct

SEQ ID NO: 528936 - DNA, 20 bp, Artificial Sequence
  chemically synthesized
ttctagagaatctgtttctc

SEQ ID NO: 528937 - DNA, 20 bp, Artificial Sequence
  chemically synthesized
agcccctcattatgattcta

SEQ ID NO: 528938 - DNA, 20 bp, Artificial Sequence
  chemically synthesized
aagcaaactgattttgtaga

SEQ ID NO: 528939 - DNA, 20 bp, Artificial Sequence
  chemically synthesized
agctagcagcagagctgata

SEQ ID NO: 528940 - DNA, 20 bp, Artificial Sequence
  chemically synthesized
agagagaaatagagaggcag

SEQ ID NO: 528941 - DNA, 20 bp, Artificial Sequence
  chemically synthesized
acatttagactttgaaagag

SEQ ID NO: 528942 - DNA, 20 bp, Artificial Sequence
  chemically synthesized
tctctttcaaagtctaaatg

SEQ ID NO: 528943 - DNA, 20 bp, Artificial Sequence
  chemically synthesized
cagatggaagatttgagatg

SEQ ID NO: 528944 - DNA, 20 bp, Artificial Sequence
  chemically synthesized
ttctgcctgaaatatgtccc

SEQ ID NO: 528945 - DNA, 20 bp, Artificial Sequence
  chemically synthesized
attttcagacaaacagagct

SEQ ID NO: 528946 - DNA, 20 bp, Artificial Sequence
  chemically synthesized
ctacttgggaggctgaggca

SEQ ID NO: 528947 - DNA, 20 bp, Artificial Sequence
  chemically synthesized
gctcaccatcactggccatc

SEQ ID NO: 528948 - DNA, 20 bp, Artificial Sequence
  chemically synthesized
gagataccatctcacaccag

SEQ ID NO: 528949 - DNA, 20 bp, Artificial Sequence
  chemically synthesized
acaggtgctggagaggatgt

SEQ ID NO: 528950 - DNA, 20 bp, Artificial Sequence
  chemically synthesized
gattcctcagggatctagaa

SEQ ID NO: 528951 - DNA, 20 bp, Artificial Sequence
  chemically synthesized
ccaacaatgatagactggat

SEQ ID NO: 528952 - DNA, 20 bp, Artificial Sequence
  chemically synthesized
ttgtccttgcgatagtttac

SEQ ID NO: 528953 - DNA, 20 bp, Artificial Sequence
  chemically synthesized
aatcctagaaacagcacaag

SEQ ID NO: 528954 - DNA, 20 bp, Artificial Sequence
  chemically synthesized
taagcagtctaaatcaaatc

SEQ ID NO: 528955 - DNA, 20 bp, Artificial Sequence
  chemically synthesized
agaagaggcactatttgttg

SEQ ID NO: 528956 - DNA, 20 bp, Artificial Sequence
  chemically synthesized
tatgtaacagagttctgaaa

SEQ ID NO: 528957 - DNA, 20 bp, Artificial Sequence
  chemically synthesized
gaactagggaagtcctgttc

SEQ ID NO: 528958 - DNA, 20 bp, Artificial Sequence
  chemically synthesized
agtaaggcagaaggaattaa

SEQ ID NO: 528959 - DNA, 20 bp, Artificial Sequence
  chemically synthesized
gggtttacagcagaccggca

SEQ ID NO: 528960 - DNA, 20 bp, Artificial Sequence
  chemically synthesized
gattattgtacttttgacat

SEQ ID NO: 528961 - DNA, 20 bp, Artificial Sequence
  chemically synthesized
tcttaattgtgtttatgcag

SEQ ID NO: 528962 - DNA, 20 bp, Artificial Sequence
  chemically synthesized
tctaactgcataaacacaat

SEQ ID NO: 528963 - DNA, 20 bp, Artificial Sequence
  chemically synthesized
acctacgataacatcatatt

SEQ ID NO: 528964 - DNA, 20 bp, Artificial Sequence
  chemically synthesized
atcaaggtgaatgagaacca

SEQ ID NO: 528965 - DNA, 20 bp, Artificial Sequence
  chemically synthesized
agaaatcaaggtggaaaaag

SEQ ID NO: 528966 - DNA, 20 bp, Artificial Sequence
  chemically synthesized
cacaagaaatcaaggtggaa

SEQ ID NO: 528967 - DNA, 20 bp, Artificial Sequence
  chemically synthesized
caaaaaacatattaagcaca

SEQ ID NO: 528968 - DNA, 20 bp, Artificial Sequence
  chemically synthesized
gctcaagcttttatttatct

SEQ ID NO: 528969 - DNA, 20 bp, Artificial Sequence
  chemically synthesized
agataaataaaagcttgagc

SEQ ID NO: 528970 - DNA, 20 bp, Artificial Sequence
  chemically synthesized
agcaaaggagaatcatctct

SEQ ID NO: 528971 - DNA, 20 bp, Artificial Sequence
  chemically synthesized
tggttcttggcaaaagcaaa

SEQ ID NO: 528972 - DNA, 20 bp, Artificial Sequence
  chemically synthesized
aggacatatccacatttcag

SEQ ID NO: 528973 - DNA, 20 bp, Artificial Sequence
  chemically synthesized
ttattatagtgttgctaaat

SEQ ID NO: 528974 - DNA, 20 bp, Artificial Sequence
  chemically synthesized
tgctactgtttaccaaagac

SEQ ID NO: 528975 - DNA, 20 bp, Artificial Sequence
  chemically synthesized
ccaccaatggaagactgaat

SEQ ID NO: 528976 - DNA, 20 bp, Artificial Sequence
  chemically synthesized
caccctggaatactccggag

SEQ ID NO: 528977 - DNA, 20 bp, Artificial Sequence
  chemically synthesized
gaatactccggagccagaaa

SEQ ID NO: 528978 - DNA, 20 bp, Artificial Sequence
  chemically synthesized
cttagcaaactaatgcagga

SEQ ID NO: 528979 - DNA, 20 bp, Artificial Sequence
  chemically synthesized
catgacacaagtttacctca

SEQ ID NO: 528980 - DNA, 20 bp, Artificial Sequence
  chemically synthesized
tctgtgatggaactctacac

SEQ ID NO: 528981 - DNA, 20 bp, Artificial Sequence
  chemically synthesized
ttgtggaaaaaaaagtttat

SEQ ID NO: 528982 - DNA, 20 bp, Artificial Sequence
  chemically synthesized
taatatttccagtttgtagc

SEQ ID NO: 528983 - DNA, 20 bp, Artificial Sequence
  chemically synthesized
gaaccgtgtctgacacatag

SEQ ID NO: 528984 - DNA, 20 bp, Artificial Sequence
  chemically synthesized
gtcatatgaagaagaagtaa

SEQ ID NO: 528985 - DNA, 20 bp, Artificial Sequence
  chemically synthesized
gcttagtttgccattgtcat

SEQ ID NO: 528986 - DNA, 20 bp, Artificial Sequence
  chemically synthesized
cattctccgcaatcatattt

SEQ ID NO: 528987 - DNA, 20 bp, Artificial Sequence
  chemically synthesized
tattcttcaaatatgattgc

SEQ ID NO: 528988 - DNA, 20 bp, Artificial Sequence
  chemically synthesized
gtaatccagttacactgtct

SEQ ID NO: 528989 - DNA, 20 bp, Artificial Sequence
  chemically synthesized
tgagcctacggtacagaaca

SEQ ID NO: 528990 - DNA, 20 bp, Artificial Sequence
  chemically synthesized
acgagaaggtcaaattaatg

SEQ ID NO: 528991 - DNA, 20 bp, Artificial Sequence
  chemically synthesized
tttaatatgttaacgtgctc

SEQ ID NO: 528992 - DNA, 20 bp, Artificial Sequence
  chemically synthesized
tctctctctctctctctctc

SEQ ID NO: 528993 - DNA, 20 bp, Artificial Sequence
  chemically synthesized
ctccactgaggacagaacaa

SEQ ID NO: 528994 - DNA, 20 bp, Artificial Sequence
  chemically synthesized
gaaacagacttaagcagcat

SEQ ID NO: 528995 - DNA, 20 bp, Artificial Sequence
  chemically synthesized
tttaggctgtagctcatatg

SEQ ID NO: 528996 - DNA, 20 bp, Artificial Sequence
  chemically synthesized
gtgaattaccaagggaggct

SEQ ID NO: 528997 - DNA, 20 bp, Artificial Sequence
  chemically synthesized
atgttcaacctttaagcata

SEQ ID NO: 528998 - DNA, 20 bp, Artificial Sequence
  chemically synthesized
catcttaggggctagaaatt

SEQ ID NO: 528999 - DNA, 20 bp, Artificial Sequence
  chemically synthesized
tggatcttgcatcttagggg

SEQ ID NO: 529000 - DNA, 20 bp, Artificial Sequence
  chemically synthesized
cataaaaatgaaagattgaa

SEQ ID NO: 529001 - DNA, 20 bp, Artificial Sequence
  chemically synthesized
ttgtctggcaatgaagaagg

SEQ ID NO: 529002 - DNA, 20 bp, Artificial Sequence
  chemically synthesized
tctgtaaagacctaacagaa

SEQ ID NO: 529003 - DNA, 20 bp, Artificial Sequence
  chemically synthesized
aaaattacatttcgatcatt

SEQ ID NO: 529004 - DNA, 20 bp, Artificial Sequence
  chemically synthesized
cccttctatgtcatgcacac

SEQ ID NO: 529005 - DNA, 20 bp, Artificial Sequence
  chemically synthesized
tgaggaccaacagaaaaaga

SEQ ID NO: 529006 - DNA, 20 bp, Artificial Sequence
  chemically synthesized
ttgctggcaggtgaggacca

SEQ ID NO: 529007 - DNA, 20 bp, Artificial Sequence
  chemically synthesized
cctgccagcaactatccata

SEQ ID NO: 529008 - DNA, 20 bp, Artificial Sequence
  chemically synthesized
atataacaaggtacacagac

SEQ ID NO: 529009 - DNA, 20 bp, Artificial Sequence
  chemically synthesized
ttgctagaaattccagatat

SEQ ID NO: 529010 - DNA, 20 bp, Artificial Sequence
  chemically synthesized
ttgataggtaaatcggtttg

SEQ ID NO: 529011 - DNA, 20 bp, Artificial Sequence
  chemically synthesized
tttatagaaagcacaacatc

SEQ ID NO: 529012 - DNA, 20 bp, Artificial Sequence
  chemically synthesized
ccttcagtgtccaaggattt

SEQ ID NO: 529013 - DNA, 20 bp, Artificial Sequence
  chemically synthesized
gaattgattttattaccttg

SEQ ID NO: 529014 - DNA, 20 bp, Artificial Sequence
  chemically synthesized
aaaatcaattcatggctaca

SEQ ID NO: 529015 - DNA, 20 bp, Artificial Sequence
  chemically synthesized
agctgggatgcagggcttgc

SEQ ID NO: 529016 - DNA, 20 bp, Artificial Sequence
  chemically synthesized
gcccagtaattctcagataa

SEQ ID NO: 529017 - DNA, 20 bp, Artificial Sequence
  chemically synthesized
gatggtggtttcttgttatc

SEQ ID NO: 529018 - DNA, 20 bp, Artificial Sequence
  chemically synthesized
taattaatctgcaatttagg

SEQ ID NO: 529019 - DNA, 20 bp, Artificial Sequence
  chemically synthesized
attcaactgcaatatgatcg

SEQ ID NO: 529020 - DNA, 20 bp, Artificial Sequence
  chemically synthesized
attataaaatctgtatgaag

SEQ ID NO: 529021 - DNA, 20 bp, Artificial Sequence
  chemically synthesized
aaaggaaattttggacagtt

SEQ ID NO: 529022 - DNA, 20 bp, Artificial Sequence
  chemically synthesized
tttatgtgtgataccatcac

SEQ ID NO: 529023 - DNA, 20 bp, Artificial Sequence
  chemically synthesized
tctggacttagaaggtatgt

SEQ ID NO: 529024 - DNA, 20 bp, Artificial Sequence
  chemically synthesized
cggttgagaaccaccgacct

SEQ ID NO: 529025 - DNA, 20 bp, Artificial Sequence
  chemically synthesized
agtgtcgaccaaaaaacatc

SEQ ID NO: 529026 - DNA, 20 bp, Artificial Sequence
  chemically synthesized
atgttaaatttattttggaa

SEQ ID NO: 529027 - DNA, 20 bp, Artificial Sequence
  chemically synthesized
gactttctaaaatcgcccca

SEQ ID NO: 529028 - DNA, 20 bp, Artificial Sequence
  chemically synthesized
gaatttcttgtggggcgatt

SEQ ID NO: 529029 - DNA, 20 bp, Artificial Sequence
  chemically synthesized
tgtgtgctgctggatgtttt

SEQ ID NO: 529030 - DNA, 20 bp, Artificial Sequence
  chemically synthesized
cagcttcccacaacaaagaa

SEQ ID NO: 529031 - DNA, 20 bp, Artificial Sequence
  chemically synthesized
agcatcagtagcaccaaggt

SEQ ID NO: 529032 - DNA, 20 bp, Artificial Sequence
  chemically synthesized
tatggttcacttgtcaaaac

SEQ ID NO: 529033 - DNA, 20 bp, Artificial Sequence
  chemically synthesized
cggcaactatcctctacaac

SEQ ID NO: 529034 - DNA, 20 bp, Artificial Sequence
  chemically synthesized
gtattccaggataaacagtt

SEQ ID NO: 529035 - DNA, 20 bp, Artificial Sequence
  chemically synthesized
agtacaggtcataaccattt

SEQ ID NO: 529036 - DNA, 20 bp, Artificial Sequence
  chemically synthesized
aaatacatacatatccataa

SEQ ID NO: 529037 - DNA, 20 bp, Artificial Sequence
  chemically synthesized
attcctaaacatttttattg

SEQ ID NO: 529038 - DNA, 20 bp, Artificial Sequence
  chemically synthesized
ggcaaaaaaagagcttgtgc

SEQ ID NO: 529039 - DNA, 20 bp, Artificial Sequence
  chemically synthesized
aaggctttttataacgaggg

SEQ ID NO: 529040 - DNA, 20 bp, Artificial Sequence
  chemically synthesized
tggtagatttagaggttgtt

SEQ ID NO: 529041 - DNA, 20 bp, Artificial Sequence
  chemically synthesized
gaggaacaagaacaagctgt

SEQ ID NO: 529042 - DNA, 20 bp, Artificial Sequence
  chemically synthesized
ttgtatcagagctataagat

SEQ ID NO: 529043 - DNA, 20 bp, Artificial Sequence
  chemically synthesized
cggcctttataacatttagc

SEQ ID NO: 529044 - DNA, 20 bp, Artificial Sequence
  chemically synthesized
ttttaactttatgttacaga

SEQ ID NO: 529045 - DNA, 20 bp, Artificial Sequence
  chemically synthesized
gaagtggcaaaaaggaaaaa

SEQ ID NO: 529046 - DNA, 20 bp, Artificial Sequence
  chemically synthesized
atctgtttatgtggctctct

SEQ ID NO: 529047 - DNA, 20 bp, Artificial Sequence
  chemically synthesized
caaggtggttctgagtgtac

SEQ ID NO: 529048 - DNA, 20 bp, Artificial Sequence
  chemically synthesized
ggtagaagctcttctttaca

SEQ ID NO: 529049 - DNA, 20 bp, Artificial Sequence
  chemically synthesized
aagaaaatggtctaatacat

SEQ ID NO: 529050 - DNA, 20 bp, Artificial Sequence
  chemically synthesized
taatacatgcagaaagtatg

SEQ ID NO: 529051 - DNA, 20 bp, Artificial Sequence
  chemically synthesized
atgcagaaagtatggtagaa

SEQ ID NO: 529052 - DNA, 20 bp, Artificial Sequence
  chemically synthesized
atatccttttccctttgtaa

SEQ ID NO: 529053 - DNA, 20 bp, Artificial Sequence
  chemically synthesized
tttgttcctattggtatcac

SEQ ID NO: 529054 - DNA, 20 bp, Artificial Sequence
  chemically synthesized
atctaatcacaaggaaacca

SEQ ID NO: 529055 - DNA, 20 bp, Artificial Sequence
  chemically synthesized
gagttcagaccagttctctt

SEQ ID NO: 529056 - DNA, 20 bp, Artificial Sequence
  chemically synthesized
aaaaccttgactagatgctg

SEQ ID NO: 529057 - DNA, 20 bp, Artificial Sequence
  chemically synthesized
actgaactttccccagtgcc

SEQ ID NO: 529058 - DNA, 20 bp, Artificial Sequence
  chemically synthesized
gatagcattgcagttatgtt

SEQ ID NO: 529059 - DNA, 20 bp, Artificial Sequence
  chemically synthesized
tgttagagaatgtcatcctt

SEQ ID NO: 529060 - DNA, 20 bp, Artificial Sequence
  chemically synthesized
tcccatgaaggggtgacttg

SEQ ID NO: 529061 - DNA, 20 bp, Artificial Sequence
  chemically synthesized
tgcgttaggtttgtattttt

SEQ ID NO: 529062 - DNA, 20 bp, Artificial Sequence
  chemically synthesized
tcccataactaccatcttgg

SEQ ID NO: 529063 - DNA, 20 bp, Artificial Sequence
  chemically synthesized
aatttaacaggaaagttaaa

SEQ ID NO: 529064 - DNA, 20 bp, Artificial Sequence
  chemically synthesized
gaaaaggcaaaattacagga

SEQ ID NO: 529065 - DNA, 20 bp, Artificial Sequence
  chemically synthesized
atgatggaattttaggggtg

SEQ ID NO: 529066 - DNA, 20 bp, Artificial Sequence
  chemically synthesized
aggggtgatagaaatggaag

SEQ ID NO: 529067 - DNA, 20 bp, Artificial Sequence
  chemically synthesized
ggagggagagagagagaacg

SEQ ID NO: 529068 - DNA, 20 bp, Artificial Sequence
  chemically synthesized
gagagagagaacgaaagaaa

SEQ ID NO: 529069 - DNA, 20 bp, Artificial Sequence
  chemically synthesized
agagaacgaaagaaaagaga

SEQ ID NO: 529070 - DNA, 20 bp, Artificial Sequence
  chemically synthesized
aacgaaagaaaagagaaaag

SEQ ID NO: 529071 - DNA, 20 bp, Artificial Sequence
  chemically synthesized
aaagaaaagagaaaagaaag

SEQ ID NO: 529072 - DNA, 20 bp, Artificial Sequence
  chemically synthesized
acagggtgagaggaaggaag

SEQ ID NO: 529073 - DNA, 20 bp, Artificial Sequence
  chemically synthesized
ggtgagaggaaggaaggaag

SEQ ID NO: 529074 - DNA, 20 bp, Artificial Sequence
  chemically synthesized
cctatcttcaaaattctggt

SEQ ID NO: 529075 - DNA, 20 bp, Artificial Sequence
  chemically synthesized
agtaatggatgttttcttca

SEQ ID NO: 529076 - DNA, 20 bp, Artificial Sequence
  chemically synthesized
agttaaaattcctgcaattt

SEQ ID NO: 529077 - DNA, 20 bp, Artificial Sequence
  chemically synthesized
ttataaagaggtggcctttc

SEQ ID NO: 529078 - DNA, 20 bp, Artificial Sequence
  chemically synthesized
ctacttgggaggctgaggca

SEQ ID NO: 529079 - DNA, 20 bp, Artificial Sequence
  chemically synthesized
tatggcattttaacatttgc

SEQ ID NO: 529080 - DNA, 20 bp, Artificial Sequence
  chemically synthesized
attttaacatttgcagagaa

SEQ ID NO: 529081 - DNA, 20 bp, Artificial Sequence
  chemically synthesized
tttgcagagaaacagaatct

SEQ ID NO: 529082 - DNA, 20 bp, Artificial Sequence
  chemically synthesized
agttcaggggccaggaaggt

SEQ ID NO: 529083 - DNA, 20 bp, Artificial Sequence
  chemically synthesized
cacataaatgagaaagcatt

SEQ ID NO: 529084 - DNA, 20 bp, Artificial Sequence
  chemically synthesized
gaggatcagtaacacataaa

SEQ ID NO: 529085 - DNA, 20 bp, Artificial Sequence
  chemically synthesized
atttcaaaataactaaaaga

SEQ ID NO: 529086 - DNA, 20 bp, Artificial Sequence
  chemically synthesized
attgggaatgtttctaacac

SEQ ID NO: 529087 - DNA, 20 bp, Artificial Sequence
  chemically synthesized
agaacaagtatttctctgtg

SEQ ID NO: 529088 - DNA, 20 bp, Artificial Sequence
  chemically synthesized
aatgtagaatgatatgaaaa

SEQ ID NO: 529089 - DNA, 20 bp, Artificial Sequence
  chemically synthesized
tgcacagttgttgtaataat

SEQ ID NO: 529090 - DNA, 20 bp, Artificial Sequence
  chemically synthesized
ttcatttttgtcatacaaat

SEQ ID NO: 529091 - DNA, 20 bp, Artificial Sequence
  chemically synthesized
aatactaagtacaacaggag

SEQ ID NO: 529092 - DNA, 20 bp, Artificial Sequence
  chemically synthesized
ttgttcacaatagccaagat

SEQ ID NO: 529093 - DNA, 20 bp, Artificial Sequence
  chemically synthesized
ccatcagtggatgaatgcat

SEQ ID NO: 529094 - DNA, 20 bp, Artificial Sequence
  chemically synthesized
tatgttgagatcagccacac

SEQ ID NO: 529095 - DNA, 20 bp, Artificial Sequence
  chemically synthesized
tgggtacaaaaatacagtaa

SEQ ID NO: 529096 - DNA, 20 bp, Artificial Sequence
  chemically synthesized
gaaatgggaatgttcctacc

SEQ ID NO: 529097 - DNA, 20 bp, Artificial Sequence
  chemically synthesized
ccattgtaacatcatagcac

SEQ ID NO: 529098 - DNA, 20 bp, Artificial Sequence
  chemically synthesized
aaactatacagtcatgtgct

SEQ ID NO: 529099 - DNA, 20 bp, Artificial Sequence
  chemically synthesized
tatatgaattttagattgta

SEQ ID NO: 529100 - DNA, 20 bp, Artificial Sequence
  chemically synthesized
tgcacctctcctttttcaga

SEQ ID NO: 529101 - DNA, 20 bp, Artificial Sequence
  chemically synthesized
tcatctgaaaaaggagaggt

SEQ ID NO: 529102 - DNA, 20 bp, Artificial Sequence
  chemically synthesized
agggctgtttccatggaata

SEQ ID NO: 529103 - DNA, 20 bp, Artificial Sequence
  chemically synthesized
tatccctccccactaaccac

SEQ ID NO: 529104 - DNA, 20 bp, Artificial Sequence
  chemically synthesized
gtggttagtggggagggata

SEQ ID NO: 529105 - DNA, 20 bp, Artificial Sequence
  chemically synthesized
tttgtttcaggttggtacag

SEQ ID NO: 529106 - DNA, 20 bp, Artificial Sequence
  chemically synthesized
gtaaggtttccaggtggtga

SEQ ID NO: 529107 - DNA, 20 bp, Artificial Sequence
  chemically synthesized
ttaccgtttacctcaggctg

SEQ ID NO: 529108 - DNA, 20 bp, Artificial Sequence
  chemically synthesized
ttgtttgaagtataggacct

SEQ ID NO: 529109 - DNA, 20 bp, Artificial Sequence
  chemically synthesized
tggaatttactagcatctga

SEQ ID NO: 529110 - DNA, 20 bp, Artificial Sequence
  chemically synthesized
ttcctgagtcctggatagaa

SEQ ID NO: 529111 - DNA, 20 bp, Artificial Sequence
  chemically synthesized
ctacttttcctgagtcctgg

SEQ ID NO: 529112 - DNA, 20 bp, Artificial Sequence
  chemically synthesized
gaagctggagagcagaagta

SEQ ID NO: 529113 - DNA, 20 bp, Artificial Sequence
  chemically synthesized
tcaccaagtctttgagggga

SEQ ID NO: 529114 - DNA, 20 bp, Artificial Sequence
  chemically synthesized
gacttggtgaggattaaatg

SEQ ID NO: 529115 - DNA, 20 bp, Artificial Sequence
  chemically synthesized
taggatttgttcactagaca

SEQ ID NO: 529116 - DNA, 20 bp, Artificial Sequence
  chemically synthesized
attgccctcatactagtttt

SEQ ID NO: 529117 - DNA, 20 bp, Artificial Sequence
  chemically synthesized
gagaaggcctggaaacaatg

SEQ ID NO: 529118 - DNA, 20 bp, Artificial Sequence
  chemically synthesized
tgctgcctctttttttaggg

SEQ ID NO: 529119 - DNA, 20 bp, Artificial Sequence
  chemically synthesized
tcttctttgaacatttataa

SEQ ID NO: 529120 - DNA, 20 bp, Artificial Sequence
  chemically synthesized
tctaattataaatgttcaaa

SEQ ID NO: 529121 - DNA, 20 bp, Artificial Sequence
  chemically synthesized
aaatgttcaaagaagaaaac

SEQ ID NO: 529122 - DNA, 20 bp, Artificial Sequence
  chemically synthesized
tcagaaaataaaaatagtac

SEQ ID NO: 529123 - DNA, 20 bp, Artificial Sequence
  chemically synthesized
actgatttccccccagtctc

SEQ ID NO: 529124 - DNA, 20 bp, Artificial Sequence
  chemically synthesized
tgaattcaaagctttgagac

SEQ ID NO: 529125 - DNA, 20 bp, Artificial Sequence
  chemically synthesized
acagagttgttattacagag

SEQ ID NO: 529126 - DNA, 20 bp, Artificial Sequence
  chemically synthesized
ccagcaaaaggatgtagcag

SEQ ID NO: 529127 - DNA, 20 bp, Artificial Sequence
  chemically synthesized
ctgatgagtcagtactcggg

SEQ ID NO: 529128 - DNA, 20 bp, Artificial Sequence
  chemically synthesized
cagtactcgggcgagaaaac

SEQ ID NO: 529129 - DNA, 20 bp, Artificial Sequence
  chemically synthesized
tgtaaatgtaaaatgcatgt

SEQ ID NO: 529130 - DNA, 20 bp, Artificial Sequence
  chemically synthesized
gtaaatctcagccattgtta

SEQ ID NO: 529131 - DNA, 20 bp, Artificial Sequence
  chemically synthesized
ctcagccattgttaatagaa

SEQ ID NO: 529132 - DNA, 20 bp, Artificial Sequence
  chemically synthesized
ttaatagaattagaatggat

SEQ ID NO: 529133 - DNA, 20 bp, Artificial Sequence
  chemically synthesized
atggattgagaaaccctaca

SEQ ID NO: 529134 - DNA, 20 bp, Artificial Sequence
  chemically synthesized
ttacaattagaacaactttt

SEQ ID NO: 529135 - DNA, 20 bp, Artificial Sequence
  chemically synthesized
ttgtctggcaatcacacgcc

SEQ ID NO: 529136 - DNA, 20 bp, Artificial Sequence
  chemically synthesized
cgcctgagaattgatcctat

SEQ ID NO: 529137 - DNA, 20 bp, Artificial Sequence
  chemically synthesized
ctactcgggaggctgaggta

SEQ ID NO: 529138 - DNA, 20 bp, Artificial Sequence
  chemically synthesized
gagcgagactgcaactcaaa

SEQ ID NO: 529139 - DNA, 20 bp, Artificial Sequence
  chemically synthesized
aaaaaaaaaaaaaaaaggaa

SEQ ID NO: 529140 - DNA, 20 bp, Artificial Sequence
  chemically synthesized
tctctgtcgtagtcagtgcc

SEQ ID NO: 529141 - DNA, 20 bp, Artificial Sequence
  chemically synthesized
tctggggcactgactacgac

SEQ ID NO: 529142 - DNA, 20 bp, Artificial Sequence
  chemically synthesized
attgaaaggaggctataatg

SEQ ID NO: 529143 - DNA, 20 bp, Artificial Sequence
  chemically synthesized
gaggctataatgatagaatt

SEQ ID NO: 529144 - DNA, 20 bp, Artificial Sequence
  chemically synthesized
ccacagaaatcctatgtata

SEQ ID NO: 529145 - DNA, 20 bp, Artificial Sequence
  chemically synthesized
gaggaaataagtctctagcc

SEQ ID NO: 529146 - DNA, 20 bp, Artificial Sequence
  chemically synthesized
aagacagtgctgaggaagga

SEQ ID NO: 529147 - DNA, 20 bp, Artificial Sequence
  chemically synthesized
tgcctactgaagagctaata

SEQ ID NO: 529148 - DNA, 20 bp, Artificial Sequence
  chemically synthesized
taattaatttctaaaatatg

SEQ ID NO: 529149 - DNA, 20 bp, Artificial Sequence
  chemically synthesized
catatttattctttcatatt

SEQ ID NO: 529150 - DNA, 20 bp, Artificial Sequence
  chemically synthesized
ccaactgtcttggaatttgg

SEQ ID NO: 529151 - DNA, 20 bp, Artificial Sequence
  chemically synthesized
tgaaaaggtctacaaaggaa

SEQ ID NO: 529152 - DNA, 20 bp, Artificial Sequence
  chemically synthesized
gtggaaatactggctactct

SEQ ID NO: 529153 - DNA, 20 bp, Artificial Sequence
  chemically synthesized
aaggattatgttctggctta

SEQ ID NO: 529154 - DNA, 20 bp, Artificial Sequence
  chemically synthesized
ctactcaggcggctgaggca

SEQ ID NO: 529155 - DNA, 20 bp, Artificial Sequence
  chemically synthesized
aacatgatgtgagctattaa

SEQ ID NO: 529156 - DNA, 20 bp, Artificial Sequence
  chemically synthesized
gtgtgccagaagtatctaca

SEQ ID NO: 529157 - DNA, 20 bp, Artificial Sequence
  chemically synthesized
gtaggtgcccaatatatgta

SEQ ID NO: 529158 - DNA, 20 bp, Artificial Sequence
  chemically synthesized
cccctcaaaaaaagtaaatc

SEQ ID NO: 529159 - DNA, 20 bp, Artificial Sequence
  chemically synthesized
tttaaagtgtgcttatgggt

SEQ ID NO: 529160 - DNA, 20 bp, Artificial Sequence
  chemically synthesized
aagtaactacaatatttaaa

SEQ ID NO: 529161 - DNA, 20 bp, Artificial Sequence
  chemically synthesized
gttttctcatcctcagaacg

SEQ ID NO: 529162 - DNA, 20 bp, Artificial Sequence
  chemically synthesized
tttttctctcgttctgagga

SEQ ID NO: 529163 - DNA, 20 bp, Artificial Sequence
  chemically synthesized
ttttgtggcttactcctgaa

SEQ ID NO: 529164 - DNA, 20 bp, Artificial Sequence
  chemically synthesized
tggctaggcctcaggggaag

SEQ ID NO: 529165 - DNA, 20 bp, Artificial Sequence
  chemically synthesized
ggatagatacgtaccaccct

SEQ ID NO: 529166 - DNA, 20 bp, Artificial Sequence
  chemically synthesized
ggtggtacgtatctatcctt

SEQ ID NO: 529167 - DNA, 20 bp, Artificial Sequence
  chemically synthesized
taccatgtgacattcatgtt

SEQ ID NO: 529168 - DNA, 20 bp, Artificial Sequence
  chemically synthesized
tagtctttgggttcttattt

SEQ ID NO: 529169 - DNA, 20 bp, Artificial Sequence
  chemically synthesized
cacacttatttttccgactt

SEQ ID NO: 529170 - DNA, 20 bp, Artificial Sequence
  chemically synthesized
ttccgacttacagaaagagg

SEQ ID NO: 529171 - DNA, 20 bp, Artificial Sequence
  chemically synthesized
taaattgcaggcatttaagt

SEQ ID NO: 529172 - DNA, 20 bp, Artificial Sequence
  chemically synthesized
gtaattagccaacattaata

SEQ ID NO: 529173 - DNA, 20 bp, Artificial Sequence
  chemically synthesized
ccctgttcgtcccctattat

SEQ ID NO: 529174 - DNA, 20 bp, Artificial Sequence
  chemically synthesized
ccctattatgaagaatcaaa

SEQ ID NO: 529175 - DNA, 20 bp, Artificial Sequence
  chemically synthesized
agagggtaaacacttctagt

SEQ ID NO: 529176 - DNA, 20 bp, Artificial Sequence
  chemically synthesized
tgcaaaagttctacataaat

SEQ ID NO: 529177 - DNA, 20 bp, Artificial Sequence
  chemically synthesized
aggtggctttccataggtga

SEQ ID NO: 529178 - DNA, 20 bp, Artificial Sequence
  chemically synthesized
ttggtttaagttggtaagca

SEQ ID NO: 529179 - DNA, 20 bp, Artificial Sequence
  chemically synthesized
catcagattgccccttattg

SEQ ID NO: 529180 - DNA, 20 bp, Artificial Sequence
  chemically synthesized
caggccacataacacataat

SEQ ID NO: 529181 - DNA, 20 bp, Artificial Sequence
  chemically synthesized
aatataaatgtttatctccg

SEQ ID NO: 529182 - DNA, 20 bp, Artificial Sequence
  chemically synthesized
tcagttttctatatgcaaat

SEQ ID NO: 529183 - DNA, 20 bp, Artificial Sequence
  chemically synthesized
agcattttctatatttgcat

SEQ ID NO: 529184 - DNA, 20 bp, Artificial Sequence
  chemically synthesized
tgggggaaaaaaaggaaaaa

SEQ ID NO: 529185 - DNA, 20 bp, Artificial Sequence
  chemically synthesized
aatgaaaagttttccatttt

SEQ ID NO: 529186 - DNA, 20 bp, Artificial Sequence
  chemically synthesized
tcaatatgaatgcccatcaa

SEQ ID NO: 529187 - DNA, 20 bp, Artificial Sequence
  chemically synthesized
gaataccatgcagctataaa

SEQ ID NO: 529188 - DNA, 20 bp, Artificial Sequence
  chemically synthesized
attatccttagcaaactaat

SEQ ID NO: 529189 - DNA, 20 bp, Artificial Sequence
  chemically synthesized
cttagcaaactaatgcagaa

SEQ ID NO: 529190 - DNA, 20 bp, Artificial Sequence
  chemically synthesized
gggtggaaggagggagagga

SEQ ID NO: 529191 - DNA, 20 bp, Artificial Sequence
  chemically synthesized
tggcccttagatattggtaa

SEQ ID NO: 529192 - DNA, 20 bp, Artificial Sequence
  chemically synthesized
gatattggtaaaaagaaaaa

SEQ ID NO: 529193 - DNA, 20 bp, Artificial Sequence
  chemically synthesized
aagaaaaaggagaaaatatt

SEQ ID NO: 529194 - DNA, 20 bp, Artificial Sequence
  chemically synthesized
ttattaaatccctcagtcaa

SEQ ID NO: 529195 - DNA, 20 bp, Artificial Sequence
  chemically synthesized
tttcttaagagggagaaaga

SEQ ID NO: 529196 - DNA, 20 bp, Artificial Sequence
  chemically synthesized
tttcttatctttctccctct

SEQ ID NO: 529197 - DNA, 20 bp, Artificial Sequence
  chemically synthesized
gatctaccttttcttaagag

SEQ ID NO: 529198 - DNA, 20 bp, Artificial Sequence
  chemically synthesized
ggtagaaggaagttatacat

SEQ ID NO: 529199 - DNA, 20 bp, Artificial Sequence
  chemically synthesized
tgcattcacatgtcatctgc

SEQ ID NO: 529200 - DNA, 20 bp, Artificial Sequence
  chemically synthesized
aaagcaataccttatcaaaa

SEQ ID NO: 529201 - DNA, 20 bp, Artificial Sequence
  chemically synthesized
caataccttatcaaaataag

SEQ ID NO: 529202 - DNA, 20 bp, Artificial Sequence
  chemically synthesized
cagttgttttgcaactcttt

SEQ ID NO: 529203 - DNA, 20 bp, Artificial Sequence
  chemically synthesized
gtaataattttgagatctaa

SEQ ID NO: 529204 - DNA, 20 bp, Artificial Sequence
  chemically synthesized
tcaattgtcttcattaagct

SEQ ID NO: 529205 - DNA, 20 bp, Artificial Sequence
  chemically synthesized
taaaatcttattaaaaaaca

SEQ ID NO: 529206 - DNA, 20 bp, Artificial Sequence
  chemically synthesized
ctggcacacctgtctccaga

SEQ ID NO: 529207 - DNA, 20 bp, Artificial Sequence
  chemically synthesized
agccacccctgaagtgcatg

SEQ ID NO: 529208 - DNA, 20 bp, Artificial Sequence
  chemically synthesized
agaattccaaaatccatggg

SEQ ID NO: 529209 - DNA, 20 bp, Artificial Sequence
  chemically synthesized
gaatgtagattgctctcaga

SEQ ID NO: 529210 - DNA, 20 bp, Artificial Sequence
  chemically synthesized
gataagctaggagttaagag

SEQ ID NO: 529211 - DNA, 20 bp, Artificial Sequence
  chemically synthesized
tgtcacaggaggcttagcgt

SEQ ID NO: 529212 - DNA, 20 bp, Artificial Sequence
  chemically synthesized
tttcagtgtcctttttcctc

SEQ ID NO: 529213 - DNA, 20 bp, Artificial Sequence
  chemically synthesized
agagtcaattgtcacctgaa

SEQ ID NO: 529214 - DNA, 20 bp, Artificial Sequence
  chemically synthesized
aagaaaaaaaaaatgtttta

SEQ ID NO: 529215 - DNA, 20 bp, Artificial Sequence
  chemically synthesized
gatcttctctaatgctaata

SEQ ID NO: 529216 - DNA, 20 bp, Artificial Sequence
  chemically synthesized
taatgattataaatgcatag

SEQ ID NO: 529217 - DNA, 20 bp, Artificial Sequence
  chemically synthesized
tgaggtgactgatatttcaa

SEQ ID NO: 529218 - DNA, 20 bp, Artificial Sequence
  chemically synthesized
gcaattactttagtttgcct

SEQ ID NO: 529219 - DNA, 20 bp, Artificial Sequence
  chemically synthesized
aatacaatttgaaggtgaaa

SEQ ID NO: 529220 - DNA, 20 bp, Artificial Sequence
  chemically synthesized
aaagttgttagaggacttag

SEQ ID NO: 529221 - DNA, 20 bp, Artificial Sequence
  chemically synthesized
ttataaagttgttagaggac

SEQ ID NO: 529222 - DNA, 20 bp, Artificial Sequence
  chemically synthesized
ttggctaataaattggcttt

SEQ ID NO: 529223 - DNA, 20 bp, Artificial Sequence
  chemically synthesized
aagccaatttattagccaaa

SEQ ID NO: 529224 - DNA, 20 bp, Artificial Sequence
  chemically synthesized
gattccttgcctcaaaggac

SEQ ID NO: 529225 - DNA, 20 bp, Artificial Sequence
  chemically synthesized
taaacacctttcccagtaat

SEQ ID NO: 529226 - DNA, 20 bp, Artificial Sequence
  chemically synthesized
ggccagttctaattaaatat

SEQ ID NO: 529227 - DNA, 20 bp, Artificial Sequence
  chemically synthesized
tctgttttcctttttttaaa

SEQ ID NO: 529228 - DNA, 20 bp, Artificial Sequence
  chemically synthesized
tctcttttaaaaaaaggaaa

SEQ ID NO: 529229 - DNA, 20 bp, Artificial Sequence
  chemically synthesized
ctctgaaatactctaaagat

SEQ ID NO: 529230 - DNA, 20 bp, Artificial Sequence
  chemically synthesized
atcttccttcctcccacttt

SEQ ID NO: 529231 - DNA, 20 bp, Artificial Sequence
  chemically synthesized
ataacttgggagacttatct

SEQ ID NO: 529232 - DNA, 20 bp, Artificial Sequence
  chemically synthesized
gacttatctgaagaatcaag

SEQ ID NO: 529233 - DNA, 20 bp, Artificial Sequence
  chemically synthesized
aatcaagtgagaaaaataat

SEQ ID NO: 529234 - DNA, 20 bp, Artificial Sequence
  chemically synthesized
aagcacacagaagagagaga

SEQ ID NO: 529235 - DNA, 20 bp, Artificial Sequence
  chemically synthesized
agtgcacgtagtaggaacac

SEQ ID NO: 529236 - DNA, 20 bp, Artificial Sequence
  chemically synthesized
gttgggaatattggtgtttg

SEQ ID NO: 529237 - DNA, 20 bp, Artificial Sequence
  chemically synthesized
gactaaagcagagtaacaaa

SEQ ID NO: 529238 - DNA, 20 bp, Artificial Sequence
  chemically synthesized
gccgtgtgatggaaatgaac

SEQ ID NO: 529239 - DNA, 20 bp, Artificial Sequence
  chemically synthesized
catagaacagcaaatgttga

SEQ ID NO: 529240 - DNA, 20 bp, Artificial Sequence
  chemically synthesized
cagaagatgacacagttagg

SEQ ID NO: 529241 - DNA, 20 bp, Artificial Sequence
  chemically synthesized
tccctaaacaaacatgtcaa

SEQ ID NO: 529242 - DNA, 20 bp, Artificial Sequence
  chemically synthesized
ctatggacccgaaaaggagg

SEQ ID NO: 529243 - DNA, 20 bp, Artificial Sequence
  chemically synthesized
ctggttgcttattgagggtc

SEQ ID NO: 529244 - DNA, 20 bp, Artificial Sequence
  chemically synthesized
atttagaaagtgaagatgta

SEQ ID NO: 529245 - DNA, 20 bp, Artificial Sequence
  chemically synthesized
tcctctactgtaaacataat

SEQ ID NO: 529246 - DNA, 20 bp, Artificial Sequence
  chemically synthesized
gagagggtggggacaggata

SEQ ID NO: 529247 - DNA, 20 bp, Artificial Sequence
  chemically synthesized
tgtggcatacatagaaagga

SEQ ID NO: 529248 - DNA, 20 bp, Artificial Sequence
  chemically synthesized
agttagctactgtggcatac

SEQ ID NO: 529249 - DNA, 20 bp, Artificial Sequence
  chemically synthesized
atatgtacctccatgagaaa

SEQ ID NO: 529250 - DNA, 20 bp, Artificial Sequence
  chemically synthesized
ccttacaatatgtacctcca

SEQ ID NO: 529251 - DNA, 20 bp, Artificial Sequence
  chemically synthesized
tgttgtcattagcatggaat

SEQ ID NO: 529252 - DNA, 20 bp, Artificial Sequence
  chemically synthesized
gcaccaaaaagttggttagt

SEQ ID NO: 529253 - DNA, 20 bp, Artificial Sequence
  chemically synthesized
agaattatttatacatcaac

SEQ ID NO: 529254 - DNA, 20 bp, Artificial Sequence
  chemically synthesized
gtttctgtgctaattagatc

SEQ ID NO: 529255 - DNA, 20 bp, Artificial Sequence
  chemically synthesized
aattctgtgatctaattagc

SEQ ID NO: 529256 - DNA, 20 bp, Artificial Sequence
  chemically synthesized
gtgatctaattagcacagaa

SEQ ID NO: 529257 - DNA, 20 bp, Artificial Sequence
  chemically synthesized
tgtagagtggcatgcctggg

SEQ ID NO: 529258 - DNA, 20 bp, Artificial Sequence
  chemically synthesized
ccaagcaaatctttgcactt

SEQ ID NO: 529259 - DNA, 20 bp, Artificial Sequence
  chemically synthesized
cctaggttacccacgggata

SEQ ID NO: 529260 - DNA, 20 bp, Artificial Sequence
  chemically synthesized
tcagtagctcttgttccaag

SEQ ID NO: 529261 - DNA, 20 bp, Artificial Sequence
  chemically synthesized
atatacccacaacattaaaa

SEQ ID NO: 529262 - DNA, 20 bp, Artificial Sequence
  chemically synthesized
ttacgaatctagagttcctt

SEQ ID NO: 529263 - DNA, 20 bp, Artificial Sequence
  chemically synthesized
gcctcagtcatacttttagc

SEQ ID NO: 529264 - DNA, 20 bp, Artificial Sequence
  chemically synthesized
aagtatgactgaggcattat

SEQ ID NO: 529265 - DNA, 20 bp, Artificial Sequence
  chemically synthesized
atgactgaggcattatttag

SEQ ID NO: 529266 - DNA, 20 bp, Artificial Sequence
  chemically synthesized
gttctttttcatccctttta

SEQ ID NO: 529267 - DNA, 20 bp, Artificial Sequence
  chemically synthesized
tctctcacttccagattcca

SEQ ID NO: 529268 - DNA, 20 bp, Artificial Sequence
  chemically synthesized
tccaaaagctaatgttaagt

SEQ ID NO: 529269 - DNA, 20 bp, Artificial Sequence
  chemically synthesized
gagagggtgaagcccagtgg

SEQ ID NO: 529270 - DNA, 20 bp, Artificial Sequence
  chemically synthesized
gctgaagcaactatcatttt

SEQ ID NO: 529271 - DNA, 20 bp, Artificial Sequence
  chemically synthesized
ctactaggtctggcatcaaa

SEQ ID NO: 529272 - DNA, 20 bp, Artificial Sequence
  chemically synthesized
tgcaaagtgatatgcattca

SEQ ID NO: 529273 - DNA, 20 bp, Artificial Sequence
  chemically synthesized
aaaaaaaaaaaaaaaagaaa

SEQ ID NO: 529274 - DNA, 20 bp, Artificial Sequence
  chemically synthesized
caaaaaaaaaaaaaaaaaaa

SEQ ID NO: 529275 - DNA, 20 bp, Artificial Sequence
  chemically synthesized
ctactcgggagtctgaggca

SEQ ID NO: 529276 - DNA, 20 bp, Artificial Sequence
  chemically synthesized
ctacggagaggtttaaaata

SEQ ID NO: 529277 - DNA, 20 bp, Artificial Sequence
  chemically synthesized
actttcctgagactgaaaag

SEQ ID NO: 529278 - DNA, 20 bp, Artificial Sequence
  chemically synthesized
gaaattggatatggatggct

SEQ ID NO: 529279 - DNA, 20 bp, Artificial Sequence
  chemically synthesized
gactttggtttgggtatgtc

SEQ ID NO: 529280 - DNA, 20 bp, Artificial Sequence
  chemically synthesized
cccaccagacatgttgccat

SEQ ID NO: 529281 - DNA, 20 bp, Artificial Sequence
  chemically synthesized
gcatgaatccacttgaaata

SEQ ID NO: 529282 - DNA, 20 bp, Artificial Sequence
  chemically synthesized
aataaaagaaacttctatta

SEQ ID NO: 529283 - DNA, 20 bp, Artificial Sequence
  chemically synthesized
ggctagagatacctggccag

SEQ ID NO: 529284 - DNA, 20 bp, Artificial Sequence
  chemically synthesized
caggtagaatttgctttgaa

SEQ ID NO: 529285 - DNA, 20 bp, Artificial Sequence
  chemically synthesized
aatgagaaatgataaactga

SEQ ID NO: 529286 - DNA, 20 bp, Artificial Sequence
  chemically synthesized
agctgccaaggttgatagct

SEQ ID NO: 529287 - DNA, 20 bp, Artificial Sequence
  chemically synthesized
gagaatggaaccaataatta

SEQ ID NO: 529288 - DNA, 20 bp, Artificial Sequence
  chemically synthesized
atctctttagcatctgactg

SEQ ID NO: 529289 - DNA, 20 bp, Artificial Sequence
  chemically synthesized
ttagctgttacccactaggg

SEQ ID NO: 529290 - DNA, 20 bp, Artificial Sequence
  chemically synthesized
atctgtcaaaccatataaac

SEQ ID NO: 529291 - DNA, 20 bp, Artificial Sequence
  chemically synthesized
tgaaaaataatacatggtat

SEQ ID NO: 529292 - DNA, 20 bp, Artificial Sequence
  chemically synthesized
tacaaatccgcgctctattg

SEQ ID NO: 529293 - DNA, 20 bp, Artificial Sequence
  chemically synthesized
ttgtcatggtgagggcgagt

SEQ ID NO: 529294 - DNA, 20 bp, Artificial Sequence
  chemically synthesized
ttctctatttcttactgttt

SEQ ID NO: 529295 - DNA, 20 bp, Artificial Sequence
  chemically synthesized
gacaaatattctgcaaacag

SEQ ID NO: 529296 - DNA, 20 bp, Artificial Sequence
  chemically synthesized
taaaaagccaacttgtaaga

SEQ ID NO: 529297 - DNA, 20 bp, Artificial Sequence
  chemically synthesized
attttagaagcctcacacct

SEQ ID NO: 529298 - DNA, 20 bp, Artificial Sequence
  chemically synthesized
atgtcatcagaactacaaag

SEQ ID NO: 529299 - DNA, 20 bp, Artificial Sequence
  chemically synthesized
catcagaactacaaagggag

SEQ ID NO: 529300 - DNA, 20 bp, Artificial Sequence
  chemically synthesized
ggaaatgaaaatgaaacttg

SEQ ID NO: 529301 - DNA, 20 bp, Artificial Sequence
  chemically synthesized
aacccaattgtatccactat

SEQ ID NO: 529302 - DNA, 20 bp, Artificial Sequence
  chemically synthesized
cctatcaatgtttccgtatt

SEQ ID NO: 529303 - DNA, 20 bp, Artificial Sequence
  chemically synthesized
tttatcatggctttgcaggc

SEQ ID NO: 529304 - DNA, 20 bp, Artificial Sequence
  chemically synthesized
tctaagcaaatataaaatta

SEQ ID NO: 529305 - DNA, 20 bp, Artificial Sequence
  chemically synthesized
cttactttcaatatatgatt

SEQ ID NO: 529306 - DNA, 20 bp, Artificial Sequence
  chemically synthesized
gtgccatatatagtaaaact

SEQ ID NO: 529307 - DNA, 20 bp, Artificial Sequence
  chemically synthesized
tggcaccctcctagcattaa

SEQ ID NO: 529308 - DNA, 20 bp, Artificial Sequence
  chemically synthesized
acttgaatctttttcacata

SEQ ID NO: 529309 - DNA, 20 bp, Artificial Sequence
  chemically synthesized
acatattagaaaagccatgc

SEQ ID NO: 529310 - DNA, 20 bp, Artificial Sequence
  chemically synthesized
catgctcagaaaggaaatgc

SEQ ID NO: 529311 - DNA, 20 bp, Artificial Sequence
  chemically synthesized
tgatttaaaagtgaaaattt

SEQ ID NO: 529312 - DNA, 20 bp, Artificial Sequence
  chemically synthesized
aataaaggtaagctccgaat

SEQ ID NO: 529313 - DNA, 20 bp, Artificial Sequence
  chemically synthesized
ccagggtgaaaatggacatt

SEQ ID NO: 529314 - DNA, 20 bp, Artificial Sequence
  chemically synthesized
gaaaaaaaaaaaaaagaaac

SEQ ID NO: 529315 - DNA, 20 bp, Artificial Sequence
  chemically synthesized
atactatggaaaaaaaaaaa

SEQ ID NO: 529316 - DNA, 20 bp, Artificial Sequence
  chemically synthesized
actggttatcatgaagtgct

SEQ ID NO: 529317 - DNA, 20 bp, Artificial Sequence
  chemically synthesized
gggcaggggcaggggcaggt

SEQ ID NO: 529318 - DNA, 20 bp, Artificial Sequence
  chemically synthesized
ggcaggtgaagaaaaagagg

SEQ ID NO: 529319 - DNA, 20 bp, Artificial Sequence
  chemically synthesized
atcgagtcagggggctgaat

SEQ ID NO: 529320 - DNA, 20 bp, Artificial Sequence
  chemically synthesized
ggttcttacacagagataga

SEQ ID NO: 529321 - DNA, 20 bp, Artificial Sequence
  chemically synthesized
gaaccctggctgccaggtct

SEQ ID NO: 529322 - DNA, 20 bp, Artificial Sequence
  chemically synthesized
catgccaatgttgaaatcat

SEQ ID NO: 529323 - DNA, 20 bp, Artificial Sequence
  chemically synthesized
caagttaaggaactgagagg

SEQ ID NO: 529324 - DNA, 20 bp, Artificial Sequence
  chemically synthesized
ggtcaagaagttgtggtcag

SEQ ID NO: 529325 - DNA, 20 bp, Artificial Sequence
  chemically synthesized
gaagttgggcttatctttgt

SEQ ID NO: 529326 - DNA, 20 bp, Artificial Sequence
  chemically synthesized
tctgggcaggtccaggtaac

SEQ ID NO: 529327 - DNA, 20 bp, Artificial Sequence
  chemically synthesized
gataaataatgggtgttctc

SEQ ID NO: 529328 - DNA, 20 bp, Artificial Sequence
  chemically synthesized
gtatcgaaacgtatttaaac

SEQ ID NO: 529329 - DNA, 20 bp, Artificial Sequence
  chemically synthesized
ttaacaatggggatatgttc

SEQ ID NO: 529330 - DNA, 20 bp, Artificial Sequence
  chemically synthesized
ccttcataagtaaatttctc

SEQ ID NO: 529331 - DNA, 20 bp, Artificial Sequence
  chemically synthesized
agaaggtatgaatgattctt

SEQ ID NO: 529332 - DNA, 20 bp, Artificial Sequence
  chemically synthesized
ttcaaaagtgaaccaaaagt

SEQ ID NO: 529333 - DNA, 20 bp, Artificial Sequence
  chemically synthesized
gccacatgctccatgggaag

SEQ ID NO: 529334 - DNA, 20 bp, Artificial Sequence
  chemically synthesized
tgatgccacatgctccatgg

SEQ ID NO: 529335 - DNA, 20 bp, Artificial Sequence
  chemically synthesized
acacggagctgtggtgctca

SEQ ID NO: 529336 - DNA, 20 bp, Artificial Sequence
  chemically synthesized
ttctccgggccacagtggaa

SEQ ID NO: 529337 - DNA, 20 bp, Artificial Sequence
  chemically synthesized
gggagataagtggagagaat

SEQ ID NO: 529338 - DNA, 20 bp, Artificial Sequence
  chemically synthesized
gtagtaagggagataagtgg

SEQ ID NO: 529339 - DNA, 20 bp, Artificial Sequence
  chemically synthesized
ggtgcgatgtgggagtgaca

SEQ ID NO: 529340 - DNA, 20 bp, Artificial Sequence
  chemically synthesized
atccatactctgttccacag

SEQ ID NO: 529341 - DNA, 20 bp, Artificial Sequence
  chemically synthesized
tgacataatcagattgtcgc

SEQ ID NO: 529342 - DNA, 20 bp, Artificial Sequence
  chemically synthesized
tatgtcagtatggctaaagc

SEQ ID NO: 529343 - DNA, 20 bp, Artificial Sequence
  chemically synthesized
gagcatgtgctgaagggccc

SEQ ID NO: 529344 - DNA, 20 bp, Artificial Sequence
  chemically synthesized
ctctaggaagagcgttctag

SEQ ID NO: 529345 - DNA, 20 bp, Artificial Sequence
  chemically synthesized
aactgtgtggaatgagattc

SEQ ID NO: 529346 - DNA, 20 bp, Artificial Sequence
  chemically synthesized
caaatatatgtataatgtat

SEQ ID NO: 529347 - DNA, 20 bp, Artificial Sequence
  chemically synthesized
agactgtaagttccatcaga

SEQ ID NO: 529348 - DNA, 20 bp, Artificial Sequence
  chemically synthesized
ctactccggaggctgagcca

SEQ ID NO: 529349 - DNA, 20 bp, Artificial Sequence
  chemically synthesized
ctacctgggaggctgacgca

SEQ ID NO: 529350 - DNA, 20 bp, Artificial Sequence
  chemically synthesized
aaaaaaaaaaaaaaaaaaaa

SEQ ID NO: 529351 - DNA, 20 bp, Artificial Sequence
  chemically synthesized
aaaaaaaaaaaaacagaaaa

SEQ ID NO: 529352 - DNA, 20 bp, Artificial Sequence
  chemically synthesized
aaaaaaacagaaaaaaagaa

SEQ ID NO: 529353 - DNA, 20 bp, Artificial Sequence
  chemically synthesized
gaagtggtagaggaaaaatg

SEQ ID NO: 529354 - DNA, 20 bp, Artificial Sequence
  chemically synthesized
atactaagtacattttgtaa

SEQ ID NO: 529355 - DNA, 20 bp, Artificial Sequence
  chemically synthesized
ctgatgttgaattaagatat

SEQ ID NO: 529356 - DNA, 20 bp, Artificial Sequence
  chemically synthesized
tagaatgttttgttttattt

SEQ ID NO: 529357 - DNA, 20 bp, Artificial Sequence
  chemically synthesized
atccttggcctagagtttgc

SEQ ID NO: 529358 - DNA, 20 bp, Artificial Sequence
  chemically synthesized
ctctaggccaaggatacatt

SEQ ID NO: 529359 - DNA, 20 bp, Artificial Sequence
  chemically synthesized
tacatttttacttagagagg

SEQ ID NO: 529360 - DNA, 20 bp, Artificial Sequence
  chemically synthesized
tcttgatactatgtctttgc

SEQ ID NO: 529361 - DNA, 20 bp, Artificial Sequence
  chemically synthesized
ttcatggcagtcctataagc

SEQ ID NO: 529362 - DNA, 20 bp, Artificial Sequence
  chemically synthesized
aaagagcatttgttattcca

SEQ ID NO: 529363 - DNA, 20 bp, Artificial Sequence
  chemically synthesized
acaaccaccacaaaaatagc

SEQ ID NO: 529364 - DNA, 20 bp, Artificial Sequence
  chemically synthesized
tttttcttttccccacgtta

SEQ ID NO: 529365 - DNA, 20 bp, Artificial Sequence
  chemically synthesized
aaattctgttaacgtgggga

SEQ ID NO: 529366 - DNA, 20 bp, Artificial Sequence
  chemically synthesized
tggacaggcattattttttt

SEQ ID NO: 529367 - DNA, 20 bp, Artificial Sequence
  chemically synthesized
cagtagatccagattacttt

SEQ ID NO: 529368 - DNA, 20 bp, Artificial Sequence
  chemically synthesized
cttgttctctttaatcttgt

SEQ ID NO: 529369 - DNA, 20 bp, Artificial Sequence
  chemically synthesized
ctgcacaagattaaagagaa

SEQ ID NO: 529370 - DNA, 20 bp, Artificial Sequence
  chemically synthesized
agcatgtataacttctacag

SEQ ID NO: 529371 - DNA, 20 bp, Artificial Sequence
  chemically synthesized
aacattagaatgattgtacc

SEQ ID NO: 529372 - DNA, 20 bp, Artificial Sequence
  chemically synthesized
ttgttattctgtgctgaaca

SEQ ID NO: 529373 - DNA, 20 bp, Artificial Sequence
  chemically synthesized
caatcattctaatgttcagc

SEQ ID NO: 529374 - DNA, 20 bp, Artificial Sequence
  chemically synthesized
ggcttgatagaccggtgact

SEQ ID NO: 529375 - DNA, 20 bp, Artificial Sequence
  chemically synthesized
accaactgaatcaataaaca

SEQ ID NO: 529376 - DNA, 20 bp, Artificial Sequence
  chemically synthesized
aatcaataaacaaaagaatg

SEQ ID NO: 529377 - DNA, 20 bp, Artificial Sequence
  chemically synthesized
aataaacaaaagaatgaaag

SEQ ID NO: 529378 - DNA, 20 bp, Artificial Sequence
  chemically synthesized
tgccctttcctaacacctca

SEQ ID NO: 529379 - DNA, 20 bp, Artificial Sequence
  chemically synthesized
gcctgaatttcaactagggg

SEQ ID NO: 529380 - DNA, 20 bp, Artificial Sequence
  chemically synthesized
cattcccaacaagcagtgtc

SEQ ID NO: 529381 - DNA, 20 bp, Artificial Sequence
  chemically synthesized
tacatgtgtgtttaatttca

SEQ ID NO: 529382 - DNA, 20 bp, Artificial Sequence
  chemically synthesized
ttctgtgcaaatatccagga

SEQ ID NO: 529383 - DNA, 20 bp, Artificial Sequence
  chemically synthesized
ttcttttcctggatatttgc

SEQ ID NO: 529384 - DNA, 20 bp, Artificial Sequence
  chemically synthesized
agatataacatttcgatcac

SEQ ID NO: 529385 - DNA, 20 bp, Artificial Sequence
  chemically synthesized
tgaagattgttgaaaaacat

SEQ ID NO: 529386 - DNA, 20 bp, Artificial Sequence
  chemically synthesized
tgcctttaaattgagtttaa

SEQ ID NO: 529387 - DNA, 20 bp, Artificial Sequence
  chemically synthesized
atccagtaggttctccatct

SEQ ID NO: 529388 - DNA, 20 bp, Artificial Sequence
  chemically synthesized
gttcaccggattcttagttg

SEQ ID NO: 529389 - DNA, 20 bp, Artificial Sequence
  chemically synthesized
tctaactgaattctggcaac

SEQ ID NO: 529390 - DNA, 20 bp, Artificial Sequence
  chemically synthesized
ttttcagacttgagcaaaca

SEQ ID NO: 529391 - DNA, 20 bp, Artificial Sequence
  chemically synthesized
cccttcccatacctactgaa

SEQ ID NO: 529392 - DNA, 20 bp, Artificial Sequence
  chemically synthesized
cagcatcacctggaaacttg

SEQ ID NO: 529393 - DNA, 20 bp, Artificial Sequence
  chemically synthesized
cctctcggctgccaggttat

SEQ ID NO: 529394 - DNA, 20 bp, Artificial Sequence
  chemically synthesized
tagtcaaagtgtgatttgag

SEQ ID NO: 529395 - DNA, 20 bp, Artificial Sequence
  chemically synthesized
cagtatctgcttggagctta

SEQ ID NO: 529396 - DNA, 20 bp, Artificial Sequence
  chemically synthesized
gcttggagcttatgagaaat

SEQ ID NO: 529397 - DNA, 20 bp, Artificial Sequence
  chemically synthesized
tgaagtttaacaacacggaa

SEQ ID NO: 529398 - DNA, 20 bp, Artificial Sequence
  chemically synthesized
acacaggatggtgttggtat

SEQ ID NO: 529399 - DNA, 20 bp, Artificial Sequence
  chemically synthesized
acaaaatggaagatagaaag

SEQ ID NO: 529400 - DNA, 20 bp, Artificial Sequence
  chemically synthesized
aaaagcccacaaaatggaag

SEQ ID NO: 529401 - DNA, 20 bp, Artificial Sequence
  chemically synthesized
tgtcttgcggcatcaatcca

SEQ ID NO: 529402 - DNA, 20 bp, Artificial Sequence
  chemically synthesized
gtccctttgactctttataa

SEQ ID NO: 529403 - DNA, 20 bp, Artificial Sequence
  chemically synthesized
tttgcataagtaaaggaatg

SEQ ID NO: 529404 - DNA, 20 bp, Artificial Sequence
  chemically synthesized
attagaaagggaaaaaaaga

SEQ ID NO: 529405 - DNA, 20 bp, Artificial Sequence
  chemically synthesized
gaggcagtggagaaggagga

SEQ ID NO: 529406 - DNA, 20 bp, Artificial Sequence
  chemically synthesized
ggaatcgtcgttctttgaaa

SEQ ID NO: 529407 - DNA, 20 bp, Artificial Sequence
  chemically synthesized
caggaaaataggaaaagagg

SEQ ID NO: 529408 - DNA, 20 bp, Artificial Sequence
  chemically synthesized
ccaaatcttagcgttcatat

SEQ ID NO: 529409 - DNA, 20 bp, Artificial Sequence
  chemically synthesized
agagatccaagtgggagagg

SEQ ID NO: 529410 - DNA, 20 bp, Artificial Sequence
  chemically synthesized
acactaatattcatgccctg

SEQ ID NO: 529411 - DNA, 20 bp, Artificial Sequence
  chemically synthesized
agttagaagtatttagaagg

SEQ ID NO: 529412 - DNA, 20 bp, Artificial Sequence
  chemically synthesized
tcagggaggattaactagag

SEQ ID NO: 529413 - DNA, 20 bp, Artificial Sequence
  chemically synthesized
ggtatgcctgaatcactgtt

SEQ ID NO: 529414 - DNA, 20 bp, Artificial Sequence
  chemically synthesized
acagtgattcaggcatacca

SEQ ID NO: 529415 - DNA, 20 bp, Artificial Sequence
  chemically synthesized
gtagttttttccaattctgt

SEQ ID NO: 529416 - DNA, 20 bp, Artificial Sequence
  chemically synthesized
agctaccaatgactttcttc

SEQ ID NO: 529417 - DNA, 20 bp, Artificial Sequence
  chemically synthesized
cattccatgctcatgggtag

SEQ ID NO: 529418 - DNA, 20 bp, Artificial Sequence
  chemically synthesized
ccaacaatgatagactggat

SEQ ID NO: 529419 - DNA, 20 bp, Artificial Sequence
  chemically synthesized
ttgttcttgcgatagtttac

SEQ ID NO: 529420 - DNA, 20 bp, Artificial Sequence
  chemically synthesized
gttcaattcccacctatgag

SEQ ID NO: 529421 - DNA, 20 bp, Artificial Sequence
  chemically synthesized
aaaaaataaaaaaaaaaaaa

SEQ ID NO: 529422 - DNA, 20 bp, Artificial Sequence
  chemically synthesized
ggaaagtgtgtaggatgcac

SEQ ID NO: 529423 - DNA, 20 bp, Artificial Sequence
  chemically synthesized
tcaagaggagtgagactatc

SEQ ID NO: 529424 - DNA, 20 bp, Artificial Sequence
  chemically synthesized
ccatgtttccatggcagctg

SEQ ID NO: 529425 - DNA, 20 bp, Artificial Sequence
  chemically synthesized
taaaataatacaagttatga

SEQ ID NO: 529426 - DNA, 20 bp, Artificial Sequence
  chemically synthesized
gctggttctagcctataaat

SEQ ID NO: 529427 - DNA, 20 bp, Artificial Sequence
  chemically synthesized
tagcctataaatagagaaat

SEQ ID NO: 529428 - DNA, 20 bp, Artificial Sequence
  chemically synthesized
acagaaatacttaccaaagt

SEQ ID NO: 529429 - DNA, 20 bp, Artificial Sequence
  chemically synthesized
gtaaaagtgaaagtcataaa

SEQ ID NO: 529430 - DNA, 20 bp, Artificial Sequence
  chemically synthesized
gtagcaggtgtcaaaattca

SEQ ID NO: 529431 - DNA, 20 bp, Artificial Sequence
  chemically synthesized
tacatgcttttgaaaaatag

SEQ ID NO: 529432 - DNA, 20 bp, Artificial Sequence
  chemically synthesized
ggaagcattccaaagatatt

SEQ ID NO: 529433 - DNA, 20 bp, Artificial Sequence
  chemically synthesized
tttgcagtattattaaaaag

SEQ ID NO: 529434 - DNA, 20 bp, Artificial Sequence
  chemically synthesized
atctctgactgaactgaggt

SEQ ID NO: 529435 - DNA, 20 bp, Artificial Sequence
  chemically synthesized
tcaatatgcctatctattag

SEQ ID NO: 529436 - DNA, 20 bp, Artificial Sequence
  chemically synthesized
ctgggaaatagagttggtat

SEQ ID NO: 529437 - DNA, 20 bp, Artificial Sequence
  chemically synthesized
cataccaactctatttccca

SEQ ID NO: 529438 - DNA, 20 bp, Artificial Sequence
  chemically synthesized
tctccccacatactcctatt

SEQ ID NO: 529439 - DNA, 20 bp, Artificial Sequence
  chemically synthesized
cttgtcatctgaaaagtcca

SEQ ID NO: 529440 - DNA, 20 bp, Artificial Sequence
  chemically synthesized
ttctagtgagtttgagctgg

SEQ ID NO: 529441 - DNA, 20 bp, Artificial Sequence
  chemically synthesized
aatatccaggcttcagaagt

SEQ ID NO: 529442 - DNA, 20 bp, Artificial Sequence
  chemically synthesized
taattctttaaagatatgtt

SEQ ID NO: 529443 - DNA, 20 bp, Artificial Sequence
  chemically synthesized
gaattctggaacatatcttt

SEQ ID NO: 529444 - DNA, 20 bp, Artificial Sequence
  chemically synthesized
gcattcatacttagataagt

SEQ ID NO: 529445 - DNA, 20 bp, Artificial Sequence
  chemically synthesized
atgactttgtaaaactcttc

SEQ ID NO: 529446 - DNA, 20 bp, Artificial Sequence
  chemically synthesized
actgcacttcagcctgggcg

SEQ ID NO: 529447 - DNA, 20 bp, Artificial Sequence
  chemically synthesized
gacagaatgagactccatct

SEQ ID NO: 529448 - DNA, 20 bp, Artificial Sequence
  chemically synthesized
atggcacaaatgtggaagac

SEQ ID NO: 529449 - DNA, 20 bp, Artificial Sequence
  chemically synthesized
aagactcagaattgaggaaa

SEQ ID NO: 529450 - DNA, 20 bp, Artificial Sequence
  chemically synthesized
ggccaagcaagaggagggag

SEQ ID NO: 529451 - DNA, 20 bp, Artificial Sequence
  chemically synthesized
ctcttgcttggccttcctca

SEQ ID NO: 529452 - DNA, 20 bp, Artificial Sequence
  chemically synthesized
tgccctggtaaaaggtttgt

SEQ ID NO: 529453 - DNA, 20 bp, Artificial Sequence
  chemically synthesized
ctttatatcggccatttgtt

SEQ ID NO: 529454 - DNA, 20 bp, Artificial Sequence
  chemically synthesized
ttaagatacacagttctccc

SEQ ID NO: 529455 - DNA, 20 bp, Artificial Sequence
  chemically synthesized
tctggggcagaattcaggcc

SEQ ID NO: 529456 - DNA, 20 bp, Artificial Sequence
  chemically synthesized
tcagccctccattatctggg

SEQ ID NO: 529457 - DNA, 20 bp, Artificial Sequence
  chemically synthesized
ctacctgggaggctgaggca

SEQ ID NO: 529458 - DNA, 20 bp, Artificial Sequence
  chemically synthesized
cagagaagaaggtggggctt

SEQ ID NO: 529459 - DNA, 20 bp, Artificial Sequence
  chemically synthesized
taaaaaatggcatttaccca

SEQ ID NO: 529460 - DNA, 20 bp, Artificial Sequence
  chemically synthesized
agctccagtattttggtggc

SEQ ID NO: 529461 - DNA, 20 bp, Artificial Sequence
  chemically synthesized
ggtaaccaacttaggagacc

SEQ ID NO: 529462 - DNA, 20 bp, Artificial Sequence
  chemically synthesized
gtttatgtagccaagaagtc

SEQ ID NO: 529463 - DNA, 20 bp, Artificial Sequence
  chemically synthesized
cataccagctctgcatcctg

SEQ ID NO: 529464 - DNA, 20 bp, Artificial Sequence
  chemically synthesized
gagctttttaaaatgagtta

SEQ ID NO: 529465 - DNA, 20 bp, Artificial Sequence
  chemically synthesized
ctggagataaaggtggcaaa

SEQ ID NO: 529466 - DNA, 20 bp, Artificial Sequence
  chemically synthesized
agtagttgtaactgcagcat

SEQ ID NO: 529467 - DNA, 20 bp, Artificial Sequence
  chemically synthesized
gaaggttctgagccaaagga

SEQ ID NO: 529468 - DNA, 20 bp, Artificial Sequence
  chemically synthesized
tgagttacccatgttgtgac

SEQ ID NO: 529469 - DNA, 20 bp, Artificial Sequence
  chemically synthesized
ctcagctacttacagaactc

SEQ ID NO: 529470 - DNA, 20 bp, Artificial Sequence
  chemically synthesized
gattcgttaattaatgaggt

SEQ ID NO: 529471 - DNA, 20 bp, Artificial Sequence
  chemically synthesized
aatttggctttgcaaaggta

SEQ ID NO: 529472 - DNA, 20 bp, Artificial Sequence
  chemically synthesized
gagacggcggtaaggccaag

SEQ ID NO: 529473 - DNA, 20 bp, Artificial Sequence
  chemically synthesized
aaatcttgggagataagggc

SEQ ID NO: 529474 - DNA, 20 bp, Artificial Sequence
  chemically synthesized
gtaattgaaatggagttttg

SEQ ID NO: 529475 - DNA, 20 bp, Artificial Sequence
  chemically synthesized
cgttgcagctgactgttcta

SEQ ID NO: 529476 - DNA, 20 bp, Artificial Sequence
  chemically synthesized
aggctgaggcaaagatctga

SEQ ID NO: 529477 - DNA, 20 bp, Artificial Sequence
  chemically synthesized
attagtaaaaggtggagtcc

SEQ ID NO: 529478 - DNA, 20 bp, Artificial Sequence
  chemically synthesized
tttttgttttccccaatatc

SEQ ID NO: 529479 - DNA, 20 bp, Artificial Sequence
  chemically synthesized
actctggttatgtgagtgtc

SEQ ID NO: 529480 - DNA, 20 bp, Artificial Sequence
  chemically synthesized
tggtggatggaaaactacta

SEQ ID NO: 529481 - DNA, 20 bp, Artificial Sequence
  chemically synthesized
tcctgttaagttttttttag

SEQ ID NO: 529482 - DNA, 20 bp, Artificial Sequence
  chemically synthesized
ttgtaaaaatccagctgtag

SEQ ID NO: 529483 - DNA, 20 bp, Artificial Sequence
  chemically synthesized
atgaggatgcttatgtacat

SEQ ID NO: 529484 - DNA, 20 bp, Artificial Sequence
  chemically synthesized
aaatttaagcctttgtgggc

SEQ ID NO: 529485 - DNA, 20 bp, Artificial Sequence
  chemically synthesized
taaaatctatagtaatactg

SEQ ID NO: 529486 - DNA, 20 bp, Artificial Sequence
  chemically synthesized
gaaatgactgatgtaactaa

SEQ ID NO: 529487 - DNA, 20 bp, Artificial Sequence
  chemically synthesized
catcttttttccctcaagta

SEQ ID NO: 529488 - DNA, 20 bp, Artificial Sequence
  chemically synthesized
tatacttgagggaaaaaaga

SEQ ID NO: 529489 - DNA, 20 bp, Artificial Sequence
  chemically synthesized
taaaagcaaggaagttcctt

SEQ ID NO: 529490 - DNA, 20 bp, Artificial Sequence
  chemically synthesized
agtggaaaattatattattt

SEQ ID NO: 529491 - DNA, 20 bp, Artificial Sequence
  chemically synthesized
ataaaggaattgggacaaag

SEQ ID NO: 529492 - DNA, 20 bp, Artificial Sequence
  chemically synthesized
aggaattgggacaaagagag

SEQ ID NO: 529493 - DNA, 20 bp, Artificial Sequence
  chemically synthesized
aaagaaaataaatggtctaa

SEQ ID NO: 529494 - DNA, 20 bp, Artificial Sequence
  chemically synthesized
agcagagaaagaccaaggag

SEQ ID NO: 529495 - DNA, 20 bp, Artificial Sequence
  chemically synthesized
ttgtagcagagaaagaccaa

SEQ ID NO: 529496 - DNA, 20 bp, Artificial Sequence
  chemically synthesized
gatcctccagcctttgtagc

SEQ ID NO: 529497 - DNA, 20 bp, Artificial Sequence
  chemically synthesized
aatgcttgagaagatatctg

SEQ ID NO: 529498 - DNA, 20 bp, Artificial Sequence
  chemically synthesized
tgcttctcaggcaggaagaa

SEQ ID NO: 529499 - DNA, 20 bp, Artificial Sequence
  chemically synthesized
gactgctgcttctcaggcag

SEQ ID NO: 529500 - DNA, 20 bp, Artificial Sequence
  chemically synthesized
cactcgttaaaaatggtaca

SEQ ID NO: 529501 - DNA, 20 bp, Artificial Sequence
  chemically synthesized
cccgcaatcctccttgcggt

SEQ ID NO: 529502 - DNA, 20 bp, Artificial Sequence
  chemically synthesized
aatccttatcttacatctgg

SEQ ID NO: 529503 - DNA, 20 bp, Artificial Sequence
  chemically synthesized
actgttagataaagggtaga

SEQ ID NO: 529504 - DNA, 20 bp, Artificial Sequence
  chemically synthesized
gtgtgttgatgttgggcacc

SEQ ID NO: 529505 - DNA, 20 bp, Artificial Sequence
  chemically synthesized
ggatgccaaaatgaaccaca

SEQ ID NO: 529506 - DNA, 20 bp, Artificial Sequence
  chemically synthesized
agcatgcataccagcctaag

SEQ ID NO: 529507 - DNA, 20 bp, Artificial Sequence
  chemically synthesized
gctgtttgagaggtgcaaga

SEQ ID NO: 529508 - DNA, 20 bp, Artificial Sequence
  chemically synthesized
tgcatgcagaagcatgtgat

SEQ ID NO: 529509 - DNA, 20 bp, Artificial Sequence
  chemically synthesized
aagttaacacataacagtga

SEQ ID NO: 529510 - DNA, 20 bp, Artificial Sequence
  chemically synthesized
tcatcattagcatctagtct

SEQ ID NO: 529511 - DNA, 20 bp, Artificial Sequence
  chemically synthesized
actgcattccagcctgggcg

SEQ ID NO: 529512 - DNA, 20 bp, Artificial Sequence
  chemically synthesized
accaatttgaagattcaatc

SEQ ID NO: 529513 - DNA, 20 bp, Artificial Sequence
  chemically synthesized
cgtggtcattgccactgaga

SEQ ID NO: 529514 - DNA, 20 bp, Artificial Sequence
  chemically synthesized
agtgagagaaacagagaggc

SEQ ID NO: 529515 - DNA, 20 bp, Artificial Sequence
  chemically synthesized
gaaagctgaggtgagaagtg

SEQ ID NO: 529516 - DNA, 20 bp, Artificial Sequence
  chemically synthesized
ggtcagatccagtgtgttga

SEQ ID NO: 529517 - DNA, 20 bp, Artificial Sequence
  chemically synthesized
tgacccagcttttattctcc

SEQ ID NO: 529518 - DNA, 20 bp, Artificial Sequence
  chemically synthesized
agttttgtccaggattctga

SEQ ID NO: 529519 - DNA, 20 bp, Artificial Sequence
  chemically synthesized
agtattccctgtagagccaa

SEQ ID NO: 529520 - DNA, 20 bp, Artificial Sequence
  chemically synthesized
gccatcagaggctttgagtg

SEQ ID NO: 529521 - DNA, 20 bp, Artificial Sequence
  chemically synthesized
agcagagggtatggggtgag

SEQ ID NO: 529522 - DNA, 20 bp, Artificial Sequence
  chemically synthesized
aaacttttgtaggaaaaatg

SEQ ID NO: 529523 - DNA, 20 bp, Artificial Sequence
  chemically synthesized
tacaaaagttttttgctccc

SEQ ID NO: 529524 - DNA, 20 bp, Artificial Sequence
  chemically synthesized
tgatatactgcaccatgtaa

SEQ ID NO: 529525 - DNA, 20 bp, Artificial Sequence
  chemically synthesized
ggtggttaggtccctaagtc

SEQ ID NO: 529526 - DNA, 20 bp, Artificial Sequence
  chemically synthesized
tgtggttcttgcctgactgc

SEQ ID NO: 529527 - DNA, 20 bp, Artificial Sequence
  chemically synthesized
attcccctaaagaatactca

SEQ ID NO: 529528 - DNA, 20 bp, Artificial Sequence
  chemically synthesized
aaaagtatatatattcccct

SEQ ID NO: 529529 - DNA, 20 bp, Artificial Sequence
  chemically synthesized
ggaatatatatactttttat

SEQ ID NO: 529530 - DNA, 20 bp, Artificial Sequence
  chemically synthesized
aaaatgaaatacatggtgcc

SEQ ID NO: 529531 - DNA, 20 bp, Artificial Sequence
  chemically synthesized
aaatacatggtgccttagaa

SEQ ID NO: 529532 - DNA, 20 bp, Artificial Sequence
  chemically synthesized
ccaaatgagagaactaagga

SEQ ID NO: 529533 - DNA, 20 bp, Artificial Sequence
  chemically synthesized
ctgaattccctagtcagcta

SEQ ID NO: 529534 - DNA, 20 bp, Artificial Sequence
  chemically synthesized
agctaggagaaaaacatcaa

SEQ ID NO: 529535 - DNA, 20 bp, Artificial Sequence
  chemically synthesized
gggaagggatacacacttgg

SEQ ID NO: 529536 - DNA, 20 bp, Artificial Sequence
  chemically synthesized
gagtagacttgaagtcccac

SEQ ID NO: 529537 - DNA, 20 bp, Artificial Sequence
  chemically synthesized
gtcagatgtttgtcaaggtt

SEQ ID NO: 529538 - DNA, 20 bp, Artificial Sequence
  chemically synthesized
atttaagaagatgccaaggt

SEQ ID NO: 529539 - DNA, 20 bp, Artificial Sequence
  chemically synthesized
gaggctgctgctactcttta

SEQ ID NO: 529540 - DNA, 20 bp, Artificial Sequence
  chemically synthesized
tcccttagacgtgccgcctt

SEQ ID NO: 529541 - DNA, 20 bp, Artificial Sequence
  chemically synthesized
tgttttaataagacaggaac

SEQ ID NO: 529542 - DNA, 20 bp, Artificial Sequence
  chemically synthesized
aaaaaaagtgcacatgactt

SEQ ID NO: 529543 - DNA, 20 bp, Artificial Sequence
  chemically synthesized
atttggaagaaatcccagat

SEQ ID NO: 529544 - DNA, 20 bp, Artificial Sequence
  chemically synthesized
cgggtgaagctaagaatttg

SEQ ID NO: 529545 - DNA, 20 bp, Artificial Sequence
  chemically synthesized
tgaaggacagcgggtgaagc

SEQ ID NO: 529546 - DNA, 20 bp, Artificial Sequence
  chemically synthesized
tggaaaaactactgggtaga

SEQ ID NO: 529547 - DNA, 20 bp, Artificial Sequence
  chemically synthesized
gcacctaataaatgataacc

SEQ ID NO: 529548 - DNA, 20 bp, Artificial Sequence
  chemically synthesized
cacagttgaaggtaattata

SEQ ID NO: 529549 - DNA, 20 bp, Artificial Sequence
  chemically synthesized
ataacaagaagtacaggggc

SEQ ID NO: 529550 - DNA, 20 bp, Artificial Sequence
  chemically synthesized
gccatttgaaaaggggaacc

SEQ ID NO: 529551 - DNA, 20 bp, Artificial Sequence
  chemically synthesized
atgccactgtcccctctcag

SEQ ID NO: 529552 - DNA, 20 bp, Artificial Sequence
  chemically synthesized
taaatccctgctttgcaatg

SEQ ID NO: 529553 - DNA, 20 bp, Artificial Sequence
  chemically synthesized
ccattgtgcagatgaggctc

SEQ ID NO: 529554 - DNA, 20 bp, Artificial Sequence
  chemically synthesized
agggtttttgaaaggattaa

SEQ ID NO: 529555 - DNA, 20 bp, Artificial Sequence
  chemically synthesized
aaaaataaatttttctaaga

SEQ ID NO: 529556 - DNA, 20 bp, Artificial Sequence
  chemically synthesized
tttatttacaatttctcttc

SEQ ID NO: 529557 - DNA, 20 bp, Artificial Sequence
  chemically synthesized
atttgaaggcgtggtgacac

SEQ ID NO: 529558 - DNA, 20 bp, Artificial Sequence
  chemically synthesized
tcacagattggacaggtttt

SEQ ID NO: 529559 - DNA, 20 bp, Artificial Sequence
  chemically synthesized
ttctggcaattctaccttgt

SEQ ID NO: 529560 - DNA, 20 bp, Artificial Sequence
  chemically synthesized
cagaggtttttcttaacaag

SEQ ID NO: 529561 - DNA, 20 bp, Artificial Sequence
  chemically synthesized
cattgttaaatcttcagaaa

SEQ ID NO: 529562 - DNA, 20 bp, Artificial Sequence
  chemically synthesized
ggaaaaacattgttaaatct

SEQ ID NO: 529563 - DNA, 20 bp, Artificial Sequence
  chemically synthesized
aagtgccttaaattatagag

SEQ ID NO: 529564 - DNA, 20 bp, Artificial Sequence
  chemically synthesized
ttcctaaagtgctgggatta

SEQ ID NO: 529565 - DNA, 20 bp, Artificial Sequence
  chemically synthesized
ctgcctggggggctgaggca

SEQ ID NO: 529566 - DNA, 20 bp, Artificial Sequence
  chemically synthesized
tcagtgaagacattgttctc

SEQ ID NO: 529567 - DNA, 20 bp, Artificial Sequence
  chemically synthesized
ggaaaaaaacattgttctag

SEQ ID NO: 529568 - DNA, 20 bp, Artificial Sequence
  chemically synthesized
ggtaggaagagcagtattaa

SEQ ID NO: 529569 - DNA, 20 bp, Artificial Sequence
  chemically synthesized
ctatctttctacctgttgta

SEQ ID NO: 529570 - DNA, 20 bp, Artificial Sequence
  chemically synthesized
aaggatttcttatacaacag

SEQ ID NO: 529571 - DNA, 20 bp, Artificial Sequence
  chemically synthesized
ttgtcatttgggttctacag

SEQ ID NO: 529572 - DNA, 20 bp, Artificial Sequence
  chemically synthesized
gttctacagacagaaaggac

SEQ ID NO: 529573 - DNA, 20 bp, Artificial Sequence
  chemically synthesized
gcagcggacttcatgatgtg

SEQ ID NO: 529574 - DNA, 20 bp, Artificial Sequence
  chemically synthesized
ttttgtgcattctattaccc

SEQ ID NO: 529575 - DNA, 20 bp, Artificial Sequence
  chemically synthesized
tcaaaacctttctctgggta

SEQ ID NO: 529576 - DNA, 20 bp, Artificial Sequence
  chemically synthesized
cccccataaatatggagtac

SEQ ID NO: 529577 - DNA, 20 bp, Artificial Sequence
  chemically synthesized
gggaaaaaaatcaatgcctc

SEQ ID NO: 529578 - DNA, 20 bp, Artificial Sequence
  chemically synthesized
aaaaggctattcagttatta

SEQ ID NO: 529579 - DNA, 20 bp, Artificial Sequence
  chemically synthesized
tgcatatatttaaaaaatgt

SEQ ID NO: 529580 - DNA, 20 bp, Artificial Sequence
  chemically synthesized
gaagaaacaggagttggtat

SEQ ID NO: 529581 - DNA, 20 bp, Artificial Sequence
  chemically synthesized
acaaaaaagtgtgtattata

SEQ ID NO: 529582 - DNA, 20 bp, Artificial Sequence
  chemically synthesized
ttttcacattactcaaaaaa

SEQ ID NO: 529583 - DNA, 20 bp, Artificial Sequence
  chemically synthesized
aaacacccagcagatattta

SEQ ID NO: 529584 - DNA, 20 bp, Artificial Sequence
  chemically synthesized
aaagaaaacatttgtggtca

SEQ ID NO: 529585 - DNA, 20 bp, Artificial Sequence
  chemically synthesized
tgtaaatggctacagccttt

SEQ ID NO: 529586 - DNA, 20 bp, Artificial Sequence
  chemically synthesized
ggcagtgcattccaagaagc

SEQ ID NO: 529587 - DNA, 20 bp, Artificial Sequence
  chemically synthesized
tccacttacatgaatcaaat

SEQ ID NO: 529588 - DNA, 20 bp, Artificial Sequence
  chemically synthesized
tcaaagtcttacgtggaaca

SEQ ID NO: 529589 - DNA, 20 bp, Artificial Sequence
  chemically synthesized
tttctggccaagacgcaatt

SEQ ID NO: 529590 - DNA, 20 bp, Artificial Sequence
  chemically synthesized
attctttaattgcgtcttgg

SEQ ID NO: 529591 - DNA, 20 bp, Artificial Sequence
  chemically synthesized
cctttaacttatctctccag

SEQ ID NO: 529592 - DNA, 20 bp, Artificial Sequence
  chemically synthesized
tattataaaaattaaaactt

SEQ ID NO: 529593 - DNA, 20 bp, Artificial Sequence
  chemically synthesized
ttcttagcaagcaattttat

SEQ ID NO: 529594 - DNA, 20 bp, Artificial Sequence
  chemically synthesized
tgacaccatacatatttggt

SEQ ID NO: 529595 - DNA, 20 bp, Artificial Sequence
  chemically synthesized
tatccattaagatatttgtg

SEQ ID NO: 529596 - DNA, 20 bp, Artificial Sequence
  chemically synthesized
caaaaacagacagtcagtta

SEQ ID NO: 529597 - DNA, 20 bp, Artificial Sequence
  chemically synthesized
acttatgtataagtgatgtt

SEQ ID NO: 529598 - DNA, 20 bp, Artificial Sequence
  chemically synthesized
tattactaacaagcttctga

SEQ ID NO: 529599 - DNA, 20 bp, Artificial Sequence
  chemically synthesized
aatttatggaaggaaatctt

SEQ ID NO: 529600 - DNA, 20 bp, Artificial Sequence
  chemically synthesized
caatttttgaaaattgtgac

SEQ ID NO: 529601 - DNA, 20 bp, Artificial Sequence
  chemically synthesized
aaataacatctctgaggaac

SEQ ID NO: 529602 - DNA, 20 bp, Artificial Sequence
  chemically synthesized
ttatatagttgtttgagata

SEQ ID NO: 529603 - DNA, 20 bp, Artificial Sequence
  chemically synthesized
atcacctcacatctcagtac

SEQ ID NO: 529604 - DNA, 20 bp, Artificial Sequence
  chemically synthesized
cacttcaccttctaaaattt

SEQ ID NO: 529605 - DNA, 20 bp, Artificial Sequence
  chemically synthesized
ttaaaacatggatgttcatt

SEQ ID NO: 529606 - DNA, 20 bp, Artificial Sequence
  chemically synthesized
caacaggctaaaaatatcaa

SEQ ID NO: 529607 - DNA, 20 bp, Artificial Sequence
  chemically synthesized
ggattcagaatttatatgac

SEQ ID NO: 529608 - DNA, 20 bp, Artificial Sequence
  chemically synthesized
taaaaagtgtcactatggat

SEQ ID NO: 529609 - DNA, 20 bp, Artificial Sequence
  chemically synthesized
aaggaataattaattgataa

SEQ ID NO: 529610 - DNA, 20 bp, Artificial Sequence
  chemically synthesized
cttttagggcaaaattaatt

SEQ ID NO: 529611 - DNA, 20 bp, Artificial Sequence
  chemically synthesized
ctggagagatggagttcttt

SEQ ID NO: 529612 - DNA, 20 bp, Artificial Sequence
  chemically synthesized
tgccagtttaataatccgcc

SEQ ID NO: 529613 - DNA, 20 bp, Artificial Sequence
  chemically synthesized
tggcctctaagtgttcaagg

SEQ ID NO: 529614 - DNA, 20 bp, Artificial Sequence
  chemically synthesized
ccctgcgagcacacaaatga

SEQ ID NO: 529615 - DNA, 20 bp, Artificial Sequence
  chemically synthesized
aacagccttattcctgatat

SEQ ID NO: 529616 - DNA, 20 bp, Artificial Sequence
  chemically synthesized
tctggattaggctttggctt

SEQ ID NO: 529617 - DNA, 20 bp, Artificial Sequence
  chemically synthesized
cctcatctcttttagccttc

SEQ ID NO: 529618 - DNA, 20 bp, Artificial Sequence
  chemically synthesized
aaagagatgaggaagctgca

SEQ ID NO: 529619 - DNA, 20 bp, Artificial Sequence
  chemically synthesized
aggactttcatagctctaga

SEQ ID NO: 529620 - DNA, 20 bp, Artificial Sequence
  chemically synthesized
ttcttaagggccctgtgatt

SEQ ID NO: 529621 - DNA, 20 bp, Artificial Sequence
  chemically synthesized
ttctgaaatcacagggccct

SEQ ID NO: 529622 - DNA, 20 bp, Artificial Sequence
  chemically synthesized
ctactcaggaggctgaggca

SEQ ID NO: 529623 - DNA, 20 bp, Artificial Sequence
  chemically synthesized
tttttcttaatccttgggct

SEQ ID NO: 529624 - DNA, 20 bp, Artificial Sequence
  chemically synthesized
ccattctgtagcccaaggat

SEQ ID NO: 529625 - DNA, 20 bp, Artificial Sequence
  chemically synthesized
gactttcaactcttattagt

SEQ ID NO: 529626 - DNA, 20 bp, Artificial Sequence
  chemically synthesized
ctactcgggaagctgaggca

SEQ ID NO: 529627 - DNA, 20 bp, Artificial Sequence
  chemically synthesized
acaaatgttcttaatggcat

SEQ ID NO: 529628 - DNA, 20 bp, Artificial Sequence
  chemically synthesized
tgcagatgtagtggaaacag

SEQ ID NO: 529629 - DNA, 20 bp, Artificial Sequence
  chemically synthesized
gagatagtatcacattctac

SEQ ID NO: 529630 - DNA, 20 bp, Artificial Sequence
  chemically synthesized
cttttgtgaaagatttctct

SEQ ID NO: 529631 - DNA, 20 bp, Artificial Sequence
  chemically synthesized
tcttcattgttgtcttattt

SEQ ID NO: 529632 - DNA, 20 bp, Artificial Sequence
  chemically synthesized
gtaaacataacttatatgta

SEQ ID NO: 529633 - DNA, 20 bp, Artificial Sequence
  chemically synthesized
ctatgcagatatttcgggaa

SEQ ID NO: 529634 - DNA, 20 bp, Artificial Sequence
  chemically synthesized
cagcagagcagagaaaaggc

SEQ ID NO: 529635 - DNA, 20 bp, Artificial Sequence
  chemically synthesized
actgtaataaacagcagagc

SEQ ID NO: 529636 - DNA, 20 bp, Artificial Sequence
  chemically synthesized
agccagacctattgccggag

SEQ ID NO: 529637 - DNA, 20 bp, Artificial Sequence
  chemically synthesized
tccctccagccctaggtata

SEQ ID NO: 529638 - DNA, 20 bp, Artificial Sequence
  chemically synthesized
aatgcgggaaattggttact

SEQ ID NO: 529639 - DNA, 20 bp, Artificial Sequence
  chemically synthesized
atcaatcagggtctgcctgg

SEQ ID NO: 529640 - DNA, 20 bp, Artificial Sequence
  chemically synthesized
tctgtggtagtggaggtatc

SEQ ID NO: 529641 - DNA, 20 bp, Artificial Sequence
  chemically synthesized
atactcgggaagctgaggca

SEQ ID NO: 529642 - DNA, 20 bp, Artificial Sequence
  chemically synthesized
atcctgaatgatatattatt

SEQ ID NO: 529643 - DNA, 20 bp, Artificial Sequence
  chemically synthesized
tggttaagaagtaaaatact

SEQ ID NO: 529644 - DNA, 20 bp, Artificial Sequence
  chemically synthesized
gggttcctgaattgagatac

SEQ ID NO: 529645 - DNA, 20 bp, Artificial Sequence
  chemically synthesized
agaatgacatatgtaaggta

SEQ ID NO: 529646 - DNA, 20 bp, Artificial Sequence
  chemically synthesized
cttatcttgtgttgtgagga

SEQ ID NO: 529647 - DNA, 20 bp, Artificial Sequence
  chemically synthesized
ttgaccacagagaactggtg

SEQ ID NO: 529648 - DNA, 20 bp, Artificial Sequence
  chemically synthesized
acagagaactggtgacagaa

SEQ ID NO: 529649 - DNA, 20 bp, Artificial Sequence
  chemically synthesized
aaatacaggtttgcttttat

SEQ ID NO: 529650 - DNA, 20 bp, Artificial Sequence
  chemically synthesized
attgttttagaagacaaagc

SEQ ID NO: 529651 - DNA, 20 bp, Artificial Sequence
  chemically synthesized
aaggagagctaccaagtggg

SEQ ID NO: 529652 - DNA, 20 bp, Artificial Sequence
  chemically synthesized
caatatagcaagacgttgtc

SEQ ID NO: 529653 - DNA, 20 bp, Artificial Sequence
  chemically synthesized
gtgatagcctctttacagac

SEQ ID NO: 529654 - DNA, 20 bp, Artificial Sequence
  chemically synthesized
ttaccaagcattaattttgg

SEQ ID NO: 529655 - DNA, 20 bp, Artificial Sequence
  chemically synthesized
taccaaaattaatgcttggt

SEQ ID NO: 529656 - DNA, 20 bp, Artificial Sequence
  chemically synthesized
gcaaattttgaaacattccc

SEQ ID NO: 529657 - DNA, 20 bp, Artificial Sequence
  chemically synthesized
ctatgtcataagagagactt

SEQ ID NO: 529658 - DNA, 20 bp, Artificial Sequence
  chemically synthesized
atcagacttgtgggcttaaa

SEQ ID NO: 529659 - DNA, 20 bp, Artificial Sequence
  chemically synthesized
taaggttacacctgcagcta

SEQ ID NO: 529660 - DNA, 20 bp, Artificial Sequence
  chemically synthesized
tatttcagaaggaaactcaa

SEQ ID NO: 529661 - DNA, 20 bp, Artificial Sequence
  chemically synthesized
taagcttggagagatgcaat

SEQ ID NO: 529662 - DNA, 20 bp, Artificial Sequence
  chemically synthesized
tttaaatcaagttatttgaa

SEQ ID NO: 529663 - DNA, 20 bp, Artificial Sequence
  chemically synthesized
tgactttccccatttgtaaa

SEQ ID NO: 529664 - DNA, 20 bp, Artificial Sequence
  chemically synthesized
tattcagcttataaaagaaa

SEQ ID NO: 529665 - DNA, 20 bp, Artificial Sequence
  chemically synthesized
cctttactattcagcttata

SEQ ID NO: 529666 - DNA, 20 bp, Artificial Sequence
  chemically synthesized
aattttgtcagctagggaat

SEQ ID NO: 529667 - DNA, 20 bp, Artificial Sequence
  chemically synthesized
aaaatctgaaactgaaattg

SEQ ID NO: 529668 - DNA, 20 bp, Artificial Sequence
  chemically synthesized
tttacaatggcgaagagttt

SEQ ID NO: 529669 - DNA, 20 bp, Artificial Sequence
  chemically synthesized
ggcgggaggctgctgaggca

SEQ ID NO: 529670 - DNA, 20 bp, Artificial Sequence
  chemically synthesized
tcactggccaacatgacata

SEQ ID NO: 529671 - DNA, 20 bp, Artificial Sequence
  chemically synthesized
atataagaaaatgaagacca

SEQ ID NO: 529672 - DNA, 20 bp, Artificial Sequence
  chemically synthesized
gtttagttcacaaaatatgc

SEQ ID NO: 529673 - DNA, 20 bp, Artificial Sequence
  chemically synthesized
aggaaggaattcatagtcat

SEQ ID NO: 529674 - DNA, 20 bp, Artificial Sequence
  chemically synthesized
ctcctgaggatgctcttggg

SEQ ID NO: 529675 - DNA, 20 bp, Artificial Sequence
  chemically synthesized
gagggaatacttaatggaat

SEQ ID NO: 529676 - DNA, 20 bp, Artificial Sequence
  chemically synthesized
ttctcctaactagaactgct

SEQ ID NO: 529677 - DNA, 20 bp, Artificial Sequence
  chemically synthesized
tctatggtttgcagagagct

SEQ ID NO: 529678 - DNA, 20 bp, Artificial Sequence
  chemically synthesized
tttttaaagaccacttttcc

SEQ ID NO: 529679 - DNA, 20 bp, Artificial Sequence
  chemically synthesized
ttctgaagaacgctataact

SEQ ID NO: 529680 - DNA, 20 bp, Artificial Sequence
  chemically synthesized
aaaggaaaaccagtacccct

SEQ ID NO: 529681 - DNA, 20 bp, Artificial Sequence
  chemically synthesized
gaagagagaatcgctgcact

SEQ ID NO: 529682 - DNA, 20 bp, Artificial Sequence
  chemically synthesized
aaaaataggataatgtgaag

SEQ ID NO: 529683 - DNA, 20 bp, Artificial Sequence
  chemically synthesized
ccccccccaataagacaggc

SEQ ID NO: 529684 - DNA, 20 bp, Artificial Sequence
  chemically synthesized
cagatatactgaccaacaga

SEQ ID NO: 529685 - DNA, 20 bp, Artificial Sequence
  chemically synthesized
taagttcattactgaaattt

SEQ ID NO: 529686 - DNA, 20 bp, Artificial Sequence
  chemically synthesized
agggacctagacataaattg

SEQ ID NO: 529687 - DNA, 20 bp, Artificial Sequence
  chemically synthesized
actctgagctcttcaaggct

SEQ ID NO: 529688 - DNA, 20 bp, Artificial Sequence
  chemically synthesized
ttacatttgtaaaaatgcta

SEQ ID NO: 529689 - DNA, 20 bp, Artificial Sequence
  chemically synthesized
tattacttctagggagtgac

SEQ ID NO: 529690 - DNA, 20 bp, Artificial Sequence
  chemically synthesized
ttctcctgttgtttgttttc

SEQ ID NO: 529691 - DNA, 20 bp, Artificial Sequence
  chemically synthesized
atgttttaaaatgtacattc

SEQ ID NO: 529692 - DNA, 20 bp, Artificial Sequence
  chemically synthesized
acataggaatgattacattt

SEQ ID NO: 529693 - DNA, 20 bp, Artificial Sequence
  chemically synthesized
aaataatgatcacagcaagt

SEQ ID NO: 529694 - DNA, 20 bp, Artificial Sequence
  chemically synthesized
cccaccctcagcccaaagta

SEQ ID NO: 529695 - DNA, 20 bp, Artificial Sequence
  chemically synthesized
ctactcaagaggccgaggct

SEQ ID NO: 529696 - DNA, 20 bp, Artificial Sequence
  chemically synthesized
aatagtcatagaatggtagt

SEQ ID NO: 529697 - DNA, 20 bp, Artificial Sequence
  chemically synthesized
tgtgactacccccaatagtc

SEQ ID NO: 529698 - DNA, 20 bp, Artificial Sequence
  chemically synthesized
gtagtcacagacaaatgctg

SEQ ID NO: 529699 - DNA, 20 bp, Artificial Sequence
  chemically synthesized
gtcattaggaatttgagtcc

SEQ ID NO: 529700 - DNA, 20 bp, Artificial Sequence
  chemically synthesized
caaacaaagcaagacatagt

SEQ ID NO: 529701 - DNA, 20 bp, Artificial Sequence
  chemically synthesized
tgtacctacacaaaaaattg

SEQ ID NO: 529702 - DNA, 20 bp, Artificial Sequence
  chemically synthesized
gaggaggtttccatcaagtg

SEQ ID NO: 529703 - DNA, 20 bp, Artificial Sequence
  chemically synthesized
gatgtagacattttagtggt

SEQ ID NO: 529704 - DNA, 20 bp, Artificial Sequence
  chemically synthesized
aagttacctgacaaagtcca

SEQ ID NO: 529705 - DNA, 20 bp, Artificial Sequence
  chemically synthesized
ttaactaatgagaacttatg

SEQ ID NO: 529706 - DNA, 20 bp, Artificial Sequence
  chemically synthesized
gtagctatagagacactaag

SEQ ID NO: 529707 - DNA, 20 bp, Artificial Sequence
  chemically synthesized
aatggaatgggggtatcgac

SEQ ID NO: 529708 - DNA, 20 bp, Artificial Sequence
  chemically synthesized
gtaaataatataaattcatt

SEQ ID NO: 529709 - DNA, 20 bp, Artificial Sequence
  chemically synthesized
atcagtggaaaaggaatgaa

SEQ ID NO: 529710 - DNA, 20 bp, Artificial Sequence
  chemically synthesized
ggaatgaaaaagaaaaccac

SEQ ID NO: 529711 - DNA, 20 bp, Artificial Sequence
  chemically synthesized
cttgggaactttggcaaatt

SEQ ID NO: 529712 - DNA, 20 bp, Artificial Sequence
  chemically synthesized
tggtgaaaggtatcttgaaa

SEQ ID NO: 529713 - DNA, 20 bp, Artificial Sequence
  chemically synthesized
ctaaagggatacctcttgaa

SEQ ID NO: 529714 - DNA, 20 bp, Artificial Sequence
  chemically synthesized
acataagcataaaatactga

SEQ ID NO: 529715 - DNA, 20 bp, Artificial Sequence
  chemically synthesized
ctactcgggaggctgaagca

SEQ ID NO: 529716 - DNA, 20 bp, Artificial Sequence
  chemically synthesized
ttccagcctgggtgacagag

SEQ ID NO: 529717 - DNA, 20 bp, Artificial Sequence
  chemically synthesized
ttcactgttgcctggcacat

SEQ ID NO: 529718 - DNA, 20 bp, Artificial Sequence
  chemically synthesized
taggacccaccataccattt

SEQ ID NO: 529719 - DNA, 20 bp, Artificial Sequence
  chemically synthesized
tgagaacagtgaaagtacta

SEQ ID NO: 529720 - DNA, 20 bp, Artificial Sequence
  chemically synthesized
gtggtttgttattgggctag

SEQ ID NO: 529721 - DNA, 20 bp, Artificial Sequence
  chemically synthesized
tgttattgggctagcaagaa

SEQ ID NO: 529722 - DNA, 20 bp, Artificial Sequence
  chemically synthesized
ctgaaagttgatttcataaa

SEQ ID NO: 529723 - DNA, 20 bp, Artificial Sequence
  chemically synthesized
tcactcaattttgaattata

SEQ ID NO: 529724 - DNA, 20 bp, Artificial Sequence
  chemically synthesized
tatcaccacatctaaagtat

SEQ ID NO: 529725 - DNA, 20 bp, Artificial Sequence
  chemically synthesized
tctaaagtatggagaaaatt

SEQ ID NO: 529726 - DNA, 20 bp, Artificial Sequence
  chemically synthesized
cactttcaattactctgtaa

SEQ ID NO: 529727 - DNA, 20 bp, Artificial Sequence
  chemically synthesized
acagagtaattgaaagtggt

SEQ ID NO: 529728 - DNA, 20 bp, Artificial Sequence
  chemically synthesized
aaaaaaaagcaagttataag

SEQ ID NO: 529729 - DNA, 20 bp, Artificial Sequence
  chemically synthesized
acttctataaaaatatatgt

SEQ ID NO: 529730 - DNA, 20 bp, Artificial Sequence
  chemically synthesized
attttaaaatcattattatt

SEQ ID NO: 529731 - DNA, 20 bp, Artificial Sequence
  chemically synthesized
agtgaattaaaatattacaa

SEQ ID NO: 529732 - DNA, 20 bp, Artificial Sequence
  chemically synthesized
ctgattgtacaagagaaaaa

SEQ ID NO: 529733 - DNA, 20 bp, Artificial Sequence
  chemically synthesized
ccaggacccctgattgtaca

SEQ ID NO: 529734 - DNA, 20 bp, Artificial Sequence
  chemically synthesized
ggggtcctgggagtactggg

SEQ ID NO: 529735 - DNA, 20 bp, Artificial Sequence
  chemically synthesized
tgcttatcttttggcaaatg

SEQ ID NO: 529736 - DNA, 20 bp, Artificial Sequence
  chemically synthesized
gtgctacatttccagcccct

SEQ ID NO: 529737 - DNA, 20 bp, Artificial Sequence
  chemically synthesized
tataaatgattaaatgtctt

SEQ ID NO: 529738 - DNA, 20 bp, Artificial Sequence
  chemically synthesized
agacatttaatcatttataa

SEQ ID NO: 529739 - DNA, 20 bp, Artificial Sequence
  chemically synthesized
tatagctgcaattcattttg

SEQ ID NO: 529740 - DNA, 20 bp, Artificial Sequence
  chemically synthesized
ccccacttacgtatacctac

SEQ ID NO: 529741 - DNA, 20 bp, Artificial Sequence
  chemically synthesized
ttctgtgaatggacatattg

SEQ ID NO: 529742 - DNA, 20 bp, Artificial Sequence
  chemically synthesized
ttctatcaatatgtccattc

SEQ ID NO: 529743 - DNA, 20 bp, Artificial Sequence
  chemically synthesized
agaaatgcaggcttgaaaaa

SEQ ID NO: 529744 - DNA, 20 bp, Artificial Sequence
  chemically synthesized
gcaacttaagataactcatt

SEQ ID NO: 529745 - DNA, 20 bp, Artificial Sequence
  chemically synthesized
ataattcaagttatgagggg

SEQ ID NO: 529746 - DNA, 20 bp, Artificial Sequence
  chemically synthesized
aacacaaaacaagccatact

SEQ ID NO: 529747 - DNA, 20 bp, Artificial Sequence
  chemically synthesized
ttgtgagcaccggaaagacg

SEQ ID NO: 529748 - DNA, 20 bp, Artificial Sequence
  chemically synthesized
ggttgtcttggtttcacacg

SEQ ID NO: 529749 - DNA, 20 bp, Artificial Sequence
  chemically synthesized
ttttttttcttcccacgaag

SEQ ID NO: 529750 - DNA, 20 bp, Artificial Sequence
  chemically synthesized
acagttttctatcttcgtgg

SEQ ID NO: 529751 - DNA, 20 bp, Artificial Sequence
  chemically synthesized
ttttaaggaacctctgataa

SEQ ID NO: 529752 - DNA, 20 bp, Artificial Sequence
  chemically synthesized
gtggctaaaacacaaaacat

SEQ ID NO: 529753 - DNA, 20 bp, Artificial Sequence
  chemically synthesized
tagcatttacaatgagtagt

SEQ ID NO: 529754 - DNA, 20 bp, Artificial Sequence
  chemically synthesized
gtagtcaagaaaacaggaaa

SEQ ID NO: 529755 - DNA, 20 bp, Artificial Sequence
  chemically synthesized
aagcgcttccatagtgtatt

SEQ ID NO: 529756 - DNA, 20 bp, Artificial Sequence
  chemically synthesized
aagaaatgtttatcttacaa

SEQ ID NO: 529757 - DNA, 20 bp, Artificial Sequence
  chemically synthesized
cttttctctttggaaacaaa

SEQ ID NO: 529758 - DNA, 20 bp, Artificial Sequence
  chemically synthesized
cctttctgctttgtttccaa

SEQ ID NO: 529759 - DNA, 20 bp, Artificial Sequence
  chemically synthesized
aatataaacattattcggtt

SEQ ID NO: 529760 - DNA, 20 bp, Artificial Sequence
  chemically synthesized
gatcgatttgtgggtgcaaa

SEQ ID NO: 529761 - DNA, 20 bp, Artificial Sequence
  chemically synthesized
cccatccaatgtggaacact

SEQ ID NO: 529762 - DNA, 20 bp, Artificial Sequence
  chemically synthesized
gtgtatagcgtactgcgttt

SEQ ID NO: 529763 - DNA, 20 bp, Artificial Sequence
  chemically synthesized
gatagccagcaaccacactt

SEQ ID NO: 529764 - DNA, 20 bp, Artificial Sequence
  chemically synthesized
caattacatgaataaaccct

SEQ ID NO: 529765 - DNA, 20 bp, Artificial Sequence
  chemically synthesized
gaaggggagggaaggaaaaa

SEQ ID NO: 529766 - DNA, 20 bp, Artificial Sequence
  chemically synthesized
actggggcatttccagagga

SEQ ID NO: 529767 - DNA, 20 bp, Artificial Sequence
  chemically synthesized
agaaagtacaggggcctcac

SEQ ID NO: 529768 - DNA, 20 bp, Artificial Sequence
  chemically synthesized
gtaattaagtcaatcaaggc

SEQ ID NO: 529769 - DNA, 20 bp, Artificial Sequence
  chemically synthesized
aacaaccgtttaagttggtt

SEQ ID NO: 529770 - DNA, 20 bp, Artificial Sequence
  chemically synthesized
gggctactgaaatcaatttg

SEQ ID NO: 529771 - DNA, 20 bp, Artificial Sequence
  chemically synthesized
tatacactcactttccgagc

SEQ ID NO: 529772 - DNA, 20 bp, Artificial Sequence
  chemically synthesized
agatgtgatataagcaccag

SEQ ID NO: 529773 - DNA, 20 bp, Artificial Sequence
  chemically synthesized
gtagcatcttctataggtct

SEQ ID NO: 529774 - DNA, 20 bp, Artificial Sequence
  chemically synthesized
tcaaattagaggaacatagg

SEQ ID NO: 529775 - DNA, 20 bp, Artificial Sequence
  chemically synthesized
aacagtgtgtacaatttaca

SEQ ID NO: 529776 - DNA, 20 bp, Artificial Sequence
  chemically synthesized
aatttacaggagaatcccac

SEQ ID NO: 529777 - DNA, 20 bp, Artificial Sequence
  chemically synthesized
catggagctccccatcttct

SEQ ID NO: 529778 - DNA, 20 bp, Artificial Sequence
  chemically synthesized
acatacattcctgccttttt

SEQ ID NO: 529779 - DNA, 20 bp, Artificial Sequence
  chemically synthesized
ttaaaattatgaaaagggtt

SEQ ID NO: 529780 - DNA, 20 bp, Artificial Sequence
  chemically synthesized
tgggcaatggaattgggggc

SEQ ID NO: 529781 - DNA, 20 bp, Artificial Sequence
  chemically synthesized
cccagaatcacagataactg

SEQ ID NO: 529782 - DNA, 20 bp, Artificial Sequence
  chemically synthesized
atctatgttattcaagtccc

SEQ ID NO: 529783 - DNA, 20 bp, Artificial Sequence
  chemically synthesized
aaaggtttgtgtgttgaagg

SEQ ID NO: 529784 - DNA, 20 bp, Artificial Sequence
  chemically synthesized
ttctagttcttttgcattgc

SEQ ID NO: 529785 - DNA, 20 bp, Artificial Sequence
  chemically synthesized
ttctaagcaatgcaaaagaa

SEQ ID NO: 529786 - DNA, 20 bp, Artificial Sequence
  chemically synthesized
gaagtgagcacaagtggaaa

SEQ ID NO: 529787 - DNA, 20 bp, Artificial Sequence
  chemically synthesized
gagcacaagtggaaagaaga

SEQ ID NO: 529788 - DNA, 20 bp, Artificial Sequence
  chemically synthesized
ggtgtgactaattcttaaaa

SEQ ID NO: 529789 - DNA, 20 bp, Artificial Sequence
  chemically synthesized
aaagactatttttctcgttt

SEQ ID NO: 529790 - DNA, 20 bp, Artificial Sequence
  chemically synthesized
tggttcgtcatatagttacc

SEQ ID NO: 529791 - DNA, 20 bp, Artificial Sequence
  chemically synthesized
gggctctggattcatcacag

SEQ ID NO: 529792 - DNA, 20 bp, Artificial Sequence
  chemically synthesized
tttagaaggcaggcacagag

SEQ ID NO: 529793 - DNA, 20 bp, Artificial Sequence
  chemically synthesized
tgcctgccttctaaaacagt

SEQ ID NO: 529794 - DNA, 20 bp, Artificial Sequence
  chemically synthesized
ggctcttctcatggagttac

SEQ ID NO: 529795 - DNA, 20 bp, Artificial Sequence
  chemically synthesized
acctggaatatgcagacgat

SEQ ID NO: 529796 - DNA, 20 bp, Artificial Sequence
  chemically synthesized
tccgatgtggagagtgaaat

SEQ ID NO: 529797 - DNA, 20 bp, Artificial Sequence
  chemically synthesized
cattaacatgtgaacaggtt

SEQ ID NO: 529798 - DNA, 20 bp, Artificial Sequence
  chemically synthesized
tatgttgaacattgttgttc

SEQ ID NO: 529799 - DNA, 20 bp, Artificial Sequence
  chemically synthesized
gaaaaagattatcatggttt

SEQ ID NO: 529800 - DNA, 20 bp, Artificial Sequence
  chemically synthesized
caacacctacttgtcaataa

SEQ ID NO: 529801 - DNA, 20 bp, Artificial Sequence
  chemically synthesized
acttgaaactaaagcaggtg

SEQ ID NO: 529802 - DNA, 20 bp, Artificial Sequence
  chemically synthesized
aagtgtttaatgtttgtttt

SEQ ID NO: 529803 - DNA, 20 bp, Artificial Sequence
  chemically synthesized
accaaataacaatggtggca

SEQ ID NO: 529804 - DNA, 20 bp, Artificial Sequence
  chemically synthesized
atctgtccactacttcccag

SEQ ID NO: 529805 - DNA, 20 bp, Artificial Sequence
  chemically synthesized
acgcaaatgccaaggttcct

SEQ ID NO: 529806 - DNA, 20 bp, Artificial Sequence
  chemically synthesized
caaacccctgccccacggta

SEQ ID NO: 529807 - DNA, 20 bp, Artificial Sequence
  chemically synthesized
ggtgggcatcaatataagca

SEQ ID NO: 529808 - DNA, 20 bp, Artificial Sequence
  chemically synthesized
agggaacaagaaatggggaa

SEQ ID NO: 529809 - DNA, 20 bp, Artificial Sequence
  chemically synthesized
atggtaaatatcccagggaa

SEQ ID NO: 529810 - DNA, 20 bp, Artificial Sequence
  chemically synthesized
tttgccctggctttagccag

SEQ ID NO: 529811 - DNA, 20 bp, Artificial Sequence
  chemically synthesized
ccgattggacacgaccctga

SEQ ID NO: 529812 - DNA, 20 bp, Artificial Sequence
  chemically synthesized
aataaaaaagctaggcaaaa

SEQ ID NO: 529813 - DNA, 20 bp, Artificial Sequence
  chemically synthesized
gaagatgagcacagacacct

SEQ ID NO: 529814 - DNA, 20 bp, Artificial Sequence
  chemically synthesized
gagaaatgcgagagaacacc

SEQ ID NO: 529815 - DNA, 20 bp, Artificial Sequence
  chemically synthesized
caagacctgcagaaatcagg

SEQ ID NO: 529816 - DNA, 20 bp, Artificial Sequence
  chemically synthesized
cattccatgccccaagacct

SEQ ID NO: 529817 - DNA, 20 bp, Artificial Sequence
  chemically synthesized
tggggcatggaatgagcacg

SEQ ID NO: 529818 - DNA, 20 bp, Artificial Sequence
  chemically synthesized
aatgtcagttggaatcctcg

SEQ ID NO: 529819 - DNA, 20 bp, Artificial Sequence
  chemically synthesized
gaatcctcggaagaaatcag

SEQ ID NO: 529820 - DNA, 20 bp, Artificial Sequence
  chemically synthesized
gttatcccctctggggacgg

SEQ ID NO: 529821 - DNA, 20 bp, Artificial Sequence
  chemically synthesized
cggctttgggacgggctcgg

SEQ ID NO: 529822 - DNA, 20 bp, Artificial Sequence
  chemically synthesized
cccactagcccggcgcctgg

SEQ ID NO: 529823 - DNA, 20 bp, Artificial Sequence
  chemically synthesized
gctttcaaaacggaaaggaa

SEQ ID NO: 529824 - DNA, 20 bp, Artificial Sequence
  chemically synthesized
aaacggaaaggaaaaagaaa

SEQ ID NO: 529825 - DNA, 20 bp, Artificial Sequence
  chemically synthesized
ggaaaggaaaaagaaaagag

SEQ ID NO: 529826 - DNA, 20 bp, Artificial Sequence
  chemically synthesized
aggaaaaagaaaagagaaag

SEQ ID NO: 529827 - DNA, 20 bp, Artificial Sequence
  chemically synthesized
aaaagaaaagagaaagaaag

SEQ ID NO: 529828 - DNA, 20 bp, Artificial Sequence
  chemically synthesized
gaaaagagaaagaaagaaag

SEQ ID NO: 529829 - DNA, 20 bp, Artificial Sequence
  chemically synthesized
agagaaagaaagaaagaaag

SEQ ID NO: 529830 - DNA, 20 bp, Artificial Sequence
  chemically synthesized
aaagaaagaaagaaagaaag

SEQ ID NO: 529831 - DNA, 20 bp, Artificial Sequence
  chemically synthesized
ttttttcttttattttttaa

SEQ ID NO: 529832 - DNA, 20 bp, Artificial Sequence
  chemically synthesized
agttttctttttaaaaaata

SEQ ID NO: 529833 - DNA, 20 bp, Artificial Sequence
  chemically synthesized
aactgaggaggaagggagag

SEQ ID NO: 529834 - DNA, 20 bp, Artificial Sequence
  chemically synthesized
cagtatcacctgcgaacttc

SEQ ID NO: 529835 - DNA, 20 bp, Artificial Sequence
  chemically synthesized
cccggcccagacctattgaa

SEQ ID NO: 529836 - DNA, 20 bp, Artificial Sequence
  chemically synthesized
actctgagcatactaatgtt

SEQ ID NO: 529837 - DNA, 20 bp, Artificial Sequence
  chemically synthesized
gttccttctagatcttccta

SEQ ID NO: 529838 - DNA, 20 bp, Artificial Sequence
  chemically synthesized
ctagaaggaacttgtttcta

SEQ ID NO: 529839 - DNA, 20 bp, Artificial Sequence
  chemically synthesized
ttttccaataaaatattcta

SEQ ID NO: 529840 - DNA, 20 bp, Artificial Sequence
  chemically synthesized
tcatactgcaaactctaaaa

SEQ ID NO: 529841 - DNA, 20 bp, Artificial Sequence
  chemically synthesized
cttggaaatactcaaaagaa

SEQ ID NO: 529842 - DNA, 20 bp, Artificial Sequence
  chemically synthesized
gaagaaagccttcattagca

SEQ ID NO: 529843 - DNA, 20 bp, Artificial Sequence
  chemically synthesized
taaggtgttatgtgaagttt

SEQ ID NO: 529844 - DNA, 20 bp, Artificial Sequence
  chemically synthesized
aaatgtttgaaagaaaataa

SEQ ID NO: 529845 - DNA, 20 bp, Artificial Sequence
  chemically synthesized
gagtggaaagcaaatgtttg

SEQ ID NO: 529846 - DNA, 20 bp, Artificial Sequence
  chemically synthesized
acagtgagacccccatccct

SEQ ID NO: 529847 - DNA, 20 bp, Artificial Sequence
  chemically synthesized
tctagggggaaaaatgttga

SEQ ID NO: 529848 - DNA, 20 bp, Artificial Sequence
  chemically synthesized
tctgctcaacatttttcccc

SEQ ID NO: 529849 - DNA, 20 bp, Artificial Sequence
  chemically synthesized
tttggtttgttaaaggtaat

SEQ ID NO: 529850 - DNA, 20 bp, Artificial Sequence
  chemically synthesized
aagtaatctcagtgtatgag

SEQ ID NO: 529851 - DNA, 20 bp, Artificial Sequence
  chemically synthesized
ccccaaggatcggagcagac

SEQ ID NO: 529852 - DNA, 20 bp, Artificial Sequence
  chemically synthesized
gtagttttctaattggacac

SEQ ID NO: 529853 - DNA, 20 bp, Artificial Sequence
  chemically synthesized
tctcttttctcagtgtccaa

SEQ ID NO: 529854 - DNA, 20 bp, Artificial Sequence
  chemically synthesized
gtgtccaattagaaaactac

SEQ ID NO: 529855 - DNA, 20 bp, Artificial Sequence
  chemically synthesized
tactaagaataatctgttga

SEQ ID NO: 529856 - DNA, 20 bp, Artificial Sequence
  chemically synthesized
aataatctgttgacaagaaa

SEQ ID NO: 529857 - DNA, 20 bp, Artificial Sequence
  chemically synthesized
gacaagaaaaaagaatggaa

SEQ ID NO: 529858 - DNA, 20 bp, Artificial Sequence
  chemically synthesized
taattaaatactgaaagtat

SEQ ID NO: 529859 - DNA, 20 bp, Artificial Sequence
  chemically synthesized
tataatcagaaggaggagaa

SEQ ID NO: 529860 - DNA, 20 bp, Artificial Sequence
  chemically synthesized
cttcagctaaaattttgact

SEQ ID NO: 529861 - DNA, 20 bp, Artificial Sequence
  chemically synthesized
cttgttcccagtaccactgt

SEQ ID NO: 529862 - DNA, 20 bp, Artificial Sequence
  chemically synthesized
tgtctcttcatggcagcata

SEQ ID NO: 529863 - DNA, 20 bp, Artificial Sequence
  chemically synthesized
agacatggcttcttttcctg

SEQ ID NO: 529864 - DNA, 20 bp, Artificial Sequence
  chemically synthesized
tgagattgtctatgagtata

SEQ ID NO: 529865 - DNA, 20 bp, Artificial Sequence
  chemically synthesized
agcagagaagagtaaatttg

SEQ ID NO: 529866 - DNA, 20 bp, Artificial Sequence
  chemically synthesized
ttgctagaaatagagataaa

SEQ ID NO: 529867 - DNA, 20 bp, Artificial Sequence
  chemically synthesized
taaactttgagggtatcttt

SEQ ID NO: 529868 - DNA, 20 bp, Artificial Sequence
  chemically synthesized
acaaagaatagagatggatg

SEQ ID NO: 529869 - DNA, 20 bp, Artificial Sequence
  chemically synthesized
agagcagaatggagaaggac

SEQ ID NO: 529870 - DNA, 20 bp, Artificial Sequence
  chemically synthesized
ccaacctcctgggccacaga

SEQ ID NO: 529871 - DNA, 20 bp, Artificial Sequence
  chemically synthesized
agatcagtaggagggaacct

SEQ ID NO: 529872 - DNA, 20 bp, Artificial Sequence
  chemically synthesized
acaaggctctaggcaggcta

SEQ ID NO: 529873 - DNA, 20 bp, Artificial Sequence
  chemically synthesized
tcagtttggtcagggtcctg

SEQ ID NO: 529874 - DNA, 20 bp, Artificial Sequence
  chemically synthesized
gagtggggactactgataga

SEQ ID NO: 529875 - DNA, 20 bp, Artificial Sequence
  chemically synthesized
cggtctgcttgatcttttgg

SEQ ID NO: 529876 - DNA, 20 bp, Artificial Sequence
  chemically synthesized
agaatgtcaagataagggtt

SEQ ID NO: 529877 - DNA, 20 bp, Artificial Sequence
  chemically synthesized
gtatgagggagctttttaag

SEQ ID NO: 529878 - DNA, 20 bp, Artificial Sequence
  chemically synthesized
gagggagctttttaaggaag

SEQ ID NO: 529879 - DNA, 20 bp, Artificial Sequence
  chemically synthesized
ggctctgtccggtttgtctt

SEQ ID NO: 529880 - DNA, 20 bp, Artificial Sequence
  chemically synthesized
acagcagtggcagaggaggt

SEQ ID NO: 529881 - DNA, 20 bp, Artificial Sequence
  chemically synthesized
aatgtccaagaccaattaaa

SEQ ID NO: 529882 - DNA, 20 bp, Artificial Sequence
  chemically synthesized
ttagaatcacttggagagtc

SEQ ID NO: 529883 - DNA, 20 bp, Artificial Sequence
  chemically synthesized
tccttaaccttcactgcata

SEQ ID NO: 529884 - DNA, 20 bp, Artificial Sequence
  chemically synthesized
cctcctgaaattcctagctc

SEQ ID NO: 529885 - DNA, 20 bp, Artificial Sequence
  chemically synthesized
acattgaaaccacatgcaac

SEQ ID NO: 529886 - DNA, 20 bp, Artificial Sequence
  chemically synthesized
ccaaatgctgacattttact

SEQ ID NO: 529887 - DNA, 20 bp, Artificial Sequence
  chemically synthesized
ttgggtatacaataaagaca

SEQ ID NO: 529888 - DNA, 20 bp, Artificial Sequence
  chemically synthesized
aaaccaacatcttctggatg

SEQ ID NO: 529889 - DNA, 20 bp, Artificial Sequence
  chemically synthesized
agctttgagaaatcttatta

SEQ ID NO: 529890 - DNA, 20 bp, Artificial Sequence
  chemically synthesized
taggtggctctgtgaagctt

SEQ ID NO: 529891 - DNA, 20 bp, Artificial Sequence
  chemically synthesized
gccgacggttgcttcatggg

SEQ ID NO: 529892 - DNA, 20 bp, Artificial Sequence
  chemically synthesized
aagcggaatttcaaaactgg

SEQ ID NO: 529893 - DNA, 20 bp, Artificial Sequence
  chemically synthesized
aagagagattatgcagagtg

SEQ ID NO: 529894 - DNA, 20 bp, Artificial Sequence
  chemically synthesized
gtgggaggaaggtagaggcc

SEQ ID NO: 529895 - DNA, 20 bp, Artificial Sequence
  chemically synthesized
ttgactccataagggaggtt

SEQ ID NO: 529896 - DNA, 20 bp, Artificial Sequence
  chemically synthesized
aaacaataaagtctgataaa

SEQ ID NO: 529897 - DNA, 20 bp, Artificial Sequence
  chemically synthesized
atgtgagtatttatggattt

SEQ ID NO: 529898 - DNA, 20 bp, Artificial Sequence
  chemically synthesized
actcacattttctgatcaat

SEQ ID NO: 529899 - DNA, 20 bp, Artificial Sequence
  chemically synthesized
aactgtaatttctagattga

SEQ ID NO: 529900 - DNA, 20 bp, Artificial Sequence
  chemically synthesized
gcattgtgagtgtcaggtag

SEQ ID NO: 529901 - DNA, 20 bp, Artificial Sequence
  chemically synthesized
attagcattgtgagtgtcag

SEQ ID NO: 529902 - DNA, 20 bp, Artificial Sequence
  chemically synthesized
aatggacagtctactacaag

SEQ ID NO: 529903 - DNA, 20 bp, Artificial Sequence
  chemically synthesized
ttattttggtgtatttgagg

SEQ ID NO: 529904 - DNA, 20 bp, Artificial Sequence
  chemically synthesized
tttgtaaatatttatttgtc

SEQ ID NO: 529905 - DNA, 20 bp, Artificial Sequence
  chemically synthesized
gtaagtcctacgacttgttt

SEQ ID NO: 529906 - DNA, 20 bp, Artificial Sequence
  chemically synthesized
caagtcgtaggacttaccca

SEQ ID NO: 529907 - DNA, 20 bp, Artificial Sequence
  chemically synthesized
ttttttgaaatttgagtatt

SEQ ID NO: 529908 - DNA, 20 bp, Artificial Sequence
  chemically synthesized
attcatctcaggaaaaaaaa

SEQ ID NO: 529909 - DNA, 20 bp, Artificial Sequence
  chemically synthesized
tttcctgagatgaatatcta

SEQ ID NO: 529910 - DNA, 20 bp, Artificial Sequence
  chemically synthesized
aagtgacccacctctaaggg

SEQ ID NO: 529911 - DNA, 20 bp, Artificial Sequence
  chemically synthesized
aagcttttgttaactcatct

SEQ ID NO: 529912 - DNA, 20 bp, Artificial Sequence
  chemically synthesized
gaacatactgagttctcttt

SEQ ID NO: 529913 - DNA, 20 bp, Artificial Sequence
  chemically synthesized
ccctcacacgacaatctaaa

SEQ ID NO: 529914 - DNA, 20 bp, Artificial Sequence
  chemically synthesized
catgttcatattctcagaca

SEQ ID NO: 529915 - DNA, 20 bp, Artificial Sequence
  chemically synthesized
tactccaggtttctgctgtc

SEQ ID NO: 529916 - DNA, 20 bp, Artificial Sequence
  chemically synthesized
atttggtgggggacagtgag

SEQ ID NO: 529917 - DNA, 20 bp, Artificial Sequence
  chemically synthesized
gaaatatcccctagcttgat

SEQ ID NO: 529918 - DNA, 20 bp, Artificial Sequence
  chemically synthesized
tttatttatccacaaatttc

SEQ ID NO: 529919 - DNA, 20 bp, Artificial Sequence
  chemically synthesized
aatataggataatatttaat

SEQ ID NO: 529920 - DNA, 20 bp, Artificial Sequence
  chemically synthesized
ccccagtttttaccaaccat

SEQ ID NO: 529921 - DNA, 20 bp, Artificial Sequence
  chemically synthesized
gtaaaaactggggagtgttt

SEQ ID NO: 529922 - DNA, 20 bp, Artificial Sequence
  chemically synthesized
tcagacagattataataatt

SEQ ID NO: 529923 - DNA, 20 bp, Artificial Sequence
  chemically synthesized
tataataattacagaaatag

SEQ ID NO: 529924 - DNA, 20 bp, Artificial Sequence
  chemically synthesized
tagtttggcctcttgggatt

SEQ ID NO: 529925 - DNA, 20 bp, Artificial Sequence
  chemically synthesized
gtgtgtgtgtgttctttttg

SEQ ID NO: 529926 - DNA, 20 bp, Artificial Sequence
  chemically synthesized
attagctcacagagtcaatg

SEQ ID NO: 529927 - DNA, 20 bp, Artificial Sequence
  chemically synthesized
tatcttgggaaggctaactg

SEQ ID NO: 529928 - DNA, 20 bp, Artificial Sequence
  chemically synthesized
gcttgacctactctcatccc

SEQ ID NO: 529929 - DNA, 20 bp, Artificial Sequence
  chemically synthesized
tcccttagaaacaggtcgac

SEQ ID NO: 529930 - DNA, 20 bp, Artificial Sequence
  chemically synthesized
ctttgcatatgatggataga

SEQ ID NO: 529931 - DNA, 20 bp, Artificial Sequence
  chemically synthesized
tgaatatctttctttttaaa

SEQ ID NO: 529932 - DNA, 20 bp, Artificial Sequence
  chemically synthesized
caaatttaattctattttaa

SEQ ID NO: 529933 - DNA, 20 bp, Artificial Sequence
  chemically synthesized
tagaattaaatttgaggtgg

SEQ ID NO: 529934 - DNA, 20 bp, Artificial Sequence
  chemically synthesized
ggtggaaaagagggtaggga

SEQ ID NO: 529935 - DNA, 20 bp, Artificial Sequence
  chemically synthesized
gagtggatgaaagtctgaac

SEQ ID NO: 529936 - DNA, 20 bp, Artificial Sequence
  chemically synthesized
ggctgaattcatgacaggtt

SEQ ID NO: 529937 - DNA, 20 bp, Artificial Sequence
  chemically synthesized
ctacttgggaggctgaggca

SEQ ID NO: 529938 - DNA, 20 bp, Artificial Sequence
  chemically synthesized
aattttgctatgcataccca

SEQ ID NO: 529939 - DNA, 20 bp, Artificial Sequence
  chemically synthesized
gcaagacaaacaacacaggg

SEQ ID NO: 529940 - DNA, 20 bp, Artificial Sequence
  chemically synthesized
ccacattggaaaactgtttg

SEQ ID NO: 529941 - DNA, 20 bp, Artificial Sequence
  chemically synthesized
acacacacagaccctataac

SEQ ID NO: 529942 - DNA, 20 bp, Artificial Sequence
  chemically synthesized
tttgaggactatatcaaggg

SEQ ID NO: 529943 - DNA, 20 bp, Artificial Sequence
  chemically synthesized
tattcatcaaatggcatgtc

SEQ ID NO: 529944 - DNA, 20 bp, Artificial Sequence
  chemically synthesized
ctactgtggatgggcatttg

SEQ ID NO: 529945 - DNA, 20 bp, Artificial Sequence
  chemically synthesized
aatgggatattacatagcaa

SEQ ID NO: 529946 - DNA, 20 bp, Artificial Sequence
  chemically synthesized
atataaaggacaagaacagg

SEQ ID NO: 529947 - DNA, 20 bp, Artificial Sequence
  chemically synthesized
catttaaccagcatccaaat

SEQ ID NO: 529948 - DNA, 20 bp, Artificial Sequence
  chemically synthesized
tttatttgtcaattaaaaaa

SEQ ID NO: 529949 - DNA, 20 bp, Artificial Sequence
  chemically synthesized
agatttaagtattatcacca

SEQ ID NO: 529950 - DNA, 20 bp, Artificial Sequence
  chemically synthesized
tactgaaatatattaggcat

SEQ ID NO: 529951 - DNA, 20 bp, Artificial Sequence
  chemically synthesized
cctttgtagatgtcaaagca

SEQ ID NO: 529952 - DNA, 20 bp, Artificial Sequence
  chemically synthesized
acactgcatggtgtcgactt

SEQ ID NO: 529953 - DNA, 20 bp, Artificial Sequence
  chemically synthesized
ggggccaaggcaaagtggtc

SEQ ID NO: 529954 - DNA, 20 bp, Artificial Sequence
  chemically synthesized
ctccacctcaggccaggtca

SEQ ID NO: 529955 - DNA, 20 bp, Artificial Sequence
  chemically synthesized
ccagtattgttcttaatgaa

SEQ ID NO: 529956 - DNA, 20 bp, Artificial Sequence
  chemically synthesized
attgttcttaatgaaacaga

SEQ ID NO: 529957 - DNA, 20 bp, Artificial Sequence
  chemically synthesized
tcttaatgaaacagaaaaga

SEQ ID NO: 529958 - DNA, 20 bp, Artificial Sequence
  chemically synthesized
tattcatgcttgtatgattg

SEQ ID NO: 529959 - DNA, 20 bp, Artificial Sequence
  chemically synthesized
aatcatacaagcatgaatag

SEQ ID NO: 529960 - DNA, 20 bp, Artificial Sequence
  chemically synthesized
agctacaggctttactacat

SEQ ID NO: 529961 - DNA, 20 bp, Artificial Sequence
  chemically synthesized
ttctttccaaatcctagtct

SEQ ID NO: 529962 - DNA, 20 bp, Artificial Sequence
  chemically synthesized
acatgagatgctgcaggggc

SEQ ID NO: 529963 - DNA, 20 bp, Artificial Sequence
  chemically synthesized
caatatcaccatgccatttg

SEQ ID NO: 529964 - DNA, 20 bp, Artificial Sequence
  chemically synthesized
aaacacttcaaaacataaac

SEQ ID NO: 529965 - DNA, 20 bp, Artificial Sequence
  chemically synthesized
aattggcaagtgtgtgcctg

SEQ ID NO: 529966 - DNA, 20 bp, Artificial Sequence
  chemically synthesized
gatgaatttataagcattaa

SEQ ID NO: 529967 - DNA, 20 bp, Artificial Sequence
  chemically synthesized
aaaatgttcctacaattata

SEQ ID NO: 529968 - DNA, 20 bp, Artificial Sequence
  chemically synthesized
atgagtaaaaataacagctt

SEQ ID NO: 529969 - DNA, 20 bp, Artificial Sequence
  chemically synthesized
gctgtgattaaatactgaaa

SEQ ID NO: 529970 - DNA, 20 bp, Artificial Sequence
  chemically synthesized
atctagtgcttttaaaaata

SEQ ID NO: 529971 - DNA, 20 bp, Artificial Sequence
  chemically synthesized
tacctacatctaaattcaga

SEQ ID NO: 529972 - DNA, 20 bp, Artificial Sequence
  chemically synthesized
gcaagatatcacaaaatatt

SEQ ID NO: 529973 - DNA, 20 bp, Artificial Sequence
  chemically synthesized
cactaccaaacatgacacaa

SEQ ID NO: 529974 - DNA, 20 bp, Artificial Sequence
  chemically synthesized
ctacatttttagagttgtaa

SEQ ID NO: 529975 - DNA, 20 bp, Artificial Sequence
  chemically synthesized
ttttagagttgtaaaaagaa

SEQ ID NO: 529976 - DNA, 20 bp, Artificial Sequence
  chemically synthesized
tgtttactatgttgtccttt

SEQ ID NO: 529977 - DNA, 20 bp, Artificial Sequence
  chemically synthesized
agctgttacacatctgctcc

SEQ ID NO: 529978 - DNA, 20 bp, Artificial Sequence
  chemically synthesized
tctgctcccaagaaagaacg

SEQ ID NO: 529979 - DNA, 20 bp, Artificial Sequence
  chemically synthesized
ctaggtgctaactgaatttg

SEQ ID NO: 529980 - DNA, 20 bp, Artificial Sequence
  chemically synthesized
ataagataatgctgaaatga

SEQ ID NO: 529981 - DNA, 20 bp, Artificial Sequence
  chemically synthesized
taagattttataaggggtat

SEQ ID NO: 529982 - DNA, 20 bp, Artificial Sequence
  chemically synthesized
aatactgtatgattctattt

SEQ ID NO: 529983 - DNA, 20 bp, Artificial Sequence
  chemically synthesized
ttttcaagaattttctataa

SEQ ID NO: 529984 - DNA, 20 bp, Artificial Sequence
  chemically synthesized
tgtgtattactttgcatttt

SEQ ID NO: 529985 - DNA, 20 bp, Artificial Sequence
  chemically synthesized
atgcaaagtaatacacagtg

SEQ ID NO: 529986 - DNA, 20 bp, Artificial Sequence
  chemically synthesized
gaaagacgatcagtggttgc

SEQ ID NO: 529987 - DNA, 20 bp, Artificial Sequence
  chemically synthesized
aaaaatgcatacaactgcac

SEQ ID NO: 529988 - DNA, 20 bp, Artificial Sequence
  chemically synthesized
attatatcctctcatccaat

SEQ ID NO: 529989 - DNA, 20 bp, Artificial Sequence
  chemically synthesized
gcatattttaactaaatatt

SEQ ID NO: 529990 - DNA, 20 bp, Artificial Sequence
  chemically synthesized
atatctagctcaatccattc

SEQ ID NO: 529991 - DNA, 20 bp, Artificial Sequence
  chemically synthesized
atttttttcctgttttattc

SEQ ID NO: 529992 - DNA, 20 bp, Artificial Sequence
  chemically synthesized
gagcttaagagatgactgaa

SEQ ID NO: 529993 - DNA, 20 bp, Artificial Sequence
  chemically synthesized
ctgattaaataatgacatct

SEQ ID NO: 529994 - DNA, 20 bp, Artificial Sequence
  chemically synthesized
acatttttcaagttctcttt

SEQ ID NO: 529995 - DNA, 20 bp, Artificial Sequence
  chemically synthesized
ggtgatgtcatataaggaga

SEQ ID NO: 529996 - DNA, 20 bp, Artificial Sequence
  chemically synthesized
gagttgccagtggaaaactc

SEQ ID NO: 529997 - DNA, 20 bp, Artificial Sequence
  chemically synthesized
ttttagtggatactggataa

SEQ ID NO: 529998 - DNA, 20 bp, Artificial Sequence
  chemically synthesized
gaagaatgcactcctgttga

SEQ ID NO: 529999 - DNA, 20 bp, Artificial Sequence
  chemically synthesized
aagatcgtccctaagattat

SEQ ID NO: 530000 - DNA, 20 bp, Artificial Sequence
  chemically synthesized
cgtccctaagattatctaga

SEQ ID NO: 530001 - DNA, 20 bp, Artificial Sequence
  chemically synthesized
atgagttgatgaccttcagt

SEQ ID NO: 530002 - DNA, 20 bp, Artificial Sequence
  chemically synthesized
tgtcgcatgactctcacaaa

SEQ ID NO: 530003 - DNA, 20 bp, Artificial Sequence
  chemically synthesized
cataggtttagggtacaata

SEQ ID NO: 530004 - DNA, 20 bp, Artificial Sequence
  chemically synthesized
aaagtgttcatttatagcat

SEQ ID NO: 530005 - DNA, 20 bp, Artificial Sequence
  chemically synthesized
aaaattcctttgattgtata

SEQ ID NO: 530006 - DNA, 20 bp, Artificial Sequence
  chemically synthesized
ctaaatgtcctttacaaaga

SEQ ID NO: 530007 - DNA, 20 bp, Artificial Sequence
  chemically synthesized
gtggagtctgatttccaatt

SEQ ID NO: 530008 - DNA, 20 bp, Artificial Sequence
  chemically synthesized
atagaaaaagttatgaaatt

SEQ ID NO: 530009 - DNA, 20 bp, Artificial Sequence
  chemically synthesized
atgagttgacacattgattc

SEQ ID NO: 530010 - DNA, 20 bp, Artificial Sequence
  chemically synthesized
tttttcaacttttcaaactg

SEQ ID NO: 530011 - DNA, 20 bp, Artificial Sequence
  chemically synthesized
attctctgagttctttcact

SEQ ID NO: 530012 - DNA, 20 bp, Artificial Sequence
  chemically synthesized
attctttagtgaaagaactc

SEQ ID NO: 530013 - DNA, 20 bp, Artificial Sequence
  chemically synthesized
aaaaaaagccctcccctacc

SEQ ID NO: 530014 - DNA, 20 bp, Artificial Sequence
  chemically synthesized
ccctaccccagaatcctgca

SEQ ID NO: 530015 - DNA, 20 bp, Artificial Sequence
  chemically synthesized
atttaaatttgctagatgga

SEQ ID NO: 530016 - DNA, 20 bp, Artificial Sequence
  chemically synthesized
attatcgtgtctgaattggt

SEQ ID NO: 530017 - DNA, 20 bp, Artificial Sequence
  chemically synthesized
tttaaaaatatattttcagg

SEQ ID NO: 530018 - DNA, 20 bp, Artificial Sequence
  chemically synthesized
gagagctaaactcagaaaaa

SEQ ID NO: 530019 - DNA, 20 bp, Artificial Sequence
  chemically synthesized
cttgcttcagagagctaaac

SEQ ID NO: 530020 - DNA, 20 bp, Artificial Sequence
  chemically synthesized
tccttaacattaatctcata

SEQ ID NO: 530021 - DNA, 20 bp, Artificial Sequence
  chemically synthesized
aaggaccataaacgttatgt

SEQ ID NO: 530022 - DNA, 20 bp, Artificial Sequence
  chemically synthesized
tgggaacagctcacgtatac

SEQ ID NO: 530023 - DNA, 20 bp, Artificial Sequence
  chemically synthesized
agctcacgtatacagagaaa

SEQ ID NO: 530024 - DNA, 20 bp, Artificial Sequence
  chemically synthesized
aataaaaagatctagcagat

SEQ ID NO: 530025 - DNA, 20 bp, Artificial Sequence
  chemically synthesized
aatactgtttttggtcccat

SEQ ID NO: 530026 - DNA, 20 bp, Artificial Sequence
  chemically synthesized
atgttaaatgcatttttgac

SEQ ID NO: 530027 - DNA, 20 bp, Artificial Sequence
  chemically synthesized
gcaaaagtgatacacattca

SEQ ID NO: 530028 - DNA, 20 bp, Artificial Sequence
  chemically synthesized
gcaagcatccgcaaatgagg

SEQ ID NO: 530029 - DNA, 20 bp, Artificial Sequence
  chemically synthesized
atgaggaaagaatagagaga

SEQ ID NO: 530030 - DNA, 20 bp, Artificial Sequence
  chemically synthesized
ggaaagaatagagagaggag

SEQ ID NO: 530031 - DNA, 20 bp, Artificial Sequence
  chemically synthesized
agaaagtactagatgaagac

SEQ ID NO: 530032 - DNA, 20 bp, Artificial Sequence
  chemically synthesized
atcactgccatggtgaatga

SEQ ID NO: 530033 - DNA, 20 bp, Artificial Sequence
  chemically synthesized
aagaagaagaagaagaagaa

SEQ ID NO: 530034 - DNA, 20 bp, Artificial Sequence
  chemically synthesized
ggaagaacaaaatttaatca

SEQ ID NO: 530035 - DNA, 20 bp, Artificial Sequence
  chemically synthesized
gacaggaggagagtgataaa

SEQ ID NO: 530036 - DNA, 20 bp, Artificial Sequence
  chemically synthesized
gatggccctctttaaatgtt

SEQ ID NO: 530037 - DNA, 20 bp, Artificial Sequence
  chemically synthesized
ttaaagagggccatctgcaa

SEQ ID NO: 530038 - DNA, 20 bp, Artificial Sequence
  chemically synthesized
aacagtactgggtcacagat

SEQ ID NO: 530039 - DNA, 20 bp, Artificial Sequence
  chemically synthesized
aatgttatagattacatatt

SEQ ID NO: 530040 - DNA, 20 bp, Artificial Sequence
  chemically synthesized
tgaaagcaatgatataataa

SEQ ID NO: 530041 - DNA, 20 bp, Artificial Sequence
  chemically synthesized
ttgcccacttccctgttatc

SEQ ID NO: 530042 - DNA, 20 bp, Artificial Sequence
  chemically synthesized
gatatgcatacattaaggac

SEQ ID NO: 530043 - DNA, 20 bp, Artificial Sequence
  chemically synthesized
cttgtaaggagataaagagg

SEQ ID NO: 530044 - DNA, 20 bp, Artificial Sequence
  chemically synthesized
aacaagtgaaatgaaaatag

SEQ ID NO: 530045 - DNA, 20 bp, Artificial Sequence
  chemically synthesized
agccactacaaattctttca

SEQ ID NO: 530046 - DNA, 20 bp, Artificial Sequence
  chemically synthesized
tatatttctactttcttttg

SEQ ID NO: 530047 - DNA, 20 bp, Artificial Sequence
  chemically synthesized
acaaattctttcaaaagaaa

SEQ ID NO: 530048 - DNA, 20 bp, Artificial Sequence
  chemically synthesized
aaagtagaaatataaattat

SEQ ID NO: 530049 - DNA, 20 bp, Artificial Sequence
  chemically synthesized
ataaaatgaagattcgtgag

SEQ ID NO: 530050 - DNA, 20 bp, Artificial Sequence
  chemically synthesized
agcagcattagcatcacctg

SEQ ID NO: 530051 - DNA, 20 bp, Artificial Sequence
  chemically synthesized
aagaaagaaaaaacgtgtag

SEQ ID NO: 530052 - DNA, 20 bp, Artificial Sequence
  chemically synthesized
aaaaaagaaagaaaaaacgt

SEQ ID NO: 530053 - DNA, 20 bp, Artificial Sequence
  chemically synthesized
gactctgtctcaaaaaaaag

SEQ ID NO: 530054 - DNA, 20 bp, Artificial Sequence
  chemically synthesized
gtgagactctgtctcaaaaa

SEQ ID NO: 530055 - DNA, 20 bp, Artificial Sequence
  chemically synthesized
tgtaatcccaggctgagtta

SEQ ID NO: 530056 - DNA, 20 bp, Artificial Sequence
  chemically synthesized
aaagcattccaatacaaagt

SEQ ID NO: 530057 - DNA, 20 bp, Artificial Sequence
  chemically synthesized
cataaagaggaggtttcaca

SEQ ID NO: 530058 - DNA, 20 bp, Artificial Sequence
  chemically synthesized
tttcagattggggtctaatg

SEQ ID NO: 530059 - DNA, 20 bp, Artificial Sequence
  chemically synthesized
ctctgtttcttttggcagac

SEQ ID NO: 530060 - DNA, 20 bp, Artificial Sequence
  chemically synthesized
gaaaatttctctgtctgcca

SEQ ID NO: 530061 - DNA, 20 bp, Artificial Sequence
  chemically synthesized
ctctgtctgccaaaagaaac

SEQ ID NO: 530062 - DNA, 20 bp, Artificial Sequence
  chemically synthesized
tcccacaacgcaagagagga

SEQ ID NO: 530063 - DNA, 20 bp, Artificial Sequence
  chemically synthesized
tgctgccagttacttgccac

SEQ ID NO: 530064 - DNA, 20 bp, Artificial Sequence
  chemically synthesized
gagcttttaatacacattga

SEQ ID NO: 530065 - DNA, 20 bp, Artificial Sequence
  chemically synthesized
gtgtattaaaagctctgaca

SEQ ID NO: 530066 - DNA, 20 bp, Artificial Sequence
  chemically synthesized
acttgtgcagctcaagattg

SEQ ID NO: 530067 - DNA, 20 bp, Artificial Sequence
  chemically synthesized
attaaaactggatgatggga

SEQ ID NO: 530068 - DNA, 20 bp, Artificial Sequence
  chemically synthesized
tttagtagagactggacaaa

SEQ ID NO: 530069 - DNA, 20 bp, Artificial Sequence
  chemically synthesized
aaagagattgaaagctgata

SEQ ID NO: 530070 - DNA, 20 bp, Artificial Sequence
  chemically synthesized
ctgacctcatgttatataaa

SEQ ID NO: 530071 - DNA, 20 bp, Artificial Sequence
  chemically synthesized
aattgggaggttttaaggca

SEQ ID NO: 530072 - DNA, 20 bp, Artificial Sequence
  chemically synthesized
ttccacccttggttgaaggg

SEQ ID NO: 530073 - DNA, 20 bp, Artificial Sequence
  chemically synthesized
cagaagcaacggtggaagca

SEQ ID NO: 530074 - DNA, 20 bp, Artificial Sequence
  chemically synthesized
gtttttgtttgctcctctct

SEQ ID NO: 530075 - DNA, 20 bp, Artificial Sequence
  chemically synthesized
gaagtgcttgtctaaggtag

SEQ ID NO: 530076 - DNA, 20 bp, Artificial Sequence
  chemically synthesized
aatttaggcacatccaggag

SEQ ID NO: 530077 - DNA, 20 bp, Artificial Sequence
  chemically synthesized
atgtgtgtttgctcattttg

SEQ ID NO: 530078 - DNA, 20 bp, Artificial Sequence
  chemically synthesized
tagacttcagttcaaaatgc

SEQ ID NO: 530079 - DNA, 20 bp, Artificial Sequence
  chemically synthesized
aataaatgaataatcatata

SEQ ID NO: 530080 - DNA, 20 bp, Artificial Sequence
  chemically synthesized
tcaacatttttgctttcctt

SEQ ID NO: 530081 - DNA, 20 bp, Artificial Sequence
  chemically synthesized
ccactcgagaggctgaggcg

SEQ ID NO: 530082 - DNA, 20 bp, Artificial Sequence
  chemically synthesized
tgatttagagctaacaaaaa

SEQ ID NO: 530083 - DNA, 20 bp, Artificial Sequence
  chemically synthesized
aaatcaaattttaaaagtaa

SEQ ID NO: 530084 - DNA, 20 bp, Artificial Sequence
  chemically synthesized
acagacttccagacttacag

SEQ ID NO: 530085 - DNA, 20 bp, Artificial Sequence
  chemically synthesized
tattacttcatttaatttta

SEQ ID NO: 530086 - DNA, 20 bp, Artificial Sequence
  chemically synthesized
gtaagtaggtactttataaa

SEQ ID NO: 530087 - DNA, 20 bp, Artificial Sequence
  chemically synthesized
aataataataataataataa

SEQ ID NO: 530088 - DNA, 20 bp, Artificial Sequence
  chemically synthesized
ctactcgggaggctgaggca

SEQ ID NO: 530089 - DNA, 20 bp, Artificial Sequence
  chemically synthesized
ttcactctatataaccttga

SEQ ID NO: 530090 - DNA, 20 bp, Artificial Sequence
  chemically synthesized
acatccaagtctgcaaataa

SEQ ID NO: 530091 - DNA, 20 bp, Artificial Sequence
  chemically synthesized
taaatattcagagatatttt

SEQ ID NO: 530092 - DNA, 20 bp, Artificial Sequence
  chemically synthesized
tccggaaagttattgtcatg

SEQ ID NO: 530093 - DNA, 20 bp, Artificial Sequence
  chemically synthesized
tatagaatacatgtgccgtt

SEQ ID NO: 530094 - DNA, 20 bp, Artificial Sequence
  chemically synthesized
aatgggagctggtagggact

SEQ ID NO: 530095 - DNA, 20 bp, Artificial Sequence
  chemically synthesized
gtcaactgacactgacaaaa

SEQ ID NO: 530096 - DNA, 20 bp, Artificial Sequence
  chemically synthesized
tgacactgacaaaagaagaa

SEQ ID NO: 530097 - DNA, 20 bp, Artificial Sequence
  chemically synthesized
tggaatagccctgtactatt

SEQ ID NO: 530098 - DNA, 20 bp, Artificial Sequence
  chemically synthesized
aaggccaaatcatatcactg

SEQ ID NO: 530099 - DNA, 20 bp, Artificial Sequence
  chemically synthesized
ctggcagaaataccaatctt

SEQ ID NO: 530100 - DNA, 20 bp, Artificial Sequence
  chemically synthesized
ccctacttgcctttatgaaa

SEQ ID NO: 530101 - DNA, 20 bp, Artificial Sequence
  chemically synthesized
atccacataccaaaccttga

SEQ ID NO: 530102 - DNA, 20 bp, Artificial Sequence
  chemically synthesized
acttgatgctaaacattcat

SEQ ID NO: 530103 - DNA, 20 bp, Artificial Sequence
  chemically synthesized
gtatcctcttttattatctt

SEQ ID NO: 530104 - DNA, 20 bp, Artificial Sequence
  chemically synthesized
taattcttttgtgtcctctt

SEQ ID NO: 530105 - DNA, 20 bp, Artificial Sequence
  chemically synthesized
gatttcttaaagaggacaca

SEQ ID NO: 530106 - DNA, 20 bp, Artificial Sequence
  chemically synthesized
aatttacaaagggctacaaa

SEQ ID NO: 530107 - DNA, 20 bp, Artificial Sequence
  chemically synthesized
aaaaaactcctacagatcaa

SEQ ID NO: 530108 - DNA, 20 bp, Artificial Sequence
  chemically synthesized
ccattgcagtgagtgtgtga

SEQ ID NO: 530109 - DNA, 20 bp, Artificial Sequence
  chemically synthesized
tgtgtgccaaaaaacgcatt

SEQ ID NO: 530110 - DNA, 20 bp, Artificial Sequence
  chemically synthesized
aaccaaaatgttccccaaca

SEQ ID NO: 530111 - DNA, 20 bp, Artificial Sequence
  chemically synthesized
catagaatataaccactacc

SEQ ID NO: 530112 - DNA, 20 bp, Artificial Sequence
  chemically synthesized
tgaaaagcttgaggagaaac

SEQ ID NO: 530113 - DNA, 20 bp, Artificial Sequence
  chemically synthesized
tttcaaaatgaaaagcttga

SEQ ID NO: 530114 - DNA, 20 bp, Artificial Sequence
  chemically synthesized
gggagtggtgagagagagag

SEQ ID NO: 530115 - DNA, 20 bp, Artificial Sequence
  chemically synthesized
gcttgaagaatgacccacat

SEQ ID NO: 530116 - DNA, 20 bp, Artificial Sequence
  chemically synthesized
tgaatctcttttttttgctt

SEQ ID NO: 530117 - DNA, 20 bp, Artificial Sequence
  chemically synthesized
atccttgttcaataaataga

SEQ ID NO: 530118 - DNA, 20 bp, Artificial Sequence
  chemically synthesized
gcttctgtattatatggaga

SEQ ID NO: 530119 - DNA, 20 bp, Artificial Sequence
  chemically synthesized
aagacaaggttgttcagggc

SEQ ID NO: 530120 - DNA, 20 bp, Artificial Sequence
  chemically synthesized
aatggttaaacgagcaagct

SEQ ID NO: 530121 - DNA, 20 bp, Artificial Sequence
  chemically synthesized
ccctgctgccatctctacga

SEQ ID NO: 530122 - DNA, 20 bp, Artificial Sequence
  chemically synthesized
atagatgacctgaggatgaa

SEQ ID NO: 530123 - DNA, 20 bp, Artificial Sequence
  chemically synthesized
ttcctttgtgttgtttacca

SEQ ID NO: 530124 - DNA, 20 bp, Artificial Sequence
  chemically synthesized
cttagatcatttgctatgga

SEQ ID NO: 530125 - DNA, 20 bp, Artificial Sequence
  chemically synthesized
agtttccaagtctgtgggaa

SEQ ID NO: 530126 - DNA, 20 bp, Artificial Sequence
  chemically synthesized
aaacattccatgggatattg

SEQ ID NO: 530127 - DNA, 20 bp, Artificial Sequence
  chemically synthesized
ctacccgaacatccatggca

SEQ ID NO: 530128 - DNA, 20 bp, Artificial Sequence
  chemically synthesized
agtaacatggctaaactggt

SEQ ID NO: 530129 - DNA, 20 bp, Artificial Sequence
  chemically synthesized
ttgtgaaatgtaagaggaag

SEQ ID NO: 530130 - DNA, 20 bp, Artificial Sequence
  chemically synthesized
aaaattgtgaaatgtaagag

SEQ ID NO: 530131 - DNA, 20 bp, Artificial Sequence
  chemically synthesized
cattcccttaaatgataatg

SEQ ID NO: 530132 - DNA, 20 bp, Artificial Sequence
  chemically synthesized
ttccatttggggaaatagat

SEQ ID NO: 530133 - DNA, 20 bp, Artificial Sequence
  chemically synthesized
caacactacgtctctgagca

SEQ ID NO: 530134 - DNA, 20 bp, Artificial Sequence
  chemically synthesized
cacacatgaatatgacacta

SEQ ID NO: 530135 - DNA, 20 bp, Artificial Sequence
  chemically synthesized
cagagtgagactccatctca

SEQ ID NO: 530136 - DNA, 20 bp, Artificial Sequence
  chemically synthesized
atactcgggaggctgaggca

SEQ ID NO: 530137 - DNA, 20 bp, Artificial Sequence
  chemically synthesized
ggtttgcttttaatatactt

SEQ ID NO: 530138 - DNA, 20 bp, Artificial Sequence
  chemically synthesized
ctacttgggaggctgaggca

SEQ ID NO: 530139 - DNA, 20 bp, Artificial Sequence
  chemically synthesized
tttattgtagcactttcacc

SEQ ID NO: 530140 - DNA, 20 bp, Artificial Sequence
  chemically synthesized
cagctctcaattgtgaatgt

SEQ ID NO: 530141 - DNA, 20 bp, Artificial Sequence
  chemically synthesized
gaatgttgagaatatactta

SEQ ID NO: 530142 - DNA, 20 bp, Artificial Sequence
  chemically synthesized
acagaagcatggactctatg

SEQ ID NO: 530143 - DNA, 20 bp, Artificial Sequence
  chemically synthesized
ttatgaccagaagaagctat

SEQ ID NO: 530144 - DNA, 20 bp, Artificial Sequence
  chemically synthesized
agaatctactctcttctgat

SEQ ID NO: 530145 - DNA, 20 bp, Artificial Sequence
  chemically synthesized
tggaaaccactccagatcaa

SEQ ID NO: 530146 - DNA, 20 bp, Artificial Sequence
  chemically synthesized
accatacttataagatagtt

SEQ ID NO: 530147 - DNA, 20 bp, Artificial Sequence
  chemically synthesized
ttaccattagctttttgaaa

SEQ ID NO: 530148 - DNA, 20 bp, Artificial Sequence
  chemically synthesized
tttatgggaatctgcagtat

SEQ ID NO: 530149 - DNA, 20 bp, Artificial Sequence
  chemically synthesized
gcagtaagcacgtttcctca

SEQ ID NO: 530150 - DNA, 20 bp, Artificial Sequence
  chemically synthesized
gcctagaaaatagttctgtg

SEQ ID NO: 530151 - DNA, 20 bp, Artificial Sequence
  chemically synthesized
ggtagggttttaaaagatgc

SEQ ID NO: 530152 - DNA, 20 bp, Artificial Sequence
  chemically synthesized
gaactactctgagctaagtg

SEQ ID NO: 530153 - DNA, 20 bp, Artificial Sequence
  chemically synthesized
tcctaggaatctcatgccag

SEQ ID NO: 530154 - DNA, 20 bp, Artificial Sequence
  chemically synthesized
gagtggtaccaatccatggt

SEQ ID NO: 530155 - DNA, 20 bp, Artificial Sequence
  chemically synthesized
gactaagaatagctaattgt

SEQ ID NO: 530156 - DNA, 20 bp, Artificial Sequence
  chemically synthesized
gacatagaaattcaaatgac

SEQ ID NO: 530157 - DNA, 20 bp, Artificial Sequence
  chemically synthesized
gccaaagcatgtgttatgac

SEQ ID NO: 530158 - DNA, 20 bp, Artificial Sequence
  chemically synthesized
tttatagagtaacctactct

SEQ ID NO: 530159 - DNA, 20 bp, Artificial Sequence
  chemically synthesized
ggaaaacatcagcatatcga

SEQ ID NO: 530160 - DNA, 20 bp, Artificial Sequence
  chemically synthesized
attttggcttgcacattcta

SEQ ID NO: 530161 - DNA, 20 bp, Artificial Sequence
  chemically synthesized
aatgttggcttttcattctg

SEQ ID NO: 530162 - DNA, 20 bp, Artificial Sequence
  chemically synthesized
tgaaatcttttcatcatata

SEQ ID NO: 530163 - DNA, 20 bp, Artificial Sequence
  chemically synthesized
tctcaacaaagtgatggcag

SEQ ID NO: 530164 - DNA, 20 bp, Artificial Sequence
  chemically synthesized
aggcctaatccacagctagt

SEQ ID NO: 530165 - DNA, 20 bp, Artificial Sequence
  chemically synthesized
aggcctagattggatcgcca

SEQ ID NO: 530166 - DNA, 20 bp, Artificial Sequence
  chemically synthesized
ggttgctgcctttcaatacc

SEQ ID NO: 530167 - DNA, 20 bp, Artificial Sequence
  chemically synthesized
tcttttatgcattttagtac

SEQ ID NO: 530168 - DNA, 20 bp, Artificial Sequence
  chemically synthesized
tatgccacttttaaagtttc

SEQ ID NO: 530169 - DNA, 20 bp, Artificial Sequence
  chemically synthesized
ttttaaagtttcccagaata

SEQ ID NO: 530170 - DNA, 20 bp, Artificial Sequence
  chemically synthesized
taattccgtctaaacatgaa

SEQ ID NO: 530171 - DNA, 20 bp, Artificial Sequence
  chemically synthesized
caggtcagacgtgtacagct

SEQ ID NO: 530172 - DNA, 20 bp, Artificial Sequence
  chemically synthesized
tactagacctctaagtctac

SEQ ID NO: 530173 - DNA, 20 bp, Artificial Sequence
  chemically synthesized
aaacttcaaaggtaaagcct

SEQ ID NO: 530174 - DNA, 20 bp, Artificial Sequence
  chemically synthesized
tttgtttcccaaaaaaagaa

SEQ ID NO: 530175 - DNA, 20 bp, Artificial Sequence
  chemically synthesized
ttgtgttttgtttcccaaaa

SEQ ID NO: 530176 - DNA, 20 bp, Artificial Sequence
  chemically synthesized
ggcacaatgttccactttaa

SEQ ID NO: 530177 - DNA, 20 bp, Artificial Sequence
  chemically synthesized
tttggtacttttcttttttt

SEQ ID NO: 530178 - DNA, 20 bp, Artificial Sequence
  chemically synthesized
ctctaaagctttctttaaaa

SEQ ID NO: 530179 - DNA, 20 bp, Artificial Sequence
  chemically synthesized
gacttttcttcagttcttac

SEQ ID NO: 530180 - DNA, 20 bp, Artificial Sequence
  chemically synthesized
gatatttctgagtaagaact

SEQ ID NO: 530181 - DNA, 20 bp, Artificial Sequence
  chemically synthesized
aaagtcaactaattgttcgt

SEQ ID NO: 530182 - DNA, 20 bp, Artificial Sequence
  chemically synthesized
ctacttgggaggctgaggca

SEQ ID NO: 530183 - DNA, 20 bp, Artificial Sequence
  chemically synthesized
atcttttaccattggagaga

SEQ ID NO: 530184 - DNA, 20 bp, Artificial Sequence
  chemically synthesized
actcaatcttttaccattgg

SEQ ID NO: 530185 - DNA, 20 bp, Artificial Sequence
  chemically synthesized
ttcactgaatagggggtgac

SEQ ID NO: 530186 - DNA, 20 bp, Artificial Sequence
  chemically synthesized
caagtctttcaaggattact

SEQ ID NO: 530187 - DNA, 20 bp, Artificial Sequence
  chemically synthesized
aatattacttgactgaagac

SEQ ID NO: 530188 - DNA, 20 bp, Artificial Sequence
  chemically synthesized
aggtttaaacttgcattgct

SEQ ID NO: 530189 - DNA, 20 bp, Artificial Sequence
  chemically synthesized
aaatgttcactgtggaaaac

SEQ ID NO: 530190 - DNA, 20 bp, Artificial Sequence
  chemically synthesized
ggaagtctgagcaatacatt

SEQ ID NO: 530191 - DNA, 20 bp, Artificial Sequence
  chemically synthesized
ggttgctcccatacttgtag

SEQ ID NO: 530192 - DNA, 20 bp, Artificial Sequence
  chemically synthesized
tgacttttcatcagtccatc

SEQ ID NO: 530193 - DNA, 20 bp, Artificial Sequence
  chemically synthesized
tgccttcacaaggaggatgc

SEQ ID NO: 530194 - DNA, 20 bp, Artificial Sequence
  chemically synthesized
aaggaggatgcgaagaatct

SEQ ID NO: 530195 - DNA, 20 bp, Artificial Sequence
  chemically synthesized
actatcacaagtacagcaac

SEQ ID NO: 530196 - DNA, 20 bp, Artificial Sequence
  chemically synthesized
ttgtttttcagccttatgca

SEQ ID NO: 530197 - DNA, 20 bp, Artificial Sequence
  chemically synthesized
ctctacctctggaggaaggg

SEQ ID NO: 530198 - DNA, 20 bp, Artificial Sequence
  chemically synthesized
tgtgtattaattcaaacatt

SEQ ID NO: 530199 - DNA, 20 bp, Artificial Sequence
  chemically synthesized
agatacaaagcatgcctaag

SEQ ID NO: 530200 - DNA, 20 bp, Artificial Sequence
  chemically synthesized
cacagtctaaggagacaaag

SEQ ID NO: 530201 - DNA, 20 bp, Artificial Sequence
  chemically synthesized
ttttaaagactcttgaggga

SEQ ID NO: 530202 - DNA, 20 bp, Artificial Sequence
  chemically synthesized
aagacaatatgcaagattag

SEQ ID NO: 530203 - DNA, 20 bp, Artificial Sequence
  chemically synthesized
aagtgaatcaaatggaaatg

SEQ ID NO: 530204 - DNA, 20 bp, Artificial Sequence
  chemically synthesized
gctagaaattaaaagcagta

SEQ ID NO: 530205 - DNA, 20 bp, Artificial Sequence
  chemically synthesized
aaattaaaagcagtaacaga

SEQ ID NO: 530206 - DNA, 20 bp, Artificial Sequence
  chemically synthesized
gtgaacttgaatatagggta

SEQ ID NO: 530207 - DNA, 20 bp, Artificial Sequence
  chemically synthesized
aaatgtgttccttctaatgc

SEQ ID NO: 530208 - DNA, 20 bp, Artificial Sequence
  chemically synthesized
acactttaaaaagtgacctt

SEQ ID NO: 530209 - DNA, 20 bp, Artificial Sequence
  chemically synthesized
tgaccttccagaatttagca

SEQ ID NO: 530210 - DNA, 20 bp, Artificial Sequence
  chemically synthesized
tagacagatagtgtgcacct

SEQ ID NO: 530211 - DNA, 20 bp, Artificial Sequence
  chemically synthesized
acagtgagttagggaactct

SEQ ID NO: 530212 - DNA, 20 bp, Artificial Sequence
  chemically synthesized
agagttccctaactcactgt

SEQ ID NO: 530213 - DNA, 20 bp, Artificial Sequence
  chemically synthesized
aattaccaactgtgcattgc

SEQ ID NO: 530214 - DNA, 20 bp, Artificial Sequence
  chemically synthesized
tcataggaggaagggcgcaa

SEQ ID NO: 530215 - DNA, 20 bp, Artificial Sequence
  chemically synthesized
tgatgatagtttggatatgg

SEQ ID NO: 530216 - DNA, 20 bp, Artificial Sequence
  chemically synthesized
actagggctggaggaggtga

SEQ ID NO: 530217 - DNA, 20 bp, Artificial Sequence
  chemically synthesized
atagataatggaaatgacac

SEQ ID NO: 530218 - DNA, 20 bp, Artificial Sequence
  chemically synthesized
tgtcaatagatgtttattta

SEQ ID NO: 530219 - DNA, 20 bp, Artificial Sequence
  chemically synthesized
taaatgtttttcttaggtaa

SEQ ID NO: 530220 - DNA, 20 bp, Artificial Sequence
  chemically synthesized
atggtttgattctccttacc

SEQ ID NO: 530221 - DNA, 20 bp, Artificial Sequence
  chemically synthesized
aatcaaaccatttaagtgca

SEQ ID NO: 530222 - DNA, 20 bp, Artificial Sequence
  chemically synthesized
aaaaagcattttagcatttg

SEQ ID NO: 530223 - DNA, 20 bp, Artificial Sequence
  chemically synthesized
actgctacttgttactgctt

SEQ ID NO: 530224 - DNA, 20 bp, Artificial Sequence
  chemically synthesized
cctcagttatatttgtaaaa

SEQ ID NO: 530225 - DNA, 20 bp, Artificial Sequence
  chemically synthesized
tcctatattacaggccaatt

SEQ ID NO: 530226 - DNA, 20 bp, Artificial Sequence
  chemically synthesized
aggaaaaatttttagatgcc

SEQ ID NO: 530227 - DNA, 20 bp, Artificial Sequence
  chemically synthesized
gtcttagatagatctttaat

SEQ ID NO: 530228 - DNA, 20 bp, Artificial Sequence
  chemically synthesized
atctttaataaagaattgaa

SEQ ID NO: 530229 - DNA, 20 bp, Artificial Sequence
  chemically synthesized
atacatttgccttttgcaaa

SEQ ID NO: 530230 - DNA, 20 bp, Artificial Sequence
  chemically synthesized
ctagatagctactcttccgt

SEQ ID NO: 530231 - DNA, 20 bp, Artificial Sequence
  chemically synthesized
ttttgatcttggtatatatt

SEQ ID NO: 530232 - DNA, 20 bp, Artificial Sequence
  chemically synthesized
catatatttcaaaattgcta

SEQ ID NO: 530233 - DNA, 20 bp, Artificial Sequence
  chemically synthesized
tgcattggaggtcaggaggg

SEQ ID NO: 530234 - DNA, 20 bp, Artificial Sequence
  chemically synthesized
ttggaatcagggaatatggt

SEQ ID NO: 530235 - DNA, 20 bp, Artificial Sequence
  chemically synthesized
gacataattggctgctgtgt

SEQ ID NO: 530236 - DNA, 20 bp, Artificial Sequence
  chemically synthesized
aaattttcctctttggagtt

SEQ ID NO: 530237 - DNA, 20 bp, Artificial Sequence
  chemically synthesized
ttcctctttggagttgcaga

SEQ ID NO: 530238 - DNA, 20 bp, Artificial Sequence
  chemically synthesized
aagtttcatgtattattttc

SEQ ID NO: 530239 - DNA, 20 bp, Artificial Sequence
  chemically synthesized
tttactataatattcaagtc

SEQ ID NO: 530240 - DNA, 20 bp, Artificial Sequence
  chemically synthesized
taatattcaagtcaaagaat

SEQ ID NO: 530241 - DNA, 20 bp, Artificial Sequence
  chemically synthesized
atcatttccccatatttcac

SEQ ID NO: 530242 - DNA, 20 bp, Artificial Sequence
  chemically synthesized
catattattttataacatct

SEQ ID NO: 530243 - DNA, 20 bp, Artificial Sequence
  chemically synthesized
tgtattacaaaacaaaaaat

SEQ ID NO: 530244 - DNA, 20 bp, Artificial Sequence
  chemically synthesized
agttttataaagagtggagt

SEQ ID NO: 530245 - DNA, 20 bp, Artificial Sequence
  chemically synthesized
attaaaaagactgaataaga

SEQ ID NO: 530246 - DNA, 20 bp, Artificial Sequence
  chemically synthesized
agaattaattcagtaaaaca

SEQ ID NO: 530247 - DNA, 20 bp, Artificial Sequence
  chemically synthesized
gttgccgtggcctggaaact

SEQ ID NO: 530248 - DNA, 20 bp, Artificial Sequence
  chemically synthesized
agttacagtcagataacttc

SEQ ID NO: 530249 - DNA, 20 bp, Artificial Sequence
  chemically synthesized
aaaaattaacatggagggat

SEQ ID NO: 530250 - DNA, 20 bp, Artificial Sequence
  chemically synthesized
ctctatagtgctttcagtaa

SEQ ID NO: 530251 - DNA, 20 bp, Artificial Sequence
  chemically synthesized
gagtatatgaaatatgagtg

SEQ ID NO: 530252 - DNA, 20 bp, Artificial Sequence
  chemically synthesized
ttttggggtttttttggtag

SEQ ID NO: 530253 - DNA, 20 bp, Artificial Sequence
  chemically synthesized
aatgatatctaatatttaac

SEQ ID NO: 530254 - DNA, 20 bp, Artificial Sequence
  chemically synthesized
gggaagaaaagacttcaagt

SEQ ID NO: 530255 - DNA, 20 bp, Artificial Sequence
  chemically synthesized
ctgcagtggtatccagtagg

SEQ ID NO: 530256 - DNA, 20 bp, Artificial Sequence
  chemically synthesized
gtctgtggaaaaattgtctt

SEQ ID NO: 530257 - DNA, 20 bp, Artificial Sequence
  chemically synthesized
tctaggttgtgacctcttta

SEQ ID NO: 530258 - DNA, 20 bp, Artificial Sequence
  chemically synthesized
actgaacaatgctggctcct

SEQ ID NO: 530259 - DNA, 20 bp, Artificial Sequence
  chemically synthesized
tcctattaccaaaactgttg

SEQ ID NO: 530260 - DNA, 20 bp, Artificial Sequence
  chemically synthesized
tctttgaaagttactgtttt

SEQ ID NO: 530261 - DNA, 20 bp, Artificial Sequence
  chemically synthesized
tgtaacaccagtggggctat

SEQ ID NO: 530262 - DNA, 20 bp, Artificial Sequence
  chemically synthesized
gcaatatagcaagactccat

SEQ ID NO: 530263 - DNA, 20 bp, Artificial Sequence
  chemically synthesized
agagttgagactccatctcc

SEQ ID NO: 530264 - DNA, 20 bp, Artificial Sequence
  chemically synthesized
ctactcaggaggctgaggca

SEQ ID NO: 530265 - DNA, 20 bp, Artificial Sequence
  chemically synthesized
cccaataggtatgcttattt

SEQ ID NO: 530266 - DNA, 20 bp, Artificial Sequence
  chemically synthesized
aaaatatttcaagagttaaa

SEQ ID NO: 530267 - DNA, 20 bp, Artificial Sequence
  chemically synthesized
tatttcaagagttaaacaag

SEQ ID NO: 530268 - DNA, 20 bp, Artificial Sequence
  chemically synthesized
aaccttattttaagcagatc

SEQ ID NO: 530269 - DNA, 20 bp, Artificial Sequence
  chemically synthesized
gttttaggaaatcacaagtc

SEQ ID NO: 530270 - DNA, 20 bp, Artificial Sequence
  chemically synthesized
taataaagattggtactaga

SEQ ID NO: 530271 - DNA, 20 bp, Artificial Sequence
  chemically synthesized
ccaatctttattaatgactg

SEQ ID NO: 530272 - DNA, 20 bp, Artificial Sequence
  chemically synthesized
atacgtttttaaaaatttac

SEQ ID NO: 530273 - DNA, 20 bp, Artificial Sequence
  chemically synthesized
ataatctgtcaattacaaaa

SEQ ID NO: 530274 - DNA, 20 bp, Artificial Sequence
  chemically synthesized
tttatgagtcgtggctggct

SEQ ID NO: 530275 - DNA, 20 bp, Artificial Sequence
  chemically synthesized
gacaacgaagaggaaactaa

SEQ ID NO: 530276 - DNA, 20 bp, Artificial Sequence
  chemically synthesized
aaaaaaaatcaaataataga

SEQ ID NO: 530277 - DNA, 20 bp, Artificial Sequence
  chemically synthesized
ccaaaaaaaaaaatcaaata

SEQ ID NO: 530278 - DNA, 20 bp, Artificial Sequence
  chemically synthesized
ttatttgatttttttttttg

SEQ ID NO: 530279 - DNA, 20 bp, Artificial Sequence
  chemically synthesized
agtattgatataagtaagag

SEQ ID NO: 530280 - DNA, 20 bp, Artificial Sequence
  chemically synthesized
taaaaaaaaaagaagaaaga

SEQ ID NO: 530281 - DNA, 20 bp, Artificial Sequence
  chemically synthesized
aggaataaaaaaaaaagaag

SEQ ID NO: 530282 - DNA, 20 bp, Artificial Sequence
  chemically synthesized
ctctaggaataaaaaaaaaa

SEQ ID NO: 530283 - DNA, 20 bp, Artificial Sequence
  chemically synthesized
acagagatttttcttaatct

SEQ ID NO: 530284 - DNA, 20 bp, Artificial Sequence
  chemically synthesized
ggcttatgttttctgaagat

SEQ ID NO: 530285 - DNA, 20 bp, Artificial Sequence
  chemically synthesized
tttgtaattttgagtcatta

SEQ ID NO: 530286 - DNA, 20 bp, Artificial Sequence
  chemically synthesized
agtcattatgagaaaaagta

SEQ ID NO: 530287 - DNA, 20 bp, Artificial Sequence
  chemically synthesized
aatgataaaaaataaagact

SEQ ID NO: 530288 - DNA, 20 bp, Artificial Sequence
  chemically synthesized
taatgaatatcattctgcaa

SEQ ID NO: 530289 - DNA, 20 bp, Artificial Sequence
  chemically synthesized
aatgatactttattcttatt

SEQ ID NO: 530290 - DNA, 20 bp, Artificial Sequence
  chemically synthesized
gcagaacatttcatcttatt

SEQ ID NO: 530291 - DNA, 20 bp, Artificial Sequence
  chemically synthesized
ttcccccagctcaaggcttg

SEQ ID NO: 530292 - DNA, 20 bp, Artificial Sequence
  chemically synthesized
aattgaccacgcgctacctt

SEQ ID NO: 530293 - DNA, 20 bp, Artificial Sequence
  chemically synthesized
acttacaattgagggtatga

SEQ ID NO: 530294 - DNA, 20 bp, Artificial Sequence
  chemically synthesized
tggaggtggtggaatatgac

SEQ ID NO: 530295 - DNA, 20 bp, Artificial Sequence
  chemically synthesized
cagacatatagaccaatgga

SEQ ID NO: 530296 - DNA, 20 bp, Artificial Sequence
  chemically synthesized
tctagctttgttctttttgc

SEQ ID NO: 530297 - DNA, 20 bp, Artificial Sequence
  chemically synthesized
aaactaccatgaccttcttc

SEQ ID NO: 530298 - DNA, 20 bp, Artificial Sequence
  chemically synthesized
ctgaggtctttcatggatag

SEQ ID NO: 530299 - DNA, 20 bp, Artificial Sequence
  chemically synthesized
cttcctatccatgaaagacc

SEQ ID NO: 530300 - DNA, 20 bp, Artificial Sequence
  chemically synthesized
ggaaaactctctagccatat

SEQ ID NO: 530301 - DNA, 20 bp, Artificial Sequence
  chemically synthesized
tctctagccatatgcagaaa

SEQ ID NO: 530302 - DNA, 20 bp, Artificial Sequence
  chemically synthesized
actgcaacaaaagacaaaat

SEQ ID NO: 530303 - DNA, 20 bp, Artificial Sequence
  chemically synthesized
taaagagcttctgcacagca

SEQ ID NO: 530304 - DNA, 20 bp, Artificial Sequence
  chemically synthesized
tcaaagtgaataggcaacct

SEQ ID NO: 530305 - DNA, 20 bp, Artificial Sequence
  chemically synthesized
atctgacaaaggtctaatat

SEQ ID NO: 530306 - DNA, 20 bp, Artificial Sequence
  chemically synthesized
aaggaacttaaacatattca

SEQ ID NO: 530307 - DNA, 20 bp, Artificial Sequence
  chemically synthesized
gctcaacatcactgatcatc

SEQ ID NO: 530308 - DNA, 20 bp, Artificial Sequence
  chemically synthesized
gagataccatctcacaccag

SEQ ID NO: 530309 - DNA, 20 bp, Artificial Sequence
  chemically synthesized
acagatgctggctaggctgt

SEQ ID NO: 530310 - DNA, 20 bp, Artificial Sequence
  chemically synthesized
aattcctcaaggatctagaa

SEQ ID NO: 530311 - DNA, 20 bp, Artificial Sequence
  chemically synthesized
catatgcatgtgtctttata

SEQ ID NO: 530312 - DNA, 20 bp, Artificial Sequence
  chemically synthesized
ccatcaatgatagactggat

SEQ ID NO: 530313 - DNA, 20 bp, Artificial Sequence
  chemically synthesized
ctcagcaaactaacacagga

SEQ ID NO: 530314 - DNA, 20 bp, Artificial Sequence
  chemically synthesized
tggtgtgtttttttttttta

SEQ ID NO: 530315 - DNA, 20 bp, Artificial Sequence
  chemically synthesized
tttttttttttagaagaaaa

SEQ ID NO: 530316 - DNA, 20 bp, Artificial Sequence
  chemically synthesized
ctcattttaattgatttaga

SEQ ID NO: 530317 - DNA, 20 bp, Artificial Sequence
  chemically synthesized
ttaaaaattaaaaaaaaaaa

SEQ ID NO: 530318 - DNA, 20 bp, Artificial Sequence
  chemically synthesized
tcttctacctccctgcaggc

SEQ ID NO: 530319 - DNA, 20 bp, Artificial Sequence
  chemically synthesized
ccagttttcaatcaaaaaca

SEQ ID NO: 530320 - DNA, 20 bp, Artificial Sequence
  chemically synthesized
aacaaaactgcacttgtacc

SEQ ID NO: 530321 - DNA, 20 bp, Artificial Sequence
  chemically synthesized
gacattggagattcagaagg

SEQ ID NO: 530322 - DNA, 20 bp, Artificial Sequence
  chemically synthesized
attctaataaaggggagggg

SEQ ID NO: 530323 - DNA, 20 bp, Artificial Sequence
  chemically synthesized
attctcccccctccccttta

SEQ ID NO: 530324 - DNA, 20 bp, Artificial Sequence
  chemically synthesized
aagttaaaaaaaaaaaaaag

SEQ ID NO: 530325 - DNA, 20 bp, Artificial Sequence
  chemically synthesized
cactccacttattatccaat

SEQ ID NO: 530326 - DNA, 20 bp, Artificial Sequence
  chemically synthesized
ccatgtaatctgctagacag

SEQ ID NO: 530327 - DNA, 20 bp, Artificial Sequence
  chemically synthesized
atctatgagacacactgttt

SEQ ID NO: 530328 - DNA, 20 bp, Artificial Sequence
  chemically synthesized
gtttacagaaaactcatgaa

SEQ ID NO: 530329 - DNA, 20 bp, Artificial Sequence
  chemically synthesized
aagaaatagtgaccaaaagg

SEQ ID NO: 530330 - DNA, 20 bp, Artificial Sequence
  chemically synthesized
caagatggatgtggataagc

SEQ ID NO: 530331 - DNA, 20 bp, Artificial Sequence
  chemically synthesized
atggatgtggataagctgag

SEQ ID NO: 530332 - DNA, 20 bp, Artificial Sequence
  chemically synthesized
ggataagctgagaaagaaaa

SEQ ID NO: 530333 - DNA, 20 bp, Artificial Sequence
  chemically synthesized
ccccaggagttaatggtatc

SEQ ID NO: 530334 - DNA, 20 bp, Artificial Sequence
  chemically synthesized
tttttaaaccgttgtacaag

SEQ ID NO: 530335 - DNA, 20 bp, Artificial Sequence
  chemically synthesized
tcacagtctatttctttaaa

SEQ ID NO: 530336 - DNA, 20 bp, Artificial Sequence
  chemically synthesized
ctgtgtatgtattctttttt

SEQ ID NO: 530337 - DNA, 20 bp, Artificial Sequence
  chemically synthesized
accgtgttaacatttttcct

SEQ ID NO: 530338 - DNA, 20 bp, Artificial Sequence
  chemically synthesized
gggatttggagttttcccac

SEQ ID NO: 530339 - DNA, 20 bp, Artificial Sequence
  chemically synthesized
ctttgaacactgacctggtt

SEQ ID NO: 530340 - DNA, 20 bp, Artificial Sequence
  chemically synthesized
ggatgctgcttcccagggga

SEQ ID NO: 530341 - DNA, 20 bp, Artificial Sequence
  chemically synthesized
cccaaattacgtgggaacgc

SEQ ID NO: 530342 - DNA, 20 bp, Artificial Sequence
  chemically synthesized
attagggacatatttgggtt

SEQ ID NO: 530343 - DNA, 20 bp, Artificial Sequence
  chemically synthesized
ccccagtgtgagctgcattt

SEQ ID NO: 530344 - DNA, 20 bp, Artificial Sequence
  chemically synthesized
gacttcaatccagtttcaga

SEQ ID NO: 530345 - DNA, 20 bp, Artificial Sequence
  chemically synthesized
gacacataaggaatattgct

SEQ ID NO: 530346 - DNA, 20 bp, Artificial Sequence
  chemically synthesized
tattccttatgtgtcataaa

SEQ ID NO: 530347 - DNA, 20 bp, Artificial Sequence
  chemically synthesized
ctttcttacataatcacgtg

SEQ ID NO: 530348 - DNA, 20 bp, Artificial Sequence
  chemically synthesized
ttttctaacacgtgattatg

SEQ ID NO: 530349 - DNA, 20 bp, Artificial Sequence
  chemically synthesized
tatgtaagaaagtgcatgtt

SEQ ID NO: 530350 - DNA, 20 bp, Artificial Sequence
  chemically synthesized
aaagtgcatgtttaagaaag

SEQ ID NO: 530351 - DNA, 20 bp, Artificial Sequence
  chemically synthesized
catgtttaagaaagttagaa

SEQ ID NO: 530352 - DNA, 20 bp, Artificial Sequence
  chemically synthesized
tcgtggcacttttggaaatg

SEQ ID NO: 530353 - DNA, 20 bp, Artificial Sequence
  chemically synthesized
ttccacatgacatatgccat

SEQ ID NO: 530354 - DNA, 20 bp, Artificial Sequence
  chemically synthesized
caatgatacatttttatttt

SEQ ID NO: 530355 - DNA, 20 bp, Artificial Sequence
  chemically synthesized
atagtagccactgagtctta

SEQ ID NO: 530356 - DNA, 20 bp, Artificial Sequence
  chemically synthesized
atttaaagctctattgacca

SEQ ID NO: 530357 - DNA, 20 bp, Artificial Sequence
  chemically synthesized
gcaccaaactgtaggagcta

SEQ ID NO: 530358 - DNA, 20 bp, Artificial Sequence
  chemically synthesized
gtcagcaaactgaaaagcac

SEQ ID NO: 530359 - DNA, 20 bp, Artificial Sequence
  chemically synthesized
gttatctgtgaggcactatg

SEQ ID NO: 530360 - DNA, 20 bp, Artificial Sequence
  chemically synthesized
tgaaaccatcaaatggcaga

SEQ ID NO: 530361 - DNA, 20 bp, Artificial Sequence
  chemically synthesized
tgataagaagtggatgcaac

SEQ ID NO: 530362 - DNA, 20 bp, Artificial Sequence
  chemically synthesized
gcaccatcaatcttatcggg

SEQ ID NO: 530363 - DNA, 20 bp, Artificial Sequence
  chemically synthesized
cgataagattgatggtgcaa

SEQ ID NO: 530364 - DNA, 20 bp, Artificial Sequence
  chemically synthesized
ttgtgaatgttgacttcgaa

SEQ ID NO: 530365 - DNA, 20 bp, Artificial Sequence
  chemically synthesized
cgaagtcaacattcacaaaa

SEQ ID NO: 530366 - DNA, 20 bp, Artificial Sequence
  chemically synthesized
tccctctgtcatttaaggaa

SEQ ID NO: 530367 - DNA, 20 bp, Artificial Sequence
  chemically synthesized
tgcttccttaaatgacagag

SEQ ID NO: 530368 - DNA, 20 bp, Artificial Sequence
  chemically synthesized
agagggagaaactgaggccc

SEQ ID NO: 530369 - DNA, 20 bp, Artificial Sequence
  chemically synthesized
aggtgacagtaaagctggaa

SEQ ID NO: 530370 - DNA, 20 bp, Artificial Sequence
  chemically synthesized
gctgctaaaaggtatatttt

SEQ ID NO: 530371 - DNA, 20 bp, Artificial Sequence
  chemically synthesized
tatacataagaaggatctta

SEQ ID NO: 530372 - DNA, 20 bp, Artificial Sequence
  chemically synthesized
ttccagacacctcactcttc

SEQ ID NO: 530373 - DNA, 20 bp, Artificial Sequence
  chemically synthesized
gaagagtgaggtgtctggaa

SEQ ID NO: 530374 - DNA, 20 bp, Artificial Sequence
  chemically synthesized
ctacttgggaggctgaggca

SEQ ID NO: 530375 - DNA, 20 bp, Artificial Sequence
  chemically synthesized
aactggagtatgatatcaac

SEQ ID NO: 530376 - DNA, 20 bp, Artificial Sequence
  chemically synthesized
atgagatgggctcttattat

SEQ ID NO: 530377 - DNA, 20 bp, Artificial Sequence
  chemically synthesized
tagcaatcaatattatgaag

SEQ ID NO: 530378 - DNA, 20 bp, Artificial Sequence
  chemically synthesized
ggtaccaacaggggctagaa

SEQ ID NO: 530379 - DNA, 20 bp, Artificial Sequence
  chemically synthesized
ccaagatccgtgagttcaaa

SEQ ID NO: 530380 - DNA, 20 bp, Artificial Sequence
  chemically synthesized
agcacaaacagcaacagtaa

SEQ ID NO: 530381 - DNA, 20 bp, Artificial Sequence
  chemically synthesized
attttgctaagcaggaagca

SEQ ID NO: 530382 - DNA, 20 bp, Artificial Sequence
  chemically synthesized
ctgtggttgctaaatattgg

SEQ ID NO: 530383 - DNA, 20 bp, Artificial Sequence
  chemically synthesized
tccttcctaagggacagctg

SEQ ID NO: 530384 - DNA, 20 bp, Artificial Sequence
  chemically synthesized
caaacacttttgctggtatt

SEQ ID NO: 530385 - DNA, 20 bp, Artificial Sequence
  chemically synthesized
gctggtattacagaaaagta

SEQ ID NO: 530386 - DNA, 20 bp, Artificial Sequence
  chemically synthesized
atttgctgtctcccattggt

SEQ ID NO: 530387 - DNA, 20 bp, Artificial Sequence
  chemically synthesized
tctagtttccactcactcat

SEQ ID NO: 530388 - DNA, 20 bp, Artificial Sequence
  chemically synthesized
gactaaaagactaaaaagga

SEQ ID NO: 530389 - DNA, 20 bp, Artificial Sequence
  chemically synthesized
tcattttcatcttcccagtc

SEQ ID NO: 530390 - DNA, 20 bp, Artificial Sequence
  chemically synthesized
aaatgtttttactgaatttc

SEQ ID NO: 530391 - DNA, 20 bp, Artificial Sequence
  chemically synthesized
ggttaaaggatgcagattca

SEQ ID NO: 530392 - DNA, 20 bp, Artificial Sequence
  chemically synthesized
tagatgtcataataaaagca

SEQ ID NO: 530393 - DNA, 20 bp, Artificial Sequence
  chemically synthesized
tcctaaattcttttgacagt

SEQ ID NO: 530394 - DNA, 20 bp, Artificial Sequence
  chemically synthesized
ttctgtattctggactgtca

SEQ ID NO: 530395 - DNA, 20 bp, Artificial Sequence
  chemically synthesized
agaacaattttctaactcat

SEQ ID NO: 530396 - DNA, 20 bp, Artificial Sequence
  chemically synthesized
tctcttgctttcttaatgag

SEQ ID NO: 530397 - DNA, 20 bp, Artificial Sequence
  chemically synthesized
gcatgcaacataaaaaggtg

SEQ ID NO: 530398 - DNA, 20 bp, Artificial Sequence
  chemically synthesized
aaaaggtgaaagaaatccta

SEQ ID NO: 530399 - DNA, 20 bp, Artificial Sequence
  chemically synthesized
aaactacaaaatggcagaga

SEQ ID NO: 530400 - DNA, 20 bp, Artificial Sequence
  chemically synthesized
atgttaatgacttaaaatct

SEQ ID NO: 530401 - DNA, 20 bp, Artificial Sequence
  chemically synthesized
acaggaactgtgccactggt

SEQ ID NO: 530402 - DNA, 20 bp, Artificial Sequence
  chemically synthesized
tccctttatcccagcattga

SEQ ID NO: 530403 - DNA, 20 bp, Artificial Sequence
  chemically synthesized
taacattttacactcatatt

SEQ ID NO: 530404 - DNA, 20 bp, Artificial Sequence
  chemically synthesized
caaagagattataattgtag

SEQ ID NO: 530405 - DNA, 20 bp, Artificial Sequence
  chemically synthesized
taaggtttcagagatatttt

SEQ ID NO: 530406 - DNA, 20 bp, Artificial Sequence
  chemically synthesized
aaaattcctgttttttaaag

SEQ ID NO: 530407 - DNA, 20 bp, Artificial Sequence
  chemically synthesized
ccaactctttattttataaa

SEQ ID NO: 530408 - DNA, 20 bp, Artificial Sequence
  chemically synthesized
gctactcgggagctaagacg

SEQ ID NO: 530409 - DNA, 20 bp, Artificial Sequence
  chemically synthesized
aaaaaaaaaaaaaaaaaaaa

SEQ ID NO: 530410 - DNA, 20 bp, Artificial Sequence
  chemically synthesized
aaaaaaaaaaaaaaaaaaag

SEQ ID NO: 530411 - DNA, 20 bp, Artificial Sequence
  chemically synthesized
taagggcacagatctatgaa

SEQ ID NO: 530412 - DNA, 20 bp, Artificial Sequence
  chemically synthesized
tagctgctctctaattccac

SEQ ID NO: 530413 - DNA, 20 bp, Artificial Sequence
  chemically synthesized
aaataataaagagacaaatt

SEQ ID NO: 530414 - DNA, 20 bp, Artificial Sequence
  chemically synthesized
ccccaaacaagtagtcattt

SEQ ID NO: 530415 - DNA, 20 bp, Artificial Sequence
  chemically synthesized
gatgaggttttaggatcact

SEQ ID NO: 530416 - DNA, 20 bp, Artificial Sequence
  chemically synthesized
ctaaaacctcatctatgaaa

SEQ ID NO: 530417 - DNA, 20 bp, Artificial Sequence
  chemically synthesized
gaaatcactgtctagagttt

SEQ ID NO: 530418 - DNA, 20 bp, Artificial Sequence
  chemically synthesized
taaaatatgaaaactaaaaa

SEQ ID NO: 530419 - DNA, 20 bp, Artificial Sequence
  chemically synthesized
gcagaatcaaacatactaaa

SEQ ID NO: 530420 - DNA, 20 bp, Artificial Sequence
  chemically synthesized
gtagtcttttgactctttca

SEQ ID NO: 530421 - DNA, 20 bp, Artificial Sequence
  chemically synthesized
tatgcctctattttgttaac

SEQ ID NO: 530422 - DNA, 20 bp, Artificial Sequence
  chemically synthesized
atcttcattactacagtcct

SEQ ID NO: 530423 - DNA, 20 bp, Artificial Sequence
  chemically synthesized
ttgctttagaaccgaattaa

SEQ ID NO: 530424 - DNA, 20 bp, Artificial Sequence
  chemically synthesized
agaagaattgatggacagtg

SEQ ID NO: 530425 - DNA, 20 bp, Artificial Sequence
  chemically synthesized
ggaaacatttgtgccagtca

SEQ ID NO: 530426 - DNA, 20 bp, Artificial Sequence
  chemically synthesized
tttgactggcacaaatgttt

SEQ ID NO: 530427 - DNA, 20 bp, Artificial Sequence
  chemically synthesized
tcagtatttgtcacctaaca

SEQ ID NO: 530428 - DNA, 20 bp, Artificial Sequence
  chemically synthesized
aaatactgagtgttatgtat

SEQ ID NO: 530429 - DNA, 20 bp, Artificial Sequence
  chemically synthesized
atactacatgtttccaaaag

SEQ ID NO: 530430 - DNA, 20 bp, Artificial Sequence
  chemically synthesized
atcttctatctttgacggaa

SEQ ID NO: 530431 - DNA, 20 bp, Artificial Sequence
  chemically synthesized
ctttgacggaagaagaaatg

SEQ ID NO: 530432 - DNA, 20 bp, Artificial Sequence
  chemically synthesized
tgtgagaaaacccctaaata

SEQ ID NO: 530433 - DNA, 20 bp, Artificial Sequence
  chemically synthesized
atgcaatggggaacgacttt

SEQ ID NO: 530434 - DNA, 20 bp, Artificial Sequence
  chemically synthesized
gcaaatttacaatggtaatt

SEQ ID NO: 530435 - DNA, 20 bp, Artificial Sequence
  chemically synthesized
ctgaaaagaagggaggaaaa

SEQ ID NO: 530436 - DNA, 20 bp, Artificial Sequence
  chemically synthesized
aggaaagacaacattaatct

SEQ ID NO: 530437 - DNA, 20 bp, Artificial Sequence
  chemically synthesized
tcagtttcgcttagattagg

SEQ ID NO: 530438 - DNA, 20 bp, Artificial Sequence
  chemically synthesized
tcaggcacaaagataaatgc

SEQ ID NO: 530439 - DNA, 20 bp, Artificial Sequence
  chemically synthesized
tgctaaacctatagaacaga

SEQ ID NO: 530440 - DNA, 20 bp, Artificial Sequence
  chemically synthesized
gcactcaagggagacacata

SEQ ID NO: 530441 - DNA, 20 bp, Artificial Sequence
  chemically synthesized
attactttagcttcaataac

SEQ ID NO: 530442 - DNA, 20 bp, Artificial Sequence
  chemically synthesized
ttttatctttattggtttaa

SEQ ID NO: 530443 - DNA, 20 bp, Artificial Sequence
  chemically synthesized
agctgaccagtgtgatctta

SEQ ID NO: 530444 - DNA, 20 bp, Artificial Sequence
  chemically synthesized
tgtagaggttcagctttagg

SEQ ID NO: 530445 - DNA, 20 bp, Artificial Sequence
  chemically synthesized
aagattattttgtcttaaag

SEQ ID NO: 530446 - DNA, 20 bp, Artificial Sequence
  chemically synthesized
caacaagattattttgtctt

SEQ ID NO: 530447 - DNA, 20 bp, Artificial Sequence
  chemically synthesized
gttttaagacactggagctt

SEQ ID NO: 530448 - DNA, 20 bp, Artificial Sequence
  chemically synthesized
acactggagctttaagaaac

SEQ ID NO: 530449 - DNA, 20 bp, Artificial Sequence
  chemically synthesized
ttaagaaacacagaatatta

SEQ ID NO: 530450 - DNA, 20 bp, Artificial Sequence
  chemically synthesized
aacacagaatattatcagaa

SEQ ID NO: 530451 - DNA, 20 bp, Artificial Sequence
  chemically synthesized
ataaagttgctagatattaa

SEQ ID NO: 530452 - DNA, 20 bp, Artificial Sequence
  chemically synthesized
agctgtgcttcaaattatta

SEQ ID NO: 530453 - DNA, 20 bp, Artificial Sequence
  chemically synthesized
ctccgcagtgtattgagatg

SEQ ID NO: 530454 - DNA, 20 bp, Artificial Sequence
  chemically synthesized
cagacggaaatttttaatac

SEQ ID NO: 530455 - DNA, 20 bp, Artificial Sequence
  chemically synthesized
gaatagagaaagaaggacag

SEQ ID NO: 530456 - DNA, 20 bp, Artificial Sequence
  chemically synthesized
aaaggaatagagaaagaagg

SEQ ID NO: 530457 - DNA, 20 bp, Artificial Sequence
  chemically synthesized
ggaagggaaaagaaaggaat

SEQ ID NO: 530458 - DNA, 20 bp, Artificial Sequence
  chemically synthesized
gggaaggcaggaggaaggga

SEQ ID NO: 530459 - DNA, 20 bp, Artificial Sequence
  chemically synthesized
gagaagagttgggaagagaa

SEQ ID NO: 530460 - DNA, 20 bp, Artificial Sequence
  chemically synthesized
ggacaagagaagagttggga

SEQ ID NO: 530461 - DNA, 20 bp, Artificial Sequence
  chemically synthesized
caggagagctgcatcctaca

SEQ ID NO: 530462 - DNA, 20 bp, Artificial Sequence
  chemically synthesized
gcaggaaacatggtggagag

SEQ ID NO: 530463 - DNA, 20 bp, Artificial Sequence
  chemically synthesized
aagcctgtgaatacctaaac

SEQ ID NO: 530464 - DNA, 20 bp, Artificial Sequence
  chemically synthesized
tgtgaatacctaaactgaga

SEQ ID NO: 530465 - DNA, 20 bp, Artificial Sequence
  chemically synthesized
gcccatagatacctttaagg

SEQ ID NO: 530466 - DNA, 20 bp, Artificial Sequence
  chemically synthesized
aaaactagaaaggtataata

SEQ ID NO: 530467 - DNA, 20 bp, Artificial Sequence
  chemically synthesized
atgataaaaaaaaaaaaaaa

SEQ ID NO: 530468 - DNA, 20 bp, Artificial Sequence
  chemically synthesized
ttttttatcattctagtggt

SEQ ID NO: 530469 - DNA, 20 bp, Artificial Sequence
  chemically synthesized
tagaaagaatttctggacca

SEQ ID NO: 530470 - DNA, 20 bp, Artificial Sequence
  chemically synthesized
tctagcatcctccaaattag

SEQ ID NO: 530471 - DNA, 20 bp, Artificial Sequence
  chemically synthesized
atggtctagcatcctccaaa

SEQ ID NO: 530472 - DNA, 20 bp, Artificial Sequence
  chemically synthesized
tagaccatcctctgatagca

SEQ ID NO: 530473 - DNA, 20 bp, Artificial Sequence
  chemically synthesized
acttctttctgagagacgcc

SEQ ID NO: 530474 - DNA, 20 bp, Artificial Sequence
  chemically synthesized
acactattcttaggcgtctc

SEQ ID NO: 530475 - DNA, 20 bp, Artificial Sequence
  chemically synthesized
gcttaggggctttcggcctg

SEQ ID NO: 530476 - DNA, 20 bp, Artificial Sequence
  chemically synthesized
attaaatgtcagagaagtta

SEQ ID NO: 530477 - DNA, 20 bp, Artificial Sequence
  chemically synthesized
aaatagctgaaaatattttt

SEQ ID NO: 530478 - DNA, 20 bp, Artificial Sequence
  chemically synthesized
gcttgaaatttcatattgat

SEQ ID NO: 530479 - DNA, 20 bp, Artificial Sequence
  chemically synthesized
tcaaaggggaaaaacatctt

SEQ ID NO: 530480 - DNA, 20 bp, Artificial Sequence
  chemically synthesized
acacactggaactacttgct

SEQ ID NO: 530481 - DNA, 20 bp, Artificial Sequence
  chemically synthesized
atgaaattgtcgacaaccct

SEQ ID NO: 530482 - DNA, 20 bp, Artificial Sequence
  chemically synthesized
acttttgaatagatggaaga

SEQ ID NO: 530483 - DNA, 20 bp, Artificial Sequence
  chemically synthesized
gcagtgctcacaagtgtgcc

SEQ ID NO: 530484 - DNA, 20 bp, Artificial Sequence
  chemically synthesized
tgttggcatcagtactgcta

SEQ ID NO: 530485 - DNA, 20 bp, Artificial Sequence
  chemically synthesized
cttccactggtacactgaga

SEQ ID NO: 530486 - DNA, 20 bp, Artificial Sequence
  chemically synthesized
attacgtaggctagctttat

SEQ ID NO: 530487 - DNA, 20 bp, Artificial Sequence
  chemically synthesized
aaaggacaacccggtgtcat

SEQ ID NO: 530488 - DNA, 20 bp, Artificial Sequence
  chemically synthesized
tggttataagcacatctgta

SEQ ID NO: 530489 - DNA, 20 bp, Artificial Sequence
  chemically synthesized
taatggttgatttgtacatt

SEQ ID NO: 530490 - DNA, 20 bp, Artificial Sequence
  chemically synthesized
acacagtatgttattaagag

SEQ ID NO: 530491 - DNA, 20 bp, Artificial Sequence
  chemically synthesized
ggaaggaaaagcatttgaag

SEQ ID NO: 530492 - DNA, 20 bp, Artificial Sequence
  chemically synthesized
cgtttttaaatgcatgatga

SEQ ID NO: 530493 - DNA, 20 bp, Artificial Sequence
  chemically synthesized
taatcaacataggggcctaa

SEQ ID NO: 530494 - DNA, 20 bp, Artificial Sequence
  chemically synthesized
gggcctaaccagaaaattaa

SEQ ID NO: 530495 - DNA, 20 bp, Artificial Sequence
  chemically synthesized
aaggtatttgtgttggaatt

SEQ ID NO: 530496 - DNA, 20 bp, Artificial Sequence
  chemically synthesized
aactccaaatccaccaagta

SEQ ID NO: 530497 - DNA, 20 bp, Artificial Sequence
  chemically synthesized
cagcaatcactggaggtaaa

SEQ ID NO: 530498 - DNA, 20 bp, Artificial Sequence
  chemically synthesized
ctagacttgttttgtctttt

SEQ ID NO: 530499 - DNA, 20 bp, Artificial Sequence
  chemically synthesized
ggcatactacttagcaatga

SEQ ID NO: 530500 - DNA, 20 bp, Artificial Sequence
  chemically synthesized
cactcttaagcattcatctt

SEQ ID NO: 530501 - DNA, 20 bp, Artificial Sequence
  chemically synthesized
ctttattgatataagtgtaa

SEQ ID NO: 530502 - DNA, 20 bp, Artificial Sequence
  chemically synthesized
caactaaatactattgacct

SEQ ID NO: 530503 - DNA, 20 bp, Artificial Sequence
  chemically synthesized
gcagtatatctaacttgctt

SEQ ID NO: 530504 - DNA, 20 bp, Artificial Sequence
  chemically synthesized
tagactgtaaaactcagagt

SEQ ID NO: 530505 - DNA, 20 bp, Artificial Sequence
  chemically synthesized
atgctggattgggctttgaa

SEQ ID NO: 530506 - DNA, 20 bp, Artificial Sequence
  chemically synthesized
ttgagagggagctggatata

SEQ ID NO: 530507 - DNA, 20 bp, Artificial Sequence
  chemically synthesized
atgctgcccaggtgagagag

SEQ ID NO: 530508 - DNA, 20 bp, Artificial Sequence
  chemically synthesized
ataaatgctgcccaggtgag

SEQ ID NO: 530509 - DNA, 20 bp, Artificial Sequence
  chemically synthesized
tgtagtataaagtatggcag

SEQ ID NO: 530510 - DNA, 20 bp, Artificial Sequence
  chemically synthesized
tggtctaggaagacagagat

SEQ ID NO: 530511 - DNA, 20 bp, Artificial Sequence
  chemically synthesized
tggtggataaatggtctagc

SEQ ID NO: 530512 - DNA, 20 bp, Artificial Sequence
  chemically synthesized
aaaggacaagaccataagta

SEQ ID NO: 530513 - DNA, 20 bp, Artificial Sequence
  chemically synthesized
tagaatcatagcagatgcta

SEQ ID NO: 530514 - DNA, 20 bp, Artificial Sequence
  chemically synthesized
caacctcatagaagcagtaa

SEQ ID NO: 530515 - DNA, 20 bp, Artificial Sequence
  chemically synthesized
agaagacagggcaggggaaa

SEQ ID NO: 530516 - DNA, 20 bp, Artificial Sequence
  chemically synthesized
ctactcgggaggctgaggca

SEQ ID NO: 530517 - DNA, 20 bp, Artificial Sequence
  chemically synthesized
ttttgcatataattataccc

SEQ ID NO: 530518 - DNA, 20 bp, Artificial Sequence
  chemically synthesized
gtggcagtagaactgctgtc

SEQ ID NO: 530519 - DNA, 20 bp, Artificial Sequence
  chemically synthesized
aaagaaaaataatacagaag

SEQ ID NO: 530520 - DNA, 20 bp, Artificial Sequence
  chemically synthesized
cacccttagtctgtcaggct

SEQ ID NO: 530521 - DNA, 20 bp, Artificial Sequence
  chemically synthesized
ttgtgtataaaaagaggaaa

SEQ ID NO: 530522 - DNA, 20 bp, Artificial Sequence
  chemically synthesized
tgcatataatttaacgttat

SEQ ID NO: 530523 - DNA, 20 bp, Artificial Sequence
  chemically synthesized
gactttaggaaatgaaaacg

SEQ ID NO: 530524 - DNA, 20 bp, Artificial Sequence
  chemically synthesized
caaaagaaaatagaaatcat

SEQ ID NO: 530525 - DNA, 20 bp, Artificial Sequence
  chemically synthesized
atgcgtcacatcaaaagaaa

SEQ ID NO: 530526 - DNA, 20 bp, Artificial Sequence
  chemically synthesized
gaactatatgcgtcacatca

SEQ ID NO: 530527 - DNA, 20 bp, Artificial Sequence
  chemically synthesized
cttggcctttcatttaaatg

SEQ ID NO: 530528 - DNA, 20 bp, Artificial Sequence
  chemically synthesized
gagaccattgcacatggtga

SEQ ID NO: 530529 - DNA, 20 bp, Artificial Sequence
  chemically synthesized
ctgcaactcagtcaccttgc

SEQ ID NO: 530530 - DNA, 20 bp, Artificial Sequence
  chemically synthesized
gcattactcatgaaaaaaaa

SEQ ID NO: 530531 - DNA, 20 bp, Artificial Sequence
  chemically synthesized
aagctgcttctaaccgactt

SEQ ID NO: 530532 - DNA, 20 bp, Artificial Sequence
  chemically synthesized
cacggtgattattagaagag

SEQ ID NO: 530533 - DNA, 20 bp, Artificial Sequence
  chemically synthesized
atagatgggatgtacatcca

SEQ ID NO: 530534 - DNA, 20 bp, Artificial Sequence
  chemically synthesized
ccattagaaagcgagaagag

SEQ ID NO: 530535 - DNA, 20 bp, Artificial Sequence
  chemically synthesized
gggctcacaacccaacacat

SEQ ID NO: 530536 - DNA, 20 bp, Artificial Sequence
  chemically synthesized
gccacaatataactactata

SEQ ID NO: 530537 - DNA, 20 bp, Artificial Sequence
  chemically synthesized
gaaacagtatcataaagatt

SEQ ID NO: 530538 - DNA, 20 bp, Artificial Sequence
  chemically synthesized
actattatggattatcagcc

SEQ ID NO: 530539 - DNA, 20 bp, Artificial Sequence
  chemically synthesized
tattgtctccatttcacaga

SEQ ID NO: 530540 - DNA, 20 bp, Artificial Sequence
  chemically synthesized
gaaaatggctagaaaaagag

SEQ ID NO: 530541 - DNA, 20 bp, Artificial Sequence
  chemically synthesized
tttaaagagtcagaaaatgg

SEQ ID NO: 530542 - DNA, 20 bp, Artificial Sequence
  chemically synthesized
gcgtaacattttttaaagag

SEQ ID NO: 530543 - DNA, 20 bp, Artificial Sequence
  chemically synthesized
tttcatagtaaacatcagca

SEQ ID NO: 530544 - DNA, 20 bp, Artificial Sequence
  chemically synthesized
tatactatattagtattgct

SEQ ID NO: 530545 - DNA, 20 bp, Artificial Sequence
  chemically synthesized
aaataaatagctaaatattt

SEQ ID NO: 530546 - DNA, 20 bp, Artificial Sequence
  chemically synthesized
aaccaacaattgaaattaaa

SEQ ID NO: 530547 - DNA, 20 bp, Artificial Sequence
  chemically synthesized
acagcacataacttcaggtc

SEQ ID NO: 530548 - DNA, 20 bp, Artificial Sequence
  chemically synthesized
cctagaccagctatcaaggg

SEQ ID NO: 530549 - DNA, 20 bp, Artificial Sequence
  chemically synthesized
aaagtgaaggagttcatgtt

SEQ ID NO: 530550 - DNA, 20 bp, Artificial Sequence
  chemically synthesized
ctccttcacttttcacctcc

SEQ ID NO: 530551 - DNA, 20 bp, Artificial Sequence
  chemically synthesized
atgagggcaatttgataggg

SEQ ID NO: 530552 - DNA, 20 bp, Artificial Sequence
  chemically synthesized
gatagaaataggcagacgag

SEQ ID NO: 530553 - DNA, 20 bp, Artificial Sequence
  chemically synthesized
agcactaatgttttaatgag

SEQ ID NO: 530554 - DNA, 20 bp, Artificial Sequence
  chemically synthesized
ttatattcattatacatacg

SEQ ID NO: 530555 - DNA, 20 bp, Artificial Sequence
  chemically synthesized
tctccttaccgcccttctgt

SEQ ID NO: 530556 - DNA, 20 bp, Artificial Sequence
  chemically synthesized
ctacttgggaggctgaggca

SEQ ID NO: 530557 - DNA, 20 bp, Artificial Sequence
  chemically synthesized
ggcccgagatattcatctta

SEQ ID NO: 530558 - DNA, 20 bp, Artificial Sequence
  chemically synthesized
tcagaatggctaagtagaag

SEQ ID NO: 530559 - DNA, 20 bp, Artificial Sequence
  chemically synthesized
ccttttgataggaacttagc

SEQ ID NO: 530560 - DNA, 20 bp, Artificial Sequence
  chemically synthesized
gaggaatccattccacagtg

SEQ ID NO: 530561 - DNA, 20 bp, Artificial Sequence
  chemically synthesized
aaatagtgggtgcaatggga

SEQ ID NO: 530562 - DNA, 20 bp, Artificial Sequence
  chemically synthesized
cctgaaatatgaagataaaa

SEQ ID NO: 530563 - DNA, 20 bp, Artificial Sequence
  chemically synthesized
gcaccatgtcacttcttagc

SEQ ID NO: 530564 - DNA, 20 bp, Artificial Sequence
  chemically synthesized
gctttgtgagaagggaagtc

SEQ ID NO: 530565 - DNA, 20 bp, Artificial Sequence
  chemically synthesized
ccagtatgactgaagccaag

SEQ ID NO: 530566 - DNA, 20 bp, Artificial Sequence
  chemically synthesized
tggagcatgcttagagggtt

SEQ ID NO: 530567 - DNA, 20 bp, Artificial Sequence
  chemically synthesized
gataagtttgatttaaaaac

SEQ ID NO: 530568 - DNA, 20 bp, Artificial Sequence
  chemically synthesized
tcactttatcttcagtcagt

SEQ ID NO: 530569 - DNA, 20 bp, Artificial Sequence
  chemically synthesized
cctggtgcttagtctaatgt

SEQ ID NO: 530570 - DNA, 20 bp, Artificial Sequence
  chemically synthesized
gacaggcatttagaagcatc

SEQ ID NO: 530571 - DNA, 20 bp, Artificial Sequence
  chemically synthesized
acaactgtggaagggaagtg

SEQ ID NO: 530572 - DNA, 20 bp, Artificial Sequence
  chemically synthesized
gggaagtgaaagaaacagga

SEQ ID NO: 530573 - DNA, 20 bp, Artificial Sequence
  chemically synthesized
accccatgggagctcttgag

SEQ ID NO: 530574 - DNA, 20 bp, Artificial Sequence
  chemically synthesized
actaaagggtccctaaggat

SEQ ID NO: 530575 - DNA, 20 bp, Artificial Sequence
  chemically synthesized
tgggtgaaattgcccctagt

SEQ ID NO: 530576 - DNA, 20 bp, Artificial Sequence
  chemically synthesized
agaatacaaagctttgcgca

SEQ ID NO: 530577 - DNA, 20 bp, Artificial Sequence
  chemically synthesized
gtagcattttgtcatctgtc

SEQ ID NO: 530578 - DNA, 20 bp, Artificial Sequence
  chemically synthesized
aaagtgtatttttacactac

SEQ ID NO: 530579 - DNA, 20 bp, Artificial Sequence
  chemically synthesized
aatgccaatagtgcccaggt

SEQ ID NO: 530580 - DNA, 20 bp, Artificial Sequence
  chemically synthesized
taaaaagtcggataacaaag

SEQ ID NO: 530581 - DNA, 20 bp, Artificial Sequence
  chemically synthesized
aaggaagaaaatggaagtca

SEQ ID NO: 530582 - DNA, 20 bp, Artificial Sequence
  chemically synthesized
aaaatggaagtcataagaaa

SEQ ID NO: 530583 - DNA, 20 bp, Artificial Sequence
  chemically synthesized
ctatggcagcaaatgcatat

SEQ ID NO: 530584 - DNA, 20 bp, Artificial Sequence
  chemically synthesized
aaaaaaaaaagaaagaaaga

SEQ ID NO: 530585 - DNA, 20 bp, Artificial Sequence
  chemically synthesized
aaaaaaaaaaaaaaagaaag

SEQ ID NO: 530586 - DNA, 20 bp, Artificial Sequence
  chemically synthesized
tctcaaaaaaaaaaaaaaag

SEQ ID NO: 530587 - DNA, 20 bp, Artificial Sequence
  chemically synthesized
tccatctcaaaaaaaaaaaa

SEQ ID NO: 530588 - DNA, 20 bp, Artificial Sequence
  chemically synthesized
ctactcaggaggctgaggca

SEQ ID NO: 530589 - DNA, 20 bp, Artificial Sequence
  chemically synthesized
ttcaggatacagagaggcat

SEQ ID NO: 530590 - DNA, 20 bp, Artificial Sequence
  chemically synthesized
ctgaaagtctatttaaaaat

SEQ ID NO: 530591 - DNA, 20 bp, Artificial Sequence
  chemically synthesized
tcctcacttcaaagttctca

SEQ ID NO: 530592 - DNA, 20 bp, Artificial Sequence
  chemically synthesized
tgggatcacatccctgtggg

SEQ ID NO: 530593 - DNA, 20 bp, Artificial Sequence
  chemically synthesized
aaaatacaaagctttgcaca

SEQ ID NO: 530594 - DNA, 20 bp, Artificial Sequence
  chemically synthesized
agggtgtatttttacactac

SEQ ID NO: 530595 - DNA, 20 bp, Artificial Sequence
  chemically synthesized
ctagctcctcatgaggccca

SEQ ID NO: 530596 - DNA, 20 bp, Artificial Sequence
  chemically synthesized
tcacaatgaggaagatgaaa

SEQ ID NO: 530597 - DNA, 20 bp, Artificial Sequence
  chemically synthesized
aatgaggaagatgaaataag

SEQ ID NO: 530598 - DNA, 20 bp, Artificial Sequence
  chemically synthesized
aggcctcattggtcctttca

SEQ ID NO: 530599 - DNA, 20 bp, Artificial Sequence
  chemically synthesized
gctttgctatctcctactcc

SEQ ID NO: 530600 - DNA, 20 bp, Artificial Sequence
  chemically synthesized
ctactcgggaggctgaggca

SEQ ID NO: 530601 - DNA, 20 bp, Artificial Sequence
  chemically synthesized
tcactcaagtccctgtaggc

SEQ ID NO: 530602 - DNA, 20 bp, Artificial Sequence
  chemically synthesized
ttttgtgcatagatggtttc

SEQ ID NO: 530603 - DNA, 20 bp, Artificial Sequence
  chemically synthesized
cattgtaagccagccccagc

SEQ ID NO: 530604 - DNA, 20 bp, Artificial Sequence
  chemically synthesized
ccagcacagaaattcccata

SEQ ID NO: 530605 - DNA, 20 bp, Artificial Sequence
  chemically synthesized
gagtatacatttgagctaaa

SEQ ID NO: 530606 - DNA, 20 bp, Artificial Sequence
  chemically synthesized
catgacaacacattttaaga

SEQ ID NO: 530607 - DNA, 20 bp, Artificial Sequence
  chemically synthesized
tgggacaacatgtgactgct

SEQ ID NO: 530608 - DNA, 20 bp, Artificial Sequence
  chemically synthesized
accctgagattttacttgaa

SEQ ID NO: 530609 - DNA, 20 bp, Artificial Sequence
  chemically synthesized
gccatcatgataaaagtcag

SEQ ID NO: 530610 - DNA, 20 bp, Artificial Sequence
  chemically synthesized
ataagccatcatgataaaag

SEQ ID NO: 530611 - DNA, 20 bp, Artificial Sequence
  chemically synthesized
ctactcgagaggctgaggca

SEQ ID NO: 530612 - DNA, 20 bp, Artificial Sequence
  chemically synthesized
aagaccagcctgaccaacat

SEQ ID NO: 530613 - DNA, 20 bp, Artificial Sequence
  chemically synthesized
aaagcttggcaactctcaag

SEQ ID NO: 530614 - DNA, 20 bp, Artificial Sequence
  chemically synthesized
tgctaggccctatgtatcaa

SEQ ID NO: 530615 - DNA, 20 bp, Artificial Sequence
  chemically synthesized
gcttgagtcactttgacaag

SEQ ID NO: 530616 - DNA, 20 bp, Artificial Sequence
  chemically synthesized
agttaagattgtaaagcctg

SEQ ID NO: 530617 - DNA, 20 bp, Artificial Sequence
  chemically synthesized
cagattatgagacactgtaa

SEQ ID NO: 530618 - DNA, 20 bp, Artificial Sequence
  chemically synthesized
caatgaaacagcttttaaat

SEQ ID NO: 530619 - DNA, 20 bp, Artificial Sequence
  chemically synthesized
aaaggtagtacatgctatta

SEQ ID NO: 530620 - DNA, 20 bp, Artificial Sequence
  chemically synthesized
cagaaaatttgtaaaagtaa

SEQ ID NO: 530621 - DNA, 20 bp, Artificial Sequence
  chemically synthesized
aaatttgtaaaagtaaaaag

SEQ ID NO: 530622 - DNA, 20 bp, Artificial Sequence
  chemically synthesized
tacaaaataaaataaaaata

SEQ ID NO: 530623 - DNA, 20 bp, Artificial Sequence
  chemically synthesized
ttagtctttgctgagaagca

SEQ ID NO: 530624 - DNA, 20 bp, Artificial Sequence
  chemically synthesized
tagatgttcagtaaatattt

SEQ ID NO: 530625 - DNA, 20 bp, Artificial Sequence
  chemically synthesized
cacataccacattaggtact

SEQ ID NO: 530626 - DNA, 20 bp, Artificial Sequence
  chemically synthesized
tagatccttggaaatcatct

SEQ ID NO: 530627 - DNA, 20 bp, Artificial Sequence
  chemically synthesized
tatactgaccattaaatgca

SEQ ID NO: 530628 - DNA, 20 bp, Artificial Sequence
  chemically synthesized
acgtttcaacagttctgaaa

SEQ ID NO: 530629 - DNA, 20 bp, Artificial Sequence
  chemically synthesized
attatccctattttaaagat

SEQ ID NO: 530630 - DNA, 20 bp, Artificial Sequence
  chemically synthesized
attttaaagatgaagaataa

SEQ ID NO: 530631 - DNA, 20 bp, Artificial Sequence
  chemically synthesized
taaagatgaagaataaagag

SEQ ID NO: 530632 - DNA, 20 bp, Artificial Sequence
  chemically synthesized
tttttagcccagaggtgttg

SEQ ID NO: 530633 - DNA, 20 bp, Artificial Sequence
  chemically synthesized
caaacgaagaggaatatacg

SEQ ID NO: 530634 - DNA, 20 bp, Artificial Sequence
  chemically synthesized
cacactgccttacccgttaa

SEQ ID NO: 530635 - DNA, 20 bp, Artificial Sequence
  chemically synthesized
gtgatgtgtggcttggatgt

SEQ ID NO: 530636 - DNA, 20 bp, Artificial Sequence
  chemically synthesized
gggttgcagtcgaaatagtt

SEQ ID NO: 530637 - DNA, 20 bp, Artificial Sequence
  chemically synthesized
tatttcgactgcaacccaca

SEQ ID NO: 530638 - DNA, 20 bp, Artificial Sequence
  chemically synthesized
atggaatggaatggaacaga

SEQ ID NO: 530639 - DNA, 20 bp, Artificial Sequence
  chemically synthesized
tttcctaactggagataagc

SEQ ID NO: 530640 - DNA, 20 bp, Artificial Sequence
  chemically synthesized
tagaaacgtgatccaattaa

SEQ ID NO: 530641 - DNA, 20 bp, Artificial Sequence
  chemically synthesized
aaaaatttctgctaaaggtt

SEQ ID NO: 530642 - DNA, 20 bp, Artificial Sequence
  chemically synthesized
tcacgtttctacaaccttta

SEQ ID NO: 530643 - DNA, 20 bp, Artificial Sequence
  chemically synthesized
tcagtgtataataaaaattc

SEQ ID NO: 530644 - DNA, 20 bp, Artificial Sequence
  chemically synthesized
aaaaattccaagaattctaa

SEQ ID NO: 530645 - DNA, 20 bp, Artificial Sequence
  chemically synthesized
ataagcaagtttatttcttg

SEQ ID NO: 530646 - DNA, 20 bp, Artificial Sequence
  chemically synthesized
caagttccagaggtccctta

SEQ ID NO: 530647 - DNA, 20 bp, Artificial Sequence
  chemically synthesized
ctctggaacttgtaaaatat

SEQ ID NO: 530648 - DNA, 20 bp, Artificial Sequence
  chemically synthesized
aaatcattctataacagtaa

SEQ ID NO: 530649 - DNA, 20 bp, Artificial Sequence
  chemically synthesized
catggattctttttactgtt

SEQ ID NO: 530650 - DNA, 20 bp, Artificial Sequence
  chemically synthesized
cactatatatttgggtaaag

SEQ ID NO: 530651 - DNA, 20 bp, Artificial Sequence
  chemically synthesized
tatatagtgatctttcttgg

SEQ ID NO: 530652 - DNA, 20 bp, Artificial Sequence
  chemically synthesized
ctaaattctacttttctcac

SEQ ID NO: 530653 - DNA, 20 bp, Artificial Sequence
  chemically synthesized
gatctttcttggtgagaaaa

SEQ ID NO: 530654 - DNA, 20 bp, Artificial Sequence
  chemically synthesized
agaatttagaacagaagacc

SEQ ID NO: 530655 - DNA, 20 bp, Artificial Sequence
  chemically synthesized
agagagactctgtctcaaaa

SEQ ID NO: 530656 - DNA, 20 bp, Artificial Sequence
  chemically synthesized
ctgcttaggaggctgaggca

SEQ ID NO: 530657 - DNA, 20 bp, Artificial Sequence
  chemically synthesized
acaaatctttaaactcttca

SEQ ID NO: 530658 - DNA, 20 bp, Artificial Sequence
  chemically synthesized
tctcttcatatgtctgtgat

SEQ ID NO: 530659 - DNA, 20 bp, Artificial Sequence
  chemically synthesized
acatatttgaagtcacacta

SEQ ID NO: 530660 - DNA, 20 bp, Artificial Sequence
  chemically synthesized
acaacttaaaccaagaaaaa

SEQ ID NO: 530661 - DNA, 20 bp, Artificial Sequence
  chemically synthesized
ttgacttctacaacttaaac

SEQ ID NO: 530662 - DNA, 20 bp, Artificial Sequence
  chemically synthesized
agatctaagagaaaatgaga

SEQ ID NO: 530663 - DNA, 20 bp, Artificial Sequence
  chemically synthesized
tttcttttatcttagatcta

SEQ ID NO: 530664 - DNA, 20 bp, Artificial Sequence
  chemically synthesized
tttctcttagatctaagata

SEQ ID NO: 530665 - DNA, 20 bp, Artificial Sequence
  chemically synthesized
tggcccaatctctacatgtt

SEQ ID NO: 530666 - DNA, 20 bp, Artificial Sequence
  chemically synthesized
tgtagagattgggccaccag

SEQ ID NO: 530667 - DNA, 20 bp, Artificial Sequence
  chemically synthesized
aggcagccttttactaaaaa

SEQ ID NO: 530668 - DNA, 20 bp, Artificial Sequence
  chemically synthesized
cgtgcgagacagagagagag

SEQ ID NO: 530669 - DNA, 20 bp, Artificial Sequence
  chemically synthesized
aagcttagaaattacaaaga

SEQ ID NO: 530670 - DNA, 20 bp, Artificial Sequence
  chemically synthesized
tcctaaagcttagaaattac

SEQ ID NO: 530671 - DNA, 20 bp, Artificial Sequence
  chemically synthesized
aatagggtggctcctaaagc

SEQ ID NO: 530672 - DNA, 20 bp, Artificial Sequence
  chemically synthesized
tcctcctgcctcagtttccc

SEQ ID NO: 530673 - DNA, 20 bp, Artificial Sequence
  chemically synthesized
cttacctctagaaaattgca

SEQ ID NO: 530674 - DNA, 20 bp, Artificial Sequence
  chemically synthesized
gtgtattgccaaacttacct

SEQ ID NO: 530675 - DNA, 20 bp, Artificial Sequence
  chemically synthesized
aaaggtggaattgtcatgtt

SEQ ID NO: 530676 - DNA, 20 bp, Artificial Sequence
  chemically synthesized
cacctttaggcatttatcct

SEQ ID NO: 530677 - DNA, 20 bp, Artificial Sequence
  chemically synthesized
tttaggcatttatcctgtag

SEQ ID NO: 530678 - DNA, 20 bp, Artificial Sequence
  chemically synthesized
taatctttatattgagcaat

SEQ ID NO: 530679 - DNA, 20 bp, Artificial Sequence
  chemically synthesized
aagagagtattagccagtca

SEQ ID NO: 530680 - DNA, 20 bp, Artificial Sequence
  chemically synthesized
attagaaaaattactctgaa

SEQ ID NO: 530681 - DNA, 20 bp, Artificial Sequence
  chemically synthesized
ttttatctgcgcatggttta

SEQ ID NO: 530682 - DNA, 20 bp, Artificial Sequence
  chemically synthesized
ctactcgggaggctgagtca

SEQ ID NO: 530683 - DNA, 20 bp, Artificial Sequence
  chemically synthesized
cacacacacacgcaaccaca

SEQ ID NO: 530684 - DNA, 20 bp, Artificial Sequence
  chemically synthesized
cacgcaaccacaagagaaat

SEQ ID NO: 530685 - DNA, 20 bp, Artificial Sequence
  chemically synthesized
tgactcagagataatcacta

SEQ ID NO: 530686 - DNA, 20 bp, Artificial Sequence
  chemically synthesized
agcccacagtacaaacaaga

SEQ ID NO: 530687 - DNA, 20 bp, Artificial Sequence
  chemically synthesized
tggaaagcccacagtacaaa

SEQ ID NO: 530688 - DNA, 20 bp, Artificial Sequence
  chemically synthesized
caaaggtactctatacacat

SEQ ID NO: 530689 - DNA, 20 bp, Artificial Sequence
  chemically synthesized
aattttaaaaagtacaatgt

SEQ ID NO: 530690 - DNA, 20 bp, Artificial Sequence
  chemically synthesized
aacttggtttaagggatatt

SEQ ID NO: 530691 - DNA, 20 bp, Artificial Sequence
  chemically synthesized
aaagctttgcttgcaggtat

SEQ ID NO: 530692 - DNA, 20 bp, Artificial Sequence
  chemically synthesized
tatcacatcagtgcccactt

SEQ ID NO: 530693 - DNA, 20 bp, Artificial Sequence
  chemically synthesized
gtgatatggtttgaaaggtg

SEQ ID NO: 530694 - DNA, 20 bp, Artificial Sequence
  chemically synthesized
ttacccattaaaacctattt

SEQ ID NO: 530695 - DNA, 20 bp, Artificial Sequence
  chemically synthesized
ttcagagggggagtcaggga

SEQ ID NO: 530696 - DNA, 20 bp, Artificial Sequence
  chemically synthesized
tttaatctcaattaaatcga

SEQ ID NO: 530697 - DNA, 20 bp, Artificial Sequence
  chemically synthesized
cgtggcttttaggaacggct

SEQ ID NO: 530698 - DNA, 20 bp, Artificial Sequence
  chemically synthesized
tcacaatgctttggagttgc

SEQ ID NO: 530699 - DNA, 20 bp, Artificial Sequence
  chemically synthesized
ataataaagttagagccagt

SEQ ID NO: 530700 - DNA, 20 bp, Artificial Sequence
  chemically synthesized
ggatctttttattaacccgt

SEQ ID NO: 530701 - DNA, 20 bp, Artificial Sequence
  chemically synthesized
attaacccgtggagaatgga

SEQ ID NO: 530702 - DNA, 20 bp, Artificial Sequence
  chemically synthesized
atggaaaagaaaggaaatga

SEQ ID NO: 530703 - DNA, 20 bp, Artificial Sequence
  chemically synthesized
atgatcagaaaatggcaatg

SEQ ID NO: 530704 - DNA, 20 bp, Artificial Sequence
  chemically synthesized
ggcaatgaaagaatatggca

SEQ ID NO: 530705 - DNA, 20 bp, Artificial Sequence
  chemically synthesized
ggcagaagaatggagatcat

SEQ ID NO: 530706 - DNA, 20 bp, Artificial Sequence
  chemically synthesized
attatacccatttcaatgat

SEQ ID NO: 530707 - DNA, 20 bp, Artificial Sequence
  chemically synthesized
ttaacgcaattactttgtgc

SEQ ID NO: 530708 - DNA, 20 bp, Artificial Sequence
  chemically synthesized
tatgaccacaaggaaataca

SEQ ID NO: 530709 - DNA, 20 bp, Artificial Sequence
  chemically synthesized
gttaactgaaagtttaagta

SEQ ID NO: 530710 - DNA, 20 bp, Artificial Sequence
  chemically synthesized
tgtttttataattaatacta

SEQ ID NO: 530711 - DNA, 20 bp, Artificial Sequence
  chemically synthesized
atagcaaaaccagtaaataa

SEQ ID NO: 530712 - DNA, 20 bp, Artificial Sequence
  chemically synthesized
gctagaggtcaagaacaaaa

SEQ ID NO: 530713 - DNA, 20 bp, Artificial Sequence
  chemically synthesized
ctactcgggaggctgaggca

SEQ ID NO: 530714 - DNA, 20 bp, Artificial Sequence
  chemically synthesized
ctgcactcacagcctgggtg

SEQ ID NO: 530715 - DNA, 20 bp, Artificial Sequence
  chemically synthesized
taatgtgatattttactggc

SEQ ID NO: 530716 - DNA, 20 bp, Artificial Sequence
  chemically synthesized
tgtatatttcaaagtaccaa

SEQ ID NO: 530717 - DNA, 20 bp, Artificial Sequence
  chemically synthesized
ctacgttatatcatttgaca

SEQ ID NO: 530718 - DNA, 20 bp, Artificial Sequence
  chemically synthesized
aaattgataataaacataga

SEQ ID NO: 530719 - DNA, 20 bp, Artificial Sequence
  chemically synthesized
taaaaaaattgataataaac

SEQ ID NO: 530720 - DNA, 20 bp, Artificial Sequence
  chemically synthesized
ttaagtgaaataaccctggc

SEQ ID NO: 530721 - DNA, 20 bp, Artificial Sequence
  chemically synthesized
ctgtacacaatgaaacactg

SEQ ID NO: 530722 - DNA, 20 bp, Artificial Sequence
  chemically synthesized
atatcaacagatgaatggat

SEQ ID NO: 530723 - DNA, 20 bp, Artificial Sequence
  chemically synthesized
ctggttatccatcccaaagc

SEQ ID NO: 530724 - DNA, 20 bp, Artificial Sequence
  chemically synthesized
tagttctatttacagtttgt

SEQ ID NO: 530725 - DNA, 20 bp, Artificial Sequence
  chemically synthesized
acagattctggtgagaatgt

SEQ ID NO: 530726 - DNA, 20 bp, Artificial Sequence
  chemically synthesized
tccctttcttcacattctca

SEQ ID NO: 530727 - DNA, 20 bp, Artificial Sequence
  chemically synthesized
caaaaaataacagattctgg

SEQ ID NO: 530728 - DNA, 20 bp, Artificial Sequence
  chemically synthesized
gatatatcgtcttaccccaa

SEQ ID NO: 530729 - DNA, 20 bp, Artificial Sequence
  chemically synthesized
gccatttgtatgccttcttt

SEQ ID NO: 530730 - DNA, 20 bp, Artificial Sequence
  chemically synthesized
gatcatttaatgaattattt

SEQ ID NO: 530731 - DNA, 20 bp, Artificial Sequence
  chemically synthesized
tttatgaactgaactgatag

SEQ ID NO: 530732 - DNA, 20 bp, Artificial Sequence
  chemically synthesized
taacattggaataatgatac

SEQ ID NO: 530733 - DNA, 20 bp, Artificial Sequence
  chemically synthesized
atattaatatggttaacatt

SEQ ID NO: 530734 - DNA, 20 bp, Artificial Sequence
  chemically synthesized
gaataacagttgaaaaaaca

SEQ ID NO: 530735 - DNA, 20 bp, Artificial Sequence
  chemically synthesized
ctttattgcatcttgattaa

SEQ ID NO: 530736 - DNA, 20 bp, Artificial Sequence
  chemically synthesized
agctgaaaatgacttactgg

SEQ ID NO: 530737 - DNA, 20 bp, Artificial Sequence
  chemically synthesized
ggccacctgggaggaaaagg

SEQ ID NO: 530738 - DNA, 20 bp, Artificial Sequence
  chemically synthesized
ttttaattgttcctcattat

SEQ ID NO: 530739 - DNA, 20 bp, Artificial Sequence
  chemically synthesized
tggagactcaaagtatctta

SEQ ID NO: 530740 - DNA, 20 bp, Artificial Sequence
  chemically synthesized
gacatttggtataggtgact

SEQ ID NO: 530741 - DNA, 20 bp, Artificial Sequence
  chemically synthesized
gtataggtgactacagaatc

SEQ ID NO: 530742 - DNA, 20 bp, Artificial Sequence
  chemically synthesized
atggtgaaaacccgtctcta

SEQ ID NO: 530743 - DNA, 20 bp, Artificial Sequence
  chemically synthesized
acagagtgaaactccacctc

SEQ ID NO: 530744 - DNA, 20 bp, Artificial Sequence
  chemically synthesized
tcagtggacttggaaattat

SEQ ID NO: 530745 - DNA, 20 bp, Artificial Sequence
  chemically synthesized
agaaaaacctaataggaaga

SEQ ID NO: 530746 - DNA, 20 bp, Artificial Sequence
  chemically synthesized
attatagaaaaacctaatag

SEQ ID NO: 530747 - DNA, 20 bp, Artificial Sequence
  chemically synthesized
gcacactgtgtcaatatatt

SEQ ID NO: 530748 - DNA, 20 bp, Artificial Sequence
  chemically synthesized
tgagttctattcttggtggg

SEQ ID NO: 530749 - DNA, 20 bp, Artificial Sequence
  chemically synthesized
attattcctttcttccccac

SEQ ID NO: 530750 - DNA, 20 bp, Artificial Sequence
  chemically synthesized
gggggtagttcccgtggtgt

SEQ ID NO: 530751 - DNA, 20 bp, Artificial Sequence
  chemically synthesized
aaaaatcgatgttaatctca

SEQ ID NO: 530752 - DNA, 20 bp, Artificial Sequence
  chemically synthesized
ttacttcctcatctcccagg

SEQ ID NO: 530753 - DNA, 20 bp, Artificial Sequence
  chemically synthesized
caggtataaaccatatactg

SEQ ID NO: 530754 - DNA, 20 bp, Artificial Sequence
  chemically synthesized
aaagggttggagacattcga

SEQ ID NO: 530755 - DNA, 20 bp, Artificial Sequence
  chemically synthesized
ccatatactatgtgcctcct

SEQ ID NO: 530756 - DNA, 20 bp, Artificial Sequence
  chemically synthesized
tagtccagtcaacttgacac

SEQ ID NO: 530757 - DNA, 20 bp, Artificial Sequence
  chemically synthesized
aaacaccctcacagacacac

SEQ ID NO: 530758 - DNA, 20 bp, Artificial Sequence
  chemically synthesized
ttgattagtcaaggttctcc

SEQ ID NO: 530759 - DNA, 20 bp, Artificial Sequence
  chemically synthesized
attttactgataaggaaagt

SEQ ID NO: 530760 - DNA, 20 bp, Artificial Sequence
  chemically synthesized
tattgagcaattaccacgtg

SEQ ID NO: 530761 - DNA, 20 bp, Artificial Sequence
  chemically synthesized
ctactcgggaagctgagaca

SEQ ID NO: 530762 - DNA, 20 bp, Artificial Sequence
  chemically synthesized
ctgcattcaataaactgatt

SEQ ID NO: 530763 - DNA, 20 bp, Artificial Sequence
  chemically synthesized
cagtttcatcgatatgcaca

SEQ ID NO: 530764 - DNA, 20 bp, Artificial Sequence
  chemically synthesized
caaggtcaattcctggtctt

SEQ ID NO: 530765 - DNA, 20 bp, Artificial Sequence
  chemically synthesized
atgtgataccataagattat

SEQ ID NO: 530766 - DNA, 20 bp, Artificial Sequence
  chemically synthesized
atatgtcattatttctaaat

SEQ ID NO: 530767 - DNA, 20 bp, Artificial Sequence
  chemically synthesized
tgaaatgacccattctaaat

SEQ ID NO: 530768 - DNA, 20 bp, Artificial Sequence
  chemically synthesized
catatgggagtggacactga

SEQ ID NO: 530769 - DNA, 20 bp, Artificial Sequence
  chemically synthesized
tcagaaatctttgcacatac

SEQ ID NO: 530770 - DNA, 20 bp, Artificial Sequence
  chemically synthesized
aaatctttgcacatactgag

SEQ ID NO: 530771 - DNA, 20 bp, Artificial Sequence
  chemically synthesized
ccataggccactttctctag

SEQ ID NO: 530772 - DNA, 20 bp, Artificial Sequence
  chemically synthesized
atgaaactaacattcttact

SEQ ID NO: 530773 - DNA, 20 bp, Artificial Sequence
  chemically synthesized
tcagagagaagattgggagt

SEQ ID NO: 530774 - DNA, 20 bp, Artificial Sequence
  chemically synthesized
agactcccaatcttctctct

SEQ ID NO: 530775 - DNA, 20 bp, Artificial Sequence
  chemically synthesized
aagagaaggtatgacagcga

SEQ ID NO: 530776 - DNA, 20 bp, Artificial Sequence
  chemically synthesized
tctccagtgataatttgtgg

SEQ ID NO: 530777 - DNA, 20 bp, Artificial Sequence
  chemically synthesized
tctttccacaaattatcact

SEQ ID NO: 530778 - DNA, 20 bp, Artificial Sequence
  chemically synthesized
gaatgcacaactggctaaat

SEQ ID NO: 530779 - DNA, 20 bp, Artificial Sequence
  chemically synthesized
taaagaaacaaatttatgaa

SEQ ID NO: 530780 - DNA, 20 bp, Artificial Sequence
  chemically synthesized
atttccttgcataattgctc

SEQ ID NO: 530781 - DNA, 20 bp, Artificial Sequence
  chemically synthesized
ttgatttaacatacagccag

SEQ ID NO: 530782 - DNA, 20 bp, Artificial Sequence
  chemically synthesized
tacaaaacaggaagcaaaag

SEQ ID NO: 530783 - DNA, 20 bp, Artificial Sequence
  chemically synthesized
gtaagaagtagtgacaagct

SEQ ID NO: 530784 - DNA, 20 bp, Artificial Sequence
  chemically synthesized
ctaaaatagtgagtcatgtc

SEQ ID NO: 530785 - DNA, 20 bp, Artificial Sequence
  chemically synthesized
aagggcacctgagactgaga

SEQ ID NO: 530786 - DNA, 20 bp, Artificial Sequence
  chemically synthesized
tagacttgggttgatatgca

SEQ ID NO: 530787 - DNA, 20 bp, Artificial Sequence
  chemically synthesized
atttcgagtaaggaagactg

SEQ ID NO: 530788 - DNA, 20 bp, Artificial Sequence
  chemically synthesized
tgctggtggcaatatgaaaa

SEQ ID NO: 530789 - DNA, 20 bp, Artificial Sequence
  chemically synthesized
caatatgaaaatcagaaaag

SEQ ID NO: 530790 - DNA, 20 bp, Artificial Sequence
  chemically synthesized
aacaatttgtctcagcaatt

SEQ ID NO: 530791 - DNA, 20 bp, Artificial Sequence
  chemically synthesized
gtgagctttggaaggtgagc

SEQ ID NO: 530792 - DNA, 20 bp, Artificial Sequence
  chemically synthesized
gaagagataaaggagtttaa

SEQ ID NO: 530793 - DNA, 20 bp, Artificial Sequence
  chemically synthesized
atcacgaaagcttagaactg

SEQ ID NO: 530794 - DNA, 20 bp, Artificial Sequence
  chemically synthesized
tgcccatctgggatagttct

SEQ ID NO: 530795 - DNA, 20 bp, Artificial Sequence
  chemically synthesized
ttcagaactatcccagatgg

SEQ ID NO: 530796 - DNA, 20 bp, Artificial Sequence
  chemically synthesized
tttcctgagatgcttttact

SEQ ID NO: 530797 - DNA, 20 bp, Artificial Sequence
  chemically synthesized
cttgtgtcagggatcttgaa

SEQ ID NO: 530798 - DNA, 20 bp, Artificial Sequence
  chemically synthesized
aaaggaagaaaaggaggaag

SEQ ID NO: 530799 - DNA, 20 bp, Artificial Sequence
  chemically synthesized
tcatcaaaaatggaagaaag

SEQ ID NO: 530800 - DNA, 20 bp, Artificial Sequence
  chemically synthesized
tactttcatcatcaaaaatg

SEQ ID NO: 530801 - DNA, 20 bp, Artificial Sequence
  chemically synthesized
tttgatgatgaaagtaaaaa

SEQ ID NO: 530802 - DNA, 20 bp, Artificial Sequence
  chemically synthesized
tgaaagtaaaaaaaagaaaa

SEQ ID NO: 530803 - DNA, 20 bp, Artificial Sequence
  chemically synthesized
atctgaaatgagaagaccaa

SEQ ID NO: 530804 - DNA, 20 bp, Artificial Sequence
  chemically synthesized
ccttcctttcttagcttcag

SEQ ID NO: 530805 - DNA, 20 bp, Artificial Sequence
  chemically synthesized
gtgatatttcttactgaagc

SEQ ID NO: 530806 - DNA, 20 bp, Artificial Sequence
  chemically synthesized
attcattcaaaagatattga

SEQ ID NO: 530807 - DNA, 20 bp, Artificial Sequence
  chemically synthesized
agagatcttatctgtcttgt

SEQ ID NO: 530808 - DNA, 20 bp, Artificial Sequence
  chemically synthesized
cctagtacatagaagatgat

SEQ ID NO: 530809 - DNA, 20 bp, Artificial Sequence
  chemically synthesized
ttggtgctcattcattatac

SEQ ID NO: 530810 - DNA, 20 bp, Artificial Sequence
  chemically synthesized
gcttatttaaaagcaatgtt

SEQ ID NO: 530811 - DNA, 20 bp, Artificial Sequence
  chemically synthesized
cattgcttttaaataagcca

SEQ ID NO: 530812 - DNA, 20 bp, Artificial Sequence
  chemically synthesized
ttaaataagccaaaagaata

SEQ ID NO: 530813 - DNA, 20 bp, Artificial Sequence
  chemically synthesized
ataagccaaaagaataaaag

SEQ ID NO: 530814 - DNA, 20 bp, Artificial Sequence
  chemically synthesized
gccaaaagaataaaagaaag

SEQ ID NO: 530815 - DNA, 20 bp, Artificial Sequence
  chemically synthesized
cgataacaacatcatggctc

SEQ ID NO: 530816 - DNA, 20 bp, Artificial Sequence
  chemically synthesized
aaagacaaagtggaagccct

SEQ ID NO: 530817 - DNA, 20 bp, Artificial Sequence
  chemically synthesized
aactcaaagtagagtaatta

SEQ ID NO: 530818 - DNA, 20 bp, Artificial Sequence
  chemically synthesized
agatgtagcttggacactag

SEQ ID NO: 530819 - DNA, 20 bp, Artificial Sequence
  chemically synthesized
aatcatgtttactccagtct

SEQ ID NO: 530820 - DNA, 20 bp, Artificial Sequence
  chemically synthesized
gggtctagacaaactgagaa

SEQ ID NO: 530821 - DNA, 20 bp, Artificial Sequence
  chemically synthesized
gataaatatccatgggaatg

SEQ ID NO: 530822 - DNA, 20 bp, Artificial Sequence
  chemically synthesized
aacaaaaacaaaagcaaaag

SEQ ID NO: 530823 - DNA, 20 bp, Artificial Sequence
  chemically synthesized
cccaacacagacacatgcac

SEQ ID NO: 530824 - DNA, 20 bp, Artificial Sequence
  chemically synthesized
tacttgtgaggatttgggag

SEQ ID NO: 530825 - DNA, 20 bp, Artificial Sequence
  chemically synthesized
acaactcaaaagaatcagaa

SEQ ID NO: 530826 - DNA, 20 bp, Artificial Sequence
  chemically synthesized
tcagttacaactcaaaagaa

SEQ ID NO: 530827 - DNA, 20 bp, Artificial Sequence
  chemically synthesized
attttttcagttacaactca

SEQ ID NO: 530828 - DNA, 20 bp, Artificial Sequence
  chemically synthesized
tgccctaatgtcaggaaaac

SEQ ID NO: 530829 - DNA, 20 bp, Artificial Sequence
  chemically synthesized
atctatcctgaagtcaaacg

SEQ ID NO: 530830 - DNA, 20 bp, Artificial Sequence
  chemically synthesized
ataagtcacacaaaatctat

SEQ ID NO: 530831 - DNA, 20 bp, Artificial Sequence
  chemically synthesized
agattaagaaagaagtcagc

SEQ ID NO: 530832 - DNA, 20 bp, Artificial Sequence
  chemically synthesized
aataaaaaaaggagtcagat

SEQ ID NO: 530833 - DNA, 20 bp, Artificial Sequence
  chemically synthesized
ggagggctggaggagaaagg

SEQ ID NO: 530834 - DNA, 20 bp, Artificial Sequence
  chemically synthesized
aataaagggggagggctgga

SEQ ID NO: 530835 - DNA, 20 bp, Artificial Sequence
  chemically synthesized
agagttcatcagaattagag

SEQ ID NO: 530836 - DNA, 20 bp, Artificial Sequence
  chemically synthesized
cagtttgatggcagagttca

SEQ ID NO: 530837 - DNA, 20 bp, Artificial Sequence
  chemically synthesized
acaaacatccaaagtgcatt

SEQ ID NO: 530838 - DNA, 20 bp, Artificial Sequence
  chemically synthesized
gaatgaggcagttgcataag

SEQ ID NO: 530839 - DNA, 20 bp, Artificial Sequence
  chemically synthesized
tataacctgactccattatc

SEQ ID NO: 530840 - DNA, 20 bp, Artificial Sequence
  chemically synthesized
agggtatcattcattttaat

SEQ ID NO: 530841 - DNA, 20 bp, Artificial Sequence
  chemically synthesized
aaaaaaaaaaaaaaaaggca

SEQ ID NO: 530842 - DNA, 20 bp, Artificial Sequence
  chemically synthesized
ttttttttttttggtctcag

SEQ ID NO: 530843 - DNA, 20 bp, Artificial Sequence
  chemically synthesized
aatgtggtataaataaagct

SEQ ID NO: 530844 - DNA, 20 bp, Artificial Sequence
  chemically synthesized
atttggaagatatcgttctc

SEQ ID NO: 530845 - DNA, 20 bp, Artificial Sequence
  chemically synthesized
aaaggaatgctccaatggcc

SEQ ID NO: 530846 - DNA, 20 bp, Artificial Sequence
  chemically synthesized
acttatgggccaaaatgccc

SEQ ID NO: 530847 - DNA, 20 bp, Artificial Sequence
  chemically synthesized
agttctgcatcagtgagaga

SEQ ID NO: 530848 - DNA, 20 bp, Artificial Sequence
  chemically synthesized
ttgtcagttctgcatcagtg

SEQ ID NO: 530849 - DNA, 20 bp, Artificial Sequence
  chemically synthesized
atatgcgaagaagagagaag

SEQ ID NO: 530850 - DNA, 20 bp, Artificial Sequence
  chemically synthesized
tggttctcacacatctacac

SEQ ID NO: 530851 - DNA, 20 bp, Artificial Sequence
  chemically synthesized
tctgtgtagatgtgtgagaa

SEQ ID NO: 530852 - DNA, 20 bp, Artificial Sequence
  chemically synthesized
caaatgtggctttacatagt

SEQ ID NO: 530853 - DNA, 20 bp, Artificial Sequence
  chemically synthesized
gtacaatgtgatcttttata

SEQ ID NO: 530854 - DNA, 20 bp, Artificial Sequence
  chemically synthesized
gtacctacttccatgatgac

SEQ ID NO: 530855 - DNA, 20 bp, Artificial Sequence
  chemically synthesized
taggatttcttgctttcgtg

SEQ ID NO: 530856 - DNA, 20 bp, Artificial Sequence
  chemically synthesized
gcttctttctttcacgaaag

SEQ ID NO: 530857 - DNA, 20 bp, Artificial Sequence
  chemically synthesized
ggctttgtgccttagcaaag

SEQ ID NO: 530858 - DNA, 20 bp, Artificial Sequence
  chemically synthesized
actccatgtttgtggtgtga

SEQ ID NO: 530859 - DNA, 20 bp, Artificial Sequence
  chemically synthesized
aacctgttttaaagaaagaa

SEQ ID NO: 530860 - DNA, 20 bp, Artificial Sequence
  chemically synthesized
gggaacaacctgttttaaag

SEQ ID NO: 530861 - DNA, 20 bp, Artificial Sequence
  chemically synthesized
atatgggaacaacctgtttt

SEQ ID NO: 530862 - DNA, 20 bp, Artificial Sequence
  chemically synthesized
gagagacatgtgtcggctta

SEQ ID NO: 530863 - DNA, 20 bp, Artificial Sequence
  chemically synthesized
ttgacaatttcaggtaaaat

SEQ ID NO: 530864 - DNA, 20 bp, Artificial Sequence
  chemically synthesized
gctaaggacaagcagttggg

SEQ ID NO: 530865 - DNA, 20 bp, Artificial Sequence
  chemically synthesized
gcactttgctaggagaggaa

SEQ ID NO: 530866 - DNA, 20 bp, Artificial Sequence
  chemically synthesized
gcagaaaaaataaaaataaa

SEQ ID NO: 530867 - DNA, 20 bp, Artificial Sequence
  chemically synthesized
cagaaattatttagacgagc

SEQ ID NO: 530868 - DNA, 20 bp, Artificial Sequence
  chemically synthesized
tcagcctcaaattaactaaa

SEQ ID NO: 530869 - DNA, 20 bp, Artificial Sequence
  chemically synthesized
gttaatttgaggctgaggct

SEQ ID NO: 530870 - DNA, 20 bp, Artificial Sequence
  chemically synthesized
agaactatctgtggagactt

SEQ ID NO: 530871 - DNA, 20 bp, Artificial Sequence
  chemically synthesized
tggtatttctattaacacat

SEQ ID NO: 530872 - DNA, 20 bp, Artificial Sequence
  chemically synthesized
cttagtttctttatgtgtta

SEQ ID NO: 530873 - DNA, 20 bp, Artificial Sequence
  chemically synthesized
tcatcaaatttaccttctga

SEQ ID NO: 530874 - DNA, 20 bp, Artificial Sequence
  chemically synthesized
ggtacctaactaactacttg

SEQ ID NO: 530875 - DNA, 20 bp, Artificial Sequence
  chemically synthesized
agatgaggaaatggaggcac

SEQ ID NO: 530876 - DNA, 20 bp, Artificial Sequence
  chemically synthesized
aaatgagtacataccgagtg

SEQ ID NO: 530877 - DNA, 20 bp, Artificial Sequence
  chemically synthesized
gttctagcaatttgcagtta

SEQ ID NO: 530878 - DNA, 20 bp, Artificial Sequence
  chemically synthesized
gcttttgatgggcaaaaaca

SEQ ID NO: 530879 - DNA, 20 bp, Artificial Sequence
  chemically synthesized
aaacactctgggtgacaaga

SEQ ID NO: 530880 - DNA, 20 bp, Artificial Sequence
  chemically synthesized
ggcccggatatgaaggataa

SEQ ID NO: 530881 - DNA, 20 bp, Artificial Sequence
  chemically synthesized
aagagttgaataatacaagg

SEQ ID NO: 530882 - DNA, 20 bp, Artificial Sequence
  chemically synthesized
ctgtacttgactgtcaggtt

SEQ ID NO: 530883 - DNA, 20 bp, Artificial Sequence
  chemically synthesized
ttatcatgtgaatgcatttg

SEQ ID NO: 530884 - DNA, 20 bp, Artificial Sequence
  chemically synthesized
attcacatgataataaaatt

SEQ ID NO: 530885 - DNA, 20 bp, Artificial Sequence
  chemically synthesized
acttgccatcagggaatggg

SEQ ID NO: 530886 - DNA, 20 bp, Artificial Sequence
  chemically synthesized
ctctacattaattttttaag

SEQ ID NO: 530887 - DNA, 20 bp, Artificial Sequence
  chemically synthesized
taccaacctaaatatcattg

SEQ ID NO: 530888 - DNA, 20 bp, Artificial Sequence
  chemically synthesized
tttaggatgaatgaaagcat

SEQ ID NO: 530889 - DNA, 20 bp, Artificial Sequence
  chemically synthesized
agcgaagagaggataagctg

SEQ ID NO: 530890 - DNA, 20 bp, Artificial Sequence
  chemically synthesized
ctgtgttaaatgtaacaata

SEQ ID NO: 530891 - DNA, 20 bp, Artificial Sequence
  chemically synthesized
aatgataagaggggctttaa

SEQ ID NO: 530892 - DNA, 20 bp, Artificial Sequence
  chemically synthesized
ggtagggatcttgctaacaa

SEQ ID NO: 530893 - DNA, 20 bp, Artificial Sequence
  chemically synthesized
acaaaaaacatggtgtcaga

SEQ ID NO: 530894 - DNA, 20 bp, Artificial Sequence
  chemically synthesized
gaaagtatgacagttgggtt

SEQ ID NO: 530895 - DNA, 20 bp, Artificial Sequence
  chemically synthesized
aagacacaaggttcttgaga

SEQ ID NO: 530896 - DNA, 20 bp, Artificial Sequence
  chemically synthesized
ccagcaagacacaaggttct

SEQ ID NO: 530897 - DNA, 20 bp, Artificial Sequence
  chemically synthesized
caggagcaatctgggaggca

SEQ ID NO: 530898 - DNA, 20 bp, Artificial Sequence
  chemically synthesized
aaaaaaaaaaaaagatggta

SEQ ID NO: 530899 - DNA, 20 bp, Artificial Sequence
  chemically synthesized
gtactcgggaggctgaggca

SEQ ID NO: 530900 - DNA, 20 bp, Artificial Sequence
  chemically synthesized
gaactttcaaaatacagtga

SEQ ID NO: 530901 - DNA, 20 bp, Artificial Sequence
  chemically synthesized
tcaatacagtaaggaaaaga

SEQ ID NO: 530902 - DNA, 20 bp, Artificial Sequence
  chemically synthesized
tccgattactttggaaaagt

SEQ ID NO: 530903 - DNA, 20 bp, Artificial Sequence
  chemically synthesized
tcaactttgtaatatataat

SEQ ID NO: 530904 - DNA, 20 bp, Artificial Sequence
  chemically synthesized
ctgctcgggaggttgaggca

SEQ ID NO: 530905 - DNA, 20 bp, Artificial Sequence
  chemically synthesized
acctcagggatatttaaata

SEQ ID NO: 530906 - DNA, 20 bp, Artificial Sequence
  chemically synthesized
accttagtttggtgaacaga

SEQ ID NO: 530907 - DNA, 20 bp, Artificial Sequence
  chemically synthesized
tctttaaggactttaactac

SEQ ID NO: 530908 - DNA, 20 bp, Artificial Sequence
  chemically synthesized
gttaatatttgttttaaaaa

SEQ ID NO: 530909 - DNA, 20 bp, Artificial Sequence
  chemically synthesized
ccaatttatttaacttttga

SEQ ID NO: 530910 - DNA, 20 bp, Artificial Sequence
  chemically synthesized
catataagaacaaaaactat

SEQ ID NO: 530911 - DNA, 20 bp, Artificial Sequence
  chemically synthesized
ctactggggaggccgaggca

SEQ ID NO: 530912 - DNA, 20 bp, Artificial Sequence
  chemically synthesized
aatgtcaataatgctgaagt

SEQ ID NO: 530913 - DNA, 20 bp, Artificial Sequence
  chemically synthesized
ctatctatcccacgaattat

SEQ ID NO: 530914 - DNA, 20 bp, Artificial Sequence
  chemically synthesized
tgggacaactgaaaatgtct

SEQ ID NO: 530915 - DNA, 20 bp, Artificial Sequence
  chemically synthesized
ttcctcaaccagttatagac

SEQ ID NO: 530916 - DNA, 20 bp, Artificial Sequence
  chemically synthesized
gtgaagaaataggggtggaa

SEQ ID NO: 530917 - DNA, 20 bp, Artificial Sequence
  chemically synthesized
tattgcagaataacacctgt

SEQ ID NO: 530918 - DNA, 20 bp, Artificial Sequence
  chemically synthesized
gatgccagggcagatttatt

SEQ ID NO: 530919 - DNA, 20 bp, Artificial Sequence
  chemically synthesized
taacaccctcaacataccct

SEQ ID NO: 530920 - DNA, 20 bp, Artificial Sequence
  chemically synthesized
aaaactcaactcagattagt

SEQ ID NO: 530921 - DNA, 20 bp, Artificial Sequence
  chemically synthesized
tggactcttggctgtaagtg

SEQ ID NO: 530922 - DNA, 20 bp, Artificial Sequence
  chemically synthesized
tttataataaaggggaaact

SEQ ID NO: 530923 - DNA, 20 bp, Artificial Sequence
  chemically synthesized
ggggaaactacagaaacatt

SEQ ID NO: 530924 - DNA, 20 bp, Artificial Sequence
  chemically synthesized
tcataaaaatgtgggacaga

SEQ ID NO: 530925 - DNA, 20 bp, Artificial Sequence
  chemically synthesized
gcagaatggtacccattatt

SEQ ID NO: 530926 - DNA, 20 bp, Artificial Sequence
  chemically synthesized
tgagactgggggaaatcttt

SEQ ID NO: 530927 - DNA, 20 bp, Artificial Sequence
  chemically synthesized
atttcccccagtctcattat

SEQ ID NO: 530928 - DNA, 20 bp, Artificial Sequence
  chemically synthesized
attatgaagaaataatagac

SEQ ID NO: 530929 - DNA, 20 bp, Artificial Sequence
  chemically synthesized
ctactcaggaggctgaggca

SEQ ID NO: 530930 - DNA, 20 bp, Artificial Sequence
  chemically synthesized
tctcaaaaaaaaaaaaaaaa

SEQ ID NO: 530931 - DNA, 20 bp, Artificial Sequence
  chemically synthesized
catttcagcactccttttaa

SEQ ID NO: 530932 - DNA, 20 bp, Artificial Sequence
  chemically synthesized
tccaagtacctttttgtaac

SEQ ID NO: 530933 - DNA, 20 bp, Artificial Sequence
  chemically synthesized
ttattgatggaaaactcatg

SEQ ID NO: 530934 - DNA, 20 bp, Artificial Sequence
  chemically synthesized
tcgtggactctcccaatctg

SEQ ID NO: 530935 - DNA, 20 bp, Artificial Sequence
  chemically synthesized
gaaaataaaaaagccaaaca

SEQ ID NO: 530936 - DNA, 20 bp, Artificial Sequence
  chemically synthesized
aagtaatgtgattggcatcc

SEQ ID NO: 530937 - DNA, 20 bp, Artificial Sequence
  chemically synthesized
caaactatgcgggcactgga

SEQ ID NO: 530938 - DNA, 20 bp, Artificial Sequence
  chemically synthesized
taagtggtgcctctaagacc

SEQ ID NO: 530939 - DNA, 20 bp, Artificial Sequence
  chemically synthesized
atctcactggaaagggatta

SEQ ID NO: 530940 - DNA, 20 bp, Artificial Sequence
  chemically synthesized
agagtggatcagccttaata

SEQ ID NO: 530941 - DNA, 20 bp, Artificial Sequence
  chemically synthesized
ataaataaataaaaaagata

SEQ ID NO: 530942 - DNA, 20 bp, Artificial Sequence
  chemically synthesized
taaaaaagataaaagaaaaa

SEQ ID NO: 530943 - DNA, 20 bp, Artificial Sequence
  chemically synthesized
gggaggtgaaaagcttctaa

SEQ ID NO: 530944 - DNA, 20 bp, Artificial Sequence
  chemically synthesized
agaagaaaaaaatcagacag

SEQ ID NO: 530945 - DNA, 20 bp, Artificial Sequence
  chemically synthesized
ggagaaaatgtctttgaata

SEQ ID NO: 530946 - DNA, 20 bp, Artificial Sequence
  chemically synthesized
ttaaataaagctataataga

SEQ ID NO: 530947 - DNA, 20 bp, Artificial Sequence
  chemically synthesized
cctaatttagagatatggat

SEQ ID NO: 530948 - DNA, 20 bp, Artificial Sequence
  chemically synthesized
tgctgaagacagactgctgc

SEQ ID NO: 530949 - DNA, 20 bp, Artificial Sequence
  chemically synthesized
atcacaaaagagactacaat

SEQ ID NO: 530950 - DNA, 20 bp, Artificial Sequence
  chemically synthesized
caatagcaaaatgaaactta

SEQ ID NO: 530951 - DNA, 20 bp, Artificial Sequence
  chemically synthesized
tcatacttatccaatgagcc

SEQ ID NO: 530952 - DNA, 20 bp, Artificial Sequence
  chemically synthesized
tatttttccatagggcataa

SEQ ID NO: 530953 - DNA, 20 bp, Artificial Sequence
  chemically synthesized
caacactgacttctatgtaa

SEQ ID NO: 530954 - DNA, 20 bp, Artificial Sequence
  chemically synthesized
attatcagccccacatcagc

SEQ ID NO: 530955 - DNA, 20 bp, Artificial Sequence
  chemically synthesized
acaattattattattgattg

SEQ ID NO: 530956 - DNA, 20 bp, Artificial Sequence
  chemically synthesized
tttgtaataaccccatgagt

SEQ ID NO: 530957 - DNA, 20 bp, Artificial Sequence
  chemically synthesized
aatacaaatgctctggcata

SEQ ID NO: 530958 - DNA, 20 bp, Artificial Sequence
  chemically synthesized
tatcgacttttaaaaactgt

SEQ ID NO: 530959 - DNA, 20 bp, Artificial Sequence
  chemically synthesized
ctatatgaataataataata

SEQ ID NO: 530960 - DNA, 20 bp, Artificial Sequence
  chemically synthesized
tattattattattcatatag

SEQ ID NO: 530961 - DNA, 20 bp, Artificial Sequence
  chemically synthesized
tgtcagtcttcttggtgtca

SEQ ID NO: 530962 - DNA, 20 bp, Artificial Sequence
  chemically synthesized
gggggtcaggggaacctaga

SEQ ID NO: 530963 - DNA, 20 bp, Artificial Sequence
  chemically synthesized
cagaagttgggaggggaaaa

SEQ ID NO: 530964 - DNA, 20 bp, Artificial Sequence
  chemically synthesized
tcatatagttcacagctttg

SEQ ID NO: 530965 - DNA, 20 bp, Artificial Sequence
  chemically synthesized
tcggaaagattcaaaacaat

SEQ ID NO: 530966 - DNA, 20 bp, Artificial Sequence
  chemically synthesized
ctgctcctgctcccactggt

SEQ ID NO: 530967 - DNA, 20 bp, Artificial Sequence
  chemically synthesized
gaactgttgagaagtgtaca

SEQ ID NO: 530968 - DNA, 20 bp, Artificial Sequence
  chemically synthesized
gtacacttctcaacagttcc

SEQ ID NO: 530969 - DNA, 20 bp, Artificial Sequence
  chemically synthesized
aacaagaagaatgaagcgac

SEQ ID NO: 530970 - DNA, 20 bp, Artificial Sequence
  chemically synthesized
aagcaggaataagagaacaa

SEQ ID NO: 530971 - DNA, 20 bp, Artificial Sequence
  chemically synthesized
tgttctcttattcctgcttc

SEQ ID NO: 530972 - DNA, 20 bp, Artificial Sequence
  chemically synthesized
ctacttgggaggctgagaca

SEQ ID NO: 530973 - DNA, 20 bp, Artificial Sequence
  chemically synthesized
tagtgaggggttacctcatc

SEQ ID NO: 530974 - DNA, 20 bp, Artificial Sequence
  chemically synthesized
aatgtgaataccattaaaaa

SEQ ID NO: 530975 - DNA, 20 bp, Artificial Sequence
  chemically synthesized
tgctgaggccgggatttaat

SEQ ID NO: 530976 - DNA, 20 bp, Artificial Sequence
  chemically synthesized
ggaacttctgccttagggca

SEQ ID NO: 530977 - DNA, 20 bp, Artificial Sequence
  chemically synthesized
cttagggcaggagaaaacaa

SEQ ID NO: 530978 - DNA, 20 bp, Artificial Sequence
  chemically synthesized
atggcttggggatagagctg

SEQ ID NO: 530979 - DNA, 20 bp, Artificial Sequence
  chemically synthesized
atttaaagataaaagtagat

SEQ ID NO: 530980 - DNA, 20 bp, Artificial Sequence
  chemically synthesized
gacattcaggttgtggtgga

SEQ ID NO: 530981 - DNA, 20 bp, Artificial Sequence
  chemically synthesized
ggctgggtctgaagcccagg

SEQ ID NO: 530982 - DNA, 20 bp, Artificial Sequence
  chemically synthesized
ctactcgggaggctgaggca

SEQ ID NO: 530983 - DNA, 20 bp, Artificial Sequence
  chemically synthesized
aaaaaaaaaaaaaaagaaca

SEQ ID NO: 530984 - DNA, 20 bp, Artificial Sequence
  chemically synthesized
tcatgcttttgtgttgagtc

SEQ ID NO: 530985 - DNA, 20 bp, Artificial Sequence
  chemically synthesized
tcttcttaacaggggatgaa

SEQ ID NO: 530986 - DNA, 20 bp, Artificial Sequence
  chemically synthesized
taagaagatgaaaagatgag

SEQ ID NO: 530987 - DNA, 20 bp, Artificial Sequence
  chemically synthesized
acatttgaaaaccctataca

SEQ ID NO: 530988 - DNA, 20 bp, Artificial Sequence
  chemically synthesized
agaaaggactagtatctgat

SEQ ID NO: 530989 - DNA, 20 bp, Artificial Sequence
  chemically synthesized
actataaaaaaacttttgaa

SEQ ID NO: 530990 - DNA, 20 bp, Artificial Sequence
  chemically synthesized
gagatattcctacacacata

SEQ ID NO: 530991 - DNA, 20 bp, Artificial Sequence
  chemically synthesized
ccaaatgttggtgaagatgc

SEQ ID NO: 530992 - DNA, 20 bp, Artificial Sequence
  chemically synthesized
aagtcttgctgcatataaaa

SEQ ID NO: 530993 - DNA, 20 bp, Artificial Sequence
  chemically synthesized
attattgaaataacaaaatt

SEQ ID NO: 530994 - DNA, 20 bp, Artificial Sequence
  chemically synthesized
tgtagattcacatggagttg

SEQ ID NO: 530995 - DNA, 20 bp, Artificial Sequence
  chemically synthesized
aaagggatagtgacagaacc

SEQ ID NO: 530996 - DNA, 20 bp, Artificial Sequence
  chemically synthesized
gttctgtcactatccctttt

SEQ ID NO: 530997 - DNA, 20 bp, Artificial Sequence
  chemically synthesized
ctattggtatattgcttcaa

SEQ ID NO: 530998 - DNA, 20 bp, Artificial Sequence
  chemically synthesized
gaagccttctgaatttttaa

SEQ ID NO: 530999 - DNA, 20 bp, Artificial Sequence
  chemically synthesized
ggcgaataattttttggtaa

SEQ ID NO: 531000 - DNA, 20 bp, Artificial Sequence
  chemically synthesized
ttggtaataagaaaaaaaac

SEQ ID NO: 531001 - DNA, 20 bp, Artificial Sequence
  chemically synthesized
ggaacctttgaactaaccac

SEQ ID NO: 531002 - DNA, 20 bp, Artificial Sequence
  chemically synthesized
ttgtttggacatacaaggag

SEQ ID NO: 531003 - DNA, 20 bp, Artificial Sequence
  chemically synthesized
ttggacatacaaggagacag

SEQ ID NO: 531004 - DNA, 20 bp, Artificial Sequence
  chemically synthesized
tttgcccagtggctctcagt

SEQ ID NO: 531005 - DNA, 20 bp, Artificial Sequence
  chemically synthesized
tatcatttttagatacaaaa

SEQ ID NO: 531006 - DNA, 20 bp, Artificial Sequence
  chemically synthesized
tactactcatcagaggtacc

SEQ ID NO: 531007 - DNA, 20 bp, Artificial Sequence
  chemically synthesized
ggtacctcagaaagtagttg

SEQ ID NO: 531008 - DNA, 20 bp, Artificial Sequence
  chemically synthesized
attttaggcatagagtacaa

SEQ ID NO: 531009 - DNA, 20 bp, Artificial Sequence
  chemically synthesized
ttcactcctcatgacaaggg

SEQ ID NO: 531010 - DNA, 20 bp, Artificial Sequence
  chemically synthesized
tttgcacactacagtcaagc

SEQ ID NO: 531011 - DNA, 20 bp, Artificial Sequence
  chemically synthesized
cggagagaaggcccagtata

SEQ ID NO: 531012 - DNA, 20 bp, Artificial Sequence
  chemically synthesized
cagatgacatgattgtatat

SEQ ID NO: 531013 - DNA, 20 bp, Artificial Sequence
  chemically synthesized
ctctgtctgttattggtgta

SEQ ID NO: 531014 - DNA, 20 bp, Artificial Sequence
  chemically synthesized
cccattcacaattgcttcaa

SEQ ID NO: 531015 - DNA, 20 bp, Artificial Sequence
  chemically synthesized
aaggaaataaaagaggatac

SEQ ID NO: 531016 - DNA, 20 bp, Artificial Sequence
  chemically synthesized
cattccatgctcatgggtag

SEQ ID NO: 531017 - DNA, 20 bp, Artificial Sequence
  chemically synthesized
agctaccaatgactttcttc

SEQ ID NO: 531018 - DNA, 20 bp, Artificial Sequence
  chemically synthesized
gtagttttttccaattctgt

SEQ ID NO: 531019 - DNA, 20 bp, Artificial Sequence
  chemically synthesized
aatggaacagaacagagccc

SEQ ID NO: 531020 - DNA, 20 bp, Artificial Sequence
  chemically synthesized
catctgatctttgacaaacc

SEQ ID NO: 531021 - DNA, 20 bp, Artificial Sequence
  chemically synthesized
ggaaaactggctagccatat

SEQ ID NO: 531022 - DNA, 20 bp, Artificial Sequence
  chemically synthesized
ctaaaaccacaaaaactcta

SEQ ID NO: 531023 - DNA, 20 bp, Artificial Sequence
  chemically synthesized
taaagagcttctgcacagca

SEQ ID NO: 531024 - DNA, 20 bp, Artificial Sequence
  chemically synthesized
aacaggcaacctacaaaatg

SEQ ID NO: 531025 - DNA, 20 bp, Artificial Sequence
  chemically synthesized
atctgacaaagggctaatat

SEQ ID NO: 531026 - DNA, 20 bp, Artificial Sequence
  chemically synthesized
aatgaactcaaacaaatgta

SEQ ID NO: 531027 - DNA, 20 bp, Artificial Sequence
  chemically synthesized
gctcaccatcactggccatc

SEQ ID NO: 531028 - DNA, 20 bp, Artificial Sequence
  chemically synthesized
gagataccatctcacaccag

SEQ ID NO: 531029 - DNA, 20 bp, Artificial Sequence
  chemically synthesized
acaggtgctggagaggatgt

SEQ ID NO: 531030 - DNA, 20 bp, Artificial Sequence
  chemically synthesized
gattcctcagggatctagaa

SEQ ID NO: 531031 - DNA, 20 bp, Artificial Sequence
  chemically synthesized
ccaacaatgataggctggat

SEQ ID NO: 531032 - DNA, 20 bp, Artificial Sequence
  chemically synthesized
ttgtccatgtgatagtttac

SEQ ID NO: 531033 - DNA, 20 bp, Artificial Sequence
  chemically synthesized
gctctcaggatttacacctc

SEQ ID NO: 531034 - DNA, 20 bp, Artificial Sequence
  chemically synthesized
aaaacgagatcatgtgcttg

SEQ ID NO: 531035 - DNA, 20 bp, Artificial Sequence
  chemically synthesized
attccgcttacatgatgttc

SEQ ID NO: 531036 - DNA, 20 bp, Artificial Sequence
  chemically synthesized
caaatgcatagagacggaaa

SEQ ID NO: 531037 - DNA, 20 bp, Artificial Sequence
  chemically synthesized
gtgtttttaccacaatttga

SEQ ID NO: 531038 - DNA, 20 bp, Artificial Sequence
  chemically synthesized
ttttaccacaatttgaaaag

SEQ ID NO: 531039 - DNA, 20 bp, Artificial Sequence
  chemically synthesized
atgagaaaatacaggagaag

SEQ ID NO: 531040 - DNA, 20 bp, Artificial Sequence
  chemically synthesized
ataggtcccacccaacagga

SEQ ID NO: 531041 - DNA, 20 bp, Artificial Sequence
  chemically synthesized
tctaaagagatgtgtggaga

SEQ ID NO: 531042 - DNA, 20 bp, Artificial Sequence
  chemically synthesized
cagggtgatttcagctcatg

SEQ ID NO: 531043 - DNA, 20 bp, Artificial Sequence
  chemically synthesized
tcaaactgcatcatgataca

SEQ ID NO: 531044 - DNA, 20 bp, Artificial Sequence
  chemically synthesized
aattacactcacccccaagc

SEQ ID NO: 531045 - DNA, 20 bp, Artificial Sequence
  chemically synthesized
tacagagagcagagtcaagg

SEQ ID NO: 531046 - DNA, 20 bp, Artificial Sequence
  chemically synthesized
tcaaactggtcagcaggaca

SEQ ID NO: 531047 - DNA, 20 bp, Artificial Sequence
  chemically synthesized
caggggccaatatccaatat

SEQ ID NO: 531048 - DNA, 20 bp, Artificial Sequence
  chemically synthesized
atccagaaattcctgtctag

SEQ ID NO: 531049 - DNA, 20 bp, Artificial Sequence
  chemically synthesized
agctgcttaaaactaggaca

SEQ ID NO: 531050 - DNA, 20 bp, Artificial Sequence
  chemically synthesized
tgctgtaatcattaaaacct

SEQ ID NO: 531051 - DNA, 20 bp, Artificial Sequence
  chemically synthesized
aaaatcaaaacaaacaggga

SEQ ID NO: 531052 - DNA, 20 bp, Artificial Sequence
  chemically synthesized
ctactctcactaccaagtct

SEQ ID NO: 531053 - DNA, 20 bp, Artificial Sequence
  chemically synthesized
tttccaaagcatacatatag

SEQ ID NO: 531054 - DNA, 20 bp, Artificial Sequence
  chemically synthesized
ctaggccaaagtgttttcta

SEQ ID NO: 531055 - DNA, 20 bp, Artificial Sequence
  chemically synthesized
ggagttcttccacatttctg

SEQ ID NO: 531056 - DNA, 20 bp, Artificial Sequence
  chemically synthesized
gtgactcccactcctgcccg

SEQ ID NO: 531057 - DNA, 20 bp, Artificial Sequence
  chemically synthesized
tcctcctgctccttgctctg

SEQ ID NO: 531058 - DNA, 20 bp, Artificial Sequence
  chemically synthesized
gtggggcgccaagattgaaa

SEQ ID NO: 531059 - DNA, 20 bp, Artificial Sequence
  chemically synthesized
aaacgcatctcctgtctcta

SEQ ID NO: 531060 - DNA, 20 bp, Artificial Sequence
  chemically synthesized
ggttggggggttcttgcccc

SEQ ID NO: 531061 - DNA, 20 bp, Artificial Sequence
  chemically synthesized
gggtggggggttcttgtccc

SEQ ID NO: 531062 - DNA, 20 bp, Artificial Sequence
  chemically synthesized
atagtgaaggaggcaagccc

SEQ ID NO: 531063 - DNA, 20 bp, Artificial Sequence
  chemically synthesized
tcttgagagcacaggctaag

SEQ ID NO: 531064 - DNA, 20 bp, Artificial Sequence
  chemically synthesized
tggggtcaagtggcatcgca

SEQ ID NO: 531065 - DNA, 20 bp, Artificial Sequence
  chemically synthesized
ttgacagtagttccaaatag

SEQ ID NO: 531066 - DNA, 20 bp, Artificial Sequence
  chemically synthesized
accgtttgcctattttatga

SEQ ID NO: 531067 - DNA, 20 bp, Artificial Sequence
  chemically synthesized
tggggaggggcagatgtgta

SEQ ID NO: 531068 - DNA, 20 bp, Artificial Sequence
  chemically synthesized
gggtctgtagaaaaggaaga

SEQ ID NO: 531069 - DNA, 20 bp, Artificial Sequence
  chemically synthesized
gggagaggtcagatgggtct

SEQ ID NO: 531070 - DNA, 20 bp, Artificial Sequence
  chemically synthesized
aacgctatctgatttgggat

SEQ ID NO: 531071 - DNA, 20 bp, Artificial Sequence
  chemically synthesized
ttgggtaataaaatatatat

SEQ ID NO: 531072 - DNA, 20 bp, Artificial Sequence
  chemically synthesized
tggagggaaggaattgcaac

SEQ ID NO: 531073 - DNA, 20 bp, Artificial Sequence
  chemically synthesized
tgcagctgcgaggggttcct

SEQ ID NO: 531074 - DNA, 20 bp, Artificial Sequence
  chemically synthesized
ccaggagcttgctacaagtg

SEQ ID NO: 531075 - DNA, 20 bp, Artificial Sequence
  chemically synthesized
aagcatgtttgagatccaga

SEQ ID NO: 531076 - DNA, 20 bp, Artificial Sequence
  chemically synthesized
gaagggtgcaaaggaatagt

SEQ ID NO: 531077 - DNA, 20 bp, Artificial Sequence
  chemically synthesized
cgagataggtaacaggtgag

SEQ ID NO: 531078 - DNA, 20 bp, Artificial Sequence
  chemically synthesized
ggagagcacgtgtgttttta

SEQ ID NO: 531079 - DNA, 20 bp, Artificial Sequence
  chemically synthesized
ctcccaaaccccaatccctt

SEQ ID NO: 531080 - DNA, 20 bp, Artificial Sequence
  chemically synthesized
acgtgatcccagtccttatg

SEQ ID NO: 531081 - DNA, 20 bp, Artificial Sequence
  chemically synthesized
gcatatgcgtcaggtgtgag

SEQ ID NO: 531082 - DNA, 20 bp, Artificial Sequence
  chemically synthesized
acagctgaaggagccgggga

SEQ ID NO: 531083 - DNA, 20 bp, Artificial Sequence
  chemically synthesized
catcgtggaaatctatcctc

SEQ ID NO: 531084 - DNA, 20 bp, Artificial Sequence
  chemically synthesized
tgaataatccctgaggagta

SEQ ID NO: 531085 - DNA, 20 bp, Artificial Sequence
  chemically synthesized
ttactaaacatgccccgagt

SEQ ID NO: 531086 - DNA, 20 bp, Artificial Sequence
  chemically synthesized
ttcactgaatactaagagcc

SEQ ID NO: 531087 - DNA, 20 bp, Artificial Sequence
  chemically synthesized
acttttaccacttgcccttc

SEQ ID NO: 531088 - DNA, 20 bp, Artificial Sequence
  chemically synthesized
ctcagaattcaggcctgtcc

SEQ ID NO: 531089 - DNA, 20 bp, Artificial Sequence
  chemically synthesized
gatatcagctgtgatggctt

SEQ ID NO: 531090 - DNA, 20 bp, Artificial Sequence
  chemically synthesized
aaaaacaggtattaaaggac

SEQ ID NO: 531091 - DNA, 20 bp, Artificial Sequence
  chemically synthesized
aactaaacggaataagagaa

SEQ ID NO: 531092 - DNA, 20 bp, Artificial Sequence
  chemically synthesized
ttagaagaaacatttgtcat

SEQ ID NO: 531093 - DNA, 20 bp, Artificial Sequence
  chemically synthesized
gtgatattgtggggttgtta

SEQ ID NO: 531094 - DNA, 20 bp, Artificial Sequence
  chemically synthesized
gatccacctcgaagcagccc

SEQ ID NO: 531095 - DNA, 20 bp, Artificial Sequence
  chemically synthesized
ttcctgtcttcttatattaa

SEQ ID NO: 531096 - DNA, 20 bp, Artificial Sequence
  chemically synthesized
agagacccgccctcttctgt

SEQ ID NO: 531097 - DNA, 20 bp, Artificial Sequence
  chemically synthesized
acaaaatcacaaccaaaaag

SEQ ID NO: 531098 - DNA, 20 bp, Artificial Sequence
  chemically synthesized
gtctacatttcagggttttt

SEQ ID NO: 531099 - DNA, 20 bp, Artificial Sequence
  chemically synthesized
caggtttgttgtttttgagg

SEQ ID NO: 531100 - DNA, 20 bp, Artificial Sequence
  chemically synthesized
cagagctttccacatcatgg

SEQ ID NO: 531101 - DNA, 20 bp, Artificial Sequence
  chemically synthesized
cactcagagaagatcctatt

SEQ ID NO: 531102 - DNA, 20 bp, Artificial Sequence
  chemically synthesized
gctgcaatttaactcagagc

SEQ ID NO: 531103 - DNA, 20 bp, Artificial Sequence
  chemically synthesized
acatcctacgcacatcgttg

SEQ ID NO: 531104 - DNA, 20 bp, Artificial Sequence
  chemically synthesized
cattttaagaacagacttga

SEQ ID NO: 531105 - DNA, 20 bp, Artificial Sequence
  chemically synthesized
ggcaaacttccaaagtccct

SEQ ID NO: 531106 - DNA, 20 bp, Artificial Sequence
  chemically synthesized
gaatacacaggtctcaatga

SEQ ID NO: 531107 - DNA, 20 bp, Artificial Sequence
  chemically synthesized
ccttcatgtaggaattttga

SEQ ID NO: 531108 - DNA, 20 bp, Artificial Sequence
  chemically synthesized
atagtagatgtaccagcaga

SEQ ID NO: 531109 - DNA, 20 bp, Artificial Sequence
  chemically synthesized
atgtgtacctacaaaaatta

SEQ ID NO: 531110 - DNA, 20 bp, Artificial Sequence
  chemically synthesized
tatattaagagatgatgttc

SEQ ID NO: 531111 - DNA, 20 bp, Artificial Sequence
  chemically synthesized
gaggtaccatctcacaccag

SEQ ID NO: 531112 - DNA, 20 bp, Artificial Sequence
  chemically synthesized
acagatgccagagaggatgt

SEQ ID NO: 531113 - DNA, 20 bp, Artificial Sequence
  chemically synthesized
aattcctcaaggatctagaa

SEQ ID NO: 531114 - DNA, 20 bp, Artificial Sequence
  chemically synthesized
ccatcaatgatagactggat

SEQ ID NO: 531115 - DNA, 20 bp, Artificial Sequence
  chemically synthesized
ctgtccttgtgatagtttgc

SEQ ID NO: 531116 - DNA, 20 bp, Artificial Sequence
  chemically synthesized
ctcagcaaactatcacaagg

SEQ ID NO: 531117 - DNA, 20 bp, Artificial Sequence
  chemically synthesized
tattttcagttttctgtttt

SEQ ID NO: 531118 - DNA, 20 bp, Artificial Sequence
  chemically synthesized
gggaaggcattttctgaaaa

SEQ ID NO: 531119 - DNA, 20 bp, Artificial Sequence
  chemically synthesized
gttagacctccctcccatat

SEQ ID NO: 531120 - DNA, 20 bp, Artificial Sequence
  chemically synthesized
tctaatccatctctgtgttt

SEQ ID NO: 531121 - DNA, 20 bp, Artificial Sequence
  chemically synthesized
gaacacctgagtatatgtgt

SEQ ID NO: 531122 - DNA, 20 bp, Artificial Sequence
  chemically synthesized
aatgtgccttttaaaaaatg

SEQ ID NO: 531123 - DNA, 20 bp, Artificial Sequence
  chemically synthesized
tatttaatgtgatatctggg

SEQ ID NO: 531124 - DNA, 20 bp, Artificial Sequence
  chemically synthesized
tctgtctcaaacaaaaaaaa

SEQ ID NO: 531125 - DNA, 20 bp, Artificial Sequence
  chemically synthesized
agctgattatataacattta

SEQ ID NO: 531126 - DNA, 20 bp, Artificial Sequence
  chemically synthesized
aaaaaaaaccgaaaaacaaa

SEQ ID NO: 531127 - DNA, 20 bp, Artificial Sequence
  chemically synthesized
ctactcgggaggctgaggca

SEQ ID NO: 531128 - DNA, 20 bp, Artificial Sequence
  chemically synthesized
cctatcatctgtcttcttta

SEQ ID NO: 531129 - DNA, 20 bp, Artificial Sequence
  chemically synthesized
gtgttaaaccagattacacc

SEQ ID NO: 531130 - DNA, 20 bp, Artificial Sequence
  chemically synthesized
tctggtttaacacaccaagt

SEQ ID NO: 531131 - DNA, 20 bp, Artificial Sequence
  chemically synthesized
aacacaccaagttgagaatc

SEQ ID NO: 531132 - DNA, 20 bp, Artificial Sequence
  chemically synthesized
ctcaatacctcattttgaag

SEQ ID NO: 531133 - DNA, 20 bp, Artificial Sequence
  chemically synthesized
ctgcttgggaggctgaggca

SEQ ID NO: 531134 - DNA, 20 bp, Artificial Sequence
  chemically synthesized
tattaggaaaagttaaactt

SEQ ID NO: 531135 - DNA, 20 bp, Artificial Sequence
  chemically synthesized
agaaaatttgcaaaagtagt

SEQ ID NO: 531136 - DNA, 20 bp, Artificial Sequence
  chemically synthesized
aggaaattagtttgcctgcc

SEQ ID NO: 531137 - DNA, 20 bp, Artificial Sequence
  chemically synthesized
ttggataaaatggcttaaaa

SEQ ID NO: 531138 - DNA, 20 bp, Artificial Sequence
  chemically synthesized
acaagagacttttaaacttc

SEQ ID NO: 531139 - DNA, 20 bp, Artificial Sequence
  chemically synthesized
cacctcctgttatttataag

SEQ ID NO: 531140 - DNA, 20 bp, Artificial Sequence
  chemically synthesized
tttctaccattggtattaaa

SEQ ID NO: 531141 - DNA, 20 bp, Artificial Sequence
  chemically synthesized
tttctcatttaataccaatg

SEQ ID NO: 531142 - DNA, 20 bp, Artificial Sequence
  chemically synthesized
atggataatctgtgattata

SEQ ID NO: 531143 - DNA, 20 bp, Artificial Sequence
  chemically synthesized
gtgaagtagggcacagaagt

SEQ ID NO: 531144 - DNA, 20 bp, Artificial Sequence
  chemically synthesized
aaaggtgctttgtgaaatgt

SEQ ID NO: 531145 - DNA, 20 bp, Artificial Sequence
  chemically synthesized
aaacctgatcttaggatatt

SEQ ID NO: 531146 - DNA, 20 bp, Artificial Sequence
  chemically synthesized
gatattcaagaaaattgacc

SEQ ID NO: 531147 - DNA, 20 bp, Artificial Sequence
  chemically synthesized
aaggattcttaaagtatatt

SEQ ID NO: 531148 - DNA, 20 bp, Artificial Sequence
  chemically synthesized
tgcatttctccaatatactt

SEQ ID NO: 531149 - DNA, 20 bp, Artificial Sequence
  chemically synthesized
cagactaaactaaacagatg

SEQ ID NO: 531150 - DNA, 20 bp, Artificial Sequence
  chemically synthesized
agctgtcatgagggcttgct

SEQ ID NO: 531151 - DNA, 20 bp, Artificial Sequence
  chemically synthesized
gccctcatgacagctgagcc

SEQ ID NO: 531152 - DNA, 20 bp, Artificial Sequence
  chemically synthesized
ggatgttaattgatacttga

SEQ ID NO: 531153 - DNA, 20 bp, Artificial Sequence
  chemically synthesized
aatcaaaagaatatgacatc

SEQ ID NO: 531154 - DNA, 20 bp, Artificial Sequence
  chemically synthesized
gagaagtcagtcaaaaatca

SEQ ID NO: 531155 - DNA, 20 bp, Artificial Sequence
  chemically synthesized
gaccaaaccttgataaactt

SEQ ID NO: 531156 - DNA, 20 bp, Artificial Sequence
  chemically synthesized
caaaatggaatttagagcat

SEQ ID NO: 531157 - DNA, 20 bp, Artificial Sequence
  chemically synthesized
acccgagctagaagcgtaaa

SEQ ID NO: 531158 - DNA, 20 bp, Artificial Sequence
  chemically synthesized
gatggcggcaatggaaatag

SEQ ID NO: 531159 - DNA, 20 bp, Artificial Sequence
  chemically synthesized
catttgcagttgtcttgatg

SEQ ID NO: 531160 - DNA, 20 bp, Artificial Sequence
  chemically synthesized
agtttattttatgggtaagc

SEQ ID NO: 531161 - DNA, 20 bp, Artificial Sequence
  chemically synthesized
acaaagaataggctactttg

SEQ ID NO: 531162 - DNA, 20 bp, Artificial Sequence
  chemically synthesized
gtgagaaatgttatgaagac

SEQ ID NO: 531163 - DNA, 20 bp, Artificial Sequence
  chemically synthesized
taaaataaaaagaaaaatag

SEQ ID NO: 531164 - DNA, 20 bp, Artificial Sequence
  chemically synthesized
aaaaaataaaaataaaataa

SEQ ID NO: 531165 - DNA, 20 bp, Artificial Sequence
  chemically synthesized
ctacttaagaggctgaggcc

SEQ ID NO: 531166 - DNA, 20 bp, Artificial Sequence
  chemically synthesized
taatatattattaaaaatag

SEQ ID NO: 531167 - DNA, 20 bp, Artificial Sequence
  chemically synthesized
tattgtctggcacaaaatag

SEQ ID NO: 531168 - DNA, 20 bp, Artificial Sequence
  chemically synthesized
ctactcaggaggctgaggca

SEQ ID NO: 531169 - DNA, 20 bp, Artificial Sequence
  chemically synthesized
acacatttagtaggaaaaat

SEQ ID NO: 531170 - DNA, 20 bp, Artificial Sequence
  chemically synthesized
tgtggaaatagataatcact

SEQ ID NO: 531171 - DNA, 20 bp, Artificial Sequence
  chemically synthesized
catctacctgcaagggaaac

SEQ ID NO: 531172 - DNA, 20 bp, Artificial Sequence
  chemically synthesized
tattagctcaacagtttcat

SEQ ID NO: 531173 - DNA, 20 bp, Artificial Sequence
  chemically synthesized
tctcacataataggaattta

SEQ ID NO: 531174 - DNA, 20 bp, Artificial Sequence
  chemically synthesized
tctcttaaattcctattatg

SEQ ID NO: 531175 - DNA, 20 bp, Artificial Sequence
  chemically synthesized
gcttcctagagtacccagat

SEQ ID NO: 531176 - DNA, 20 bp, Artificial Sequence
  chemically synthesized
tatgcacacatgcacactgg

SEQ ID NO: 531177 - DNA, 20 bp, Artificial Sequence
  chemically synthesized
gttttcattatttcaaagac

SEQ ID NO: 531178 - DNA, 20 bp, Artificial Sequence
  chemically synthesized
ttttgtgatgcctcagagag

SEQ ID NO: 531179 - DNA, 20 bp, Artificial Sequence
  chemically synthesized
aagcttttgtgatgcctcag

SEQ ID NO: 531180 - DNA, 20 bp, Artificial Sequence
  chemically synthesized
gaggcatcacaaaagcttcc

SEQ ID NO: 531181 - DNA, 20 bp, Artificial Sequence
  chemically synthesized
aagcttccatagaaacagat

SEQ ID NO: 531182 - DNA, 20 bp, Artificial Sequence
  chemically synthesized
atagagaatgaatgtcacac

SEQ ID NO: 531183 - DNA, 20 bp, Artificial Sequence
  chemically synthesized
ccaagaataggaaataaagc

SEQ ID NO: 531184 - DNA, 20 bp, Artificial Sequence
  chemically synthesized
aatgatatgtggagatgatg

SEQ ID NO: 531185 - DNA, 20 bp, Artificial Sequence
  chemically synthesized
agatgcagttcagtttttta

SEQ ID NO: 531186 - DNA, 20 bp, Artificial Sequence
  chemically synthesized
catgagccaccatgcccagc

SEQ ID NO: 531187 - DNA, 20 bp, Artificial Sequence
  chemically synthesized
tcctatggaatatttgattt

SEQ ID NO: 531188 - DNA, 20 bp, Artificial Sequence
  chemically synthesized
tgatgagcattcacatatca

SEQ ID NO: 531189 - DNA, 20 bp, Artificial Sequence
  chemically synthesized
cgtcatcatcatatcaacaa

SEQ ID NO: 531190 - DNA, 20 bp, Artificial Sequence
  chemically synthesized
cagactctaagcttaaaaat

SEQ ID NO: 531191 - DNA, 20 bp, Artificial Sequence
  chemically synthesized
aaactagcgttcttatcagc

SEQ ID NO: 531192 - DNA, 20 bp, Artificial Sequence
  chemically synthesized
tagcaaatattgacatagct

SEQ ID NO: 531193 - DNA, 20 bp, Artificial Sequence
  chemically synthesized
atggatatcatgtgtcataa

SEQ ID NO: 531194 - DNA, 20 bp, Artificial Sequence
  chemically synthesized
tataacatttgtatgcaact

SEQ ID NO: 531195 - DNA, 20 bp, Artificial Sequence
  chemically synthesized
gagatatgaagattgtgata

SEQ ID NO: 531196 - DNA, 20 bp, Artificial Sequence
  chemically synthesized
gatggaaaggtttatgcgca

SEQ ID NO: 531197 - DNA, 20 bp, Artificial Sequence
  chemically synthesized
gctgtagctctgttctcttt

SEQ ID NO: 531198 - DNA, 20 bp, Artificial Sequence
  chemically synthesized
ttcaaatgctatcaatggaa

SEQ ID NO: 531199 - DNA, 20 bp, Artificial Sequence
  chemically synthesized
aaaaatatttttaaggtagt

SEQ ID NO: 531200 - DNA, 20 bp, Artificial Sequence
  chemically synthesized
ggaatatcgatttaattgta

SEQ ID NO: 531201 - DNA, 20 bp, Artificial Sequence
  chemically synthesized
ctactcaggaggctgaggca

SEQ ID NO: 531202 - DNA, 20 bp, Artificial Sequence
  chemically synthesized
aaaaaaatctgtatttaagt

SEQ ID NO: 531203 - DNA, 20 bp, Artificial Sequence
  chemically synthesized
tcctcaaaggaaaaacaaaa

SEQ ID NO: 531204 - DNA, 20 bp, Artificial Sequence
  chemically synthesized
tggcagctctactagagtca

SEQ ID NO: 531205 - DNA, 20 bp, Artificial Sequence
  chemically synthesized
cactcaggaagctgacaaag

SEQ ID NO: 531206 - DNA, 20 bp, Artificial Sequence
  chemically synthesized
agtaatttgaaaactaggtc

SEQ ID NO: 531207 - DNA, 20 bp, Artificial Sequence
  chemically synthesized
tctttatttaaaagatactc

SEQ ID NO: 531208 - DNA, 20 bp, Artificial Sequence
  chemically synthesized
tttataaagccaaaaatttc

SEQ ID NO: 531209 - DNA, 20 bp, Artificial Sequence
  chemically synthesized
tcccattttattggctgggg

SEQ ID NO: 531210 - DNA, 20 bp, Artificial Sequence
  chemically synthesized
tatgaatccttctaaacaat

SEQ ID NO: 531211 - DNA, 20 bp, Artificial Sequence
  chemically synthesized
aagggccctgtatcagagta

SEQ ID NO: 531212 - DNA, 20 bp, Artificial Sequence
  chemically synthesized
ctactcaggaggctgaggca

SEQ ID NO: 531213 - DNA, 20 bp, Artificial Sequence
  chemically synthesized
ctgggatttcctttgtctaa

SEQ ID NO: 531214 - DNA, 20 bp, Artificial Sequence
  chemically synthesized
acagtccaggattgaaagca

SEQ ID NO: 531215 - DNA, 20 bp, Artificial Sequence
  chemically synthesized
catacagtctcctcagagat

SEQ ID NO: 531216 - DNA, 20 bp, Artificial Sequence
  chemically synthesized
gagattgagaaaggtcaata

SEQ ID NO: 531217 - DNA, 20 bp, Artificial Sequence
  chemically synthesized
cagtttttgaatgattttcc

SEQ ID NO: 531218 - DNA, 20 bp, Artificial Sequence
  chemically synthesized
acctccagggtgctgaaaat

SEQ ID NO: 531219 - DNA, 20 bp, Artificial Sequence
  chemically synthesized
tctaatgcaatcaataaaat

SEQ ID NO: 531220 - DNA, 20 bp, Artificial Sequence
  chemically synthesized
tttatgtggctctctattga

SEQ ID NO: 531221 - DNA, 20 bp, Artificial Sequence
  chemically synthesized
tgatgagaaaagtcttccta

SEQ ID NO: 531222 - DNA, 20 bp, Artificial Sequence
  chemically synthesized
ttttatcatagctaagagca

SEQ ID NO: 531223 - DNA, 20 bp, Artificial Sequence
  chemically synthesized
actcatctctttggtatcat

SEQ ID NO: 531224 - DNA, 20 bp, Artificial Sequence
  chemically synthesized
aatgatgtctcagggatgac

SEQ ID NO: 531225 - DNA, 20 bp, Artificial Sequence
  chemically synthesized
acaagtgaggcttccttgtc

SEQ ID NO: 531226 - DNA, 20 bp, Artificial Sequence
  chemically synthesized
agctatttcctctttttaag

SEQ ID NO: 531227 - DNA, 20 bp, Artificial Sequence
  chemically synthesized
tctgcaacgatatgggatgg

SEQ ID NO: 531228 - DNA, 20 bp, Artificial Sequence
  chemically synthesized
aaagcgaacaggaggaccgt

SEQ ID NO: 531229 - DNA, 20 bp, Artificial Sequence
  chemically synthesized
ccaacggagatgtgaaattt

SEQ ID NO: 531230 - DNA, 20 bp, Artificial Sequence
  chemically synthesized
atgtaacttgacttatgtgc

SEQ ID NO: 531231 - DNA, 20 bp, Artificial Sequence
  chemically synthesized
ttatgtgctaagaataatgc

SEQ ID NO: 531232 - DNA, 20 bp, Artificial Sequence
  chemically synthesized
atgcctcagtttcctcatca

SEQ ID NO: 531233 - DNA, 20 bp, Artificial Sequence
  chemically synthesized
gattgaggttggcaaagcag

SEQ ID NO: 531234 - DNA, 20 bp, Artificial Sequence
  chemically synthesized
ggcaaagcagacagaatctg

SEQ ID NO: 531235 - DNA, 20 bp, Artificial Sequence
  chemically synthesized
tggactggctcagagttgaa

SEQ ID NO: 531236 - DNA, 20 bp, Artificial Sequence
  chemically synthesized
tttataagggctttccaggc

SEQ ID NO: 531237 - DNA, 20 bp, Artificial Sequence
  chemically synthesized
tattttcaaaggcatgaagc

SEQ ID NO: 531238 - DNA, 20 bp, Artificial Sequence
  chemically synthesized
tctacaacacattttttcaa

SEQ ID NO: 531239 - DNA, 20 bp, Artificial Sequence
  chemically synthesized
cactttgagaggccaagaca

SEQ ID NO: 531240 - DNA, 20 bp, Artificial Sequence
  chemically synthesized
agcaagatctcatctctaaa

SEQ ID NO: 531241 - DNA, 20 bp, Artificial Sequence
  chemically synthesized
ggaggagaagcagatggatg

SEQ ID NO: 531242 - DNA, 20 bp, Artificial Sequence
  chemically synthesized
ggggacctgccctcttctgc

SEQ ID NO: 531243 - DNA, 20 bp, Artificial Sequence
  chemically synthesized
atggatactgacctggaggg

SEQ ID NO: 531244 - DNA, 20 bp, Artificial Sequence
  chemically synthesized
gccaaatcattaatagtcac

SEQ ID NO: 531245 - DNA, 20 bp, Artificial Sequence
  chemically synthesized
ttagatataagagtcagcaa

SEQ ID NO: 531246 - DNA, 20 bp, Artificial Sequence
  chemically synthesized
attaatgatgtcattgcaat

SEQ ID NO: 531247 - DNA, 20 bp, Artificial Sequence
  chemically synthesized
attgcaatgacatcattaat

SEQ ID NO: 531248 - DNA, 20 bp, Artificial Sequence
  chemically synthesized
gagcagagggatgactttga

SEQ ID NO: 531249 - DNA, 20 bp, Artificial Sequence
  chemically synthesized
aaaggcgaatcagatactca

SEQ ID NO: 531250 - DNA, 20 bp, Artificial Sequence
  chemically synthesized
gaagtttattttgccaaggt

SEQ ID NO: 531251 - DNA, 20 bp, Artificial Sequence
  chemically synthesized
ttcgtctttatcttcctctg

SEQ ID NO: 531252 - DNA, 20 bp, Artificial Sequence
  chemically synthesized
gtcctgctaagtcgaaaagc

SEQ ID NO: 531253 - DNA, 20 bp, Artificial Sequence
  chemically synthesized
ttcctgcccactggagccaa

SEQ ID NO: 531254 - DNA, 20 bp, Artificial Sequence
  chemically synthesized
agggtcgaatcctgccttag

SEQ ID NO: 531255 - DNA, 20 bp, Artificial Sequence
  chemically synthesized
tctcagaatttaaagggatt

SEQ ID NO: 531256 - DNA, 20 bp, Artificial Sequence
  chemically synthesized
cgtgcttctgccatgcaatc

SEQ ID NO: 531257 - DNA, 20 bp, Artificial Sequence
  chemically synthesized
ttttaaagcaacaggaaacc

SEQ ID NO: 531258 - DNA, 20 bp, Artificial Sequence
  chemically synthesized
tttagagttgcttgatgtcg

SEQ ID NO: 531259 - DNA, 20 bp, Artificial Sequence
  chemically synthesized
gtcgttagaaatattgaatg

SEQ ID NO: 531260 - DNA, 20 bp, Artificial Sequence
  chemically synthesized
ggaatatttatttaattgga

SEQ ID NO: 531261 - DNA, 20 bp, Artificial Sequence
  chemically synthesized
tttatttaattggataagaa

SEQ ID NO: 531262 - DNA, 20 bp, Artificial Sequence
  chemically synthesized
aaaactttgttcaaaaattt

SEQ ID NO: 531263 - DNA, 20 bp, Artificial Sequence
  chemically synthesized
cctatgttacagggttgtta

SEQ ID NO: 531264 - DNA, 20 bp, Artificial Sequence
  chemically synthesized
gtatgaatcctctctaccac

SEQ ID NO: 531265 - DNA, 20 bp, Artificial Sequence
  chemically synthesized
tgaaagttctctgtaaaggg

SEQ ID NO: 531266 - DNA, 20 bp, Artificial Sequence
  chemically synthesized
gatttatgtgttcctcaaag

SEQ ID NO: 531267 - DNA, 20 bp, Artificial Sequence
  chemically synthesized
taagttgtacgaaacccaaa

SEQ ID NO: 531268 - DNA, 20 bp, Artificial Sequence
  chemically synthesized
actgaaacacaaatacaagg

SEQ ID NO: 531269 - DNA, 20 bp, Artificial Sequence
  chemically synthesized
ggggcagggagggactggaa

SEQ ID NO: 531270 - DNA, 20 bp, Artificial Sequence
  chemically synthesized
gagcttggcttacttagaga

SEQ ID NO: 531271 - DNA, 20 bp, Artificial Sequence
  chemically synthesized
ctctttcttttggcagtttc

SEQ ID NO: 531272 - DNA, 20 bp, Artificial Sequence
  chemically synthesized
aaaattctaggaaactgcca

SEQ ID NO: 531273 - DNA, 20 bp, Artificial Sequence
  chemically synthesized
aaactgccaaaagaaagagc

SEQ ID NO: 531274 - DNA, 20 bp, Artificial Sequence
  chemically synthesized
ttgagggaacgatttctgaa

SEQ ID NO: 531275 - DNA, 20 bp, Artificial Sequence
  chemically synthesized
cccttctgttcaattctttt

SEQ ID NO: 531276 - DNA, 20 bp, Artificial Sequence
  chemically synthesized
ttgctgagagcagtaagaca

SEQ ID NO: 531277 - DNA, 20 bp, Artificial Sequence
  chemically synthesized
gaatgactcttaactggctc

SEQ ID NO: 531278 - DNA, 20 bp, Artificial Sequence
  chemically synthesized
ttaactggctcagagaaaga

SEQ ID NO: 531279 - DNA, 20 bp, Artificial Sequence
  chemically synthesized
gaaagatcagaaaatgtata

SEQ ID NO: 531280 - DNA, 20 bp, Artificial Sequence
  chemically synthesized
acgtgatcgtttctggctcc

SEQ ID NO: 531281 - DNA, 20 bp, Artificial Sequence
  chemically synthesized
tgtttccttattctttggag

SEQ ID NO: 531282 - DNA, 20 bp, Artificial Sequence
  chemically synthesized
aataaggaaacatgggaaat

SEQ ID NO: 531283 - DNA, 20 bp, Artificial Sequence
  chemically synthesized
aaatatgaagaagtatgagg

SEQ ID NO: 531284 - DNA, 20 bp, Artificial Sequence
  chemically synthesized
atttgggttgcctatttaga

SEQ ID NO: 531285 - DNA, 20 bp, Artificial Sequence
  chemically synthesized
tgcctcctagtacaattgga

SEQ ID NO: 531286 - DNA, 20 bp, Artificial Sequence
  chemically synthesized
tatcactaggaaaagacata

SEQ ID NO: 531287 - DNA, 20 bp, Artificial Sequence
  chemically synthesized
aagacatagaagaattactt

SEQ ID NO: 531288 - DNA, 20 bp, Artificial Sequence
  chemically synthesized
cactgaacttgacacgaaga

SEQ ID NO: 531289 - DNA, 20 bp, Artificial Sequence
  chemically synthesized
ccagatactacatgctctca

SEQ ID NO: 531290 - DNA, 20 bp, Artificial Sequence
  chemically synthesized
tttaaaatgaatcacatagt

SEQ ID NO: 531291 - DNA, 20 bp, Artificial Sequence
  chemically synthesized
gatctagatgtgtcctttcc

SEQ ID NO: 531292 - DNA, 20 bp, Artificial Sequence
  chemically synthesized
tttttttcacatacataaaa

SEQ ID NO: 531293 - DNA, 20 bp, Artificial Sequence
  chemically synthesized
tatataaactcatattcatt

SEQ ID NO: 531294 - DNA, 20 bp, Artificial Sequence
  chemically synthesized
ctccttaatactgggtacaa

SEQ ID NO: 531295 - DNA, 20 bp, Artificial Sequence
  chemically synthesized
caaaaagaaaaataagttta

SEQ ID NO: 531296 - DNA, 20 bp, Artificial Sequence
  chemically synthesized
attgaaatgaggtcaactaa

SEQ ID NO: 531297 - DNA, 20 bp, Artificial Sequence
  chemically synthesized
agtgatttcaaaatagaatt

SEQ ID NO: 531298 - DNA, 20 bp, Artificial Sequence
  chemically synthesized
acataggcagtgatttcaaa

SEQ ID NO: 531299 - DNA, 20 bp, Artificial Sequence
  chemically synthesized
ttcattttcataagatcatc

SEQ ID NO: 531300 - DNA, 20 bp, Artificial Sequence
  chemically synthesized
tatatataaggctattttgc

SEQ ID NO: 531301 - DNA, 20 bp, Artificial Sequence
  chemically synthesized
ggctgggggtaggaagggag

SEQ ID NO: 531302 - DNA, 20 bp, Artificial Sequence
  chemically synthesized
cactacgtatgtatgtcaat

SEQ ID NO: 531303 - DNA, 20 bp, Artificial Sequence
  chemically synthesized
cttctaaagtaaccccatgg

SEQ ID NO: 531304 - DNA, 20 bp, Artificial Sequence
  chemically synthesized
tttatgtgtgaatgaatttg

SEQ ID NO: 531305 - DNA, 20 bp, Artificial Sequence
  chemically synthesized
gaaggctgtggctacaaaac

SEQ ID NO: 531306 - DNA, 20 bp, Artificial Sequence
  chemically synthesized
ggcgcccacacaaatgaaat

SEQ ID NO: 531307 - DNA, 20 bp, Artificial Sequence
  chemically synthesized
cacatggtggatggttgtaa

SEQ ID NO: 531308 - DNA, 20 bp, Artificial Sequence
  chemically synthesized
cagaatatatattgactaat

SEQ ID NO: 531309 - DNA, 20 bp, Artificial Sequence
  chemically synthesized
aaatttgcagaatgtaacct

SEQ ID NO: 531310 - DNA, 20 bp, Artificial Sequence
  chemically synthesized
ttttgtccatgttcaaattt

SEQ ID NO: 531311 - DNA, 20 bp, Artificial Sequence
  chemically synthesized
acagatgtcttggagagatt

SEQ ID NO: 531312 - DNA, 20 bp, Artificial Sequence
  chemically synthesized
tcaccaggaggctgaatgtc

SEQ ID NO: 531313 - DNA, 20 bp, Artificial Sequence
  chemically synthesized
attgcatttagatggacaag

SEQ ID NO: 531314 - DNA, 20 bp, Artificial Sequence
  chemically synthesized
tcagcaatttacacttaaat

SEQ ID NO: 531315 - DNA, 20 bp, Artificial Sequence
  chemically synthesized
gaaaggaggtatggatgtga

SEQ ID NO: 531316 - DNA, 20 bp, Artificial Sequence
  chemically synthesized
aatgaatgatcttcagatga

SEQ ID NO: 531317 - DNA, 20 bp, Artificial Sequence
  chemically synthesized
tgtgaaataatgtcaattag

SEQ ID NO: 531318 - DNA, 20 bp, Artificial Sequence
  chemically synthesized
gactctcggcactattcctg

SEQ ID NO: 531319 - DNA, 20 bp, Artificial Sequence
  chemically synthesized
tggaagaataaccaccatgc

SEQ ID NO: 531320 - DNA, 20 bp, Artificial Sequence
  chemically synthesized
agttctgggaaacaatggcc

SEQ ID NO: 531321 - DNA, 20 bp, Artificial Sequence
  chemically synthesized
attaagatttcagttgtgct

SEQ ID NO: 531322 - DNA, 20 bp, Artificial Sequence
  chemically synthesized
actacaattatatcatctga

SEQ ID NO: 531323 - DNA, 20 bp, Artificial Sequence
  chemically synthesized
acaggcaatgaaaaattaga

SEQ ID NO: 531324 - DNA, 20 bp, Artificial Sequence
  chemically synthesized
ggcaatggttgataaatctg

SEQ ID NO: 531325 - DNA, 20 bp, Artificial Sequence
  chemically synthesized
ttaaagggacaaaagggtgc

SEQ ID NO: 531326 - DNA, 20 bp, Artificial Sequence
  chemically synthesized
agcacccttttgtcccttta

SEQ ID NO: 531327 - DNA, 20 bp, Artificial Sequence
  chemically synthesized
ttccagcaaaatcaaaagta

SEQ ID NO: 531328 - DNA, 20 bp, Artificial Sequence
  chemically synthesized
gttcaaaaatcccaactttt

SEQ ID NO: 531329 - DNA, 20 bp, Artificial Sequence
  chemically synthesized
cataagttgactcaaattaa

SEQ ID NO: 531330 - DNA, 20 bp, Artificial Sequence
  chemically synthesized
aagaaagagctacaaaatat

SEQ ID NO: 531331 - DNA, 20 bp, Artificial Sequence
  chemically synthesized
cggctaaacaggtgatttag

SEQ ID NO: 531332 - DNA, 20 bp, Artificial Sequence
  chemically synthesized
atcacctgtttagccgaagt

SEQ ID NO: 531333 - DNA, 20 bp, Artificial Sequence
  chemically synthesized
tgtatagaatttcagaggcc

SEQ ID NO: 531334 - DNA, 20 bp, Artificial Sequence
  chemically synthesized
tagtacttttgagaacctgt

SEQ ID NO: 531335 - DNA, 20 bp, Artificial Sequence
  chemically synthesized
cagatataaaggttttatac

SEQ ID NO: 531336 - DNA, 20 bp, Artificial Sequence
  chemically synthesized
ttgaacatattaataccaaa

SEQ ID NO: 531337 - DNA, 20 bp, Artificial Sequence
  chemically synthesized
gataatgaaaatacgagtag

SEQ ID NO: 531338 - DNA, 20 bp, Artificial Sequence
  chemically synthesized
acctaaaataaaagctaaaa

SEQ ID NO: 531339 - DNA, 20 bp, Artificial Sequence
  chemically synthesized
gctaaaaaaagaaaatacaa

SEQ ID NO: 531340 - DNA, 20 bp, Artificial Sequence
  chemically synthesized
gaaaagtaatattattaata

SEQ ID NO: 531341 - DNA, 20 bp, Artificial Sequence
  chemically synthesized
gtggaattggtgttccaggt

SEQ ID NO: 531342 - DNA, 20 bp, Artificial Sequence
  chemically synthesized
aactcaaagattattgggta

SEQ ID NO: 531343 - DNA, 20 bp, Artificial Sequence
  chemically synthesized
accaacttcgtgaggctttt

SEQ ID NO: 531344 - DNA, 20 bp, Artificial Sequence
  chemically synthesized
ctatcaatggagtggattga

SEQ ID NO: 531345 - DNA, 20 bp, Artificial Sequence
  chemically synthesized
tagttggcatgtagtttgta

SEQ ID NO: 531346 - DNA, 20 bp, Artificial Sequence
  chemically synthesized
tattaataccataaacacca

SEQ ID NO: 531347 - DNA, 20 bp, Artificial Sequence
  chemically synthesized
aagaatatagtgccatcatc

SEQ ID NO: 531348 - DNA, 20 bp, Artificial Sequence
  chemically synthesized
ttttgaatatcataggcatc

SEQ ID NO: 531349 - DNA, 20 bp, Artificial Sequence
  chemically synthesized
ctactacggaggctgaggca

SEQ ID NO: 531350 - DNA, 20 bp, Artificial Sequence
  chemically synthesized
agactctgtctcaaaaaaaa

SEQ ID NO: 531351 - DNA, 20 bp, Artificial Sequence
  chemically synthesized
ctactcgggaggctgaggca

SEQ ID NO: 531352 - DNA, 20 bp, Artificial Sequence
  chemically synthesized
gcaggagaaagaggcttaat

SEQ ID NO: 531353 - DNA, 20 bp, Artificial Sequence
  chemically synthesized
ttcaggagatatgtttcgca

SEQ ID NO: 531354 - DNA, 20 bp, Artificial Sequence
  chemically synthesized
aaacatatctcctgaagcat

SEQ ID NO: 531355 - DNA, 20 bp, Artificial Sequence
  chemically synthesized
attaaaaaaaaaaaaagttt

SEQ ID NO: 531356 - DNA, 20 bp, Artificial Sequence
  chemically synthesized
atcccagctacactgaggca

SEQ ID NO: 531357 - DNA, 20 bp, Artificial Sequence
  chemically synthesized
tggtccttgtgatagtttgc

SEQ ID NO: 531358 - DNA, 20 bp, Artificial Sequence
  chemically synthesized
tcaaagagcacatatacacc

SEQ ID NO: 531359 - DNA, 20 bp, Artificial Sequence
  chemically synthesized
catctggagggagtaaacgc

SEQ ID NO: 531360 - DNA, 20 bp, Artificial Sequence
  chemically synthesized
atgctgctgggcatgactta

SEQ ID NO: 531361 - DNA, 20 bp, Artificial Sequence
  chemically synthesized
ccatttccccactggaaagc

SEQ ID NO: 531362 - DNA, 20 bp, Artificial Sequence
  chemically synthesized
aagttttgtttacttaatgg

SEQ ID NO: 531363 - DNA, 20 bp, Artificial Sequence
  chemically synthesized
gaacttcaaaccatctggca

SEQ ID NO: 531364 - DNA, 20 bp, Artificial Sequence
  chemically synthesized
ttaatgtaaagaacatgatc

SEQ ID NO: 531365 - DNA, 20 bp, Artificial Sequence
  chemically synthesized
ggtatgatataaatggttac

SEQ ID NO: 531366 - DNA, 20 bp, Artificial Sequence
  chemically synthesized
ttgctgcatcgtgcttctag

SEQ ID NO: 531367 - DNA, 20 bp, Artificial Sequence
  chemically synthesized
tcataattttacatgttggg

SEQ ID NO: 531368 - DNA, 20 bp, Artificial Sequence
  chemically synthesized
gacaggaggccaaattgtac

SEQ ID NO: 531369 - DNA, 20 bp, Artificial Sequence
  chemically synthesized
tctgtttcattccaactata

SEQ ID NO: 531370 - DNA, 20 bp, Artificial Sequence
  chemically synthesized
aaatgtaatgtaggtcaaaa

SEQ ID NO: 531371 - DNA, 20 bp, Artificial Sequence
  chemically synthesized
ctacttgggaggctgatgtg

SEQ ID NO: 531372 - DNA, 20 bp, Artificial Sequence
  chemically synthesized
aaaaaaaaaaaaacacacac

SEQ ID NO: 531373 - DNA, 20 bp, Artificial Sequence
  chemically synthesized
taaagtacctacgcccttac

SEQ ID NO: 531374 - DNA, 20 bp, Artificial Sequence
  chemically synthesized
taggtactttaaatgcaaag

SEQ ID NO: 531375 - DNA, 20 bp, Artificial Sequence
  chemically synthesized
agaaatgcagtattaccagg

SEQ ID NO: 531376 - DNA, 20 bp, Artificial Sequence
  chemically synthesized
attgttcacatccctgtagt

SEQ ID NO: 531377 - DNA, 20 bp, Artificial Sequence
  chemically synthesized
cacagcagaagcatggcaat

SEQ ID NO: 531378 - DNA, 20 bp, Artificial Sequence
  chemically synthesized
acacaaaacacaacacaggc

SEQ ID NO: 531379 - DNA, 20 bp, Artificial Sequence
  chemically synthesized
gagtcaaaaaagtgttcctt

SEQ ID NO: 531380 - DNA, 20 bp, Artificial Sequence
  chemically synthesized
tgagaaccaattctctttgt

SEQ ID NO: 531381 - DNA, 20 bp, Artificial Sequence
  chemically synthesized
acaacctcctttctctacaa

SEQ ID NO: 531382 - DNA, 20 bp, Artificial Sequence
  chemically synthesized
ctactcgggaggctgaggca

SEQ ID NO: 531383 - DNA, 20 bp, Artificial Sequence
  chemically synthesized
ctactcgggaggctgaggca

SEQ ID NO: 531384 - DNA, 20 bp, Artificial Sequence
  chemically synthesized
cttgcacaaagatgttttac

SEQ ID NO: 531385 - DNA, 20 bp, Artificial Sequence
  chemically synthesized
aattatgagttctattgcca

SEQ ID NO: 531386 - DNA, 20 bp, Artificial Sequence
  chemically synthesized
ggtatgtagatgcctgaagg

SEQ ID NO: 531387 - DNA, 20 bp, Artificial Sequence
  chemically synthesized
tatttacatctatgtgaggc

SEQ ID NO: 531388 - DNA, 20 bp, Artificial Sequence
  chemically synthesized
cagtgttgtgagaaaatctt

SEQ ID NO: 531389 - DNA, 20 bp, Artificial Sequence
  chemically synthesized
ggcgtgtgccagcagtgttg

SEQ ID NO: 531390 - DNA, 20 bp, Artificial Sequence
  chemically synthesized
attggaccatgtggtgacaa

SEQ ID NO: 531391 - DNA, 20 bp, Artificial Sequence
  chemically synthesized
aggacttcggacttagtgaa

SEQ ID NO: 531392 - DNA, 20 bp, Artificial Sequence
  chemically synthesized
gtaacaatagcttaaacaat

SEQ ID NO: 531393 - DNA, 20 bp, Artificial Sequence
  chemically synthesized
tgacaaatatttgaaagaat

SEQ ID NO: 531394 - DNA, 20 bp, Artificial Sequence
  chemically synthesized
ggttatatgacaaatatttg

SEQ ID NO: 531395 - DNA, 20 bp, Artificial Sequence
  chemically synthesized
tttttcaaatgacacaaagg

SEQ ID NO: 531396 - DNA, 20 bp, Artificial Sequence
  chemically synthesized
tgcacaatgtatatgcttat

SEQ ID NO: 531397 - DNA, 20 bp, Artificial Sequence
  chemically synthesized
actacatgaattatacatgg

SEQ ID NO: 531398 - DNA, 20 bp, Artificial Sequence
  chemically synthesized
ttaaagtctaaaataaagga

SEQ ID NO: 531399 - DNA, 20 bp, Artificial Sequence
  chemically synthesized
taaagaaaactataaatctg

SEQ ID NO: 531400 - DNA, 20 bp, Artificial Sequence
  chemically synthesized
taataataaaataaagaaat

SEQ ID NO: 531401 - DNA, 20 bp, Artificial Sequence
  chemically synthesized
tcaaaaaataataataaaat

SEQ ID NO: 531402 - DNA, 20 bp, Artificial Sequence
  chemically synthesized
ctacttgggaggctgaggca

SEQ ID NO: 531403 - DNA, 20 bp, Artificial Sequence
  chemically synthesized
atgtctgtatcagatgagcg

SEQ ID NO: 531404 - DNA, 20 bp, Artificial Sequence
  chemically synthesized
aaacgcatccaaatattata

SEQ ID NO: 531405 - DNA, 20 bp, Artificial Sequence
  chemically synthesized
attggttttccccaaggatt

SEQ ID NO: 531406 - DNA, 20 bp, Artificial Sequence
  chemically synthesized
gcagcaccttagatataaag

SEQ ID NO: 531407 - DNA, 20 bp, Artificial Sequence
  chemically synthesized
aaaattcttgtcttttgctg

SEQ ID NO: 531408 - DNA, 20 bp, Artificial Sequence
  chemically synthesized
ggttttctaccagcaaaaga

SEQ ID NO: 531409 - DNA, 20 bp, Artificial Sequence
  chemically synthesized
aagcattccttaatagcggc

SEQ ID NO: 531410 - DNA, 20 bp, Artificial Sequence
  chemically synthesized
gctcagaaaggcactcttta

SEQ ID NO: 531411 - DNA, 20 bp, Artificial Sequence
  chemically synthesized
cactggagaataacttgcat

SEQ ID NO: 531412 - DNA, 20 bp, Artificial Sequence
  chemically synthesized
tcaacctttgtttactcact

SEQ ID NO: 531413 - DNA, 20 bp, Artificial Sequence
  chemically synthesized
acaactgtcagaatcaagta

SEQ ID NO: 531414 - DNA, 20 bp, Artificial Sequence
  chemically synthesized
agcaattaaaaggacaactg

SEQ ID NO: 531415 - DNA, 20 bp, Artificial Sequence
  chemically synthesized
ggaagacgactggggtaaat

SEQ ID NO: 531416 - DNA, 20 bp, Artificial Sequence
  chemically synthesized
tcattatgcaaatgttcctt

SEQ ID NO: 531417 - DNA, 20 bp, Artificial Sequence
  chemically synthesized
actttggctacgatgatgag

SEQ ID NO: 531418 - DNA, 20 bp, Artificial Sequence
  chemically synthesized
gtttgcaaacccttgtaata

SEQ ID NO: 531419 - DNA, 20 bp, Artificial Sequence
  chemically synthesized
cctaaagcgcagaccacata

SEQ ID NO: 531420 - DNA, 20 bp, Artificial Sequence
  chemically synthesized
taaaggggttaccacatctc

SEQ ID NO: 531421 - DNA, 20 bp, Artificial Sequence
  chemically synthesized
aagatgaaggctgtgctgtc

SEQ ID NO: 531422 - DNA, 20 bp, Artificial Sequence
  chemically synthesized
aacattgcataaacaggata

SEQ ID NO: 531423 - DNA, 20 bp, Artificial Sequence
  chemically synthesized
gtatccaaccattggcttag

SEQ ID NO: 531424 - DNA, 20 bp, Artificial Sequence
  chemically synthesized
ttagatttggcatcaggtca

SEQ ID NO: 531425 - DNA, 20 bp, Artificial Sequence
  chemically synthesized
tgatgccaaatctaaaggta

SEQ ID NO: 531426 - DNA, 20 bp, Artificial Sequence
  chemically synthesized
cactcttataaatgaggaga

SEQ ID NO: 531427 - DNA, 20 bp, Artificial Sequence
  chemically synthesized
ttcatttgttccaagcaaca

SEQ ID NO: 531428 - DNA, 20 bp, Artificial Sequence
  chemically synthesized
tgatttctcaggcattaact

SEQ ID NO: 531429 - DNA, 20 bp, Artificial Sequence
  chemically synthesized
tgctttcttgagttaatgcc

SEQ ID NO: 531430 - DNA, 20 bp, Artificial Sequence
  chemically synthesized
aaagaaaaaaagaaaagaaa

SEQ ID NO: 531431 - DNA, 20 bp, Artificial Sequence
  chemically synthesized
agaaaaaaaagaaaaaaaga

SEQ ID NO: 531432 - DNA, 20 bp, Artificial Sequence
  chemically synthesized
aaaaaagaaaaaaaagaaaa

SEQ ID NO: 531433 - DNA, 20 bp, Artificial Sequence
  chemically synthesized
tctcaaaaaaaaaagaaaaa

SEQ ID NO: 531434 - DNA, 20 bp, Artificial Sequence
  chemically synthesized
gagactccgtctcaaaaaaa

SEQ ID NO: 531435 - DNA, 20 bp, Artificial Sequence
  chemically synthesized
ctactcgggaggctgaggca

SEQ ID NO: 531436 - DNA, 20 bp, Artificial Sequence
  chemically synthesized
acttcaaatgaaacaggact

SEQ ID NO: 531437 - DNA, 20 bp, Artificial Sequence
  chemically synthesized
gagggatgttttctatatct

SEQ ID NO: 531438 - DNA, 20 bp, Artificial Sequence
  chemically synthesized
atttacgtatttcttaagat

SEQ ID NO: 531439 - DNA, 20 bp, Artificial Sequence
  chemically synthesized
ccattgcactctagcctgga

SEQ ID NO: 531440 - DNA, 20 bp, Artificial Sequence
  chemically synthesized
ctactcaggaggctgaggca

SEQ ID NO: 531441 - DNA, 20 bp, Artificial Sequence
  chemically synthesized
ttaattttctacagatctct

SEQ ID NO: 531442 - DNA, 20 bp, Artificial Sequence
  chemically synthesized
gcatgtttctgcagagatct

SEQ ID NO: 531443 - DNA, 20 bp, Artificial Sequence
  chemically synthesized
gaaaattaaaaaaaaaaaaa

SEQ ID NO: 531444 - DNA, 20 bp, Artificial Sequence
  chemically synthesized
cggactaaaacattcatttt

SEQ ID NO: 531445 - DNA, 20 bp, Artificial Sequence
  chemically synthesized
cttcctagccttcagaattg

SEQ ID NO: 531446 - DNA, 20 bp, Artificial Sequence
  chemically synthesized
gatatcagacttcctagcct

SEQ ID NO: 531447 - DNA, 20 bp, Artificial Sequence
  chemically synthesized
aagaaggtgctatctatgaa

SEQ ID NO: 531448 - DNA, 20 bp, Artificial Sequence
  chemically synthesized
ctgatgataggggagaaggc

SEQ ID NO: 531449 - DNA, 20 bp, Artificial Sequence
  chemically synthesized
gtaaataaagagaggggcag

SEQ ID NO: 531450 - DNA, 20 bp, Artificial Sequence
  chemically synthesized
aaaaaacaaaaaacaaaaaa

SEQ ID NO: 531451 - DNA, 20 bp, Artificial Sequence
  chemically synthesized
ctactggggaggctgaggca

SEQ ID NO: 531452 - DNA, 20 bp, Artificial Sequence
  chemically synthesized
actttgaccatgacctacag

SEQ ID NO: 531453 - DNA, 20 bp, Artificial Sequence
  chemically synthesized
aatacattcatcatagttac

SEQ ID NO: 531454 - DNA, 20 bp, Artificial Sequence
  chemically synthesized
acccatgaatgtatacgtgt

SEQ ID NO: 531455 - DNA, 20 bp, Artificial Sequence
  chemically synthesized
attccaattgtaatgagtac

SEQ ID NO: 531456 - DNA, 20 bp, Artificial Sequence
  chemically synthesized
gtccctgccctcagaaagcc

SEQ ID NO: 531457 - DNA, 20 bp, Artificial Sequence
  chemically synthesized
gaggaagaaggtccctgccc

SEQ ID NO: 531458 - DNA, 20 bp, Artificial Sequence
  chemically synthesized
tctacctcaagatttccaaa

SEQ ID NO: 531459 - DNA, 20 bp, Artificial Sequence
  chemically synthesized
ttcaagccctgaaaaaataa

SEQ ID NO: 531460 - DNA, 20 bp, Artificial Sequence
  chemically synthesized
taaatatgagtggataccaa

SEQ ID NO: 531461 - DNA, 20 bp, Artificial Sequence
  chemically synthesized
acacaataaataaatgagat

SEQ ID NO: 531462 - DNA, 20 bp, Artificial Sequence
  chemically synthesized
ggcaaaaaaatatcaaaact

SEQ ID NO: 531463 - DNA, 20 bp, Artificial Sequence
  chemically synthesized
ttaagaaaaatgggtgtttt

SEQ ID NO: 531464 - DNA, 20 bp, Artificial Sequence
  chemically synthesized
gtgtatttttacccaacttt

SEQ ID NO: 531465 - DNA, 20 bp, Artificial Sequence
  chemically synthesized
ttcacagagcaaggcagcat

SEQ ID NO: 531466 - DNA, 20 bp, Artificial Sequence
  chemically synthesized
tgccttgctctgtgaacaaa

SEQ ID NO: 531467 - DNA, 20 bp, Artificial Sequence
  chemically synthesized
actgagggaaagccctttct

SEQ ID NO: 531468 - DNA, 20 bp, Artificial Sequence
  chemically synthesized
gggaaagccctttctataga

SEQ ID NO: 531469 - DNA, 20 bp, Artificial Sequence
  chemically synthesized
caggatgtaaattctattct

SEQ ID NO: 531470 - DNA, 20 bp, Artificial Sequence
  chemically synthesized
aattaatgggaaacatagaa

SEQ ID NO: 531471 - DNA, 20 bp, Artificial Sequence
  chemically synthesized
cagctgagggtgtttactct

SEQ ID NO: 531472 - DNA, 20 bp, Artificial Sequence
  chemically synthesized
gcaagttagttttaaagaag

SEQ ID NO: 531473 - DNA, 20 bp, Artificial Sequence
  chemically synthesized
tgggcactcattcatagaag

SEQ ID NO: 531474 - DNA, 20 bp, Artificial Sequence
  chemically synthesized
tgaaataggtgagtagttag

SEQ ID NO: 531475 - DNA, 20 bp, Artificial Sequence
  chemically synthesized
gaagtttttccactgcactg

SEQ ID NO: 531476 - DNA, 20 bp, Artificial Sequence
  chemically synthesized
gacgtgaaaggcaaccccat

SEQ ID NO: 531477 - DNA, 20 bp, Artificial Sequence
  chemically synthesized
cctccaaagaacctcttgga

SEQ ID NO: 531478 - DNA, 20 bp, Artificial Sequence
  chemically synthesized
gaggttctttggaggaatac

SEQ ID NO: 531479 - DNA, 20 bp, Artificial Sequence
  chemically synthesized
attttcccagaaatcgtaga

SEQ ID NO: 531480 - DNA, 20 bp, Artificial Sequence
  chemically synthesized
actaaagttctcgcattttc

SEQ ID NO: 531481 - DNA, 20 bp, Artificial Sequence
  chemically synthesized
tttaagttaataaaattcac

SEQ ID NO: 531482 - DNA, 20 bp, Artificial Sequence
  chemically synthesized
gaatatgcatataataattg

SEQ ID NO: 531483 - DNA, 20 bp, Artificial Sequence
  chemically synthesized
aactaaacctagagatttca

SEQ ID NO: 531484 - DNA, 20 bp, Artificial Sequence
  chemically synthesized
atacgtcttgttttccacaa

SEQ ID NO: 531485 - DNA, 20 bp, Artificial Sequence
  chemically synthesized
ctcatttgttaaaagcaaga

SEQ ID NO: 531486 - DNA, 20 bp, Artificial Sequence
  chemically synthesized
gaacgtctcagctaagtcaa

SEQ ID NO: 531487 - DNA, 20 bp, Artificial Sequence
  chemically synthesized
ggggttgaagccagaaaaga

SEQ ID NO: 531488 - DNA, 20 bp, Artificial Sequence
  chemically synthesized
taagcagggaggggttgaag

SEQ ID NO: 531489 - DNA, 20 bp, Artificial Sequence
  chemically synthesized
gtgtgtgtgtatatatatat

SEQ ID NO: 531490 - DNA, 20 bp, Artificial Sequence
  chemically synthesized
agactctgtctcaaaaagaa

SEQ ID NO: 531491 - DNA, 20 bp, Artificial Sequence
  chemically synthesized
agagtaagactctgtctcaa

SEQ ID NO: 531492 - DNA, 20 bp, Artificial Sequence
  chemically synthesized
ctactcgggaggctgaggtg

SEQ ID NO: 531493 - DNA, 20 bp, Artificial Sequence
  chemically synthesized
aaactgcagcaacacatgga

SEQ ID NO: 531494 - DNA, 20 bp, Artificial Sequence
  chemically synthesized
gaatttgttgtcactgaaat

SEQ ID NO: 531495 - DNA, 20 bp, Artificial Sequence
  chemically synthesized
tttttaaaaaatagaagagc

SEQ ID NO: 531496 - DNA, 20 bp, Artificial Sequence
  chemically synthesized
cctatggagttttgatttta

SEQ ID NO: 531497 - DNA, 20 bp, Artificial Sequence
  chemically synthesized
tggtttggagattttacaca

SEQ ID NO: 531498 - DNA, 20 bp, Artificial Sequence
  chemically synthesized
ttcttgaacaataaacaaag

SEQ ID NO: 531499 - DNA, 20 bp, Artificial Sequence
  chemically synthesized
gcacggatatatgtattttt

SEQ ID NO: 531500 - DNA, 20 bp, Artificial Sequence
  chemically synthesized
attttagaggacattaagat

SEQ ID NO: 531501 - DNA, 20 bp, Artificial Sequence
  chemically synthesized
tttgagaggatgtcagggaa

SEQ ID NO: 531502 - DNA, 20 bp, Artificial Sequence
  chemically synthesized
agaggatgtcagggaaggag

SEQ ID NO: 531503 - DNA, 20 bp, Artificial Sequence
  chemically synthesized
attttactgtgatgtgatta

SEQ ID NO: 531504 - DNA, 20 bp, Artificial Sequence
  chemically synthesized
tgtcgagctcagaacattat

SEQ ID NO: 531505 - DNA, 20 bp, Artificial Sequence
  chemically synthesized
tctgagctcgacaaaccttg

SEQ ID NO: 531506 - DNA, 20 bp, Artificial Sequence
  chemically synthesized
tcgacaaaccttggtagaaa

SEQ ID NO: 531507 - DNA, 20 bp, Artificial Sequence
  chemically synthesized
accatttcagtgacacaata

SEQ ID NO: 531508 - DNA, 20 bp, Artificial Sequence
  chemically synthesized
aatttgattctccagctttc

SEQ ID NO: 531509 - DNA, 20 bp, Artificial Sequence
  chemically synthesized
atctacattctttgaaagct

SEQ ID NO: 531510 - DNA, 20 bp, Artificial Sequence
  chemically synthesized
cacactgctgtgtgtgactg

SEQ ID NO: 531511 - DNA, 20 bp, Artificial Sequence
  chemically synthesized
tgtgtgactgttagaaacat

SEQ ID NO: 531512 - DNA, 20 bp, Artificial Sequence
  chemically synthesized
ggttcactgccgggaaaaga

SEQ ID NO: 531513 - DNA, 20 bp, Artificial Sequence
  chemically synthesized
ttttcccggcagtgaaccca

SEQ ID NO: 531514 - DNA, 20 bp, Artificial Sequence
  chemically synthesized
acggaagtttccaaagtgca

SEQ ID NO: 531515 - DNA, 20 bp, Artificial Sequence
  chemically synthesized
aataatgccacaagctttgt

SEQ ID NO: 531516 - DNA, 20 bp, Artificial Sequence
  chemically synthesized
cactgtaaggtgtagtcaaa

SEQ ID NO: 531517 - DNA, 20 bp, Artificial Sequence
  chemically synthesized
ctttcctctatcaaaaggat

SEQ ID NO: 531518 - DNA, 20 bp, Artificial Sequence
  chemically synthesized
gctgagttgtgagtctgtta

SEQ ID NO: 531519 - DNA, 20 bp, Artificial Sequence
  chemically synthesized
acactttcaggaatgaataa

SEQ ID NO: 531520 - DNA, 20 bp, Artificial Sequence
  chemically synthesized
tttataggtatccaacatag

SEQ ID NO: 531521 - DNA, 20 bp, Artificial Sequence
  chemically synthesized
tgtgcagactaacacatagg

SEQ ID NO: 531522 - DNA, 20 bp, Artificial Sequence
  chemically synthesized
aagaatttggcacagccatt

SEQ ID NO: 531523 - DNA, 20 bp, Artificial Sequence
  chemically synthesized
caacagaataacagtctcat

SEQ ID NO: 531524 - DNA, 20 bp, Artificial Sequence
  chemically synthesized
ctttcttatcaccatttgca

SEQ ID NO: 531525 - DNA, 20 bp, Artificial Sequence
  chemically synthesized
tattctgttgcaaatggtga

SEQ ID NO: 531526 - DNA, 20 bp, Artificial Sequence
  chemically synthesized
aagtgtgattataatgaggt

SEQ ID NO: 531527 - DNA, 20 bp, Artificial Sequence
  chemically synthesized
tttaagccaatcactggcta

SEQ ID NO: 531528 - DNA, 20 bp, Artificial Sequence
  chemically synthesized
cagttctagttgacacataa

SEQ ID NO: 531529 - DNA, 20 bp, Artificial Sequence
  chemically synthesized
ggaccatgaggaaaaagaca

SEQ ID NO: 531530 - DNA, 20 bp, Artificial Sequence
  chemically synthesized
cagcataacttggcaaccta

SEQ ID NO: 531531 - DNA, 20 bp, Artificial Sequence
  chemically synthesized
cttggcaacctactagaaat

SEQ ID NO: 531532 - DNA, 20 bp, Artificial Sequence
  chemically synthesized
tccacgctggacctactgca

SEQ ID NO: 531533 - DNA, 20 bp, Artificial Sequence
  chemically synthesized
ttcccaaactttagtatgca

SEQ ID NO: 531534 - DNA, 20 bp, Artificial Sequence
  chemically synthesized
tatcgttaataatagacaca

SEQ ID NO: 531535 - DNA, 20 bp, Artificial Sequence
  chemically synthesized
atattcccaagtctattgca

SEQ ID NO: 531536 - DNA, 20 bp, Artificial Sequence
  chemically synthesized
gcccctggtgattcttatga

SEQ ID NO: 531537 - DNA, 20 bp, Artificial Sequence
  chemically synthesized
ttcccaaggttttctggtca

SEQ ID NO: 531538 - DNA, 20 bp, Artificial Sequence
  chemically synthesized
gattgcagatggaatgtcag

SEQ ID NO: 531539 - DNA, 20 bp, Artificial Sequence
  chemically synthesized
taagtcaagaaaccaacatc

SEQ ID NO: 531540 - DNA, 20 bp, Artificial Sequence
  chemically synthesized
attcaaatagacagttaagt

SEQ ID NO: 531541 - DNA, 20 bp, Artificial Sequence
  chemically synthesized
ggccaccagataacactgat

SEQ ID NO: 531542 - DNA, 20 bp, Artificial Sequence
  chemically synthesized
tggtggcctcaccaaccctg

SEQ ID NO: 531543 - DNA, 20 bp, Artificial Sequence
  chemically synthesized
gtaggtaggaatctgccccc

SEQ ID NO: 531544 - DNA, 20 bp, Artificial Sequence
  chemically synthesized
aaaaggttctactcatccaa

SEQ ID NO: 531545 - DNA, 20 bp, Artificial Sequence
  chemically synthesized
tttggccaagtaaacaaggg

SEQ ID NO: 531546 - DNA, 20 bp, Artificial Sequence
  chemically synthesized
tcccagacctggttttcttc

SEQ ID NO: 531547 - DNA, 20 bp, Artificial Sequence
  chemically synthesized
aaaatggaatggttttctag

SEQ ID NO: 531548 - DNA, 20 bp, Artificial Sequence
  chemically synthesized
tgagtagggttccaagaggt

SEQ ID NO: 531549 - DNA, 20 bp, Artificial Sequence
  chemically synthesized
ccactagagatgtgagcccc

SEQ ID NO: 531550 - DNA, 20 bp, Artificial Sequence
  chemically synthesized
cttcatgcaaaagtgatttc

SEQ ID NO: 531551 - DNA, 20 bp, Artificial Sequence
  chemically synthesized
tatttggttaatgccttttc

SEQ ID NO: 531552 - DNA, 20 bp, Artificial Sequence
  chemically synthesized
ggtagaggtcccagcttaac

SEQ ID NO: 531553 - DNA, 20 bp, Artificial Sequence
  chemically synthesized
aatgtatctcatctgcactg

SEQ ID NO: 531554 - DNA, 20 bp, Artificial Sequence
  chemically synthesized
agatgactagacatgtagcc

SEQ ID NO: 531555 - DNA, 20 bp, Artificial Sequence
  chemically synthesized
taaaccaggtgctttgctca

SEQ ID NO: 531556 - DNA, 20 bp, Artificial Sequence
  chemically synthesized
tagaaaagcctcggtcaaca

SEQ ID NO: 531557 - DNA, 20 bp, Artificial Sequence
  chemically synthesized
agcctcggtcaacaagagaa

SEQ ID NO: 531558 - DNA, 20 bp, Artificial Sequence
  chemically synthesized
agaaagagaaagagtggttt

SEQ ID NO: 531559 - DNA, 20 bp, Artificial Sequence
  chemically synthesized
ctgagtcccatgcatctaag

SEQ ID NO: 531560 - DNA, 20 bp, Artificial Sequence
  chemically synthesized
tcagttttctacaacctgca

SEQ ID NO: 531561 - DNA, 20 bp, Artificial Sequence
  chemically synthesized
gatgctttctgctgcaggtt

SEQ ID NO: 531562 - DNA, 20 bp, Artificial Sequence
  chemically synthesized
tgagaactcacttattactg

SEQ ID NO: 531563 - DNA, 20 bp, Artificial Sequence
  chemically synthesized
tggacagttcaccaagaatg

SEQ ID NO: 531564 - DNA, 20 bp, Artificial Sequence
  chemically synthesized
tgagtatgtggacagttcac

SEQ ID NO: 531565 - DNA, 20 bp, Artificial Sequence
  chemically synthesized
tgaatgaacgagtgaataga

SEQ ID NO: 531566 - DNA, 20 bp, Artificial Sequence
  chemically synthesized
gctaatgtatccaaattacc

SEQ ID NO: 531567 - DNA, 20 bp, Artificial Sequence
  chemically synthesized
ctactcgggaggctgaggca

SEQ ID NO: 531568 - DNA, 20 bp, Artificial Sequence
  chemically synthesized
atattacacatgttaatcct

SEQ ID NO: 531569 - DNA, 20 bp, Artificial Sequence
  chemically synthesized
tgagtgtatgataggaaaaa

SEQ ID NO: 531570 - DNA, 20 bp, Artificial Sequence
  chemically synthesized
aacacatgaaagaacccaag

SEQ ID NO: 531571 - DNA, 20 bp, Artificial Sequence
  chemically synthesized
tatttagctttgaacttctt

SEQ ID NO: 531572 - DNA, 20 bp, Artificial Sequence
  chemically synthesized
tgtacaacaaactgaaggag

SEQ ID NO: 531573 - DNA, 20 bp, Artificial Sequence
  chemically synthesized
agttagtcacaaagatttct

SEQ ID NO: 531574 - DNA, 20 bp, Artificial Sequence
  chemically synthesized
agtcacaaagatttctggag

SEQ ID NO: 531575 - DNA, 20 bp, Artificial Sequence
  chemically synthesized
ctacctggaacattctttct

SEQ ID NO: 531576 - DNA, 20 bp, Artificial Sequence
  chemically synthesized
ctggagaaagaatgttccag

SEQ ID NO: 531577 - DNA, 20 bp, Artificial Sequence
  chemically synthesized
tgcctgtttagttctctaga

SEQ ID NO: 531578 - DNA, 20 bp, Artificial Sequence
  chemically synthesized
cattcagctaagggaccttc

SEQ ID NO: 531579 - DNA, 20 bp, Artificial Sequence
  chemically synthesized
tatatggacacatttgggga

SEQ ID NO: 531580 - DNA, 20 bp, Artificial Sequence
  chemically synthesized
tttaatccccagggtgtggg

SEQ ID NO: 531581 - DNA, 20 bp, Artificial Sequence
  chemically synthesized
cctagatcctgactatcagc

SEQ ID NO: 531582 - DNA, 20 bp, Artificial Sequence
  chemically synthesized
ttctgctcttacaccaagca

SEQ ID NO: 531583 - DNA, 20 bp, Artificial Sequence
  chemically synthesized
ttcttgtgcttggtgtaaga

SEQ ID NO: 531584 - DNA, 20 bp, Artificial Sequence
  chemically synthesized
aatgggaaaatatgactctg

SEQ ID NO: 531585 - DNA, 20 bp, Artificial Sequence
  chemically synthesized
tctgatgggaatgccagacc

SEQ ID NO: 531586 - DNA, 20 bp, Artificial Sequence
  chemically synthesized
ctacttgggaggctgaggct

SEQ ID NO: 531587 - DNA, 20 bp, Artificial Sequence
  chemically synthesized
atatactatctttttgtaac

SEQ ID NO: 531588 - DNA, 20 bp, Artificial Sequence
  chemically synthesized
atggaaacagaggtgaatat

SEQ ID NO: 531589 - DNA, 20 bp, Artificial Sequence
  chemically synthesized
ctaaatcaaactgagataat

SEQ ID NO: 531590 - DNA, 20 bp, Artificial Sequence
  chemically synthesized
ttttttcctgccagctgttg

SEQ ID NO: 531591 - DNA, 20 bp, Artificial Sequence
  chemically synthesized
ctactcgggaggctgaggca

SEQ ID NO: 531592 - DNA, 20 bp, Artificial Sequence
  chemically synthesized
gagaccagcctgaccaacat

SEQ ID NO: 531593 - DNA, 20 bp, Artificial Sequence
  chemically synthesized
gcgtgagccactgcgcctgg

SEQ ID NO: 531594 - DNA, 20 bp, Artificial Sequence
  chemically synthesized
agagagaaagaaaagaaaag

SEQ ID NO: 531595 - DNA, 20 bp, Artificial Sequence
  chemically synthesized
agagagagagaaagaaaaga

SEQ ID NO: 531596 - DNA, 20 bp, Artificial Sequence
  chemically synthesized
gaaagagagagagagaaaga

SEQ ID NO: 531597 - DNA, 20 bp, Artificial Sequence
  chemically synthesized
agaaagaaagagagagagag

SEQ ID NO: 531598 - DNA, 20 bp, Artificial Sequence
  chemically synthesized
aaaaagaaagaaagagagag

SEQ ID NO: 531599 - DNA, 20 bp, Artificial Sequence
  chemically synthesized
ggagactccatctaaaaaag

SEQ ID NO: 531600 - DNA, 20 bp, Artificial Sequence
  chemically synthesized
agagggagactccatctaaa

SEQ ID NO: 531601 - DNA, 20 bp, Artificial Sequence
  chemically synthesized
ctactcaggaggctgaggca

SEQ ID NO: 531602 - DNA, 20 bp, Artificial Sequence
  chemically synthesized
aaaaaaatcctgatctttaa

SEQ ID NO: 531603 - DNA, 20 bp, Artificial Sequence
  chemically synthesized
caggattttttttcacatgt

SEQ ID NO: 531604 - DNA, 20 bp, Artificial Sequence
  chemically synthesized
attttttttcacatgtctag

SEQ ID NO: 531605 - DNA, 20 bp, Artificial Sequence
  chemically synthesized
tcccaataaatacatagtga

SEQ ID NO: 531606 - DNA, 20 bp, Artificial Sequence
  chemically synthesized
taatcaaatatcaatagatt

SEQ ID NO: 531607 - DNA, 20 bp, Artificial Sequence
  chemically synthesized
ctttccgccctgctgggttg

SEQ ID NO: 531608 - DNA, 20 bp, Artificial Sequence
  chemically synthesized
tatttgttctccctttataa

SEQ ID NO: 531609 - DNA, 20 bp, Artificial Sequence
  chemically synthesized
ataaagggagaacaaataga

SEQ ID NO: 531610 - DNA, 20 bp, Artificial Sequence
  chemically synthesized
aagacgctgcgtagtcaagt

SEQ ID NO: 531611 - DNA, 20 bp, Artificial Sequence
  chemically synthesized
cgtagtcaagttcagaaaag

SEQ ID NO: 531612 - DNA, 20 bp, Artificial Sequence
  chemically synthesized
gttcagaaaagtgagaaagt

SEQ ID NO: 531613 - DNA, 20 bp, Artificial Sequence
  chemically synthesized
tagactgacaaatgccttta

SEQ ID NO: 531614 - DNA, 20 bp, Artificial Sequence
  chemically synthesized
tacacttcagcacagaaagt

SEQ ID NO: 531615 - DNA, 20 bp, Artificial Sequence
  chemically synthesized
ttttagttttacacttcagc

SEQ ID NO: 531616 - DNA, 20 bp, Artificial Sequence
  chemically synthesized
tatcaaatcataaaaataaa

SEQ ID NO: 531617 - DNA, 20 bp, Artificial Sequence
  chemically synthesized
ctaagcgaattaaagcagaa

SEQ ID NO: 531618 - DNA, 20 bp, Artificial Sequence
  chemically synthesized
attatcctaagcgaattaaa

SEQ ID NO: 531619 - DNA, 20 bp, Artificial Sequence
  chemically synthesized
ccatcaatggtggattggat

SEQ ID NO: 531620 - DNA, 20 bp, Artificial Sequence
  chemically synthesized
tatgagcgcacgtctttttg

SEQ ID NO: 531621 - DNA, 20 bp, Artificial Sequence
  chemically synthesized
ccattacttggtatgtaccc

SEQ ID NO: 531622 - DNA, 20 bp, Artificial Sequence
  chemically synthesized
caaaaaaaaaaaaaagaaag

SEQ ID NO: 531623 - DNA, 20 bp, Artificial Sequence
  chemically synthesized
gtctcaaaaaaaaaaaaaag

SEQ ID NO: 531624 - DNA, 20 bp, Artificial Sequence
  chemically synthesized
ctctgtctcaaaaaaaaaaa

SEQ ID NO: 531625 - DNA, 20 bp, Artificial Sequence
  chemically synthesized
aaatagttttgccaaaactc

SEQ ID NO: 531626 - DNA, 20 bp, Artificial Sequence
  chemically synthesized
tagatgtaagtactacgtct

SEQ ID NO: 531627 - DNA, 20 bp, Artificial Sequence
  chemically synthesized
aagcagaaagttataccaga

SEQ ID NO: 531628 - DNA, 20 bp, Artificial Sequence
  chemically synthesized
actgaaaactataaaaataa

SEQ ID NO: 531629 - DNA, 20 bp, Artificial Sequence
  chemically synthesized
ttcatctattcaagacattt

SEQ ID NO: 531630 - DNA, 20 bp, Artificial Sequence
  chemically synthesized
tagattttcgtaagtgctgt

SEQ ID NO: 531631 - DNA, 20 bp, Artificial Sequence
  chemically synthesized
aaagaaaatacaggacacta

SEQ ID NO: 531632 - DNA, 20 bp, Artificial Sequence
  chemically synthesized
ataattacaaatgtgtcagg

SEQ ID NO: 531633 - DNA, 20 bp, Artificial Sequence
  chemically synthesized
aaaattactgtctgtcatcc

SEQ ID NO: 531634 - DNA, 20 bp, Artificial Sequence
  chemically synthesized
agtttggtaaagagtagaca

SEQ ID NO: 531635 - DNA, 20 bp, Artificial Sequence
  chemically synthesized
aatcattcacagactaaaaa

SEQ ID NO: 531636 - DNA, 20 bp, Artificial Sequence
  chemically synthesized
tgaatttcagaccacgatct

SEQ ID NO: 531637 - DNA, 20 bp, Artificial Sequence
  chemically synthesized
tcctgacaaattaataaatg

SEQ ID NO: 531638 - DNA, 20 bp, Artificial Sequence
  chemically synthesized
ttttaacctcattttacagg

SEQ ID NO: 531639 - DNA, 20 bp, Artificial Sequence
  chemically synthesized
taaaggctgtacttctgata

SEQ ID NO: 531640 - DNA, 20 bp, Artificial Sequence
  chemically synthesized
tggaaactagcgtatgaaat

SEQ ID NO: 531641 - DNA, 20 bp, Artificial Sequence
  chemically synthesized
cacattcctctagaaagtag

SEQ ID NO: 531642 - DNA, 20 bp, Artificial Sequence
  chemically synthesized
acagcacattcctctagaaa

SEQ ID NO: 531643 - DNA, 20 bp, Artificial Sequence
  chemically synthesized
ctccttcacagcacattcct

SEQ ID NO: 531644 - DNA, 20 bp, Artificial Sequence
  chemically synthesized
ggggcagtgggaaaggcaat

SEQ ID NO: 531645 - DNA, 20 bp, Artificial Sequence
  chemically synthesized
aaccagtgcaaacaaatgca

SEQ ID NO: 531646 - DNA, 20 bp, Artificial Sequence
  chemically synthesized
acaagaacacttacaagaac

SEQ ID NO: 531647 - DNA, 20 bp, Artificial Sequence
  chemically synthesized
aagaacaaagaataaagcag

SEQ ID NO: 531648 - DNA, 20 bp, Artificial Sequence
  chemically synthesized
gacaagggcaaatgtcagtt

SEQ ID NO: 531649 - DNA, 20 bp, Artificial Sequence
  chemically synthesized
tgcagaataagggaaaagga

SEQ ID NO: 531650 - DNA, 20 bp, Artificial Sequence
  chemically synthesized
ctgagacctctagttcctta

SEQ ID NO: 531651 - DNA, 20 bp, Artificial Sequence
  chemically synthesized
tagttcccgattaaaacaaa

SEQ ID NO: 531652 - DNA, 20 bp, Artificial Sequence
  chemically synthesized
aagaaatatttatgaattta

SEQ ID NO: 531653 - DNA, 20 bp, Artificial Sequence
  chemically synthesized
gaatgaagccatcaggagcc

SEQ ID NO: 531654 - DNA, 20 bp, Artificial Sequence
  chemically synthesized
gggggataaatgaacgatgt

SEQ ID NO: 531655 - DNA, 20 bp, Artificial Sequence
  chemically synthesized
tgccttcaaaaaaaaaaaat

SEQ ID NO: 531656 - DNA, 20 bp, Artificial Sequence
  chemically synthesized
ctgtctttctcaccctagga

SEQ ID NO: 531657 - DNA, 20 bp, Artificial Sequence
  chemically synthesized
agaccattcttctcctaggg

SEQ ID NO: 531658 - DNA, 20 bp, Artificial Sequence
  chemically synthesized
ggatgtaaacaaaacccttt

SEQ ID NO: 531659 - DNA, 20 bp, Artificial Sequence
  chemically synthesized
aaaacatcttttcagtaagg

SEQ ID NO: 531660 - DNA, 20 bp, Artificial Sequence
  chemically synthesized
aggatttgttgatattagga

SEQ ID NO: 531661 - DNA, 20 bp, Artificial Sequence
  chemically synthesized
aaaagtaaaggaaataaaaa

SEQ ID NO: 531662 - DNA, 20 bp, Artificial Sequence
  chemically synthesized
acataagagcaacctatagt

SEQ ID NO: 531663 - DNA, 20 bp, Artificial Sequence
  chemically synthesized
atacacagggttaaaacaaa

SEQ ID NO: 531664 - DNA, 20 bp, Artificial Sequence
  chemically synthesized
tccagtttttggaatgttat

SEQ ID NO: 531665 - DNA, 20 bp, Artificial Sequence
  chemically synthesized
tcaataacattccaaaaact

SEQ ID NO: 531666 - DNA, 20 bp, Artificial Sequence
  chemically synthesized
actacttagtatctgctaat

SEQ ID NO: 531667 - DNA, 20 bp, Artificial Sequence
  chemically synthesized
ctgtctatttgtaaccacat

SEQ ID NO: 531668 - DNA, 20 bp, Artificial Sequence
  chemically synthesized
cagcatctcctgggagcatg

SEQ ID NO: 531669 - DNA, 20 bp, Artificial Sequence
  chemically synthesized
cctgggagcatgatagaaat

SEQ ID NO: 531670 - DNA, 20 bp, Artificial Sequence
  chemically synthesized
cttgttaaaccaatccgccc

SEQ ID NO: 531671 - DNA, 20 bp, Artificial Sequence
  chemically synthesized
ttttcaaaatctagcatgga

SEQ ID NO: 531672 - DNA, 20 bp, Artificial Sequence
  chemically synthesized
ttttaggccaatgctatcca

SEQ ID NO: 531673 - DNA, 20 bp, Artificial Sequence
  chemically synthesized
taggcacatgtaaaaatttt

SEQ ID NO: 531674 - DNA, 20 bp, Artificial Sequence
  chemically synthesized
aggctcacttcattcatttt

SEQ ID NO: 531675 - DNA, 20 bp, Artificial Sequence
  chemically synthesized
gcaaagacttagtaccaaaa

SEQ ID NO: 531676 - DNA, 20 bp, Artificial Sequence
  chemically synthesized
gggaaactgttaatagatcc

SEQ ID NO: 531677 - DNA, 20 bp, Artificial Sequence
  chemically synthesized
tatcttcctctttctgcctc

SEQ ID NO: 531678 - DNA, 20 bp, Artificial Sequence
  chemically synthesized
gcacttaacttttctatgag

SEQ ID NO: 531679 - DNA, 20 bp, Artificial Sequence
  chemically synthesized
agtgggtctggtgtggagct

SEQ ID NO: 531680 - DNA, 20 bp, Artificial Sequence
  chemically synthesized
gtaggaaaacatatttattt

SEQ ID NO: 531681 - DNA, 20 bp, Artificial Sequence
  chemically synthesized
tggttctaccacagaactca

SEQ ID NO: 531682 - DNA, 20 bp, Artificial Sequence
  chemically synthesized
tgaatcattttagtcttctt

SEQ ID NO: 531683 - DNA, 20 bp, Artificial Sequence
  chemically synthesized
tcattttagtcttcttaaag

SEQ ID NO: 531684 - DNA, 20 bp, Artificial Sequence
  chemically synthesized
aaaaagtcaagaaggacatg

SEQ ID NO: 531685 - DNA, 20 bp, Artificial Sequence
  chemically synthesized
caggatcattaaaaaacaaa

SEQ ID NO: 531686 - DNA, 20 bp, Artificial Sequence
  chemically synthesized
gatacagataaaagacctgc

SEQ ID NO: 531687 - DNA, 20 bp, Artificial Sequence
  chemically synthesized
aaatcctatctcaccaaagt

SEQ ID NO: 531688 - DNA, 20 bp, Artificial Sequence
  chemically synthesized
gaatataaatggttctgata

SEQ ID NO: 531689 - DNA, 20 bp, Artificial Sequence
  chemically synthesized
tatatagaccaagtttccag

SEQ ID NO: 531690 - DNA, 20 bp, Artificial Sequence
  chemically synthesized
tcctttctcagtgttaaaaa

SEQ ID NO: 531691 - DNA, 20 bp, Artificial Sequence
  chemically synthesized
atatttctggtttttaacac

SEQ ID NO: 531692 - DNA, 20 bp, Artificial Sequence
  chemically synthesized
tactgttctttgacatatgt

SEQ ID NO: 531693 - DNA, 20 bp, Artificial Sequence
  chemically synthesized
ttgtgggtttactcatgagt

SEQ ID NO: 531694 - DNA, 20 bp, Artificial Sequence
  chemically synthesized
gtgtgtgtactatttcaaaa

SEQ ID NO: 531695 - DNA, 20 bp, Artificial Sequence
  chemically synthesized
aaacgaatatctaaaccagg

SEQ ID NO: 531696 - DNA, 20 bp, Artificial Sequence
  chemically synthesized
taatgctaatatttgaccaa

SEQ ID NO: 531697 - DNA, 20 bp, Artificial Sequence
  chemically synthesized
aacccagttcagtgtacccc

SEQ ID NO: 531698 - DNA, 20 bp, Artificial Sequence
  chemically synthesized
gatttaaaagttaatatacc

SEQ ID NO: 531699 - DNA, 20 bp, Artificial Sequence
  chemically synthesized
ctacttgggaagctgaggca

SEQ ID NO: 531700 - DNA, 20 bp, Artificial Sequence
  chemically synthesized
acgtgtaaggaaaccgaggc

SEQ ID NO: 531701 - DNA, 20 bp, Artificial Sequence
  chemically synthesized
aaggttgtgattcttagatg

SEQ ID NO: 531702 - DNA, 20 bp, Artificial Sequence
  chemically synthesized
ctcatgtgcattctctcatc

SEQ ID NO: 531703 - DNA, 20 bp, Artificial Sequence
  chemically synthesized
gaaaccatcactccttgcag

SEQ ID NO: 531704 - DNA, 20 bp, Artificial Sequence
  chemically synthesized
accaatgtgtctactttgag

SEQ ID NO: 531705 - DNA, 20 bp, Artificial Sequence
  chemically synthesized
gaaaataggacttcattccc

SEQ ID NO: 531706 - DNA, 20 bp, Artificial Sequence
  chemically synthesized
aactgactttgaatcttcta

SEQ ID NO: 531707 - DNA, 20 bp, Artificial Sequence
  chemically synthesized
tgtatagaatcataatgtat

SEQ ID NO: 531708 - DNA, 20 bp, Artificial Sequence
  chemically synthesized
cagtcacaatttacctatgt

SEQ ID NO: 531709 - DNA, 20 bp, Artificial Sequence
  chemically synthesized
caggccgtgtctacttgata

SEQ ID NO: 531710 - DNA, 20 bp, Artificial Sequence
  chemically synthesized
aatttgggcaaaatagtata

SEQ ID NO: 531711 - DNA, 20 bp, Artificial Sequence
  chemically synthesized
tagaaaggcagatgtaaacc

SEQ ID NO: 531712 - DNA, 20 bp, Artificial Sequence
  chemically synthesized
aaaaatagagaactggagta

SEQ ID NO: 531713 - DNA, 20 bp, Artificial Sequence
  chemically synthesized
ctactctggaggctgaggca

SEQ ID NO: 531714 - DNA, 20 bp, Artificial Sequence
  chemically synthesized
tgactaaattctttattttc

SEQ ID NO: 531715 - DNA, 20 bp, Artificial Sequence
  chemically synthesized
agacatatttctatgaaaat

SEQ ID NO: 531716 - DNA, 20 bp, Artificial Sequence
  chemically synthesized
aagcaattcatacatcctgt

SEQ ID NO: 531717 - DNA, 20 bp, Artificial Sequence
  chemically synthesized
tgttcagaaagagaagaaag

SEQ ID NO: 531718 - DNA, 20 bp, Artificial Sequence
  chemically synthesized
tgaggccttgttcagaaaga

SEQ ID NO: 531719 - DNA, 20 bp, Artificial Sequence
  chemically synthesized
ttataaatgtgaggccttgt

SEQ ID NO: 531720 - DNA, 20 bp, Artificial Sequence
  chemically synthesized
ggcctcacatttataatgta

SEQ ID NO: 531721 - DNA, 20 bp, Artificial Sequence
  chemically synthesized
aatgtagcagaattactatc

SEQ ID NO: 531722 - DNA, 20 bp, Artificial Sequence
  chemically synthesized
agcagaattactatcaaaga

SEQ ID NO: 531723 - DNA, 20 bp, Artificial Sequence
  chemically synthesized
atgcttaaaaagtgttttta

SEQ ID NO: 531724 - DNA, 20 bp, Artificial Sequence
  chemically synthesized
ctttaaggtcatgttcaaaa

SEQ ID NO: 531725 - DNA, 20 bp, Artificial Sequence
  chemically synthesized
taaaagttagagttatacaa

SEQ ID NO: 531726 - DNA, 20 bp, Artificial Sequence
  chemically synthesized
accacatttgtattatgaat

SEQ ID NO: 531727 - DNA, 20 bp, Artificial Sequence
  chemically synthesized
ctgggggagatacacatttg

SEQ ID NO: 531728 - DNA, 20 bp, Artificial Sequence
  chemically synthesized
tctcccccagatatctagag

SEQ ID NO: 531729 - DNA, 20 bp, Artificial Sequence
  chemically synthesized
attctcctcatttttaaaat

SEQ ID NO: 531730 - DNA, 20 bp, Artificial Sequence
  chemically synthesized
tttctgcattttaaaaatga

SEQ ID NO: 531731 - DNA, 20 bp, Artificial Sequence
  chemically synthesized
attatttgaccgtgttattg

SEQ ID NO: 531732 - DNA, 20 bp, Artificial Sequence
  chemically synthesized
accaagtttttactcattgt

SEQ ID NO: 531733 - DNA, 20 bp, Artificial Sequence
  chemically synthesized
aatgcaaataaatagtgcaa

SEQ ID NO: 531734 - DNA, 20 bp, Artificial Sequence
  chemically synthesized
ggtcaaaggattatgactag

SEQ ID NO: 531735 - DNA, 20 bp, Artificial Sequence
  chemically synthesized
acgtggcattctgctctcta

SEQ ID NO: 531736 - DNA, 20 bp, Artificial Sequence
  chemically synthesized
tttataatttcttttagaga

SEQ ID NO: 531737 - DNA, 20 bp, Artificial Sequence
  chemically synthesized
aaggaaagtaataaatgtcc

SEQ ID NO: 531738 - DNA, 20 bp, Artificial Sequence
  chemically synthesized
tcaactactatggagcaaac

SEQ ID NO: 531739 - DNA, 20 bp, Artificial Sequence
  chemically synthesized
tcgatgccacttataacaat

SEQ ID NO: 531740 - DNA, 20 bp, Artificial Sequence
  chemically synthesized
ttcaggactatccatcacaa

SEQ ID NO: 531741 - DNA, 20 bp, Artificial Sequence
  chemically synthesized
gtgtgattgagaggcctgtt

SEQ ID NO: 531742 - DNA, 20 bp, Artificial Sequence
  chemically synthesized
atttggttttaactttttaa

SEQ ID NO: 531743 - DNA, 20 bp, Artificial Sequence
  chemically synthesized
cttctgcatcctgttggaaa

SEQ ID NO: 531744 - DNA, 20 bp, Artificial Sequence
  chemically synthesized
aaaggagaaaattggaaagg

SEQ ID NO: 531745 - DNA, 20 bp, Artificial Sequence
  chemically synthesized
attagtttaaccgtagaatt

SEQ ID NO: 531746 - DNA, 20 bp, Artificial Sequence
  chemically synthesized
accctaaaattagtttaacc

SEQ ID NO: 531747 - DNA, 20 bp, Artificial Sequence
  chemically synthesized
aataataacaacatcaagag

SEQ ID NO: 531748 - DNA, 20 bp, Artificial Sequence
  chemically synthesized
taataataaactgatattgc

SEQ ID NO: 531749 - DNA, 20 bp, Artificial Sequence
  chemically synthesized
ttttgatgaaagactgaggc

SEQ ID NO: 531750 - DNA, 20 bp, Artificial Sequence
  chemically synthesized
gatgtgtccaaaagtcattt

SEQ ID NO: 531751 - DNA, 20 bp, Artificial Sequence
  chemically synthesized
tctcaaaaacatctttccct

SEQ ID NO: 531752 - DNA, 20 bp, Artificial Sequence
  chemically synthesized
tctaaagggaaagatgtttt

SEQ ID NO: 531753 - DNA, 20 bp, Artificial Sequence
  chemically synthesized
gcattattttctgtttatcg

SEQ ID NO: 531754 - DNA, 20 bp, Artificial Sequence
  chemically synthesized
tagcagtattcttacgataa

SEQ ID NO: 531755 - DNA, 20 bp, Artificial Sequence
  chemically synthesized
caaaacctcgctcactaccg

SEQ ID NO: 531756 - DNA, 20 bp, Artificial Sequence
  chemically synthesized
gatcacacggcaagagagga

SEQ ID NO: 531757 - DNA, 20 bp, Artificial Sequence
  chemically synthesized
gtctgtttagtgttgctata

SEQ ID NO: 531758 - DNA, 20 bp, Artificial Sequence
  chemically synthesized
attgcacacaggcacttcga

SEQ ID NO: 531759 - DNA, 20 bp, Artificial Sequence
  chemically synthesized
gtcaaaagcaaattggaaga

SEQ ID NO: 531760 - DNA, 20 bp, Artificial Sequence
  chemically synthesized
ttactggcactgcaccctaa

SEQ ID NO: 531761 - DNA, 20 bp, Artificial Sequence
  chemically synthesized
cttctcaacctccagaacag

SEQ ID NO: 531762 - DNA, 20 bp, Artificial Sequence
  chemically synthesized
agtctgttccagctgctata

SEQ ID NO: 531763 - DNA, 20 bp, Artificial Sequence
  chemically synthesized
tggcctcataggattgttgg

SEQ ID NO: 531764 - DNA, 20 bp, Artificial Sequence
  chemically synthesized
atcctatgaggccagtagtt

SEQ ID NO: 531765 - DNA, 20 bp, Artificial Sequence
  chemically synthesized
ttgttttctcatgtataaaa

SEQ ID NO: 531766 - DNA, 20 bp, Artificial Sequence
  chemically synthesized
gagaattctaattttataca

SEQ ID NO: 531767 - DNA, 20 bp, Artificial Sequence
  chemically synthesized
atatgcaggtttgcctgcct

SEQ ID NO: 531768 - DNA, 20 bp, Artificial Sequence
  chemically synthesized
gaagcatataacataatagt

SEQ ID NO: 531769 - DNA, 20 bp, Artificial Sequence
  chemically synthesized
attatgttatatgcttcccc

SEQ ID NO: 531770 - DNA, 20 bp, Artificial Sequence
  chemically synthesized
tttcttgttactttgccaat

SEQ ID NO: 531771 - DNA, 20 bp, Artificial Sequence
  chemically synthesized
attctggattggcaaagtaa

SEQ ID NO: 531772 - DNA, 20 bp, Artificial Sequence
  chemically synthesized
ggttgtgacatgagtagaat

SEQ ID NO: 531773 - DNA, 20 bp, Artificial Sequence
  chemically synthesized
catttctggttgtgacatga

SEQ ID NO: 531774 - DNA, 20 bp, Artificial Sequence
  chemically synthesized
aaattctactcatgtcacaa

SEQ ID NO: 531775 - DNA, 20 bp, Artificial Sequence
  chemically synthesized
atggatccttattttttaca

SEQ ID NO: 531776 - DNA, 20 bp, Artificial Sequence
  chemically synthesized
tagggtattttgtcaagtcc

SEQ ID NO: 531777 - DNA, 20 bp, Artificial Sequence
  chemically synthesized
taagtgagggaatttgtccc

SEQ ID NO: 531778 - DNA, 20 bp, Artificial Sequence
  chemically synthesized
atcaacatagtgaaccagac

SEQ ID NO: 531779 - DNA, 20 bp, Artificial Sequence
  chemically synthesized
aacattttcgttatcgtcca

SEQ ID NO: 531780 - DNA, 20 bp, Artificial Sequence
  chemically synthesized
cactggaatcagtgtgaaat

SEQ ID NO: 531781 - DNA, 20 bp, Artificial Sequence
  chemically synthesized
aaatacatggattaaaagta

SEQ ID NO: 531782 - DNA, 20 bp, Artificial Sequence
  chemically synthesized
gtatcagaataagggcccat

SEQ ID NO: 531783 - DNA, 20 bp, Artificial Sequence
  chemically synthesized
tattaattttgttttgcata

SEQ ID NO: 531784 - DNA, 20 bp, Artificial Sequence
  chemically synthesized
tgttttgcataatagaaagg

SEQ ID NO: 531785 - DNA, 20 bp, Artificial Sequence
  chemically synthesized
aagtttcccccattgacatt

SEQ ID NO: 531786 - DNA, 20 bp, Artificial Sequence
  chemically synthesized
aatgcacgttattatccaga

SEQ ID NO: 531787 - DNA, 20 bp, Artificial Sequence
  chemically synthesized
atgatatttatttgtggcta

SEQ ID NO: 531788 - DNA, 20 bp, Artificial Sequence
  chemically synthesized
acattttcaaatgtctctta

SEQ ID NO: 531789 - DNA, 20 bp, Artificial Sequence
  chemically synthesized
tgtgtgctcaggaatttggg

SEQ ID NO: 531790 - DNA, 20 bp, Artificial Sequence
  chemically synthesized
agaagaaaagtaaattttaa

SEQ ID NO: 531791 - DNA, 20 bp, Artificial Sequence
  chemically synthesized
atcttatggtaaagtttaaa

SEQ ID NO: 531792 - DNA, 20 bp, Artificial Sequence
  chemically synthesized
ccatcactgctgtttcacaa

SEQ ID NO: 531793 - DNA, 20 bp, Artificial Sequence
  chemically synthesized
ttgtgattatgtaatttaat

SEQ ID NO: 531794 - DNA, 20 bp, Artificial Sequence
  chemically synthesized
tcataaaaatattagtttaa

SEQ ID NO: 531795 - DNA, 20 bp, Artificial Sequence
  chemically synthesized
aaaatattagtttaaaaaga

SEQ ID NO: 531796 - DNA, 20 bp, Artificial Sequence
  chemically synthesized
gagtatttggcctggttttt

SEQ ID NO: 531797 - DNA, 20 bp, Artificial Sequence
  chemically synthesized
actctggagagttgcttcaa

SEQ ID NO: 531798 - DNA, 20 bp, Artificial Sequence
  chemically synthesized
gagagttgcttcaaaaagaa

SEQ ID NO: 531799 - DNA, 20 bp, Artificial Sequence
  chemically synthesized
acaagacaactgctaaagat

SEQ ID NO: 531800 - DNA, 20 bp, Artificial Sequence
  chemically synthesized
caaaaaaaaaaaaaaaaaaa

SEQ ID NO: 531801 - DNA, 20 bp, Artificial Sequence
  chemically synthesized
ttccattgtcaaatatttta

SEQ ID NO: 531802 - DNA, 20 bp, Artificial Sequence
  chemically synthesized
gactaaaggacttcagtcag

SEQ ID NO: 531803 - DNA, 20 bp, Artificial Sequence
  chemically synthesized
gcactcaacgcatgaaggtg

SEQ ID NO: 531804 - DNA, 20 bp, Artificial Sequence
  chemically synthesized
ataaaaaggaaaaggaggca

SEQ ID NO: 531805 - DNA, 20 bp, Artificial Sequence
  chemically synthesized
tctcacttactgcttccaaa

SEQ ID NO: 531806 - DNA, 20 bp, Artificial Sequence
  chemically synthesized
tctagtttggaagcagtaag

SEQ ID NO: 531807 - DNA, 20 bp, Artificial Sequence
  chemically synthesized
gcagtaagtgagaaaacatt

SEQ ID NO: 531808 - DNA, 20 bp, Artificial Sequence
  chemically synthesized
tccagatgtttaagtgattc

SEQ ID NO: 531809 - DNA, 20 bp, Artificial Sequence
  chemically synthesized
ttatgactagtttctcacag

SEQ ID NO: 531810 - DNA, 20 bp, Artificial Sequence
  chemically synthesized
tgaactgaaaattctgcctg

SEQ ID NO: 531811 - DNA, 20 bp, Artificial Sequence
  chemically synthesized
atagatacaaaagtactgat

SEQ ID NO: 531812 - DNA, 20 bp, Artificial Sequence
  chemically synthesized
caggcaatttaattttatat

SEQ ID NO: 531813 - DNA, 20 bp, Artificial Sequence
  chemically synthesized
atagtcatctactacttttc

SEQ ID NO: 531814 - DNA, 20 bp, Artificial Sequence
  chemically synthesized
tagacaattcctttattttc

SEQ ID NO: 531815 - DNA, 20 bp, Artificial Sequence
  chemically synthesized
cagaaggtcagttggaaaga

SEQ ID NO: 531816 - DNA, 20 bp, Artificial Sequence
  chemically synthesized
aggaaataaaacccctccaa

SEQ ID NO: 531817 - DNA, 20 bp, Artificial Sequence
  chemically synthesized
tgcaacactgttggagaaaa

SEQ ID NO: 531818 - DNA, 20 bp, Artificial Sequence
  chemically synthesized
tgcttacatgcaacactgtt

SEQ ID NO: 531819 - DNA, 20 bp, Artificial Sequence
  chemically synthesized
aaaatgaagcttgtagatgg

SEQ ID NO: 531820 - DNA, 20 bp, Artificial Sequence
  chemically synthesized
atatatagatagatagatag

SEQ ID NO: 531821 - DNA, 20 bp, Artificial Sequence
  chemically synthesized
ctctgcacgtgtatgtagcc

SEQ ID NO: 531822 - DNA, 20 bp, Artificial Sequence
  chemically synthesized
cttgggctacatacacgtgc

SEQ ID NO: 531823 - DNA, 20 bp, Artificial Sequence
  chemically synthesized
taaaaagaggaggtgctagg

SEQ ID NO: 531824 - DNA, 20 bp, Artificial Sequence
  chemically synthesized
tctcatgactagctcagcat

SEQ ID NO: 531825 - DNA, 20 bp, Artificial Sequence
  chemically synthesized
gagaaggcaaggatgagcaa

SEQ ID NO: 531826 - DNA, 20 bp, Artificial Sequence
  chemically synthesized
cgtggttcagggaagccctc

SEQ ID NO: 531827 - DNA, 20 bp, Artificial Sequence
  chemically synthesized
catgaggatgatatatctgc

SEQ ID NO: 531828 - DNA, 20 bp, Artificial Sequence
  chemically synthesized
aatgctgttgaaacaattaa

SEQ ID NO: 531829 - DNA, 20 bp, Artificial Sequence
  chemically synthesized
cagagcagtcagggaaccaa

SEQ ID NO: 531830 - DNA, 20 bp, Artificial Sequence
  chemically synthesized
ttccctgactgctctgatgc

SEQ ID NO: 531831 - DNA, 20 bp, Artificial Sequence
  chemically synthesized
ctgaaggcagtaggtatctg

SEQ ID NO: 531832 - DNA, 20 bp, Artificial Sequence
  chemically synthesized
aagcagagtctgagtgctct

SEQ ID NO: 531833 - DNA, 20 bp, Artificial Sequence
  chemically synthesized
agagaagcaggaagacaggg

SEQ ID NO: 531834 - DNA, 20 bp, Artificial Sequence
  chemically synthesized
aggaaggaaggaagaaaaga

SEQ ID NO: 531835 - DNA, 20 bp, Artificial Sequence
  chemically synthesized
aaagaaggaaggaaggaaga

SEQ ID NO: 531836 - DNA, 20 bp, Artificial Sequence
  chemically synthesized
aaagaaaagaaggaaggaag

SEQ ID NO: 531837 - DNA, 20 bp, Artificial Sequence
  chemically synthesized
cctgtataaaaaaaggaaag

SEQ ID NO: 531838 - DNA, 20 bp, Artificial Sequence
  chemically synthesized
gtctcctgtataaaaaaagg

SEQ ID NO: 531839 - DNA, 20 bp, Artificial Sequence
  chemically synthesized
aaagaaaggaagaaagaaag

SEQ ID NO: 531840 - DNA, 20 bp, Artificial Sequence
  chemically synthesized
aaaaaaagaaaggaagaaag

SEQ ID NO: 531841 - DNA, 20 bp, Artificial Sequence
  chemically synthesized
cttgaaaaaaagaaaggaag

SEQ ID NO: 531842 - DNA, 20 bp, Artificial Sequence
  chemically synthesized
gtctcttgaaaaaaagaaag

SEQ ID NO: 531843 - DNA, 20 bp, Artificial Sequence
  chemically synthesized
agaaagaagtctcttgaaaa

SEQ ID NO: 531844 - DNA, 20 bp, Artificial Sequence
  chemically synthesized
aggaaggaaggaaagaaaaa

SEQ ID NO: 531845 - DNA, 20 bp, Artificial Sequence
  chemically synthesized
aaggaaggaaggaaggaagg

SEQ ID NO: 531846 - DNA, 20 bp, Artificial Sequence
  chemically synthesized
gaaaaaaaaaaaaaaaaagg

SEQ ID NO: 531847 - DNA, 20 bp, Artificial Sequence
  chemically synthesized
ctactcaggaggctgaggca

SEQ ID NO: 531848 - DNA, 20 bp, Artificial Sequence
  chemically synthesized
gaaatgagggactcaacttt

SEQ ID NO: 531849 - DNA, 20 bp, Artificial Sequence
  chemically synthesized
acacagtccctcagaatttg

SEQ ID NO: 531850 - DNA, 20 bp, Artificial Sequence
  chemically synthesized
tcttagctccacacagtccc

SEQ ID NO: 531851 - DNA, 20 bp, Artificial Sequence
  chemically synthesized
tcaatggcataatttattgt

SEQ ID NO: 531852 - DNA, 20 bp, Artificial Sequence
  chemically synthesized
tgaacggaaggagacaacga

SEQ ID NO: 531853 - DNA, 20 bp, Artificial Sequence
  chemically synthesized
tgcccaaatatgaaagttta

SEQ ID NO: 531854 - DNA, 20 bp, Artificial Sequence
  chemically synthesized
atggcctagatttagcataa

SEQ ID NO: 531855 - DNA, 20 bp, Artificial Sequence
  chemically synthesized
ttagcataatcagaaacact

SEQ ID NO: 531856 - DNA, 20 bp, Artificial Sequence
  chemically synthesized
aatattaagtttgtaggcat

SEQ ID NO: 531857 - DNA, 20 bp, Artificial Sequence
  chemically synthesized
tggaagcgtgttgagtctga

SEQ ID NO: 531858 - DNA, 20 bp, Artificial Sequence
  chemically synthesized
aactgctctgtgttttccat

SEQ ID NO: 531859 - DNA, 20 bp, Artificial Sequence
  chemically synthesized
aaaccctgtctctactaaaa

SEQ ID NO: 531860 - DNA, 20 bp, Artificial Sequence
  chemically synthesized
ccactctggaggctgaggca

SEQ ID NO: 531861 - DNA, 20 bp, Artificial Sequence
  chemically synthesized
attctttttcgatattgtaa

SEQ ID NO: 531862 - DNA, 20 bp, Artificial Sequence
  chemically synthesized
tttctctttacaatatcgaa

SEQ ID NO: 531863 - DNA, 20 bp, Artificial Sequence
  chemically synthesized
gtgcaaagagaaaatgttaa

SEQ ID NO: 531864 - DNA, 20 bp, Artificial Sequence
  chemically synthesized
aagaattatgatcagtgcaa

SEQ ID NO: 531865 - DNA, 20 bp, Artificial Sequence
  chemically synthesized
aaagccatgtcctaaaagat

SEQ ID NO: 531866 - DNA, 20 bp, Artificial Sequence
  chemically synthesized
acattggagttacaagcttc

SEQ ID NO: 531867 - DNA, 20 bp, Artificial Sequence
  chemically synthesized
aggaaatgtgagcacccaga

SEQ ID NO: 531868 - DNA, 20 bp, Artificial Sequence
  chemically synthesized
catgaaggaaatgtgagcac

SEQ ID NO: 531869 - DNA, 20 bp, Artificial Sequence
  chemically synthesized
gaactcctacaactcaatag

SEQ ID NO: 531870 - DNA, 20 bp, Artificial Sequence
  chemically synthesized
ctcatttctatatcttcttt

SEQ ID NO: 531871 - DNA, 20 bp, Artificial Sequence
  chemically synthesized
gacatttctccaaagaagat

SEQ ID NO: 531872 - DNA, 20 bp, Artificial Sequence
  chemically synthesized
ttcagatttatagacaggaa

SEQ ID NO: 531873 - DNA, 20 bp, Artificial Sequence
  chemically synthesized
tccatctcaaaaggaacaaa

SEQ ID NO: 531874 - DNA, 20 bp, Artificial Sequence
  chemically synthesized
ctacttgggaggctgaggca

SEQ ID NO: 531875 - DNA, 20 bp, Artificial Sequence
  chemically synthesized
aataagtacaatttgtaaaa

SEQ ID NO: 531876 - DNA, 20 bp, Artificial Sequence
  chemically synthesized
tggcagttgcagttaggatt

SEQ ID NO: 531877 - DNA, 20 bp, Artificial Sequence
  chemically synthesized
tgctttaggttgctaaggaa

SEQ ID NO: 531878 - DNA, 20 bp, Artificial Sequence
  chemically synthesized
atataattaaaatttttcag

SEQ ID NO: 531879 - DNA, 20 bp, Artificial Sequence
  chemically synthesized
ctacttgggaggttgaagca

SEQ ID NO: 531880 - DNA, 20 bp, Artificial Sequence
  chemically synthesized
aaacccagtctctagtaaaa

SEQ ID NO: 531881 - DNA, 20 bp, Artificial Sequence
  chemically synthesized
ttaacacatgtggctcagac

SEQ ID NO: 531882 - DNA, 20 bp, Artificial Sequence
  chemically synthesized
atgagatgcacactattgtg

SEQ ID NO: 531883 - DNA, 20 bp, Artificial Sequence
  chemically synthesized
cagtgggtgtaaggtgggcc

SEQ ID NO: 531884 - DNA, 20 bp, Artificial Sequence
  chemically synthesized
ttggcatttctaataagaag

SEQ ID NO: 531885 - DNA, 20 bp, Artificial Sequence
  chemically synthesized
caacattttctaacttctta

SEQ ID NO: 531886 - DNA, 20 bp, Artificial Sequence
  chemically synthesized
aaaataaaataaaaataaat

SEQ ID NO: 531887 - DNA, 20 bp, Artificial Sequence
  chemically synthesized
gctgcactccagcctgggcg

SEQ ID NO: 531888 - DNA, 20 bp, Artificial Sequence
  chemically synthesized
aaaaaaaaaaaaaaaaagaa

SEQ ID NO: 531889 - DNA, 20 bp, Artificial Sequence
  chemically synthesized
ctcgcaaaaaaaaaaaaaaa

SEQ ID NO: 531890 - DNA, 20 bp, Artificial Sequence
  chemically synthesized
ttgtctgttccttcccaaga

SEQ ID NO: 531891 - DNA, 20 bp, Artificial Sequence
  chemically synthesized
tattaaagaacaagcagtca

SEQ ID NO: 531892 - DNA, 20 bp, Artificial Sequence
  chemically synthesized
tgcttcgtaaacagtttctc

SEQ ID NO: 531893 - DNA, 20 bp, Artificial Sequence
  chemically synthesized
aactctatgtcaggtttctg

SEQ ID NO: 531894 - DNA, 20 bp, Artificial Sequence
  chemically synthesized
tgacatagagttcctaaata

SEQ ID NO: 531895 - DNA, 20 bp, Artificial Sequence
  chemically synthesized
cccaaagaatgagagatgct

SEQ ID NO: 531896 - DNA, 20 bp, Artificial Sequence
  chemically synthesized
agcatctctcattctttggg

SEQ ID NO: 531897 - DNA, 20 bp, Artificial Sequence
  chemically synthesized
gaaatgttatattcttgccc

SEQ ID NO: 531898 - DNA, 20 bp, Artificial Sequence
  chemically synthesized
acttgtgccaccaccaccaa

SEQ ID NO: 531899 - DNA, 20 bp, Artificial Sequence
  chemically synthesized
caagggcctctttgggcaaa

SEQ ID NO: 531900 - DNA, 20 bp, Artificial Sequence
  chemically synthesized
aatttttgggcttttccact

SEQ ID NO: 531901 - DNA, 20 bp, Artificial Sequence
  chemically synthesized
tacaaatattttccacttgt

SEQ ID NO: 531902 - DNA, 20 bp, Artificial Sequence
  chemically synthesized
ctatatgtgaactaaaagaa

SEQ ID NO: 531903 - DNA, 20 bp, Artificial Sequence
  chemically synthesized
aggttgcccctggggcgatg

SEQ ID NO: 531904 - DNA, 20 bp, Artificial Sequence
  chemically synthesized
aagaggaagcatagtgtggg

SEQ ID NO: 531905 - DNA, 20 bp, Artificial Sequence
  chemically synthesized
gacccaccacaatcttgatc

SEQ ID NO: 531906 - DNA, 20 bp, Artificial Sequence
  chemically synthesized
aatgaggtggcctttacaat

SEQ ID NO: 531907 - DNA, 20 bp, Artificial Sequence
  chemically synthesized
taattaaatctaagagttgc

SEQ ID NO: 531908 - DNA, 20 bp, Artificial Sequence
  chemically synthesized
cataggggtttggaaggtgc

SEQ ID NO: 531909 - DNA, 20 bp, Artificial Sequence
  chemically synthesized
gagacaagaagtaacaatgg

SEQ ID NO: 531910 - DNA, 20 bp, Artificial Sequence
  chemically synthesized
tataaaatacaatttttgac

SEQ ID NO: 531911 - DNA, 20 bp, Artificial Sequence
  chemically synthesized
atttgctttaataagtgaaa

SEQ ID NO: 531912 - DNA, 20 bp, Artificial Sequence
  chemically synthesized
ataatgattaatagaggaat

SEQ ID NO: 531913 - DNA, 20 bp, Artificial Sequence
  chemically synthesized
tcattcaatatattattaac

SEQ ID NO: 531914 - DNA, 20 bp, Artificial Sequence
  chemically synthesized
attaacttagaaatactaag

SEQ ID NO: 531915 - DNA, 20 bp, Artificial Sequence
  chemically synthesized
ttgcaagaaataagaccatt

SEQ ID NO: 531916 - DNA, 20 bp, Artificial Sequence
  chemically synthesized
ctgcttttttattttgtttg

SEQ ID NO: 531917 - DNA, 20 bp, Artificial Sequence
  chemically synthesized
cttaaagtcaaacgaaagga

SEQ ID NO: 531918 - DNA, 20 bp, Artificial Sequence
  chemically synthesized
gatgttgcatagattttaat

SEQ ID NO: 531919 - DNA, 20 bp, Artificial Sequence
  chemically synthesized
tcatcatattctgaggctga

SEQ ID NO: 531920 - DNA, 20 bp, Artificial Sequence
  chemically synthesized
ataagactttcttttcagcc

SEQ ID NO: 531921 - DNA, 20 bp, Artificial Sequence
  chemically synthesized
gtccagagggcccacattgc

SEQ ID NO: 531922 - DNA, 20 bp, Artificial Sequence
  chemically synthesized
tgaaaatatcaattttatgg

SEQ ID NO: 531923 - DNA, 20 bp, Artificial Sequence
  chemically synthesized
ttaagatgtgatcataaaaa

SEQ ID NO: 531924 - DNA, 20 bp, Artificial Sequence
  chemically synthesized
tcattggccaaatctaccct

SEQ ID NO: 531925 - DNA, 20 bp, Artificial Sequence
  chemically synthesized
aatcatactcctattttgaa

SEQ ID NO: 531926 - DNA, 20 bp, Artificial Sequence
  chemically synthesized
tgctgcattgattatctaaa

SEQ ID NO: 531927 - DNA, 20 bp, Artificial Sequence
  chemically synthesized
aaaccctaggcagttttata

SEQ ID NO: 531928 - DNA, 20 bp, Artificial Sequence
  chemically synthesized
tccaataaagcataaggtta

SEQ ID NO: 531929 - DNA, 20 bp, Artificial Sequence
  chemically synthesized
actttcacaaacccaatata

SEQ ID NO: 531930 - DNA, 20 bp, Artificial Sequence
  chemically synthesized
ggatggggctaaagcaaggg

SEQ ID NO: 531931 - DNA, 20 bp, Artificial Sequence
  chemically synthesized
ttgctttagccccatccctg

SEQ ID NO: 531932 - DNA, 20 bp, Artificial Sequence
  chemically synthesized
tctgcttgcttgggggcaga

SEQ ID NO: 531933 - DNA, 20 bp, Artificial Sequence
  chemically synthesized
tgccgaagtacaggaattaa

SEQ ID NO: 531934 - DNA, 20 bp, Artificial Sequence
  chemically synthesized
gccgtgttaagatcatgatg

SEQ ID NO: 531935 - DNA, 20 bp, Artificial Sequence
  chemically synthesized
tggcaggttcttaactttat

SEQ ID NO: 531936 - DNA, 20 bp, Artificial Sequence
  chemically synthesized
ccataaaaatcaattcctta

SEQ ID NO: 531937 - DNA, 20 bp, Artificial Sequence
  chemically synthesized
aatcaattccttaaaagaaa

SEQ ID NO: 531938 - DNA, 20 bp, Artificial Sequence
  chemically synthesized
ctccagcctcattctggtta

SEQ ID NO: 531939 - DNA, 20 bp, Artificial Sequence
  chemically synthesized
gaaacgccaaattctcttaa

SEQ ID NO: 531940 - DNA, 20 bp, Artificial Sequence
  chemically synthesized
aatctgggagaggagaagga

SEQ ID NO: 531941 - DNA, 20 bp, Artificial Sequence
  chemically synthesized
acttaaacttttcccttatc

SEQ ID NO: 531942 - DNA, 20 bp, Artificial Sequence
  chemically synthesized
agggtgagtggtatatgaaa

SEQ ID NO: 531943 - DNA, 20 bp, Artificial Sequence
  chemically synthesized
gtgggatcaactgggagaaa

SEQ ID NO: 531944 - DNA, 20 bp, Artificial Sequence
  chemically synthesized
agatgatgtgggatcaactg

SEQ ID NO: 531945 - DNA, 20 bp, Artificial Sequence
  chemically synthesized
gggagggtatatttttgtgt

SEQ ID NO: 531946 - DNA, 20 bp, Artificial Sequence
  chemically synthesized
ctatttttaatatcctagat

SEQ ID NO: 531947 - DNA, 20 bp, Artificial Sequence
  chemically synthesized
ttttatcatcagtatgtttg

SEQ ID NO: 531948 - DNA, 20 bp, Artificial Sequence
  chemically synthesized
tgtttggtagaaaagtgtaa

SEQ ID NO: 531949 - DNA, 20 bp, Artificial Sequence
  chemically synthesized
aagtcttccacaagtgagat

SEQ ID NO: 531950 - DNA, 20 bp, Artificial Sequence
  chemically synthesized
tctggatattgataaatata

SEQ ID NO: 531951 - DNA, 20 bp, Artificial Sequence
  chemically synthesized
tatatttattacttgtaatt

SEQ ID NO: 531952 - DNA, 20 bp, Artificial Sequence
  chemically synthesized
ttactatggaatattggttc

SEQ ID NO: 531953 - DNA, 20 bp, Artificial Sequence
  chemically synthesized
cagaatcacctggagggctt

SEQ ID NO: 531954 - DNA, 20 bp, Artificial Sequence
  chemically synthesized
ggttctcacctcagcataca

SEQ ID NO: 531955 - DNA, 20 bp, Artificial Sequence
  chemically synthesized
ccagacatcattgagaatgt

SEQ ID NO: 531956 - DNA, 20 bp, Artificial Sequence
  chemically synthesized
cagacatgtccagacatcat

SEQ ID NO: 531957 - DNA, 20 bp, Artificial Sequence
  chemically synthesized
aagaaagtgatcactattag

SEQ ID NO: 531958 - DNA, 20 bp, Artificial Sequence
  chemically synthesized
agttaatgaatgaaaaagtc

SEQ ID NO: 531959 - DNA, 20 bp, Artificial Sequence
  chemically synthesized
aatagcttgatagctgttca

SEQ ID NO: 531960 - DNA, 20 bp, Artificial Sequence
  chemically synthesized
agggtaggtggattttccat

SEQ ID NO: 531961 - DNA, 20 bp, Artificial Sequence
  chemically synthesized
cagtaattctttataaataa

SEQ ID NO: 531962 - DNA, 20 bp, Artificial Sequence
  chemically synthesized
acaaaattctcattatttat

SEQ ID NO: 531963 - DNA, 20 bp, Artificial Sequence
  chemically synthesized
ctactcaggaggctgaggca

SEQ ID NO: 531964 - DNA, 20 bp, Artificial Sequence
  chemically synthesized
gagagagagcaagccctcga

SEQ ID NO: 531965 - DNA, 20 bp, Artificial Sequence
  chemically synthesized
gttagggaaacaatacagga

SEQ ID NO: 531966 - DNA, 20 bp, Artificial Sequence
  chemically synthesized
atggacatgaaagcgtaagt

SEQ ID NO: 531967 - DNA, 20 bp, Artificial Sequence
  chemically synthesized
gtgctgaaagattccttact

SEQ ID NO: 531968 - DNA, 20 bp, Artificial Sequence
  chemically synthesized
gattccttacttcagaattt

SEQ ID NO: 531969 - DNA, 20 bp, Artificial Sequence
  chemically synthesized
aaaaataaaacaagaacatc

SEQ ID NO: 531970 - DNA, 20 bp, Artificial Sequence
  chemically synthesized
ataactgaagtaaataagtt

SEQ ID NO: 531971 - DNA, 20 bp, Artificial Sequence
  chemically synthesized
ctctcggaagatgcttttaa

SEQ ID NO: 531972 - DNA, 20 bp, Artificial Sequence
  chemically synthesized
tctctcattttaatggggcc

SEQ ID NO: 531973 - DNA, 20 bp, Artificial Sequence
  chemically synthesized
cacaactgttcccataatac

SEQ ID NO: 531974 - DNA, 20 bp, Artificial Sequence
  chemically synthesized
tacccagaaaactgatttac

SEQ ID NO: 531975 - DNA, 20 bp, Artificial Sequence
  chemically synthesized
tactgaacggtaggagagta

SEQ ID NO: 531976 - DNA, 20 bp, Artificial Sequence
  chemically synthesized
gacatctaccaaagttgtga

SEQ ID NO: 531977 - DNA, 20 bp, Artificial Sequence
  chemically synthesized
aactgaaattccatatttcc

SEQ ID NO: 531978 - DNA, 20 bp, Artificial Sequence
  chemically synthesized
atgtgcatgtaccacattaa

SEQ ID NO: 531979 - DNA, 20 bp, Artificial Sequence
  chemically synthesized
ttagcaccaagctgagggag

SEQ ID NO: 531980 - DNA, 20 bp, Artificial Sequence
  chemically synthesized
ttgtttgtggtgggtaataa

SEQ ID NO: 531981 - DNA, 20 bp, Artificial Sequence
  chemically synthesized
acccaccacaaacaaagctt

SEQ ID NO: 531982 - DNA, 20 bp, Artificial Sequence
  chemically synthesized
taggaaggatggtattattt

SEQ ID NO: 531983 - DNA, 20 bp, Artificial Sequence
  chemically synthesized
tctgattaaacacttcttga

SEQ ID NO: 531984 - DNA, 20 bp, Artificial Sequence
  chemically synthesized
gactgtgataaaagaaggag

SEQ ID NO: 531985 - DNA, 20 bp, Artificial Sequence
  chemically synthesized
gagagctgacaagtgaatta

SEQ ID NO: 531986 - DNA, 20 bp, Artificial Sequence
  chemically synthesized
agacttaaaagctaattcat

SEQ ID NO: 531987 - DNA, 20 bp, Artificial Sequence
  chemically synthesized
taaaatcagatgctttgggg

SEQ ID NO: 531988 - DNA, 20 bp, Artificial Sequence
  chemically synthesized
ttaggggagggatagcagta

SEQ ID NO: 531989 - DNA, 20 bp, Artificial Sequence
  chemically synthesized
ctcagcaaactaacacagga

SEQ ID NO: 531990 - DNA, 20 bp, Artificial Sequence
  chemically synthesized
catggaatactatgcagcca

SEQ ID NO: 531991 - DNA, 20 bp, Artificial Sequence
  chemically synthesized
tcatcaatgatagactggat

SEQ ID NO: 531992 - DNA, 20 bp, Artificial Sequence
  chemically synthesized
catgtgcatgtgtctttata

SEQ ID NO: 531993 - DNA, 20 bp, Artificial Sequence
  chemically synthesized
tcaggtgctggggaagatgt

SEQ ID NO: 531994 - DNA, 20 bp, Artificial Sequence
  chemically synthesized
gctcatcatcactggtgatt

SEQ ID NO: 531995 - DNA, 20 bp, Artificial Sequence
  chemically synthesized
aaggaacttaaacaaattta

SEQ ID NO: 531996 - DNA, 20 bp, Artificial Sequence
  chemically synthesized
atctgacaaagggctgatat

SEQ ID NO: 531997 - DNA, 20 bp, Artificial Sequence
  chemically synthesized
aacaagcaacctacagaatg

SEQ ID NO: 531998 - DNA, 20 bp, Artificial Sequence
  chemically synthesized
tcagagtgaacaagcaacct

SEQ ID NO: 531999 - DNA, 20 bp, Artificial Sequence
  chemically synthesized
taaagagcttctgcacagca

SEQ ID NO: 532000 - DNA, 20 bp, Artificial Sequence
  chemically synthesized
ctaaaaccataaaaacccta

SEQ ID NO: 532001 - DNA, 20 bp, Artificial Sequence
  chemically synthesized
ggtaaaccggctagccatct

SEQ ID NO: 532002 - DNA, 20 bp, Artificial Sequence
  chemically synthesized
acctgacaaaaacaagcaat

SEQ ID NO: 532003 - DNA, 20 bp, Artificial Sequence
  chemically synthesized
agaccaatggaacagaggcc

SEQ ID NO: 532004 - DNA, 20 bp, Artificial Sequence
  chemically synthesized
agtagtttttctaattatgt

SEQ ID NO: 532005 - DNA, 20 bp, Artificial Sequence
  chemically synthesized
cattgactttcttcacataa

SEQ ID NO: 532006 - DNA, 20 bp, Artificial Sequence
  chemically synthesized
cattccatgctcatggatag

SEQ ID NO: 532007 - DNA, 20 bp, Artificial Sequence
  chemically synthesized
cccattcacaattgcttcaa

SEQ ID NO: 532008 - DNA, 20 bp, Artificial Sequence
  chemically synthesized
cagctgacatgattgtatat

SEQ ID NO: 532009 - DNA, 20 bp, Artificial Sequence
  chemically synthesized
ccaggacaatcaggcaaggg

SEQ ID NO: 532010 - DNA, 20 bp, Artificial Sequence
  chemically synthesized
atgccaggctggttcaacat

SEQ ID NO: 532011 - DNA, 20 bp, Artificial Sequence
  chemically synthesized
ctggcagagacacaacagac

SEQ ID NO: 532012 - DNA, 20 bp, Artificial Sequence
  chemically synthesized
agtccctcttttcctattgt

SEQ ID NO: 532013 - DNA, 20 bp, Artificial Sequence
  chemically synthesized
agctcctctttgtacctctg

SEQ ID NO: 532014 - DNA, 20 bp, Artificial Sequence
  chemically synthesized
ccctcccaagactaaaccag

SEQ ID NO: 532015 - DNA, 20 bp, Artificial Sequence
  chemically synthesized
tcttgggagggtgtatgtgt

SEQ ID NO: 532016 - DNA, 20 bp, Artificial Sequence
  chemically synthesized
caaataaactagaaaatcta

SEQ ID NO: 532017 - DNA, 20 bp, Artificial Sequence
  chemically synthesized
aacacctctacgcaaataaa

SEQ ID NO: 532018 - DNA, 20 bp, Artificial Sequence
  chemically synthesized
cagaaatacaaactaccatc

SEQ ID NO: 532019 - DNA, 20 bp, Artificial Sequence
  chemically synthesized
gggatattagctctcatccc

SEQ ID NO: 532020 - DNA, 20 bp, Artificial Sequence
  chemically synthesized
agagaagaatcagacagaca

SEQ ID NO: 532021 - DNA, 20 bp, Artificial Sequence
  chemically synthesized
ctaataaagaagaaaagaga

SEQ ID NO: 532022 - DNA, 20 bp, Artificial Sequence
  chemically synthesized
ctgctagccagactaataaa

SEQ ID NO: 532023 - DNA, 20 bp, Artificial Sequence
  chemically synthesized
aactgaaggagatagagaca

SEQ ID NO: 532024 - DNA, 20 bp, Artificial Sequence
  chemically synthesized
attccaaagctagcagaaga

SEQ ID NO: 532025 - DNA, 20 bp, Artificial Sequence
  chemically synthesized
acagcattaaaatccccaca

SEQ ID NO: 532026 - DNA, 20 bp, Artificial Sequence
  chemically synthesized
gagaataaatacacaacgga

SEQ ID NO: 532027 - DNA, 20 bp, Artificial Sequence
  chemically synthesized
aataagttctttcaaaccaa

SEQ ID NO: 532028 - DNA, 20 bp, Artificial Sequence
  chemically synthesized
ggataaataaggaaattaag

SEQ ID NO: 532029 - DNA, 20 bp, Artificial Sequence
  chemically synthesized
atcaaattagaactcaggat

SEQ ID NO: 532030 - DNA, 20 bp, Artificial Sequence
  chemically synthesized
tcctcagcaaatgcaaaaaa

SEQ ID NO: 532031 - DNA, 20 bp, Artificial Sequence
  chemically synthesized
taataagtgtgatgtggtgc

SEQ ID NO: 532032 - DNA, 20 bp, Artificial Sequence
  chemically synthesized
gaactccccaccccaaatca

SEQ ID NO: 532033 - DNA, 20 bp, Artificial Sequence
  chemically synthesized
atattagacggatcaacgaa

SEQ ID NO: 532034 - DNA, 20 bp, Artificial Sequence
  chemically synthesized
atttaccaagcagcaaatgg

SEQ ID NO: 532035 - DNA, 20 bp, Artificial Sequence
  chemically synthesized
tgtaaagaccatcacactat

SEQ ID NO: 532036 - DNA, 20 bp, Artificial Sequence
  chemically synthesized
aactaagcttcataagcaaa

SEQ ID NO: 532037 - DNA, 20 bp, Artificial Sequence
  chemically synthesized
taaagaaaagaattttcaac

SEQ ID NO: 532038 - DNA, 20 bp, Artificial Sequence
  chemically synthesized
gggttgaaaattcttttctt

SEQ ID NO: 532039 - DNA, 20 bp, Artificial Sequence
  chemically synthesized
atattcaacattcttaaaga

SEQ ID NO: 532040 - DNA, 20 bp, Artificial Sequence
  chemically synthesized
ggccaatattcaacattctt

SEQ ID NO: 532041 - DNA, 20 bp, Artificial Sequence
  chemically synthesized
gactaacagcggatcatttg

SEQ ID NO: 532042 - DNA, 20 bp, Artificial Sequence
  chemically synthesized
aaaatgttaagggcagccag

SEQ ID NO: 532043 - DNA, 20 bp, Artificial Sequence
  chemically synthesized
ggtgtacctgaaagtgatgg

SEQ ID NO: 532044 - DNA, 20 bp, Artificial Sequence
  chemically synthesized
aaaggaacaaacaaagcctt

SEQ ID NO: 532045 - DNA, 20 bp, Artificial Sequence
  chemically synthesized
tgaagagaagattactgaaa

SEQ ID NO: 532046 - DNA, 20 bp, Artificial Sequence
  chemically synthesized
atagccaaatcgaccaagca

SEQ ID NO: 532047 - DNA, 20 bp, Artificial Sequence
  chemically synthesized
cataaatgacctgaaggagc

SEQ ID NO: 532048 - DNA, 20 bp, Artificial Sequence
  chemically synthesized
aaggttagaggaattgctaa

SEQ ID NO: 532049 - DNA, 20 bp, Artificial Sequence
  chemically synthesized
gcaagggaacaaaactggat

SEQ ID NO: 532050 - DNA, 20 bp, Artificial Sequence
  chemically synthesized
ctctgggcagggcatctctg

SEQ ID NO: 532051 - DNA, 20 bp, Artificial Sequence
  chemically synthesized
tcagactgctgtgctggcag

SEQ ID NO: 532052 - DNA, 20 bp, Artificial Sequence
  chemically synthesized
cgggtactgcagttggaaat

SEQ ID NO: 532053 - DNA, 20 bp, Artificial Sequence
  chemically synthesized
tatctagggtttaatacagc

SEQ ID NO: 532054 - DNA, 20 bp, Artificial Sequence
  chemically synthesized
ttactttcagtagcttttca

SEQ ID NO: 532055 - DNA, 20 bp, Artificial Sequence
  chemically synthesized
atccttaatacagtactggt

SEQ ID NO: 532056 - DNA, 20 bp, Artificial Sequence
  chemically synthesized
ataagtacggtatattttta

SEQ ID NO: 532057 - DNA, 20 bp, Artificial Sequence
  chemically synthesized
tttgatggagaagaaaaaac

SEQ ID NO: 532058 - DNA, 20 bp, Artificial Sequence
  chemically synthesized
ttaagtaagcctttgatgga

SEQ ID NO: 532059 - DNA, 20 bp, Artificial Sequence
  chemically synthesized
tcattcatcccctaattcta

SEQ ID NO: 532060 - DNA, 20 bp, Artificial Sequence
  chemically synthesized
aggaaaacttatcttttctt

SEQ ID NO: 532061 - DNA, 20 bp, Artificial Sequence
  chemically synthesized
ttccttacataactcatata

SEQ ID NO: 532062 - DNA, 20 bp, Artificial Sequence
  chemically synthesized
taacaaaattaatacaataa

SEQ ID NO: 532063 - DNA, 20 bp, Artificial Sequence
  chemically synthesized
ctttagaaccaaggttaaga

SEQ ID NO: 532064 - DNA, 20 bp, Artificial Sequence
  chemically synthesized
gtgaaatgtgatataatgta

SEQ ID NO: 532065 - DNA, 20 bp, Artificial Sequence
  chemically synthesized
tttgtcaaagaaacgctatg

SEQ ID NO: 532066 - DNA, 20 bp, Artificial Sequence
  chemically synthesized
gtttttttgagaaatttgtc

SEQ ID NO: 532067 - DNA, 20 bp, Artificial Sequence
  chemically synthesized
cctgtggctttgggtttttt

SEQ ID NO: 532068 - DNA, 20 bp, Artificial Sequence
  chemically synthesized
attcacatctaaagttttaa

SEQ ID NO: 532069 - DNA, 20 bp, Artificial Sequence
  chemically synthesized
ttaatgatgtgtgtagtagg

SEQ ID NO: 532070 - DNA, 20 bp, Artificial Sequence
  chemically synthesized
catttcattgtaggaacttt

SEQ ID NO: 532071 - DNA, 20 bp, Artificial Sequence
  chemically synthesized
gaactttaaagaaaaaactc

SEQ ID NO: 532072 - DNA, 20 bp, Artificial Sequence
  chemically synthesized
cctgccctgacttttcacag

SEQ ID NO: 532073 - DNA, 20 bp, Artificial Sequence
  chemically synthesized
ggacataccacttttggtac

SEQ ID NO: 532074 - DNA, 20 bp, Artificial Sequence
  chemically synthesized
gctactcaggaggctgaggc

SEQ ID NO: 532075 - DNA, 20 bp, Artificial Sequence
  chemically synthesized
aaaaaaaaaaaattaaaaaa

SEQ ID NO: 532076 - DNA, 20 bp, Artificial Sequence
  chemically synthesized
ctactcaggaggctgaggca

SEQ ID NO: 532077 - DNA, 20 bp, Artificial Sequence
  chemically synthesized
tgtctcaaaaaaaaaaaaaa

SEQ ID NO: 532078 - DNA, 20 bp, Artificial Sequence
  chemically synthesized
tatataaaggctttaataaa

SEQ ID NO: 532079 - DNA, 20 bp, Artificial Sequence
  chemically synthesized
tattccccattacaaggaag

SEQ ID NO: 532080 - DNA, 20 bp, Artificial Sequence
  chemically synthesized
agcttccataggaaaaaaca

SEQ ID NO: 532081 - DNA, 20 bp, Artificial Sequence
  chemically synthesized
attgactatattgctcacta

SEQ ID NO: 532082 - DNA, 20 bp, Artificial Sequence
  chemically synthesized
caaatgtggcttttggattt

SEQ ID NO: 532083 - DNA, 20 bp, Artificial Sequence
  chemically synthesized
ccacatttgctaatacaatt

SEQ ID NO: 532084 - DNA, 20 bp, Artificial Sequence
  chemically synthesized
attacagaatgctaaatctc

SEQ ID NO: 532085 - DNA, 20 bp, Artificial Sequence
  chemically synthesized
gtgttaaataacttgttatt

SEQ ID NO: 532086 - DNA, 20 bp, Artificial Sequence
  chemically synthesized
aagttatttaacacataaga

SEQ ID NO: 532087 - DNA, 20 bp, Artificial Sequence
  chemically synthesized
aaataaaataaaataaaaaa

SEQ ID NO: 532088 - DNA, 20 bp, Artificial Sequence
  chemically synthesized
aaaagagaaaccatggttta

SEQ ID NO: 532089 - DNA, 20 bp, Artificial Sequence
  chemically synthesized
tttattaactaaaatttatt

SEQ ID NO: 532090 - DNA, 20 bp, Artificial Sequence
  chemically synthesized
ctttgggggtagtagtttac

SEQ ID NO: 532091 - DNA, 20 bp, Artificial Sequence
  chemically synthesized
cagtgtcaataagatgcagt

SEQ ID NO: 532092 - DNA, 20 bp, Artificial Sequence
  chemically synthesized
aacttaagtgtatatatgtc

SEQ ID NO: 532093 - DNA, 20 bp, Artificial Sequence
  chemically synthesized
atgttttgctatcattggga

SEQ ID NO: 532094 - DNA, 20 bp, Artificial Sequence
  chemically synthesized
atactgagtatggatggaga

SEQ ID NO: 532095 - DNA, 20 bp, Artificial Sequence
  chemically synthesized
ttgacagacttctccaaaaa

SEQ ID NO: 532096 - DNA, 20 bp, Artificial Sequence
  chemically synthesized
atagtaggtaaaatttttaa

SEQ ID NO: 532097 - DNA, 20 bp, Artificial Sequence
  chemically synthesized
gtgctggacaggtagttata

SEQ ID NO: 532098 - DNA, 20 bp, Artificial Sequence
  chemically synthesized
tagcaacttcactttctctg

SEQ ID NO: 532099 - DNA, 20 bp, Artificial Sequence
  chemically synthesized
tatgcatttttttttctccc

SEQ ID NO: 532100 - DNA, 20 bp, Artificial Sequence
  chemically synthesized
cccccaactcccaccaagca

SEQ ID NO: 532101 - DNA, 20 bp, Artificial Sequence
  chemically synthesized
gctggtccttgagggctgaa

SEQ ID NO: 532102 - DNA, 20 bp, Artificial Sequence
  chemically synthesized
cagagtgtattaaatggtct

SEQ ID NO: 532103 - DNA, 20 bp, Artificial Sequence
  chemically synthesized
agaaggtaagtcaaggctag

SEQ ID NO: 532104 - DNA, 20 bp, Artificial Sequence
  chemically synthesized
ttgcgggagaatacttgcct

SEQ ID NO: 532105 - DNA, 20 bp, Artificial Sequence
  chemically synthesized
tccaatccaaactccttgcg

SEQ ID NO: 532106 - DNA, 20 bp, Artificial Sequence
  chemically synthesized
ggtaatgcaggaacatcagc

SEQ ID NO: 532107 - DNA, 20 bp, Artificial Sequence
  chemically synthesized
aggacattggttaaaagagg

SEQ ID NO: 532108 - DNA, 20 bp, Artificial Sequence
  chemically synthesized
acatgatggctcatgttacc

SEQ ID NO: 532109 - DNA, 20 bp, Artificial Sequence
  chemically synthesized
catccaacaaattttccagg

SEQ ID NO: 532110 - DNA, 20 bp, Artificial Sequence
  chemically synthesized
gagaacaaatgaacttggtt

SEQ ID NO: 532111 - DNA, 20 bp, Artificial Sequence
  chemically synthesized
ggagggtttaaacaatcaaa

SEQ ID NO: 532112 - DNA, 20 bp, Artificial Sequence
  chemically synthesized
aaaagagaattaggctaagg

SEQ ID NO: 532113 - DNA, 20 bp, Artificial Sequence
  chemically synthesized
tatttgaggggtggctagga

SEQ ID NO: 532114 - DNA, 20 bp, Artificial Sequence
  chemically synthesized
ggggtggctaggagaagaat

SEQ ID NO: 532115 - DNA, 20 bp, Artificial Sequence
  chemically synthesized
gccaaggaagaggacaactt

SEQ ID NO: 532116 - DNA, 20 bp, Artificial Sequence
  chemically synthesized
ctaaatatgtatttttttct

SEQ ID NO: 532117 - DNA, 20 bp, Artificial Sequence
  chemically synthesized
aaagatggcaaatatattct

SEQ ID NO: 532118 - DNA, 20 bp, Artificial Sequence
  chemically synthesized
tcaagtttcattggcccact

SEQ ID NO: 532119 - DNA, 20 bp, Artificial Sequence
  chemically synthesized
gtgttacttagtatcagaat

SEQ ID NO: 532120 - DNA, 20 bp, Artificial Sequence
  chemically synthesized
attgcttgtgttacttagta

SEQ ID NO: 532121 - DNA, 20 bp, Artificial Sequence
  chemically synthesized
atattaaaacagttacaggg

SEQ ID NO: 532122 - DNA, 20 bp, Artificial Sequence
  chemically synthesized
ttagatcactgtcttctctt

SEQ ID NO: 532123 - DNA, 20 bp, Artificial Sequence
  chemically synthesized
cttcccacaaagttaaagct

SEQ ID NO: 532124 - DNA, 20 bp, Artificial Sequence
  chemically synthesized
gactctctccaagatcacct

SEQ ID NO: 532125 - DNA, 20 bp, Artificial Sequence
  chemically synthesized
cctgcactccgctgactggc

SEQ ID NO: 532126 - DNA, 20 bp, Artificial Sequence
  chemically synthesized
ctgcctcctgaggagagagc

SEQ ID NO: 532127 - DNA, 20 bp, Artificial Sequence
  chemically synthesized
ttttgacaatgtttaaaaaa

SEQ ID NO: 532128 - DNA, 20 bp, Artificial Sequence
  chemically synthesized
ttgtcaaaaaggtcatactg

SEQ ID NO: 532129 - DNA, 20 bp, Artificial Sequence
  chemically synthesized
caaaaaggtcatactggaag

SEQ ID NO: 532130 - DNA, 20 bp, Artificial Sequence
  chemically synthesized
aattgtcggattgatataag

SEQ ID NO: 532131 - DNA, 20 bp, Artificial Sequence
  chemically synthesized
agattcacttaagctattga

SEQ ID NO: 532132 - DNA, 20 bp, Artificial Sequence
  chemically synthesized
aacttgtagtctttgcaaca

SEQ ID NO: 532133 - DNA, 20 bp, Artificial Sequence
  chemically synthesized
gcaatcagttattggaacat

SEQ ID NO: 532134 - DNA, 20 bp, Artificial Sequence
  chemically synthesized
ttgaattgattctatttaac

SEQ ID NO: 532135 - DNA, 20 bp, Artificial Sequence
  chemically synthesized
tctcatattttcttggttaa

SEQ ID NO: 532136 - DNA, 20 bp, Artificial Sequence
  chemically synthesized
agctatccagaccctggcag

SEQ ID NO: 532137 - DNA, 20 bp, Artificial Sequence
  chemically synthesized
gagcagcctttggaaggact

SEQ ID NO: 532138 - DNA, 20 bp, Artificial Sequence
  chemically synthesized
tccttccaaaggctgctctg

SEQ ID NO: 532139 - DNA, 20 bp, Artificial Sequence
  chemically synthesized
gcacccaggattaattttga

SEQ ID NO: 532140 - DNA, 20 bp, Artificial Sequence
  chemically synthesized
tcagtgtataaataaaagag

SEQ ID NO: 532141 - DNA, 20 bp, Artificial Sequence
  chemically synthesized
agaatgctccccccatctcc

SEQ ID NO: 532142 - DNA, 20 bp, Artificial Sequence
  chemically synthesized
aatgagagggcattaactat

SEQ ID NO: 532143 - DNA, 20 bp, Artificial Sequence
  chemically synthesized
ataccttgtcagacattttg

SEQ ID NO: 532144 - DNA, 20 bp, Artificial Sequence
  chemically synthesized
ggtataaaataggtaagcta

SEQ ID NO: 532145 - DNA, 20 bp, Artificial Sequence
  chemically synthesized
atcatccattgtgacctctt

SEQ ID NO: 532146 - DNA, 20 bp, Artificial Sequence
  chemically synthesized
ttgtgacctctttgagaata

SEQ ID NO: 532147 - DNA, 20 bp, Artificial Sequence
  chemically synthesized
aattctagatctgttcattt

SEQ ID NO: 532148 - DNA, 20 bp, Artificial Sequence
  chemically synthesized
gtttctataaatgaacagat

SEQ ID NO: 532149 - DNA, 20 bp, Artificial Sequence
  chemically synthesized
ttcctttatccaggggatca

SEQ ID NO: 532150 - DNA, 20 bp, Artificial Sequence
  chemically synthesized
gatctagaaactttttgaag

SEQ ID NO: 532151 - DNA, 20 bp, Artificial Sequence
  chemically synthesized
attttctcccttctttggat

SEQ ID NO: 532152 - DNA, 20 bp, Artificial Sequence
  chemically synthesized
agtttctagatccaaagaag

SEQ ID NO: 532153 - DNA, 20 bp, Artificial Sequence
  chemically synthesized
tcgtgaggtataccgtgagc

SEQ ID NO: 532154 - DNA, 20 bp, Artificial Sequence
  chemically synthesized
ataccctcacttctgagatc

SEQ ID NO: 532155 - DNA, 20 bp, Artificial Sequence
  chemically synthesized
tggcatatctgaaattcaag

SEQ ID NO: 532156 - DNA, 20 bp, Artificial Sequence
  chemically synthesized
ttagcggtgttcaccattca

SEQ ID NO: 532157 - DNA, 20 bp, Artificial Sequence
  chemically synthesized
acagctatttacaattcaat

SEQ ID NO: 532158 - DNA, 20 bp, Artificial Sequence
  chemically synthesized
aaaatactggagttctgtaa

SEQ ID NO: 532159 - DNA, 20 bp, Artificial Sequence
  chemically synthesized
gtacagaaatatcccattat

SEQ ID NO: 532160 - DNA, 20 bp, Artificial Sequence
  chemically synthesized
atctagcatgattttagggt

SEQ ID NO: 532161 - DNA, 20 bp, Artificial Sequence
  chemically synthesized
agatttcaagtgaaatatca

SEQ ID NO: 532162 - DNA, 20 bp, Artificial Sequence
  chemically synthesized
taattgtatgaaaaaaaaca

SEQ ID NO: 532163 - DNA, 20 bp, Artificial Sequence
  chemically synthesized
gcctcccttcaggtccaaac

SEQ ID NO: 532164 - DNA, 20 bp, Artificial Sequence
  chemically synthesized
tatatgttaaatattcctaa

SEQ ID NO: 532165 - DNA, 20 bp, Artificial Sequence
  chemically synthesized
atagacttgcgcaatatggg

SEQ ID NO: 532166 - DNA, 20 bp, Artificial Sequence
  chemically synthesized
caggagaagctagtaatcac

SEQ ID NO: 532167 - DNA, 20 bp, Artificial Sequence
  chemically synthesized
ctctccttgttctttatgct

SEQ ID NO: 532168 - DNA, 20 bp, Artificial Sequence
  chemically synthesized
aaatacattagatttttaaa

SEQ ID NO: 532169 - DNA, 20 bp, Artificial Sequence
  chemically synthesized
agagtatgtatttgagaaga

SEQ ID NO: 532170 - DNA, 20 bp, Artificial Sequence
  chemically synthesized
gagagataatgaggcaattg

SEQ ID NO: 532171 - DNA, 20 bp, Artificial Sequence
  chemically synthesized
gaatagatgctggagagaag

SEQ ID NO: 532172 - DNA, 20 bp, Artificial Sequence
  chemically synthesized
atgctggagagaagagagaa

SEQ ID NO: 532173 - DNA, 20 bp, Artificial Sequence
  chemically synthesized
agagaagagagaaaaagaaa

SEQ ID NO: 532174 - DNA, 20 bp, Artificial Sequence
  chemically synthesized
ctggatgtctcagttcacct

SEQ ID NO: 532175 - DNA, 20 bp, Artificial Sequence
  chemically synthesized
tacagaaagctctagcctcc

SEQ ID NO: 532176 - DNA, 20 bp, Artificial Sequence
  chemically synthesized
ccgtttgaccctcttggatc

SEQ ID NO: 532177 - DNA, 20 bp, Artificial Sequence
  chemically synthesized
ctaagctgaactctatgttg

SEQ ID NO: 532178 - DNA, 20 bp, Artificial Sequence
  chemically synthesized
attttttgaaatgtaaatac

SEQ ID NO: 532179 - DNA, 20 bp, Artificial Sequence
  chemically synthesized
gagtcctaattccagcttct

SEQ ID NO: 532180 - DNA, 20 bp, Artificial Sequence
  chemically synthesized
atgtttccacagagaacctt

SEQ ID NO: 532181 - DNA, 20 bp, Artificial Sequence
  chemically synthesized
agcctccttctcctttataa

SEQ ID NO: 532182 - DNA, 20 bp, Artificial Sequence
  chemically synthesized
taataaattctgaggtttga

SEQ ID NO: 532183 - DNA, 20 bp, Artificial Sequence
  chemically synthesized
attttttttctcctcaaacc

SEQ ID NO: 532184 - DNA, 20 bp, Artificial Sequence
  chemically synthesized
ctcaacgtatattagctgaa

SEQ ID NO: 532185 - DNA, 20 bp, Artificial Sequence
  chemically synthesized
ggaacaggatctcttgagag

SEQ ID NO: 532186 - DNA, 20 bp, Artificial Sequence
  chemically synthesized
gattaggggaaatgaggagt

SEQ ID NO: 532187 - DNA, 20 bp, Artificial Sequence
  chemically synthesized
tagaaatttcaaggagagag

SEQ ID NO: 532188 - DNA, 20 bp, Artificial Sequence
  chemically synthesized
tcctcttttccttctcagaa

SEQ ID NO: 532189 - DNA, 20 bp, Artificial Sequence
  chemically synthesized
gtgtcttcctcttttccttc

SEQ ID NO: 532190 - DNA, 20 bp, Artificial Sequence
  chemically synthesized
agagactttcgatgttaaaa

SEQ ID NO: 532191 - DNA, 20 bp, Artificial Sequence
  chemically synthesized
ctactcgggaggctgaggca

SEQ ID NO: 532192 - DNA, 20 bp, Artificial Sequence
  chemically synthesized
aatcttcaatgactcatatt

SEQ ID NO: 532193 - DNA, 20 bp, Artificial Sequence
  chemically synthesized
ttgaagattaaaatgaggcc

SEQ ID NO: 532194 - DNA, 20 bp, Artificial Sequence
  chemically synthesized
aatgaggccaaagaaaagac

SEQ ID NO: 532195 - DNA, 20 bp, Artificial Sequence
  chemically synthesized
ttcacattgttgcctgaaat

SEQ ID NO: 532196 - DNA, 20 bp, Artificial Sequence
  chemically synthesized
attgttgcctgaaattaaga

SEQ ID NO: 532197 - DNA, 20 bp, Artificial Sequence
  chemically synthesized
agggttaagtgattgtatct

SEQ ID NO: 532198 - DNA, 20 bp, Artificial Sequence
  chemically synthesized
gataaaactcccacaaaaag

SEQ ID NO: 532199 - DNA, 20 bp, Artificial Sequence
  chemically synthesized
gttcaaggaggtcagaggtt

SEQ ID NO: 532200 - DNA, 20 bp, Artificial Sequence
  chemically synthesized
ttatagtttttcccacatga

SEQ ID NO: 532201 - DNA, 20 bp, Artificial Sequence
  chemically synthesized
tgtagtaaaaaaaaagcaat

SEQ ID NO: 532202 - DNA, 20 bp, Artificial Sequence
  chemically synthesized
gtataatttattgcatttta

SEQ ID NO: 532203 - DNA, 20 bp, Artificial Sequence
  chemically synthesized
aatttattgcattttaaaag

SEQ ID NO: 532204 - DNA, 20 bp, Artificial Sequence
  chemically synthesized
tttttttaaaaaaagacaaa

SEQ ID NO: 532205 - DNA, 20 bp, Artificial Sequence
  chemically synthesized
aggcctgtttgaaagaggtt

SEQ ID NO: 532206 - DNA, 20 bp, Artificial Sequence
  chemically synthesized
gtcagttcctttatgtgatg

SEQ ID NO: 532207 - DNA, 20 bp, Artificial Sequence
  chemically synthesized
acgtattctgtatgtacatg

SEQ ID NO: 532208 - DNA, 20 bp, Artificial Sequence
  chemically synthesized
atattttctcccatgtacat

SEQ ID NO: 532209 - DNA, 20 bp, Artificial Sequence
  chemically synthesized
tggctgtcttggaaaggtga

SEQ ID NO: 532210 - DNA, 20 bp, Artificial Sequence
  chemically synthesized
gggtccaaaatagtgatatg

SEQ ID NO: 532211 - DNA, 20 bp, Artificial Sequence
  chemically synthesized
atgaaaataaaatatgcaat

SEQ ID NO: 532212 - DNA, 20 bp, Artificial Sequence
  chemically synthesized
cactcactttcagcttcact

SEQ ID NO: 532213 - DNA, 20 bp, Artificial Sequence
  chemically synthesized
aaacataaaatctccctgac

SEQ ID NO: 532214 - DNA, 20 bp, Artificial Sequence
  chemically synthesized
ggaaaatcctaatggccatg

SEQ ID NO: 532215 - DNA, 20 bp, Artificial Sequence
  chemically synthesized
cctaatggccatggaagaaa

SEQ ID NO: 532216 - DNA, 20 bp, Artificial Sequence
  chemically synthesized
ctactcaggaggctgaggca

SEQ ID NO: 532217 - DNA, 20 bp, Artificial Sequence
  chemically synthesized
ataagcaggaagcaagaggg

SEQ ID NO: 532218 - DNA, 20 bp, Artificial Sequence
  chemically synthesized
cataggtaatgacatgacag

SEQ ID NO: 532219 - DNA, 20 bp, Artificial Sequence
  chemically synthesized
tcctaaatccactgtcccca

SEQ ID NO: 532220 - DNA, 20 bp, Artificial Sequence
  chemically synthesized
aaatggtaaatttgtgtttt

SEQ ID NO: 532221 - DNA, 20 bp, Artificial Sequence
  chemically synthesized
aataaaatctgatggaatga

SEQ ID NO: 532222 - DNA, 20 bp, Artificial Sequence
  chemically synthesized
atatttgtaagcagaacttc

SEQ ID NO: 532223 - DNA, 20 bp, Artificial Sequence
  chemically synthesized
cagaacctggctgcagtgat

SEQ ID NO: 532224 - DNA, 20 bp, Artificial Sequence
  chemically synthesized
gatctggaacatgagtagac

SEQ ID NO: 532225 - DNA, 20 bp, Artificial Sequence
  chemically synthesized
ttggacatgaaaatctcctt

SEQ ID NO: 532226 - DNA, 20 bp, Artificial Sequence
  chemically synthesized
cctacctaatcctgcagact

SEQ ID NO: 532227 - DNA, 20 bp, Artificial Sequence
  chemically synthesized
aggtagaaataacacaggaa

SEQ ID NO: 532228 - DNA, 20 bp, Artificial Sequence
  chemically synthesized
caggagacataaaaaataag

SEQ ID NO: 532229 - DNA, 20 bp, Artificial Sequence
  chemically synthesized
tgtattgtttctatgtctga

SEQ ID NO: 532230 - DNA, 20 bp, Artificial Sequence
  chemically synthesized
cagcaactttcttgtcagac

SEQ ID NO: 532231 - DNA, 20 bp, Artificial Sequence
  chemically synthesized
taaagaaggtccttttggtg

SEQ ID NO: 532232 - DNA, 20 bp, Artificial Sequence
  chemically synthesized
tttattgagtctcaaacaca

SEQ ID NO: 532233 - DNA, 20 bp, Artificial Sequence
  chemically synthesized
ggatgtacatggcagggtgg

SEQ ID NO: 532234 - DNA, 20 bp, Artificial Sequence
  chemically synthesized
caaattcataggggttcatg

SEQ ID NO: 532235 - DNA, 20 bp, Artificial Sequence
  chemically synthesized
ttcatggaagaaaaaaattt

SEQ ID NO: 532236 - DNA, 20 bp, Artificial Sequence
  chemically synthesized
aagaggcaatggagcaaaca

SEQ ID NO: 532237 - DNA, 20 bp, Artificial Sequence
  chemically synthesized
aacatgggtatctgggctat

SEQ ID NO: 532238 - DNA, 20 bp, Artificial Sequence
  chemically synthesized
attaagtgttcttatctcaa

SEQ ID NO: 532239 - DNA, 20 bp, Artificial Sequence
  chemically synthesized
ctactcgggaggctgaggca

SEQ ID NO: 532240 - DNA, 20 bp, Artificial Sequence
  chemically synthesized
tctctactaaaaatacaaaa

SEQ ID NO: 532241 - DNA, 20 bp, Artificial Sequence
  chemically synthesized
caaactcatagaagcagaga

SEQ ID NO: 532242 - DNA, 20 bp, Artificial Sequence
  chemically synthesized
atctttgttttcaaagactt

SEQ ID NO: 532243 - DNA, 20 bp, Artificial Sequence
  chemically synthesized
tagcccgtgcccttgatctc

SEQ ID NO: 532244 - DNA, 20 bp, Artificial Sequence
  chemically synthesized
tctgagatcaagggcacggg

SEQ ID NO: 532245 - DNA, 20 bp, Artificial Sequence
  chemically synthesized
ttgttggaagcagcccagcc

SEQ ID NO: 532246 - DNA, 20 bp, Artificial Sequence
  chemically synthesized
aaattacttctgaaatgtta

SEQ ID NO: 532247 - DNA, 20 bp, Artificial Sequence
  chemically synthesized
tagtagaaatgaatggatta

SEQ ID NO: 532248 - DNA, 20 bp, Artificial Sequence
  chemically synthesized
tcacgtttgagtgtatgtgc

SEQ ID NO: 532249 - DNA, 20 bp, Artificial Sequence
  chemically synthesized
aaaataatgatgttgccatc

SEQ ID NO: 532250 - DNA, 20 bp, Artificial Sequence
  chemically synthesized
atttgttcaagccattgacc

SEQ ID NO: 532251 - DNA, 20 bp, Artificial Sequence
  chemically synthesized
attgatagaacttaagatag

SEQ ID NO: 532252 - DNA, 20 bp, Artificial Sequence
  chemically synthesized
atcgaagatatatttggagg

SEQ ID NO: 532253 - DNA, 20 bp, Artificial Sequence
  chemically synthesized
aaaagagcgaaactgaagac

SEQ ID NO: 532254 - DNA, 20 bp, Artificial Sequence
  chemically synthesized
aagttgactcttgctgctat

SEQ ID NO: 532255 - DNA, 20 bp, Artificial Sequence
  chemically synthesized
ccagtgatgtctctttactc

SEQ ID NO: 532256 - DNA, 20 bp, Artificial Sequence
  chemically synthesized
tcagtagacagtgataggtt

SEQ ID NO: 532257 - DNA, 20 bp, Artificial Sequence
  chemically synthesized
aagaacaggttttgagtgtt

SEQ ID NO: 532258 - DNA, 20 bp, Artificial Sequence
  chemically synthesized
gaatttggtgcttcttctgc

SEQ ID NO: 532259 - DNA, 20 bp, Artificial Sequence
  chemically synthesized
ctacccaggaggctgaggta

SEQ ID NO: 532260 - DNA, 20 bp, Artificial Sequence
  chemically synthesized
ccacgcccagctagtttttg

SEQ ID NO: 532261 - DNA, 20 bp, Artificial Sequence
  chemically synthesized
aaaataaacaaagcatgaat

SEQ ID NO: 532262 - DNA, 20 bp, Artificial Sequence
  chemically synthesized
ttgggtagtaagtgctatga

SEQ ID NO: 532263 - DNA, 20 bp, Artificial Sequence
  chemically synthesized
tggatgtttagattttagtg

SEQ ID NO: 532264 - DNA, 20 bp, Artificial Sequence
  chemically synthesized
ttataccataactcagattc

SEQ ID NO: 532265 - DNA, 20 bp, Artificial Sequence
  chemically synthesized
tgggggacaaaaggaagagc

SEQ ID NO: 532266 - DNA, 20 bp, Artificial Sequence
  chemically synthesized
ttttcagaagactcaaatgc

SEQ ID NO: 532267 - DNA, 20 bp, Artificial Sequence
  chemically synthesized
gtcatatttagggatgctga

SEQ ID NO: 532268 - DNA, 20 bp, Artificial Sequence
  chemically synthesized
caaacttatacaaaaatgat

SEQ ID NO: 532269 - DNA, 20 bp, Artificial Sequence
  chemically synthesized
ataactaacagtcaagtggt

SEQ ID NO: 532270 - DNA, 20 bp, Artificial Sequence
  chemically synthesized
agaggccaggtcattgaatg

SEQ ID NO: 532271 - DNA, 20 bp, Artificial Sequence
  chemically synthesized
tcccagctgaggcaggagaa

SEQ ID NO: 532272 - DNA, 20 bp, Artificial Sequence
  chemically synthesized
ctccatctcaaaaaaaaatt

SEQ ID NO: 532273 - DNA, 20 bp, Artificial Sequence
  chemically synthesized
attaaagaaaaaataaataa

SEQ ID NO: 532274 - DNA, 20 bp, Artificial Sequence
  chemically synthesized
agaaaaaataaataaaaaga

SEQ ID NO: 532275 - DNA, 20 bp, Artificial Sequence
  chemically synthesized
ataaataaaaagaaaagaaa

SEQ ID NO: 532276 - DNA, 20 bp, Artificial Sequence
  chemically synthesized
gatttaagtcagctctgtgt

SEQ ID NO: 532277 - DNA, 20 bp, Artificial Sequence
  chemically synthesized
tgtgttttctttttacagaa

SEQ ID NO: 532278 - DNA, 20 bp, Artificial Sequence
  chemically synthesized
gatattttctctttctgtaa

SEQ ID NO: 532279 - DNA, 20 bp, Artificial Sequence
  chemically synthesized
gttttctgtgttttcttttt

SEQ ID NO: 532280 - DNA, 20 bp, Artificial Sequence
  chemically synthesized
tctttctgtaaaaagaaaac

SEQ ID NO: 532281 - DNA, 20 bp, Artificial Sequence
  chemically synthesized
taagcaggccagcactgata

SEQ ID NO: 532282 - DNA, 20 bp, Artificial Sequence
  chemically synthesized
ccacaaagtgagagacaggc

SEQ ID NO: 532283 - DNA, 20 bp, Artificial Sequence
  chemically synthesized
ctcactttgtggtgacttct

SEQ ID NO: 532284 - DNA, 20 bp, Artificial Sequence
  chemically synthesized
atacattattaaaagagtgg

SEQ ID NO: 532285 - DNA, 20 bp, Artificial Sequence
  chemically synthesized
tacttccatctaaatcttaa

SEQ ID NO: 532286 - DNA, 20 bp, Artificial Sequence
  chemically synthesized
atgttttattgcagttctcc

SEQ ID NO: 532287 - DNA, 20 bp, Artificial Sequence
  chemically synthesized
gtttttaaaatatatctgga

SEQ ID NO: 532288 - DNA, 20 bp, Artificial Sequence
  chemically synthesized
ttgactgtatattttctcta

SEQ ID NO: 532289 - DNA, 20 bp, Artificial Sequence
  chemically synthesized
atcttgtactcttttcttgt

SEQ ID NO: 532290 - DNA, 20 bp, Artificial Sequence
  chemically synthesized
actaatctgaaatggtatac

SEQ ID NO: 532291 - DNA, 20 bp, Artificial Sequence
  chemically synthesized
ttttgtaaacatcctgattt

SEQ ID NO: 532292 - DNA, 20 bp, Artificial Sequence
  chemically synthesized
cagcaaaggatattaataat

SEQ ID NO: 532293 - DNA, 20 bp, Artificial Sequence
  chemically synthesized
ttgatttaattgttgtttgt

SEQ ID NO: 532294 - DNA, 20 bp, Artificial Sequence
  chemically synthesized
tatacaaacaacaattaaat

SEQ ID NO: 532295 - DNA, 20 bp, Artificial Sequence
  chemically synthesized
tgttttactttgccatgttt

SEQ ID NO: 532296 - DNA, 20 bp, Artificial Sequence
  chemically synthesized
gttagaaaaagagaaaaaga

SEQ ID NO: 532297 - DNA, 20 bp, Artificial Sequence
  chemically synthesized
tcctgaactcagttagaaaa

SEQ ID NO: 532298 - DNA, 20 bp, Artificial Sequence
  chemically synthesized
atcagatctcctgaactcag

SEQ ID NO: 532299 - DNA, 20 bp, Artificial Sequence
  chemically synthesized
ggaaggagagtgttttgtgt

SEQ ID NO: 532300 - DNA, 20 bp, Artificial Sequence
  chemically synthesized
caagcttctcttggtatctt

SEQ ID NO: 532301 - DNA, 20 bp, Artificial Sequence
  chemically synthesized
ccatcaatgatatactggat

SEQ ID NO: 532302 - DNA, 20 bp, Artificial Sequence
  chemically synthesized
cggttcctctgttagtttgc

SEQ ID NO: 532303 - DNA, 20 bp, Artificial Sequence
  chemically synthesized
ctaggggagggatagcatta

SEQ ID NO: 532304 - DNA, 20 bp, Artificial Sequence
  chemically synthesized
ttacattctgggatacatgt

SEQ ID NO: 532305 - DNA, 20 bp, Artificial Sequence
  chemically synthesized
gcactttctgcacatgtatc

SEQ ID NO: 532306 - DNA, 20 bp, Artificial Sequence
  chemically synthesized
ctttacaaaaagatgcttaa

SEQ ID NO: 532307 - DNA, 20 bp, Artificial Sequence
  chemically synthesized
agatgcttaattagaaataa

SEQ ID NO: 532308 - DNA, 20 bp, Artificial Sequence
  chemically synthesized
gagaccaagagcagggaaag

SEQ ID NO: 532309 - DNA, 20 bp, Artificial Sequence
  chemically synthesized
tattgagaccaagagcaggg

SEQ ID NO: 532310 - DNA, 20 bp, Artificial Sequence
  chemically synthesized
ggcactttggaatgtgctga

SEQ ID NO: 532311 - DNA, 20 bp, Artificial Sequence
  chemically synthesized
atgacaaacaacgctatgtt

SEQ ID NO: 532312 - DNA, 20 bp, Artificial Sequence
  chemically synthesized
agacaattttagaagtgtgt

SEQ ID NO: 532313 - DNA, 20 bp, Artificial Sequence
  chemically synthesized
gccccacataagagggacac

SEQ ID NO: 532314 - DNA, 20 bp, Artificial Sequence
  chemically synthesized
atgcaatctctacatttcag

SEQ ID NO: 532315 - DNA, 20 bp, Artificial Sequence
  chemically synthesized
gtagggtggcaagagtagat

SEQ ID NO: 532316 - DNA, 20 bp, Artificial Sequence
  chemically synthesized
gagtagatgcagaaaggtta

SEQ ID NO: 532317 - DNA, 20 bp, Artificial Sequence
  chemically synthesized
ctactcgggaggctgaggcg

SEQ ID NO: 532318 - DNA, 20 bp, Artificial Sequence
  chemically synthesized
aactacattgttgtctggta

SEQ ID NO: 532319 - DNA, 20 bp, Artificial Sequence
  chemically synthesized
agagttatgagtgatactca

SEQ ID NO: 532320 - DNA, 20 bp, Artificial Sequence
  chemically synthesized
ttataacaaaatactggctg

SEQ ID NO: 532321 - DNA, 20 bp, Artificial Sequence
  chemically synthesized
gttgaagaacaaaatagcaa

SEQ ID NO: 532322 - DNA, 20 bp, Artificial Sequence
  chemically synthesized
gcaatcagaatccatcttat

SEQ ID NO: 532323 - DNA, 20 bp, Artificial Sequence
  chemically synthesized
catcttatgaagaaatatga

SEQ ID NO: 532324 - DNA, 20 bp, Artificial Sequence
  chemically synthesized
ttatgctagttccagaaacc

SEQ ID NO: 532325 - DNA, 20 bp, Artificial Sequence
  chemically synthesized
agatgaattttatgctagtt

SEQ ID NO: 532326 - DNA, 20 bp, Artificial Sequence
  chemically synthesized
tagcataaaattcatctttt

SEQ ID NO: 532327 - DNA, 20 bp, Artificial Sequence
  chemically synthesized
atgcgatatagtgaaatgag

SEQ ID NO: 532328 - DNA, 20 bp, Artificial Sequence
  chemically synthesized
caaaacactctggtgtacat

SEQ ID NO: 532329 - DNA, 20 bp, Artificial Sequence
  chemically synthesized
cacaaaagctaatttaatat

SEQ ID NO: 532330 - DNA, 20 bp, Artificial Sequence
  chemically synthesized
tatgaaggcaaatggctaaa

SEQ ID NO: 532331 - DNA, 20 bp, Artificial Sequence
  chemically synthesized
aatttcctatatcctcttct

SEQ ID NO: 532332 - DNA, 20 bp, Artificial Sequence
  chemically synthesized
tgagaataaaagatacaaga

SEQ ID NO: 532333 - DNA, 20 bp, Artificial Sequence
  chemically synthesized
actgataagtgttttggaaa

SEQ ID NO: 532334 - DNA, 20 bp, Artificial Sequence
  chemically synthesized
ctcagagcttagtagagaag

SEQ ID NO: 532335 - DNA, 20 bp, Artificial Sequence
  chemically synthesized
taaaaataaaacaaacaaac

SEQ ID NO: 532336 - DNA, 20 bp, Artificial Sequence
  chemically synthesized
ctattaaacatcacacaaaa

SEQ ID NO: 532337 - DNA, 20 bp, Artificial Sequence
  chemically synthesized
tataccacctcctgatgatg

SEQ ID NO: 532338 - DNA, 20 bp, Artificial Sequence
  chemically synthesized
gtcatttcaacatgcaatca

SEQ ID NO: 532339 - DNA, 20 bp, Artificial Sequence
  chemically synthesized
attgcatgttgaaatgacaa

SEQ ID NO: 532340 - DNA, 20 bp, Artificial Sequence
  chemically synthesized
tgcatgacatataatgatga

SEQ ID NO: 532341 - DNA, 20 bp, Artificial Sequence
  chemically synthesized
tacagggaaactattctatt

SEQ ID NO: 532342 - DNA, 20 bp, Artificial Sequence
  chemically synthesized
attcacagtaagtttctaaa

SEQ ID NO: 532343 - DNA, 20 bp, Artificial Sequence
  chemically synthesized
aatttttatttaaaccaaaa

SEQ ID NO: 532344 - DNA, 20 bp, Artificial Sequence
  chemically synthesized
taaaaaatgcataatatgta

SEQ ID NO: 532345 - DNA, 20 bp, Artificial Sequence
  chemically synthesized
aaaacaatctgggaagagct

SEQ ID NO: 532346 - DNA, 20 bp, Artificial Sequence
  chemically synthesized
ttgaacatatacaaaagtag

SEQ ID NO: 532347 - DNA, 20 bp, Artificial Sequence
  chemically synthesized
tttgtgttaataataccctt

SEQ ID NO: 532348 - DNA, 20 bp, Artificial Sequence
  chemically synthesized
tttgtttgaaattaagttga

SEQ ID NO: 532349 - DNA, 20 bp, Artificial Sequence
  chemically synthesized
gccacaccagaagttcctgc

SEQ ID NO: 532350 - DNA, 20 bp, Artificial Sequence
  chemically synthesized
aagaacagcagcgtaccatg

SEQ ID NO: 532351 - DNA, 20 bp, Artificial Sequence
  chemically synthesized
gtactttttcaatggaattg

SEQ ID NO: 532352 - DNA, 20 bp, Artificial Sequence
  chemically synthesized
ggatagtttgatggcaattt

SEQ ID NO: 532353 - DNA, 20 bp, Artificial Sequence
  chemically synthesized
ccatatgtttatttccacat

SEQ ID NO: 532354 - DNA, 20 bp, Artificial Sequence
  chemically synthesized
attttttctaccagaaatat

SEQ ID NO: 532355 - DNA, 20 bp, Artificial Sequence
  chemically synthesized
aacaattcttaatatttctg

SEQ ID NO: 532356 - DNA, 20 bp, Artificial Sequence
  chemically synthesized
actgcatccaattttttcta

SEQ ID NO: 532357 - DNA, 20 bp, Artificial Sequence
  chemically synthesized
tactggaattctttttgcct

SEQ ID NO: 532358 - DNA, 20 bp, Artificial Sequence
  chemically synthesized
ctttccatttctcaaggcaa

SEQ ID NO: 532359 - DNA, 20 bp, Artificial Sequence
  chemically synthesized
tggaaaaggctgcctagggt

SEQ ID NO: 532360 - DNA, 20 bp, Artificial Sequence
  chemically synthesized
agacgcatttgggaagagga

SEQ ID NO: 532361 - DNA, 20 bp, Artificial Sequence
  chemically synthesized
ttttacacaaaggaaacaaa

SEQ ID NO: 532362 - DNA, 20 bp, Artificial Sequence
  chemically synthesized
gttaatccttagaagccatt

SEQ ID NO: 532363 - DNA, 20 bp, Artificial Sequence
  chemically synthesized
ttaataaaataaatcatcat

SEQ ID NO: 532364 - DNA, 20 bp, Artificial Sequence
  chemically synthesized
aagctttatcttcaggtaaa

SEQ ID NO: 532365 - DNA, 20 bp, Artificial Sequence
  chemically synthesized
ctgtttgactaaggccaaaa

SEQ ID NO: 532366 - DNA, 20 bp, Artificial Sequence
  chemically synthesized
ctccttttggccttagtcaa

SEQ ID NO: 532367 - DNA, 20 bp, Artificial Sequence
  chemically synthesized
cttagtcaaacagaatcacc

SEQ ID NO: 532368 - DNA, 20 bp, Artificial Sequence
  chemically synthesized
atgtattgtcaaattatcct

SEQ ID NO: 532369 - DNA, 20 bp, Artificial Sequence
  chemically synthesized
ttcaaggaaattatactaac

SEQ ID NO: 532370 - DNA, 20 bp, Artificial Sequence
  chemically synthesized
tttatgattgataaaacaaa

SEQ ID NO: 532371 - DNA, 20 bp, Artificial Sequence
  chemically synthesized
ttcaatatgagggaattgct

SEQ ID NO: 532372 - DNA, 20 bp, Artificial Sequence
  chemically synthesized
aacttgtatatgctttaaat

SEQ ID NO: 532373 - DNA, 20 bp, Artificial Sequence
  chemically synthesized
tcatcatcccagttactaaa

SEQ ID NO: 532374 - DNA, 20 bp, Artificial Sequence
  chemically synthesized
catacacatacacaaatgtt

SEQ ID NO: 532375 - DNA, 20 bp, Artificial Sequence
  chemically synthesized
atttggaaaagtagaaagat

SEQ ID NO: 532376 - DNA, 20 bp, Artificial Sequence
  chemically synthesized
aatcttgacaatttggaaaa

SEQ ID NO: 532377 - DNA, 20 bp, Artificial Sequence
  chemically synthesized
tgtttatactgcaattatag

SEQ ID NO: 532378 - DNA, 20 bp, Artificial Sequence
  chemically synthesized
atattgtttatactgcaatt

SEQ ID NO: 532379 - DNA, 20 bp, Artificial Sequence
  chemically synthesized
gtggtaactgaaaggatggt

SEQ ID NO: 532380 - DNA, 20 bp, Artificial Sequence
  chemically synthesized
acatggaaaagcagcaaatg

SEQ ID NO: 532381 - DNA, 20 bp, Artificial Sequence
  chemically synthesized
tagggagagaggaagggaag

SEQ ID NO: 532382 - DNA, 20 bp, Artificial Sequence
  chemically synthesized
ccacttgggaggctgatgca

SEQ ID NO: 532383 - DNA, 20 bp, Artificial Sequence
  chemically synthesized
attcagttctaaaggatcta

SEQ ID NO: 532384 - DNA, 20 bp, Artificial Sequence
  chemically synthesized
attttatctaactccacagc

SEQ ID NO: 532385 - DNA, 20 bp, Artificial Sequence
  chemically synthesized
ctgtggagttagataaaatt

SEQ ID NO: 532386 - DNA, 20 bp, Artificial Sequence
  chemically synthesized
tgaagaggtgaaaggcagcc

SEQ ID NO: 532387 - DNA, 20 bp, Artificial Sequence
  chemically synthesized
gtctcaaactatagtgtgta

SEQ ID NO: 532388 - DNA, 20 bp, Artificial Sequence
  chemically synthesized
cagagattgttgatagaatt

SEQ ID NO: 532389 - DNA, 20 bp, Artificial Sequence
  chemically synthesized
gttgaaagcagagattgttg

SEQ ID NO: 532390 - DNA, 20 bp, Artificial Sequence
  chemically synthesized
gctttaataaatgctttatc

SEQ ID NO: 532391 - DNA, 20 bp, Artificial Sequence
  chemically synthesized
gaagtaatgtttggggcata

SEQ ID NO: 532392 - DNA, 20 bp, Artificial Sequence
  chemically synthesized
ttcacgggcttaacatggtc

SEQ ID NO: 532393 - DNA, 20 bp, Artificial Sequence
  chemically synthesized
aactgcttccgataaatgta

SEQ ID NO: 532394 - DNA, 20 bp, Artificial Sequence
  chemically synthesized
aaaaaagtcattacaaatac

SEQ ID NO: 532395 - DNA, 20 bp, Artificial Sequence
  chemically synthesized
acagcctatgtatgatataa

SEQ ID NO: 532396 - DNA, 20 bp, Artificial Sequence
  chemically synthesized
aaccttcttgttttgcatat

SEQ ID NO: 532397 - DNA, 20 bp, Artificial Sequence
  chemically synthesized
gtcctatttagatatgggaa

SEQ ID NO: 532398 - DNA, 20 bp, Artificial Sequence
  chemically synthesized
aattacaaacctttgttaga

SEQ ID NO: 532399 - DNA, 20 bp, Artificial Sequence
  chemically synthesized
tgaggctcagctatttgtta

SEQ ID NO: 532400 - DNA, 20 bp, Artificial Sequence
  chemically synthesized
acagcttgactggttacagc

SEQ ID NO: 532401 - DNA, 20 bp, Artificial Sequence
  chemically synthesized
atagaaaaaggaagtgacat

SEQ ID NO: 532402 - DNA, 20 bp, Artificial Sequence
  chemically synthesized
tgggcaggcagtatttatag

SEQ ID NO: 532403 - DNA, 20 bp, Artificial Sequence
  chemically synthesized
cagtactcagaattagaagt

SEQ ID NO: 532404 - DNA, 20 bp, Artificial Sequence
  chemically synthesized
attcatgaatcagacagtac

SEQ ID NO: 532405 - DNA, 20 bp, Artificial Sequence
  chemically synthesized
cgttgagtgggtaggagtaa

SEQ ID NO: 532406 - DNA, 20 bp, Artificial Sequence
  chemically synthesized
actcctcagtgtcaggacac

SEQ ID NO: 532407 - DNA, 20 bp, Artificial Sequence
  chemically synthesized
cagttgaaatatctgtgtct

SEQ ID NO: 532408 - DNA, 20 bp, Artificial Sequence
  chemically synthesized
caatataacacatttcactt

SEQ ID NO: 532409 - DNA, 20 bp, Artificial Sequence
  chemically synthesized
ataaaatagcacttaaacat

SEQ ID NO: 532410 - DNA, 20 bp, Artificial Sequence
  chemically synthesized
aatagcacttaaacatgcag

SEQ ID NO: 532411 - DNA, 20 bp, Artificial Sequence
  chemically synthesized
cagaaagaaaagggaggaat

SEQ ID NO: 532412 - DNA, 20 bp, Artificial Sequence
  chemically synthesized
gaaaaactggatatccatat

SEQ ID NO: 532413 - DNA, 20 bp, Artificial Sequence
  chemically synthesized
aaactactacaagagaacac

SEQ ID NO: 532414 - DNA, 20 bp, Artificial Sequence
  chemically synthesized
gaataatttgaatttgtact

SEQ ID NO: 532415 - DNA, 20 bp, Artificial Sequence
  chemically synthesized
acaaaaaaaattaaagaacc

SEQ ID NO: 532416 - DNA, 20 bp, Artificial Sequence
  chemically synthesized
ggagctatctctttaaatag

SEQ ID NO: 532417 - DNA, 20 bp, Artificial Sequence
  chemically synthesized
tgttggagttcaagacctgt

SEQ ID NO: 532418 - DNA, 20 bp, Artificial Sequence
  chemically synthesized
taattaacattctaaaagag

SEQ ID NO: 532419 - DNA, 20 bp, Artificial Sequence
  chemically synthesized
tgaccttctttctctctctt

SEQ ID NO: 532420 - DNA, 20 bp, Artificial Sequence
  chemically synthesized
agaggtggggtctacctttg

SEQ ID NO: 532421 - DNA, 20 bp, Artificial Sequence
  chemically synthesized
ggagtgcttgctattagagg

SEQ ID NO: 532422 - DNA, 20 bp, Artificial Sequence
  chemically synthesized
atgtgagatttttatatttg

SEQ ID NO: 532423 - DNA, 20 bp, Artificial Sequence
  chemically synthesized
atgttatcaacataatttca

SEQ ID NO: 532424 - DNA, 20 bp, Artificial Sequence
  chemically synthesized
gtcaagtcaattgttttaca

SEQ ID NO: 532425 - DNA, 20 bp, Artificial Sequence
  chemically synthesized
caatccttgcatttttaatt

SEQ ID NO: 532426 - DNA, 20 bp, Artificial Sequence
  chemically synthesized
aggattgtggatatggaatt

SEQ ID NO: 532427 - DNA, 20 bp, Artificial Sequence
  chemically synthesized
tattaagatggtaattagtc

SEQ ID NO: 532428 - DNA, 20 bp, Artificial Sequence
  chemically synthesized
ctgctttaagtgggagaaaa

SEQ ID NO: 532429 - DNA, 20 bp, Artificial Sequence
  chemically synthesized
aacattaactgctttaagtg

SEQ ID NO: 532430 - DNA, 20 bp, Artificial Sequence
  chemically synthesized
tgttggccaagaggtataag

SEQ ID NO: 532431 - DNA, 20 bp, Artificial Sequence
  chemically synthesized
tcctatctcataatttaatt

SEQ ID NO: 532432 - DNA, 20 bp, Artificial Sequence
  chemically synthesized
attaagatgtctttgagaga

SEQ ID NO: 532433 - DNA, 20 bp, Artificial Sequence
  chemically synthesized
aagtaattaagatgtctttg

SEQ ID NO: 532434 - DNA, 20 bp, Artificial Sequence
  chemically synthesized
tcaatcagttctattttaat

SEQ ID NO: 532435 - DNA, 20 bp, Artificial Sequence
  chemically synthesized
ttttaattaagaaaaccaag

SEQ ID NO: 532436 - DNA, 20 bp, Artificial Sequence
  chemically synthesized
aaagtgtgattgcagaacta

SEQ ID NO: 532437 - DNA, 20 bp, Artificial Sequence
  chemically synthesized
cactgaaatgaagagtttga

SEQ ID NO: 532438 - DNA, 20 bp, Artificial Sequence
  chemically synthesized
aaactcttcatttcagtgaa

SEQ ID NO: 532439 - DNA, 20 bp, Artificial Sequence
  chemically synthesized
atatgctaagacagttagtg

SEQ ID NO: 532440 - DNA, 20 bp, Artificial Sequence
  chemically synthesized
aaatatgtgagtatggtaga

SEQ ID NO: 532441 - DNA, 20 bp, Artificial Sequence
  chemically synthesized
aaagcaactcttgaacactt

SEQ ID NO: 532442 - DNA, 20 bp, Artificial Sequence
  chemically synthesized
aacatgttatcaagtgtaaa

SEQ ID NO: 532443 - DNA, 20 bp, Artificial Sequence
  chemically synthesized
aagacctagtgaggaaacag

SEQ ID NO: 532444 - DNA, 20 bp, Artificial Sequence
  chemically synthesized
ctagtgaggaaacagccaga

SEQ ID NO: 532445 - DNA, 20 bp, Artificial Sequence
  chemically synthesized
tggaatatgaatcaaaattt

SEQ ID NO: 532446 - DNA, 20 bp, Artificial Sequence
  chemically synthesized
aatttggagaataagaggaa

SEQ ID NO: 532447 - DNA, 20 bp, Artificial Sequence
  chemically synthesized
gttggagagtaggaatgggg

SEQ ID NO: 532448 - DNA, 20 bp, Artificial Sequence
  chemically synthesized
agtaggaatggggttagaaa

SEQ ID NO: 532449 - DNA, 20 bp, Artificial Sequence
  chemically synthesized
tttattgattctcttggctc

SEQ ID NO: 532450 - DNA, 20 bp, Artificial Sequence
  chemically synthesized
aacatagattctctgagcca

SEQ ID NO: 532451 - DNA, 20 bp, Artificial Sequence
  chemically synthesized
agaatctatgttggggagta

SEQ ID NO: 532452 - DNA, 20 bp, Artificial Sequence
  chemically synthesized
agtaacagaatgatgcttgg

SEQ ID NO: 532453 - DNA, 20 bp, Artificial Sequence
  chemically synthesized
tggtgagaaaggaactggag

SEQ ID NO: 532454 - DNA, 20 bp, Artificial Sequence
  chemically synthesized
gaaaggaactggaggcagaa

SEQ ID NO: 532455 - DNA, 20 bp, Artificial Sequence
  chemically synthesized
aatgaagttatatttaatca

SEQ ID NO: 532456 - DNA, 20 bp, Artificial Sequence
  chemically synthesized
atgccatattgatacatttg

SEQ ID NO: 532457 - DNA, 20 bp, Artificial Sequence
  chemically synthesized
gcataacatgatgacttaaa

SEQ ID NO: 532458 - DNA, 20 bp, Artificial Sequence
  chemically synthesized
taagaatcttaatcacagga

SEQ ID NO: 532459 - DNA, 20 bp, Artificial Sequence
  chemically synthesized
aagagaaaagatgtatggca

SEQ ID NO: 532460 - DNA, 20 bp, Artificial Sequence
  chemically synthesized
ccattaatgtgtccattttt

SEQ ID NO: 532461 - DNA, 20 bp, Artificial Sequence
  chemically synthesized
tttgaaatataagagcagtt

SEQ ID NO: 532462 - DNA, 20 bp, Artificial Sequence
  chemically synthesized
agggatgattatgaaataga

SEQ ID NO: 532463 - DNA, 20 bp, Artificial Sequence
  chemically synthesized
taattagggatgattatgaa

SEQ ID NO: 532464 - DNA, 20 bp, Artificial Sequence
  chemically synthesized
aagctaaattgctttgatgt

SEQ ID NO: 532465 - DNA, 20 bp, Artificial Sequence
  chemically synthesized
ttgatctgaatatttaaatt

SEQ ID NO: 532466 - DNA, 20 bp, Artificial Sequence
  chemically synthesized
tatctaaggtgctgccaatt

SEQ ID NO: 532467 - DNA, 20 bp, Artificial Sequence
  chemically synthesized
ttcttgctgtcattaatcag

SEQ ID NO: 532468 - DNA, 20 bp, Artificial Sequence
  chemically synthesized
ttctacctgattaatgacag

SEQ ID NO: 532469 - DNA, 20 bp, Artificial Sequence
  chemically synthesized
tagctgacatgggaaactgc

SEQ ID NO: 532470 - DNA, 20 bp, Artificial Sequence
  chemically synthesized
gtgaacttgataaaataaaa

SEQ ID NO: 532471 - DNA, 20 bp, Artificial Sequence
  chemically synthesized
ttatcaagttcacatgaggc

SEQ ID NO: 532472 - DNA, 20 bp, Artificial Sequence
  chemically synthesized
ttcttttctgcacaaaagaa

SEQ ID NO: 532473 - DNA, 20 bp, Artificial Sequence
  chemically synthesized
catctttctttttcttttgt

SEQ ID NO: 532474 - DNA, 20 bp, Artificial Sequence
  chemically synthesized
aagttattcttttctgcaca

SEQ ID NO: 532475 - DNA, 20 bp, Artificial Sequence
  chemically synthesized
ttctttttcttttgtgcaga

SEQ ID NO: 532476 - DNA, 20 bp, Artificial Sequence
  chemically synthesized
tgataaccttcgtcattaaa

SEQ ID NO: 532477 - DNA, 20 bp, Artificial Sequence
  chemically synthesized
ctctcttaagagtttaagct

SEQ ID NO: 532478 - DNA, 20 bp, Artificial Sequence
  chemically synthesized
aaacaaatccttttctactc

SEQ ID NO: 532479 - DNA, 20 bp, Artificial Sequence
  chemically synthesized
agagtagattttttctagga

SEQ ID NO: 532480 - DNA, 20 bp, Artificial Sequence
  chemically synthesized
agaaagaaggaaacttctac

SEQ ID NO: 532481 - DNA, 20 bp, Artificial Sequence
  chemically synthesized
catatgataccgtagcatat

SEQ ID NO: 532482 - DNA, 20 bp, Artificial Sequence
  chemically synthesized
aaaagaaaaaagtaaaagaa

SEQ ID NO: 532483 - DNA, 20 bp, Artificial Sequence
  chemically synthesized
aaagaaaaaagaaaaaagta

SEQ ID NO: 532484 - DNA, 20 bp, Artificial Sequence
  chemically synthesized
agactctgtctcaaaagaaa

SEQ ID NO: 532485 - DNA, 20 bp, Artificial Sequence
  chemically synthesized
cagagtgagactctgtctca

SEQ ID NO: 532486 - DNA, 20 bp, Artificial Sequence
  chemically synthesized
ctactcaggaggctgaggca

SEQ ID NO: 532487 - DNA, 20 bp, Artificial Sequence
  chemically synthesized
attgaattctttttacattt

SEQ ID NO: 532488 - DNA, 20 bp, Artificial Sequence
  chemically synthesized
ctcactttcttcaaatgtaa

SEQ ID NO: 532489 - DNA, 20 bp, Artificial Sequence
  chemically synthesized
caagttagaagaactataaa

SEQ ID NO: 532490 - DNA, 20 bp, Artificial Sequence
  chemically synthesized
ggagtagttactacctctag

SEQ ID NO: 532491 - DNA, 20 bp, Artificial Sequence
  chemically synthesized
tcactttttctctagacaca

SEQ ID NO: 532492 - DNA, 20 bp, Artificial Sequence
  chemically synthesized
ttgtgctttcttctgtgtct

SEQ ID NO: 532493 - DNA, 20 bp, Artificial Sequence
  chemically synthesized
gcacaaaatatttttaataa

SEQ ID NO: 532494 - DNA, 20 bp, Artificial Sequence
  chemically synthesized
tttaataaagagaaatgaat

SEQ ID NO: 532495 - DNA, 20 bp, Artificial Sequence
  chemically synthesized
gaattaagaaaggcaactgc

SEQ ID NO: 532496 - DNA, 20 bp, Artificial Sequence
  chemically synthesized
atccattaactaacttctcc

SEQ ID NO: 532497 - DNA, 20 bp, Artificial Sequence
  chemically synthesized
taaccctgtgatatgccaag

SEQ ID NO: 532498 - DNA, 20 bp, Artificial Sequence
  chemically synthesized
caagagagaaatttatgaaa

SEQ ID NO: 532499 - DNA, 20 bp, Artificial Sequence
  chemically synthesized
tctacgtaaatcatccaatt

SEQ ID NO: 532500 - DNA, 20 bp, Artificial Sequence
  chemically synthesized
gtcctacaggacagcaggaa

SEQ ID NO: 532501 - DNA, 20 bp, Artificial Sequence
  chemically synthesized
cagcaggaagaagaatatgt

SEQ ID NO: 532502 - DNA, 20 bp, Artificial Sequence
  chemically synthesized
atgtgcagaattaccaaaca

SEQ ID NO: 532503 - DNA, 20 bp, Artificial Sequence
  chemically synthesized
caagcgatgaatgtgaattt

SEQ ID NO: 532504 - DNA, 20 bp, Artificial Sequence
  chemically synthesized
aacaggagaaggcaatacgc

SEQ ID NO: 532505 - DNA, 20 bp, Artificial Sequence
  chemically synthesized
gcactggggtacactttatc

SEQ ID NO: 532506 - DNA, 20 bp, Artificial Sequence
  chemically synthesized
ctctacagattactacgtaa

SEQ ID NO: 532507 - DNA, 20 bp, Artificial Sequence
  chemically synthesized
tcctgggagtctgtcatggg

SEQ ID NO: 532508 - DNA, 20 bp, Artificial Sequence
  chemically synthesized
tcacttgtatacacacagat

SEQ ID NO: 532509 - DNA, 20 bp, Artificial Sequence
  chemically synthesized
tcaagaaaattattatagta

SEQ ID NO: 532510 - DNA, 20 bp, Artificial Sequence
  chemically synthesized
atcctgttgcatagcaatcc

SEQ ID NO: 532511 - DNA, 20 bp, Artificial Sequence
  chemically synthesized
catagcaatcctgagaaaac

SEQ ID NO: 532512 - DNA, 20 bp, Artificial Sequence
  chemically synthesized
actttgcttacattctgttg

SEQ ID NO: 532513 - DNA, 20 bp, Artificial Sequence
  chemically synthesized
ctccaaaattcattctgtca

SEQ ID NO: 532514 - DNA, 20 bp, Artificial Sequence
  chemically synthesized
ggcttgtaatggcagaatga

SEQ ID NO: 532515 - DNA, 20 bp, Artificial Sequence
  chemically synthesized
aatgtctctggcttgtaatg

SEQ ID NO: 532516 - DNA, 20 bp, Artificial Sequence
  chemically synthesized
tgtttccttccttgttccca

SEQ ID NO: 532517 - DNA, 20 bp, Artificial Sequence
  chemically synthesized
agcctccattcattgtgtag

SEQ ID NO: 532518 - DNA, 20 bp, Artificial Sequence
  chemically synthesized
caatccaattgtttggagct

SEQ ID NO: 532519 - DNA, 20 bp, Artificial Sequence
  chemically synthesized
aattggattgatctgtgtaa

SEQ ID NO: 532520 - DNA, 20 bp, Artificial Sequence
  chemically synthesized
taattcaatttgagagagag

SEQ ID NO: 532521 - DNA, 20 bp, Artificial Sequence
  chemically synthesized
aattactctgctaaagtaag

SEQ ID NO: 532522 - DNA, 20 bp, Artificial Sequence
  chemically synthesized
aaagtaagggagaaaaagtg

SEQ ID NO: 532523 - DNA, 20 bp, Artificial Sequence
  chemically synthesized
aaagtggcagaaataacatg

SEQ ID NO: 532524 - DNA, 20 bp, Artificial Sequence
  chemically synthesized
tgaaaacttgagccagttct

SEQ ID NO: 532525 - DNA, 20 bp, Artificial Sequence
  chemically synthesized
cagccacagcctcttaagat

SEQ ID NO: 532526 - DNA, 20 bp, Artificial Sequence
  chemically synthesized
ctaccttacttgttcaacat

SEQ ID NO: 532527 - DNA, 20 bp, Artificial Sequence
  chemically synthesized
cctgcctgtctcccagtcaa

SEQ ID NO: 532528 - DNA, 20 bp, Artificial Sequence
  chemically synthesized
agacaggcaggggaatatgg

SEQ ID NO: 532529 - DNA, 20 bp, Artificial Sequence
  chemically synthesized
gtactactcagagatactac

SEQ ID NO: 532530 - DNA, 20 bp, Artificial Sequence
  chemically synthesized
tttgaccaaacttcgttctg

SEQ ID NO: 532531 - DNA, 20 bp, Artificial Sequence
  chemically synthesized
cgtaggcaaaaggaaaaaag

SEQ ID NO: 532532 - DNA, 20 bp, Artificial Sequence
  chemically synthesized
tccacgtaggcaaaaggaaa

SEQ ID NO: 532533 - DNA, 20 bp, Artificial Sequence
  chemically synthesized
atttgcacttcttcagcaaa

SEQ ID NO: 532534 - DNA, 20 bp, Artificial Sequence
  chemically synthesized
taatttatctaagtacttca

SEQ ID NO: 532535 - DNA, 20 bp, Artificial Sequence
  chemically synthesized
tagaaaactgatgctactag

SEQ ID NO: 532536 - DNA, 20 bp, Artificial Sequence
  chemically synthesized
tgtatgttaatgtagtaaac

SEQ ID NO: 532537 - DNA, 20 bp, Artificial Sequence
  chemically synthesized
ctatttatgcttgagaagac

SEQ ID NO: 532538 - DNA, 20 bp, Artificial Sequence
  chemically synthesized
tgggataaagactccttcct

SEQ ID NO: 532539 - DNA, 20 bp, Artificial Sequence
  chemically synthesized
agactccttcctttagaaat

SEQ ID NO: 532540 - DNA, 20 bp, Artificial Sequence
  chemically synthesized
ctctgtatcaccatcatgac

SEQ ID NO: 532541 - DNA, 20 bp, Artificial Sequence
  chemically synthesized
tcagtgctctcatctgcaaa

SEQ ID NO: 532542 - DNA, 20 bp, Artificial Sequence
  chemically synthesized
cccaagatcttctagaatca

SEQ ID NO: 532543 - DNA, 20 bp, Artificial Sequence
  chemically synthesized
tggaggcagcccaagatctt

SEQ ID NO: 532544 - DNA, 20 bp, Artificial Sequence
  chemically synthesized
ggtaaacattttatcaaact

SEQ ID NO: 532545 - DNA, 20 bp, Artificial Sequence
  chemically synthesized
aaaaaaaaaaaaaagagcag

SEQ ID NO: 532546 - DNA, 20 bp, Artificial Sequence
  chemically synthesized
ctacttgggaggctgaggca

SEQ ID NO: 532547 - DNA, 20 bp, Artificial Sequence
  chemically synthesized
taattttttttgtattttta

SEQ ID NO: 532548 - DNA, 20 bp, Artificial Sequence
  chemically synthesized
ttctggcaacagggaaattt

SEQ ID NO: 532549 - DNA, 20 bp, Artificial Sequence
  chemically synthesized
caaatttccctgttgccaga

SEQ ID NO: 532550 - DNA, 20 bp, Artificial Sequence
  chemically synthesized
aaagagatgaattactgatg

SEQ ID NO: 532551 - DNA, 20 bp, Artificial Sequence
  chemically synthesized
tggactactatgaaccatac

SEQ ID NO: 532552 - DNA, 20 bp, Artificial Sequence
  chemically synthesized
gttcaattcccacctatgag

SEQ ID NO: 532553 - DNA, 20 bp, Artificial Sequence
  chemically synthesized
ctgttcttgtgatagtttac

SEQ ID NO: 532554 - DNA, 20 bp, Artificial Sequence
  chemically synthesized
ccaacagtgatagactggat

SEQ ID NO: 532555 - DNA, 20 bp, Artificial Sequence
  chemically synthesized
gattcctcagggatctagaa

SEQ ID NO: 532556 - DNA, 20 bp, Artificial Sequence
  chemically synthesized
acaggtgctggagaggatgt

SEQ ID NO: 532557 - DNA, 20 bp, Artificial Sequence
  chemically synthesized
gagataccatctcacaccag

SEQ ID NO: 532558 - DNA, 20 bp, Artificial Sequence
  chemically synthesized
gctcaccatcactggccatc

SEQ ID NO: 532559 - DNA, 20 bp, Artificial Sequence
  chemically synthesized
aatgaactcaaacaaatgta

SEQ ID NO: 532560 - DNA, 20 bp, Artificial Sequence
  chemically synthesized
atctgacaaagggctaatat

SEQ ID NO: 532561 - DNA, 20 bp, Artificial Sequence
  chemically synthesized
aacaggcaacctacaacatg

SEQ ID NO: 532562 - DNA, 20 bp, Artificial Sequence
  chemically synthesized
taaagagcttctgcacagca

SEQ ID NO: 532563 - DNA, 20 bp, Artificial Sequence
  chemically synthesized
aaaagcaatggcaacaaaag

SEQ ID NO: 532564 - DNA, 20 bp, Artificial Sequence
  chemically synthesized
ctaaaaccataaaaacccta

SEQ ID NO: 532565 - DNA, 20 bp, Artificial Sequence
  chemically synthesized
ggaaaactggctagccatat

SEQ ID NO: 532566 - DNA, 20 bp, Artificial Sequence
  chemically synthesized
tatctgatctttaacaaacc

SEQ ID NO: 532567 - DNA, 20 bp, Artificial Sequence
  chemically synthesized
agtggaacagaacagagccc

SEQ ID NO: 532568 - DNA, 20 bp, Artificial Sequence
  chemically synthesized
gtagttttttccaattctgt

SEQ ID NO: 532569 - DNA, 20 bp, Artificial Sequence
  chemically synthesized
agctaccaatgcctttcttc

SEQ ID NO: 532570 - DNA, 20 bp, Artificial Sequence
  chemically synthesized
cattccatgctcatgggtag

SEQ ID NO: 532571 - DNA, 20 bp, Artificial Sequence
  chemically synthesized
cccattcacaattgcttcaa

SEQ ID NO: 532572 - DNA, 20 bp, Artificial Sequence
  chemically synthesized
gtttgtctgttgttggtgta

SEQ ID NO: 532573 - DNA, 20 bp, Artificial Sequence
  chemically synthesized
cagacgacatgattgtatat

SEQ ID NO: 532574 - DNA, 20 bp, Artificial Sequence
  chemically synthesized
aaagagcaaaagattgatat

SEQ ID NO: 532575 - DNA, 20 bp, Artificial Sequence
  chemically synthesized
ctggacaaaggataattttc

SEQ ID NO: 532576 - DNA, 20 bp, Artificial Sequence
  chemically synthesized
ttatttcacttctgacttaa

SEQ ID NO: 532577 - DNA, 20 bp, Artificial Sequence
  chemically synthesized
aagactacaatcacaaaaaa

SEQ ID NO: 532578 - DNA, 20 bp, Artificial Sequence
  chemically synthesized
accctagagggttgttgaga

SEQ ID NO: 532579 - DNA, 20 bp, Artificial Sequence
  chemically synthesized
tagcaaatctagcactgcca

SEQ ID NO: 532580 - DNA, 20 bp, Artificial Sequence
  chemically synthesized
gagatgcatccaatacaaca

SEQ ID NO: 532581 - DNA, 20 bp, Artificial Sequence
  chemically synthesized
aagagaaaacacaaagtaat

SEQ ID NO: 532582 - DNA, 20 bp, Artificial Sequence
  chemically synthesized
aaataatgtgtgtccccata

SEQ ID NO: 532583 - DNA, 20 bp, Artificial Sequence
  chemically synthesized
gtggaatttgaaaaagccct

SEQ ID NO: 532584 - DNA, 20 bp, Artificial Sequence
  chemically synthesized
aatctcctttctcagcttcc

SEQ ID NO: 532585 - DNA, 20 bp, Artificial Sequence
  chemically synthesized
catgagttttctctggaagc

SEQ ID NO: 532586 - DNA, 20 bp, Artificial Sequence
  chemically synthesized
atccatgtggaaatcagatg

SEQ ID NO: 532587 - DNA, 20 bp, Artificial Sequence
  chemically synthesized
acgattgggaaattggaaca

SEQ ID NO: 532588 - DNA, 20 bp, Artificial Sequence
  chemically synthesized
aaagaaaatattccaggtaa

SEQ ID NO: 532589 - DNA, 20 bp, Artificial Sequence
  chemically synthesized
ggaatggacaatgagagttg

SEQ ID NO: 532590 - DNA, 20 bp, Artificial Sequence
  chemically synthesized
atgagagttgagagaaatag

SEQ ID NO: 532591 - DNA, 20 bp, Artificial Sequence
  chemically synthesized
agaccaactgcttaaaccaa

SEQ ID NO: 532592 - DNA, 20 bp, Artificial Sequence
  chemically synthesized
gtcttcctttaggaagccac

SEQ ID NO: 532593 - DNA, 20 bp, Artificial Sequence
  chemically synthesized
aagccaccgagaataaaagt

SEQ ID NO: 532594 - DNA, 20 bp, Artificial Sequence
  chemically synthesized
caccgagaataaaagtttag

SEQ ID NO: 532595 - DNA, 20 bp, Artificial Sequence
  chemically synthesized
tgtactatttcattcaaaaa

SEQ ID NO: 532596 - DNA, 20 bp, Artificial Sequence
  chemically synthesized
taagtaataatacaactggg

SEQ ID NO: 532597 - DNA, 20 bp, Artificial Sequence
  chemically synthesized
aagttatggatgttttacta

SEQ ID NO: 532598 - DNA, 20 bp, Artificial Sequence
  chemically synthesized
aaaataaagaagggagatgt

SEQ ID NO: 532599 - DNA, 20 bp, Artificial Sequence
  chemically synthesized
atacgattattcatgatgtt

SEQ ID NO: 532600 - DNA, 20 bp, Artificial Sequence
  chemically synthesized
aaggaaacaaacacaatggt

SEQ ID NO: 532601 - DNA, 20 bp, Artificial Sequence
  chemically synthesized
aaacaaacacaatggtgtag

SEQ ID NO: 532602 - DNA, 20 bp, Artificial Sequence
  chemically synthesized
aataagtgaccaaatctcct

SEQ ID NO: 532603 - DNA, 20 bp, Artificial Sequence
  chemically synthesized
tattcatatactaactgctt

SEQ ID NO: 532604 - DNA, 20 bp, Artificial Sequence
  chemically synthesized
gttcctgaccttctaagttc

SEQ ID NO: 532605 - DNA, 20 bp, Artificial Sequence
  chemically synthesized
aacatacaattcaaaatagt

SEQ ID NO: 532606 - DNA, 20 bp, Artificial Sequence
  chemically synthesized
aggaagaagtgacaccttac

SEQ ID NO: 532607 - DNA, 20 bp, Artificial Sequence
  chemically synthesized
aagtgacaccttacagagaa

SEQ ID NO: 532608 - DNA, 20 bp, Artificial Sequence
  chemically synthesized
attcagtaaaatctgtttaa

SEQ ID NO: 532609 - DNA, 20 bp, Artificial Sequence
  chemically synthesized
acactcatacgtatacacac

SEQ ID NO: 532610 - DNA, 20 bp, Artificial Sequence
  chemically synthesized
tctgttcttatgtcttcata

SEQ ID NO: 532611 - DNA, 20 bp, Artificial Sequence
  chemically synthesized
tctattatgaagacataaga

SEQ ID NO: 532612 - DNA, 20 bp, Artificial Sequence
  chemically synthesized
cagaaattgaaagcaaatct

SEQ ID NO: 532613 - DNA, 20 bp, Artificial Sequence
  chemically synthesized
tttcctaacaagtttttcga

SEQ ID NO: 532614 - DNA, 20 bp, Artificial Sequence
  chemically synthesized
ttttcgagaagaatccatag

SEQ ID NO: 532615 - DNA, 20 bp, Artificial Sequence
  chemically synthesized
aggaacctccggtggttaga

SEQ ID NO: 532616 - DNA, 20 bp, Artificial Sequence
  chemically synthesized
accggaggttcctaaccaga

SEQ ID NO: 532617 - DNA, 20 bp, Artificial Sequence
  chemically synthesized
aaggtgttgcgtggccacat

SEQ ID NO: 532618 - DNA, 20 bp, Artificial Sequence
  chemically synthesized
gcagcagagttgtcgtccca

SEQ ID NO: 532619 - DNA, 20 bp, Artificial Sequence
  chemically synthesized
gctgttgcagtgcttaagtg

SEQ ID NO: 532620 - DNA, 20 bp, Artificial Sequence
  chemically synthesized
cacttgggaatatactgagg

SEQ ID NO: 532621 - DNA, 20 bp, Artificial Sequence
  chemically synthesized
agtcagagggtcacacaagg

SEQ ID NO: 532622 - DNA, 20 bp, Artificial Sequence
  chemically synthesized
tcagttttaaaaggtaatct

SEQ ID NO: 532623 - DNA, 20 bp, Artificial Sequence
  chemically synthesized
taggaaaaacaagacgtaga

SEQ ID NO: 532624 - DNA, 20 bp, Artificial Sequence
  chemically synthesized
tttgcattgtgactggatga

SEQ ID NO: 532625 - DNA, 20 bp, Artificial Sequence
  chemically synthesized
ctagcaggattggagtcatg

SEQ ID NO: 532626 - DNA, 20 bp, Artificial Sequence
  chemically synthesized
agaagatatgaggccgttca

SEQ ID NO: 532627 - DNA, 20 bp, Artificial Sequence
  chemically synthesized
acagtgtagccaatgagagc

SEQ ID NO: 532628 - DNA, 20 bp, Artificial Sequence
  chemically synthesized
tacagtggaatattatcctt

SEQ ID NO: 532629 - DNA, 20 bp, Artificial Sequence
  chemically synthesized
gaaccaaaacagcagtggct

SEQ ID NO: 532630 - DNA, 20 bp, Artificial Sequence
  chemically synthesized
tcttgtcctacctttggaag

SEQ ID NO: 532631 - DNA, 20 bp, Artificial Sequence
  chemically synthesized
ttcacaagtacattttaaag

SEQ ID NO: 532632 - DNA, 20 bp, Artificial Sequence
  chemically synthesized
aagttctatttctcaaggag

SEQ ID NO: 532633 - DNA, 20 bp, Artificial Sequence
  chemically synthesized
tgtatttttttcttactcct

SEQ ID NO: 532634 - DNA, 20 bp, Artificial Sequence
  chemically synthesized
acaccttggggccaaataaa

SEQ ID NO: 532635 - DNA, 20 bp, Artificial Sequence
  chemically synthesized
ttctaaaggacacaatttcc

SEQ ID NO: 532636 - DNA, 20 bp, Artificial Sequence
  chemically synthesized
ctctgcacataaactttaaa

SEQ ID NO: 532637 - DNA, 20 bp, Artificial Sequence
  chemically synthesized
cttttaattctggtgttgaa

SEQ ID NO: 532638 - DNA, 20 bp, Artificial Sequence
  chemically synthesized
actcgttttctctttcaaca

SEQ ID NO: 532639 - DNA, 20 bp, Artificial Sequence
  chemically synthesized
ttttagatgcagtattaaaa

SEQ ID NO: 532640 - DNA, 20 bp, Artificial Sequence
  chemically synthesized
taatactgcatctaaaatcc

SEQ ID NO: 532641 - DNA, 20 bp, Artificial Sequence
  chemically synthesized
actgaggctgtatagcaata

SEQ ID NO: 532642 - DNA, 20 bp, Artificial Sequence
  chemically synthesized
gtgcaggaatcagtctgttt

SEQ ID NO: 532643 - DNA, 20 bp, Artificial Sequence
  chemically synthesized
tgaagaaaactacccttatc

SEQ ID NO: 532644 - DNA, 20 bp, Artificial Sequence
  chemically synthesized
gacactggagcttggaggga

SEQ ID NO: 532645 - DNA, 20 bp, Artificial Sequence
  chemically synthesized
ttgtgttcatttagaaccat

SEQ ID NO: 532646 - DNA, 20 bp, Artificial Sequence
  chemically synthesized
gggaagagagttacctattt

SEQ ID NO: 532647 - DNA, 20 bp, Artificial Sequence
  chemically synthesized
agcttagtgacaaagagatt

SEQ ID NO: 532648 - DNA, 20 bp, Artificial Sequence
  chemically synthesized
taagctattttttgtcctcc

SEQ ID NO: 532649 - DNA, 20 bp, Artificial Sequence
  chemically synthesized
ctgtggttcaaggttgtata

SEQ ID NO: 532650 - DNA, 20 bp, Artificial Sequence
  chemically synthesized
tcccaataacacatatctaa

SEQ ID NO: 532651 - DNA, 20 bp, Artificial Sequence
  chemically synthesized
taattatttttgatcataca

SEQ ID NO: 532652 - DNA, 20 bp, Artificial Sequence
  chemically synthesized
tttagggggtaaagtggggg

SEQ ID NO: 532653 - DNA, 20 bp, Artificial Sequence
  chemically synthesized
tgctatttaaaatgaaaaaa

SEQ ID NO: 532654 - DNA, 20 bp, Artificial Sequence
  chemically synthesized
cattcaaaacttatgaatac

SEQ ID NO: 532655 - DNA, 20 bp, Artificial Sequence
  chemically synthesized
ttaactcactgaagatcacc

SEQ ID NO: 532656 - DNA, 20 bp, Artificial Sequence
  chemically synthesized
tttgctctacttggtagtag

SEQ ID NO: 532657 - DNA, 20 bp, Artificial Sequence
  chemically synthesized
aaagtcacactctccagaag

SEQ ID NO: 532658 - DNA, 20 bp, Artificial Sequence
  chemically synthesized
cacaaaagtcacactctcca

SEQ ID NO: 532659 - DNA, 20 bp, Artificial Sequence
  chemically synthesized
gttcaccctattgtataaga

SEQ ID NO: 532660 - DNA, 20 bp, Artificial Sequence
  chemically synthesized
aatagggtgaacagtgatgg

SEQ ID NO: 532661 - DNA, 20 bp, Artificial Sequence
  chemically synthesized
gaaagctcatgaatgggttc

SEQ ID NO: 532662 - DNA, 20 bp, Artificial Sequence
  chemically synthesized
cacaaggcagcaggagagag

SEQ ID NO: 532663 - DNA, 20 bp, Artificial Sequence
  chemically synthesized
gagactggggtaatttattt

SEQ ID NO: 532664 - DNA, 20 bp, Artificial Sequence
  chemically synthesized
aactgaactgaatgctttgg

SEQ ID NO: 532665 - DNA, 20 bp, Artificial Sequence
  chemically synthesized
tccgtctcaaaaaaaaagaa

SEQ ID NO: 532666 - DNA, 20 bp, Artificial Sequence
  chemically synthesized
ctacttgggaggctgaggca

SEQ ID NO: 532667 - DNA, 20 bp, Artificial Sequence
  chemically synthesized
tgactttacagattatttta

SEQ ID NO: 532668 - DNA, 20 bp, Artificial Sequence
  chemically synthesized
attttacaagaatttttaca

SEQ ID NO: 532669 - DNA, 20 bp, Artificial Sequence
  chemically synthesized
ctactcaggaggctgaggca

SEQ ID NO: 532670 - DNA, 20 bp, Artificial Sequence
  chemically synthesized
ctgcttcataacaccctgag

SEQ ID NO: 532671 - DNA, 20 bp, Artificial Sequence
  chemically synthesized
ataacaccctgagtaagaaa

SEQ ID NO: 532672 - DNA, 20 bp, Artificial Sequence
  chemically synthesized
agcctcatggtgacccaaac

SEQ ID NO: 532673 - DNA, 20 bp, Artificial Sequence
  chemically synthesized
tccacccttctaaggcaggg

SEQ ID NO: 532674 - DNA, 20 bp, Artificial Sequence
  chemically synthesized
gtgatacggttttaaattta

SEQ ID NO: 532675 - DNA, 20 bp, Artificial Sequence
  chemically synthesized
cagaaaaatattcaccaaca

SEQ ID NO: 532676 - DNA, 20 bp, Artificial Sequence
  chemically synthesized
aatattcaccaacaggagaa

SEQ ID NO: 532677 - DNA, 20 bp, Artificial Sequence
  chemically synthesized
aattattaatgttatcctga

SEQ ID NO: 532678 - DNA, 20 bp, Artificial Sequence
  chemically synthesized
gagaactctgacaaaaccag

SEQ ID NO: 532679 - DNA, 20 bp, Artificial Sequence
  chemically synthesized
tgttttccttttgtgggctg

SEQ ID NO: 532680 - DNA, 20 bp, Artificial Sequence
  chemically synthesized
aagttgaagataagacgaga

SEQ ID NO: 532681 - DNA, 20 bp, Artificial Sequence
  chemically synthesized
agagagagagagagagagag

SEQ ID NO: 532682 - DNA, 20 bp, Artificial Sequence
  chemically synthesized
aggcaagaacattagaggca

SEQ ID NO: 532683 - DNA, 20 bp, Artificial Sequence
  chemically synthesized
ctgaggtaatagacacagga

SEQ ID NO: 532684 - DNA, 20 bp, Artificial Sequence
  chemically synthesized
cccccatcttcttctctaag

SEQ ID NO: 532685 - DNA, 20 bp, Artificial Sequence
  chemically synthesized
aacacagacgcctgagagag

SEQ ID NO: 532686 - DNA, 20 bp, Artificial Sequence
  chemically synthesized
ttctcaaacttgagtgggct

SEQ ID NO: 532687 - DNA, 20 bp, Artificial Sequence
  chemically synthesized
ttgagttctaccccagacat

SEQ ID NO: 532688 - DNA, 20 bp, Artificial Sequence
  chemically synthesized
tgtatgtctggggtagaact

SEQ ID NO: 532689 - DNA, 20 bp, Artificial Sequence
  chemically synthesized
cggcatcacttgggaacttc

SEQ ID NO: 532690 - DNA, 20 bp, Artificial Sequence
  chemically synthesized
ctagtccagagaccccattt

SEQ ID NO: 532691 - DNA, 20 bp, Artificial Sequence
  chemically synthesized
ggaggtcatgaatgccttta

SEQ ID NO: 532692 - DNA, 20 bp, Artificial Sequence
  chemically synthesized
gatcttctcctcaaaaacct

SEQ ID NO: 532693 - DNA, 20 bp, Artificial Sequence
  chemically synthesized
taaaggagaacccccaagaa

SEQ ID NO: 532694 - DNA, 20 bp, Artificial Sequence
  chemically synthesized
attttacttatttagttgtc

SEQ ID NO: 532695 - DNA, 20 bp, Artificial Sequence
  chemically synthesized
agaggtgggtgggtaaccat

SEQ ID NO: 532696 - DNA, 20 bp, Artificial Sequence
  chemically synthesized
agatcaaaggaaaagataat

SEQ ID NO: 532697 - DNA, 20 bp, Artificial Sequence
  chemically synthesized
gataattaagaatgtgctta

SEQ ID NO: 532698 - DNA, 20 bp, Artificial Sequence
  chemically synthesized
tatgagacaatgcctgttgt

SEQ ID NO: 532699 - DNA, 20 bp, Artificial Sequence
  chemically synthesized
agagcattttgactttaccc

SEQ ID NO: 532700 - DNA, 20 bp, Artificial Sequence
  chemically synthesized
gctgggctatggaaagcaca

SEQ ID NO: 532701 - DNA, 20 bp, Artificial Sequence
  chemically synthesized
aatgatggctctgaggttgg

SEQ ID NO: 532702 - DNA, 20 bp, Artificial Sequence
  chemically synthesized
gcaaaacagcccatgcaata

SEQ ID NO: 532703 - DNA, 20 bp, Artificial Sequence
  chemically synthesized
tgggctgttttgcctacagc

SEQ ID NO: 532704 - DNA, 20 bp, Artificial Sequence
  chemically synthesized
agctaaaacattaccatcag

SEQ ID NO: 532705 - DNA, 20 bp, Artificial Sequence
  chemically synthesized
acccaataaaagtttgctga

SEQ ID NO: 532706 - DNA, 20 bp, Artificial Sequence
  chemically synthesized
gtttgaggctaatggcttca

SEQ ID NO: 532707 - DNA, 20 bp, Artificial Sequence
  chemically synthesized
ctcttagaactcagaggcaa

SEQ ID NO: 532708 - DNA, 20 bp, Artificial Sequence
  chemically synthesized
catggttttaagtgtgattg

SEQ ID NO: 532709 - DNA, 20 bp, Artificial Sequence
  chemically synthesized
ctgaaaaactgcctggtgcc

SEQ ID NO: 532710 - DNA, 20 bp, Artificial Sequence
  chemically synthesized
tatattgattttacagtgaa

SEQ ID NO: 532711 - DNA, 20 bp, Artificial Sequence
  chemically synthesized
caagtcctcttttaaatgct

SEQ ID NO: 532712 - DNA, 20 bp, Artificial Sequence
  chemically synthesized
atttaggcaaagaaaggagc

SEQ ID NO: 532713 - DNA, 20 bp, Artificial Sequence
  chemically synthesized
atgaaatagttcatttaggc

SEQ ID NO: 532714 - DNA, 20 bp, Artificial Sequence
  chemically synthesized
tttagcacaatattttgttt

SEQ ID NO: 532715 - DNA, 20 bp, Artificial Sequence
  chemically synthesized
acggaattaaactataatta

SEQ ID NO: 532716 - DNA, 20 bp, Artificial Sequence
  chemically synthesized
aaagcacagtaactatttga

SEQ ID NO: 532717 - DNA, 20 bp, Artificial Sequence
  chemically synthesized
ttgtaggcagatgtaagaca

SEQ ID NO: 532718 - DNA, 20 bp, Artificial Sequence
  chemically synthesized
aaaataatgtacactttcaa

SEQ ID NO: 532719 - DNA, 20 bp, Artificial Sequence
  chemically synthesized
acctctgaaataaaagcaat

SEQ ID NO: 532720 - DNA, 20 bp, Artificial Sequence
  chemically synthesized
gtgtaagcaaacagttctac

SEQ ID NO: 532721 - DNA, 20 bp, Artificial Sequence
  chemically synthesized
ctgttacaatcagtggtagc

SEQ ID NO: 532722 - DNA, 20 bp, Artificial Sequence
  chemically synthesized
ccaagtgttttaaatgcgga

SEQ ID NO: 532723 - DNA, 20 bp, Artificial Sequence
  chemically synthesized
gttaattcactatttagtga

SEQ ID NO: 532724 - DNA, 20 bp, Artificial Sequence
  chemically synthesized
aaagattcaagaagtacgga

SEQ ID NO: 532725 - DNA, 20 bp, Artificial Sequence
  chemically synthesized
aaacataaggaagtttggga

SEQ ID NO: 532726 - DNA, 20 bp, Artificial Sequence
  chemically synthesized
taagattttcaacagataga

SEQ ID NO: 532727 - DNA, 20 bp, Artificial Sequence
  chemically synthesized
ttttaaaatataaaaatctc

SEQ ID NO: 532728 - DNA, 20 bp, Artificial Sequence
  chemically synthesized
tgtggcgaaactctgtttct

SEQ ID NO: 532729 - DNA, 20 bp, Artificial Sequence
  chemically synthesized
cgctactttttgtattttct

SEQ ID NO: 532730 - DNA, 20 bp, Artificial Sequence
  chemically synthesized
tcacagattgataggatttc

SEQ ID NO: 532731 - DNA, 20 bp, Artificial Sequence
  chemically synthesized
tgataggatttccaagaata

SEQ ID NO: 532732 - DNA, 20 bp, Artificial Sequence
  chemically synthesized
ggtagcataagcgtctgggg

SEQ ID NO: 532733 - DNA, 20 bp, Artificial Sequence
  chemically synthesized
aaccaaagtagattgcctac

SEQ ID NO: 532734 - DNA, 20 bp, Artificial Sequence
  chemically synthesized
actaaataaaaaaagattgt

SEQ ID NO: 532735 - DNA, 20 bp, Artificial Sequence
  chemically synthesized
aacagaaatagccaaaaggg

SEQ ID NO: 532736 - DNA, 20 bp, Artificial Sequence
  chemically synthesized
ttctttgactaagctcgcca

SEQ ID NO: 532737 - DNA, 20 bp, Artificial Sequence
  chemically synthesized
ttctgttggcgagcttagtc

SEQ ID NO: 532738 - DNA, 20 bp, Artificial Sequence
  chemically synthesized
ccttctccagccaggaagct

SEQ ID NO: 532739 - DNA, 20 bp, Artificial Sequence
  chemically synthesized
actatatagaactgatccaa

SEQ ID NO: 532740 - DNA, 20 bp, Artificial Sequence
  chemically synthesized
tggatcagttctatatagtt

SEQ ID NO: 532741 - DNA, 20 bp, Artificial Sequence
  chemically synthesized
aacggagttcactgcagaaa

SEQ ID NO: 532742 - DNA, 20 bp, Artificial Sequence
  chemically synthesized
tcaatataacggagttcact

SEQ ID NO: 532743 - DNA, 20 bp, Artificial Sequence
  chemically synthesized
aaaggaagatattgcaagta

SEQ ID NO: 532744 - DNA, 20 bp, Artificial Sequence
  chemically synthesized
gctgtgacaaagaaccatgt

SEQ ID NO: 532745 - DNA, 20 bp, Artificial Sequence
  chemically synthesized
tgtcttgtaaagtatgttct

SEQ ID NO: 532746 - DNA, 20 bp, Artificial Sequence
  chemically synthesized
gatatgagggacaaaagaga

SEQ ID NO: 532747 - DNA, 20 bp, Artificial Sequence
  chemically synthesized
aaattgtacatgagatatat

SEQ ID NO: 532748 - DNA, 20 bp, Artificial Sequence
  chemically synthesized
gtaccaggttctaacatcag

SEQ ID NO: 532749 - DNA, 20 bp, Artificial Sequence
  chemically synthesized
aagagtagagaccttgacca

SEQ ID NO: 532750 - DNA, 20 bp, Artificial Sequence
  chemically synthesized
ctactcaggaggctgaggca

SEQ ID NO: 532751 - DNA, 20 bp, Artificial Sequence
  chemically synthesized
tatagtaaagtaaagtaaca

SEQ ID NO: 532752 - DNA, 20 bp, Artificial Sequence
  chemically synthesized
tacttggagagaatgagcgg

SEQ ID NO: 532753 - DNA, 20 bp, Artificial Sequence
  chemically synthesized
acagaccttttgttacttgg

SEQ ID NO: 532754 - DNA, 20 bp, Artificial Sequence
  chemically synthesized
ctgcgtgcagtgaaccccag

SEQ ID NO: 532755 - DNA, 20 bp, Artificial Sequence
  chemically synthesized
tgctttccgttccctgaatg

SEQ ID NO: 532756 - DNA, 20 bp, Artificial Sequence
  chemically synthesized
acattcagggaacggaaagc

SEQ ID NO: 532757 - DNA, 20 bp, Artificial Sequence
  chemically synthesized
tcggttctgtttgctacgga

SEQ ID NO: 532758 - DNA, 20 bp, Artificial Sequence
  chemically synthesized
ccaataacaaaatgcccttc

SEQ ID NO: 532759 - DNA, 20 bp, Artificial Sequence
  chemically synthesized
taagaactaggacactgtca

SEQ ID NO: 532760 - DNA, 20 bp, Artificial Sequence
  chemically synthesized
acactgtcatgagaaagatc

SEQ ID NO: 532761 - DNA, 20 bp, Artificial Sequence
  chemically synthesized
gatcctagaatagcttcttg

SEQ ID NO: 532762 - DNA, 20 bp, Artificial Sequence
  chemically synthesized
cattcttttttttttttttt

SEQ ID NO: 532763 - DNA, 20 bp, Artificial Sequence
  chemically synthesized
atttctttaaaaaaaaaaaa

SEQ ID NO: 532764 - DNA, 20 bp, Artificial Sequence
  chemically synthesized
cgtttgcattaccgacagat

SEQ ID NO: 532765 - DNA, 20 bp, Artificial Sequence
  chemically synthesized
ctgtcggtaatgcaaacggg

SEQ ID NO: 532766 - DNA, 20 bp, Artificial Sequence
  chemically synthesized
tactttaaattttcctttac

SEQ ID NO: 532767 - DNA, 20 bp, Artificial Sequence
  chemically synthesized
atacagttagaaatgtctag

SEQ ID NO: 532768 - DNA, 20 bp, Artificial Sequence
  chemically synthesized
cctgttttctctagatacag

SEQ ID NO: 532769 - DNA, 20 bp, Artificial Sequence
  chemically synthesized
agacatttctaactgtatct

SEQ ID NO: 532770 - DNA, 20 bp, Artificial Sequence
  chemically synthesized
cacatcagccttttcctttt

SEQ ID NO: 532771 - DNA, 20 bp, Artificial Sequence
  chemically synthesized
aaaaaaaaaaaaaaaaaaaa

SEQ ID NO: 532772 - DNA, 20 bp, Artificial Sequence
  chemically synthesized
gttcaattcccacctatgag

SEQ ID NO: 532773 - DNA, 20 bp, Artificial Sequence
  chemically synthesized
ttgttcttgcgatagtttac

SEQ ID NO: 532774 - DNA, 20 bp, Artificial Sequence
  chemically synthesized
ccaacaatgatagactggat

SEQ ID NO: 532775 - DNA, 20 bp, Artificial Sequence
  chemically synthesized
gattcctcagggatctagaa

SEQ ID NO: 532776 - DNA, 20 bp, Artificial Sequence
  chemically synthesized
acaggtgctggagaggatgt

SEQ ID NO: 532777 - DNA, 20 bp, Artificial Sequence
  chemically synthesized
gagatatcatctcacaccag

SEQ ID NO: 532778 - DNA, 20 bp, Artificial Sequence
  chemically synthesized
gctcatcatcactggccatc

SEQ ID NO: 532779 - DNA, 20 bp, Artificial Sequence
  chemically synthesized
tatgcagccaaaaaacacat

SEQ ID NO: 532780 - DNA, 20 bp, Artificial Sequence
  chemically synthesized
aatgaactcaaacaaattta

SEQ ID NO: 532781 - DNA, 20 bp, Artificial Sequence
  chemically synthesized
atctgacaaagggctaatat

SEQ ID NO: 532782 - DNA, 20 bp, Artificial Sequence
  chemically synthesized
aacaggcaacctacaacatg

SEQ ID NO: 532783 - DNA, 20 bp, Artificial Sequence
  chemically synthesized
tcaagagcttctgcacagca

SEQ ID NO: 532784 - DNA, 20 bp, Artificial Sequence
  chemically synthesized
aaaactttgaaaaaaattta

SEQ ID NO: 532785 - DNA, 20 bp, Artificial Sequence
  chemically synthesized
aaatttagaagaatgtataa

SEQ ID NO: 532786 - DNA, 20 bp, Artificial Sequence
  chemically synthesized
ccaaggctcgagaactacgt

SEQ ID NO: 532787 - DNA, 20 bp, Artificial Sequence
  chemically synthesized
ggagccgatgcgatcaactg

SEQ ID NO: 532788 - DNA, 20 bp, Artificial Sequence
  chemically synthesized
tgaagcgagaagggaagttt

SEQ ID NO: 532789 - DNA, 20 bp, Artificial Sequence
  chemically synthesized
agaagggaagtttagagaaa

SEQ ID NO: 532790 - DNA, 20 bp, Artificial Sequence
  chemically synthesized
gtttagagaaaaaagaataa

SEQ ID NO: 532791 - DNA, 20 bp, Artificial Sequence
  chemically synthesized
aaagaaatgagcaaagcctc

SEQ ID NO: 532792 - DNA, 20 bp, Artificial Sequence
  chemically synthesized
ggtgtacctgaaagtgatgt

SEQ ID NO: 532793 - DNA, 20 bp, Artificial Sequence
  chemically synthesized
aaaatgttaagggcagccag

SEQ ID NO: 532794 - DNA, 20 bp, Artificial Sequence
  chemically synthesized
gactaacagcggatctctcg

SEQ ID NO: 532795 - DNA, 20 bp, Artificial Sequence
  chemically synthesized
ggccaatattcaacattctt

SEQ ID NO: 532796 - DNA, 20 bp, Artificial Sequence
  chemically synthesized
atattcaacattcttaaaga

SEQ ID NO: 532797 - DNA, 20 bp, Artificial Sequence
  chemically synthesized
gggttgaaaattcttttctt

SEQ ID NO: 532798 - DNA, 20 bp, Artificial Sequence
  chemically synthesized
taaagaaaagaattttcaac

SEQ ID NO: 532799 - DNA, 20 bp, Artificial Sequence
  chemically synthesized
aactaagcttcataagtgaa

SEQ ID NO: 532800 - DNA, 20 bp, Artificial Sequence
  chemically synthesized
gtaaagaccatcgagactag

SEQ ID NO: 532801 - DNA, 20 bp, Artificial Sequence
  chemically synthesized
ccagtctgtgtcttttaatt

SEQ ID NO: 532802 - DNA, 20 bp, Artificial Sequence
  chemically synthesized
acattagacagatcaacgag

SEQ ID NO: 532803 - DNA, 20 bp, Artificial Sequence
  chemically synthesized
gaactctccaccccaaatca

SEQ ID NO: 532804 - DNA, 20 bp, Artificial Sequence
  chemically synthesized
tcctcagcaaatgtaaaaga

SEQ ID NO: 532805 - DNA, 20 bp, Artificial Sequence
  chemically synthesized
atcaaactagaactcaggat

SEQ ID NO: 532806 - DNA, 20 bp, Artificial Sequence
  chemically synthesized
gggtacataacgaaatgaag

SEQ ID NO: 532807 - DNA, 20 bp, Artificial Sequence
  chemically synthesized
gagaacaaagacaccacata

SEQ ID NO: 532808 - DNA, 20 bp, Artificial Sequence
  chemically synthesized
tatagcactaaatgcctaca

SEQ ID NO: 532809 - DNA, 20 bp, Artificial Sequence
  chemically synthesized
taacatcacaattaaaagaa

SEQ ID NO: 532810 - DNA, 20 bp, Artificial Sequence
  chemically synthesized
attcaaaagctagcagaagg

SEQ ID NO: 532811 - DNA, 20 bp, Artificial Sequence
  chemically synthesized
agaccgctagcaagactaat

SEQ ID NO: 532812 - DNA, 20 bp, Artificial Sequence
  chemically synthesized
ctaataaagaaaaaaagaga

SEQ ID NO: 532813 - DNA, 20 bp, Artificial Sequence
  chemically synthesized
gggatatcaccaccgatccc

SEQ ID NO: 532814 - DNA, 20 bp, Artificial Sequence
  chemically synthesized
cagaaatacaaactaccatc

SEQ ID NO: 532815 - DNA, 20 bp, Artificial Sequence
  chemically synthesized
aacacctctatgcaaataaa

SEQ ID NO: 532816 - DNA, 20 bp, Artificial Sequence
  chemically synthesized
caaataaactagaaaatcta

SEQ ID NO: 532817 - DNA, 20 bp, Artificial Sequence
  chemically synthesized
agttcctccttgtacctctg

SEQ ID NO: 532818 - DNA, 20 bp, Artificial Sequence
  chemically synthesized
ttctgaaactattccaatca

SEQ ID NO: 532819 - DNA, 20 bp, Artificial Sequence
  chemically synthesized
gtctctgcccggctttggta

SEQ ID NO: 532820 - DNA, 20 bp, Artificial Sequence
  chemically synthesized
ggcagagacacaaccaaaaa

SEQ ID NO: 532821 - DNA, 20 bp, Artificial Sequence
  chemically synthesized
acatgattatctcaatagat

SEQ ID NO: 532822 - DNA, 20 bp, Artificial Sequence
  chemically synthesized
cagacgacatgattgtttat

SEQ ID NO: 532823 - DNA, 20 bp, Artificial Sequence
  chemically synthesized
gtttgtctgttgttggtgta

SEQ ID NO: 532824 - DNA, 20 bp, Artificial Sequence
  chemically synthesized
cccattcacaattgcttcaa

SEQ ID NO: 532825 - DNA, 20 bp, Artificial Sequence
  chemically synthesized
aaagaggacacaaacaaatg

SEQ ID NO: 532826 - DNA, 20 bp, Artificial Sequence
  chemically synthesized
tattccatgctcatgggtag

SEQ ID NO: 532827 - DNA, 20 bp, Artificial Sequence
  chemically synthesized
agctaccaatgactttcttc

SEQ ID NO: 532828 - DNA, 20 bp, Artificial Sequence
  chemically synthesized
gtagttttttccaattctgt

SEQ ID NO: 532829 - DNA, 20 bp, Artificial Sequence
  chemically synthesized
aatggaacagaacagagccc

SEQ ID NO: 532830 - DNA, 20 bp, Artificial Sequence
  chemically synthesized
tatctgatctttgacaaacc

SEQ ID NO: 532831 - DNA, 20 bp, Artificial Sequence
  chemically synthesized
ggaaaactggctagccatat

SEQ ID NO: 532832 - DNA, 20 bp, Artificial Sequence
  chemically synthesized
ctaaaaccataaaaacccta

SEQ ID NO: 532833 - DNA, 20 bp, Artificial Sequence
  chemically synthesized
agtaaactgggctgctatca

SEQ ID NO: 532834 - DNA, 20 bp, Artificial Sequence
  chemically synthesized
ctgcatctccctcagtattt

SEQ ID NO: 532835 - DNA, 20 bp, Artificial Sequence
  chemically synthesized
atccggggttttctgttata

SEQ ID NO: 532836 - DNA, 20 bp, Artificial Sequence
  chemically synthesized
cctgatatcattcttttata

SEQ ID NO: 532837 - DNA, 20 bp, Artificial Sequence
  chemically synthesized
acatgatgaacaagtatctg

SEQ ID NO: 532838 - DNA, 20 bp, Artificial Sequence
  chemically synthesized
tgattttctaggtgttaaat

SEQ ID NO: 532839 - DNA, 20 bp, Artificial Sequence
  chemically synthesized
gaattttcttaatttaacac

SEQ ID NO: 532840 - DNA, 20 bp, Artificial Sequence
  chemically synthesized
aaaagggtaaaactgtttgc

SEQ ID NO: 532841 - DNA, 20 bp, Artificial Sequence
  chemically synthesized
tattagattcttttgatcag

SEQ ID NO: 532842 - DNA, 20 bp, Artificial Sequence
  chemically synthesized
ataggttttctacctgatca

SEQ ID NO: 532843 - DNA, 20 bp, Artificial Sequence
  chemically synthesized
taattgaaaactatcctcca

SEQ ID NO: 532844 - DNA, 20 bp, Artificial Sequence
  chemically synthesized
gactgtttaaactggggagg

SEQ ID NO: 532845 - DNA, 20 bp, Artificial Sequence
  chemically synthesized
agaaaacagaaggaaaagag

SEQ ID NO: 532846 - DNA, 20 bp, Artificial Sequence
  chemically synthesized
aaaggtacttgaaactgcaa

SEQ ID NO: 532847 - DNA, 20 bp, Artificial Sequence
  chemically synthesized
gctctaggatcctatttaac

SEQ ID NO: 532848 - DNA, 20 bp, Artificial Sequence
  chemically synthesized
agaaggcagaaagatgaaat

SEQ ID NO: 532849 - DNA, 20 bp, Artificial Sequence
  chemically synthesized
tagcacaggtacttgagaag

SEQ ID NO: 532850 - DNA, 20 bp, Artificial Sequence
  chemically synthesized
agggagaggttgaggatgca

SEQ ID NO: 532851 - DNA, 20 bp, Artificial Sequence
  chemically synthesized
cttttggctgcgatgggaag

SEQ ID NO: 532852 - DNA, 20 bp, Artificial Sequence
  chemically synthesized
gttcaggcatgattgagaat

SEQ ID NO: 532853 - DNA, 20 bp, Artificial Sequence
  chemically synthesized
gcagtacgttcaggcatgat

SEQ ID NO: 532854 - DNA, 20 bp, Artificial Sequence
  chemically synthesized
tccaagggaagagaggtttt

SEQ ID NO: 532855 - DNA, 20 bp, Artificial Sequence
  chemically synthesized
gactaggttcgtgtgatgtc

SEQ ID NO: 532856 - DNA, 20 bp, Artificial Sequence
  chemically synthesized
gcaaagtttcaggggtaaat

SEQ ID NO: 532857 - DNA, 20 bp, Artificial Sequence
  chemically synthesized
atggagaaatgttctaggct

SEQ ID NO: 532858 - DNA, 20 bp, Artificial Sequence
  chemically synthesized
ggtatgtgagctgaacctat

SEQ ID NO: 532859 - DNA, 20 bp, Artificial Sequence
  chemically synthesized
tatgcataaaggcctggaag

SEQ ID NO: 532860 - DNA, 20 bp, Artificial Sequence
  chemically synthesized
aacaatatcttgacaccacc

SEQ ID NO: 532861 - DNA, 20 bp, Artificial Sequence
  chemically synthesized
tttattcagcatccccaagg

SEQ ID NO: 532862 - DNA, 20 bp, Artificial Sequence
  chemically synthesized
aacatcaataaatattcatg

SEQ ID NO: 532863 - DNA, 20 bp, Artificial Sequence
  chemically synthesized
aaaattcaaattaccaagga

SEQ ID NO: 532864 - DNA, 20 bp, Artificial Sequence
  chemically synthesized
tgaaacaatgtcttttaaaa

SEQ ID NO: 532865 - DNA, 20 bp, Artificial Sequence
  chemically synthesized
agcccatgcttttcattata

SEQ ID NO: 532866 - DNA, 20 bp, Artificial Sequence
  chemically synthesized
atttctagatttacgatata

SEQ ID NO: 532867 - DNA, 20 bp, Artificial Sequence
  chemically synthesized
atttcttatatatcgtaaat

SEQ ID NO: 532868 - DNA, 20 bp, Artificial Sequence
  chemically synthesized
aagaactgaggtacagctat

SEQ ID NO: 532869 - DNA, 20 bp, Artificial Sequence
  chemically synthesized
cagctgtgcaagttgtacac

SEQ ID NO: 532870 - DNA, 20 bp, Artificial Sequence
  chemically synthesized
tagactgaaatttaagaata

SEQ ID NO: 532871 - DNA, 20 bp, Artificial Sequence
  chemically synthesized
aactctattagactgaaatt

SEQ ID NO: 532872 - DNA, 20 bp, Artificial Sequence
  chemically synthesized
atttcagtctaatagagtta

SEQ ID NO: 532873 - DNA, 20 bp, Artificial Sequence
  chemically synthesized
gtctttcaggggtaaacgag

SEQ ID NO: 532874 - DNA, 20 bp, Artificial Sequence
  chemically synthesized
taatctattcattttccaga

SEQ ID NO: 532875 - DNA, 20 bp, Artificial Sequence
  chemically synthesized
ccagaagagaaaattaaggt

SEQ ID NO: 532876 - DNA, 20 bp, Artificial Sequence
  chemically synthesized
aagggacgtaggctagaagt

SEQ ID NO: 532877 - DNA, 20 bp, Artificial Sequence
  chemically synthesized
aaaggcagcaaatcttaggg

SEQ ID NO: 532878 - DNA, 20 bp, Artificial Sequence
  chemically synthesized
agttaagcaatgcagggggg

SEQ ID NO: 532879 - DNA, 20 bp, Artificial Sequence
  chemically synthesized
ttgaatctatacaaatggca

SEQ ID NO: 532880 - DNA, 20 bp, Artificial Sequence
  chemically synthesized
ttggtcatggtgctagatac

SEQ ID NO: 532881 - DNA, 20 bp, Artificial Sequence
  chemically synthesized
ttgacaattgccactcggaa

SEQ ID NO: 532882 - DNA, 20 bp, Artificial Sequence
  chemically synthesized
agcctggatgcagaatagct

SEQ ID NO: 532883 - DNA, 20 bp, Artificial Sequence
  chemically synthesized
tttggatatccagcctggat

SEQ ID NO: 532884 - DNA, 20 bp, Artificial Sequence
  chemically synthesized
tctaattgtttttacttatt

SEQ ID NO: 532885 - DNA, 20 bp, Artificial Sequence
  chemically synthesized
tctaaaataagtaaaaacaa

SEQ ID NO: 532886 - DNA, 20 bp, Artificial Sequence
  chemically synthesized
agtcataaatcatttcctgt

SEQ ID NO: 532887 - DNA, 20 bp, Artificial Sequence
  chemically synthesized
acgctcagtgttagagaaat

SEQ ID NO: 532888 - DNA, 20 bp, Artificial Sequence
  chemically synthesized
cttttgctacgctcagtgtt

SEQ ID NO: 532889 - DNA, 20 bp, Artificial Sequence
  chemically synthesized
ccttggtttccttctacttt

SEQ ID NO: 532890 - DNA, 20 bp, Artificial Sequence
  chemically synthesized
accaaggagttcttataata

SEQ ID NO: 532891 - DNA, 20 bp, Artificial Sequence
  chemically synthesized
ttaagaagcaaggaaaatag

SEQ ID NO: 532892 - DNA, 20 bp, Artificial Sequence
  chemically synthesized
gaaaggcattgttggtacaa

SEQ ID NO: 532893 - DNA, 20 bp, Artificial Sequence
  chemically synthesized
atttccaaaactgtttctgc

SEQ ID NO: 532894 - DNA, 20 bp, Artificial Sequence
  chemically synthesized
ttcctcttacttctttctga

SEQ ID NO: 532895 - DNA, 20 bp, Artificial Sequence
  chemically synthesized
ttggcccttttgagagtgtg

SEQ ID NO: 532896 - DNA, 20 bp, Artificial Sequence
  chemically synthesized
gaaaatttgcagtgattatg

SEQ ID NO: 532897 - DNA, 20 bp, Artificial Sequence
  chemically synthesized
agaaattaatcaatgacagt

SEQ ID NO: 532898 - DNA, 20 bp, Artificial Sequence
  chemically synthesized
atcctaaatcgatgtttatt

SEQ ID NO: 532899 - DNA, 20 bp, Artificial Sequence
  chemically synthesized
cttaaagtataataaaaaaa

SEQ ID NO: 532900 - DNA, 20 bp, Artificial Sequence
  chemically synthesized
ctgagcaaactatcacaagg

SEQ ID NO: 532901 - DNA, 20 bp, Artificial Sequence
  chemically synthesized
ctgtccttgtgatagtttgc

SEQ ID NO: 532902 - DNA, 20 bp, Artificial Sequence
  chemically synthesized
ccatcaatgatagaccggat

SEQ ID NO: 532903 - DNA, 20 bp, Artificial Sequence
  chemically synthesized
acatgccagatttcaaagac

SEQ ID NO: 532904 - DNA, 20 bp, Artificial Sequence
  chemically synthesized
acttttaaagaacgtggcta

SEQ ID NO: 532905 - DNA, 20 bp, Artificial Sequence
  chemically synthesized
gtccagaacagtgttgtccc

SEQ ID NO: 532906 - DNA, 20 bp, Artificial Sequence
  chemically synthesized
agtttgagtggaagttagat

SEQ ID NO: 532907 - DNA, 20 bp, Artificial Sequence
  chemically synthesized
aagtagtacaatacagtgat

SEQ ID NO: 532908 - DNA, 20 bp, Artificial Sequence
  chemically synthesized
tcaaccttataaagttatcg

SEQ ID NO: 532909 - DNA, 20 bp, Artificial Sequence
  chemically synthesized
tttcctgctattattgtgaa

SEQ ID NO: 532910 - DNA, 20 bp, Artificial Sequence
  chemically synthesized
ctagatacctaaaaagaagc

SEQ ID NO: 532911 - DNA, 20 bp, Artificial Sequence
  chemically synthesized
ctacttgggaggctgaagca

SEQ ID NO: 532912 - DNA, 20 bp, Artificial Sequence
  chemically synthesized
gtgacacccacataattatt

SEQ ID NO: 532913 - DNA, 20 bp, Artificial Sequence
  chemically synthesized
ttcaccttagactgtttaca

SEQ ID NO: 532914 - DNA, 20 bp, Artificial Sequence
  chemically synthesized
ccttagactgtttacatgag

SEQ ID NO: 532915 - DNA, 20 bp, Artificial Sequence
  chemically synthesized
attaaaatgacttaaacaaa

SEQ ID NO: 532916 - DNA, 20 bp, Artificial Sequence
  chemically synthesized
agataagatatgagagtgat

SEQ ID NO: 532917 - DNA, 20 bp, Artificial Sequence
  chemically synthesized
cacttgaggccctgctactc

SEQ ID NO: 532918 - DNA, 20 bp, Artificial Sequence
  chemically synthesized
agtaggaatttggtgaggtt

SEQ ID NO: 532919 - DNA, 20 bp, Artificial Sequence
  chemically synthesized
caggtatcttcctcaattca

SEQ ID NO: 532920 - DNA, 20 bp, Artificial Sequence
  chemically synthesized
tgggaagtgtgggtgaccct

SEQ ID NO: 532921 - DNA, 20 bp, Artificial Sequence
  chemically synthesized
ttactcgggaggctgaggca

SEQ ID NO: 532922 - DNA, 20 bp, Artificial Sequence
  chemically synthesized
acagggacacaggaggttct

SEQ ID NO: 532923 - DNA, 20 bp, Artificial Sequence
  chemically synthesized
ggagccttcagaaatgaccc

SEQ ID NO: 532924 - DNA, 20 bp, Artificial Sequence
  chemically synthesized
ttcacatgacacaggagcct

SEQ ID NO: 532925 - DNA, 20 bp, Artificial Sequence
  chemically synthesized
gccatgaacctagcgatggg

SEQ ID NO: 532926 - DNA, 20 bp, Artificial Sequence
  chemically synthesized
atctacttgactcttacagg

SEQ ID NO: 532927 - DNA, 20 bp, Artificial Sequence
  chemically synthesized
aaacctgcttgtttagaatt

SEQ ID NO: 532928 - DNA, 20 bp, Artificial Sequence
  chemically synthesized
agaacccgaaacctgcttgt

SEQ ID NO: 532929 - DNA, 20 bp, Artificial Sequence
  chemically synthesized
aacaagcaggtttcgggttc

SEQ ID NO: 532930 - DNA, 20 bp, Artificial Sequence
  chemically synthesized
ctcagaaaacagggggttga

SEQ ID NO: 532931 - DNA, 20 bp, Artificial Sequence
  chemically synthesized
aacctagatgtggtttactc

SEQ ID NO: 532932 - DNA, 20 bp, Artificial Sequence
  chemically synthesized
aaggactctccctgtgttga

SEQ ID NO: 532933 - DNA, 20 bp, Artificial Sequence
  chemically synthesized
ttctgatcctgggtagggtc

SEQ ID NO: 532934 - DNA, 20 bp, Artificial Sequence
  chemically synthesized
tctagagctcacaccggtta

SEQ ID NO: 532935 - DNA, 20 bp, Artificial Sequence
  chemically synthesized
cataaggaaaatgatttgag

SEQ ID NO: 532936 - DNA, 20 bp, Artificial Sequence
  chemically synthesized
acagcataaggaaaatgatt

SEQ ID NO: 532937 - DNA, 20 bp, Artificial Sequence
  chemically synthesized
gaaaagtgtatcattcctgt

SEQ ID NO: 532938 - DNA, 20 bp, Artificial Sequence
  chemically synthesized
catattttcaaaaattatga

SEQ ID NO: 532939 - DNA, 20 bp, Artificial Sequence
  chemically synthesized
ctttctttttaaggcaaagg

SEQ ID NO: 532940 - DNA, 20 bp, Artificial Sequence
  chemically synthesized
tattctttcctttgccttaa

SEQ ID NO: 532941 - DNA, 20 bp, Artificial Sequence
  chemically synthesized
tggtgttttccatcctttcc

SEQ ID NO: 532942 - DNA, 20 bp, Artificial Sequence
  chemically synthesized
ggaaaacaccacagaagttg

SEQ ID NO: 532943 - DNA, 20 bp, Artificial Sequence
  chemically synthesized
caaaggctgacaaatccttg

SEQ ID NO: 532944 - DNA, 20 bp, Artificial Sequence
  chemically synthesized
atgacctcatagggttgtta

SEQ ID NO: 532945 - DNA, 20 bp, Artificial Sequence
  chemically synthesized
ttaatcttcactgcggatac

SEQ ID NO: 532946 - DNA, 20 bp, Artificial Sequence
  chemically synthesized
ggtatatagaggtgactcag

SEQ ID NO: 532947 - DNA, 20 bp, Artificial Sequence
  chemically synthesized
acttcaggaaaggcagttgt

SEQ ID NO: 532948 - DNA, 20 bp, Artificial Sequence
  chemically synthesized
taggtttcagttccttaagg

SEQ ID NO: 532949 - DNA, 20 bp, Artificial Sequence
  chemically synthesized
actgaaacctagctggtacc

SEQ ID NO: 532950 - DNA, 20 bp, Artificial Sequence
  chemically synthesized
gtggccatagtaggctttat

SEQ ID NO: 532951 - DNA, 20 bp, Artificial Sequence
  chemically synthesized
gtaattggtattcaagtctt

SEQ ID NO: 532952 - DNA, 20 bp, Artificial Sequence
  chemically synthesized
gggtcatgctttacctctaa

SEQ ID NO: 532953 - DNA, 20 bp, Artificial Sequence
  chemically synthesized
aatagccccctatctatgac

SEQ ID NO: 532954 - DNA, 20 bp, Artificial Sequence
  chemically synthesized
gaatagtctatgtgctaaga

SEQ ID NO: 532955 - DNA, 20 bp, Artificial Sequence
  chemically synthesized
tccttcattcattcacgtat

SEQ ID NO: 532956 - DNA, 20 bp, Artificial Sequence
  chemically synthesized
acgtgaatgaatgaaggaat

SEQ ID NO: 532957 - DNA, 20 bp, Artificial Sequence
  chemically synthesized
gcgataactcaaatttccaa

SEQ ID NO: 532958 - DNA, 20 bp, Artificial Sequence
  chemically synthesized
cagttctagttggtattctg

SEQ ID NO: 532959 - DNA, 20 bp, Artificial Sequence
  chemically synthesized
ctgcagtataattttttctg

SEQ ID NO: 532960 - DNA, 20 bp, Artificial Sequence
  chemically synthesized
aattaatttattccaagata

SEQ ID NO: 532961 - DNA, 20 bp, Artificial Sequence
  chemically synthesized
acaatggctggagatataat

SEQ ID NO: 532962 - DNA, 20 bp, Artificial Sequence
  chemically synthesized
tatattaattaccttctgtt

SEQ ID NO: 532963 - DNA, 20 bp, Artificial Sequence
  chemically synthesized
aatgaatcagacatgaccgc

SEQ ID NO: 532964 - DNA, 20 bp, Artificial Sequence
  chemically synthesized
gggcatgctgtggaaggatc

SEQ ID NO: 532965 - DNA, 20 bp, Artificial Sequence
  chemically synthesized
gattttataccaacagattt

SEQ ID NO: 532966 - DNA, 20 bp, Artificial Sequence
  chemically synthesized
acttttgagtatggtttcat

SEQ ID NO: 532967 - DNA, 20 bp, Artificial Sequence
  chemically synthesized
gaggcaccttgcagaacttt

SEQ ID NO: 532968 - DNA, 20 bp, Artificial Sequence
  chemically synthesized
tgcaaaccattcaagtcatt

SEQ ID NO: 532969 - DNA, 20 bp, Artificial Sequence
  chemically synthesized
tgttccagggggcagggcaa

SEQ ID NO: 532970 - DNA, 20 bp, Artificial Sequence
  chemically synthesized
cctgggagctggttagcaat

SEQ ID NO: 532971 - DNA, 20 bp, Artificial Sequence
  chemically synthesized
cttgccacagacctgctaaa

SEQ ID NO: 532972 - DNA, 20 bp, Artificial Sequence
  chemically synthesized
tgttcaagggtgaggatgct

SEQ ID NO: 532973 - DNA, 20 bp, Artificial Sequence
  chemically synthesized
gagttgaggaatcatgacca

SEQ ID NO: 532974 - DNA, 20 bp, Artificial Sequence
  chemically synthesized
gaaaatgttgttataaagga

SEQ ID NO: 532975 - DNA, 20 bp, Artificial Sequence
  chemically synthesized
caaaaaaaaaaaaaaaagaa

SEQ ID NO: 532976 - DNA, 20 bp, Artificial Sequence
  chemically synthesized
ctgtctcaaaaaaaaaaaaa

SEQ ID NO: 532977 - DNA, 20 bp, Artificial Sequence
  chemically synthesized
gctttttttaaatgagtaaa

SEQ ID NO: 532978 - DNA, 20 bp, Artificial Sequence
  chemically synthesized
gcgtgcaacatttggccaca

SEQ ID NO: 532979 - DNA, 20 bp, Artificial Sequence
  chemically synthesized
tcatgatactaaaaatgtta

SEQ ID NO: 532980 - DNA, 20 bp, Artificial Sequence
  chemically synthesized
attattgaaattgtgtgaaa

SEQ ID NO: 532981 - DNA, 20 bp, Artificial Sequence
  chemically synthesized
gtgtgaaattagaaaactac

SEQ ID NO: 532982 - DNA, 20 bp, Artificial Sequence
  chemically synthesized
attaaagatgatctgaatta

SEQ ID NO: 532983 - DNA, 20 bp, Artificial Sequence
  chemically synthesized
aaaaaaaaaaatggattact

SEQ ID NO: 532984 - DNA, 20 bp, Artificial Sequence
  chemically synthesized
atggattactttagaatgtg

SEQ ID NO: 532985 - DNA, 20 bp, Artificial Sequence
  chemically synthesized
caaagttatttttgctttga

SEQ ID NO: 532986 - DNA, 20 bp, Artificial Sequence
  chemically synthesized
gaaaccctgagtgcaatgtt

SEQ ID NO: 532987 - DNA, 20 bp, Artificial Sequence
  chemically synthesized
tcccaacatgcaaaaattct

SEQ ID NO: 532988 - DNA, 20 bp, Artificial Sequence
  chemically synthesized
gggttcatttgaagaattct

SEQ ID NO: 532989 - DNA, 20 bp, Artificial Sequence
  chemically synthesized
ctgacttggagggttcattt

SEQ ID NO: 532990 - DNA, 20 bp, Artificial Sequence
  chemically synthesized
gaaaagattgttctgggaat

SEQ ID NO: 532991 - DNA, 20 bp, Artificial Sequence
  chemically synthesized
tatttgtgttttttgtggct

SEQ ID NO: 532992 - DNA, 20 bp, Artificial Sequence
  chemically synthesized
taaagccacaaaaaacacaa

SEQ ID NO: 532993 - DNA, 20 bp, Artificial Sequence
  chemically synthesized
tgtgacaacataggatattc

SEQ ID NO: 532994 - DNA, 20 bp, Artificial Sequence
  chemically synthesized
atgcgttttagcttaactta

SEQ ID NO: 532995 - DNA, 20 bp, Artificial Sequence
  chemically synthesized
taagttattcttgatattta

SEQ ID NO: 532996 - DNA, 20 bp, Artificial Sequence
  chemically synthesized
taaacgattcttttaaatat

SEQ ID NO: 532997 - DNA, 20 bp, Artificial Sequence
  chemically synthesized
gttacggtattttgtttaac

SEQ ID NO: 532998 - DNA, 20 bp, Artificial Sequence
  chemically synthesized
attgtggattccatggcaat

SEQ ID NO: 532999 - DNA, 20 bp, Artificial Sequence
  chemically synthesized
agtaactcattcagttccaa

SEQ ID NO: 533000 - DNA, 20 bp, Artificial Sequence
  chemically synthesized
actgaatgagttactgtttc

SEQ ID NO: 533001 - DNA, 20 bp, Artificial Sequence
  chemically synthesized
ctgacatccaaggaagtcat

SEQ ID NO: 533002 - DNA, 20 bp, Artificial Sequence
  chemically synthesized
ggaaaggaggagaggaaaag

SEQ ID NO: 533003 - DNA, 20 bp, Artificial Sequence
  chemically synthesized
ctactcaagaggctgaggca

SEQ ID NO: 533004 - DNA, 20 bp, Artificial Sequence
  chemically synthesized
aaaattatcccagtgagggg

SEQ ID NO: 533005 - DNA, 20 bp, Artificial Sequence
  chemically synthesized
gatgagtctagtttatatgc

SEQ ID NO: 533006 - DNA, 20 bp, Artificial Sequence
  chemically synthesized
atatatacattcagaacaga

SEQ ID NO: 533007 - DNA, 20 bp, Artificial Sequence
  chemically synthesized
attgttcctggggttgaatc

SEQ ID NO: 533008 - DNA, 20 bp, Artificial Sequence
  chemically synthesized
gcgcaaatgctctcctgcat

SEQ ID NO: 533009 - DNA, 20 bp, Artificial Sequence
  chemically synthesized
agcagggtgagaccctgtct

SEQ ID NO: 533010 - DNA, 20 bp, Artificial Sequence
  chemically synthesized
ctgcttcttaccaggcagac

SEQ ID NO: 533011 - DNA, 20 bp, Artificial Sequence
  chemically synthesized
gaggagcaggcactgtgctg

SEQ ID NO: 533012 - DNA, 20 bp, Artificial Sequence
  chemically synthesized
tctgcggataaggaaataga

SEQ ID NO: 533013 - DNA, 20 bp, Artificial Sequence
  chemically synthesized
tcttatctatttccttatcc

SEQ ID NO: 533014 - DNA, 20 bp, Artificial Sequence
  chemically synthesized
aacttaaaaacctctgctct

SEQ ID NO: 533015 - DNA, 20 bp, Artificial Sequence
  chemically synthesized
agttggtctgggatggggcc

SEQ ID NO: 533016 - DNA, 20 bp, Artificial Sequence
  chemically synthesized
cccatcccagaccaactgac

SEQ ID NO: 533017 - DNA, 20 bp, Artificial Sequence
  chemically synthesized
aagactgcatggtatataag

SEQ ID NO: 533018 - DNA, 20 bp, Artificial Sequence
  chemically synthesized
tatttgttctctgtccaaaa

SEQ ID NO: 533019 - DNA, 20 bp, Artificial Sequence
  chemically synthesized
tccaaaaccagaaagactga

SEQ ID NO: 533020 - DNA, 20 bp, Artificial Sequence
  chemically synthesized
tagctactctttaaatctac

SEQ ID NO: 533021 - DNA, 20 bp, Artificial Sequence
  chemically synthesized
atctgactttatgttaatac

SEQ ID NO: 533022 - DNA, 20 bp, Artificial Sequence
  chemically synthesized
atttcaaatcttaaaggctt

SEQ ID NO: 533023 - DNA, 20 bp, Artificial Sequence
  chemically synthesized
gccatatggttaatagttgt

SEQ ID NO: 533024 - DNA, 20 bp, Artificial Sequence
  chemically synthesized
agacaatgtttttttactgc

SEQ ID NO: 533025 - DNA, 20 bp, Artificial Sequence
  chemically synthesized
tcttaagtattgtccttcat

SEQ ID NO: 533026 - DNA, 20 bp, Artificial Sequence
  chemically synthesized
atttcaacaatgaagaagtg

SEQ ID NO: 533027 - DNA, 20 bp, Artificial Sequence
  chemically synthesized
tatgcagtgtcaagatggga

SEQ ID NO: 533028 - DNA, 20 bp, Artificial Sequence
  chemically synthesized
actgaaacaatatatgtgtc

SEQ ID NO: 533029 - DNA, 20 bp, Artificial Sequence
  chemically synthesized
ttctcttcttctcgcataga

SEQ ID NO: 533030 - DNA, 20 bp, Artificial Sequence
  chemically synthesized
ttcttatctatgcgagaaga

SEQ ID NO: 533031 - DNA, 20 bp, Artificial Sequence
  chemically synthesized
tactagctggtatctggttg

SEQ ID NO: 533032 - DNA, 20 bp, Artificial Sequence
  chemically synthesized
tatgatcaacgcctggctgg

SEQ ID NO: 533033 - DNA, 20 bp, Artificial Sequence
  chemically synthesized
atttgatggagggccagaag

SEQ ID NO: 533034 - DNA, 20 bp, Artificial Sequence
  chemically synthesized
attgtgagagcacttacacc

SEQ ID NO: 533035 - DNA, 20 bp, Artificial Sequence
  chemically synthesized
agcaccgtaagtcttctgcc

SEQ ID NO: 533036 - DNA, 20 bp, Artificial Sequence
  chemically synthesized
gtttatcagagacacagaga

SEQ ID NO: 533037 - DNA, 20 bp, Artificial Sequence
  chemically synthesized
gacatataatgttgtgtact

SEQ ID NO: 533038 - DNA, 20 bp, Artificial Sequence
  chemically synthesized
tatgtgctaagttaacacgc

SEQ ID NO: 533039 - DNA, 20 bp, Artificial Sequence
  chemically synthesized
cagcctatccaaatcatgaa

SEQ ID NO: 533040 - DNA, 20 bp, Artificial Sequence
  chemically synthesized
gagaccatcctggctaacaa

SEQ ID NO: 533041 - DNA, 20 bp, Artificial Sequence
  chemically synthesized
ctgctcgggaggctgaggca

SEQ ID NO: 533042 - DNA, 20 bp, Artificial Sequence
  chemically synthesized
tctgtatcaaaaaaaaaaaa

SEQ ID NO: 533043 - DNA, 20 bp, Artificial Sequence
  chemically synthesized
ttaatcatttgctacatttt

SEQ ID NO: 533044 - DNA, 20 bp, Artificial Sequence
  chemically synthesized
aatgatttgtgaggccacat

SEQ ID NO: 533045 - DNA, 20 bp, Artificial Sequence
  chemically synthesized
ggccacatccagaaaggaat

SEQ ID NO: 533046 - DNA, 20 bp, Artificial Sequence
  chemically synthesized
aagtctttaaatatatgatc

SEQ ID NO: 533047 - DNA, 20 bp, Artificial Sequence
  chemically synthesized
gtgaaaatgagcaagtgtca

SEQ ID NO: 533048 - DNA, 20 bp, Artificial Sequence
  chemically synthesized
cattgaaagacctaattgga

SEQ ID NO: 533049 - DNA, 20 bp, Artificial Sequence
  chemically synthesized
aatatttaaataaataatat

SEQ ID NO: 533050 - DNA, 20 bp, Artificial Sequence
  chemically synthesized
taaaattaaatatgcaattt

SEQ ID NO: 533051 - DNA, 20 bp, Artificial Sequence
  chemically synthesized
gtagccccctgcagtatcta

SEQ ID NO: 533052 - DNA, 20 bp, Artificial Sequence
  chemically synthesized
gtaattagactgtaaagtcc

SEQ ID NO: 533053 - DNA, 20 bp, Artificial Sequence
  chemically synthesized
tacagtctaattacaactat

SEQ ID NO: 533054 - DNA, 20 bp, Artificial Sequence
  chemically synthesized
ataaaaagctaaagaggttt

SEQ ID NO: 533055 - DNA, 20 bp, Artificial Sequence
  chemically synthesized
gctaaagaggtttgaagaaa

SEQ ID NO: 533056 - DNA, 20 bp, Artificial Sequence
  chemically synthesized
tattggcaggcaaagagcac

SEQ ID NO: 533057 - DNA, 20 bp, Artificial Sequence
  chemically synthesized
tggttgccaaaggaggggaa

SEQ ID NO: 533058 - DNA, 20 bp, Artificial Sequence
  chemically synthesized
aaatctgttcattgtgctag

SEQ ID NO: 533059 - DNA, 20 bp, Artificial Sequence
  chemically synthesized
tcaaggctcctttagacatt

SEQ ID NO: 533060 - DNA, 20 bp, Artificial Sequence
  chemically synthesized
aattctgcaatattttcatt

SEQ ID NO: 533061 - DNA, 20 bp, Artificial Sequence
  chemically synthesized
cattctagaatgaaaatatt

SEQ ID NO: 533062 - DNA, 20 bp, Artificial Sequence
  chemically synthesized
taatttcgcttataacaatg

SEQ ID NO: 533063 - DNA, 20 bp, Artificial Sequence
  chemically synthesized
aaagtgtcatgtgaattatc

SEQ ID NO: 533064 - DNA, 20 bp, Artificial Sequence
  chemically synthesized
atgaataatacacattatat

SEQ ID NO: 533065 - DNA, 20 bp, Artificial Sequence
  chemically synthesized
tcaatcatgtattcaccaaa

SEQ ID NO: 533066 - DNA, 20 bp, Artificial Sequence
  chemically synthesized
tttggtgaatacatgattga

SEQ ID NO: 533067 - DNA, 20 bp, Artificial Sequence
  chemically synthesized
acatattcaacaccaaagag

SEQ ID NO: 533068 - DNA, 20 bp, Artificial Sequence
  chemically synthesized
cccacttcagaactgttgaa

SEQ ID NO: 533069 - DNA, 20 bp, Artificial Sequence
  chemically synthesized
aacatctcttgggagttttt

SEQ ID NO: 533070 - DNA, 20 bp, Artificial Sequence
  chemically synthesized
acagcaaggtgatgctcttt

SEQ ID NO: 533071 - DNA, 20 bp, Artificial Sequence
  chemically synthesized
cagaagtgaatctgtgcaca

SEQ ID NO: 533072 - DNA, 20 bp, Artificial Sequence
  chemically synthesized
gcacaaaagaaagaactatg

SEQ ID NO: 533073 - DNA, 20 bp, Artificial Sequence
  chemically synthesized
ttggcattattattactgtg

SEQ ID NO: 533074 - DNA, 20 bp, Artificial Sequence
  chemically synthesized
ttgtaggggaaaaaagaaga

SEQ ID NO: 533075 - DNA, 20 bp, Artificial Sequence
  chemically synthesized
tgcaattgtaggggaaaaaa

SEQ ID NO: 533076 - DNA, 20 bp, Artificial Sequence
  chemically synthesized
gatctccttgaaagggtcaa

SEQ ID NO: 533077 - DNA, 20 bp, Artificial Sequence
  chemically synthesized
ccacatcattcccattatca

SEQ ID NO: 533078 - DNA, 20 bp, Artificial Sequence
  chemically synthesized
tcagaagaaataattcaaat

SEQ ID NO: 533079 - DNA, 20 bp, Artificial Sequence
  chemically synthesized
ataattcaaattaagaaaaa

SEQ ID NO: 533080 - DNA, 20 bp, Artificial Sequence
  chemically synthesized
aaaaatgaagagatgacact

SEQ ID NO: 533081 - DNA, 20 bp, Artificial Sequence
  chemically synthesized
taggcaatttgctcatgaaa

SEQ ID NO: 533082 - DNA, 20 bp, Artificial Sequence
  chemically synthesized
gaaatgaggcaatagctaga

SEQ ID NO: 533083 - DNA, 20 bp, Artificial Sequence
  chemically synthesized
atgaagacatgaaaggaatt

SEQ ID NO: 533084 - DNA, 20 bp, Artificial Sequence
  chemically synthesized
ctacacgggaggctgaggca

SEQ ID NO: 533085 - DNA, 20 bp, Artificial Sequence
  chemically synthesized
aggttcatgatgatgcaatc

SEQ ID NO: 533086 - DNA, 20 bp, Artificial Sequence
  chemically synthesized
gaggttcatgatgatgcctc

SEQ ID NO: 533087 - DNA, 20 bp, Artificial Sequence
  chemically synthesized
ctcttacttgctgaaaactc

SEQ ID NO: 533088 - DNA, 20 bp, Artificial Sequence
  chemically synthesized
atgactaggaacctgagcaa

SEQ ID NO: 533089 - DNA, 20 bp, Artificial Sequence
  chemically synthesized
aaatggcaggctacaaagga

SEQ ID NO: 533090 - DNA, 20 bp, Artificial Sequence
  chemically synthesized
tgtaggagctaagcaggtgg

SEQ ID NO: 533091 - DNA, 20 bp, Artificial Sequence
  chemically synthesized
tttctcaggcaggatatcta

SEQ ID NO: 533092 - DNA, 20 bp, Artificial Sequence
  chemically synthesized
tttctgttagatatcctgcc

SEQ ID NO: 533093 - DNA, 20 bp, Artificial Sequence
  chemically synthesized
acattcctcacctaagattt

SEQ ID NO: 533094 - DNA, 20 bp, Artificial Sequence
  chemically synthesized
cccacttcaaaactgttgaa

SEQ ID NO: 533095 - DNA, 20 bp, Artificial Sequence
  chemically synthesized
gcaaggttgacactgtcttt

SEQ ID NO: 533096 - DNA, 20 bp, Artificial Sequence
  chemically synthesized
tcactaaaaaaggaaccatg

SEQ ID NO: 533097 - DNA, 20 bp, Artificial Sequence
  chemically synthesized
gcttcacaatgatcagggtg

SEQ ID NO: 533098 - DNA, 20 bp, Artificial Sequence
  chemically synthesized
cctacttaacgtgaagataa

SEQ ID NO: 533099 - DNA, 20 bp, Artificial Sequence
  chemically synthesized
tactaagaaaatcataagga

SEQ ID NO: 533100 - DNA, 20 bp, Artificial Sequence
  chemically synthesized
tagagaaaatacgatgttac

SEQ ID NO: 533101 - DNA, 20 bp, Artificial Sequence
  chemically synthesized
ttcttgcaataaagtaagtt

SEQ ID NO: 533102 - DNA, 20 bp, Artificial Sequence
  chemically synthesized
ttctctaacttactttattg

SEQ ID NO: 533103 - DNA, 20 bp, Artificial Sequence
  chemically synthesized
aggatttttgccctcaatct

SEQ ID NO: 533104 - DNA, 20 bp, Artificial Sequence
  chemically synthesized
gcaaaaaacggggtgggagg

SEQ ID NO: 533105 - DNA, 20 bp, Artificial Sequence
  chemically synthesized
tttaatatgttgtgttttac

SEQ ID NO: 533106 - DNA, 20 bp, Artificial Sequence
  chemically synthesized
gacaaggacgataagataat

SEQ ID NO: 533107 - DNA, 20 bp, Artificial Sequence
  chemically synthesized
tgttaccttggattttcaaa

SEQ ID NO: 533108 - DNA, 20 bp, Artificial Sequence
  chemically synthesized
gagctgtgtctactgtcctg

SEQ ID NO: 533109 - DNA, 20 bp, Artificial Sequence
  chemically synthesized
tatggaattatttgggcatc

SEQ ID NO: 533110 - DNA, 20 bp, Artificial Sequence
  chemically synthesized
ttgtctatgatggtcaaaaa

SEQ ID NO: 533111 - DNA, 20 bp, Artificial Sequence
  chemically synthesized
catttctgagaatcaatact

SEQ ID NO: 533112 - DNA, 20 bp, Artificial Sequence
  chemically synthesized
tatttctgtagtattgattc

SEQ ID NO: 533113 - DNA, 20 bp, Artificial Sequence
  chemically synthesized
ttgatcagtcactccatttc

SEQ ID NO: 533114 - DNA, 20 bp, Artificial Sequence
  chemically synthesized
aattgctgtggtctttgagg

SEQ ID NO: 533115 - DNA, 20 bp, Artificial Sequence
  chemically synthesized
tctaacaaatagacagaaat

SEQ ID NO: 533116 - DNA, 20 bp, Artificial Sequence
  chemically synthesized
catgtctatctaacaaatag

SEQ ID NO: 533117 - DNA, 20 bp, Artificial Sequence
  chemically synthesized
gtagtaagggataggaaaat

SEQ ID NO: 533118 - DNA, 20 bp, Artificial Sequence
  chemically synthesized
atttaattaacaaatttgta

SEQ ID NO: 533119 - DNA, 20 bp, Artificial Sequence
  chemically synthesized
aataacagaagacaaagtca

SEQ ID NO: 533120 - DNA, 20 bp, Artificial Sequence
  chemically synthesized
ttttgagttttgtgtcttgt

SEQ ID NO: 533121 - DNA, 20 bp, Artificial Sequence
  chemically synthesized
agaaaacgtcttcctcattc

SEQ ID NO: 533122 - DNA, 20 bp, Artificial Sequence
  chemically synthesized
gcctcctagcttatgcaatg

SEQ ID NO: 533123 - DNA, 20 bp, Artificial Sequence
  chemically synthesized
agcactctttgcaattcctc

SEQ ID NO: 533124 - DNA, 20 bp, Artificial Sequence
  chemically synthesized
ctacttgggaggctgaggca

SEQ ID NO: 533125 - DNA, 20 bp, Artificial Sequence
  chemically synthesized
ttaatattggtgtctgtttc

SEQ ID NO: 533126 - DNA, 20 bp, Artificial Sequence
  chemically synthesized
taaatttggagaaaatttgg

SEQ ID NO: 533127 - DNA, 20 bp, Artificial Sequence
  chemically synthesized
ggacttcaacatttaaattt

SEQ ID NO: 533128 - DNA, 20 bp, Artificial Sequence
  chemically synthesized
aagtcctaacccctggtacc

SEQ ID NO: 533129 - DNA, 20 bp, Artificial Sequence
  chemically synthesized
caaagattgccaacaaacca

SEQ ID NO: 533130 - DNA, 20 bp, Artificial Sequence
  chemically synthesized
ttccttctgagggctcggaa

SEQ ID NO: 533131 - DNA, 20 bp, Artificial Sequence
  chemically synthesized
attttcctgtatcagtacat

SEQ ID NO: 533132 - DNA, 20 bp, Artificial Sequence
  chemically synthesized
tactgatacaggaaaatgtc

SEQ ID NO: 533133 - DNA, 20 bp, Artificial Sequence
  chemically synthesized
tgagagagaagcataattca

SEQ ID NO: 533134 - DNA, 20 bp, Artificial Sequence
  chemically synthesized
taatgtaaagatgcatatat

SEQ ID NO: 533135 - DNA, 20 bp, Artificial Sequence
  chemically synthesized
ttcgacagtgcatagaggta

SEQ ID NO: 533136 - DNA, 20 bp, Artificial Sequence
  chemically synthesized
tgatttaattaagatagtaa

SEQ ID NO: 533137 - DNA, 20 bp, Artificial Sequence
  chemically synthesized
agtctgatataactttccac

SEQ ID NO: 533138 - DNA, 20 bp, Artificial Sequence
  chemically synthesized
ttgaagtaatatgggagtta

SEQ ID NO: 533139 - DNA, 20 bp, Artificial Sequence
  chemically synthesized
cagttaagagcttctgtaat

SEQ ID NO: 533140 - DNA, 20 bp, Artificial Sequence
  chemically synthesized
gaagctcttaactgagtgat

SEQ ID NO: 533141 - DNA, 20 bp, Artificial Sequence
  chemically synthesized
tcttaactgagtgatggaga

SEQ ID NO: 533142 - DNA, 20 bp, Artificial Sequence
  chemically synthesized
actgttgagaaaacaggcac

SEQ ID NO: 533143 - DNA, 20 bp, Artificial Sequence
  chemically synthesized
ctcatttgttattttactgt

SEQ ID NO: 533144 - DNA, 20 bp, Artificial Sequence
  chemically synthesized
caaaaaacaaataaaacaat

SEQ ID NO: 533145 - DNA, 20 bp, Artificial Sequence
  chemically synthesized
tgtatgttcacatgtagttg

SEQ ID NO: 533146 - DNA, 20 bp, Artificial Sequence
  chemically synthesized
gtagttgtgagaaataatac

SEQ ID NO: 533147 - DNA, 20 bp, Artificial Sequence
  chemically synthesized
cgtcttgaagtgacagaatt

SEQ ID NO: 533148 - DNA, 20 bp, Artificial Sequence
  chemically synthesized
tatatagccgtcttgaagtg

SEQ ID NO: 533149 - DNA, 20 bp, Artificial Sequence
  chemically synthesized
acttcaagacggctatataa

SEQ ID NO: 533150 - DNA, 20 bp, Artificial Sequence
  chemically synthesized
caacttttagatcaatctcc

SEQ ID NO: 533151 - DNA, 20 bp, Artificial Sequence
  chemically synthesized
gtagctgcatgtttagtttt

SEQ ID NO: 533152 - DNA, 20 bp, Artificial Sequence
  chemically synthesized
ccagatgctagcaaggatgt

SEQ ID NO: 533153 - DNA, 20 bp, Artificial Sequence
  chemically synthesized
tatatattcctacacatcta

SEQ ID NO: 533154 - DNA, 20 bp, Artificial Sequence
  chemically synthesized
tatcaaaaacattagccatt

SEQ ID NO: 533155 - DNA, 20 bp, Artificial Sequence
  chemically synthesized
aggaaatgggcaagacacat

SEQ ID NO: 533156 - DNA, 20 bp, Artificial Sequence
  chemically synthesized
ctcaaaactgcaaggtaaaa

SEQ ID NO: 533157 - DNA, 20 bp, Artificial Sequence
  chemically synthesized
tatagccaaaagatggatgt

SEQ ID NO: 533158 - DNA, 20 bp, Artificial Sequence
  chemically synthesized
aaaagacaagctacagactg

SEQ ID NO: 533159 - DNA, 20 bp, Artificial Sequence
  chemically synthesized
attgaaagcatgatccacac

SEQ ID NO: 533160 - DNA, 20 bp, Artificial Sequence
  chemically synthesized
aaaatcttcaggctctaggg

SEQ ID NO: 533161 - DNA, 20 bp, Artificial Sequence
  chemically synthesized
tatcaaaatttagggaaaaa

SEQ ID NO: 533162 - DNA, 20 bp, Artificial Sequence
  chemically synthesized
ccttttcaacaaatggtcct

SEQ ID NO: 533163 - DNA, 20 bp, Artificial Sequence
  chemically synthesized
agttgcaaaagcaattcaat

SEQ ID NO: 533164 - DNA, 20 bp, Artificial Sequence
  chemically synthesized
agactcatagaccaaatgaa

SEQ ID NO: 533165 - DNA, 20 bp, Artificial Sequence
  chemically synthesized
tataagaaaagtcacaggcc

SEQ ID NO: 533166 - DNA, 20 bp, Artificial Sequence
  chemically synthesized
caagcatactctaaaatcta

SEQ ID NO: 533167 - DNA, 20 bp, Artificial Sequence
  chemically synthesized
gagtatgcttgtctatgtgt

SEQ ID NO: 533168 - DNA, 20 bp, Artificial Sequence
  chemically synthesized
aaatccttgataagattttg

SEQ ID NO: 533169 - DNA, 20 bp, Artificial Sequence
  chemically synthesized
tacatgtacaggatcggtat

SEQ ID NO: 533170 - DNA, 20 bp, Artificial Sequence
  chemically synthesized
ttatttttgcttttgttttt

SEQ ID NO: 533171 - DNA, 20 bp, Artificial Sequence
  chemically synthesized
tggatggcatgactgtgtac

SEQ ID NO: 533172 - DNA, 20 bp, Artificial Sequence
  chemically synthesized
cacagtcatgccatccacaa

SEQ ID NO: 533173 - DNA, 20 bp, Artificial Sequence
  chemically synthesized
catcttaataaagggtatct

SEQ ID NO: 533174 - DNA, 20 bp, Artificial Sequence
  chemically synthesized
tccattcatgataaaaacta

SEQ ID NO: 533175 - DNA, 20 bp, Artificial Sequence
  chemically synthesized
taccatatcaacaaactaaa

SEQ ID NO: 533176 - DNA, 20 bp, Artificial Sequence
  chemically synthesized
agatgtcataaaagcagtat

SEQ ID NO: 533177 - DNA, 20 bp, Artificial Sequence
  chemically synthesized
tcactttatttttttttgcc

SEQ ID NO: 533178 - DNA, 20 bp, Artificial Sequence
  chemically synthesized
acagtggattgcatcacagg

SEQ ID NO: 533179 - DNA, 20 bp, Artificial Sequence
  chemically synthesized
agatatgcttgccctttgct

SEQ ID NO: 533180 - DNA, 20 bp, Artificial Sequence
  chemically synthesized
caggtcaaggaggaggttgc

SEQ ID NO: 533181 - DNA, 20 bp, Artificial Sequence
  chemically synthesized
aaatcaataagagaaagaca

SEQ ID NO: 533182 - DNA, 20 bp, Artificial Sequence
  chemically synthesized
aaccaagctagaaatcaata

SEQ ID NO: 533183 - DNA, 20 bp, Artificial Sequence
  chemically synthesized
cagaacataatgaaaccaag

SEQ ID NO: 533184 - DNA, 20 bp, Artificial Sequence
  chemically synthesized
caagcaacttcagcaaattt

SEQ ID NO: 533185 - DNA, 20 bp, Artificial Sequence
  chemically synthesized
ttgctgaagttgcttggagt

SEQ ID NO: 533186 - DNA, 20 bp, Artificial Sequence
  chemically synthesized
aagcactcctcccaacagta

SEQ ID NO: 533187 - DNA, 20 bp, Artificial Sequence
  chemically synthesized
aggagtgttgaagtccctaa

SEQ ID NO: 533188 - DNA, 20 bp, Artificial Sequence
  chemically synthesized
aaaaatgaatagagctgaaa

SEQ ID NO: 533189 - DNA, 20 bp, Artificial Sequence
  chemically synthesized
gataaagtaggcttcattgc

SEQ ID NO: 533190 - DNA, 20 bp, Artificial Sequence
  chemically synthesized
cattatgcaacaattaatca

SEQ ID NO: 533191 - DNA, 20 bp, Artificial Sequence
  chemically synthesized
acctaggtaggttaaaatta

SEQ ID NO: 533192 - DNA, 20 bp, Artificial Sequence
  chemically synthesized
atgagaaataaagaaaacaa

SEQ ID NO: 533193 - DNA, 20 bp, Artificial Sequence
  chemically synthesized
gaaagagaagaatgagaaat

SEQ ID NO: 533194 - DNA, 20 bp, Artificial Sequence
  chemically synthesized
agaaaaaagaaagagaagaa

SEQ ID NO: 533195 - DNA, 20 bp, Artificial Sequence
  chemically synthesized
aaggtaagaaaaaagaaaga

SEQ ID NO: 533196 - DNA, 20 bp, Artificial Sequence
  chemically synthesized
acccacaagaaggtaagaaa

SEQ ID NO: 533197 - DNA, 20 bp, Artificial Sequence
  chemically synthesized
tcaaataacccacaagaagg

SEQ ID NO: 533198 - DNA, 20 bp, Artificial Sequence
  chemically synthesized
aataaattttgatggaatct

SEQ ID NO: 533199 - DNA, 20 bp, Artificial Sequence
  chemically synthesized
aactatacaaagtgatacgt

SEQ ID NO: 533200 - DNA, 20 bp, Artificial Sequence
  chemically synthesized
atgtggttctcaatgtatgt

SEQ ID NO: 533201 - DNA, 20 bp, Artificial Sequence
  chemically synthesized
gacatttcagaaagaaaata

SEQ ID NO: 533202 - DNA, 20 bp, Artificial Sequence
  chemically synthesized
acgaagtcttgacatttcag

SEQ ID NO: 533203 - DNA, 20 bp, Artificial Sequence
  chemically synthesized
tataacgaagtcttgacatt

SEQ ID NO: 533204 - DNA, 20 bp, Artificial Sequence
  chemically synthesized
ttataatttcctttctgttt

SEQ ID NO: 533205 - DNA, 20 bp, Artificial Sequence
  chemically synthesized
gacaaaaagacattctctaa

SEQ ID NO: 533206 - DNA, 20 bp, Artificial Sequence
  chemically synthesized
ttgctagcaaatctgctctt

SEQ ID NO: 533207 - DNA, 20 bp, Artificial Sequence
  chemically synthesized
tttaagagcagatttgctag

SEQ ID NO: 533208 - DNA, 20 bp, Artificial Sequence
  chemically synthesized
attctcagattaaggaaaac

SEQ ID NO: 533209 - DNA, 20 bp, Artificial Sequence
  chemically synthesized
attctttgttttccttaatc

SEQ ID NO: 533210 - DNA, 20 bp, Artificial Sequence
  chemically synthesized
acaaattgacttttaaacgt

SEQ ID NO: 533211 - DNA, 20 bp, Artificial Sequence
  chemically synthesized
ttttactggcatctagtgaa

SEQ ID NO: 533212 - DNA, 20 bp, Artificial Sequence
  chemically synthesized
caggaatctattgcgttcca

SEQ ID NO: 533213 - DNA, 20 bp, Artificial Sequence
  chemically synthesized
atatatatataaaaaacact

SEQ ID NO: 533214 - DNA, 20 bp, Artificial Sequence
  chemically synthesized
gttggttcaaaggagagtct

SEQ ID NO: 533215 - DNA, 20 bp, Artificial Sequence
  chemically synthesized
ggactcacaattttgtctct

SEQ ID NO: 533216 - DNA, 20 bp, Artificial Sequence
  chemically synthesized
ggaagctgtgtgtcaggcac

SEQ ID NO: 533217 - DNA, 20 bp, Artificial Sequence
  chemically synthesized
attctggattggatcctgaa

SEQ ID NO: 533218 - DNA, 20 bp, Artificial Sequence
  chemically synthesized
tttctgtttcaggatccaat

SEQ ID NO: 533219 - DNA, 20 bp, Artificial Sequence
  chemically synthesized
ttcaaggtcatgaagaacaa

SEQ ID NO: 533220 - DNA, 20 bp, Artificial Sequence
  chemically synthesized
agtcaaatcttaagagactt

SEQ ID NO: 533221 - DNA, 20 bp, Artificial Sequence
  chemically synthesized
aagaagttacaggttttggg

SEQ ID NO: 533222 - DNA, 20 bp, Artificial Sequence
  chemically synthesized
aaagtaggaataacaatgga

SEQ ID NO: 533223 - DNA, 20 bp, Artificial Sequence
  chemically synthesized
tggtaacttacttccagata

SEQ ID NO: 533224 - DNA, 20 bp, Artificial Sequence
  chemically synthesized
ggagtatctatgtatattat

SEQ ID NO: 533225 - DNA, 20 bp, Artificial Sequence
  chemically synthesized
ttagtaaaaaagcatatttg

SEQ ID NO: 533226 - DNA, 20 bp, Artificial Sequence
  chemically synthesized
aatatgcttttttactaaac

SEQ ID NO: 533227 - DNA, 20 bp, Artificial Sequence
  chemically synthesized
tgctggtacaatttgtatcc

SEQ ID NO: 533228 - DNA, 20 bp, Artificial Sequence
  chemically synthesized
tatcgagttacttaagcttc

SEQ ID NO: 533229 - DNA, 20 bp, Artificial Sequence
  chemically synthesized
ttgatgggccagccaggctg

SEQ ID NO: 533230 - DNA, 20 bp, Artificial Sequence
  chemically synthesized
agaaattgttgagaaactta

SEQ ID NO: 533231 - DNA, 20 bp, Artificial Sequence
  chemically synthesized
aacttgcccagagaaattgt

SEQ ID NO: 533232 - DNA, 20 bp, Artificial Sequence
  chemically synthesized
catttgaaacaaacttgccc

SEQ ID NO: 533233 - DNA, 20 bp, Artificial Sequence
  chemically synthesized
agtttctcaaaatagtttcc

SEQ ID NO: 533234 - DNA, 20 bp, Artificial Sequence
  chemically synthesized
actttcttaggaaactattt

SEQ ID NO: 533235 - DNA, 20 bp, Artificial Sequence
  chemically synthesized
caatagcattgttaaataaa

SEQ ID NO: 533236 - DNA, 20 bp, Artificial Sequence
  chemically synthesized
tcttattttacccttttgtc

SEQ ID NO: 533237 - DNA, 20 bp, Artificial Sequence
  chemically synthesized
gtgtgtgtgtgtgtgtgtgt

SEQ ID NO: 533238 - DNA, 20 bp, Artificial Sequence
  chemically synthesized
ggtgaatttccacccttagc

SEQ ID NO: 533239 - DNA, 20 bp, Artificial Sequence
  chemically synthesized
taagggtggaaattcacctc

SEQ ID NO: 533240 - DNA, 20 bp, Artificial Sequence
  chemically synthesized
gttccataccgaggaaagaa

SEQ ID NO: 533241 - DNA, 20 bp, Artificial Sequence
  chemically synthesized
taaaatatcttcatcatcgc

SEQ ID NO: 533242 - DNA, 20 bp, Artificial Sequence
  chemically synthesized
acaagacagccccccacaac

SEQ ID NO: 533243 - DNA, 20 bp, Artificial Sequence
  chemically synthesized
cccgcccccaatgtgacaac

SEQ ID NO: 533244 - DNA, 20 bp, Artificial Sequence
  chemically synthesized
gagaacatttgacagtatct

SEQ ID NO: 533245 - DNA, 20 bp, Artificial Sequence
  chemically synthesized
aggtggccaagacttattct

SEQ ID NO: 533246 - DNA, 20 bp, Artificial Sequence
  chemically synthesized
aaataatttttagcaattct

SEQ ID NO: 533247 - DNA, 20 bp, Artificial Sequence
  chemically synthesized
tcctcccggcatctctttta

SEQ ID NO: 533248 - DNA, 20 bp, Artificial Sequence
  chemically synthesized
tgccgggaggagagagagga

SEQ ID NO: 533249 - DNA, 20 bp, Artificial Sequence
  chemically synthesized
aataaaagttaaaaaaatga

SEQ ID NO: 533250 - DNA, 20 bp, Artificial Sequence
  chemically synthesized
taaggcaatgctgcttaata

SEQ ID NO: 533251 - DNA, 20 bp, Artificial Sequence
  chemically synthesized
taaaagaaaaatttagtata

SEQ ID NO: 533252 - DNA, 20 bp, Artificial Sequence
  chemically synthesized
gattcaaggtgtgttggtta

SEQ ID NO: 533253 - DNA, 20 bp, Artificial Sequence
  chemically synthesized
gaaggtggttacctcttatg

SEQ ID NO: 533254 - DNA, 20 bp, Artificial Sequence
  chemically synthesized
tttagagatacaggtctaag

SEQ ID NO: 533255 - DNA, 20 bp, Artificial Sequence
  chemically synthesized
ttcttttagagatacaggtc

SEQ ID NO: 533256 - DNA, 20 bp, Artificial Sequence
  chemically synthesized
ttcttagacctgtatctcta

SEQ ID NO: 533257 - DNA, 20 bp, Artificial Sequence
  chemically synthesized
tttctggcataccaccttgg

SEQ ID NO: 533258 - DNA, 20 bp, Artificial Sequence
  chemically synthesized
tttcttgccaaggtggtatg

SEQ ID NO: 533259 - DNA, 20 bp, Artificial Sequence
  chemically synthesized
ccagctcccttgcccctttg

SEQ ID NO: 533260 - DNA, 20 bp, Artificial Sequence
  chemically synthesized
aacacatgtcttcaatccat

SEQ ID NO: 533261 - DNA, 20 bp, Artificial Sequence
  chemically synthesized
gtaagatagtgagactgtga

SEQ ID NO: 533262 - DNA, 20 bp, Artificial Sequence
  chemically synthesized
tacttagaacttgggaagtc

SEQ ID NO: 533263 - DNA, 20 bp, Artificial Sequence
  chemically synthesized
taaaaaatttaggaatatgc

SEQ ID NO: 533264 - DNA, 20 bp, Artificial Sequence
  chemically synthesized
taaaatgatatttaccacaa

SEQ ID NO: 533265 - DNA, 20 bp, Artificial Sequence
  chemically synthesized
ctctttaaccttcactaaaa

SEQ ID NO: 533266 - DNA, 20 bp, Artificial Sequence
  chemically synthesized
tccctataagtgatctatgg

SEQ ID NO: 533267 - DNA, 20 bp, Artificial Sequence
  chemically synthesized
ctatggaaagaaaaaattag

SEQ ID NO: 533268 - DNA, 20 bp, Artificial Sequence
  chemically synthesized
aagactcctctctctgtaag

SEQ ID NO: 533269 - DNA, 20 bp, Artificial Sequence
  chemically synthesized
cctgggaaatttaaggctat

SEQ ID NO: 533270 - DNA, 20 bp, Artificial Sequence
  chemically synthesized
gctttaacctaatcattaaa

SEQ ID NO: 533271 - DNA, 20 bp, Artificial Sequence
  chemically synthesized
acatattgtttatggacata

SEQ ID NO: 533272 - DNA, 20 bp, Artificial Sequence
  chemically synthesized
tatgaacatatttattcagc

SEQ ID NO: 533273 - DNA, 20 bp, Artificial Sequence
  chemically synthesized
attatcatgtcttttgataa

SEQ ID NO: 533274 - DNA, 20 bp, Artificial Sequence
  chemically synthesized
ataatcatgtatatgaaaca

SEQ ID NO: 533275 - DNA, 20 bp, Artificial Sequence
  chemically synthesized
agttaaactgaaagatctac

SEQ ID NO: 533276 - DNA, 20 bp, Artificial Sequence
  chemically synthesized
ttttaaaaagccagaattca

SEQ ID NO: 533277 - DNA, 20 bp, Artificial Sequence
  chemically synthesized
tcaaaaataattttaaaaag

SEQ ID NO: 533278 - DNA, 20 bp, Artificial Sequence
  chemically synthesized
ttagtaattataatgcacca

SEQ ID NO: 533279 - DNA, 20 bp, Artificial Sequence
  chemically synthesized
ttaatattgtgaagattaaa

SEQ ID NO: 533280 - DNA, 20 bp, Artificial Sequence
  chemically synthesized
ctctactcctattcctctat

SEQ ID NO: 533281 - DNA, 20 bp, Artificial Sequence
  chemically synthesized
gaaaccagacctggagtgat

SEQ ID NO: 533282 - DNA, 20 bp, Artificial Sequence
  chemically synthesized
gaaagtgacatagctagtgt

SEQ ID NO: 533283 - DNA, 20 bp, Artificial Sequence
  chemically synthesized
ggattatctttaagttaaac

SEQ ID NO: 533284 - DNA, 20 bp, Artificial Sequence
  chemically synthesized
ataaggatgtaaaatggaat

SEQ ID NO: 533285 - DNA, 20 bp, Artificial Sequence
  chemically synthesized
agtttccttgttgatagact

SEQ ID NO: 533286 - DNA, 20 bp, Artificial Sequence
  chemically synthesized
agtgctacctgcggacagag

SEQ ID NO: 533287 - DNA, 20 bp, Artificial Sequence
  chemically synthesized
cgtagttttattttgtctct

SEQ ID NO: 533288 - DNA, 20 bp, Artificial Sequence
  chemically synthesized
taggagaaaagtaactacga

SEQ ID NO: 533289 - DNA, 20 bp, Artificial Sequence
  chemically synthesized
gtgacatttgcaaaagatta

SEQ ID NO: 533290 - DNA, 20 bp, Artificial Sequence
  chemically synthesized
aagttgtcaaatttacacta

SEQ ID NO: 533291 - DNA, 20 bp, Artificial Sequence
  chemically synthesized
aaatgatttatctaaatctc

SEQ ID NO: 533292 - DNA, 20 bp, Artificial Sequence
  chemically synthesized
tttcacataaaattggtgct

SEQ ID NO: 533293 - DNA, 20 bp, Artificial Sequence
  chemically synthesized
atggacccactgcaacatgc

SEQ ID NO: 533294 - DNA, 20 bp, Artificial Sequence
  chemically synthesized
catcatcaagtaagtctaga

SEQ ID NO: 533295 - DNA, 20 bp, Artificial Sequence
  chemically synthesized
gctaattagccactagttac

SEQ ID NO: 533296 - DNA, 20 bp, Artificial Sequence
  chemically synthesized
aaaatatctaaatatatatt

SEQ ID NO: 533297 - DNA, 20 bp, Artificial Sequence
  chemically synthesized
catttcaaagtaaagttatt

SEQ ID NO: 533298 - DNA, 20 bp, Artificial Sequence
  chemically synthesized
tttactacactgaacattat

SEQ ID NO: 533299 - DNA, 20 bp, Artificial Sequence
  chemically synthesized
tgttcagtgtagtaaaatta

SEQ ID NO: 533300 - DNA, 20 bp, Artificial Sequence
  chemically synthesized
aagagttttgaattaagtga

SEQ ID NO: 533301 - DNA, 20 bp, Artificial Sequence
  chemically synthesized
tctgtggcaacagtcccata

SEQ ID NO: 533302 - DNA, 20 bp, Artificial Sequence
  chemically synthesized
tctgctatgggactgttgcc

SEQ ID NO: 533303 - DNA, 20 bp, Artificial Sequence
  chemically synthesized
acttttttttttttttaaag

SEQ ID NO: 533304 - DNA, 20 bp, Artificial Sequence
  chemically synthesized
tgtacgttctcaattactcc

SEQ ID NO: 533305 - DNA, 20 bp, Artificial Sequence
  chemically synthesized
gatgttaagaaaaatgctag

SEQ ID NO: 533306 - DNA, 20 bp, Artificial Sequence
  chemically synthesized
gtgaacattgaaccagatgt

SEQ ID NO: 533307 - DNA, 20 bp, Artificial Sequence
  chemically synthesized
caaatacttttttttaaaac

SEQ ID NO: 533308 - DNA, 20 bp, Artificial Sequence
  chemically synthesized
gcctttaggatttttacttg

SEQ ID NO: 533309 - DNA, 20 bp, Artificial Sequence
  chemically synthesized
gaacattaatcactactaga

SEQ ID NO: 533310 - DNA, 20 bp, Artificial Sequence
  chemically synthesized
ccacagcagcttgtctggac

SEQ ID NO: 533311 - DNA, 20 bp, Artificial Sequence
  chemically synthesized
gacttagaattgaaaaggtt

SEQ ID NO: 533312 - DNA, 20 bp, Artificial Sequence
  chemically synthesized
ggcaattaatctaaggacaa

SEQ ID NO: 533313 - DNA, 20 bp, Artificial Sequence
  chemically synthesized
attcacctttcccagccaca

SEQ ID NO: 533314 - DNA, 20 bp, Artificial Sequence
  chemically synthesized
cactacttgacttgtaaaac

SEQ ID NO: 533315 - DNA, 20 bp, Artificial Sequence
  chemically synthesized
gtttgtatagtttacctaaa

SEQ ID NO: 533316 - DNA, 20 bp, Artificial Sequence
  chemically synthesized
atgggctgcagtggaaagac

SEQ ID NO: 533317 - DNA, 20 bp, Artificial Sequence
  chemically synthesized
cagcctgtagagaacagatg

SEQ ID NO: 533318 - DNA, 20 bp, Artificial Sequence
  chemically synthesized
agactattagggtggccagg

SEQ ID NO: 533319 - DNA, 20 bp, Artificial Sequence
  chemically synthesized
gaataccaagtctgtaagtc

SEQ ID NO: 533320 - DNA, 20 bp, Artificial Sequence
  chemically synthesized
aattcaaattacaaagacca

SEQ ID NO: 533321 - DNA, 20 bp, Artificial Sequence
  chemically synthesized
ccagagccacttagactaat

SEQ ID NO: 533322 - DNA, 20 bp, Artificial Sequence
  chemically synthesized
tatcttgttgaaaattatga

SEQ ID NO: 533323 - DNA, 20 bp, Artificial Sequence
  chemically synthesized
tatacagtcagtctgttctg

SEQ ID NO: 533324 - DNA, 20 bp, Artificial Sequence
  chemically synthesized
tgttggcagacaaaggtaga

SEQ ID NO: 533325 - DNA, 20 bp, Artificial Sequence
  chemically synthesized
aagaagcatttggccaatgg

SEQ ID NO: 533326 - DNA, 20 bp, Artificial Sequence
  chemically synthesized
tgcaagaacaagaatttatt

SEQ ID NO: 533327 - DNA, 20 bp, Artificial Sequence
  chemically synthesized
agcaagtgattgtgcaagaa

SEQ ID NO: 533328 - DNA, 20 bp, Artificial Sequence
  chemically synthesized
attatcacttaaggctaaaa

SEQ ID NO: 533329 - DNA, 20 bp, Artificial Sequence
  chemically synthesized
aaaacaaaatgagctgattt

SEQ ID NO: 533330 - DNA, 20 bp, Artificial Sequence
  chemically synthesized
cccctgctggctttgaagat

SEQ ID NO: 533331 - DNA, 20 bp, Artificial Sequence
  chemically synthesized
tttatttccccctgtggtag

SEQ ID NO: 533332 - DNA, 20 bp, Artificial Sequence
  chemically synthesized
aggaaggggtatttcaacca

SEQ ID NO: 533333 - DNA, 20 bp, Artificial Sequence
  chemically synthesized
atttcaaccacaagaaataa

SEQ ID NO: 533334 - DNA, 20 bp, Artificial Sequence
  chemically synthesized
gcctaaatggtaggctgtcc

SEQ ID NO: 533335 - DNA, 20 bp, Artificial Sequence
  chemically synthesized
agaaagagagagagagagaa

SEQ ID NO: 533336 - DNA, 20 bp, Artificial Sequence
  chemically synthesized
aaggacagaaagagagagag

SEQ ID NO: 533337 - DNA, 20 bp, Artificial Sequence
  chemically synthesized
gagaaatgagaactataagg

SEQ ID NO: 533338 - DNA, 20 bp, Artificial Sequence
  chemically synthesized
agaagatttcctcaataagc

SEQ ID NO: 533339 - DNA, 20 bp, Artificial Sequence
  chemically synthesized
ctttgcacattgtaaaccct

SEQ ID NO: 533340 - DNA, 20 bp, Artificial Sequence
  chemically synthesized
aatgaccacattactcagtt

SEQ ID NO: 533341 - DNA, 20 bp, Artificial Sequence
  chemically synthesized
actaagctgcgtgaaaactt

SEQ ID NO: 533342 - DNA, 20 bp, Artificial Sequence
  chemically synthesized
aacttctagaaaaaaattat

SEQ ID NO: 533343 - DNA, 20 bp, Artificial Sequence
  chemically synthesized
acaggcaggtgaaaattaaa

SEQ ID NO: 533344 - DNA, 20 bp, Artificial Sequence
  chemically synthesized
ataaaggtcaaagttaaatt

SEQ ID NO: 533345 - DNA, 20 bp, Artificial Sequence
  chemically synthesized
aagaatctaggtttgtcaat

SEQ ID NO: 533346 - DNA, 20 bp, Artificial Sequence
  chemically synthesized
ttaggaagagttattataat

SEQ ID NO: 533347 - DNA, 20 bp, Artificial Sequence
  chemically synthesized
tatccattaacaatataacc

SEQ ID NO: 533348 - DNA, 20 bp, Artificial Sequence
  chemically synthesized
attatttaagggtaagagta

SEQ ID NO: 533349 - DNA, 20 bp, Artificial Sequence
  chemically synthesized
tagaatattaaaaattgatc

SEQ ID NO: 533350 - DNA, 20 bp, Artificial Sequence
  chemically synthesized
ctaatcatacagcaaagtcg

SEQ ID NO: 533351 - DNA, 20 bp, Artificial Sequence
  chemically synthesized
aaggtttaataatcacattt

SEQ ID NO: 533352 - DNA, 20 bp, Artificial Sequence
  chemically synthesized
tgaagtttgaggttattttt

SEQ ID NO: 533353 - DNA, 20 bp, Artificial Sequence
  chemically synthesized
gtttgaggttatttttaaag

SEQ ID NO: 533354 - DNA, 20 bp, Artificial Sequence
  chemically synthesized
ggttatttttaaagaaagaa

SEQ ID NO: 533355 - DNA, 20 bp, Artificial Sequence
  chemically synthesized
ctccttgagtgatatatgtg

SEQ ID NO: 533356 - DNA, 20 bp, Artificial Sequence
  chemically synthesized
tatatcactcaaggagagtg

SEQ ID NO: 533357 - DNA, 20 bp, Artificial Sequence
  chemically synthesized
gaatttatcttaaaggtatt

SEQ ID NO: 533358 - DNA, 20 bp, Artificial Sequence
  chemically synthesized
ctgaggaagtgatgctagat

SEQ ID NO: 533359 - DNA, 20 bp, Artificial Sequence
  chemically synthesized
atgctattactattcgtatc

SEQ ID NO: 533360 - DNA, 20 bp, Artificial Sequence
  chemically synthesized
gtacataaaatgcaattaat

SEQ ID NO: 533361 - DNA, 20 bp, Artificial Sequence
  chemically synthesized
tttaagccctttagtcaccc

SEQ ID NO: 533362 - DNA, 20 bp, Artificial Sequence
  chemically synthesized
ccctttagtcaccctaagaa

SEQ ID NO: 533363 - DNA, 20 bp, Artificial Sequence
  chemically synthesized
tgataagggcctgaaaccat

SEQ ID NO: 533364 - DNA, 20 bp, Artificial Sequence
  chemically synthesized
ctgaaaccatagagaatcat

SEQ ID NO: 533365 - DNA, 20 bp, Artificial Sequence
  chemically synthesized
cataaaagagagaagtctca

SEQ ID NO: 533366 - DNA, 20 bp, Artificial Sequence
  chemically synthesized
catctacccaattatttaag

SEQ ID NO: 533367 - DNA, 20 bp, Artificial Sequence
  chemically synthesized
gtggtgccatcttctgaaat

SEQ ID NO: 533368 - DNA, 20 bp, Artificial Sequence
  chemically synthesized
tagcaaaagcccaaccaaat

SEQ ID NO: 533369 - DNA, 20 bp, Artificial Sequence
  chemically synthesized
ggggagttgcagatgtcaat

SEQ ID NO: 533370 - DNA, 20 bp, Artificial Sequence
  chemically synthesized
gagggtgttagagaactaaa

SEQ ID NO: 533371 - DNA, 20 bp, Artificial Sequence
  chemically synthesized
gccaggcaaactgctctcac

SEQ ID NO: 533372 - DNA, 20 bp, Artificial Sequence
  chemically synthesized
catagaactttaaaaaaaga

SEQ ID NO: 533373 - DNA, 20 bp, Artificial Sequence
  chemically synthesized
ttaatcatagaactttaaaa

SEQ ID NO: 533374 - DNA, 20 bp, Artificial Sequence
  chemically synthesized
ttgtccttgccatagtttgc

SEQ ID NO: 533375 - DNA, 20 bp, Artificial Sequence
  chemically synthesized
ccaacaatgatagactggat

SEQ ID NO: 533376 - DNA, 20 bp, Artificial Sequence
  chemically synthesized
ctcagcaaactaacacagga

SEQ ID NO: 533377 - DNA, 20 bp, Artificial Sequence
  chemically synthesized
agctcctcaaagatctagaa

SEQ ID NO: 533378 - DNA, 20 bp, Artificial Sequence
  chemically synthesized
cgtgtgcatgtatctttaaa

SEQ ID NO: 533379 - DNA, 20 bp, Artificial Sequence
  chemically synthesized
ccatcagtgatagactggat

SEQ ID NO: 533380 - DNA, 20 bp, Artificial Sequence
  chemically synthesized
gtttggccatcagaagaggg

SEQ ID NO: 533381 - DNA, 20 bp, Artificial Sequence
  chemically synthesized
tcctctgagccttgttctgt

SEQ ID NO: 533382 - DNA, 20 bp, Artificial Sequence
  chemically synthesized
atcctatagtcacacaatag

SEQ ID NO: 533383 - DNA, 20 bp, Artificial Sequence
  chemically synthesized
tttattggctattttcccaa

SEQ ID NO: 533384 - DNA, 20 bp, Artificial Sequence
  chemically synthesized
aaaaaaaaaaaaaaaaaaaa

SEQ ID NO: 533385 - DNA, 20 bp, Artificial Sequence
  chemically synthesized
aaaaaagagaaaaggagtaa

SEQ ID NO: 533386 - DNA, 20 bp, Artificial Sequence
  chemically synthesized
attgttcacagggcgaaaaa

SEQ ID NO: 533387 - DNA, 20 bp, Artificial Sequence
  chemically synthesized
gagtgggaatgagtagggag

SEQ ID NO: 533388 - DNA, 20 bp, Artificial Sequence
  chemically synthesized
ttaggccagcaaaacctcct

SEQ ID NO: 533389 - DNA, 20 bp, Artificial Sequence
  chemically synthesized
tagtatcccctgggaatttg

SEQ ID NO: 533390 - DNA, 20 bp, Artificial Sequence
  chemically synthesized
cttcagtggcaaaagccaat

SEQ ID NO: 533391 - DNA, 20 bp, Artificial Sequence
  chemically synthesized
gttacagatagggtaggacc

SEQ ID NO: 533392 - DNA, 20 bp, Artificial Sequence
  chemically synthesized
tcaaagctactagaggactt

SEQ ID NO: 533393 - DNA, 20 bp, Artificial Sequence
  chemically synthesized
taacctataactgtttcttt

SEQ ID NO: 533394 - DNA, 20 bp, Artificial Sequence
  chemically synthesized
ccgacatagttgttttctag

SEQ ID NO: 533395 - DNA, 20 bp, Artificial Sequence
  chemically synthesized
tcccccgacatagttgtttt

SEQ ID NO: 533396 - DNA, 20 bp, Artificial Sequence
  chemically synthesized
ctatgtcgggggaaaaataa

SEQ ID NO: 533397 - DNA, 20 bp, Artificial Sequence
  chemically synthesized
gaattctacgtttttaatta

SEQ ID NO: 533398 - DNA, 20 bp, Artificial Sequence
  chemically synthesized
gttttctattaattaaaaac

SEQ ID NO: 533399 - DNA, 20 bp, Artificial Sequence
  chemically synthesized
agctacatatgtgctaaatc

SEQ ID NO: 533400 - DNA, 20 bp, Artificial Sequence
  chemically synthesized
ctcaaactagcacatggaaa

SEQ ID NO: 533401 - DNA, 20 bp, Artificial Sequence
  chemically synthesized
aaatgcatatggcagttgtg

SEQ ID NO: 533402 - DNA, 20 bp, Artificial Sequence
  chemically synthesized
tagtaaactagttttcaatg

SEQ ID NO: 533403 - DNA, 20 bp, Artificial Sequence
  chemically synthesized
tcctgtttatattcttgata

SEQ ID NO: 533404 - DNA, 20 bp, Artificial Sequence
  chemically synthesized
tcccaaagctattctgctat

SEQ ID NO: 533405 - DNA, 20 bp, Artificial Sequence
  chemically synthesized
agctttgggaaatgttctga

SEQ ID NO: 533406 - DNA, 20 bp, Artificial Sequence
  chemically synthesized
gttcctatgtaccatgaatc

SEQ ID NO: 533407 - DNA, 20 bp, Artificial Sequence
  chemically synthesized
cacatatctcagattggctc

SEQ ID NO: 533408 - DNA, 20 bp, Artificial Sequence
  chemically synthesized
caagacagtttgcaattaca

SEQ ID NO: 533409 - DNA, 20 bp, Artificial Sequence
  chemically synthesized
caaatttttatattttgaaa

SEQ ID NO: 533410 - DNA, 20 bp, Artificial Sequence
  chemically synthesized
atacctttaaagatgttaaa

SEQ ID NO: 533411 - DNA, 20 bp, Artificial Sequence
  chemically synthesized
atgttaaaaaagaaaaagac

SEQ ID NO: 533412 - DNA, 20 bp, Artificial Sequence
  chemically synthesized
taggctcctaaggtgaccat

SEQ ID NO: 533413 - DNA, 20 bp, Artificial Sequence
  chemically synthesized
aaaaacttaatacctgtaag

SEQ ID NO: 533414 - DNA, 20 bp, Artificial Sequence
  chemically synthesized
gaggagttaacaaagctgac

SEQ ID NO: 533415 - DNA, 20 bp, Artificial Sequence
  chemically synthesized
tcccaagcctcgctgaccat

SEQ ID NO: 533416 - DNA, 20 bp, Artificial Sequence
  chemically synthesized
ggggagagaggtccatgtac

SEQ ID NO: 533417 - DNA, 20 bp, Artificial Sequence
  chemically synthesized
gtgtgagtctgaaattcagg

SEQ ID NO: 533418 - DNA, 20 bp, Artificial Sequence
  chemically synthesized
gactcacacagccaactgcc

SEQ ID NO: 533419 - DNA, 20 bp, Artificial Sequence
  chemically synthesized
caaaatcatggaagaacttt

SEQ ID NO: 533420 - DNA, 20 bp, Artificial Sequence
  chemically synthesized
aaggaaaagaaatgagtgag

SEQ ID NO: 533421 - DNA, 20 bp, Artificial Sequence
  chemically synthesized
tttattgtggtttccaagga

SEQ ID NO: 533422 - DNA, 20 bp, Artificial Sequence
  chemically synthesized
gttccagagtcggtcagcag

SEQ ID NO: 533423 - DNA, 20 bp, Artificial Sequence
  chemically synthesized
gttgcacagggatttgcttt

SEQ ID NO: 533424 - DNA, 20 bp, Artificial Sequence
  chemically synthesized
agtttctactttttggacag

SEQ ID NO: 533425 - DNA, 20 bp, Artificial Sequence
  chemically synthesized
ggtttctagctgtccaaaaa

SEQ ID NO: 533426 - DNA, 20 bp, Artificial Sequence
  chemically synthesized
ttgaattgggagagatgaag

SEQ ID NO: 533427 - DNA, 20 bp, Artificial Sequence
  chemically synthesized
cacagtatgttgcctggctt

SEQ ID NO: 533428 - DNA, 20 bp, Artificial Sequence
  chemically synthesized
atagctgagcctgaaggcat

SEQ ID NO: 533429 - DNA, 20 bp, Artificial Sequence
  chemically synthesized
ataggatagaacccggaatg

SEQ ID NO: 533430 - DNA, 20 bp, Artificial Sequence
  chemically synthesized
gctttcctttgctgattttg

SEQ ID NO: 533431 - DNA, 20 bp, Artificial Sequence
  chemically synthesized
aatgccttcagagtttcaac

SEQ ID NO: 533432 - DNA, 20 bp, Artificial Sequence
  chemically synthesized
attaaattaaattcacataa

SEQ ID NO: 533433 - DNA, 20 bp, Artificial Sequence
  chemically synthesized
taattagaattttatgagag

SEQ ID NO: 533434 - DNA, 20 bp, Artificial Sequence
  chemically synthesized
ttattgtttacttcccactg

SEQ ID NO: 533435 - DNA, 20 bp, Artificial Sequence
  chemically synthesized
ttgaaatacatttgccacag

SEQ ID NO: 533436 - DNA, 20 bp, Artificial Sequence
  chemically synthesized
aaacaactacgaatgagcaa

SEQ ID NO: 533437 - DNA, 20 bp, Artificial Sequence
  chemically synthesized
gctgggacctttttgcattg

SEQ ID NO: 533438 - DNA, 20 bp, Artificial Sequence
  chemically synthesized
aaagttacttcgcaacttaa

SEQ ID NO: 533439 - DNA, 20 bp, Artificial Sequence
  chemically synthesized
tatcagactaaaattcatat

SEQ ID NO: 533440 - DNA, 20 bp, Artificial Sequence
  chemically synthesized
tgtgataagaaagtagtctt

SEQ ID NO: 533441 - DNA, 20 bp, Artificial Sequence
  chemically synthesized
gtgatgtgagaactttgtga

SEQ ID NO: 533442 - DNA, 20 bp, Artificial Sequence
  chemically synthesized
ctgtagtcatttatcacccc

SEQ ID NO: 533443 - DNA, 20 bp, Artificial Sequence
  chemically synthesized
cttacagagtgttctgtaaa

SEQ ID NO: 533444 - DNA, 20 bp, Artificial Sequence
  chemically synthesized
cttaatgccatagtattttt

SEQ ID NO: 533445 - DNA, 20 bp, Artificial Sequence
  chemically synthesized
tgtgtctagtggttaccata

SEQ ID NO: 533446 - DNA, 20 bp, Artificial Sequence
  chemically synthesized
attttttcagtgtgcctact

SEQ ID NO: 533447 - DNA, 20 bp, Artificial Sequence
  chemically synthesized
tactacagcagctctgccca

SEQ ID NO: 533448 - DNA, 20 bp, Artificial Sequence
  chemically synthesized
ctgtagtaaaatgaagagaa

SEQ ID NO: 533449 - DNA, 20 bp, Artificial Sequence
  chemically synthesized
tttttgtgtcatttcaagtc

SEQ ID NO: 533450 - DNA, 20 bp, Artificial Sequence
  chemically synthesized
caataaattgcattgccaat

SEQ ID NO: 533451 - DNA, 20 bp, Artificial Sequence
  chemically synthesized
ttatgcataatgtatttttg

SEQ ID NO: 533452 - DNA, 20 bp, Artificial Sequence
  chemically synthesized
gagagaaaataaacacaagc

SEQ ID NO: 533453 - DNA, 20 bp, Artificial Sequence
  chemically synthesized
aggaaattaaatataatgag

SEQ ID NO: 533454 - DNA, 20 bp, Artificial Sequence
  chemically synthesized
ctcttaacttcagaaaaaaa

SEQ ID NO: 533455 - DNA, 20 bp, Artificial Sequence
  chemically synthesized
agtctactttgctcttaact

SEQ ID NO: 533456 - DNA, 20 bp, Artificial Sequence
  chemically synthesized
atataaggcataatgctcta

SEQ ID NO: 533457 - DNA, 20 bp, Artificial Sequence
  chemically synthesized
cagcgaggagaaattcaata

SEQ ID NO: 533458 - DNA, 20 bp, Artificial Sequence
  chemically synthesized
actctagtttgggacagcga

SEQ ID NO: 533459 - DNA, 20 bp, Artificial Sequence
  chemically synthesized
caatattaataccatctcat

SEQ ID NO: 533460 - DNA, 20 bp, Artificial Sequence
  chemically synthesized
gaaatttaaactacatatat

SEQ ID NO: 533461 - DNA, 20 bp, Artificial Sequence
  chemically synthesized
ttttttttactgtgcctact

SEQ ID NO: 533462 - DNA, 20 bp, Artificial Sequence
  chemically synthesized
tatatatatagaatatatat

SEQ ID NO: 533463 - DNA, 20 bp, Artificial Sequence
  chemically synthesized
atatatatatatatatatat

SEQ ID NO: 533464 - DNA, 20 bp, Artificial Sequence
  chemically synthesized
tatatatatatatatggcac

SEQ ID NO: 533465 - DNA, 20 bp, Artificial Sequence
  chemically synthesized
acctttaataatatgatcac

SEQ ID NO: 533466 - DNA, 20 bp, Artificial Sequence
  chemically synthesized
tgaaaagatatgtttatttt

SEQ ID NO: 533467 - DNA, 20 bp, Artificial Sequence
  chemically synthesized
ctaaatatggatataaatta

SEQ ID NO: 533468 - DNA, 20 bp, Artificial Sequence
  chemically synthesized
gatcatctggagtaaaatct

SEQ ID NO: 533469 - DNA, 20 bp, Artificial Sequence
  chemically synthesized
agtcaatttgtaaaccgcat

SEQ ID NO: 533470 - DNA, 20 bp, Artificial Sequence
  chemically synthesized
tattgcctccgtattacaga

SEQ ID NO: 533471 - DNA, 20 bp, Artificial Sequence
  chemically synthesized
taaacccaagctctgtagct

SEQ ID NO: 533472 - DNA, 20 bp, Artificial Sequence
  chemically synthesized
agattgagctgagtagtttg

SEQ ID NO: 533473 - DNA, 20 bp, Artificial Sequence
  chemically synthesized
ttgtgaaaaccaaagtttca

SEQ ID NO: 533474 - DNA, 20 bp, Artificial Sequence
  chemically synthesized
tctgattgtttacagagcaa

SEQ ID NO: 533475 - DNA, 20 bp, Artificial Sequence
  chemically synthesized
tgataaaacccaaaaactat

SEQ ID NO: 533476 - DNA, 20 bp, Artificial Sequence
  chemically synthesized
gatttttaactctaattaca

SEQ ID NO: 533477 - DNA, 20 bp, Artificial Sequence
  chemically synthesized
cacagtaatctcaaaaagct

SEQ ID NO: 533478 - DNA, 20 bp, Artificial Sequence
  chemically synthesized
aatgtcagtagtataaaaat

SEQ ID NO: 533479 - DNA, 20 bp, Artificial Sequence
  chemically synthesized
gccctttcgacttctggtct

SEQ ID NO: 533480 - DNA, 20 bp, Artificial Sequence
  chemically synthesized
taaacttgtattatagacac

SEQ ID NO: 533481 - DNA, 20 bp, Artificial Sequence
  chemically synthesized
aacaacatttttttgatgat

SEQ ID NO: 533482 - DNA, 20 bp, Artificial Sequence
  chemically synthesized
cttccaatagatttccaaac

SEQ ID NO: 533483 - DNA, 20 bp, Artificial Sequence
  chemically synthesized
cacagtaatctcaaaaagcc

SEQ ID NO: 533484 - DNA, 20 bp, Artificial Sequence
  chemically synthesized
ctcacataatttgaaaatat

SEQ ID NO: 533485 - DNA, 20 bp, Artificial Sequence
  chemically synthesized
aatattaagaatttgaagct

SEQ ID NO: 533486 - DNA, 20 bp, Artificial Sequence
  chemically synthesized
aatgcattgaattccatatg

SEQ ID NO: 533487 - DNA, 20 bp, Artificial Sequence
  chemically synthesized
tctccagctcccccacacaa

SEQ ID NO: 533488 - DNA, 20 bp, Artificial Sequence
  chemically synthesized
tttgtgtgggggagctggag

SEQ ID NO: 533489 - DNA, 20 bp, Artificial Sequence
  chemically synthesized
acactagagagattataacc

SEQ ID NO: 533490 - DNA, 20 bp, Artificial Sequence
  chemically synthesized
aaaaaatattacactaaata

SEQ ID NO: 533491 - DNA, 20 bp, Artificial Sequence
  chemically synthesized
aatattttttcataatttaa

SEQ ID NO: 533492 - DNA, 20 bp, Artificial Sequence
  chemically synthesized
ctataagctataataaaatg

SEQ ID NO: 533493 - DNA, 20 bp, Artificial Sequence
  chemically synthesized
tttttcagtccttgaaactt

SEQ ID NO: 533494 - DNA, 20 bp, Artificial Sequence
  chemically synthesized
tgaaccaagccacaaaaaaa

SEQ ID NO: 533495 - DNA, 20 bp, Artificial Sequence
  chemically synthesized
cataacataatattgatgaa

SEQ ID NO: 533496 - DNA, 20 bp, Artificial Sequence
  chemically synthesized
catacataattaaaatcacc

SEQ ID NO: 533497 - DNA, 20 bp, Artificial Sequence
  chemically synthesized
ttcagctgctgaaacactaa

SEQ ID NO: 533498 - DNA, 20 bp, Artificial Sequence
  chemically synthesized
ctggttttcatctttaattg

SEQ ID NO: 533499 - DNA, 20 bp, Artificial Sequence
  chemically synthesized
tgcttgactgcatttaacct

SEQ ID NO: 533500 - DNA, 20 bp, Artificial Sequence
  chemically synthesized
taaagttcttgaggcaaagc

SEQ ID NO: 533501 - DNA, 20 bp, Artificial Sequence
  chemically synthesized
tggtgctatgaaaacaaaga

SEQ ID NO: 533502 - DNA, 20 bp, Artificial Sequence
  chemically synthesized
ggtgtccgcagtagaccact

SEQ ID NO: 533503 - DNA, 20 bp, Artificial Sequence
  chemically synthesized
gaaaaccaggaattggaaaa

SEQ ID NO: 533504 - DNA, 20 bp, Artificial Sequence
  chemically synthesized
aatttgtcttgcacagtgaa

SEQ ID NO: 533505 - DNA, 20 bp, Artificial Sequence
  chemically synthesized
gtgcaagacaaattttaaaa

SEQ ID NO: 533506 - DNA, 20 bp, Artificial Sequence
  chemically synthesized
caatgttggctgaaattaat

SEQ ID NO: 533507 - DNA, 20 bp, Artificial Sequence
  chemically synthesized
atgcagaatgttctgtggaa

SEQ ID NO: 533508 - DNA, 20 bp, Artificial Sequence
  chemically synthesized
agatgggtcttgaagcagta

SEQ ID NO: 533509 - DNA, 20 bp, Artificial Sequence
  chemically synthesized
gataaataaggaagtcattt

SEQ ID NO: 533510 - DNA, 20 bp, Artificial Sequence
  chemically synthesized
tttcatgacagtaccagtta

SEQ ID NO: 533511 - DNA, 20 bp, Artificial Sequence
  chemically synthesized
cgttgtttgccaaagtaatg

SEQ ID NO: 533512 - DNA, 20 bp, Artificial Sequence
  chemically synthesized
ggactctaataagtatctag

SEQ ID NO: 533513 - DNA, 20 bp, Artificial Sequence
  chemically synthesized
actgtactccagtctaggtg

SEQ ID NO: 533514 - DNA, 20 bp, Artificial Sequence
  chemically synthesized
caatttgggaggctaaggca

SEQ ID NO: 533515 - DNA, 20 bp, Artificial Sequence
  chemically synthesized
tttaatgttaaacttttaca

SEQ ID NO: 533516 - DNA, 20 bp, Artificial Sequence
  chemically synthesized
aatggtcttatttaacaact

SEQ ID NO: 533517 - DNA, 20 bp, Artificial Sequence
  chemically synthesized
tgaaaacagtacagtgaaat

SEQ ID NO: 533518 - DNA, 20 bp, Artificial Sequence
  chemically synthesized
tacaagtcatattcaggtgg

SEQ ID NO: 533519 - DNA, 20 bp, Artificial Sequence
  chemically synthesized
agaaactttaccttacacaa

SEQ ID NO: 533520 - DNA, 20 bp, Artificial Sequence
  chemically synthesized
tatctgcaactagttaggtt

SEQ ID NO: 533521 - DNA, 20 bp, Artificial Sequence
  chemically synthesized
gcaactagttaggtttaaga

SEQ ID NO: 533522 - DNA, 20 bp, Artificial Sequence
  chemically synthesized
ttgggggaaaataaatcctt

SEQ ID NO: 533523 - DNA, 20 bp, Artificial Sequence
  chemically synthesized
tcctttcatgttaaacttta

SEQ ID NO: 533524 - DNA, 20 bp, Artificial Sequence
  chemically synthesized
gtaaaaacagatgttattca

SEQ ID NO: 533525 - DNA, 20 bp, Artificial Sequence
  chemically synthesized
agaagagatttatgcgatgt

SEQ ID NO: 533526 - DNA, 20 bp, Artificial Sequence
  chemically synthesized
gtgatcaggattttataact

SEQ ID NO: 533527 - DNA, 20 bp, Artificial Sequence
  chemically synthesized
ctgaatggtaaacatagact

SEQ ID NO: 533528 - DNA, 20 bp, Artificial Sequence
  chemically synthesized
tttttaataattaaaagaag

SEQ ID NO: 533529 - DNA, 20 bp, Artificial Sequence
  chemically synthesized
taagtaactaaacagattaa

SEQ ID NO: 533530 - DNA, 20 bp, Artificial Sequence
  chemically synthesized
agactgtaggcttctcttga

SEQ ID NO: 533531 - DNA, 20 bp, Artificial Sequence
  chemically synthesized
ggttatttaattggaactcc

SEQ ID NO: 533532 - DNA, 20 bp, Artificial Sequence
  chemically synthesized
ctgtgaagaatgccaaggaa

SEQ ID NO: 533533 - DNA, 20 bp, Artificial Sequence
  chemically synthesized
aacactgtgccaggtgctgt

SEQ ID NO: 533534 - DNA, 20 bp, Artificial Sequence
  chemically synthesized
atatcctctccatgaatagg

SEQ ID NO: 533535 - DNA, 20 bp, Artificial Sequence
  chemically synthesized
tattcatggagaggatatga

SEQ ID NO: 533536 - DNA, 20 bp, Artificial Sequence
  chemically synthesized
ctgaagacattttaaaaatt

SEQ ID NO: 533537 - DNA, 20 bp, Artificial Sequence
  chemically synthesized
tgtccttaaacaagttaaaa

SEQ ID NO: 533538 - DNA, 20 bp, Artificial Sequence
  chemically synthesized
taatgagctcataagatcat

SEQ ID NO: 533539 - DNA, 20 bp, Artificial Sequence
  chemically synthesized
tatggtcatttttttctgca

SEQ ID NO: 533540 - DNA, 20 bp, Artificial Sequence
  chemically synthesized
tcagtgacctacattctagt

SEQ ID NO: 533541 - DNA, 20 bp, Artificial Sequence
  chemically synthesized
gagaccctatcaaaaaaaaa

SEQ ID NO: 533542 - DNA, 20 bp, Artificial Sequence
  chemically synthesized
tgtaaggtactttgtaaggt

SEQ ID NO: 533543 - DNA, 20 bp, Artificial Sequence
  chemically synthesized
gaatctactgttgaatacta

SEQ ID NO: 533544 - DNA, 20 bp, Artificial Sequence
  chemically synthesized
gtataacctctagaattggt

SEQ ID NO: 533545 - DNA, 20 bp, Artificial Sequence
  chemically synthesized
cttctttgaatgtataacct

SEQ ID NO: 533546 - DNA, 20 bp, Artificial Sequence
  chemically synthesized
atctggattcttatatcatg

SEQ ID NO: 533547 - DNA, 20 bp, Artificial Sequence
  chemically synthesized
tgatattttcttgcatgata

SEQ ID NO: 533548 - DNA, 20 bp, Artificial Sequence
  chemically synthesized
ctctccttggtcaaacccaa

SEQ ID NO: 533549 - DNA, 20 bp, Artificial Sequence
  chemically synthesized
cgaggcaaattctgtcctta

SEQ ID NO: 533550 - DNA, 20 bp, Artificial Sequence
  chemically synthesized
gcagtggctttctcttaagg

SEQ ID NO: 533551 - DNA, 20 bp, Artificial Sequence
  chemically synthesized
gtttctcagagcccagaaaa

SEQ ID NO: 533552 - DNA, 20 bp, Artificial Sequence
  chemically synthesized
ttttctttttttctgggctc

SEQ ID NO: 533553 - DNA, 20 bp, Artificial Sequence
  chemically synthesized
ggagagaggtttctcagagc

SEQ ID NO: 533554 - DNA, 20 bp, Artificial Sequence
  chemically synthesized
tcagtcagtcagagtcccaa

SEQ ID NO: 533555 - DNA, 20 bp, Artificial Sequence
  chemically synthesized
gctgactttatacttataac

SEQ ID NO: 533556 - DNA, 20 bp, Artificial Sequence
  chemically synthesized
gctcagccccaatcagggta

SEQ ID NO: 533557 - DNA, 20 bp, Artificial Sequence
  chemically synthesized
gcttgcaggaaattttctgt

SEQ ID NO: 533558 - DNA, 20 bp, Artificial Sequence
  chemically synthesized
cataaaaacataaattctta

SEQ ID NO: 533559 - DNA, 20 bp, Artificial Sequence
  chemically synthesized
ggtactgccagcccaaatag

SEQ ID NO: 533560 - DNA, 20 bp, Artificial Sequence
  chemically synthesized
gggctggcagtaccttataa

SEQ ID NO: 533561 - DNA, 20 bp, Artificial Sequence
  chemically synthesized
aaaaggtcctatactatttt

SEQ ID NO: 533562 - DNA, 20 bp, Artificial Sequence
  chemically synthesized
ttggcagggcattgttgtaa

SEQ ID NO: 533563 - DNA, 20 bp, Artificial Sequence
  chemically synthesized
cttccaaggaagggtgatat

SEQ ID NO: 533564 - DNA, 20 bp, Artificial Sequence
  chemically synthesized
taaaaaaaaaaaaaaaaact

SEQ ID NO: 533565 - DNA, 20 bp, Artificial Sequence
  chemically synthesized
taacctgtttgtggtctggg

SEQ ID NO: 533566 - DNA, 20 bp, Artificial Sequence
  chemically synthesized
ctacattgtattcccaaatt

SEQ ID NO: 533567 - DNA, 20 bp, Artificial Sequence
  chemically synthesized
ctaactttgcaacccaagga

SEQ ID NO: 533568 - DNA, 20 bp, Artificial Sequence
  chemically synthesized
tcccttcagcttgagtctca

SEQ ID NO: 533569 - DNA, 20 bp, Artificial Sequence
  chemically synthesized
aaatgtatgtctatcaagca

SEQ ID NO: 533570 - DNA, 20 bp, Artificial Sequence
  chemically synthesized
aaaagaaaaaaaacagatga

SEQ ID NO: 533571 - DNA, 20 bp, Artificial Sequence
  chemically synthesized
tatgtatatggactttgtta

SEQ ID NO: 533572 - DNA, 20 bp, Artificial Sequence
  chemically synthesized
gtccatatacataccaggta

SEQ ID NO: 533573 - DNA, 20 bp, Artificial Sequence
  chemically synthesized
taattgcctaggggtaaggg

SEQ ID NO: 533574 - DNA, 20 bp, Artificial Sequence
  chemically synthesized
ttggaactattccaaagacc

SEQ ID NO: 533575 - DNA, 20 bp, Artificial Sequence
  chemically synthesized
ttctgagcaagaaagatatt

SEQ ID NO: 533576 - DNA, 20 bp, Artificial Sequence
  chemically synthesized
ttctcaaatatctttcttgc

SEQ ID NO: 533577 - DNA, 20 bp, Artificial Sequence
  chemically synthesized
ggacttaaatcctttctgag

SEQ ID NO: 533578 - DNA, 20 bp, Artificial Sequence
  chemically synthesized
aaggatttaagtccttttgt

SEQ ID NO: 533579 - DNA, 20 bp, Artificial Sequence
  chemically synthesized
ccactctggaaacataggta

SEQ ID NO: 533580 - DNA, 20 bp, Artificial Sequence
  chemically synthesized
aagcacattgcattatgggt

SEQ ID NO: 533581 - DNA, 20 bp, Artificial Sequence
  chemically synthesized
cagcttatttgaggagagtt

SEQ ID NO: 533582 - DNA, 20 bp, Artificial Sequence
  chemically synthesized
gtttaagaaagaagatttta

SEQ ID NO: 533583 - DNA, 20 bp, Artificial Sequence
  chemically synthesized
atttggagactacataagaa

SEQ ID NO: 533584 - DNA, 20 bp, Artificial Sequence
  chemically synthesized
tgtttcaataatgttgatgt

SEQ ID NO: 533585 - DNA, 20 bp, Artificial Sequence
  chemically synthesized
tgttttacattggaggctaa

SEQ ID NO: 533586 - DNA, 20 bp, Artificial Sequence
  chemically synthesized
cattgaatccacttatcaga

SEQ ID NO: 533587 - DNA, 20 bp, Artificial Sequence
  chemically synthesized
aactacagtatccagagacc

SEQ ID NO: 533588 - DNA, 20 bp, Artificial Sequence
  chemically synthesized
taccaaacaggtatatgaat

SEQ ID NO: 533589 - DNA, 20 bp, Artificial Sequence
  chemically synthesized
tcaaatatttaaactttgga

SEQ ID NO: 533590 - DNA, 20 bp, Artificial Sequence
  chemically synthesized
cttgatgataaccactgagc

SEQ ID NO: 533591 - DNA, 20 bp, Artificial Sequence
  chemically synthesized
aggttagtgaaagtggtaaa

SEQ ID NO: 533592 - DNA, 20 bp, Artificial Sequence
  chemically synthesized
aatacattgcttattacagt

SEQ ID NO: 533593 - DNA, 20 bp, Artificial Sequence
  chemically synthesized
ttacagtcaagaaatgttat

SEQ ID NO: 533594 - DNA, 20 bp, Artificial Sequence
  chemically synthesized
caagaaatgttatacagaaa

SEQ ID NO: 533595 - DNA, 20 bp, Artificial Sequence
  chemically synthesized
agccataaataaggaagtgg

SEQ ID NO: 533596 - DNA, 20 bp, Artificial Sequence
  chemically synthesized
taagacatgtgctgataacc

SEQ ID NO: 533597 - DNA, 20 bp, Artificial Sequence
  chemically synthesized
gactcctaaaataaatacta

SEQ ID NO: 533598 - DNA, 20 bp, Artificial Sequence
  chemically synthesized
tgataatttgtgggcacaaa

SEQ ID NO: 533599 - DNA, 20 bp, Artificial Sequence
  chemically synthesized
tttatgtgttctaatattat

SEQ ID NO: 533600 - DNA, 20 bp, Artificial Sequence
  chemically synthesized
ttagctaaaaccaccataat

SEQ ID NO: 533601 - DNA, 20 bp, Artificial Sequence
  chemically synthesized
ctaaaaccaccataattgag

SEQ ID NO: 533602 - DNA, 20 bp, Artificial Sequence
  chemically synthesized
cactgctccattcaactagt

SEQ ID NO: 533603 - DNA, 20 bp, Artificial Sequence
  chemically synthesized
tggtgtcgtggttttatgaa

SEQ ID NO: 533604 - DNA, 20 bp, Artificial Sequence
  chemically synthesized
ggttttatgaaaaagaaaca

SEQ ID NO: 533605 - DNA, 20 bp, Artificial Sequence
  chemically synthesized
gctatcatgagaacagcatg

SEQ ID NO: 533606 - DNA, 20 bp, Artificial Sequence
  chemically synthesized
gtcaattaaacctctttcct

SEQ ID NO: 533607 - DNA, 20 bp, Artificial Sequence
  chemically synthesized
cattggtctcttaatctcag

SEQ ID NO: 533608 - DNA, 20 bp, Artificial Sequence
  chemically synthesized
ctaaatccttagatcattaa

SEQ ID NO: 533609 - DNA, 20 bp, Artificial Sequence
  chemically synthesized
ttttgttttatataatagtt

SEQ ID NO: 533610 - DNA, 20 bp, Artificial Sequence
  chemically synthesized
taagactgcaatttaaaatg

SEQ ID NO: 533611 - DNA, 20 bp, Artificial Sequence
  chemically synthesized
aacgaattttgtccccatga

SEQ ID NO: 533612 - DNA, 20 bp, Artificial Sequence
  chemically synthesized
gctcagtctgcacagctgat

SEQ ID NO: 533613 - DNA, 20 bp, Artificial Sequence
  chemically synthesized
agtcatttcataaagatgat

SEQ ID NO: 533614 - DNA, 20 bp, Artificial Sequence
  chemically synthesized
agaggaggagtaaagagtgg

SEQ ID NO: 533615 - DNA, 20 bp, Artificial Sequence
  chemically synthesized
agttgagtgatgccttaaag

SEQ ID NO: 533616 - DNA, 20 bp, Artificial Sequence
  chemically synthesized
gattagttgagtgatgcctt

SEQ ID NO: 533617 - DNA, 20 bp, Artificial Sequence
  chemically synthesized
tggttcttcaagtgttctct

SEQ ID NO: 533618 - DNA, 20 bp, Artificial Sequence
  chemically synthesized
acatacctctactgaggtct

SEQ ID NO: 533619 - DNA, 20 bp, Artificial Sequence
  chemically synthesized
ccttgcagagagccaatctc

SEQ ID NO: 533620 - DNA, 20 bp, Artificial Sequence
  chemically synthesized
atcaaactccttgtgacatt

SEQ ID NO: 533621 - DNA, 20 bp, Artificial Sequence
  chemically synthesized
gaatttagggaaatggcaca

SEQ ID NO: 533622 - DNA, 20 bp, Artificial Sequence
  chemically synthesized
cttgtgccatttccctaaat

SEQ ID NO: 533623 - DNA, 20 bp, Artificial Sequence
  chemically synthesized
ttccctaaattcagaaatgt

SEQ ID NO: 533624 - DNA, 20 bp, Artificial Sequence
  chemically synthesized
cataaaaatagatgtcagct

SEQ ID NO: 533625 - DNA, 20 bp, Artificial Sequence
  chemically synthesized
tagattcagggactaaacat

SEQ ID NO: 533626 - DNA, 20 bp, Artificial Sequence
  chemically synthesized
gggactaaacatgaagaaat

SEQ ID NO: 533627 - DNA, 20 bp, Artificial Sequence
  chemically synthesized
ttccaatttgttatataata

SEQ ID NO: 533628 - DNA, 20 bp, Artificial Sequence
  chemically synthesized
tgttacttacaaaaaaatga

SEQ ID NO: 533629 - DNA, 20 bp, Artificial Sequence
  chemically synthesized
ttagctattgtcacagtaat

SEQ ID NO: 533630 - DNA, 20 bp, Artificial Sequence
  chemically synthesized
ctagccattcacatccagga

SEQ ID NO: 533631 - DNA, 20 bp, Artificial Sequence
  chemically synthesized
cagcctagatggacgtgttc

SEQ ID NO: 533632 - DNA, 20 bp, Artificial Sequence
  chemically synthesized
ttgtgattgcagaaggtgga

SEQ ID NO: 533633 - DNA, 20 bp, Artificial Sequence
  chemically synthesized
cacaatatatcatctgcttt

SEQ ID NO: 533634 - DNA, 20 bp, Artificial Sequence
  chemically synthesized
tgtggcaaaaattacaccct

SEQ ID NO: 533635 - DNA, 20 bp, Artificial Sequence
  chemically synthesized
gattaacctgctgctaaatt

SEQ ID NO: 533636 - DNA, 20 bp, Artificial Sequence
  chemically synthesized
tgctgctaaatttaagaaat

SEQ ID NO: 533637 - DNA, 20 bp, Artificial Sequence
  chemically synthesized
atgtcttttaattccttata

SEQ ID NO: 533638 - DNA, 20 bp, Artificial Sequence
  chemically synthesized
ttcttgcatattgtattgga

SEQ ID NO: 533639 - DNA, 20 bp, Artificial Sequence
  chemically synthesized
ttcttttccaatacaatatg

SEQ ID NO: 533640 - DNA, 20 bp, Artificial Sequence
  chemically synthesized
taagttgtaattggaaacag

SEQ ID NO: 533641 - DNA, 20 bp, Artificial Sequence
  chemically synthesized
caagaatttgaaagacgaga

SEQ ID NO: 533642 - DNA, 20 bp, Artificial Sequence
  chemically synthesized
atggaacaccaccagaaaaa

SEQ ID NO: 533643 - DNA, 20 bp, Artificial Sequence
  chemically synthesized
tttacaaaaatggaacacca

SEQ ID NO: 533644 - DNA, 20 bp, Artificial Sequence
  chemically synthesized
gtggtgttccatttttgtaa

SEQ ID NO: 533645 - DNA, 20 bp, Artificial Sequence
  chemically synthesized
tgatcacaccaggattgcac

SEQ ID NO: 533646 - DNA, 20 bp, Artificial Sequence
  chemically synthesized
tcacatttggtgaagcacca

SEQ ID NO: 533647 - DNA, 20 bp, Artificial Sequence
  chemically synthesized
acaaaggaaagagaaatatg

SEQ ID NO: 533648 - DNA, 20 bp, Artificial Sequence
  chemically synthesized
ggcctagtgaaacaaaggaa

SEQ ID NO: 533649 - DNA, 20 bp, Artificial Sequence
  chemically synthesized
aatggagtgggtaataagca

SEQ ID NO: 533650 - DNA, 20 bp, Artificial Sequence
  chemically synthesized
ggagaacaggaaggacagag

SEQ ID NO: 533651 - DNA, 20 bp, Artificial Sequence
  chemically synthesized
gtgtgaaggagagagggagg

SEQ ID NO: 533652 - DNA, 20 bp, Artificial Sequence
  chemically synthesized
agtcaatatattttatgtgc

SEQ ID NO: 533653 - DNA, 20 bp, Artificial Sequence
  chemically synthesized
tgtgcaaagaaatacatatt

SEQ ID NO: 533654 - DNA, 20 bp, Artificial Sequence
  chemically synthesized
aacgacaacaaaaacctgtt

SEQ ID NO: 533655 - DNA, 20 bp, Artificial Sequence
  chemically synthesized
tctttaagacacaaatttgg

SEQ ID NO: 533656 - DNA, 20 bp, Artificial Sequence
  chemically synthesized
tcttatatacagtctttcag

SEQ ID NO: 533657 - DNA, 20 bp, Artificial Sequence
  chemically synthesized
ctcttgattaactttacttt

SEQ ID NO: 533658 - DNA, 20 bp, Artificial Sequence
  chemically synthesized
ttatgggattcaacctgaaa

SEQ ID NO: 533659 - DNA, 20 bp, Artificial Sequence
  chemically synthesized
aatatgaccaaattacaata

SEQ ID NO: 533660 - DNA, 20 bp, Artificial Sequence
  chemically synthesized
ttgtatcttcaaaacagtgg

SEQ ID NO: 533661 - DNA, 20 bp, Artificial Sequence
  chemically synthesized
atctccagtggctagccaat

SEQ ID NO: 533662 - DNA, 20 bp, Artificial Sequence
  chemically synthesized
cttttgcaggataaagaaat

SEQ ID NO: 533663 - DNA, 20 bp, Artificial Sequence
  chemically synthesized
tctctgtgcttttgcaggat

SEQ ID NO: 533664 - DNA, 20 bp, Artificial Sequence
  chemically synthesized
aagcacagagactctgtctt

SEQ ID NO: 533665 - DNA, 20 bp, Artificial Sequence
  chemically synthesized
tgtccgtggtatgtaaacct

SEQ ID NO: 533666 - DNA, 20 bp, Artificial Sequence
  chemically synthesized
tggtcaagatcccaaatcaa

SEQ ID NO: 533667 - DNA, 20 bp, Artificial Sequence
  chemically synthesized
tggcaaggccccatctctac

SEQ ID NO: 533668 - DNA, 20 bp, Artificial Sequence
  chemically synthesized
actgtatacttaaaaatggt

SEQ ID NO: 533669 - DNA, 20 bp, Artificial Sequence
  chemically synthesized
accatcaccactatccatct

SEQ ID NO: 533670 - DNA, 20 bp, Artificial Sequence
  chemically synthesized
taccaggagctggaggaaga

SEQ ID NO: 533671 - DNA, 20 bp, Artificial Sequence
  chemically synthesized
tcatcttgaacaagaagtta

SEQ ID NO: 533672 - DNA, 20 bp, Artificial Sequence
  chemically synthesized
aagatgatgttctggctctt

SEQ ID NO: 533673 - DNA, 20 bp, Artificial Sequence
  chemically synthesized
ctattgaagttggacaaatg

SEQ ID NO: 533674 - DNA, 20 bp, Artificial Sequence
  chemically synthesized
caatagatagctgctaaatg

SEQ ID NO: 533675 - DNA, 20 bp, Artificial Sequence
  chemically synthesized
tgctaaatgagagaaagcat

SEQ ID NO: 533676 - DNA, 20 bp, Artificial Sequence
  chemically synthesized
ttcaagtgactttcaactaa

SEQ ID NO: 533677 - DNA, 20 bp, Artificial Sequence
  chemically synthesized
cttagttgaaagtcacttga

SEQ ID NO: 533678 - DNA, 20 bp, Artificial Sequence
  chemically synthesized
tgaaagtcacttgaaaagaa

SEQ ID NO: 533679 - DNA, 20 bp, Artificial Sequence
  chemically synthesized
agaagagagatgaactaaac

SEQ ID NO: 533680 - DNA, 20 bp, Artificial Sequence
  chemically synthesized
atctgagcacagcgcagcct

SEQ ID NO: 533681 - DNA, 20 bp, Artificial Sequence
  chemically synthesized
cagtgtgtaccaattaatat

SEQ ID NO: 533682 - DNA, 20 bp, Artificial Sequence
  chemically synthesized
ctttggggcaaactatagac

SEQ ID NO: 533683 - DNA, 20 bp, Artificial Sequence
  chemically synthesized
tatttaatttatgttttatt

SEQ ID NO: 533684 - DNA, 20 bp, Artificial Sequence
  chemically synthesized
aattttccaggtagacaagg

SEQ ID NO: 533685 - DNA, 20 bp, Artificial Sequence
  chemically synthesized
tcaagagaagttatctttgc

SEQ ID NO: 533686 - DNA, 20 bp, Artificial Sequence
  chemically synthesized
attcagctcagtgtcattta

SEQ ID NO: 533687 - DNA, 20 bp, Artificial Sequence
  chemically synthesized
gctctgtcactgattgacaa

SEQ ID NO: 533688 - DNA, 20 bp, Artificial Sequence
  chemically synthesized
ctcaaggcctgccctaaaag

SEQ ID NO: 533689 - DNA, 20 bp, Artificial Sequence
  chemically synthesized
agagcaattatcctaaggga

SEQ ID NO: 533690 - DNA, 20 bp, Artificial Sequence
  chemically synthesized
ctccatggagaggtccacat

SEQ ID NO: 533691 - DNA, 20 bp, Artificial Sequence
  chemically synthesized
tgttatgtagcaaaagttaa

SEQ ID NO: 533692 - DNA, 20 bp, Artificial Sequence
  chemically synthesized
catctttcatccatgacctg

SEQ ID NO: 533693 - DNA, 20 bp, Artificial Sequence
  chemically synthesized
cacttgttttccactccaaa

SEQ ID NO: 533694 - DNA, 20 bp, Artificial Sequence
  chemically synthesized
atttatggagtaaatcatgg

SEQ ID NO: 533695 - DNA, 20 bp, Artificial Sequence
  chemically synthesized
attcaaggctgtgaccccaa

SEQ ID NO: 533696 - DNA, 20 bp, Artificial Sequence
  chemically synthesized
tgaattgttgaattgggagc

SEQ ID NO: 533697 - DNA, 20 bp, Artificial Sequence
  chemically synthesized
actgaaatgctgcttcctgc

SEQ ID NO: 533698 - DNA, 20 bp, Artificial Sequence
  chemically synthesized
tattattctctgggagttac

SEQ ID NO: 533699 - DNA, 20 bp, Artificial Sequence
  chemically synthesized
taactttctttgtaactccc

SEQ ID NO: 533700 - DNA, 20 bp, Artificial Sequence
  chemically synthesized
atttgttgctttctcactat

SEQ ID NO: 533701 - DNA, 20 bp, Artificial Sequence
  chemically synthesized
gaatgtctgtttcttgatag

SEQ ID NO: 533702 - DNA, 20 bp, Artificial Sequence
  chemically synthesized
agatcatattagtctagatg

SEQ ID NO: 533703 - DNA, 20 bp, Artificial Sequence
  chemically synthesized
atgacttcttttacctcttc

SEQ ID NO: 533704 - DNA, 20 bp, Artificial Sequence
  chemically synthesized
gtttaacagcatcaatcttt

SEQ ID NO: 533705 - DNA, 20 bp, Artificial Sequence
  chemically synthesized
aattatattaaaataaaatg

SEQ ID NO: 533706 - DNA, 20 bp, Artificial Sequence
  chemically synthesized
acattttattttaatataat

SEQ ID NO: 533707 - DNA, 20 bp, Artificial Sequence
  chemically synthesized
atacctggaatgttttatta

SEQ ID NO: 533708 - DNA, 20 bp, Artificial Sequence
  chemically synthesized
tgtaaattgaggggataaaa

SEQ ID NO: 533709 - DNA, 20 bp, Artificial Sequence
  chemically synthesized
tatcccctcaatttacactt

SEQ ID NO: 533710 - DNA, 20 bp, Artificial Sequence
  chemically synthesized
atcattttttttgttttggt

SEQ ID NO: 533711 - DNA, 20 bp, Artificial Sequence
  chemically synthesized
aaggttagaggaagggagga

SEQ ID NO: 533712 - DNA, 20 bp, Artificial Sequence
  chemically synthesized
tttgaccacagaaaaatgtc

SEQ ID NO: 533713 - DNA, 20 bp, Artificial Sequence
  chemically synthesized
aggtcaggaaaagtttgacc

SEQ ID NO: 533714 - DNA, 20 bp, Artificial Sequence
  chemically synthesized
ttcagaacttcttctccaaa

SEQ ID NO: 533715 - DNA, 20 bp, Artificial Sequence
  chemically synthesized
tccaggttctaatggagatc

SEQ ID NO: 533716 - DNA, 20 bp, Artificial Sequence
  chemically synthesized
ttactcaggatgtttgggaa

SEQ ID NO: 533717 - DNA, 20 bp, Artificial Sequence
  chemically synthesized
gttgaaaatccattttgttt

SEQ ID NO: 533718 - DNA, 20 bp, Artificial Sequence
  chemically synthesized
ttgtgtgagaaactacttag

SEQ ID NO: 533719 - DNA, 20 bp, Artificial Sequence
  chemically synthesized
tgatttgtgtgagaaactac

SEQ ID NO: 533720 - DNA, 20 bp, Artificial Sequence
  chemically synthesized
caattctcatttgatttgtg

SEQ ID NO: 533721 - DNA, 20 bp, Artificial Sequence
  chemically synthesized
agtttctcacacaaatcaaa

SEQ ID NO: 533722 - DNA, 20 bp, Artificial Sequence
  chemically synthesized
tattgggtgcttaccgtgtg

SEQ ID NO: 533723 - DNA, 20 bp, Artificial Sequence
  chemically synthesized
ctccataatctgagagcaat

SEQ ID NO: 533724 - DNA, 20 bp, Artificial Sequence
  chemically synthesized
gcgtctatggtcagtaagcc

SEQ ID NO: 533725 - DNA, 20 bp, Artificial Sequence
  chemically synthesized
ctaaacgtcatttaaagtgc

SEQ ID NO: 533726 - DNA, 20 bp, Artificial Sequence
  chemically synthesized
aggtgcattgagaggtaaaa

SEQ ID NO: 533727 - DNA, 20 bp, Artificial Sequence
  chemically synthesized
agagccaggtgaaggagtct

SEQ ID NO: 533728 - DNA, 20 bp, Artificial Sequence
  chemically synthesized
ttttttgacttcaaagccct

SEQ ID NO: 533729 - DNA, 20 bp, Artificial Sequence
  chemically synthesized
gagtggaggtaaggggctag

SEQ ID NO: 533730 - DNA, 20 bp, Artificial Sequence
  chemically synthesized
agtgagaaaggaatggtcat

SEQ ID NO: 533731 - DNA, 20 bp, Artificial Sequence
  chemically synthesized
ggtcataaagaattagggag

SEQ ID NO: 533732 - DNA, 20 bp, Artificial Sequence
  chemically synthesized
gaggcaagtaagtgggagat

SEQ ID NO: 533733 - DNA, 20 bp, Artificial Sequence
  chemically synthesized
tcatttgtgagacatttgag

SEQ ID NO: 533734 - DNA, 20 bp, Artificial Sequence
  chemically synthesized
aagaaatgtcctacatacag

SEQ ID NO: 533735 - DNA, 20 bp, Artificial Sequence
  chemically synthesized
atcattggattaaaggagat

SEQ ID NO: 533736 - DNA, 20 bp, Artificial Sequence
  chemically synthesized
gttatgtgttagttattata

SEQ ID NO: 533737 - DNA, 20 bp, Artificial Sequence
  chemically synthesized
agataatgagattaatgaaa

SEQ ID NO: 533738 - DNA, 20 bp, Artificial Sequence
  chemically synthesized
atgagattaatgaaatcaga

SEQ ID NO: 533739 - DNA, 20 bp, Artificial Sequence
  chemically synthesized
atgaaatcagaaaagaatgc

SEQ ID NO: 533740 - DNA, 20 bp, Artificial Sequence
  chemically synthesized
ctacttgggaggctgaggca

SEQ ID NO: 533741 - DNA, 20 bp, Artificial Sequence
  chemically synthesized
ccagatgctggtgaggttgt

SEQ ID NO: 533742 - DNA, 20 bp, Artificial Sequence
  chemically synthesized
cagctgcatgtgtctttatg

SEQ ID NO: 533743 - DNA, 20 bp, Artificial Sequence
  chemically synthesized
ccatcaatggtagatcagat

SEQ ID NO: 533744 - DNA, 20 bp, Artificial Sequence
  chemically synthesized
caccagggaatactgtgcag

SEQ ID NO: 533745 - DNA, 20 bp, Artificial Sequence
  chemically synthesized
gaatactgtgcagccagaaa

SEQ ID NO: 533746 - DNA, 20 bp, Artificial Sequence
  chemically synthesized
ctaggtgaaataacatagga

SEQ ID NO: 533747 - DNA, 20 bp, Artificial Sequence
  chemically synthesized
tgtttagctccacttataag

SEQ ID NO: 533748 - DNA, 20 bp, Artificial Sequence
  chemically synthesized
tgaacacaaagaagggaaca

SEQ ID NO: 533749 - DNA, 20 bp, Artificial Sequence
  chemically synthesized
ggtgggaggatggtgaagac

SEQ ID NO: 533750 - DNA, 20 bp, Artificial Sequence
  chemically synthesized
aaaagtgaaaaaaaaaaaaa

SEQ ID NO: 533751 - DNA, 20 bp, Artificial Sequence
  chemically synthesized
gtgaaaaaaaaaaaaagaag

SEQ ID NO: 533752 - DNA, 20 bp, Artificial Sequence
  chemically synthesized
tttatcaagtcctcattgcc

SEQ ID NO: 533753 - DNA, 20 bp, Artificial Sequence
  chemically synthesized
gtttcagttgggaggcagat

SEQ ID NO: 533754 - DNA, 20 bp, Artificial Sequence
  chemically synthesized
gaaagatggatgtttaggaa

SEQ ID NO: 533755 - DNA, 20 bp, Artificial Sequence
  chemically synthesized
agcttcaaatcactcatcta

SEQ ID NO: 533756 - DNA, 20 bp, Artificial Sequence
  chemically synthesized
acagtagagttggtagaaga

SEQ ID NO: 533757 - DNA, 20 bp, Artificial Sequence
  chemically synthesized
gggatgctcaacccgaatat

SEQ ID NO: 533758 - DNA, 20 bp, Artificial Sequence
  chemically synthesized
actccaatgagcatttactt

SEQ ID NO: 533759 - DNA, 20 bp, Artificial Sequence
  chemically synthesized
aaaaaatctgaaatccaaaa

SEQ ID NO: 533760 - DNA, 20 bp, Artificial Sequence
  chemically synthesized
tctgaaatccaaaaaaagaa

SEQ ID NO: 533761 - DNA, 20 bp, Artificial Sequence
  chemically synthesized
aatacatgatgactttaatc

SEQ ID NO: 533762 - DNA, 20 bp, Artificial Sequence
  chemically synthesized
ttatttccattttcatttga

SEQ ID NO: 533763 - DNA, 20 bp, Artificial Sequence
  chemically synthesized
ggttttcactaaggatcaaa

SEQ ID NO: 533764 - DNA, 20 bp, Artificial Sequence
  chemically synthesized
tcaaagttatattaattaat

SEQ ID NO: 533765 - DNA, 20 bp, Artificial Sequence
  chemically synthesized
aattttatatctataaacca

SEQ ID NO: 533766 - DNA, 20 bp, Artificial Sequence
  chemically synthesized
ccattacattaaacaattat

SEQ ID NO: 533767 - DNA, 20 bp, Artificial Sequence
  chemically synthesized
gaaagactgaatgcagaaaa

SEQ ID NO: 533768 - DNA, 20 bp, Artificial Sequence
  chemically synthesized
tgcaggaagaaagactgaat

SEQ ID NO: 533769 - DNA, 20 bp, Artificial Sequence
  chemically synthesized
tggtcttttatctcctgcag

SEQ ID NO: 533770 - DNA, 20 bp, Artificial Sequence
  chemically synthesized
taatgaaaataattaaaagt

SEQ ID NO: 533771 - DNA, 20 bp, Artificial Sequence
  chemically synthesized
cctgaattcctgtagatctc

SEQ ID NO: 533772 - DNA, 20 bp, Artificial Sequence
  chemically synthesized
gggtttttatagtatcaata

SEQ ID NO: 533773 - DNA, 20 bp, Artificial Sequence
  chemically synthesized
tgaaaatttccatgtttata

SEQ ID NO: 533774 - DNA, 20 bp, Artificial Sequence
  chemically synthesized
ctactcgggaggcagaggca

SEQ ID NO: 533775 - DNA, 20 bp, Artificial Sequence
  chemically synthesized
aaactaattgtgaaaaaggc

SEQ ID NO: 533776 - DNA, 20 bp, Artificial Sequence
  chemically synthesized
aaaatgttacttactgtagt

SEQ ID NO: 533777 - DNA, 20 bp, Artificial Sequence
  chemically synthesized
tgaatttctccatggtccac

SEQ ID NO: 533778 - DNA, 20 bp, Artificial Sequence
  chemically synthesized
tatatttctgagtggaccat

SEQ ID NO: 533779 - DNA, 20 bp, Artificial Sequence
  chemically synthesized
aggacatcaacatggaagcc

SEQ ID NO: 533780 - DNA, 20 bp, Artificial Sequence
  chemically synthesized
tcttcactcaatcatgagtt

SEQ ID NO: 533781 - DNA, 20 bp, Artificial Sequence
  chemically synthesized
gcagaaaatgtgaggtaaaa

SEQ ID NO: 533782 - DNA, 20 bp, Artificial Sequence
  chemically synthesized
tttgtgggaggtggaggtga

SEQ ID NO: 533783 - DNA, 20 bp, Artificial Sequence
  chemically synthesized
tatttctgtaataagccaag

SEQ ID NO: 533784 - DNA, 20 bp, Artificial Sequence
  chemically synthesized
caattcttgcttggcttatt

SEQ ID NO: 533785 - DNA, 20 bp, Artificial Sequence
  chemically synthesized
gatcattctggtagtggtta

SEQ ID NO: 533786 - DNA, 20 bp, Artificial Sequence
  chemically synthesized
attcattctcctaaccacta

SEQ ID NO: 533787 - DNA, 20 bp, Artificial Sequence
  chemically synthesized
tggctggggtatggttgcta

SEQ ID NO: 533788 - DNA, 20 bp, Artificial Sequence
  chemically synthesized
gcttagtcagtgtggtagtg

SEQ ID NO: 533789 - DNA, 20 bp, Artificial Sequence
  chemically synthesized
gtttagagaaagtcacctta

SEQ ID NO: 533790 - DNA, 20 bp, Artificial Sequence
  chemically synthesized
tccagtgagaacctctgttt

SEQ ID NO: 533791 - DNA, 20 bp, Artificial Sequence
  chemically synthesized
acaaaattataatagcatta

SEQ ID NO: 533792 - DNA, 20 bp, Artificial Sequence
  chemically synthesized
ggaatgtgaacctctcaaag

SEQ ID NO: 533793 - DNA, 20 bp, Artificial Sequence
  chemically synthesized
aatgaaattagtaaaataga

SEQ ID NO: 533794 - DNA, 20 bp, Artificial Sequence
  chemically synthesized
aaatgaatgaaattagtaaa

SEQ ID NO: 533795 - DNA, 20 bp, Artificial Sequence
  chemically synthesized
tatcaatccatatttttaag

SEQ ID NO: 533796 - DNA, 20 bp, Artificial Sequence
  chemically synthesized
taattccatcataagggccc

SEQ ID NO: 533797 - DNA, 20 bp, Artificial Sequence
  chemically synthesized
aatcccagcctccagaactg

SEQ ID NO: 533798 - DNA, 20 bp, Artificial Sequence
  chemically synthesized
agggaaagaaggcttataca

SEQ ID NO: 533799 - DNA, 20 bp, Artificial Sequence
  chemically synthesized
tcccttacccaccccccaaa

SEQ ID NO: 533800 - DNA, 20 bp, Artificial Sequence
  chemically synthesized
ttacccaccccccaaaaaag

SEQ ID NO: 533801 - DNA, 20 bp, Artificial Sequence
  chemically synthesized
cgctgaattaataaaagttc

SEQ ID NO: 533802 - DNA, 20 bp, Artificial Sequence
  chemically synthesized
ctctttagacaacaatcaaa

SEQ ID NO: 533803 - DNA, 20 bp, Artificial Sequence
  chemically synthesized
acactaaaggtttcttctcc

SEQ ID NO: 533804 - DNA, 20 bp, Artificial Sequence
  chemically synthesized
aggatccctaattctaagga

SEQ ID NO: 533805 - DNA, 20 bp, Artificial Sequence
  chemically synthesized
ctctgcattctcagatagtc

SEQ ID NO: 533806 - DNA, 20 bp, Artificial Sequence
  chemically synthesized
atcgtatttcttggactatc

SEQ ID NO: 533807 - DNA, 20 bp, Artificial Sequence
  chemically synthesized
attaattctgaagaaagaag

SEQ ID NO: 533808 - DNA, 20 bp, Artificial Sequence
  chemically synthesized
ttgcattctttcttctttct

SEQ ID NO: 533809 - DNA, 20 bp, Artificial Sequence
  chemically synthesized
acggattaattctgaagaaa

SEQ ID NO: 533810 - DNA, 20 bp, Artificial Sequence
  chemically synthesized
ttggcgcacggattaattct

SEQ ID NO: 533811 - DNA, 20 bp, Artificial Sequence
  chemically synthesized
tccgtgcgccaaaattttgg

SEQ ID NO: 533812 - DNA, 20 bp, Artificial Sequence
  chemically synthesized
ctactcaggaggctgaggca

SEQ ID NO: 533813 - DNA, 20 bp, Artificial Sequence
  chemically synthesized
cacccaattttaataacata

SEQ ID NO: 533814 - DNA, 20 bp, Artificial Sequence
  chemically synthesized
tgctccttagtttgtcttgc

SEQ ID NO: 533815 - DNA, 20 bp, Artificial Sequence
  chemically synthesized
gtgaaactcttgtgaaatat

SEQ ID NO: 533816 - DNA, 20 bp, Artificial Sequence
  chemically synthesized
caactcttcttaggcccaaa

SEQ ID NO: 533817 - DNA, 20 bp, Artificial Sequence
  chemically synthesized
aagcagaaaatgttttggat

SEQ ID NO: 533818 - DNA, 20 bp, Artificial Sequence
  chemically synthesized
taaaaattccagttagcata

SEQ ID NO: 533819 - DNA, 20 bp, Artificial Sequence
  chemically synthesized
atcagaaataacaatattta

SEQ ID NO: 533820 - DNA, 20 bp, Artificial Sequence
  chemically synthesized
taattcttctctgaaagaca

SEQ ID NO: 533821 - DNA, 20 bp, Artificial Sequence
  chemically synthesized
aaattctaatgtctttcaga

SEQ ID NO: 533822 - DNA, 20 bp, Artificial Sequence
  chemically synthesized
attaatcatgttaattccat

SEQ ID NO: 533823 - DNA, 20 bp, Artificial Sequence
  chemically synthesized
tttatattacatgtatgttt

SEQ ID NO: 533824 - DNA, 20 bp, Artificial Sequence
  chemically synthesized
atgaattatgattattgctg

SEQ ID NO: 533825 - DNA, 20 bp, Artificial Sequence
  chemically synthesized
aagagctggagtctccatat

SEQ ID NO: 533826 - DNA, 20 bp, Artificial Sequence
  chemically synthesized
aaaaacggattgacagtctt

SEQ ID NO: 533827 - DNA, 20 bp, Artificial Sequence
  chemically synthesized
ttttctataatatgtaggta

SEQ ID NO: 533828 - DNA, 20 bp, Artificial Sequence
  chemically synthesized
ttttctcctacctacatatt

SEQ ID NO: 533829 - DNA, 20 bp, Artificial Sequence
  chemically synthesized
ttcagctgattgaattgagt

SEQ ID NO: 533830 - DNA, 20 bp, Artificial Sequence
  chemically synthesized
aaccttgggcaagtggattt

SEQ ID NO: 533831 - DNA, 20 bp, Artificial Sequence
  chemically synthesized
tgggagttttatctggattt

SEQ ID NO: 533832 - DNA, 20 bp, Artificial Sequence
  chemically synthesized
taactttcagtgtacccgag

SEQ ID NO: 533833 - DNA, 20 bp, Artificial Sequence
  chemically synthesized
ttagcttatcccatgttact

SEQ ID NO: 533834 - DNA, 20 bp, Artificial Sequence
  chemically synthesized
aaagcagttggaaattatgc

SEQ ID NO: 533835 - DNA, 20 bp, Artificial Sequence
  chemically synthesized
aactgcttttgaaagagaga

SEQ ID NO: 533836 - DNA, 20 bp, Artificial Sequence
  chemically synthesized
aagcttgcagtttcttgaga

SEQ ID NO: 533837 - DNA, 20 bp, Artificial Sequence
  chemically synthesized
tttatctctatttctaatct

SEQ ID NO: 533838 - DNA, 20 bp, Artificial Sequence
  chemically synthesized
atataaatacaaattgtata

SEQ ID NO: 533839 - DNA, 20 bp, Artificial Sequence
  chemically synthesized
agcagattactttgaaaaat

SEQ ID NO: 533840 - DNA, 20 bp, Artificial Sequence
  chemically synthesized
ctacttgggaggctgaggtg

SEQ ID NO: 533841 - DNA, 20 bp, Artificial Sequence
  chemically synthesized
taaatgctgataaagctact

SEQ ID NO: 533842 - DNA, 20 bp, Artificial Sequence
  chemically synthesized
gatatctcccatggcttgtg

SEQ ID NO: 533843 - DNA, 20 bp, Artificial Sequence
  chemically synthesized
aactcaacacgcattttgga

SEQ ID NO: 533844 - DNA, 20 bp, Artificial Sequence
  chemically synthesized
agatcaactatcatatcaaa

SEQ ID NO: 533845 - DNA, 20 bp, Artificial Sequence
  chemically synthesized
atattctagtttgaataatt

SEQ ID NO: 533846 - DNA, 20 bp, Artificial Sequence
  chemically synthesized
tgattctggaattattcaaa

SEQ ID NO: 533847 - DNA, 20 bp, Artificial Sequence
  chemically synthesized
agtaaagttattatatcaag

SEQ ID NO: 533848 - DNA, 20 bp, Artificial Sequence
  chemically synthesized
aggaaaattatatcaggtat

SEQ ID NO: 533849 - DNA, 20 bp, Artificial Sequence
  chemically synthesized
tttaagagcctccttgtact

SEQ ID NO: 533850 - DNA, 20 bp, Artificial Sequence
  chemically synthesized
ttgtttaaatgaagtcttgg

SEQ ID NO: 533851 - DNA, 20 bp, Artificial Sequence
  chemically synthesized
ttttcagacaattgtttttc

SEQ ID NO: 533852 - DNA, 20 bp, Artificial Sequence
  chemically synthesized
cctaacatgatctgtgaaaa

SEQ ID NO: 533853 - DNA, 20 bp, Artificial Sequence
  chemically synthesized
attttcacagatcatgttag

SEQ ID NO: 533854 - DNA, 20 bp, Artificial Sequence
  chemically synthesized
gtcaaggagaaactttgctc

SEQ ID NO: 533855 - DNA, 20 bp, Artificial Sequence
  chemically synthesized
aaaaccagagcttcggtcaa

SEQ ID NO: 533856 - DNA, 20 bp, Artificial Sequence
  chemically synthesized
ttccacttaacaccctcgtc

SEQ ID NO: 533857 - DNA, 20 bp, Artificial Sequence
  chemically synthesized
tcagttacaagtacaaatgc

SEQ ID NO: 533858 - DNA, 20 bp, Artificial Sequence
  chemically synthesized
ttcagcttctgtaagccagg

SEQ ID NO: 533859 - DNA, 20 bp, Artificial Sequence
  chemically synthesized
gtgagcgagaggctgctttg

SEQ ID NO: 533860 - DNA, 20 bp, Artificial Sequence
  chemically synthesized
tcagatgcaattattaaata

SEQ ID NO: 533861 - DNA, 20 bp, Artificial Sequence
  chemically synthesized
acctagtgaactccataaaa

SEQ ID NO: 533862 - DNA, 20 bp, Artificial Sequence
  chemically synthesized
tttgtatgggggaaggcatg

SEQ ID NO: 533863 - DNA, 20 bp, Artificial Sequence
  chemically synthesized
tcctctgtggagaggggttt

SEQ ID NO: 533864 - DNA, 20 bp, Artificial Sequence
  chemically synthesized
gtctttgatgctgctctgag

SEQ ID NO: 533865 - DNA, 20 bp, Artificial Sequence
  chemically synthesized
aacaaggatttgatatgcaa

SEQ ID NO: 533866 - DNA, 20 bp, Artificial Sequence
  chemically synthesized
tgatatgcaaggagaaaagt

SEQ ID NO: 533867 - DNA, 20 bp, Artificial Sequence
  chemically synthesized
aaagtcaagaaaatacaaac

SEQ ID NO: 533868 - DNA, 20 bp, Artificial Sequence
  chemically synthesized
aaggggattggagggcaaag

SEQ ID NO: 533869 - DNA, 20 bp, Artificial Sequence
  chemically synthesized
ggaagaaagacttaacaagt

SEQ ID NO: 533870 - DNA, 20 bp, Artificial Sequence
  chemically synthesized
aagtaaagaaataacatttc

SEQ ID NO: 533871 - DNA, 20 bp, Artificial Sequence
  chemically synthesized
agatattgcagatgagaaac

SEQ ID NO: 533872 - DNA, 20 bp, Artificial Sequence
  chemically synthesized
acagcaatagatattgcaga

SEQ ID NO: 533873 - DNA, 20 bp, Artificial Sequence
  chemically synthesized
tgcaatatctattgctgtga

SEQ ID NO: 533874 - DNA, 20 bp, Artificial Sequence
  chemically synthesized
aatatctatataataatagc

SEQ ID NO: 533875 - DNA, 20 bp, Artificial Sequence
  chemically synthesized
tttttagcttatgtttaatc

SEQ ID NO: 533876 - DNA, 20 bp, Artificial Sequence
  chemically synthesized
tctgcattaactggtggagg

SEQ ID NO: 533877 - DNA, 20 bp, Artificial Sequence
  chemically synthesized
caggcaaactatcaatgcaa

SEQ ID NO: 533878 - DNA, 20 bp, Artificial Sequence
  chemically synthesized
tctccagtgcaaaatttgga

SEQ ID NO: 533879 - DNA, 20 bp, Artificial Sequence
  chemically synthesized
cagaaataagctgtcacatt

SEQ ID NO: 533880 - DNA, 20 bp, Artificial Sequence
  chemically synthesized
ttgtttgaaattggactaca

SEQ ID NO: 533881 - DNA, 20 bp, Artificial Sequence
  chemically synthesized
ctaagtttcactctgccatg

SEQ ID NO: 533882 - DNA, 20 bp, Artificial Sequence
  chemically synthesized
cccatggcagagtgaaactt

SEQ ID NO: 533883 - DNA, 20 bp, Artificial Sequence
  chemically synthesized
ttagctcctctatccttaaa

SEQ ID NO: 533884 - DNA, 20 bp, Artificial Sequence
  chemically synthesized
gccgcttaccctctgcttcc

SEQ ID NO: 533885 - DNA, 20 bp, Artificial Sequence
  chemically synthesized
cagtaactctttcaggacag

SEQ ID NO: 533886 - DNA, 20 bp, Artificial Sequence
  chemically synthesized
tttttaacgtattttccaaa

SEQ ID NO: 533887 - DNA, 20 bp, Artificial Sequence
  chemically synthesized
aaaattcgatggcaataaca

SEQ ID NO: 533888 - DNA, 20 bp, Artificial Sequence
  chemically synthesized
gtacacacacatagattccg

SEQ ID NO: 533889 - DNA, 20 bp, Artificial Sequence
  chemically synthesized
ttaattgtgccaggtctagt

SEQ ID NO: 533890 - DNA, 20 bp, Artificial Sequence
  chemically synthesized
aggtctagtctagaatgagt

SEQ ID NO: 533891 - DNA, 20 bp, Artificial Sequence
  chemically synthesized
tgataagtaaaatgtaaaaa

SEQ ID NO: 533892 - DNA, 20 bp, Artificial Sequence
  chemically synthesized
aatgtaaaaataagaatcat

SEQ ID NO: 533893 - DNA, 20 bp, Artificial Sequence
  chemically synthesized
taaagaaaaaaaagatatgt

SEQ ID NO: 533894 - DNA, 20 bp, Artificial Sequence
  chemically synthesized
gttatcaaactacaggccct

SEQ ID NO: 533895 - DNA, 20 bp, Artificial Sequence
  chemically synthesized
caagtaacaatgaccagata

SEQ ID NO: 533896 - DNA, 20 bp, Artificial Sequence
  chemically synthesized
actgtaataatgctttgcaa

SEQ ID NO: 533897 - DNA, 20 bp, Artificial Sequence
  chemically synthesized
ttatggtgcacaaaaatagc

SEQ ID NO: 533898 - DNA, 20 bp, Artificial Sequence
  chemically synthesized
ggtacacagtgctcttatga

SEQ ID NO: 533899 - DNA, 20 bp, Artificial Sequence
  chemically synthesized
tgctgcccttatttacatac

SEQ ID NO: 533900 - DNA, 20 bp, Artificial Sequence
  chemically synthesized
cagcaacgtctgagaagtta

SEQ ID NO: 533901 - DNA, 20 bp, Artificial Sequence
  chemically synthesized
ttccaatatatgctaaagct

SEQ ID NO: 533902 - DNA, 20 bp, Artificial Sequence
  chemically synthesized
tctgaaggtagaatagccct

SEQ ID NO: 533903 - DNA, 20 bp, Artificial Sequence
  chemically synthesized
aggatctctgaagtctgaag

SEQ ID NO: 533904 - DNA, 20 bp, Artificial Sequence
  chemically synthesized
ccttcatgctaatcactttc

SEQ ID NO: 533905 - DNA, 20 bp, Artificial Sequence
  chemically synthesized
ttctcccagaaagcagattc

SEQ ID NO: 533906 - DNA, 20 bp, Artificial Sequence
  chemically synthesized
attcaggaggtcaagttctc

SEQ ID NO: 533907 - DNA, 20 bp, Artificial Sequence
  chemically synthesized
attttaaaaatatacttgcc

SEQ ID NO: 533908 - DNA, 20 bp, Artificial Sequence
  chemically synthesized
tcaggcacaattactgcatg

SEQ ID NO: 533909 - DNA, 20 bp, Artificial Sequence
  chemically synthesized
gcattatcatcagttacaag

SEQ ID NO: 533910 - DNA, 20 bp, Artificial Sequence
  chemically synthesized
agtgcaaccctatacgtgcc

SEQ ID NO: 533911 - DNA, 20 bp, Artificial Sequence
  chemically synthesized
agacaactgcacatgaaggt

SEQ ID NO: 533912 - DNA, 20 bp, Artificial Sequence
  chemically synthesized
cattgataatcaggtcttaa

SEQ ID NO: 533913 - DNA, 20 bp, Artificial Sequence
  chemically synthesized
tttaagacctgattatcaat

SEQ ID NO: 533914 - DNA, 20 bp, Artificial Sequence
  chemically synthesized
atgcagtcttagagatttat

SEQ ID NO: 533915 - DNA, 20 bp, Artificial Sequence
  chemically synthesized
tttatgtattatgttggcca

SEQ ID NO: 533916 - DNA, 20 bp, Artificial Sequence
  chemically synthesized
tttcatccatatatctaata

SEQ ID NO: 533917 - DNA, 20 bp, Artificial Sequence
  chemically synthesized
gtaagtgtgtaggtataatt

SEQ ID NO: 533918 - DNA, 20 bp, Artificial Sequence
  chemically synthesized
cagaaacatattgagtattt

SEQ ID NO: 533919 - DNA, 20 bp, Artificial Sequence
  chemically synthesized
tcatttcctatgatatttta

SEQ ID NO: 533920 - DNA, 20 bp, Artificial Sequence
  chemically synthesized
atgagtagcggttgatatgg

SEQ ID NO: 533921 - DNA, 20 bp, Artificial Sequence
  chemically synthesized
attgtacttgtgaggggaag

SEQ ID NO: 533922 - DNA, 20 bp, Artificial Sequence
  chemically synthesized
ctatggatatacagcacttt

SEQ ID NO: 533923 - DNA, 20 bp, Artificial Sequence
  chemically synthesized
ctcattagtgcacgttacta

SEQ ID NO: 533924 - DNA, 20 bp, Artificial Sequence
  chemically synthesized
tgtttttgggcaacatctac

SEQ ID NO: 533925 - DNA, 20 bp, Artificial Sequence
  chemically synthesized
ggagaagggtggtggcaatg

SEQ ID NO: 533926 - DNA, 20 bp, Artificial Sequence
  chemically synthesized
gtttcataacagaggagaaa

SEQ ID NO: 533927 - DNA, 20 bp, Artificial Sequence
  chemically synthesized
ccttacagtttcataacaga

SEQ ID NO: 533928 - DNA, 20 bp, Artificial Sequence
  chemically synthesized
ttgcttttcatccacagcat

SEQ ID NO: 533929 - DNA, 20 bp, Artificial Sequence
  chemically synthesized
aaatatcttatgaagtgatg

SEQ ID NO: 533930 - DNA, 20 bp, Artificial Sequence
  chemically synthesized
tacatagaaaaagaaggtag

SEQ ID NO: 533931 - DNA, 20 bp, Artificial Sequence
  chemically synthesized
aaatatccagctgagtatac

SEQ ID NO: 533932 - DNA, 20 bp, Artificial Sequence
  chemically synthesized
tcgagtgtaaagccattggc

SEQ ID NO: 533933 - DNA, 20 bp, Artificial Sequence
  chemically synthesized
tgtggaaataagaatgaggt

SEQ ID NO: 533934 - DNA, 20 bp, Artificial Sequence
  chemically synthesized
tgttggtaggcatgtggaaa

SEQ ID NO: 533935 - DNA, 20 bp, Artificial Sequence
  chemically synthesized
atctgtgcctgatgatggtg

SEQ ID NO: 533936 - DNA, 20 bp, Artificial Sequence
  chemically synthesized
ggctggagagattgattctg

SEQ ID NO: 533937 - DNA, 20 bp, Artificial Sequence
  chemically synthesized
ggaacatcattacaattctc

SEQ ID NO: 533938 - DNA, 20 bp, Artificial Sequence
  chemically synthesized
tatagcccaagtcttgcatt

SEQ ID NO: 533939 - DNA, 20 bp, Artificial Sequence
  chemically synthesized
gagttacaaaaacttctttt

SEQ ID NO: 533940 - DNA, 20 bp, Artificial Sequence
  chemically synthesized
ctgatatattcattgtacta

SEQ ID NO: 533941 - DNA, 20 bp, Artificial Sequence
  chemically synthesized
tatattcattgtactaaaag

SEQ ID NO: 533942 - DNA, 20 bp, Artificial Sequence
  chemically synthesized
cgaccctgcatatggcaata

SEQ ID NO: 533943 - DNA, 20 bp, Artificial Sequence
  chemically synthesized
tttctgcaatagtttgggta

SEQ ID NO: 533944 - DNA, 20 bp, Artificial Sequence
  chemically synthesized
attctcctacccaaactatt

SEQ ID NO: 533945 - DNA, 20 bp, Artificial Sequence
  chemically synthesized
aaagtattgctgattagttc

SEQ ID NO: 533946 - DNA, 20 bp, Artificial Sequence
  chemically synthesized
gcagtagcaacacactggca

SEQ ID NO: 533947 - DNA, 20 bp, Artificial Sequence
  chemically synthesized
acctgcattaggagacagca

SEQ ID NO: 533948 - DNA, 20 bp, Artificial Sequence
  chemically synthesized
aacgggtaatgcaaagtaaa

SEQ ID NO: 533949 - DNA, 20 bp, Artificial Sequence
  chemically synthesized
actgaaaaaaattagttgat

SEQ ID NO: 533950 - DNA, 20 bp, Artificial Sequence
  chemically synthesized
aatctctttaaaaattcaag

SEQ ID NO: 533951 - DNA, 20 bp, Artificial Sequence
  chemically synthesized
tatcaatctctttaaaaatt

SEQ ID NO: 533952 - DNA, 20 bp, Artificial Sequence
  chemically synthesized
taccttttcgtattgtatca

SEQ ID NO: 533953 - DNA, 20 bp, Artificial Sequence
  chemically synthesized
tatacaactgtaagggatct

SEQ ID NO: 533954 - DNA, 20 bp, Artificial Sequence
  chemically synthesized
tcattgagaatttatttaga

SEQ ID NO: 533955 - DNA, 20 bp, Artificial Sequence
  chemically synthesized
attcgcattatacaaatcat

SEQ ID NO: 533956 - DNA, 20 bp, Artificial Sequence
  chemically synthesized
aaacaaatccttttaggaga

SEQ ID NO: 533957 - DNA, 20 bp, Artificial Sequence
  chemically synthesized
atcctcatccacaataactt

SEQ ID NO: 533958 - DNA, 20 bp, Artificial Sequence
  chemically synthesized
tgtgtgtttgccatttgata

SEQ ID NO: 533959 - DNA, 20 bp, Artificial Sequence
  chemically synthesized
cacacaacagattcacttta

SEQ ID NO: 533960 - DNA, 20 bp, Artificial Sequence
  chemically synthesized
aaatatttcgatatcataat

SEQ ID NO: 533961 - DNA, 20 bp, Artificial Sequence
  chemically synthesized
acatgaacagacacttttta

SEQ ID NO: 533962 - DNA, 20 bp, Artificial Sequence
  chemically synthesized
gctcaacatcactgatcatt

SEQ ID NO: 533963 - DNA, 20 bp, Artificial Sequence
  chemically synthesized
gagataccatcacataccag

SEQ ID NO: 533964 - DNA, 20 bp, Artificial Sequence
  chemically synthesized
agtcaaaaataacaggttct

SEQ ID NO: 533965 - DNA, 20 bp, Artificial Sequence
  chemically synthesized
cagctccatccatgatctct

SEQ ID NO: 533966 - DNA, 20 bp, Artificial Sequence
  chemically synthesized
cttagcaaactaatgcagga

SEQ ID NO: 533967 - DNA, 20 bp, Artificial Sequence
  chemically synthesized
ggtgggaggagggagaggat

SEQ ID NO: 533968 - DNA, 20 bp, Artificial Sequence
  chemically synthesized
cctgaacttaaaataaaagt

SEQ ID NO: 533969 - DNA, 20 bp, Artificial Sequence
  chemically synthesized
aacagaaaacaaagggcttt

SEQ ID NO: 533970 - DNA, 20 bp, Artificial Sequence
  chemically synthesized
tcctaattcatataataata

SEQ ID NO: 533971 - DNA, 20 bp, Artificial Sequence
  chemically synthesized
gtgtgtatatatgtgtgaaa

SEQ ID NO: 533972 - DNA, 20 bp, Artificial Sequence
  chemically synthesized
tatatatgtgtgaaaagaga

SEQ ID NO: 533973 - DNA, 20 bp, Artificial Sequence
  chemically synthesized
ggtaagcttgaggatttgat

SEQ ID NO: 533974 - DNA, 20 bp, Artificial Sequence
  chemically synthesized
tataactttgtataatttca

SEQ ID NO: 533975 - DNA, 20 bp, Artificial Sequence
  chemically synthesized
tgaagtattttattttcatg

SEQ ID NO: 533976 - DNA, 20 bp, Artificial Sequence
  chemically synthesized
cttagtttaagtagattcta

SEQ ID NO: 533977 - DNA, 20 bp, Artificial Sequence
  chemically synthesized
caattagaagggcaattctt

SEQ ID NO: 533978 - DNA, 20 bp, Artificial Sequence
  chemically synthesized
ggtaattaaaagtacgaaag

SEQ ID NO: 533979 - DNA, 20 bp, Artificial Sequence
  chemically synthesized
tctgagggtgcatctggttt

SEQ ID NO: 533980 - DNA, 20 bp, Artificial Sequence
  chemically synthesized
attattcaataaattcacat

SEQ ID NO: 533981 - DNA, 20 bp, Artificial Sequence
  chemically synthesized
gaataataatttatatttat

SEQ ID NO: 533982 - DNA, 20 bp, Artificial Sequence
  chemically synthesized
ataaccaagatgtttaaaaa

SEQ ID NO: 533983 - DNA, 20 bp, Artificial Sequence
  chemically synthesized
agcaaaacacaattttgggc

SEQ ID NO: 533984 - DNA, 20 bp, Artificial Sequence
  chemically synthesized
ttaactttcgtggaagagta

SEQ ID NO: 533985 - DNA, 20 bp, Artificial Sequence
  chemically synthesized
cagacactcattttgaaaat

SEQ ID NO: 533986 - DNA, 20 bp, Artificial Sequence
  chemically synthesized
caatactttctaggtgtatt

SEQ ID NO: 533987 - DNA, 20 bp, Artificial Sequence
  chemically synthesized
tgtctatttctttaatacac

SEQ ID NO: 533988 - DNA, 20 bp, Artificial Sequence
  chemically synthesized
tatactcttgtgaataagtt

SEQ ID NO: 533989 - DNA, 20 bp, Artificial Sequence
  chemically synthesized
caacttacgtggaggctata

SEQ ID NO: 533990 - DNA, 20 bp, Artificial Sequence
  chemically synthesized
atatagctatgtgaggggaa

SEQ ID NO: 533991 - DNA, 20 bp, Artificial Sequence
  chemically synthesized
ttataattgcagtgataatc

SEQ ID NO: 533992 - DNA, 20 bp, Artificial Sequence
  chemically synthesized
aaaaatggcaactgtatcac

SEQ ID NO: 533993 - DNA, 20 bp, Artificial Sequence
  chemically synthesized
ccacaaaaaaaagaggcatc

SEQ ID NO: 533994 - DNA, 20 bp, Artificial Sequence
  chemically synthesized
accatcttcattccctctcc

SEQ ID NO: 533995 - DNA, 20 bp, Artificial Sequence
  chemically synthesized
aactaactgccataacgatc

SEQ ID NO: 533996 - DNA, 20 bp, Artificial Sequence
  chemically synthesized
tcaatgcagtataaacaaat

SEQ ID NO: 533997 - DNA, 20 bp, Artificial Sequence
  chemically synthesized
atgccgtaactctattttaa

SEQ ID NO: 533998 - DNA, 20 bp, Artificial Sequence
  chemically synthesized
caaagtatttgttatttaaa

SEQ ID NO: 533999 - DNA, 20 bp, Artificial Sequence
  chemically synthesized
agagccactggggaatctca

SEQ ID NO: 534000 - DNA, 20 bp, Artificial Sequence
  chemically synthesized
gtttattatactgaaaatta

SEQ ID NO: 534001 - DNA, 20 bp, Artificial Sequence
  chemically synthesized
aattaatagaatttttcagg

SEQ ID NO: 534002 - DNA, 20 bp, Artificial Sequence
  chemically synthesized
tctgatccctagagctccat

SEQ ID NO: 534003 - DNA, 20 bp, Artificial Sequence
  chemically synthesized
gtctggtaaacctgttttga

SEQ ID NO: 534004 - DNA, 20 bp, Artificial Sequence
  chemically synthesized
ttgtcaaatgaaagctttca

SEQ ID NO: 534005 - DNA, 20 bp, Artificial Sequence
  chemically synthesized
attttaatgcaccgtttacc

SEQ ID NO: 534006 - DNA, 20 bp, Artificial Sequence
  chemically synthesized
gaagtaatttacagaattac

SEQ ID NO: 534007 - DNA, 20 bp, Artificial Sequence
  chemically synthesized
atataggagagaagtaattt

SEQ ID NO: 534008 - DNA, 20 bp, Artificial Sequence
  chemically synthesized
gtccttggttattccacccc

SEQ ID NO: 534009 - DNA, 20 bp, Artificial Sequence
  chemically synthesized
tgcaaactgccctgatctgc

SEQ ID NO: 534010 - DNA, 20 bp, Artificial Sequence
  chemically synthesized
gatgacagtgcagacatgga

SEQ ID NO: 534011 - DNA, 20 bp, Artificial Sequence
  chemically synthesized
gcagatgggaaaacatgaat

SEQ ID NO: 534012 - DNA, 20 bp, Artificial Sequence
  chemically synthesized
gtcttctatctcagcccact

SEQ ID NO: 534013 - DNA, 20 bp, Artificial Sequence
  chemically synthesized
ctgacagtgtgcaagagctc

SEQ ID NO: 534014 - DNA, 20 bp, Artificial Sequence
  chemically synthesized
aagcaaatgctaacagtaat

SEQ ID NO: 534015 - DNA, 20 bp, Artificial Sequence
  chemically synthesized
tgaggcagaggtagagataa

SEQ ID NO: 534016 - DNA, 20 bp, Artificial Sequence
  chemically synthesized
gccactcgggaggctgagac

SEQ ID NO: 534017 - DNA, 20 bp, Artificial Sequence
  chemically synthesized
acaggcgcactggggaaatg

SEQ ID NO: 534018 - DNA, 20 bp, Artificial Sequence
  chemically synthesized
aatgacagaaataacaactc

SEQ ID NO: 534019 - DNA, 20 bp, Artificial Sequence
  chemically synthesized
aactaatggatatccctcaa

SEQ ID NO: 534020 - DNA, 20 bp, Artificial Sequence
  chemically synthesized
aaatgtatgtaactgtacta

SEQ ID NO: 534021 - DNA, 20 bp, Artificial Sequence
  chemically synthesized
cagttacatacatttgggaa

SEQ ID NO: 534022 - DNA, 20 bp, Artificial Sequence
  chemically synthesized
caaaatgattaaaacttgga

SEQ ID NO: 534023 - DNA, 20 bp, Artificial Sequence
  chemically synthesized
ctttgtggatgtgcataatt

SEQ ID NO: 534024 - DNA, 20 bp, Artificial Sequence
  chemically synthesized
gattgttgaccaatcttaaa

SEQ ID NO: 534025 - DNA, 20 bp, Artificial Sequence
  chemically synthesized
tctatagattctgttctcct

SEQ ID NO: 534026 - DNA, 20 bp, Artificial Sequence
  chemically synthesized
attttgttttctaaaggaga

SEQ ID NO: 534027 - DNA, 20 bp, Artificial Sequence
  chemically synthesized
caaaattcacgtcttctgtt

SEQ ID NO: 534028 - DNA, 20 bp, Artificial Sequence
  chemically synthesized
tctttgacagttcttaatgt

SEQ ID NO: 534029 - DNA, 20 bp, Artificial Sequence
  chemically synthesized
actcttttctcaataatatt

SEQ ID NO: 534030 - DNA, 20 bp, Artificial Sequence
  chemically synthesized
tcaacattctttaatattat

SEQ ID NO: 534031 - DNA, 20 bp, Artificial Sequence
  chemically synthesized
gtaaagtttgtaaaaaataa

SEQ ID NO: 534032 - DNA, 20 bp, Artificial Sequence
  chemically synthesized
aaaaacactttaaggtaatg

SEQ ID NO: 534033 - DNA, 20 bp, Artificial Sequence
  chemically synthesized
ttccttatgatttggctaag

SEQ ID NO: 534034 - DNA, 20 bp, Artificial Sequence
  chemically synthesized
caaatcataaggaaactgaa

SEQ ID NO: 534035 - DNA, 20 bp, Artificial Sequence
  chemically synthesized
tttggaaaatcatgacagca

SEQ ID NO: 534036 - DNA, 20 bp, Artificial Sequence
  chemically synthesized
cattttttttttagtgagtc

SEQ ID NO: 534037 - DNA, 20 bp, Artificial Sequence
  chemically synthesized
tctatcagttttgtgagccc

SEQ ID NO: 534038 - DNA, 20 bp, Artificial Sequence
  chemically synthesized
gttgtcaataagaaggtgaa

SEQ ID NO: 534039 - DNA, 20 bp, Artificial Sequence
  chemically synthesized
atcaactactaatatatcta

SEQ ID NO: 534040 - DNA, 20 bp, Artificial Sequence
  chemically synthesized
aaatatgtgctcaaatgata

SEQ ID NO: 534041 - DNA, 20 bp, Artificial Sequence
  chemically synthesized
atatggaaaagtagttctat

SEQ ID NO: 534042 - DNA, 20 bp, Artificial Sequence
  chemically synthesized
tcaatgcagtgaaagcaaat

SEQ ID NO: 534043 - DNA, 20 bp, Artificial Sequence
  chemically synthesized
ataatttaatgggagaatct

SEQ ID NO: 534044 - DNA, 20 bp, Artificial Sequence
  chemically synthesized
aatactgttataatttaatg

SEQ ID NO: 534045 - DNA, 20 bp, Artificial Sequence
  chemically synthesized
ccattaaattataacagtat

SEQ ID NO: 534046 - DNA, 20 bp, Artificial Sequence
  chemically synthesized
gcttcttccaccatatattg

SEQ ID NO: 534047 - DNA, 20 bp, Artificial Sequence
  chemically synthesized
agaagcaaaagctgatatta

SEQ ID NO: 534048 - DNA, 20 bp, Artificial Sequence
  chemically synthesized
atagaatattatgccttttc

SEQ ID NO: 534049 - DNA, 20 bp, Artificial Sequence
  chemically synthesized
atgaaagtataatgtttttc

SEQ ID NO: 534050 - DNA, 20 bp, Artificial Sequence
  chemically synthesized
cagaaaaacattatactttc

SEQ ID NO: 534051 - DNA, 20 bp, Artificial Sequence
  chemically synthesized
ggactcatatatatgtatat

SEQ ID NO: 534052 - DNA, 20 bp, Artificial Sequence
  chemically synthesized
atttttactgaagcacttaa

SEQ ID NO: 534053 - DNA, 20 bp, Artificial Sequence
  chemically synthesized
tctaactttgaaagtacaag

SEQ ID NO: 534054 - DNA, 20 bp, Artificial Sequence
  chemically synthesized
tctgacttgtactttcaaag

SEQ ID NO: 534055 - DNA, 20 bp, Artificial Sequence
  chemically synthesized
gaatacaaaaaagaagatgg

SEQ ID NO: 534056 - DNA, 20 bp, Artificial Sequence
  chemically synthesized
agagaaacttgcctttccag

SEQ ID NO: 534057 - DNA, 20 bp, Artificial Sequence
  chemically synthesized
atgttaatacgctaataaaa

SEQ ID NO: 534058 - DNA, 20 bp, Artificial Sequence
  chemically synthesized
aagtaacacatcactgtatg

SEQ ID NO: 534059 - DNA, 20 bp, Artificial Sequence
  chemically synthesized
tgttaggttctgtaactttt

SEQ ID NO: 534060 - DNA, 20 bp, Artificial Sequence
  chemically synthesized
atgtaaaaacacacacacac

SEQ ID NO: 534061 - DNA, 20 bp, Artificial Sequence
  chemically synthesized
aaggagactgatagcaaata

SEQ ID NO: 534062 - DNA, 20 bp, Artificial Sequence
  chemically synthesized
caaatacaagaatttctgtg

SEQ ID NO: 534063 - DNA, 20 bp, Artificial Sequence
  chemically synthesized
cagtttgtgttaattctgac

SEQ ID NO: 534064 - DNA, 20 bp, Artificial Sequence
  chemically synthesized
aatatcaaaatatttatgac

SEQ ID NO: 534065 - DNA, 20 bp, Artificial Sequence
  chemically synthesized
tcataggttaactcagacct

SEQ ID NO: 534066 - DNA, 20 bp, Artificial Sequence
  chemically synthesized
ctatagaatgtcacgttcat

SEQ ID NO: 534067 - DNA, 20 bp, Artificial Sequence
  chemically synthesized
atcaattaagggcttgaagt

SEQ ID NO: 534068 - DNA, 20 bp, Artificial Sequence
  chemically synthesized
taatagtgcagttgcaagaa

SEQ ID NO: 534069 - DNA, 20 bp, Artificial Sequence
  chemically synthesized
tatgagttacttccattcta

SEQ ID NO: 534070 - DNA, 20 bp, Artificial Sequence
  chemically synthesized
ctgtcttcatcaacattcta

SEQ ID NO: 534071 - DNA, 20 bp, Artificial Sequence
  chemically synthesized
aatggcatttgtttcaggga

SEQ ID NO: 534072 - DNA, 20 bp, Artificial Sequence
  chemically synthesized
gaggatggaggagaaatttt

SEQ ID NO: 534073 - DNA, 20 bp, Artificial Sequence
  chemically synthesized
cttcccacaaggaggatgga

SEQ ID NO: 534074 - DNA, 20 bp, Artificial Sequence
  chemically synthesized
tgattcaaataggctctgcc

SEQ ID NO: 534075 - DNA, 20 bp, Artificial Sequence
  chemically synthesized
tagctaattaatcaatattc

SEQ ID NO: 534076 - DNA, 20 bp, Artificial Sequence
  chemically synthesized
aaaaagtccttaaacttcta

SEQ ID NO: 534077 - DNA, 20 bp, Artificial Sequence
  chemically synthesized
acttctaccagaatatgagg

SEQ ID NO: 534078 - DNA, 20 bp, Artificial Sequence
  chemically synthesized
ataacagccttggaggagtc

SEQ ID NO: 534079 - DNA, 20 bp, Artificial Sequence
  chemically synthesized
gtataggcttatgcctacgt

SEQ ID NO: 534080 - DNA, 20 bp, Artificial Sequence
  chemically synthesized
agaattgagctaatggcact

SEQ ID NO: 534081 - DNA, 20 bp, Artificial Sequence
  chemically synthesized
gtagtgttgtataagattct

SEQ ID NO: 534082 - DNA, 20 bp, Artificial Sequence
  chemically synthesized
tgaccatgaaaacaatttct

SEQ ID NO: 534083 - DNA, 20 bp, Artificial Sequence
  chemically synthesized
tatcttaataagtaataact

SEQ ID NO: 534084 - DNA, 20 bp, Artificial Sequence
  chemically synthesized
tgccaaaaccccatttggaa

SEQ ID NO: 534085 - DNA, 20 bp, Artificial Sequence
  chemically synthesized
gttctcaaattttaatatgc

SEQ ID NO: 534086 - DNA, 20 bp, Artificial Sequence
  chemically synthesized
tcctaccccatccaactaaa

SEQ ID NO: 534087 - DNA, 20 bp, Artificial Sequence
  chemically synthesized
tggtatcacctatgagctca

SEQ ID NO: 534088 - DNA, 20 bp, Artificial Sequence
  chemically synthesized
aggtgctacatgtgggttca

SEQ ID NO: 534089 - DNA, 20 bp, Artificial Sequence
  chemically synthesized
aaatcaatgccacaaagcag

SEQ ID NO: 534090 - DNA, 20 bp, Artificial Sequence
  chemically synthesized
gctttgtggcattgatttga

SEQ ID NO: 534091 - DNA, 20 bp, Artificial Sequence
  chemically synthesized
tacttaagtttcctattaaa

SEQ ID NO: 534092 - DNA, 20 bp, Artificial Sequence
  chemically synthesized
tttaaaatactggcaatata

SEQ ID NO: 534093 - DNA, 20 bp, Artificial Sequence
  chemically synthesized
tccgtctgtcatcagtattc

SEQ ID NO: 534094 - DNA, 20 bp, Artificial Sequence
  chemically synthesized
acagcataaaacattggctg

SEQ ID NO: 534095 - DNA, 20 bp, Artificial Sequence
  chemically synthesized
aagaatgtcactatgtactt

SEQ ID NO: 534096 - DNA, 20 bp, Artificial Sequence
  chemically synthesized
aatatgatagaaggaattgc

SEQ ID NO: 534097 - DNA, 20 bp, Artificial Sequence
  chemically synthesized
gaaggaattgctaagaatgt

SEQ ID NO: 534098 - DNA, 20 bp, Artificial Sequence
  chemically synthesized
actatcaaaaatttacaaat

SEQ ID NO: 534099 - DNA, 20 bp, Artificial Sequence
  chemically synthesized
atttttgatagtttctacaa

SEQ ID NO: 534100 - DNA, 20 bp, Artificial Sequence
  chemically synthesized
tagtacaagtgattcttatt

SEQ ID NO: 534101 - DNA, 20 bp, Artificial Sequence
  chemically synthesized
agaagttatttcaaaatata

SEQ ID NO: 534102 - DNA, 20 bp, Artificial Sequence
  chemically synthesized
tatagaagaaacatccaaac

SEQ ID NO: 534103 - DNA, 20 bp, Artificial Sequence
  chemically synthesized
atggtagataaaataccaaa

SEQ ID NO: 534104 - DNA, 20 bp, Artificial Sequence
  chemically synthesized
caaaaaggcacaatctgggc

SEQ ID NO: 534105 - DNA, 20 bp, Artificial Sequence
  chemically synthesized
aagttaagtagctctgtgtt

SEQ ID NO: 534106 - DNA, 20 bp, Artificial Sequence
  chemically synthesized
agttcagattctgctgggct

SEQ ID NO: 534107 - DNA, 20 bp, Artificial Sequence
  chemically synthesized
tttatagattcttgagccca

SEQ ID NO: 534108 - DNA, 20 bp, Artificial Sequence
  chemically synthesized
atgtccaaacatttttaata

SEQ ID NO: 534109 - DNA, 20 bp, Artificial Sequence
  chemically synthesized
atcatttgaattaatgattt

SEQ ID NO: 534110 - DNA, 20 bp, Artificial Sequence
  chemically synthesized
atcccaaaactataagattt

SEQ ID NO: 534111 - DNA, 20 bp, Artificial Sequence
  chemically synthesized
tataagatttctagaattgt

SEQ ID NO: 534112 - DNA, 20 bp, Artificial Sequence
  chemically synthesized
taatttttttctgcacaatt

SEQ ID NO: 534113 - DNA, 20 bp, Artificial Sequence
  chemically synthesized
gaatttaggtagatttattt

SEQ ID NO: 534114 - DNA, 20 bp, Artificial Sequence
  chemically synthesized
ctttaaaacattcaataaaa

SEQ ID NO: 534115 - DNA, 20 bp, Artificial Sequence
  chemically synthesized
atgttttaaagaagtctttc

SEQ ID NO: 534116 - DNA, 20 bp, Artificial Sequence
  chemically synthesized
tatttctatctgtatcattc

SEQ ID NO: 534117 - DNA, 20 bp, Artificial Sequence
  chemically synthesized
tctttctgagaatgatacag

SEQ ID NO: 534118 - DNA, 20 bp, Artificial Sequence
  chemically synthesized
aatggttcaattaaaccaaa

SEQ ID NO: 534119 - DNA, 20 bp, Artificial Sequence
  chemically synthesized
atcaaatattaaagcaaatg

SEQ ID NO: 534120 - DNA, 20 bp, Artificial Sequence
  chemically synthesized
caacgcaccaaaatatatgc

SEQ ID NO: 534121 - DNA, 20 bp, Artificial Sequence
  chemically synthesized
ttcaggactgtaggactggg

SEQ ID NO: 534122 - DNA, 20 bp, Artificial Sequence
  chemically synthesized
ttgtgtgcaatccctgcaag

SEQ ID NO: 534123 - DNA, 20 bp, Artificial Sequence
  chemically synthesized
tgtcatctcctttcaagtaa

SEQ ID NO: 534124 - DNA, 20 bp, Artificial Sequence
  chemically synthesized
agatgttatattaccctact

SEQ ID NO: 534125 - DNA, 20 bp, Artificial Sequence
  chemically synthesized
attaccctactgtagaatgc

SEQ ID NO: 534126 - DNA, 20 bp, Artificial Sequence
  chemically synthesized
ttgaactgaactcctaggtt

SEQ ID NO: 534127 - DNA, 20 bp, Artificial Sequence
  chemically synthesized
tttttttttttttatgtttt

SEQ ID NO: 534128 - DNA, 20 bp, Artificial Sequence
  chemically synthesized
aagctatgtacaaaaatatg

SEQ ID NO: 534129 - DNA, 20 bp, Artificial Sequence
  chemically synthesized
aaaacagtccttaagtagtt

SEQ ID NO: 534130 - DNA, 20 bp, Artificial Sequence
  chemically synthesized
aaagtaaaacattttcctgg

SEQ ID NO: 534131 - DNA, 20 bp, Artificial Sequence
  chemically synthesized
tttttcatttgtttttactt

SEQ ID NO: 534132 - DNA, 20 bp, Artificial Sequence
  chemically synthesized
tttttactttcagaaaaatt

SEQ ID NO: 534133 - DNA, 20 bp, Artificial Sequence
  chemically synthesized
gcgtaaagacttgataactg

SEQ ID NO: 534134 - DNA, 20 bp, Artificial Sequence
  chemically synthesized
gacttgataactggcagaat

SEQ ID NO: 534135 - DNA, 20 bp, Artificial Sequence
  chemically synthesized
gaaaagttggttacaatctc

SEQ ID NO: 534136 - DNA, 20 bp, Artificial Sequence
  chemically synthesized
attctacttcaaaaattgct

SEQ ID NO: 534137 - DNA, 20 bp, Artificial Sequence
  chemically synthesized
tttctagagcaatttttgaa

SEQ ID NO: 534138 - DNA, 20 bp, Artificial Sequence
  chemically synthesized
caatttttgaagtagaattc

SEQ ID NO: 534139 - DNA, 20 bp, Artificial Sequence
  chemically synthesized
agattgggaaagagagatca

SEQ ID NO: 534140 - DNA, 20 bp, Artificial Sequence
  chemically synthesized
tgtctctaaaactggaaacc

SEQ ID NO: 534141 - DNA, 20 bp, Artificial Sequence
  chemically synthesized
aattacactacactgaaaac

SEQ ID NO: 534142 - DNA, 20 bp, Artificial Sequence
  chemically synthesized
aatgcattatcttgccccta

SEQ ID NO: 534143 - DNA, 20 bp, Artificial Sequence
  chemically synthesized
caggctgcaaaatgtgtcaa

SEQ ID NO: 534144 - DNA, 20 bp, Artificial Sequence
  chemically synthesized
gtggtaatgtaggttaggtg

SEQ ID NO: 534145 - DNA, 20 bp, Artificial Sequence
  chemically synthesized
aagctactcaaaatgtgcag

SEQ ID NO: 534146 - DNA, 20 bp, Artificial Sequence
  chemically synthesized
agagaaagaagagagacaat

SEQ ID NO: 534147 - DNA, 20 bp, Artificial Sequence
  chemically synthesized
gagaaagagtcaagaagact

SEQ ID NO: 534148 - DNA, 20 bp, Artificial Sequence
  chemically synthesized
atggaataaatttaggtgtg

SEQ ID NO: 534149 - DNA, 20 bp, Artificial Sequence
  chemically synthesized
tgctctgtacccaaaatata

SEQ ID NO: 534150 - DNA, 20 bp, Artificial Sequence
  chemically synthesized
agagatgactgtggctggga

SEQ ID NO: 534151 - DNA, 20 bp, Artificial Sequence
  chemically synthesized
ttaaaagggagatcagttag

SEQ ID NO: 534152 - DNA, 20 bp, Artificial Sequence
  chemically synthesized
ttaaggttccttcaacatgc

SEQ ID NO: 534153 - DNA, 20 bp, Artificial Sequence
  chemically synthesized
ggcccacatcctcaggtctt

SEQ ID NO: 534154 - DNA, 20 bp, Artificial Sequence
  chemically synthesized
tgtcttccaacttctgcttc

SEQ ID NO: 534155 - DNA, 20 bp, Artificial Sequence
  chemically synthesized
ctcacaattattatatgatt

SEQ ID NO: 534156 - DNA, 20 bp, Artificial Sequence
  chemically synthesized
gcagaagcaagtacagctgg

SEQ ID NO: 534157 - DNA, 20 bp, Artificial Sequence
  chemically synthesized
ctgctaaaggggaggagcaa

SEQ ID NO: 534158 - DNA, 20 bp, Artificial Sequence
  chemically synthesized
aggggaggagcaaaaagaaa

SEQ ID NO: 534159 - DNA, 20 bp, Artificial Sequence
  chemically synthesized
aatatcccaaaaaaaggaaa

SEQ ID NO: 534160 - DNA, 20 bp, Artificial Sequence
  chemically synthesized
aattactaaaacaacatgtt

SEQ ID NO: 534161 - DNA, 20 bp, Artificial Sequence
  chemically synthesized
atcttcattgcaacaagaaa

SEQ ID NO: 534162 - DNA, 20 bp, Artificial Sequence
  chemically synthesized
ctttctcatcttcattgcaa

SEQ ID NO: 534163 - DNA, 20 bp, Artificial Sequence
  chemically synthesized
ttttcttgttgcaatgaaga

SEQ ID NO: 534164 - DNA, 20 bp, Artificial Sequence
  chemically synthesized
ccttcaaggttgtcaaagac

SEQ ID NO: 534165 - DNA, 20 bp, Artificial Sequence
  chemically synthesized
aaaacagtattataaagaac

SEQ ID NO: 534166 - DNA, 20 bp, Artificial Sequence
  chemically synthesized
gagaatactgagatgttatg

SEQ ID NO: 534167 - DNA, 20 bp, Artificial Sequence
  chemically synthesized
taaaaaatccctctaggttc

SEQ ID NO: 534168 - DNA, 20 bp, Artificial Sequence
  chemically synthesized
ttccaggatcactctttaaa

SEQ ID NO: 534169 - DNA, 20 bp, Artificial Sequence
  chemically synthesized
gtttaaagagtgatcctgga

SEQ ID NO: 534170 - DNA, 20 bp, Artificial Sequence
  chemically synthesized
tattcacagagattgaagac

SEQ ID NO: 534171 - DNA, 20 bp, Artificial Sequence
  chemically synthesized
gtccatgataacatataaag

SEQ ID NO: 534172 - DNA, 20 bp, Artificial Sequence
  chemically synthesized
tctcaactaaattgtacagt

SEQ ID NO: 534173 - DNA, 20 bp, Artificial Sequence
  chemically synthesized
atttttacttgccattttat

SEQ ID NO: 534174 - DNA, 20 bp, Artificial Sequence
  chemically synthesized
tgatcatatcaaaagccact

SEQ ID NO: 534175 - DNA, 20 bp, Artificial Sequence
  chemically synthesized
taagatataaaatgtacttg

SEQ ID NO: 534176 - DNA, 20 bp, Artificial Sequence
  chemically synthesized
gcaaaatttttgtacacttg

SEQ ID NO: 534177 - DNA, 20 bp, Artificial Sequence
  chemically synthesized
actgagactttcagtcacat

SEQ ID NO: 534178 - DNA, 20 bp, Artificial Sequence
  chemically synthesized
atggtgtctaacctgaactg

SEQ ID NO: 534179 - DNA, 20 bp, Artificial Sequence
  chemically synthesized
aactgtgagaaatgatgtaa

SEQ ID NO: 534180 - DNA, 20 bp, Artificial Sequence
  chemically synthesized
atgtaatcagaaaactttcc

SEQ ID NO: 534181 - DNA, 20 bp, Artificial Sequence
  chemically synthesized
aatgtcaatatttgggttat

SEQ ID NO: 534182 - DNA, 20 bp, Artificial Sequence
  chemically synthesized
aatactacgtagccataaaa

SEQ ID NO: 534183 - DNA, 20 bp, Artificial Sequence
  chemically synthesized
aaaataaaaataaaaataaa

SEQ ID NO: 534184 - DNA, 20 bp, Artificial Sequence
  chemically synthesized
ataaaaaagaaaatgtataa

SEQ ID NO: 534185 - DNA, 20 bp, Artificial Sequence
  chemically synthesized
gtataaatagaaaaaatcag

SEQ ID NO: 534186 - DNA, 20 bp, Artificial Sequence
  chemically synthesized
cttggtgaggaccttgaaca

SEQ ID NO: 534187 - DNA, 20 bp, Artificial Sequence
  chemically synthesized
gcatcaggtaaccaccaatc

SEQ ID NO: 534188 - DNA, 20 bp, Artificial Sequence
  chemically synthesized
tattttgtctttgagaagaa

SEQ ID NO: 534189 - DNA, 20 bp, Artificial Sequence
  chemically synthesized
agaattttggggaaaagggg

SEQ ID NO: 534190 - DNA, 20 bp, Artificial Sequence
  chemically synthesized
ggaaggtggaagaccaaaag

SEQ ID NO: 534191 - DNA, 20 bp, Artificial Sequence
  chemically synthesized
aacagaagtaggttgcattt

SEQ ID NO: 534192 - DNA, 20 bp, Artificial Sequence
  chemically synthesized
cctgtgggacattaacatcg

SEQ ID NO: 534193 - DNA, 20 bp, Artificial Sequence
  chemically synthesized
tacccatctataattccagc

SEQ ID NO: 534194 - DNA, 20 bp, Artificial Sequence
  chemically synthesized
cacttcacatgtactctttg

SEQ ID NO: 534195 - DNA, 20 bp, Artificial Sequence
  chemically synthesized
tgcaaagagtacatgtgaag

SEQ ID NO: 534196 - DNA, 20 bp, Artificial Sequence
  chemically synthesized
aactcacatttttagcctgt

SEQ ID NO: 534197 - DNA, 20 bp, Artificial Sequence
  chemically synthesized
tcccctatgggtaaagtaaa

SEQ ID NO: 534198 - DNA, 20 bp, Artificial Sequence
  chemically synthesized
aaactggaagtcattcccat

SEQ ID NO: 534199 - DNA, 20 bp, Artificial Sequence
  chemically synthesized
gcttgggccatcaaggagca

SEQ ID NO: 534200 - DNA, 20 bp, Artificial Sequence
  chemically synthesized
agaatgaagagaggggtctg

SEQ ID NO: 534201 - DNA, 20 bp, Artificial Sequence
  chemically synthesized
ggtaatataaactaaggggc

SEQ ID NO: 534202 - DNA, 20 bp, Artificial Sequence
  chemically synthesized
cagggacagattaggttcag

SEQ ID NO: 534203 - DNA, 20 bp, Artificial Sequence
  chemically synthesized
atataagatctgtattttga

SEQ ID NO: 534204 - DNA, 20 bp, Artificial Sequence
  chemically synthesized
gaaagtccaagccttgccat

SEQ ID NO: 534205 - DNA, 20 bp, Artificial Sequence
  chemically synthesized
ttgagaaaaagtagttacta

SEQ ID NO: 534206 - DNA, 20 bp, Artificial Sequence
  chemically synthesized
cctatgaaaaagaccctggt

SEQ ID NO: 534207 - DNA, 20 bp, Artificial Sequence
  chemically synthesized
actaagagtaggaagtctta

SEQ ID NO: 534208 - DNA, 20 bp, Artificial Sequence
  chemically synthesized
tttgaatgatgactcccttt

SEQ ID NO: 534209 - DNA, 20 bp, Artificial Sequence
  chemically synthesized
ggacctggggatgtatcaaa

SEQ ID NO: 534210 - DNA, 20 bp, Artificial Sequence
  chemically synthesized
gcagtgtgcgccatgatgag

SEQ ID NO: 534211 - DNA, 20 bp, Artificial Sequence
  chemically synthesized
tattacagccaacagtagtt

SEQ ID NO: 534212 - DNA, 20 bp, Artificial Sequence
  chemically synthesized
agaaaagtccacatgataac

SEQ ID NO: 534213 - DNA, 20 bp, Artificial Sequence
  chemically synthesized
ggattattctgcagatgata

SEQ ID NO: 534214 - DNA, 20 bp, Artificial Sequence
  chemically synthesized
ggacttttctggtatcatct

SEQ ID NO: 534215 - DNA, 20 bp, Artificial Sequence
  chemically synthesized
ccaactgctatagattttta

SEQ ID NO: 534216 - DNA, 20 bp, Artificial Sequence
  chemically synthesized
gctatagatttttatgagaa

SEQ ID NO: 534217 - DNA, 20 bp, Artificial Sequence
  chemically synthesized
acagcttctgaatcctcagg

SEQ ID NO: 534218 - DNA, 20 bp, Artificial Sequence
  chemically synthesized
gcttaattgtttttatcaca

SEQ ID NO: 534219 - DNA, 20 bp, Artificial Sequence
  chemically synthesized
caacaagttaatgaagaggg

SEQ ID NO: 534220 - DNA, 20 bp, Artificial Sequence
  chemically synthesized
gcgttcaactaaacctgcat

SEQ ID NO: 534221 - DNA, 20 bp, Artificial Sequence
  chemically synthesized
acagaaaatattgaacaaca

SEQ ID NO: 534222 - DNA, 20 bp, Artificial Sequence
  chemically synthesized
atccttcaaaaaattcgtga

SEQ ID NO: 534223 - DNA, 20 bp, Artificial Sequence
  chemically synthesized
tttgaaggatcaaaatactt

SEQ ID NO: 534224 - DNA, 20 bp, Artificial Sequence
  chemically synthesized
tagaataccttactttaaaa

SEQ ID NO: 534225 - DNA, 20 bp, Artificial Sequence
  chemically synthesized
ttagaaaaaaagtcaaaata

SEQ ID NO: 534226 - DNA, 20 bp, Artificial Sequence
  chemically synthesized
aattgccaaagacaaacaac

SEQ ID NO: 534227 - DNA, 20 bp, Artificial Sequence
  chemically synthesized
catcacttgaaacatatttc

SEQ ID NO: 534228 - DNA, 20 bp, Artificial Sequence
  chemically synthesized
tgcacttgcagaaatgttta

SEQ ID NO: 534229 - DNA, 20 bp, Artificial Sequence
  chemically synthesized
gaagcctcctctctgcactt

SEQ ID NO: 534230 - DNA, 20 bp, Artificial Sequence
  chemically synthesized
aggaacaggtagttcaaaca

SEQ ID NO: 534231 - DNA, 20 bp, Artificial Sequence
  chemically synthesized
agtgggatgattttatttaa

SEQ ID NO: 534232 - DNA, 20 bp, Artificial Sequence
  chemically synthesized
taaccaaagcagtaaaaaaa

SEQ ID NO: 534233 - DNA, 20 bp, Artificial Sequence
  chemically synthesized
gctactcgggaggctgaggc

SEQ ID NO: 534234 - DNA, 20 bp, Artificial Sequence
  chemically synthesized
aaaaaaaaaaaaaaaaaaaa

SEQ ID NO: 534235 - DNA, 20 bp, Artificial Sequence
  chemically synthesized
attgtgttctgttttttaca

SEQ ID NO: 534236 - DNA, 20 bp, Artificial Sequence
  chemically synthesized
aactacactgtgtttatctc

SEQ ID NO: 534237 - DNA, 20 bp, Artificial Sequence
  chemically synthesized
catgagctgaacacgaaatg

SEQ ID NO: 534238 - DNA, 20 bp, Artificial Sequence
  chemically synthesized
attgaaaataatgcttctga

SEQ ID NO: 534239 - DNA, 20 bp, Artificial Sequence
  chemically synthesized
tttgcgttagtatgatattt

SEQ ID NO: 534240 - DNA, 20 bp, Artificial Sequence
  chemically synthesized
tctaggatgttttagttaac

SEQ ID NO: 534241 - DNA, 20 bp, Artificial Sequence
  chemically synthesized
tctcagttaactaaaacatc

SEQ ID NO: 534242 - DNA, 20 bp, Artificial Sequence
  chemically synthesized
tgcttgataaaaggagtatg

SEQ ID NO: 534243 - DNA, 20 bp, Artificial Sequence
  chemically synthesized
gaggatctgaaaagtggaga

SEQ ID NO: 534244 - DNA, 20 bp, Artificial Sequence
  chemically synthesized
agtgcgaggatctgaaaagt

SEQ ID NO: 534245 - DNA, 20 bp, Artificial Sequence
  chemically synthesized
ctgccaaaggcttgcctttt

SEQ ID NO: 534246 - DNA, 20 bp, Artificial Sequence
  chemically synthesized
ttttgtaccctaggatattt

SEQ ID NO: 534247 - DNA, 20 bp, Artificial Sequence
  chemically synthesized
ttggcttaagtgaggaggag

SEQ ID NO: 534248 - DNA, 20 bp, Artificial Sequence
  chemically synthesized
aggtttggcttaagtgagga

SEQ ID NO: 534249 - DNA, 20 bp, Artificial Sequence
  chemically synthesized
aagccaaacctaaagtgata

SEQ ID NO: 534250 - DNA, 20 bp, Artificial Sequence
  chemically synthesized
attataaattataacatatc

SEQ ID NO: 534251 - DNA, 20 bp, Artificial Sequence
  chemically synthesized
agaattttccaaaatctctg

SEQ ID NO: 534252 - DNA, 20 bp, Artificial Sequence
  chemically synthesized
tgtactttaatgcttgaaag

SEQ ID NO: 534253 - DNA, 20 bp, Artificial Sequence
  chemically synthesized
ttcgctgtgaatacaatttt

SEQ ID NO: 534254 - DNA, 20 bp, Artificial Sequence
  chemically synthesized
tggggaatgtctttaagaag

SEQ ID NO: 534255 - DNA, 20 bp, Artificial Sequence
  chemically synthesized
ttcttaaagacattccccac

SEQ ID NO: 534256 - DNA, 20 bp, Artificial Sequence
  chemically synthesized
gcgggcagaatattaccgta

SEQ ID NO: 534257 - DNA, 20 bp, Artificial Sequence
  chemically synthesized
gtaaaacccaaggtgggcgg

SEQ ID NO: 534258 - DNA, 20 bp, Artificial Sequence
  chemically synthesized
attgtcaatggaattcagaa

SEQ ID NO: 534259 - DNA, 20 bp, Artificial Sequence
  chemically synthesized
tacaccattgtcaatggaat

SEQ ID NO: 534260 - DNA, 20 bp, Artificial Sequence
  chemically synthesized
gtgtggtgatcatggtgtgt

SEQ ID NO: 534261 - DNA, 20 bp, Artificial Sequence
  chemically synthesized
tatgtgtgtgtgttttctat

SEQ ID NO: 534262 - DNA, 20 bp, Artificial Sequence
  chemically synthesized
tttagcattttatattcttc

SEQ ID NO: 534263 - DNA, 20 bp, Artificial Sequence
  chemically synthesized
agattgtttccccaaccagg

SEQ ID NO: 534264 - DNA, 20 bp, Artificial Sequence
  chemically synthesized
atatattcacagtatcttag

SEQ ID NO: 534265 - DNA, 20 bp, Artificial Sequence
  chemically synthesized
gagacaacctgaattaattt

SEQ ID NO: 534266 - DNA, 20 bp, Artificial Sequence
  chemically synthesized
agagaagacaaacaattaaa

SEQ ID NO: 534267 - DNA, 20 bp, Artificial Sequence
  chemically synthesized
aaaataagttcttacacata

SEQ ID NO: 534268 - DNA, 20 bp, Artificial Sequence
  chemically synthesized
agtgatattgaccctacatg

SEQ ID NO: 534269 - DNA, 20 bp, Artificial Sequence
  chemically synthesized
tggtagaaaagagaggagga

SEQ ID NO: 534270 - DNA, 20 bp, Artificial Sequence
  chemically synthesized
gcaaaggaggaaactgaggc

SEQ ID NO: 534271 - DNA, 20 bp, Artificial Sequence
  chemically synthesized
atgattaggtgggttaactt

SEQ ID NO: 534272 - DNA, 20 bp, Artificial Sequence
  chemically synthesized
cgctgttttatggacattgt

SEQ ID NO: 534273 - DNA, 20 bp, Artificial Sequence
  chemically synthesized
ttttatcttccaagttaaag

SEQ ID NO: 534274 - DNA, 20 bp, Artificial Sequence
  chemically synthesized
actgtgtctcaaaggaactt

SEQ ID NO: 534275 - DNA, 20 bp, Artificial Sequence
  chemically synthesized
gagtggagtaggaaatgggt

SEQ ID NO: 534276 - DNA, 20 bp, Artificial Sequence
  chemically synthesized
gtactaactcccataggagg

SEQ ID NO: 534277 - DNA, 20 bp, Artificial Sequence
  chemically synthesized
cctagttagaagccagctag

SEQ ID NO: 534278 - DNA, 20 bp, Artificial Sequence
  chemically synthesized
tagtgggagacagaagagca

SEQ ID NO: 534279 - DNA, 20 bp, Artificial Sequence
  chemically synthesized
ccgacaagttttaccaaagc

SEQ ID NO: 534280 - DNA, 20 bp, Artificial Sequence
  chemically synthesized
attcctgacaacacgaactg

SEQ ID NO: 534281 - DNA, 20 bp, Artificial Sequence
  chemically synthesized
ggtgaaatcaacttccaata

SEQ ID NO: 534282 - DNA, 20 bp, Artificial Sequence
  chemically synthesized
ggagtatgtggaggaggatc

SEQ ID NO: 534283 - DNA, 20 bp, Artificial Sequence
  chemically synthesized
aagagtgtgactgtgaaagg

SEQ ID NO: 534284 - DNA, 20 bp, Artificial Sequence
  chemically synthesized
atttgccatagtgacttctg

SEQ ID NO: 534285 - DNA, 20 bp, Artificial Sequence
  chemically synthesized
gcatggatacagggagaggt

SEQ ID NO: 534286 - DNA, 20 bp, Artificial Sequence
  chemically synthesized
gggcatgctgtctttcgtag

SEQ ID NO: 534287 - DNA, 20 bp, Artificial Sequence
  chemically synthesized
ctagcctactcatctcagga

SEQ ID NO: 534288 - DNA, 20 bp, Artificial Sequence
  chemically synthesized
gaaagcagagaacttcgaga

SEQ ID NO: 534289 - DNA, 20 bp, Artificial Sequence
  chemically synthesized
gcgaccaaaagagtggaagc

SEQ ID NO: 534290 - DNA, 20 bp, Artificial Sequence
  chemically synthesized
aaaaaaaagcttgaacactc

SEQ ID NO: 534291 - DNA, 20 bp, Artificial Sequence
  chemically synthesized
catatcagattgatccagag

SEQ ID NO: 534292 - DNA, 20 bp, Artificial Sequence
  chemically synthesized
attgaaaggttttacacaga

SEQ ID NO: 534293 - DNA, 20 bp, Artificial Sequence
  chemically synthesized
caattccataattgtccaca

SEQ ID NO: 534294 - DNA, 20 bp, Artificial Sequence
  chemically synthesized
atgaaacctgaattgagagt

SEQ ID NO: 534295 - DNA, 20 bp, Artificial Sequence
  chemically synthesized
aagaagttatgcatccatat

SEQ ID NO: 534296 - DNA, 20 bp, Artificial Sequence
  chemically synthesized
gtttattttaactgagcttt

SEQ ID NO: 534297 - DNA, 20 bp, Artificial Sequence
  chemically synthesized
atttttctgctgtctttttt

SEQ ID NO: 534298 - DNA, 20 bp, Artificial Sequence
  chemically synthesized
gcatttctgaaaaaaagaca

SEQ ID NO: 534299 - DNA, 20 bp, Artificial Sequence
  chemically synthesized
atcactaaacaatttggtcc

SEQ ID NO: 534300 - DNA, 20 bp, Artificial Sequence
  chemically synthesized
ttttaattcacacaaggagg

SEQ ID NO: 534301 - DNA, 20 bp, Artificial Sequence
  chemically synthesized
aacctctttatggatttata

SEQ ID NO: 534302 - DNA, 20 bp, Artificial Sequence
  chemically synthesized
tagaaatgttaaaatagctg

SEQ ID NO: 534303 - DNA, 20 bp, Artificial Sequence
  chemically synthesized
tctatacagggcatactatt

SEQ ID NO: 534304 - DNA, 20 bp, Artificial Sequence
  chemically synthesized
ttgtagtcattgttgaaagg

SEQ ID NO: 534305 - DNA, 20 bp, Artificial Sequence
  chemically synthesized
attacatgaagccatgtaag

SEQ ID NO: 534306 - DNA, 20 bp, Artificial Sequence
  chemically synthesized
cttattccaaagcagctgga

SEQ ID NO: 534307 - DNA, 20 bp, Artificial Sequence
  chemically synthesized
taaagagagagcccagataa

SEQ ID NO: 534308 - DNA, 20 bp, Artificial Sequence
  chemically synthesized
acccagctaccccaggcatc

SEQ ID NO: 534309 - DNA, 20 bp, Artificial Sequence
  chemically synthesized
gaaaagtcagttgagagggt

SEQ ID NO: 534310 - DNA, 20 bp, Artificial Sequence
  chemically synthesized
atggatgggtggaaacgatt

SEQ ID NO: 534311 - DNA, 20 bp, Artificial Sequence
  chemically synthesized
caatgccagaggacagaacc

SEQ ID NO: 534312 - DNA, 20 bp, Artificial Sequence
  chemically synthesized
tccttgcctctatgatcatg

SEQ ID NO: 534313 - DNA, 20 bp, Artificial Sequence
  chemically synthesized
tccccgagtgactaagctaa

SEQ ID NO: 534314 - DNA, 20 bp, Artificial Sequence
  chemically synthesized
tccaggactgtctggaggta

SEQ ID NO: 534315 - DNA, 20 bp, Artificial Sequence
  chemically synthesized
gtcctggaccaggaccaggg

SEQ ID NO: 534316 - DNA, 20 bp, Artificial Sequence
  chemically synthesized
tctgagatgttacctgtagt

SEQ ID NO: 534317 - DNA, 20 bp, Artificial Sequence
  chemically synthesized
tctgaactacaggtaacatc

SEQ ID NO: 534318 - DNA, 20 bp, Artificial Sequence
  chemically synthesized
agataggcaggttctgtcct

SEQ ID NO: 534319 - DNA, 20 bp, Artificial Sequence
  chemically synthesized
acctgcctatcttgaccata

SEQ ID NO: 534320 - DNA, 20 bp, Artificial Sequence
  chemically synthesized
catgaagctgcttgccagct

SEQ ID NO: 534321 - DNA, 20 bp, Artificial Sequence
  chemically synthesized
ctggcaagcagcttcatgaa

SEQ ID NO: 534322 - DNA, 20 bp, Artificial Sequence
  chemically synthesized
caagttttatgaacacagtt

SEQ ID NO: 534323 - DNA, 20 bp, Artificial Sequence
  chemically synthesized
gttcataaaacttgaaaaaa

SEQ ID NO: 534324 - DNA, 20 bp, Artificial Sequence
  chemically synthesized
aaaattatgcactttaagtg

SEQ ID NO: 534325 - DNA, 20 bp, Artificial Sequence
  chemically synthesized
aaccctgaatacattaagaa

SEQ ID NO: 534326 - DNA, 20 bp, Artificial Sequence
  chemically synthesized
aaggaggaggagaatagaca

SEQ ID NO: 534327 - DNA, 20 bp, Artificial Sequence
  chemically synthesized
cagtaaagactgaaggagga

SEQ ID NO: 534328 - DNA, 20 bp, Artificial Sequence
  chemically synthesized
ggaatattatttagcaataa

SEQ ID NO: 534329 - DNA, 20 bp, Artificial Sequence
  chemically synthesized
aaataaaaatacatatgtac

SEQ ID NO: 534330 - DNA, 20 bp, Artificial Sequence
  chemically synthesized
tactcccaggtgtatgctga

SEQ ID NO: 534331 - DNA, 20 bp, Artificial Sequence
  chemically synthesized
tgttcagcatacacctggga

SEQ ID NO: 534332 - DNA, 20 bp, Artificial Sequence
  chemically synthesized
taatacaaaaatatagtttg

SEQ ID NO: 534333 - DNA, 20 bp, Artificial Sequence
  chemically synthesized
ttattagattgtcgtttgta

SEQ ID NO: 534334 - DNA, 20 bp, Artificial Sequence
  chemically synthesized
ataacaagtgttgagaagat

SEQ ID NO: 534335 - DNA, 20 bp, Artificial Sequence
  chemically synthesized
gagatctatacatctacttt

SEQ ID NO: 534336 - DNA, 20 bp, Artificial Sequence
  chemically synthesized
taaatgacttaattacaagt

SEQ ID NO: 534337 - DNA, 20 bp, Artificial Sequence
  chemically synthesized
atttgataagatacttgtat

SEQ ID NO: 534338 - DNA, 20 bp, Artificial Sequence
  chemically synthesized
agaaagggaaaagacaatcc

SEQ ID NO: 534339 - DNA, 20 bp, Artificial Sequence
  chemically synthesized
tgtactgcaagcaatattgt

SEQ ID NO: 534340 - DNA, 20 bp, Artificial Sequence
  chemically synthesized
tttgcttttggtgtcatatc

SEQ ID NO: 534341 - DNA, 20 bp, Artificial Sequence
  chemically synthesized
ctaaaactttaaaactcttc

SEQ ID NO: 534342 - DNA, 20 bp, Artificial Sequence
  chemically synthesized
caaactcattgaagtagaga

SEQ ID NO: 534343 - DNA, 20 bp, Artificial Sequence
  chemically synthesized
ctaaatgaaataagccaggc

SEQ ID NO: 534344 - DNA, 20 bp, Artificial Sequence
  chemically synthesized
agtattattcagccttaaat

SEQ ID NO: 534345 - DNA, 20 bp, Artificial Sequence
  chemically synthesized
ccatcagtggatgaatggat

SEQ ID NO: 534346 - DNA, 20 bp, Artificial Sequence
  chemically synthesized
cacttccgggtatatatcca

SEQ ID NO: 534347 - DNA, 20 bp, Artificial Sequence
  chemically synthesized
agctcctcaaaaaactgaaa

SEQ ID NO: 534348 - DNA, 20 bp, Artificial Sequence
  chemically synthesized
gaatggctgttataaaaaga

SEQ ID NO: 534349 - DNA, 20 bp, Artificial Sequence
  chemically synthesized
gagatgtcaccttacacctg

SEQ ID NO: 534350 - DNA, 20 bp, Artificial Sequence
  chemically synthesized
gctatttgtacatcttcttt

SEQ ID NO: 534351 - DNA, 20 bp, Artificial Sequence
  chemically synthesized
attagcttaaatgtatcata

SEQ ID NO: 534352 - DNA, 20 bp, Artificial Sequence
  chemically synthesized
tagtctttcacaacctggtg

SEQ ID NO: 534353 - DNA, 20 bp, Artificial Sequence
  chemically synthesized
accaagagaattcaatggaa

SEQ ID NO: 534354 - DNA, 20 bp, Artificial Sequence
  chemically synthesized
gatttttgacaagggtacca

SEQ ID NO: 534355 - DNA, 20 bp, Artificial Sequence
  chemically synthesized
tagacatatagatcaatgaa

SEQ ID NO: 534356 - DNA, 20 bp, Artificial Sequence
  chemically synthesized
attattaagtcaatgtggta

SEQ ID NO: 534357 - DNA, 20 bp, Artificial Sequence
  chemically synthesized
tctattgaaatgcaagggat

SEQ ID NO: 534358 - DNA, 20 bp, Artificial Sequence
  chemically synthesized
tctacatcccttgcatttca

SEQ ID NO: 534359 - DNA, 20 bp, Artificial Sequence
  chemically synthesized
aactggcttttttttttttt

SEQ ID NO: 534360 - DNA, 20 bp, Artificial Sequence
  chemically synthesized
aagaaattaaagataaaaaa

SEQ ID NO: 534361 - DNA, 20 bp, Artificial Sequence
  chemically synthesized
aagaatacaaagcagtgttg

SEQ ID NO: 534362 - DNA, 20 bp, Artificial Sequence
  chemically synthesized
agatgcaaggcttgtatact

SEQ ID NO: 534363 - DNA, 20 bp, Artificial Sequence
  chemically synthesized
gaataatctaaaagtgaaat

SEQ ID NO: 534364 - DNA, 20 bp, Artificial Sequence
  chemically synthesized
gaagaatctatgaaaaaata

SEQ ID NO: 534365 - DNA, 20 bp, Artificial Sequence
  chemically synthesized
ccttgtaattagaaaatttt

SEQ ID NO: 534366 - DNA, 20 bp, Artificial Sequence
  chemically synthesized
cagacaacatgaccttgtaa

SEQ ID NO: 534367 - DNA, 20 bp, Artificial Sequence
  chemically synthesized
ataaataaaagacatccaga

SEQ ID NO: 534368 - DNA, 20 bp, Artificial Sequence
  chemically synthesized
ttcaggccagggaaattagg

SEQ ID NO: 534369 - DNA, 20 bp, Artificial Sequence
  chemically synthesized
ctcctgctgaaacctgtagg

SEQ ID NO: 534370 - DNA, 20 bp, Artificial Sequence
  chemically synthesized
aaaagaggcatacacagaga

SEQ ID NO: 534371 - DNA, 20 bp, Artificial Sequence
  chemically synthesized
atctgcaaatgtgaccttat

SEQ ID NO: 534372 - DNA, 20 bp, Artificial Sequence
  chemically synthesized
ctactcaggaggctgaggca

SEQ ID NO: 534373 - DNA, 20 bp, Artificial Sequence
  chemically synthesized
ataaagaacacttaacaaat

SEQ ID NO: 534374 - DNA, 20 bp, Artificial Sequence
  chemically synthesized
gtatggtcatcacaataaat

SEQ ID NO: 534375 - DNA, 20 bp, Artificial Sequence
  chemically synthesized
caatgtattataccatatca

SEQ ID NO: 534376 - DNA, 20 bp, Artificial Sequence
  chemically synthesized
ctaaccagacaaagatatca

SEQ ID NO: 534377 - DNA, 20 bp, Artificial Sequence
  chemically synthesized
caactcttccaaaaaataga

SEQ ID NO: 534378 - DNA, 20 bp, Artificial Sequence
  chemically synthesized
aagagttgtttatatgtttg

SEQ ID NO: 534379 - DNA, 20 bp, Artificial Sequence
  chemically synthesized
taacctggatagacctataa

SEQ ID NO: 534380 - DNA, 20 bp, Artificial Sequence
  chemically synthesized
ggtgcattactaccaacatt

SEQ ID NO: 534381 - DNA, 20 bp, Artificial Sequence
  chemically synthesized
atggtcaaattactaatatt

SEQ ID NO: 534382 - DNA, 20 bp, Artificial Sequence
  chemically synthesized
gttttagctgattggttagg

SEQ ID NO: 534383 - DNA, 20 bp, Artificial Sequence
  chemically synthesized
aaaatcaacaaaaccaaaat

SEQ ID NO: 534384 - DNA, 20 bp, Artificial Sequence
  chemically synthesized
agatagaggaagaaaatata

SEQ ID NO: 534385 - DNA, 20 bp, Artificial Sequence
  chemically synthesized
gtgaaaaaaatcagatagag

SEQ ID NO: 534386 - DNA, 20 bp, Artificial Sequence
  chemically synthesized
cttaagaaactagaaaaaga

SEQ ID NO: 534387 - DNA, 20 bp, Artificial Sequence
  chemically synthesized
taagcttctaccttaagaaa

SEQ ID NO: 534388 - DNA, 20 bp, Artificial Sequence
  chemically synthesized
agtagcctaagcttctacct

SEQ ID NO: 534389 - DNA, 20 bp, Artificial Sequence
  chemically synthesized
ccaatgggacaaagaagaaa

SEQ ID NO: 534390 - DNA, 20 bp, Artificial Sequence
  chemically synthesized
taaatagccaatgggacaaa

SEQ ID NO: 534391 - DNA, 20 bp, Artificial Sequence
  chemically synthesized
aatttgggagttcataaata

SEQ ID NO: 534392 - DNA, 20 bp, Artificial Sequence
  chemically synthesized
cctagcatatggcctaccct

SEQ ID NO: 534393 - DNA, 20 bp, Artificial Sequence
  chemically synthesized
aatatttcgtgtacagttga

SEQ ID NO: 534394 - DNA, 20 bp, Artificial Sequence
  chemically synthesized
cagcgtttcatccaataata

SEQ ID NO: 534395 - DNA, 20 bp, Artificial Sequence
  chemically synthesized
aaaaactgactgaactgaaa

SEQ ID NO: 534396 - DNA, 20 bp, Artificial Sequence
  chemically synthesized
agaaaaaatattaaggaaat

SEQ ID NO: 534397 - DNA, 20 bp, Artificial Sequence
  chemically synthesized
taatccaatccaaagaaaag

SEQ ID NO: 534398 - DNA, 20 bp, Artificial Sequence
  chemically synthesized
gggataatccaatccaaaga

SEQ ID NO: 534399 - DNA, 20 bp, Artificial Sequence
  chemically synthesized
taaatgggataatccaatcc

SEQ ID NO: 534400 - DNA, 20 bp, Artificial Sequence
  chemically synthesized
tcagattcaagctgcaaaag

SEQ ID NO: 534401 - DNA, 20 bp, Artificial Sequence
  chemically synthesized
gacgtcagattcaagctgca

SEQ ID NO: 534402 - DNA, 20 bp, Artificial Sequence
  chemically synthesized
tagagagtatcaataaagag

SEQ ID NO: 534403 - DNA, 20 bp, Artificial Sequence
  chemically synthesized
aaaacttccagtgaagctct

SEQ ID NO: 534404 - DNA, 20 bp, Artificial Sequence
  chemically synthesized
gttgagataaacataggtct

SEQ ID NO: 534405 - DNA, 20 bp, Artificial Sequence
  chemically synthesized
ccttaggaacctgttatgtt

SEQ ID NO: 534406 - DNA, 20 bp, Artificial Sequence
  chemically synthesized
ccctggagctagggcttttc

SEQ ID NO: 534407 - DNA, 20 bp, Artificial Sequence
  chemically synthesized
ggaataaaattggccttttt

SEQ ID NO: 534408 - DNA, 20 bp, Artificial Sequence
  chemically synthesized
tcaaggctactgtggagctg

SEQ ID NO: 534409 - DNA, 20 bp, Artificial Sequence
  chemically synthesized
ctttggttaattcccagggt

SEQ ID NO: 534410 - DNA, 20 bp, Artificial Sequence
  chemically synthesized
ccctgtctctactaaaaaca

SEQ ID NO: 534411 - DNA, 20 bp, Artificial Sequence
  chemically synthesized
ccatctcaaaaaaaggaaaa

SEQ ID NO: 534412 - DNA, 20 bp, Artificial Sequence
  chemically synthesized
ctcaaaaaaaggaaaaaaag

SEQ ID NO: 534413 - DNA, 20 bp, Artificial Sequence
  chemically synthesized
aaaaaggaaaaaaagaaaga

SEQ ID NO: 534414 - DNA, 20 bp, Artificial Sequence
  chemically synthesized
aaaaaaagaaagaaaagaaa

SEQ ID NO: 534415 - DNA, 20 bp, Artificial Sequence
  chemically synthesized
taaattgtgaaaagcaaact

SEQ ID NO: 534416 - DNA, 20 bp, Artificial Sequence
  chemically synthesized
taaagcttctatgtgattaa

SEQ ID NO: 534417 - DNA, 20 bp, Artificial Sequence
  chemically synthesized
aggggagaacaaaagggaat

SEQ ID NO: 534418 - DNA, 20 bp, Artificial Sequence
  chemically synthesized
agggaataaagaaaatacat

SEQ ID NO: 534419 - DNA, 20 bp, Artificial Sequence
  chemically synthesized
tacaataatgaaaagcatta

SEQ ID NO: 534420 - DNA, 20 bp, Artificial Sequence
  chemically synthesized
taatgcttttcattattgta

SEQ ID NO: 534421 - DNA, 20 bp, Artificial Sequence
  chemically synthesized
aaaaatacacaaaatatata

SEQ ID NO: 534422 - DNA, 20 bp, Artificial Sequence
  chemically synthesized
ttaaaattaattatgtgatt

SEQ ID NO: 534423 - DNA, 20 bp, Artificial Sequence
  chemically synthesized
gtctgtgtttcaagtttcct

SEQ ID NO: 534424 - DNA, 20 bp, Artificial Sequence
  chemically synthesized
aacacagagattttgcagcc

SEQ ID NO: 534425 - DNA, 20 bp, Artificial Sequence
  chemically synthesized
atattgaaaactatctgaag

SEQ ID NO: 534426 - DNA, 20 bp, Artificial Sequence
  chemically synthesized
ttcccctgtcagtttttgaa

SEQ ID NO: 534427 - DNA, 20 bp, Artificial Sequence
  chemically synthesized
aaatctctcttgacactgga

SEQ ID NO: 534428 - DNA, 20 bp, Artificial Sequence
  chemically synthesized
aaaagaaagtttaaaacgat

SEQ ID NO: 534429 - DNA, 20 bp, Artificial Sequence
  chemically synthesized
gatcaagaaataatttttcc

SEQ ID NO: 534430 - DNA, 20 bp, Artificial Sequence
  chemically synthesized
gaacaggttatgaactcaac

SEQ ID NO: 534431 - DNA, 20 bp, Artificial Sequence
  chemically synthesized
atctttgccaataggctatg

SEQ ID NO: 534432 - DNA, 20 bp, Artificial Sequence
  chemically synthesized
cctattggcaaagattttga

SEQ ID NO: 534433 - DNA, 20 bp, Artificial Sequence
  chemically synthesized
aacaataaagttcttttgag

SEQ ID NO: 534434 - DNA, 20 bp, Artificial Sequence
  chemically synthesized
tctaaaacaaaaacatgaag

SEQ ID NO: 534435 - DNA, 20 bp, Artificial Sequence
  chemically synthesized
tctaacttcatgtttttgtt

SEQ ID NO: 534436 - DNA, 20 bp, Artificial Sequence
  chemically synthesized
tttagaaaaaattaagggtg

SEQ ID NO: 534437 - DNA, 20 bp, Artificial Sequence
  chemically synthesized
agtcttgatttggtgaaaaa

SEQ ID NO: 534438 - DNA, 20 bp, Artificial Sequence
  chemically synthesized
tgaaagcgtggtcagagtgg

SEQ ID NO: 534439 - DNA, 20 bp, Artificial Sequence
  chemically synthesized
aataacaacctattcacaga

SEQ ID NO: 534440 - DNA, 20 bp, Artificial Sequence
  chemically synthesized
tctcaaaaatacataaataa

SEQ ID NO: 534441 - DNA, 20 bp, Artificial Sequence
  chemically synthesized
tcctccttttatttagaaaa

SEQ ID NO: 534442 - DNA, 20 bp, Artificial Sequence
  chemically synthesized
gaaaaaactcctccttttat

SEQ ID NO: 534443 - DNA, 20 bp, Artificial Sequence
  chemically synthesized
tgtccttgctggtctgacat

SEQ ID NO: 534444 - DNA, 20 bp, Artificial Sequence
  chemically synthesized
tgcaatattaagtttacaaa

SEQ ID NO: 534445 - DNA, 20 bp, Artificial Sequence
  chemically synthesized
gtcaccatacctgaacgtaa

SEQ ID NO: 534446 - DNA, 20 bp, Artificial Sequence
  chemically synthesized
ttaatcttaggcacacagac

SEQ ID NO: 534447 - DNA, 20 bp, Artificial Sequence
  chemically synthesized
attttcacacttttttccta

SEQ ID NO: 534448 - DNA, 20 bp, Artificial Sequence
  chemically synthesized
tatttgctccctacctttta

SEQ ID NO: 534449 - DNA, 20 bp, Artificial Sequence
  chemically synthesized
tattgttttattttttcatc

SEQ ID NO: 534450 - DNA, 20 bp, Artificial Sequence
  chemically synthesized
cattactgataaaccaacag

SEQ ID NO: 534451 - DNA, 20 bp, Artificial Sequence
  chemically synthesized
aacaaagcaagaaaacccca

SEQ ID NO: 534452 - DNA, 20 bp, Artificial Sequence
  chemically synthesized
tctacgtggctaaaacaaag

SEQ ID NO: 534453 - DNA, 20 bp, Artificial Sequence
  chemically synthesized
aaactgaaggctagagaagt

SEQ ID NO: 534454 - DNA, 20 bp, Artificial Sequence
  chemically synthesized
tattattcttagtttgcaga

SEQ ID NO: 534455 - DNA, 20 bp, Artificial Sequence
  chemically synthesized
cagttttcttctctgcaaac

SEQ ID NO: 534456 - DNA, 20 bp, Artificial Sequence
  chemically synthesized
taattttagcatacatcatt

SEQ ID NO: 534457 - DNA, 20 bp, Artificial Sequence
  chemically synthesized
tttaatcacctaaaataaaa

SEQ ID NO: 534458 - DNA, 20 bp, Artificial Sequence
  chemically synthesized
ctgcagaaggaaatatgaaa

SEQ ID NO: 534459 - DNA, 20 bp, Artificial Sequence
  chemically synthesized
agaaaatcctaaagtgatgg

SEQ ID NO: 534460 - DNA, 20 bp, Artificial Sequence
  chemically synthesized
aatgagaaataaatttaacc

SEQ ID NO: 534461 - DNA, 20 bp, Artificial Sequence
  chemically synthesized
ggactctggtagttagcaaa

SEQ ID NO: 534462 - DNA, 20 bp, Artificial Sequence
  chemically synthesized
taactggtaagaaggtataa

SEQ ID NO: 534463 - DNA, 20 bp, Artificial Sequence
  chemically synthesized
tagtatccgaaacttataga

SEQ ID NO: 534464 - DNA, 20 bp, Artificial Sequence
  chemically synthesized
acgaatatgactagagcttt

SEQ ID NO: 534465 - DNA, 20 bp, Artificial Sequence
  chemically synthesized
ctggtctgactatgtaatat

SEQ ID NO: 534466 - DNA, 20 bp, Artificial Sequence
  chemically synthesized
gtggtaacatgtgtctcttg

SEQ ID NO: 534467 - DNA, 20 bp, Artificial Sequence
  chemically synthesized
tgaggatgttagaaagccac

SEQ ID NO: 534468 - DNA, 20 bp, Artificial Sequence
  chemically synthesized
tagtttatatgatgaggatg

SEQ ID NO: 534469 - DNA, 20 bp, Artificial Sequence
  chemically synthesized
agccactgcagaaaaggaag

SEQ ID NO: 534470 - DNA, 20 bp, Artificial Sequence
  chemically synthesized
acacactgccaaaagccact

SEQ ID NO: 534471 - DNA, 20 bp, Artificial Sequence
  chemically synthesized
ccatgttgggggacagctcc

SEQ ID NO: 534472 - DNA, 20 bp, Artificial Sequence
  chemically synthesized
ctactggactatgatataac

SEQ ID NO: 534473 - DNA, 20 bp, Artificial Sequence
  chemically synthesized
taggctatgctaagctatag

SEQ ID NO: 534474 - DNA, 20 bp, Artificial Sequence
  chemically synthesized
gaaatggaagccatttcatc

SEQ ID NO: 534475 - DNA, 20 bp, Artificial Sequence
  chemically synthesized
cttagatgacataaccaatt

SEQ ID NO: 534476 - DNA, 20 bp, Artificial Sequence
  chemically synthesized
ctctatagatattttatctg

SEQ ID NO: 534477 - DNA, 20 bp, Artificial Sequence
  chemically synthesized
gataaaagaaaaaggaaaag

SEQ ID NO: 534478 - DNA, 20 bp, Artificial Sequence
  chemically synthesized
gtctataattcctcaggata

SEQ ID NO: 534479 - DNA, 20 bp, Artificial Sequence
  chemically synthesized
ttgaggaaatttcagaggaa

SEQ ID NO: 534480 - DNA, 20 bp, Artificial Sequence
  chemically synthesized
cagaggaaagagaaagaaga

SEQ ID NO: 534481 - DNA, 20 bp, Artificial Sequence
  chemically synthesized
aatgagctgggctggaggta

SEQ ID NO: 534482 - DNA, 20 bp, Artificial Sequence
  chemically synthesized
ctggaggtaagagaatgggg

SEQ ID NO: 534483 - DNA, 20 bp, Artificial Sequence
  chemically synthesized
cttatttggaggccctggat

SEQ ID NO: 534484 - DNA, 20 bp, Artificial Sequence
  chemically synthesized
cattcgggcttaattccttc

SEQ ID NO: 534485 - DNA, 20 bp, Artificial Sequence
  chemically synthesized
gtgatcttaaagatggtgca

SEQ ID NO: 534486 - DNA, 20 bp, Artificial Sequence
  chemically synthesized
gtagacttttgagtcaaggt

SEQ ID NO: 534487 - DNA, 20 bp, Artificial Sequence
  chemically synthesized
tgctttgggaggccaaggaa

SEQ ID NO: 534488 - DNA, 20 bp, Artificial Sequence
  chemically synthesized
gagttcaagaacccatctct

SEQ ID NO: 534489 - DNA, 20 bp, Artificial Sequence
  chemically synthesized
tgacagtgagactctgtctc

SEQ ID NO: 534490 - DNA, 20 bp, Artificial Sequence
  chemically synthesized
tgtttaatgtaaagttatta

SEQ ID NO: 534491 - DNA, 20 bp, Artificial Sequence
  chemically synthesized
atgcaatccaaaagaaaatc

SEQ ID NO: 534492 - DNA, 20 bp, Artificial Sequence
  chemically synthesized
tatacagtagatgcaatcca

SEQ ID NO: 534493 - DNA, 20 bp, Artificial Sequence
  chemically synthesized
tttattctagttgaaagaat

SEQ ID NO: 534494 - DNA, 20 bp, Artificial Sequence
  chemically synthesized
ctgattctgaattctttcaa

SEQ ID NO: 534495 - DNA, 20 bp, Artificial Sequence
  chemically synthesized
ttttccttttattctagttg

SEQ ID NO: 534496 - DNA, 20 bp, Artificial Sequence
  chemically synthesized
atatttgccatcaaaaaagc

SEQ ID NO: 534497 - DNA, 20 bp, Artificial Sequence
  chemically synthesized
accttcaggaaaataattta

SEQ ID NO: 534498 - DNA, 20 bp, Artificial Sequence
  chemically synthesized
tcatatttggttctagggat

SEQ ID NO: 534499 - DNA, 20 bp, Artificial Sequence
  chemically synthesized
aaccaaatatgaatcatctg

SEQ ID NO: 534500 - DNA, 20 bp, Artificial Sequence
  chemically synthesized
tctgttagaaaagcactaca

SEQ ID NO: 534501 - DNA, 20 bp, Artificial Sequence
  chemically synthesized
caaagcaaactcctgtggca

SEQ ID NO: 534502 - DNA, 20 bp, Artificial Sequence
  chemically synthesized
cccaagggaagataagtgta

SEQ ID NO: 534503 - DNA, 20 bp, Artificial Sequence
  chemically synthesized
ctccatcaaaaaaaaaaaag

SEQ ID NO: 534504 - DNA, 20 bp, Artificial Sequence
  chemically synthesized
aaaactccatcaaaaaaaaa

SEQ ID NO: 534505 - DNA, 20 bp, Artificial Sequence
  chemically synthesized
caacttcttttaacaatacc

SEQ ID NO: 534506 - DNA, 20 bp, Artificial Sequence
  chemically synthesized
tgaaaagaacatatttcaga

SEQ ID NO: 534507 - DNA, 20 bp, Artificial Sequence
  chemically synthesized
aaccagcttagagaagttgc

SEQ ID NO: 534508 - DNA, 20 bp, Artificial Sequence
  chemically synthesized
ttttatgaaataaaaataat

SEQ ID NO: 534509 - DNA, 20 bp, Artificial Sequence
  chemically synthesized
ggtgacgcttaggaaagaat

SEQ ID NO: 534510 - DNA, 20 bp, Artificial Sequence
  chemically synthesized
ggtgttgggtgacgcttagg

SEQ ID NO: 534511 - DNA, 20 bp, Artificial Sequence
  chemically synthesized
gaggaaagaagttatatatg

SEQ ID NO: 534512 - DNA, 20 bp, Artificial Sequence
  chemically synthesized
gatagaggtttgcagtgcca

SEQ ID NO: 534513 - DNA, 20 bp, Artificial Sequence
  chemically synthesized
cccagacccaaatctctgtt

SEQ ID NO: 534514 - DNA, 20 bp, Artificial Sequence
  chemically synthesized
agttttaatctttaattggg

SEQ ID NO: 534515 - DNA, 20 bp, Artificial Sequence
  chemically synthesized
atcacaagataagcagggta

SEQ ID NO: 534516 - DNA, 20 bp, Artificial Sequence
  chemically synthesized
agggaaaagtggccaaaagc

SEQ ID NO: 534517 - DNA, 20 bp, Artificial Sequence
  chemically synthesized
ccaaaagcagagaattggaa

SEQ ID NO: 534518 - DNA, 20 bp, Artificial Sequence
  chemically synthesized
acctcaaagggagggaatta

SEQ ID NO: 534519 - DNA, 20 bp, Artificial Sequence
  chemically synthesized
tgatgacagaggtcagcctc

SEQ ID NO: 534520 - DNA, 20 bp, Artificial Sequence
  chemically synthesized
agagcaagggagagaaggtc

SEQ ID NO: 534521 - DNA, 20 bp, Artificial Sequence
  chemically synthesized
gttatgtgaagttataagtt

SEQ ID NO: 534522 - DNA, 20 bp, Artificial Sequence
  chemically synthesized
ctactcaggaggctgaggca

SEQ ID NO: 534523 - DNA, 20 bp, Artificial Sequence
  chemically synthesized
tccatctcaaaaataaatac

SEQ ID NO: 534524 - DNA, 20 bp, Artificial Sequence
  chemically synthesized
tctcaaaaataaatacatag

SEQ ID NO: 534525 - DNA, 20 bp, Artificial Sequence
  chemically synthesized
tttgtaaataagcatcagga

SEQ ID NO: 534526 - DNA, 20 bp, Artificial Sequence
  chemically synthesized
tgaaatcaaaaatatagtcc

SEQ ID NO: 534527 - DNA, 20 bp, Artificial Sequence
  chemically synthesized
aatacatagcaaacacccaa

SEQ ID NO: 534528 - DNA, 20 bp, Artificial Sequence
  chemically synthesized
aaatggtgtaaatgctctta

SEQ ID NO: 534529 - DNA, 20 bp, Artificial Sequence
  chemically synthesized
ggtttgtaattggaatatcc

SEQ ID NO: 534530 - DNA, 20 bp, Artificial Sequence
  chemically synthesized
tggtacataacagtaggata

SEQ ID NO: 534531 - DNA, 20 bp, Artificial Sequence
  chemically synthesized
tactatgctagcaatatttt

SEQ ID NO: 534532 - DNA, 20 bp, Artificial Sequence
  chemically synthesized
gtgctattcactgcctatcc

SEQ ID NO: 534533 - DNA, 20 bp, Artificial Sequence
  chemically synthesized
agctgtgtattttgggagag

SEQ ID NO: 534534 - DNA, 20 bp, Artificial Sequence
  chemically synthesized
ctgggattggccgtcactac

SEQ ID NO: 534535 - DNA, 20 bp, Artificial Sequence
  chemically synthesized
cagtctatgtgccatataaa

SEQ ID NO: 534536 - DNA, 20 bp, Artificial Sequence
  chemically synthesized
tcctggaaaatacaacgtaa

SEQ ID NO: 534537 - DNA, 20 bp, Artificial Sequence
  chemically synthesized
tagagaaggaggaggaatat

SEQ ID NO: 534538 - DNA, 20 bp, Artificial Sequence
  chemically synthesized
gtacttttatagaacatgga

SEQ ID NO: 534539 - DNA, 20 bp, Artificial Sequence
  chemically synthesized
aaatgaggataattgcagca

SEQ ID NO: 534540 - DNA, 20 bp, Artificial Sequence
  chemically synthesized
aaaatgatttcagtgcagtg

SEQ ID NO: 534541 - DNA, 20 bp, Artificial Sequence
  chemically synthesized
gacaaagatgatgccagatg

SEQ ID NO: 534542 - DNA, 20 bp, Artificial Sequence
  chemically synthesized
ttgttgttcgtgattctaaa

SEQ ID NO: 534543 - DNA, 20 bp, Artificial Sequence
  chemically synthesized
gaagcaatgggttttctctt

SEQ ID NO: 534544 - DNA, 20 bp, Artificial Sequence
  chemically synthesized
tgcttcttgtttaagatgga

SEQ ID NO: 534545 - DNA, 20 bp, Artificial Sequence
  chemically synthesized
catgcaatggagaaggaaaa

SEQ ID NO: 534546 - DNA, 20 bp, Artificial Sequence
  chemically synthesized
aaggtctcctaggaattgta

SEQ ID NO: 534547 - DNA, 20 bp, Artificial Sequence
  chemically synthesized
ccttcctacccataaggctc

SEQ ID NO: 534548 - DNA, 20 bp, Artificial Sequence
  chemically synthesized
tcataatataaagaaattga

SEQ ID NO: 534549 - DNA, 20 bp, Artificial Sequence
  chemically synthesized
catttatgtattcataatat

SEQ ID NO: 534550 - DNA, 20 bp, Artificial Sequence
  chemically synthesized
ctacttaaaagggaaaaaga

SEQ ID NO: 534551 - DNA, 20 bp, Artificial Sequence
  chemically synthesized
gttatgggagaaccacggtg

SEQ ID NO: 534552 - DNA, 20 bp, Artificial Sequence
  chemically synthesized
gacactgtctagagtcagag

SEQ ID NO: 534553 - DNA, 20 bp, Artificial Sequence
  chemically synthesized
tccttgcctcaaaggcaagg

SEQ ID NO: 534554 - DNA, 20 bp, Artificial Sequence
  chemically synthesized
ctaacttaggctagcttctt

SEQ ID NO: 534555 - DNA, 20 bp, Artificial Sequence
  chemically synthesized
ctctggcaaagcggaagaag

SEQ ID NO: 534556 - DNA, 20 bp, Artificial Sequence
  chemically synthesized
gcatttttatatcattataa

SEQ ID NO: 534557 - DNA, 20 bp, Artificial Sequence
  chemically synthesized
atgctgggcaaaggttaact

SEQ ID NO: 534558 - DNA, 20 bp, Artificial Sequence
  chemically synthesized
aacaaatagtggttacttaa

SEQ ID NO: 534559 - DNA, 20 bp, Artificial Sequence
  chemically synthesized
gttgatacaaaggcattaaa

SEQ ID NO: 534560 - DNA, 20 bp, Artificial Sequence
  chemically synthesized
ctttaatgtcatgtttacta

SEQ ID NO: 534561 - DNA, 20 bp, Artificial Sequence
  chemically synthesized
tctctaacctatagttattt

SEQ ID NO: 534562 - DNA, 20 bp, Artificial Sequence
  chemically synthesized
ttaaaataactataggttag

SEQ ID NO: 534563 - DNA, 20 bp, Artificial Sequence
  chemically synthesized
tcaaattacagataaataat

SEQ ID NO: 534564 - DNA, 20 bp, Artificial Sequence
  chemically synthesized
ccttttggcccagggtgtgt

SEQ ID NO: 534565 - DNA, 20 bp, Artificial Sequence
  chemically synthesized
ggtgaaagaccccttctgtt

SEQ ID NO: 534566 - DNA, 20 bp, Artificial Sequence
  chemically synthesized
cttctgtttgagaaaagtag

SEQ ID NO: 534567 - DNA, 20 bp, Artificial Sequence
  chemically synthesized
ccttaggtaccagctcagcc

SEQ ID NO: 534568 - DNA, 20 bp, Artificial Sequence
  chemically synthesized
ccaagaacctaggccaggac

SEQ ID NO: 534569 - DNA, 20 bp, Artificial Sequence
  chemically synthesized
tgagtgctagcttagccaca

SEQ ID NO: 534570 - DNA, 20 bp, Artificial Sequence
  chemically synthesized
aaagaatcctaaaagcagca

SEQ ID NO: 534571 - DNA, 20 bp, Artificial Sequence
  chemically synthesized
cccacaggtcaaggataaag

SEQ ID NO: 534572 - DNA, 20 bp, Artificial Sequence
  chemically synthesized
aactcccacaggtcaaggat

SEQ ID NO: 534573 - DNA, 20 bp, Artificial Sequence
  chemically synthesized
acaaagttatagaacaccaa

SEQ ID NO: 534574 - DNA, 20 bp, Artificial Sequence
  chemically synthesized
tatcagagaacttcagaaac

SEQ ID NO: 534575 - DNA, 20 bp, Artificial Sequence
  chemically synthesized
agggacaatatcagagaact

SEQ ID NO: 534576 - DNA, 20 bp, Artificial Sequence
  chemically synthesized
aggtagagaaagagataggg

SEQ ID NO: 534577 - DNA, 20 bp, Artificial Sequence
  chemically synthesized
attggccttaaacaggaggt

SEQ ID NO: 534578 - DNA, 20 bp, Artificial Sequence
  chemically synthesized
aggctgtctgcctacaagat

SEQ ID NO: 534579 - DNA, 20 bp, Artificial Sequence
  chemically synthesized
atacacagccagagaagaca

SEQ ID NO: 534580 - DNA, 20 bp, Artificial Sequence
  chemically synthesized
aagacaaaagaaaaaaataa

SEQ ID NO: 534581 - DNA, 20 bp, Artificial Sequence
  chemically synthesized
ccagttttttgaaaagatca

SEQ ID NO: 534582 - DNA, 20 bp, Artificial Sequence
  chemically synthesized
ccgctagtaagactaataaa

SEQ ID NO: 534583 - DNA, 20 bp, Artificial Sequence
  chemically synthesized
ctaataaagaagaaaagaga

SEQ ID NO: 534584 - DNA, 20 bp, Artificial Sequence
  chemically synthesized
gggatatcaccaccgacacc

SEQ ID NO: 534585 - DNA, 20 bp, Artificial Sequence
  chemically synthesized
cagaaatacaaactaccatc

SEQ ID NO: 534586 - DNA, 20 bp, Artificial Sequence
  chemically synthesized
aacacctctacgcaaataaa

SEQ ID NO: 534587 - DNA, 20 bp, Artificial Sequence
  chemically synthesized
caaataaactagaaaatcta

SEQ ID NO: 534588 - DNA, 20 bp, Artificial Sequence
  chemically synthesized
agttcctctttgcacctctg

SEQ ID NO: 534589 - DNA, 20 bp, Artificial Sequence
  chemically synthesized
ttctaaaactattccaatca

SEQ ID NO: 534590 - DNA, 20 bp, Artificial Sequence
  chemically synthesized
ggcagagacacaacaaaaaa

SEQ ID NO: 534591 - DNA, 20 bp, Artificial Sequence
  chemically synthesized
acatggttatctcaatagat

SEQ ID NO: 534592 - DNA, 20 bp, Artificial Sequence
  chemically synthesized
ccagggcgatcaggcaggaa

SEQ ID NO: 534593 - DNA, 20 bp, Artificial Sequence
  chemically synthesized
cagacgacatgattgtatat

SEQ ID NO: 534594 - DNA, 20 bp, Artificial Sequence
  chemically synthesized
gtttgtctgttattggtgta

SEQ ID NO: 534595 - DNA, 20 bp, Artificial Sequence
  chemically synthesized
ctcattcacaattgcttcaa

SEQ ID NO: 534596 - DNA, 20 bp, Artificial Sequence
  chemically synthesized
cattccatgctcatggatag

SEQ ID NO: 534597 - DNA, 20 bp, Artificial Sequence
  chemically synthesized
agctaccaatgactttcttc

SEQ ID NO: 534598 - DNA, 20 bp, Artificial Sequence
  chemically synthesized
gtagttttttccaattctgt

SEQ ID NO: 534599 - DNA, 20 bp, Artificial Sequence
  chemically synthesized
aatggaacagaacagagctc

SEQ ID NO: 534600 - DNA, 20 bp, Artificial Sequence
  chemically synthesized
tttgacaaacctgacaaaaa

SEQ ID NO: 534601 - DNA, 20 bp, Artificial Sequence
  chemically synthesized
ctaaaaccataaaaacccta

SEQ ID NO: 534602 - DNA, 20 bp, Artificial Sequence
  chemically synthesized
taaagagcttctgcacagca

SEQ ID NO: 534603 - DNA, 20 bp, Artificial Sequence
  chemically synthesized
tcagagtgaacaggcagcct

SEQ ID NO: 534604 - DNA, 20 bp, Artificial Sequence
  chemically synthesized
aacaggcagcctacagaatg

SEQ ID NO: 534605 - DNA, 20 bp, Artificial Sequence
  chemically synthesized
atctgacaaagggctaatat

SEQ ID NO: 534606 - DNA, 20 bp, Artificial Sequence
  chemically synthesized
aaagaactcaaacaaactta

SEQ ID NO: 534607 - DNA, 20 bp, Artificial Sequence
  chemically synthesized
gctcatcatcactggccatc

SEQ ID NO: 534608 - DNA, 20 bp, Artificial Sequence
  chemically synthesized
gagataccatctcacaccag

SEQ ID NO: 534609 - DNA, 20 bp, Artificial Sequence
  chemically synthesized
acaggtgctggagaggatgt

SEQ ID NO: 534610 - DNA, 20 bp, Artificial Sequence
  chemically synthesized
gattcctcagggatctagaa

SEQ ID NO: 534611 - DNA, 20 bp, Artificial Sequence
  chemically synthesized
ccatcaatgatagactggat

SEQ ID NO: 534612 - DNA, 20 bp, Artificial Sequence
  chemically synthesized
ctgtccttgtgatagtttgc

SEQ ID NO: 534613 - DNA, 20 bp, Artificial Sequence
  chemically synthesized
ctcagcaaactatcacaagg

SEQ ID NO: 534614 - DNA, 20 bp, Artificial Sequence
  chemically synthesized
aaaaaaagtaagttgtgatg

SEQ ID NO: 534615 - DNA, 20 bp, Artificial Sequence
  chemically synthesized
aaaggaagacagcaatagag

SEQ ID NO: 534616 - DNA, 20 bp, Artificial Sequence
  chemically synthesized
caatagaggaagaaaggaac

SEQ ID NO: 534617 - DNA, 20 bp, Artificial Sequence
  chemically synthesized
tattccactttaagcaatag

SEQ ID NO: 534618 - DNA, 20 bp, Artificial Sequence
  chemically synthesized
gcaatagacagaaaaattca

SEQ ID NO: 534619 - DNA, 20 bp, Artificial Sequence
  chemically synthesized
aatgttacatgtgtacttga

SEQ ID NO: 534620 - DNA, 20 bp, Artificial Sequence
  chemically synthesized
cctaacatatgatctatcct

SEQ ID NO: 534621 - DNA, 20 bp, Artificial Sequence
  chemically synthesized
cagacaagtctcaacaaatt

SEQ ID NO: 534622 - DNA, 20 bp, Artificial Sequence
  chemically synthesized
tttctaattttatattgtgg

SEQ ID NO: 534623 - DNA, 20 bp, Artificial Sequence
  chemically synthesized
tttctgaccacaatataaaa

SEQ ID NO: 534624 - DNA, 20 bp, Artificial Sequence
  chemically synthesized
aaaattagaaatcaattaca

SEQ ID NO: 534625 - DNA, 20 bp, Artificial Sequence
  chemically synthesized
catgagaaatcatataaaat

SEQ ID NO: 534626 - DNA, 20 bp, Artificial Sequence
  chemically synthesized
aaacaattattgggtcaaaa

SEQ ID NO: 534627 - DNA, 20 bp, Artificial Sequence
  chemically synthesized
ttttaaaagtcttgagacaa

SEQ ID NO: 534628 - DNA, 20 bp, Artificial Sequence
  chemically synthesized
aacagaaatgaaaacacaac

SEQ ID NO: 534629 - DNA, 20 bp, Artificial Sequence
  chemically synthesized
taaattcctacatcaaaaaa

SEQ ID NO: 534630 - DNA, 20 bp, Artificial Sequence
  chemically synthesized
acctcaggaaactacaaaaa

SEQ ID NO: 534631 - DNA, 20 bp, Artificial Sequence
  chemically synthesized
atgaattaagcccaaagtta

SEQ ID NO: 534632 - DNA, 20 bp, Artificial Sequence
  chemically synthesized
aagcccaaagttagcagaaa

SEQ ID NO: 534633 - DNA, 20 bp, Artificial Sequence
  chemically synthesized
agaaaataacaaagatcaga

SEQ ID NO: 534634 - DNA, 20 bp, Artificial Sequence
  chemically synthesized
aaataaatgaaatagagact

SEQ ID NO: 534635 - DNA, 20 bp, Artificial Sequence
  chemically synthesized
aaatagagactagagaaaca

SEQ ID NO: 534636 - DNA, 20 bp, Artificial Sequence
  chemically synthesized
tgacaaatccttagctagac

SEQ ID NO: 534637 - DNA, 20 bp, Artificial Sequence
  chemically synthesized
gcaggctcaaataaatcaaa

SEQ ID NO: 534638 - DNA, 20 bp, Artificial Sequence
  chemically synthesized
aagacattatgactgataac

SEQ ID NO: 534639 - DNA, 20 bp, Artificial Sequence
  chemically synthesized
tacgatgaacaattatatac

SEQ ID NO: 534640 - DNA, 20 bp, Artificial Sequence
  chemically synthesized
ccaagaaattggacatccta

SEQ ID NO: 534641 - DNA, 20 bp, Artificial Sequence
  chemically synthesized
taacagaaatggatgaattc

SEQ ID NO: 534642 - DNA, 20 bp, Artificial Sequence
  chemically synthesized
tttggtagattatgtatttc

SEQ ID NO: 534643 - DNA, 20 bp, Artificial Sequence
  chemically synthesized
caagaccagatggcttcatg

SEQ ID NO: 534644 - DNA, 20 bp, Artificial Sequence
  chemically synthesized
taggtcttctttaaatgttt

SEQ ID NO: 534645 - DNA, 20 bp, Artificial Sequence
  chemically synthesized
tttagttttccaaaagagtt

SEQ ID NO: 534646 - DNA, 20 bp, Artificial Sequence
  chemically synthesized
caggcaaagacactacaagg

SEQ ID NO: 534647 - DNA, 20 bp, Artificial Sequence
  chemically synthesized
atggttcactagtatttcat

SEQ ID NO: 534648 - DNA, 20 bp, Artificial Sequence
  chemically synthesized
taaatgtgattcaacatata

SEQ ID NO: 534649 - DNA, 20 bp, Artificial Sequence
  chemically synthesized
gtatgatcattttaataaac

SEQ ID NO: 534650 - DNA, 20 bp, Artificial Sequence
  chemically synthesized
caaaattcaacatcctttta

SEQ ID NO: 534651 - DNA, 20 bp, Artificial Sequence
  chemically synthesized
ctcttagcaaattaggtata

SEQ ID NO: 534652 - DNA, 20 bp, Artificial Sequence
  chemically synthesized
tatagaagaaatgttctcca

SEQ ID NO: 534653 - DNA, 20 bp, Artificial Sequence
  chemically synthesized
tttgtcttgctcctgatctt

SEQ ID NO: 534654 - DNA, 20 bp, Artificial Sequence
  chemically synthesized
ctagccagagcaattaggca

SEQ ID NO: 534655 - DNA, 20 bp, Artificial Sequence
  chemically synthesized
ccagagcaattaggcaggag

SEQ ID NO: 534656 - DNA, 20 bp, Artificial Sequence
  chemically synthesized
aaggactccactgaaaactg

SEQ ID NO: 534657 - DNA, 20 bp, Artificial Sequence
  chemically synthesized
ataacaacaaactgtctaaa

SEQ ID NO: 534658 - DNA, 20 bp, Artificial Sequence
  chemically synthesized
atatttggagtgaatttaac

SEQ ID NO: 534659 - DNA, 20 bp, Artificial Sequence
  chemically synthesized
gaaactataagacactgacg

SEQ ID NO: 534660 - DNA, 20 bp, Artificial Sequence
  chemically synthesized
aatttttccaatttatgaac

SEQ ID NO: 534661 - DNA, 20 bp, Artificial Sequence
  chemically synthesized
aaatctgcatattgttcttt

SEQ ID NO: 534662 - DNA, 20 bp, Artificial Sequence
  chemically synthesized
gccaaagctgtctttactaa

SEQ ID NO: 534663 - DNA, 20 bp, Artificial Sequence
  chemically synthesized
ggaaaactgaatgttcacat

SEQ ID NO: 534664 - DNA, 20 bp, Artificial Sequence
  chemically synthesized
cccttatctcaccccttata

SEQ ID NO: 534665 - DNA, 20 bp, Artificial Sequence
  chemically synthesized
ttgtgtttgggggtcatatg

SEQ ID NO: 534666 - DNA, 20 bp, Artificial Sequence
  chemically synthesized
gaactcaagctactcaataa

SEQ ID NO: 534667 - DNA, 20 bp, Artificial Sequence
  chemically synthesized
atatgctgtttgtcatcttt

SEQ ID NO: 534668 - DNA, 20 bp, Artificial Sequence
  chemically synthesized
acaagtgttcatgaggatac

SEQ ID NO: 534669 - DNA, 20 bp, Artificial Sequence
  chemically synthesized
tcattctctttttattattt

SEQ ID NO: 534670 - DNA, 20 bp, Artificial Sequence
  chemically synthesized
tgtttctcaaaataataaaa

SEQ ID NO: 534671 - DNA, 20 bp, Artificial Sequence
  chemically synthesized
aaagagaatgaccatatgtt

SEQ ID NO: 534672 - DNA, 20 bp, Artificial Sequence
  chemically synthesized
cacttctgggtacatactca

SEQ ID NO: 534673 - DNA, 20 bp, Artificial Sequence
  chemically synthesized
ccatcaacatgcgaatggat

SEQ ID NO: 534674 - DNA, 20 bp, Artificial Sequence
  chemically synthesized
cggtactatttagcaataaa

SEQ ID NO: 534675 - DNA, 20 bp, Artificial Sequence
  chemically synthesized
aaactattgaactcatggag

SEQ ID NO: 534676 - DNA, 20 bp, Artificial Sequence
  chemically synthesized
ttagcggctacaaaaaatag

SEQ ID NO: 534677 - DNA, 20 bp, Artificial Sequence
  chemically synthesized
cggctacaaaaaatagttag

SEQ ID NO: 534678 - DNA, 20 bp, Artificial Sequence
  chemically synthesized
atgtgaaacaagcacatcat

SEQ ID NO: 534679 - DNA, 20 bp, Artificial Sequence
  chemically synthesized
catccttattattccaaatg

SEQ ID NO: 534680 - DNA, 20 bp, Artificial Sequence
  chemically synthesized
gtttaaaaaaagttgaactc

SEQ ID NO: 534681 - DNA, 20 bp, Artificial Sequence
  chemically synthesized
aatacttctcatttttgtgg

SEQ ID NO: 534682 - DNA, 20 bp, Artificial Sequence
  chemically synthesized
cactcccaggtgtatatcca

SEQ ID NO: 534683 - DNA, 20 bp, Artificial Sequence
  chemically synthesized
tgatagcatggctatggatt

SEQ ID NO: 534684 - DNA, 20 bp, Artificial Sequence
  chemically synthesized
tttacacatgttgatataga

SEQ ID NO: 534685 - DNA, 20 bp, Artificial Sequence
  chemically synthesized
gtaaatacactgtggtatca

SEQ ID NO: 534686 - DNA, 20 bp, Artificial Sequence
  chemically synthesized
atcaatagaatattattcag

SEQ ID NO: 534687 - DNA, 20 bp, Artificial Sequence
  chemically synthesized
cacaaaaacaggaaaaagta

SEQ ID NO: 534688 - DNA, 20 bp, Artificial Sequence
  chemically synthesized
tgtgtaaatagcatccaaat

SEQ ID NO: 534689 - DNA, 20 bp, Artificial Sequence
  chemically synthesized
tacacagttgcattctattt

SEQ ID NO: 534690 - DNA, 20 bp, Artificial Sequence
  chemically synthesized
agaagagtgaatttctataa

SEQ ID NO: 534691 - DNA, 20 bp, Artificial Sequence
  chemically synthesized
tgaattgtccaaagttgtat

SEQ ID NO: 534692 - DNA, 20 bp, Artificial Sequence
  chemically synthesized
aaaatcgtattgtgtttgta

SEQ ID NO: 534693 - DNA, 20 bp, Artificial Sequence
  chemically synthesized
ttgatgtgacaaagaacatt

SEQ ID NO: 534694 - DNA, 20 bp, Artificial Sequence
  chemically synthesized
tagtccagttcactgtccaa

SEQ ID NO: 534695 - DNA, 20 bp, Artificial Sequence
  chemically synthesized
tttgtttcttttattaaata

SEQ ID NO: 534696 - DNA, 20 bp, Artificial Sequence
  chemically synthesized
agctattctgctatttaata

SEQ ID NO: 534697 - DNA, 20 bp, Artificial Sequence
  chemically synthesized
tagtcccaagagtagaccct

SEQ ID NO: 534698 - DNA, 20 bp, Artificial Sequence
  chemically synthesized
actgagcatcaatttatact

SEQ ID NO: 534699 - DNA, 20 bp, Artificial Sequence
  chemically synthesized
ctttccatgacggacctttg

SEQ ID NO: 534700 - DNA, 20 bp, Artificial Sequence
  chemically synthesized
gtcaagaaccacaatattgc

SEQ ID NO: 534701 - DNA, 20 bp, Artificial Sequence
  chemically synthesized
agaaccacaatattgcagag

SEQ ID NO: 534702 - DNA, 20 bp, Artificial Sequence
  chemically synthesized
ttgtgggaatttatatcagt

SEQ ID NO: 534703 - DNA, 20 bp, Artificial Sequence
  chemically synthesized
ggaggaatgttatttataca

SEQ ID NO: 534704 - DNA, 20 bp, Artificial Sequence
  chemically synthesized
tctcgtgctgtacagtcagt

SEQ ID NO: 534705 - DNA, 20 bp, Artificial Sequence
  chemically synthesized
tctgcactgactgtacagca

SEQ ID NO: 534706 - DNA, 20 bp, Artificial Sequence
  chemically synthesized
gaagtctgtgtaactgattt

SEQ ID NO: 534707 - DNA, 20 bp, Artificial Sequence
  chemically synthesized
ataatgacaactgcagaacc

SEQ ID NO: 534708 - DNA, 20 bp, Artificial Sequence
  chemically synthesized
agagtacgccagagttccag

SEQ ID NO: 534709 - DNA, 20 bp, Artificial Sequence
  chemically synthesized
tcctgatcccaacaaatagt

SEQ ID NO: 534710 - DNA, 20 bp, Artificial Sequence
  chemically synthesized
ttgttgggatcaggaaaaag

SEQ ID NO: 534711 - DNA, 20 bp, Artificial Sequence
  chemically synthesized
caaaaaatgttaggcatgat

SEQ ID NO: 534712 - DNA, 20 bp, Artificial Sequence
  chemically synthesized
caactcaaacccacaaagag

SEQ ID NO: 534713 - DNA, 20 bp, Artificial Sequence
  chemically synthesized
gcattttttttcacttagat

SEQ ID NO: 534714 - DNA, 20 bp, Artificial Sequence
  chemically synthesized
aatgtggttgttttacaaat

SEQ ID NO: 534715 - DNA, 20 bp, Artificial Sequence
  chemically synthesized
attctagctttttgggattt

SEQ ID NO: 534716 - DNA, 20 bp, Artificial Sequence
  chemically synthesized
tttctctaaatcccaaaaag

SEQ ID NO: 534717 - DNA, 20 bp, Artificial Sequence
  chemically synthesized
aaatcccaaaaagctagaat

SEQ ID NO: 534718 - DNA, 20 bp, Artificial Sequence
  chemically synthesized
ctattatatggggataataa

SEQ ID NO: 534719 - DNA, 20 bp, Artificial Sequence
  chemically synthesized
ataacaagaaaattaataat

SEQ ID NO: 534720 - DNA, 20 bp, Artificial Sequence
  chemically synthesized
aaataatgtacacaaggcac

SEQ ID NO: 534721 - DNA, 20 bp, Artificial Sequence
  chemically synthesized
gactcaggatttaagaagcc

SEQ ID NO: 534722 - DNA, 20 bp, Artificial Sequence
  chemically synthesized
ttcagctctgacagaggcat

SEQ ID NO: 534723 - DNA, 20 bp, Artificial Sequence
  chemically synthesized
tgtggcaaaatttgtataga

SEQ ID NO: 534724 - DNA, 20 bp, Artificial Sequence
  chemically synthesized
ttgccacaaacaaacaaaca

SEQ ID NO: 534725 - DNA, 20 bp, Artificial Sequence
  chemically synthesized
ccaacttactttgaagggca

SEQ ID NO: 534726 - DNA, 20 bp, Artificial Sequence
  chemically synthesized
aataataggggttggcgggt

SEQ ID NO: 534727 - DNA, 20 bp, Artificial Sequence
  chemically synthesized
ttcaaatacacagaaagctg

SEQ ID NO: 534728 - DNA, 20 bp, Artificial Sequence
  chemically synthesized
ttttaaaatttttcaaatac

SEQ ID NO: 534729 - DNA, 20 bp, Artificial Sequence
  chemically synthesized
tgtatttgaaaaattttaaa

SEQ ID NO: 534730 - DNA, 20 bp, Artificial Sequence
  chemically synthesized
ctactcgggaggctgaggca

SEQ ID NO: 534731 - DNA, 20 bp, Artificial Sequence
  chemically synthesized
aaaaaaaaaaaaattctctc

SEQ ID NO: 534732 - DNA, 20 bp, Artificial Sequence
  chemically synthesized
actgctttgtgttttctgtg

SEQ ID NO: 534733 - DNA, 20 bp, Artificial Sequence
  chemically synthesized
tggaaagtggtgttagtgat

SEQ ID NO: 534734 - DNA, 20 bp, Artificial Sequence
  chemically synthesized
cactaacaccactttccaat

SEQ ID NO: 534735 - DNA, 20 bp, Artificial Sequence
  chemically synthesized
ggtctttgacagtctgttga

SEQ ID NO: 534736 - DNA, 20 bp, Artificial Sequence
  chemically synthesized
agtatgctgaatattctaat

SEQ ID NO: 534737 - DNA, 20 bp, Artificial Sequence
  chemically synthesized
aggttaactcattttctcta

SEQ ID NO: 534738 - DNA, 20 bp, Artificial Sequence
  chemically synthesized
agaaaatgagttaaccttct

SEQ ID NO: 534739 - DNA, 20 bp, Artificial Sequence
  chemically synthesized
tatgttttattaccaaaaca

SEQ ID NO: 534740 - DNA, 20 bp, Artificial Sequence
  chemically synthesized
aagatgaaagcctgaagtta

SEQ ID NO: 534741 - DNA, 20 bp, Artificial Sequence
  chemically synthesized
tcttaggtcacttacaagtc

SEQ ID NO: 534742 - DNA, 20 bp, Artificial Sequence
  chemically synthesized
ggtcacttacaagtcacaga

SEQ ID NO: 534743 - DNA, 20 bp, Artificial Sequence
  chemically synthesized
atggtaataaatctgtggtg

SEQ ID NO: 534744 - DNA, 20 bp, Artificial Sequence
  chemically synthesized
ataaatatttttaaaatcat

SEQ ID NO: 534745 - DNA, 20 bp, Artificial Sequence
  chemically synthesized
gaaattcagtgtgtgctaag

SEQ ID NO: 534746 - DNA, 20 bp, Artificial Sequence
  chemically synthesized
tcaacttttacttgatgagt

SEQ ID NO: 534747 - DNA, 20 bp, Artificial Sequence
  chemically synthesized
caccatccaactattcaagt

SEQ ID NO: 534748 - DNA, 20 bp, Artificial Sequence
  chemically synthesized
aatggaaaacaatttcttga

SEQ ID NO: 534749 - DNA, 20 bp, Artificial Sequence
  chemically synthesized
ttttagccatagtttctgtt

SEQ ID NO: 534750 - DNA, 20 bp, Artificial Sequence
  chemically synthesized
aggtaaggaagaattgaaat

SEQ ID NO: 534751 - DNA, 20 bp, Artificial Sequence
  chemically synthesized
tctgaagagaaggaggtaag

SEQ ID NO: 534752 - DNA, 20 bp, Artificial Sequence
  chemically synthesized
tacaaccatgtttattttaa

SEQ ID NO: 534753 - DNA, 20 bp, Artificial Sequence
  chemically synthesized
cagcatcacctgataacttg

SEQ ID NO: 534754 - DNA, 20 bp, Artificial Sequence
  chemically synthesized
cctgataacttgttagaaat

SEQ ID NO: 534755 - DNA, 20 bp, Artificial Sequence
  chemically synthesized
agtgaggagtggccaaatag

SEQ ID NO: 534756 - DNA, 20 bp, Artificial Sequence
  chemically synthesized
tacatacatgaactcaccag

SEQ ID NO: 534757 - DNA, 20 bp, Artificial Sequence
  chemically synthesized
gtaaaatctgtgttttaagc

SEQ ID NO: 534758 - DNA, 20 bp, Artificial Sequence
  chemically synthesized
tatcagtgattaggggagag

SEQ ID NO: 534759 - DNA, 20 bp, Artificial Sequence
  chemically synthesized
tcctctacttagtcactgaa

SEQ ID NO: 534760 - DNA, 20 bp, Artificial Sequence
  chemically synthesized
gttaaagtataaggaagaaa

SEQ ID NO: 534761 - DNA, 20 bp, Artificial Sequence
  chemically synthesized
cttcttggttaaagtataag

SEQ ID NO: 534762 - DNA, 20 bp, Artificial Sequence
  chemically synthesized
ttctcatccctggctgcacg

SEQ ID NO: 534763 - DNA, 20 bp, Artificial Sequence
  chemically synthesized
ctactcaggaggctgaggca

SEQ ID NO: 534764 - DNA, 20 bp, Artificial Sequence
  chemically synthesized
aggcagcagaagccaagaaa

SEQ ID NO: 534765 - DNA, 20 bp, Artificial Sequence
  chemically synthesized
tcacaacaggcagcagaagc

SEQ ID NO: 534766 - DNA, 20 bp, Artificial Sequence
  chemically synthesized
gcagagagcattgtaggcag

SEQ ID NO: 534767 - DNA, 20 bp, Artificial Sequence
  chemically synthesized
ttaagttcttggttatgact

SEQ ID NO: 534768 - DNA, 20 bp, Artificial Sequence
  chemically synthesized
gcttttctggagaagcattt

SEQ ID NO: 534769 - DNA, 20 bp, Artificial Sequence
  chemically synthesized
tgatttcttcaaatgcttct

SEQ ID NO: 534770 - DNA, 20 bp, Artificial Sequence
  chemically synthesized
tagtatgtatgttaaatgaa

SEQ ID NO: 534771 - DNA, 20 bp, Artificial Sequence
  chemically synthesized
tattttagactaaaatgctg

SEQ ID NO: 534772 - DNA, 20 bp, Artificial Sequence
  chemically synthesized
tggggattattggaacgagg

SEQ ID NO: 534773 - DNA, 20 bp, Artificial Sequence
  chemically synthesized
tagatttttaggataagtca

SEQ ID NO: 534774 - DNA, 20 bp, Artificial Sequence
  chemically synthesized
atcataactatacatccaga

SEQ ID NO: 534775 - DNA, 20 bp, Artificial Sequence
  chemically synthesized
tatggctacgaaatacagga

SEQ ID NO: 534776 - DNA, 20 bp, Artificial Sequence
  chemically synthesized
taaagggaaattctcctgaa

SEQ ID NO: 534777 - DNA, 20 bp, Artificial Sequence
  chemically synthesized
actatgggaattctgtttca

SEQ ID NO: 534778 - DNA, 20 bp, Artificial Sequence
  chemically synthesized
gctattctgtatcttatttt

SEQ ID NO: 534779 - DNA, 20 bp, Artificial Sequence
  chemically synthesized
tattttctttaaaataagat

SEQ ID NO: 534780 - DNA, 20 bp, Artificial Sequence
  chemically synthesized
ctctttatttattaaagaac

SEQ ID NO: 534781 - DNA, 20 bp, Artificial Sequence
  chemically synthesized
ctcaattatgtaatttactt

SEQ ID NO: 534782 - DNA, 20 bp, Artificial Sequence
  chemically synthesized
aattaaaaggaaaaactaaa

SEQ ID NO: 534783 - DNA, 20 bp, Artificial Sequence
  chemically synthesized
gaggggagggcaaaaaagat

SEQ ID NO: 534784 - DNA, 20 bp, Artificial Sequence
  chemically synthesized
gtgggtggtagatggaaaga

SEQ ID NO: 534785 - DNA, 20 bp, Artificial Sequence
  chemically synthesized
gcccaagttcttccctctgc

SEQ ID NO: 534786 - DNA, 20 bp, Artificial Sequence
  chemically synthesized
tttcatctttttcctgcaag

SEQ ID NO: 534787 - DNA, 20 bp, Artificial Sequence
  chemically synthesized
tcaaataactcaaagtcaag

SEQ ID NO: 534788 - DNA, 20 bp, Artificial Sequence
  chemically synthesized
atttgagataaataagtaag

SEQ ID NO: 534789 - DNA, 20 bp, Artificial Sequence
  chemically synthesized
tttattttttagactatgat

SEQ ID NO: 534790 - DNA, 20 bp, Artificial Sequence
  chemically synthesized
aattataattccacattcaa

SEQ ID NO: 534791 - DNA, 20 bp, Artificial Sequence
  chemically synthesized
cagagcttctgccttgaaag

SEQ ID NO: 534792 - DNA, 20 bp, Artificial Sequence
  chemically synthesized
gctgacaagagattggatgt

SEQ ID NO: 534793 - DNA, 20 bp, Artificial Sequence
  chemically synthesized
gattggatgtaaagaaaatg

SEQ ID NO: 534794 - DNA, 20 bp, Artificial Sequence
  chemically synthesized
gactcagaagaagtagagaa

SEQ ID NO: 534795 - DNA, 20 bp, Artificial Sequence
  chemically synthesized
caaaaaaaaaatgctaaaag

SEQ ID NO: 534796 - DNA, 20 bp, Artificial Sequence
  chemically synthesized
aagatggcaggatttggaaa

SEQ ID NO: 534797 - DNA, 20 bp, Artificial Sequence
  chemically synthesized
gagtggtttttgtggaaatg

SEQ ID NO: 534798 - DNA, 20 bp, Artificial Sequence
  chemically synthesized
actaatgttggctccaatga

SEQ ID NO: 534799 - DNA, 20 bp, Artificial Sequence
  chemically synthesized
tagcaactgcttgccagcca

SEQ ID NO: 534800 - DNA, 20 bp, Artificial Sequence
  chemically synthesized
tgctatattgctcctgaaaa

SEQ ID NO: 534801 - DNA, 20 bp, Artificial Sequence
  chemically synthesized
aagagttgtgctgtgaagca

SEQ ID NO: 534802 - DNA, 20 bp, Artificial Sequence
  chemically synthesized
ttcagattgaaagaatccat

SEQ ID NO: 534803 - DNA, 20 bp, Artificial Sequence
  chemically synthesized
cccaaactgtattcagattg

SEQ ID NO: 534804 - DNA, 20 bp, Artificial Sequence
  chemically synthesized
cctcttgctaatgcctgtct

SEQ ID NO: 534805 - DNA, 20 bp, Artificial Sequence
  chemically synthesized
gcattagcaagaggttcaga

SEQ ID NO: 534806 - DNA, 20 bp, Artificial Sequence
  chemically synthesized
gcaagaggcagagatttagc

SEQ ID NO: 534807 - DNA, 20 bp, Artificial Sequence
  chemically synthesized
ttttttaatgttcaaagtaa

SEQ ID NO: 534808 - DNA, 20 bp, Artificial Sequence
  chemically synthesized
ctaaaagttgaaattaaaaa

SEQ ID NO: 534809 - DNA, 20 bp, Artificial Sequence
  chemically synthesized
acatagcttcaacaatgacc

SEQ ID NO: 534810 - DNA, 20 bp, Artificial Sequence
  chemically synthesized
ctttatctaactgtctgact

SEQ ID NO: 534811 - DNA, 20 bp, Artificial Sequence
  chemically synthesized
ttctttacttttccttccac

SEQ ID NO: 534812 - DNA, 20 bp, Artificial Sequence
  chemically synthesized
ttctatgtggaaggaaaagt

SEQ ID NO: 534813 - DNA, 20 bp, Artificial Sequence
  chemically synthesized
aaatttatatgttccagaca

SEQ ID NO: 534814 - DNA, 20 bp, Artificial Sequence
  chemically synthesized
tttcagctatcctgaaaaaa

SEQ ID NO: 534815 - DNA, 20 bp, Artificial Sequence
  chemically synthesized
tctgattcagtaagtttagg

SEQ ID NO: 534816 - DNA, 20 bp, Artificial Sequence
  chemically synthesized
cttggggtgtcattatctgt

SEQ ID NO: 534817 - DNA, 20 bp, Artificial Sequence
  chemically synthesized
cattgtgactcagaaatagc

SEQ ID NO: 534818 - DNA, 20 bp, Artificial Sequence
  chemically synthesized
gggtaataaaccattgtgac

SEQ ID NO: 534819 - DNA, 20 bp, Artificial Sequence
  chemically synthesized
aaaaacagagaaaaccagca

SEQ ID NO: 534820 - DNA, 20 bp, Artificial Sequence
  chemically synthesized
atcctaattttgtaaaaaac

SEQ ID NO: 534821 - DNA, 20 bp, Artificial Sequence
  chemically synthesized
ctattaaaacattaattttt

SEQ ID NO: 534822 - DNA, 20 bp, Artificial Sequence
  chemically synthesized
gaacagggatggaaactgag

SEQ ID NO: 534823 - DNA, 20 bp, Artificial Sequence
  chemically synthesized
gagcaagaaagaaagcagag

SEQ ID NO: 534824 - DNA, 20 bp, Artificial Sequence
  chemically synthesized
agaaagagagcaagagcaag

SEQ ID NO: 534825 - DNA, 20 bp, Artificial Sequence
  chemically synthesized
caaaagaaagagagcaagag

SEQ ID NO: 534826 - DNA, 20 bp, Artificial Sequence
  chemically synthesized
tgatttcaaaagtcttctca

SEQ ID NO: 534827 - DNA, 20 bp, Artificial Sequence
  chemically synthesized
gacttttgaaatcaaacttt

SEQ ID NO: 534828 - DNA, 20 bp, Artificial Sequence
  chemically synthesized
ctagctcatatgcagacatt

SEQ ID NO: 534829 - DNA, 20 bp, Artificial Sequence
  chemically synthesized
ctactcaggaggctgaggca

SEQ ID NO: 534830 - DNA, 20 bp, Artificial Sequence
  chemically synthesized
atcaatcaatcgagtcaaat

SEQ ID NO: 534831 - DNA, 20 bp, Artificial Sequence
  chemically synthesized
aattaccattttaatttaat

SEQ ID NO: 534832 - DNA, 20 bp, Artificial Sequence
  chemically synthesized
ttaatctagaaaaaataata

SEQ ID NO: 534833 - DNA, 20 bp, Artificial Sequence
  chemically synthesized
tagaaaaaataataatagaa

SEQ ID NO: 534834 - DNA, 20 bp, Artificial Sequence
  chemically synthesized
aaccaattcctgacccagat

SEQ ID NO: 534835 - DNA, 20 bp, Artificial Sequence
  chemically synthesized
gtgtgtgtgtggtgtgtcag

SEQ ID NO: 534836 - DNA, 20 bp, Artificial Sequence
  chemically synthesized
aatatgccatttagaactct

SEQ ID NO: 534837 - DNA, 20 bp, Artificial Sequence
  chemically synthesized
acatatatgtatacatagaa

SEQ ID NO: 534838 - DNA, 20 bp, Artificial Sequence
  chemically synthesized
atagaaacatatatgtatac

SEQ ID NO: 534839 - DNA, 20 bp, Artificial Sequence
  chemically synthesized
catagaagtagacatatata

SEQ ID NO: 534840 - DNA, 20 bp, Artificial Sequence
  chemically synthesized
aggctctaagtcctaacatt

SEQ ID NO: 534841 - DNA, 20 bp, Artificial Sequence
  chemically synthesized
cctaacattccagaaatttc

SEQ ID NO: 534842 - DNA, 20 bp, Artificial Sequence
  chemically synthesized
ttccagaaatttcaaagaaa

SEQ ID NO: 534843 - DNA, 20 bp, Artificial Sequence
  chemically synthesized
agaaatttcaaagaaactag

SEQ ID NO: 534844 - DNA, 20 bp, Artificial Sequence
  chemically synthesized
tttatcctattgtaattgca

SEQ ID NO: 534845 - DNA, 20 bp, Artificial Sequence
  chemically synthesized
cttcttatatccctattatg

SEQ ID NO: 534846 - DNA, 20 bp, Artificial Sequence
  chemically synthesized
cggacatcttgcttccaaca

SEQ ID NO: 534847 - DNA, 20 bp, Artificial Sequence
  chemically synthesized
tccgggaatggccagtaata

SEQ ID NO: 534848 - DNA, 20 bp, Artificial Sequence
  chemically synthesized
ttaaaaatattaatagaaac

SEQ ID NO: 534849 - DNA, 20 bp, Artificial Sequence
  chemically synthesized
agatgaccttaaaaatatta

SEQ ID NO: 534850 - DNA, 20 bp, Artificial Sequence
  chemically synthesized
attaatatttttaaggtcat

SEQ ID NO: 534851 - DNA, 20 bp, Artificial Sequence
  chemically synthesized
tgaaaggatgcttccttaag

SEQ ID NO: 534852 - DNA, 20 bp, Artificial Sequence
  chemically synthesized
atagattattgttcaaagtg

SEQ ID NO: 534853 - DNA, 20 bp, Artificial Sequence
  chemically synthesized
ggtttataaaccatttgaaa

SEQ ID NO: 534854 - DNA, 20 bp, Artificial Sequence
  chemically synthesized
ttaaaaataatcattaacct

SEQ ID NO: 534855 - DNA, 20 bp, Artificial Sequence
  chemically synthesized
tgcctgttaatattgaatgt

SEQ ID NO: 534856 - DNA, 20 bp, Artificial Sequence
  chemically synthesized
cattcaatattaacaggcat

SEQ ID NO: 534857 - DNA, 20 bp, Artificial Sequence
  chemically synthesized
gaggaaacattttgagaata

SEQ ID NO: 534858 - DNA, 20 bp, Artificial Sequence
  chemically synthesized
attctcctgaggaaacattt

SEQ ID NO: 534859 - DNA, 20 bp, Artificial Sequence
  chemically synthesized
attctcaaaatgtttcctca

SEQ ID NO: 534860 - DNA, 20 bp, Artificial Sequence
  chemically synthesized
gatgggagggggtacataaa

SEQ ID NO: 534861 - DNA, 20 bp, Artificial Sequence
  chemically synthesized
catattgcaatgtaaagcat

SEQ ID NO: 534862 - DNA, 20 bp, Artificial Sequence
  chemically synthesized
gcctattggatttcacacgt

SEQ ID NO: 534863 - DNA, 20 bp, Artificial Sequence
  chemically synthesized
cttatatcacaatacacagt

SEQ ID NO: 534864 - DNA, 20 bp, Artificial Sequence
  chemically synthesized
gtttagaatggaaaacaaat

SEQ ID NO: 534865 - DNA, 20 bp, Artificial Sequence
  chemically synthesized
acaaatatagaaatcagagt

SEQ ID NO: 534866 - DNA, 20 bp, Artificial Sequence
  chemically synthesized
acagatgaggaaaagaagat

SEQ ID NO: 534867 - DNA, 20 bp, Artificial Sequence
  chemically synthesized
tggtcttgaagcatatttct

SEQ ID NO: 534868 - DNA, 20 bp, Artificial Sequence
  chemically synthesized
atacagatacttgatattct

SEQ ID NO: 534869 - DNA, 20 bp, Artificial Sequence
  chemically synthesized
ttatttaaaaataattattc

SEQ ID NO: 534870 - DNA, 20 bp, Artificial Sequence
  chemically synthesized
gaaggatatgactggatatt

SEQ ID NO: 534871 - DNA, 20 bp, Artificial Sequence
  chemically synthesized
agtaggttgacagagcctcc

SEQ ID NO: 534872 - DNA, 20 bp, Artificial Sequence
  chemically synthesized
gaccccatagctaaagataa

SEQ ID NO: 534873 - DNA, 20 bp, Artificial Sequence
  chemically synthesized
atttatacattttatgaatt

SEQ ID NO: 534874 - DNA, 20 bp, Artificial Sequence
  chemically synthesized
taatcaggacttatgctgtg

SEQ ID NO: 534875 - DNA, 20 bp, Artificial Sequence
  chemically synthesized
ctttgtttccttaatgatga

SEQ ID NO: 534876 - DNA, 20 bp, Artificial Sequence
  chemically synthesized
tccatatcgagacattaaaa

SEQ ID NO: 534877 - DNA, 20 bp, Artificial Sequence
  chemically synthesized
tccatcctcttctaattgag

SEQ ID NO: 534878 - DNA, 20 bp, Artificial Sequence
  chemically synthesized
tggtagagaagactagcaag

SEQ ID NO: 534879 - DNA, 20 bp, Artificial Sequence
  chemically synthesized
cccattaacccttgttaggg

SEQ ID NO: 534880 - DNA, 20 bp, Artificial Sequence
  chemically synthesized
gtggaagaagaagaaggggt

SEQ ID NO: 534881 - DNA, 20 bp, Artificial Sequence
  chemically synthesized
agtgacagtactgagtgaag

SEQ ID NO: 534882 - DNA, 20 bp, Artificial Sequence
  chemically synthesized
cccagaagtgatatttgaca

SEQ ID NO: 534883 - DNA, 20 bp, Artificial Sequence
  chemically synthesized
gaggctggatcttaaaactg

SEQ ID NO: 534884 - DNA, 20 bp, Artificial Sequence
  chemically synthesized
aagaaaaatgaaagtacaaa

SEQ ID NO: 534885 - DNA, 20 bp, Artificial Sequence
  chemically synthesized
cataaattagaggtacaagc

SEQ ID NO: 534886 - DNA, 20 bp, Artificial Sequence
  chemically synthesized
tccctagattatcaacttct

SEQ ID NO: 534887 - DNA, 20 bp, Artificial Sequence
  chemically synthesized
attacagtgtttattattag

SEQ ID NO: 534888 - DNA, 20 bp, Artificial Sequence
  chemically synthesized
agtaaggatctaatttacac

SEQ ID NO: 534889 - DNA, 20 bp, Artificial Sequence
  chemically synthesized
tctcatctattctgtctcta

SEQ ID NO: 534890 - DNA, 20 bp, Artificial Sequence
  chemically synthesized
ttgacccttttctaatagag

SEQ ID NO: 534891 - DNA, 20 bp, Artificial Sequence
  chemically synthesized
acctagattaagaacagtac

SEQ ID NO: 534892 - DNA, 20 bp, Artificial Sequence
  chemically synthesized
ttatgtccatatgtgatttg

SEQ ID NO: 534893 - DNA, 20 bp, Artificial Sequence
  chemically synthesized
gcacagtgcactgatatact

SEQ ID NO: 534894 - DNA, 20 bp, Artificial Sequence
  chemically synthesized
gtccaatttagcatactaaa

SEQ ID NO: 534895 - DNA, 20 bp, Artificial Sequence
  chemically synthesized
ataaagttgattttgtaaaa

SEQ ID NO: 534896 - DNA, 20 bp, Artificial Sequence
  chemically synthesized
actttaaatatgtttttgac

SEQ ID NO: 534897 - DNA, 20 bp, Artificial Sequence
  chemically synthesized
tagcttgttgacgtatatat

SEQ ID NO: 534898 - DNA, 20 bp, Artificial Sequence
  chemically synthesized
atatcaacatgtggcaacta

SEQ ID NO: 534899 - DNA, 20 bp, Artificial Sequence
  chemically synthesized
acctgttgtccctaggagaa

SEQ ID NO: 534900 - DNA, 20 bp, Artificial Sequence
  chemically synthesized
aacttaagacaaaatgggaa

SEQ ID NO: 534901 - DNA, 20 bp, Artificial Sequence
  chemically synthesized
ctcaaaaaacatcatggtaa

SEQ ID NO: 534902 - DNA, 20 bp, Artificial Sequence
  chemically synthesized
aaacatcatggtaataagaa

SEQ ID NO: 534903 - DNA, 20 bp, Artificial Sequence
  chemically synthesized
ctacacgggaggctgaggca

SEQ ID NO: 534904 - DNA, 20 bp, Artificial Sequence
  chemically synthesized
aaaatggaaatgaaatgtat

SEQ ID NO: 534905 - DNA, 20 bp, Artificial Sequence
  chemically synthesized
agttcacatacctcatcctt

SEQ ID NO: 534906 - DNA, 20 bp, Artificial Sequence
  chemically synthesized
gaaaagcaaacaaaaagcca

SEQ ID NO: 534907 - DNA, 20 bp, Artificial Sequence
  chemically synthesized
gttattttcagaacaagatg

SEQ ID NO: 534908 - DNA, 20 bp, Artificial Sequence
  chemically synthesized
aggcgaaacatatactacat

SEQ ID NO: 534909 - DNA, 20 bp, Artificial Sequence
  chemically synthesized
aacttacagatgtggcaaca

SEQ ID NO: 534910 - DNA, 20 bp, Artificial Sequence
  chemically synthesized
gagaccagcctgaccaacat

SEQ ID NO: 534911 - DNA, 20 bp, Artificial Sequence
  chemically synthesized
ctactcagatggctgaggca

SEQ ID NO: 534912 - DNA, 20 bp, Artificial Sequence
  chemically synthesized
aaaataatgtttagcccgtt

SEQ ID NO: 534913 - DNA, 20 bp, Artificial Sequence
  chemically synthesized
acattattttgcttaaaggc

SEQ ID NO: 534914 - DNA, 20 bp, Artificial Sequence
  chemically synthesized
ggcatagaaattaatgcctc

SEQ ID NO: 534915 - DNA, 20 bp, Artificial Sequence
  chemically synthesized
tatctacatgcatgagtata

SEQ ID NO: 534916 - DNA, 20 bp, Artificial Sequence
  chemically synthesized
ctttcagcataggtttgggg

SEQ ID NO: 534917 - DNA, 20 bp, Artificial Sequence
  chemically synthesized
tacccatctaacacctattt

SEQ ID NO: 534918 - DNA, 20 bp, Artificial Sequence
  chemically synthesized
aaaacatgttccagggaact

SEQ ID NO: 534919 - DNA, 20 bp, Artificial Sequence
  chemically synthesized
ttggttgccctgccagacat

SEQ ID NO: 534920 - DNA, 20 bp, Artificial Sequence
  chemically synthesized
tttaagagacatagcaataa

SEQ ID NO: 534921 - DNA, 20 bp, Artificial Sequence
  chemically synthesized
atttacaaattcttgtaatc

SEQ ID NO: 534922 - DNA, 20 bp, Artificial Sequence
  chemically synthesized
gggaattctttctatgatta

SEQ ID NO: 534923 - DNA, 20 bp, Artificial Sequence
  chemically synthesized
acaaattcttgtaatcatag

SEQ ID NO: 534924 - DNA, 20 bp, Artificial Sequence
  chemically synthesized
acacctttctctgtaattaa

SEQ ID NO: 534925 - DNA, 20 bp, Artificial Sequence
  chemically synthesized
acacttttctgtttaattac

SEQ ID NO: 534926 - DNA, 20 bp, Artificial Sequence
  chemically synthesized
caagtctcaaatgcacagaa

SEQ ID NO: 534927 - DNA, 20 bp, Artificial Sequence
  chemically synthesized
taaaatcaagtctcaaatgc

SEQ ID NO: 534928 - DNA, 20 bp, Artificial Sequence
  chemically synthesized
gaaaattgtctgttcaaaca

SEQ ID NO: 534929 - DNA, 20 bp, Artificial Sequence
  chemically synthesized
agtccttgattcacttgtta

SEQ ID NO: 534930 - DNA, 20 bp, Artificial Sequence
  chemically synthesized
ccctgggccacagctggctc

SEQ ID NO: 534931 - DNA, 20 bp, Artificial Sequence
  chemically synthesized
ttccatggttcctgtatgaa

SEQ ID NO: 534932 - DNA, 20 bp, Artificial Sequence
  chemically synthesized
agtaattggaaacactgaaa

SEQ ID NO: 534933 - DNA, 20 bp, Artificial Sequence
  chemically synthesized
taagataaagcaaaatgtat

SEQ ID NO: 534934 - DNA, 20 bp, Artificial Sequence
  chemically synthesized
tttgctttatcttaatattg

SEQ ID NO: 534935 - DNA, 20 bp, Artificial Sequence
  chemically synthesized
agcatttcatttattcattc

SEQ ID NO: 534936 - DNA, 20 bp, Artificial Sequence
  chemically synthesized
cagaatttttagaacttgct

SEQ ID NO: 534937 - DNA, 20 bp, Artificial Sequence
  chemically synthesized
aactgttctaatgtctatgc

SEQ ID NO: 534938 - DNA, 20 bp, Artificial Sequence
  chemically synthesized
gagtaaaaaaattttcacat

SEQ ID NO: 534939 - DNA, 20 bp, Artificial Sequence
  chemically synthesized
atatttggaggtggggcctt

SEQ ID NO: 534940 - DNA, 20 bp, Artificial Sequence
  chemically synthesized
caggatcccagttttacaga

SEQ ID NO: 534941 - DNA, 20 bp, Artificial Sequence
  chemically synthesized
gctgttactactatattact

SEQ ID NO: 534942 - DNA, 20 bp, Artificial Sequence
  chemically synthesized
ttactaaagaaataaaggcc

SEQ ID NO: 534943 - DNA, 20 bp, Artificial Sequence
  chemically synthesized
tcctgacttctagttttata

SEQ ID NO: 534944 - DNA, 20 bp, Artificial Sequence
  chemically synthesized
tagtatagctttcctctaat

SEQ ID NO: 534945 - DNA, 20 bp, Artificial Sequence
  chemically synthesized
ctttcctctaatccagaaat

SEQ ID NO: 534946 - DNA, 20 bp, Artificial Sequence
  chemically synthesized
atgttagtgagataaataca

SEQ ID NO: 534947 - DNA, 20 bp, Artificial Sequence
  chemically synthesized
atggaaaatatgggtattgt

SEQ ID NO: 534948 - DNA, 20 bp, Artificial Sequence
  chemically synthesized
tggtgggttcttgtttcttt

SEQ ID NO: 534949 - DNA, 20 bp, Artificial Sequence
  chemically synthesized
acatgtgtttttgtttcttg

SEQ ID NO: 534950 - DNA, 20 bp, Artificial Sequence
  chemically synthesized
catgtgtacaggaaacacgt

SEQ ID NO: 534951 - DNA, 20 bp, Artificial Sequence
  chemically synthesized
aagcaacatgggatcatgtt

SEQ ID NO: 534952 - DNA, 20 bp, Artificial Sequence
  chemically synthesized
ctcggctttccccttttcat

SEQ ID NO: 534953 - DNA, 20 bp, Artificial Sequence
  chemically synthesized
ttttacttaagacaagtaca

SEQ ID NO: 534954 - DNA, 20 bp, Artificial Sequence
  chemically synthesized
atgtataagtaaattttggt

SEQ ID NO: 534955 - DNA, 20 bp, Artificial Sequence
  chemically synthesized
atgctctcagctctcaagtt

SEQ ID NO: 534956 - DNA, 20 bp, Artificial Sequence
  chemically synthesized
cccacaggtaccaaaatata

SEQ ID NO: 534957 - DNA, 20 bp, Artificial Sequence
  chemically synthesized
aaatacaaacagagatgagc

SEQ ID NO: 534958 - DNA, 20 bp, Artificial Sequence
  chemically synthesized
tgattatgagtaaatatatt

SEQ ID NO: 534959 - DNA, 20 bp, Artificial Sequence
  chemically synthesized
tcatctttatcacaaaaaag

SEQ ID NO: 534960 - DNA, 20 bp, Artificial Sequence
  chemically synthesized
attaaataaataaaccaatt

SEQ ID NO: 534961 - DNA, 20 bp, Artificial Sequence
  chemically synthesized
acccagatctttccccttaa

SEQ ID NO: 534962 - DNA, 20 bp, Artificial Sequence
  chemically synthesized
aatgaagacaaaaacaatta

SEQ ID NO: 534963 - DNA, 20 bp, Artificial Sequence
  chemically synthesized
taatttaacacaacgtatag

SEQ ID NO: 534964 - DNA, 20 bp, Artificial Sequence
  chemically synthesized
ctggaaatatacgttaaata

SEQ ID NO: 534965 - DNA, 20 bp, Artificial Sequence
  chemically synthesized
gaaccacgagatttatatgt

SEQ ID NO: 534966 - DNA, 20 bp, Artificial Sequence
  chemically synthesized
aatcaattttgaagtcctta

SEQ ID NO: 534967 - DNA, 20 bp, Artificial Sequence
  chemically synthesized
aagagaaaagactgaagtcc

SEQ ID NO: 534968 - DNA, 20 bp, Artificial Sequence
  chemically synthesized
agtccaaaggtaatccgata

SEQ ID NO: 534969 - DNA, 20 bp, Artificial Sequence
  chemically synthesized
ttcaccattatcattagagt

SEQ ID NO: 534970 - DNA, 20 bp, Artificial Sequence
  chemically synthesized
tgcacaatatatttctaatg

SEQ ID NO: 534971 - DNA, 20 bp, Artificial Sequence
  chemically synthesized
atcatatttcctttctgtca

SEQ ID NO: 534972 - DNA, 20 bp, Artificial Sequence
  chemically synthesized
tcaccacataatattagctg

SEQ ID NO: 534973 - DNA, 20 bp, Artificial Sequence
  chemically synthesized
ataaataaataaataataaa

SEQ ID NO: 534974 - DNA, 20 bp, Artificial Sequence
  chemically synthesized
ctactcgggaggctgaggca

SEQ ID NO: 534975 - DNA, 20 bp, Artificial Sequence
  chemically synthesized
aatcttatgagaaattttaa

SEQ ID NO: 534976 - DNA, 20 bp, Artificial Sequence
  chemically synthesized
gatagtgaaagacaatctta

SEQ ID NO: 534977 - DNA, 20 bp, Artificial Sequence
  chemically synthesized
actatctctttatacttcca

SEQ ID NO: 534978 - DNA, 20 bp, Artificial Sequence
  chemically synthesized
ctggtatactgagggctgca

SEQ ID NO: 534979 - DNA, 20 bp, Artificial Sequence
  chemically synthesized
aatgataccatgaataaagt

SEQ ID NO: 534980 - DNA, 20 bp, Artificial Sequence
  chemically synthesized
acttgaatggttgtacagca

SEQ ID NO: 534981 - DNA, 20 bp, Artificial Sequence
  chemically synthesized
ctactcggtaggctgaggca

SEQ ID NO: 534982 - DNA, 20 bp, Artificial Sequence
  chemically synthesized
agagagagggtacctggtgc

SEQ ID NO: 534983 - DNA, 20 bp, Artificial Sequence
  chemically synthesized
ggagtgatgttacttttgga

SEQ ID NO: 534984 - DNA, 20 bp, Artificial Sequence
  chemically synthesized
gatgaccatactgagatttt

SEQ ID NO: 534985 - DNA, 20 bp, Artificial Sequence
  chemically synthesized
ggttatgacattaatcttcc

SEQ ID NO: 534986 - DNA, 20 bp, Artificial Sequence
  chemically synthesized
aattgagacataaggtggag

SEQ ID NO: 534987 - DNA, 20 bp, Artificial Sequence
  chemically synthesized
gagcagtgaccatggagtaa

SEQ ID NO: 534988 - DNA, 20 bp, Artificial Sequence
  chemically synthesized
tatttcaggaattgatgaca

SEQ ID NO: 534989 - DNA, 20 bp, Artificial Sequence
  chemically synthesized
agcagtattacaaaatgttg

SEQ ID NO: 534990 - DNA, 20 bp, Artificial Sequence
  chemically synthesized
ggggagaatgttcttctgta

SEQ ID NO: 534991 - DNA, 20 bp, Artificial Sequence
  chemically synthesized
gtatacagggccatagaagg

SEQ ID NO: 534992 - DNA, 20 bp, Artificial Sequence
  chemically synthesized
tagtgatagcttataaattt

SEQ ID NO: 534993 - DNA, 20 bp, Artificial Sequence
  chemically synthesized
aagctatcactaaatttctc

SEQ ID NO: 534994 - DNA, 20 bp, Artificial Sequence
  chemically synthesized
caacccagtccagaattctt

SEQ ID NO: 534995 - DNA, 20 bp, Artificial Sequence
  chemically synthesized
taaggatttttcaacccagt

SEQ ID NO: 534996 - DNA, 20 bp, Artificial Sequence
  chemically synthesized
ccaagggaaggacttctgaa

SEQ ID NO: 534997 - DNA, 20 bp, Artificial Sequence
  chemically synthesized
tacagagagaactggagatg

SEQ ID NO: 534998 - DNA, 20 bp, Artificial Sequence
  chemically synthesized
atatgtgccacatatttact

SEQ ID NO: 534999 - DNA, 20 bp, Artificial Sequence
  chemically synthesized
acttatgctggtagggtgat

SEQ ID NO: 535000 - DNA, 20 bp, Artificial Sequence
  chemically synthesized
agagaaccacagtttaggaa

SEQ ID NO: 535001 - DNA, 20 bp, Artificial Sequence
  chemically synthesized
aaatggaaaaggctggttag

SEQ ID NO: 535002 - DNA, 20 bp, Artificial Sequence
  chemically synthesized
ggaagatgacaagtgaggaa

SEQ ID NO: 535003 - DNA, 20 bp, Artificial Sequence
  chemically synthesized
ttactactcccattttagag

SEQ ID NO: 535004 - DNA, 20 bp, Artificial Sequence
  chemically synthesized
agatggaataagatctataa

SEQ ID NO: 535005 - DNA, 20 bp, Artificial Sequence
  chemically synthesized
gggttacggagggagaagct

SEQ ID NO: 535006 - DNA, 20 bp, Artificial Sequence
  chemically synthesized
caatattgtttgtgaaataa

SEQ ID NO: 535007 - DNA, 20 bp, Artificial Sequence
  chemically synthesized
gtaattcagacgcctccaag

SEQ ID NO: 535008 - DNA, 20 bp, Artificial Sequence
  chemically synthesized
accaaaagcagataagatta

SEQ ID NO: 535009 - DNA, 20 bp, Artificial Sequence
  chemically synthesized
cctgacccagcccttttgca

SEQ ID NO: 535010 - DNA, 20 bp, Artificial Sequence
  chemically synthesized
aattcagacaccaaagagtt

SEQ ID NO: 535011 - DNA, 20 bp, Artificial Sequence
  chemically synthesized
aaaaatgagcaattcgaata

SEQ ID NO: 535012 - DNA, 20 bp, Artificial Sequence
  chemically synthesized
aattcgaatattagaaagag

SEQ ID NO: 535013 - DNA, 20 bp, Artificial Sequence
  chemically synthesized
tacaaagctatttatgtcta

SEQ ID NO: 535014 - DNA, 20 bp, Artificial Sequence
  chemically synthesized
atagttattgcagtctatca

SEQ ID NO: 535015 - DNA, 20 bp, Artificial Sequence
  chemically synthesized
gttatgaaatgggatttacc

SEQ ID NO: 535016 - DNA, 20 bp, Artificial Sequence
  chemically synthesized
tgaaatgggatttaccagag

SEQ ID NO: 535017 - DNA, 20 bp, Artificial Sequence
  chemically synthesized
caaaaagaaatcagctaaat

SEQ ID NO: 535018 - DNA, 20 bp, Artificial Sequence
  chemically synthesized
aaacttctagaaatgctcaa

SEQ ID NO: 535019 - DNA, 20 bp, Artificial Sequence
  chemically synthesized
tttttattgccatgaaactt

SEQ ID NO: 535020 - DNA, 20 bp, Artificial Sequence
  chemically synthesized
ggaagaccaaaatcatcaaa

SEQ ID NO: 535021 - DNA, 20 bp, Artificial Sequence
  chemically synthesized
atttggttttcaggaaaagg

SEQ ID NO: 535022 - DNA, 20 bp, Artificial Sequence
  chemically synthesized
cctgaaaaccaaatctttac

SEQ ID NO: 535023 - DNA, 20 bp, Artificial Sequence
  chemically synthesized
acttttcgatcgtgttcaaa

SEQ ID NO: 535024 - DNA, 20 bp, Artificial Sequence
  chemically synthesized
gtttagataaacatatcttg

SEQ ID NO: 535025 - DNA, 20 bp, Artificial Sequence
  chemically synthesized
tctcgacagacacttgcttt

SEQ ID NO: 535026 - DNA, 20 bp, Artificial Sequence
  chemically synthesized
aggctgtaatccaaatggtc

SEQ ID NO: 535027 - DNA, 20 bp, Artificial Sequence
  chemically synthesized
cattcctaaaagacaaaagc

SEQ ID NO: 535028 - DNA, 20 bp, Artificial Sequence
  chemically synthesized
aaatttccatatttctcagg

SEQ ID NO: 535029 - DNA, 20 bp, Artificial Sequence
  chemically synthesized
taagtgatcagtttcttgcc

SEQ ID NO: 535030 - DNA, 20 bp, Artificial Sequence
  chemically synthesized
catgtgacaagatccatcca

SEQ ID NO: 535031 - DNA, 20 bp, Artificial Sequence
  chemically synthesized
tatgcatttaatgggcagat

SEQ ID NO: 535032 - DNA, 20 bp, Artificial Sequence
  chemically synthesized
aatcttggaggcttactaca

SEQ ID NO: 535033 - DNA, 20 bp, Artificial Sequence
  chemically synthesized
gatgggaaatggtaaacata

SEQ ID NO: 535034 - DNA, 20 bp, Artificial Sequence
  chemically synthesized
aaagagcgcagattttcaag

SEQ ID NO: 535035 - DNA, 20 bp, Artificial Sequence
  chemically synthesized
ctacttgggaggctgaggca

SEQ ID NO: 535036 - DNA, 20 bp, Artificial Sequence
  chemically synthesized
tataatccccattttataga

SEQ ID NO: 535037 - DNA, 20 bp, Artificial Sequence
  chemically synthesized
tgtgtgtgtacaaaatcttt

SEQ ID NO: 535038 - DNA, 20 bp, Artificial Sequence
  chemically synthesized
taaagattttgtacacacac

SEQ ID NO: 535039 - DNA, 20 bp, Artificial Sequence
  chemically synthesized
gtacacacacacagaaacac

SEQ ID NO: 535040 - DNA, 20 bp, Artificial Sequence
  chemically synthesized
cttagggaagggttaacata

SEQ ID NO: 535041 - DNA, 20 bp, Artificial Sequence
  chemically synthesized
taaaagacaaaagatttcaa

SEQ ID NO: 535042 - DNA, 20 bp, Artificial Sequence
  chemically synthesized
cattttccttcccacaaccc

SEQ ID NO: 535043 - DNA, 20 bp, Artificial Sequence
  chemically synthesized
aggggatattgcagaggaag

SEQ ID NO: 535044 - DNA, 20 bp, Artificial Sequence
  chemically synthesized
gaaggaaggtagagagaagt

SEQ ID NO: 535045 - DNA, 20 bp, Artificial Sequence
  chemically synthesized
gacttggacctcatttctga

SEQ ID NO: 535046 - DNA, 20 bp, Artificial Sequence
  chemically synthesized
gtttccctcagagattctcc

SEQ ID NO: 535047 - DNA, 20 bp, Artificial Sequence
  chemically synthesized
atggataggagtgtatgtca

SEQ ID NO: 535048 - DNA, 20 bp, Artificial Sequence
  chemically synthesized
taggagtgtatgtcagaaga

SEQ ID NO: 535049 - DNA, 20 bp, Artificial Sequence
  chemically synthesized
gaatgtaattccattgaata

SEQ ID NO: 535050 - DNA, 20 bp, Artificial Sequence
  chemically synthesized
tgagaccagccaaaacactt

SEQ ID NO: 535051 - DNA, 20 bp, Artificial Sequence
  chemically synthesized
atgttactgtataagggttt

SEQ ID NO: 535052 - DNA, 20 bp, Artificial Sequence
  chemically synthesized
tttgaaatatttttgatatc

SEQ ID NO: 535053 - DNA, 20 bp, Artificial Sequence
  chemically synthesized
ctccatttgagcctttaaat

SEQ ID NO: 535054 - DNA, 20 bp, Artificial Sequence
  chemically synthesized
cactgtctgaatgccttgag

SEQ ID NO: 535055 - DNA, 20 bp, Artificial Sequence
  chemically synthesized
tttaaatacattgtcgtaat

SEQ ID NO: 535056 - DNA, 20 bp, Artificial Sequence
  chemically synthesized
taccttaattttgacgtcac

SEQ ID NO: 535057 - DNA, 20 bp, Artificial Sequence
  chemically synthesized
aaggtatatttattttaaaa

SEQ ID NO: 535058 - DNA, 20 bp, Artificial Sequence
  chemically synthesized
tcaccttttcatttgacagg

SEQ ID NO: 535059 - DNA, 20 bp, Artificial Sequence
  chemically synthesized
tcttacggacaggcagctta

SEQ ID NO: 535060 - DNA, 20 bp, Artificial Sequence
  chemically synthesized
tctcctaagctgcctgtccg

SEQ ID NO: 535061 - DNA, 20 bp, Artificial Sequence
  chemically synthesized
aaatagacactgaagaaagg

SEQ ID NO: 535062 - DNA, 20 bp, Artificial Sequence
  chemically synthesized
tgacagagaaaatagacact

SEQ ID NO: 535063 - DNA, 20 bp, Artificial Sequence
  chemically synthesized
tctagagagactaagatgac

SEQ ID NO: 535064 - DNA, 20 bp, Artificial Sequence
  chemically synthesized
acaatctcagaggtatttat

SEQ ID NO: 535065 - DNA, 20 bp, Artificial Sequence
  chemically synthesized
tggttattataagaaaaaaa

SEQ ID NO: 535066 - DNA, 20 bp, Artificial Sequence
  chemically synthesized
gtttactagtgtggttatta

SEQ ID NO: 535067 - DNA, 20 bp, Artificial Sequence
  chemically synthesized
ctttccaaaaccaaaattcg

SEQ ID NO: 535068 - DNA, 20 bp, Artificial Sequence
  chemically synthesized
ctcttcacagaagaaacact

SEQ ID NO: 535069 - DNA, 20 bp, Artificial Sequence
  chemically synthesized
tgtctccctacctcttcaca

SEQ ID NO: 535070 - DNA, 20 bp, Artificial Sequence
  chemically synthesized
ccaatttttcaatacagaga

SEQ ID NO: 535071 - DNA, 20 bp, Artificial Sequence
  chemically synthesized
catttgtaagctgtgattgc

SEQ ID NO: 535072 - DNA, 20 bp, Artificial Sequence
  chemically synthesized
gtgtaaagaaaccataaaag

SEQ ID NO: 535073 - DNA, 20 bp, Artificial Sequence
  chemically synthesized
tttcaaacactctgttgtgt

SEQ ID NO: 535074 - DNA, 20 bp, Artificial Sequence
  chemically synthesized
aaataagatgttttccagtg

SEQ ID NO: 535075 - DNA, 20 bp, Artificial Sequence
  chemically synthesized
aaaatgtttgaatatgttca

SEQ ID NO: 535076 - DNA, 20 bp, Artificial Sequence
  chemically synthesized
aatttttaaaacggacttac

SEQ ID NO: 535077 - DNA, 20 bp, Artificial Sequence
  chemically synthesized
cactgccacatgcatagtcc

SEQ ID NO: 535078 - DNA, 20 bp, Artificial Sequence
  chemically synthesized
atgtgtctgtcagcagaatt

SEQ ID NO: 535079 - DNA, 20 bp, Artificial Sequence
  chemically synthesized
tacaaagcatgtgtctgtca

SEQ ID NO: 535080 - DNA, 20 bp, Artificial Sequence
  chemically synthesized
aaattttgttttgaaatatt

SEQ ID NO: 535081 - DNA, 20 bp, Artificial Sequence
  chemically synthesized
cttagtggtcttttagtata

SEQ ID NO: 535082 - DNA, 20 bp, Artificial Sequence
  chemically synthesized
tttctagaaagggaatcaaa

SEQ ID NO: 535083 - DNA, 20 bp, Artificial Sequence
  chemically synthesized
tttctcctttgattcccttt

SEQ ID NO: 535084 - DNA, 20 bp, Artificial Sequence
  chemically synthesized
ttaaatccctctctttattt

SEQ ID NO: 535085 - DNA, 20 bp, Artificial Sequence
  chemically synthesized
tattataaaaacagtggtta

SEQ ID NO: 535086 - DNA, 20 bp, Artificial Sequence
  chemically synthesized
tatgcttgtgttcttattag

SEQ ID NO: 535087 - DNA, 20 bp, Artificial Sequence
  chemically synthesized
gaaagtatagtagcaaataa

SEQ ID NO: 535088 - DNA, 20 bp, Artificial Sequence
  chemically synthesized
tataaaactaagttgaagtc

SEQ ID NO: 535089 - DNA, 20 bp, Artificial Sequence
  chemically synthesized
tccttcgagccacccacaga

SEQ ID NO: 535090 - DNA, 20 bp, Artificial Sequence
  chemically synthesized
tagcagattgggggcagaga

SEQ ID NO: 535091 - DNA, 20 bp, Artificial Sequence
  chemically synthesized
actaaagctaggttgaggaa

SEQ ID NO: 535092 - DNA, 20 bp, Artificial Sequence
  chemically synthesized
gctttagtcataacaaacaa

SEQ ID NO: 535093 - DNA, 20 bp, Artificial Sequence
  chemically synthesized
caaatatctgggatcatatc

SEQ ID NO: 535094 - DNA, 20 bp, Artificial Sequence
  chemically synthesized
gttttgtttcctctagaatg

SEQ ID NO: 535095 - DNA, 20 bp, Artificial Sequence
  chemically synthesized
tctcctgtgttttgtttcct

SEQ ID NO: 535096 - DNA, 20 bp, Artificial Sequence
  chemically synthesized
agtagctgacttatgactcc

SEQ ID NO: 535097 - DNA, 20 bp, Artificial Sequence
  chemically synthesized
aactgcttaccccttggaga

SEQ ID NO: 535098 - DNA, 20 bp, Artificial Sequence
  chemically synthesized
ttctgattcactttgtattt

SEQ ID NO: 535099 - DNA, 20 bp, Artificial Sequence
  chemically synthesized
tttttattgtattcattaaa

SEQ ID NO: 535100 - DNA, 20 bp, Artificial Sequence
  chemically synthesized
atgcttagtatttacatgtc

SEQ ID NO: 535101 - DNA, 20 bp, Artificial Sequence
  chemically synthesized
tatgtagattgttgattttt

SEQ ID NO: 535102 - DNA, 20 bp, Artificial Sequence
  chemically synthesized
caacttcaaaaaattaatat

SEQ ID NO: 535103 - DNA, 20 bp, Artificial Sequence
  chemically synthesized
acggaaccattttatgtatt

SEQ ID NO: 535104 - DNA, 20 bp, Artificial Sequence
  chemically synthesized
cagtaaaaccctttcggtaa

SEQ ID NO: 535105 - DNA, 20 bp, Artificial Sequence
  chemically synthesized
tttggagaggcagccgaatg

SEQ ID NO: 535106 - DNA, 20 bp, Artificial Sequence
  chemically synthesized
cacctccatcggtaacttct

SEQ ID NO: 535107 - DNA, 20 bp, Artificial Sequence
  chemically synthesized
ttttatataatttcaagctt

SEQ ID NO: 535108 - DNA, 20 bp, Artificial Sequence
  chemically synthesized
ttatatatctatacacacag

SEQ ID NO: 535109 - DNA, 20 bp, Artificial Sequence
  chemically synthesized
tattttttttctgaatcatt

SEQ ID NO: 535110 - DNA, 20 bp, Artificial Sequence
  chemically synthesized
gcaaattattctcaaatgat

SEQ ID NO: 535111 - DNA, 20 bp, Artificial Sequence
  chemically synthesized
taagagaatgtctttgctat

SEQ ID NO: 535112 - DNA, 20 bp, Artificial Sequence
  chemically synthesized
aactgagctgaggttattta

SEQ ID NO: 535113 - DNA, 20 bp, Artificial Sequence
  chemically synthesized
ctgtaagtgttataaagttc

SEQ ID NO: 535114 - DNA, 20 bp, Artificial Sequence
  chemically synthesized
caacagaggccaggtatttt

SEQ ID NO: 535115 - DNA, 20 bp, Artificial Sequence
  chemically synthesized
gcaggggctgtagcagtgaa

SEQ ID NO: 535116 - DNA, 20 bp, Artificial Sequence
  chemically synthesized
aaaataattcctgttctcaa

SEQ ID NO: 535117 - DNA, 20 bp, Artificial Sequence
  chemically synthesized
ctgttttgtataatttaaat

SEQ ID NO: 535118 - DNA, 20 bp, Artificial Sequence
  chemically synthesized
tcatacccaagtggccacca

SEQ ID NO: 535119 - DNA, 20 bp, Artificial Sequence
  chemically synthesized
cctctctcttccttgcagag

SEQ ID NO: 535120 - DNA, 20 bp, Artificial Sequence
  chemically synthesized
ttagtggaaatatctatgtg

SEQ ID NO: 535121 - DNA, 20 bp, Artificial Sequence
  chemically synthesized
ggccagcccatgggaggcat

SEQ ID NO: 535122 - DNA, 20 bp, Artificial Sequence
  chemically synthesized
tttttacatactacctctat

SEQ ID NO: 535123 - DNA, 20 bp, Artificial Sequence
  chemically synthesized
gaccattatttccaaggagc

SEQ ID NO: 535124 - DNA, 20 bp, Artificial Sequence
  chemically synthesized
aagttttcagatgacggaag

SEQ ID NO: 535125 - DNA, 20 bp, Artificial Sequence
  chemically synthesized
gcccttggttaaaaaaaaat

SEQ ID NO: 535126 - DNA, 20 bp, Artificial Sequence
  chemically synthesized
acctcaaccctaaggttagt

SEQ ID NO: 535127 - DNA, 20 bp, Artificial Sequence
  chemically synthesized
aatgcctcttgcttaattcc

SEQ ID NO: 535128 - DNA, 20 bp, Artificial Sequence
  chemically synthesized
tagcttcataactgctcctt

SEQ ID NO: 535129 - DNA, 20 bp, Artificial Sequence
  chemically synthesized
aaatgaagtagggaaacgac

SEQ ID NO: 535130 - DNA, 20 bp, Artificial Sequence
  chemically synthesized
aaagtggtgaatcatctgag

SEQ ID NO: 535131 - DNA, 20 bp, Artificial Sequence
  chemically synthesized
cagctaacacttagctaaac

SEQ ID NO: 535132 - DNA, 20 bp, Artificial Sequence
  chemically synthesized
ggatagacttgggaaataca

SEQ ID NO: 535133 - DNA, 20 bp, Artificial Sequence
  chemically synthesized
gaaacaactaataatttgtt

SEQ ID NO: 535134 - DNA, 20 bp, Artificial Sequence
  chemically synthesized
ctatcacagcatactagtta

SEQ ID NO: 535135 - DNA, 20 bp, Artificial Sequence
  chemically synthesized
tctacctctcagattcatta

SEQ ID NO: 535136 - DNA, 20 bp, Artificial Sequence
  chemically synthesized
attgcccctattttactagt

SEQ ID NO: 535137 - DNA, 20 bp, Artificial Sequence
  chemically synthesized
aaagggacagggatatgaaa

SEQ ID NO: 535138 - DNA, 20 bp, Artificial Sequence
  chemically synthesized
ttgcaagaaccatgactgat

SEQ ID NO: 535139 - DNA, 20 bp, Artificial Sequence
  chemically synthesized
ctaaggggagggtatagtta

SEQ ID NO: 535140 - DNA, 20 bp, Artificial Sequence
  chemically synthesized
acttgatatgaagtctttgc

SEQ ID NO: 535141 - DNA, 20 bp, Artificial Sequence
  chemically synthesized
gaactttggcagatttggct

SEQ ID NO: 535142 - DNA, 20 bp, Artificial Sequence
  chemically synthesized
acttatttgccattatttgt

SEQ ID NO: 535143 - DNA, 20 bp, Artificial Sequence
  chemically synthesized
aactgggaagcagcgaactt

SEQ ID NO: 535144 - DNA, 20 bp, Artificial Sequence
  chemically synthesized
aattgagaaatttatcccaa

SEQ ID NO: 535145 - DNA, 20 bp, Artificial Sequence
  chemically synthesized
tctaggaatggaccaagaat

SEQ ID NO: 535146 - DNA, 20 bp, Artificial Sequence
  chemically synthesized
ctgtatttctaggaatggac

SEQ ID NO: 535147 - DNA, 20 bp, Artificial Sequence
  chemically synthesized
tctcaattcttggtccattc

SEQ ID NO: 535148 - DNA, 20 bp, Artificial Sequence
  chemically synthesized
aatgaagggaaacagtggta

SEQ ID NO: 535149 - DNA, 20 bp, Artificial Sequence
  chemically synthesized
attagagacttgtggcagat

SEQ ID NO: 535150 - DNA, 20 bp, Artificial Sequence
  chemically synthesized
tcactgaatcattgataacc

SEQ ID NO: 535151 - DNA, 20 bp, Artificial Sequence
  chemically synthesized
accaatgttgacaagtatgt

SEQ ID NO: 535152 - DNA, 20 bp, Artificial Sequence
  chemically synthesized
cgctgctgggtatataccca

SEQ ID NO: 535153 - DNA, 20 bp, Artificial Sequence
  chemically synthesized
gaatactactcagccacaaa

SEQ ID NO: 535154 - DNA, 20 bp, Artificial Sequence
  chemically synthesized
caacaatgttgttgcagatg

SEQ ID NO: 535155 - DNA, 20 bp, Artificial Sequence
  chemically synthesized
ctaggtgaaataaatcagac

SEQ ID NO: 535156 - DNA, 20 bp, Artificial Sequence
  chemically synthesized
tactgggtacaaaaaattag

SEQ ID NO: 535157 - DNA, 20 bp, Artificial Sequence
  chemically synthesized
gggtacaaaaaattagttag

SEQ ID NO: 535158 - DNA, 20 bp, Artificial Sequence
  chemically synthesized
aattggattgtttggaacat

SEQ ID NO: 535159 - DNA, 20 bp, Artificial Sequence
  chemically synthesized
aaaatataaaaataaaacaa

SEQ ID NO: 535160 - DNA, 20 bp, Artificial Sequence
  chemically synthesized
aaacaaaaagaaacaagtaa

SEQ ID NO: 535161 - DNA, 20 bp, Artificial Sequence
  chemically synthesized
aaagaaacaagtaattagaa

SEQ ID NO: 535162 - DNA, 20 bp, Artificial Sequence
  chemically synthesized
ataatactgataaatactgc

SEQ ID NO: 535163 - DNA, 20 bp, Artificial Sequence
  chemically synthesized
taaaaaatatgatagctgtt

SEQ ID NO: 535164 - DNA, 20 bp, Artificial Sequence
  chemically synthesized
aaacattactacaaagaaat

SEQ ID NO: 535165 - DNA, 20 bp, Artificial Sequence
  chemically synthesized
acaaattgaaacattactac

SEQ ID NO: 535166 - DNA, 20 bp, Artificial Sequence
  chemically synthesized
ttgaaatacaatttcaaagt

SEQ ID NO: 535167 - DNA, 20 bp, Artificial Sequence
  chemically synthesized
atttcaaagtcaagaaaaaa

SEQ ID NO: 535168 - DNA, 20 bp, Artificial Sequence
  chemically synthesized
tcaacgccctttatatcact

SEQ ID NO: 535169 - DNA, 20 bp, Artificial Sequence
  chemically synthesized
tttcaagaaatgtgaacaat

SEQ ID NO: 535170 - DNA, 20 bp, Artificial Sequence
  chemically synthesized
tttatagaacaatagagttt

SEQ ID NO: 535171 - DNA, 20 bp, Artificial Sequence
  chemically synthesized
tttcttctaaaatgtgtgta

SEQ ID NO: 535172 - DNA, 20 bp, Artificial Sequence
  chemically synthesized
tttctcctacacacatttta

SEQ ID NO: 535173 - DNA, 20 bp, Artificial Sequence
  chemically synthesized
acttcgttgttgtcttattt

SEQ ID NO: 535174 - DNA, 20 bp, Artificial Sequence
  chemically synthesized
caaacagcatcacatgctac

SEQ ID NO: 535175 - DNA, 20 bp, Artificial Sequence
  chemically synthesized
ttgaaatgacaacaaaggat

SEQ ID NO: 535176 - DNA, 20 bp, Artificial Sequence
  chemically synthesized
tggtagaaatagcatgagaa

SEQ ID NO: 535177 - DNA, 20 bp, Artificial Sequence
  chemically synthesized
aagaagtcactgcagatgtg

SEQ ID NO: 535178 - DNA, 20 bp, Artificial Sequence
  chemically synthesized
ctcaccattccagatgccat

SEQ ID NO: 535179 - DNA, 20 bp, Artificial Sequence
  chemically synthesized
gacttcttgatccaaggact

SEQ ID NO: 535180 - DNA, 20 bp, Artificial Sequence
  chemically synthesized
gccctgaggaatatgtccaa

SEQ ID NO: 535181 - DNA, 20 bp, Artificial Sequence
  chemically synthesized
agagaggtgaggaagctgca

SEQ ID NO: 535182 - DNA, 20 bp, Artificial Sequence
  chemically synthesized
cctcacctctctcggcattc

SEQ ID NO: 535183 - DNA, 20 bp, Artificial Sequence
  chemically synthesized
ctcggcattcacagaattgc

SEQ ID NO: 535184 - DNA, 20 bp, Artificial Sequence
  chemically synthesized
aacggccttatttttaatat

SEQ ID NO: 535185 - DNA, 20 bp, Artificial Sequence
  chemically synthesized
tactctgttgaacacaggaa

SEQ ID NO: 535186 - DNA, 20 bp, Artificial Sequence
  chemically synthesized
aatgcaaaggaaacgttctt

SEQ ID NO: 535187 - DNA, 20 bp, Artificial Sequence
  chemically synthesized
ttgtcactttaaatcaaaag

SEQ ID NO: 535188 - DNA, 20 bp, Artificial Sequence
  chemically synthesized
tggctggttagccatatgca

SEQ ID NO: 535189 - DNA, 20 bp, Artificial Sequence
  chemically synthesized
aaacattagatctcaaatta

SEQ ID NO: 535190 - DNA, 20 bp, Artificial Sequence
  chemically synthesized
ctcaaattataagaatccta

SEQ ID NO: 535191 - DNA, 20 bp, Artificial Sequence
  chemically synthesized
ctctggacatcagacttggg

SEQ ID NO: 535192 - DNA, 20 bp, Artificial Sequence
  chemically synthesized
ctaaagagctcttcacagtg

SEQ ID NO: 535193 - DNA, 20 bp, Artificial Sequence
  chemically synthesized
acagagtaaacagacagtct

SEQ ID NO: 535194 - DNA, 20 bp, Artificial Sequence
  chemically synthesized
aacagacagtctacagaata

SEQ ID NO: 535195 - DNA, 20 bp, Artificial Sequence
  chemically synthesized
atctgacaaaggtctaatat

SEQ ID NO: 535196 - DNA, 20 bp, Artificial Sequence
  chemically synthesized
gctccacatcactcaacatc

SEQ ID NO: 535197 - DNA, 20 bp, Artificial Sequence
  chemically synthesized
tagttgtgttttaagtcctt

SEQ ID NO: 535198 - DNA, 20 bp, Artificial Sequence
  chemically synthesized
gaatagtgctgaaatgagga

SEQ ID NO: 535199 - DNA, 20 bp, Artificial Sequence
  chemically synthesized
gtgcccatcagtggcagact

SEQ ID NO: 535200 - DNA, 20 bp, Artificial Sequence
  chemically synthesized
ccatcagtggcagactggag

SEQ ID NO: 535201 - DNA, 20 bp, Artificial Sequence
  chemically synthesized
gtgtttctgcattaattcac

SEQ ID NO: 535202 - DNA, 20 bp, Artificial Sequence
  chemically synthesized
attattctaagtgaattaat

SEQ ID NO: 535203 - DNA, 20 bp, Artificial Sequence
  chemically synthesized
tggacataatgatggcaaca

SEQ ID NO: 535204 - DNA, 20 bp, Artificial Sequence
  chemically synthesized
ttcactccagtgccctccag

SEQ ID NO: 535205 - DNA, 20 bp, Artificial Sequence
  chemically synthesized
cctgtctttaaaatatatat

SEQ ID NO: 535206 - DNA, 20 bp, Artificial Sequence
  chemically synthesized
tgatgttattcaaggtagaa

SEQ ID NO: 535207 - DNA, 20 bp, Artificial Sequence
  chemically synthesized
gattcctctgaatagggaca

SEQ ID NO: 535208 - DNA, 20 bp, Artificial Sequence
  chemically synthesized
aaagatactatccaaagact

SEQ ID NO: 535209 - DNA, 20 bp, Artificial Sequence
  chemically synthesized
agctttggtcaatcaaagag

SEQ ID NO: 535210 - DNA, 20 bp, Artificial Sequence
  chemically synthesized
cccatataaaatcccatctc

SEQ ID NO: 535211 - DNA, 20 bp, Artificial Sequence
  chemically synthesized
ttaaaactaaagtgtagaag

SEQ ID NO: 535212 - DNA, 20 bp, Artificial Sequence
  chemically synthesized
tcagaatacagcagagtggt

SEQ ID NO: 535213 - DNA, 20 bp, Artificial Sequence
  chemically synthesized
ggcagctgtgtaattagtta

SEQ ID NO: 535214 - DNA, 20 bp, Artificial Sequence
  chemically synthesized
gttgagaagggaagctgggg

SEQ ID NO: 535215 - DNA, 20 bp, Artificial Sequence
  chemically synthesized
tcatcagaggtttgagagca

SEQ ID NO: 535216 - DNA, 20 bp, Artificial Sequence
  chemically synthesized
gccacaataaaagtggcatg

SEQ ID NO: 535217 - DNA, 20 bp, Artificial Sequence
  chemically synthesized
actgcatccaatgtcccttc

SEQ ID NO: 535218 - DNA, 20 bp, Artificial Sequence
  chemically synthesized
catccaatgtcccttccaag

SEQ ID NO: 535219 - DNA, 20 bp, Artificial Sequence
  chemically synthesized
aaaattaaattgcagtaacc

SEQ ID NO: 535220 - DNA, 20 bp, Artificial Sequence
  chemically synthesized
aaaagatgcatgaaggtaaa

SEQ ID NO: 535221 - DNA, 20 bp, Artificial Sequence
  chemically synthesized
accttcatgcatctttttaa

SEQ ID NO: 535222 - DNA, 20 bp, Artificial Sequence
  chemically synthesized
ttgcttgtaaaaactgtccc

SEQ ID NO: 535223 - DNA, 20 bp, Artificial Sequence
  chemically synthesized
agtaaaatataatattacaa

SEQ ID NO: 535224 - DNA, 20 bp, Artificial Sequence
  chemically synthesized
aaagggattgtagtttcagt

SEQ ID NO: 535225 - DNA, 20 bp, Artificial Sequence
  chemically synthesized
tttagaaaaaaggtaaacat

SEQ ID NO: 535226 - DNA, 20 bp, Artificial Sequence
  chemically synthesized
tatcctttagagtaggaatg

SEQ ID NO: 535227 - DNA, 20 bp, Artificial Sequence
  chemically synthesized
cagagactttcagagtgtga

SEQ ID NO: 535228 - DNA, 20 bp, Artificial Sequence
  chemically synthesized
tacctgaagacttatttccc

SEQ ID NO: 535229 - DNA, 20 bp, Artificial Sequence
  chemically synthesized
aataccccagtactcctttc

SEQ ID NO: 535230 - DNA, 20 bp, Artificial Sequence
  chemically synthesized
cagtttattgatggctgccg

SEQ ID NO: 535231 - DNA, 20 bp, Artificial Sequence
  chemically synthesized
ctgtagatgggaagtgaagt

SEQ ID NO: 535232 - DNA, 20 bp, Artificial Sequence
  chemically synthesized
acactcatgaacacagttaa

SEQ ID NO: 535233 - DNA, 20 bp, Artificial Sequence
  chemically synthesized
ttcatgtttcccatataggg

SEQ ID NO: 535234 - DNA, 20 bp, Artificial Sequence
  chemically synthesized
taaagcaatgaatctattta

SEQ ID NO: 535235 - DNA, 20 bp, Artificial Sequence
  chemically synthesized
taagaattcaaataccttag

SEQ ID NO: 535236 - DNA, 20 bp, Artificial Sequence
  chemically synthesized
gtcttaattgctgttactgt

SEQ ID NO: 535237 - DNA, 20 bp, Artificial Sequence
  chemically synthesized
gcaattaagacatatgttat

SEQ ID NO: 535238 - DNA, 20 bp, Artificial Sequence
  chemically synthesized
gtatcttcactttgtagcac

SEQ ID NO: 535239 - DNA, 20 bp, Artificial Sequence
  chemically synthesized
caaaggatgttgtttatttt

SEQ ID NO: 535240 - DNA, 20 bp, Artificial Sequence
  chemically synthesized
ttgatctcccagacaactgc

SEQ ID NO: 535241 - DNA, 20 bp, Artificial Sequence
  chemically synthesized
cccagtcatataagttctga

SEQ ID NO: 535242 - DNA, 20 bp, Artificial Sequence
  chemically synthesized
tagcaattccactcacctac

SEQ ID NO: 535243 - DNA, 20 bp, Artificial Sequence
  chemically synthesized
agcagaatcattgttttatt

SEQ ID NO: 535244 - DNA, 20 bp, Artificial Sequence
  chemically synthesized
tggtgttttttgacagagaa

SEQ ID NO: 535245 - DNA, 20 bp, Artificial Sequence
  chemically synthesized
tggagaacgtaaaaattaca

SEQ ID NO: 535246 - DNA, 20 bp, Artificial Sequence
  chemically synthesized
gtatgtctaaaatcctcccc

SEQ ID NO: 535247 - DNA, 20 bp, Artificial Sequence
  chemically synthesized
gtagacccatttttatatga

SEQ ID NO: 535248 - DNA, 20 bp, Artificial Sequence
  chemically synthesized
tgtttgcttggaactatgcc

SEQ ID NO: 535249 - DNA, 20 bp, Artificial Sequence
  chemically synthesized
acataaagtttccatattcc

SEQ ID NO: 535250 - DNA, 20 bp, Artificial Sequence
  chemically synthesized
acaacattacagaaaccact

SEQ ID NO: 535251 - DNA, 20 bp, Artificial Sequence
  chemically synthesized
tcggttaggaacacaacatt

SEQ ID NO: 535252 - DNA, 20 bp, Artificial Sequence
  chemically synthesized
tgagaaacctgcctaataaa

SEQ ID NO: 535253 - DNA, 20 bp, Artificial Sequence
  chemically synthesized
attgaaattattgttcataa

SEQ ID NO: 535254 - DNA, 20 bp, Artificial Sequence
  chemically synthesized
aaaaataagcagtaatccct

SEQ ID NO: 535255 - DNA, 20 bp, Artificial Sequence
  chemically synthesized
acacagaaaaaggaatcact

SEQ ID NO: 535256 - DNA, 20 bp, Artificial Sequence
  chemically synthesized
tcaccttatacaaataaaac

SEQ ID NO: 535257 - DNA, 20 bp, Artificial Sequence
  chemically synthesized
actaaagtctctgaggcaac

SEQ ID NO: 535258 - DNA, 20 bp, Artificial Sequence
  chemically synthesized
taagacagatcattaatata

SEQ ID NO: 535259 - DNA, 20 bp, Artificial Sequence
  chemically synthesized
cctattctgtctactatctt

SEQ ID NO: 535260 - DNA, 20 bp, Artificial Sequence
  chemically synthesized
agttttctgtaagatagtag

SEQ ID NO: 535261 - DNA, 20 bp, Artificial Sequence
  chemically synthesized
tggagagtcactgaccttta

SEQ ID NO: 535262 - DNA, 20 bp, Artificial Sequence
  chemically synthesized
aattgtagttacgatgtaaa

SEQ ID NO: 535263 - DNA, 20 bp, Artificial Sequence
  chemically synthesized
ttacacatgaggaaataagc

SEQ ID NO: 535264 - DNA, 20 bp, Artificial Sequence
  chemically synthesized
aaatctcaaaataattaaaa

SEQ ID NO: 535265 - DNA, 20 bp, Artificial Sequence
  chemically synthesized
gttcaattcccacctatgaa

SEQ ID NO: 535266 - DNA, 20 bp, Artificial Sequence
  chemically synthesized
ttgttcttgcaatagtttac

SEQ ID NO: 535267 - DNA, 20 bp, Artificial Sequence
  chemically synthesized
ccaacaatgatagactggat

SEQ ID NO: 535268 - DNA, 20 bp, Artificial Sequence
  chemically synthesized
gattcctcagggatctagaa

SEQ ID NO: 535269 - DNA, 20 bp, Artificial Sequence
  chemically synthesized
acaggtgctggagaggatgt

SEQ ID NO: 535270 - DNA, 20 bp, Artificial Sequence
  chemically synthesized
gagataccatctcacaccag

SEQ ID NO: 535271 - DNA, 20 bp, Artificial Sequence
  chemically synthesized
gctcaccatcactggccatc

SEQ ID NO: 535272 - DNA, 20 bp, Artificial Sequence
  chemically synthesized
aatgaactccaacaaattta

SEQ ID NO: 535273 - DNA, 20 bp, Artificial Sequence
  chemically synthesized
atctgacaaagagctaatat

SEQ ID NO: 535274 - DNA, 20 bp, Artificial Sequence
  chemically synthesized
aacaggcaacctacaacatg

SEQ ID NO: 535275 - DNA, 20 bp, Artificial Sequence
  chemically synthesized
taaagagcttctgcacagca

SEQ ID NO: 535276 - DNA, 20 bp, Artificial Sequence
  chemically synthesized
ctaaaaccataaaaacccta

SEQ ID NO: 535277 - DNA, 20 bp, Artificial Sequence
  chemically synthesized
ggaaaactggctagccatat

SEQ ID NO: 535278 - DNA, 20 bp, Artificial Sequence
  chemically synthesized
tatctgatctttgacaaacc

SEQ ID NO: 535279 - DNA, 20 bp, Artificial Sequence
  chemically synthesized
cagacgacatgattgtatat

SEQ ID NO: 535280 - DNA, 20 bp, Artificial Sequence
  chemically synthesized
gtttgtctgtcgttggtgta

SEQ ID NO: 535281 - DNA, 20 bp, Artificial Sequence
  chemically synthesized
cccattcacaattgcttcaa

SEQ ID NO: 535282 - DNA, 20 bp, Artificial Sequence
  chemically synthesized
cattccgtgctcatgggtag

SEQ ID NO: 535283 - DNA, 20 bp, Artificial Sequence
  chemically synthesized
agctaccaatgactttcttc

SEQ ID NO: 535284 - DNA, 20 bp, Artificial Sequence
  chemically synthesized
gtagttttttccaattctgt

SEQ ID NO: 535285 - DNA, 20 bp, Artificial Sequence
  chemically synthesized
gacagggctagacttaggag

SEQ ID NO: 535286 - DNA, 20 bp, Artificial Sequence
  chemically synthesized
aggaaagtaaggaataagtg

SEQ ID NO: 535287 - DNA, 20 bp, Artificial Sequence
  chemically synthesized
cttgcagtcctgtttctaaa

SEQ ID NO: 535288 - DNA, 20 bp, Artificial Sequence
  chemically synthesized
ttaacccactgaattctatt

SEQ ID NO: 535289 - DNA, 20 bp, Artificial Sequence
  chemically synthesized
gtccagctggaaatgaagtt

SEQ ID NO: 535290 - DNA, 20 bp, Artificial Sequence
  chemically synthesized
ccacttttattccttgtaat

SEQ ID NO: 535291 - DNA, 20 bp, Artificial Sequence
  chemically synthesized
caaaaaatgggtctcacaag

SEQ ID NO: 535292 - DNA, 20 bp, Artificial Sequence
  chemically synthesized
aaagctggaaaaggcatgga

SEQ ID NO: 535293 - DNA, 20 bp, Artificial Sequence
  chemically synthesized
tgaaggacagggccaagagc

SEQ ID NO: 535294 - DNA, 20 bp, Artificial Sequence
  chemically synthesized
gagttacagtatctcacaat

SEQ ID NO: 535295 - DNA, 20 bp, Artificial Sequence
  chemically synthesized
gaagagcagcttgtcaccaa

SEQ ID NO: 535296 - DNA, 20 bp, Artificial Sequence
  chemically synthesized
ctcttcaggaatgaatccta

SEQ ID NO: 535297 - DNA, 20 bp, Artificial Sequence
  chemically synthesized
agggtattgccttctgggat

SEQ ID NO: 535298 - DNA, 20 bp, Artificial Sequence
  chemically synthesized
agtagtagttgttgcagaga

SEQ ID NO: 535299 - DNA, 20 bp, Artificial Sequence
  chemically synthesized
attttagtagtagttgttgc

SEQ ID NO: 535300 - DNA, 20 bp, Artificial Sequence
  chemically synthesized
gcaccacctcctttacttgt

SEQ ID NO: 535301 - DNA, 20 bp, Artificial Sequence
  chemically synthesized
ggcagcccctcaatcctaaa

SEQ ID NO: 535302 - DNA, 20 bp, Artificial Sequence
  chemically synthesized
aggtcatttacctgaaaatg

SEQ ID NO: 535303 - DNA, 20 bp, Artificial Sequence
  chemically synthesized
cattttcaggtaaatgacct

SEQ ID NO: 535304 - DNA, 20 bp, Artificial Sequence
  chemically synthesized
aatggcagtagatggatttc

SEQ ID NO: 535305 - DNA, 20 bp, Artificial Sequence
  chemically synthesized
tgtttgtatttcatgatttc

SEQ ID NO: 535306 - DNA, 20 bp, Artificial Sequence
  chemically synthesized
gaagtgctataagaactgag

SEQ ID NO: 535307 - DNA, 20 bp, Artificial Sequence
  chemically synthesized
tgtatagagaagaatagaag

SEQ ID NO: 535308 - DNA, 20 bp, Artificial Sequence
  chemically synthesized
aacttgtatagagaagaata

SEQ ID NO: 535309 - DNA, 20 bp, Artificial Sequence
  chemically synthesized
cacttcataacttgtataga

SEQ ID NO: 535310 - DNA, 20 bp, Artificial Sequence
  chemically synthesized
tctatacaagttatgaagtg

SEQ ID NO: 535311 - DNA, 20 bp, Artificial Sequence
  chemically synthesized
atgtcaggagaattagaaca

SEQ ID NO: 535312 - DNA, 20 bp, Artificial Sequence
  chemically synthesized
catatatatggttcatgtca

SEQ ID NO: 535313 - DNA, 20 bp, Artificial Sequence
  chemically synthesized
atttttctcagaatcatcag

SEQ ID NO: 535314 - DNA, 20 bp, Artificial Sequence
  chemically synthesized
tttattctttctgatgattc

SEQ ID NO: 535315 - DNA, 20 bp, Artificial Sequence
  chemically synthesized
tttgatttttctcagaatca

SEQ ID NO: 535316 - DNA, 20 bp, Artificial Sequence
  chemically synthesized
aattcagaatttgatttttc

SEQ ID NO: 535317 - DNA, 20 bp, Artificial Sequence
  chemically synthesized
aacatcatcattttaaaaat

SEQ ID NO: 535318 - DNA, 20 bp, Artificial Sequence
  chemically synthesized
aataaatcaccatattttcc

SEQ ID NO: 535319 - DNA, 20 bp, Artificial Sequence
  chemically synthesized
aatttatgtacaggaattgt

SEQ ID NO: 535320 - DNA, 20 bp, Artificial Sequence
  chemically synthesized
gtgtggaaaggcttgtatca

SEQ ID NO: 535321 - DNA, 20 bp, Artificial Sequence
  chemically synthesized
ttgagaaggggaagaggatc

SEQ ID NO: 535322 - DNA, 20 bp, Artificial Sequence
  chemically synthesized
gaaatgttcatcattgtgct

SEQ ID NO: 535323 - DNA, 20 bp, Artificial Sequence
  chemically synthesized
ttcaggtgtataaaaaatat

SEQ ID NO: 535324 - DNA, 20 bp, Artificial Sequence
  chemically synthesized
tttataaaatagcagtgtta

SEQ ID NO: 535325 - DNA, 20 bp, Artificial Sequence
  chemically synthesized
ttgtaatcgtacactacttg

SEQ ID NO: 535326 - DNA, 20 bp, Artificial Sequence
  chemically synthesized
tctgcatataggccagatgt

SEQ ID NO: 535327 - DNA, 20 bp, Artificial Sequence
  chemically synthesized
ttgtaattgcttttgaattc

SEQ ID NO: 535328 - DNA, 20 bp, Artificial Sequence
  chemically synthesized
tcagttttgctttgcaaata

SEQ ID NO: 535329 - DNA, 20 bp, Artificial Sequence
  chemically synthesized
tacttgcttatctattcctg

SEQ ID NO: 535330 - DNA, 20 bp, Artificial Sequence
  chemically synthesized
gatactatgtgaagtggcaa

SEQ ID NO: 535331 - DNA, 20 bp, Artificial Sequence
  chemically synthesized
tgcctctttgcaatatatac

SEQ ID NO: 535332 - DNA, 20 bp, Artificial Sequence
  chemically synthesized
agtaactgagttcctgcaca

SEQ ID NO: 535333 - DNA, 20 bp, Artificial Sequence
  chemically synthesized
gaattcacgtggggatagag

SEQ ID NO: 535334 - DNA, 20 bp, Artificial Sequence
  chemically synthesized
gggatagagttagaatttaa

SEQ ID NO: 535335 - DNA, 20 bp, Artificial Sequence
  chemically synthesized
gctaatgagcaaaatgaata

SEQ ID NO: 535336 - DNA, 20 bp, Artificial Sequence
  chemically synthesized
taaatcttgggcaccattcc

SEQ ID NO: 535337 - DNA, 20 bp, Artificial Sequence
  chemically synthesized
ttagagaaggcatcagacaa

SEQ ID NO: 535338 - DNA, 20 bp, Artificial Sequence
  chemically synthesized
aagggagacatgagaatatt

SEQ ID NO: 535339 - DNA, 20 bp, Artificial Sequence
  chemically synthesized
aggttcaatcaagggagaca

SEQ ID NO: 535340 - DNA, 20 bp, Artificial Sequence
  chemically synthesized
aaaaatgtaataatatactc

SEQ ID NO: 535341 - DNA, 20 bp, Artificial Sequence
  chemically synthesized
atataaccatgaggaaataa

SEQ ID NO: 535342 - DNA, 20 bp, Artificial Sequence
  chemically synthesized
tcttatgagttatgcatgtg

SEQ ID NO: 535343 - DNA, 20 bp, Artificial Sequence
  chemically synthesized
ccgatcattattgaggggtg

SEQ ID NO: 535344 - DNA, 20 bp, Artificial Sequence
  chemically synthesized
caagataaaaatgtcagaga

SEQ ID NO: 535345 - DNA, 20 bp, Artificial Sequence
  chemically synthesized
atacccagggaagaaataat

SEQ ID NO: 535346 - DNA, 20 bp, Artificial Sequence
  chemically synthesized
tgtgaaaatagatacccagg

SEQ ID NO: 535347 - DNA, 20 bp, Artificial Sequence
  chemically synthesized
ttccctgggtatctattttc

SEQ ID NO: 535348 - DNA, 20 bp, Artificial Sequence
  chemically synthesized
ttgttgccaataaacctgtg

SEQ ID NO: 535349 - DNA, 20 bp, Artificial Sequence
  chemically synthesized
cgtttttcttgttttgaaag

SEQ ID NO: 535350 - DNA, 20 bp, Artificial Sequence
  chemically synthesized
tgagtttctccctttcaaaa

SEQ ID NO: 535351 - DNA, 20 bp, Artificial Sequence
  chemically synthesized
ttgtaccacttttgagagga

SEQ ID NO: 535352 - DNA, 20 bp, Artificial Sequence
  chemically synthesized
agcacaatgcctggtatata

SEQ ID NO: 535353 - DNA, 20 bp, Artificial Sequence
  chemically synthesized
gagcagattttgaaaaatgg

SEQ ID NO: 535354 - DNA, 20 bp, Artificial Sequence
  chemically synthesized
atagtagaaataattgtgaa

SEQ ID NO: 535355 - DNA, 20 bp, Artificial Sequence
  chemically synthesized
tcccattaaaatattaaata

SEQ ID NO: 535356 - DNA, 20 bp, Artificial Sequence
  chemically synthesized
actttaagtgatcactatga

SEQ ID NO: 535357 - DNA, 20 bp, Artificial Sequence
  chemically synthesized
tttttttttttaccttatat

SEQ ID NO: 535358 - DNA, 20 bp, Artificial Sequence
  chemically synthesized
caaacacacatatattactt

SEQ ID NO: 535359 - DNA, 20 bp, Artificial Sequence
  chemically synthesized
gactgggtaatttataaaca

SEQ ID NO: 535360 - DNA, 20 bp, Artificial Sequence
  chemically synthesized
gtgcccttataaaagcggct

SEQ ID NO: 535361 - DNA, 20 bp, Artificial Sequence
  chemically synthesized
aggtcatgcgggctctgcct

SEQ ID NO: 535362 - DNA, 20 bp, Artificial Sequence
  chemically synthesized
atggaaattcccgtggctaa

SEQ ID NO: 535363 - DNA, 20 bp, Artificial Sequence
  chemically synthesized
cttcagaagtgctaggaaac

SEQ ID NO: 535364 - DNA, 20 bp, Artificial Sequence
  chemically synthesized
taggcatttgggactgattt

SEQ ID NO: 535365 - DNA, 20 bp, Artificial Sequence
  chemically synthesized
agttttagattaagagcatt

SEQ ID NO: 535366 - DNA, 20 bp, Artificial Sequence
  chemically synthesized
acttgataaaggagcaatgg

SEQ ID NO: 535367 - DNA, 20 bp, Artificial Sequence
  chemically synthesized
aagtacttgggaattaaggt

SEQ ID NO: 535368 - DNA, 20 bp, Artificial Sequence
  chemically synthesized
attaaggtaaagaatatttg

SEQ ID NO: 535369 - DNA, 20 bp, Artificial Sequence
  chemically synthesized
actgaaaaatttgaatctat

SEQ ID NO: 535370 - DNA, 20 bp, Artificial Sequence
  chemically synthesized
atacgcttttttggaagctc

SEQ ID NO: 535371 - DNA, 20 bp, Artificial Sequence
  chemically synthesized
atttaaaaagagagagagag

SEQ ID NO: 535372 - DNA, 20 bp, Artificial Sequence
  chemically synthesized
tcagcgcaaagttaaagtgt

SEQ ID NO: 535373 - DNA, 20 bp, Artificial Sequence
  chemically synthesized
accatcaaagggaatttctt

SEQ ID NO: 535374 - DNA, 20 bp, Artificial Sequence
  chemically synthesized
tgaatttgttctatattctt

SEQ ID NO: 535375 - DNA, 20 bp, Artificial Sequence
  chemically synthesized
tctatgtcatattttcgtta

SEQ ID NO: 535376 - DNA, 20 bp, Artificial Sequence
  chemically synthesized
ttacagttgaacaaactgta

SEQ ID NO: 535377 - DNA, 20 bp, Artificial Sequence
  chemically synthesized
tcatgctatttctacaaata

SEQ ID NO: 535378 - DNA, 20 bp, Artificial Sequence
  chemically synthesized
tttctggttttcttgtattt

SEQ ID NO: 535379 - DNA, 20 bp, Artificial Sequence
  chemically synthesized
tttctacaaatacaagaaaa

SEQ ID NO: 535380 - DNA, 20 bp, Artificial Sequence
  chemically synthesized
acatcaccttttattcatga

SEQ ID NO: 535381 - DNA, 20 bp, Artificial Sequence
  chemically synthesized
gacaaaaaaaaaaaaaagga

SEQ ID NO: 535382 - DNA, 20 bp, Artificial Sequence
  chemically synthesized
ttcattacacatccagagaa

SEQ ID NO: 535383 - DNA, 20 bp, Artificial Sequence
  chemically synthesized
ttttctttcattacacatcc

SEQ ID NO: 535384 - DNA, 20 bp, Artificial Sequence
  chemically synthesized
atttctctggatgtgtaatg

SEQ ID NO: 535385 - DNA, 20 bp, Artificial Sequence
  chemically synthesized
cttttgttatttcaaatgga

SEQ ID NO: 535386 - DNA, 20 bp, Artificial Sequence
  chemically synthesized
tctggaaagagaatgtggac

SEQ ID NO: 535387 - DNA, 20 bp, Artificial Sequence
  chemically synthesized
ataaaacttaaaatctggaa

SEQ ID NO: 535388 - DNA, 20 bp, Artificial Sequence
  chemically synthesized
cactatcaacgaataggaca

SEQ ID NO: 535389 - DNA, 20 bp, Artificial Sequence
  chemically synthesized
ttacatatagtaatttatat

SEQ ID NO: 535390 - DNA, 20 bp, Artificial Sequence
  chemically synthesized
tttataaataaaatgatttc

SEQ ID NO: 535391 - DNA, 20 bp, Artificial Sequence
  chemically synthesized
ctagagcaactgtctgaggg

SEQ ID NO: 535392 - DNA, 20 bp, Artificial Sequence
  chemically synthesized
aaattatagacatagtgcga

SEQ ID NO: 535393 - DNA, 20 bp, Artificial Sequence
  chemically synthesized
gcttttaccaaattaatctt

SEQ ID NO: 535394 - DNA, 20 bp, Artificial Sequence
  chemically synthesized
aatttggtaaaagcatatgt

SEQ ID NO: 535395 - DNA, 20 bp, Artificial Sequence
  chemically synthesized
tctacacaaatggtttccat

SEQ ID NO: 535396 - DNA, 20 bp, Artificial Sequence
  chemically synthesized
ggtttccatggagaaatcac

SEQ ID NO: 535397 - DNA, 20 bp, Artificial Sequence
  chemically synthesized
aacatttccaaaattgtcct

SEQ ID NO: 535398 - DNA, 20 bp, Artificial Sequence
  chemically synthesized
atgttgagatcttttatcaa

SEQ ID NO: 535399 - DNA, 20 bp, Artificial Sequence
  chemically synthesized
ttttatgtcaataaagtggt

SEQ ID NO: 535400 - DNA, 20 bp, Artificial Sequence
  chemically synthesized
catctaaacatagaaaagtt

SEQ ID NO: 535401 - DNA, 20 bp, Artificial Sequence
  chemically synthesized
gtatctaatcacatctaaac

SEQ ID NO: 535402 - DNA, 20 bp, Artificial Sequence
  chemically synthesized
tcaacaacagatatacattc

SEQ ID NO: 535403 - DNA, 20 bp, Artificial Sequence
  chemically synthesized
atacccctgtgaaatcatgt

SEQ ID NO: 535404 - DNA, 20 bp, Artificial Sequence
  chemically synthesized
aatagtaaataaggaaggta

SEQ ID NO: 535405 - DNA, 20 bp, Artificial Sequence
  chemically synthesized
tccttctatggttgttctaa

SEQ ID NO: 535406 - DNA, 20 bp, Artificial Sequence
  chemically synthesized
agaaggaaaaaaaagtgtta

SEQ ID NO: 535407 - DNA, 20 bp, Artificial Sequence
  chemically synthesized
agaaaggcaacattggtaag

SEQ ID NO: 535408 - DNA, 20 bp, Artificial Sequence
  chemically synthesized
aaacaagtaatatagtctgt

SEQ ID NO: 535409 - DNA, 20 bp, Artificial Sequence
  chemically synthesized
ttctagcaatgataatcaaa

SEQ ID NO: 535410 - DNA, 20 bp, Artificial Sequence
  chemically synthesized
aaataaacccactgagttca

SEQ ID NO: 535411 - DNA, 20 bp, Artificial Sequence
  chemically synthesized
tttatttgggtcttaataat

SEQ ID NO: 535412 - DNA, 20 bp, Artificial Sequence
  chemically synthesized
attgatgctaacggacatgt

SEQ ID NO: 535413 - DNA, 20 bp, Artificial Sequence
  chemically synthesized
aatatttttatgttggagaa

SEQ ID NO: 535414 - DNA, 20 bp, Artificial Sequence
  chemically synthesized
cctctgaatatttttatgtt

SEQ ID NO: 535415 - DNA, 20 bp, Artificial Sequence
  chemically synthesized
caacataaaaatattcagag

SEQ ID NO: 535416 - DNA, 20 bp, Artificial Sequence
  chemically synthesized
agaaatcaaggaaataaaat

SEQ ID NO: 535417 - DNA, 20 bp, Artificial Sequence
  chemically synthesized
tagttctgtttaaatttgtt

SEQ ID NO: 535418 - DNA, 20 bp, Artificial Sequence
  chemically synthesized
taaaactgcttatgtccaaa

SEQ ID NO: 535419 - DNA, 20 bp, Artificial Sequence
  chemically synthesized
gatttttttagctaagaagg

SEQ ID NO: 535420 - DNA, 20 bp, Artificial Sequence
  chemically synthesized
ataaaaccttgctagtctga

SEQ ID NO: 535421 - DNA, 20 bp, Artificial Sequence
  chemically synthesized
attttcacattttgaattat

SEQ ID NO: 535422 - DNA, 20 bp, Artificial Sequence
  chemically synthesized
tcacattttgaattatgaag

SEQ ID NO: 535423 - DNA, 20 bp, Artificial Sequence
  chemically synthesized
ctacttgaacagtgcattaa

SEQ ID NO: 535424 - DNA, 20 bp, Artificial Sequence
  chemically synthesized
ctggttaatgcactgttcaa

SEQ ID NO: 535425 - DNA, 20 bp, Artificial Sequence
  chemically synthesized
aactcttctgtgtggggctg

SEQ ID NO: 535426 - DNA, 20 bp, Artificial Sequence
  chemically synthesized
ctactcaggaggctgaggca

SEQ ID NO: 535427 - DNA, 20 bp, Artificial Sequence
  chemically synthesized
aaaacaacaaaacaaaacaa

SEQ ID NO: 535428 - DNA, 20 bp, Artificial Sequence
  chemically synthesized
tttctcatagagcaagactt

SEQ ID NO: 535429 - DNA, 20 bp, Artificial Sequence
  chemically synthesized
attctggaagtcttgctcta

SEQ ID NO: 535430 - DNA, 20 bp, Artificial Sequence
  chemically synthesized
gaagtcttgctctatgagaa

SEQ ID NO: 535431 - DNA, 20 bp, Artificial Sequence
  chemically synthesized
atctggataagccactgtag

SEQ ID NO: 535432 - DNA, 20 bp, Artificial Sequence
  chemically synthesized
ttttagacactctaagaatt

SEQ ID NO: 535433 - DNA, 20 bp, Artificial Sequence
  chemically synthesized
aatcataattttagacactc

SEQ ID NO: 535434 - DNA, 20 bp, Artificial Sequence
  chemically synthesized
aatgatgaatgaaagtctcc

SEQ ID NO: 535435 - DNA, 20 bp, Artificial Sequence
  chemically synthesized
atctttagcggctatgtcaa

SEQ ID NO: 535436 - DNA, 20 bp, Artificial Sequence
  chemically synthesized
atttaaatttatttcgagga

SEQ ID NO: 535437 - DNA, 20 bp, Artificial Sequence
  chemically synthesized
aaatgacaacatacatttga

SEQ ID NO: 535438 - DNA, 20 bp, Artificial Sequence
  chemically synthesized
agacaacagaagcagcttta

SEQ ID NO: 535439 - DNA, 20 bp, Artificial Sequence
  chemically synthesized
ctactcaggaggctgaagca

SEQ ID NO: 535440 - DNA, 20 bp, Artificial Sequence
  chemically synthesized
gaattaacaaaacaaccttt

SEQ ID NO: 535441 - DNA, 20 bp, Artificial Sequence
  chemically synthesized
taatcaactttaaggagtgt

SEQ ID NO: 535442 - DNA, 20 bp, Artificial Sequence
  chemically synthesized
gttttatattttattctttt

SEQ ID NO: 535443 - DNA, 20 bp, Artificial Sequence
  chemically synthesized
aacaaaactccatttctaaa

SEQ ID NO: 535444 - DNA, 20 bp, Artificial Sequence
  chemically synthesized
ggacccgtcctcattttcat

SEQ ID NO: 535445 - DNA, 20 bp, Artificial Sequence
  chemically synthesized
gggcaaagatcagtagttgg

SEQ ID NO: 535446 - DNA, 20 bp, Artificial Sequence
  chemically synthesized
agtggcaggctaatttttat

SEQ ID NO: 535447 - DNA, 20 bp, Artificial Sequence
  chemically synthesized
atagaatcagaagtcccctc

SEQ ID NO: 535448 - DNA, 20 bp, Artificial Sequence
  chemically synthesized
gtaatgaaatgcttccacag

SEQ ID NO: 535449 - DNA, 20 bp, Artificial Sequence
  chemically synthesized
ctttcgtataatataacatg

SEQ ID NO: 535450 - DNA, 20 bp, Artificial Sequence
  chemically synthesized
tcctctccactttcttaagt

SEQ ID NO: 535451 - DNA, 20 bp, Artificial Sequence
  chemically synthesized
aattgagttgattctatact

SEQ ID NO: 535452 - DNA, 20 bp, Artificial Sequence
  chemically synthesized
attatttttgaacactcaaa

SEQ ID NO: 535453 - DNA, 20 bp, Artificial Sequence
  chemically synthesized
aagttaatctatgttcaact

SEQ ID NO: 535454 - DNA, 20 bp, Artificial Sequence
  chemically synthesized
ctgtattatttatttcaaga

SEQ ID NO: 535455 - DNA, 20 bp, Artificial Sequence
  chemically synthesized
ctcctatgatttattcaaga

SEQ ID NO: 535456 - DNA, 20 bp, Artificial Sequence
  chemically synthesized
tatatctcctatgatttatt

SEQ ID NO: 535457 - DNA, 20 bp, Artificial Sequence
  chemically synthesized
taaacaagtgacataatatt

SEQ ID NO: 535458 - DNA, 20 bp, Artificial Sequence
  chemically synthesized
atattatgtcacttgtttac

SEQ ID NO: 535459 - DNA, 20 bp, Artificial Sequence
  chemically synthesized
agttatttttataaatcgaa

SEQ ID NO: 535460 - DNA, 20 bp, Artificial Sequence
  chemically synthesized
agaaattgactcaaatcatt

SEQ ID NO: 535461 - DNA, 20 bp, Artificial Sequence
  chemically synthesized
attgtgcttttatgattttt

SEQ ID NO: 535462 - DNA, 20 bp, Artificial Sequence
  chemically synthesized
tgaaaaaggcaggcacatat

SEQ ID NO: 535463 - DNA, 20 bp, Artificial Sequence
  chemically synthesized
aggcaggcacatatttagaa

SEQ ID NO: 535464 - DNA, 20 bp, Artificial Sequence
  chemically synthesized
tggtttcaatcatatatgta

SEQ ID NO: 535465 - DNA, 20 bp, Artificial Sequence
  chemically synthesized
atagggcagtcatggccaca

SEQ ID NO: 535466 - DNA, 20 bp, Artificial Sequence
  chemically synthesized
attttagagtgtatcctcta

SEQ ID NO: 535467 - DNA, 20 bp, Artificial Sequence
  chemically synthesized
aagacagtcaatatatttct

SEQ ID NO: 535468 - DNA, 20 bp, Artificial Sequence
  chemically synthesized
tacagtgtcataaagattct

SEQ ID NO: 535469 - DNA, 20 bp, Artificial Sequence
  chemically synthesized
aagtaagcacttgaaggagg

SEQ ID NO: 535470 - DNA, 20 bp, Artificial Sequence
  chemically synthesized
ataaaagtgtggatacaggt

SEQ ID NO: 535471 - DNA, 20 bp, Artificial Sequence
  chemically synthesized
aagactattaagaaaggaga

SEQ ID NO: 535472 - DNA, 20 bp, Artificial Sequence
  chemically synthesized
ggttgaagactattaagaaa

SEQ ID NO: 535473 - DNA, 20 bp, Artificial Sequence
  chemically synthesized
agagtcaggttgaagactat

SEQ ID NO: 535474 - DNA, 20 bp, Artificial Sequence
  chemically synthesized
cctaacattaaaggtaataa

SEQ ID NO: 535475 - DNA, 20 bp, Artificial Sequence
  chemically synthesized
acaataacattatataactt

SEQ ID NO: 535476 - DNA, 20 bp, Artificial Sequence
  chemically synthesized
cttattacattgctttcctg

SEQ ID NO: 535477 - DNA, 20 bp, Artificial Sequence
  chemically synthesized
tattgttttcatagaaatac

SEQ ID NO: 535478 - DNA, 20 bp, Artificial Sequence
  chemically synthesized
gagtgatttttattgttttc

SEQ ID NO: 535479 - DNA, 20 bp, Artificial Sequence
  chemically synthesized
aaaggagccctaactagatc

SEQ ID NO: 535480 - DNA, 20 bp, Artificial Sequence
  chemically synthesized
ccaagaaaggaaatttgtaa

SEQ ID NO: 535481 - DNA, 20 bp, Artificial Sequence
  chemically synthesized
tctcaaataaataaataatt

SEQ ID NO: 535482 - DNA, 20 bp, Artificial Sequence
  chemically synthesized
ctactcctgaggctgaggca

SEQ ID NO: 535483 - DNA, 20 bp, Artificial Sequence
  chemically synthesized
gagaccagcctgaccaacat

SEQ ID NO: 535484 - DNA, 20 bp, Artificial Sequence
  chemically synthesized
cgtgagctaccatgcccggc

SEQ ID NO: 535485 - DNA, 20 bp, Artificial Sequence
  chemically synthesized
gtttgccattgtgtttaaat

SEQ ID NO: 535486 - DNA, 20 bp, Artificial Sequence
  chemically synthesized
ggcaaacataaacttcctta

SEQ ID NO: 535487 - DNA, 20 bp, Artificial Sequence
  chemically synthesized
acacagtacagtgacttcca

SEQ ID NO: 535488 - DNA, 20 bp, Artificial Sequence
  chemically synthesized
ttttgcttgataagattttg

SEQ ID NO: 535489 - DNA, 20 bp, Artificial Sequence
  chemically synthesized
ataagtttatgtagtttctt

SEQ ID NO: 535490 - DNA, 20 bp, Artificial Sequence
  chemically synthesized
ataccatatgcttttttctt

SEQ ID NO: 535491 - DNA, 20 bp, Artificial Sequence
  chemically synthesized
taaaaaggtaattaggagac

SEQ ID NO: 535492 - DNA, 20 bp, Artificial Sequence
  chemically synthesized
ggtttatttttgttatgacc

SEQ ID NO: 535493 - DNA, 20 bp, Artificial Sequence
  chemically synthesized
tggatttggtctcattaggt

SEQ ID NO: 535494 - DNA, 20 bp, Artificial Sequence
  chemically synthesized
tttggtctcattaggtaaag

SEQ ID NO: 535495 - DNA, 20 bp, Artificial Sequence
  chemically synthesized
ataccaattaagaaattaat

SEQ ID NO: 535496 - DNA, 20 bp, Artificial Sequence
  chemically synthesized
cttgtttaagaaataccaat

SEQ ID NO: 535497 - DNA, 20 bp, Artificial Sequence
  chemically synthesized
catttctgcacaaacttgtt

SEQ ID NO: 535498 - DNA, 20 bp, Artificial Sequence
  chemically synthesized
tatttcttaaacaagtttgt

SEQ ID NO: 535499 - DNA, 20 bp, Artificial Sequence
  chemically synthesized
ctggattgttgatcgatgaa

SEQ ID NO: 535500 - DNA, 20 bp, Artificial Sequence
  chemically synthesized
ttgatcgatgaaagagaaaa

SEQ ID NO: 535501 - DNA, 20 bp, Artificial Sequence
  chemically synthesized
tgttttgttataatttggat

SEQ ID NO: 535502 - DNA, 20 bp, Artificial Sequence
  chemically synthesized
tgaggggggtggctgaggaa

SEQ ID NO: 535503 - DNA, 20 bp, Artificial Sequence
  chemically synthesized
ctgaggaaatagaaaagaag

SEQ ID NO: 535504 - DNA, 20 bp, Artificial Sequence
  chemically synthesized
attctgttgtcacaaaccca

SEQ ID NO: 535505 - DNA, 20 bp, Artificial Sequence
  chemically synthesized
tttctgctgggtttgtgaca

SEQ ID NO: 535506 - DNA, 20 bp, Artificial Sequence
  chemically synthesized
ttgtgacaacagaataaaac

SEQ ID NO: 535507 - DNA, 20 bp, Artificial Sequence
  chemically synthesized
taaactaaaagcaatacaaa

SEQ ID NO: 535508 - DNA, 20 bp, Artificial Sequence
  chemically synthesized
acttgtgtagtatagccctg

SEQ ID NO: 535509 - DNA, 20 bp, Artificial Sequence
  chemically synthesized
ctattcaccaaaagttataa

SEQ ID NO: 535510 - DNA, 20 bp, Artificial Sequence
  chemically synthesized
aaaaagcatttgaattagct

SEQ ID NO: 535511 - DNA, 20 bp, Artificial Sequence
  chemically synthesized
ccactgcacttgtattgaat

SEQ ID NO: 535512 - DNA, 20 bp, Artificial Sequence
  chemically synthesized
actagtgttgctatcaacaa

SEQ ID NO: 535513 - DNA, 20 bp, Artificial Sequence
  chemically synthesized
gggatggtgggagacaggag

SEQ ID NO: 535514 - DNA, 20 bp, Artificial Sequence
  chemically synthesized
agcaaggaaagaaaaaaaga

SEQ ID NO: 535515 - DNA, 20 bp, Artificial Sequence
  chemically synthesized
acaaaagaaaggtagcaagg

SEQ ID NO: 535516 - DNA, 20 bp, Artificial Sequence
  chemically synthesized
ggaaggagagagaaaagaca

SEQ ID NO: 535517 - DNA, 20 bp, Artificial Sequence
  chemically synthesized
gcaggaaaaaggggaaggag

SEQ ID NO: 535518 - DNA, 20 bp, Artificial Sequence
  chemically synthesized
gagagaacaaagaagggagg

SEQ ID NO: 535519 - DNA, 20 bp, Artificial Sequence
  chemically synthesized
atttgatagattatgtcaaa

SEQ ID NO: 535520 - DNA, 20 bp, Artificial Sequence
  chemically synthesized
tctgaaacaacaatatttga

SEQ ID NO: 535521 - DNA, 20 bp, Artificial Sequence
  chemically synthesized
acttatgtttatgtgatgaa

SEQ ID NO: 535522 - DNA, 20 bp, Artificial Sequence
  chemically synthesized
gtactttatagcttagtgtc

SEQ ID NO: 535523 - DNA, 20 bp, Artificial Sequence
  chemically synthesized
actgctattgattcacaatt

SEQ ID NO: 535524 - DNA, 20 bp, Artificial Sequence
  chemically synthesized
tgaagttcaaagtttaattt

SEQ ID NO: 535525 - DNA, 20 bp, Artificial Sequence
  chemically synthesized
aaatataccattatctttta

SEQ ID NO: 535526 - DNA, 20 bp, Artificial Sequence
  chemically synthesized
aatctgcttcattttagaca

SEQ ID NO: 535527 - DNA, 20 bp, Artificial Sequence
  chemically synthesized
actttaatttttttaagttt

SEQ ID NO: 535528 - DNA, 20 bp, Artificial Sequence
  chemically synthesized
tgcttgattaaagtattatt

SEQ ID NO: 535529 - DNA, 20 bp, Artificial Sequence
  chemically synthesized
actagctttagactttgaac

SEQ ID NO: 535530 - DNA, 20 bp, Artificial Sequence
  chemically synthesized
ttccctgggccacactggaa

SEQ ID NO: 535531 - DNA, 20 bp, Artificial Sequence
  chemically synthesized
acaaaaagtatctcatgttt

SEQ ID NO: 535532 - DNA, 20 bp, Artificial Sequence
  chemically synthesized
ctgaactcagtcaagaacat

SEQ ID NO: 535533 - DNA, 20 bp, Artificial Sequence
  chemically synthesized
aattattgtttagtggttgg

SEQ ID NO: 535534 - DNA, 20 bp, Artificial Sequence
  chemically synthesized
tagaacccagtttctattca

SEQ ID NO: 535535 - DNA, 20 bp, Artificial Sequence
  chemically synthesized
gggaaaggcaattctcctga

SEQ ID NO: 535536 - DNA, 20 bp, Artificial Sequence
  chemically synthesized
aatacatgagctagaaggga

SEQ ID NO: 535537 - DNA, 20 bp, Artificial Sequence
  chemically synthesized
aacagagttacacacaggat

SEQ ID NO: 535538 - DNA, 20 bp, Artificial Sequence
  chemically synthesized
acttcttgctagccacatgc

SEQ ID NO: 535539 - DNA, 20 bp, Artificial Sequence
  chemically synthesized
aacaaaacttacaaaaggaa

SEQ ID NO: 535540 - DNA, 20 bp, Artificial Sequence
  chemically synthesized
tcattctctgattaaatcag

SEQ ID NO: 535541 - DNA, 20 bp, Artificial Sequence
  chemically synthesized
actttctgcctgatttaatc

SEQ ID NO: 535542 - DNA, 20 bp, Artificial Sequence
  chemically synthesized
gagctctctggatgcaagca

SEQ ID NO: 535543 - DNA, 20 bp, Artificial Sequence
  chemically synthesized
agttaagggtatatgatgag

SEQ ID NO: 535544 - DNA, 20 bp, Artificial Sequence
  chemically synthesized
aaaaacttaagccaggcatt

SEQ ID NO: 535545 - DNA, 20 bp, Artificial Sequence
  chemically synthesized
agggaaaactaagccaggag

SEQ ID NO: 535546 - DNA, 20 bp, Artificial Sequence
  chemically synthesized
ctcctggcttagttttccct

SEQ ID NO: 535547 - DNA, 20 bp, Artificial Sequence
  chemically synthesized
ataacctgcctgagatcgag

SEQ ID NO: 535548 - DNA, 20 bp, Artificial Sequence
  chemically synthesized
acagtaatgttgtaagcatt

SEQ ID NO: 535549 - DNA, 20 bp, Artificial Sequence
  chemically synthesized
gcaggtaaaagaggttgaag

SEQ ID NO: 535550 - DNA, 20 bp, Artificial Sequence
  chemically synthesized
gaaacataaagttgtacaac

SEQ ID NO: 535551 - DNA, 20 bp, Artificial Sequence
  chemically synthesized
ccaagaactgacaatgtctt

SEQ ID NO: 535552 - DNA, 20 bp, Artificial Sequence
  chemically synthesized
aaatcctgtatttttgtgtc

SEQ ID NO: 535553 - DNA, 20 bp, Artificial Sequence
  chemically synthesized
tgacagagtgagactccatc

SEQ ID NO: 535554 - DNA, 20 bp, Artificial Sequence
  chemically synthesized
ctactagggaggctgaggca

SEQ ID NO: 535555 - DNA, 20 bp, Artificial Sequence
  chemically synthesized
tctaaataaatgtgtccttt

SEQ ID NO: 535556 - DNA, 20 bp, Artificial Sequence
  chemically synthesized
ttaccagataatagattggg

SEQ ID NO: 535557 - DNA, 20 bp, Artificial Sequence
  chemically synthesized
atttggttccaccacgaact

SEQ ID NO: 535558 - DNA, 20 bp, Artificial Sequence
  chemically synthesized
ataaacttgggctcaggtag

SEQ ID NO: 535559 - DNA, 20 bp, Artificial Sequence
  chemically synthesized
gttgctatgtactgatacat

SEQ ID NO: 535560 - DNA, 20 bp, Artificial Sequence
  chemically synthesized
agtaattatagccacatttt

SEQ ID NO: 535561 - DNA, 20 bp, Artificial Sequence
  chemically synthesized
gtactctgtatgctctgtac

SEQ ID NO: 535562 - DNA, 20 bp, Artificial Sequence
  chemically synthesized
attggtgaagtttattttac

SEQ ID NO: 535563 - DNA, 20 bp, Artificial Sequence
  chemically synthesized
cagcacaactttgtatttct

SEQ ID NO: 535564 - DNA, 20 bp, Artificial Sequence
  chemically synthesized
aacagctttcaagcctttct

SEQ ID NO: 535565 - DNA, 20 bp, Artificial Sequence
  chemically synthesized
cttttatatttgtgaatgat

SEQ ID NO: 535566 - DNA, 20 bp, Artificial Sequence
  chemically synthesized
tatgacatcaactagaaaca

SEQ ID NO: 535567 - DNA, 20 bp, Artificial Sequence
  chemically synthesized
tggtaaaattatgacatcaa

SEQ ID NO: 535568 - DNA, 20 bp, Artificial Sequence
  chemically synthesized
aagagagctataacttaaaa

SEQ ID NO: 535569 - DNA, 20 bp, Artificial Sequence
  chemically synthesized
actacgcagcccaacatatt

SEQ ID NO: 535570 - DNA, 20 bp, Artificial Sequence
  chemically synthesized
aaaaaaaagcagaaacctta

SEQ ID NO: 535571 - DNA, 20 bp, Artificial Sequence
  chemically synthesized
aaaaaaaaaaaaaaaaaaaa

SEQ ID NO: 535572 - DNA, 20 bp, Artificial Sequence
  chemically synthesized
agagtaatgtgtttgctgag

SEQ ID NO: 535573 - DNA, 20 bp, Artificial Sequence
  chemically synthesized
tggtggaaaatcttcatttt

SEQ ID NO: 535574 - DNA, 20 bp, Artificial Sequence
  chemically synthesized
tgatcatcaagcagaaggta

SEQ ID NO: 535575 - DNA, 20 bp, Artificial Sequence
  chemically synthesized
attttataacttgatcaagc

SEQ ID NO: 535576 - DNA, 20 bp, Artificial Sequence
  chemically synthesized
aggaaactgccatctccaaa

SEQ ID NO: 535577 - DNA, 20 bp, Artificial Sequence
  chemically synthesized
tttttgcaaaaaggaaaaaa

SEQ ID NO: 535578 - DNA, 20 bp, Artificial Sequence
  chemically synthesized
caaaaaggaaaaaagaagaa

SEQ ID NO: 535579 - DNA, 20 bp, Artificial Sequence
  chemically synthesized
aaaaagaagaaaaagaaaaa

SEQ ID NO: 535580 - DNA, 20 bp, Artificial Sequence
  chemically synthesized
taaacaaagtatccacattg

SEQ ID NO: 535581 - DNA, 20 bp, Artificial Sequence
  chemically synthesized
actttgtttagcaatacatg

SEQ ID NO: 535582 - DNA, 20 bp, Artificial Sequence
  chemically synthesized
ttaagttacttgtccaggca

SEQ ID NO: 535583 - DNA, 20 bp, Artificial Sequence
  chemically synthesized
atatacattgtggaagtggt

SEQ ID NO: 535584 - DNA, 20 bp, Artificial Sequence
  chemically synthesized
ttacttattttttttttatt

SEQ ID NO: 535585 - DNA, 20 bp, Artificial Sequence
  chemically synthesized
ctattcaagggaattttaaa

SEQ ID NO: 535586 - DNA, 20 bp, Artificial Sequence
  chemically synthesized
ttactaacaatctgaaataa

SEQ ID NO: 535587 - DNA, 20 bp, Artificial Sequence
  chemically synthesized
ttagtaaactggccagcagt

SEQ ID NO: 535588 - DNA, 20 bp, Artificial Sequence
  chemically synthesized
aaactactaactcgcatttt

SEQ ID NO: 535589 - DNA, 20 bp, Artificial Sequence
  chemically synthesized
aaacagtatttcatgtctaa

SEQ ID NO: 535590 - DNA, 20 bp, Artificial Sequence
  chemically synthesized
aatggttaagatgcatagta

SEQ ID NO: 535591 - DNA, 20 bp, Artificial Sequence
  chemically synthesized
gcaatacacgtatgacaatg

SEQ ID NO: 535592 - DNA, 20 bp, Artificial Sequence
  chemically synthesized
ttttataaacgcctggctag

SEQ ID NO: 535593 - DNA, 20 bp, Artificial Sequence
  chemically synthesized
acagtgatgaacaactgtgg

SEQ ID NO: 535594 - DNA, 20 bp, Artificial Sequence
  chemically synthesized
ggacaaccagtgaacgattc

SEQ ID NO: 535595 - DNA, 20 bp, Artificial Sequence
  chemically synthesized
ctcatttttttttaatattc

SEQ ID NO: 535596 - DNA, 20 bp, Artificial Sequence
  chemically synthesized
aaaattaatgattggctacc

SEQ ID NO: 535597 - DNA, 20 bp, Artificial Sequence
  chemically synthesized
ctcattagagaagaagatga

SEQ ID NO: 535598 - DNA, 20 bp, Artificial Sequence
  chemically synthesized
agaagaagatgagtagaatg

SEQ ID NO: 535599 - DNA, 20 bp, Artificial Sequence
  chemically synthesized
tccctgagaagcttgagaga

SEQ ID NO: 535600 - DNA, 20 bp, Artificial Sequence
  chemically synthesized
caaaattagttccttcattc

SEQ ID NO: 535601 - DNA, 20 bp, Artificial Sequence
  chemically synthesized
actaattttgatcaatgcag

SEQ ID NO: 535602 - DNA, 20 bp, Artificial Sequence
  chemically synthesized
aatagtgttttaattgtcag

SEQ ID NO: 535603 - DNA, 20 bp, Artificial Sequence
  chemically synthesized
ggcagtaacagtgaggcaat

SEQ ID NO: 535604 - DNA, 20 bp, Artificial Sequence
  chemically synthesized
tcagagtagtcagatagctt

SEQ ID NO: 535605 - DNA, 20 bp, Artificial Sequence
  chemically synthesized
tgactactctgaggctcttt

SEQ ID NO: 535606 - DNA, 20 bp, Artificial Sequence
  chemically synthesized
tactctgaggctctttctag

SEQ ID NO: 535607 - DNA, 20 bp, Artificial Sequence
  chemically synthesized
tacattacatttaattcttt

SEQ ID NO: 535608 - DNA, 20 bp, Artificial Sequence
  chemically synthesized
agaattaaatgtaatgtaaa

SEQ ID NO: 535609 - DNA, 20 bp, Artificial Sequence
  chemically synthesized
ttttgtgtcacagtccagga

SEQ ID NO: 535610 - DNA, 20 bp, Artificial Sequence
  chemically synthesized
aatcatggaagcaaaaagat

SEQ ID NO: 535611 - DNA, 20 bp, Artificial Sequence
  chemically synthesized
tttcaagcttatgggaagtg

SEQ ID NO: 535612 - DNA, 20 bp, Artificial Sequence
  chemically synthesized
tcatggtcagaagtaagtct

SEQ ID NO: 535613 - DNA, 20 bp, Artificial Sequence
  chemically synthesized
aaagtgaaggatgaggaact

SEQ ID NO: 535614 - DNA, 20 bp, Artificial Sequence
  chemically synthesized
aaaagcacgtttggaaaaag

SEQ ID NO: 535615 - DNA, 20 bp, Artificial Sequence
  chemically synthesized
gacagaaaggaagaaggaaa

SEQ ID NO: 535616 - DNA, 20 bp, Artificial Sequence
  chemically synthesized
agggcctgagactcaaaaag

SEQ ID NO: 535617 - DNA, 20 bp, Artificial Sequence
  chemically synthesized
gcatgctggagaagagaaga

SEQ ID NO: 535618 - DNA, 20 bp, Artificial Sequence
  chemically synthesized
agatgcaagagatagagcag

SEQ ID NO: 535619 - DNA, 20 bp, Artificial Sequence
  chemically synthesized
aattgattccctttgaatct

SEQ ID NO: 535620 - DNA, 20 bp, Artificial Sequence
  chemically synthesized
taaaatttaacagccaccca

SEQ ID NO: 535621 - DNA, 20 bp, Artificial Sequence
  chemically synthesized
aacagccacccattagaatg

SEQ ID NO: 535622 - DNA, 20 bp, Artificial Sequence
  chemically synthesized
tgaaagatcaaatattaaag

SEQ ID NO: 535623 - DNA, 20 bp, Artificial Sequence
  chemically synthesized
cattttttttcctatcgaag

SEQ ID NO: 535624 - DNA, 20 bp, Artificial Sequence
  chemically synthesized
aagcaggaaatagctctgaa

SEQ ID NO: 535625 - DNA, 20 bp, Artificial Sequence
  chemically synthesized
tctgaatcagaaagcagggt

SEQ ID NO: 535626 - DNA, 20 bp, Artificial Sequence
  chemically synthesized
tcaaatacaacaatctggtc

SEQ ID NO: 535627 - DNA, 20 bp, Artificial Sequence
  chemically synthesized
gagaaatgcaggaaaaagag

SEQ ID NO: 535628 - DNA, 20 bp, Artificial Sequence
  chemically synthesized
aggagccaataaccattgtg

SEQ ID NO: 535629 - DNA, 20 bp, Artificial Sequence
  chemically synthesized
atgggtgtggaggagcctgg

SEQ ID NO: 535630 - DNA, 20 bp, Artificial Sequence
  chemically synthesized
tgaaatggcctgtgctcatg

SEQ ID NO: 535631 - DNA, 20 bp, Artificial Sequence
  chemically synthesized
agaaaaagttttcaagaagt

SEQ ID NO: 535632 - DNA, 20 bp, Artificial Sequence
  chemically synthesized
gatttttgtctggaaacagg

SEQ ID NO: 535633 - DNA, 20 bp, Artificial Sequence
  chemically synthesized
aatctagagttgacatttaa

SEQ ID NO: 535634 - DNA, 20 bp, Artificial Sequence
  chemically synthesized
attctggtcctccccaaaac

SEQ ID NO: 535635 - DNA, 20 bp, Artificial Sequence
  chemically synthesized
tttctgtgttttggggagga

SEQ ID NO: 535636 - DNA, 20 bp, Artificial Sequence
  chemically synthesized
ctaaaatatctccatgagga

SEQ ID NO: 535637 - DNA, 20 bp, Artificial Sequence
  chemically synthesized
taaaaagtgtttaggaccca

SEQ ID NO: 535638 - DNA, 20 bp, Artificial Sequence
  chemically synthesized
tagtgataactagatttaag

SEQ ID NO: 535639 - DNA, 20 bp, Artificial Sequence
  chemically synthesized
ttgagagttggattctaaag

SEQ ID NO: 535640 - DNA, 20 bp, Artificial Sequence
  chemically synthesized
gagacccaaagtttctgact

SEQ ID NO: 535641 - DNA, 20 bp, Artificial Sequence
  chemically synthesized
cacattagagccatttctgt

SEQ ID NO: 535642 - DNA, 20 bp, Artificial Sequence
  chemically synthesized
tttaagtaatgtttttctga

SEQ ID NO: 535643 - DNA, 20 bp, Artificial Sequence
  chemically synthesized
gaatccagaggcaagtcttt

SEQ ID NO: 535644 - DNA, 20 bp, Artificial Sequence
  chemically synthesized
aaacgcatctgaaagtgcag

SEQ ID NO: 535645 - DNA, 20 bp, Artificial Sequence
  chemically synthesized
tagtactatgacatggtgga

SEQ ID NO: 535646 - DNA, 20 bp, Artificial Sequence
  chemically synthesized
ttttccaccatgtcatagta

SEQ ID NO: 535647 - DNA, 20 bp, Artificial Sequence
  chemically synthesized
taggatatataaattattac

SEQ ID NO: 535648 - DNA, 20 bp, Artificial Sequence
  chemically synthesized
tgtaacccaagataggggca

SEQ ID NO: 535649 - DNA, 20 bp, Artificial Sequence
  chemically synthesized
aattcctccaatggacttga

SEQ ID NO: 535650 - DNA, 20 bp, Artificial Sequence
  chemically synthesized
gaacctttaatagcataaca

SEQ ID NO: 535651 - DNA, 20 bp, Artificial Sequence
  chemically synthesized
ttaattttctaatgaatgca

SEQ ID NO: 535652 - DNA, 20 bp, Artificial Sequence
  chemically synthesized
atacctttctcatgcattca

SEQ ID NO: 535653 - DNA, 20 bp, Artificial Sequence
  chemically synthesized
ttccctccatagttaagcag

SEQ ID NO: 535654 - DNA, 20 bp, Artificial Sequence
  chemically synthesized
aatgaattgagtttggcaca

SEQ ID NO: 535655 - DNA, 20 bp, Artificial Sequence
  chemically synthesized
cacaggtctcctttggttga

SEQ ID NO: 535656 - DNA, 20 bp, Artificial Sequence
  chemically synthesized
cccacattcattcaacaaag

SEQ ID NO: 535657 - DNA, 20 bp, Artificial Sequence
  chemically synthesized
ctcacattaacaattctatg

SEQ ID NO: 535658 - DNA, 20 bp, Artificial Sequence
  chemically synthesized
cactttttagatattctctc

SEQ ID NO: 535659 - DNA, 20 bp, Artificial Sequence
  chemically synthesized
ctatttaatactatggggta

SEQ ID NO: 535660 - DNA, 20 bp, Artificial Sequence
  chemically synthesized
tcctccatgtaagcaacatt

SEQ ID NO: 535661 - DNA, 20 bp, Artificial Sequence
  chemically synthesized
ccatcctttcaaatattcaa

SEQ ID NO: 535662 - DNA, 20 bp, Artificial Sequence
  chemically synthesized
atttggattaatgaattccg

SEQ ID NO: 535663 - DNA, 20 bp, Artificial Sequence
  chemically synthesized
aagaattcaagagaacttct

SEQ ID NO: 535664 - DNA, 20 bp, Artificial Sequence
  chemically synthesized
ttgaaatcatgtctagattc

SEQ ID NO: 535665 - DNA, 20 bp, Artificial Sequence
  chemically synthesized
tacacaatagattgtctttc

SEQ ID NO: 535666 - DNA, 20 bp, Artificial Sequence
  chemically synthesized
caatctattgtgtaggtaag

SEQ ID NO: 535667 - DNA, 20 bp, Artificial Sequence
  chemically synthesized
tgcacatacaagttggaaaa

SEQ ID NO: 535668 - DNA, 20 bp, Artificial Sequence
  chemically synthesized
ttactctttagagtgacaga

SEQ ID NO: 535669 - DNA, 20 bp, Artificial Sequence
  chemically synthesized
tttatttactctttagagtg

SEQ ID NO: 535670 - DNA, 20 bp, Artificial Sequence
  chemically synthesized
taacatcaataattctcatt

SEQ ID NO: 535671 - DNA, 20 bp, Artificial Sequence
  chemically synthesized
aagcatttatttttctaaaa

SEQ ID NO: 535672 - DNA, 20 bp, Artificial Sequence
  chemically synthesized
accatttgtatttctggatt

SEQ ID NO: 535673 - DNA, 20 bp, Artificial Sequence
  chemically synthesized
aacatttttttttcttaaat

SEQ ID NO: 535674 - DNA, 20 bp, Artificial Sequence
  chemically synthesized
attatatttttaatagcaag

SEQ ID NO: 535675 - DNA, 20 bp, Artificial Sequence
  chemically synthesized
ttggattatatttttaatag

SEQ ID NO: 535676 - DNA, 20 bp, Artificial Sequence
  chemically synthesized
gaagaaccttgcctagcaca

SEQ ID NO: 535677 - DNA, 20 bp, Artificial Sequence
  chemically synthesized
ttaaccactgcacatatttc

SEQ ID NO: 535678 - DNA, 20 bp, Artificial Sequence
  chemically synthesized
tacctgatgtcctatgattc

SEQ ID NO: 535679 - DNA, 20 bp, Artificial Sequence
  chemically synthesized
tgcatattgaatgagacatg

SEQ ID NO: 535680 - DNA, 20 bp, Artificial Sequence
  chemically synthesized
tacatgtctcattcaatatg

SEQ ID NO: 535681 - DNA, 20 bp, Artificial Sequence
  chemically synthesized
cacaacttaaatattaccct

SEQ ID NO: 535682 - DNA, 20 bp, Artificial Sequence
  chemically synthesized
cttccttcactaacttgaat

SEQ ID NO: 535683 - DNA, 20 bp, Artificial Sequence
  chemically synthesized
aatgtcaatagtgctgagat

SEQ ID NO: 535684 - DNA, 20 bp, Artificial Sequence
  chemically synthesized
ctgtcctgtgcattgtagga

SEQ ID NO: 535685 - DNA, 20 bp, Artificial Sequence
  chemically synthesized
ttaccaaatgtctcctgagg

SEQ ID NO: 535686 - DNA, 20 bp, Artificial Sequence
  chemically synthesized
cccacctctcaaatagctgc

SEQ ID NO: 535687 - DNA, 20 bp, Artificial Sequence
  chemically synthesized
taatttctacttctgaggaa

SEQ ID NO: 535688 - DNA, 20 bp, Artificial Sequence
  chemically synthesized
ttttttctcattcctcagaa

SEQ ID NO: 535689 - DNA, 20 bp, Artificial Sequence
  chemically synthesized
ttcctcagaagtagaaatta

SEQ ID NO: 535690 - DNA, 20 bp, Artificial Sequence
  chemically synthesized
acaaaagtgtagatgcaaga

SEQ ID NO: 535691 - DNA, 20 bp, Artificial Sequence
  chemically synthesized
acagactatggctcttaatg

SEQ ID NO: 535692 - DNA, 20 bp, Artificial Sequence
  chemically synthesized
ccaatccatattcaaggagt

SEQ ID NO: 535693 - DNA, 20 bp, Artificial Sequence
  chemically synthesized
gagcacagctgagtctagca

SEQ ID NO: 535694 - DNA, 20 bp, Artificial Sequence
  chemically synthesized
ctcgatgaaccaagccccaa

SEQ ID NO: 535695 - DNA, 20 bp, Artificial Sequence
  chemically synthesized
aaccaagccccaagcagaat

SEQ ID NO: 535696 - DNA, 20 bp, Artificial Sequence
  chemically synthesized
ccaaatgtagagacttaaaa

SEQ ID NO: 535697 - DNA, 20 bp, Artificial Sequence
  chemically synthesized
aaaattcccttcccattacc

SEQ ID NO: 535698 - DNA, 20 bp, Artificial Sequence
  chemically synthesized
tcccattaccacagaaatta

SEQ ID NO: 535699 - DNA, 20 bp, Artificial Sequence
  chemically synthesized
aatgtggaatggaattccac

SEQ ID NO: 535700 - DNA, 20 bp, Artificial Sequence
  chemically synthesized
cagcatttgacaggatattt

SEQ ID NO: 535701 - DNA, 20 bp, Artificial Sequence
  chemically synthesized
tgaagaaagtaacactttta

SEQ ID NO: 535702 - DNA, 20 bp, Artificial Sequence
  chemically synthesized
gcccagtgcagaagacaagg

SEQ ID NO: 535703 - DNA, 20 bp, Artificial Sequence
  chemically synthesized
catcaattgcaaaactgata

SEQ ID NO: 535704 - DNA, 20 bp, Artificial Sequence
  chemically synthesized
aacattgtgtagttcttatt

SEQ ID NO: 535705 - DNA, 20 bp, Artificial Sequence
  chemically synthesized
ttaaggtgctcagaattttg

SEQ ID NO: 535706 - DNA, 20 bp, Artificial Sequence
  chemically synthesized
tcaggagttttttaaggtgc

SEQ ID NO: 535707 - DNA, 20 bp, Artificial Sequence
  chemically synthesized
attgaataaacaaacccaaa

SEQ ID NO: 535708 - DNA, 20 bp, Artificial Sequence
  chemically synthesized
tgaggtaagcagtgttttct

SEQ ID NO: 535709 - DNA, 20 bp, Artificial Sequence
  chemically synthesized
agagatttagactgaattct

SEQ ID NO: 535710 - DNA, 20 bp, Artificial Sequence
  chemically synthesized
gagctacgttttcaccttaa

SEQ ID NO: 535711 - DNA, 20 bp, Artificial Sequence
  chemically synthesized
taagctatttgagataagta

SEQ ID NO: 535712 - DNA, 20 bp, Artificial Sequence
  chemically synthesized
atttgttgttgttttcacaa

SEQ ID NO: 535713 - DNA, 20 bp, Artificial Sequence
  chemically synthesized
tcaatctagaacttcatcag

SEQ ID NO: 535714 - DNA, 20 bp, Artificial Sequence
  chemically synthesized
attataattgatttgaacca

SEQ ID NO: 535715 - DNA, 20 bp, Artificial Sequence
  chemically synthesized
tggtatgatgaggaaccaat

SEQ ID NO: 535716 - DNA, 20 bp, Artificial Sequence
  chemically synthesized
gtaaattagatgaaaggttc

SEQ ID NO: 535717 - DNA, 20 bp, Artificial Sequence
  chemically synthesized
ctgagaaatctgtattttaa

SEQ ID NO: 535718 - DNA, 20 bp, Artificial Sequence
  chemically synthesized
atttaaatagacatttctcc

SEQ ID NO: 535719 - DNA, 20 bp, Artificial Sequence
  chemically synthesized
gctgtgtatatattttcttt

SEQ ID NO: 535720 - DNA, 20 bp, Artificial Sequence
  chemically synthesized
gaggatgaccacgatcataa

SEQ ID NO: 535721 - DNA, 20 bp, Artificial Sequence
  chemically synthesized
acatgtgctggcaaggatgt

SEQ ID NO: 535722 - DNA, 20 bp, Artificial Sequence
  chemically synthesized
aagttcctcaaaacataaaa

SEQ ID NO: 535723 - DNA, 20 bp, Artificial Sequence
  chemically synthesized
ccagtcctcaaaaaataaaa

SEQ ID NO: 535724 - DNA, 20 bp, Artificial Sequence
  chemically synthesized
gttggggactaaccgtacac

SEQ ID NO: 535725 - DNA, 20 bp, Artificial Sequence
  chemically synthesized
tgaaagcgatatgcattcat

SEQ ID NO: 535726 - DNA, 20 bp, Artificial Sequence
  chemically synthesized
atactgcatatttactagcc

SEQ ID NO: 535727 - DNA, 20 bp, Artificial Sequence
  chemically synthesized
aatgagcatctgtatatcca

SEQ ID NO: 535728 - DNA, 20 bp, Artificial Sequence
  chemically synthesized
agtagttaaactctttagag

SEQ ID NO: 535729 - DNA, 20 bp, Artificial Sequence
  chemically synthesized
cattgttattcaacagatct

SEQ ID NO: 535730 - DNA, 20 bp, Artificial Sequence
  chemically synthesized
ttaagttctgggatacatgt

SEQ ID NO: 535731 - DNA, 20 bp, Artificial Sequence
  chemically synthesized
cagagggagggataacgtta

SEQ ID NO: 535732 - DNA, 20 bp, Artificial Sequence
  chemically synthesized
ctcagcaaactaacacagga

SEQ ID NO: 535733 - DNA, 20 bp, Artificial Sequence
  chemically synthesized
ctgttcctgtgttagtttgc

SEQ ID NO: 535734 - DNA, 20 bp, Artificial Sequence
  chemically synthesized
aaatgtggcacatatacacc

SEQ ID NO: 535735 - DNA, 20 bp, Artificial Sequence
  chemically synthesized
ccatcaataatagactggat

SEQ ID NO: 535736 - DNA, 20 bp, Artificial Sequence
  chemically synthesized
cgtgtgcatgtgtctttaca

SEQ ID NO: 535737 - DNA, 20 bp, Artificial Sequence
  chemically synthesized
gattcctcaaggatctacaa

SEQ ID NO: 535738 - DNA, 20 bp, Artificial Sequence
  chemically synthesized
acagatgctggagaggatgt

SEQ ID NO: 535739 - DNA, 20 bp, Artificial Sequence
  chemically synthesized
gagataccatctcacatcag

SEQ ID NO: 535740 - DNA, 20 bp, Artificial Sequence
  chemically synthesized
gctcatcatcactggtcatt

SEQ ID NO: 535741 - DNA, 20 bp, Artificial Sequence
  chemically synthesized
atgtggtttaatcaaattta

SEQ ID NO: 535742 - DNA, 20 bp, Artificial Sequence
  chemically synthesized
ttgcaatatttgtggggtaa

SEQ ID NO: 535743 - DNA, 20 bp, Artificial Sequence
  chemically synthesized
gtggtgtggttgcattgact

SEQ ID NO: 535744 - DNA, 20 bp, Artificial Sequence
  chemically synthesized
tagccaagagcaggcaccag

SEQ ID NO: 535745 - DNA, 20 bp, Artificial Sequence
  chemically synthesized
aaggaggcagtattgggcag

SEQ ID NO: 535746 - DNA, 20 bp, Artificial Sequence
  chemically synthesized
tctgagacaaaaagttgcac

SEQ ID NO: 535747 - DNA, 20 bp, Artificial Sequence
  chemically synthesized
attttttcaggcattcgata

SEQ ID NO: 535748 - DNA, 20 bp, Artificial Sequence
  chemically synthesized
ctacttgggaggctgaggca

SEQ ID NO: 535749 - DNA, 20 bp, Artificial Sequence
  chemically synthesized
ctccagcctgggagacaaag

SEQ ID NO: 535750 - DNA, 20 bp, Artificial Sequence
  chemically synthesized
aactttttatttatttattt

SEQ ID NO: 535751 - DNA, 20 bp, Artificial Sequence
  chemically synthesized
ggaagtgtgcatatttcaca

SEQ ID NO: 535752 - DNA, 20 bp, Artificial Sequence
  chemically synthesized
tttatgtttttatttaactt

SEQ ID NO: 535753 - DNA, 20 bp, Artificial Sequence
  chemically synthesized
aaaagagatcaaaatcaagg

SEQ ID NO: 535754 - DNA, 20 bp, Artificial Sequence
  chemically synthesized
tggtttggcagggatgtctt

SEQ ID NO: 535755 - DNA, 20 bp, Artificial Sequence
  chemically synthesized
attacctttcatacgttcaa

SEQ ID NO: 535756 - DNA, 20 bp, Artificial Sequence
  chemically synthesized
cacagtaaatggtttctgaa

SEQ ID NO: 535757 - DNA, 20 bp, Artificial Sequence
  chemically synthesized
gagttggatatgtttctact

SEQ ID NO: 535758 - DNA, 20 bp, Artificial Sequence
  chemically synthesized
acatatccaactctgtttat

SEQ ID NO: 535759 - DNA, 20 bp, Artificial Sequence
  chemically synthesized
cctaacatatgatctaccct

SEQ ID NO: 535760 - DNA, 20 bp, Artificial Sequence
  chemically synthesized
atacattcttatcaagtgca

SEQ ID NO: 535761 - DNA, 20 bp, Artificial Sequence
  chemically synthesized
attgtttcttgtgcacttga

SEQ ID NO: 535762 - DNA, 20 bp, Artificial Sequence
  chemically synthesized
gtacatctcatctaacagca

SEQ ID NO: 535763 - DNA, 20 bp, Artificial Sequence
  chemically synthesized
aatccacattaaaaaatcaa

SEQ ID NO: 535764 - DNA, 20 bp, Artificial Sequence
  chemically synthesized
taccccaaattcaacaatag

SEQ ID NO: 535765 - DNA, 20 bp, Artificial Sequence
  chemically synthesized
aagcaaatataaagtgataa

SEQ ID NO: 535766 - DNA, 20 bp, Artificial Sequence
  chemically synthesized
ccatgcaaatggaaaccaaa

SEQ ID NO: 535767 - DNA, 20 bp, Artificial Sequence
  chemically synthesized
tgttgactgaaatagaagag

SEQ ID NO: 535768 - DNA, 20 bp, Artificial Sequence
  chemically synthesized
acaaaggatctacaaaacaa

SEQ ID NO: 535769 - DNA, 20 bp, Artificial Sequence
  chemically synthesized
aaaacccttacgtaagatgt

SEQ ID NO: 535770 - DNA, 20 bp, Artificial Sequence
  chemically synthesized
ggtaaagttaattacaaagt

SEQ ID NO: 535771 - DNA, 20 bp, Artificial Sequence
  chemically synthesized
tcatgctatttttttcatta

SEQ ID NO: 535772 - DNA, 20 bp, Artificial Sequence
  chemically synthesized
tatctagatatcttaggaaa

SEQ ID NO: 535773 - DNA, 20 bp, Artificial Sequence
  chemically synthesized
taaaacaaaaagatacgaag

SEQ ID NO: 535774 - DNA, 20 bp, Artificial Sequence
  chemically synthesized
gcatgaaattaaaccacata

SEQ ID NO: 535775 - DNA, 20 bp, Artificial Sequence
  chemically synthesized
tatctagggtttatcaaact

SEQ ID NO: 535776 - DNA, 20 bp, Artificial Sequence
  chemically synthesized
ggtttatcaaactacagaaa

SEQ ID NO: 535777 - DNA, 20 bp, Artificial Sequence
  chemically synthesized
aggaaaggaattatacatct

SEQ ID NO: 535778 - DNA, 20 bp, Artificial Sequence
  chemically synthesized
accatttacagggcaaaaat

SEQ ID NO: 535779 - DNA, 20 bp, Artificial Sequence
  chemically synthesized
ttttgccctgtaaatggtgg

SEQ ID NO: 535780 - DNA, 20 bp, Artificial Sequence
  chemically synthesized
caatgattaacaatttttaa

SEQ ID NO: 535781 - DNA, 20 bp, Artificial Sequence
  chemically synthesized
tgttcacgttcttgtattcc

SEQ ID NO: 535782 - DNA, 20 bp, Artificial Sequence
  chemically synthesized
gaacagaggcaaagagctag

SEQ ID NO: 535783 - DNA, 20 bp, Artificial Sequence
  chemically synthesized
gtagaaagaccaatttccaa

SEQ ID NO: 535784 - DNA, 20 bp, Artificial Sequence
  chemically synthesized
ccagatgtagcatctatggt

SEQ ID NO: 535785 - DNA, 20 bp, Artificial Sequence
  chemically synthesized
catttatcaattaaaccaag

SEQ ID NO: 535786 - DNA, 20 bp, Artificial Sequence
  chemically synthesized
tatatctagcatgcgtagat

SEQ ID NO: 535787 - DNA, 20 bp, Artificial Sequence
  chemically synthesized
atattacaatattactgaat

SEQ ID NO: 535788 - DNA, 20 bp, Artificial Sequence
  chemically synthesized
acttgaggtggttgtggatt

SEQ ID NO: 535789 - DNA, 20 bp, Artificial Sequence
  chemically synthesized
aaaatttcccaggaccattg

SEQ ID NO: 535790 - DNA, 20 bp, Artificial Sequence
  chemically synthesized
gactgtgcaccctctctcac

SEQ ID NO: 535791 - DNA, 20 bp, Artificial Sequence
  chemically synthesized
ctttctgtaagtaaagtgga

SEQ ID NO: 535792 - DNA, 20 bp, Artificial Sequence
  chemically synthesized
aattctcttccactttactt

SEQ ID NO: 535793 - DNA, 20 bp, Artificial Sequence
  chemically synthesized
aatgggtgcaaaaaaaagtc

SEQ ID NO: 535794 - DNA, 20 bp, Artificial Sequence
  chemically synthesized
tccataatttccttccaatt

SEQ ID NO: 535795 - DNA, 20 bp, Artificial Sequence
  chemically synthesized
taagatttacaatgctcaaa

SEQ ID NO: 535796 - DNA, 20 bp, Artificial Sequence
  chemically synthesized
agactcttaggcatacctct

SEQ ID NO: 535797 - DNA, 20 bp, Artificial Sequence
  chemically synthesized
gatcaatgctattaaacaca

SEQ ID NO: 535798 - DNA, 20 bp, Artificial Sequence
  chemically synthesized
tcactacatatcatggacct

SEQ ID NO: 535799 - DNA, 20 bp, Artificial Sequence
  chemically synthesized
gacatttctcataatctaaa

SEQ ID NO: 535800 - DNA, 20 bp, Artificial Sequence
  chemically synthesized
gccatttcttatttagatta

SEQ ID NO: 535801 - DNA, 20 bp, Artificial Sequence
  chemically synthesized
atcagaatgatgtgatatac

SEQ ID NO: 535802 - DNA, 20 bp, Artificial Sequence
  chemically synthesized
ttttgctttagtgcagataa

SEQ ID NO: 535803 - DNA, 20 bp, Artificial Sequence
  chemically synthesized
tttcaaaatatgttctacca

SEQ ID NO: 535804 - DNA, 20 bp, Artificial Sequence
  chemically synthesized
ggaaataataggttcatgaa

SEQ ID NO: 535805 - DNA, 20 bp, Artificial Sequence
  chemically synthesized
ttcagattatcaaagacacg

SEQ ID NO: 535806 - DNA, 20 bp, Artificial Sequence
  chemically synthesized
gataatctgaatttagtcta

SEQ ID NO: 535807 - DNA, 20 bp, Artificial Sequence
  chemically synthesized
cttgatggcataactttaga

SEQ ID NO: 535808 - DNA, 20 bp, Artificial Sequence
  chemically synthesized
ggggtggggccatgggtggt

SEQ ID NO: 535809 - DNA, 20 bp, Artificial Sequence
  chemically synthesized
aggaggcagagaagctctag

SEQ ID NO: 535810 - DNA, 20 bp, Artificial Sequence
  chemically synthesized
gtgaaagtaatatgcactca

SEQ ID NO: 535811 - DNA, 20 bp, Artificial Sequence
  chemically synthesized
ttgtcaagggcctgagaaat

SEQ ID NO: 535812 - DNA, 20 bp, Artificial Sequence
  chemically synthesized
atctccttttgtcaagggcc

SEQ ID NO: 535813 - DNA, 20 bp, Artificial Sequence
  chemically synthesized
tgttcactgtttaataaaaa

SEQ ID NO: 535814 - DNA, 20 bp, Artificial Sequence
  chemically synthesized
aacaaaggaaaattatattc

SEQ ID NO: 535815 - DNA, 20 bp, Artificial Sequence
  chemically synthesized
tactctttagagttaaatgc

SEQ ID NO: 535816 - DNA, 20 bp, Artificial Sequence
  chemically synthesized
tagattttttttttcaagat

SEQ ID NO: 535817 - DNA, 20 bp, Artificial Sequence
  chemically synthesized
attttgaggtagtttatctt

SEQ ID NO: 535818 - DNA, 20 bp, Artificial Sequence
  chemically synthesized
atcaacattaagcagcagct

SEQ ID NO: 535819 - DNA, 20 bp, Artificial Sequence
  chemically synthesized
gtgaagcataactgaaggat

SEQ ID NO: 535820 - DNA, 20 bp, Artificial Sequence
  chemically synthesized
ctaggtttaattttaaaaaa

SEQ ID NO: 535821 - DNA, 20 bp, Artificial Sequence
  chemically synthesized
aatctctttttattaggtct

SEQ ID NO: 535822 - DNA, 20 bp, Artificial Sequence
  chemically synthesized
tttattaggtctgcagaaac

SEQ ID NO: 535823 - DNA, 20 bp, Artificial Sequence
  chemically synthesized
gtcaaagatcaagataagga

SEQ ID NO: 535824 - DNA, 20 bp, Artificial Sequence
  chemically synthesized
aatgacaacgagaagtattt

SEQ ID NO: 535825 - DNA, 20 bp, Artificial Sequence
  chemically synthesized
ctctgaaattctgctttcta

SEQ ID NO: 535826 - DNA, 20 bp, Artificial Sequence
  chemically synthesized
aattggaattctcctagaaa

SEQ ID NO: 535827 - DNA, 20 bp, Artificial Sequence
  chemically synthesized
tgaagacaattggaattctc

SEQ ID NO: 535828 - DNA, 20 bp, Artificial Sequence
  chemically synthesized
cagaactgaggatggattcc

SEQ ID NO: 535829 - DNA, 20 bp, Artificial Sequence
  chemically synthesized
atgagattatcttgactggc

SEQ ID NO: 535830 - DNA, 20 bp, Artificial Sequence
  chemically synthesized
atctcatcctcttggttcag

SEQ ID NO: 535831 - DNA, 20 bp, Artificial Sequence
  chemically synthesized
actattgtactaaagatgat

SEQ ID NO: 535832 - DNA, 20 bp, Artificial Sequence
  chemically synthesized
gtttatgtctctcactgtaa

SEQ ID NO: 535833 - DNA, 20 bp, Artificial Sequence
  chemically synthesized
gaggaggtcaaagctgacgc

SEQ ID NO: 535834 - DNA, 20 bp, Artificial Sequence
  chemically synthesized
gcagagaaaaaaatcaggac

SEQ ID NO: 535835 - DNA, 20 bp, Artificial Sequence
  chemically synthesized
atcaggacaaagaaagtcat

SEQ ID NO: 535836 - DNA, 20 bp, Artificial Sequence
  chemically synthesized
tttcaaagtggcttcaaaaa

SEQ ID NO: 535837 - DNA, 20 bp, Artificial Sequence
  chemically synthesized
gatgctttgggctgcaagaa

SEQ ID NO: 535838 - DNA, 20 bp, Artificial Sequence
  chemically synthesized
agttaagatgctttgggctg

SEQ ID NO: 535839 - DNA, 20 bp, Artificial Sequence
  chemically synthesized
acacaaataatattataaac

SEQ ID NO: 535840 - DNA, 20 bp, Artificial Sequence
  chemically synthesized
aaatgtatttctagcaaaag

SEQ ID NO: 535841 - DNA, 20 bp, Artificial Sequence
  chemically synthesized
aacatatattcttccttttg

SEQ ID NO: 535842 - DNA, 20 bp, Artificial Sequence
  chemically synthesized
aatttagcttttatcctaga

SEQ ID NO: 535843 - DNA, 20 bp, Artificial Sequence
  chemically synthesized
tgtacaagatgagctgagag

SEQ ID NO: 535844 - DNA, 20 bp, Artificial Sequence
  chemically synthesized
gaagatgctatctgaatgaa

SEQ ID NO: 535845 - DNA, 20 bp, Artificial Sequence
  chemically synthesized
ttgcagtgctaaataagaga

SEQ ID NO: 535846 - DNA, 20 bp, Artificial Sequence
  chemically synthesized
ggggcttaatattaaggaat

SEQ ID NO: 535847 - DNA, 20 bp, Artificial Sequence
  chemically synthesized
attaaggaataaagaaagtg

SEQ ID NO: 535848 - DNA, 20 bp, Artificial Sequence
  chemically synthesized
atagtaagaggaatagattt

SEQ ID NO: 535849 - DNA, 20 bp, Artificial Sequence
  chemically synthesized
tcaattttacatatcctgag

SEQ ID NO: 535850 - DNA, 20 bp, Artificial Sequence
  chemically synthesized
tactaccaattccatttatt

SEQ ID NO: 535851 - DNA, 20 bp, Artificial Sequence
  chemically synthesized
actagctcttgcagaaccta

SEQ ID NO: 535852 - DNA, 20 bp, Artificial Sequence
  chemically synthesized
ccagagactgggcaatttat

SEQ ID NO: 535853 - DNA, 20 bp, Artificial Sequence
  chemically synthesized
cagggaaaaaagtaaactaa

SEQ ID NO: 535854 - DNA, 20 bp, Artificial Sequence
  chemically synthesized
ctgaaaaaccaaaccaaacc

SEQ ID NO: 535855 - DNA, 20 bp, Artificial Sequence
  chemically synthesized
aaaccagagaatgtgcaatc

SEQ ID NO: 535856 - DNA, 20 bp, Artificial Sequence
  chemically synthesized
atctcagaaactaacacaat

SEQ ID NO: 535857 - DNA, 20 bp, Artificial Sequence
  chemically synthesized
taaaaaacaattatatttac

SEQ ID NO: 535858 - DNA, 20 bp, Artificial Sequence
  chemically synthesized
taggtaaaatgtgcataaaa

SEQ ID NO: 535859 - DNA, 20 bp, Artificial Sequence
  chemically synthesized
actcaagaagcaaactatag

SEQ ID NO: 535860 - DNA, 20 bp, Artificial Sequence
  chemically synthesized
actatagtaagaaagacaga

SEQ ID NO: 535861 - DNA, 20 bp, Artificial Sequence
  chemically synthesized
tttgtcatcctatatgtcag

SEQ ID NO: 535862 - DNA, 20 bp, Artificial Sequence
  chemically synthesized
attctttgtcatcctatatg

SEQ ID NO: 535863 - DNA, 20 bp, Artificial Sequence
  chemically synthesized
tttctgacatataggatgac

SEQ ID NO: 535864 - DNA, 20 bp, Artificial Sequence
  chemically synthesized
ccaggaagatttataggtgg

SEQ ID NO: 535865 - DNA, 20 bp, Artificial Sequence
  chemically synthesized
tggaagtgaccaactggttt

SEQ ID NO: 535866 - DNA, 20 bp, Artificial Sequence
  chemically synthesized
ccaactggtttcaagaaaac

SEQ ID NO: 535867 - DNA, 20 bp, Artificial Sequence
  chemically synthesized
cctcactatttccacctata

SEQ ID NO: 535868 - DNA, 20 bp, Artificial Sequence
  chemically synthesized
ttttgagactcaaaagtacc

SEQ ID NO: 535869 - DNA, 20 bp, Artificial Sequence
  chemically synthesized
aagtgtgaggagaagagagc

SEQ ID NO: 535870 - DNA, 20 bp, Artificial Sequence
  chemically synthesized
tagtgcaaacatcactggac

SEQ ID NO: 535871 - DNA, 20 bp, Artificial Sequence
  chemically synthesized
taccactgtactcccagtgc

SEQ ID NO: 535872 - DNA, 20 bp, Artificial Sequence
  chemically synthesized
catggaatttatattgtgat

SEQ ID NO: 535873 - DNA, 20 bp, Artificial Sequence
  chemically synthesized
cagtaaaagaggaagtatgt

SEQ ID NO: 535874 - DNA, 20 bp, Artificial Sequence
  chemically synthesized
ggggagtgaaaaagagaagt

SEQ ID NO: 535875 - DNA, 20 bp, Artificial Sequence
  chemically synthesized
aaatcagcgtattgttcaat

SEQ ID NO: 535876 - DNA, 20 bp, Artificial Sequence
  chemically synthesized
aatgaatgaggaaggcagaa

SEQ ID NO: 535877 - DNA, 20 bp, Artificial Sequence
  chemically synthesized
cctgggaatgaatgaggaag

SEQ ID NO: 535878 - DNA, 20 bp, Artificial Sequence
  chemically synthesized
gtctgttctcatgctgctat

SEQ ID NO: 535879 - DNA, 20 bp, Artificial Sequence
  chemically synthesized
cccgagactgggtaatttat

SEQ ID NO: 535880 - DNA, 20 bp, Artificial Sequence
  chemically synthesized
cctgaggcctccccagccat

SEQ ID NO: 535881 - DNA, 20 bp, Artificial Sequence
  chemically synthesized
tcttcacagggtggcaggag

SEQ ID NO: 535882 - DNA, 20 bp, Artificial Sequence
  chemically synthesized
tgtgaaatcacccactatca

SEQ ID NO: 535883 - DNA, 20 bp, Artificial Sequence
  chemically synthesized
agatttgggaggggccagga

SEQ ID NO: 535884 - DNA, 20 bp, Artificial Sequence
  chemically synthesized
aaatacacctgttccgaatg

SEQ ID NO: 535885 - DNA, 20 bp, Artificial Sequence
  chemically synthesized
tgatagtttgaaccatgcat

SEQ ID NO: 535886 - DNA, 20 bp, Artificial Sequence
  chemically synthesized
tcatccaaaccccagaatag

SEQ ID NO: 535887 - DNA, 20 bp, Artificial Sequence
  chemically synthesized
ggaccaccatcatccaaacc

SEQ ID NO: 535888 - DNA, 20 bp, Artificial Sequence
  chemically synthesized
ttgaggtttgcaacctctgc

SEQ ID NO: 535889 - DNA, 20 bp, Artificial Sequence
  chemically synthesized
gcctggggttggacagaagt

SEQ ID NO: 535890 - DNA, 20 bp, Artificial Sequence
  chemically synthesized
ctgcagccagcttgtatttc

SEQ ID NO: 535891 - DNA, 20 bp, Artificial Sequence
  chemically synthesized
gaaaagaaaaacccattttc

SEQ ID NO: 535892 - DNA, 20 bp, Artificial Sequence
  chemically synthesized
cagcctaacaatgtgataga

SEQ ID NO: 535893 - DNA, 20 bp, Artificial Sequence
  chemically synthesized
atctgcagcctaacaatgtg

SEQ ID NO: 535894 - DNA, 20 bp, Artificial Sequence
  chemically synthesized
gtccgttctcatgctgctat

SEQ ID NO: 535895 - DNA, 20 bp, Artificial Sequence
  chemically synthesized
cccaagaccgggtaatttat

SEQ ID NO: 535896 - DNA, 20 bp, Artificial Sequence
  chemically synthesized
ttttcacagggtgataggag

SEQ ID NO: 535897 - DNA, 20 bp, Artificial Sequence
  chemically synthesized
attaattaatacatctagca

SEQ ID NO: 535898 - DNA, 20 bp, Artificial Sequence
  chemically synthesized
tagctttattgaagtataat

SEQ ID NO: 535899 - DNA, 20 bp, Artificial Sequence
  chemically synthesized
atgtgcaatggctttaaaaa

SEQ ID NO: 535900 - DNA, 20 bp, Artificial Sequence
  chemically synthesized
tcaaaataaaaatttcaaaa

SEQ ID NO: 535901 - DNA, 20 bp, Artificial Sequence
  chemically synthesized
cagctaagatgcataggaga

SEQ ID NO: 535902 - DNA, 20 bp, Artificial Sequence
  chemically synthesized
atcatagtcttgatttgcct

SEQ ID NO: 535903 - DNA, 20 bp, Artificial Sequence
  chemically synthesized
tctaaaaatgaaagctgaac

SEQ ID NO: 535904 - DNA, 20 bp, Artificial Sequence
  chemically synthesized
ggggtgaggtgggaaggttt

SEQ ID NO: 535905 - DNA, 20 bp, Artificial Sequence
  chemically synthesized
taagtggtgctacaaaacct

SEQ ID NO: 535906 - DNA, 20 bp, Artificial Sequence
  chemically synthesized
aggggacccaaagacaacaa

SEQ ID NO: 535907 - DNA, 20 bp, Artificial Sequence
  chemically synthesized
ggaagctgatccctaggaag

SEQ ID NO: 535908 - DNA, 20 bp, Artificial Sequence
  chemically synthesized
acagaacttttgtatgttcc

SEQ ID NO: 535909 - DNA, 20 bp, Artificial Sequence
  chemically synthesized
tgtatgttcctgagaatcac

SEQ ID NO: 535910 - DNA, 20 bp, Artificial Sequence
  chemically synthesized
actcactaaaacttcaaggg

SEQ ID NO: 535911 - DNA, 20 bp, Artificial Sequence
  chemically synthesized
atgtcagagaagtcccttag

SEQ ID NO: 535912 - DNA, 20 bp, Artificial Sequence
  chemically synthesized
agaagtcccttagatagaaa

SEQ ID NO: 535913 - DNA, 20 bp, Artificial Sequence
  chemically synthesized
ataagacagatttcactgta

SEQ ID NO: 535914 - DNA, 20 bp, Artificial Sequence
  chemically synthesized
agaacgtacacataaagtgt

SEQ ID NO: 535915 - DNA, 20 bp, Artificial Sequence
  chemically synthesized
tatgtaaatacaaccccaat

SEQ ID NO: 535916 - DNA, 20 bp, Artificial Sequence
  chemically synthesized
aatacaaccccaatcaagaa

SEQ ID NO: 535917 - DNA, 20 bp, Artificial Sequence
  chemically synthesized
aagaaaaggagaaaaattca

SEQ ID NO: 535918 - DNA, 20 bp, Artificial Sequence
  chemically synthesized
gggagggaaagaaaagaaaa

SEQ ID NO: 535919 - DNA, 20 bp, Artificial Sequence
  chemically synthesized
gggagggagggagggaaaga

SEQ ID NO: 535920 - DNA, 20 bp, Artificial Sequence
  chemically synthesized
agggagggagggagggaggg

SEQ ID NO: 535921 - DNA, 20 bp, Artificial Sequence
  chemically synthesized
agaaagagagagaggaagac

SEQ ID NO: 535922 - DNA, 20 bp, Artificial Sequence
  chemically synthesized
agagagagagagagagaaac

SEQ ID NO: 535923 - DNA, 20 bp, Artificial Sequence
  chemically synthesized
agagagagagagagagagag

SEQ ID NO: 535924 - DNA, 20 bp, Artificial Sequence
  chemically synthesized
aactccgtctcaaaaaataa

SEQ ID NO: 535925 - DNA, 20 bp, Artificial Sequence
  chemically synthesized
ctactcgggaggctgaggca

SEQ ID NO: 535926 - DNA, 20 bp, Artificial Sequence
  chemically synthesized
gagaccagcctgaccaacat

SEQ ID NO: 535927 - DNA, 20 bp, Artificial Sequence
  chemically synthesized
gataaaccgagtagaccgtg

SEQ ID NO: 535928 - DNA, 20 bp, Artificial Sequence
  chemically synthesized
ttagagggattactctggct

SEQ ID NO: 535929 - DNA, 20 bp, Artificial Sequence
  chemically synthesized
actgcattttaagacatgtt

SEQ ID NO: 535930 - DNA, 20 bp, Artificial Sequence
  chemically synthesized
aggggagagtgttccaggca

SEQ ID NO: 535931 - DNA, 20 bp, Artificial Sequence
  chemically synthesized
ttcctttttttttttttttt

SEQ ID NO: 535932 - DNA, 20 bp, Artificial Sequence
  chemically synthesized
gaatactagggaagaatcag

SEQ ID NO: 535933 - DNA, 20 bp, Artificial Sequence
  chemically synthesized
ctaggatgtagaatactagg

SEQ ID NO: 535934 - DNA, 20 bp, Artificial Sequence
  chemically synthesized
tacgtgacaaatactaggat

SEQ ID NO: 535935 - DNA, 20 bp, Artificial Sequence
  chemically synthesized
attcctagactcctagaaag

SEQ ID NO: 535936 - DNA, 20 bp, Artificial Sequence
  chemically synthesized
taagcgtgattcctagactc

SEQ ID NO: 535937 - DNA, 20 bp, Artificial Sequence
  chemically synthesized
tcttgatccatattgtatcc

SEQ ID NO: 535938 - DNA, 20 bp, Artificial Sequence
  chemically synthesized
caaagcagcgtcatagatta

SEQ ID NO: 535939 - DNA, 20 bp, Artificial Sequence
  chemically synthesized
aatggcatacttgtacaaag

SEQ ID NO: 535940 - DNA, 20 bp, Artificial Sequence
  chemically synthesized
agtatgccatttcaagtttc

SEQ ID NO: 535941 - DNA, 20 bp, Artificial Sequence
  chemically synthesized
atatatgggacttatagtca

SEQ ID NO: 535942 - DNA, 20 bp, Artificial Sequence
  chemically synthesized
ggacttatagtcatgagaat

SEQ ID NO: 535943 - DNA, 20 bp, Artificial Sequence
  chemically synthesized
atctcagcatcaaaaaatac

SEQ ID NO: 535944 - DNA, 20 bp, Artificial Sequence
  chemically synthesized
atttataaagccactcatgg

SEQ ID NO: 535945 - DNA, 20 bp, Artificial Sequence
  chemically synthesized
aagaataccacttacttagc

SEQ ID NO: 535946 - DNA, 20 bp, Artificial Sequence
  chemically synthesized
tattaatgcttactcagaac

SEQ ID NO: 535947 - DNA, 20 bp, Artificial Sequence
  chemically synthesized
attaataacactgctgatga

SEQ ID NO: 535948 - DNA, 20 bp, Artificial Sequence
  chemically synthesized
tatttactatctggcttttt

SEQ ID NO: 535949 - DNA, 20 bp, Artificial Sequence
  chemically synthesized
tctaactacagtagtgagaa

SEQ ID NO: 535950 - DNA, 20 bp, Artificial Sequence
  chemically synthesized
tgttctcactactgtagtta

SEQ ID NO: 535951 - DNA, 20 bp, Artificial Sequence
  chemically synthesized
aaaatggactaggaatacga

SEQ ID NO: 535952 - DNA, 20 bp, Artificial Sequence
  chemically synthesized
tgaataagaggagaatcagg

SEQ ID NO: 535953 - DNA, 20 bp, Artificial Sequence
  chemically synthesized
gttgaggaaactgaataaga

SEQ ID NO: 535954 - DNA, 20 bp, Artificial Sequence
  chemically synthesized
atattatctaaaatttccct

SEQ ID NO: 535955 - DNA, 20 bp, Artificial Sequence
  chemically synthesized
tagttagtgaaccctagagt

SEQ ID NO: 535956 - DNA, 20 bp, Artificial Sequence
  chemically synthesized
caaggaataaattggaggta

SEQ ID NO: 535957 - DNA, 20 bp, Artificial Sequence
  chemically synthesized
gagtggatagacctgcgtgg

SEQ ID NO: 535958 - DNA, 20 bp, Artificial Sequence
  chemically synthesized
atgcttcagatttatccaga

SEQ ID NO: 535959 - DNA, 20 bp, Artificial Sequence
  chemically synthesized
gttaactccctttttatttt

SEQ ID NO: 535960 - DNA, 20 bp, Artificial Sequence
  chemically synthesized
tttttcaagtgagctcctaa

SEQ ID NO: 535961 - DNA, 20 bp, Artificial Sequence
  chemically synthesized
acttcaatcaatcacacaaa

SEQ ID NO: 535962 - DNA, 20 bp, Artificial Sequence
  chemically synthesized
attgcctacagcatgaaatc

SEQ ID NO: 535963 - DNA, 20 bp, Artificial Sequence
  chemically synthesized
attcaccacagccaccgaac

SEQ ID NO: 535964 - DNA, 20 bp, Artificial Sequence
  chemically synthesized
gccaccgaacaaagaaaaca

SEQ ID NO: 535965 - DNA, 20 bp, Artificial Sequence
  chemically synthesized
aaacactagaaaatactttc

SEQ ID NO: 535966 - DNA, 20 bp, Artificial Sequence
  chemically synthesized
gaatcaggtctgaacacaaa

SEQ ID NO: 535967 - DNA, 20 bp, Artificial Sequence
  chemically synthesized
gtcaaaaagccagtacagca

SEQ ID NO: 535968 - DNA, 20 bp, Artificial Sequence
  chemically synthesized
aattgacagttacagatgtg

SEQ ID NO: 535969 - DNA, 20 bp, Artificial Sequence
  chemically synthesized
agctaagtagtaacactgtg

SEQ ID NO: 535970 - DNA, 20 bp, Artificial Sequence
  chemically synthesized
tagaatagaaggcaatcagg

SEQ ID NO: 535971 - DNA, 20 bp, Artificial Sequence
  chemically synthesized
cttttctttttttggctcct

SEQ ID NO: 535972 - DNA, 20 bp, Artificial Sequence
  chemically synthesized
ctattctagaggagccaaaa

SEQ ID NO: 535973 - DNA, 20 bp, Artificial Sequence
  chemically synthesized
ctagaggagccaaaaaaaga

SEQ ID NO: 535974 - DNA, 20 bp, Artificial Sequence
  chemically synthesized
ggagccaaaaaaagaaaaga

SEQ ID NO: 535975 - DNA, 20 bp, Artificial Sequence
  chemically synthesized
caaaaaaagaaaagaaaaga

SEQ ID NO: 535976 - DNA, 20 bp, Artificial Sequence
  chemically synthesized
tacggaagtggtttcaatat

SEQ ID NO: 535977 - DNA, 20 bp, Artificial Sequence
  chemically synthesized
tagatgtcatgcaaaacgga

SEQ ID NO: 535978 - DNA, 20 bp, Artificial Sequence
  chemically synthesized
acaaaagcatgcacaatatg

SEQ ID NO: 535979 - DNA, 20 bp, Artificial Sequence
  chemically synthesized
gagaggaaatgaaagcctag

SEQ ID NO: 535980 - DNA, 20 bp, Artificial Sequence
  chemically synthesized
taaggctgctgtaagattaa

SEQ ID NO: 535981 - DNA, 20 bp, Artificial Sequence
  chemically synthesized
gattaaacagaaaaatgcac

SEQ ID NO: 535982 - DNA, 20 bp, Artificial Sequence
  chemically synthesized
agagatcaagatggaaatcc

SEQ ID NO: 535983 - DNA, 20 bp, Artificial Sequence
  chemically synthesized
gggcagtgtcagctttttaa

SEQ ID NO: 535984 - DNA, 20 bp, Artificial Sequence
  chemically synthesized
cactcccaccagctgaaaga

SEQ ID NO: 535985 - DNA, 20 bp, Artificial Sequence
  chemically synthesized
aaaagggcatattttacctt

SEQ ID NO: 535986 - DNA, 20 bp, Artificial Sequence
  chemically synthesized
catattttaccttaaagaaa

SEQ ID NO: 535987 - DNA, 20 bp, Artificial Sequence
  chemically synthesized
tgaaaagtatgctaataatc

SEQ ID NO: 535988 - DNA, 20 bp, Artificial Sequence
  chemically synthesized
tcccattcacttcagtatga

SEQ ID NO: 535989 - DNA, 20 bp, Artificial Sequence
  chemically synthesized
tgtgtattcatacatttctt

SEQ ID NO: 535990 - DNA, 20 bp, Artificial Sequence
  chemically synthesized
caggactcttctttattctc

SEQ ID NO: 535991 - DNA, 20 bp, Artificial Sequence
  chemically synthesized
atttgatttcaagacacagt

SEQ ID NO: 535992 - DNA, 20 bp, Artificial Sequence
  chemically synthesized
ggaagatttgcatcaatgcc

SEQ ID NO: 535993 - DNA, 20 bp, Artificial Sequence
  chemically synthesized
gggaacaaagttgagatata

SEQ ID NO: 535994 - DNA, 20 bp, Artificial Sequence
  chemically synthesized
gcttgaccagctgtttagtg

SEQ ID NO: 535995 - DNA, 20 bp, Artificial Sequence
  chemically synthesized
ctatttttctgttgtgggct

SEQ ID NO: 535996 - DNA, 20 bp, Artificial Sequence
  chemically synthesized
atccaattctgaagcccaca

SEQ ID NO: 535997 - DNA, 20 bp, Artificial Sequence
  chemically synthesized
ccacagagacgttaaaaatt

SEQ ID NO: 535998 - DNA, 20 bp, Artificial Sequence
  chemically synthesized
ggggactcatctgatttaag

SEQ ID NO: 535999 - DNA, 20 bp, Artificial Sequence
  chemically synthesized
ctcatctgatttaagataga

SEQ ID NO: 536000 - DNA, 20 bp, Artificial Sequence
  chemically synthesized
gagattaaataacagacctc

SEQ ID NO: 536001 - DNA, 20 bp, Artificial Sequence
  chemically synthesized
cgcttctaagattgcttcta

SEQ ID NO: 536002 - DNA, 20 bp, Artificial Sequence
  chemically synthesized
gcctttcctgagatagtgga

SEQ ID NO: 536003 - DNA, 20 bp, Artificial Sequence
  chemically synthesized
ttcctgagatagtggaaaag

SEQ ID NO: 536004 - DNA, 20 bp, Artificial Sequence
  chemically synthesized
gaatataactttaccttcag

SEQ ID NO: 536005 - DNA, 20 bp, Artificial Sequence
  chemically synthesized
cttgactgtcatactctgac

SEQ ID NO: 536006 - DNA, 20 bp, Artificial Sequence
  chemically synthesized
ttatgctatttaacactctt

SEQ ID NO: 536007 - DNA, 20 bp, Artificial Sequence
  chemically synthesized
tacctatgtcctgcatttta

SEQ ID NO: 536008 - DNA, 20 bp, Artificial Sequence
  chemically synthesized
aatcaaaaaatctctaatca

SEQ ID NO: 536009 - DNA, 20 bp, Artificial Sequence
  chemically synthesized
atgttagccttctctttttc

SEQ ID NO: 536010 - DNA, 20 bp, Artificial Sequence
  chemically synthesized
gggtctgaactgatgaagga

SEQ ID NO: 536011 - DNA, 20 bp, Artificial Sequence
  chemically synthesized
ccaaaaggttaagagaggga

SEQ ID NO: 536012 - DNA, 20 bp, Artificial Sequence
  chemically synthesized
tgttaacatccaagacagtg

SEQ ID NO: 536013 - DNA, 20 bp, Artificial Sequence
  chemically synthesized
ctgtagaaaggggagtgaca

SEQ ID NO: 536014 - DNA, 20 bp, Artificial Sequence
  chemically synthesized
ataatgagatgtgtcacact

SEQ ID NO: 536015 - DNA, 20 bp, Artificial Sequence
  chemically synthesized
atgtcgtaagtgtttttagc

SEQ ID NO: 536016 - DNA, 20 bp, Artificial Sequence
  chemically synthesized
agaaatcatctgttaatgag

SEQ ID NO: 536017 - DNA, 20 bp, Artificial Sequence
  chemically synthesized
atcctaaaggttcacctgaa

SEQ ID NO: 536018 - DNA, 20 bp, Artificial Sequence
  chemically synthesized
ggtcctgatccttctcatta

SEQ ID NO: 536019 - DNA, 20 bp, Artificial Sequence
  chemically synthesized
atcaggacccaagagaggaa

SEQ ID NO: 536020 - DNA, 20 bp, Artificial Sequence
  chemically synthesized
ttgtccttgcgatagtttgc

SEQ ID NO: 536021 - DNA, 20 bp, Artificial Sequence
  chemically synthesized
gttcaattcccacctgtgag

SEQ ID NO: 536022 - DNA, 20 bp, Artificial Sequence
  chemically synthesized
atagatgagataaccaaggg

SEQ ID NO: 536023 - DNA, 20 bp, Artificial Sequence
  chemically synthesized
aacctaaattaatacaagtc

SEQ ID NO: 536024 - DNA, 20 bp, Artificial Sequence
  chemically synthesized
aattcaattgggagctgatc

SEQ ID NO: 536025 - DNA, 20 bp, Artificial Sequence
  chemically synthesized
gggaacaaagttgagatata

SEQ ID NO: 536026 - DNA, 20 bp, Artificial Sequence
  chemically synthesized
taggctttcttcccattttg

SEQ ID NO: 536027 - DNA, 20 bp, Artificial Sequence
  chemically synthesized
tccagattctgccaaaatgg

SEQ ID NO: 536028 - DNA, 20 bp, Artificial Sequence
  chemically synthesized
catagttttcatactgctat

SEQ ID NO: 536029 - DNA, 20 bp, Artificial Sequence
  chemically synthesized
ggagagctactcctacaggc

SEQ ID NO: 536030 - DNA, 20 bp, Artificial Sequence
  chemically synthesized
gctccagtgacactttattt

SEQ ID NO: 536031 - DNA, 20 bp, Artificial Sequence
  chemically synthesized
ttgaccacatgacccataaa

SEQ ID NO: 536032 - DNA, 20 bp, Artificial Sequence
  chemically synthesized
atatctagtatcggtccttt

SEQ ID NO: 536033 - DNA, 20 bp, Artificial Sequence
  chemically synthesized
ttggtagcacaactgagata

SEQ ID NO: 536034 - DNA, 20 bp, Artificial Sequence
  chemically synthesized
ttttaccagtgtttaatcaa

SEQ ID NO: 536035 - DNA, 20 bp, Artificial Sequence
  chemically synthesized
ctacgggggaggctgaggca

SEQ ID NO: 536036 - DNA, 20 bp, Artificial Sequence
  chemically synthesized
aaaaaaaaaaaaaaaaaaaa

SEQ ID NO: 536037 - DNA, 20 bp, Artificial Sequence
  chemically synthesized
tacccgatttagcatttttg

SEQ ID NO: 536038 - DNA, 20 bp, Artificial Sequence
  chemically synthesized
caggcccagcagcttgtgga

SEQ ID NO: 536039 - DNA, 20 bp, Artificial Sequence
  chemically synthesized
ttcctggatgagacctctga

SEQ ID NO: 536040 - DNA, 20 bp, Artificial Sequence
  chemically synthesized
acagacatacagtgagtggg

SEQ ID NO: 536041 - DNA, 20 bp, Artificial Sequence
  chemically synthesized
ctcaccccagagctagtaaa

SEQ ID NO: 536042 - DNA, 20 bp, Artificial Sequence
  chemically synthesized
ttctaacgcatggtaatttt

SEQ ID NO: 536043 - DNA, 20 bp, Artificial Sequence
  chemically synthesized
cctctcttggaaaactgccc

SEQ ID NO: 536044 - DNA, 20 bp, Artificial Sequence
  chemically synthesized
aggatgatgagtggccttat

SEQ ID NO: 536045 - DNA, 20 bp, Artificial Sequence
  chemically synthesized
agtaacaccaagcaagacca

SEQ ID NO: 536046 - DNA, 20 bp, Artificial Sequence
  chemically synthesized
acagagcaaacttcagacac

SEQ ID NO: 536047 - DNA, 20 bp, Artificial Sequence
  chemically synthesized
tggggtgcttctatgcaaca

SEQ ID NO: 536048 - DNA, 20 bp, Artificial Sequence
  chemically synthesized
cagcttctacatctataaaa

SEQ ID NO: 536049 - DNA, 20 bp, Artificial Sequence
  chemically synthesized
agtttggatttctatggttc

SEQ ID NO: 536050 - DNA, 20 bp, Artificial Sequence
  chemically synthesized
tatttgaatttcttagaacc

SEQ ID NO: 536051 - DNA, 20 bp, Artificial Sequence
  chemically synthesized
caattttttctacttcttaa

SEQ ID NO: 536052 - DNA, 20 bp, Artificial Sequence
  chemically synthesized
gtgttttttctacttaagaa

SEQ ID NO: 536053 - DNA, 20 bp, Artificial Sequence
  chemically synthesized
acttcttaagtagaaaaaac

SEQ ID NO: 536054 - DNA, 20 bp, Artificial Sequence
  chemically synthesized
ctacttgggaggctgaggca

SEQ ID NO: 536055 - DNA, 20 bp, Artificial Sequence
  chemically synthesized
tgtgtgtgtgtgtgtgtgtg

SEQ ID NO: 536056 - DNA, 20 bp, Artificial Sequence
  chemically synthesized
acacacacacacacacacac

SEQ ID NO: 536057 - DNA, 20 bp, Artificial Sequence
  chemically synthesized
cacacacacacacaaagaaa

SEQ ID NO: 536058 - DNA, 20 bp, Artificial Sequence
  chemically synthesized
cacacacacaaagaaaaaag

SEQ ID NO: 536059 - DNA, 20 bp, Artificial Sequence
  chemically synthesized
cacacaaagaaaaaagaaag

SEQ ID NO: 536060 - DNA, 20 bp, Artificial Sequence
  chemically synthesized
aaagaaaaaagaaagaaaga

SEQ ID NO: 536061 - DNA, 20 bp, Artificial Sequence
  chemically synthesized
gctagattaaggccacacag

SEQ ID NO: 536062 - DNA, 20 bp, Artificial Sequence
  chemically synthesized
atgtactgtattacaatgta

SEQ ID NO: 536063 - DNA, 20 bp, Artificial Sequence
  chemically synthesized
gaaataaatgcaatataaaa

SEQ ID NO: 536064 - DNA, 20 bp, Artificial Sequence
  chemically synthesized
cctgacttgcaggaagttaa

SEQ ID NO: 536065 - DNA, 20 bp, Artificial Sequence
  chemically synthesized
tgcaagtcaggaagtcggga

SEQ ID NO: 536066 - DNA, 20 bp, Artificial Sequence
  chemically synthesized
ggtagttcaaatatcagaat

SEQ ID NO: 536067 - DNA, 20 bp, Artificial Sequence
  chemically synthesized
ttactgtggtagttcaaata

SEQ ID NO: 536068 - DNA, 20 bp, Artificial Sequence
  chemically synthesized
gatatttgaactaccacagt

SEQ ID NO: 536069 - DNA, 20 bp, Artificial Sequence
  chemically synthesized
gaactaccacagtaaagaaa

SEQ ID NO: 536070 - DNA, 20 bp, Artificial Sequence
  chemically synthesized
ggatgaaaagcacctgcttt

SEQ ID NO: 536071 - DNA, 20 bp, Artificial Sequence
  chemically synthesized
gagttgtggtagtagctaaa

SEQ ID NO: 536072 - DNA, 20 bp, Artificial Sequence
  chemically synthesized
gaaaattattccaggcaggg

SEQ ID NO: 536073 - DNA, 20 bp, Artificial Sequence
  chemically synthesized
ccctgcctggaataattttc

SEQ ID NO: 536074 - DNA, 20 bp, Artificial Sequence
  chemically synthesized
gcttgtctgttaagagaaca

SEQ ID NO: 536075 - DNA, 20 bp, Artificial Sequence
  chemically synthesized
atcctgtgcacactgacatt

SEQ ID NO: 536076 - DNA, 20 bp, Artificial Sequence
  chemically synthesized
gaatcacaatctgcatttta

SEQ ID NO: 536077 - DNA, 20 bp, Artificial Sequence
  chemically synthesized
aatgggtatttgttagacac

SEQ ID NO: 536078 - DNA, 20 bp, Artificial Sequence
  chemically synthesized
gagaaagacaataaactaat

SEQ ID NO: 536079 - DNA, 20 bp, Artificial Sequence
  chemically synthesized
aaacatatattgtaattgaa

SEQ ID NO: 536080 - DNA, 20 bp, Artificial Sequence
  chemically synthesized
actggtgctgcgagtacagc

SEQ ID NO: 536081 - DNA, 20 bp, Artificial Sequence
  chemically synthesized
cctaaatgtaacaatgttta

SEQ ID NO: 536082 - DNA, 20 bp, Artificial Sequence
  chemically synthesized
gctgaacctaccagagacag

SEQ ID NO: 536083 - DNA, 20 bp, Artificial Sequence
  chemically synthesized
agtagaaaaatactgaactg

SEQ ID NO: 536084 - DNA, 20 bp, Artificial Sequence
  chemically synthesized
tgatttttattttatgtcaa

SEQ ID NO: 536085 - DNA, 20 bp, Artificial Sequence
  chemically synthesized
tgactctcaggggaaagagg

SEQ ID NO: 536086 - DNA, 20 bp, Artificial Sequence
  chemically synthesized
agccagcattaacattgcca

SEQ ID NO: 536087 - DNA, 20 bp, Artificial Sequence
  chemically synthesized
tctatcaacaactgaagagg

SEQ ID NO: 536088 - DNA, 20 bp, Artificial Sequence
  chemically synthesized
tcccatttttagttcaagaa

SEQ ID NO: 536089 - DNA, 20 bp, Artificial Sequence
  chemically synthesized
gagctctcccatttttagtt

SEQ ID NO: 536090 - DNA, 20 bp, Artificial Sequence
  chemically synthesized
ctacaaaaatcacagaaacc

SEQ ID NO: 536091 - DNA, 20 bp, Artificial Sequence
  chemically synthesized
caagtatgtctacaaaaatc

SEQ ID NO: 536092 - DNA, 20 bp, Artificial Sequence
  chemically synthesized
ttgttaatggtgttccttac

SEQ ID NO: 536093 - DNA, 20 bp, Artificial Sequence
  chemically synthesized
actaagaattgccttcggcc

SEQ ID NO: 536094 - DNA, 20 bp, Artificial Sequence
  chemically synthesized
acaaaggtttatctctatct

SEQ ID NO: 536095 - DNA, 20 bp, Artificial Sequence
  chemically synthesized
tgaagtgatgactgggtgag

SEQ ID NO: 536096 - DNA, 20 bp, Artificial Sequence
  chemically synthesized
gaacaaatagctagagccaa

SEQ ID NO: 536097 - DNA, 20 bp, Artificial Sequence
  chemically synthesized
atcttctaacttcctcttta

SEQ ID NO: 536098 - DNA, 20 bp, Artificial Sequence
  chemically synthesized
taatttagaagtaaaatata

SEQ ID NO: 536099 - DNA, 20 bp, Artificial Sequence
  chemically synthesized
ttctaaattaactttagtgg

SEQ ID NO: 536100 - DNA, 20 bp, Artificial Sequence
  chemically synthesized
aaataattataattccttta

SEQ ID NO: 536101 - DNA, 20 bp, Artificial Sequence
  chemically synthesized
ctttaaataaaattatgcct

SEQ ID NO: 536102 - DNA, 20 bp, Artificial Sequence
  chemically synthesized
caaccacaatagatactctt

SEQ ID NO: 536103 - DNA, 20 bp, Artificial Sequence
  chemically synthesized
tgctactcagagcccccttc

SEQ ID NO: 536104 - DNA, 20 bp, Artificial Sequence
  chemically synthesized
ccctgaagggactgacagtt

SEQ ID NO: 536105 - DNA, 20 bp, Artificial Sequence
  chemically synthesized
gtggtaggaatatttacacc

SEQ ID NO: 536106 - DNA, 20 bp, Artificial Sequence
  chemically synthesized
tatacgataatttatagcca

SEQ ID NO: 536107 - DNA, 20 bp, Artificial Sequence
  chemically synthesized
agagtcttctgcttccagca

SEQ ID NO: 536108 - DNA, 20 bp, Artificial Sequence
  chemically synthesized
atctttacaacttactgagg

SEQ ID NO: 536109 - DNA, 20 bp, Artificial Sequence
  chemically synthesized
gttctcatactttaggatca

SEQ ID NO: 536110 - DNA, 20 bp, Artificial Sequence
  chemically synthesized
ctgagggtctattatgttct

SEQ ID NO: 536111 - DNA, 20 bp, Artificial Sequence
  chemically synthesized
tcctcttgcgaaacccgagc

SEQ ID NO: 536112 - DNA, 20 bp, Artificial Sequence
  chemically synthesized
gctttcttacatatgttatt

SEQ ID NO: 536113 - DNA, 20 bp, Artificial Sequence
  chemically synthesized
ggtttctgcaataacatatg

SEQ ID NO: 536114 - DNA, 20 bp, Artificial Sequence
  chemically synthesized
acgctgggttgtcatgtgag

SEQ ID NO: 536115 - DNA, 20 bp, Artificial Sequence
  chemically synthesized
tggttaaaataaatacatta

SEQ ID NO: 536116 - DNA, 20 bp, Artificial Sequence
  chemically synthesized
agaaattgcatttctagtct

SEQ ID NO: 536117 - DNA, 20 bp, Artificial Sequence
  chemically synthesized
tccaactctgattcttcaga

SEQ ID NO: 536118 - DNA, 20 bp, Artificial Sequence
  chemically synthesized
gaatcagagttggaaaagag

SEQ ID NO: 536119 - DNA, 20 bp, Artificial Sequence
  chemically synthesized
aaaccattactttatttatt

SEQ ID NO: 536120 - DNA, 20 bp, Artificial Sequence
  chemically synthesized
aagaggtatcgagccttaaa

SEQ ID NO: 536121 - DNA, 20 bp, Artificial Sequence
  chemically synthesized
caagtaatgatacagagctg

SEQ ID NO: 536122 - DNA, 20 bp, Artificial Sequence
  chemically synthesized
atctactctgtggttttaga

SEQ ID NO: 536123 - DNA, 20 bp, Artificial Sequence
  chemically synthesized
ggactgaaggctttggccat

SEQ ID NO: 536124 - DNA, 20 bp, Artificial Sequence
  chemically synthesized
aaaatctcaactatcaaagg

SEQ ID NO: 536125 - DNA, 20 bp, Artificial Sequence
  chemically synthesized
tttgagctggtaaacgacga

SEQ ID NO: 536126 - DNA, 20 bp, Artificial Sequence
  chemically synthesized
ctcatcatatcccacaactg

SEQ ID NO: 536127 - DNA, 20 bp, Artificial Sequence
  chemically synthesized
agattgatcagattatttga

SEQ ID NO: 536128 - DNA, 20 bp, Artificial Sequence
  chemically synthesized
atcagggggtactatgaatt

SEQ ID NO: 536129 - DNA, 20 bp, Artificial Sequence
  chemically synthesized
acaaaggtaaaaaggaaaaa

SEQ ID NO: 536130 - DNA, 20 bp, Artificial Sequence
  chemically synthesized
gaaggggcgtctgtaatgag

SEQ ID NO: 536131 - DNA, 20 bp, Artificial Sequence
  chemically synthesized
cagaagtaaaattgctttgc

SEQ ID NO: 536132 - DNA, 20 bp, Artificial Sequence
  chemically synthesized
ggaagcactagactggatat

SEQ ID NO: 536133 - DNA, 20 bp, Artificial Sequence
  chemically synthesized
ttcatttaattttattcaat

SEQ ID NO: 536134 - DNA, 20 bp, Artificial Sequence
  chemically synthesized
tgctacttgaataaaggaaa

SEQ ID NO: 536135 - DNA, 20 bp, Artificial Sequence
  chemically synthesized
attgaagtcaagttggggga

SEQ ID NO: 536136 - DNA, 20 bp, Artificial Sequence
  chemically synthesized
cagagtgagaccctgtctca

SEQ ID NO: 536137 - DNA, 20 bp, Artificial Sequence
  chemically synthesized
ggactaggttgtaacaaagg

SEQ ID NO: 536138 - DNA, 20 bp, Artificial Sequence
  chemically synthesized
gatgtggctgctgactgcca

SEQ ID NO: 536139 - DNA, 20 bp, Artificial Sequence
  chemically synthesized
cataagttaaaaagcaaaac

SEQ ID NO: 536140 - DNA, 20 bp, Artificial Sequence
  chemically synthesized
cttatgaccttaagaatgtg

SEQ ID NO: 536141 - DNA, 20 bp, Artificial Sequence
  chemically synthesized
cttgtacttccttatgacct

SEQ ID NO: 536142 - DNA, 20 bp, Artificial Sequence
  chemically synthesized
cttaaggtcataaggaagta

SEQ ID NO: 536143 - DNA, 20 bp, Artificial Sequence
  chemically synthesized
ccaacatgggtatgtatgtg

SEQ ID NO: 536144 - DNA, 20 bp, Artificial Sequence
  chemically synthesized
aaactccatctaaaaaaaaa

SEQ ID NO: 536145 - DNA, 20 bp, Artificial Sequence
  chemically synthesized
gctaccgggaggctgaggca

SEQ ID NO: 536146 - DNA, 20 bp, Artificial Sequence
  chemically synthesized
ttaaaacacaattatgaatg

SEQ ID NO: 536147 - DNA, 20 bp, Artificial Sequence
  chemically synthesized
attatgaatgttagaaaagc

SEQ ID NO: 536148 - DNA, 20 bp, Artificial Sequence
  chemically synthesized
ttttaaaaggataaagcagg

SEQ ID NO: 536149 - DNA, 20 bp, Artificial Sequence
  chemically synthesized
gaacaaaagataatatatag

SEQ ID NO: 536150 - DNA, 20 bp, Artificial Sequence
  chemically synthesized
aaggctttcaatgtttttat

SEQ ID NO: 536151 - DNA, 20 bp, Artificial Sequence
  chemically synthesized
atatattactcactagtctc

SEQ ID NO: 536152 - DNA, 20 bp, Artificial Sequence
  chemically synthesized
tattctgtctttgtagggtt

SEQ ID NO: 536153 - DNA, 20 bp, Artificial Sequence
  chemically synthesized
gtttctgtaaccctacaaag

SEQ ID NO: 536154 - DNA, 20 bp, Artificial Sequence
  chemically synthesized
gagaagtaatcattctgata

SEQ ID NO: 536155 - DNA, 20 bp, Artificial Sequence
  chemically synthesized
cctattgctactttctgtta

SEQ ID NO: 536156 - DNA, 20 bp, Artificial Sequence
  chemically synthesized
gaacatgaaaaacttaaaac

SEQ ID NO: 536157 - DNA, 20 bp, Artificial Sequence
  chemically synthesized
acctatatgtgctgagatag

SEQ ID NO: 536158 - DNA, 20 bp, Artificial Sequence
  chemically synthesized
ctcagtaagcatattgcccc

SEQ ID NO: 536159 - DNA, 20 bp, Artificial Sequence
  chemically synthesized
ctaagtcaactggtagaaac

SEQ ID NO: 536160 - DNA, 20 bp, Artificial Sequence
  chemically synthesized
agtggaacctaagtcaactg

SEQ ID NO: 536161 - DNA, 20 bp, Artificial Sequence
  chemically synthesized
acttcaactgggtctcaact

SEQ ID NO: 536162 - DNA, 20 bp, Artificial Sequence
  chemically synthesized
ataacgacacccctgaaaat

SEQ ID NO: 536163 - DNA, 20 bp, Artificial Sequence
  chemically synthesized
aagttaatttacattgtgat

SEQ ID NO: 536164 - DNA, 20 bp, Artificial Sequence
  chemically synthesized
acctaactcatagctttgtt

SEQ ID NO: 536165 - DNA, 20 bp, Artificial Sequence
  chemically synthesized
gaagcaaaacagaagatatt

SEQ ID NO: 536166 - DNA, 20 bp, Artificial Sequence
  chemically synthesized
aaggactaggttttagttac

SEQ ID NO: 536167 - DNA, 20 bp, Artificial Sequence
  chemically synthesized
agagtttatgtattaataaa

SEQ ID NO: 536168 - DNA, 20 bp, Artificial Sequence
  chemically synthesized
acagcttaattggaatgatg

SEQ ID NO: 536169 - DNA, 20 bp, Artificial Sequence
  chemically synthesized
taaaatttaagcagtgctca

SEQ ID NO: 536170 - DNA, 20 bp, Artificial Sequence
  chemically synthesized
taaaattatggagatgtagt

SEQ ID NO: 536171 - DNA, 20 bp, Artificial Sequence
  chemically synthesized
gatttttccatttacaaaca

SEQ ID NO: 536172 - DNA, 20 bp, Artificial Sequence
  chemically synthesized
tcaagcaaagtatatacaat

SEQ ID NO: 536173 - DNA, 20 bp, Artificial Sequence
  chemically synthesized
taattcctgttcttcataaa

SEQ ID NO: 536174 - DNA, 20 bp, Artificial Sequence
  chemically synthesized
tgaagaacaggaattagtta

SEQ ID NO: 536175 - DNA, 20 bp, Artificial Sequence
  chemically synthesized
ttttaaaaggaaagctatat

SEQ ID NO: 536176 - DNA, 20 bp, Artificial Sequence
  chemically synthesized
aaagcccattttgtctgata

SEQ ID NO: 536177 - DNA, 20 bp, Artificial Sequence
  chemically synthesized
aataaccgtaaataaaagat

SEQ ID NO: 536178 - DNA, 20 bp, Artificial Sequence
  chemically synthesized
taaaacaatagtactagacc

SEQ ID NO: 536179 - DNA, 20 bp, Artificial Sequence
  chemically synthesized
cactgaaacaaaaacttaac

SEQ ID NO: 536180 - DNA, 20 bp, Artificial Sequence
  chemically synthesized
gtatattctataattgttag

SEQ ID NO: 536181 - DNA, 20 bp, Artificial Sequence
  chemically synthesized
gaacattcttcctaacaatt

SEQ ID NO: 536182 - DNA, 20 bp, Artificial Sequence
  chemically synthesized
gagaatggtccatctgctga

SEQ ID NO: 536183 - DNA, 20 bp, Artificial Sequence
  chemically synthesized
tctcttgtatgacctgtctt

SEQ ID NO: 536184 - DNA, 20 bp, Artificial Sequence
  chemically synthesized
ctatacaaacacatggaaat

SEQ ID NO: 536185 - DNA, 20 bp, Artificial Sequence
  chemically synthesized
ggttgtcaatttgtgctctt

SEQ ID NO: 536186 - DNA, 20 bp, Artificial Sequence
  chemically synthesized
atgtcacatttcaaggaact

SEQ ID NO: 536187 - DNA, 20 bp, Artificial Sequence
  chemically synthesized
aactaaactcaaatccagca

SEQ ID NO: 536188 - DNA, 20 bp, Artificial Sequence
  chemically synthesized
aactcaaatccagcagaaga

SEQ ID NO: 536189 - DNA, 20 bp, Artificial Sequence
  chemically synthesized
gaagattcaaataagctcaa

SEQ ID NO: 536190 - DNA, 20 bp, Artificial Sequence
  chemically synthesized
aacacctttatgcacacaaa

SEQ ID NO: 536191 - DNA, 20 bp, Artificial Sequence
  chemically synthesized
accctcctagtttaaatcaa

SEQ ID NO: 536192 - DNA, 20 bp, Artificial Sequence
  chemically synthesized
ctagtttaaatcaagaagaa

SEQ ID NO: 536193 - DNA, 20 bp, Artificial Sequence
  chemically synthesized
ctacttgggaggctgaggca

SEQ ID NO: 536194 - DNA, 20 bp, Artificial Sequence
  chemically synthesized
atctcaaaaaaaaaaaaaaa

SEQ ID NO: 536195 - DNA, 20 bp, Artificial Sequence
  chemically synthesized
caaaaaaaaaaaaaaaaaag

SEQ ID NO: 536196 - DNA, 20 bp, Artificial Sequence
  chemically synthesized
aattcttctttgaatgtctg

SEQ ID NO: 536197 - DNA, 20 bp, Artificial Sequence
  chemically synthesized
aattctaccagacattcaaa

SEQ ID NO: 536198 - DNA, 20 bp, Artificial Sequence
  chemically synthesized
attagggtgatactgacttc

SEQ ID NO: 536199 - DNA, 20 bp, Artificial Sequence
  chemically synthesized
gtatcaccctaataccaaaa

SEQ ID NO: 536200 - DNA, 20 bp, Artificial Sequence
  chemically synthesized
ccagaaaaggaaataacaaa

SEQ ID NO: 536201 - DNA, 20 bp, Artificial Sequence
  chemically synthesized
ccatcgaccaatgaatggat

SEQ ID NO: 536202 - DNA, 20 bp, Artificial Sequence
  chemically synthesized
gaatattactcagccataaa

SEQ ID NO: 536203 - DNA, 20 bp, Artificial Sequence
  chemically synthesized
aaatggatacataaaaaatt

SEQ ID NO: 536204 - DNA, 20 bp, Artificial Sequence
  chemically synthesized
aatatccaaaaaatatgagg

SEQ ID NO: 536205 - DNA, 20 bp, Artificial Sequence
  chemically synthesized
cttttttccttgtcttaatg

SEQ ID NO: 536206 - DNA, 20 bp, Artificial Sequence
  chemically synthesized
aagacaaggaaaaaagcctt

SEQ ID NO: 536207 - DNA, 20 bp, Artificial Sequence
  chemically synthesized
agaaatagatattatttgat

SEQ ID NO: 536208 - DNA, 20 bp, Artificial Sequence
  chemically synthesized
catttgtttaaaaaagtaaa

SEQ ID NO: 536209 - DNA, 20 bp, Artificial Sequence
  chemically synthesized
cttttcactcaaatattctc

SEQ ID NO: 536210 - DNA, 20 bp, Artificial Sequence
  chemically synthesized
cactcaaatattctctcaga

SEQ ID NO: 536211 - DNA, 20 bp, Artificial Sequence
  chemically synthesized
tgagccaactttcttttctg

SEQ ID NO: 536212 - DNA, 20 bp, Artificial Sequence
  chemically synthesized
atgcttacataagtattctg

SEQ ID NO: 536213 - DNA, 20 bp, Artificial Sequence
  chemically synthesized
ttttaattaagcaaattctg

SEQ ID NO: 536214 - DNA, 20 bp, Artificial Sequence
  chemically synthesized
gcttaattaaaaagggaggc

SEQ ID NO: 536215 - DNA, 20 bp, Artificial Sequence
  chemically synthesized
tcattgtaaacgagtctttc

SEQ ID NO: 536216 - DNA, 20 bp, Artificial Sequence
  chemically synthesized
aaagccaaacaacttaaaaa

SEQ ID NO: 536217 - DNA, 20 bp, Artificial Sequence
  chemically synthesized
ccaaacaacttaaaaagcag

SEQ ID NO: 536218 - DNA, 20 bp, Artificial Sequence
  chemically synthesized
gagaccagcttgaccaacgt

SEQ ID NO: 536219 - DNA, 20 bp, Artificial Sequence
  chemically synthesized
ctacttggaaggctgaggca

SEQ ID NO: 536220 - DNA, 20 bp, Artificial Sequence
  chemically synthesized
caaacaaccaaaatcatatc

SEQ ID NO: 536221 - DNA, 20 bp, Artificial Sequence
  chemically synthesized
ctggatgttaaaaaacactc

SEQ ID NO: 536222 - DNA, 20 bp, Artificial Sequence
  chemically synthesized
gacaaggcctttctgctatc

SEQ ID NO: 536223 - DNA, 20 bp, Artificial Sequence
  chemically synthesized
tattagtcatttctgtgata

SEQ ID NO: 536224 - DNA, 20 bp, Artificial Sequence
  chemically synthesized
atttctggattagatgcttt

SEQ ID NO: 536225 - DNA, 20 bp, Artificial Sequence
  chemically synthesized
gtttcttgaaagcatctaat

SEQ ID NO: 536226 - DNA, 20 bp, Artificial Sequence
  chemically synthesized
gcatgattctaaggaggaat

SEQ ID NO: 536227 - DNA, 20 bp, Artificial Sequence
  chemically synthesized
tctactttctgaattcctcc

SEQ ID NO: 536228 - DNA, 20 bp, Artificial Sequence
  chemically synthesized
catatctgtaatcaaaaaat

SEQ ID NO: 536229 - DNA, 20 bp, Artificial Sequence
  chemically synthesized
aggtgatgagctctacaatt

SEQ ID NO: 536230 - DNA, 20 bp, Artificial Sequence
  chemically synthesized
aaacccttcgtatgtatatt

SEQ ID NO: 536231 - DNA, 20 bp, Artificial Sequence
  chemically synthesized
ttataaaataacacactcat

SEQ ID NO: 536232 - DNA, 20 bp, Artificial Sequence
  chemically synthesized
atatggaaatgctactcaat

SEQ ID NO: 536233 - DNA, 20 bp, Artificial Sequence
  chemically synthesized
caacttgtaaacataaacat

SEQ ID NO: 536234 - DNA, 20 bp, Artificial Sequence
  chemically synthesized
gcttcactttcccaatgaga

SEQ ID NO: 536235 - DNA, 20 bp, Artificial Sequence
  chemically synthesized
ctactcgggaggctgaggca

SEQ ID NO: 536236 - DNA, 20 bp, Artificial Sequence
  chemically synthesized
aataagttgggagaggactt

SEQ ID NO: 536237 - DNA, 20 bp, Artificial Sequence
  chemically synthesized
caatttccatgccaataaca

SEQ ID NO: 536238 - DNA, 20 bp, Artificial Sequence
  chemically synthesized
gtgtaacttcacttgtagca

SEQ ID NO: 536239 - DNA, 20 bp, Artificial Sequence
  chemically synthesized
gcagtagaacaaactcattg

SEQ ID NO: 536240 - DNA, 20 bp, Artificial Sequence
  chemically synthesized
atggaacgctttggccaaat

SEQ ID NO: 536241 - DNA, 20 bp, Artificial Sequence
  chemically synthesized
ttgaattatttttcaatgta

SEQ ID NO: 536242 - DNA, 20 bp, Artificial Sequence
  chemically synthesized
gctggcttcattttatcact

SEQ ID NO: 536243 - DNA, 20 bp, Artificial Sequence
  chemically synthesized
gttaaaaatgagtatgaata

SEQ ID NO: 536244 - DNA, 20 bp, Artificial Sequence
  chemically synthesized
gttatttcttcatcttaact

SEQ ID NO: 536245 - DNA, 20 bp, Artificial Sequence
  chemically synthesized
gtaatttctgaagttaagat

SEQ ID NO: 536246 - DNA, 20 bp, Artificial Sequence
  chemically synthesized
agagagagagagacagagag

SEQ ID NO: 536247 - DNA, 20 bp, Artificial Sequence
  chemically synthesized
accttttacaggaagtcctc

SEQ ID NO: 536248 - DNA, 20 bp, Artificial Sequence
  chemically synthesized
ggttagtcagagattttaaa

SEQ ID NO: 536249 - DNA, 20 bp, Artificial Sequence
  chemically synthesized
cagagattttaaaaaagaaa

SEQ ID NO: 536250 - DNA, 20 bp, Artificial Sequence
  chemically synthesized
atataccatctttgaaaata

SEQ ID NO: 536251 - DNA, 20 bp, Artificial Sequence
  chemically synthesized
agttgacgaagtgaaggaaa

SEQ ID NO: 536252 - DNA, 20 bp, Artificial Sequence
  chemically synthesized
tgaaggaaagaagaaagagg

SEQ ID NO: 536253 - DNA, 20 bp, Artificial Sequence
  chemically synthesized
ggacagacaggctgtctgat

SEQ ID NO: 536254 - DNA, 20 bp, Artificial Sequence
  chemically synthesized
caatagacaagtcaatttcc

SEQ ID NO: 536255 - DNA, 20 bp, Artificial Sequence
  chemically synthesized
acaagtcaatttcctaagaa

SEQ ID NO: 536256 - DNA, 20 bp, Artificial Sequence
  chemically synthesized
gctccctgatgtgtctttaa

SEQ ID NO: 536257 - DNA, 20 bp, Artificial Sequence
  chemically synthesized
gagattttcattttcttttt

SEQ ID NO: 536258 - DNA, 20 bp, Artificial Sequence
  chemically synthesized
aagaaaatgatattctttaa

SEQ ID NO: 536259 - DNA, 20 bp, Artificial Sequence
  chemically synthesized
ttggaaactgtaataattat

SEQ ID NO: 536260 - DNA, 20 bp, Artificial Sequence
  chemically synthesized
acctcccccaaaaaacaaaa

SEQ ID NO: 536261 - DNA, 20 bp, Artificial Sequence
  chemically synthesized
gcctgcagcacattttcatg

SEQ ID NO: 536262 - DNA, 20 bp, Artificial Sequence
  chemically synthesized
tcagagcaatggagtgtcct

SEQ ID NO: 536263 - DNA, 20 bp, Artificial Sequence
  chemically synthesized
atgacacccagcaatacaag

SEQ ID NO: 536264 - DNA, 20 bp, Artificial Sequence
  chemically synthesized
gcaaaaatgcaagaatgatt

SEQ ID NO: 536265 - DNA, 20 bp, Artificial Sequence
  chemically synthesized
agttgataggggcaaaaatg

SEQ ID NO: 536266 - DNA, 20 bp, Artificial Sequence
  chemically synthesized
ctacttgggaggctgaggca

SEQ ID NO: 536267 - DNA, 20 bp, Artificial Sequence
  chemically synthesized
cccatttctcccttggattt

SEQ ID NO: 536268 - DNA, 20 bp, Artificial Sequence
  chemically synthesized
gatttttctccaaatccaag

SEQ ID NO: 536269 - DNA, 20 bp, Artificial Sequence
  chemically synthesized
tctcccaatgtgtcaaattg

SEQ ID NO: 536270 - DNA, 20 bp, Artificial Sequence
  chemically synthesized
gaaaatagggaaacagggaa

SEQ ID NO: 536271 - DNA, 20 bp, Artificial Sequence
  chemically synthesized
cctggttctttctttttatt

SEQ ID NO: 536272 - DNA, 20 bp, Artificial Sequence
  chemically synthesized
gaattacttttctgaaataa

SEQ ID NO: 536273 - DNA, 20 bp, Artificial Sequence
  chemically synthesized
gatgcattagtgatgtaaaa

SEQ ID NO: 536274 - DNA, 20 bp, Artificial Sequence
  chemically synthesized
agatcttaattaaaagccac

SEQ ID NO: 536275 - DNA, 20 bp, Artificial Sequence
  chemically synthesized
tgaggatcaacaaagagtag

SEQ ID NO: 536276 - DNA, 20 bp, Artificial Sequence
  chemically synthesized
agagtttccgttgatgttct

SEQ ID NO: 536277 - DNA, 20 bp, Artificial Sequence
  chemically synthesized
attgcaaccactccaaaaat

SEQ ID NO: 536278 - DNA, 20 bp, Artificial Sequence
  chemically synthesized
agatatcaacatacttttat

SEQ ID NO: 536279 - DNA, 20 bp, Artificial Sequence
  chemically synthesized
aaaagtatgttgatatctac

SEQ ID NO: 536280 - DNA, 20 bp, Artificial Sequence
  chemically synthesized
taaggaaaacaaacaatctt

SEQ ID NO: 536281 - DNA, 20 bp, Artificial Sequence
  chemically synthesized
actaagcagcgaccttagag

SEQ ID NO: 536282 - DNA, 20 bp, Artificial Sequence
  chemically synthesized
tccaagcctgcaacattaac

SEQ ID NO: 536283 - DNA, 20 bp, Artificial Sequence
  chemically synthesized
acctgattctctgtacctga

SEQ ID NO: 536284 - DNA, 20 bp, Artificial Sequence
  chemically synthesized
ttataattctggtcaggtac

SEQ ID NO: 536285 - DNA, 20 bp, Artificial Sequence
  chemically synthesized
gacttcaacatggatatgga

SEQ ID NO: 536286 - DNA, 20 bp, Artificial Sequence
  chemically synthesized
gatatggagaagaaaaaaaa

SEQ ID NO: 536287 - DNA, 20 bp, Artificial Sequence
  chemically synthesized
tcccaggccagctttttgcc

SEQ ID NO: 536288 - DNA, 20 bp, Artificial Sequence
  chemically synthesized
gcttcagtattttattgggt

SEQ ID NO: 536289 - DNA, 20 bp, Artificial Sequence
  chemically synthesized
atgccgattttactctttta

SEQ ID NO: 536290 - DNA, 20 bp, Artificial Sequence
  chemically synthesized
cttttataagaaagagcaac

SEQ ID NO: 536291 - DNA, 20 bp, Artificial Sequence
  chemically synthesized
ataagaaagagcaacaaaga

SEQ ID NO: 536292 - DNA, 20 bp, Artificial Sequence
  chemically synthesized
tgtctgtctccaacagctgt

SEQ ID NO: 536293 - DNA, 20 bp, Artificial Sequence
  chemically synthesized
aagcaaagcaataaagcccc

SEQ ID NO: 536294 - DNA, 20 bp, Artificial Sequence
  chemically synthesized
attgatggcagcacaccagg

SEQ ID NO: 536295 - DNA, 20 bp, Artificial Sequence
  chemically synthesized
tttgtgcccttatgtaccag

SEQ ID NO: 536296 - DNA, 20 bp, Artificial Sequence
  chemically synthesized
aaaaatgtagcttttggtgc

SEQ ID NO: 536297 - DNA, 20 bp, Artificial Sequence
  chemically synthesized
tgtagcttttggtgcagaga

SEQ ID NO: 536298 - DNA, 20 bp, Artificial Sequence
  chemically synthesized
ttgaattatataatactcat

SEQ ID NO: 536299 - DNA, 20 bp, Artificial Sequence
  chemically synthesized
atttatatccaatactaaac

SEQ ID NO: 536300 - DNA, 20 bp, Artificial Sequence
  chemically synthesized
aaaataattttgacagtgat

SEQ ID NO: 536301 - DNA, 20 bp, Artificial Sequence
  chemically synthesized
tttaagtgtttaccctttgg

SEQ ID NO: 536302 - DNA, 20 bp, Artificial Sequence
  chemically synthesized
gcttcagccttctccagact

SEQ ID NO: 536303 - DNA, 20 bp, Artificial Sequence
  chemically synthesized
gctctcttgatgagacgaca

SEQ ID NO: 536304 - DNA, 20 bp, Artificial Sequence
  chemically synthesized
tgagacgacaaaagaattgt

SEQ ID NO: 536305 - DNA, 20 bp, Artificial Sequence
  chemically synthesized
atggtcttactgccccttgc

SEQ ID NO: 536306 - DNA, 20 bp, Artificial Sequence
  chemically synthesized
actgtatgtctttgctagag

SEQ ID NO: 536307 - DNA, 20 bp, Artificial Sequence
  chemically synthesized
tatggtctcaaaatacttta

SEQ ID NO: 536308 - DNA, 20 bp, Artificial Sequence
  chemically synthesized
atatattattctaaggaagt

SEQ ID NO: 536309 - DNA, 20 bp, Artificial Sequence
  chemically synthesized
atgctcttttctctacttcc

SEQ ID NO: 536310 - DNA, 20 bp, Artificial Sequence
  chemically synthesized
tcagcaaggtaaaaatgatt

SEQ ID NO: 536311 - DNA, 20 bp, Artificial Sequence
  chemically synthesized
agaaaatagtgctttgtctt

SEQ ID NO: 536312 - DNA, 20 bp, Artificial Sequence
  chemically synthesized
tcccagctgtcagtgaataa

SEQ ID NO: 536313 - DNA, 20 bp, Artificial Sequence
  chemically synthesized
agctatatcaataactatca

SEQ ID NO: 536314 - DNA, 20 bp, Artificial Sequence
  chemically synthesized
tacagctatgatgaagctaa

SEQ ID NO: 536315 - DNA, 20 bp, Artificial Sequence
  chemically synthesized
acagattgccactttacaga

SEQ ID NO: 536316 - DNA, 20 bp, Artificial Sequence
  chemically synthesized
attatgttatttctaagcat

SEQ ID NO: 536317 - DNA, 20 bp, Artificial Sequence
  chemically synthesized
aaagtaaaatttcttaatgc

SEQ ID NO: 536318 - DNA, 20 bp, Artificial Sequence
  chemically synthesized
tgccctacctctctgataat

SEQ ID NO: 536319 - DNA, 20 bp, Artificial Sequence
  chemically synthesized
gtatagttttgaccattcct

SEQ ID NO: 536320 - DNA, 20 bp, Artificial Sequence
  chemically synthesized
aactctagcagattatttag

SEQ ID NO: 536321 - DNA, 20 bp, Artificial Sequence
  chemically synthesized
atttaactctagcagattat

SEQ ID NO: 536322 - DNA, 20 bp, Artificial Sequence
  chemically synthesized
ttattgattacaacaatgtc

SEQ ID NO: 536323 - DNA, 20 bp, Artificial Sequence
  chemically synthesized
taatcccattttaatttgtc

SEQ ID NO: 536324 - DNA, 20 bp, Artificial Sequence
  chemically synthesized
aattatacaaattcagctaa

SEQ ID NO: 536325 - DNA, 20 bp, Artificial Sequence
  chemically synthesized
tcctatgctcgatgagtgaa

SEQ ID NO: 536326 - DNA, 20 bp, Artificial Sequence
  chemically synthesized
ttaaatttaagggaatatga

SEQ ID NO: 536327 - DNA, 20 bp, Artificial Sequence
  chemically synthesized
tttgaatacgcactccaatt

SEQ ID NO: 536328 - DNA, 20 bp, Artificial Sequence
  chemically synthesized
ctagagattgggatacagca

SEQ ID NO: 536329 - DNA, 20 bp, Artificial Sequence
  chemically synthesized
tgaaaaagcttgaaatattg

SEQ ID NO: 536330 - DNA, 20 bp, Artificial Sequence
  chemically synthesized
atgactggtcagtggagcgt

SEQ ID NO: 536331 - DNA, 20 bp, Artificial Sequence
  chemically synthesized
aatttcaatattgttgtgtc

SEQ ID NO: 536332 - DNA, 20 bp, Artificial Sequence
  chemically synthesized
ctctcactttaaatcaaaag

SEQ ID NO: 536333 - DNA, 20 bp, Artificial Sequence
  chemically synthesized
aatgcaaaggaaaaattctt

SEQ ID NO: 536334 - DNA, 20 bp, Artificial Sequence
  chemically synthesized
ctggcacttttaattttctt

SEQ ID NO: 536335 - DNA, 20 bp, Artificial Sequence
  chemically synthesized
aacagccttattgttaatat

SEQ ID NO: 536336 - DNA, 20 bp, Artificial Sequence
  chemically synthesized
ctggattaggctttggctta

SEQ ID NO: 536337 - DNA, 20 bp, Artificial Sequence
  chemically synthesized
ctcagcattcatacaactga

SEQ ID NO: 536338 - DNA, 20 bp, Artificial Sequence
  chemically synthesized
agagaggtgaggaaattgta

SEQ ID NO: 536339 - DNA, 20 bp, Artificial Sequence
  chemically synthesized
ctggccatacctattgcaca

SEQ ID NO: 536340 - DNA, 20 bp, Artificial Sequence
  chemically synthesized
gactcctttgtccaaggact

SEQ ID NO: 536341 - DNA, 20 bp, Artificial Sequence
  chemically synthesized
ccttacaaaatgtacttttt

SEQ ID NO: 536342 - DNA, 20 bp, Artificial Sequence
  chemically synthesized
ctcaccattccagatgccat

SEQ ID NO: 536343 - DNA, 20 bp, Artificial Sequence
  chemically synthesized
attaagaaaatttgtgattc

SEQ ID NO: 536344 - DNA, 20 bp, Artificial Sequence
  chemically synthesized
taggggaagtcactggatgt

SEQ ID NO: 536345 - DNA, 20 bp, Artificial Sequence
  chemically synthesized
tggagaaaattgcaagagaa

SEQ ID NO: 536346 - DNA, 20 bp, Artificial Sequence
  chemically synthesized
aaacaaagtgttttcatgag

SEQ ID NO: 536347 - DNA, 20 bp, Artificial Sequence
  chemically synthesized
ttgaaatgacaacaaagggt

SEQ ID NO: 536348 - DNA, 20 bp, Artificial Sequence
  chemically synthesized
ctgctttaccaactaagttt

SEQ ID NO: 536349 - DNA, 20 bp, Artificial Sequence
  chemically synthesized
acctcatggttgttttattc

SEQ ID NO: 536350 - DNA, 20 bp, Artificial Sequence
  chemically synthesized
ggagtgactatgccaatttc

SEQ ID NO: 536351 - DNA, 20 bp, Artificial Sequence
  chemically synthesized
tcgtaaatgaattagtagga

SEQ ID NO: 536352 - DNA, 20 bp, Artificial Sequence
  chemically synthesized
aaatactacacaaccattaa

SEQ ID NO: 536353 - DNA, 20 bp, Artificial Sequence
  chemically synthesized
ccatcaatggtggactggat

SEQ ID NO: 536354 - DNA, 20 bp, Artificial Sequence
  chemically synthesized
tcactgcagcactattcaca

SEQ ID NO: 536355 - DNA, 20 bp, Artificial Sequence
  chemically synthesized
caagtgcatgtgtctttttg

SEQ ID NO: 536356 - DNA, 20 bp, Artificial Sequence
  chemically synthesized
aatgacagtgcattttaagt

SEQ ID NO: 536357 - DNA, 20 bp, Artificial Sequence
  chemically synthesized
atagatgttggtgaggctgc

SEQ ID NO: 536358 - DNA, 20 bp, Artificial Sequence
  chemically synthesized
gagataccatctcacaccag

SEQ ID NO: 536359 - DNA, 20 bp, Artificial Sequence
  chemically synthesized
gctccacatcactcatcatt

SEQ ID NO: 536360 - DNA, 20 bp, Artificial Sequence
  chemically synthesized
aacagacaacccacaagatg

SEQ ID NO: 536361 - DNA, 20 bp, Artificial Sequence
  chemically synthesized
taaagagcttctacacagca

SEQ ID NO: 536362 - DNA, 20 bp, Artificial Sequence
  chemically synthesized
ttctggacatcagccttcag

SEQ ID NO: 536363 - DNA, 20 bp, Artificial Sequence
  chemically synthesized
actattctggacatcagcct

SEQ ID NO: 536364 - DNA, 20 bp, Artificial Sequence
  chemically synthesized
ttctttctgaaggctgatgt

SEQ ID NO: 536365 - DNA, 20 bp, Artificial Sequence
  chemically synthesized
ctcaaactagaagaatcgca

SEQ ID NO: 536366 - DNA, 20 bp, Artificial Sequence
  chemically synthesized
tacaataaaatctcaaacta

SEQ ID NO: 536367 - DNA, 20 bp, Artificial Sequence
  chemically synthesized
agtagaacagaatagagaac

SEQ ID NO: 536368 - DNA, 20 bp, Artificial Sequence
  chemically synthesized
cagaaacttggaccagtaga

SEQ ID NO: 536369 - DNA, 20 bp, Artificial Sequence
  chemically synthesized
agaatgggacttctacaaaa

SEQ ID NO: 536370 - DNA, 20 bp, Artificial Sequence
  chemically synthesized
ataaggctacagttacccaa

SEQ ID NO: 536371 - DNA, 20 bp, Artificial Sequence
  chemically synthesized
gtaaaaacaatgctaagtga

SEQ ID NO: 536372 - DNA, 20 bp, Artificial Sequence
  chemically synthesized
aactagcaatgtcatttttc

SEQ ID NO: 536373 - DNA, 20 bp, Artificial Sequence
  chemically synthesized
cattccatgttaatggaaag

SEQ ID NO: 536374 - DNA, 20 bp, Artificial Sequence
  chemically synthesized
catagataacacaaacaaat

SEQ ID NO: 536375 - DNA, 20 bp, Artificial Sequence
  chemically synthesized
ctaactacaaaacactgctg

SEQ ID NO: 536376 - DNA, 20 bp, Artificial Sequence
  chemically synthesized
gttcaagctgagagccaaat

SEQ ID NO: 536377 - DNA, 20 bp, Artificial Sequence
  chemically synthesized
tatatgtatatgtatgctat

SEQ ID NO: 536378 - DNA, 20 bp, Artificial Sequence
  chemically synthesized
ttcaggaaatggaatgaagt

SEQ ID NO: 536379 - DNA, 20 bp, Artificial Sequence
  chemically synthesized
ctctgttaacataaatatgt

SEQ ID NO: 536380 - DNA, 20 bp, Artificial Sequence
  chemically synthesized
tcattcaggtgttatagagg

SEQ ID NO: 536381 - DNA, 20 bp, Artificial Sequence
  chemically synthesized
tggtatatacaatcaacttg

SEQ ID NO: 536382 - DNA, 20 bp, Artificial Sequence
  chemically synthesized
gtcaaatcagggttggtatc

SEQ ID NO: 536383 - DNA, 20 bp, Artificial Sequence
  chemically synthesized
ttaaggataaggggctggtg

SEQ ID NO: 536384 - DNA, 20 bp, Artificial Sequence
  chemically synthesized
tggcaggacttgatggggaa

SEQ ID NO: 536385 - DNA, 20 bp, Artificial Sequence
  chemically synthesized
gatggggaaaaagaaaattt

SEQ ID NO: 536386 - DNA, 20 bp, Artificial Sequence
  chemically synthesized
caccaagattttataacttg

SEQ ID NO: 536387 - DNA, 20 bp, Artificial Sequence
  chemically synthesized
attaacactgatgcaaatgt

SEQ ID NO: 536388 - DNA, 20 bp, Artificial Sequence
  chemically synthesized
gtgcagattaggggtaaggc

SEQ ID NO: 536389 - DNA, 20 bp, Artificial Sequence
  chemically synthesized
agtgactgaagaggatagag

SEQ ID NO: 536390 - DNA, 20 bp, Artificial Sequence
  chemically synthesized
ttcgcctccacaggataaga

SEQ ID NO: 536391 - DNA, 20 bp, Artificial Sequence
  chemically synthesized
ataagagaagaaagttgaac

SEQ ID NO: 536392 - DNA, 20 bp, Artificial Sequence
  chemically synthesized
gaaagttgaaccaagaaaag

SEQ ID NO: 536393 - DNA, 20 bp, Artificial Sequence
  chemically synthesized
aacccaaaatagaagtgagg

SEQ ID NO: 536394 - DNA, 20 bp, Artificial Sequence
  chemically synthesized
tacagataagcaaggaagct

SEQ ID NO: 536395 - DNA, 20 bp, Artificial Sequence
  chemically synthesized
gaacgtttgctctggaaaat

SEQ ID NO: 536396 - DNA, 20 bp, Artificial Sequence
  chemically synthesized
aaggatagttattaattatg

SEQ ID NO: 536397 - DNA, 20 bp, Artificial Sequence
  chemically synthesized
gcaagacttttttaaaatgt

SEQ ID NO: 536398 - DNA, 20 bp, Artificial Sequence
  chemically synthesized
acttgtaagcaattttaaag

SEQ ID NO: 536399 - DNA, 20 bp, Artificial Sequence
  chemically synthesized
ccagtgaaaattctgtacct

SEQ ID NO: 536400 - DNA, 20 bp, Artificial Sequence
  chemically synthesized
tctgttcattttctaaaggt

SEQ ID NO: 536401 - DNA, 20 bp, Artificial Sequence
  chemically synthesized
tctgtacctttagaaaatga

SEQ ID NO: 536402 - DNA, 20 bp, Artificial Sequence
  chemically synthesized
gctagtcatttggctgcaca

SEQ ID NO: 536403 - DNA, 20 bp, Artificial Sequence
  chemically synthesized
ggaactatttatgggtgatt

SEQ ID NO: 536404 - DNA, 20 bp, Artificial Sequence
  chemically synthesized
taaatagttccaaaaatcat

SEQ ID NO: 536405 - DNA, 20 bp, Artificial Sequence
  chemically synthesized
aaattgttattggcgaataa

SEQ ID NO: 536406 - DNA, 20 bp, Artificial Sequence
  chemically synthesized
atatttttcacttgcaggaa

SEQ ID NO: 536407 - DNA, 20 bp, Artificial Sequence
  chemically synthesized
tgagatttattctcagttct

SEQ ID NO: 536408 - DNA, 20 bp, Artificial Sequence
  chemically synthesized
ttgctctgtttctatagaac

SEQ ID NO: 536409 - DNA, 20 bp, Artificial Sequence
  chemically synthesized
tagaaacagagcaatgggtg

SEQ ID NO: 536410 - DNA, 20 bp, Artificial Sequence
  chemically synthesized
tgccaaggaaaagtagccac

SEQ ID NO: 536411 - DNA, 20 bp, Artificial Sequence
  chemically synthesized
tgcacctttgatagatcact

SEQ ID NO: 536412 - DNA, 20 bp, Artificial Sequence
  chemically synthesized
taaatgtagtgaggtaaatt

SEQ ID NO: 536413 - DNA, 20 bp, Artificial Sequence
  chemically synthesized
cactgaagaaaatatgtacg

SEQ ID NO: 536414 - DNA, 20 bp, Artificial Sequence
  chemically synthesized
ttattttccttatactcact

SEQ ID NO: 536415 - DNA, 20 bp, Artificial Sequence
  chemically synthesized
agtataaggaaaataaactg

SEQ ID NO: 536416 - DNA, 20 bp, Artificial Sequence
  chemically synthesized
tgacaattatcctaaaaatt

SEQ ID NO: 536417 - DNA, 20 bp, Artificial Sequence
  chemically synthesized
atgtcacattttatttgcat

SEQ ID NO: 536418 - DNA, 20 bp, Artificial Sequence
  chemically synthesized
ccatgcaaataaaatgtgac

SEQ ID NO: 536419 - DNA, 20 bp, Artificial Sequence
  chemically synthesized
agaaaagctaaaaaacaaag

SEQ ID NO: 536420 - DNA, 20 bp, Artificial Sequence
  chemically synthesized
acaaagcaagaaacaactcc

SEQ ID NO: 536421 - DNA, 20 bp, Artificial Sequence
  chemically synthesized
aaccacatgagatggaaaga

SEQ ID NO: 536422 - DNA, 20 bp, Artificial Sequence
  chemically synthesized
atacacacatacactcctac

SEQ ID NO: 536423 - DNA, 20 bp, Artificial Sequence
  chemically synthesized
acacagtatacacaacagat

SEQ ID NO: 536424 - DNA, 20 bp, Artificial Sequence
  chemically synthesized
ttaagaaacgtcaattttgg

SEQ ID NO: 536425 - DNA, 20 bp, Artificial Sequence
  chemically synthesized
agaaataattaacataatat

SEQ ID NO: 536426 - DNA, 20 bp, Artificial Sequence
  chemically synthesized
tgtatttgagttcaagagga

SEQ ID NO: 536427 - DNA, 20 bp, Artificial Sequence
  chemically synthesized
ttatattctggaagaatatt

SEQ ID NO: 536428 - DNA, 20 bp, Artificial Sequence
  chemically synthesized
atacattctacaatattctt

SEQ ID NO: 536429 - DNA, 20 bp, Artificial Sequence
  chemically synthesized
tttctctcatttatattctg

SEQ ID NO: 536430 - DNA, 20 bp, Artificial Sequence
  chemically synthesized
attcttccagaatataaatg

SEQ ID NO: 536431 - DNA, 20 bp, Artificial Sequence
  chemically synthesized
tggcaatcataaacccacta

SEQ ID NO: 536432 - DNA, 20 bp, Artificial Sequence
  chemically synthesized
atagtggccggcttgtgtaa

SEQ ID NO: 536433 - DNA, 20 bp, Artificial Sequence
  chemically synthesized
aacttcaaagaacattcaga

SEQ ID NO: 536434 - DNA, 20 bp, Artificial Sequence
  chemically synthesized
ttaatggaaatgttctgtta

SEQ ID NO: 536435 - DNA, 20 bp, Artificial Sequence
  chemically synthesized
tcttgcattggaggggacat

SEQ ID NO: 536436 - DNA, 20 bp, Artificial Sequence
  chemically synthesized
tagtgaactatcaatactat

SEQ ID NO: 536437 - DNA, 20 bp, Artificial Sequence
  chemically synthesized
tacaatgtcaggtataattt

SEQ ID NO: 536438 - DNA, 20 bp, Artificial Sequence
  chemically synthesized
gtaatggttcaataacagta

SEQ ID NO: 536439 - DNA, 20 bp, Artificial Sequence
  chemically synthesized
aagattagtgatgaaaagag

SEQ ID NO: 536440 - DNA, 20 bp, Artificial Sequence
  chemically synthesized
tatgttgaataaatcaatta

SEQ ID NO: 536441 - DNA, 20 bp, Artificial Sequence
  chemically synthesized
acaatcggcatgatgtagaa

SEQ ID NO: 536442 - DNA, 20 bp, Artificial Sequence
  chemically synthesized
gcacacacaatcggcatgat

SEQ ID NO: 536443 - DNA, 20 bp, Artificial Sequence
  chemically synthesized
ttgtgtgtgcgtgtgtttaa

SEQ ID NO: 536444 - DNA, 20 bp, Artificial Sequence
  chemically synthesized
taactagaaatttggtgttc

SEQ ID NO: 536445 - DNA, 20 bp, Artificial Sequence
  chemically synthesized
gtacaagaaaggaaaacaag

SEQ ID NO: 536446 - DNA, 20 bp, Artificial Sequence
  chemically synthesized
aaatttaaagaaattgagta

SEQ ID NO: 536447 - DNA, 20 bp, Artificial Sequence
  chemically synthesized
agtaggtaaaatgaaaattt

SEQ ID NO: 536448 - DNA, 20 bp, Artificial Sequence
  chemically synthesized
cattttacctactaataacc

SEQ ID NO: 536449 - DNA, 20 bp, Artificial Sequence
  chemically synthesized
atatatgattatatatatat

SEQ ID NO: 536450 - DNA, 20 bp, Artificial Sequence
  chemically synthesized
tgatagacaagaaggtcagg

SEQ ID NO: 536451 - DNA, 20 bp, Artificial Sequence
  chemically synthesized
tcaggacagaaaggctggga

SEQ ID NO: 536452 - DNA, 20 bp, Artificial Sequence
  chemically synthesized
tataaggggatggacggcag

SEQ ID NO: 536453 - DNA, 20 bp, Artificial Sequence
  chemically synthesized
ggggaatgggaagtaatgga

SEQ ID NO: 536454 - DNA, 20 bp, Artificial Sequence
  chemically synthesized
tgggaagtaatggagtagaa

SEQ ID NO: 536455 - DNA, 20 bp, Artificial Sequence
  chemically synthesized
agaaatagaaagcaaaagcc

SEQ ID NO: 536456 - DNA, 20 bp, Artificial Sequence
  chemically synthesized
attcagatcagcttatttga

SEQ ID NO: 536457 - DNA, 20 bp, Artificial Sequence
  chemically synthesized
aatgagatataaatattgct

SEQ ID NO: 536458 - DNA, 20 bp, Artificial Sequence
  chemically synthesized
tataaatattgctacagaaa

SEQ ID NO: 536459 - DNA, 20 bp, Artificial Sequence
  chemically synthesized
ggttgggcggagggagagaa

SEQ ID NO: 536460 - DNA, 20 bp, Artificial Sequence
  chemically synthesized
tatcatcaatgatagattag

SEQ ID NO: 536461 - DNA, 20 bp, Artificial Sequence
  chemically synthesized
gccactattgttatgtaaac

SEQ ID NO: 536462 - DNA, 20 bp, Artificial Sequence
  chemically synthesized
tgttcttatcttccatcatg

SEQ ID NO: 536463 - DNA, 20 bp, Artificial Sequence
  chemically synthesized
atttagagcagatccatatt

SEQ ID NO: 536464 - DNA, 20 bp, Artificial Sequence
  chemically synthesized
caagttaaggtcttttcatt

SEQ ID NO: 536465 - DNA, 20 bp, Artificial Sequence
  chemically synthesized
cttactttggtttttttgtc

SEQ ID NO: 536466 - DNA, 20 bp, Artificial Sequence
  chemically synthesized
tgcactatctctcattccat

SEQ ID NO: 536467 - DNA, 20 bp, Artificial Sequence
  chemically synthesized
ctgtttgctaaaaagtgtag

SEQ ID NO: 536468 - DNA, 20 bp, Artificial Sequence
  chemically synthesized
tctgactgacaatctggact

SEQ ID NO: 536469 - DNA, 20 bp, Artificial Sequence
  chemically synthesized
cccaacatgagaggaaagac

SEQ ID NO: 536470 - DNA, 20 bp, Artificial Sequence
  chemically synthesized
tacgtgccaacctgattgac

SEQ ID NO: 536471 - DNA, 20 bp, Artificial Sequence
  chemically synthesized
ggggtttcaaagtctttttg

SEQ ID NO: 536472 - DNA, 20 bp, Artificial Sequence
  chemically synthesized
tggtaatatttcatttgcca

SEQ ID NO: 536473 - DNA, 20 bp, Artificial Sequence
  chemically synthesized
tttactacacattatcacca

SEQ ID NO: 536474 - DNA, 20 bp, Artificial Sequence
  chemically synthesized
tggtgataatgtgtagtaaa

SEQ ID NO: 536475 - DNA, 20 bp, Artificial Sequence
  chemically synthesized
ggaggtggcatgtggagagt

SEQ ID NO: 536476 - DNA, 20 bp, Artificial Sequence
  chemically synthesized
gtctaatcttaatacagcag

SEQ ID NO: 536477 - DNA, 20 bp, Artificial Sequence
  chemically synthesized
gctgtattaagattagactt

SEQ ID NO: 536478 - DNA, 20 bp, Artificial Sequence
  chemically synthesized
caatgcagattgtaccccct

SEQ ID NO: 536479 - DNA, 20 bp, Artificial Sequence
  chemically synthesized
ttttttctttaaaaggccaa

SEQ ID NO: 536480 - DNA, 20 bp, Artificial Sequence
  chemically synthesized
atttttctatttggcctttt

SEQ ID NO: 536481 - DNA, 20 bp, Artificial Sequence
  chemically synthesized
aagttggccaacactgatgt

SEQ ID NO: 536482 - DNA, 20 bp, Artificial Sequence
  chemically synthesized
gtatttttaataatcaaaca

SEQ ID NO: 536483 - DNA, 20 bp, Artificial Sequence
  chemically synthesized
tgagtctatataaggagttt

SEQ ID NO: 536484 - DNA, 20 bp, Artificial Sequence
  chemically synthesized
taaactccttatatagactc

SEQ ID NO: 536485 - DNA, 20 bp, Artificial Sequence
  chemically synthesized
aagagttaaacaatttataa

SEQ ID NO: 536486 - DNA, 20 bp, Artificial Sequence
  chemically synthesized
tatttactatatggtgtttt

SEQ ID NO: 536487 - DNA, 20 bp, Artificial Sequence
  chemically synthesized
actactttcatgccacattg

SEQ ID NO: 536488 - DNA, 20 bp, Artificial Sequence
  chemically synthesized
atttagtcctccacctattt

SEQ ID NO: 536489 - DNA, 20 bp, Artificial Sequence
  chemically synthesized
tgttgttggaaataatcagt

SEQ ID NO: 536490 - DNA, 20 bp, Artificial Sequence
  chemically synthesized
acaccctttgtccatctgta

SEQ ID NO: 536491 - DNA, 20 bp, Artificial Sequence
  chemically synthesized
gttttctagggagaagggag

SEQ ID NO: 536492 - DNA, 20 bp, Artificial Sequence
  chemically synthesized
actttctagctcccttctcc

SEQ ID NO: 536493 - DNA, 20 bp, Artificial Sequence
  chemically synthesized
aaaaaggacatgcttagtta

SEQ ID NO: 536494 - DNA, 20 bp, Artificial Sequence
  chemically synthesized
attgttattttatttttcac

SEQ ID NO: 536495 - DNA, 20 bp, Artificial Sequence
  chemically synthesized
aaaactagagtcacgaaagg

SEQ ID NO: 536496 - DNA, 20 bp, Artificial Sequence
  chemically synthesized
ttatgtatgcaggatttgcc

SEQ ID NO: 536497 - DNA, 20 bp, Artificial Sequence
  chemically synthesized
aatggcaatagggctgaagc

SEQ ID NO: 536498 - DNA, 20 bp, Artificial Sequence
  chemically synthesized
gtacacagggtagctcccga

SEQ ID NO: 536499 - DNA, 20 bp, Artificial Sequence
  chemically synthesized
tggttgtcacacatggggga

SEQ ID NO: 536500 - DNA, 20 bp, Artificial Sequence
  chemically synthesized
gttccttcatgtattcaata

SEQ ID NO: 536501 - DNA, 20 bp, Artificial Sequence
  chemically synthesized
aatacatgaaggaacaaatg

SEQ ID NO: 536502 - DNA, 20 bp, Artificial Sequence
  chemically synthesized
tacatacaatgttgtatata

SEQ ID NO: 536503 - DNA, 20 bp, Artificial Sequence
  chemically synthesized
actgaaacatgccatgatgg

SEQ ID NO: 536504 - DNA, 20 bp, Artificial Sequence
  chemically synthesized
agatattaggacccattcag

SEQ ID NO: 536505 - DNA, 20 bp, Artificial Sequence
  chemically synthesized
gaatacagtagatctaagga

SEQ ID NO: 536506 - DNA, 20 bp, Artificial Sequence
  chemically synthesized
acatggttctttaagtctta

SEQ ID NO: 536507 - DNA, 20 bp, Artificial Sequence
  chemically synthesized
ggctaattttcattaaaagc

SEQ ID NO: 536508 - DNA, 20 bp, Artificial Sequence
  chemically synthesized
agtgcatgtcagtcatgaag

SEQ ID NO: 536509 - DNA, 20 bp, Artificial Sequence
  chemically synthesized
tttattagttatggtagcac

SEQ ID NO: 536510 - DNA, 20 bp, Artificial Sequence
  chemically synthesized
ttaggaagagtattcagaag

SEQ ID NO: 536511 - DNA, 20 bp, Artificial Sequence
  chemically synthesized
aatatatgggtttctgaaat

SEQ ID NO: 536512 - DNA, 20 bp, Artificial Sequence
  chemically synthesized
atgtgtcctttttcttgatt

SEQ ID NO: 536513 - DNA, 20 bp, Artificial Sequence
  chemically synthesized
gcatataatccagaactcta

SEQ ID NO: 536514 - DNA, 20 bp, Artificial Sequence
  chemically synthesized
atccagaactctactagaat

SEQ ID NO: 536515 - DNA, 20 bp, Artificial Sequence
  chemically synthesized
acaactcatattaatcggta

SEQ ID NO: 536516 - DNA, 20 bp, Artificial Sequence
  chemically synthesized
gtctatctgaggagacctac

SEQ ID NO: 536517 - DNA, 20 bp, Artificial Sequence
  chemically synthesized
tgtttggtttctattaaaat

SEQ ID NO: 536518 - DNA, 20 bp, Artificial Sequence
  chemically synthesized
taaaagtattcttgatttta

SEQ ID NO: 536519 - DNA, 20 bp, Artificial Sequence
  chemically synthesized
aacaaagatttttaatggct

SEQ ID NO: 536520 - DNA, 20 bp, Artificial Sequence
  chemically synthesized
ttatttgatgaaataggtga

SEQ ID NO: 536521 - DNA, 20 bp, Artificial Sequence
  chemically synthesized
aacttttgtgaatgacaagt

SEQ ID NO: 536522 - DNA, 20 bp, Artificial Sequence
  chemically synthesized
gtagtttcatgtttcagtaa

SEQ ID NO: 536523 - DNA, 20 bp, Artificial Sequence
  chemically synthesized
cttaccaaaattattaatgt

SEQ ID NO: 536524 - DNA, 20 bp, Artificial Sequence
  chemically synthesized
ctacttggcagtctgaggca

SEQ ID NO: 536525 - DNA, 20 bp, Artificial Sequence
  chemically synthesized
aaaaaaaaaaaaaaaaaaaa

SEQ ID NO: 536526 - DNA, 20 bp, Artificial Sequence
  chemically synthesized
ttatttaaattaggctattt

SEQ ID NO: 536527 - DNA, 20 bp, Artificial Sequence
  chemically synthesized
caagggggtcaccaaagtgt

SEQ ID NO: 536528 - DNA, 20 bp, Artificial Sequence
  chemically synthesized
atcagtatgtgattcatgat

SEQ ID NO: 536529 - DNA, 20 bp, Artificial Sequence
  chemically synthesized
attgctcaaaggagggtcag

SEQ ID NO: 536530 - DNA, 20 bp, Artificial Sequence
  chemically synthesized
gataggggtacttatataaa

SEQ ID NO: 536531 - DNA, 20 bp, Artificial Sequence
  chemically synthesized
aatagaattgtatttgttaa

SEQ ID NO: 536532 - DNA, 20 bp, Artificial Sequence
  chemically synthesized
actaagtgaaatctcagtat

SEQ ID NO: 536533 - DNA, 20 bp, Artificial Sequence
  chemically synthesized
ttatgcgttgaatttacggc

SEQ ID NO: 536534 - DNA, 20 bp, Artificial Sequence
  chemically synthesized
gatgattacatcttcattgg

SEQ ID NO: 536535 - DNA, 20 bp, Artificial Sequence
  chemically synthesized
aatacttcatatatcctaat

SEQ ID NO: 536536 - DNA, 20 bp, Artificial Sequence
  chemically synthesized
gaagtattacttaaaaccct

SEQ ID NO: 536537 - DNA, 20 bp, Artificial Sequence
  chemically synthesized
ttccactcatatttgagagt

SEQ ID NO: 536538 - DNA, 20 bp, Artificial Sequence
  chemically synthesized
gaacactaaaaagaacactt

SEQ ID NO: 536539 - DNA, 20 bp, Artificial Sequence
  chemically synthesized
gttactttatttcccaatgg

SEQ ID NO: 536540 - DNA, 20 bp, Artificial Sequence
  chemically synthesized
gaggtatcataattacaaat

SEQ ID NO: 536541 - DNA, 20 bp, Artificial Sequence
  chemically synthesized
gagttactgctgaagaacac

SEQ ID NO: 536542 - DNA, 20 bp, Artificial Sequence
  chemically synthesized
tcagcagtaactcagagatt

SEQ ID NO: 536543 - DNA, 20 bp, Artificial Sequence
  chemically synthesized
ccctttcccatactgggcag

SEQ ID NO: 536544 - DNA, 20 bp, Artificial Sequence
  chemically synthesized
gaaagggttatgaagatcac

SEQ ID NO: 536545 - DNA, 20 bp, Artificial Sequence
  chemically synthesized
aaatgaagaagttttcattc

SEQ ID NO: 536546 - DNA, 20 bp, Artificial Sequence
  chemically synthesized
cgggagtcaaatattgattc

SEQ ID NO: 536547 - DNA, 20 bp, Artificial Sequence
  chemically synthesized
tgcatgaaaatgtatctact

SEQ ID NO: 536548 - DNA, 20 bp, Artificial Sequence
  chemically synthesized
tcaaactgtggttccacaga

SEQ ID NO: 536549 - DNA, 20 bp, Artificial Sequence
  chemically synthesized
atggctctagataggatata

SEQ ID NO: 536550 - DNA, 20 bp, Artificial Sequence
  chemically synthesized
atatagctttatgagacaat

SEQ ID NO: 536551 - DNA, 20 bp, Artificial Sequence
  chemically synthesized
tttttaaaaagttatgatta

SEQ ID NO: 536552 - DNA, 20 bp, Artificial Sequence
  chemically synthesized
cttggtggcattgactgttg

SEQ ID NO: 536553 - DNA, 20 bp, Artificial Sequence
  chemically synthesized
attggcagacagaacgcggt

SEQ ID NO: 536554 - DNA, 20 bp, Artificial Sequence
  chemically synthesized
tggtccattcatccacttaa

SEQ ID NO: 536555 - DNA, 20 bp, Artificial Sequence
  chemically synthesized
ttcccatttttctcctccac

SEQ ID NO: 536556 - DNA, 20 bp, Artificial Sequence
  chemically synthesized
tctttctgattctgtgtgga

SEQ ID NO: 536557 - DNA, 20 bp, Artificial Sequence
  chemically synthesized
tttttctcctccacacagaa

SEQ ID NO: 536558 - DNA, 20 bp, Artificial Sequence
  chemically synthesized
tttttttttttatgtactct

SEQ ID NO: 536559 - DNA, 20 bp, Artificial Sequence
  chemically synthesized
aataatgcttttactgcata

SEQ ID NO: 536560 - DNA, 20 bp, Artificial Sequence
  chemically synthesized
atgcagtaaaagcattattt

SEQ ID NO: 536561 - DNA, 20 bp, Artificial Sequence
  chemically synthesized
taaggtttatttcaaaagca

SEQ ID NO: 536562 - DNA, 20 bp, Artificial Sequence
  chemically synthesized
gagagagtagaactgcttta

SEQ ID NO: 536563 - DNA, 20 bp, Artificial Sequence
  chemically synthesized
ataatattggtgaatggaaa

SEQ ID NO: 536564 - DNA, 20 bp, Artificial Sequence
  chemically synthesized
acatacaagaaacaaaccca

SEQ ID NO: 536565 - DNA, 20 bp, Artificial Sequence
  chemically synthesized
ataccattcctcttgacata

SEQ ID NO: 536566 - DNA, 20 bp, Artificial Sequence
  chemically synthesized
aggaatggtattctaactgc

SEQ ID NO: 536567 - DNA, 20 bp, Artificial Sequence
  chemically synthesized
atttgttttattctttgcag

SEQ ID NO: 536568 - DNA, 20 bp, Artificial Sequence
  chemically synthesized
gtccaagatgggtaaagaga

SEQ ID NO: 536569 - DNA, 20 bp, Artificial Sequence
  chemically synthesized
attagaaagcccccagctgc

SEQ ID NO: 536570 - DNA, 20 bp, Artificial Sequence
  chemically synthesized
gatagttatttcagatttgg

SEQ ID NO: 536571 - DNA, 20 bp, Artificial Sequence
  chemically synthesized
tctttaggtaatgtattttg

SEQ ID NO: 536572 - DNA, 20 bp, Artificial Sequence
  chemically synthesized
tcaatgtattgttagataaa

SEQ ID NO: 536573 - DNA, 20 bp, Artificial Sequence
  chemically synthesized
ttcaggttataaccttaaga

SEQ ID NO: 536574 - DNA, 20 bp, Artificial Sequence
  chemically synthesized
aagactagaatctgtctgtt

SEQ ID NO: 536575 - DNA, 20 bp, Artificial Sequence
  chemically synthesized
cattcattaaaacctttatc

SEQ ID NO: 536576 - DNA, 20 bp, Artificial Sequence
  chemically synthesized
gtaaactatatttgccttag

SEQ ID NO: 536577 - DNA, 20 bp, Artificial Sequence
  chemically synthesized
aaaaaagtagcaaacagtgc

SEQ ID NO: 536578 - DNA, 20 bp, Artificial Sequence
  chemically synthesized
tttgaattttttcatgtgtt

SEQ ID NO: 536579 - DNA, 20 bp, Artificial Sequence
  chemically synthesized
aattcactcacaaaatgaat

SEQ ID NO: 536580 - DNA, 20 bp, Artificial Sequence
  chemically synthesized
aacctttttgatcttctaaa

SEQ ID NO: 536581 - DNA, 20 bp, Artificial Sequence
  chemically synthesized
agtgggcacgggtatgggga

SEQ ID NO: 536582 - DNA, 20 bp, Artificial Sequence
  chemically synthesized
gtttcgacttttggctaaga

SEQ ID NO: 536583 - DNA, 20 bp, Artificial Sequence
  chemically synthesized
aattatggtatatccttaga

SEQ ID NO: 536584 - DNA, 20 bp, Artificial Sequence
  chemically synthesized
acagttctttaactactaat

SEQ ID NO: 536585 - DNA, 20 bp, Artificial Sequence
  chemically synthesized
gcactcttctccctccctta

SEQ ID NO: 536586 - DNA, 20 bp, Artificial Sequence
  chemically synthesized
gcactcttcttcctccttca

SEQ ID NO: 536587 - DNA, 20 bp, Artificial Sequence
  chemically synthesized
agaaccatcttttgaaggat

SEQ ID NO: 536588 - DNA, 20 bp, Artificial Sequence
  chemically synthesized
tcttaaaataaagccagctg

SEQ ID NO: 536589 - DNA, 20 bp, Artificial Sequence
  chemically synthesized
tttattttaagaggacaaga

SEQ ID NO: 536590 - DNA, 20 bp, Artificial Sequence
  chemically synthesized
cagtttcctgggtagccttc

SEQ ID NO: 536591 - DNA, 20 bp, Artificial Sequence
  chemically synthesized
aaccttggcagcacatgggg

SEQ ID NO: 536592 - DNA, 20 bp, Artificial Sequence
  chemically synthesized
tgcttttgaattttgtactg

SEQ ID NO: 536593 - DNA, 20 bp, Artificial Sequence
  chemically synthesized
ctactcgggaggctgaggca

SEQ ID NO: 536594 - DNA, 20 bp, Artificial Sequence
  chemically synthesized
aagataatctgcacagtttt

SEQ ID NO: 536595 - DNA, 20 bp, Artificial Sequence
  chemically synthesized
tacaaatgataacaacagtt

SEQ ID NO: 536596 - DNA, 20 bp, Artificial Sequence
  chemically synthesized
ataagatagcatagggtacc

SEQ ID NO: 536597 - DNA, 20 bp, Artificial Sequence
  chemically synthesized
catttaatgggtaaaataaa

SEQ ID NO: 536598 - DNA, 20 bp, Artificial Sequence
  chemically synthesized
cttaagctttcaggcccggg

SEQ ID NO: 536599 - DNA, 20 bp, Artificial Sequence
  chemically synthesized
ttgtgccttaggaatgggcc

SEQ ID NO: 536600 - DNA, 20 bp, Artificial Sequence
  chemically synthesized
agacaagtacctctgaagat

SEQ ID NO: 536601 - DNA, 20 bp, Artificial Sequence
  chemically synthesized
ctgctcgggaggatgacgca

SEQ ID NO: 536602 - DNA, 20 bp, Artificial Sequence
  chemically synthesized
gtcattaaccaaaaagtggg

SEQ ID NO: 536603 - DNA, 20 bp, Artificial Sequence
  chemically synthesized
tgcttttattttgtaaagcg

SEQ ID NO: 536604 - DNA, 20 bp, Artificial Sequence
  chemically synthesized
ctttaaatactactcaatct

SEQ ID NO: 536605 - DNA, 20 bp, Artificial Sequence
  chemically synthesized
ccacataaatataattttat

SEQ ID NO: 536606 - DNA, 20 bp, Artificial Sequence
  chemically synthesized
tgtatcacatatttatcaca

SEQ ID NO: 536607 - DNA, 20 bp, Artificial Sequence
  chemically synthesized
aaaagggtttatagtacagt

SEQ ID NO: 536608 - DNA, 20 bp, Artificial Sequence
  chemically synthesized
atatttactgtatcccaagg

SEQ ID NO: 536609 - DNA, 20 bp, Artificial Sequence
  chemically synthesized
ttataaaaaataaaaatatt

SEQ ID NO: 536610 - DNA, 20 bp, Artificial Sequence
  chemically synthesized
cactcttctcccctccctca

SEQ ID NO: 536611 - DNA, 20 bp, Artificial Sequence
  chemically synthesized
gactaacaatttgttggaca

SEQ ID NO: 536612 - DNA, 20 bp, Artificial Sequence
  chemically synthesized
ctgttccaggaattctcatt

SEQ ID NO: 536613 - DNA, 20 bp, Artificial Sequence
  chemically synthesized
cttgagaacagtttcttgaa

SEQ ID NO: 536614 - DNA, 20 bp, Artificial Sequence
  chemically synthesized
cctacagcagcaagttggta

SEQ ID NO: 536615 - DNA, 20 bp, Artificial Sequence
  chemically synthesized
ctacctgggaggctgaggca

SEQ ID NO: 536616 - DNA, 20 bp, Artificial Sequence
  chemically synthesized
aaaccccatctctactaaaa

SEQ ID NO: 536617 - DNA, 20 bp, Artificial Sequence
  chemically synthesized
taccataactcctgatacaa

SEQ ID NO: 536618 - DNA, 20 bp, Artificial Sequence
  chemically synthesized
gggaacacatttcctaaggc

SEQ ID NO: 536619 - DNA, 20 bp, Artificial Sequence
  chemically synthesized
tgaagtagaataataagggg

SEQ ID NO: 536620 - DNA, 20 bp, Artificial Sequence
  chemically synthesized
aaaaccattgctgagttgaa

SEQ ID NO: 536621 - DNA, 20 bp, Artificial Sequence
  chemically synthesized
gcaatggtttttggagttga

SEQ ID NO: 536622 - DNA, 20 bp, Artificial Sequence
  chemically synthesized
cgcttcaaggtgttatcaag

SEQ ID NO: 536623 - DNA, 20 bp, Artificial Sequence
  chemically synthesized
ccagaggcaacctaaactca

SEQ ID NO: 536624 - DNA, 20 bp, Artificial Sequence
  chemically synthesized
aaggaacaaggaagagacct

SEQ ID NO: 536625 - DNA, 20 bp, Artificial Sequence
  chemically synthesized
ttaatgtcattaaattcact

SEQ ID NO: 536626 - DNA, 20 bp, Artificial Sequence
  chemically synthesized
caagaatatactcagattac

SEQ ID NO: 536627 - DNA, 20 bp, Artificial Sequence
  chemically synthesized
gaagcctgggactctagact

SEQ ID NO: 536628 - DNA, 20 bp, Artificial Sequence
  chemically synthesized
tgaaccaaatgagatttcaa

SEQ ID NO: 536629 - DNA, 20 bp, Artificial Sequence
  chemically synthesized
acttcagattttcagtattt

SEQ ID NO: 536630 - DNA, 20 bp, Artificial Sequence
  chemically synthesized
tctctacaaacgtgatctgt

SEQ ID NO: 536631 - DNA, 20 bp, Artificial Sequence
  chemically synthesized
gaggaggagaaacagaatag

SEQ ID NO: 536632 - DNA, 20 bp, Artificial Sequence
  chemically synthesized
tagtcttcagaggaggagaa

SEQ ID NO: 536633 - DNA, 20 bp, Artificial Sequence
  chemically synthesized
cagcagtagtcttcagagga

SEQ ID NO: 536634 - DNA, 20 bp, Artificial Sequence
  chemically synthesized
gttgagagactggagtagga

SEQ ID NO: 536635 - DNA, 20 bp, Artificial Sequence
  chemically synthesized
ataaattacatatcagggca

SEQ ID NO: 536636 - DNA, 20 bp, Artificial Sequence
  chemically synthesized
attagtaagtcttattttat

SEQ ID NO: 536637 - DNA, 20 bp, Artificial Sequence
  chemically synthesized
aatatatgtaaataaaactt

SEQ ID NO: 536638 - DNA, 20 bp, Artificial Sequence
  chemically synthesized
tgtgtttttgttaaggaaaa

SEQ ID NO: 536639 - DNA, 20 bp, Artificial Sequence
  chemically synthesized
attttatcattttttaacaa

SEQ ID NO: 536640 - DNA, 20 bp, Artificial Sequence
  chemically synthesized
aaaagagcagaccaataatc

SEQ ID NO: 536641 - DNA, 20 bp, Artificial Sequence
  chemically synthesized
ctcttattaagagaagacca

SEQ ID NO: 536642 - DNA, 20 bp, Artificial Sequence
  chemically synthesized
gaaacaaatattgtttctta

SEQ ID NO: 536643 - DNA, 20 bp, Artificial Sequence
  chemically synthesized
aacacaggtacttattctga

SEQ ID NO: 536644 - DNA, 20 bp, Artificial Sequence
  chemically synthesized
ttgtatgtccttgaattttt

SEQ ID NO: 536645 - DNA, 20 bp, Artificial Sequence
  chemically synthesized
aagtttttagttctttccaa

SEQ ID NO: 536646 - DNA, 20 bp, Artificial Sequence
  chemically synthesized
taggatcattgctcactatg

SEQ ID NO: 536647 - DNA, 20 bp, Artificial Sequence
  chemically synthesized
agattaaaaaaaattttatt

SEQ ID NO: 536648 - DNA, 20 bp, Artificial Sequence
  chemically synthesized
taaagatctgattcattcga

SEQ ID NO: 536649 - DNA, 20 bp, Artificial Sequence
  chemically synthesized
ctcttacaatcagttagagg

SEQ ID NO: 536650 - DNA, 20 bp, Artificial Sequence
  chemically synthesized
taactcaagatcaagcaaga

SEQ ID NO: 536651 - DNA, 20 bp, Artificial Sequence
  chemically synthesized
aatgttctgtttgctaaata

SEQ ID NO: 536652 - DNA, 20 bp, Artificial Sequence
  chemically synthesized
catgagttatagataactta

SEQ ID NO: 536653 - DNA, 20 bp, Artificial Sequence
  chemically synthesized
cttaagttatctataactca

SEQ ID NO: 536654 - DNA, 20 bp, Artificial Sequence
  chemically synthesized
tttagagtatgcttttgtaa

SEQ ID NO: 536655 - DNA, 20 bp, Artificial Sequence
  chemically synthesized
ctgcctgatccctgtaaaat

SEQ ID NO: 536656 - DNA, 20 bp, Artificial Sequence
  chemically synthesized
atgaaaataagaatactcgg

SEQ ID NO: 536657 - DNA, 20 bp, Artificial Sequence
  chemically synthesized
taattatattgccatgaaaa

SEQ ID NO: 536658 - DNA, 20 bp, Artificial Sequence
  chemically synthesized
tttgactggaatgtcatatt

SEQ ID NO: 536659 - DNA, 20 bp, Artificial Sequence
  chemically synthesized
actgtcccggtacctggctt

SEQ ID NO: 536660 - DNA, 20 bp, Artificial Sequence
  chemically synthesized
ccttggtttcctgggtctcc

SEQ ID NO: 536661 - DNA, 20 bp, Artificial Sequence
  chemically synthesized
tattgaggtatgattgacaa

SEQ ID NO: 536662 - DNA, 20 bp, Artificial Sequence
  chemically synthesized
aacgatactgtactgtacaa

SEQ ID NO: 536663 - DNA, 20 bp, Artificial Sequence
  chemically synthesized
gattagctggaagttttcat

SEQ ID NO: 536664 - DNA, 20 bp, Artificial Sequence
  chemically synthesized
atcaaagacaatgaacagga

SEQ ID NO: 536665 - DNA, 20 bp, Artificial Sequence
  chemically synthesized
aaaaaaatcatgtcgtttac

SEQ ID NO: 536666 - DNA, 20 bp, Artificial Sequence
  chemically synthesized
aaaatttgaaatgttaattt

SEQ ID NO: 536667 - DNA, 20 bp, Artificial Sequence
  chemically synthesized
gtcaccaagtcaggatggtg

SEQ ID NO: 536668 - DNA, 20 bp, Artificial Sequence
  chemically synthesized
acctcttccgtgccatgctc

SEQ ID NO: 536669 - DNA, 20 bp, Artificial Sequence
  chemically synthesized
gccatcctcactctaccatc

SEQ ID NO: 536670 - DNA, 20 bp, Artificial Sequence
  chemically synthesized
gttcagctagtccttcaaca

SEQ ID NO: 536671 - DNA, 20 bp, Artificial Sequence
  chemically synthesized
gaacaaaatggagggttgac

SEQ ID NO: 536672 - DNA, 20 bp, Artificial Sequence
  chemically synthesized
aaggtcaggtctaaagtcag

SEQ ID NO: 536673 - DNA, 20 bp, Artificial Sequence
  chemically synthesized
gttttctagagtaaatgctc

SEQ ID NO: 536674 - DNA, 20 bp, Artificial Sequence
  chemically synthesized
cttttcttagagcatttact

SEQ ID NO: 536675 - DNA, 20 bp, Artificial Sequence
  chemically synthesized
tatttttgtctcaaaaaagt

SEQ ID NO: 536676 - DNA, 20 bp, Artificial Sequence
  chemically synthesized
ataaaagtggcaagaggcta

SEQ ID NO: 536677 - DNA, 20 bp, Artificial Sequence
  chemically synthesized
agtgctagctcccaagtcct

SEQ ID NO: 536678 - DNA, 20 bp, Artificial Sequence
  chemically synthesized
ttgggagctagcactttgat

SEQ ID NO: 536679 - DNA, 20 bp, Artificial Sequence
  chemically synthesized
taagtgctgagatgagttag

SEQ ID NO: 536680 - DNA, 20 bp, Artificial Sequence
  chemically synthesized
ctctcctgccttttatttca

SEQ ID NO: 536681 - DNA, 20 bp, Artificial Sequence
  chemically synthesized
aaatagcactagacaacaga

SEQ ID NO: 536682 - DNA, 20 bp, Artificial Sequence
  chemically synthesized
acattgctgtgagtgttgtc

SEQ ID NO: 536683 - DNA, 20 bp, Artificial Sequence
  chemically synthesized
agggggttttttcctcccct

SEQ ID NO: 536684 - DNA, 20 bp, Artificial Sequence
  chemically synthesized
ttaaaaacataagacccttt

SEQ ID NO: 536685 - DNA, 20 bp, Artificial Sequence
  chemically synthesized
gctaagatcccgggaccagt

SEQ ID NO: 536686 - DNA, 20 bp, Artificial Sequence
  chemically synthesized
aaatatgttgatttcagatt

SEQ ID NO: 536687 - DNA, 20 bp, Artificial Sequence
  chemically synthesized
tcacagaacccttagcaagc

SEQ ID NO: 536688 - DNA, 20 bp, Artificial Sequence
  chemically synthesized
tcaaactctgagcacacctg

SEQ ID NO: 536689 - DNA, 20 bp, Artificial Sequence
  chemically synthesized
ggtgtgctcagagtttgact

SEQ ID NO: 536690 - DNA, 20 bp, Artificial Sequence
  chemically synthesized
tagctccaaatcctaaatgt

SEQ ID NO: 536691 - DNA, 20 bp, Artificial Sequence
  chemically synthesized
aaacacctttactaaaatct

SEQ ID NO: 536692 - DNA, 20 bp, Artificial Sequence
  chemically synthesized
aattaaactatttttccatt

SEQ ID NO: 536693 - DNA, 20 bp, Artificial Sequence
  chemically synthesized
ctaatatcctatatcttaaa

SEQ ID NO: 536694 - DNA, 20 bp, Artificial Sequence
  chemically synthesized
ctaattataagctgggggtt

SEQ ID NO: 536695 - DNA, 20 bp, Artificial Sequence
  chemically synthesized
tgggggtttgagaatttttg

SEQ ID NO: 536696 - DNA, 20 bp, Artificial Sequence
  chemically synthesized
cttgaacacagccacaagca

SEQ ID NO: 536697 - DNA, 20 bp, Artificial Sequence
  chemically synthesized
tgaagtctgcactccagaga

SEQ ID NO: 536698 - DNA, 20 bp, Artificial Sequence
  chemically synthesized
agggagctgcttttttcctg

SEQ ID NO: 536699 - DNA, 20 bp, Artificial Sequence
  chemically synthesized
ggaggcaaatatcatgactc

SEQ ID NO: 536700 - DNA, 20 bp, Artificial Sequence
  chemically synthesized
tggtgacttgtagctttgat

SEQ ID NO: 536701 - DNA, 20 bp, Artificial Sequence
  chemically synthesized
ctctcttcctggaacacatt

SEQ ID NO: 536702 - DNA, 20 bp, Artificial Sequence
  chemically synthesized
caaagattgcatttaaaaga

SEQ ID NO: 536703 - DNA, 20 bp, Artificial Sequence
  chemically synthesized
cataaagtctttcctcccaa

SEQ ID NO: 536704 - DNA, 20 bp, Artificial Sequence
  chemically synthesized
atattacgccagttactttt

SEQ ID NO: 536705 - DNA, 20 bp, Artificial Sequence
  chemically synthesized
tatactggatataagataat

SEQ ID NO: 536706 - DNA, 20 bp, Artificial Sequence
  chemically synthesized
tgctcaataaacaaccccaa

SEQ ID NO: 536707 - DNA, 20 bp, Artificial Sequence
  chemically synthesized
acaatatgtactagctaagt

SEQ ID NO: 536708 - DNA, 20 bp, Artificial Sequence
  chemically synthesized
gtaacaaatttagttagctt

SEQ ID NO: 536709 - DNA, 20 bp, Artificial Sequence
  chemically synthesized
ctgctcttgaggagtagcta

SEQ ID NO: 536710 - DNA, 20 bp, Artificial Sequence
  chemically synthesized
aaacttttacttcctcttca

SEQ ID NO: 536711 - DNA, 20 bp, Artificial Sequence
  chemically synthesized
agcaaagggaaaaggaagtt

SEQ ID NO: 536712 - DNA, 20 bp, Artificial Sequence
  chemically synthesized
caattaaagtcaattaaata

SEQ ID NO: 536713 - DNA, 20 bp, Artificial Sequence
  chemically synthesized
caaaacggggcagcatattg

SEQ ID NO: 536714 - DNA, 20 bp, Artificial Sequence
  chemically synthesized
tggaatagattccttgaaag

SEQ ID NO: 536715 - DNA, 20 bp, Artificial Sequence
  chemically synthesized
taaagacagtaccaagacac

SEQ ID NO: 536716 - DNA, 20 bp, Artificial Sequence
  chemically synthesized
tggagaagcagagataaata

SEQ ID NO: 536717 - DNA, 20 bp, Artificial Sequence
  chemically synthesized
gagatgaataaaaaggttta

SEQ ID NO: 536718 - DNA, 20 bp, Artificial Sequence
  chemically synthesized
cttccgtaccccaagtagag

SEQ ID NO: 536719 - DNA, 20 bp, Artificial Sequence
  chemically synthesized
ctaactctacttggggtacg

SEQ ID NO: 536720 - DNA, 20 bp, Artificial Sequence
  chemically synthesized
atgactttgaattcattctt

SEQ ID NO: 536721 - DNA, 20 bp, Artificial Sequence
  chemically synthesized
gaattcattcttaaagaatg

SEQ ID NO: 536722 - DNA, 20 bp, Artificial Sequence
  chemically synthesized
atgaattttcttccattctt

SEQ ID NO: 536723 - DNA, 20 bp, Artificial Sequence
  chemically synthesized
aaagaagtcatttaaagaag

SEQ ID NO: 536724 - DNA, 20 bp, Artificial Sequence
  chemically synthesized
actatacggggagattgctg

SEQ ID NO: 536725 - DNA, 20 bp, Artificial Sequence
  chemically synthesized
attgctggcagaatgagaag

SEQ ID NO: 536726 - DNA, 20 bp, Artificial Sequence
  chemically synthesized
taagcacaattaaaacaggg

SEQ ID NO: 536727 - DNA, 20 bp, Artificial Sequence
  chemically synthesized
tcttcattaaacttatgtta

SEQ ID NO: 536728 - DNA, 20 bp, Artificial Sequence
  chemically synthesized
tgctttttcctcagcattta

SEQ ID NO: 536729 - DNA, 20 bp, Artificial Sequence
  chemically synthesized
taataattattattatttta

SEQ ID NO: 536730 - DNA, 20 bp, Artificial Sequence
  chemically synthesized
gacaacccttggggaatggt

SEQ ID NO: 536731 - DNA, 20 bp, Artificial Sequence
  chemically synthesized
taaccctggcctatcttcag

SEQ ID NO: 536732 - DNA, 20 bp, Artificial Sequence
  chemically synthesized
atcctgtgaggttggtttag

SEQ ID NO: 536733 - DNA, 20 bp, Artificial Sequence
  chemically synthesized
tctttaataatgataccaaa

SEQ ID NO: 536734 - DNA, 20 bp, Artificial Sequence
  chemically synthesized
ttaaatatttttgtcttttt

SEQ ID NO: 536735 - DNA, 20 bp, Artificial Sequence
  chemically synthesized
gagctttacctgagaaacaa

SEQ ID NO: 536736 - DNA, 20 bp, Artificial Sequence
  chemically synthesized
caggtttccagagctttacc

SEQ ID NO: 536737 - DNA, 20 bp, Artificial Sequence
  chemically synthesized
aaacattttggcttatgcct

SEQ ID NO: 536738 - DNA, 20 bp, Artificial Sequence
  chemically synthesized
gttatttatcatgaaatatt

SEQ ID NO: 536739 - DNA, 20 bp, Artificial Sequence
  chemically synthesized
ctacaaaaattctttgcttt

SEQ ID NO: 536740 - DNA, 20 bp, Artificial Sequence
  chemically synthesized
ggtattagtttctttaaagc

SEQ ID NO: 536741 - DNA, 20 bp, Artificial Sequence
  chemically synthesized
ccaactgcaactgataaagt

SEQ ID NO: 536742 - DNA, 20 bp, Artificial Sequence
  chemically synthesized
agctagaagcaagtatagta

SEQ ID NO: 536743 - DNA, 20 bp, Artificial Sequence
  chemically synthesized
ttacaatcttccatgacata

SEQ ID NO: 536744 - DNA, 20 bp, Artificial Sequence
  chemically synthesized
ttggattagagtagactgta

SEQ ID NO: 536745 - DNA, 20 bp, Artificial Sequence
  chemically synthesized
atgttaggcaagaactagaa

SEQ ID NO: 536746 - DNA, 20 bp, Artificial Sequence
  chemically synthesized
cagaggaggcattgagagtt

SEQ ID NO: 536747 - DNA, 20 bp, Artificial Sequence
  chemically synthesized
aacaaaacaaaaaaacagag

SEQ ID NO: 536748 - DNA, 20 bp, Artificial Sequence
  chemically synthesized
caagagtaaagctattttct

SEQ ID NO: 536749 - DNA, 20 bp, Artificial Sequence
  chemically synthesized
gttttaactcttgatattct

SEQ ID NO: 536750 - DNA, 20 bp, Artificial Sequence
  chemically synthesized
caagagttaaaactggcatc

SEQ ID NO: 536751 - DNA, 20 bp, Artificial Sequence
  chemically synthesized
taaaactggcatcccagaat

SEQ ID NO: 536752 - DNA, 20 bp, Artificial Sequence
  chemically synthesized
caagagttaggagatgaaaa

SEQ ID NO: 536753 - DNA, 20 bp, Artificial Sequence
  chemically synthesized
gatgaaaaagagaaagttgt

SEQ ID NO: 536754 - DNA, 20 bp, Artificial Sequence
  chemically synthesized
agaaaaaaatcaattaatgt

SEQ ID NO: 536755 - DNA, 20 bp, Artificial Sequence
  chemically synthesized
agcattgtgtttcagatagc

SEQ ID NO: 536756 - DNA, 20 bp, Artificial Sequence
  chemically synthesized
ctttttacatctacttgtga

SEQ ID NO: 536757 - DNA, 20 bp, Artificial Sequence
  chemically synthesized
tttaggcttcatatataagc

SEQ ID NO: 536758 - DNA, 20 bp, Artificial Sequence
  chemically synthesized
tagaggtaaaacaattcctg

SEQ ID NO: 536759 - DNA, 20 bp, Artificial Sequence
  chemically synthesized
agtgagaaggagcaatgtaa

SEQ ID NO: 536760 - DNA, 20 bp, Artificial Sequence
  chemically synthesized
aggaacagagcttgtttgac

SEQ ID NO: 536761 - DNA, 20 bp, Artificial Sequence
  chemically synthesized
aaagaccttctgcaaagtaa

SEQ ID NO: 536762 - DNA, 20 bp, Artificial Sequence
  chemically synthesized
agaaaaaggccaacaaccca

SEQ ID NO: 536763 - DNA, 20 bp, Artificial Sequence
  chemically synthesized
acaaaagataaggacagttc

SEQ ID NO: 536764 - DNA, 20 bp, Artificial Sequence
  chemically synthesized
agataaggacagttcacaga

SEQ ID NO: 536765 - DNA, 20 bp, Artificial Sequence
  chemically synthesized
gcttagccttggtaataatg

SEQ ID NO: 536766 - DNA, 20 bp, Artificial Sequence
  chemically synthesized
tttattttgtagatttgttt

SEQ ID NO: 536767 - DNA, 20 bp, Artificial Sequence
  chemically synthesized
actgcacattaaccttaatt

SEQ ID NO: 536768 - DNA, 20 bp, Artificial Sequence
  chemically synthesized
gtgaggcccccccccgccat

SEQ ID NO: 536769 - DNA, 20 bp, Artificial Sequence
  chemically synthesized
gctctcttccctgctgccat

SEQ ID NO: 536770 - DNA, 20 bp, Artificial Sequence
  chemically synthesized
ttcctaccacaaaatgttgt

SEQ ID NO: 536771 - DNA, 20 bp, Artificial Sequence
  chemically synthesized
atggctttagatatgttata

SEQ ID NO: 536772 - DNA, 20 bp, Artificial Sequence
  chemically synthesized
aaccattaagtgatattgcc

SEQ ID NO: 536773 - DNA, 20 bp, Artificial Sequence
  chemically synthesized
tgtaaattaatttaaaacac

SEQ ID NO: 536774 - DNA, 20 bp, Artificial Sequence
  chemically synthesized
tataatacataaaaggatta

SEQ ID NO: 536775 - DNA, 20 bp, Artificial Sequence
  chemically synthesized
ataacatgttccctgtggtg

SEQ ID NO: 536776 - DNA, 20 bp, Artificial Sequence
  chemically synthesized
aaattaacattcagagattg

SEQ ID NO: 536777 - DNA, 20 bp, Artificial Sequence
  chemically synthesized
gataagcaaaagtgtctgtt

SEQ ID NO: 536778 - DNA, 20 bp, Artificial Sequence
  chemically synthesized
atttcataacacaaaacatt

SEQ ID NO: 536779 - DNA, 20 bp, Artificial Sequence
  chemically synthesized
gaagccttttagaagcaaaa

SEQ ID NO: 536780 - DNA, 20 bp, Artificial Sequence
  chemically synthesized
aaactggataaagaacataa

SEQ ID NO: 536781 - DNA, 20 bp, Artificial Sequence
  chemically synthesized
aaatgtaaacagccaataaa

SEQ ID NO: 536782 - DNA, 20 bp, Artificial Sequence
  chemically synthesized
aactttgacaaagacctttt

SEQ ID NO: 536783 - DNA, 20 bp, Artificial Sequence
  chemically synthesized
atgccttcttttgaactaat

SEQ ID NO: 536784 - DNA, 20 bp, Artificial Sequence
  chemically synthesized
tgtttgtgttttacttttta

SEQ ID NO: 536785 - DNA, 20 bp, Artificial Sequence
  chemically synthesized
aacagcaaaaatattaaaaa

SEQ ID NO: 536786 - DNA, 20 bp, Artificial Sequence
  chemically synthesized
caatatttgtgtatctagac

SEQ ID NO: 536787 - DNA, 20 bp, Artificial Sequence
  chemically synthesized
tcagaacatatctcatttgt

SEQ ID NO: 536788 - DNA, 20 bp, Artificial Sequence
  chemically synthesized
acaaacactactgagacagt

SEQ ID NO: 536789 - DNA, 20 bp, Artificial Sequence
  chemically synthesized
aggactaccttcttcatgaa

SEQ ID NO: 536790 - DNA, 20 bp, Artificial Sequence
  chemically synthesized
attgcagcaaccatttctta

SEQ ID NO: 536791 - DNA, 20 bp, Artificial Sequence
  chemically synthesized
attggcatgtcaatttctac

SEQ ID NO: 536792 - DNA, 20 bp, Artificial Sequence
  chemically synthesized
tatatgtaagtgcaaagggc

SEQ ID NO: 536793 - DNA, 20 bp, Artificial Sequence
  chemically synthesized
ctttgaagaacgacgaagtt

SEQ ID NO: 536794 - DNA, 20 bp, Artificial Sequence
  chemically synthesized
cattgaggtctgcaaacaat

SEQ ID NO: 536795 - DNA, 20 bp, Artificial Sequence
  chemically synthesized
gcaaaaaaataaagttttca

SEQ ID NO: 536796 - DNA, 20 bp, Artificial Sequence
  chemically synthesized
taaagttttcaaaagaaaat

SEQ ID NO: 536797 - DNA, 20 bp, Artificial Sequence
  chemically synthesized
tttatcaggaaagattgtta

SEQ ID NO: 536798 - DNA, 20 bp, Artificial Sequence
  chemically synthesized
ccaaataacttctacatcag

SEQ ID NO: 536799 - DNA, 20 bp, Artificial Sequence
  chemically synthesized
agcccaatgtccattgatta

SEQ ID NO: 536800 - DNA, 20 bp, Artificial Sequence
  chemically synthesized
aactgtggcatattcacaca

SEQ ID NO: 536801 - DNA, 20 bp, Artificial Sequence
  chemically synthesized
cacacaatagaataccatac

SEQ ID NO: 536802 - DNA, 20 bp, Artificial Sequence
  chemically synthesized
actatggcacaggcaatagc

SEQ ID NO: 536803 - DNA, 20 bp, Artificial Sequence
  chemically synthesized
tgactttgaaattactataa

SEQ ID NO: 536804 - DNA, 20 bp, Artificial Sequence
  chemically synthesized
catgctactaccaccaagtt

SEQ ID NO: 536805 - DNA, 20 bp, Artificial Sequence
  chemically synthesized
aaagtacacaaatcataaga

SEQ ID NO: 536806 - DNA, 20 bp, Artificial Sequence
  chemically synthesized
atagaaaagtacacaaatca

SEQ ID NO: 536807 - DNA, 20 bp, Artificial Sequence
  chemically synthesized
aaactgaagtataaagacac

SEQ ID NO: 536808 - DNA, 20 bp, Artificial Sequence
  chemically synthesized
atgtgtctttatacttcagt

SEQ ID NO: 536809 - DNA, 20 bp, Artificial Sequence
  chemically synthesized
ataaacacagagacctatga

SEQ ID NO: 536810 - DNA, 20 bp, Artificial Sequence
  chemically synthesized
gtgaaacgaaatctccccaa

SEQ ID NO: 536811 - DNA, 20 bp, Artificial Sequence
  chemically synthesized
gccatttgtatgtttgcttt

SEQ ID NO: 536812 - DNA, 20 bp, Artificial Sequence
  chemically synthesized
aagatatcatcttatacctg

SEQ ID NO: 536813 - DNA, 20 bp, Artificial Sequence
  chemically synthesized
tgactattatcaaaaagaca

SEQ ID NO: 536814 - DNA, 20 bp, Artificial Sequence
  chemically synthesized
agacaaaagaaaagtgttgg

SEQ ID NO: 536815 - DNA, 20 bp, Artificial Sequence
  chemically synthesized
aaaagtgttggccagaatgt

SEQ ID NO: 536816 - DNA, 20 bp, Artificial Sequence
  chemically synthesized
ccatcaataaatgaacggtt

SEQ ID NO: 536817 - DNA, 20 bp, Artificial Sequence
  chemically synthesized
gaactctattcagccttagg

SEQ ID NO: 536818 - DNA, 20 bp, Artificial Sequence
  chemically synthesized
tctattcagccttaggaaag

SEQ ID NO: 536819 - DNA, 20 bp, Artificial Sequence
  chemically synthesized
tcaagtgaaataagctaggc

SEQ ID NO: 536820 - DNA, 20 bp, Artificial Sequence
  chemically synthesized
aatctaaaaatgtcaaactc

SEQ ID NO: 536821 - DNA, 20 bp, Artificial Sequence
  chemically synthesized
aatgtcaaactcagagaaac

SEQ ID NO: 536822 - DNA, 20 bp, Artificial Sequence
  chemically synthesized
aatttttatttgtcaatttt

SEQ ID NO: 536823 - DNA, 20 bp, Artificial Sequence
  chemically synthesized
attttcatatttgtgaatga

SEQ ID NO: 536824 - DNA, 20 bp, Artificial Sequence
  chemically synthesized
tcccttttcaaagttaccac

SEQ ID NO: 536825 - DNA, 20 bp, Artificial Sequence
  chemically synthesized
ttttcaaagttaccactcag

SEQ ID NO: 536826 - DNA, 20 bp, Artificial Sequence
  chemically synthesized
ttatatgttttatatgttaa

SEQ ID NO: 536827 - DNA, 20 bp, Artificial Sequence
  chemically synthesized
tcataggatcatgggtagaa

SEQ ID NO: 536828 - DNA, 20 bp, Artificial Sequence
  chemically synthesized
tgtacttcataggatcatgg

SEQ ID NO: 536829 - DNA, 20 bp, Artificial Sequence
  chemically synthesized
aatatcctcacttgataatt

SEQ ID NO: 536830 - DNA, 20 bp, Artificial Sequence
  chemically synthesized
agggaagagggaaggaaaga

SEQ ID NO: 536831 - DNA, 20 bp, Artificial Sequence
  chemically synthesized
ctactctggaggctgaggca

SEQ ID NO: 536832 - DNA, 20 bp, Artificial Sequence
  chemically synthesized
aaaaaaaaaaaaaaaaaaaa

SEQ ID NO: 536833 - DNA, 20 bp, Artificial Sequence
  chemically synthesized
cattgagaagtcaacttcaa

SEQ ID NO: 536834 - DNA, 20 bp, Artificial Sequence
  chemically synthesized
tatggggactagaagaacag

SEQ ID NO: 536835 - DNA, 20 bp, Artificial Sequence
  chemically synthesized
tggcttttaaattaaaatta

SEQ ID NO: 536836 - DNA, 20 bp, Artificial Sequence
  chemically synthesized
gcttgtttgattttttatgt

SEQ ID NO: 536837 - DNA, 20 bp, Artificial Sequence
  chemically synthesized
cataaaaaatcaaacaagcc

SEQ ID NO: 536838 - DNA, 20 bp, Artificial Sequence
  chemically synthesized
aaaaacattctcacaaatca

SEQ ID NO: 536839 - DNA, 20 bp, Artificial Sequence
  chemically synthesized
tctttttttctactgatttg

SEQ ID NO: 536840 - DNA, 20 bp, Artificial Sequence
  chemically synthesized
caatacaatagtctcataca

SEQ ID NO: 536841 - DNA, 20 bp, Artificial Sequence
  chemically synthesized
aaaagaagcacatattcatt

SEQ ID NO: 536842 - DNA, 20 bp, Artificial Sequence
  chemically synthesized
gaatatgtgcttcttttaaa

SEQ ID NO: 536843 - DNA, 20 bp, Artificial Sequence
  chemically synthesized
aggtacacatgtatacttct

SEQ ID NO: 536844 - DNA, 20 bp, Artificial Sequence
  chemically synthesized
tccctttagctatatgactt

SEQ ID NO: 536845 - DNA, 20 bp, Artificial Sequence
  chemically synthesized
ccacttactttcaaagttat

SEQ ID NO: 536846 - DNA, 20 bp, Artificial Sequence
  chemically synthesized
cagtcacacaattttaagca

SEQ ID NO: 536847 - DNA, 20 bp, Artificial Sequence
  chemically synthesized
ctttgttattaggaagattt

SEQ ID NO: 536848 - DNA, 20 bp, Artificial Sequence
  chemically synthesized
ttaatgctagagtttattag

SEQ ID NO: 536849 - DNA, 20 bp, Artificial Sequence
  chemically synthesized
ttggaagagaacagtaaaat

SEQ ID NO: 536850 - DNA, 20 bp, Artificial Sequence
  chemically synthesized
gcttttggggagagacaaga

SEQ ID NO: 536851 - DNA, 20 bp, Artificial Sequence
  chemically synthesized
ctcttgtctctccccaaaag

SEQ ID NO: 536852 - DNA, 20 bp, Artificial Sequence
  chemically synthesized
ttaacaaatgctatatcatg

SEQ ID NO: 536853 - DNA, 20 bp, Artificial Sequence
  chemically synthesized
atcaatcattcgctaataaa

SEQ ID NO: 536854 - DNA, 20 bp, Artificial Sequence
  chemically synthesized
ctaactaacagaaaacatat

SEQ ID NO: 536855 - DNA, 20 bp, Artificial Sequence
  chemically synthesized
ccatgacatcaagctaacta

SEQ ID NO: 536856 - DNA, 20 bp, Artificial Sequence
  chemically synthesized
acctagccctgtctccagcc

SEQ ID NO: 536857 - DNA, 20 bp, Artificial Sequence
  chemically synthesized
gtgatttttggttgggggca

SEQ ID NO: 536858 - DNA, 20 bp, Artificial Sequence
  chemically synthesized
tgacattaatttattgttgt

SEQ ID NO: 536859 - DNA, 20 bp, Artificial Sequence
  chemically synthesized
tttattaaatttccagaggg

SEQ ID NO: 536860 - DNA, 20 bp, Artificial Sequence
  chemically synthesized
gtattatatgtttgaggtct

SEQ ID NO: 536861 - DNA, 20 bp, Artificial Sequence
  chemically synthesized
ttactgactttgaaatcttg

SEQ ID NO: 536862 - DNA, 20 bp, Artificial Sequence
  chemically synthesized
aagcatctaactccatggtc

SEQ ID NO: 536863 - DNA, 20 bp, Artificial Sequence
  chemically synthesized
gtttagatcaaggtgaacag

SEQ ID NO: 536864 - DNA, 20 bp, Artificial Sequence
  chemically synthesized
cacacacacacacgcacacc

SEQ ID NO: 536865 - DNA, 20 bp, Artificial Sequence
  chemically synthesized
gctgggagggagggagagag

SEQ ID NO: 536866 - DNA, 20 bp, Artificial Sequence
  chemically synthesized
tttattcccacactctccaa

SEQ ID NO: 536867 - DNA, 20 bp, Artificial Sequence
  chemically synthesized
ttagcatcagcctggctgat

SEQ ID NO: 536868 - DNA, 20 bp, Artificial Sequence
  chemically synthesized
tgttaaaatttggtttctta

SEQ ID NO: 536869 - DNA, 20 bp, Artificial Sequence
  chemically synthesized
tttttttttttaaattctat

SEQ ID NO: 536870 - DNA, 20 bp, Artificial Sequence
  chemically synthesized
tttatataaatcactgtact

SEQ ID NO: 536871 - DNA, 20 bp, Artificial Sequence
  chemically synthesized
aatatggatttcaggggggg

SEQ ID NO: 536872 - DNA, 20 bp, Artificial Sequence
  chemically synthesized
tcaaattcagaagtttcatt

SEQ ID NO: 536873 - DNA, 20 bp, Artificial Sequence
  chemically synthesized
caaaacaaaaaaaaaaagaa

SEQ ID NO: 536874 - DNA, 20 bp, Artificial Sequence
  chemically synthesized
acaaaaaaaaaaagaagaag

SEQ ID NO: 536875 - DNA, 20 bp, Artificial Sequence
  chemically synthesized
aaaaaaaaagaagaagaaag

SEQ ID NO: 536876 - DNA, 20 bp, Artificial Sequence
  chemically synthesized
aaaaagaagaagaaagaaag

SEQ ID NO: 536877 - DNA, 20 bp, Artificial Sequence
  chemically synthesized
agaagaaagaaagaaagaaa

SEQ ID NO: 536878 - DNA, 20 bp, Artificial Sequence
  chemically synthesized
cacattgtattagacagggc

SEQ ID NO: 536879 - DNA, 20 bp, Artificial Sequence
  chemically synthesized
ttttttgaaagcgtaacatt

SEQ ID NO: 536880 - DNA, 20 bp, Artificial Sequence
  chemically synthesized
ttaatttcaatattttctgt

SEQ ID NO: 536881 - DNA, 20 bp, Artificial Sequence
  chemically synthesized
gagaaaaacaagctttctag

SEQ ID NO: 536882 - DNA, 20 bp, Artificial Sequence
  chemically synthesized
ttttttagagaatgagtttt

SEQ ID NO: 536883 - DNA, 20 bp, Artificial Sequence
  chemically synthesized
tttgttttgttttgtttttt

SEQ ID NO: 536884 - DNA, 20 bp, Artificial Sequence
  chemically synthesized
caaaacaaaacaaaacaaaa

SEQ ID NO: 536885 - DNA, 20 bp, Artificial Sequence
  chemically synthesized
atagaaaaccaccacactga

SEQ ID NO: 536886 - DNA, 20 bp, Artificial Sequence
  chemically synthesized
tatgtaggtcatgccatttg

SEQ ID NO: 536887 - DNA, 20 bp, Artificial Sequence
  chemically synthesized
caacaatatgaatattacac

SEQ ID NO: 536888 - DNA, 20 bp, Artificial Sequence
  chemically synthesized
aatgaaacatggctaacaaa

SEQ ID NO: 536889 - DNA, 20 bp, Artificial Sequence
  chemically synthesized
aagtaaaataataatatcat

SEQ ID NO: 536890 - DNA, 20 bp, Artificial Sequence
  chemically synthesized
actcctgggaatggtgatgc

SEQ ID NO: 536891 - DNA, 20 bp, Artificial Sequence
  chemically synthesized
tggccagaagagaagagagc

SEQ ID NO: 536892 - DNA, 20 bp, Artificial Sequence
  chemically synthesized
agaagagagcaaagaaaaaa

SEQ ID NO: 536893 - DNA, 20 bp, Artificial Sequence
  chemically synthesized
aatatggatataaatttgaa

SEQ ID NO: 536894 - DNA, 20 bp, Artificial Sequence
  chemically synthesized
ctgatttttttattgtttcc

SEQ ID NO: 536895 - DNA, 20 bp, Artificial Sequence
  chemically synthesized
gggttatggcaacaatcctc

SEQ ID NO: 536896 - DNA, 20 bp, Artificial Sequence
  chemically synthesized
taacaattgttttaacattt

SEQ ID NO: 536897 - DNA, 20 bp, Artificial Sequence
  chemically synthesized
catttaccatctggaccgtt

SEQ ID NO: 536898 - DNA, 20 bp, Artificial Sequence
  chemically synthesized
cagtacagggcttcaatgta

SEQ ID NO: 536899 - DNA, 20 bp, Artificial Sequence
  chemically synthesized
tgtgcgtttccaaagcagtg

SEQ ID NO: 536900 - DNA, 20 bp, Artificial Sequence
  chemically synthesized
acgatatgtcaacataaaag

SEQ ID NO: 536901 - DNA, 20 bp, Artificial Sequence
  chemically synthesized
gtagctattgagcacccagc

SEQ ID NO: 536902 - DNA, 20 bp, Artificial Sequence
  chemically synthesized
ggcatagtactgaaaaaaaa

SEQ ID NO: 536903 - DNA, 20 bp, Artificial Sequence
  chemically synthesized
atcacctaatgacacatctc

SEQ ID NO: 536904 - DNA, 20 bp, Artificial Sequence
  chemically synthesized
cacgagtacttgccactatg

SEQ ID NO: 536905 - DNA, 20 bp, Artificial Sequence
  chemically synthesized
gcatctaaacatacctaaac

SEQ ID NO: 536906 - DNA, 20 bp, Artificial Sequence
  chemically synthesized
atttttctgctattcctact

SEQ ID NO: 536907 - DNA, 20 bp, Artificial Sequence
  chemically synthesized
tttattctatagtaggaata

SEQ ID NO: 536908 - DNA, 20 bp, Artificial Sequence
  chemically synthesized
aaaaattgatgttatgttaa

SEQ ID NO: 536909 - DNA, 20 bp, Artificial Sequence
  chemically synthesized
cagcatttatttagtggggg

SEQ ID NO: 536910 - DNA, 20 bp, Artificial Sequence
  chemically synthesized
agatcaattaaacatggagg

SEQ ID NO: 536911 - DNA, 20 bp, Artificial Sequence
  chemically synthesized
taccacctctaccgctactt

SEQ ID NO: 536912 - DNA, 20 bp, Artificial Sequence
  chemically synthesized
cagtcaagctagaagggacc

SEQ ID NO: 536913 - DNA, 20 bp, Artificial Sequence
  chemically synthesized
attgctcattatcttgctgt

SEQ ID NO: 536914 - DNA, 20 bp, Artificial Sequence
  chemically synthesized
tcacagcaagataatgagca

SEQ ID NO: 536915 - DNA, 20 bp, Artificial Sequence
  chemically synthesized
aagcggtggttcccaaggcc

SEQ ID NO: 536916 - DNA, 20 bp, Artificial Sequence
  chemically synthesized
ggccttgggaaccaccgctt

SEQ ID NO: 536917 - DNA, 20 bp, Artificial Sequence
  chemically synthesized
acagcgatgtgtagacttca

SEQ ID NO: 536918 - DNA, 20 bp, Artificial Sequence
  chemically synthesized
gtaaaaagtttcatcccaat

SEQ ID NO: 536919 - DNA, 20 bp, Artificial Sequence
  chemically synthesized
ggttagttggttactggtta

SEQ ID NO: 536920 - DNA, 20 bp, Artificial Sequence
  chemically synthesized
ttctatgaacacttattctg

SEQ ID NO: 536921 - DNA, 20 bp, Artificial Sequence
  chemically synthesized
ttaaatacattttttttctt

SEQ ID NO: 536922 - DNA, 20 bp, Artificial Sequence
  chemically synthesized
gaaaaaaaatgtatttaaac

SEQ ID NO: 536923 - DNA, 20 bp, Artificial Sequence
  chemically synthesized
ctggagggcctctgtctcct

SEQ ID NO: 536924 - DNA, 20 bp, Artificial Sequence
  chemically synthesized
agggcctctgtctcctggag

SEQ ID NO: 536925 - DNA, 20 bp, Artificial Sequence
  chemically synthesized
gatagtttacccattaatta

SEQ ID NO: 536926 - DNA, 20 bp, Artificial Sequence
  chemically synthesized
agtaccttttaatgggctgc

SEQ ID NO: 536927 - DNA, 20 bp, Artificial Sequence
  chemically synthesized
gcttgacagtgtgtgaggaa

SEQ ID NO: 536928 - DNA, 20 bp, Artificial Sequence
  chemically synthesized
tatttgggacatagttatgc

SEQ ID NO: 536929 - DNA, 20 bp, Artificial Sequence
  chemically synthesized
caaataaaaatatgaaacat

SEQ ID NO: 536930 - DNA, 20 bp, Artificial Sequence
  chemically synthesized
tccagtcataactaggatcc

SEQ ID NO: 536931 - DNA, 20 bp, Artificial Sequence
  chemically synthesized
ctagttatgactggaatgtg

SEQ ID NO: 536932 - DNA, 20 bp, Artificial Sequence
  chemically synthesized
tttcaaaagtgtttatccct

SEQ ID NO: 536933 - DNA, 20 bp, Artificial Sequence
  chemically synthesized
gcagattagatatttggaaa

SEQ ID NO: 536934 - DNA, 20 bp, Artificial Sequence
  chemically synthesized
gaaaaattatgccgcgcttt

SEQ ID NO: 536935 - DNA, 20 bp, Artificial Sequence
  chemically synthesized
gaaacaggaaaggggaaatc

SEQ ID NO: 536936 - DNA, 20 bp, Artificial Sequence
  chemically synthesized
catcctcaaatgtaagagtg

SEQ ID NO: 536937 - DNA, 20 bp, Artificial Sequence
  chemically synthesized
ctcaagaacagaatgtaaga

SEQ ID NO: 536938 - DNA, 20 bp, Artificial Sequence
  chemically synthesized
tagtttaaatacactcaaga

SEQ ID NO: 536939 - DNA, 20 bp, Artificial Sequence
  chemically synthesized
ccatttatccttactttttg

SEQ ID NO: 536940 - DNA, 20 bp, Artificial Sequence
  chemically synthesized
atcagggtttagtatgacta

SEQ ID NO: 536941 - DNA, 20 bp, Artificial Sequence
  chemically synthesized
aattttacagttcatatgtg

SEQ ID NO: 536942 - DNA, 20 bp, Artificial Sequence
  chemically synthesized
tgacttctatcattgatagt

SEQ ID NO: 536943 - DNA, 20 bp, Artificial Sequence
  chemically synthesized
cacctcttcatgtgagagca

SEQ ID NO: 536944 - DNA, 20 bp, Artificial Sequence
  chemically synthesized
ggtgctgaaagaggatgcat

SEQ ID NO: 536945 - DNA, 20 bp, Artificial Sequence
  chemically synthesized
aagaggatgcatccagaaag

SEQ ID NO: 536946 - DNA, 20 bp, Artificial Sequence
  chemically synthesized
aatgaaccatctctgcaata

SEQ ID NO: 536947 - DNA, 20 bp, Artificial Sequence
  chemically synthesized
ttgcagagatggttcattat

SEQ ID NO: 536948 - DNA, 20 bp, Artificial Sequence
  chemically synthesized
acaaaaattgaaaaaaataa

SEQ ID NO: 536949 - DNA, 20 bp, Artificial Sequence
  chemically synthesized
aggtatgaacatgattatag

SEQ ID NO: 536950 - DNA, 20 bp, Artificial Sequence
  chemically synthesized
aattaggtatgaacatgatt

SEQ ID NO: 536951 - DNA, 20 bp, Artificial Sequence
  chemically synthesized
cctgttatattctttgactt

SEQ ID NO: 536952 - DNA, 20 bp, Artificial Sequence
  chemically synthesized
ttggcagttttctttaagtc

SEQ ID NO: 536953 - DNA, 20 bp, Artificial Sequence
  chemically synthesized
acttaaagaaaactgccaaa

SEQ ID NO: 536954 - DNA, 20 bp, Artificial Sequence
  chemically synthesized
attagaatgtgcttcaagtt

SEQ ID NO: 536955 - DNA, 20 bp, Artificial Sequence
  chemically synthesized
ttctatactcaataaaggta

SEQ ID NO: 536956 - DNA, 20 bp, Artificial Sequence
  chemically synthesized
ttcttttacctttattgagt

SEQ ID NO: 536957 - DNA, 20 bp, Artificial Sequence
  chemically synthesized
tctttttgtttttacatctg

SEQ ID NO: 536958 - DNA, 20 bp, Artificial Sequence
  chemically synthesized
tctaacagatgtaaaaacaa

SEQ ID NO: 536959 - DNA, 20 bp, Artificial Sequence
  chemically synthesized
aattgtaaaatgttgttcta

SEQ ID NO: 536960 - DNA, 20 bp, Artificial Sequence
  chemically synthesized
gaaaaaaaaaagaaaaaagc

SEQ ID NO: 536961 - DNA, 20 bp, Artificial Sequence
  chemically synthesized
acaataataaaagaaaaaaa

SEQ ID NO: 536962 - DNA, 20 bp, Artificial Sequence
  chemically synthesized
aaacttaaagtacaataata

SEQ ID NO: 536963 - DNA, 20 bp, Artificial Sequence
  chemically synthesized
ccaacaatgatagactggat

SEQ ID NO: 536964 - DNA, 20 bp, Artificial Sequence
  chemically synthesized
gattcctcagggatctagaa

SEQ ID NO: 536965 - DNA, 20 bp, Artificial Sequence
  chemically synthesized
acaggtgctggagaggatgt

SEQ ID NO: 536966 - DNA, 20 bp, Artificial Sequence
  chemically synthesized
gagataccatctcacaccag

SEQ ID NO: 536967 - DNA, 20 bp, Artificial Sequence
  chemically synthesized
gctcaccatcactggccatc

SEQ ID NO: 536968 - DNA, 20 bp, Artificial Sequence
  chemically synthesized
aatgaactccaacaaattta

SEQ ID NO: 536969 - DNA, 20 bp, Artificial Sequence
  chemically synthesized
atctgataaagggctaatat

SEQ ID NO: 536970 - DNA, 20 bp, Artificial Sequence
  chemically synthesized
aacaggcaacctacaaaatg

SEQ ID NO: 536971 - DNA, 20 bp, Artificial Sequence
  chemically synthesized
taaggagcttctgcacagca

SEQ ID NO: 536972 - DNA, 20 bp, Artificial Sequence
  chemically synthesized
tcctgaatggtaatgcctca

SEQ ID NO: 536973 - DNA, 20 bp, Artificial Sequence
  chemically synthesized
cattccatgctcatgggtag

SEQ ID NO: 536974 - DNA, 20 bp, Artificial Sequence
  chemically synthesized
agctaccaatgcctttcttc

SEQ ID NO: 536975 - DNA, 20 bp, Artificial Sequence
  chemically synthesized
gtagttttttccaattctgt

SEQ ID NO: 536976 - DNA, 20 bp, Artificial Sequence
  chemically synthesized
tatctgatctttgacaaacc

SEQ ID NO: 536977 - DNA, 20 bp, Artificial Sequence
  chemically synthesized
ggaaaattggctagccatac

SEQ ID NO: 536978 - DNA, 20 bp, Artificial Sequence
  chemically synthesized
caaaccatcattccttaaga

SEQ ID NO: 536979 - DNA, 20 bp, Artificial Sequence
  chemically synthesized
ttactcaaaccatcattcct

SEQ ID NO: 536980 - DNA, 20 bp, Artificial Sequence
  chemically synthesized
acaatttagaggctgataca

SEQ ID NO: 536981 - DNA, 20 bp, Artificial Sequence
  chemically synthesized
ccctcatgatgtgttttcct

SEQ ID NO: 536982 - DNA, 20 bp, Artificial Sequence
  chemically synthesized
tagcagactcagtattgact

SEQ ID NO: 536983 - DNA, 20 bp, Artificial Sequence
  chemically synthesized
tcatacatattcattgtttg

SEQ ID NO: 536984 - DNA, 20 bp, Artificial Sequence
  chemically synthesized
aattaaattattaaaatata

SEQ ID NO: 536985 - DNA, 20 bp, Artificial Sequence
  chemically synthesized
ttgtaataatctcaatttta

SEQ ID NO: 536986 - DNA, 20 bp, Artificial Sequence
  chemically synthesized
tttagccttctccaaccaat

SEQ ID NO: 536987 - DNA, 20 bp, Artificial Sequence
  chemically synthesized
agactagatcgtcagttgaa

SEQ ID NO: 536988 - DNA, 20 bp, Artificial Sequence
  chemically synthesized
atttattccaacatgaagtt

SEQ ID NO: 536989 - DNA, 20 bp, Artificial Sequence
  chemically synthesized
gtgcctattgatttttggag

SEQ ID NO: 536990 - DNA, 20 bp, Artificial Sequence
  chemically synthesized
aacaaatacgtgtgaaaatt

SEQ ID NO: 536991 - DNA, 20 bp, Artificial Sequence
  chemically synthesized
aaattgaagaaaataataac

SEQ ID NO: 536992 - DNA, 20 bp, Artificial Sequence
  chemically synthesized
ctagttaagactgttatggt

SEQ ID NO: 536993 - DNA, 20 bp, Artificial Sequence
  chemically synthesized
agtcttaactagagcacaca

SEQ ID NO: 536994 - DNA, 20 bp, Artificial Sequence
  chemically synthesized
gtatatccaagctccatacc

SEQ ID NO: 536995 - DNA, 20 bp, Artificial Sequence
  chemically synthesized
ctaatttttctatttataat

SEQ ID NO: 536996 - DNA, 20 bp, Artificial Sequence
  chemically synthesized
catctatttctatattataa

SEQ ID NO: 536997 - DNA, 20 bp, Artificial Sequence
  chemically synthesized
actgcaatgcctattagtag

SEQ ID NO: 536998 - DNA, 20 bp, Artificial Sequence
  chemically synthesized
aatctgaggtaaatgcagat

SEQ ID NO: 536999 - DNA, 20 bp, Artificial Sequence
  chemically synthesized
taactctctgttctacaaaa

SEQ ID NO: 537000 - DNA, 20 bp, Artificial Sequence
  chemically synthesized
actaggaagtatagatactg

SEQ ID NO: 537001 - DNA, 20 bp, Artificial Sequence
  chemically synthesized
ctgtggagtaaattacacat

SEQ ID NO: 537002 - DNA, 20 bp, Artificial Sequence
  chemically synthesized
ccgagactgggcaatttaca

SEQ ID NO: 537003 - DNA, 20 bp, Artificial Sequence
  chemically synthesized
ggtacagtttggagggctca

SEQ ID NO: 537004 - DNA, 20 bp, Artificial Sequence
  chemically synthesized
acaggggagggactcatttt

SEQ ID NO: 537005 - DNA, 20 bp, Artificial Sequence
  chemically synthesized
tgtctacatgggagaatata

SEQ ID NO: 537006 - DNA, 20 bp, Artificial Sequence
  chemically synthesized
ctgccttgtatgtctacatg

SEQ ID NO: 537007 - DNA, 20 bp, Artificial Sequence
  chemically synthesized
tgagtactgcaaattctact

SEQ ID NO: 537008 - DNA, 20 bp, Artificial Sequence
  chemically synthesized
agacattgttctattctgaa

SEQ ID NO: 537009 - DNA, 20 bp, Artificial Sequence
  chemically synthesized
tgcttctgctatagtttatt

SEQ ID NO: 537010 - DNA, 20 bp, Artificial Sequence
  chemically synthesized
ctgtaatttctattctttat

SEQ ID NO: 537011 - DNA, 20 bp, Artificial Sequence
  chemically synthesized
agaatgtttctaaataaaga

SEQ ID NO: 537012 - DNA, 20 bp, Artificial Sequence
  chemically synthesized
tagacagaatgtttctaaat

SEQ ID NO: 537013 - DNA, 20 bp, Artificial Sequence
  chemically synthesized
acaaaataataaaggaatag

SEQ ID NO: 537014 - DNA, 20 bp, Artificial Sequence
  chemically synthesized
ttaatttaaaaataaataca

SEQ ID NO: 537015 - DNA, 20 bp, Artificial Sequence
  chemically synthesized
ttctcaccataaaaaaatga

SEQ ID NO: 537016 - DNA, 20 bp, Artificial Sequence
  chemically synthesized
ttcttatcatttttttatgg

SEQ ID NO: 537017 - DNA, 20 bp, Artificial Sequence
  chemically synthesized
tgtaatctcttggcaatttt

SEQ ID NO: 537018 - DNA, 20 bp, Artificial Sequence
  chemically synthesized
tcagaatgaactaattcatt

SEQ ID NO: 537019 - DNA, 20 bp, Artificial Sequence
  chemically synthesized
attgacagaagtattagttt

SEQ ID NO: 537020 - DNA, 20 bp, Artificial Sequence
  chemically synthesized
ttgcatatcaaaagagattt

SEQ ID NO: 537021 - DNA, 20 bp, Artificial Sequence
  chemically synthesized
ttgtctttctttgttcagaa

SEQ ID NO: 537022 - DNA, 20 bp, Artificial Sequence
  chemically synthesized
ctggatttctctttctgaac

SEQ ID NO: 537023 - DNA, 20 bp, Artificial Sequence
  chemically synthesized
tggatcttgtctttctttgt

SEQ ID NO: 537024 - DNA, 20 bp, Artificial Sequence
  chemically synthesized
ggttcaatcagctaattttt

SEQ ID NO: 537025 - DNA, 20 bp, Artificial Sequence
  chemically synthesized
tataaagcattataagacca

SEQ ID NO: 537026 - DNA, 20 bp, Artificial Sequence
  chemically synthesized
ttataagaccaaaagaaatc

SEQ ID NO: 537027 - DNA, 20 bp, Artificial Sequence
  chemically synthesized
ttttacacacccagtatcaa

SEQ ID NO: 537028 - DNA, 20 bp, Artificial Sequence
  chemically synthesized
tgtattagccgcagagttgc

SEQ ID NO: 537029 - DNA, 20 bp, Artificial Sequence
  chemically synthesized
gggacaattgtctctgtgaa

SEQ ID NO: 537030 - DNA, 20 bp, Artificial Sequence
  chemically synthesized
gttttttacttttgtaatgt

SEQ ID NO: 537031 - DNA, 20 bp, Artificial Sequence
  chemically synthesized
acaatttggctatttaagtt

SEQ ID NO: 537032 - DNA, 20 bp, Artificial Sequence
  chemically synthesized
aagaaacaataagagactga

SEQ ID NO: 537033 - DNA, 20 bp, Artificial Sequence
  chemically synthesized
attgcgaatatttttgagag

SEQ ID NO: 537034 - DNA, 20 bp, Artificial Sequence
  chemically synthesized
catttgaaaaagatggaaga

SEQ ID NO: 537035 - DNA, 20 bp, Artificial Sequence
  chemically synthesized
aagcagccattttgttattt

SEQ ID NO: 537036 - DNA, 20 bp, Artificial Sequence
  chemically synthesized
atttgctttcagtattcaca

SEQ ID NO: 537037 - DNA, 20 bp, Artificial Sequence
  chemically synthesized
cttaaaattacattacagat

SEQ ID NO: 537038 - DNA, 20 bp, Artificial Sequence
  chemically synthesized
ttaaaaagcttttattgcaa

SEQ ID NO: 537039 - DNA, 20 bp, Artificial Sequence
  chemically synthesized
ggattttagttactaggaaa

SEQ ID NO: 537040 - DNA, 20 bp, Artificial Sequence
  chemically synthesized
gcagccttatactatctctt

SEQ ID NO: 537041 - DNA, 20 bp, Artificial Sequence
  chemically synthesized
tgttaagtgtagtaatatat

SEQ ID NO: 537042 - DNA, 20 bp, Artificial Sequence
  chemically synthesized
tatacaaaaaaattaggttt

SEQ ID NO: 537043 - DNA, 20 bp, Artificial Sequence
  chemically synthesized
ttttgacttgcttctgacaa

SEQ ID NO: 537044 - DNA, 20 bp, Artificial Sequence
  chemically synthesized
gggggaggggggaaagagac

SEQ ID NO: 537045 - DNA, 20 bp, Artificial Sequence
  chemically synthesized
ttgcctcatcaaaatcagtg

SEQ ID NO: 537046 - DNA, 20 bp, Artificial Sequence
  chemically synthesized
taaacgtggccatcagccaa

SEQ ID NO: 537047 - DNA, 20 bp, Artificial Sequence
  chemically synthesized
tttgtgagagaccccgaagc

SEQ ID NO: 537048 - DNA, 20 bp, Artificial Sequence
  chemically synthesized
acataatattataatctttt

SEQ ID NO: 537049 - DNA, 20 bp, Artificial Sequence
  chemically synthesized
cgaattttaaagtttcaatg

SEQ ID NO: 537050 - DNA, 20 bp, Artificial Sequence
  chemically synthesized
taaagtttcaatgtcagaaa

SEQ ID NO: 537051 - DNA, 20 bp, Artificial Sequence
  chemically synthesized
ttaaaatttgaaaattaatg

SEQ ID NO: 537052 - DNA, 20 bp, Artificial Sequence
  chemically synthesized
tttcacacagagacgaatgc

SEQ ID NO: 537053 - DNA, 20 bp, Artificial Sequence
  chemically synthesized
tccaatttaacatgtaaaat

SEQ ID NO: 537054 - DNA, 20 bp, Artificial Sequence
  chemically synthesized
tattaaagataaaccatgtg

SEQ ID NO: 537055 - DNA, 20 bp, Artificial Sequence
  chemically synthesized
tgagagaatggaatcaaaat

SEQ ID NO: 537056 - DNA, 20 bp, Artificial Sequence
  chemically synthesized
gagatttcaggtaaaagaga

SEQ ID NO: 537057 - DNA, 20 bp, Artificial Sequence
  chemically synthesized
attaaaaaaaaaggaagggg

SEQ ID NO: 537058 - DNA, 20 bp, Artificial Sequence
  chemically synthesized
attgttgatgaatgcacagt

SEQ ID NO: 537059 - DNA, 20 bp, Artificial Sequence
  chemically synthesized
caaaagaagctaatttagtt

SEQ ID NO: 537060 - DNA, 20 bp, Artificial Sequence
  chemically synthesized
tcacatggcagcaggaagga

SEQ ID NO: 537061 - DNA, 20 bp, Artificial Sequence
  chemically synthesized
ttcacaattcaatgggacaa

SEQ ID NO: 537062 - DNA, 20 bp, Artificial Sequence
  chemically synthesized
actttcaaaatcttccagat

SEQ ID NO: 537063 - DNA, 20 bp, Artificial Sequence
  chemically synthesized
ctggaagattttgaaagtga

SEQ ID NO: 537064 - DNA, 20 bp, Artificial Sequence
  chemically synthesized
tcaatgttatgatgtcaata

SEQ ID NO: 537065 - DNA, 20 bp, Artificial Sequence
  chemically synthesized
acataagtcatctagtctcc

SEQ ID NO: 537066 - DNA, 20 bp, Artificial Sequence
  chemically synthesized
tgcagccatgttttgagaca

SEQ ID NO: 537067 - DNA, 20 bp, Artificial Sequence
  chemically synthesized
gacaccagaatgtaagacac

SEQ ID NO: 537068 - DNA, 20 bp, Artificial Sequence
  chemically synthesized
agaatgtaagacacacagaa

SEQ ID NO: 537069 - DNA, 20 bp, Artificial Sequence
  chemically synthesized
aacagaaaatactgtggaag

SEQ ID NO: 537070 - DNA, 20 bp, Artificial Sequence
  chemically synthesized
gatcatggatatcaattgaa

SEQ ID NO: 537071 - DNA, 20 bp, Artificial Sequence
  chemically synthesized
tgggtctcccagtagcaaac

SEQ ID NO: 537072 - DNA, 20 bp, Artificial Sequence
  chemically synthesized
aatggaacagaacggaagcc

SEQ ID NO: 537073 - DNA, 20 bp, Artificial Sequence
  chemically synthesized
ttgacaaacctgacaaaaaa

SEQ ID NO: 537074 - DNA, 20 bp, Artificial Sequence
  chemically synthesized
ggaaaactggctagccatat

SEQ ID NO: 537075 - DNA, 20 bp, Artificial Sequence
  chemically synthesized
cctaaaaccataaaacccta

SEQ ID NO: 537076 - DNA, 20 bp, Artificial Sequence
  chemically synthesized
gaaagagcttctgcacagca

SEQ ID NO: 537077 - DNA, 20 bp, Artificial Sequence
  chemically synthesized
aacaagcaacctacataatg

SEQ ID NO: 537078 - DNA, 20 bp, Artificial Sequence
  chemically synthesized
atctgacaaagggctaatat

SEQ ID NO: 537079 - DNA, 20 bp, Artificial Sequence
  chemically synthesized
aaagaacttaaacaaattta

SEQ ID NO: 537080 - DNA, 20 bp, Artificial Sequence
  chemically synthesized
gctcatcatcactggtcatc

SEQ ID NO: 537081 - DNA, 20 bp, Artificial Sequence
  chemically synthesized
gagataccatctcactccag

SEQ ID NO: 537082 - DNA, 20 bp, Artificial Sequence
  chemically synthesized
acagatgctggagaggatgt

SEQ ID NO: 537083 - DNA, 20 bp, Artificial Sequence
  chemically synthesized
gattcctcaaggatctagaa

SEQ ID NO: 537084 - DNA, 20 bp, Artificial Sequence
  chemically synthesized
ccatcagtgatagactggat

SEQ ID NO: 537085 - DNA, 20 bp, Artificial Sequence
  chemically synthesized
ctgtccttgtgatagtttgc

SEQ ID NO: 537086 - DNA, 20 bp, Artificial Sequence
  chemically synthesized
ctgagcaaactatcacaagg

SEQ ID NO: 537087 - DNA, 20 bp, Artificial Sequence
  chemically synthesized
gctggggagggatagcatta

SEQ ID NO: 537088 - DNA, 20 bp, Artificial Sequence
  chemically synthesized
gctacatttctgctctctcc

SEQ ID NO: 537089 - DNA, 20 bp, Artificial Sequence
  chemically synthesized
ctgctcattcttgggagaga

SEQ ID NO: 537090 - DNA, 20 bp, Artificial Sequence
  chemically synthesized
actgataaacagacaggtag

SEQ ID NO: 537091 - DNA, 20 bp, Artificial Sequence
  chemically synthesized
ggtgaagctgctaggtcaac

SEQ ID NO: 537092 - DNA, 20 bp, Artificial Sequence
  chemically synthesized
aacacagaaaaatagaaccc

SEQ ID NO: 537093 - DNA, 20 bp, Artificial Sequence
  chemically synthesized
tgaaaaaaaaaaaaaaaaaa

SEQ ID NO: 537094 - DNA, 20 bp, Artificial Sequence
  chemically synthesized
ttctcttaatgctgtaagtg

SEQ ID NO: 537095 - DNA, 20 bp, Artificial Sequence
  chemically synthesized
tatgatattcaagtaaaatg

SEQ ID NO: 537096 - DNA, 20 bp, Artificial Sequence
  chemically synthesized
ttttaggtgttagaaaaacg

SEQ ID NO: 537097 - DNA, 20 bp, Artificial Sequence
  chemically synthesized
atgaaatatggttttaggtg

SEQ ID NO: 537098 - DNA, 20 bp, Artificial Sequence
  chemically synthesized
ctctggagttcaaaaaatag

SEQ ID NO: 537099 - DNA, 20 bp, Artificial Sequence
  chemically synthesized
ctctctctggagttcaaaaa

SEQ ID NO: 537100 - DNA, 20 bp, Artificial Sequence
  chemically synthesized
tctcaaaggcacacaaaaag

SEQ ID NO: 537101 - DNA, 20 bp, Artificial Sequence
  chemically synthesized
caaatccacatccacatatt

SEQ ID NO: 537102 - DNA, 20 bp, Artificial Sequence
  chemically synthesized
ttccttgcttgcctggcaag

SEQ ID NO: 537103 - DNA, 20 bp, Artificial Sequence
  chemically synthesized
agtgctttgcactgttagaa

SEQ ID NO: 537104 - DNA, 20 bp, Artificial Sequence
  chemically synthesized
cttctaacagtgcaaagcac

SEQ ID NO: 537105 - DNA, 20 bp, Artificial Sequence
  chemically synthesized
gcctgcactagacggtccaa

SEQ ID NO: 537106 - DNA, 20 bp, Artificial Sequence
  chemically synthesized
caggcttggtgtagatataa

SEQ ID NO: 537107 - DNA, 20 bp, Artificial Sequence
  chemically synthesized
aaatgcctgacacatctgag

SEQ ID NO: 537108 - DNA, 20 bp, Artificial Sequence
  chemically synthesized
acaaggcaggctctatggga

SEQ ID NO: 537109 - DNA, 20 bp, Artificial Sequence
  chemically synthesized
tgattccctgcctggtccac

SEQ ID NO: 537110 - DNA, 20 bp, Artificial Sequence
  chemically synthesized
ggcagggaatcagaggcgag

SEQ ID NO: 537111 - DNA, 20 bp, Artificial Sequence
  chemically synthesized
ctgagtgaaaatgaccagtg

SEQ ID NO: 537112 - DNA, 20 bp, Artificial Sequence
  chemically synthesized
aacccctgtgtcattcagct

SEQ ID NO: 537113 - DNA, 20 bp, Artificial Sequence
  chemically synthesized
gttggaaacccagggctaaa

SEQ ID NO: 537114 - DNA, 20 bp, Artificial Sequence
  chemically synthesized
aaagggaaagcaagacagga

SEQ ID NO: 537115 - DNA, 20 bp, Artificial Sequence
  chemically synthesized
aaagcaagacaggaagagaa

SEQ ID NO: 537116 - DNA, 20 bp, Artificial Sequence
  chemically synthesized
tcatgtcagaggtaacattt

SEQ ID NO: 537117 - DNA, 20 bp, Artificial Sequence
  chemically synthesized
ataacataatcacatttatt

SEQ ID NO: 537118 - DNA, 20 bp, Artificial Sequence
  chemically synthesized
attagcaaaaaaaaaaaaag

SEQ ID NO: 537119 - DNA, 20 bp, Artificial Sequence
  chemically synthesized
caatccattttgaactcgaa

SEQ ID NO: 537120 - DNA, 20 bp, Artificial Sequence
  chemically synthesized
aatggtttgttgttgttggc

SEQ ID NO: 537121 - DNA, 20 bp, Artificial Sequence
  chemically synthesized
gttgcacgttacaatccgat

SEQ ID NO: 537122 - DNA, 20 bp, Artificial Sequence
  chemically synthesized
tgtagtggtttcgccgggat

SEQ ID NO: 537123 - DNA, 20 bp, Artificial Sequence
  chemically synthesized
cctgcagccagcagtggtca

SEQ ID NO: 537124 - DNA, 20 bp, Artificial Sequence
  chemically synthesized
cggtcgggcgttgtcacaga

SEQ ID NO: 537125 - DNA, 20 bp, Artificial Sequence
  chemically synthesized
gcttccacaactagcaggat

SEQ ID NO: 537126 - DNA, 20 bp, Artificial Sequence
  chemically synthesized
agtcaacacatttttgccaa

SEQ ID NO: 537127 - DNA, 20 bp, Artificial Sequence
  chemically synthesized
agatatattaggttggtgca

SEQ ID NO: 537128 - DNA, 20 bp, Artificial Sequence
  chemically synthesized
tttttgttcctgtttccagg

SEQ ID NO: 537129 - DNA, 20 bp, Artificial Sequence
  chemically synthesized
agccaggcatatggccaagt

SEQ ID NO: 537130 - DNA, 20 bp, Artificial Sequence
  chemically synthesized
atgaatatcatagtcaactc

SEQ ID NO: 537131 - DNA, 20 bp, Artificial Sequence
  chemically synthesized
atagtcaactctcagaatta

SEQ ID NO: 537132 - DNA, 20 bp, Artificial Sequence
  chemically synthesized
cgtagtctggtatagccaat

SEQ ID NO: 537133 - DNA, 20 bp, Artificial Sequence
  chemically synthesized
tgagagcaaagataatgtca

SEQ ID NO: 537134 - DNA, 20 bp, Artificial Sequence
  chemically synthesized
ttatctttgctctcaggaac

SEQ ID NO: 537135 - DNA, 20 bp, Artificial Sequence
  chemically synthesized
attttaattagcaccaaatt

SEQ ID NO: 537136 - DNA, 20 bp, Artificial Sequence
  chemically synthesized
taatatgactgagttgtggt

SEQ ID NO: 537137 - DNA, 20 bp, Artificial Sequence
  chemically synthesized
cactgagacatttatttggg

SEQ ID NO: 537138 - DNA, 20 bp, Artificial Sequence
  chemically synthesized
aagctttttgaagtcaagga

SEQ ID NO: 537139 - DNA, 20 bp, Artificial Sequence
  chemically synthesized
cttagcttacatttgaaaac

SEQ ID NO: 537140 - DNA, 20 bp, Artificial Sequence
  chemically synthesized
tgtctttgtgcctgggctgg

SEQ ID NO: 537141 - DNA, 20 bp, Artificial Sequence
  chemically synthesized
gcctgggctggagagaatgt

SEQ ID NO: 537142 - DNA, 20 bp, Artificial Sequence
  chemically synthesized
ccactgctgggtatataccc

SEQ ID NO: 537143 - DNA, 20 bp, Artificial Sequence
  chemically synthesized
ccatcaacaaatgaatggat

SEQ ID NO: 537144 - DNA, 20 bp, Artificial Sequence
  chemically synthesized
aaatggagtactattctgcc

SEQ ID NO: 537145 - DNA, 20 bp, Artificial Sequence
  chemically synthesized
ggatctcaatcttttctatg

SEQ ID NO: 537146 - DNA, 20 bp, Artificial Sequence
  chemically synthesized
ttaagcaaaataagccaagc

SEQ ID NO: 537147 - DNA, 20 bp, Artificial Sequence
  chemically synthesized
tctcatgttctcacttattt

SEQ ID NO: 537148 - DNA, 20 bp, Artificial Sequence
  chemically synthesized
ggaactcatggacatagaga

SEQ ID NO: 537149 - DNA, 20 bp, Artificial Sequence
  chemically synthesized
tttaaaaaaattttaaaaag

SEQ ID NO: 537150 - DNA, 20 bp, Artificial Sequence
  chemically synthesized
actgtgtgttctcttgatga

SEQ ID NO: 537151 - DNA, 20 bp, Artificial Sequence
  chemically synthesized
tttgaaatgcagtattatat

SEQ ID NO: 537152 - DNA, 20 bp, Artificial Sequence
  chemically synthesized
tagtagctcagtctacaccc

SEQ ID NO: 537153 - DNA, 20 bp, Artificial Sequence
  chemically synthesized
ttatgcaaaatcctaggagt

SEQ ID NO: 537154 - DNA, 20 bp, Artificial Sequence
  chemically synthesized
ccctctagactattggcttt

SEQ ID NO: 537155 - DNA, 20 bp, Artificial Sequence
  chemically synthesized
gatactgtgtcaatattacg

SEQ ID NO: 537156 - DNA, 20 bp, Artificial Sequence
  chemically synthesized
tgagaatcaggattagttga

SEQ ID NO: 537157 - DNA, 20 bp, Artificial Sequence
  chemically synthesized
ataccttacttgtgaggggg

SEQ ID NO: 537158 - DNA, 20 bp, Artificial Sequence
  chemically synthesized
gctttggttaaaaaaatgtg

SEQ ID NO: 537159 - DNA, 20 bp, Artificial Sequence
  chemically synthesized
aagtcttgtttccttctcta

SEQ ID NO: 537160 - DNA, 20 bp, Artificial Sequence
  chemically synthesized
ttagaatcctgtttcttgca

SEQ ID NO: 537161 - DNA, 20 bp, Artificial Sequence
  chemically synthesized
ctcctgggcttattctcatg

SEQ ID NO: 537162 - DNA, 20 bp, Artificial Sequence
  chemically synthesized
aactgatatataggggaaag

SEQ ID NO: 537163 - DNA, 20 bp, Artificial Sequence
  chemically synthesized
gtctcttcagacatctttgc

SEQ ID NO: 537164 - DNA, 20 bp, Artificial Sequence
  chemically synthesized
cccaaagcagtgaaagaggg

SEQ ID NO: 537165 - DNA, 20 bp, Artificial Sequence
  chemically synthesized
tctatacagaagatagttga

SEQ ID NO: 537166 - DNA, 20 bp, Artificial Sequence
  chemically synthesized
tgcaatatacaatatattgc

SEQ ID NO: 537167 - DNA, 20 bp, Artificial Sequence
  chemically synthesized
gaagatacatatcaactttg

SEQ ID NO: 537168 - DNA, 20 bp, Artificial Sequence
  chemically synthesized
tttgcctaagtcacagtttc

SEQ ID NO: 537169 - DNA, 20 bp, Artificial Sequence
  chemically synthesized
accataggctaattgataaa

SEQ ID NO: 537170 - DNA, 20 bp, Artificial Sequence
  chemically synthesized
aagcacttctaatattaaac

SEQ ID NO: 537171 - DNA, 20 bp, Artificial Sequence
  chemically synthesized
atgtgagatatacatccact

SEQ ID NO: 537172 - DNA, 20 bp, Artificial Sequence
  chemically synthesized
gtctacgactgtgccctgcg

SEQ ID NO: 537173 - DNA, 20 bp, Artificial Sequence
  chemically synthesized
gtgaggaaaccagagtacta

SEQ ID NO: 537174 - DNA, 20 bp, Artificial Sequence
  chemically synthesized
gaagaaaacccacagagaca

SEQ ID NO: 537175 - DNA, 20 bp, Artificial Sequence
  chemically synthesized
tttaccccttaccactgcta

SEQ ID NO: 537176 - DNA, 20 bp, Artificial Sequence
  chemically synthesized
ccaggactgagatgaggcat

SEQ ID NO: 537177 - DNA, 20 bp, Artificial Sequence
  chemically synthesized
ggcactcattacacaaacca

SEQ ID NO: 537178 - DNA, 20 bp, Artificial Sequence
  chemically synthesized
aagctggaaaggggtatctt

SEQ ID NO: 537179 - DNA, 20 bp, Artificial Sequence
  chemically synthesized
aaactaatccttcacccgaa

SEQ ID NO: 537180 - DNA, 20 bp, Artificial Sequence
  chemically synthesized
ttcaagtctttatgctgaaa

SEQ ID NO: 537181 - DNA, 20 bp, Artificial Sequence
  chemically synthesized
ctacttgggaggctgaggca

SEQ ID NO: 537182 - DNA, 20 bp, Artificial Sequence
  chemically synthesized
attttaattactaaaataat

SEQ ID NO: 537183 - DNA, 20 bp, Artificial Sequence
  chemically synthesized
cacacaaaacaggaaaatta

SEQ ID NO: 537184 - DNA, 20 bp, Artificial Sequence
  chemically synthesized
actgagctgctggttaagga

SEQ ID NO: 537185 - DNA, 20 bp, Artificial Sequence
  chemically synthesized
tgtgtattttatcagtgatg

SEQ ID NO: 537186 - DNA, 20 bp, Artificial Sequence
  chemically synthesized
catttacattgcaattgagt

SEQ ID NO: 537187 - DNA, 20 bp, Artificial Sequence
  chemically synthesized
gacttattgaaacttttata

SEQ ID NO: 537188 - DNA, 20 bp, Artificial Sequence
  chemically synthesized
tgatgtcacccacatcacag

SEQ ID NO: 537189 - DNA, 20 bp, Artificial Sequence
  chemically synthesized
tcatcagtcacaggttgcct

SEQ ID NO: 537190 - DNA, 20 bp, Artificial Sequence
  chemically synthesized
aagtcatcaaaagggtattt

SEQ ID NO: 537191 - DNA, 20 bp, Artificial Sequence
  chemically synthesized
gcatttcattgtttgttgct

SEQ ID NO: 537192 - DNA, 20 bp, Artificial Sequence
  chemically synthesized
atcagcaagccaatcaaaag

SEQ ID NO: 537193 - DNA, 20 bp, Artificial Sequence
  chemically synthesized
agggctgataagggcctgat

SEQ ID NO: 537194 - DNA, 20 bp, Artificial Sequence
  chemically synthesized
tccttctcagctgacacgag

SEQ ID NO: 537195 - DNA, 20 bp, Artificial Sequence
  chemically synthesized
accatggaaccccaggtttg

SEQ ID NO: 537196 - DNA, 20 bp, Artificial Sequence
  chemically synthesized
ggtttcttaccttttattgt

SEQ ID NO: 537197 - DNA, 20 bp, Artificial Sequence
  chemically synthesized
attttctacacaataaaagg

SEQ ID NO: 537198 - DNA, 20 bp, Artificial Sequence
  chemically synthesized
gacccctagtgcttcaaacc

SEQ ID NO: 537199 - DNA, 20 bp, Artificial Sequence
  chemically synthesized
tgtatgagtataaagatttg

SEQ ID NO: 537200 - DNA, 20 bp, Artificial Sequence
  chemically synthesized
agggtgatttttattaaaga

SEQ ID NO: 537201 - DNA, 20 bp, Artificial Sequence
  chemically synthesized
atataataaatgaaactggg

SEQ ID NO: 537202 - DNA, 20 bp, Artificial Sequence
  chemically synthesized
atttcacgattattaaatta

SEQ ID NO: 537203 - DNA, 20 bp, Artificial Sequence
  chemically synthesized
gctatgtaagtaaaagcatt

SEQ ID NO: 537204 - DNA, 20 bp, Artificial Sequence
  chemically synthesized
agcattgcagaaacaaaagg

SEQ ID NO: 537205 - DNA, 20 bp, Artificial Sequence
  chemically synthesized
gcaatgacttctagaaagga

SEQ ID NO: 537206 - DNA, 20 bp, Artificial Sequence
  chemically synthesized
tttgcctgaagcaatgactt

SEQ ID NO: 537207 - DNA, 20 bp, Artificial Sequence
  chemically synthesized
gatgatgaaaagagaaagga

SEQ ID NO: 537208 - DNA, 20 bp, Artificial Sequence
  chemically synthesized
gagtataaatgatgatgaaa

SEQ ID NO: 537209 - DNA, 20 bp, Artificial Sequence
  chemically synthesized
gaacggggaggagagattgc

SEQ ID NO: 537210 - DNA, 20 bp, Artificial Sequence
  chemically synthesized
gtatttggtgaggtttccta

SEQ ID NO: 537211 - DNA, 20 bp, Artificial Sequence
  chemically synthesized
attgtaacccagaaatccaa

SEQ ID NO: 537212 - DNA, 20 bp, Artificial Sequence
  chemically synthesized
tctattggcctgattgtaac

SEQ ID NO: 537213 - DNA, 20 bp, Artificial Sequence
  chemically synthesized
tagattgataaaaacgatgt

SEQ ID NO: 537214 - DNA, 20 bp, Artificial Sequence
  chemically synthesized
ttatgttcatactttaaaag

SEQ ID NO: 537215 - DNA, 20 bp, Artificial Sequence
  chemically synthesized
gggcttcttaggcaatagga

SEQ ID NO: 537216 - DNA, 20 bp, Artificial Sequence
  chemically synthesized
agctgaaatgctagttggtc

SEQ ID NO: 537217 - DNA, 20 bp, Artificial Sequence
  chemically synthesized
gttgtaaatatggctcttgg

SEQ ID NO: 537218 - DNA, 20 bp, Artificial Sequence
  chemically synthesized
attaagaaggtgagactttt

SEQ ID NO: 537219 - DNA, 20 bp, Artificial Sequence
  chemically synthesized
acttttggagaatttggagg

SEQ ID NO: 537220 - DNA, 20 bp, Artificial Sequence
  chemically synthesized
acagtaggagtaatactaaa

SEQ ID NO: 537221 - DNA, 20 bp, Artificial Sequence
  chemically synthesized
taataccatataggcaatgc

SEQ ID NO: 537222 - DNA, 20 bp, Artificial Sequence
  chemically synthesized
gttatgagccaggaacctgg

SEQ ID NO: 537223 - DNA, 20 bp, Artificial Sequence
  chemically synthesized
gattgttacgatttgagagt

SEQ ID NO: 537224 - DNA, 20 bp, Artificial Sequence
  chemically synthesized
agagtagagaaaaaacacgg

SEQ ID NO: 537225 - DNA, 20 bp, Artificial Sequence
  chemically synthesized
tagagaaaaaacacggttag

SEQ ID NO: 537226 - DNA, 20 bp, Artificial Sequence
  chemically synthesized
tctttaatgacaatagtata

SEQ ID NO: 537227 - DNA, 20 bp, Artificial Sequence
  chemically synthesized
gctgagaatttcggcctatc

SEQ ID NO: 537228 - DNA, 20 bp, Artificial Sequence
  chemically synthesized
tcctaatactttagttcagc

SEQ ID NO: 537229 - DNA, 20 bp, Artificial Sequence
  chemically synthesized
gtgattatgatatgcttaga

SEQ ID NO: 537230 - DNA, 20 bp, Artificial Sequence
  chemically synthesized
gctgtaattattaactacat

SEQ ID NO: 537231 - DNA, 20 bp, Artificial Sequence
  chemically synthesized
ggatttccaggaacttacat

SEQ ID NO: 537232 - DNA, 20 bp, Artificial Sequence
  chemically synthesized
ggcatatagtctgatagttc

SEQ ID NO: 537233 - DNA, 20 bp, Artificial Sequence
  chemically synthesized
ctatttgggaggctgaggca

SEQ ID NO: 537234 - DNA, 20 bp, Artificial Sequence
  chemically synthesized
tgtgctaaaacgctattata

SEQ ID NO: 537235 - DNA, 20 bp, Artificial Sequence
  chemically synthesized
tgttacaaatacacttcaag

SEQ ID NO: 537236 - DNA, 20 bp, Artificial Sequence
  chemically synthesized
ccctgctaagacttccagct

SEQ ID NO: 537237 - DNA, 20 bp, Artificial Sequence
  chemically synthesized
gatgttttttcaaccaaata

SEQ ID NO: 537238 - DNA, 20 bp, Artificial Sequence
  chemically synthesized
ataaatgtgaatagcaaaaa

SEQ ID NO: 537239 - DNA, 20 bp, Artificial Sequence
  chemically synthesized
agttggctgtatctaaattt

SEQ ID NO: 537240 - DNA, 20 bp, Artificial Sequence
  chemically synthesized
aaagcattttggaaaacaat

SEQ ID NO: 537241 - DNA, 20 bp, Artificial Sequence
  chemically synthesized
cagtataaaatggtgcacat

SEQ ID NO: 537242 - DNA, 20 bp, Artificial Sequence
  chemically synthesized
caaaacatgtttatgttgtt

SEQ ID NO: 537243 - DNA, 20 bp, Artificial Sequence
  chemically synthesized
gttccacagcagagaaggtt

SEQ ID NO: 537244 - DNA, 20 bp, Artificial Sequence
  chemically synthesized
aaactcatatagttttttta

SEQ ID NO: 537245 - DNA, 20 bp, Artificial Sequence
  chemically synthesized
ggaatcacttttatatttaa

SEQ ID NO: 537246 - DNA, 20 bp, Artificial Sequence
  chemically synthesized
ttatttttgaacaccgagtc

SEQ ID NO: 537247 - DNA, 20 bp, Artificial Sequence
  chemically synthesized
aggactcggtgttcaaaaat

SEQ ID NO: 537248 - DNA, 20 bp, Artificial Sequence
  chemically synthesized
taacatatacaaagagcaat

SEQ ID NO: 537249 - DNA, 20 bp, Artificial Sequence
  chemically synthesized
ggtcagggaaggagagcaga

SEQ ID NO: 537250 - DNA, 20 bp, Artificial Sequence
  chemically synthesized
gtgttacataaacaactggg

SEQ ID NO: 537251 - DNA, 20 bp, Artificial Sequence
  chemically synthesized
aaagagtggcaaatatgcaa

SEQ ID NO: 537252 - DNA, 20 bp, Artificial Sequence
  chemically synthesized
ctactcgggaagctgaggca

SEQ ID NO: 537253 - DNA, 20 bp, Artificial Sequence
  chemically synthesized
gatgaaaattagcctaaaag

SEQ ID NO: 537254 - DNA, 20 bp, Artificial Sequence
  chemically synthesized
ctacacccacatgcatgttc

SEQ ID NO: 537255 - DNA, 20 bp, Artificial Sequence
  chemically synthesized
tgcatgttcagagaaaatac

SEQ ID NO: 537256 - DNA, 20 bp, Artificial Sequence
  chemically synthesized
cagaagtgtgggtgaagatc

SEQ ID NO: 537257 - DNA, 20 bp, Artificial Sequence
  chemically synthesized
aggtcaagttatgtattaga

SEQ ID NO: 537258 - DNA, 20 bp, Artificial Sequence
  chemically synthesized
accctgtccaccactccctt

SEQ ID NO: 537259 - DNA, 20 bp, Artificial Sequence
  chemically synthesized
tttatatttcattactgaag

SEQ ID NO: 537260 - DNA, 20 bp, Artificial Sequence
  chemically synthesized
ctactcgagaggctgaggca

SEQ ID NO: 537261 - DNA, 20 bp, Artificial Sequence
  chemically synthesized
ggggtcagttggctcaatac

SEQ ID NO: 537262 - DNA, 20 bp, Artificial Sequence
  chemically synthesized
agcatattagagttagctgt

SEQ ID NO: 537263 - DNA, 20 bp, Artificial Sequence
  chemically synthesized
ctcttacttattacaggagg

SEQ ID NO: 537264 - DNA, 20 bp, Artificial Sequence
  chemically synthesized
cacaagtttttttaaaagta

SEQ ID NO: 537265 - DNA, 20 bp, Artificial Sequence
  chemically synthesized
ctgttagtttagatttaggg

SEQ ID NO: 537266 - DNA, 20 bp, Artificial Sequence
  chemically synthesized
ggatacagaggcatatggat

SEQ ID NO: 537267 - DNA, 20 bp, Artificial Sequence
  chemically synthesized
taaaaagtcaaatttttatg

SEQ ID NO: 537268 - DNA, 20 bp, Artificial Sequence
  chemically synthesized
aaggttttatgtgtcctgca

SEQ ID NO: 537269 - DNA, 20 bp, Artificial Sequence
  chemically synthesized
atgttttgcaatcattaaag

SEQ ID NO: 537270 - DNA, 20 bp, Artificial Sequence
  chemically synthesized
gtcgtgtaaatgatctgtta

SEQ ID NO: 537271 - DNA, 20 bp, Artificial Sequence
  chemically synthesized
attccaattatataaaagat

SEQ ID NO: 537272 - DNA, 20 bp, Artificial Sequence
  chemically synthesized
gatctagaatagccaaattc

SEQ ID NO: 537273 - DNA, 20 bp, Artificial Sequence
  chemically synthesized
gaatagccaaattcatagaa

SEQ ID NO: 537274 - DNA, 20 bp, Artificial Sequence
  chemically synthesized
ctactagcggatgggaagag

SEQ ID NO: 537275 - DNA, 20 bp, Artificial Sequence
  chemically synthesized
agcgagactctgtctccaaa

SEQ ID NO: 537276 - DNA, 20 bp, Artificial Sequence
  chemically synthesized
ttaatcaaatggaagaggat

SEQ ID NO: 537277 - DNA, 20 bp, Artificial Sequence
  chemically synthesized
ttattctgaagaatcagact

SEQ ID NO: 537278 - DNA, 20 bp, Artificial Sequence
  chemically synthesized
catttcttcagtctgattct

SEQ ID NO: 537279 - DNA, 20 bp, Artificial Sequence
  chemically synthesized
ttttttgcataaattattct

SEQ ID NO: 537280 - DNA, 20 bp, Artificial Sequence
  chemically synthesized
ggctatatgttttgttgtgg

SEQ ID NO: 537281 - DNA, 20 bp, Artificial Sequence
  chemically synthesized
tccagtttcatttaattgtt

SEQ ID NO: 537282 - DNA, 20 bp, Artificial Sequence
  chemically synthesized
tcaatcagctctgtgctcag

SEQ ID NO: 537283 - DNA, 20 bp, Artificial Sequence
  chemically synthesized
ccctcagtagataaatctct

SEQ ID NO: 537284 - DNA, 20 bp, Artificial Sequence
  chemically synthesized
tatccctcataaatttttta

SEQ ID NO: 537285 - DNA, 20 bp, Artificial Sequence
  chemically synthesized
tctgaaaacctatctctcta

SEQ ID NO: 537286 - DNA, 20 bp, Artificial Sequence
  chemically synthesized
agcataccgtagcttgctgc

SEQ ID NO: 537287 - DNA, 20 bp, Artificial Sequence
  chemically synthesized
tgaagtaaaaaatgaggact

SEQ ID NO: 537288 - DNA, 20 bp, Artificial Sequence
  chemically synthesized
tatgtggtggtgaatgagtt

SEQ ID NO: 537289 - DNA, 20 bp, Artificial Sequence
  chemically synthesized
tcgttacaaaaatggatgat

SEQ ID NO: 537290 - DNA, 20 bp, Artificial Sequence
  chemically synthesized
cactgatctagattctttca

SEQ ID NO: 537291 - DNA, 20 bp, Artificial Sequence
  chemically synthesized
catgagtctattttctcctg

SEQ ID NO: 537292 - DNA, 20 bp, Artificial Sequence
  chemically synthesized
gactcatgcatattaattaa

SEQ ID NO: 537293 - DNA, 20 bp, Artificial Sequence
  chemically synthesized
atttgggaaagataaatttc

SEQ ID NO: 537294 - DNA, 20 bp, Artificial Sequence
  chemically synthesized
taggtatttgggattcaaaa

SEQ ID NO: 537295 - DNA, 20 bp, Artificial Sequence
  chemically synthesized
acaagaggtttacacctgaa

SEQ ID NO: 537296 - DNA, 20 bp, Artificial Sequence
  chemically synthesized
aggtgtaaacctcttgtttc

SEQ ID NO: 537297 - DNA, 20 bp, Artificial Sequence
  chemically synthesized
aagcagaaggtgaaagggga

SEQ ID NO: 537298 - DNA, 20 bp, Artificial Sequence
  chemically synthesized
ctggcaatccagatcttccc

SEQ ID NO: 537299 - DNA, 20 bp, Artificial Sequence
  chemically synthesized
ttgagaagagtctttaaaaa

SEQ ID NO: 537300 - DNA, 20 bp, Artificial Sequence
  chemically synthesized
gttcagaactgcagggttaa

SEQ ID NO: 537301 - DNA, 20 bp, Artificial Sequence
  chemically synthesized
gttaagaagaaataaagttg

SEQ ID NO: 537302 - DNA, 20 bp, Artificial Sequence
  chemically synthesized
aactatgaataacctaatgg

SEQ ID NO: 537303 - DNA, 20 bp, Artificial Sequence
  chemically synthesized
caagcaggccctgggggatt

SEQ ID NO: 537304 - DNA, 20 bp, Artificial Sequence
  chemically synthesized
ctggaaaagagcagcaacta

SEQ ID NO: 537305 - DNA, 20 bp, Artificial Sequence
  chemically synthesized
aagaacaaaagaatatcttg

SEQ ID NO: 537306 - DNA, 20 bp, Artificial Sequence
  chemically synthesized
ttctccaggctagaagaaca

SEQ ID NO: 537307 - DNA, 20 bp, Artificial Sequence
  chemically synthesized
ttcttttgttcttctagcct

SEQ ID NO: 537308 - DNA, 20 bp, Artificial Sequence
  chemically synthesized
gttcttctagcctggagaaa

SEQ ID NO: 537309 - DNA, 20 bp, Artificial Sequence
  chemically synthesized
gatgttaaccatacataatt

SEQ ID NO: 537310 - DNA, 20 bp, Artificial Sequence
  chemically synthesized
acaaagtaatttcaatattt

SEQ ID NO: 537311 - DNA, 20 bp, Artificial Sequence
  chemically synthesized
gataagagattaaaatcgaa

SEQ ID NO: 537312 - DNA, 20 bp, Artificial Sequence
  chemically synthesized
cctggccaggaatttttgaa

SEQ ID NO: 537313 - DNA, 20 bp, Artificial Sequence
  chemically synthesized
ctactagggaggctgaggca

SEQ ID NO: 537314 - DNA, 20 bp, Artificial Sequence
  chemically synthesized
tgcactccaccccgggcaac

SEQ ID NO: 537315 - DNA, 20 bp, Artificial Sequence
  chemically synthesized
gatataatgacataatgttg

SEQ ID NO: 537316 - DNA, 20 bp, Artificial Sequence
  chemically synthesized
aatgttagtaatgctaaagt

SEQ ID NO: 537317 - DNA, 20 bp, Artificial Sequence
  chemically synthesized
agaggatagctgctcacagc

SEQ ID NO: 537318 - DNA, 20 bp, Artificial Sequence
  chemically synthesized
cctatccaaatccttgaccc

SEQ ID NO: 537319 - DNA, 20 bp, Artificial Sequence
  chemically synthesized
tcacaaccttatttgaggaa

SEQ ID NO: 537320 - DNA, 20 bp, Artificial Sequence
  chemically synthesized
ctgtcttacaatcgaatatg

SEQ ID NO: 537321 - DNA, 20 bp, Artificial Sequence
  chemically synthesized
ctgtacaaccagagaaggaa

SEQ ID NO: 537322 - DNA, 20 bp, Artificial Sequence
  chemically synthesized
gagaaggaaatagaatatta

SEQ ID NO: 537323 - DNA, 20 bp, Artificial Sequence
  chemically synthesized
aatagaatattatcagaatc

SEQ ID NO: 537324 - DNA, 20 bp, Artificial Sequence
  chemically synthesized
gaggatttcatagtcaatga

SEQ ID NO: 537325 - DNA, 20 bp, Artificial Sequence
  chemically synthesized
gatgtctcccaagcactgcc

SEQ ID NO: 537326 - DNA, 20 bp, Artificial Sequence
  chemically synthesized
agttgcgatcattctgtaaa

SEQ ID NO: 537327 - DNA, 20 bp, Artificial Sequence
  chemically synthesized
caataaccagattctgattt

SEQ ID NO: 537328 - DNA, 20 bp, Artificial Sequence
  chemically synthesized
taaaagagaatagacagagg

SEQ ID NO: 537329 - DNA, 20 bp, Artificial Sequence
  chemically synthesized
aatgtataaatgaatttaaa

SEQ ID NO: 537330 - DNA, 20 bp, Artificial Sequence
  chemically synthesized
attttgatacacgcatgcaa

SEQ ID NO: 537331 - DNA, 20 bp, Artificial Sequence
  chemically synthesized
gtcattagcaatcagttggc

SEQ ID NO: 537332 - DNA, 20 bp, Artificial Sequence
  chemically synthesized
aaaacgaagaaagaatggac

SEQ ID NO: 537333 - DNA, 20 bp, Artificial Sequence
  chemically synthesized
ttaaaattcataaaacgaag

SEQ ID NO: 537334 - DNA, 20 bp, Artificial Sequence
  chemically synthesized
atgattaaaattcataaaac

SEQ ID NO: 537335 - DNA, 20 bp, Artificial Sequence
  chemically synthesized
tatttttcaatttaaataag

SEQ ID NO: 537336 - DNA, 20 bp, Artificial Sequence
  chemically synthesized
accgtaaggttaaccataca

SEQ ID NO: 537337 - DNA, 20 bp, Artificial Sequence
  chemically synthesized
agtcagaagtagagacttcg

SEQ ID NO: 537338 - DNA, 20 bp, Artificial Sequence
  chemically synthesized
tcgattgctggcagtttgtt

SEQ ID NO: 537339 - DNA, 20 bp, Artificial Sequence
  chemically synthesized
tttcccctcagattctgacc

SEQ ID NO: 537340 - DNA, 20 bp, Artificial Sequence
  chemically synthesized
ttccacaattgattctaagg

SEQ ID NO: 537341 - DNA, 20 bp, Artificial Sequence
  chemically synthesized
ccttagaatcaattgtggaa

SEQ ID NO: 537342 - DNA, 20 bp, Artificial Sequence
  chemically synthesized
tgcagagtagaaacagagag

SEQ ID NO: 537343 - DNA, 20 bp, Artificial Sequence
  chemically synthesized
tggaggcaatgatttgcaga

SEQ ID NO: 537344 - DNA, 20 bp, Artificial Sequence
  chemically synthesized
gaagcagacacgtttaagga

SEQ ID NO: 537345 - DNA, 20 bp, Artificial Sequence
  chemically synthesized
aataataataaccctcaagt

SEQ ID NO: 537346 - DNA, 20 bp, Artificial Sequence
  chemically synthesized
aaaagaggggagtgtttgat

SEQ ID NO: 537347 - DNA, 20 bp, Artificial Sequence
  chemically synthesized
actagcatatttttttctat

SEQ ID NO: 537348 - DNA, 20 bp, Artificial Sequence
  chemically synthesized
ctctgtactggatattcttg

SEQ ID NO: 537349 - DNA, 20 bp, Artificial Sequence
  chemically synthesized
cacatagtagaataataaat

SEQ ID NO: 537350 - DNA, 20 bp, Artificial Sequence
  chemically synthesized
atgacctacagagacacata

SEQ ID NO: 537351 - DNA, 20 bp, Artificial Sequence
  chemically synthesized
gaatcatgtatctgctggaa

SEQ ID NO: 537352 - DNA, 20 bp, Artificial Sequence
  chemically synthesized
tgttctgagtaccaaccttg

SEQ ID NO: 537353 - DNA, 20 bp, Artificial Sequence
  chemically synthesized
cattttcaactttcctatta

SEQ ID NO: 537354 - DNA, 20 bp, Artificial Sequence
  chemically synthesized
aataaactgttaaattttat

SEQ ID NO: 537355 - DNA, 20 bp, Artificial Sequence
  chemically synthesized
ctatcaatgaacataatatc

SEQ ID NO: 537356 - DNA, 20 bp, Artificial Sequence
  chemically synthesized
agtaaaggatcaagaataaa

SEQ ID NO: 537357 - DNA, 20 bp, Artificial Sequence
  chemically synthesized
caaatgaaagagtaaaggat

SEQ ID NO: 537358 - DNA, 20 bp, Artificial Sequence
  chemically synthesized
ttctgaaaaactcttcaagg

SEQ ID NO: 537359 - DNA, 20 bp, Artificial Sequence
  chemically synthesized
ttctaaccttgaagagtttt

SEQ ID NO: 537360 - DNA, 20 bp, Artificial Sequence
  chemically synthesized
gcagaaacttaaaatatcat

SEQ ID NO: 537361 - DNA, 20 bp, Artificial Sequence
  chemically synthesized
aatctacagtagatcaacaa

SEQ ID NO: 537362 - DNA, 20 bp, Artificial Sequence
  chemically synthesized
tgggagagcgggttaaccta

SEQ ID NO: 537363 - DNA, 20 bp, Artificial Sequence
  chemically synthesized
tgaatgatacattacataag

SEQ ID NO: 537364 - DNA, 20 bp, Artificial Sequence
  chemically synthesized
tcccatttaaaaattttcag

SEQ ID NO: 537365 - DNA, 20 bp, Artificial Sequence
  chemically synthesized
atatcaataagttaatttgt

SEQ ID NO: 537366 - DNA, 20 bp, Artificial Sequence
  chemically synthesized
ctgtaaatacagaaagttta

SEQ ID NO: 537367 - DNA, 20 bp, Artificial Sequence
  chemically synthesized
tgtccaagaacactgtaaat

SEQ ID NO: 537368 - DNA, 20 bp, Artificial Sequence
  chemically synthesized
gatattaaccatatactaat

SEQ ID NO: 537369 - DNA, 20 bp, Artificial Sequence
  chemically synthesized
tagaaaactcttaagaactc

SEQ ID NO: 537370 - DNA, 20 bp, Artificial Sequence
  chemically synthesized
tttccacaaatatcgtgtaa

SEQ ID NO: 537371 - DNA, 20 bp, Artificial Sequence
  chemically synthesized
aagtataaaaaaaatctaga

SEQ ID NO: 537372 - DNA, 20 bp, Artificial Sequence
  chemically synthesized
aaatcgaggcttttgaaatt

SEQ ID NO: 537373 - DNA, 20 bp, Artificial Sequence
  chemically synthesized
atttatgtattcagatgatt

SEQ ID NO: 537374 - DNA, 20 bp, Artificial Sequence
  chemically synthesized
tcagatgattgcagaaaagc

SEQ ID NO: 537375 - DNA, 20 bp, Artificial Sequence
  chemically synthesized
cattaagcaagtaggtaaac

SEQ ID NO: 537376 - DNA, 20 bp, Artificial Sequence
  chemically synthesized
atttagacatttagcttttt

SEQ ID NO: 537377 - DNA, 20 bp, Artificial Sequence
  chemically synthesized
agacatttagctttttttag

SEQ ID NO: 537378 - DNA, 20 bp, Artificial Sequence
  chemically synthesized
atggtgagagatttgcataa

SEQ ID NO: 537379 - DNA, 20 bp, Artificial Sequence
  chemically synthesized
cttagcgtaagagtagcccg

SEQ ID NO: 537380 - DNA, 20 bp, Artificial Sequence
  chemically synthesized
gccttttatatgctttcaat

SEQ ID NO: 537381 - DNA, 20 bp, Artificial Sequence
  chemically synthesized
gttttttgatcacctttaac

SEQ ID NO: 537382 - DNA, 20 bp, Artificial Sequence
  chemically synthesized
tcacctttaacatagaaact

SEQ ID NO: 537383 - DNA, 20 bp, Artificial Sequence
  chemically synthesized
tcaatgttgaaggtgcctgt

SEQ ID NO: 537384 - DNA, 20 bp, Artificial Sequence
  chemically synthesized
cacaagcacacatttacata

SEQ ID NO: 537385 - DNA, 20 bp, Artificial Sequence
  chemically synthesized
gtagctcatggacatatggc

SEQ ID NO: 537386 - DNA, 20 bp, Artificial Sequence
  chemically synthesized
ccattgtaaacaagctatgg

SEQ ID NO: 537387 - DNA, 20 bp, Artificial Sequence
  chemically synthesized
acacagacacacacacactg

SEQ ID NO: 537388 - DNA, 20 bp, Artificial Sequence
  chemically synthesized
cctccaaaataagcataaat

SEQ ID NO: 537389 - DNA, 20 bp, Artificial Sequence
  chemically synthesized
taaatgaccatcttgtaatt

SEQ ID NO: 537390 - DNA, 20 bp, Artificial Sequence
  chemically synthesized
gaggaggttactaggtgtgt

SEQ ID NO: 537391 - DNA, 20 bp, Artificial Sequence
  chemically synthesized
ataccctccgtaggtcatta

SEQ ID NO: 537392 - DNA, 20 bp, Artificial Sequence
  chemically synthesized
aatagtgaggcataaatgac

SEQ ID NO: 537393 - DNA, 20 bp, Artificial Sequence
  chemically synthesized
tgaggattaaagtttttttt

SEQ ID NO: 537394 - DNA, 20 bp, Artificial Sequence
  chemically synthesized
cagagctttctgttttaatc

SEQ ID NO: 537395 - DNA, 20 bp, Artificial Sequence
  chemically synthesized
gacacaattctaggattaaa

SEQ ID NO: 537396 - DNA, 20 bp, Artificial Sequence
  chemically synthesized
tcaaggtagtttgtcagtag

SEQ ID NO: 537397 - DNA, 20 bp, Artificial Sequence
  chemically synthesized
tttgctggggaaaaaacaat

SEQ ID NO: 537398 - DNA, 20 bp, Artificial Sequence
  chemically synthesized
aggcagacagtaaacaagat

SEQ ID NO: 537399 - DNA, 20 bp, Artificial Sequence
  chemically synthesized
gacagctagctgcacaatta

SEQ ID NO: 537400 - DNA, 20 bp, Artificial Sequence
  chemically synthesized
aatcactgtgctcttgtaca

SEQ ID NO: 537401 - DNA, 20 bp, Artificial Sequence
  chemically synthesized
ggaggaaatctacttgttga

SEQ ID NO: 537402 - DNA, 20 bp, Artificial Sequence
  chemically synthesized
cacctcagtggcttaacata

SEQ ID NO: 537403 - DNA, 20 bp, Artificial Sequence
  chemically synthesized
ctttaataaagataggtaat

SEQ ID NO: 537404 - DNA, 20 bp, Artificial Sequence
  chemically synthesized
cgggaaagaacgccctaagc

SEQ ID NO: 537405 - DNA, 20 bp, Artificial Sequence
  chemically synthesized
cgaagaagtgaacaagaagt

SEQ ID NO: 537406 - DNA, 20 bp, Artificial Sequence
  chemically synthesized
taaaagccttcagattccag

SEQ ID NO: 537407 - DNA, 20 bp, Artificial Sequence
  chemically synthesized
gctctataatttatttttac

SEQ ID NO: 537408 - DNA, 20 bp, Artificial Sequence
  chemically synthesized
cacaaagccattaccatccg

SEQ ID NO: 537409 - DNA, 20 bp, Artificial Sequence
  chemically synthesized
aaactgaactgggattcaaa

SEQ ID NO: 537410 - DNA, 20 bp, Artificial Sequence
  chemically synthesized
ctctgggagtgagggagaga

SEQ ID NO: 537411 - DNA, 20 bp, Artificial Sequence
  chemically synthesized
catgtcctcataagtccact

SEQ ID NO: 537412 - DNA, 20 bp, Artificial Sequence
  chemically synthesized
atcaaaaataaaagttgaaa

SEQ ID NO: 537413 - DNA, 20 bp, Artificial Sequence
  chemically synthesized
ctaagtgaattaatgcagga

SEQ ID NO: 537414 - DNA, 20 bp, Artificial Sequence
  chemically synthesized
tgagtacatgtgtctctttg

SEQ ID NO: 537415 - DNA, 20 bp, Artificial Sequence
  chemically synthesized
cagctctcttttaagttctt

SEQ ID NO: 537416 - DNA, 20 bp, Artificial Sequence
  chemically synthesized
acagatgatggtgaggcttc

SEQ ID NO: 537417 - DNA, 20 bp, Artificial Sequence
  chemically synthesized
agaggctgttagaaatcaga

SEQ ID NO: 537418 - DNA, 20 bp, Artificial Sequence
  chemically synthesized
aagcagtctcagagaggctg

SEQ ID NO: 537419 - DNA, 20 bp, Artificial Sequence
  chemically synthesized
aggtaggaggcacgagctaa

SEQ ID NO: 537420 - DNA, 20 bp, Artificial Sequence
  chemically synthesized
tcttatccactctttacact

SEQ ID NO: 537421 - DNA, 20 bp, Artificial Sequence
  chemically synthesized
gacatgatcagcaacatatt

SEQ ID NO: 537422 - DNA, 20 bp, Artificial Sequence
  chemically synthesized
tatacagtgcaaagaaagat

SEQ ID NO: 537423 - DNA, 20 bp, Artificial Sequence
  chemically synthesized
ttccatgaactatacagtgc

SEQ ID NO: 537424 - DNA, 20 bp, Artificial Sequence
  chemically synthesized
atagggtgcgatcacaatag

SEQ ID NO: 537425 - DNA, 20 bp, Artificial Sequence
  chemically synthesized
aagatacgagagttctgata

SEQ ID NO: 537426 - DNA, 20 bp, Artificial Sequence
  chemically synthesized
attattatttcacaggacaa

SEQ ID NO: 537427 - DNA, 20 bp, Artificial Sequence
  chemically synthesized
ggaaatgttcgtgaatttaa

SEQ ID NO: 537428 - DNA, 20 bp, Artificial Sequence
  chemically synthesized
ttcacgaacatttccaacta

SEQ ID NO: 537429 - DNA, 20 bp, Artificial Sequence
  chemically synthesized
agaaactatatctacttacc

SEQ ID NO: 537430 - DNA, 20 bp, Artificial Sequence
  chemically synthesized
gcataatgtaaaagccaaga

SEQ ID NO: 537431 - DNA, 20 bp, Artificial Sequence
  chemically synthesized
ttaggaagaaagagaaatat

SEQ ID NO: 537432 - DNA, 20 bp, Artificial Sequence
  chemically synthesized
tggttgtgggttaggaagaa

SEQ ID NO: 537433 - DNA, 20 bp, Artificial Sequence
  chemically synthesized
taaagttggttgtgggttag

SEQ ID NO: 537434 - DNA, 20 bp, Artificial Sequence
  chemically synthesized
ggtagtaattctttccaccc

SEQ ID NO: 537435 - DNA, 20 bp, Artificial Sequence
  chemically synthesized
gacattttttctgggggtgg

SEQ ID NO: 537436 - DNA, 20 bp, Artificial Sequence
  chemically synthesized
cactggaaacatacatagtt

SEQ ID NO: 537437 - DNA, 20 bp, Artificial Sequence
  chemically synthesized
agagagagagagagagagag

SEQ ID NO: 537438 - DNA, 20 bp, Artificial Sequence
  chemically synthesized
atcatcactttcatactcga

SEQ ID NO: 537439 - DNA, 20 bp, Artificial Sequence
  chemically synthesized
cataattgcagctaagttcc

SEQ ID NO: 537440 - DNA, 20 bp, Artificial Sequence
  chemically synthesized
acagaggttactattcttta

SEQ ID NO: 537441 - DNA, 20 bp, Artificial Sequence
  chemically synthesized
tcctgtggctatattctttt

SEQ ID NO: 537442 - DNA, 20 bp, Artificial Sequence
  chemically synthesized
tagcctctgaaaaactcata

SEQ ID NO: 537443 - DNA, 20 bp, Artificial Sequence
  chemically synthesized
gatatgacagcacattcaat

SEQ ID NO: 537444 - DNA, 20 bp, Artificial Sequence
  chemically synthesized
tttaaactatctcttctaca

SEQ ID NO: 537445 - DNA, 20 bp, Artificial Sequence
  chemically synthesized
ctactcgggaggctgaagca

SEQ ID NO: 537446 - DNA, 20 bp, Artificial Sequence
  chemically synthesized
tggccaagataatttttttt

SEQ ID NO: 537447 - DNA, 20 bp, Artificial Sequence
  chemically synthesized
tgaaataatccattaggtat

SEQ ID NO: 537448 - DNA, 20 bp, Artificial Sequence
  chemically synthesized
acaaacattccagttggagt

SEQ ID NO: 537449 - DNA, 20 bp, Artificial Sequence
  chemically synthesized
gctactcggaggctgaggca

SEQ ID NO: 537450 - DNA, 20 bp, Artificial Sequence
  chemically synthesized
aatgcaaaccatacatatat

SEQ ID NO: 537451 - DNA, 20 bp, Artificial Sequence
  chemically synthesized
cataatgagattaataatgt

SEQ ID NO: 537452 - DNA, 20 bp, Artificial Sequence
  chemically synthesized
gttgagagtcctgggaaaac

SEQ ID NO: 537453 - DNA, 20 bp, Artificial Sequence
  chemically synthesized
agatattcagttaagccctt

SEQ ID NO: 537454 - DNA, 20 bp, Artificial Sequence
  chemically synthesized
agtaagatccactgctcttc

SEQ ID NO: 537455 - DNA, 20 bp, Artificial Sequence
  chemically synthesized
aattagcttttatcaaggta

SEQ ID NO: 537456 - DNA, 20 bp, Artificial Sequence
  chemically synthesized
tcagtgtggctaaagtttag

SEQ ID NO: 537457 - DNA, 20 bp, Artificial Sequence
  chemically synthesized
gagttgcaggagctaagtcc

SEQ ID NO: 537458 - DNA, 20 bp, Artificial Sequence
  chemically synthesized
aatacactaataaagttcat

SEQ ID NO: 537459 - DNA, 20 bp, Artificial Sequence
  chemically synthesized
taagcatccgttttaaaata

SEQ ID NO: 537460 - DNA, 20 bp, Artificial Sequence
  chemically synthesized
catggctaggtctgtttaaa

SEQ ID NO: 537461 - DNA, 20 bp, Artificial Sequence
  chemically synthesized
atgtcctattgatctgagaa

SEQ ID NO: 537462 - DNA, 20 bp, Artificial Sequence
  chemically synthesized
gcagactgacatagcactta

SEQ ID NO: 537463 - DNA, 20 bp, Artificial Sequence
  chemically synthesized
ttcagttttcgtaaacatac

SEQ ID NO: 537464 - DNA, 20 bp, Artificial Sequence
  chemically synthesized
aatgatggtcagctcccagt

SEQ ID NO: 537465 - DNA, 20 bp, Artificial Sequence
  chemically synthesized
accttccagctgaatctatg

SEQ ID NO: 537466 - DNA, 20 bp, Artificial Sequence
  chemically synthesized
attaattcaggagaatggga

SEQ ID NO: 537467 - DNA, 20 bp, Artificial Sequence
  chemically synthesized
tcttagcaactattaattca

SEQ ID NO: 537468 - DNA, 20 bp, Artificial Sequence
  chemically synthesized
tctcctgaattaatagttgc

SEQ ID NO: 537469 - DNA, 20 bp, Artificial Sequence
  chemically synthesized
gtaaaataaaaggccattaa

SEQ ID NO: 537470 - DNA, 20 bp, Artificial Sequence
  chemically synthesized
ttgcatcataccaatatcag

SEQ ID NO: 537471 - DNA, 20 bp, Artificial Sequence
  chemically synthesized
taacctccaactcctgggct

SEQ ID NO: 537472 - DNA, 20 bp, Artificial Sequence
  chemically synthesized
atgctcgggaggctgagttg

SEQ ID NO: 537473 - DNA, 20 bp, Artificial Sequence
  chemically synthesized
aggagaaagtgaagaagaag

SEQ ID NO: 537474 - DNA, 20 bp, Artificial Sequence
  chemically synthesized
gagaaggagaaagtgaagaa

SEQ ID NO: 537475 - DNA, 20 bp, Artificial Sequence
  chemically synthesized
aagaagaagaagaaggagaa

SEQ ID NO: 537476 - DNA, 20 bp, Artificial Sequence
  chemically synthesized
caaactcgtagaaccagaga

SEQ ID NO: 537477 - DNA, 20 bp, Artificial Sequence
  chemically synthesized
gcatggaagaatgcatggat

SEQ ID NO: 537478 - DNA, 20 bp, Artificial Sequence
  chemically synthesized
atacagcatagctgtgcatg

SEQ ID NO: 537479 - DNA, 20 bp, Artificial Sequence
  chemically synthesized
tatatcccaaagaattaaaa

SEQ ID NO: 537480 - DNA, 20 bp, Artificial Sequence
  chemically synthesized
cactcctgggtatatatccc

SEQ ID NO: 537481 - DNA, 20 bp, Artificial Sequence
  chemically synthesized
tgcagctgctatagaacaca

SEQ ID NO: 537482 - DNA, 20 bp, Artificial Sequence
  chemically synthesized
aacaaaccaaaaacaagaga

SEQ ID NO: 537483 - DNA, 20 bp, Artificial Sequence
  chemically synthesized
tatatttctccaaagaagac

SEQ ID NO: 537484 - DNA, 20 bp, Artificial Sequence
  chemically synthesized
gccatttctatgtcttcttt

SEQ ID NO: 537485 - DNA, 20 bp, Artificial Sequence
  chemically synthesized
gggtagcttattgttagtgt

SEQ ID NO: 537486 - DNA, 20 bp, Artificial Sequence
  chemically synthesized
ggtgacaagataatccaata

SEQ ID NO: 537487 - DNA, 20 bp, Artificial Sequence
  chemically synthesized
aggagtgcagttagtagatt

SEQ ID NO: 537488 - DNA, 20 bp, Artificial Sequence
  chemically synthesized
gccaaaacaattgtgaaaaa

SEQ ID NO: 537489 - DNA, 20 bp, Artificial Sequence
  chemically synthesized
aaatctatagaacaagttgg

SEQ ID NO: 537490 - DNA, 20 bp, Artificial Sequence
  chemically synthesized
aaaactgtaatacattgctg

SEQ ID NO: 537491 - DNA, 20 bp, Artificial Sequence
  chemically synthesized
tttaatctattttatgctac

SEQ ID NO: 537492 - DNA, 20 bp, Artificial Sequence
  chemically synthesized
taaaaaattgaaaatgatac

SEQ ID NO: 537493 - DNA, 20 bp, Artificial Sequence
  chemically synthesized
cttgcaagataatcaatata

SEQ ID NO: 537494 - DNA, 20 bp, Artificial Sequence
  chemically synthesized
cagacaatacaatcctgtat

SEQ ID NO: 537495 - DNA, 20 bp, Artificial Sequence
  chemically synthesized
gaggcatccacagtatagaa

SEQ ID NO: 537496 - DNA, 20 bp, Artificial Sequence
  chemically synthesized
aacaaaaaaacccaggtcca

SEQ ID NO: 537497 - DNA, 20 bp, Artificial Sequence
  chemically synthesized
tgaatagacctaacacaaac

SEQ ID NO: 537498 - DNA, 20 bp, Artificial Sequence
  chemically synthesized
ataaattaacaaaactgatt

SEQ ID NO: 537499 - DNA, 20 bp, Artificial Sequence
  chemically synthesized
tttgttaatttatgtctttc

SEQ ID NO: 537500 - DNA, 20 bp, Artificial Sequence
  chemically synthesized
catattaaatgaaaaaattc

SEQ ID NO: 537501 - DNA, 20 bp, Artificial Sequence
  chemically synthesized
tttttcatttaatatgtttt

SEQ ID NO: 537502 - DNA, 20 bp, Artificial Sequence
  chemically synthesized
ccctacagaaattagaaaga

SEQ ID NO: 537503 - DNA, 20 bp, Artificial Sequence
  chemically synthesized
tactaccaaccctacagaaa

SEQ ID NO: 537504 - DNA, 20 bp, Artificial Sequence
  chemically synthesized
gggtaattactaccaaccct

SEQ ID NO: 537505 - DNA, 20 bp, Artificial Sequence
  chemically synthesized
agctagactgaccaaaaaaa

SEQ ID NO: 537506 - DNA, 20 bp, Artificial Sequence
  chemically synthesized
caataaaatagaagaagaag

SEQ ID NO: 537507 - DNA, 20 bp, Artificial Sequence
  chemically synthesized
aagtcaataaaatagaagaa

SEQ ID NO: 537508 - DNA, 20 bp, Artificial Sequence
  chemically synthesized
caagctttcgccataagaaa

SEQ ID NO: 537509 - DNA, 20 bp, Artificial Sequence
  chemically synthesized
attaactcaagctttcgcca

SEQ ID NO: 537510 - DNA, 20 bp, Artificial Sequence
  chemically synthesized
gaaagcttgagttaatgatt

SEQ ID NO: 537511 - DNA, 20 bp, Artificial Sequence
  chemically synthesized
ttttaaatacctattttaga

SEQ ID NO: 537512 - DNA, 20 bp, Artificial Sequence
  chemically synthesized
tctagttttaaatacctatt

SEQ ID NO: 537513 - DNA, 20 bp, Artificial Sequence
  chemically synthesized
aattatgttctcttaatatg

SEQ ID NO: 537514 - DNA, 20 bp, Artificial Sequence
  chemically synthesized
gatttgttttttgacctagc

SEQ ID NO: 537515 - DNA, 20 bp, Artificial Sequence
  chemically synthesized
cctagcatagaatctatccc

SEQ ID NO: 537516 - DNA, 20 bp, Artificial Sequence
  chemically synthesized
ggagacgccaccaaatgaaa

SEQ ID NO: 537517 - DNA, 20 bp, Artificial Sequence
  chemically synthesized
agaaaaatagcaacaatata

SEQ ID NO: 537518 - DNA, 20 bp, Artificial Sequence
  chemically synthesized
atagctggcaggccaattag

SEQ ID NO: 537519 - DNA, 20 bp, Artificial Sequence
  chemically synthesized
attctatgatgcagaaattg

SEQ ID NO: 537520 - DNA, 20 bp, Artificial Sequence
  chemically synthesized
attctgtcaatttctgcatc

SEQ ID NO: 537521 - DNA, 20 bp, Artificial Sequence
  chemically synthesized
aaagtcccaaattctatgat

SEQ ID NO: 537522 - DNA, 20 bp, Artificial Sequence
  chemically synthesized
ttatataaggggtcaattaa

SEQ ID NO: 537523 - DNA, 20 bp, Artificial Sequence
  chemically synthesized
ttatgacaaaatatgtaaca

SEQ ID NO: 537524 - DNA, 20 bp, Artificial Sequence
  chemically synthesized
agccaaaaccatataatttc

SEQ ID NO: 537525 - DNA, 20 bp, Artificial Sequence
  chemically synthesized
ccaaccatagtttgtttaaa

SEQ ID NO: 537526 - DNA, 20 bp, Artificial Sequence
  chemically synthesized
atgcaaatattacaaaatct

SEQ ID NO: 537527 - DNA, 20 bp, Artificial Sequence
  chemically synthesized
ttgtggtattatatcaacct

SEQ ID NO: 537528 - DNA, 20 bp, Artificial Sequence
  chemically synthesized
atgtaattgcaactaaaagt

SEQ ID NO: 537529 - DNA, 20 bp, Artificial Sequence
  chemically synthesized
taacaagacagtgcagtaaa

SEQ ID NO: 537530 - DNA, 20 bp, Artificial Sequence
  chemically synthesized
gtaatctttagagcaagcac

SEQ ID NO: 537531 - DNA, 20 bp, Artificial Sequence
  chemically synthesized
gagcaaaaatggagcttagc

SEQ ID NO: 537532 - DNA, 20 bp, Artificial Sequence
  chemically synthesized
gtcttttaaagaagttaaaa

SEQ ID NO: 537533 - DNA, 20 bp, Artificial Sequence
  chemically synthesized
tcgaacccaaatgaagagat

SEQ ID NO: 537534 - DNA, 20 bp, Artificial Sequence
  chemically synthesized
ttgctagctgacctgactta

SEQ ID NO: 537535 - DNA, 20 bp, Artificial Sequence
  chemically synthesized
ttgtaagtcaggtcagctag

SEQ ID NO: 537536 - DNA, 20 bp, Artificial Sequence
  chemically synthesized
atatattaccaagttgagaa

SEQ ID NO: 537537 - DNA, 20 bp, Artificial Sequence
  chemically synthesized
aaataaatatattaccaagt

SEQ ID NO: 537538 - DNA, 20 bp, Artificial Sequence
  chemically synthesized
gagaacacaaaattgccaac

SEQ ID NO: 537539 - DNA, 20 bp, Artificial Sequence
  chemically synthesized
ctggcctctattgtttatga

SEQ ID NO: 537540 - DNA, 20 bp, Artificial Sequence
  chemically synthesized
tgggaaagtctttaaaacaa

SEQ ID NO: 537541 - DNA, 20 bp, Artificial Sequence
  chemically synthesized
ttaagctcaacaaaccccaa

SEQ ID NO: 537542 - DNA, 20 bp, Artificial Sequence
  chemically synthesized
aagaggcagaaaaattattt

SEQ ID NO: 537543 - DNA, 20 bp, Artificial Sequence
  chemically synthesized
aagagaatgttgttaaagag

SEQ ID NO: 537544 - DNA, 20 bp, Artificial Sequence
  chemically synthesized
tacaagagttccagaaaaaa

SEQ ID NO: 537545 - DNA, 20 bp, Artificial Sequence
  chemically synthesized
atgtagatgttacaagagtt

SEQ ID NO: 537546 - DNA, 20 bp, Artificial Sequence
  chemically synthesized
gctcaagagcagatagtaag

SEQ ID NO: 537547 - DNA, 20 bp, Artificial Sequence
  chemically synthesized
gaaaattctagaattggaaa

SEQ ID NO: 537548 - DNA, 20 bp, Artificial Sequence
  chemically synthesized
ggttattctactttccaatt

SEQ ID NO: 537549 - DNA, 20 bp, Artificial Sequence
  chemically synthesized
aaaagaaccaaatgaaaatt

SEQ ID NO: 537550 - DNA, 20 bp, Artificial Sequence
  chemically synthesized
tggtaacaataactacaaat

SEQ ID NO: 537551 - DNA, 20 bp, Artificial Sequence
  chemically synthesized
ataaataccttcaaacaact

SEQ ID NO: 537552 - DNA, 20 bp, Artificial Sequence
  chemically synthesized
ttgttgactgcttttcccca

SEQ ID NO: 537553 - DNA, 20 bp, Artificial Sequence
  chemically synthesized
tatttaaaatgtcaaatttt

SEQ ID NO: 537554 - DNA, 20 bp, Artificial Sequence
  chemically synthesized
gctgggcataagaaggaaca

SEQ ID NO: 537555 - DNA, 20 bp, Artificial Sequence
  chemically synthesized
gtttctgttgtttgacagag

SEQ ID NO: 537556 - DNA, 20 bp, Artificial Sequence
  chemically synthesized
gtttgtttctgttgtttgac

SEQ ID NO: 537557 - DNA, 20 bp, Artificial Sequence
  chemically synthesized
tattctttctctgtcaaaca

SEQ ID NO: 537558 - DNA, 20 bp, Artificial Sequence
  chemically synthesized
gtaactgactggcagactgg

SEQ ID NO: 537559 - DNA, 20 bp, Artificial Sequence
  chemically synthesized
cctaggcggcaaacaaaaag

SEQ ID NO: 537560 - DNA, 20 bp, Artificial Sequence
  chemically synthesized
tcagtaaaatgggacacact

SEQ ID NO: 537561 - DNA, 20 bp, Artificial Sequence
  chemically synthesized
agtagctcgataaatctccc

SEQ ID NO: 537562 - DNA, 20 bp, Artificial Sequence
  chemically synthesized
taatttaagtagctggtgca

SEQ ID NO: 537563 - DNA, 20 bp, Artificial Sequence
  chemically synthesized
ctagtataaaggctaattag

SEQ ID NO: 537564 - DNA, 20 bp, Artificial Sequence
  chemically synthesized
aaacaccaaataagtcagta

SEQ ID NO: 537565 - DNA, 20 bp, Artificial Sequence
  chemically synthesized
cattatattggctcataaag

SEQ ID NO: 537566 - DNA, 20 bp, Artificial Sequence
  chemically synthesized
acgtgggaccctggatttta

SEQ ID NO: 537567 - DNA, 20 bp, Artificial Sequence
  chemically synthesized
cgttaaagagttacaccaac

SEQ ID NO: 537568 - DNA, 20 bp, Artificial Sequence
  chemically synthesized
ataaaaaaaagtgaggagga

SEQ ID NO: 537569 - DNA, 20 bp, Artificial Sequence
  chemically synthesized
ctttcaacctctgaaacact

SEQ ID NO: 537570 - DNA, 20 bp, Artificial Sequence
  chemically synthesized
tctaccccataaagataaca

SEQ ID NO: 537571 - DNA, 20 bp, Artificial Sequence
  chemically synthesized
ttttaaatggtgtggaattt

SEQ ID NO: 537572 - DNA, 20 bp, Artificial Sequence
  chemically synthesized
aatttataggatgaatggat

SEQ ID NO: 537573 - DNA, 20 bp, Artificial Sequence
  chemically synthesized
ttaagtaaggtaaaccaggc

SEQ ID NO: 537574 - DNA, 20 bp, Artificial Sequence
  chemically synthesized
accttggtggttaccagaga

SEQ ID NO: 537575 - DNA, 20 bp, Artificial Sequence
  chemically synthesized
accaaaaaaaaaaaaaaaaa

SEQ ID NO: 537576 - DNA, 20 bp, Artificial Sequence
  chemically synthesized
agccagaaccccatctcaaa

SEQ ID NO: 537577 - DNA, 20 bp, Artificial Sequence
  chemically synthesized
tgacgacagggtagaacaaa

SEQ ID NO: 537578 - DNA, 20 bp, Artificial Sequence
  chemically synthesized
acaaattaccacattaagca

SEQ ID NO: 537579 - DNA, 20 bp, Artificial Sequence
  chemically synthesized
ggtaatttgtaaaatggaca

SEQ ID NO: 537580 - DNA, 20 bp, Artificial Sequence
  chemically synthesized
attgcagtttggcattgtca

SEQ ID NO: 537581 - DNA, 20 bp, Artificial Sequence
  chemically synthesized
tttagcttgtatgtcattgg

SEQ ID NO: 537582 - DNA, 20 bp, Artificial Sequence
  chemically synthesized
attatagtaactgaaacaaa

SEQ ID NO: 537583 - DNA, 20 bp, Artificial Sequence
  chemically synthesized
taatatctagggagattaaa

SEQ ID NO: 537584 - DNA, 20 bp, Artificial Sequence
  chemically synthesized
tgtagctttcactgtatcaa

SEQ ID NO: 537585 - DNA, 20 bp, Artificial Sequence
  chemically synthesized
ataacaatcagggaaaccgt

SEQ ID NO: 537586 - DNA, 20 bp, Artificial Sequence
  chemically synthesized
gagggttcagaacatgtcct

SEQ ID NO: 537587 - DNA, 20 bp, Artificial Sequence
  chemically synthesized
taaggaattacatagagagg

SEQ ID NO: 537588 - DNA, 20 bp, Artificial Sequence
  chemically synthesized
atgtccagtggatttaacta

SEQ ID NO: 537589 - DNA, 20 bp, Artificial Sequence
  chemically synthesized
cttttgatccaaaccactgc

SEQ ID NO: 537590 - DNA, 20 bp, Artificial Sequence
  chemically synthesized
ggagagggaaatgtgataat

SEQ ID NO: 537591 - DNA, 20 bp, Artificial Sequence
  chemically synthesized
gattcaaatgggaataataa

SEQ ID NO: 537592 - DNA, 20 bp, Artificial Sequence
  chemically synthesized
catttgttaactttggttgc

SEQ ID NO: 537593 - DNA, 20 bp, Artificial Sequence
  chemically synthesized
ttttgaatctggaatgagtg

SEQ ID NO: 537594 - DNA, 20 bp, Artificial Sequence
  chemically synthesized
acagaattataaggcactat

SEQ ID NO: 537595 - DNA, 20 bp, Artificial Sequence
  chemically synthesized
aagaatgtcattgctactgg

SEQ ID NO: 537596 - DNA, 20 bp, Artificial Sequence
  chemically synthesized
taccactgcagacactgggt

SEQ ID NO: 537597 - DNA, 20 bp, Artificial Sequence
  chemically synthesized
tcccattcctaaacaaaggg

SEQ ID NO: 537598 - DNA, 20 bp, Artificial Sequence
  chemically synthesized
agaagcggaaacggacttta

SEQ ID NO: 537599 - DNA, 20 bp, Artificial Sequence
  chemically synthesized
tgatcagggatagtgaggca

SEQ ID NO: 537600 - DNA, 20 bp, Artificial Sequence
  chemically synthesized
tgtttgtgtgcattcaagag

SEQ ID NO: 537601 - DNA, 20 bp, Artificial Sequence
  chemically synthesized
tataacaatccttatattca

SEQ ID NO: 537602 - DNA, 20 bp, Artificial Sequence
  chemically synthesized
tttaattcaaattaaccttt

SEQ ID NO: 537603 - DNA, 20 bp, Artificial Sequence
  chemically synthesized
catataattagtaaaacaaa

SEQ ID NO: 537604 - DNA, 20 bp, Artificial Sequence
  chemically synthesized
aaagaaaacccaaagtccta

SEQ ID NO: 537605 - DNA, 20 bp, Artificial Sequence
  chemically synthesized
gtgtcctacctttgtttaca

SEQ ID NO: 537606 - DNA, 20 bp, Artificial Sequence
  chemically synthesized
tttacaaagttctttttatg

SEQ ID NO: 537607 - DNA, 20 bp, Artificial Sequence
  chemically synthesized
ctttgagacacattttataa

SEQ ID NO: 537608 - DNA, 20 bp, Artificial Sequence
  chemically synthesized
catttattttccttgttgct

SEQ ID NO: 537609 - DNA, 20 bp, Artificial Sequence
  chemically synthesized
cagcaacaaggaaaataaat

SEQ ID NO: 537610 - DNA, 20 bp, Artificial Sequence
  chemically synthesized
tgcaataaccttaaagggag

SEQ ID NO: 537611 - DNA, 20 bp, Artificial Sequence
  chemically synthesized
ataacatgaaaaggaaacac

SEQ ID NO: 537612 - DNA, 20 bp, Artificial Sequence
  chemically synthesized
ttcatcctacagattgcaga

SEQ ID NO: 537613 - DNA, 20 bp, Artificial Sequence
  chemically synthesized
tttgctaaccagtaaacaaa

SEQ ID NO: 537614 - DNA, 20 bp, Artificial Sequence
  chemically synthesized
tggttagcaaattaatgact

SEQ ID NO: 537615 - DNA, 20 bp, Artificial Sequence
  chemically synthesized
gaacattgaaaataaggtga

SEQ ID NO: 537616 - DNA, 20 bp, Artificial Sequence
  chemically synthesized
aacctggaaaagggatcatc

SEQ ID NO: 537617 - DNA, 20 bp, Artificial Sequence
  chemically synthesized
ctttaaaaacctgacagatt

SEQ ID NO: 537618 - DNA, 20 bp, Artificial Sequence
  chemically synthesized
aagttagagacaatgagtaa

SEQ ID NO: 537619 - DNA, 20 bp, Artificial Sequence
  chemically synthesized
ctcaaagaattttttccagg

SEQ ID NO: 537620 - DNA, 20 bp, Artificial Sequence
  chemically synthesized
catggaagatttgaaatctc

SEQ ID NO: 537621 - DNA, 20 bp, Artificial Sequence
  chemically synthesized
cttcaaacattttatttttc

SEQ ID NO: 537622 - DNA, 20 bp, Artificial Sequence
  chemically synthesized
gagtgaccacttgtatattc

SEQ ID NO: 537623 - DNA, 20 bp, Artificial Sequence
  chemically synthesized
tccaaatctgactgtaattc

SEQ ID NO: 537624 - DNA, 20 bp, Artificial Sequence
  chemically synthesized
tttaagattgggtatgaggg

SEQ ID NO: 537625 - DNA, 20 bp, Artificial Sequence
  chemically synthesized
tggcgaaaccacatcgctac

SEQ ID NO: 537626 - DNA, 20 bp, Artificial Sequence
  chemically synthesized
ggaagacttgataaaggtga

SEQ ID NO: 537627 - DNA, 20 bp, Artificial Sequence
  chemically synthesized
aagcattcaatttagtattc

SEQ ID NO: 537628 - DNA, 20 bp, Artificial Sequence
  chemically synthesized
gaaatagaaatgaaaagata

SEQ ID NO: 537629 - DNA, 20 bp, Artificial Sequence
  chemically synthesized
atatcatgaaaactaatgaa

SEQ ID NO: 537630 - DNA, 20 bp, Artificial Sequence
  chemically synthesized
aaataggacaattttaataa

SEQ ID NO: 537631 - DNA, 20 bp, Artificial Sequence
  chemically synthesized
gggagccaaggtacatggta

SEQ ID NO: 537632 - DNA, 20 bp, Artificial Sequence
  chemically synthesized
gggaattgggcagtttatat

SEQ ID NO: 537633 - DNA, 20 bp, Artificial Sequence
  chemically synthesized
caggagcaaaatcactgaag

SEQ ID NO: 537634 - DNA, 20 bp, Artificial Sequence
  chemically synthesized
agagtaaatggacatgccag

SEQ ID NO: 537635 - DNA, 20 bp, Artificial Sequence
  chemically synthesized
atttttcatagtcttttgat

SEQ ID NO: 537636 - DNA, 20 bp, Artificial Sequence
  chemically synthesized
gctatttttagattgatcag

SEQ ID NO: 537637 - DNA, 20 bp, Artificial Sequence
  chemically synthesized
tcttaaatgtactaaattct

SEQ ID NO: 537638 - DNA, 20 bp, Artificial Sequence
  chemically synthesized
aataatattttaggtattct

SEQ ID NO: 537639 - DNA, 20 bp, Artificial Sequence
  chemically synthesized
gaagggatcaaggtcaattt

SEQ ID NO: 537640 - DNA, 20 bp, Artificial Sequence
  chemically synthesized
ccatggatacgtttgcaatt

SEQ ID NO: 537641 - DNA, 20 bp, Artificial Sequence
  chemically synthesized
aatgtgataacatgataaaa

SEQ ID NO: 537642 - DNA, 20 bp, Artificial Sequence
  chemically synthesized
tactttcttaatttaaatcg

SEQ ID NO: 537643 - DNA, 20 bp, Artificial Sequence
  chemically synthesized
aaaattcttacgatttaaat

SEQ ID NO: 537644 - DNA, 20 bp, Artificial Sequence
  chemically synthesized
tctataacccacagtactta

SEQ ID NO: 537645 - DNA, 20 bp, Artificial Sequence
  chemically synthesized
atgagtgttataaaaagggg

SEQ ID NO: 537646 - DNA, 20 bp, Artificial Sequence
  chemically synthesized
aaaggggcaagaaaacctta

SEQ ID NO: 537647 - DNA, 20 bp, Artificial Sequence
  chemically synthesized
gggaaaaaaaataaggggaa

SEQ ID NO: 537648 - DNA, 20 bp, Artificial Sequence
  chemically synthesized
ttttttgcaaaagctgaaga

SEQ ID NO: 537649 - DNA, 20 bp, Artificial Sequence
  chemically synthesized
attcaaagcttcagacataa

SEQ ID NO: 537650 - DNA, 20 bp, Artificial Sequence
  chemically synthesized
tagtagcaaaagaattgaac

SEQ ID NO: 537651 - DNA, 20 bp, Artificial Sequence
  chemically synthesized
gatggccacacgtagtagca

SEQ ID NO: 537652 - DNA, 20 bp, Artificial Sequence
  chemically synthesized
ggtaaggagaaggttggtag

SEQ ID NO: 537653 - DNA, 20 bp, Artificial Sequence
  chemically synthesized
agaaattgcaagtgtatacc

SEQ ID NO: 537654 - DNA, 20 bp, Artificial Sequence
  chemically synthesized
gccctcctgtaaaattaaaa

SEQ ID NO: 537655 - DNA, 20 bp, Artificial Sequence
  chemically synthesized
cctgggagttgctaagaaat

SEQ ID NO: 537656 - DNA, 20 bp, Artificial Sequence
  chemically synthesized
agacatcacctgggagttgc

SEQ ID NO: 537657 - DNA, 20 bp, Artificial Sequence
  chemically synthesized
agagaccacactttgagtag

SEQ ID NO: 537658 - DNA, 20 bp, Artificial Sequence
  chemically synthesized
agttgtaggtgatggtgcca

SEQ ID NO: 537659 - DNA, 20 bp, Artificial Sequence
  chemically synthesized
atctaaattttcaaaagaag

SEQ ID NO: 537660 - DNA, 20 bp, Artificial Sequence
  chemically synthesized
gtcaaggtctaaactggcaa

SEQ ID NO: 537661 - DNA, 20 bp, Artificial Sequence
  chemically synthesized
atttgtaagaagccaaagtt

SEQ ID NO: 537662 - DNA, 20 bp, Artificial Sequence
  chemically synthesized
atgcaaatacacgctgttga

SEQ ID NO: 537663 - DNA, 20 bp, Artificial Sequence
  chemically synthesized
attcgtaaatgtacttaaag

SEQ ID NO: 537664 - DNA, 20 bp, Artificial Sequence
  chemically synthesized
tatactagtacattttggtt

SEQ ID NO: 537665 - DNA, 20 bp, Artificial Sequence
  chemically synthesized
tgattcttgacaaatctctt

SEQ ID NO: 537666 - DNA, 20 bp, Artificial Sequence
  chemically synthesized
gtattctgaaagagatttgt

SEQ ID NO: 537667 - DNA, 20 bp, Artificial Sequence
  chemically synthesized
atctcctttgggactgcttg

SEQ ID NO: 537668 - DNA, 20 bp, Artificial Sequence
  chemically synthesized
cttttagaggtgaatagtac

SEQ ID NO: 537669 - DNA, 20 bp, Artificial Sequence
  chemically synthesized
ggactttgcctatcccagat

SEQ ID NO: 537670 - DNA, 20 bp, Artificial Sequence
  chemically synthesized
attgagcaggaagctctggg

SEQ ID NO: 537671 - DNA, 20 bp, Artificial Sequence
  chemically synthesized
ttttttttttttttcaaaca

SEQ ID NO: 537672 - DNA, 20 bp, Artificial Sequence
  chemically synthesized
ttagatgatttattaattgc

SEQ ID NO: 537673 - DNA, 20 bp, Artificial Sequence
  chemically synthesized
tgcatgtcaaacatgtttgg

SEQ ID NO: 537674 - DNA, 20 bp, Artificial Sequence
  chemically synthesized
tagacctaacttccagttta

SEQ ID NO: 537675 - DNA, 20 bp, Artificial Sequence
  chemically synthesized
atgccctatatatgagagat

SEQ ID NO: 537676 - DNA, 20 bp, Artificial Sequence
  chemically synthesized
gagagatacagaaagagggt

SEQ ID NO: 537677 - DNA, 20 bp, Artificial Sequence
  chemically synthesized
gaaagagggtagagaaagcg

SEQ ID NO: 537678 - DNA, 20 bp, Artificial Sequence
  chemically synthesized
atgttaacaattgttgactc

SEQ ID NO: 537679 - DNA, 20 bp, Artificial Sequence
  chemically synthesized
ttgtgaaaaatttcaaacat

SEQ ID NO: 537680 - DNA, 20 bp, Artificial Sequence
  chemically synthesized
ctattccttaatgcatatta

SEQ ID NO: 537681 - DNA, 20 bp, Artificial Sequence
  chemically synthesized
aatatcagacttgtctaaaa

SEQ ID NO: 537682 - DNA, 20 bp, Artificial Sequence
  chemically synthesized
tcagacttgtctaaaagaag

SEQ ID NO: 537683 - DNA, 20 bp, Artificial Sequence
  chemically synthesized
cataatgaagaggattttac

SEQ ID NO: 537684 - DNA, 20 bp, Artificial Sequence
  chemically synthesized
ctcgactggtatgtcttctc

SEQ ID NO: 537685 - DNA, 20 bp, Artificial Sequence
  chemically synthesized
tcttctcctagaatactcca

SEQ ID NO: 537686 - DNA, 20 bp, Artificial Sequence
  chemically synthesized
ccagctgtctgtttatctgc

SEQ ID NO: 537687 - DNA, 20 bp, Artificial Sequence
  chemically synthesized
ctgttgaagcctgacattcc

SEQ ID NO: 537688 - DNA, 20 bp, Artificial Sequence
  chemically synthesized
gcgccatgctcttcactgga

SEQ ID NO: 537689 - DNA, 20 bp, Artificial Sequence
  chemically synthesized
tcttctgaaattttaagata

SEQ ID NO: 537690 - DNA, 20 bp, Artificial Sequence
  chemically synthesized
ttagtccagggacatcaatg

SEQ ID NO: 537691 - DNA, 20 bp, Artificial Sequence
  chemically synthesized
atggactttaagtacagcgg

SEQ ID NO: 537692 - DNA, 20 bp, Artificial Sequence
  chemically synthesized
cttgatttgctactggatgc

SEQ ID NO: 537693 - DNA, 20 bp, Artificial Sequence
  chemically synthesized
tataccactttcttataaaa

SEQ ID NO: 537694 - DNA, 20 bp, Artificial Sequence
  chemically synthesized
tttagatctttctaatttta

SEQ ID NO: 537695 - DNA, 20 bp, Artificial Sequence
  chemically synthesized
gaaacaatactttatatatt

SEQ ID NO: 537696 - DNA, 20 bp, Artificial Sequence
  chemically synthesized
ctataaatatatatatacgg

SEQ ID NO: 537697 - DNA, 20 bp, Artificial Sequence
  chemically synthesized
caaattaagatggtaagaaa

SEQ ID NO: 537698 - DNA, 20 bp, Artificial Sequence
  chemically synthesized
tctaatccaaattaagatgg

SEQ ID NO: 537699 - DNA, 20 bp, Artificial Sequence
  chemically synthesized
tggattagattgagcctagt

SEQ ID NO: 537700 - DNA, 20 bp, Artificial Sequence
  chemically synthesized
aaatacttgtatgattaaga

SEQ ID NO: 537701 - DNA, 20 bp, Artificial Sequence
  chemically synthesized
acacaccccttgccaaagtt

SEQ ID NO: 537702 - DNA, 20 bp, Artificial Sequence
  chemically synthesized
ctttattcatgttacattat

SEQ ID NO: 537703 - DNA, 20 bp, Artificial Sequence
  chemically synthesized
ccttggaatgtattgaaggc

SEQ ID NO: 537704 - DNA, 20 bp, Artificial Sequence
  chemically synthesized
ctttggctcaagttcccctt

SEQ ID NO: 537705 - DNA, 20 bp, Artificial Sequence
  chemically synthesized
agttgtttttcaagaagatt

SEQ ID NO: 537706 - DNA, 20 bp, Artificial Sequence
  chemically synthesized
caaacttcaagtttaaaata

SEQ ID NO: 537707 - DNA, 20 bp, Artificial Sequence
  chemically synthesized
tatattttagtatatgaaaa

SEQ ID NO: 537708 - DNA, 20 bp, Artificial Sequence
  chemically synthesized
aaccattaatcaacagcagt

SEQ ID NO: 537709 - DNA, 20 bp, Artificial Sequence
  chemically synthesized
ctctcatgaaatattcttct

SEQ ID NO: 537710 - DNA, 20 bp, Artificial Sequence
  chemically synthesized
gactttttaagctttcttta

SEQ ID NO: 537711 - DNA, 20 bp, Artificial Sequence
  chemically synthesized
ggtctgcaaacagctgtcag

SEQ ID NO: 537712 - DNA, 20 bp, Artificial Sequence
  chemically synthesized
caggcttcccaatttttcct

SEQ ID NO: 537713 - DNA, 20 bp, Artificial Sequence
  chemically synthesized
gaacattgaatgcaactggg

SEQ ID NO: 537714 - DNA, 20 bp, Artificial Sequence
  chemically synthesized
aagccccatgtctttttatt

SEQ ID NO: 537715 - DNA, 20 bp, Artificial Sequence
  chemically synthesized
ccacatgcagttgtactggc

SEQ ID NO: 537716 - DNA, 20 bp, Artificial Sequence
  chemically synthesized
atgcagttgtactggcaaag

SEQ ID NO: 537717 - DNA, 20 bp, Artificial Sequence
  chemically synthesized
ccatatccaaaggatacaag

SEQ ID NO: 537718 - DNA, 20 bp, Artificial Sequence
  chemically synthesized
atggaacatccttgtgggga

SEQ ID NO: 537719 - DNA, 20 bp, Artificial Sequence
  chemically synthesized
cctctcgtatccacgatcac

SEQ ID NO: 537720 - DNA, 20 bp, Artificial Sequence
  chemically synthesized
taaaattaattgctatatta

SEQ ID NO: 537721 - DNA, 20 bp, Artificial Sequence
  chemically synthesized
tgcaaaatacattgacgcag

SEQ ID NO: 537722 - DNA, 20 bp, Artificial Sequence
  chemically synthesized
cattagaagccacaaaaaac

SEQ ID NO: 537723 - DNA, 20 bp, Artificial Sequence
  chemically synthesized
gaaattttaagagtaaagta

SEQ ID NO: 537724 - DNA, 20 bp, Artificial Sequence
  chemically synthesized
aaaaatagctcaattgaaaa

SEQ ID NO: 537725 - DNA, 20 bp, Artificial Sequence
  chemically synthesized
aactttttaaaaaagataat

SEQ ID NO: 537726 - DNA, 20 bp, Artificial Sequence
  chemically synthesized
atattaactaaatacgaacc

SEQ ID NO: 537727 - DNA, 20 bp, Artificial Sequence
  chemically synthesized
ctcaaatccttatgtcactg

SEQ ID NO: 537728 - DNA, 20 bp, Artificial Sequence
  chemically synthesized
tgacagaataatgtgcgtat

SEQ ID NO: 537729 - DNA, 20 bp, Artificial Sequence
  chemically synthesized
taggagaatacaaaaatatt

SEQ ID NO: 537730 - DNA, 20 bp, Artificial Sequence
  chemically synthesized
tgctattgtgtcaaggagta

SEQ ID NO: 537731 - DNA, 20 bp, Artificial Sequence
  chemically synthesized
aagggagctttacctcagtc

SEQ ID NO: 537732 - DNA, 20 bp, Artificial Sequence
  chemically synthesized
atgtagaaaaagaaaaaagc

SEQ ID NO: 537733 - DNA, 20 bp, Artificial Sequence
  chemically synthesized
aattttgcttgaatgtagaa

SEQ ID NO: 537734 - DNA, 20 bp, Artificial Sequence
  chemically synthesized
gaaaataattttgcttgaat

SEQ ID NO: 537735 - DNA, 20 bp, Artificial Sequence
  chemically synthesized
aagacacaatatctgacctc

SEQ ID NO: 537736 - DNA, 20 bp, Artificial Sequence
  chemically synthesized
gaagagaggaaggaatggag

SEQ ID NO: 537737 - DNA, 20 bp, Artificial Sequence
  chemically synthesized
gaagggaggaaaggagagag

SEQ ID NO: 537738 - DNA, 20 bp, Artificial Sequence
  chemically synthesized
ggaggaaaggagagaggtag

SEQ ID NO: 537739 - DNA, 20 bp, Artificial Sequence
  chemically synthesized
gattatgtactgcctaagac

SEQ ID NO: 537740 - DNA, 20 bp, Artificial Sequence
  chemically synthesized
tctgggtcaatttggaattt

SEQ ID NO: 537741 - DNA, 20 bp, Artificial Sequence
  chemically synthesized
aggcaacatgaactattaca

SEQ ID NO: 537742 - DNA, 20 bp, Artificial Sequence
  chemically synthesized
ttttgaagtttgtaggaaat

SEQ ID NO: 537743 - DNA, 20 bp, Artificial Sequence
  chemically synthesized
tatagcattataagcagcaa

SEQ ID NO: 537744 - DNA, 20 bp, Artificial Sequence
  chemically synthesized
ttcggtttcccaaataagag

SEQ ID NO: 537745 - DNA, 20 bp, Artificial Sequence
  chemically synthesized
tagatctaaatctcatttgt

SEQ ID NO: 537746 - DNA, 20 bp, Artificial Sequence
  chemically synthesized
atgagaaggttttgcaacca

SEQ ID NO: 537747 - DNA, 20 bp, Artificial Sequence
  chemically synthesized
gagttttcagtgataaagca

SEQ ID NO: 537748 - DNA, 20 bp, Artificial Sequence
  chemically synthesized
tttcagtgataaagcataag

SEQ ID NO: 537749 - DNA, 20 bp, Artificial Sequence
  chemically synthesized
aagaaaaataagggatcaaa

SEQ ID NO: 537750 - DNA, 20 bp, Artificial Sequence
  chemically synthesized
ccagtgttatcttttccagc

SEQ ID NO: 537751 - DNA, 20 bp, Artificial Sequence
  chemically synthesized
acttaaaatatttagaagct

SEQ ID NO: 537752 - DNA, 20 bp, Artificial Sequence
  chemically synthesized
ttaattgccagagaaataga

SEQ ID NO: 537753 - DNA, 20 bp, Artificial Sequence
  chemically synthesized
aagactagatgttaattgcc

SEQ ID NO: 537754 - DNA, 20 bp, Artificial Sequence
  chemically synthesized
ctagtcttggttctggacaa

SEQ ID NO: 537755 - DNA, 20 bp, Artificial Sequence
  chemically synthesized
tgttggattattcatcatag

SEQ ID NO: 537756 - DNA, 20 bp, Artificial Sequence
  chemically synthesized
gttagatatgcacttcttat

SEQ ID NO: 537757 - DNA, 20 bp, Artificial Sequence
  chemically synthesized
gcttttcaaaatataaaagc

SEQ ID NO: 537758 - DNA, 20 bp, Artificial Sequence
  chemically synthesized
gaaattctgattcagtagac

SEQ ID NO: 537759 - DNA, 20 bp, Artificial Sequence
  chemically synthesized
tccattctaagtctactgaa

SEQ ID NO: 537760 - DNA, 20 bp, Artificial Sequence
  chemically synthesized
tctttcatatacctttgtcc

SEQ ID NO: 537761 - DNA, 20 bp, Artificial Sequence
  chemically synthesized
tatgaaagagatacactaaa

SEQ ID NO: 537762 - DNA, 20 bp, Artificial Sequence
  chemically synthesized
ttgggaagcaggaaggacat

SEQ ID NO: 537763 - DNA, 20 bp, Artificial Sequence
  chemically synthesized
tcaaaagctgttcctaaatt

SEQ ID NO: 537764 - DNA, 20 bp, Artificial Sequence
  chemically synthesized
aggaaagaggaaacataggc

SEQ ID NO: 537765 - DNA, 20 bp, Artificial Sequence
  chemically synthesized
tttttatacagggaaggata

SEQ ID NO: 537766 - DNA, 20 bp, Artificial Sequence
  chemically synthesized
tacagggaaggatataagaa

SEQ ID NO: 537767 - DNA, 20 bp, Artificial Sequence
  chemically synthesized
aaaatgtacgtaatgttttc

SEQ ID NO: 537768 - DNA, 20 bp, Artificial Sequence
  chemically synthesized
gaaaacacaatagatgaaaa

SEQ ID NO: 537769 - DNA, 20 bp, Artificial Sequence
  chemically synthesized
aaaaatagaatgtgacaaat

SEQ ID NO: 537770 - DNA, 20 bp, Artificial Sequence
  chemically synthesized
aataagctaagaagcagtta

SEQ ID NO: 537771 - DNA, 20 bp, Artificial Sequence
  chemically synthesized
gaagagataaaatgcaactg

SEQ ID NO: 537772 - DNA, 20 bp, Artificial Sequence
  chemically synthesized
taaatacagggaaatagagg

SEQ ID NO: 537773 - DNA, 20 bp, Artificial Sequence
  chemically synthesized
cattgaacaaggagatgttt

SEQ ID NO: 537774 - DNA, 20 bp, Artificial Sequence
  chemically synthesized
ccgagtttactgattggtca

SEQ ID NO: 537775 - DNA, 20 bp, Artificial Sequence
  chemically synthesized
gcactgacgaagagacacaa

SEQ ID NO: 537776 - DNA, 20 bp, Artificial Sequence
  chemically synthesized
ttgtgtctcttcgtcagtgc

SEQ ID NO: 537777 - DNA, 20 bp, Artificial Sequence
  chemically synthesized
atttatcattgaaaaaagta

SEQ ID NO: 537778 - DNA, 20 bp, Artificial Sequence
  chemically synthesized
ttaaccagtcatgctaatta

SEQ ID NO: 537779 - DNA, 20 bp, Artificial Sequence
  chemically synthesized
ccatcatccgatagaagttg

SEQ ID NO: 537780 - DNA, 20 bp, Artificial Sequence
  chemically synthesized
ggagagaagggcaaaatagt

SEQ ID NO: 537781 - DNA, 20 bp, Artificial Sequence
  chemically synthesized
aaaaagagtggaaaaatagt

SEQ ID NO: 537782 - DNA, 20 bp, Artificial Sequence
  chemically synthesized
agaaaagcaactaggaagga

SEQ ID NO: 537783 - DNA, 20 bp, Artificial Sequence
  chemically synthesized
taaatggcctttttttgagt

SEQ ID NO: 537784 - DNA, 20 bp, Artificial Sequence
  chemically synthesized
tggcctttttttgagtaaag

SEQ ID NO: 537785 - DNA, 20 bp, Artificial Sequence
  chemically synthesized
agaatgaaagttataggagg

SEQ ID NO: 537786 - DNA, 20 bp, Artificial Sequence
  chemically synthesized
gaatcaaggtcaaggagagc

SEQ ID NO: 537787 - DNA, 20 bp, Artificial Sequence
  chemically synthesized
agagctcagaatgagaagga

SEQ ID NO: 537788 - DNA, 20 bp, Artificial Sequence
  chemically synthesized
ttaacagtatcgtcaaggaa

SEQ ID NO: 537789 - DNA, 20 bp, Artificial Sequence
  chemically synthesized
ctaggcctcttaaaagtcct

SEQ ID NO: 537790 - DNA, 20 bp, Artificial Sequence
  chemically synthesized
gctgtaaagtccaaaacata

SEQ ID NO: 537791 - DNA, 20 bp, Artificial Sequence
  chemically synthesized
tgagggctttcttctcttga

SEQ ID NO: 537792 - DNA, 20 bp, Artificial Sequence
  chemically synthesized
gatgtattttctgttcaaga

SEQ ID NO: 537793 - DNA, 20 bp, Artificial Sequence
  chemically synthesized
gaaacaatggtagattggat

SEQ ID NO: 537794 - DNA, 20 bp, Artificial Sequence
  chemically synthesized
gaaatactacatagtcataa

SEQ ID NO: 537795 - DNA, 20 bp, Artificial Sequence
  chemically synthesized
gcagtctttacaatgaacga

SEQ ID NO: 537796 - DNA, 20 bp, Artificial Sequence
  chemically synthesized
tgaaaaaaaaaaagataaca

SEQ ID NO: 537797 - DNA, 20 bp, Artificial Sequence
  chemically synthesized
tcctgataatggttgctata

SEQ ID NO: 537798 - DNA, 20 bp, Artificial Sequence
  chemically synthesized
tggttgctataaaagaataa

SEQ ID NO: 537799 - DNA, 20 bp, Artificial Sequence
  chemically synthesized
aatgagaattccttctaaaa

SEQ ID NO: 537800 - DNA, 20 bp, Artificial Sequence
  chemically synthesized
ggttgtttttctttctcttc

SEQ ID NO: 537801 - DNA, 20 bp, Artificial Sequence
  chemically synthesized
ggcagcatttcttggaagag

SEQ ID NO: 537802 - DNA, 20 bp, Artificial Sequence
  chemically synthesized
ccagggcagcatttcttgga

SEQ ID NO: 537803 - DNA, 20 bp, Artificial Sequence
  chemically synthesized
gaaatgctgccctgggccaa

SEQ ID NO: 537804 - DNA, 20 bp, Artificial Sequence
  chemically synthesized
ccaccaattcaaatgccttt

SEQ ID NO: 537805 - DNA, 20 bp, Artificial Sequence
  chemically synthesized
gaattggtggctcttgtttt

SEQ ID NO: 537806 - DNA, 20 bp, Artificial Sequence
  chemically synthesized
tcatgagaacttcaggacaa

SEQ ID NO: 537807 - DNA, 20 bp, Artificial Sequence
  chemically synthesized
ttgcaaatctaagtaaatgg

SEQ ID NO: 537808 - DNA, 20 bp, Artificial Sequence
  chemically synthesized
ctccatttacttagatttgc

SEQ ID NO: 537809 - DNA, 20 bp, Artificial Sequence
  chemically synthesized
ctataaccaggatcacttaa

SEQ ID NO: 537810 - DNA, 20 bp, Artificial Sequence
  chemically synthesized
gcatgctagtaatcatgtag

SEQ ID NO: 537811 - DNA, 20 bp, Artificial Sequence
  chemically synthesized
agaggcatgctagtaatcat

SEQ ID NO: 537812 - DNA, 20 bp, Artificial Sequence
  chemically synthesized
acctctagagagaagagaaa

SEQ ID NO: 537813 - DNA, 20 bp, Artificial Sequence
  chemically synthesized
tgataatacctctagagaga

SEQ ID NO: 537814 - DNA, 20 bp, Artificial Sequence
  chemically synthesized
tacaatatgtatgtgtgcat

SEQ ID NO: 537815 - DNA, 20 bp, Artificial Sequence
  chemically synthesized
caatccattcatcctccagc

SEQ ID NO: 537816 - DNA, 20 bp, Artificial Sequence
  chemically synthesized
ggattgaggaggagtcagtg

SEQ ID NO: 537817 - DNA, 20 bp, Artificial Sequence
  chemically synthesized
caggacttaatgcattggag

SEQ ID NO: 537818 - DNA, 20 bp, Artificial Sequence
  chemically synthesized
attgctagctttgagtttgc

SEQ ID NO: 537819 - DNA, 20 bp, Artificial Sequence
  chemically synthesized
aatatcataattagcataat

SEQ ID NO: 537820 - DNA, 20 bp, Artificial Sequence
  chemically synthesized
gtatgattccccacaaattt

SEQ ID NO: 537821 - DNA, 20 bp, Artificial Sequence
  chemically synthesized
tccccacaaatttgaagaaa

SEQ ID NO: 537822 - DNA, 20 bp, Artificial Sequence
  chemically synthesized
ggtgatttcaaaatatgttt

SEQ ID NO: 537823 - DNA, 20 bp, Artificial Sequence
  chemically synthesized
aagtgttgtgctttaagaga

SEQ ID NO: 537824 - DNA, 20 bp, Artificial Sequence
  chemically synthesized
acacttctattctgtgttca

SEQ ID NO: 537825 - DNA, 20 bp, Artificial Sequence
  chemically synthesized
cccatggaattcttgtgaac

SEQ ID NO: 537826 - DNA, 20 bp, Artificial Sequence
  chemically synthesized
cattaagttgagagtgttga

SEQ ID NO: 537827 - DNA, 20 bp, Artificial Sequence
  chemically synthesized
ctcaacttaatggggacacc

SEQ ID NO: 537828 - DNA, 20 bp, Artificial Sequence
  chemically synthesized
atttggcgaaatggtaagga

SEQ ID NO: 537829 - DNA, 20 bp, Artificial Sequence
  chemically synthesized
tgctcagcttaataattgct

SEQ ID NO: 537830 - DNA, 20 bp, Artificial Sequence
  chemically synthesized
aatatttgttgataaattga

SEQ ID NO: 537831 - DNA, 20 bp, Artificial Sequence
  chemically synthesized
acttttgaccctttccagaa

SEQ ID NO: 537832 - DNA, 20 bp, Artificial Sequence
  chemically synthesized
aaagttacttttgacccttt

SEQ ID NO: 537833 - DNA, 20 bp, Artificial Sequence
  chemically synthesized
gctgtcgtttctcaggctct

SEQ ID NO: 537834 - DNA, 20 bp, Artificial Sequence
  chemically synthesized
ccttcccattctcaagagcc

SEQ ID NO: 537835 - DNA, 20 bp, Artificial Sequence
  chemically synthesized
gctcttgagaatgggaaggc

SEQ ID NO: 537836 - DNA, 20 bp, Artificial Sequence
  chemically synthesized
acagataatgagttggaaaa

SEQ ID NO: 537837 - DNA, 20 bp, Artificial Sequence
  chemically synthesized
aaatcaaaaaaaaaaaaaaa

SEQ ID NO: 537838 - DNA, 20 bp, Artificial Sequence
  chemically synthesized
tagatattcacatgaataat

SEQ ID NO: 537839 - DNA, 20 bp, Artificial Sequence
  chemically synthesized
cttcatacaagctaaattga

SEQ ID NO: 537840 - DNA, 20 bp, Artificial Sequence
  chemically synthesized
cgttcctagagagaaaaaaa

SEQ ID NO: 537841 - DNA, 20 bp, Artificial Sequence
  chemically synthesized
taagaaggaagcgttcctag

SEQ ID NO: 537842 - DNA, 20 bp, Artificial Sequence
  chemically synthesized
aataaataatgtaatgaata

SEQ ID NO: 537843 - DNA, 20 bp, Artificial Sequence
  chemically synthesized
taacaattaggatcagtaaa

SEQ ID NO: 537844 - DNA, 20 bp, Artificial Sequence
  chemically synthesized
gattaatctggaaagattgt

SEQ ID NO: 537845 - DNA, 20 bp, Artificial Sequence
  chemically synthesized
aattgcactgaagcatggat

SEQ ID NO: 537846 - DNA, 20 bp, Artificial Sequence
  chemically synthesized
tggagaatagtcaaaggtct

SEQ ID NO: 537847 - DNA, 20 bp, Artificial Sequence
  chemically synthesized
agacacacatgatggaggat

SEQ ID NO: 537848 - DNA, 20 bp, Artificial Sequence
  chemically synthesized
cacgttactaggcactagag

SEQ ID NO: 537849 - DNA, 20 bp, Artificial Sequence
  chemically synthesized
actgcactcaaacttgcatg

SEQ ID NO: 537850 - DNA, 20 bp, Artificial Sequence
  chemically synthesized
agtttcaccacataccagta

SEQ ID NO: 537851 - DNA, 20 bp, Artificial Sequence
  chemically synthesized
tactggtatgtggtgaaact

SEQ ID NO: 537852 - DNA, 20 bp, Artificial Sequence
  chemically synthesized
cagaatttttatgcacgttg

SEQ ID NO: 537853 - DNA, 20 bp, Artificial Sequence
  chemically synthesized
aggtatttaaaagtacagaa

SEQ ID NO: 537854 - DNA, 20 bp, Artificial Sequence
  chemically synthesized
cctagtaggtatttaaaagt

SEQ ID NO: 537855 - DNA, 20 bp, Artificial Sequence
  chemically synthesized
tactttatctgaagagtcta

SEQ ID NO: 537856 - DNA, 20 bp, Artificial Sequence
  chemically synthesized
agactcttcagataaagtaa

SEQ ID NO: 537857 - DNA, 20 bp, Artificial Sequence
  chemically synthesized
cttcagataaagtaaaaaga

SEQ ID NO: 537858 - DNA, 20 bp, Artificial Sequence
  chemically synthesized
attttaatttttgctatctt

SEQ ID NO: 537859 - DNA, 20 bp, Artificial Sequence
  chemically synthesized
tgcaaaatggcacaaccact

SEQ ID NO: 537860 - DNA, 20 bp, Artificial Sequence
  chemically synthesized
cacctgaatgtccatcaaaa

SEQ ID NO: 537861 - DNA, 20 bp, Artificial Sequence
  chemically synthesized
aattgtggtatatctataca

SEQ ID NO: 537862 - DNA, 20 bp, Artificial Sequence
  chemically synthesized
atctatggtgatataaatca

SEQ ID NO: 537863 - DNA, 20 bp, Artificial Sequence
  chemically synthesized
aaataaaaatttccattacc

SEQ ID NO: 537864 - DNA, 20 bp, Artificial Sequence
  chemically synthesized
taagttactgtcacacccag

SEQ ID NO: 537865 - DNA, 20 bp, Artificial Sequence
  chemically synthesized
cgtggaaaatatattagatg

SEQ ID NO: 537866 - DNA, 20 bp, Artificial Sequence
  chemically synthesized
atataaaattttacctcaat

SEQ ID NO: 537867 - DNA, 20 bp, Artificial Sequence
  chemically synthesized
tgtactgtgtgaagtaagag

SEQ ID NO: 537868 - DNA, 20 bp, Artificial Sequence
  chemically synthesized
acatatggacccttcttatg

SEQ ID NO: 537869 - DNA, 20 bp, Artificial Sequence
  chemically synthesized
caaacctcagtcatttgcag

SEQ ID NO: 537870 - DNA, 20 bp, Artificial Sequence
  chemically synthesized
ttcaacgatcttgaatttca

SEQ ID NO: 537871 - DNA, 20 bp, Artificial Sequence
  chemically synthesized
aatttcaagagaaaatggct

SEQ ID NO: 537872 - DNA, 20 bp, Artificial Sequence
  chemically synthesized
agaaagcctgtaaaagctct

SEQ ID NO: 537873 - DNA, 20 bp, Artificial Sequence
  chemically synthesized
cttcccatgttcatactcta

SEQ ID NO: 537874 - DNA, 20 bp, Artificial Sequence
  chemically synthesized
ctaatagagtatgaacatgg

SEQ ID NO: 537875 - DNA, 20 bp, Artificial Sequence
  chemically synthesized
tccatttggaggaagaagaa

SEQ ID NO: 537876 - DNA, 20 bp, Artificial Sequence
  chemically synthesized
aggttagggatagagacgac

SEQ ID NO: 537877 - DNA, 20 bp, Artificial Sequence
  chemically synthesized
ttgcttgtctgctctgtcaa

SEQ ID NO: 537878 - DNA, 20 bp, Artificial Sequence
  chemically synthesized
gcgcaagttctctcatttcc

SEQ ID NO: 537879 - DNA, 20 bp, Artificial Sequence
  chemically synthesized
tttgctccttgttccatcat

SEQ ID NO: 537880 - DNA, 20 bp, Artificial Sequence
  chemically synthesized
agaagtggtttttaagttgt

SEQ ID NO: 537881 - DNA, 20 bp, Artificial Sequence
  chemically synthesized
tttatatggttatttcattt

SEQ ID NO: 537882 - DNA, 20 bp, Artificial Sequence
  chemically synthesized
tttcctcttgttctgttctt

SEQ ID NO: 537883 - DNA, 20 bp, Artificial Sequence
  chemically synthesized
gatttagactgtatcaatat

SEQ ID NO: 537884 - DNA, 20 bp, Artificial Sequence
  chemically synthesized
aaagtgatagaagaaaacca

SEQ ID NO: 537885 - DNA, 20 bp, Artificial Sequence
  chemically synthesized
aaaatccactaaaagtgata

SEQ ID NO: 537886 - DNA, 20 bp, Artificial Sequence
  chemically synthesized
gaagagacatacgtttatga

SEQ ID NO: 537887 - DNA, 20 bp, Artificial Sequence
  chemically synthesized
tcactcttgaataaaaaaat

SEQ ID NO: 537888 - DNA, 20 bp, Artificial Sequence
  chemically synthesized
gatttttttattcaagagtg

SEQ ID NO: 537889 - DNA, 20 bp, Artificial Sequence
  chemically synthesized
gctgaataatgttacttgag

SEQ ID NO: 537890 - DNA, 20 bp, Artificial Sequence
  chemically synthesized
aggagctgaataatgttact

SEQ ID NO: 537891 - DNA, 20 bp, Artificial Sequence
  chemically synthesized
aatttattcaaaactagtat

SEQ ID NO: 537892 - DNA, 20 bp, Artificial Sequence
  chemically synthesized
gtctaccatgaactatctag

SEQ ID NO: 537893 - DNA, 20 bp, Artificial Sequence
  chemically synthesized
actactgaaatcaggaaagc

SEQ ID NO: 537894 - DNA, 20 bp, Artificial Sequence
  chemically synthesized
ctctaattttgttctgacat

SEQ ID NO: 537895 - DNA, 20 bp, Artificial Sequence
  chemically synthesized
aaaagtaagtatatatggaa

SEQ ID NO: 537896 - DNA, 20 bp, Artificial Sequence
  chemically synthesized
aaatatctaaactgcttaaa

SEQ ID NO: 537897 - DNA, 20 bp, Artificial Sequence
  chemically synthesized
tagctatgtattgcacattt

SEQ ID NO: 537898 - DNA, 20 bp, Artificial Sequence
  chemically synthesized
atatcacactgtcaatgtga

SEQ ID NO: 537899 - DNA, 20 bp, Artificial Sequence
  chemically synthesized
tgttttaacagaagatcatg

SEQ ID NO: 537900 - DNA, 20 bp, Artificial Sequence
  chemically synthesized
caaggaaaggcagttaccat

SEQ ID NO: 537901 - DNA, 20 bp, Artificial Sequence
  chemically synthesized
gacatcactaatactatgcc

SEQ ID NO: 537902 - DNA, 20 bp, Artificial Sequence
  chemically synthesized
gatccacgtgaagtatgagg

SEQ ID NO: 537903 - DNA, 20 bp, Artificial Sequence
  chemically synthesized
ttaatatctaagtatttgag

SEQ ID NO: 537904 - DNA, 20 bp, Artificial Sequence
  chemically synthesized
atatatgcgagacatgaaaa

SEQ ID NO: 537905 - DNA, 20 bp, Artificial Sequence
  chemically synthesized
cataattatagatgtttttg

SEQ ID NO: 537906 - DNA, 20 bp, Artificial Sequence
  chemically synthesized
aataaacaatgtggatcaaa

SEQ ID NO: 537907 - DNA, 20 bp, Artificial Sequence
  chemically synthesized
caatgtggatcaaaaaagaa

SEQ ID NO: 537908 - DNA, 20 bp, Artificial Sequence
  chemically synthesized
aaagaatgagaaatatcaac

SEQ ID NO: 537909 - DNA, 20 bp, Artificial Sequence
  chemically synthesized
gtttttgtaaagctgctata

SEQ ID NO: 537910 - DNA, 20 bp, Artificial Sequence
  chemically synthesized
ttacccattaaatacattat

SEQ ID NO: 537911 - DNA, 20 bp, Artificial Sequence
  chemically synthesized
ccttcgtgtatcaaaagaaa

SEQ ID NO: 537912 - DNA, 20 bp, Artificial Sequence
  chemically synthesized
tcattcaccttcgtgtatca

SEQ ID NO: 537913 - DNA, 20 bp, Artificial Sequence
  chemically synthesized
aattttcattaagttcaaca

SEQ ID NO: 537914 - DNA, 20 bp, Artificial Sequence
  chemically synthesized
atctatttgattgatagtgg

SEQ ID NO: 537915 - DNA, 20 bp, Artificial Sequence
  chemically synthesized
atttgtttggacaacaaaca

SEQ ID NO: 537916 - DNA, 20 bp, Artificial Sequence
  chemically synthesized
taaataatatgagccaatct

SEQ ID NO: 537917 - DNA, 20 bp, Artificial Sequence
  chemically synthesized
aatcacaatgtatgccatac

SEQ ID NO: 537918 - DNA, 20 bp, Artificial Sequence
  chemically synthesized
catacaaagaaatgatatgg

SEQ ID NO: 537919 - DNA, 20 bp, Artificial Sequence
  chemically synthesized
actctattttgaagatcacc

SEQ ID NO: 537920 - DNA, 20 bp, Artificial Sequence
  chemically synthesized
ttttgaagatcaccatagaa

SEQ ID NO: 537921 - DNA, 20 bp, Artificial Sequence
  chemically synthesized
atagaattagaaacaatgta

SEQ ID NO: 537922 - DNA, 20 bp, Artificial Sequence
  chemically synthesized
aactataatttctttcaaaa

SEQ ID NO: 537923 - DNA, 20 bp, Artificial Sequence
  chemically synthesized
gtttatgaattctctttttg

SEQ ID NO: 537924 - DNA, 20 bp, Artificial Sequence
  chemically synthesized
caaaaagagaattcataaac

SEQ ID NO: 537925 - DNA, 20 bp, Artificial Sequence
  chemically synthesized
agaagaaccacttataaaca

SEQ ID NO: 537926 - DNA, 20 bp, Artificial Sequence
  chemically synthesized
ctgcttttcataactgagag

SEQ ID NO: 537927 - DNA, 20 bp, Artificial Sequence
  chemically synthesized
cttgccaattttaacaatat

SEQ ID NO: 537928 - DNA, 20 bp, Artificial Sequence
  chemically synthesized
agaaacatatgccccactct

SEQ ID NO: 537929 - DNA, 20 bp, Artificial Sequence
  chemically synthesized
ccagaataaatagctgtgta

SEQ ID NO: 537930 - DNA, 20 bp, Artificial Sequence
  chemically synthesized
atattgtggtaatagggaca

SEQ ID NO: 537931 - DNA, 20 bp, Artificial Sequence
  chemically synthesized
aaatcacgggatgctttcac

SEQ ID NO: 537932 - DNA, 20 bp, Artificial Sequence
  chemically synthesized
atgctttcacagagaataat

SEQ ID NO: 537933 - DNA, 20 bp, Artificial Sequence
  chemically synthesized
cgggagatgcacaaagaaga

SEQ ID NO: 537934 - DNA, 20 bp, Artificial Sequence
  chemically synthesized
aattaactacttatccagat

SEQ ID NO: 537935 - DNA, 20 bp, Artificial Sequence
  chemically synthesized
gcctggatataaagaagctg

SEQ ID NO: 537936 - DNA, 20 bp, Artificial Sequence
  chemically synthesized
ataaagaagctgaaagaaaa

SEQ ID NO: 537937 - DNA, 20 bp, Artificial Sequence
  chemically synthesized
agtcccaatgcccaataatg

SEQ ID NO: 537938 - DNA, 20 bp, Artificial Sequence
  chemically synthesized
attttattgatgtttaataa

SEQ ID NO: 537939 - DNA, 20 bp, Artificial Sequence
  chemically synthesized
cttgctaatgggacagaact

SEQ ID NO: 537940 - DNA, 20 bp, Artificial Sequence
  chemically synthesized
cattaagaaggcaacctatg

SEQ ID NO: 537941 - DNA, 20 bp, Artificial Sequence
  chemically synthesized
tgacagagcgagactctgtc

SEQ ID NO: 537942 - DNA, 20 bp, Artificial Sequence
  chemically synthesized
ctactcgggaggctgaggca

SEQ ID NO: 537943 - DNA, 20 bp, Artificial Sequence
  chemically synthesized
tatactttttaaagctcagt

SEQ ID NO: 537944 - DNA, 20 bp, Artificial Sequence
  chemically synthesized
tcctatatgcatgttcacat

SEQ ID NO: 537945 - DNA, 20 bp, Artificial Sequence
  chemically synthesized
tctgaatcctggtaactatg

SEQ ID NO: 537946 - DNA, 20 bp, Artificial Sequence
  chemically synthesized
gataaatatagataatcgag

SEQ ID NO: 537947 - DNA, 20 bp, Artificial Sequence
  chemically synthesized
aacaattcagtagtgatttt

SEQ ID NO: 537948 - DNA, 20 bp, Artificial Sequence
  chemically synthesized
agacctttacttgatcaaat

SEQ ID NO: 537949 - DNA, 20 bp, Artificial Sequence
  chemically synthesized
acatttaccatttatttggg

SEQ ID NO: 537950 - DNA, 20 bp, Artificial Sequence
  chemically synthesized
acaaagtcacgattagaaag

SEQ ID NO: 537951 - DNA, 20 bp, Artificial Sequence
  chemically synthesized
caatgggtacaaagtcacga

SEQ ID NO: 537952 - DNA, 20 bp, Artificial Sequence
  chemically synthesized
tgggggaagtaggggaaaag

SEQ ID NO: 537953 - DNA, 20 bp, Artificial Sequence
  chemically synthesized
gtaaatggacggtggtcacc

SEQ ID NO: 537954 - DNA, 20 bp, Artificial Sequence
  chemically synthesized
ttgtattaactaagccaaac

SEQ ID NO: 537955 - DNA, 20 bp, Artificial Sequence
  chemically synthesized
gagatatcatctcattccag

SEQ ID NO: 537956 - DNA, 20 bp, Artificial Sequence
  chemically synthesized
caaaagataaaaagtgttgg

SEQ ID NO: 537957 - DNA, 20 bp, Artificial Sequence
  chemically synthesized
aaaagtgttggcaagaatat

SEQ ID NO: 537958 - DNA, 20 bp, Artificial Sequence
  chemically synthesized
ttattcacaatagccaagat

SEQ ID NO: 537959 - DNA, 20 bp, Artificial Sequence
  chemically synthesized
gtgtttaataatggatgaat

SEQ ID NO: 537960 - DNA, 20 bp, Artificial Sequence
  chemically synthesized
ggatattattgagtcatata

SEQ ID NO: 537961 - DNA, 20 bp, Artificial Sequence
  chemically synthesized
ggtttaggatattagcttga

SEQ ID NO: 537962 - DNA, 20 bp, Artificial Sequence
  chemically synthesized
aatatttaaaaagtgactca

SEQ ID NO: 537963 - DNA, 20 bp, Artificial Sequence
  chemically synthesized
ctacttgggaggctgaggca

SEQ ID NO: 537964 - DNA, 20 bp, Artificial Sequence
  chemically synthesized
aaaaaaaaaaaaaaaaagga

SEQ ID NO: 537965 - DNA, 20 bp, Artificial Sequence
  chemically synthesized
ctatttaaaaatagcaacac

SEQ ID NO: 537966 - DNA, 20 bp, Artificial Sequence
  chemically synthesized
tgaaagtcacaattaaaaag

SEQ ID NO: 537967 - DNA, 20 bp, Artificial Sequence
  chemically synthesized
aagagtaaccagtgatattt

SEQ ID NO: 537968 - DNA, 20 bp, Artificial Sequence
  chemically synthesized
agagagagagagagacagag

SEQ ID NO: 537969 - DNA, 20 bp, Artificial Sequence
  chemically synthesized
gagtccaaaggcatgagaac

SEQ ID NO: 537970 - DNA, 20 bp, Artificial Sequence
  chemically synthesized
tgattcaaatgtgaatctct

SEQ ID NO: 537971 - DNA, 20 bp, Artificial Sequence
  chemically synthesized
aaacagcctcataaacacac

SEQ ID NO: 537972 - DNA, 20 bp, Artificial Sequence
  chemically synthesized
gacacatgaaattaaccatc

SEQ ID NO: 537973 - DNA, 20 bp, Artificial Sequence
  chemically synthesized
aaaggaaaaaacacatcagg

SEQ ID NO: 537974 - DNA, 20 bp, Artificial Sequence
  chemically synthesized
aaaggctagatttcttcagg

SEQ ID NO: 537975 - DNA, 20 bp, Artificial Sequence
  chemically synthesized
tacggcagaatttctgacct

SEQ ID NO: 537976 - DNA, 20 bp, Artificial Sequence
  chemically synthesized
ttcttcatgcattgaatacg

SEQ ID NO: 537977 - DNA, 20 bp, Artificial Sequence
  chemically synthesized
ttctgccgtattcaatgcat

SEQ ID NO: 537978 - DNA, 20 bp, Artificial Sequence
  chemically synthesized
aaggttttgatttacaagcg

SEQ ID NO: 537979 - DNA, 20 bp, Artificial Sequence
  chemically synthesized
actcaacttggctgccacaa

SEQ ID NO: 537980 - DNA, 20 bp, Artificial Sequence
  chemically synthesized
aagttgagtggggaaaaaca

SEQ ID NO: 537981 - DNA, 20 bp, Artificial Sequence
  chemically synthesized
aaagagaggatttttgcaac

SEQ ID NO: 537982 - DNA, 20 bp, Artificial Sequence
  chemically synthesized
ctaaaattttattttaaaaa

SEQ ID NO: 537983 - DNA, 20 bp, Artificial Sequence
  chemically synthesized
ttaatcttaggggaacattc

SEQ ID NO: 537984 - DNA, 20 bp, Artificial Sequence
  chemically synthesized
tttcatcattgagaatgcgt

SEQ ID NO: 537985 - DNA, 20 bp, Artificial Sequence
  chemically synthesized
gtcaacatgattttcatcat

SEQ ID NO: 537986 - DNA, 20 bp, Artificial Sequence
  chemically synthesized
gaagcgatgaaaatatactg

SEQ ID NO: 537987 - DNA, 20 bp, Artificial Sequence
  chemically synthesized
ataaaaacagacatacttta

SEQ ID NO: 537988 - DNA, 20 bp, Artificial Sequence
  chemically synthesized
agtagtaggaaagtgtgtgc

SEQ ID NO: 537989 - DNA, 20 bp, Artificial Sequence
  chemically synthesized
acaataatgtacagtgacaa

SEQ ID NO: 537990 - DNA, 20 bp, Artificial Sequence
  chemically synthesized
ctaagtttgttggcatttca

SEQ ID NO: 537991 - DNA, 20 bp, Artificial Sequence
  chemically synthesized
gttaacttgagctgtgatta

SEQ ID NO: 537992 - DNA, 20 bp, Artificial Sequence
  chemically synthesized
cctcacggagtgttaaccta

SEQ ID NO: 537993 - DNA, 20 bp, Artificial Sequence
  chemically synthesized
tgacaaacaaaaggtctaca

SEQ ID NO: 537994 - DNA, 20 bp, Artificial Sequence
  chemically synthesized
gacatggttgatgagatgta

SEQ ID NO: 537995 - DNA, 20 bp, Artificial Sequence
  chemically synthesized
acaaatggaaaggaaagcag

SEQ ID NO: 537996 - DNA, 20 bp, Artificial Sequence
  chemically synthesized
gtcatgtccaggtagtaggg

SEQ ID NO: 537997 - DNA, 20 bp, Artificial Sequence
  chemically synthesized
aaacaaaggtgaggtcagag

SEQ ID NO: 537998 - DNA, 20 bp, Artificial Sequence
  chemically synthesized
aggtgaggtcagagtgagaa

SEQ ID NO: 537999 - DNA, 20 bp, Artificial Sequence
  chemically synthesized
tgggcattccttaaatagct

SEQ ID NO: 538000 - DNA, 20 bp, Artificial Sequence
  chemically synthesized
ggcaacataaaataaacaac

SEQ ID NO: 538001 - DNA, 20 bp, Artificial Sequence
  chemically synthesized
gatgcatgatacaaggtgat

SEQ ID NO: 538002 - DNA, 20 bp, Artificial Sequence
  chemically synthesized
ggtaagacgtgtggatagct

SEQ ID NO: 538003 - DNA, 20 bp, Artificial Sequence
  chemically synthesized
ttgtgtagctagtttttctt

SEQ ID NO: 538004 - DNA, 20 bp, Artificial Sequence
  chemically synthesized
ggataagccagtttattctt

SEQ ID NO: 538005 - DNA, 20 bp, Artificial Sequence
  chemically synthesized
agacatttaatgttaggaag

SEQ ID NO: 538006 - DNA, 20 bp, Artificial Sequence
  chemically synthesized
gccaatgatgagggataact

SEQ ID NO: 538007 - DNA, 20 bp, Artificial Sequence
  chemically synthesized
ggaggaggagaggagtgagc

SEQ ID NO: 538008 - DNA, 20 bp, Artificial Sequence
  chemically synthesized
aaaatatcaagtgcaaaatt

SEQ ID NO: 538009 - DNA, 20 bp, Artificial Sequence
  chemically synthesized
ggatataaatgaaaatgaaa

SEQ ID NO: 538010 - DNA, 20 bp, Artificial Sequence
  chemically synthesized
agatttatttttaccttggt

SEQ ID NO: 538011 - DNA, 20 bp, Artificial Sequence
  chemically synthesized
agccaatctcttgggagagt

SEQ ID NO: 538012 - DNA, 20 bp, Artificial Sequence
  chemically synthesized
taattaaatgtgtcgtagag

SEQ ID NO: 538013 - DNA, 20 bp, Artificial Sequence
  chemically synthesized
aagatggtaattaagatttg

SEQ ID NO: 538014 - DNA, 20 bp, Artificial Sequence
  chemically synthesized
agcatactgataagattttc

SEQ ID NO: 538015 - DNA, 20 bp, Artificial Sequence
  chemically synthesized
tttaggtcccttatcatagg

SEQ ID NO: 538016 - DNA, 20 bp, Artificial Sequence
  chemically synthesized
caacaagcaacaatgttctt

SEQ ID NO: 538017 - DNA, 20 bp, Artificial Sequence
  chemically synthesized
atacagtctcaaaaggccac

SEQ ID NO: 538018 - DNA, 20 bp, Artificial Sequence
  chemically synthesized
gagactgtattatgtgaaat

SEQ ID NO: 538019 - DNA, 20 bp, Artificial Sequence
  chemically synthesized
gtgaaatgaagaatttacaa

SEQ ID NO: 538020 - DNA, 20 bp, Artificial Sequence
  chemically synthesized
ttacagattcacatgaaaaa

SEQ ID NO: 538021 - DNA, 20 bp, Artificial Sequence
  chemically synthesized
acaaaaaatgtagcaaataa

SEQ ID NO: 538022 - DNA, 20 bp, Artificial Sequence
  chemically synthesized
aaacagaatctgggactaaa

SEQ ID NO: 538023 - DNA, 20 bp, Artificial Sequence
  chemically synthesized
cacgggctggaagagtttgt

SEQ ID NO: 538024 - DNA, 20 bp, Artificial Sequence
  chemically synthesized
acaagactccataaactaaa

SEQ ID NO: 538025 - DNA, 20 bp, Artificial Sequence
  chemically synthesized
acataagttggtaggacagg

SEQ ID NO: 538026 - DNA, 20 bp, Artificial Sequence
  chemically synthesized
caaagcatggggctgctccc

SEQ ID NO: 538027 - DNA, 20 bp, Artificial Sequence
  chemically synthesized
cccagtgacacagactaact

SEQ ID NO: 538028 - DNA, 20 bp, Artificial Sequence
  chemically synthesized
tgcaatgaagagatcaacag

SEQ ID NO: 538029 - DNA, 20 bp, Artificial Sequence
  chemically synthesized
tggttctcaaagtgaacgcg

SEQ ID NO: 538030 - DNA, 20 bp, Artificial Sequence
  chemically synthesized
aagtgaacgcgaaagaaact

SEQ ID NO: 538031 - DNA, 20 bp, Artificial Sequence
  chemically synthesized
aaacaactatttggagcttt

SEQ ID NO: 538032 - DNA, 20 bp, Artificial Sequence
  chemically synthesized
aagcacacagatacacacag

SEQ ID NO: 538033 - DNA, 20 bp, Artificial Sequence
  chemically synthesized
aaaggtaataagtgctcatt

SEQ ID NO: 538034 - DNA, 20 bp, Artificial Sequence
  chemically synthesized
agcacttattacctttataa

SEQ ID NO: 538035 - DNA, 20 bp, Artificial Sequence
  chemically synthesized
attacctttataataagaaa

SEQ ID NO: 538036 - DNA, 20 bp, Artificial Sequence
  chemically synthesized
tagaggctttcactggctaa

SEQ ID NO: 538037 - DNA, 20 bp, Artificial Sequence
  chemically synthesized
ctcctccctttccattcaac

SEQ ID NO: 538038 - DNA, 20 bp, Artificial Sequence
  chemically synthesized
gggagaggggaataagcaag

SEQ ID NO: 538039 - DNA, 20 bp, Artificial Sequence
  chemically synthesized
acatgttaattgatgataat

SEQ ID NO: 538040 - DNA, 20 bp, Artificial Sequence
  chemically synthesized
tgtgtggtggtgctcacaaa

SEQ ID NO: 538041 - DNA, 20 bp, Artificial Sequence
  chemically synthesized
cattaatggtatagggagaa

SEQ ID NO: 538042 - DNA, 20 bp, Artificial Sequence
  chemically synthesized
gggtgtcattaatggtatag

SEQ ID NO: 538043 - DNA, 20 bp, Artificial Sequence
  chemically synthesized
gcaaaggaaatgcagacatg

SEQ ID NO: 538044 - DNA, 20 bp, Artificial Sequence
  chemically synthesized
catgtctgcatttcctttgc

SEQ ID NO: 538045 - DNA, 20 bp, Artificial Sequence
  chemically synthesized
catttcctttgctgagaaat

SEQ ID NO: 538046 - DNA, 20 bp, Artificial Sequence
  chemically synthesized
gggacaacacataggcatgg

SEQ ID NO: 538047 - DNA, 20 bp, Artificial Sequence
  chemically synthesized
catggagagaaattggaaaa

SEQ ID NO: 538048 - DNA, 20 bp, Artificial Sequence
  chemically synthesized
aaaaaagaaaataacgtgaa

SEQ ID NO: 538049 - DNA, 20 bp, Artificial Sequence
  chemically synthesized
cattagcactaatactattg

SEQ ID NO: 538050 - DNA, 20 bp, Artificial Sequence
  chemically synthesized
attcactatgattaccctga

SEQ ID NO: 538051 - DNA, 20 bp, Artificial Sequence
  chemically synthesized
ttcgaaaggcaaactattac

SEQ ID NO: 538052 - DNA, 20 bp, Artificial Sequence
  chemically synthesized
gtcagaaccaagatcaacaa

SEQ ID NO: 538053 - DNA, 20 bp, Artificial Sequence
  chemically synthesized
ttggatcattatatgggcaa

SEQ ID NO: 538054 - DNA, 20 bp, Artificial Sequence
  chemically synthesized
gcctgaactgggtgaaccct

SEQ ID NO: 538055 - DNA, 20 bp, Artificial Sequence
  chemically synthesized
gattcttgccaatgcaggca

SEQ ID NO: 538056 - DNA, 20 bp, Artificial Sequence
  chemically synthesized
aattctgctgcctgcattgg

SEQ ID NO: 538057 - DNA, 20 bp, Artificial Sequence
  chemically synthesized
aaggcaacctaggtggcaca

SEQ ID NO: 538058 - DNA, 20 bp, Artificial Sequence
  chemically synthesized
gatttttctggtgcgagacc

SEQ ID NO: 538059 - DNA, 20 bp, Artificial Sequence
  chemically synthesized
tcctattctcaggtctcgca

SEQ ID NO: 538060 - DNA, 20 bp, Artificial Sequence
  chemically synthesized
ctcgcaccagaaaaatcaaa

SEQ ID NO: 538061 - DNA, 20 bp, Artificial Sequence
  chemically synthesized
gagatgcctagttcccacct

SEQ ID NO: 538062 - DNA, 20 bp, Artificial Sequence
  chemically synthesized
aggcctaaagttatatattt

SEQ ID NO: 538063 - DNA, 20 bp, Artificial Sequence
  chemically synthesized
tacgtgcacaaatctttatt

SEQ ID NO: 538064 - DNA, 20 bp, Artificial Sequence
  chemically synthesized
taatcatcacattaagttgc

SEQ ID NO: 538065 - DNA, 20 bp, Artificial Sequence
  chemically synthesized
aggcgactgcttttaaatag

SEQ ID NO: 538066 - DNA, 20 bp, Artificial Sequence
  chemically synthesized
attttcattattaaaagcag

SEQ ID NO: 538067 - DNA, 20 bp, Artificial Sequence
  chemically synthesized
tccctaaaaaggatttcctg

SEQ ID NO: 538068 - DNA, 20 bp, Artificial Sequence
  chemically synthesized
tcataagagcgtatgggagt

SEQ ID NO: 538069 - DNA, 20 bp, Artificial Sequence
  chemically synthesized
taaagtgctttaagctcttt

SEQ ID NO: 538070 - DNA, 20 bp, Artificial Sequence
  chemically synthesized
tatcacattaaaataaagag

SEQ ID NO: 538071 - DNA, 20 bp, Artificial Sequence
  chemically synthesized
atacttgaaatccaaagggt

SEQ ID NO: 538072 - DNA, 20 bp, Artificial Sequence
  chemically synthesized
attccagatgctctggcatt

SEQ ID NO: 538073 - DNA, 20 bp, Artificial Sequence
  chemically synthesized
agttaattttaatattatct

SEQ ID NO: 538074 - DNA, 20 bp, Artificial Sequence
  chemically synthesized
gcctgttaatacgttctggt

SEQ ID NO: 538075 - DNA, 20 bp, Artificial Sequence
  chemically synthesized
aggatgggagtacataatag

SEQ ID NO: 538076 - DNA, 20 bp, Artificial Sequence
  chemically synthesized
ctaacctggtcagattttct

SEQ ID NO: 538077 - DNA, 20 bp, Artificial Sequence
  chemically synthesized
tcttttattaattttattct

SEQ ID NO: 538078 - DNA, 20 bp, Artificial Sequence
  chemically synthesized
tcttcagaataaaattaata

SEQ ID NO: 538079 - DNA, 20 bp, Artificial Sequence
  chemically synthesized
ttggcacattcaaagacata

SEQ ID NO: 538080 - DNA, 20 bp, Artificial Sequence
  chemically synthesized
gatttcacagattatgcatt

SEQ ID NO: 538081 - DNA, 20 bp, Artificial Sequence
  chemically synthesized
aatcttaaaagatgaacatc

SEQ ID NO: 538082 - DNA, 20 bp, Artificial Sequence
  chemically synthesized
gagtcaagagttagtacaaa

SEQ ID NO: 538083 - DNA, 20 bp, Artificial Sequence
  chemically synthesized
aatagtccttataagatatg

SEQ ID NO: 538084 - DNA, 20 bp, Artificial Sequence
  chemically synthesized
caattagtccctaggcatgt

SEQ ID NO: 538085 - DNA, 20 bp, Artificial Sequence
  chemically synthesized
atctcttttactgcaaaagg

SEQ ID NO: 538086 - DNA, 20 bp, Artificial Sequence
  chemically synthesized
cattagcaacaccacctgaa

SEQ ID NO: 538087 - DNA, 20 bp, Artificial Sequence
  chemically synthesized
cattagccataaggttgttg

SEQ ID NO: 538088 - DNA, 20 bp, Artificial Sequence
  chemically synthesized
accttatggctaatgaggat

SEQ ID NO: 538089 - DNA, 20 bp, Artificial Sequence
  chemically synthesized
ggctaatgaggattcagaat

SEQ ID NO: 538090 - DNA, 20 bp, Artificial Sequence
  chemically synthesized
aggattcagaatccagaaat

SEQ ID NO: 538091 - DNA, 20 bp, Artificial Sequence
  chemically synthesized
aatggagaatttgttcctct

SEQ ID NO: 538092 - DNA, 20 bp, Artificial Sequence
  chemically synthesized
atttgttcctctgaagaaag

SEQ ID NO: 538093 - DNA, 20 bp, Artificial Sequence
  chemically synthesized
cttggacaatccatgcacaa

SEQ ID NO: 538094 - DNA, 20 bp, Artificial Sequence
  chemically synthesized
tatgttcaacctatttgttc

SEQ ID NO: 538095 - DNA, 20 bp, Artificial Sequence
  chemically synthesized
atttatgtatacaataagca

SEQ ID NO: 538096 - DNA, 20 bp, Artificial Sequence
  chemically synthesized
cctttaaatagtcacagacc

SEQ ID NO: 538097 - DNA, 20 bp, Artificial Sequence
  chemically synthesized
atgtgaaaagaaaacttaca

SEQ ID NO: 538098 - DNA, 20 bp, Artificial Sequence
  chemically synthesized
gggtcactggtgttatgtga

SEQ ID NO: 538099 - DNA, 20 bp, Artificial Sequence
  chemically synthesized
tatactgcatttctaacatt

SEQ ID NO: 538100 - DNA, 20 bp, Artificial Sequence
  chemically synthesized
ttatagaacattcttcaatg

SEQ ID NO: 538101 - DNA, 20 bp, Artificial Sequence
  chemically synthesized
tcctacaaccacgtccgtga

SEQ ID NO: 538102 - DNA, 20 bp, Artificial Sequence
  chemically synthesized
aacaaaaaggaattggaaag

SEQ ID NO: 538103 - DNA, 20 bp, Artificial Sequence
  chemically synthesized
ctaaaccagatgattactac

SEQ ID NO: 538104 - DNA, 20 bp, Artificial Sequence
  chemically synthesized
agaaacaacaataaaaatat

SEQ ID NO: 538105 - DNA, 20 bp, Artificial Sequence
  chemically synthesized
tatgttaacccaagacaatt

SEQ ID NO: 538106 - DNA, 20 bp, Artificial Sequence
  chemically synthesized
tggtaaaatcaaaagtgatt

SEQ ID NO: 538107 - DNA, 20 bp, Artificial Sequence
  chemically synthesized
ctggcacaacaaaggttcag

SEQ ID NO: 538108 - DNA, 20 bp, Artificial Sequence
  chemically synthesized
acttttgtgcaatgtggaaa

SEQ ID NO: 538109 - DNA, 20 bp, Artificial Sequence
  chemically synthesized
cagtgatgcactgactgttc

SEQ ID NO: 538110 - DNA, 20 bp, Artificial Sequence
  chemically synthesized
tactttccagggaatgtgat

SEQ ID NO: 538111 - DNA, 20 bp, Artificial Sequence
  chemically synthesized
cctggaaagtaaaccttgtg

SEQ ID NO: 538112 - DNA, 20 bp, Artificial Sequence
  chemically synthesized
ccaagcaatttggtatgtgc

SEQ ID NO: 538113 - DNA, 20 bp, Artificial Sequence
  chemically synthesized
cacccagaaaggaacggctt

SEQ ID NO: 538114 - DNA, 20 bp, Artificial Sequence
  chemically synthesized
caatcaagttcctgctgcac

SEQ ID NO: 538115 - DNA, 20 bp, Artificial Sequence
  chemically synthesized
aacttgattggggatttcca

SEQ ID NO: 538116 - DNA, 20 bp, Artificial Sequence
  chemically synthesized
ccagcttgttaatcttcaga

SEQ ID NO: 538117 - DNA, 20 bp, Artificial Sequence
  chemically synthesized
taaaggtatgtctctgctta

SEQ ID NO: 538118 - DNA, 20 bp, Artificial Sequence
  chemically synthesized
acggtttactcaatattcac

SEQ ID NO: 538119 - DNA, 20 bp, Artificial Sequence
  chemically synthesized
agcatttgattatcttctca

SEQ ID NO: 538120 - DNA, 20 bp, Artificial Sequence
  chemically synthesized
tcatcctccttctaggactg

SEQ ID NO: 538121 - DNA, 20 bp, Artificial Sequence
  chemically synthesized
taccttcataaccttggtga

SEQ ID NO: 538122 - DNA, 20 bp, Artificial Sequence
  chemically synthesized
cacttcttcaattttgagat

SEQ ID NO: 538123 - DNA, 20 bp, Artificial Sequence
  chemically synthesized
tacttatagactagaatgtg

SEQ ID NO: 538124 - DNA, 20 bp, Artificial Sequence
  chemically synthesized
atagctgtgctacttataga

SEQ ID NO: 538125 - DNA, 20 bp, Artificial Sequence
  chemically synthesized
tctggggtcttagttttttt

SEQ ID NO: 538126 - DNA, 20 bp, Artificial Sequence
  chemically synthesized
cctgagctctaggcctctgg

SEQ ID NO: 538127 - DNA, 20 bp, Artificial Sequence
  chemically synthesized
gaattaatgtgaggaaggaa

SEQ ID NO: 538128 - DNA, 20 bp, Artificial Sequence
  chemically synthesized
ttggggcttaccatatatat

SEQ ID NO: 538129 - DNA, 20 bp, Artificial Sequence
  chemically synthesized
tccataggaccagaaaggct

SEQ ID NO: 538130 - DNA, 20 bp, Artificial Sequence
  chemically synthesized
ctccaacactttccatagga

SEQ ID NO: 538131 - DNA, 20 bp, Artificial Sequence
  chemically synthesized
aagtgttggagtttattgct

SEQ ID NO: 538132 - DNA, 20 bp, Artificial Sequence
  chemically synthesized
actatggatcacaataaact

SEQ ID NO: 538133 - DNA, 20 bp, Artificial Sequence
  chemically synthesized
aattgaaaatatgctctgaa

SEQ ID NO: 538134 - DNA, 20 bp, Artificial Sequence
  chemically synthesized
ctcaaccagatagttaaatt

SEQ ID NO: 538135 - DNA, 20 bp, Artificial Sequence
  chemically synthesized
agccctgggataagtcttga

SEQ ID NO: 538136 - DNA, 20 bp, Artificial Sequence
  chemically synthesized
tatttaccacccacttatta

SEQ ID NO: 538137 - DNA, 20 bp, Artificial Sequence
  chemically synthesized
gactcttagagctataaaag

SEQ ID NO: 538138 - DNA, 20 bp, Artificial Sequence
  chemically synthesized
gggattacctgtgttgctta

SEQ ID NO: 538139 - DNA, 20 bp, Artificial Sequence
  chemically synthesized
gtctgaagaaatgaaaataa

SEQ ID NO: 538140 - DNA, 20 bp, Artificial Sequence
  chemically synthesized
atgttaggggaaaaaagtct

SEQ ID NO: 538141 - DNA, 20 bp, Artificial Sequence
  chemically synthesized
gtataattagtattctgtat

SEQ ID NO: 538142 - DNA, 20 bp, Artificial Sequence
  chemically synthesized
aactacggtcatttctttat

SEQ ID NO: 538143 - DNA, 20 bp, Artificial Sequence
  chemically synthesized
ttacagattcagccatttgc

SEQ ID NO: 538144 - DNA, 20 bp, Artificial Sequence
  chemically synthesized
ataaggtcaaaattttaggg

SEQ ID NO: 538145 - DNA, 20 bp, Artificial Sequence
  chemically synthesized
attttagggtaagaaaataa

SEQ ID NO: 538146 - DNA, 20 bp, Artificial Sequence
  chemically synthesized
tattagaaagaaacttttag

SEQ ID NO: 538147 - DNA, 20 bp, Artificial Sequence
  chemically synthesized
actatattagaaagaaactt

SEQ ID NO: 538148 - DNA, 20 bp, Artificial Sequence
  chemically synthesized
taaataaaatactatattag

SEQ ID NO: 538149 - DNA, 20 bp, Artificial Sequence
  chemically synthesized
aaattaaataaaatactata

SEQ ID NO: 538150 - DNA, 20 bp, Artificial Sequence
  chemically synthesized
gtggataggtgtgccacttt

SEQ ID NO: 538151 - DNA, 20 bp, Artificial Sequence
  chemically synthesized
tttacatctaaaaacacttc

SEQ ID NO: 538152 - DNA, 20 bp, Artificial Sequence
  chemically synthesized
atatcagagatattacaagt

SEQ ID NO: 538153 - DNA, 20 bp, Artificial Sequence
  chemically synthesized
taacttgtgttaggcaagtg

SEQ ID NO: 538154 - DNA, 20 bp, Artificial Sequence
  chemically synthesized
tggcagaaaaaaaaagtgac

SEQ ID NO: 538155 - DNA, 20 bp, Artificial Sequence
  chemically synthesized
aaacatactgcatctgtttg

SEQ ID NO: 538156 - DNA, 20 bp, Artificial Sequence
  chemically synthesized
aacagatgcagtatgtttca

SEQ ID NO: 538157 - DNA, 20 bp, Artificial Sequence
  chemically synthesized
gagagatcatcaagaaagat

SEQ ID NO: 538158 - DNA, 20 bp, Artificial Sequence
  chemically synthesized
ttgcaggcatgagagatcat

SEQ ID NO: 538159 - DNA, 20 bp, Artificial Sequence
  chemically synthesized
agtggggtgcagtcttcagc

SEQ ID NO: 538160 - DNA, 20 bp, Artificial Sequence
  chemically synthesized
gctcagcagcctgctgcaga

SEQ ID NO: 538161 - DNA, 20 bp, Artificial Sequence
  chemically synthesized
ccaggtggaatcttctcttt

SEQ ID NO: 538162 - DNA, 20 bp, Artificial Sequence
  chemically synthesized
cttaaaaagcaatttaccag

SEQ ID NO: 538163 - DNA, 20 bp, Artificial Sequence
  chemically synthesized
aataacacatccatcccaag

SEQ ID NO: 538164 - DNA, 20 bp, Artificial Sequence
  chemically synthesized
tcctaataacacatccatcc

SEQ ID NO: 538165 - DNA, 20 bp, Artificial Sequence
  chemically synthesized
ttcctgttgtcctgaaatgt

SEQ ID NO: 538166 - DNA, 20 bp, Artificial Sequence
  chemically synthesized
ggtataaagatacaaaaaat

SEQ ID NO: 538167 - DNA, 20 bp, Artificial Sequence
  chemically synthesized
agaagtactctgttattggt

SEQ ID NO: 538168 - DNA, 20 bp, Artificial Sequence
  chemically synthesized
tactacaagttatataaaat

SEQ ID NO: 538169 - DNA, 20 bp, Artificial Sequence
  chemically synthesized
aagtggtgggtgtaccagtc

SEQ ID NO: 538170 - DNA, 20 bp, Artificial Sequence
  chemically synthesized
gagtcagtcttattatgtct

SEQ ID NO: 538171 - DNA, 20 bp, Artificial Sequence
  chemically synthesized
ttctagatatatagctgttg

SEQ ID NO: 538172 - DNA, 20 bp, Artificial Sequence
  chemically synthesized
ttcttccaacagctatatat

SEQ ID NO: 538173 - DNA, 20 bp, Artificial Sequence
  chemically synthesized
aacaatggaaactaaatctc

SEQ ID NO: 538174 - DNA, 20 bp, Artificial Sequence
  chemically synthesized
agcctttattactacatttt

SEQ ID NO: 538175 - DNA, 20 bp, Artificial Sequence
  chemically synthesized
tctttgaagatgtaattagt

SEQ ID NO: 538176 - DNA, 20 bp, Artificial Sequence
  chemically synthesized
ccaacaatgatagactggat

SEQ ID NO: 538177 - DNA, 20 bp, Artificial Sequence
  chemically synthesized
ttgttcttgcgatagtttac

SEQ ID NO: 538178 - DNA, 20 bp, Artificial Sequence
  chemically synthesized
ataataataataataataat

SEQ ID NO: 538179 - DNA, 20 bp, Artificial Sequence
  chemically synthesized
taataaagaaaagagtggac

SEQ ID NO: 538180 - DNA, 20 bp, Artificial Sequence
  chemically synthesized
cagaagctggaagaggcaag

SEQ ID NO: 538181 - DNA, 20 bp, Artificial Sequence
  chemically synthesized
atccctctgaaggctctggg

SEQ ID NO: 538182 - DNA, 20 bp, Artificial Sequence
  chemically synthesized
acctagcttccagatttgtg

SEQ ID NO: 538183 - DNA, 20 bp, Artificial Sequence
  chemically synthesized
ggtttggggggacgtggtgg

SEQ ID NO: 538184 - DNA, 20 bp, Artificial Sequence
  chemically synthesized
aatgcgtgactagacagtaa

SEQ ID NO: 538185 - DNA, 20 bp, Artificial Sequence
  chemically synthesized
aacctcataaattttaaaaa

SEQ ID NO: 538186 - DNA, 20 bp, Artificial Sequence
  chemically synthesized
taaatggatgatgaaaatgg

SEQ ID NO: 538187 - DNA, 20 bp, Artificial Sequence
  chemically synthesized
atggagagaatttatgttag

SEQ ID NO: 538188 - DNA, 20 bp, Artificial Sequence
  chemically synthesized
attatatggaacactagctg

SEQ ID NO: 538189 - DNA, 20 bp, Artificial Sequence
  chemically synthesized
gtaagataacacttactaaa

SEQ ID NO: 538190 - DNA, 20 bp, Artificial Sequence
  chemically synthesized
ataaagagggtgatatgaat

SEQ ID NO: 538191 - DNA, 20 bp, Artificial Sequence
  chemically synthesized
acagaattgtggagctttga

SEQ ID NO: 538192 - DNA, 20 bp, Artificial Sequence
  chemically synthesized
cttttaggtccaagaataca

SEQ ID NO: 538193 - DNA, 20 bp, Artificial Sequence
  chemically synthesized
accgttaggtcttttaggtc

SEQ ID NO: 538194 - DNA, 20 bp, Artificial Sequence
  chemically synthesized
agtatgaataagagactgtg

SEQ ID NO: 538195 - DNA, 20 bp, Artificial Sequence
  chemically synthesized
gctataggaggtaagaggtg

SEQ ID NO: 538196 - DNA, 20 bp, Artificial Sequence
  chemically synthesized
gttgaaaagtttgcatgaac

SEQ ID NO: 538197 - DNA, 20 bp, Artificial Sequence
  chemically synthesized
atgaacccagaatatgaaag

SEQ ID NO: 538198 - DNA, 20 bp, Artificial Sequence
  chemically synthesized
ttaacttgagcctgtgagga

SEQ ID NO: 538199 - DNA, 20 bp, Artificial Sequence
  chemically synthesized
cgctatgttattaatcttcc

SEQ ID NO: 538200 - DNA, 20 bp, Artificial Sequence
  chemically synthesized
atattcaaacatgattattt

SEQ ID NO: 538201 - DNA, 20 bp, Artificial Sequence
  chemically synthesized
atgattatttttagaaacaa

SEQ ID NO: 538202 - DNA, 20 bp, Artificial Sequence
  chemically synthesized
aacaaatagaaacagaggaa

SEQ ID NO: 538203 - DNA, 20 bp, Artificial Sequence
  chemically synthesized
atccacaagattgcacatga

SEQ ID NO: 538204 - DNA, 20 bp, Artificial Sequence
  chemically synthesized
ttatgataacgttgtgtgtt

SEQ ID NO: 538205 - DNA, 20 bp, Artificial Sequence
  chemically synthesized
aaattacttcattattctct

SEQ ID NO: 538206 - DNA, 20 bp, Artificial Sequence
  chemically synthesized
aatctctgtccattttcttt

SEQ ID NO: 538207 - DNA, 20 bp, Artificial Sequence
  chemically synthesized
agagattactatttttattt

SEQ ID NO: 538208 - DNA, 20 bp, Artificial Sequence
  chemically synthesized
attactatttttatttggag

SEQ ID NO: 538209 - DNA, 20 bp, Artificial Sequence
  chemically synthesized
gttcacaccagatgagcttc

SEQ ID NO: 538210 - DNA, 20 bp, Artificial Sequence
  chemically synthesized
taggtaggtagtatggtata

SEQ ID NO: 538211 - DNA, 20 bp, Artificial Sequence
  chemically synthesized
tattatgcccattttacagc

SEQ ID NO: 538212 - DNA, 20 bp, Artificial Sequence
  chemically synthesized
gtttggcacagagcagaggc

SEQ ID NO: 538213 - DNA, 20 bp, Artificial Sequence
  chemically synthesized
gtcattgaatgcagaattgg

SEQ ID NO: 538214 - DNA, 20 bp, Artificial Sequence
  chemically synthesized
ccagtgtgacgtcattgaat

SEQ ID NO: 538215 - DNA, 20 bp, Artificial Sequence
  chemically synthesized
ttttggtgactgctagtatt

SEQ ID NO: 538216 - DNA, 20 bp, Artificial Sequence
  chemically synthesized
ttgccttgaaaatttccctc

SEQ ID NO: 538217 - DNA, 20 bp, Artificial Sequence
  chemically synthesized
agctcctgtagaagcaagat

SEQ ID NO: 538218 - DNA, 20 bp, Artificial Sequence
  chemically synthesized
ggctaagtgtgttattagtc

SEQ ID NO: 538219 - DNA, 20 bp, Artificial Sequence
  chemically synthesized
agagatgacttcaaatgtca

SEQ ID NO: 538220 - DNA, 20 bp, Artificial Sequence
  chemically synthesized
acagccacctacagggccac

SEQ ID NO: 538221 - DNA, 20 bp, Artificial Sequence
  chemically synthesized
ccttcatgcacaaagatgca

SEQ ID NO: 538222 - DNA, 20 bp, Artificial Sequence
  chemically synthesized
ctttgtgcatgaagggatct

SEQ ID NO: 538223 - DNA, 20 bp, Artificial Sequence
  chemically synthesized
accttccagagcagagagaa

SEQ ID NO: 538224 - DNA, 20 bp, Artificial Sequence
  chemically synthesized
acaggaggaggatgcgtcaa

SEQ ID NO: 538225 - DNA, 20 bp, Artificial Sequence
  chemically synthesized
gcacaaggtgacatgagatt

SEQ ID NO: 538226 - DNA, 20 bp, Artificial Sequence
  chemically synthesized
gagagtcctgagaagccaaa

SEQ ID NO: 538227 - DNA, 20 bp, Artificial Sequence
  chemically synthesized
aaataagatagtagtactat

SEQ ID NO: 538228 - DNA, 20 bp, Artificial Sequence
  chemically synthesized
aataggaagccaaagataat

SEQ ID NO: 538229 - DNA, 20 bp, Artificial Sequence
  chemically synthesized
ttgttgtcccaggaatgaga

SEQ ID NO: 538230 - DNA, 20 bp, Artificial Sequence
  chemically synthesized
tcacattgttgtcccaggaa

SEQ ID NO: 538231 - DNA, 20 bp, Artificial Sequence
  chemically synthesized
acttaagccagcttggatgg

SEQ ID NO: 538232 - DNA, 20 bp, Artificial Sequence
  chemically synthesized
gtcataactctgagcatgac

SEQ ID NO: 538233 - DNA, 20 bp, Artificial Sequence
  chemically synthesized
gtcctggattcaaggcaaca

SEQ ID NO: 538234 - DNA, 20 bp, Artificial Sequence
  chemically synthesized
acagtagcagccgggtaaat

SEQ ID NO: 538235 - DNA, 20 bp, Artificial Sequence
  chemically synthesized
attatgagggagaagaaatt

SEQ ID NO: 538236 - DNA, 20 bp, Artificial Sequence
  chemically synthesized
caattcagaattatgaggga

SEQ ID NO: 538237 - DNA, 20 bp, Artificial Sequence
  chemically synthesized
ccttgaaagctatgtacaat

SEQ ID NO: 538238 - DNA, 20 bp, Artificial Sequence
  chemically synthesized
tcttggaaaacccaagaatt

SEQ ID NO: 538239 - DNA, 20 bp, Artificial Sequence
  chemically synthesized
tctgaaattcttgggttttc

SEQ ID NO: 538240 - DNA, 20 bp, Artificial Sequence
  chemically synthesized
atttctattcttggaaaacc

SEQ ID NO: 538241 - DNA, 20 bp, Artificial Sequence
  chemically synthesized
aattcttgggttttccaaga

SEQ ID NO: 538242 - DNA, 20 bp, Artificial Sequence
  chemically synthesized
tgattacataggataaacaa

SEQ ID NO: 538243 - DNA, 20 bp, Artificial Sequence
  chemically synthesized
gtatatatatgaagagcagt

SEQ ID NO: 538244 - DNA, 20 bp, Artificial Sequence
  chemically synthesized
ctgaatatctctttctcagt

SEQ ID NO: 538245 - DNA, 20 bp, Artificial Sequence
  chemically synthesized
gaatgaatgacattctacac

SEQ ID NO: 538246 - DNA, 20 bp, Artificial Sequence
  chemically synthesized
gggatcaggctgatgttagg

SEQ ID NO: 538247 - DNA, 20 bp, Artificial Sequence
  chemically synthesized
taaatcaaggaaggcttcat

SEQ ID NO: 538248 - DNA, 20 bp, Artificial Sequence
  chemically synthesized
aaaaaaaaaaaaaggaaaga

SEQ ID NO: 538249 - DNA, 20 bp, Artificial Sequence
  chemically synthesized
atctcaaaaaaaaaaaaagg

SEQ ID NO: 538250 - DNA, 20 bp, Artificial Sequence
  chemically synthesized
ctacttagcaggctgaggca

SEQ ID NO: 538251 - DNA, 20 bp, Artificial Sequence
  chemically synthesized
acgatttgcatttattataa

SEQ ID NO: 538252 - DNA, 20 bp, Artificial Sequence
  chemically synthesized
atagaaaataaatacaagcc

SEQ ID NO: 538253 - DNA, 20 bp, Artificial Sequence
  chemically synthesized
cataaaaattataatgtata

SEQ ID NO: 538254 - DNA, 20 bp, Artificial Sequence
  chemically synthesized
taataggtgtaagttcttag

SEQ ID NO: 538255 - DNA, 20 bp, Artificial Sequence
  chemically synthesized
caatggcaagaatgatgttt

SEQ ID NO: 538256 - DNA, 20 bp, Artificial Sequence
  chemically synthesized
tgagctcaaaacaacaatgg

SEQ ID NO: 538257 - DNA, 20 bp, Artificial Sequence
  chemically synthesized
catttcatagacatcaggat

SEQ ID NO: 538258 - DNA, 20 bp, Artificial Sequence
  chemically synthesized
ttagaagagtggtgagataa

SEQ ID NO: 538259 - DNA, 20 bp, Artificial Sequence
  chemically synthesized
ttaacttatttacataatct

SEQ ID NO: 538260 - DNA, 20 bp, Artificial Sequence
  chemically synthesized
caaggaatcctagataattg

SEQ ID NO: 538261 - DNA, 20 bp, Artificial Sequence
  chemically synthesized
tggattgaacaaatactcat

SEQ ID NO: 538262 - DNA, 20 bp, Artificial Sequence
  chemically synthesized
tgtaaatgatgttataaatt

SEQ ID NO: 538263 - DNA, 20 bp, Artificial Sequence
  chemically synthesized
taatgaaaagttctgatatt

SEQ ID NO: 538264 - DNA, 20 bp, Artificial Sequence
  chemically synthesized
ctatttaactgcttcttatg

SEQ ID NO: 538265 - DNA, 20 bp, Artificial Sequence
  chemically synthesized
gatcctccttgcttatcagg

SEQ ID NO: 538266 - DNA, 20 bp, Artificial Sequence
  chemically synthesized
atgtgattattaaaagccag

SEQ ID NO: 538267 - DNA, 20 bp, Artificial Sequence
  chemically synthesized
ggagactattatgaaaatgt

SEQ ID NO: 538268 - DNA, 20 bp, Artificial Sequence
  chemically synthesized
aaggtaaaatcaaagcagta

SEQ ID NO: 538269 - DNA, 20 bp, Artificial Sequence
  chemically synthesized
gaactaccatcttcgcaaaa

SEQ ID NO: 538270 - DNA, 20 bp, Artificial Sequence
  chemically synthesized
tcccagagtgtagctaaggt

SEQ ID NO: 538271 - DNA, 20 bp, Artificial Sequence
  chemically synthesized
agctacactctgggatcatt

SEQ ID NO: 538272 - DNA, 20 bp, Artificial Sequence
  chemically synthesized
tcacatctagaccaattgaa

SEQ ID NO: 538273 - DNA, 20 bp, Artificial Sequence
  chemically synthesized
ttttcaaattttgacatgaa

SEQ ID NO: 538274 - DNA, 20 bp, Artificial Sequence
  chemically synthesized
agagtttttgggagtagggc

SEQ ID NO: 538275 - DNA, 20 bp, Artificial Sequence
  chemically synthesized
cacctgaaagcttgttagaa

SEQ ID NO: 538276 - DNA, 20 bp, Artificial Sequence
  chemically synthesized
gattgctgtgcctttggatt

SEQ ID NO: 538277 - DNA, 20 bp, Artificial Sequence
  chemically synthesized
ctgtgcatccaagtagacag

SEQ ID NO: 538278 - DNA, 20 bp, Artificial Sequence
  chemically synthesized
gatgcacagctgcccagcac

SEQ ID NO: 538279 - DNA, 20 bp, Artificial Sequence
  chemically synthesized
aaagaactattagataagga

SEQ ID NO: 538280 - DNA, 20 bp, Artificial Sequence
  chemically synthesized
agtgttctatcagcatctaa

SEQ ID NO: 538281 - DNA, 20 bp, Artificial Sequence
  chemically synthesized
acaacatatcttccatggcc

SEQ ID NO: 538282 - DNA, 20 bp, Artificial Sequence
  chemically synthesized
agatatgttgtgatttaatt

SEQ ID NO: 538283 - DNA, 20 bp, Artificial Sequence
  chemically synthesized
cagtcatgaaatcttaaaga

SEQ ID NO: 538284 - DNA, 20 bp, Artificial Sequence
  chemically synthesized
atgaccagagataggacatt

SEQ ID NO: 538285 - DNA, 20 bp, Artificial Sequence
  chemically synthesized
gcactgctaggaagtgctgg

SEQ ID NO: 538286 - DNA, 20 bp, Artificial Sequence
  chemically synthesized
aggcataaacactacatttg

SEQ ID NO: 538287 - DNA, 20 bp, Artificial Sequence
  chemically synthesized
agccctgaccataagcacca

SEQ ID NO: 538288 - DNA, 20 bp, Artificial Sequence
  chemically synthesized
cagttttatcatcagcattt

SEQ ID NO: 538289 - DNA, 20 bp, Artificial Sequence
  chemically synthesized
tgtgtttaacagcccatttt

SEQ ID NO: 538290 - DNA, 20 bp, Artificial Sequence
  chemically synthesized
ttcaaacaaagccgtttcca

SEQ ID NO: 538291 - DNA, 20 bp, Artificial Sequence
  chemically synthesized
tccatttacgggcttcttcc

SEQ ID NO: 538292 - DNA, 20 bp, Artificial Sequence
  chemically synthesized
gagattccagacatatctga

SEQ ID NO: 538293 - DNA, 20 bp, Artificial Sequence
  chemically synthesized
tcaataattttgaagcatca

SEQ ID NO: 538294 - DNA, 20 bp, Artificial Sequence
  chemically synthesized
tggcatcgtcgttgcatttt

SEQ ID NO: 538295 - DNA, 20 bp, Artificial Sequence
  chemically synthesized
tcgtcgttgcatttttcaga

SEQ ID NO: 538296 - DNA, 20 bp, Artificial Sequence
  chemically synthesized
acttcctggtgtagtgcctt

SEQ ID NO: 538297 - DNA, 20 bp, Artificial Sequence
  chemically synthesized
cattgtgtaataaggtagaa

SEQ ID NO: 538298 - DNA, 20 bp, Artificial Sequence
  chemically synthesized
ttcaaaattattggaaagtg

SEQ ID NO: 538299 - DNA, 20 bp, Artificial Sequence
  chemically synthesized
aaaagcatggcattatgcta

SEQ ID NO: 538300 - DNA, 20 bp, Artificial Sequence
  chemically synthesized
ctgtttcaagtgctatgtac

SEQ ID NO: 538301 - DNA, 20 bp, Artificial Sequence
  chemically synthesized
gcacataatttacagtccag

SEQ ID NO: 538302 - DNA, 20 bp, Artificial Sequence
  chemically synthesized
actgttcgatctaattgtct

SEQ ID NO: 538303 - DNA, 20 bp, Artificial Sequence
  chemically synthesized
ttttgaaaaaggtgggatgg

SEQ ID NO: 538304 - DNA, 20 bp, Artificial Sequence
  chemically synthesized
tgagggacaaaagaggacaa

SEQ ID NO: 538305 - DNA, 20 bp, Artificial Sequence
  chemically synthesized
caattcagatcctactcttt

SEQ ID NO: 538306 - DNA, 20 bp, Artificial Sequence
  chemically synthesized
taacagttaatgaatgtttt

SEQ ID NO: 538307 - DNA, 20 bp, Artificial Sequence
  chemically synthesized
gttattgtactataaagaat

SEQ ID NO: 538308 - DNA, 20 bp, Artificial Sequence
  chemically synthesized
agtaagtgttattgtactat

SEQ ID NO: 538309 - DNA, 20 bp, Artificial Sequence
  chemically synthesized
aaaaagccctcacagagaaa

SEQ ID NO: 538310 - DNA, 20 bp, Artificial Sequence
  chemically synthesized
agaaaaaaaaaagccctcac

SEQ ID NO: 538311 - DNA, 20 bp, Artificial Sequence
  chemically synthesized
gaaattatttttactttata

SEQ ID NO: 538312 - DNA, 20 bp, Artificial Sequence
  chemically synthesized
atcatattgttctcttgtga

SEQ ID NO: 538313 - DNA, 20 bp, Artificial Sequence
  chemically synthesized
aattgttccctttgacaaaa

SEQ ID NO: 538314 - DNA, 20 bp, Artificial Sequence
  chemically synthesized
ttaaattttcatgtttggct

SEQ ID NO: 538315 - DNA, 20 bp, Artificial Sequence
  chemically synthesized
tgggagtgcactgtaatatt

SEQ ID NO: 538316 - DNA, 20 bp, Artificial Sequence
  chemically synthesized
tacgagctttgaaacatgtg

SEQ ID NO: 538317 - DNA, 20 bp, Artificial Sequence
  chemically synthesized
gaatgtaaaattttcaaaaa

SEQ ID NO: 538318 - DNA, 20 bp, Artificial Sequence
  chemically synthesized
tttgaaaattttacattcaa

SEQ ID NO: 538319 - DNA, 20 bp, Artificial Sequence
  chemically synthesized
agttatctgaagacagacaa

SEQ ID NO: 538320 - DNA, 20 bp, Artificial Sequence
  chemically synthesized
ttattttagtttgttaaatc

SEQ ID NO: 538321 - DNA, 20 bp, Artificial Sequence
  chemically synthesized
ttctccaaatcctcacaatt

SEQ ID NO: 538322 - DNA, 20 bp, Artificial Sequence
  chemically synthesized
ttcttaaattgtgaggattt

SEQ ID NO: 538323 - DNA, 20 bp, Artificial Sequence
  chemically synthesized
tgcaaaaaagccgctatgtt

SEQ ID NO: 538324 - DNA, 20 bp, Artificial Sequence
  chemically synthesized
gtaattgcaacttttaattg

SEQ ID NO: 538325 - DNA, 20 bp, Artificial Sequence
  chemically synthesized
gaatcactacgagaggttta

SEQ ID NO: 538326 - DNA, 20 bp, Artificial Sequence
  chemically synthesized
cccaacaaatttcacactta

SEQ ID NO: 538327 - DNA, 20 bp, Artificial Sequence
  chemically synthesized
tagttaattaaagaccatct

SEQ ID NO: 538328 - DNA, 20 bp, Artificial Sequence
  chemically synthesized
ttaaagaccatcttcagaat

SEQ ID NO: 538329 - DNA, 20 bp, Artificial Sequence
  chemically synthesized
agccaatgggggaggactca

SEQ ID NO: 538330 - DNA, 20 bp, Artificial Sequence
  chemically synthesized
acgttcaacttccggaactg

SEQ ID NO: 538331 - DNA, 20 bp, Artificial Sequence
  chemically synthesized
cccactgggtggcttaagca

SEQ ID NO: 538332 - DNA, 20 bp, Artificial Sequence
  chemically synthesized
catagggtatgcacacataa

SEQ ID NO: 538333 - DNA, 20 bp, Artificial Sequence
  chemically synthesized
atactactagcgaatactgt

SEQ ID NO: 538334 - DNA, 20 bp, Artificial Sequence
  chemically synthesized
atatgtaaaacatagtattg

SEQ ID NO: 538335 - DNA, 20 bp, Artificial Sequence
  chemically synthesized
taaaacatagtattgagaga

SEQ ID NO: 538336 - DNA, 20 bp, Artificial Sequence
  chemically synthesized
taaaaaatgagcattgttta

SEQ ID NO: 538337 - DNA, 20 bp, Artificial Sequence
  chemically synthesized
gtgttcttcttatttgaaac

SEQ ID NO: 538338 - DNA, 20 bp, Artificial Sequence
  chemically synthesized
gtgttggacagcacaggttt

SEQ ID NO: 538339 - DNA, 20 bp, Artificial Sequence
  chemically synthesized
ctagatttcagagacttact

SEQ ID NO: 538340 - DNA, 20 bp, Artificial Sequence
  chemically synthesized
gccatattagaaaaagaaac

SEQ ID NO: 538341 - DNA, 20 bp, Artificial Sequence
  chemically synthesized
ttctactagccatattagaa

SEQ ID NO: 538342 - DNA, 20 bp, Artificial Sequence
  chemically synthesized
tcaattttctactagccata

SEQ ID NO: 538343 - DNA, 20 bp, Artificial Sequence
  chemically synthesized
ttctttttctaatatggcta

SEQ ID NO: 538344 - DNA, 20 bp, Artificial Sequence
  chemically synthesized
tgaactggtttatattgtat

SEQ ID NO: 538345 - DNA, 20 bp, Artificial Sequence
  chemically synthesized
tggttaatttcaacacatat

SEQ ID NO: 538346 - DNA, 20 bp, Artificial Sequence
  chemically synthesized
ttaaaatctgctctaaaaat

SEQ ID NO: 538347 - DNA, 20 bp, Artificial Sequence
  chemically synthesized
ttgatatattgaattatcac

SEQ ID NO: 538348 - DNA, 20 bp, Artificial Sequence
  chemically synthesized
tatattgaattatcactgag

SEQ ID NO: 538349 - DNA, 20 bp, Artificial Sequence
  chemically synthesized
attcaataattagggaagct

SEQ ID NO: 538350 - DNA, 20 bp, Artificial Sequence
  chemically synthesized
cattctgactctagcagatt

SEQ ID NO: 538351 - DNA, 20 bp, Artificial Sequence
  chemically synthesized
ttttctaaaatctgctagag

SEQ ID NO: 538352 - DNA, 20 bp, Artificial Sequence
  chemically synthesized
gaatgtcatgtacaagttct

SEQ ID NO: 538353 - DNA, 20 bp, Artificial Sequence
  chemically synthesized
caagttctaaagaattttta

SEQ ID NO: 538354 - DNA, 20 bp, Artificial Sequence
  chemically synthesized
ttttatcagttgacactgga

SEQ ID NO: 538355 - DNA, 20 bp, Artificial Sequence
  chemically synthesized
agattcaatggaaaataaat

SEQ ID NO: 538356 - DNA, 20 bp, Artificial Sequence
  chemically synthesized
ggccacaggatgtgtgatac

SEQ ID NO: 538357 - DNA, 20 bp, Artificial Sequence
  chemically synthesized
aagagcaaaactccgtctca

SEQ ID NO: 538358 - DNA, 20 bp, Artificial Sequence
  chemically synthesized
ctactcgggaggctgaggta

SEQ ID NO: 538359 - DNA, 20 bp, Artificial Sequence
  chemically synthesized
agttgcaaagaaagtgaatg

SEQ ID NO: 538360 - DNA, 20 bp, Artificial Sequence
  chemically synthesized
agaaatttttccgaagttgc

SEQ ID NO: 538361 - DNA, 20 bp, Artificial Sequence
  chemically synthesized
agaaaactgatgttcataag

SEQ ID NO: 538362 - DNA, 20 bp, Artificial Sequence
  chemically synthesized
catagttattatacagtaat

SEQ ID NO: 538363 - DNA, 20 bp, Artificial Sequence
  chemically synthesized
ctgttctaccctcttcacta

SEQ ID NO: 538364 - DNA, 20 bp, Artificial Sequence
  chemically synthesized
ataaaactgcacttacaaaa

SEQ ID NO: 538365 - DNA, 20 bp, Artificial Sequence
  chemically synthesized
ttatttataatgttaaagga

SEQ ID NO: 538366 - DNA, 20 bp, Artificial Sequence
  chemically synthesized
gaagagaatggtgctcctaa

SEQ ID NO: 538367 - DNA, 20 bp, Artificial Sequence
  chemically synthesized
gtactttttggtatattcaa

SEQ ID NO: 538368 - DNA, 20 bp, Artificial Sequence
  chemically synthesized
ccattaatggtggacaggat

SEQ ID NO: 538369 - DNA, 20 bp, Artificial Sequence
  chemically synthesized
aataaaagttgaaattataa

SEQ ID NO: 538370 - DNA, 20 bp, Artificial Sequence
  chemically synthesized
ttgaaattataaaaagaaaa

SEQ ID NO: 538371 - DNA, 20 bp, Artificial Sequence
  chemically synthesized
aatttcatttaactgtttcc

SEQ ID NO: 538372 - DNA, 20 bp, Artificial Sequence
  chemically synthesized
aaaaaaagtatgaaacaaac

SEQ ID NO: 538373 - DNA, 20 bp, Artificial Sequence
  chemically synthesized
tattattttactattttaga

SEQ ID NO: 538374 - DNA, 20 bp, Artificial Sequence
  chemically synthesized
atgattgcctgaattaatgt

SEQ ID NO: 538375 - DNA, 20 bp, Artificial Sequence
  chemically synthesized
tattgctgaaatgaatatga

SEQ ID NO: 538376 - DNA, 20 bp, Artificial Sequence
  chemically synthesized
cccctgttgcatttattgaa

SEQ ID NO: 538377 - DNA, 20 bp, Artificial Sequence
  chemically synthesized
gagaacaccaagtatagtgg

SEQ ID NO: 538378 - DNA, 20 bp, Artificial Sequence
  chemically synthesized
catttaatgttaaaataaaa

SEQ ID NO: 538379 - DNA, 20 bp, Artificial Sequence
  chemically synthesized
gggttgagagtactattaaa

SEQ ID NO: 538380 - DNA, 20 bp, Artificial Sequence
  chemically synthesized
gatactgcagttatagaaaa

SEQ ID NO: 538381 - DNA, 20 bp, Artificial Sequence
  chemically synthesized
tgtcatcagatactgcagtt

SEQ ID NO: 538382 - DNA, 20 bp, Artificial Sequence
  chemically synthesized
atgctgacaatattaggtgt

SEQ ID NO: 538383 - DNA, 20 bp, Artificial Sequence
  chemically synthesized
tttcattaactgcagtgcat

SEQ ID NO: 538384 - DNA, 20 bp, Artificial Sequence
  chemically synthesized
ttaagaaaataaattcctcc

SEQ ID NO: 538385 - DNA, 20 bp, Artificial Sequence
  chemically synthesized
gacactttaagagaagtact

SEQ ID NO: 538386 - DNA, 20 bp, Artificial Sequence
  chemically synthesized
cagtttacatgaagaacaag

SEQ ID NO: 538387 - DNA, 20 bp, Artificial Sequence
  chemically synthesized
aagaacaagtgagaaagtga

SEQ ID NO: 538388 - DNA, 20 bp, Artificial Sequence
  chemically synthesized
tccagatgaaaaaaatacat

SEQ ID NO: 538389 - DNA, 20 bp, Artificial Sequence
  chemically synthesized
agactagctcgactacttct

SEQ ID NO: 538390 - DNA, 20 bp, Artificial Sequence
  chemically synthesized
agactccagggctactgatt

SEQ ID NO: 538391 - DNA, 20 bp, Artificial Sequence
  chemically synthesized
tgtctaagtttgccttctag

SEQ ID NO: 538392 - DNA, 20 bp, Artificial Sequence
  chemically synthesized
acatttaaatttggaaatta

SEQ ID NO: 538393 - DNA, 20 bp, Artificial Sequence
  chemically synthesized
ttaaatttggaaattaaaag

SEQ ID NO: 538394 - DNA, 20 bp, Artificial Sequence
  chemically synthesized
ctgaagacaaaaacatatat

SEQ ID NO: 538395 - DNA, 20 bp, Artificial Sequence
  chemically synthesized
tttaatcgttgaaaggggag

SEQ ID NO: 538396 - DNA, 20 bp, Artificial Sequence
  chemically synthesized
attttttaatcgttgaaagg

SEQ ID NO: 538397 - DNA, 20 bp, Artificial Sequence
  chemically synthesized
atcccacaattttagtggct

SEQ ID NO: 538398 - DNA, 20 bp, Artificial Sequence
  chemically synthesized
acaattttagtggcttaaga

SEQ ID NO: 538399 - DNA, 20 bp, Artificial Sequence
  chemically synthesized
ttttagtggcttaagaaaag

SEQ ID NO: 538400 - DNA, 20 bp, Artificial Sequence
  chemically synthesized
gagtccctgaattactgggt

SEQ ID NO: 538401 - DNA, 20 bp, Artificial Sequence
  chemically synthesized
tctgccacaacatatgcttg

SEQ ID NO: 538402 - DNA, 20 bp, Artificial Sequence
  chemically synthesized
cacaacatatgcttgaaaga

SEQ ID NO: 538403 - DNA, 20 bp, Artificial Sequence
  chemically synthesized
gttctctagcatctaagtaa

SEQ ID NO: 538404 - DNA, 20 bp, Artificial Sequence
  chemically synthesized
ttgtcttctacatgtttaag

SEQ ID NO: 538405 - DNA, 20 bp, Artificial Sequence
  chemically synthesized
aagacaaagtaagtcctggc

SEQ ID NO: 538406 - DNA, 20 bp, Artificial Sequence
  chemically synthesized
gaaaaaaagcttggtgtaaa

SEQ ID NO: 538407 - DNA, 20 bp, Artificial Sequence
  chemically synthesized
atctctagtgtccccaactt

SEQ ID NO: 538408 - DNA, 20 bp, Artificial Sequence
  chemically synthesized
acaaaccaaggggtattagg

SEQ ID NO: 538409 - DNA, 20 bp, Artificial Sequence
  chemically synthesized
ggaaccctgaactacagtct

SEQ ID NO: 538410 - DNA, 20 bp, Artificial Sequence
  chemically synthesized
aaagttatgtcatttgaaat

SEQ ID NO: 538411 - DNA, 20 bp, Artificial Sequence
  chemically synthesized
taaaagtcactatgaagagt

SEQ ID NO: 538412 - DNA, 20 bp, Artificial Sequence
  chemically synthesized
aaggtgcaggctacccaggt

SEQ ID NO: 538413 - DNA, 20 bp, Artificial Sequence
  chemically synthesized
tgagctgagtttttgatctt

SEQ ID NO: 538414 - DNA, 20 bp, Artificial Sequence
  chemically synthesized
cagttgcatatacaagtctg

SEQ ID NO: 538415 - DNA, 20 bp, Artificial Sequence
  chemically synthesized
gaatattaaagggagagatg

SEQ ID NO: 538416 - DNA, 20 bp, Artificial Sequence
  chemically synthesized
ggaatttagcttctgtagta

SEQ ID NO: 538417 - DNA, 20 bp, Artificial Sequence
  chemically synthesized
ttcacccacagcattttgct

SEQ ID NO: 538418 - DNA, 20 bp, Artificial Sequence
  chemically synthesized
acatttgtcaggtttggcaa

SEQ ID NO: 538419 - DNA, 20 bp, Artificial Sequence
  chemically synthesized
gtgtatgtgaggatgaagaa

SEQ ID NO: 538420 - DNA, 20 bp, Artificial Sequence
  chemically synthesized
gaaaatgtgtatgtgaggat

SEQ ID NO: 538421 - DNA, 20 bp, Artificial Sequence
  chemically synthesized
ctcacatacacattttcatt

SEQ ID NO: 538422 - DNA, 20 bp, Artificial Sequence
  chemically synthesized
caaccctgcagcttttctga

SEQ ID NO: 538423 - DNA, 20 bp, Artificial Sequence
  chemically synthesized
cgtgaacctcaggtttctct

SEQ ID NO: 538424 - DNA, 20 bp, Artificial Sequence
  chemically synthesized
cgacctcatgcaaaaatatt

SEQ ID NO: 538425 - DNA, 20 bp, Artificial Sequence
  chemically synthesized
tagaggtcaaacttcacaaa

SEQ ID NO: 538426 - DNA, 20 bp, Artificial Sequence
  chemically synthesized
tatttcccaatttatcccct

SEQ ID NO: 538427 - DNA, 20 bp, Artificial Sequence
  chemically synthesized
attgggaaataaggaacacc

SEQ ID NO: 538428 - DNA, 20 bp, Artificial Sequence
  chemically synthesized
aaataaggaacacctaagaa

SEQ ID NO: 538429 - DNA, 20 bp, Artificial Sequence
  chemically synthesized
acctaagaatcagaaatgag

SEQ ID NO: 538430 - DNA, 20 bp, Artificial Sequence
  chemically synthesized
tacaagaattgtctagaata

SEQ ID NO: 538431 - DNA, 20 bp, Artificial Sequence
  chemically synthesized
tcattcagtacaagaattgt

SEQ ID NO: 538432 - DNA, 20 bp, Artificial Sequence
  chemically synthesized
gaaattaagttcattcagta

SEQ ID NO: 538433 - DNA, 20 bp, Artificial Sequence
  chemically synthesized
tccaaactatgccagaactg

SEQ ID NO: 538434 - DNA, 20 bp, Artificial Sequence
  chemically synthesized
acagaagtttgtttagcagc

SEQ ID NO: 538435 - DNA, 20 bp, Artificial Sequence
  chemically synthesized
gtaatgggggaaaggttacc

SEQ ID NO: 538436 - DNA, 20 bp, Artificial Sequence
  chemically synthesized
ttgaacctatggggttcaat

SEQ ID NO: 538437 - DNA, 20 bp, Artificial Sequence
  chemically synthesized
tggttgctaagcatgtagac

SEQ ID NO: 538438 - DNA, 20 bp, Artificial Sequence
  chemically synthesized
tctcagagataaaatgccag

SEQ ID NO: 538439 - DNA, 20 bp, Artificial Sequence
  chemically synthesized
ctcgacgataaatccacgtc

SEQ ID NO: 538440 - DNA, 20 bp, Artificial Sequence
  chemically synthesized
actcttatgtgcagacttct

SEQ ID NO: 538441 - DNA, 20 bp, Artificial Sequence
  chemically synthesized
tggagttaaaaaataaaaac

SEQ ID NO: 538442 - DNA, 20 bp, Artificial Sequence
  chemically synthesized
aagtcaaagatataaaatgt

SEQ ID NO: 538443 - DNA, 20 bp, Artificial Sequence
  chemically synthesized
caaacacctgacattagcta

SEQ ID NO: 538444 - DNA, 20 bp, Artificial Sequence
  chemically synthesized
aattagataacagcttgttg

SEQ ID NO: 538445 - DNA, 20 bp, Artificial Sequence
  chemically synthesized
gtgaaggaggcagacatgta

SEQ ID NO: 538446 - DNA, 20 bp, Artificial Sequence
  chemically synthesized
gaagtgtaagattcacatgg

SEQ ID NO: 538447 - DNA, 20 bp, Artificial Sequence
  chemically synthesized
actttaccaaggtcatagag

SEQ ID NO: 538448 - DNA, 20 bp, Artificial Sequence
  chemically synthesized
caagttagctagtggaagag

SEQ ID NO: 538449 - DNA, 20 bp, Artificial Sequence
  chemically synthesized
ggcaggcactttgtgatact

SEQ ID NO: 538450 - DNA, 20 bp, Artificial Sequence
  chemically synthesized
gttttcaatgacgtgaacca

SEQ ID NO: 538451 - DNA, 20 bp, Artificial Sequence
  chemically synthesized
atattacttagttcaacgca

SEQ ID NO: 538452 - DNA, 20 bp, Artificial Sequence
  chemically synthesized
cttagttcaacgcaagagaa

SEQ ID NO: 538453 - DNA, 20 bp, Artificial Sequence
  chemically synthesized
cgcaagagaaaaagaatttc

SEQ ID NO: 538454 - DNA, 20 bp, Artificial Sequence
  chemically synthesized
ttcgttatttcatttagtag

SEQ ID NO: 538455 - DNA, 20 bp, Artificial Sequence
  chemically synthesized
aaagtaaaaagaaggcaaaa

SEQ ID NO: 538456 - DNA, 20 bp, Artificial Sequence
  chemically synthesized
tgtagatgactgaatttcaa

SEQ ID NO: 538457 - DNA, 20 bp, Artificial Sequence
  chemically synthesized
atgtttatctgttcttccta

SEQ ID NO: 538458 - DNA, 20 bp, Artificial Sequence
  chemically synthesized
tttttattttgtaagaagta

SEQ ID NO: 538459 - DNA, 20 bp, Artificial Sequence
  chemically synthesized
aaaagctcgatgtggttatt

SEQ ID NO: 538460 - DNA, 20 bp, Artificial Sequence
  chemically synthesized
ccgctcccatgatctggcat

SEQ ID NO: 538461 - DNA, 20 bp, Artificial Sequence
  chemically synthesized
agattcacaatagctaagat

SEQ ID NO: 538462 - DNA, 20 bp, Artificial Sequence
  chemically synthesized
catccatattgtttcatatt

SEQ ID NO: 538463 - DNA, 20 bp, Artificial Sequence
  chemically synthesized
tacattattattgactctag

SEQ ID NO: 538464 - DNA, 20 bp, Artificial Sequence
  chemically synthesized
agtaaaattttttttaagct

SEQ ID NO: 538465 - DNA, 20 bp, Artificial Sequence
  chemically synthesized
aaaacaagacagacagacag

SEQ ID NO: 538466 - DNA, 20 bp, Artificial Sequence
  chemically synthesized
caagacagacagacagacag

SEQ ID NO: 538467 - DNA, 20 bp, Artificial Sequence
  chemically synthesized
acagacagacagacagaaag

SEQ ID NO: 538468 - DNA, 20 bp, Artificial Sequence
  chemically synthesized
acagacagacagaaagaaag

SEQ ID NO: 538469 - DNA, 20 bp, Artificial Sequence
  chemically synthesized
acagacagaaagaaagaaag

SEQ ID NO: 538470 - DNA, 20 bp, Artificial Sequence
  chemically synthesized
acagaaagaaagaaagaaag

SEQ ID NO: 538471 - DNA, 20 bp, Artificial Sequence
  chemically synthesized
aaagaaagaaagaaagaaag

SEQ ID NO: 538472 - DNA, 20 bp, Artificial Sequence
  chemically synthesized
aaagaaagaaagaaagaaag

SEQ ID NO: 538473 - DNA, 20 bp, Artificial Sequence
  chemically synthesized
aaagaaagaaagaaagaaag

SEQ ID NO: 538474 - DNA, 20 bp, Artificial Sequence
  chemically synthesized
aaagaaagaaagaaagaaag

SEQ ID NO: 538475 - DNA, 20 bp, Artificial Sequence
  chemically synthesized
aaagaaagaaagaaagaaag

SEQ ID NO: 538476 - DNA, 20 bp, Artificial Sequence
  chemically synthesized
aaagaaagaaagaaagaaag

SEQ ID NO: 538477 - DNA, 20 bp, Artificial Sequence
  chemically synthesized
gaaagaaagaaagaaagaaa

SEQ ID NO: 538478 - DNA, 20 bp, Artificial Sequence
  chemically synthesized
gaaagaaagaaagaaagaag

SEQ ID NO: 538479 - DNA, 20 bp, Artificial Sequence
  chemically synthesized
gaaagaaagaaagaagaaag

SEQ ID NO: 538480 - DNA, 20 bp, Artificial Sequence
  chemically synthesized
gaaagaaagaagaaagaaag

SEQ ID NO: 538481 - DNA, 20 bp, Artificial Sequence
  chemically synthesized
aagaaagaaagaaaggaagg

SEQ ID NO: 538482 - DNA, 20 bp, Artificial Sequence
  chemically synthesized
aagaaagaaaggaaggaaag

SEQ ID NO: 538483 - DNA, 20 bp, Artificial Sequence
  chemically synthesized
gaaaggaaggaaagaaagaa

SEQ ID NO: 538484 - DNA, 20 bp, Artificial Sequence
  chemically synthesized
ggaaggaaagaaagaaagag

SEQ ID NO: 538485 - DNA, 20 bp, Artificial Sequence
  chemically synthesized
ggaaagaaagaaagagaaag

SEQ ID NO: 538486 - DNA, 20 bp, Artificial Sequence
  chemically synthesized
aagaaagagaaagaaagaaa

SEQ ID NO: 538487 - DNA, 20 bp, Artificial Sequence
  chemically synthesized
gagaaagaaagaaagaagaa

SEQ ID NO: 538488 - DNA, 20 bp, Artificial Sequence
  chemically synthesized
agaaaaagaaaatgagagag

SEQ ID NO: 538489 - DNA, 20 bp, Artificial Sequence
  chemically synthesized
tatggacatctagattcgat

SEQ ID NO: 538490 - DNA, 20 bp, Artificial Sequence
  chemically synthesized
tatgtctggcttcattccct

SEQ ID NO: 538491 - DNA, 20 bp, Artificial Sequence
  chemically synthesized
gatcccaaaagattcacaca

SEQ ID NO: 538492 - DNA, 20 bp, Artificial Sequence
  chemically synthesized
ttaattatattgccagaaat

SEQ ID NO: 538493 - DNA, 20 bp, Artificial Sequence
  chemically synthesized
ttagaaacttaattatattg

SEQ ID NO: 538494 - DNA, 20 bp, Artificial Sequence
  chemically synthesized
tttaattgttgagcttagag

SEQ ID NO: 538495 - DNA, 20 bp, Artificial Sequence
  chemically synthesized
gatagttcattagcatttta

SEQ ID NO: 538496 - DNA, 20 bp, Artificial Sequence
  chemically synthesized
ttcaaacaacaaatttagct

SEQ ID NO: 538497 - DNA, 20 bp, Artificial Sequence
  chemically synthesized
ttacatttaaaataattaat

SEQ ID NO: 538498 - DNA, 20 bp, Artificial Sequence
  chemically synthesized
taccacactatatttttcac

SEQ ID NO: 538499 - DNA, 20 bp, Artificial Sequence
  chemically synthesized
ttcttgagattatttttcct

SEQ ID NO: 538500 - DNA, 20 bp, Artificial Sequence
  chemically synthesized
ttcctaaggaactgtgacaa

SEQ ID NO: 538501 - DNA, 20 bp, Artificial Sequence
  chemically synthesized
aagtattttgacctacaaag

SEQ ID NO: 538502 - DNA, 20 bp, Artificial Sequence
  chemically synthesized
ttttgcaaaataattgtatt

SEQ ID NO: 538503 - DNA, 20 bp, Artificial Sequence
  chemically synthesized
tttgatttaaaaaatttaaa

SEQ ID NO: 538504 - DNA, 20 bp, Artificial Sequence
  chemically synthesized
atttaaaaaatttaaaaaag

SEQ ID NO: 538505 - DNA, 20 bp, Artificial Sequence
  chemically synthesized
tttagactctagtaaggaca

SEQ ID NO: 538506 - DNA, 20 bp, Artificial Sequence
  chemically synthesized
aaactctttagttatttggg

SEQ ID NO: 538507 - DNA, 20 bp, Artificial Sequence
  chemically synthesized
aactctcatgcaattgccta

SEQ ID NO: 538508 - DNA, 20 bp, Artificial Sequence
  chemically synthesized
gttccttaagagctataata

SEQ ID NO: 538509 - DNA, 20 bp, Artificial Sequence
  chemically synthesized
gaaatacaggcttctaaaaa

SEQ ID NO: 538510 - DNA, 20 bp, Artificial Sequence
  chemically synthesized
tacaggcttctaaaaaacag

SEQ ID NO: 538511 - DNA, 20 bp, Artificial Sequence
  chemically synthesized
ccttctcctctactagagtg

SEQ ID NO: 538512 - DNA, 20 bp, Artificial Sequence
  chemically synthesized
aggctagtaatgatttcctg

SEQ ID NO: 538513 - DNA, 20 bp, Artificial Sequence
  chemically synthesized
agagatgtaagagactggag

SEQ ID NO: 538514 - DNA, 20 bp, Artificial Sequence
  chemically synthesized
agactggaggaagaaacatt

SEQ ID NO: 538515 - DNA, 20 bp, Artificial Sequence
  chemically synthesized
tctatccctggaagaacaaa

SEQ ID NO: 538516 - DNA, 20 bp, Artificial Sequence
  chemically synthesized
gaattactgaaggcttttag

SEQ ID NO: 538517 - DNA, 20 bp, Artificial Sequence
  chemically synthesized
aaaattactctagcttttgt

SEQ ID NO: 538518 - DNA, 20 bp, Artificial Sequence
  chemically synthesized
gaaattccagagtctagggt

SEQ ID NO: 538519 - DNA, 20 bp, Artificial Sequence
  chemically synthesized
gggaaaataagacattctag

SEQ ID NO: 538520 - DNA, 20 bp, Artificial Sequence
  chemically synthesized
tacgttcttacattttctct

SEQ ID NO: 538521 - DNA, 20 bp, Artificial Sequence
  chemically synthesized
cagggagccagggaggagaa

SEQ ID NO: 538522 - DNA, 20 bp, Artificial Sequence
  chemically synthesized
tcatttttctgaggaagcta

SEQ ID NO: 538523 - DNA, 20 bp, Artificial Sequence
  chemically synthesized
tgtgtattcttgtagcttcc

SEQ ID NO: 538524 - DNA, 20 bp, Artificial Sequence
  chemically synthesized
tagcttaagggtcatcaaca

SEQ ID NO: 538525 - DNA, 20 bp, Artificial Sequence
  chemically synthesized
aatgattaaacaaaaatact

SEQ ID NO: 538526 - DNA, 20 bp, Artificial Sequence
  chemically synthesized
tagagaatgttcaaatgctc

SEQ ID NO: 538527 - DNA, 20 bp, Artificial Sequence
  chemically synthesized
acatcatcctatcagtattt

SEQ ID NO: 538528 - DNA, 20 bp, Artificial Sequence
  chemically synthesized
gcatttatttgttcaaatgt

SEQ ID NO: 538529 - DNA, 20 bp, Artificial Sequence
  chemically synthesized
agagttttaagaatctatca

SEQ ID NO: 538530 - DNA, 20 bp, Artificial Sequence
  chemically synthesized
atctttaataataagagttt

SEQ ID NO: 538531 - DNA, 20 bp, Artificial Sequence
  chemically synthesized
accaataaaacggaggattt

SEQ ID NO: 538532 - DNA, 20 bp, Artificial Sequence
  chemically synthesized
tattggtaccgagattttcc

SEQ ID NO: 538533 - DNA, 20 bp, Artificial Sequence
  chemically synthesized
cacggtcaatttctagtaaa

SEQ ID NO: 538534 - DNA, 20 bp, Artificial Sequence
  chemically synthesized
gctagttactttctaattta

SEQ ID NO: 538535 - DNA, 20 bp, Artificial Sequence
  chemically synthesized
atcattgaatctccagtatt

SEQ ID NO: 538536 - DNA, 20 bp, Artificial Sequence
  chemically synthesized
acactggaaacaaagaattt

SEQ ID NO: 538537 - DNA, 20 bp, Artificial Sequence
  chemically synthesized
tatgaatatacactggaaac

SEQ ID NO: 538538 - DNA, 20 bp, Artificial Sequence
  chemically synthesized
tattttaaattatagcaatt

SEQ ID NO: 538539 - DNA, 20 bp, Artificial Sequence
  chemically synthesized
aacaaacgtcttctaatcag

SEQ ID NO: 538540 - DNA, 20 bp, Artificial Sequence
  chemically synthesized
taaatcctcatataataata

SEQ ID NO: 538541 - DNA, 20 bp, Artificial Sequence
  chemically synthesized
cattgctaatgtatttattt

SEQ ID NO: 538542 - DNA, 20 bp, Artificial Sequence
  chemically synthesized
aaacaatagcatgggatatc

SEQ ID NO: 538543 - DNA, 20 bp, Artificial Sequence
  chemically synthesized
gaggattcctgaatttcaat

SEQ ID NO: 538544 - DNA, 20 bp, Artificial Sequence
  chemically synthesized
agcagagataactcctgaat

SEQ ID NO: 538545 - DNA, 20 bp, Artificial Sequence
  chemically synthesized
cctgaatagagaaactaggt

SEQ ID NO: 538546 - DNA, 20 bp, Artificial Sequence
  chemically synthesized
tcatggttctcattttcatc

SEQ ID NO: 538547 - DNA, 20 bp, Artificial Sequence
  chemically synthesized
aggaaaaacgaacaagagaa

SEQ ID NO: 538548 - DNA, 20 bp, Artificial Sequence
  chemically synthesized
caaagtgtataataggcctt

SEQ ID NO: 538549 - DNA, 20 bp, Artificial Sequence
  chemically synthesized
tataataggccttcaagaaa

SEQ ID NO: 538550 - DNA, 20 bp, Artificial Sequence
  chemically synthesized
caatggcctcatgagaagga

SEQ ID NO: 538551 - DNA, 20 bp, Artificial Sequence
  chemically synthesized
gtgccctcgcctgtaaaatg

SEQ ID NO: 538552 - DNA, 20 bp, Artificial Sequence
  chemically synthesized
tttcacggacagtgtgcatt

SEQ ID NO: 538553 - DNA, 20 bp, Artificial Sequence
  chemically synthesized
aaaaatctaggtgtgggtta

SEQ ID NO: 538554 - DNA, 20 bp, Artificial Sequence
  chemically synthesized
tgaattcatagagatgtaga

SEQ ID NO: 538555 - DNA, 20 bp, Artificial Sequence
  chemically synthesized
tgtcacttaaatgtgcaatg

SEQ ID NO: 538556 - DNA, 20 bp, Artificial Sequence
  chemically synthesized
tgaacatttttcccccaggc

SEQ ID NO: 538557 - DNA, 20 bp, Artificial Sequence
  chemically synthesized
ctttttatttatcttgttct

SEQ ID NO: 538558 - DNA, 20 bp, Artificial Sequence
  chemically synthesized
gtgctaaacagttggggtag

SEQ ID NO: 538559 - DNA, 20 bp, Artificial Sequence
  chemically synthesized
gaacacagattgaagagaga

SEQ ID NO: 538560 - DNA, 20 bp, Artificial Sequence
  chemically synthesized
ttaaagggccagtgaaccaa

SEQ ID NO: 538561 - DNA, 20 bp, Artificial Sequence
  chemically synthesized
ctttagctacggttttaaat

SEQ ID NO: 538562 - DNA, 20 bp, Artificial Sequence
  chemically synthesized
ccgtagctaaagtccagacc

SEQ ID NO: 538563 - DNA, 20 bp, Artificial Sequence
  chemically synthesized
atgatttgaaaaccatacct

SEQ ID NO: 538564 - DNA, 20 bp, Artificial Sequence
  chemically synthesized
tctggatgggggggagtcaa

SEQ ID NO: 538565 - DNA, 20 bp, Artificial Sequence
  chemically synthesized
aaagaaagttggggaggaag

SEQ ID NO: 538566 - DNA, 20 bp, Artificial Sequence
  chemically synthesized
ctggctgcactctgaggcct

SEQ ID NO: 538567 - DNA, 20 bp, Artificial Sequence
  chemically synthesized
gggccatgcagtgttaaact

SEQ ID NO: 538568 - DNA, 20 bp, Artificial Sequence
  chemically synthesized
ttgggaactgggatgcctac

SEQ ID NO: 538569 - DNA, 20 bp, Artificial Sequence
  chemically synthesized
aatcctaaatggaaaccaat

SEQ ID NO: 538570 - DNA, 20 bp, Artificial Sequence
  chemically synthesized
gttatgttttctgtcttcaa

SEQ ID NO: 538571 - DNA, 20 bp, Artificial Sequence
  chemically synthesized
tgacccctttctacttgaag

SEQ ID NO: 538572 - DNA, 20 bp, Artificial Sequence
  chemically synthesized
gggtcatgtccatccattca

SEQ ID NO: 538573 - DNA, 20 bp, Artificial Sequence
  chemically synthesized
tgggcgaaacaggtctattt

SEQ ID NO: 538574 - DNA, 20 bp, Artificial Sequence
  chemically synthesized
ctcagaaagcagaaggtttt

SEQ ID NO: 538575 - DNA, 20 bp, Artificial Sequence
  chemically synthesized
acaataagcccaatgttaac

SEQ ID NO: 538576 - DNA, 20 bp, Artificial Sequence
  chemically synthesized
tcaaacatatgagtatacag

SEQ ID NO: 538577 - DNA, 20 bp, Artificial Sequence
  chemically synthesized
ctgttacagtgatgtacagg

SEQ ID NO: 538578 - DNA, 20 bp, Artificial Sequence
  chemically synthesized
caatgagtctttcaatgtgt

SEQ ID NO: 538579 - DNA, 20 bp, Artificial Sequence
  chemically synthesized
acagtgctaatttgaaagtg

SEQ ID NO: 538580 - DNA, 20 bp, Artificial Sequence
  chemically synthesized
aagagagagtaatagcctaa

SEQ ID NO: 538581 - DNA, 20 bp, Artificial Sequence
  chemically synthesized
ggagagagggagggaagcat

SEQ ID NO: 538582 - DNA, 20 bp, Artificial Sequence
  chemically synthesized
agtagaaggtgaagggcata

SEQ ID NO: 538583 - DNA, 20 bp, Artificial Sequence
  chemically synthesized
ggcatagtagaaagggcata

SEQ ID NO: 538584 - DNA, 20 bp, Artificial Sequence
  chemically synthesized
cctttacaaggtggcaagaa

SEQ ID NO: 538585 - DNA, 20 bp, Artificial Sequence
  chemically synthesized
aaaatgagatttgagtgggg

SEQ ID NO: 538586 - DNA, 20 bp, Artificial Sequence
  chemically synthesized
ttgatgaacatgttcatcta

SEQ ID NO: 538587 - DNA, 20 bp, Artificial Sequence
  chemically synthesized
ttcctctcattttatattta

SEQ ID NO: 538588 - DNA, 20 bp, Artificial Sequence
  chemically synthesized
taatcaattacttttttcct

SEQ ID NO: 538589 - DNA, 20 bp, Artificial Sequence
  chemically synthesized
agtaattgattatatgaaga

SEQ ID NO: 538590 - DNA, 20 bp, Artificial Sequence
  chemically synthesized
tgtggaaatgttctaagatg

SEQ ID NO: 538591 - DNA, 20 bp, Artificial Sequence
  chemically synthesized
gttctaagatgttagaaaaa

SEQ ID NO: 538592 - DNA, 20 bp, Artificial Sequence
  chemically synthesized
aaataactaacagagtataa

SEQ ID NO: 538593 - DNA, 20 bp, Artificial Sequence
  chemically synthesized
atatgaaatagtcacatcat

SEQ ID NO: 538594 - DNA, 20 bp, Artificial Sequence
  chemically synthesized
caaagataaaaaacccattg

SEQ ID NO: 538595 - DNA, 20 bp, Artificial Sequence
  chemically synthesized
ccattgaaagaaaaaactta

SEQ ID NO: 538596 - DNA, 20 bp, Artificial Sequence
  chemically synthesized
tgttcaataaaaaatcatta

SEQ ID NO: 538597 - DNA, 20 bp, Artificial Sequence
  chemically synthesized
ctattttaattatttatgca

SEQ ID NO: 538598 - DNA, 20 bp, Artificial Sequence
  chemically synthesized
ctcttgcataaataattaaa

SEQ ID NO: 538599 - DNA, 20 bp, Artificial Sequence
  chemically synthesized
tgcataaataattaaaatag

SEQ ID NO: 538600 - DNA, 20 bp, Artificial Sequence
  chemically synthesized
acgattattagatcaatttg

SEQ ID NO: 538601 - DNA, 20 bp, Artificial Sequence
  chemically synthesized
tttggaaagataattttttt

SEQ ID NO: 538602 - DNA, 20 bp, Artificial Sequence
  chemically synthesized
aatactattgagaaacattt

SEQ ID NO: 538603 - DNA, 20 bp, Artificial Sequence
  chemically synthesized
gtattagaacaaaatactat

SEQ ID NO: 538604 - DNA, 20 bp, Artificial Sequence
  chemically synthesized
attcgaaatccccttacctg

SEQ ID NO: 538605 - DNA, 20 bp, Artificial Sequence
  chemically synthesized
gaagagagtatttgccagct

SEQ ID NO: 538606 - DNA, 20 bp, Artificial Sequence
  chemically synthesized
cagctttagaaagcaaatgt

SEQ ID NO: 538607 - DNA, 20 bp, Artificial Sequence
  chemically synthesized
tacacacaccaaacatataa

SEQ ID NO: 538608 - DNA, 20 bp, Artificial Sequence
  chemically synthesized
ctacttgggaggctgaggca

SEQ ID NO: 538609 - DNA, 20 bp, Artificial Sequence
  chemically synthesized
atggtgcccactgttttaaa

SEQ ID NO: 538610 - DNA, 20 bp, Artificial Sequence
  chemically synthesized
ttcttgtgttcgtattcaat

SEQ ID NO: 538611 - DNA, 20 bp, Artificial Sequence
  chemically synthesized
cacttggcattatatttcaa

SEQ ID NO: 538612 - DNA, 20 bp, Artificial Sequence
  chemically synthesized
tcctgcttcctgtacaacct

SEQ ID NO: 538613 - DNA, 20 bp, Artificial Sequence
  chemically synthesized
gtgttagcatgtattgctat

SEQ ID NO: 538614 - DNA, 20 bp, Artificial Sequence
  chemically synthesized
atacaataggaataaaatcg

SEQ ID NO: 538615 - DNA, 20 bp, Artificial Sequence
  chemically synthesized
atctactctttgtttgatgt

SEQ ID NO: 538616 - DNA, 20 bp, Artificial Sequence
  chemically synthesized
aaccaaaataagactaagca

SEQ ID NO: 538617 - DNA, 20 bp, Artificial Sequence
  chemically synthesized
gattaagtagaggtaacagt

SEQ ID NO: 538618 - DNA, 20 bp, Artificial Sequence
  chemically synthesized
catatactctaaggtggaca

SEQ ID NO: 538619 - DNA, 20 bp, Artificial Sequence
  chemically synthesized
ggtcgtttttaatcctaaag

SEQ ID NO: 538620 - DNA, 20 bp, Artificial Sequence
  chemically synthesized
agacagaataatctacctat

SEQ ID NO: 538621 - DNA, 20 bp, Artificial Sequence
  chemically synthesized
atatagaaatcattaaacaa

SEQ ID NO: 538622 - DNA, 20 bp, Artificial Sequence
  chemically synthesized
gaactaatataatgtactgg

SEQ ID NO: 538623 - DNA, 20 bp, Artificial Sequence
  chemically synthesized
gtgatgacaagggtcaaaat

SEQ ID NO: 538624 - DNA, 20 bp, Artificial Sequence
  chemically synthesized
ttcattacccttctcctcac

SEQ ID NO: 538625 - DNA, 20 bp, Artificial Sequence
  chemically synthesized
aacaaaatagaactctccac

SEQ ID NO: 538626 - DNA, 20 bp, Artificial Sequence
  chemically synthesized
ttcgaaatctacgtttccaa

SEQ ID NO: 538627 - DNA, 20 bp, Artificial Sequence
  chemically synthesized
ttgttttaaataatgcttaa

SEQ ID NO: 538628 - DNA, 20 bp, Artificial Sequence
  chemically synthesized
ttaaaataagaagtatttaa

SEQ ID NO: 538629 - DNA, 20 bp, Artificial Sequence
  chemically synthesized
aaccatagatattattagta

SEQ ID NO: 538630 - DNA, 20 bp, Artificial Sequence
  chemically synthesized
atagatgataaatagatgac

SEQ ID NO: 538631 - DNA, 20 bp, Artificial Sequence
  chemically synthesized
gataaatagatgacagagaa

SEQ ID NO: 538632 - DNA, 20 bp, Artificial Sequence
  chemically synthesized
gatgacagagaaagagaaag

SEQ ID NO: 538633 - DNA, 20 bp, Artificial Sequence
  chemically synthesized
agaaagagaaagatagaaac

SEQ ID NO: 538634 - DNA, 20 bp, Artificial Sequence
  chemically synthesized
cctaaaatctttgcagataa

SEQ ID NO: 538635 - DNA, 20 bp, Artificial Sequence
  chemically synthesized
aattttgcaaatctgtttgt

SEQ ID NO: 538636 - DNA, 20 bp, Artificial Sequence
  chemically synthesized
ttttataaactgatgaacta

SEQ ID NO: 538637 - DNA, 20 bp, Artificial Sequence
  chemically synthesized
tttataaaactagtgaaatg

SEQ ID NO: 538638 - DNA, 20 bp, Artificial Sequence
  chemically synthesized
gataatgataaatattagtg

SEQ ID NO: 538639 - DNA, 20 bp, Artificial Sequence
  chemically synthesized
aaatgaggaagataaaacgt

SEQ ID NO: 538640 - DNA, 20 bp, Artificial Sequence
  chemically synthesized
aaaccttatgatatgtgtca

SEQ ID NO: 538641 - DNA, 20 bp, Artificial Sequence
  chemically synthesized
tgatatgatgtgaaaaatga

SEQ ID NO: 538642 - DNA, 20 bp, Artificial Sequence
  chemically synthesized
aatgaaacatgctactatct

SEQ ID NO: 538643 - DNA, 20 bp, Artificial Sequence
  chemically synthesized
ggtaccaggtatccatccat

SEQ ID NO: 538644 - DNA, 20 bp, Artificial Sequence
  chemically synthesized
aaaggacaaacgaatggagg

SEQ ID NO: 538645 - DNA, 20 bp, Artificial Sequence
  chemically synthesized
tgcgggatacttgagaacga

SEQ ID NO: 538646 - DNA, 20 bp, Artificial Sequence
  chemically synthesized
aaaatgtattatctatatct

SEQ ID NO: 538647 - DNA, 20 bp, Artificial Sequence
  chemically synthesized
gaaatgagtatggaaagctt

SEQ ID NO: 538648 - DNA, 20 bp, Artificial Sequence
  chemically synthesized
tttgtggagggggctcgctt

SEQ ID NO: 538649 - DNA, 20 bp, Artificial Sequence
  chemically synthesized
aaaaatacagcttgaatgat

SEQ ID NO: 538650 - DNA, 20 bp, Artificial Sequence
  chemically synthesized
cagtgtaaggaacaccccag

SEQ ID NO: 538651 - DNA, 20 bp, Artificial Sequence
  chemically synthesized
cttacactgtattccatccc

SEQ ID NO: 538652 - DNA, 20 bp, Artificial Sequence
  chemically synthesized
gtttaaacgagataatttat

SEQ ID NO: 538653 - DNA, 20 bp, Artificial Sequence
  chemically synthesized
atacgtttattaaaaaactg

SEQ ID NO: 538654 - DNA, 20 bp, Artificial Sequence
  chemically synthesized
aatcagtagagtataaacaa

SEQ ID NO: 538655 - DNA, 20 bp, Artificial Sequence
  chemically synthesized
ccctatactatttgatatag

SEQ ID NO: 538656 - DNA, 20 bp, Artificial Sequence
  chemically synthesized
tttagggagttattaagtct

SEQ ID NO: 538657 - DNA, 20 bp, Artificial Sequence
  chemically synthesized
tgtaataatgctgataaatg

SEQ ID NO: 538658 - DNA, 20 bp, Artificial Sequence
  chemically synthesized
gtttaattgtacattttaat

SEQ ID NO: 538659 - DNA, 20 bp, Artificial Sequence
  chemically synthesized
gtgcctttattgtagtaagg

SEQ ID NO: 538660 - DNA, 20 bp, Artificial Sequence
  chemically synthesized
attgtaatagactccctttt

SEQ ID NO: 538661 - DNA, 20 bp, Artificial Sequence
  chemically synthesized
gtgtttttatttcagttaac

SEQ ID NO: 538662 - DNA, 20 bp, Artificial Sequence
  chemically synthesized
acactattttgctaggattt

SEQ ID NO: 538663 - DNA, 20 bp, Artificial Sequence
  chemically synthesized
tgtctaacctatactttatg

SEQ ID NO: 538664 - DNA, 20 bp, Artificial Sequence
  chemically synthesized
ttaataatatgaaagctgat

SEQ ID NO: 538665 - DNA, 20 bp, Artificial Sequence
  chemically synthesized
tgttgaaatatagtgtaatg

SEQ ID NO: 538666 - DNA, 20 bp, Artificial Sequence
  chemically synthesized
taatgatagaatgtaatttt

SEQ ID NO: 538667 - DNA, 20 bp, Artificial Sequence
  chemically synthesized
gaaatgtttaaataaataat

SEQ ID NO: 538668 - DNA, 20 bp, Artificial Sequence
  chemically synthesized
ctagtgtgtctactatttgc

SEQ ID NO: 538669 - DNA, 20 bp, Artificial Sequence
  chemically synthesized
taggtgaagtgaatgaatat

SEQ ID NO: 538670 - DNA, 20 bp, Artificial Sequence
  chemically synthesized
gaacggctcaatgatgatat

SEQ ID NO: 538671 - DNA, 20 bp, Artificial Sequence
  chemically synthesized
agggtttgcttgtggtggag

SEQ ID NO: 538672 - DNA, 20 bp, Artificial Sequence
  chemically synthesized
tttgaagtaatttgggaaat

SEQ ID NO: 538673 - DNA, 20 bp, Artificial Sequence
  chemically synthesized
cccaggaattttcgtattgg

SEQ ID NO: 538674 - DNA, 20 bp, Artificial Sequence
  chemically synthesized
catacttttatactgcactt

SEQ ID NO: 538675 - DNA, 20 bp, Artificial Sequence
  chemically synthesized
gcctagatggtctgcccaac

SEQ ID NO: 538676 - DNA, 20 bp, Artificial Sequence
  chemically synthesized
tgttaagattcatttggggt

SEQ ID NO: 538677 - DNA, 20 bp, Artificial Sequence
  chemically synthesized
caggtgactggtgaaacagg

SEQ ID NO: 538678 - DNA, 20 bp, Artificial Sequence
  chemically synthesized
aaatatgggtcactcgaagt

SEQ ID NO: 538679 - DNA, 20 bp, Artificial Sequence
  chemically synthesized
gtaaagtgggctaggaaatt

SEQ ID NO: 538680 - DNA, 20 bp, Artificial Sequence
  chemically synthesized
ccggtcttctcattgtatgt

SEQ ID NO: 538681 - DNA, 20 bp, Artificial Sequence
  chemically synthesized
ctcattgtatgttcagaata

SEQ ID NO: 538682 - DNA, 20 bp, Artificial Sequence
  chemically synthesized
ataaaagaaaaggaccacga

SEQ ID NO: 538683 - DNA, 20 bp, Artificial Sequence
  chemically synthesized
cattagtttagtcaggtaat

SEQ ID NO: 538684 - DNA, 20 bp, Artificial Sequence
  chemically synthesized
tccaccaaaacatcactgct

SEQ ID NO: 538685 - DNA, 20 bp, Artificial Sequence
  chemically synthesized
gtcttcccaaagtctttcat

SEQ ID NO: 538686 - DNA, 20 bp, Artificial Sequence
  chemically synthesized
tttgggaagacttgggcaat

SEQ ID NO: 538687 - DNA, 20 bp, Artificial Sequence
  chemically synthesized
tttatcttcctaaaatagtt

SEQ ID NO: 538688 - DNA, 20 bp, Artificial Sequence
  chemically synthesized
aggtcacgcattcatggatc

SEQ ID NO: 538689 - DNA, 20 bp, Artificial Sequence
  chemically synthesized
aatctaagaagctctcaaat

SEQ ID NO: 538690 - DNA, 20 bp, Artificial Sequence
  chemically synthesized
atctgttagggatgcttaga

SEQ ID NO: 538691 - DNA, 20 bp, Artificial Sequence
  chemically synthesized
tgtgatgctcaaaatactat

SEQ ID NO: 538692 - DNA, 20 bp, Artificial Sequence
  chemically synthesized
atgataaaaagaagtatagg

SEQ ID NO: 538693 - DNA, 20 bp, Artificial Sequence
  chemically synthesized
tagtagtttactagatcaac

SEQ ID NO: 538694 - DNA, 20 bp, Artificial Sequence
  chemically synthesized
gaataagggaatgatacaca

SEQ ID NO: 538695 - DNA, 20 bp, Artificial Sequence
  chemically synthesized
tgaacaagagctaacaaagt

SEQ ID NO: 538696 - DNA, 20 bp, Artificial Sequence
  chemically synthesized
atgtgtggcttgagagtggg

SEQ ID NO: 538697 - DNA, 20 bp, Artificial Sequence
  chemically synthesized
gatttaaagaactattttaa

SEQ ID NO: 538698 - DNA, 20 bp, Artificial Sequence
  chemically synthesized
atatagtctttttttaaaaa

SEQ ID NO: 538699 - DNA, 20 bp, Artificial Sequence
  chemically synthesized
gaagaggactgaggaaccaa

SEQ ID NO: 538700 - DNA, 20 bp, Artificial Sequence
  chemically synthesized
agtataataaaaaaaaaaaa

SEQ ID NO: 538701 - DNA, 20 bp, Artificial Sequence
  chemically synthesized
aggtcaattagaattttttt

SEQ ID NO: 538702 - DNA, 20 bp, Artificial Sequence
  chemically synthesized
aaataatgtgcacaggtcaa

SEQ ID NO: 538703 - DNA, 20 bp, Artificial Sequence
  chemically synthesized
ataacaagtgtttgccaaag

SEQ ID NO: 538704 - DNA, 20 bp, Artificial Sequence
  chemically synthesized
ctattaaatttccttcacat

SEQ ID NO: 538705 - DNA, 20 bp, Artificial Sequence
  chemically synthesized
agagaaagagttaaggtatt

SEQ ID NO: 538706 - DNA, 20 bp, Artificial Sequence
  chemically synthesized
cctcccctctctcacacatt

SEQ ID NO: 538707 - DNA, 20 bp, Artificial Sequence
  chemically synthesized
ggagagagagatcaaaggac

SEQ ID NO: 538708 - DNA, 20 bp, Artificial Sequence
  chemically synthesized
ccagagatacaaggatgcaa

SEQ ID NO: 538709 - DNA, 20 bp, Artificial Sequence
  chemically synthesized
agaataactagattttggaa

SEQ ID NO: 538710 - DNA, 20 bp, Artificial Sequence
  chemically synthesized
ttcgttcttaacgtttttgc

SEQ ID NO: 538711 - DNA, 20 bp, Artificial Sequence
  chemically synthesized
aacgttaagaacgaactttg

SEQ ID NO: 538712 - DNA, 20 bp, Artificial Sequence
  chemically synthesized
aaacagcccatcatagagta

SEQ ID NO: 538713 - DNA, 20 bp, Artificial Sequence
  chemically synthesized
caatctcctcattcataaga

SEQ ID NO: 538714 - DNA, 20 bp, Artificial Sequence
  chemically synthesized
acattactctgtttaattta

SEQ ID NO: 538715 - DNA, 20 bp, Artificial Sequence
  chemically synthesized
cttgcctgttgagcataaat

SEQ ID NO: 538716 - DNA, 20 bp, Artificial Sequence
  chemically synthesized
aaataaattatagctagata

SEQ ID NO: 538717 - DNA, 20 bp, Artificial Sequence
  chemically synthesized
attttacattgtttactttt

SEQ ID NO: 538718 - DNA, 20 bp, Artificial Sequence
  chemically synthesized
tgtcaagttcttcctttgcc

SEQ ID NO: 538719 - DNA, 20 bp, Artificial Sequence
  chemically synthesized
cattttatataacttctttg

SEQ ID NO: 538720 - DNA, 20 bp, Artificial Sequence
  chemically synthesized
agtggctctactatttttct

SEQ ID NO: 538721 - DNA, 20 bp, Artificial Sequence
  chemically synthesized
actgtgattttatgcattct

SEQ ID NO: 538722 - DNA, 20 bp, Artificial Sequence
  chemically synthesized
cctgtctgtttgtatctaac

SEQ ID NO: 538723 - DNA, 20 bp, Artificial Sequence
  chemically synthesized
agaaactgagggttggagaa

SEQ ID NO: 538724 - DNA, 20 bp, Artificial Sequence
  chemically synthesized
agatggagaaactgagggtt

SEQ ID NO: 538725 - DNA, 20 bp, Artificial Sequence
  chemically synthesized
aactttcttatttccaagat

SEQ ID NO: 538726 - DNA, 20 bp, Artificial Sequence
  chemically synthesized
cagtttctccatcttggaaa

SEQ ID NO: 538727 - DNA, 20 bp, Artificial Sequence
  chemically synthesized
gcattgtccttccaactgct

SEQ ID NO: 538728 - DNA, 20 bp, Artificial Sequence
  chemically synthesized
tctttttctaagtctttgag

SEQ ID NO: 538729 - DNA, 20 bp, Artificial Sequence
  chemically synthesized
ccattttcttcctcaaagac

SEQ ID NO: 538730 - DNA, 20 bp, Artificial Sequence
  chemically synthesized
aaggaaatattaagattaga

SEQ ID NO: 538731 - DNA, 20 bp, Artificial Sequence
  chemically synthesized
agaaaaaagccaaaattgaa

SEQ ID NO: 538732 - DNA, 20 bp, Artificial Sequence
  chemically synthesized
caaaattgaaatagaaaaca

SEQ ID NO: 538733 - DNA, 20 bp, Artificial Sequence
  chemically synthesized
gaaaattcaaataagtaaaa

SEQ ID NO: 538734 - DNA, 20 bp, Artificial Sequence
  chemically synthesized
acattacaactggtatccaa

SEQ ID NO: 538735 - DNA, 20 bp, Artificial Sequence
  chemically synthesized
gtaaacaactgtatgttaac

SEQ ID NO: 538736 - DNA, 20 bp, Artificial Sequence
  chemically synthesized
atctaccaatattgaatctt

SEQ ID NO: 538737 - DNA, 20 bp, Artificial Sequence
  chemically synthesized
caatattgaatcttgaagaa

SEQ ID NO: 538738 - DNA, 20 bp, Artificial Sequence
  chemically synthesized
gtagtccaaaaccttccaac

SEQ ID NO: 538739 - DNA, 20 bp, Artificial Sequence
  chemically synthesized
aaatctaatgaacagttaaa

SEQ ID NO: 538740 - DNA, 20 bp, Artificial Sequence
  chemically synthesized
accaatccttctcaaattct

SEQ ID NO: 538741 - DNA, 20 bp, Artificial Sequence
  chemically synthesized
ctcttctctttaatttttct

SEQ ID NO: 538742 - DNA, 20 bp, Artificial Sequence
  chemically synthesized
tcaggatactgatgcccctt

SEQ ID NO: 538743 - DNA, 20 bp, Artificial Sequence
  chemically synthesized
aaagtcaataaaagacacta

SEQ ID NO: 538744 - DNA, 20 bp, Artificial Sequence
  chemically synthesized
attgaaccatttttgcattc

SEQ ID NO: 538745 - DNA, 20 bp, Artificial Sequence
  chemically synthesized
ctatggtcatctcaatagct

SEQ ID NO: 538746 - DNA, 20 bp, Artificial Sequence
  chemically synthesized
gaaaatcttttcccttaaga

SEQ ID NO: 538747 - DNA, 20 bp, Artificial Sequence
  chemically synthesized
ccttaagatcagaaacaaga

SEQ ID NO: 538748 - DNA, 20 bp, Artificial Sequence
  chemically synthesized
tactagccagaacaattaga

SEQ ID NO: 538749 - DNA, 20 bp, Artificial Sequence
  chemically synthesized
ccagaacaattagataagaa

SEQ ID NO: 538750 - DNA, 20 bp, Artificial Sequence
  chemically synthesized
caaattagatgatctgatac

SEQ ID NO: 538751 - DNA, 20 bp, Artificial Sequence
  chemically synthesized
tgtttttatgttgctagcgt

SEQ ID NO: 538752 - DNA, 20 bp, Artificial Sequence
  chemically synthesized
gcaacataaaaacaggaaat

SEQ ID NO: 538753 - DNA, 20 bp, Artificial Sequence
  chemically synthesized
ctcatttacaatagcaataa

SEQ ID NO: 538754 - DNA, 20 bp, Artificial Sequence
  chemically synthesized
aaagctatgaaatattgttg

SEQ ID NO: 538755 - DNA, 20 bp, Artificial Sequence
  chemically synthesized
taatcccaatcgcatttttt

SEQ ID NO: 538756 - DNA, 20 bp, Artificial Sequence
  chemically synthesized
gccaaaacagtcttgaggaa

SEQ ID NO: 538757 - DNA, 20 bp, Artificial Sequence
  chemically synthesized
cagacatatagaccaatgga

SEQ ID NO: 538758 - DNA, 20 bp, Artificial Sequence
  chemically synthesized
aatggaacagaatagagatc

SEQ ID NO: 538759 - DNA, 20 bp, Artificial Sequence
  chemically synthesized
atcaccttcaataggggtgc

SEQ ID NO: 538760 - DNA, 20 bp, Artificial Sequence
  chemically synthesized
aaactggatatacacattgc

SEQ ID NO: 538761 - DNA, 20 bp, Artificial Sequence
  chemically synthesized
ctgaaactatgaaactcata

SEQ ID NO: 538762 - DNA, 20 bp, Artificial Sequence
  chemically synthesized
acaaaaacaaaactagataa

SEQ ID NO: 538763 - DNA, 20 bp, Artificial Sequence
  chemically synthesized
caaagcaagggaaacaatca

SEQ ID NO: 538764 - DNA, 20 bp, Artificial Sequence
  chemically synthesized
aacagaattaaaagcaacct

SEQ ID NO: 538765 - DNA, 20 bp, Artificial Sequence
  chemically synthesized
taaaagcaacctatagaatg

SEQ ID NO: 538766 - DNA, 20 bp, Artificial Sequence
  chemically synthesized
gtcattttaatgtcttcttt

SEQ ID NO: 538767 - DNA, 20 bp, Artificial Sequence
  chemically synthesized
ggtaagatttcctttttgtg

SEQ ID NO: 538768 - DNA, 20 bp, Artificial Sequence
  chemically synthesized
tatctaaagtagtcaaaatt

SEQ ID NO: 538769 - DNA, 20 bp, Artificial Sequence
  chemically synthesized
aagtagtcaaaattatagaa

SEQ ID NO: 538770 - DNA, 20 bp, Artificial Sequence
  chemically synthesized
ttgctaagggctggaggagg

SEQ ID NO: 538771 - DNA, 20 bp, Artificial Sequence
  chemically synthesized
aataaaaacaagtgcttcat

SEQ ID NO: 538772 - DNA, 20 bp, Artificial Sequence
  chemically synthesized
caatgattaagttcattaac

SEQ ID NO: 538773 - DNA, 20 bp, Artificial Sequence
  chemically synthesized
gaaatggtatacctgacaac

SEQ ID NO: 538774 - DNA, 20 bp, Artificial Sequence
  chemically synthesized
cagtgtgagatcattgtgaa

SEQ ID NO: 538775 - DNA, 20 bp, Artificial Sequence
  chemically synthesized
aacggaagtagacttgaagg

SEQ ID NO: 538776 - DNA, 20 bp, Artificial Sequence
  chemically synthesized
atctgatgttttagtttttt

SEQ ID NO: 538777 - DNA, 20 bp, Artificial Sequence
  chemically synthesized
aatagctgtagagattcaaa

SEQ ID NO: 538778 - DNA, 20 bp, Artificial Sequence
  chemically synthesized
caccgattacttgcacagtg

SEQ ID NO: 538779 - DNA, 20 bp, Artificial Sequence
  chemically synthesized
cactgagtttactgatgacc

SEQ ID NO: 538780 - DNA, 20 bp, Artificial Sequence
  chemically synthesized
aaggagctttataatgcaac

SEQ ID NO: 538781 - DNA, 20 bp, Artificial Sequence
  chemically synthesized
gttgcattataaagctcctt

SEQ ID NO: 538782 - DNA, 20 bp, Artificial Sequence
  chemically synthesized
gtttttttctaggtctctta

SEQ ID NO: 538783 - DNA, 20 bp, Artificial Sequence
  chemically synthesized
atcactttctggtaagagac

SEQ ID NO: 538784 - DNA, 20 bp, Artificial Sequence
  chemically synthesized
aaaattcagagggcagtttg

SEQ ID NO: 538785 - DNA, 20 bp, Artificial Sequence
  chemically synthesized
aataaagcatcattaacctg

SEQ ID NO: 538786 - DNA, 20 bp, Artificial Sequence
  chemically synthesized
tgtctatcactaggaacatt

SEQ ID NO: 538787 - DNA, 20 bp, Artificial Sequence
  chemically synthesized
agctccaaacctgaaacttt

SEQ ID NO: 538788 - DNA, 20 bp, Artificial Sequence
  chemically synthesized
aatgtagagaagtggttcaa

SEQ ID NO: 538789 - DNA, 20 bp, Artificial Sequence
  chemically synthesized
tctcattgagctctaacctt

SEQ ID NO: 538790 - DNA, 20 bp, Artificial Sequence
  chemically synthesized
accccaggccagggcagagt

SEQ ID NO: 538791 - DNA, 20 bp, Artificial Sequence
  chemically synthesized
ataaacaactgcttagatct

SEQ ID NO: 538792 - DNA, 20 bp, Artificial Sequence
  chemically synthesized
taatattaccaacataccta

SEQ ID NO: 538793 - DNA, 20 bp, Artificial Sequence
  chemically synthesized
gccattaaaatttggaagag

SEQ ID NO: 538794 - DNA, 20 bp, Artificial Sequence
  chemically synthesized
gtattcctcatctcagctgg

SEQ ID NO: 538795 - DNA, 20 bp, Artificial Sequence
  chemically synthesized
aaagtgtctcagtacgatga

SEQ ID NO: 538796 - DNA, 20 bp, Artificial Sequence
  chemically synthesized
tagtcagagcacaactgtag

SEQ ID NO: 538797 - DNA, 20 bp, Artificial Sequence
  chemically synthesized
cttgtagtcagagcacaact

SEQ ID NO: 538798 - DNA, 20 bp, Artificial Sequence
  chemically synthesized
aggcgattcagcattggaat

SEQ ID NO: 538799 - DNA, 20 bp, Artificial Sequence
  chemically synthesized
actgcttataaccttggaat

SEQ ID NO: 538800 - DNA, 20 bp, Artificial Sequence
  chemically synthesized
acaaaaacaaaagacctatt

SEQ ID NO: 538801 - DNA, 20 bp, Artificial Sequence
  chemically synthesized
ttcgtggtgttgctctagct

SEQ ID NO: 538802 - DNA, 20 bp, Artificial Sequence
  chemically synthesized
tttgtcactaaaatgatgag

SEQ ID NO: 538803 - DNA, 20 bp, Artificial Sequence
  chemically synthesized
atgctcagccttcctatagc

SEQ ID NO: 538804 - DNA, 20 bp, Artificial Sequence
  chemically synthesized
catgtggactctgtaattta

SEQ ID NO: 538805 - DNA, 20 bp, Artificial Sequence
  chemically synthesized
aagacctggagaaatcagca

SEQ ID NO: 538806 - DNA, 20 bp, Artificial Sequence
  chemically synthesized
catgctgatttctccaggtc

SEQ ID NO: 538807 - DNA, 20 bp, Artificial Sequence
  chemically synthesized
acctcagatttctaagacct

SEQ ID NO: 538808 - DNA, 20 bp, Artificial Sequence
  chemically synthesized
caagcagttatgtaaagtgt

SEQ ID NO: 538809 - DNA, 20 bp, Artificial Sequence
  chemically synthesized
tgtaaagtgtaaagaattgg

SEQ ID NO: 538810 - DNA, 20 bp, Artificial Sequence
  chemically synthesized
caaatgacaaccaattgtat

SEQ ID NO: 538811 - DNA, 20 bp, Artificial Sequence
  chemically synthesized
tgaagaaatgttaaacacaa

SEQ ID NO: 538812 - DNA, 20 bp, Artificial Sequence
  chemically synthesized
tgttaaacacaattagaatg

SEQ ID NO: 538813 - DNA, 20 bp, Artificial Sequence
  chemically synthesized
aggagttagtgaatgctacc

SEQ ID NO: 538814 - DNA, 20 bp, Artificial Sequence
  chemically synthesized
ctaagaatacagatattaac

SEQ ID NO: 538815 - DNA, 20 bp, Artificial Sequence
  chemically synthesized
ttacgtgacaagagctagac

SEQ ID NO: 538816 - DNA, 20 bp, Artificial Sequence
  chemically synthesized
atataaactttccttttaaa

SEQ ID NO: 538817 - DNA, 20 bp, Artificial Sequence
  chemically synthesized
ttttaatatatataacatat

SEQ ID NO: 538818 - DNA, 20 bp, Artificial Sequence
  chemically synthesized
ggatgattcacatgaacact

SEQ ID NO: 538819 - DNA, 20 bp, Artificial Sequence
  chemically synthesized
agaaagttaaatggggcaag

SEQ ID NO: 538820 - DNA, 20 bp, Artificial Sequence
  chemically synthesized
tcctttttacttatactttt

SEQ ID NO: 538821 - DNA, 20 bp, Artificial Sequence
  chemically synthesized
aagtataagtaaaaaggatt

SEQ ID NO: 538822 - DNA, 20 bp, Artificial Sequence
  chemically synthesized
aaacaagcagcttgccatat

SEQ ID NO: 538823 - DNA, 20 bp, Artificial Sequence
  chemically synthesized
agccagtccaaacaagtaaa

SEQ ID NO: 538824 - DNA, 20 bp, Artificial Sequence
  chemically synthesized
aactgatattcaattttgga

SEQ ID NO: 538825 - DNA, 20 bp, Artificial Sequence
  chemically synthesized
aaacattatctcaagctttg

SEQ ID NO: 538826 - DNA, 20 bp, Artificial Sequence
  chemically synthesized
tgttatacttttccatttgt

SEQ ID NO: 538827 - DNA, 20 bp, Artificial Sequence
  chemically synthesized
atacttaaaacattatttga

SEQ ID NO: 538828 - DNA, 20 bp, Artificial Sequence
  chemically synthesized
ctataaatcttttgattagg

SEQ ID NO: 538829 - DNA, 20 bp, Artificial Sequence
  chemically synthesized
gtcttagcaacgagaacatt

SEQ ID NO: 538830 - DNA, 20 bp, Artificial Sequence
  chemically synthesized
ctaagactttagagctagcc

SEQ ID NO: 538831 - DNA, 20 bp, Artificial Sequence
  chemically synthesized
ataagtatatttgaaagata

SEQ ID NO: 538832 - DNA, 20 bp, Artificial Sequence
  chemically synthesized
tacaaaaaataataaaaagt

SEQ ID NO: 538833 - DNA, 20 bp, Artificial Sequence
  chemically synthesized
tatatttgtgggttacttat

SEQ ID NO: 538834 - DNA, 20 bp, Artificial Sequence
  chemically synthesized
atcgcggatattaaaactga

SEQ ID NO: 538835 - DNA, 20 bp, Artificial Sequence
  chemically synthesized
ttgacattaagatttactaa

SEQ ID NO: 538836 - DNA, 20 bp, Artificial Sequence
  chemically synthesized
tatgatggatgcttccaatt

SEQ ID NO: 538837 - DNA, 20 bp, Artificial Sequence
  chemically synthesized
gatgcttccaattgtagaat

SEQ ID NO: 538838 - DNA, 20 bp, Artificial Sequence
  chemically synthesized
acaagtttaaaatgtaaact

SEQ ID NO: 538839 - DNA, 20 bp, Artificial Sequence
  chemically synthesized
tgtttggactgaatatataa

SEQ ID NO: 538840 - DNA, 20 bp, Artificial Sequence
  chemically synthesized
atattagataattcattcgt

SEQ ID NO: 538841 - DNA, 20 bp, Artificial Sequence
  chemically synthesized
atgagataaacatgtttata

SEQ ID NO: 538842 - DNA, 20 bp, Artificial Sequence
  chemically synthesized
cactataagataaacactat

SEQ ID NO: 538843 - DNA, 20 bp, Artificial Sequence
  chemically synthesized
cttcacacatgcacacacac

SEQ ID NO: 538844 - DNA, 20 bp, Artificial Sequence
  chemically synthesized
ctatgtgtgtgtgcatgtgt

SEQ ID NO: 538845 - DNA, 20 bp, Artificial Sequence
  chemically synthesized
tgacaagtagtcaagtggat

SEQ ID NO: 538846 - DNA, 20 bp, Artificial Sequence
  chemically synthesized
attttacacttagatataac

SEQ ID NO: 538847 - DNA, 20 bp, Artificial Sequence
  chemically synthesized
aagtgtaaaatgcagacata

SEQ ID NO: 538848 - DNA, 20 bp, Artificial Sequence
  chemically synthesized
acttttatcacctagaaagc

SEQ ID NO: 538849 - DNA, 20 bp, Artificial Sequence
  chemically synthesized
taattaggcacttttatcac

SEQ ID NO: 538850 - DNA, 20 bp, Artificial Sequence
  chemically synthesized
aataaaatcctttaagatgc

SEQ ID NO: 538851 - DNA, 20 bp, Artificial Sequence
  chemically synthesized
acaggaaattcagatatact

SEQ ID NO: 538852 - DNA, 20 bp, Artificial Sequence
  chemically synthesized
tggcctgtgggaaaatttgg

SEQ ID NO: 538853 - DNA, 20 bp, Artificial Sequence
  chemically synthesized
tgaatgcctaagcaacattt

SEQ ID NO: 538854 - DNA, 20 bp, Artificial Sequence
  chemically synthesized
acgaagcaaccaatgataaa

SEQ ID NO: 538855 - DNA, 20 bp, Artificial Sequence
  chemically synthesized
aaagacagtgcaagtttgcc

SEQ ID NO: 538856 - DNA, 20 bp, Artificial Sequence
  chemically synthesized
cttttgagaatcagactatg

SEQ ID NO: 538857 - DNA, 20 bp, Artificial Sequence
  chemically synthesized
agtctgattctcaaaagcaa

SEQ ID NO: 538858 - DNA, 20 bp, Artificial Sequence
  chemically synthesized
gaagtgattctaattgcttt

SEQ ID NO: 538859 - DNA, 20 bp, Artificial Sequence
  chemically synthesized
tgttcacatagcactgacaa

SEQ ID NO: 538860 - DNA, 20 bp, Artificial Sequence
  chemically synthesized
tgggtaagctgcttccagga

SEQ ID NO: 538861 - DNA, 20 bp, Artificial Sequence
  chemically synthesized
cactccgtatttctctctgt

SEQ ID NO: 538862 - DNA, 20 bp, Artificial Sequence
  chemically synthesized
atttcaaaaattctaaacag

SEQ ID NO: 538863 - DNA, 20 bp, Artificial Sequence
  chemically synthesized
atttaagcaaattacagtgt

SEQ ID NO: 538864 - DNA, 20 bp, Artificial Sequence
  chemically synthesized
aaatacaggatatgttgata

SEQ ID NO: 538865 - DNA, 20 bp, Artificial Sequence
  chemically synthesized
acagacattgtctttacttg

SEQ ID NO: 538866 - DNA, 20 bp, Artificial Sequence
  chemically synthesized
agtgctaaacatctttggcc

SEQ ID NO: 538867 - DNA, 20 bp, Artificial Sequence
  chemically synthesized
taataaaattgagcaataaa

SEQ ID NO: 538868 - DNA, 20 bp, Artificial Sequence
  chemically synthesized
aaaacatgcacatacttttg

SEQ ID NO: 538869 - DNA, 20 bp, Artificial Sequence
  chemically synthesized
aagaagattcactgtcgagg

SEQ ID NO: 538870 - DNA, 20 bp, Artificial Sequence
  chemically synthesized
aaaaatctcaacagtctaaa

SEQ ID NO: 538871 - DNA, 20 bp, Artificial Sequence
  chemically synthesized
tgatatggatatgtcatgtt

SEQ ID NO: 538872 - DNA, 20 bp, Artificial Sequence
  chemically synthesized
gaaaaatattacagtaagaa

SEQ ID NO: 538873 - DNA, 20 bp, Artificial Sequence
  chemically synthesized
acctgtgaagagggacatgg

SEQ ID NO: 538874 - DNA, 20 bp, Artificial Sequence
  chemically synthesized
taagatatgttcagagactg

SEQ ID NO: 538875 - DNA, 20 bp, Artificial Sequence
  chemically synthesized
tacacatgggtagtcaggta

SEQ ID NO: 538876 - DNA, 20 bp, Artificial Sequence
  chemically synthesized
tagttaccaacgatggatgg

SEQ ID NO: 538877 - DNA, 20 bp, Artificial Sequence
  chemically synthesized
ggatggatagaaatattgtt

SEQ ID NO: 538878 - DNA, 20 bp, Artificial Sequence
  chemically synthesized
tatagtggaaatggggatat

SEQ ID NO: 538879 - DNA, 20 bp, Artificial Sequence
  chemically synthesized
tgctcttctcacttaaaaca

SEQ ID NO: 538880 - DNA, 20 bp, Artificial Sequence
  chemically synthesized
aaattttcagacacatggac

SEQ ID NO: 538881 - DNA, 20 bp, Artificial Sequence
  chemically synthesized
tttatctttctgacagatta

SEQ ID NO: 538882 - DNA, 20 bp, Artificial Sequence
  chemically synthesized
ttacatattctgataatctg

SEQ ID NO: 538883 - DNA, 20 bp, Artificial Sequence
  chemically synthesized
tgactggtaacaaaaatgca

SEQ ID NO: 538884 - DNA, 20 bp, Artificial Sequence
  chemically synthesized
gaattcacactgtgatcaaa

SEQ ID NO: 538885 - DNA, 20 bp, Artificial Sequence
  chemically synthesized
tctccgacatgacttgatac

SEQ ID NO: 538886 - DNA, 20 bp, Artificial Sequence
  chemically synthesized
tagaattgaagatggcaaca

SEQ ID NO: 538887 - DNA, 20 bp, Artificial Sequence
  chemically synthesized
gagctaaatgttaggtactt

SEQ ID NO: 538888 - DNA, 20 bp, Artificial Sequence
  chemically synthesized
ctaagcaaattaacataaga

SEQ ID NO: 538889 - DNA, 20 bp, Artificial Sequence
  chemically synthesized
atactatacagccacgaaaa

SEQ ID NO: 538890 - DNA, 20 bp, Artificial Sequence
  chemically synthesized
cattactgagtagatatcca

SEQ ID NO: 538891 - DNA, 20 bp, Artificial Sequence
  chemically synthesized
tagttctattttaagttctt

SEQ ID NO: 538892 - DNA, 20 bp, Artificial Sequence
  chemically synthesized
tgttaattagttcagccact

SEQ ID NO: 538893 - DNA, 20 bp, Artificial Sequence
  chemically synthesized
gcgtcacatcactcatcatc

SEQ ID NO: 538894 - DNA, 20 bp, Artificial Sequence
  chemically synthesized
gctgcgtgtatatcttcttt

SEQ ID NO: 538895 - DNA, 20 bp, Artificial Sequence
  chemically synthesized
atctgacggtggtgtaatat

SEQ ID NO: 538896 - DNA, 20 bp, Artificial Sequence
  chemically synthesized
aaacagacaaacaccaaatg

SEQ ID NO: 538897 - DNA, 20 bp, Artificial Sequence
  chemically synthesized
attctggacattggcttggg

SEQ ID NO: 538898 - DNA, 20 bp, Artificial Sequence
  chemically synthesized
attctttcccaagccaatgt

SEQ ID NO: 538899 - DNA, 20 bp, Artificial Sequence
  chemically synthesized
gacttcaagctataagaatc

SEQ ID NO: 538900 - DNA, 20 bp, Artificial Sequence
  chemically synthesized
aaatgtaagacttcaagcta

SEQ ID NO: 538901 - DNA, 20 bp, Artificial Sequence
  chemically synthesized
tgtacacatagaccaataga

SEQ ID NO: 538902 - DNA, 20 bp, Artificial Sequence
  chemically synthesized
ctgagattacccttctcatt

SEQ ID NO: 538903 - DNA, 20 bp, Artificial Sequence
  chemically synthesized
catattgacctgacaactgg

SEQ ID NO: 538904 - DNA, 20 bp, Artificial Sequence
  chemically synthesized
atcataccaaaaggaagtaa

SEQ ID NO: 538905 - DNA, 20 bp, Artificial Sequence
  chemically synthesized
tggtatgatggcattgaaaa

SEQ ID NO: 538906 - DNA, 20 bp, Artificial Sequence
  chemically synthesized
acgcttgtatcaaaatatca

SEQ ID NO: 538907 - DNA, 20 bp, Artificial Sequence
  chemically synthesized
atcaaaatatcactagaatc

SEQ ID NO: 538908 - DNA, 20 bp, Artificial Sequence
  chemically synthesized
ctaaatctaaatatgtttct

SEQ ID NO: 538909 - DNA, 20 bp, Artificial Sequence
  chemically synthesized
tgacattcttccttttttct

SEQ ID NO: 538910 - DNA, 20 bp, Artificial Sequence
  chemically synthesized
tatgtttctttagaaaaaag

SEQ ID NO: 538911 - DNA, 20 bp, Artificial Sequence
  chemically synthesized
ttctaccataattatgtata

SEQ ID NO: 538912 - DNA, 20 bp, Artificial Sequence
  chemically synthesized
ttctcatatacataattatg

SEQ ID NO: 538913 - DNA, 20 bp, Artificial Sequence
  chemically synthesized
tgcccacaaatctattgcta

SEQ ID NO: 538914 - DNA, 20 bp, Artificial Sequence
  chemically synthesized
tgtaactttctcgaagcagc

SEQ ID NO: 538915 - DNA, 20 bp, Artificial Sequence
  chemically synthesized
cagaactttctctgctgctt

SEQ ID NO: 538916 - DNA, 20 bp, Artificial Sequence
  chemically synthesized
aaaaaagatcaaactatgtt

SEQ ID NO: 538917 - DNA, 20 bp, Artificial Sequence
  chemically synthesized
ttttttcatttgaagcagta

SEQ ID NO: 538918 - DNA, 20 bp, Artificial Sequence
  chemically synthesized
gtcctaaatttaaattggag

SEQ ID NO: 538919 - DNA, 20 bp, Artificial Sequence
  chemically synthesized
acacattcattacctgcatt

SEQ ID NO: 538920 - DNA, 20 bp, Artificial Sequence
  chemically synthesized
ctatgtcagtgttacataga

SEQ ID NO: 538921 - DNA, 20 bp, Artificial Sequence
  chemically synthesized
atctatgtaacactgacata

SEQ ID NO: 538922 - DNA, 20 bp, Artificial Sequence
  chemically synthesized
gtcacttacatcatgcttcc

SEQ ID NO: 538923 - DNA, 20 bp, Artificial Sequence
  chemically synthesized
ccatcaatcgacaagtagat

SEQ ID NO: 538924 - DNA, 20 bp, Artificial Sequence
  chemically synthesized
gctatgaggatgcaaaggca

SEQ ID NO: 538925 - DNA, 20 bp, Artificial Sequence
  chemically synthesized
gggctttggagacttggggg

SEQ ID NO: 538926 - DNA, 20 bp, Artificial Sequence
  chemically synthesized
tactcattgcaatagtttgc

SEQ ID NO: 538927 - DNA, 20 bp, Artificial Sequence
  chemically synthesized
ccgacaatgatagactggat

SEQ ID NO: 538928 - DNA, 20 bp, Artificial Sequence
  chemically synthesized
gattcctcaggcatctagaa

SEQ ID NO: 538929 - DNA, 20 bp, Artificial Sequence
  chemically synthesized
acaggtgctggtgaggatgt

SEQ ID NO: 538930 - DNA, 20 bp, Artificial Sequence
  chemically synthesized
gaggtaccatctcacgccag

SEQ ID NO: 538931 - DNA, 20 bp, Artificial Sequence
  chemically synthesized
ttgtccttgcgatagtttgc

SEQ ID NO: 538932 - DNA, 20 bp, Artificial Sequence
  chemically synthesized
catgtaccctaaaacttaaa

SEQ ID NO: 538933 - DNA, 20 bp, Artificial Sequence
  chemically synthesized
agtagaataaaaaaaaaatc

SEQ ID NO: 538934 - DNA, 20 bp, Artificial Sequence
  chemically synthesized
cacctgtaccccaataattt

SEQ ID NO: 538935 - DNA, 20 bp, Artificial Sequence
  chemically synthesized
ataataaaaactaaaataaa

SEQ ID NO: 538936 - DNA, 20 bp, Artificial Sequence
  chemically synthesized
aagatcataacaaccctaga

SEQ ID NO: 538937 - DNA, 20 bp, Artificial Sequence
  chemically synthesized
ctcttcatacatatcattga

SEQ ID NO: 538938 - DNA, 20 bp, Artificial Sequence
  chemically synthesized
ctcttcaatgatatgtatga

SEQ ID NO: 538939 - DNA, 20 bp, Artificial Sequence
  chemically synthesized
tatgaagagaaatattaatg

SEQ ID NO: 538940 - DNA, 20 bp, Artificial Sequence
  chemically synthesized
ctgataaatgccaacagaat

SEQ ID NO: 538941 - DNA, 20 bp, Artificial Sequence
  chemically synthesized
aataattctgataaatgcca

SEQ ID NO: 538942 - DNA, 20 bp, Artificial Sequence
  chemically synthesized
ctctattctgttggcattta

SEQ ID NO: 538943 - DNA, 20 bp, Artificial Sequence
  chemically synthesized
ttaaatttcaaagcacagtc

SEQ ID NO: 538944 - DNA, 20 bp, Artificial Sequence
  chemically synthesized
taagaaatgacttcaaatga

SEQ ID NO: 538945 - DNA, 20 bp, Artificial Sequence
  chemically synthesized
taaaaataatgtagaaacat

SEQ ID NO: 538946 - DNA, 20 bp, Artificial Sequence
  chemically synthesized
agcagtgttttaaaaataat

SEQ ID NO: 538947 - DNA, 20 bp, Artificial Sequence
  chemically synthesized
cactcaaggaattcgttagt

SEQ ID NO: 538948 - DNA, 20 bp, Artificial Sequence
  chemically synthesized
acaaattatcatatatacat

SEQ ID NO: 538949 - DNA, 20 bp, Artificial Sequence
  chemically synthesized
aggtttctattaaggaatta

SEQ ID NO: 538950 - DNA, 20 bp, Artificial Sequence
  chemically synthesized
gatattctagtaattcctta

SEQ ID NO: 538951 - DNA, 20 bp, Artificial Sequence
  chemically synthesized
aattccttaatagaaaccta

SEQ ID NO: 538952 - DNA, 20 bp, Artificial Sequence
  chemically synthesized
aaactagatgttaaaggaaa

SEQ ID NO: 538953 - DNA, 20 bp, Artificial Sequence
  chemically synthesized
ctaacaaaatgacaaagcat

SEQ ID NO: 538954 - DNA, 20 bp, Artificial Sequence
  chemically synthesized
attaaacactaaaaaaaaat

SEQ ID NO: 538955 - DNA, 20 bp, Artificial Sequence
  chemically synthesized
ttactacttcacttagcctt

SEQ ID NO: 538956 - DNA, 20 bp, Artificial Sequence
  chemically synthesized
aatgacgccctagtgaactg

SEQ ID NO: 538957 - DNA, 20 bp, Artificial Sequence
  chemically synthesized
caaagagttcgaagatgcct

SEQ ID NO: 538958 - DNA, 20 bp, Artificial Sequence
  chemically synthesized
gaaggcaagagaataatcct

SEQ ID NO: 538959 - DNA, 20 bp, Artificial Sequence
  chemically synthesized
ttctaatttaccagaaggca

SEQ ID NO: 538960 - DNA, 20 bp, Artificial Sequence
  chemically synthesized
ttctcttgccttctggtaaa

SEQ ID NO: 538961 - DNA, 20 bp, Artificial Sequence
  chemically synthesized
ctttagactcataagttttc

SEQ ID NO: 538962 - DNA, 20 bp, Artificial Sequence
  chemically synthesized
atttggtgacttaatagata

SEQ ID NO: 538963 - DNA, 20 bp, Artificial Sequence
  chemically synthesized
gtgacttaatagataagaga

SEQ ID NO: 538964 - DNA, 20 bp, Artificial Sequence
  chemically synthesized
gatgtaaaaatatgtttaaa

SEQ ID NO: 538965 - DNA, 20 bp, Artificial Sequence
  chemically synthesized
aaacatatttttacatctca

SEQ ID NO: 538966 - DNA, 20 bp, Artificial Sequence
  chemically synthesized
ttccataaaaatagatagac

SEQ ID NO: 538967 - DNA, 20 bp, Artificial Sequence
  chemically synthesized
atttataaaatgaaaaagtt

SEQ ID NO: 538968 - DNA, 20 bp, Artificial Sequence
  chemically synthesized
aaactttttcattttataaa

SEQ ID NO: 538969 - DNA, 20 bp, Artificial Sequence
  chemically synthesized
tatagttctaaatgctagcc

SEQ ID NO: 538970 - DNA, 20 bp, Artificial Sequence
  chemically synthesized
gaacaatatacagtattttc

SEQ ID NO: 538971 - DNA, 20 bp, Artificial Sequence
  chemically synthesized
catcatcctgatttttattc

SEQ ID NO: 538972 - DNA, 20 bp, Artificial Sequence
  chemically synthesized
agaataaaaatcaggatgat

SEQ ID NO: 538973 - DNA, 20 bp, Artificial Sequence
  chemically synthesized
ttagtggactgtttggaaaa

SEQ ID NO: 538974 - DNA, 20 bp, Artificial Sequence
  chemically synthesized
gtttactttaagacataaag

SEQ ID NO: 538975 - DNA, 20 bp, Artificial Sequence
  chemically synthesized
tgtgcgtatggcacacaagc

SEQ ID NO: 538976 - DNA, 20 bp, Artificial Sequence
  chemically synthesized
tttacatattaaatggttgg

SEQ ID NO: 538977 - DNA, 20 bp, Artificial Sequence
  chemically synthesized
aaatggttggggagaaatca

SEQ ID NO: 538978 - DNA, 20 bp, Artificial Sequence
  chemically synthesized
tcctagcaaactttacgcac

SEQ ID NO: 538979 - DNA, 20 bp, Artificial Sequence
  chemically synthesized
tatttactaactagcccttc

SEQ ID NO: 538980 - DNA, 20 bp, Artificial Sequence
  chemically synthesized
ggcttctgactcctgcttta

SEQ ID NO: 538981 - DNA, 20 bp, Artificial Sequence
  chemically synthesized
tctgtgacttcaggagagca

SEQ ID NO: 538982 - DNA, 20 bp, Artificial Sequence
  chemically synthesized
tctcatgctctcctgaagtc

SEQ ID NO: 538983 - DNA, 20 bp, Artificial Sequence
  chemically synthesized
cctcagataaagctctaata

SEQ ID NO: 538984 - DNA, 20 bp, Artificial Sequence
  chemically synthesized
ttgagcttgaaggaaatgag

SEQ ID NO: 538985 - DNA, 20 bp, Artificial Sequence
  chemically synthesized
ttctgtttttaggatggcag

SEQ ID NO: 538986 - DNA, 20 bp, Artificial Sequence
  chemically synthesized
atgtaggatttttttcagtt

SEQ ID NO: 538987 - DNA, 20 bp, Artificial Sequence
  chemically synthesized
ggttctgcaataacaatgca

SEQ ID NO: 538988 - DNA, 20 bp, Artificial Sequence
  chemically synthesized
taacatacaggcacacaaac

SEQ ID NO: 538989 - DNA, 20 bp, Artificial Sequence
  chemically synthesized
caagataaacaacggtttca

SEQ ID NO: 538990 - DNA, 20 bp, Artificial Sequence
  chemically synthesized
gaaaattatgggtacagaat

SEQ ID NO: 538991 - DNA, 20 bp, Artificial Sequence
  chemically synthesized
gggataggaaaattatgggt

SEQ ID NO: 538992 - DNA, 20 bp, Artificial Sequence
  chemically synthesized
gaataattaagagattaaat

SEQ ID NO: 538993 - DNA, 20 bp, Artificial Sequence
  chemically synthesized
actggaaagatgttattgcc

SEQ ID NO: 538994 - DNA, 20 bp, Artificial Sequence
  chemically synthesized
gctactggaagacagaggca

SEQ ID NO: 538995 - DNA, 20 bp, Artificial Sequence
  chemically synthesized
caaaaaaaaaaaaaagaaag

SEQ ID NO: 538996 - DNA, 20 bp, Artificial Sequence
  chemically synthesized
gtctcaaaaaaaaaaaaaag

SEQ ID NO: 538997 - DNA, 20 bp, Artificial Sequence
  chemically synthesized
ctctgtctcaaaaaaaaaaa

SEQ ID NO: 538998 - DNA, 20 bp, Artificial Sequence
  chemically synthesized
tctttgctgcatctcttatt

SEQ ID NO: 538999 - DNA, 20 bp, Artificial Sequence
  chemically synthesized
tataatgtaataatgtcttc

SEQ ID NO: 539000 - DNA, 20 bp, Artificial Sequence
  chemically synthesized
cagtttgcagaacccctcca

SEQ ID NO: 539001 - DNA, 20 bp, Artificial Sequence
  chemically synthesized
aactgcactctaagactgat

SEQ ID NO: 539002 - DNA, 20 bp, Artificial Sequence
  chemically synthesized
gactgatatagaatatctac

SEQ ID NO: 539003 - DNA, 20 bp, Artificial Sequence
  chemically synthesized
taggcttgatgataataaaa

SEQ ID NO: 539004 - DNA, 20 bp, Artificial Sequence
  chemically synthesized
ggcaaaattaatctatggta

SEQ ID NO: 539005 - DNA, 20 bp, Artificial Sequence
  chemically synthesized
ctgaagtataatatacttca

SEQ ID NO: 539006 - DNA, 20 bp, Artificial Sequence
  chemically synthesized
gagtaggtgtatttcaacta

SEQ ID NO: 539007 - DNA, 20 bp, Artificial Sequence
  chemically synthesized
taattgttatcttattaatc

SEQ ID NO: 539008 - DNA, 20 bp, Artificial Sequence
  chemically synthesized
atcacatttatataactttc

SEQ ID NO: 539009 - DNA, 20 bp, Artificial Sequence
  chemically synthesized
agttatataaatgtgataaa

SEQ ID NO: 539010 - DNA, 20 bp, Artificial Sequence
  chemically synthesized
ttaagaagttattttcccca

SEQ ID NO: 539011 - DNA, 20 bp, Artificial Sequence
  chemically synthesized
caaggatggtaactttagaa

SEQ ID NO: 539012 - DNA, 20 bp, Artificial Sequence
  chemically synthesized
tagactcaaggatggtaact

SEQ ID NO: 539013 - DNA, 20 bp, Artificial Sequence
  chemically synthesized
tctggacaagagcaatttga

SEQ ID NO: 539014 - DNA, 20 bp, Artificial Sequence
  chemically synthesized
ggacatccaatatagaatac

SEQ ID NO: 539015 - DNA, 20 bp, Artificial Sequence
  chemically synthesized
acagaagagggacatccaat

SEQ ID NO: 539016 - DNA, 20 bp, Artificial Sequence
  chemically synthesized
cagatttgttcaaaaagtat

SEQ ID NO: 539017 - DNA, 20 bp, Artificial Sequence
  chemically synthesized
gtattaccatttattgagat

SEQ ID NO: 539018 - DNA, 20 bp, Artificial Sequence
  chemically synthesized
tcaacaaggcttaattggta

SEQ ID NO: 539019 - DNA, 20 bp, Artificial Sequence
  chemically synthesized
tgcattagtggtactcctgc

SEQ ID NO: 539020 - DNA, 20 bp, Artificial Sequence
  chemically synthesized
tacttttagttagaggcaag

SEQ ID NO: 539021 - DNA, 20 bp, Artificial Sequence
  chemically synthesized
cttcccttgtctaaataaaa

SEQ ID NO: 539022 - DNA, 20 bp, Artificial Sequence
  chemically synthesized
taaataaaagcagaaacttc

SEQ ID NO: 539023 - DNA, 20 bp, Artificial Sequence
  chemically synthesized
tgggaaattgttatggccat

SEQ ID NO: 539024 - DNA, 20 bp, Artificial Sequence
  chemically synthesized
tgtaggaaggtaaatatatg

SEQ ID NO: 539025 - DNA, 20 bp, Artificial Sequence
  chemically synthesized
ttgtagagaaatgacaaaac

SEQ ID NO: 539026 - DNA, 20 bp, Artificial Sequence
  chemically synthesized
acaaagaacagtaaacttgt

SEQ ID NO: 539027 - DNA, 20 bp, Artificial Sequence
  chemically synthesized
tgagtaactcaaaggggtgg

SEQ ID NO: 539028 - DNA, 20 bp, Artificial Sequence
  chemically synthesized
attcagtgcacatacacctg

SEQ ID NO: 539029 - DNA, 20 bp, Artificial Sequence
  chemically synthesized
gccagctctgtgatgtaggg

SEQ ID NO: 539030 - DNA, 20 bp, Artificial Sequence
  chemically synthesized
ctctgtttaaataacatggc

SEQ ID NO: 539031 - DNA, 20 bp, Artificial Sequence
  chemically synthesized
acagagcaagactccgaaag

SEQ ID NO: 539032 - DNA, 20 bp, Artificial Sequence
  chemically synthesized
agcaagactccgaaaggcag

SEQ ID NO: 539033 - DNA, 20 bp, Artificial Sequence
  chemically synthesized
actccgaaaggcagaaagaa

SEQ ID NO: 539034 - DNA, 20 bp, Artificial Sequence
  chemically synthesized
cgaaaggcagaaagaaaaag

SEQ ID NO: 539035 - DNA, 20 bp, Artificial Sequence
  chemically synthesized
ggcagaaagaaaaagaaaga

SEQ ID NO: 539036 - DNA, 20 bp, Artificial Sequence
  chemically synthesized
gaaagaaaaagaaagaaaag

SEQ ID NO: 539037 - DNA, 20 bp, Artificial Sequence
  chemically synthesized
aaaagaaagaaaagaaagaa

SEQ ID NO: 539038 - DNA, 20 bp, Artificial Sequence
  chemically synthesized
aagaaaagaaagaaaaagaa

SEQ ID NO: 539039 - DNA, 20 bp, Artificial Sequence
  chemically synthesized
aagaaaaagaaaaagaaaaa

SEQ ID NO: 539040 - DNA, 20 bp, Artificial Sequence
  chemically synthesized
gagggagggaggggaaaaaa

SEQ ID NO: 539041 - DNA, 20 bp, Artificial Sequence
  chemically synthesized
gacaggatgaccactttggt

SEQ ID NO: 539042 - DNA, 20 bp, Artificial Sequence
  chemically synthesized
ggagacagaaaacaaaataa

SEQ ID NO: 539043 - DNA, 20 bp, Artificial Sequence
  chemically synthesized
attacattctctcacaggag

SEQ ID NO: 539044 - DNA, 20 bp, Artificial Sequence
  chemically synthesized
tttgttttctgtctcctgtg

SEQ ID NO: 539045 - DNA, 20 bp, Artificial Sequence
  chemically synthesized
cttgtcaaagggtttaacat

SEQ ID NO: 539046 - DNA, 20 bp, Artificial Sequence
  chemically synthesized
aaggattaaaaaatttccat

SEQ ID NO: 539047 - DNA, 20 bp, Artificial Sequence
  chemically synthesized
gccaatgggtatagaggcca

SEQ ID NO: 539048 - DNA, 20 bp, Artificial Sequence
  chemically synthesized
tgtaaaatgtttttcaaaac

SEQ ID NO: 539049 - DNA, 20 bp, Artificial Sequence
  chemically synthesized
taaagttatgtaaataccca

SEQ ID NO: 539050 - DNA, 20 bp, Artificial Sequence
  chemically synthesized
aagcttgcacttatattgtt

SEQ ID NO: 539051 - DNA, 20 bp, Artificial Sequence
  chemically synthesized
cacaatgttgtcataagaag

SEQ ID NO: 539052 - DNA, 20 bp, Artificial Sequence
  chemically synthesized
gtcattggatgatagccttc

SEQ ID NO: 539053 - DNA, 20 bp, Artificial Sequence
  chemically synthesized
accataaccagaaaggcaga

SEQ ID NO: 539054 - DNA, 20 bp, Artificial Sequence
  chemically synthesized
catcatatgtctcaccataa

SEQ ID NO: 539055 - DNA, 20 bp, Artificial Sequence
  chemically synthesized
gggcttagaagcaggattgg

SEQ ID NO: 539056 - DNA, 20 bp, Artificial Sequence
  chemically synthesized
tctaaaataaagtttaatat

SEQ ID NO: 539057 - DNA, 20 bp, Artificial Sequence
  chemically synthesized
atacttgggagtttgaggca

SEQ ID NO: 539058 - DNA, 20 bp, Artificial Sequence
  chemically synthesized
tattattattattattttag

SEQ ID NO: 539059 - DNA, 20 bp, Artificial Sequence
  chemically synthesized
ctcctgacagccaaataaaa

SEQ ID NO: 539060 - DNA, 20 bp, Artificial Sequence
  chemically synthesized
ctactcaggaggctgagatg

SEQ ID NO: 539061 - DNA, 20 bp, Artificial Sequence
  chemically synthesized
tgttaaagcatcatctttgc

SEQ ID NO: 539062 - DNA, 20 bp, Artificial Sequence
  chemically synthesized
actagatttttctaccccat

SEQ ID NO: 539063 - DNA, 20 bp, Artificial Sequence
  chemically synthesized
tgagactatttctccatggg

SEQ ID NO: 539064 - DNA, 20 bp, Artificial Sequence
  chemically synthesized
ttatacctgctcttgatgga

SEQ ID NO: 539065 - DNA, 20 bp, Artificial Sequence
  chemically synthesized
aagcccttagaaacatagga

SEQ ID NO: 539066 - DNA, 20 bp, Artificial Sequence
  chemically synthesized
ttgagtaaatgagaaagccc

SEQ ID NO: 539067 - DNA, 20 bp, Artificial Sequence
  chemically synthesized
aaattattagattgagtaaa

SEQ ID NO: 539068 - DNA, 20 bp, Artificial Sequence
  chemically synthesized
taacaccctggatgaaatgg

SEQ ID NO: 539069 - DNA, 20 bp, Artificial Sequence
  chemically synthesized
tatttgacctcagacaagta

SEQ ID NO: 539070 - DNA, 20 bp, Artificial Sequence
  chemically synthesized
ttgaaatgttatttaaaaag

SEQ ID NO: 539071 - DNA, 20 bp, Artificial Sequence
  chemically synthesized
tggactatgttcataaaata

SEQ ID NO: 539072 - DNA, 20 bp, Artificial Sequence
  chemically synthesized
agccagactccatctcaaaa

SEQ ID NO: 539073 - DNA, 20 bp, Artificial Sequence
  chemically synthesized
ctactcgggaggctgaggca

SEQ ID NO: 539074 - DNA, 20 bp, Artificial Sequence
  chemically synthesized
tgttttcaaggttttggttc

SEQ ID NO: 539075 - DNA, 20 bp, Artificial Sequence
  chemically synthesized
ggtttaaatgttcagattgc

SEQ ID NO: 539076 - DNA, 20 bp, Artificial Sequence
  chemically synthesized
aaagcaggtttatgagtctg

SEQ ID NO: 539077 - DNA, 20 bp, Artificial Sequence
  chemically synthesized
tattagaagaaaaatgctgg

SEQ ID NO: 539078 - DNA, 20 bp, Artificial Sequence
  chemically synthesized
gccctatttatgaaatatta

SEQ ID NO: 539079 - DNA, 20 bp, Artificial Sequence
  chemically synthesized
attatagacaaaaagaaaat

SEQ ID NO: 539080 - DNA, 20 bp, Artificial Sequence
  chemically synthesized
caaaatacaattatagacaa

SEQ ID NO: 539081 - DNA, 20 bp, Artificial Sequence
  chemically synthesized
tgaggtttcaatattaaaat

SEQ ID NO: 539082 - DNA, 20 bp, Artificial Sequence
  chemically synthesized
atcctgagtctttgtatgta

SEQ ID NO: 539083 - DNA, 20 bp, Artificial Sequence
  chemically synthesized
tattccttcctagacaaaag

SEQ ID NO: 539084 - DNA, 20 bp, Artificial Sequence
  chemically synthesized
gacaaaagcaagaaatatat

SEQ ID NO: 539085 - DNA, 20 bp, Artificial Sequence
  chemically synthesized
gcaagaaatatatgaagaaa

SEQ ID NO: 539086 - DNA, 20 bp, Artificial Sequence
  chemically synthesized
atatatgaaacaactcagaa

SEQ ID NO: 539087 - DNA, 20 bp, Artificial Sequence
  chemically synthesized
ctgatattgatggcttttct

SEQ ID NO: 539088 - DNA, 20 bp, Artificial Sequence
  chemically synthesized
tagagatttatactttttct

SEQ ID NO: 539089 - DNA, 20 bp, Artificial Sequence
  chemically synthesized
ctattacatgtcttttggta

SEQ ID NO: 539090 - DNA, 20 bp, Artificial Sequence
  chemically synthesized
cttataccaaaagacatgta

SEQ ID NO: 539091 - DNA, 20 bp, Artificial Sequence
  chemically synthesized
ttgtttaataactacacaca

SEQ ID NO: 539092 - DNA, 20 bp, Artificial Sequence
  chemically synthesized
taatcagcatccacttcaag

SEQ ID NO: 539093 - DNA, 20 bp, Artificial Sequence
  chemically synthesized
catgtaatcagcatccactt

SEQ ID NO: 539094 - DNA, 20 bp, Artificial Sequence
  chemically synthesized
agattgttgacacagacaaa

SEQ ID NO: 539095 - DNA, 20 bp, Artificial Sequence
  chemically synthesized
ttttaattcacagtaccaaa

SEQ ID NO: 539096 - DNA, 20 bp, Artificial Sequence
  chemically synthesized
tagaacaaaaaaagtcttcc

SEQ ID NO: 539097 - DNA, 20 bp, Artificial Sequence
  chemically synthesized
aaaaaaagtcttccgaagaa

SEQ ID NO: 539098 - DNA, 20 bp, Artificial Sequence
  chemically synthesized
tccaaaagtactttgttgac

SEQ ID NO: 539099 - DNA, 20 bp, Artificial Sequence
  chemically synthesized
ataatatatatgacgtgttc

SEQ ID NO: 539100 - DNA, 20 bp, Artificial Sequence
  chemically synthesized
actgttaaggtttttgatgt

SEQ ID NO: 539101 - DNA, 20 bp, Artificial Sequence
  chemically synthesized
ggagtggtggttaagatagg

SEQ ID NO: 539102 - DNA, 20 bp, Artificial Sequence
  chemically synthesized
attatactctttcctagtca

SEQ ID NO: 539103 - DNA, 20 bp, Artificial Sequence
  chemically synthesized
atcagtggataagttaagga

SEQ ID NO: 539104 - DNA, 20 bp, Artificial Sequence
  chemically synthesized
tccttaacttatccactgat

SEQ ID NO: 539105 - DNA, 20 bp, Artificial Sequence
  chemically synthesized
tgtagaaacgtacatgtaat

SEQ ID NO: 539106 - DNA, 20 bp, Artificial Sequence
  chemically synthesized
gatgttgacggtatttccca

SEQ ID NO: 539107 - DNA, 20 bp, Artificial Sequence
  chemically synthesized
ccacatgtacttcagaggct

SEQ ID NO: 539108 - DNA, 20 bp, Artificial Sequence
  chemically synthesized
gaaaatgctacataaacgta

SEQ ID NO: 539109 - DNA, 20 bp, Artificial Sequence
  chemically synthesized
aataactaacttaataagct

SEQ ID NO: 539110 - DNA, 20 bp, Artificial Sequence
  chemically synthesized
catcattttaatgacttatg

SEQ ID NO: 539111 - DNA, 20 bp, Artificial Sequence
  chemically synthesized
taggaacatgatctggacgt

SEQ ID NO: 539112 - DNA, 20 bp, Artificial Sequence
  chemically synthesized
tagtctagaaccagtcatca

SEQ ID NO: 539113 - DNA, 20 bp, Artificial Sequence
  chemically synthesized
ttaagctacaagctgaagag

SEQ ID NO: 539114 - DNA, 20 bp, Artificial Sequence
  chemically synthesized
ttcccagcagtgccttatat

SEQ ID NO: 539115 - DNA, 20 bp, Artificial Sequence
  chemically synthesized
attctcctgagaaactcatt

SEQ ID NO: 539116 - DNA, 20 bp, Artificial Sequence
  chemically synthesized
attctataatgagtttctca

SEQ ID NO: 539117 - DNA, 20 bp, Artificial Sequence
  chemically synthesized
accaaaattcattattctcc

SEQ ID NO: 539118 - DNA, 20 bp, Artificial Sequence
  chemically synthesized
catggggttcatgtgaaggt

SEQ ID NO: 539119 - DNA, 20 bp, Artificial Sequence
  chemically synthesized
cctggttgagagcttcaatt

SEQ ID NO: 539120 - DNA, 20 bp, Artificial Sequence
  chemically synthesized
tcctaagtagtttcgtaata

SEQ ID NO: 539121 - DNA, 20 bp, Artificial Sequence
  chemically synthesized
tgatcctttccttttactac

SEQ ID NO: 539122 - DNA, 20 bp, Artificial Sequence
  chemically synthesized
agtgttcagtccgagcccta

SEQ ID NO: 539123 - DNA, 20 bp, Artificial Sequence
  chemically synthesized
atagcgtattgaatggatct

SEQ ID NO: 539124 - DNA, 20 bp, Artificial Sequence
  chemically synthesized
tactatgtttagtacctgcg

SEQ ID NO: 539125 - DNA, 20 bp, Artificial Sequence
  chemically synthesized
cttagcaaacttatatggaa

SEQ ID NO: 539126 - DNA, 20 bp, Artificial Sequence
  chemically synthesized
gaatactatgtggccatgaa

SEQ ID NO: 539127 - DNA, 20 bp, Artificial Sequence
  chemically synthesized
tatcaatgaacagactgaat

SEQ ID NO: 539128 - DNA, 20 bp, Artificial Sequence
  chemically synthesized
aacgtgcatatgtctttatg

SEQ ID NO: 539129 - DNA, 20 bp, Artificial Sequence
  chemically synthesized
ttgggcatatacccagagga

SEQ ID NO: 539130 - DNA, 20 bp, Artificial Sequence
  chemically synthesized
gatttctcaaataacttaca

SEQ ID NO: 539131 - DNA, 20 bp, Artificial Sequence
  chemically synthesized
taattcttttgtaagttatt

SEQ ID NO: 539132 - DNA, 20 bp, Artificial Sequence
  chemically synthesized
aatcttacagctagctacta

SEQ ID NO: 539133 - DNA, 20 bp, Artificial Sequence
  chemically synthesized
actcattaaacataatgtaa

SEQ ID NO: 539134 - DNA, 20 bp, Artificial Sequence
  chemically synthesized
tatgtttaatgagtcctcat

SEQ ID NO: 539135 - DNA, 20 bp, Artificial Sequence
  chemically synthesized
taataaacagagatgacatg

SEQ ID NO: 539136 - DNA, 20 bp, Artificial Sequence
  chemically synthesized
aagtttaccagaacaaatca

SEQ ID NO: 539137 - DNA, 20 bp, Artificial Sequence
  chemically synthesized
aacaaatcaacagaaattgc

SEQ ID NO: 539138 - DNA, 20 bp, Artificial Sequence
  chemically synthesized
tcaacagaaattgcatagaa

SEQ ID NO: 539139 - DNA, 20 bp, Artificial Sequence
  chemically synthesized
gaagtccattaggaggggag

SEQ ID NO: 539140 - DNA, 20 bp, Artificial Sequence
  chemically synthesized
aggggagttagaataccttc

SEQ ID NO: 539141 - DNA, 20 bp, Artificial Sequence
  chemically synthesized
cccaggttttcatgtaggta

SEQ ID NO: 539142 - DNA, 20 bp, Artificial Sequence
  chemically synthesized
aagagcacagatttatctct

SEQ ID NO: 539143 - DNA, 20 bp, Artificial Sequence
  chemically synthesized
ttatctcatggttagaagtt

SEQ ID NO: 539144 - DNA, 20 bp, Artificial Sequence
  chemically synthesized
cctgagtgtgtgagggtaac

SEQ ID NO: 539145 - DNA, 20 bp, Artificial Sequence
  chemically synthesized
acattacttgtactaccttt

SEQ ID NO: 539146 - DNA, 20 bp, Artificial Sequence
  chemically synthesized
agaaaaaaaaaacccaaaat

SEQ ID NO: 539147 - DNA, 20 bp, Artificial Sequence
  chemically synthesized
acctagattggattgtccca

SEQ ID NO: 539148 - DNA, 20 bp, Artificial Sequence
  chemically synthesized
tttcagcaacggatattgca

SEQ ID NO: 539149 - DNA, 20 bp, Artificial Sequence
  chemically synthesized
actaatagtcaggagctttg

SEQ ID NO: 539150 - DNA, 20 bp, Artificial Sequence
  chemically synthesized
aggagctttgacagaatgtt

SEQ ID NO: 539151 - DNA, 20 bp, Artificial Sequence
  chemically synthesized
atgttgtcctgaaaaaaatc

SEQ ID NO: 539152 - DNA, 20 bp, Artificial Sequence
  chemically synthesized
atggattttgatgtgtggaa

SEQ ID NO: 539153 - DNA, 20 bp, Artificial Sequence
  chemically synthesized
cacacatcaaaatccatatc

SEQ ID NO: 539154 - DNA, 20 bp, Artificial Sequence
  chemically synthesized
atccatatctaagaaacacc

SEQ ID NO: 539155 - DNA, 20 bp, Artificial Sequence
  chemically synthesized
cagagaattcttccagatac

SEQ ID NO: 539156 - DNA, 20 bp, Artificial Sequence
  chemically synthesized
tataagtttctatgtatctg

SEQ ID NO: 539157 - DNA, 20 bp, Artificial Sequence
  chemically synthesized
atcaataaataatggaagct

SEQ ID NO: 539158 - DNA, 20 bp, Artificial Sequence
  chemically synthesized
ctctggataacatccctatt

SEQ ID NO: 539159 - DNA, 20 bp, Artificial Sequence
  chemically synthesized
tcaagctatagatcacctgt

SEQ ID NO: 539160 - DNA, 20 bp, Artificial Sequence
  chemically synthesized
gttactgaaaacatacacta

SEQ ID NO: 539161 - DNA, 20 bp, Artificial Sequence
  chemically synthesized
aaatatatacaagacataca

SEQ ID NO: 539162 - DNA, 20 bp, Artificial Sequence
  chemically synthesized
tacaataattacaagaactt

SEQ ID NO: 539163 - DNA, 20 bp, Artificial Sequence
  chemically synthesized
agtatgttcactactagcta

SEQ ID NO: 539164 - DNA, 20 bp, Artificial Sequence
  chemically synthesized
ctttttaagacagttatgcc

SEQ ID NO: 539165 - DNA, 20 bp, Artificial Sequence
  chemically synthesized
tgataatttatcagattgtc

SEQ ID NO: 539166 - DNA, 20 bp, Artificial Sequence
  chemically synthesized
tcttgaaaaccatgtacacc

SEQ ID NO: 539167 - DNA, 20 bp, Artificial Sequence
  chemically synthesized
tctttggtgtacatggtttt

SEQ ID NO: 539168 - DNA, 20 bp, Artificial Sequence
  chemically synthesized
tatcatgcacaacctaactc

SEQ ID NO: 539169 - DNA, 20 bp, Artificial Sequence
  chemically synthesized
tttttctctgcggtactgaa

SEQ ID NO: 539170 - DNA, 20 bp, Artificial Sequence
  chemically synthesized
tctttctctttcagtaccgc

SEQ ID NO: 539171 - DNA, 20 bp, Artificial Sequence
  chemically synthesized
ctatttaaaatagaaatacc

SEQ ID NO: 539172 - DNA, 20 bp, Artificial Sequence
  chemically synthesized
cagcccctgcactatttaaa

SEQ ID NO: 539173 - DNA, 20 bp, Artificial Sequence
  chemically synthesized
aatatatcaatacaatacct

SEQ ID NO: 539174 - DNA, 20 bp, Artificial Sequence
  chemically synthesized
tttttttttttttttttttt

SEQ ID NO: 539175 - DNA, 20 bp, Artificial Sequence
  chemically synthesized
gaagagtgcctttggtcttt

SEQ ID NO: 539176 - DNA, 20 bp, Artificial Sequence
  chemically synthesized
ccttgatgttttatttgtta

SEQ ID NO: 539177 - DNA, 20 bp, Artificial Sequence
  chemically synthesized
aggaacaataacagggagca

SEQ ID NO: 539178 - DNA, 20 bp, Artificial Sequence
  chemically synthesized
cctgttattgttcctttcta

SEQ ID NO: 539179 - DNA, 20 bp, Artificial Sequence
  chemically synthesized
atataagggagaacattctt

SEQ ID NO: 539180 - DNA, 20 bp, Artificial Sequence
  chemically synthesized
gactaaagtgactattaaag

SEQ ID NO: 539181 - DNA, 20 bp, Artificial Sequence
  chemically synthesized
tagtcactttagtcttcaca

SEQ ID NO: 539182 - DNA, 20 bp, Artificial Sequence
  chemically synthesized
aagtattgagttatagattt

SEQ ID NO: 539183 - DNA, 20 bp, Artificial Sequence
  chemically synthesized
actcaatacttaacagctga

SEQ ID NO: 539184 - DNA, 20 bp, Artificial Sequence
  chemically synthesized
aaaagaaaatgtggtatgaa

SEQ ID NO: 539185 - DNA, 20 bp, Artificial Sequence
  chemically synthesized
tccatcagtggatgaattga

SEQ ID NO: 539186 - DNA, 20 bp, Artificial Sequence
  chemically synthesized
ccactactgggcatttatcc

SEQ ID NO: 539187 - DNA, 20 bp, Artificial Sequence
  chemically synthesized
ggtagcaattcatgttttat

SEQ ID NO: 539188 - DNA, 20 bp, Artificial Sequence
  chemically synthesized
acaggtcaacaaaggccaga

SEQ ID NO: 539189 - DNA, 20 bp, Artificial Sequence
  chemically synthesized
gatgaaaacagcttgtgcct

SEQ ID NO: 539190 - DNA, 20 bp, Artificial Sequence
  chemically synthesized
tagaattaagacaatggccc

SEQ ID NO: 539191 - DNA, 20 bp, Artificial Sequence
  chemically synthesized
aattaaattctctatatttc

SEQ ID NO: 539192 - DNA, 20 bp, Artificial Sequence
  chemically synthesized
tgttattttctgtgaaatat

SEQ ID NO: 539193 - DNA, 20 bp, Artificial Sequence
  chemically synthesized
gttcaactctgtataactaa

SEQ ID NO: 539194 - DNA, 20 bp, Artificial Sequence
  chemically synthesized
ggagatatcaatgaggttac

SEQ ID NO: 539195 - DNA, 20 bp, Artificial Sequence
  chemically synthesized
gaggttacggagaattattt

SEQ ID NO: 539196 - DNA, 20 bp, Artificial Sequence
  chemically synthesized
catagttcttgaaatggcaa

SEQ ID NO: 539197 - DNA, 20 bp, Artificial Sequence
  chemically synthesized
tgccatgaatatttgtaaat

SEQ ID NO: 539198 - DNA, 20 bp, Artificial Sequence
  chemically synthesized
ctcaatacacaaaacagata

SEQ ID NO: 539199 - DNA, 20 bp, Artificial Sequence
  chemically synthesized
atctcttccttcaacagcat

SEQ ID NO: 539200 - DNA, 20 bp, Artificial Sequence
  chemically synthesized
ctccagtgtaggacctcctt

SEQ ID NO: 539201 - DNA, 20 bp, Artificial Sequence
  chemically synthesized
gaataaccctatgcaaagtg

SEQ ID NO: 539202 - DNA, 20 bp, Artificial Sequence
  chemically synthesized
tcagatgtgcaggaaagaac

SEQ ID NO: 539203 - DNA, 20 bp, Artificial Sequence
  chemically synthesized
catcaaaataggaagatagc

SEQ ID NO: 539204 - DNA, 20 bp, Artificial Sequence
  chemically synthesized
gcgaacaggagagcatgggg

SEQ ID NO: 539205 - DNA, 20 bp, Artificial Sequence
  chemically synthesized
ttattcctccttccagaggt

SEQ ID NO: 539206 - DNA, 20 bp, Artificial Sequence
  chemically synthesized
aaggtacattttaactagtg

SEQ ID NO: 539207 - DNA, 20 bp, Artificial Sequence
  chemically synthesized
aaatgacgtgagtgagagta

SEQ ID NO: 539208 - DNA, 20 bp, Artificial Sequence
  chemically synthesized
caagcctagatttgtggaag

SEQ ID NO: 539209 - DNA, 20 bp, Artificial Sequence
  chemically synthesized
aatgaaaacttgttatatta

SEQ ID NO: 539210 - DNA, 20 bp, Artificial Sequence
  chemically synthesized
tttcattgataaaattattt

SEQ ID NO: 539211 - DNA, 20 bp, Artificial Sequence
  chemically synthesized
taaccaactcaagagtactt

SEQ ID NO: 539212 - DNA, 20 bp, Artificial Sequence
  chemically synthesized
aagtccttatttccctcccc

SEQ ID NO: 539213 - DNA, 20 bp, Artificial Sequence
  chemically synthesized
tttctatgtgatataaagaa

SEQ ID NO: 539214 - DNA, 20 bp, Artificial Sequence
  chemically synthesized
attctagttctttatatcac

SEQ ID NO: 539215 - DNA, 20 bp, Artificial Sequence
  chemically synthesized
tctttatatcacatagaaat

SEQ ID NO: 539216 - DNA, 20 bp, Artificial Sequence
  chemically synthesized
tttcacatttacaaaattta

SEQ ID NO: 539217 - DNA, 20 bp, Artificial Sequence
  chemically synthesized
ttataaattttgtaaatgtg

SEQ ID NO: 539218 - DNA, 20 bp, Artificial Sequence
  chemically synthesized
tgaaagaaaatagaaccaat

SEQ ID NO: 539219 - DNA, 20 bp, Artificial Sequence
  chemically synthesized
ttaatccatagaaaatcaaa

SEQ ID NO: 539220 - DNA, 20 bp, Artificial Sequence
  chemically synthesized
gcacagaatgcttttaatcc

SEQ ID NO: 539221 - DNA, 20 bp, Artificial Sequence
  chemically synthesized
aataatgagcttccaactgc

SEQ ID NO: 539222 - DNA, 20 bp, Artificial Sequence
  chemically synthesized
aaaacttataatcaactgta

SEQ ID NO: 539223 - DNA, 20 bp, Artificial Sequence
  chemically synthesized
gatcatgctatgcattttgg

SEQ ID NO: 539224 - DNA, 20 bp, Artificial Sequence
  chemically synthesized
ccaaacctcactttacaaat

SEQ ID NO: 539225 - DNA, 20 bp, Artificial Sequence
  chemically synthesized
acacgcccaatgccccacag

SEQ ID NO: 539226 - DNA, 20 bp, Artificial Sequence
  chemically synthesized
ctttgactccagagcccctg

SEQ ID NO: 539227 - DNA, 20 bp, Artificial Sequence
  chemically synthesized
cagtgatttcctaatagttt

SEQ ID NO: 539228 - DNA, 20 bp, Artificial Sequence
  chemically synthesized
agtttccagaattctagcca

SEQ ID NO: 539229 - DNA, 20 bp, Artificial Sequence
  chemically synthesized
aaccattatttttctcatgg

SEQ ID NO: 539230 - DNA, 20 bp, Artificial Sequence
  chemically synthesized
ggttactaatttgaataacg

SEQ ID NO: 539231 - DNA, 20 bp, Artificial Sequence
  chemically synthesized
taggagacactgtgataaca

SEQ ID NO: 539232 - DNA, 20 bp, Artificial Sequence
  chemically synthesized
ccgtcactgtgaataaaata

SEQ ID NO: 539233 - DNA, 20 bp, Artificial Sequence
  chemically synthesized
aactgaaggctcttaccatg

SEQ ID NO: 539234 - DNA, 20 bp, Artificial Sequence
  chemically synthesized
aacagtaatacctgaataca

SEQ ID NO: 539235 - DNA, 20 bp, Artificial Sequence
  chemically synthesized
gtattactgtttaaaatcta

SEQ ID NO: 539236 - DNA, 20 bp, Artificial Sequence
  chemically synthesized
gtttgaatggcttcaatagc

SEQ ID NO: 539237 - DNA, 20 bp, Artificial Sequence
  chemically synthesized
ctcttgaacccttgaatctt

SEQ ID NO: 539238 - DNA, 20 bp, Artificial Sequence
  chemically synthesized
agggttcaagagtagtctac

SEQ ID NO: 539239 - DNA, 20 bp, Artificial Sequence
  chemically synthesized
gctcaactcccaattatgag

SEQ ID NO: 539240 - DNA, 20 bp, Artificial Sequence
  chemically synthesized
ccatcagtgatggactggat

SEQ ID NO: 539241 - DNA, 20 bp, Artificial Sequence
  chemically synthesized
aagtatacttttccttagga

SEQ ID NO: 539242 - DNA, 20 bp, Artificial Sequence
  chemically synthesized
tttccatatacatgttgtat

SEQ ID NO: 539243 - DNA, 20 bp, Artificial Sequence
  chemically synthesized
ttaaatgctatgatatagta

SEQ ID NO: 539244 - DNA, 20 bp, Artificial Sequence
  chemically synthesized
cattttgcatgttttacagt

SEQ ID NO: 539245 - DNA, 20 bp, Artificial Sequence
  chemically synthesized
tttttagctgagatttactg

SEQ ID NO: 539246 - DNA, 20 bp, Artificial Sequence
  chemically synthesized
tgtaaaaatcatataaatat

SEQ ID NO: 539247 - DNA, 20 bp, Artificial Sequence
  chemically synthesized
aagatctatagtaccatttt

SEQ ID NO: 539248 - DNA, 20 bp, Artificial Sequence
  chemically synthesized
tacccaactttaattttttg

SEQ ID NO: 539249 - DNA, 20 bp, Artificial Sequence
  chemically synthesized
ttcaaatatcagtccattat

SEQ ID NO: 539250 - DNA, 20 bp, Artificial Sequence
  chemically synthesized
gtatagtacctggtgtaaaa

SEQ ID NO: 539251 - DNA, 20 bp, Artificial Sequence
  chemically synthesized
taaactaccttgtttgaaaa

SEQ ID NO: 539252 - DNA, 20 bp, Artificial Sequence
  chemically synthesized
aatgaaatatctagaatgag

SEQ ID NO: 539253 - DNA, 20 bp, Artificial Sequence
  chemically synthesized
agaaagagagaatgaaatat

SEQ ID NO: 539254 - DNA, 20 bp, Artificial Sequence
  chemically synthesized
aaaattacatgggtagaaag

SEQ ID NO: 539255 - DNA, 20 bp, Artificial Sequence
  chemically synthesized
gcaatgctaaaattacatgg

SEQ ID NO: 539256 - DNA, 20 bp, Artificial Sequence
  chemically synthesized
ttgagttaaagaacttgtat

SEQ ID NO: 539257 - DNA, 20 bp, Artificial Sequence
  chemically synthesized
agtgatcatatttagccccg

SEQ ID NO: 539258 - DNA, 20 bp, Artificial Sequence
  chemically synthesized
gctaaatatgatcacttcaa

SEQ ID NO: 539259 - DNA, 20 bp, Artificial Sequence
  chemically synthesized
actttattgccttggtaaat

SEQ ID NO: 539260 - DNA, 20 bp, Artificial Sequence
  chemically synthesized
attggggtcattaaaaagtt

SEQ ID NO: 539261 - DNA, 20 bp, Artificial Sequence
  chemically synthesized
ttttaggaataaattgatgt

SEQ ID NO: 539262 - DNA, 20 bp, Artificial Sequence
  chemically synthesized
acaggtgctggagaggatgg

SEQ ID NO: 539263 - DNA, 20 bp, Artificial Sequence
  chemically synthesized
gagataccatctcacaccag

SEQ ID NO: 539264 - DNA, 20 bp, Artificial Sequence
  chemically synthesized
gattcctcaggggcctagaa

SEQ ID NO: 539265 - DNA, 20 bp, Artificial Sequence
  chemically synthesized
ccaacaatgatagactggat

SEQ ID NO: 539266 - DNA, 20 bp, Artificial Sequence
  chemically synthesized
caccatggaatactatgcag

SEQ ID NO: 539267 - DNA, 20 bp, Artificial Sequence
  chemically synthesized
ttgtccttgcgatagtttac

SEQ ID NO: 539268 - DNA, 20 bp, Artificial Sequence
  chemically synthesized
ggtagttcaaagttgaaatg

SEQ ID NO: 539269 - DNA, 20 bp, Artificial Sequence
  chemically synthesized
tttgaactaccccatcccca

SEQ ID NO: 539270 - DNA, 20 bp, Artificial Sequence
  chemically synthesized
aagcttttcagttaaatgag

SEQ ID NO: 539271 - DNA, 20 bp, Artificial Sequence
  chemically synthesized
ctttttttcatctacttatg

SEQ ID NO: 539272 - DNA, 20 bp, Artificial Sequence
  chemically synthesized
ctcacataagtagatgaaaa

SEQ ID NO: 539273 - DNA, 20 bp, Artificial Sequence
  chemically synthesized
cataagtagatgaaaaaaag

SEQ ID NO: 539274 - DNA, 20 bp, Artificial Sequence
  chemically synthesized
cgatgaaaacacgtgttaat

SEQ ID NO: 539275 - DNA, 20 bp, Artificial Sequence
  chemically synthesized
cagtttgtcttcagctgcaa

SEQ ID NO: 539276 - DNA, 20 bp, Artificial Sequence
  chemically synthesized
gaggcgaagaaaaaccctcc

SEQ ID NO: 539277 - DNA, 20 bp, Artificial Sequence
  chemically synthesized
ttagtcaggaaagaggaggc

SEQ ID NO: 539278 - DNA, 20 bp, Artificial Sequence
  chemically synthesized
tttgacggatgcacgggatg

SEQ ID NO: 539279 - DNA, 20 bp, Artificial Sequence
  chemically synthesized
gcgggctttgaacaaacaaa

SEQ ID NO: 539280 - DNA, 20 bp, Artificial Sequence
  chemically synthesized
agggagatgtgaagctaaaa

SEQ ID NO: 539281 - DNA, 20 bp, Artificial Sequence
  chemically synthesized
atatttgcctcgagaaactt

SEQ ID NO: 539282 - DNA, 20 bp, Artificial Sequence
  chemically synthesized
gtaacactaaatatttgcct

SEQ ID NO: 539283 - DNA, 20 bp, Artificial Sequence
  chemically synthesized
tacgagttgatgtctggttg

SEQ ID NO: 539284 - DNA, 20 bp, Artificial Sequence
  chemically synthesized
actccaaatctaggtgaaaa

SEQ ID NO: 539285 - DNA, 20 bp, Artificial Sequence
  chemically synthesized
cagtggtggtttaaaagacc

SEQ ID NO: 539286 - DNA, 20 bp, Artificial Sequence
  chemically synthesized
tacaatagcaatggtgagga

SEQ ID NO: 539287 - DNA, 20 bp, Artificial Sequence
  chemically synthesized
tctgggaaccaattgcaagg

SEQ ID NO: 539288 - DNA, 20 bp, Artificial Sequence
  chemically synthesized
tctccccttgcaattggttc

SEQ ID NO: 539289 - DNA, 20 bp, Artificial Sequence
  chemically synthesized
gggaaaattagaaatgttta

SEQ ID NO: 539290 - DNA, 20 bp, Artificial Sequence
  chemically synthesized
cttttcaagaaatgggaaaa

SEQ ID NO: 539291 - DNA, 20 bp, Artificial Sequence
  chemically synthesized
catctggtaaaagttctttt

SEQ ID NO: 539292 - DNA, 20 bp, Artificial Sequence
  chemically synthesized
ggaagagagacatgaacaca

SEQ ID NO: 539293 - DNA, 20 bp, Artificial Sequence
  chemically synthesized
cctgaaaatgggtaatttac

SEQ ID NO: 539294 - DNA, 20 bp, Artificial Sequence
  chemically synthesized
tccatttgctgttgcttgta

SEQ ID NO: 539295 - DNA, 20 bp, Artificial Sequence
  chemically synthesized
caataaaatcttatactgtg

SEQ ID NO: 539296 - DNA, 20 bp, Artificial Sequence
  chemically synthesized
catagtgtgttgaataaata

SEQ ID NO: 539297 - DNA, 20 bp, Artificial Sequence
  chemically synthesized
ggttgtataacacagttact

SEQ ID NO: 539298 - DNA, 20 bp, Artificial Sequence
  chemically synthesized
ttatgaaatatgacatgaat

SEQ ID NO: 539299 - DNA, 20 bp, Artificial Sequence
  chemically synthesized
tgaacccatcttctgatgaa

SEQ ID NO: 539300 - DNA, 20 bp, Artificial Sequence
  chemically synthesized
ttaatcacatgacttatcac

SEQ ID NO: 539301 - DNA, 20 bp, Artificial Sequence
  chemically synthesized
taaaaacattttatcccctt

SEQ ID NO: 539302 - DNA, 20 bp, Artificial Sequence
  chemically synthesized
acttagggaacatataattt

SEQ ID NO: 539303 - DNA, 20 bp, Artificial Sequence
  chemically synthesized
tgaataaatgtggatataaa

SEQ ID NO: 539304 - DNA, 20 bp, Artificial Sequence
  chemically synthesized
taaatgtggatataaagtag

SEQ ID NO: 539305 - DNA, 20 bp, Artificial Sequence
  chemically synthesized
ttaaaggatttttactaaga

SEQ ID NO: 539306 - DNA, 20 bp, Artificial Sequence
  chemically synthesized
aagttatagagtcatcatgt

SEQ ID NO: 539307 - DNA, 20 bp, Artificial Sequence
  chemically synthesized
tcttaactatttactgggat

SEQ ID NO: 539308 - DNA, 20 bp, Artificial Sequence
  chemically synthesized
tagatcccagtaaatagtta

SEQ ID NO: 539309 - DNA, 20 bp, Artificial Sequence
  chemically synthesized
ttaggatatcctttagaaca

SEQ ID NO: 539310 - DNA, 20 bp, Artificial Sequence
  chemically synthesized
ataggattgagtgtcattta

SEQ ID NO: 539311 - DNA, 20 bp, Artificial Sequence
  chemically synthesized
aactgcttagcaaaaaggaa

SEQ ID NO: 539312 - DNA, 20 bp, Artificial Sequence
  chemically synthesized
aaaaatatattttccaattc

SEQ ID NO: 539313 - DNA, 20 bp, Artificial Sequence
  chemically synthesized
gaactatgaatagccctagc

SEQ ID NO: 539314 - DNA, 20 bp, Artificial Sequence
  chemically synthesized
aaagggagacattgggtatt

SEQ ID NO: 539315 - DNA, 20 bp, Artificial Sequence
  chemically synthesized
tgatctaaccatcatataaa

SEQ ID NO: 539316 - DNA, 20 bp, Artificial Sequence
  chemically synthesized
ctaaccatcatataaaaaag

SEQ ID NO: 539317 - DNA, 20 bp, Artificial Sequence
  chemically synthesized
ccagacacttgcgcctatgt

SEQ ID NO: 539318 - DNA, 20 bp, Artificial Sequence
  chemically synthesized
tgttaagaatcccctttaat

SEQ ID NO: 539319 - DNA, 20 bp, Artificial Sequence
  chemically synthesized
cctaggagctcttttccata

SEQ ID NO: 539320 - DNA, 20 bp, Artificial Sequence
  chemically synthesized
aaagagctcctaggaaactt

SEQ ID NO: 539321 - DNA, 20 bp, Artificial Sequence
  chemically synthesized
ttgatagttgctgaattttt

SEQ ID NO: 539322 - DNA, 20 bp, Artificial Sequence
  chemically synthesized
ttgtttatagttaatttccc

SEQ ID NO: 539323 - DNA, 20 bp, Artificial Sequence
  chemically synthesized
ttcagagagaccatattcca

SEQ ID NO: 539324 - DNA, 20 bp, Artificial Sequence
  chemically synthesized
gagaccatattccagcagaa

SEQ ID NO: 539325 - DNA, 20 bp, Artificial Sequence
  chemically synthesized
agaaacagaaatgcctcagg

SEQ ID NO: 539326 - DNA, 20 bp, Artificial Sequence
  chemically synthesized
aatgacaattctatatttat

SEQ ID NO: 539327 - DNA, 20 bp, Artificial Sequence
  chemically synthesized
aagagcaattctgtataaat

SEQ ID NO: 539328 - DNA, 20 bp, Artificial Sequence
  chemically synthesized
agcttatattaacagcttaa

SEQ ID NO: 539329 - DNA, 20 bp, Artificial Sequence
  chemically synthesized
gatttaaattttaaaaactg

SEQ ID NO: 539330 - DNA, 20 bp, Artificial Sequence
  chemically synthesized
tcattaatatgattgtttta

SEQ ID NO: 539331 - DNA, 20 bp, Artificial Sequence
  chemically synthesized
aaggtcagttagatgtcaat

SEQ ID NO: 539332 - DNA, 20 bp, Artificial Sequence
  chemically synthesized
tgtatcagacttaattcacg

SEQ ID NO: 539333 - DNA, 20 bp, Artificial Sequence
  chemically synthesized
caattattaacattatttcg

SEQ ID NO: 539334 - DNA, 20 bp, Artificial Sequence
  chemically synthesized
tgctgtctaatagatctaac

SEQ ID NO: 539335 - DNA, 20 bp, Artificial Sequence
  chemically synthesized
aggtagaccaatcaaatgaa

SEQ ID NO: 539336 - DNA, 20 bp, Artificial Sequence
  chemically synthesized
agacacatcatttatgtact

SEQ ID NO: 539337 - DNA, 20 bp, Artificial Sequence
  chemically synthesized
agtagttaatgagctcaact

SEQ ID NO: 539338 - DNA, 20 bp, Artificial Sequence
  chemically synthesized
tcagatgaagaaactgaagc

SEQ ID NO: 539339 - DNA, 20 bp, Artificial Sequence
  chemically synthesized
agacagcctctccttcagat

SEQ ID NO: 539340 - DNA, 20 bp, Artificial Sequence
  chemically synthesized
gctgtctgagtaggggacca

SEQ ID NO: 539341 - DNA, 20 bp, Artificial Sequence
  chemically synthesized
ggtgaaaaatacagatatgt

SEQ ID NO: 539342 - DNA, 20 bp, Artificial Sequence
  chemically synthesized
gaagtgaagtggtagaacaa

SEQ ID NO: 539343 - DNA, 20 bp, Artificial Sequence
  chemically synthesized
aatcagttttgcctgggtcc

SEQ ID NO: 539344 - DNA, 20 bp, Artificial Sequence
  chemically synthesized
tcaagctctgcaatgatcct

SEQ ID NO: 539345 - DNA, 20 bp, Artificial Sequence
  chemically synthesized
ctgcaatgatccttgagaaa

SEQ ID NO: 539346 - DNA, 20 bp, Artificial Sequence
  chemically synthesized
ccttgaagatctctaaggca

SEQ ID NO: 539347 - DNA, 20 bp, Artificial Sequence
  chemically synthesized
ggagtatattagggttcctt

SEQ ID NO: 539348 - DNA, 20 bp, Artificial Sequence
  chemically synthesized
ttagagaaacaaaaggaata

SEQ ID NO: 539349 - DNA, 20 bp, Artificial Sequence
  chemically synthesized
ctgtgtgtgtttgtatgtgg

SEQ ID NO: 539350 - DNA, 20 bp, Artificial Sequence
  chemically synthesized
attaattaaaggcctgaata

SEQ ID NO: 539351 - DNA, 20 bp, Artificial Sequence
  chemically synthesized
tctcatctgataacacttgc

SEQ ID NO: 539352 - DNA, 20 bp, Artificial Sequence
  chemically synthesized
taacacttgcacagaatcac

SEQ ID NO: 539353 - DNA, 20 bp, Artificial Sequence
  chemically synthesized
caaagtgaacaacagtatca

SEQ ID NO: 539354 - DNA, 20 bp, Artificial Sequence
  chemically synthesized
gtccagggactttttcaatt

SEQ ID NO: 539355 - DNA, 20 bp, Artificial Sequence
  chemically synthesized
taaagtttgggacagggggt

SEQ ID NO: 539356 - DNA, 20 bp, Artificial Sequence
  chemically synthesized
ggatgaactgtgaccggaaa

SEQ ID NO: 539357 - DNA, 20 bp, Artificial Sequence
  chemically synthesized
atccaacttcactaaagcgt

SEQ ID NO: 539358 - DNA, 20 bp, Artificial Sequence
  chemically synthesized
cattttgatcattgcaaata

SEQ ID NO: 539359 - DNA, 20 bp, Artificial Sequence
  chemically synthesized
tcaggtcatttaaaaatgtg

SEQ ID NO: 539360 - DNA, 20 bp, Artificial Sequence
  chemically synthesized
gaatgaaatttaagagcaaa

SEQ ID NO: 539361 - DNA, 20 bp, Artificial Sequence
  chemically synthesized
gctacagagatttctcttac

SEQ ID NO: 539362 - DNA, 20 bp, Artificial Sequence
  chemically synthesized
tttagatgactttctttgta

SEQ ID NO: 539363 - DNA, 20 bp, Artificial Sequence
  chemically synthesized
agtcatctaaattctcatgg

SEQ ID NO: 539364 - DNA, 20 bp, Artificial Sequence
  chemically synthesized
aatctattgcattctatcca

SEQ ID NO: 539365 - DNA, 20 bp, Artificial Sequence
  chemically synthesized
ttaattaggaaacagtattt

SEQ ID NO: 539366 - DNA, 20 bp, Artificial Sequence
  chemically synthesized
agaacaaacactagcttaaa

SEQ ID NO: 539367 - DNA, 20 bp, Artificial Sequence
  chemically synthesized
gtgatacaatgatggcattt

SEQ ID NO: 539368 - DNA, 20 bp, Artificial Sequence
  chemically synthesized
tgatactgagggactggcaa

SEQ ID NO: 539369 - DNA, 20 bp, Artificial Sequence
  chemically synthesized
atgattataaaaccaatagc

SEQ ID NO: 539370 - DNA, 20 bp, Artificial Sequence
  chemically synthesized
acttaaaaattaaaatactt

SEQ ID NO: 539371 - DNA, 20 bp, Artificial Sequence
  chemically synthesized
ttaagaacacaaggagcatg

SEQ ID NO: 539372 - DNA, 20 bp, Artificial Sequence
  chemically synthesized
tacactgcatgttgtgaagt

SEQ ID NO: 539373 - DNA, 20 bp, Artificial Sequence
  chemically synthesized
ataggctgatagatgagcat

SEQ ID NO: 539374 - DNA, 20 bp, Artificial Sequence
  chemically synthesized
acaagtaaataacacttttt

SEQ ID NO: 539375 - DNA, 20 bp, Artificial Sequence
  chemically synthesized
agcattccaaaaactgagca

SEQ ID NO: 539376 - DNA, 20 bp, Artificial Sequence
  chemically synthesized
tctacactcaatctatctga

SEQ ID NO: 539377 - DNA, 20 bp, Artificial Sequence
  chemically synthesized
catttagagactctatgcgc

SEQ ID NO: 539378 - DNA, 20 bp, Artificial Sequence
  chemically synthesized
gataaagagaaatacatatc

SEQ ID NO: 539379 - DNA, 20 bp, Artificial Sequence
  chemically synthesized
ctatatagacttttagataa

SEQ ID NO: 539380 - DNA, 20 bp, Artificial Sequence
  chemically synthesized
atgttcgatggtggcttaaa

SEQ ID NO: 539381 - DNA, 20 bp, Artificial Sequence
  chemically synthesized
agagacctgtatcaataaca

SEQ ID NO: 539382 - DNA, 20 bp, Artificial Sequence
  chemically synthesized
cttttatttcctagggtgaa

SEQ ID NO: 539383 - DNA, 20 bp, Artificial Sequence
  chemically synthesized
aatatcatacaaaattcatt

SEQ ID NO: 539384 - DNA, 20 bp, Artificial Sequence
  chemically synthesized
agtgcggaaattaccaaatc

SEQ ID NO: 539385 - DNA, 20 bp, Artificial Sequence
  chemically synthesized
ggaaaagacattgtacagat

SEQ ID NO: 539386 - DNA, 20 bp, Artificial Sequence
  chemically synthesized
gtgatcattctgctgtcctc

SEQ ID NO: 539387 - DNA, 20 bp, Artificial Sequence
  chemically synthesized
caggcatttctgtgaggaca

SEQ ID NO: 539388 - DNA, 20 bp, Artificial Sequence
  chemically synthesized
gattacacacaccacgcact

SEQ ID NO: 539389 - DNA, 20 bp, Artificial Sequence
  chemically synthesized
ggcaggactatcaaaatata

SEQ ID NO: 539390 - DNA, 20 bp, Artificial Sequence
  chemically synthesized
aagagattatgttggagaca

SEQ ID NO: 539391 - DNA, 20 bp, Artificial Sequence
  chemically synthesized
ttaggataaaaaaaatattt

SEQ ID NO: 539392 - DNA, 20 bp, Artificial Sequence
  chemically synthesized
accattcacatccatgaggt

SEQ ID NO: 539393 - DNA, 20 bp, Artificial Sequence
  chemically synthesized
ctcagaatataggaggatgc

SEQ ID NO: 539394 - DNA, 20 bp, Artificial Sequence
  chemically synthesized
aaaatgtataacgctgaatc

SEQ ID NO: 539395 - DNA, 20 bp, Artificial Sequence
  chemically synthesized
cgtgtgtaggttgtctcccc

SEQ ID NO: 539396 - DNA, 20 bp, Artificial Sequence
  chemically synthesized
attttactctgcaacgtgtt

SEQ ID NO: 539397 - DNA, 20 bp, Artificial Sequence
  chemically synthesized
aactagtttccacagtaaaa

SEQ ID NO: 539398 - DNA, 20 bp, Artificial Sequence
  chemically synthesized
tttccacagtaaaaaaagaa

SEQ ID NO: 539399 - DNA, 20 bp, Artificial Sequence
  chemically synthesized
gctattacctgggaaaagag

SEQ ID NO: 539400 - DNA, 20 bp, Artificial Sequence
  chemically synthesized
acacattttttcaaaaggaa

SEQ ID NO: 539401 - DNA, 20 bp, Artificial Sequence
  chemically synthesized
gttcttgggtaaatctggtg

SEQ ID NO: 539402 - DNA, 20 bp, Artificial Sequence
  chemically synthesized
ttataaaggaggatcacatt

SEQ ID NO: 539403 - DNA, 20 bp, Artificial Sequence
  chemically synthesized
aaaattgttattacttgtgg

SEQ ID NO: 539404 - DNA, 20 bp, Artificial Sequence
  chemically synthesized
gtactgtgtcagatgctgaa

SEQ ID NO: 539405 - DNA, 20 bp, Artificial Sequence
  chemically synthesized
aaaaagaaagtgagcatctc

SEQ ID NO: 539406 - DNA, 20 bp, Artificial Sequence
  chemically synthesized
catttatttggtcactgttt

SEQ ID NO: 539407 - DNA, 20 bp, Artificial Sequence
  chemically synthesized
cagtttatccattgtttaca

SEQ ID NO: 539408 - DNA, 20 bp, Artificial Sequence
  chemically synthesized
aaaaaatacagttttaaaag

SEQ ID NO: 539409 - DNA, 20 bp, Artificial Sequence
  chemically synthesized
tacattttattgccatctgg

SEQ ID NO: 539410 - DNA, 20 bp, Artificial Sequence
  chemically synthesized
gagaagccacggagaaacga

SEQ ID NO: 539411 - DNA, 20 bp, Artificial Sequence
  chemically synthesized
ttctctttgggagaagccac

SEQ ID NO: 539412 - DNA, 20 bp, Artificial Sequence
  chemically synthesized
ttctccgtggcttctcccaa

SEQ ID NO: 539413 - DNA, 20 bp, Artificial Sequence
  chemically synthesized
cgcttataaaaaaattgttt

SEQ ID NO: 539414 - DNA, 20 bp, Artificial Sequence
  chemically synthesized
ctttattctactgttatcct

SEQ ID NO: 539415 - DNA, 20 bp, Artificial Sequence
  chemically synthesized
tttttttcttaaggataaca

SEQ ID NO: 539416 - DNA, 20 bp, Artificial Sequence
  chemically synthesized
ggcaaatacattataaacca

SEQ ID NO: 539417 - DNA, 20 bp, Artificial Sequence
  chemically synthesized
acaatctaggcttatcctaa

SEQ ID NO: 539418 - DNA, 20 bp, Artificial Sequence
  chemically synthesized
ttgatatgataaccaaaaag

SEQ ID NO: 539419 - DNA, 20 bp, Artificial Sequence
  chemically synthesized
ggacttgatatgataaccaa

SEQ ID NO: 539420 - DNA, 20 bp, Artificial Sequence
  chemically synthesized
tatataactatagagtaaca

SEQ ID NO: 539421 - DNA, 20 bp, Artificial Sequence
  chemically synthesized
gaggtatctgaaatttgttt

SEQ ID NO: 539422 - DNA, 20 bp, Artificial Sequence
  chemically synthesized
tgattagctgatttattggc

SEQ ID NO: 539423 - DNA, 20 bp, Artificial Sequence
  chemically synthesized
aagtgtactacgccctgaag

SEQ ID NO: 539424 - DNA, 20 bp, Artificial Sequence
  chemically synthesized
cctgaagtcagaaagatgac

SEQ ID NO: 539425 - DNA, 20 bp, Artificial Sequence
  chemically synthesized
taactctcttctaaaaatta

SEQ ID NO: 539426 - DNA, 20 bp, Artificial Sequence
  chemically synthesized
atttttagaagagagttaaa

SEQ ID NO: 539427 - DNA, 20 bp, Artificial Sequence
  chemically synthesized
ctcatctcagacctgcttga

SEQ ID NO: 539428 - DNA, 20 bp, Artificial Sequence
  chemically synthesized
cagcaccatctgggaattca

SEQ ID NO: 539429 - DNA, 20 bp, Artificial Sequence
  chemically synthesized
gtccagcgaaagagtgattt

SEQ ID NO: 539430 - DNA, 20 bp, Artificial Sequence
  chemically synthesized
ggtaaggaatgtagatatta

SEQ ID NO: 539431 - DNA, 20 bp, Artificial Sequence
  chemically synthesized
tattagaagaatcatcatca

SEQ ID NO: 539432 - DNA, 20 bp, Artificial Sequence
  chemically synthesized
tcacacctgggctttagctt

SEQ ID NO: 539433 - DNA, 20 bp, Artificial Sequence
  chemically synthesized
acctgggctttagcttttag

SEQ ID NO: 539434 - DNA, 20 bp, Artificial Sequence
  chemically synthesized
atacctagccctcagtgttg

SEQ ID NO: 539435 - DNA, 20 bp, Artificial Sequence
  chemically synthesized
tttctcctgctataatagcc

SEQ ID NO: 539436 - DNA, 20 bp, Artificial Sequence
  chemically synthesized
tttctcaggctattatagca

SEQ ID NO: 539437 - DNA, 20 bp, Artificial Sequence
  chemically synthesized
cctatgagacgtatctgttt

SEQ ID NO: 539438 - DNA, 20 bp, Artificial Sequence
  chemically synthesized
aaatgtttgaggtgacggat

SEQ ID NO: 539439 - DNA, 20 bp, Artificial Sequence
  chemically synthesized
ggcctcgatttcgttcatgg

SEQ ID NO: 539440 - DNA, 20 bp, Artificial Sequence
  chemically synthesized
tcaggagttgcttgtgaaat

SEQ ID NO: 539441 - DNA, 20 bp, Artificial Sequence
  chemically synthesized
taaaattggacaataaattc

SEQ ID NO: 539442 - DNA, 20 bp, Artificial Sequence
  chemically synthesized
tttatttggatttaggaaag

SEQ ID NO: 539443 - DNA, 20 bp, Artificial Sequence
  chemically synthesized
tcctaaatccaaataaaaca

SEQ ID NO: 539444 - DNA, 20 bp, Artificial Sequence
  chemically synthesized
agaaaaaaaacaagaaaata

SEQ ID NO: 539445 - DNA, 20 bp, Artificial Sequence
  chemically synthesized
ccacattctcagaaaaaaaa

SEQ ID NO: 539446 - DNA, 20 bp, Artificial Sequence
  chemically synthesized
atattttcttgttttttttc

SEQ ID NO: 539447 - DNA, 20 bp, Artificial Sequence
  chemically synthesized
tctattcaataaccacattc

SEQ ID NO: 539448 - DNA, 20 bp, Artificial Sequence
  chemically synthesized
acacaatatttttctttagc

SEQ ID NO: 539449 - DNA, 20 bp, Artificial Sequence
  chemically synthesized
gttaaacatgtttcttagct

SEQ ID NO: 539450 - DNA, 20 bp, Artificial Sequence
  chemically synthesized
tccagctacaacattttctc

SEQ ID NO: 539451 - DNA, 20 bp, Artificial Sequence
  chemically synthesized
tacaacattttctcacagaa

SEQ ID NO: 539452 - DNA, 20 bp, Artificial Sequence
  chemically synthesized
acaatgtaattcttattctg

SEQ ID NO: 539453 - DNA, 20 bp, Artificial Sequence
  chemically synthesized
accagagacatgaaaaaccc

SEQ ID NO: 539454 - DNA, 20 bp, Artificial Sequence
  chemically synthesized
atcctgtgtagcccttctaa

SEQ ID NO: 539455 - DNA, 20 bp, Artificial Sequence
  chemically synthesized
aatacaattagacaaacaca

SEQ ID NO: 539456 - DNA, 20 bp, Artificial Sequence
  chemically synthesized
gatgaagaaagtccttcatg

SEQ ID NO: 539457 - DNA, 20 bp, Artificial Sequence
  chemically synthesized
gaaaaccaggcaagtgggat

SEQ ID NO: 539458 - DNA, 20 bp, Artificial Sequence
  chemically synthesized
aagcaacttctgtgatttat

SEQ ID NO: 539459 - DNA, 20 bp, Artificial Sequence
  chemically synthesized
tgcacctttcaaaacaggag

SEQ ID NO: 539460 - DNA, 20 bp, Artificial Sequence
  chemically synthesized
gagagtttgggaaaagagcc

SEQ ID NO: 539461 - DNA, 20 bp, Artificial Sequence
  chemically synthesized
cactttgggaggccaggata

SEQ ID NO: 539462 - DNA, 20 bp, Artificial Sequence
  chemically synthesized
tatccaagtggaaatgctgg

SEQ ID NO: 539463 - DNA, 20 bp, Artificial Sequence
  chemically synthesized
acttttccccagcaaagaac

SEQ ID NO: 539464 - DNA, 20 bp, Artificial Sequence
  chemically synthesized
atgtaaagtatgagaataat

SEQ ID NO: 539465 - DNA, 20 bp, Artificial Sequence
  chemically synthesized
gatgaattagatgtaaagta

SEQ ID NO: 539466 - DNA, 20 bp, Artificial Sequence
  chemically synthesized
caatgatgaatgaactcttt

SEQ ID NO: 539467 - DNA, 20 bp, Artificial Sequence
  chemically synthesized
acaggacatcattgaagaat

SEQ ID NO: 539468 - DNA, 20 bp, Artificial Sequence
  chemically synthesized
aattttgacaggacatcatt

SEQ ID NO: 539469 - DNA, 20 bp, Artificial Sequence
  chemically synthesized
ggatcttgcaggccgtgata

SEQ ID NO: 539470 - DNA, 20 bp, Artificial Sequence
  chemically synthesized
ggaatgtttttgcccaaatt

SEQ ID NO: 539471 - DNA, 20 bp, Artificial Sequence
  chemically synthesized
aaataaagctggttaaggga

SEQ ID NO: 539472 - DNA, 20 bp, Artificial Sequence
  chemically synthesized
ttacactctagtagtgagct

SEQ ID NO: 539473 - DNA, 20 bp, Artificial Sequence
  chemically synthesized
tatgccaggtacttgggata

SEQ ID NO: 539474 - DNA, 20 bp, Artificial Sequence
  chemically synthesized
tttaggcagatagggggagt

SEQ ID NO: 539475 - DNA, 20 bp, Artificial Sequence
  chemically synthesized
tttaaaacagttgaattatt

SEQ ID NO: 539476 - DNA, 20 bp, Artificial Sequence
  chemically synthesized
gtcactctttacccctggtg

SEQ ID NO: 539477 - DNA, 20 bp, Artificial Sequence
  chemically synthesized
atgagaagttgtcgctggga

SEQ ID NO: 539478 - DNA, 20 bp, Artificial Sequence
  chemically synthesized
caaagttggtgggaaatatg

SEQ ID NO: 539479 - DNA, 20 bp, Artificial Sequence
  chemically synthesized
gggttttgaaaagaagagtg

SEQ ID NO: 539480 - DNA, 20 bp, Artificial Sequence
  chemically synthesized
gaaaacatagctcaatgaag

SEQ ID NO: 539481 - DNA, 20 bp, Artificial Sequence
  chemically synthesized
agagaagtatgtgggagctc

SEQ ID NO: 539482 - DNA, 20 bp, Artificial Sequence
  chemically synthesized
tgacgacagatagattggca

SEQ ID NO: 539483 - DNA, 20 bp, Artificial Sequence
  chemically synthesized
tgtccatttgtgttgtcagg

SEQ ID NO: 539484 - DNA, 20 bp, Artificial Sequence
  chemically synthesized
aaaatgtaatggagtgaggc

SEQ ID NO: 539485 - DNA, 20 bp, Artificial Sequence
  chemically synthesized
acgacaaatgggaattctta

SEQ ID NO: 539486 - DNA, 20 bp, Artificial Sequence
  chemically synthesized
acttctaatgccctttctct

SEQ ID NO: 539487 - DNA, 20 bp, Artificial Sequence
  chemically synthesized
accacagagagctgtcacat

SEQ ID NO: 539488 - DNA, 20 bp, Artificial Sequence
  chemically synthesized
tcactcctagttgggagtca

SEQ ID NO: 539489 - DNA, 20 bp, Artificial Sequence
  chemically synthesized
aaaatatgtcaaaagacaca

SEQ ID NO: 539490 - DNA, 20 bp, Artificial Sequence
  chemically synthesized
gattctgtggaaccgtatta

SEQ ID NO: 539491 - DNA, 20 bp, Artificial Sequence
  chemically synthesized
tattctactaatacggttcc

SEQ ID NO: 539492 - DNA, 20 bp, Artificial Sequence
  chemically synthesized
gaagcctgcctacagggcac

SEQ ID NO: 539493 - DNA, 20 bp, Artificial Sequence
  chemically synthesized
cctacagggcacttagaatc

SEQ ID NO: 539494 - DNA, 20 bp, Artificial Sequence
  chemically synthesized
tctaagaaagtgccttcggt

SEQ ID NO: 539495 - DNA, 20 bp, Artificial Sequence
  chemically synthesized
tgtcacatctctgggcatta

SEQ ID NO: 539496 - DNA, 20 bp, Artificial Sequence
  chemically synthesized
aaccagagaggctgggcaga

SEQ ID NO: 539497 - DNA, 20 bp, Artificial Sequence
  chemically synthesized
agccttacgtgaacttgagg

SEQ ID NO: 539498 - DNA, 20 bp, Artificial Sequence
  chemically synthesized
gaaaactgctagcctaggat

SEQ ID NO: 539499 - DNA, 20 bp, Artificial Sequence
  chemically synthesized
gaggcatgggcttgtaagtt

SEQ ID NO: 539500 - DNA, 20 bp, Artificial Sequence
  chemically synthesized
ttctctgcataattgaaaat

SEQ ID NO: 539501 - DNA, 20 bp, Artificial Sequence
  chemically synthesized
ttctggattttcaattatgc

SEQ ID NO: 539502 - DNA, 20 bp, Artificial Sequence
  chemically synthesized
cagcatgacctgggaactta

SEQ ID NO: 539503 - DNA, 20 bp, Artificial Sequence
  chemically synthesized
ggtagctgtggggtgagacc

SEQ ID NO: 539504 - DNA, 20 bp, Artificial Sequence
  chemically synthesized
tctaggttgtgtgctcctta

SEQ ID NO: 539505 - DNA, 20 bp, Artificial Sequence
  chemically synthesized
caatagggttcgtgatccta

SEQ ID NO: 539506 - DNA, 20 bp, Artificial Sequence
  chemically synthesized
ctacttgggaggctgtggca

SEQ ID NO: 539507 - DNA, 20 bp, Artificial Sequence
  chemically synthesized
tttatgcatctacatggaag

SEQ ID NO: 539508 - DNA, 20 bp, Artificial Sequence
  chemically synthesized
gctgagaaggtcctcagcct

SEQ ID NO: 539509 - DNA, 20 bp, Artificial Sequence
  chemically synthesized
agggaagggtaattcagaaa

SEQ ID NO: 539510 - DNA, 20 bp, Artificial Sequence
  chemically synthesized
tgaaagcagggaagggtaat

SEQ ID NO: 539511 - DNA, 20 bp, Artificial Sequence
  chemically synthesized
tgtggaatcagtcccaaaat

SEQ ID NO: 539512 - DNA, 20 bp, Artificial Sequence
  chemically synthesized
acttttgatgaatgaatgaa

SEQ ID NO: 539513 - DNA, 20 bp, Artificial Sequence
  chemically synthesized
aacaaatgtgtctggattca

SEQ ID NO: 539514 - DNA, 20 bp, Artificial Sequence
  chemically synthesized
cacaaatgtgttgggattca

SEQ ID NO: 539515 - DNA, 20 bp, Artificial Sequence
  chemically synthesized
ccactgctttagctaggcta

SEQ ID NO: 539516 - DNA, 20 bp, Artificial Sequence
  chemically synthesized
cagcatcacctggtaacttg

SEQ ID NO: 539517 - DNA, 20 bp, Artificial Sequence
  chemically synthesized
ccagtaactttggtgcaggt

SEQ ID NO: 539518 - DNA, 20 bp, Artificial Sequence
  chemically synthesized
ctaggccagtagtactcacg

SEQ ID NO: 539519 - DNA, 20 bp, Artificial Sequence
  chemically synthesized
gactttggtataactaccag

SEQ ID NO: 539520 - DNA, 20 bp, Artificial Sequence
  chemically synthesized
ggatttgagcagccagaatt

SEQ ID NO: 539521 - DNA, 20 bp, Artificial Sequence
  chemically synthesized
tgcaattgggatttgagcag

SEQ ID NO: 539522 - DNA, 20 bp, Artificial Sequence
  chemically synthesized
attttgaaaaccttatttga

SEQ ID NO: 539523 - DNA, 20 bp, Artificial Sequence
  chemically synthesized
atatatgtattcggttttat

SEQ ID NO: 539524 - DNA, 20 bp, Artificial Sequence
  chemically synthesized
gccaaaaggaaaagcaaaca

SEQ ID NO: 539525 - DNA, 20 bp, Artificial Sequence
  chemically synthesized
acaacagtggcatatttgag

SEQ ID NO: 539526 - DNA, 20 bp, Artificial Sequence
  chemically synthesized
aataaacaagggtgtgcatt

SEQ ID NO: 539527 - DNA, 20 bp, Artificial Sequence
  chemically synthesized
ggacaaaaatcaaataaatc

SEQ ID NO: 539528 - DNA, 20 bp, Artificial Sequence
  chemically synthesized
aacgtgaatatgagggggta

SEQ ID NO: 539529 - DNA, 20 bp, Artificial Sequence
  chemically synthesized
cgaaggaaacagaactaaca

SEQ ID NO: 539530 - DNA, 20 bp, Artificial Sequence
  chemically synthesized
tgacttcacaggcctgaatt

SEQ ID NO: 539531 - DNA, 20 bp, Artificial Sequence
  chemically synthesized
ctaggccagtaatactcaca

SEQ ID NO: 539532 - DNA, 20 bp, Artificial Sequence
  chemically synthesized
tgcaatccagataacacctt

SEQ ID NO: 539533 - DNA, 20 bp, Artificial Sequence
  chemically synthesized
gtgttatctggattgcattt

SEQ ID NO: 539534 - DNA, 20 bp, Artificial Sequence
  chemically synthesized
ccaaagtgcagtttatttat

SEQ ID NO: 539535 - DNA, 20 bp, Artificial Sequence
  chemically synthesized
ttgcctcatttgtctagata

SEQ ID NO: 539536 - DNA, 20 bp, Artificial Sequence
  chemically synthesized
tcttgtaatgttcaatgtga

SEQ ID NO: 539537 - DNA, 20 bp, Artificial Sequence
  chemically synthesized
atcggttttctaaaacacaa

SEQ ID NO: 539538 - DNA, 20 bp, Artificial Sequence
  chemically synthesized
atttgttttctttttgtgtt

SEQ ID NO: 539539 - DNA, 20 bp, Artificial Sequence
  chemically synthesized
tttacttttgaaaagcagtg

SEQ ID NO: 539540 - DNA, 20 bp, Artificial Sequence
  chemically synthesized
ctcaagttaaagaaccacgg

SEQ ID NO: 539541 - DNA, 20 bp, Artificial Sequence
  chemically synthesized
ttctttaacttgagtgtgcg

SEQ ID NO: 539542 - DNA, 20 bp, Artificial Sequence
  chemically synthesized
gatctgcgggctccactctc

SEQ ID NO: 539543 - DNA, 20 bp, Artificial Sequence
  chemically synthesized
ctcacaacagacctactgaa

SEQ ID NO: 539544 - DNA, 20 bp, Artificial Sequence
  chemically synthesized
agtaggtctgttgtgaggct

SEQ ID NO: 539545 - DNA, 20 bp, Artificial Sequence
  chemically synthesized
gatcagcatcacggggatgg

SEQ ID NO: 539546 - DNA, 20 bp, Artificial Sequence
  chemically synthesized
gaaaaaggtgctctgtttct

SEQ ID NO: 539547 - DNA, 20 bp, Artificial Sequence
  chemically synthesized
ggtgctctgtttctgaagaa

SEQ ID NO: 539548 - DNA, 20 bp, Artificial Sequence
  chemically synthesized
cctttcatgtttctctttct

SEQ ID NO: 539549 - DNA, 20 bp, Artificial Sequence
  chemically synthesized
agaaacatgaaaggttagac

SEQ ID NO: 539550 - DNA, 20 bp, Artificial Sequence
  chemically synthesized
taaaggagctcactatatca

SEQ ID NO: 539551 - DNA, 20 bp, Artificial Sequence
  chemically synthesized
catttgttgcgttaaaagta

SEQ ID NO: 539552 - DNA, 20 bp, Artificial Sequence
  chemically synthesized
gtacactttattctcgattg

SEQ ID NO: 539553 - DNA, 20 bp, Artificial Sequence
  chemically synthesized
accataaaatttctaccaat

SEQ ID NO: 539554 - DNA, 20 bp, Artificial Sequence
  chemically synthesized
acacatgtgaattgttttag

SEQ ID NO: 539555 - DNA, 20 bp, Artificial Sequence
  chemically synthesized
taaataaggagcataatgct

SEQ ID NO: 539556 - DNA, 20 bp, Artificial Sequence
  chemically synthesized
tcatttcttagctgtgtgat

SEQ ID NO: 539557 - DNA, 20 bp, Artificial Sequence
  chemically synthesized
tttattctaaatcacacagc

SEQ ID NO: 539558 - DNA, 20 bp, Artificial Sequence
  chemically synthesized
gtttcgctcaggtttaaaca

SEQ ID NO: 539559 - DNA, 20 bp, Artificial Sequence
  chemically synthesized
ttgtacacaacaaatattca

SEQ ID NO: 539560 - DNA, 20 bp, Artificial Sequence
  chemically synthesized
gaattcagtggtgagtaagt

SEQ ID NO: 539561 - DNA, 20 bp, Artificial Sequence
  chemically synthesized
gagattacagcactgtagtt

SEQ ID NO: 539562 - DNA, 20 bp, Artificial Sequence
  chemically synthesized
agttagtgtagttggagtac

SEQ ID NO: 539563 - DNA, 20 bp, Artificial Sequence
  chemically synthesized
attaatgtgaaccttttgaa

SEQ ID NO: 539564 - DNA, 20 bp, Artificial Sequence
  chemically synthesized
actaggatactaatgggcat

SEQ ID NO: 539565 - DNA, 20 bp, Artificial Sequence
  chemically synthesized
atgtaaatattagaagcttt

SEQ ID NO: 539566 - DNA, 20 bp, Artificial Sequence
  chemically synthesized
ctagggacagaagacaaagt

SEQ ID NO: 539567 - DNA, 20 bp, Artificial Sequence
  chemically synthesized
ttggaaccttgtgtagtgaa

SEQ ID NO: 539568 - DNA, 20 bp, Artificial Sequence
  chemically synthesized
taagaaatatcgataaaggt

SEQ ID NO: 539569 - DNA, 20 bp, Artificial Sequence
  chemically synthesized
ctggttccaggaccacattt

SEQ ID NO: 539570 - DNA, 20 bp, Artificial Sequence
  chemically synthesized
actctgtgccagaagagatt

SEQ ID NO: 539571 - DNA, 20 bp, Artificial Sequence
  chemically synthesized
atctgtctcttttgcaaagc

SEQ ID NO: 539572 - DNA, 20 bp, Artificial Sequence
  chemically synthesized
gagatttatctggcaagcat

SEQ ID NO: 539573 - DNA, 20 bp, Artificial Sequence
  chemically synthesized
tatttcaaaggaacaaaaca

SEQ ID NO: 539574 - DNA, 20 bp, Artificial Sequence
  chemically synthesized
acttgatgtgttcgcacaat

SEQ ID NO: 539575 - DNA, 20 bp, Artificial Sequence
  chemically synthesized
gctctacaacagtctatcag

SEQ ID NO: 539576 - DNA, 20 bp, Artificial Sequence
  chemically synthesized
attagatagcccagttaaaa

SEQ ID NO: 539577 - DNA, 20 bp, Artificial Sequence
  chemically synthesized
ctgatcttcctttgtgacag

SEQ ID NO: 539578 - DNA, 20 bp, Artificial Sequence
  chemically synthesized
agggacatggccttctgggg

SEQ ID NO: 539579 - DNA, 20 bp, Artificial Sequence
  chemically synthesized
ccttcccttaagtgcctgct

SEQ ID NO: 539580 - DNA, 20 bp, Artificial Sequence
  chemically synthesized
gcccttttgagtaaatgttc

SEQ ID NO: 539581 - DNA, 20 bp, Artificial Sequence
  chemically synthesized
ttcttgatgatgtcatttga

SEQ ID NO: 539582 - DNA, 20 bp, Artificial Sequence
  chemically synthesized
ctcctgttctctgtgggaag

SEQ ID NO: 539583 - DNA, 20 bp, Artificial Sequence
  chemically synthesized
ccaagtcgcctctgcacaaa

SEQ ID NO: 539584 - DNA, 20 bp, Artificial Sequence
  chemically synthesized
atattaaagagaaagaaaaa

SEQ ID NO: 539585 - DNA, 20 bp, Artificial Sequence
  chemically synthesized
tcctgtggcatattaaagag

SEQ ID NO: 539586 - DNA, 20 bp, Artificial Sequence
  chemically synthesized
cccttcctgtggcatattaa

SEQ ID NO: 539587 - DNA, 20 bp, Artificial Sequence
  chemically synthesized
gtatttgcaattgcattgct

SEQ ID NO: 539588 - DNA, 20 bp, Artificial Sequence
  chemically synthesized
gacagtagtgattacctcta

SEQ ID NO: 539589 - DNA, 20 bp, Artificial Sequence
  chemically synthesized
actactgtccaatgcaagac

SEQ ID NO: 539590 - DNA, 20 bp, Artificial Sequence
  chemically synthesized
tatacctatatagaaagtta

SEQ ID NO: 539591 - DNA, 20 bp, Artificial Sequence
  chemically synthesized
catgtaaaaagtatacctat

SEQ ID NO: 539592 - DNA, 20 bp, Artificial Sequence
  chemically synthesized
aagtaaaattatatgattaa

SEQ ID NO: 539593 - DNA, 20 bp, Artificial Sequence
  chemically synthesized
aaaaccagcttctaagattt

SEQ ID NO: 539594 - DNA, 20 bp, Artificial Sequence
  chemically synthesized
aaaatcagtggaagacttcc

SEQ ID NO: 539595 - DNA, 20 bp, Artificial Sequence
  chemically synthesized
aaatgcctagggtgggctga

SEQ ID NO: 539596 - DNA, 20 bp, Artificial Sequence
  chemically synthesized
attgcttgaacattagttct

SEQ ID NO: 539597 - DNA, 20 bp, Artificial Sequence
  chemically synthesized
tcacataaggaaaatatgtt

SEQ ID NO: 539598 - DNA, 20 bp, Artificial Sequence
  chemically synthesized
agcatcgaacagaggatctg

SEQ ID NO: 539599 - DNA, 20 bp, Artificial Sequence
  chemically synthesized
gatctgaaagaaagagcaca

SEQ ID NO: 539600 - DNA, 20 bp, Artificial Sequence
  chemically synthesized
agctttgcttcatcagatta

SEQ ID NO: 539601 - DNA, 20 bp, Artificial Sequence
  chemically synthesized
aataaaagtacattttatga

SEQ ID NO: 539602 - DNA, 20 bp, Artificial Sequence
  chemically synthesized
taggatgcaatgattattgg

SEQ ID NO: 539603 - DNA, 20 bp, Artificial Sequence
  chemically synthesized
atcattgcatcctaaaagcc

SEQ ID NO: 539604 - DNA, 20 bp, Artificial Sequence
  chemically synthesized
gataggaattggtagttcct

SEQ ID NO: 539605 - DNA, 20 bp, Artificial Sequence
  chemically synthesized
agagagagagagagagagag

SEQ ID NO: 539606 - DNA, 20 bp, Artificial Sequence
  chemically synthesized
gagagaaaattggtaattct

SEQ ID NO: 539607 - DNA, 20 bp, Artificial Sequence
  chemically synthesized
tcttggacataatgttttct

SEQ ID NO: 539608 - DNA, 20 bp, Artificial Sequence
  chemically synthesized
ggttggccagattgaccaaa

SEQ ID NO: 539609 - DNA, 20 bp, Artificial Sequence
  chemically synthesized
aaaatgagaaaggaaggata

SEQ ID NO: 539610 - DNA, 20 bp, Artificial Sequence
  chemically synthesized
aaaaaaaagtctttgaaaaa

SEQ ID NO: 539611 - DNA, 20 bp, Artificial Sequence
  chemically synthesized
ttttttttttttttttggtc

SEQ ID NO: 539612 - DNA, 20 bp, Artificial Sequence
  chemically synthesized
ctatatgtcactgagacctc

SEQ ID NO: 539613 - DNA, 20 bp, Artificial Sequence
  chemically synthesized
tccacactggtgcaagtggt

SEQ ID NO: 539614 - DNA, 20 bp, Artificial Sequence
  chemically synthesized
tacagatcaagtgtaggttt

SEQ ID NO: 539615 - DNA, 20 bp, Artificial Sequence
  chemically synthesized
catacccactactatcaatg

SEQ ID NO: 539616 - DNA, 20 bp, Artificial Sequence
  chemically synthesized
atatataaaactcagtgtca

SEQ ID NO: 539617 - DNA, 20 bp, Artificial Sequence
  chemically synthesized
tgtgcattatgggaatttat

SEQ ID NO: 539618 - DNA, 20 bp, Artificial Sequence
  chemically synthesized
agtgacagaggcagatacct

SEQ ID NO: 539619 - DNA, 20 bp, Artificial Sequence
  chemically synthesized
taaatatcaatatgtcttat

SEQ ID NO: 539620 - DNA, 20 bp, Artificial Sequence
  chemically synthesized
ctactcggtaggctgaggca

SEQ ID NO: 539621 - DNA, 20 bp, Artificial Sequence
  chemically synthesized
tcattcctgtaattcagcac

SEQ ID NO: 539622 - DNA, 20 bp, Artificial Sequence
  chemically synthesized
attttttatccttaagataa

SEQ ID NO: 539623 - DNA, 20 bp, Artificial Sequence
  chemically synthesized
atctgcgttttccaatgcga

SEQ ID NO: 539624 - DNA, 20 bp, Artificial Sequence
  chemically synthesized
gcagatattatcatgtatta

SEQ ID NO: 539625 - DNA, 20 bp, Artificial Sequence
  chemically synthesized
cactaatgaccatccctgac

SEQ ID NO: 539626 - DNA, 20 bp, Artificial Sequence
  chemically synthesized
cagggatggtcattagtgat

SEQ ID NO: 539627 - DNA, 20 bp, Artificial Sequence
  chemically synthesized
ctttaaaactaagataactt

SEQ ID NO: 539628 - DNA, 20 bp, Artificial Sequence
  chemically synthesized
ctgaatacgtaatacctaga

SEQ ID NO: 539629 - DNA, 20 bp, Artificial Sequence
  chemically synthesized
gttcagtaacatatattgca

SEQ ID NO: 539630 - DNA, 20 bp, Artificial Sequence
  chemically synthesized
attatcctcatttcaccaaa

SEQ ID NO: 539631 - DNA, 20 bp, Artificial Sequence
  chemically synthesized
ttctagctatataaccaaaa

SEQ ID NO: 539632 - DNA, 20 bp, Artificial Sequence
  chemically synthesized
ttctccttttggttatatag

SEQ ID NO: 539633 - DNA, 20 bp, Artificial Sequence
  chemically synthesized
aggagtgatcaatgagatgg

SEQ ID NO: 539634 - DNA, 20 bp, Artificial Sequence
  chemically synthesized
aaaaaaaaaaaaaaaaaaga

SEQ ID NO: 539635 - DNA, 20 bp, Artificial Sequence
  chemically synthesized
aaaaaaaaaaaaaaaaaaaa

SEQ ID NO: 539636 - DNA, 20 bp, Artificial Sequence
  chemically synthesized
ctgctctggaggctgaggca

SEQ ID NO: 539637 - DNA, 20 bp, Artificial Sequence
  chemically synthesized
ttaagaggtggattgacaaa

SEQ ID NO: 539638 - DNA, 20 bp, Artificial Sequence
  chemically synthesized
atcactaaggaagaatatag

SEQ ID NO: 539639 - DNA, 20 bp, Artificial Sequence
  chemically synthesized
tatcagattgtatcactaag

SEQ ID NO: 539640 - DNA, 20 bp, Artificial Sequence
  chemically synthesized
tgaaataataaagactatag

SEQ ID NO: 539641 - DNA, 20 bp, Artificial Sequence
  chemically synthesized
tgaattggataaggggcatg

SEQ ID NO: 539642 - DNA, 20 bp, Artificial Sequence
  chemically synthesized
atgccccttatccaattcat

SEQ ID NO: 539643 - DNA, 20 bp, Artificial Sequence
  chemically synthesized
ggccccacttccaaacacgt

SEQ ID NO: 539644 - DNA, 20 bp, Artificial Sequence
  chemically synthesized
gctgactgagaccagggtga

SEQ ID NO: 539645 - DNA, 20 bp, Artificial Sequence
  chemically synthesized
tcagcatcatcttctcacac

SEQ ID NO: 539646 - DNA, 20 bp, Artificial Sequence
  chemically synthesized
tcatcttctcacacttagaa

SEQ ID NO: 539647 - DNA, 20 bp, Artificial Sequence
  chemically synthesized
gtaagtgagagaggtttagg

SEQ ID NO: 539648 - DNA, 20 bp, Artificial Sequence
  chemically synthesized
gggttcagtaaacagtcaat

SEQ ID NO: 539649 - DNA, 20 bp, Artificial Sequence
  chemically synthesized
gacatttgagcaaagatctc

SEQ ID NO: 539650 - DNA, 20 bp, Artificial Sequence
  chemically synthesized
tcaaatgtcaccttctcaat

SEQ ID NO: 539651 - DNA, 20 bp, Artificial Sequence
  chemically synthesized
ctttcactatttgagacccc

SEQ ID NO: 539652 - DNA, 20 bp, Artificial Sequence
  chemically synthesized
tgaatgtgtcagtgaacaaa

SEQ ID NO: 539653 - DNA, 20 bp, Artificial Sequence
  chemically synthesized
agtgggttcatgtagataga

SEQ ID NO: 539654 - DNA, 20 bp, Artificial Sequence
  chemically synthesized
tgtagatagagaagaaatta

SEQ ID NO: 539655 - DNA, 20 bp, Artificial Sequence
  chemically synthesized
aaaagaattctcattctcat

SEQ ID NO: 539656 - DNA, 20 bp, Artificial Sequence
  chemically synthesized
cttctcattctacatgagaa

SEQ ID NO: 539657 - DNA, 20 bp, Artificial Sequence
  chemically synthesized
cattgtcttctcattctaca

SEQ ID NO: 539658 - DNA, 20 bp, Artificial Sequence
  chemically synthesized
gcttctgtgccttgcctgca

SEQ ID NO: 539659 - DNA, 20 bp, Artificial Sequence
  chemically synthesized
tagtttattttatctttttt

SEQ ID NO: 539660 - DNA, 20 bp, Artificial Sequence
  chemically synthesized
aaataatatagcgctggaag

SEQ ID NO: 539661 - DNA, 20 bp, Artificial Sequence
  chemically synthesized
tttgaaataatatagcgctg

SEQ ID NO: 539662 - DNA, 20 bp, Artificial Sequence
  chemically synthesized
tgtataagtcagatgaataa

SEQ ID NO: 539663 - DNA, 20 bp, Artificial Sequence
  chemically synthesized
tcaaagtatacctcatttat

SEQ ID NO: 539664 - DNA, 20 bp, Artificial Sequence
  chemically synthesized
atactttgaaggcaaaatgt

SEQ ID NO: 539665 - DNA, 20 bp, Artificial Sequence
  chemically synthesized
catctggtctagacttcaca

SEQ ID NO: 539666 - DNA, 20 bp, Artificial Sequence
  chemically synthesized
tagatgaaaatgaagtaatt

SEQ ID NO: 539667 - DNA, 20 bp, Artificial Sequence
  chemically synthesized
gtttgaaaattcatgctttg

SEQ ID NO: 539668 - DNA, 20 bp, Artificial Sequence
  chemically synthesized
caataaaaataaacaactta

SEQ ID NO: 539669 - DNA, 20 bp, Artificial Sequence
  chemically synthesized
taaataaggtatatatttta

SEQ ID NO: 539670 - DNA, 20 bp, Artificial Sequence
  chemically synthesized
aactgcacaaatcaaaataa

SEQ ID NO: 539671 - DNA, 20 bp, Artificial Sequence
  chemically synthesized
aattggcattataaaaccat

SEQ ID NO: 539672 - DNA, 20 bp, Artificial Sequence
  chemically synthesized
atgacccatgtattagactt

SEQ ID NO: 539673 - DNA, 20 bp, Artificial Sequence
  chemically synthesized
agttgaaaagacatatccca

SEQ ID NO: 539674 - DNA, 20 bp, Artificial Sequence
  chemically synthesized
gtgggacacaccaacagtgc

SEQ ID NO: 539675 - DNA, 20 bp, Artificial Sequence
  chemically synthesized
ctttatcatgccccctgggc

SEQ ID NO: 539676 - DNA, 20 bp, Artificial Sequence
  chemically synthesized
aaaaactgattccatttata

SEQ ID NO: 539677 - DNA, 20 bp, Artificial Sequence
  chemically synthesized
gcaaatcaatgcagattaca

SEQ ID NO: 539678 - DNA, 20 bp, Artificial Sequence
  chemically synthesized
ctacttcatccatcggtgga

SEQ ID NO: 539679 - DNA, 20 bp, Artificial Sequence
  chemically synthesized
ttattttctaagtggcagtg

SEQ ID NO: 539680 - DNA, 20 bp, Artificial Sequence
  chemically synthesized
catgtttcttccactgccac

SEQ ID NO: 539681 - DNA, 20 bp, Artificial Sequence
  chemically synthesized
tataataataaatttaaaaa

SEQ ID NO: 539682 - DNA, 20 bp, Artificial Sequence
  chemically synthesized
agcctcatagatttaaaaat

SEQ ID NO: 539683 - DNA, 20 bp, Artificial Sequence
  chemically synthesized
tttaaatctatgaggcttat

SEQ ID NO: 539684 - DNA, 20 bp, Artificial Sequence
  chemically synthesized
caaggtcagaggaatacctt

SEQ ID NO: 539685 - DNA, 20 bp, Artificial Sequence
  chemically synthesized
cttaaacccatttgaacagt

SEQ ID NO: 539686 - DNA, 20 bp, Artificial Sequence
  chemically synthesized
ggatggaaaaaactctaata

SEQ ID NO: 539687 - DNA, 20 bp, Artificial Sequence
  chemically synthesized
gtttttgatttcaggttttt

SEQ ID NO: 539688 - DNA, 20 bp, Artificial Sequence
  chemically synthesized
tgagaccaggccttcattct

SEQ ID NO: 539689 - DNA, 20 bp, Artificial Sequence
  chemically synthesized
tttcaagaggcaggaattct

SEQ ID NO: 539690 - DNA, 20 bp, Artificial Sequence
  chemically synthesized
agggttgtaagtcagggcct

SEQ ID NO: 539691 - DNA, 20 bp, Artificial Sequence
  chemically synthesized
agcaggactttagtccctca

SEQ ID NO: 539692 - DNA, 20 bp, Artificial Sequence
  chemically synthesized
gtccccagttggagacaaga

SEQ ID NO: 539693 - DNA, 20 bp, Artificial Sequence
  chemically synthesized
ggataaataggatttgaaaa

SEQ ID NO: 539694 - DNA, 20 bp, Artificial Sequence
  chemically synthesized
aaaataacacctacagcttt

SEQ ID NO: 539695 - DNA, 20 bp, Artificial Sequence
  chemically synthesized
cagataatgtgctagctgag

SEQ ID NO: 539696 - DNA, 20 bp, Artificial Sequence
  chemically synthesized
aaataaagtaataaatgatg

SEQ ID NO: 539697 - DNA, 20 bp, Artificial Sequence
  chemically synthesized
gctagttgatgagacaaatg

SEQ ID NO: 539698 - DNA, 20 bp, Artificial Sequence
  chemically synthesized
caggagctgtagcttgagat

SEQ ID NO: 539699 - DNA, 20 bp, Artificial Sequence
  chemically synthesized
ggaactttttttggaaacca

SEQ ID NO: 539700 - DNA, 20 bp, Artificial Sequence
  chemically synthesized
tctggaaaatgtgaagtgta

SEQ ID NO: 539701 - DNA, 20 bp, Artificial Sequence
  chemically synthesized
tctcatacacttcacatttt

SEQ ID NO: 539702 - DNA, 20 bp, Artificial Sequence
  chemically synthesized
ttatgatgatgtgaacatgt

SEQ ID NO: 539703 - DNA, 20 bp, Artificial Sequence
  chemically synthesized
tgaattacagttgatgaata

SEQ ID NO: 539704 - DNA, 20 bp, Artificial Sequence
  chemically synthesized
ctatagacatggttaatgtc

SEQ ID NO: 539705 - DNA, 20 bp, Artificial Sequence
  chemically synthesized
taaaacattcttaaaacttt

SEQ ID NO: 539706 - DNA, 20 bp, Artificial Sequence
  chemically synthesized
gcaaaatttctataaagttt

SEQ ID NO: 539707 - DNA, 20 bp, Artificial Sequence
  chemically synthesized
aagagactgtaagggaaaat

SEQ ID NO: 539708 - DNA, 20 bp, Artificial Sequence
  chemically synthesized
agggaaaatagagaaagaag

SEQ ID NO: 539709 - DNA, 20 bp, Artificial Sequence
  chemically synthesized
tccgtttcttgtataaaaat

SEQ ID NO: 539710 - DNA, 20 bp, Artificial Sequence
  chemically synthesized
aagttttctttatttttata

SEQ ID NO: 539711 - DNA, 20 bp, Artificial Sequence
  chemically synthesized
cacaccttcttcagctttgt

SEQ ID NO: 539712 - DNA, 20 bp, Artificial Sequence
  chemically synthesized
agtatattattcacttgcac

SEQ ID NO: 539713 - DNA, 20 bp, Artificial Sequence
  chemically synthesized
gtcactaatcttaagctatg

SEQ ID NO: 539714 - DNA, 20 bp, Artificial Sequence
  chemically synthesized
tatgatgccacaacacacat

SEQ ID NO: 539715 - DNA, 20 bp, Artificial Sequence
  chemically synthesized
ctttcaaaattaaaataatc

SEQ ID NO: 539716 - DNA, 20 bp, Artificial Sequence
  chemically synthesized
ttgtctaatagactttcaca

SEQ ID NO: 539717 - DNA, 20 bp, Artificial Sequence
  chemically synthesized
aaagacatacttgagactgg

SEQ ID NO: 539718 - DNA, 20 bp, Artificial Sequence
  chemically synthesized
tccacatgactggggaggcc

SEQ ID NO: 539719 - DNA, 20 bp, Artificial Sequence
  chemically synthesized
acttcttacatggaagcaga

SEQ ID NO: 539720 - DNA, 20 bp, Artificial Sequence
  chemically synthesized
gaaaatgtggagacgcaaga

SEQ ID NO: 539721 - DNA, 20 bp, Artificial Sequence
  chemically synthesized
aacaagtaggaattatggga

SEQ ID NO: 539722 - DNA, 20 bp, Artificial Sequence
  chemically synthesized
ctgcttgggaggccgaggca

SEQ ID NO: 539723 - DNA, 20 bp, Artificial Sequence
  chemically synthesized
gcacactgaggccatttaga

SEQ ID NO: 539724 - DNA, 20 bp, Artificial Sequence
  chemically synthesized
taggaggcacagagagcaaa

SEQ ID NO: 539725 - DNA, 20 bp, Artificial Sequence
  chemically synthesized
tatttttaaaattttattta

SEQ ID NO: 539726 - DNA, 20 bp, Artificial Sequence
  chemically synthesized
ttttatttataagaaaaaat

SEQ ID NO: 539727 - DNA, 20 bp, Artificial Sequence
  chemically synthesized
ctacatgagtgtctattatt

SEQ ID NO: 539728 - DNA, 20 bp, Artificial Sequence
  chemically synthesized
ctcaaataatagacactcat

SEQ ID NO: 539729 - DNA, 20 bp, Artificial Sequence
  chemically synthesized
ttaacactctggaagttaca

SEQ ID NO: 539730 - DNA, 20 bp, Artificial Sequence
  chemically synthesized
tcaatgtctatttgtagaaa

SEQ ID NO: 539731 - DNA, 20 bp, Artificial Sequence
  chemically synthesized
tgagccctcaatgtctattt

SEQ ID NO: 539732 - DNA, 20 bp, Artificial Sequence
  chemically synthesized
agacaaaaacaaggcaggaa

SEQ ID NO: 539733 - DNA, 20 bp, Artificial Sequence
  chemically synthesized
cagaaacaaggagctgagct

SEQ ID NO: 539734 - DNA, 20 bp, Artificial Sequence
  chemically synthesized
tttacggcccttccatcctc

SEQ ID NO: 539735 - DNA, 20 bp, Artificial Sequence
  chemically synthesized
ttatctacactatccatctc

SEQ ID NO: 539736 - DNA, 20 bp, Artificial Sequence
  chemically synthesized
gcattaagcaaagtaacggt

SEQ ID NO: 539737 - DNA, 20 bp, Artificial Sequence
  chemically synthesized
atccttctctgcacaaagga

SEQ ID NO: 539738 - DNA, 20 bp, Artificial Sequence
  chemically synthesized
atccatgagtttattggggt

SEQ ID NO: 539739 - DNA, 20 bp, Artificial Sequence
  chemically synthesized
aaaagctctgtgcatgcttg

SEQ ID NO: 539740 - DNA, 20 bp, Artificial Sequence
  chemically synthesized
aatggcaaagtgcctggcat

SEQ ID NO: 539741 - DNA, 20 bp, Artificial Sequence
  chemically synthesized
acactagcatcgtcataatt

SEQ ID NO: 539742 - DNA, 20 bp, Artificial Sequence
  chemically synthesized
ctctacctgaaggatgatga

SEQ ID NO: 539743 - DNA, 20 bp, Artificial Sequence
  chemically synthesized
aagttgtcgatatctgatga

SEQ ID NO: 539744 - DNA, 20 bp, Artificial Sequence
  chemically synthesized
tgttaatctttacccgtgta

SEQ ID NO: 539745 - DNA, 20 bp, Artificial Sequence
  chemically synthesized
tcatgagggtgaactgtgct

SEQ ID NO: 539746 - DNA, 20 bp, Artificial Sequence
  chemically synthesized
agagggagactccatctcaa

SEQ ID NO: 539747 - DNA, 20 bp, Artificial Sequence
  chemically synthesized
ctactcgggaggttaaggca

SEQ ID NO: 539748 - DNA, 20 bp, Artificial Sequence
  chemically synthesized
ttcaatgtgattatgaggcc

SEQ ID NO: 539749 - DNA, 20 bp, Artificial Sequence
  chemically synthesized
aaagaaataaaagcagatta

SEQ ID NO: 539750 - DNA, 20 bp, Artificial Sequence
  chemically synthesized
ctcaaatgctttatcttaat

SEQ ID NO: 539751 - DNA, 20 bp, Artificial Sequence
  chemically synthesized
tcacaatgttctatggaaat

SEQ ID NO: 539752 - DNA, 20 bp, Artificial Sequence
  chemically synthesized
tcaagcacatttctgttgcc

SEQ ID NO: 539753 - DNA, 20 bp, Artificial Sequence
  chemically synthesized
tttgagatgattctatggca

SEQ ID NO: 539754 - DNA, 20 bp, Artificial Sequence
  chemically synthesized
tttttctactaaaacccatg

SEQ ID NO: 539755 - DNA, 20 bp, Artificial Sequence
  chemically synthesized
ggattctcacatgggtttta

SEQ ID NO: 539756 - DNA, 20 bp, Artificial Sequence
  chemically synthesized
cccttctcatttaataatcc

SEQ ID NO: 539757 - DNA, 20 bp, Artificial Sequence
  chemically synthesized
tgcttttgatactattttaa

SEQ ID NO: 539758 - DNA, 20 bp, Artificial Sequence
  chemically synthesized
agtacactgatgaggatctt

SEQ ID NO: 539759 - DNA, 20 bp, Artificial Sequence
  chemically synthesized
tgaattttatttttgaaaga

SEQ ID NO: 539760 - DNA, 20 bp, Artificial Sequence
  chemically synthesized
ctactagggaggctgaggca

SEQ ID NO: 539761 - DNA, 20 bp, Artificial Sequence
  chemically synthesized
tatttcaaaagagatcactg

SEQ ID NO: 539762 - DNA, 20 bp, Artificial Sequence
  chemically synthesized
tatattaaaatgtgttaata

SEQ ID NO: 539763 - DNA, 20 bp, Artificial Sequence
  chemically synthesized
ttaaaatgtgttaatagtag

SEQ ID NO: 539764 - DNA, 20 bp, Artificial Sequence
  chemically synthesized
taatttcaatttgtgatttt

SEQ ID NO: 539765 - DNA, 20 bp, Artificial Sequence
  chemically synthesized
attaaatttaacctgtaaaa

SEQ ID NO: 539766 - DNA, 20 bp, Artificial Sequence
  chemically synthesized
gtagttggtatttggctctt

SEQ ID NO: 539767 - DNA, 20 bp, Artificial Sequence
  chemically synthesized
tctatgaatttaaaaactgt

SEQ ID NO: 539768 - DNA, 20 bp, Artificial Sequence
  chemically synthesized
ataccgtaagtcatataaca

SEQ ID NO: 539769 - DNA, 20 bp, Artificial Sequence
  chemically synthesized
attacagtatgctagtgagt

SEQ ID NO: 539770 - DNA, 20 bp, Artificial Sequence
  chemically synthesized
taaatcacaaagctgttgct

SEQ ID NO: 539771 - DNA, 20 bp, Artificial Sequence
  chemically synthesized
tcataaaaacgctacctatc

SEQ ID NO: 539772 - DNA, 20 bp, Artificial Sequence
  chemically synthesized
atttgacaaatacactgact

SEQ ID NO: 539773 - DNA, 20 bp, Artificial Sequence
  chemically synthesized
tgtcatatatgtttgttagc

SEQ ID NO: 539774 - DNA, 20 bp, Artificial Sequence
  chemically synthesized
tgttagcatagaaaaagcag

SEQ ID NO: 539775 - DNA, 20 bp, Artificial Sequence
  chemically synthesized
atctaagtgccagttggaaa

SEQ ID NO: 539776 - DNA, 20 bp, Artificial Sequence
  chemically synthesized
aatatgaaaacctaagcata

SEQ ID NO: 539777 - DNA, 20 bp, Artificial Sequence
  chemically synthesized
ttttcatattagcatactga

SEQ ID NO: 539778 - DNA, 20 bp, Artificial Sequence
  chemically synthesized
atttttttgagtgtatacag

SEQ ID NO: 539779 - DNA, 20 bp, Artificial Sequence
  chemically synthesized
tcaaaaaaaaaaaaaaaaaa

SEQ ID NO: 539780 - DNA, 20 bp, Artificial Sequence
  chemically synthesized
ctactcgggaggctgaggca

SEQ ID NO: 539781 - DNA, 20 bp, Artificial Sequence
  chemically synthesized
tgaggaagtagaggtataaa

SEQ ID NO: 539782 - DNA, 20 bp, Artificial Sequence
  chemically synthesized
atggcactattacttctata

SEQ ID NO: 539783 - DNA, 20 bp, Artificial Sequence
  chemically synthesized
agaagatattatgttagtaa

SEQ ID NO: 539784 - DNA, 20 bp, Artificial Sequence
  chemically synthesized
gtaataagaaaaacattgtt

SEQ ID NO: 539785 - DNA, 20 bp, Artificial Sequence
  chemically synthesized
gttaaagaatttgaaaataa

SEQ ID NO: 539786 - DNA, 20 bp, Artificial Sequence
  chemically synthesized
tatcacctccaataagcttc

SEQ ID NO: 539787 - DNA, 20 bp, Artificial Sequence
  chemically synthesized
cagagggacttaataaaaat

SEQ ID NO: 539788 - DNA, 20 bp, Artificial Sequence
  chemically synthesized
ttttgttttgttttgtttta

SEQ ID NO: 539789 - DNA, 20 bp, Artificial Sequence
  chemically synthesized
tttcatttcaaaatatactt

SEQ ID NO: 539790 - DNA, 20 bp, Artificial Sequence
  chemically synthesized
gaaaagttattaacttctga

SEQ ID NO: 539791 - DNA, 20 bp, Artificial Sequence
  chemically synthesized
attgcatgatttgacttatt

SEQ ID NO: 539792 - DNA, 20 bp, Artificial Sequence
  chemically synthesized
tttttaaagaaaatggtata

SEQ ID NO: 539793 - DNA, 20 bp, Artificial Sequence
  chemically synthesized
aattaaggactccttttttt

SEQ ID NO: 539794 - DNA, 20 bp, Artificial Sequence
  chemically synthesized
actttcatattttggagttc

SEQ ID NO: 539795 - DNA, 20 bp, Artificial Sequence
  chemically synthesized
aagaactccaaaatatgaaa

SEQ ID NO: 539796 - DNA, 20 bp, Artificial Sequence
  chemically synthesized
agctatgactgaatacattt

SEQ ID NO: 539797 - DNA, 20 bp, Artificial Sequence
  chemically synthesized
ctggactcagcagatcaatt

SEQ ID NO: 539798 - DNA, 20 bp, Artificial Sequence
  chemically synthesized
aaattgatctgctgagtcca

SEQ ID NO: 539799 - DNA, 20 bp, Artificial Sequence
  chemically synthesized
cctttagccttggctcgtca

SEQ ID NO: 539800 - DNA, 20 bp, Artificial Sequence
  chemically synthesized
gcattgaaacttgaagcata

SEQ ID NO: 539801 - DNA, 20 bp, Artificial Sequence
  chemically synthesized
aaatgatatatgccaagtgt

SEQ ID NO: 539802 - DNA, 20 bp, Artificial Sequence
  chemically synthesized
actgtggcccagagaggtca

SEQ ID NO: 539803 - DNA, 20 bp, Artificial Sequence
  chemically synthesized
gtgtttgctgactaaagatt

SEQ ID NO: 539804 - DNA, 20 bp, Artificial Sequence
  chemically synthesized
taaagacagggaatttggac

SEQ ID NO: 539805 - DNA, 20 bp, Artificial Sequence
  chemically synthesized
atcaataaagtttctatttt

SEQ ID NO: 539806 - DNA, 20 bp, Artificial Sequence
  chemically synthesized
aaactaagatattctctaaa

SEQ ID NO: 539807 - DNA, 20 bp, Artificial Sequence
  chemically synthesized
gatctaatgggatgtgtttt

SEQ ID NO: 539808 - DNA, 20 bp, Artificial Sequence
  chemically synthesized
tgagctttcttgttcccaac

SEQ ID NO: 539809 - DNA, 20 bp, Artificial Sequence
  chemically synthesized
ctgaatttctcagttgggaa

SEQ ID NO: 539810 - DNA, 20 bp, Artificial Sequence
  chemically synthesized
cgttatttttattcctgaat

SEQ ID NO: 539811 - DNA, 20 bp, Artificial Sequence
  chemically synthesized
ctggtggtggcatacctaaa

SEQ ID NO: 539812 - DNA, 20 bp, Artificial Sequence
  chemically synthesized
catggtagcaataaagatgg

SEQ ID NO: 539813 - DNA, 20 bp, Artificial Sequence
  chemically synthesized
tttattgataacagtattaa

SEQ ID NO: 539814 - DNA, 20 bp, Artificial Sequence
  chemically synthesized
ggaggatcatgaaagaaata

SEQ ID NO: 539815 - DNA, 20 bp, Artificial Sequence
  chemically synthesized
caaaatctgggaggatcatg

SEQ ID NO: 539816 - DNA, 20 bp, Artificial Sequence
  chemically synthesized
gctgctactcctcactcttg

SEQ ID NO: 539817 - DNA, 20 bp, Artificial Sequence
  chemically synthesized
aatattaagggaggggatag

SEQ ID NO: 539818 - DNA, 20 bp, Artificial Sequence
  chemically synthesized
gaaacaggatggagtcacat

SEQ ID NO: 539819 - DNA, 20 bp, Artificial Sequence
  chemically synthesized
tatactttgtgtgtaagata

SEQ ID NO: 539820 - DNA, 20 bp, Artificial Sequence
  chemically synthesized
agataaaagaaagtttaaaa

SEQ ID NO: 539821 - DNA, 20 bp, Artificial Sequence
  chemically synthesized
tcttaccttggctgggtttt

SEQ ID NO: 539822 - DNA, 20 bp, Artificial Sequence
  chemically synthesized
tcttaaaaacccagccaagg

SEQ ID NO: 539823 - DNA, 20 bp, Artificial Sequence
  chemically synthesized
aaaacccagccaaggtaaga

SEQ ID NO: 539824 - DNA, 20 bp, Artificial Sequence
  chemically synthesized
aagagtatacataaattggc

SEQ ID NO: 539825 - DNA, 20 bp, Artificial Sequence
  chemically synthesized
ctgactgtataagaatgcct

SEQ ID NO: 539826 - DNA, 20 bp, Artificial Sequence
  chemically synthesized
tgtttcatggtctgactgta

SEQ ID NO: 539827 - DNA, 20 bp, Artificial Sequence
  chemically synthesized
aaattctgctgcctttgctt

SEQ ID NO: 539828 - DNA, 20 bp, Artificial Sequence
  chemically synthesized
catttctggaagcaaaggca

SEQ ID NO: 539829 - DNA, 20 bp, Artificial Sequence
  chemically synthesized
cacctcagtattccttgtct

SEQ ID NO: 539830 - DNA, 20 bp, Artificial Sequence
  chemically synthesized
tcagtattccttgtctccag

SEQ ID NO: 539831 - DNA, 20 bp, Artificial Sequence
  chemically synthesized
agaaagaaaatgtcttgagg

SEQ ID NO: 539832 - DNA, 20 bp, Artificial Sequence
  chemically synthesized
gccatcttttttaagatgga

SEQ ID NO: 539833 - DNA, 20 bp, Artificial Sequence
  chemically synthesized
ttattagatactatgtcagt

SEQ ID NO: 539834 - DNA, 20 bp, Artificial Sequence
  chemically synthesized
atattttaactcattcaaca

SEQ ID NO: 539835 - DNA, 20 bp, Artificial Sequence
  chemically synthesized
ccatatgtggtatgcatcct

SEQ ID NO: 539836 - DNA, 20 bp, Artificial Sequence
  chemically synthesized
gatcagtatattcatataaa

SEQ ID NO: 539837 - DNA, 20 bp, Artificial Sequence
  chemically synthesized
agataagtgaagagacaaat

SEQ ID NO: 539838 - DNA, 20 bp, Artificial Sequence
  chemically synthesized
ccacatatttattatcagca

SEQ ID NO: 539839 - DNA, 20 bp, Artificial Sequence
  chemically synthesized
aaactactgttatttttaaa

SEQ ID NO: 539840 - DNA, 20 bp, Artificial Sequence
  chemically synthesized
gaaattgtaaaatcaaggga

SEQ ID NO: 539841 - DNA, 20 bp, Artificial Sequence
  chemically synthesized
tattttgggcaaaatcttct

SEQ ID NO: 539842 - DNA, 20 bp, Artificial Sequence
  chemically synthesized
gggcaaaatcttcttaagaa

SEQ ID NO: 539843 - DNA, 20 bp, Artificial Sequence
  chemically synthesized
ctggcacgtttaaacatagg

SEQ ID NO: 539844 - DNA, 20 bp, Artificial Sequence
  chemically synthesized
cgtttaaacataggaaagaa

SEQ ID NO: 539845 - DNA, 20 bp, Artificial Sequence
  chemically synthesized
tttgtattctatggagtaaa

SEQ ID NO: 539846 - DNA, 20 bp, Artificial Sequence
  chemically synthesized
tgataattctcctttactcc

SEQ ID NO: 539847 - DNA, 20 bp, Artificial Sequence
  chemically synthesized
gtgaacgttaactttcctca

SEQ ID NO: 539848 - DNA, 20 bp, Artificial Sequence
  chemically synthesized
tgagtttgtagttgtattat

SEQ ID NO: 539849 - DNA, 20 bp, Artificial Sequence
  chemically synthesized
gttgagaacaagggaaaaca

SEQ ID NO: 539850 - DNA, 20 bp, Artificial Sequence
  chemically synthesized
ctgtgtacaaacttaaaaaa

SEQ ID NO: 539851 - DNA, 20 bp, Artificial Sequence
  chemically synthesized
aaaataaaaagaggagctct

SEQ ID NO: 539852 - DNA, 20 bp, Artificial Sequence
  chemically synthesized
tgtgtcagccaagaagtcac

SEQ ID NO: 539853 - DNA, 20 bp, Artificial Sequence
  chemically synthesized
ttcattaatccttcctggct

SEQ ID NO: 539854 - DNA, 20 bp, Artificial Sequence
  chemically synthesized
gccctcacgctgcctccatg

SEQ ID NO: 539855 - DNA, 20 bp, Artificial Sequence
  chemically synthesized
tttattatttagatttaatt

SEQ ID NO: 539856 - DNA, 20 bp, Artificial Sequence
  chemically synthesized
atcacatctggaatgtgtgg

SEQ ID NO: 539857 - DNA, 20 bp, Artificial Sequence
  chemically synthesized
tttccaaagtaaacctcaca

SEQ ID NO: 539858 - DNA, 20 bp, Artificial Sequence
  chemically synthesized
gttttcctttcagtaagagt

SEQ ID NO: 539859 - DNA, 20 bp, Artificial Sequence
  chemically synthesized
caactcaaataacttgttac

SEQ ID NO: 539860 - DNA, 20 bp, Artificial Sequence
  chemically synthesized
cctctatactgtgttttatc

SEQ ID NO: 539861 - DNA, 20 bp, Artificial Sequence
  chemically synthesized
caaattgctttgtgtcacat

SEQ ID NO: 539862 - DNA, 20 bp, Artificial Sequence
  chemically synthesized
ataaactgagaaggctgctt

SEQ ID NO: 539863 - DNA, 20 bp, Artificial Sequence
  chemically synthesized
ttaatgactgctttagtaaa

SEQ ID NO: 539864 - DNA, 20 bp, Artificial Sequence
  chemically synthesized
tgctttagtaaagcagaaag

SEQ ID NO: 539865 - DNA, 20 bp, Artificial Sequence
  chemically synthesized
ttgttccctgatggagtata

SEQ ID NO: 539866 - DNA, 20 bp, Artificial Sequence
  chemically synthesized
tccctgatggagtatagaag

SEQ ID NO: 539867 - DNA, 20 bp, Artificial Sequence
  chemically synthesized
ttttttttttttaatttccc

SEQ ID NO: 539868 - DNA, 20 bp, Artificial Sequence
  chemically synthesized
attgtaatagctagttagag

SEQ ID NO: 539869 - DNA, 20 bp, Artificial Sequence
  chemically synthesized
actgctcacacgctcctgca

SEQ ID NO: 539870 - DNA, 20 bp, Artificial Sequence
  chemically synthesized
tgcatcagaatagaagactt

SEQ ID NO: 539871 - DNA, 20 bp, Artificial Sequence
  chemically synthesized
ctttgccattgctagtgtga

SEQ ID NO: 539872 - DNA, 20 bp, Artificial Sequence
  chemically synthesized
ttgtgtgtagcaaaggctct

SEQ ID NO: 539873 - DNA, 20 bp, Artificial Sequence
  chemically synthesized
caaacatgccctaagtgctt

SEQ ID NO: 539874 - DNA, 20 bp, Artificial Sequence
  chemically synthesized
tattttttaaattgttaagg

SEQ ID NO: 539875 - DNA, 20 bp, Artificial Sequence
  chemically synthesized
caattgatatcaggttcaaa

SEQ ID NO: 539876 - DNA, 20 bp, Artificial Sequence
  chemically synthesized
ctactcgggaggctgaggta

SEQ ID NO: 539877 - DNA, 20 bp, Artificial Sequence
  chemically synthesized
aaacccactgataacaatac

SEQ ID NO: 539878 - DNA, 20 bp, Artificial Sequence
  chemically synthesized
tataatgaactattatgata

SEQ ID NO: 539879 - DNA, 20 bp, Artificial Sequence
  chemically synthesized
gctttgggacagtaacatgt

SEQ ID NO: 539880 - DNA, 20 bp, Artificial Sequence
  chemically synthesized
gcacaataaagcctgccaca

SEQ ID NO: 539881 - DNA, 20 bp, Artificial Sequence
  chemically synthesized
gaagtggagtaataggcagt

SEQ ID NO: 539882 - DNA, 20 bp, Artificial Sequence
  chemically synthesized
catcaacttcatgcatatcc

SEQ ID NO: 539883 - DNA, 20 bp, Artificial Sequence
  chemically synthesized
tcagataaatgataaatgaa

SEQ ID NO: 539884 - DNA, 20 bp, Artificial Sequence
  chemically synthesized
gcaactgccaattatatttt

SEQ ID NO: 539885 - DNA, 20 bp, Artificial Sequence
  chemically synthesized
tgataactagttccagaatt

SEQ ID NO: 539886 - DNA, 20 bp, Artificial Sequence
  chemically synthesized
gccaagcctgataactagtt

SEQ ID NO: 539887 - DNA, 20 bp, Artificial Sequence
  chemically synthesized
taactgcagattttacaact

SEQ ID NO: 539888 - DNA, 20 bp, Artificial Sequence
  chemically synthesized
ataatcgatacaatttgtaa

SEQ ID NO: 539889 - DNA, 20 bp, Artificial Sequence
  chemically synthesized
aggttaccagacattccttg

SEQ ID NO: 539890 - DNA, 20 bp, Artificial Sequence
  chemically synthesized
gctgttcatatttttatgca

SEQ ID NO: 539891 - DNA, 20 bp, Artificial Sequence
  chemically synthesized
tatgcatcagaaaacttgaa

SEQ ID NO: 539892 - DNA, 20 bp, Artificial Sequence
  chemically synthesized
cagaaaacttgaaagagaaa

SEQ ID NO: 539893 - DNA, 20 bp, Artificial Sequence
  chemically synthesized
tatggatgtggaagttgaag

SEQ ID NO: 539894 - DNA, 20 bp, Artificial Sequence
  chemically synthesized
aataatacctcatcaagtga

SEQ ID NO: 539895 - DNA, 20 bp, Artificial Sequence
  chemically synthesized
accccatctcaaaaacaaat

SEQ ID NO: 539896 - DNA, 20 bp, Artificial Sequence
  chemically synthesized
aagaaaaatgcatcgaaagt

SEQ ID NO: 539897 - DNA, 20 bp, Artificial Sequence
  chemically synthesized
atgcatcgaaagtaaagaaa

SEQ ID NO: 539898 - DNA, 20 bp, Artificial Sequence
  chemically synthesized
cacaaattcactatcatttg

SEQ ID NO: 539899 - DNA, 20 bp, Artificial Sequence
  chemically synthesized
caggaagctttcaatctatg

SEQ ID NO: 539900 - DNA, 20 bp, Artificial Sequence
  chemically synthesized
atagtctctgagcctcttgg

SEQ ID NO: 539901 - DNA, 20 bp, Artificial Sequence
  chemically synthesized
gctttggtagtatttcataa

SEQ ID NO: 539902 - DNA, 20 bp, Artificial Sequence
  chemically synthesized
aaatttattgcttactatgg

SEQ ID NO: 539903 - DNA, 20 bp, Artificial Sequence
  chemically synthesized
gagctgaaatttcccatatg

SEQ ID NO: 539904 - DNA, 20 bp, Artificial Sequence
  chemically synthesized
tgttgttaaactaagtttgc

SEQ ID NO: 539905 - DNA, 20 bp, Artificial Sequence
  chemically synthesized
gcctgggtgagtaaataaga

SEQ ID NO: 539906 - DNA, 20 bp, Artificial Sequence
  chemically synthesized
acctaaaactacatggaggc

SEQ ID NO: 539907 - DNA, 20 bp, Artificial Sequence
  chemically synthesized
caaaatggggaaagagcgag

SEQ ID NO: 539908 - DNA, 20 bp, Artificial Sequence
  chemically synthesized
gctataaccctgagcacttg

SEQ ID NO: 539909 - DNA, 20 bp, Artificial Sequence
  chemically synthesized
cctgagcacttgctagaaat

SEQ ID NO: 539910 - DNA, 20 bp, Artificial Sequence
  chemically synthesized
ctgaatcagcatcagttaat

SEQ ID NO: 539911 - DNA, 20 bp, Artificial Sequence
  chemically synthesized
ttctcaaactttgatgtgca

SEQ ID NO: 539912 - DNA, 20 bp, Artificial Sequence
  chemically synthesized
gacataattgaatttgcatt

SEQ ID NO: 539913 - DNA, 20 bp, Artificial Sequence
  chemically synthesized
ctactcaggagcctgaggca

SEQ ID NO: 539914 - DNA, 20 bp, Artificial Sequence
  chemically synthesized
tgtccaggacaaataactgt

SEQ ID NO: 539915 - DNA, 20 bp, Artificial Sequence
  chemically synthesized
ggtttttttgatgtagtttt

SEQ ID NO: 539916 - DNA, 20 bp, Artificial Sequence
  chemically synthesized
ctatgtttgcatataggaag

SEQ ID NO: 539917 - DNA, 20 bp, Artificial Sequence
  chemically synthesized
ttagaggcagcccgagtaac

SEQ ID NO: 539918 - DNA, 20 bp, Artificial Sequence
  chemically synthesized
gcaggaacactaaatttcat

SEQ ID NO: 539919 - DNA, 20 bp, Artificial Sequence
  chemically synthesized
attacccagctttttgggag

SEQ ID NO: 539920 - DNA, 20 bp, Artificial Sequence
  chemically synthesized
tgccaaaccctatgaggcta

SEQ ID NO: 539921 - DNA, 20 bp, Artificial Sequence
  chemically synthesized
taaataaaagaacaaagtag

SEQ ID NO: 539922 - DNA, 20 bp, Artificial Sequence
  chemically synthesized
tatgtaaataaaagaacaaa

SEQ ID NO: 539923 - DNA, 20 bp, Artificial Sequence
  chemically synthesized
gcaatgataatatctttgtt

SEQ ID NO: 539924 - DNA, 20 bp, Artificial Sequence
  chemically synthesized
attactcggaggattaaata

SEQ ID NO: 539925 - DNA, 20 bp, Artificial Sequence
  chemically synthesized
tgaattaggaagcctgttat

SEQ ID NO: 539926 - DNA, 20 bp, Artificial Sequence
  chemically synthesized
tagtgaatgagaggcttcaa

SEQ ID NO: 539927 - DNA, 20 bp, Artificial Sequence
  chemically synthesized
gaatgagaggcttcaaaaag

SEQ ID NO: 539928 - DNA, 20 bp, Artificial Sequence
  chemically synthesized
ttaagttctgggatacacgt

SEQ ID NO: 539929 - DNA, 20 bp, Artificial Sequence
  chemically synthesized
acttaaagtataataataaa

SEQ ID NO: 539930 - DNA, 20 bp, Artificial Sequence
  chemically synthesized
agaaagaaggaaaacaatgt

SEQ ID NO: 539931 - DNA, 20 bp, Artificial Sequence
  chemically synthesized
gggatgttactgattcaccc

SEQ ID NO: 539932 - DNA, 20 bp, Artificial Sequence
  chemically synthesized
aggatcttgaatgtttaatg

SEQ ID NO: 539933 - DNA, 20 bp, Artificial Sequence
  chemically synthesized
cctctacaaccatgaacata

SEQ ID NO: 539934 - DNA, 20 bp, Artificial Sequence
  chemically synthesized
tgatcaatgaagatgggtca

SEQ ID NO: 539935 - DNA, 20 bp, Artificial Sequence
  chemically synthesized
gtacttgggaggctgaggca

SEQ ID NO: 539936 - DNA, 20 bp, Artificial Sequence
  chemically synthesized
gtggataaggtgaatagaat

SEQ ID NO: 539937 - DNA, 20 bp, Artificial Sequence
  chemically synthesized
gtccaaggtggataaggtga

SEQ ID NO: 539938 - DNA, 20 bp, Artificial Sequence
  chemically synthesized
tgaatggggtatggggtggg

SEQ ID NO: 539939 - DNA, 20 bp, Artificial Sequence
  chemically synthesized
gtgctaccttccaaaaatac

SEQ ID NO: 539940 - DNA, 20 bp, Artificial Sequence
  chemically synthesized
ttcactgaaagcttcctggt

SEQ ID NO: 539941 - DNA, 20 bp, Artificial Sequence
  chemically synthesized
agtcattgcaataattcaaa

SEQ ID NO: 539942 - DNA, 20 bp, Artificial Sequence
  chemically synthesized
ctaagtaaactcatttgggg

SEQ ID NO: 539943 - DNA, 20 bp, Artificial Sequence
  chemically synthesized
ctttccccaaatgagtttac

SEQ ID NO: 539944 - DNA, 20 bp, Artificial Sequence
  chemically synthesized
ggttgctagtgattcaggaa

SEQ ID NO: 539945 - DNA, 20 bp, Artificial Sequence
  chemically synthesized
taaacatggtataaaattgc

SEQ ID NO: 539946 - DNA, 20 bp, Artificial Sequence
  chemically synthesized
acaggaagttgcaaaagtat

SEQ ID NO: 539947 - DNA, 20 bp, Artificial Sequence
  chemically synthesized
gagcattccaggtagaagaa

SEQ ID NO: 539948 - DNA, 20 bp, Artificial Sequence
  chemically synthesized
gggaaagagcattccaggta

SEQ ID NO: 539949 - DNA, 20 bp, Artificial Sequence
  chemically synthesized
aacagaaatctcaaggaagg

SEQ ID NO: 539950 - DNA, 20 bp, Artificial Sequence
  chemically synthesized
ctctatgaggtgacatttga

SEQ ID NO: 539951 - DNA, 20 bp, Artificial Sequence
  chemically synthesized
agtctctttgttagtcatag

SEQ ID NO: 539952 - DNA, 20 bp, Artificial Sequence
  chemically synthesized
atgatttaaggtatctgaca

SEQ ID NO: 539953 - DNA, 20 bp, Artificial Sequence
  chemically synthesized
cctcttgaatgctttgctgc

SEQ ID NO: 539954 - DNA, 20 bp, Artificial Sequence
  chemically synthesized
atttgcaacctgacaatgca

SEQ ID NO: 539955 - DNA, 20 bp, Artificial Sequence
  chemically synthesized
caacctgacaatgcagtaga

SEQ ID NO: 539956 - DNA, 20 bp, Artificial Sequence
  chemically synthesized
aatttctacagccagcctct

SEQ ID NO: 539957 - DNA, 20 bp, Artificial Sequence
  chemically synthesized
attttctggagaggctggct

SEQ ID NO: 539958 - DNA, 20 bp, Artificial Sequence
  chemically synthesized
ggtgttgagtctgtggatac

SEQ ID NO: 539959 - DNA, 20 bp, Artificial Sequence
  chemically synthesized
gtctgtggatacacagaatt

SEQ ID NO: 539960 - DNA, 20 bp, Artificial Sequence
  chemically synthesized
gcatcagtgttacctggatg

SEQ ID NO: 539961 - DNA, 20 bp, Artificial Sequence
  chemically synthesized
aaatatacccattacaaatg

SEQ ID NO: 539962 - DNA, 20 bp, Artificial Sequence
  chemically synthesized
tataaaaccatcagattttg

SEQ ID NO: 539963 - DNA, 20 bp, Artificial Sequence
  chemically synthesized
tcaggaaacttaaaatcatg

SEQ ID NO: 539964 - DNA, 20 bp, Artificial Sequence
  chemically synthesized
attagcccgttttcataccg

SEQ ID NO: 539965 - DNA, 20 bp, Artificial Sequence
  chemically synthesized
ctctttgatgtgatatttga

SEQ ID NO: 539966 - DNA, 20 bp, Artificial Sequence
  chemically synthesized
acagtgagactctgtctcta

SEQ ID NO: 539967 - DNA, 20 bp, Artificial Sequence
  chemically synthesized
gagactctgtctctataaga

SEQ ID NO: 539968 - DNA, 20 bp, Artificial Sequence
  chemically synthesized
actgcacaccagcttaggca

SEQ ID NO: 539969 - DNA, 20 bp, Artificial Sequence
  chemically synthesized
attaaagtgttaagaagaaa

SEQ ID NO: 539970 - DNA, 20 bp, Artificial Sequence
  chemically synthesized
tggaagtattaaagtgttaa

SEQ ID NO: 539971 - DNA, 20 bp, Artificial Sequence
  chemically synthesized
agtaatgggaagttaggaaa

SEQ ID NO: 539972 - DNA, 20 bp, Artificial Sequence
  chemically synthesized
ttaaaaaaactgggaaggaa

SEQ ID NO: 539973 - DNA, 20 bp, Artificial Sequence
  chemically synthesized
tcctgctgcttctgtgatac

SEQ ID NO: 539974 - DNA, 20 bp, Artificial Sequence
  chemically synthesized
ataaagttgagcattaccat

SEQ ID NO: 539975 - DNA, 20 bp, Artificial Sequence
  chemically synthesized
aaaataagtaacttccctgg

SEQ ID NO: 539976 - DNA, 20 bp, Artificial Sequence
  chemically synthesized
taggggtgaagtgaacccgg

SEQ ID NO: 539977 - DNA, 20 bp, Artificial Sequence
  chemically synthesized
catttaatggtatatttacc

SEQ ID NO: 539978 - DNA, 20 bp, Artificial Sequence
  chemically synthesized
aaattaaggcttcaagaagt

SEQ ID NO: 539979 - DNA, 20 bp, Artificial Sequence
  chemically synthesized
cttttagcaaacctgtgagt

SEQ ID NO: 539980 - DNA, 20 bp, Artificial Sequence
  chemically synthesized
taaatgtacattttcattaa

SEQ ID NO: 539981 - DNA, 20 bp, Artificial Sequence
  chemically synthesized
gtacattttcattaaaaaga

SEQ ID NO: 539982 - DNA, 20 bp, Artificial Sequence
  chemically synthesized
catctttttgaccttagttt

SEQ ID NO: 539983 - DNA, 20 bp, Artificial Sequence
  chemically synthesized
ctgattcctaggctcccaag

SEQ ID NO: 539984 - DNA, 20 bp, Artificial Sequence
  chemically synthesized
cacattggtaggatcattga

SEQ ID NO: 539985 - DNA, 20 bp, Artificial Sequence
  chemically synthesized
cttcctcttgaaacacatgt

SEQ ID NO: 539986 - DNA, 20 bp, Artificial Sequence
  chemically synthesized
caaaaaaactaaattccctc

SEQ ID NO: 539987 - DNA, 20 bp, Artificial Sequence
  chemically synthesized
ggaaagtatgggagcaactt

SEQ ID NO: 539988 - DNA, 20 bp, Artificial Sequence
  chemically synthesized
ttttcactagccgtcaaaag

SEQ ID NO: 539989 - DNA, 20 bp, Artificial Sequence
  chemically synthesized
ggtactggcatattcatgca

SEQ ID NO: 539990 - DNA, 20 bp, Artificial Sequence
  chemically synthesized
attcctacctgaagcttaag

SEQ ID NO: 539991 - DNA, 20 bp, Artificial Sequence
  chemically synthesized
taatgatttgaaatcattgt

SEQ ID NO: 539992 - DNA, 20 bp, Artificial Sequence
  chemically synthesized
ataaaaattatgcatagtga

SEQ ID NO: 539993 - DNA, 20 bp, Artificial Sequence
  chemically synthesized
agatgcctgttgggggacta

SEQ ID NO: 539994 - DNA, 20 bp, Artificial Sequence
  chemically synthesized
attgccttgctttgtctctt

SEQ ID NO: 539995 - DNA, 20 bp, Artificial Sequence
  chemically synthesized
ttacacttctcagagtcaag

SEQ ID NO: 539996 - DNA, 20 bp, Artificial Sequence
  chemically synthesized
atcaccttctatatgtatgt

SEQ ID NO: 539997 - DNA, 20 bp, Artificial Sequence
  chemically synthesized
aaaaaatattgacaattgat

SEQ ID NO: 539998 - DNA, 20 bp, Artificial Sequence
  chemically synthesized
gggattgtggacagatggac

SEQ ID NO: 539999 - DNA, 20 bp, Artificial Sequence
  chemically synthesized
ttctctagagttgccatgga

SEQ ID NO: 540000 - DNA, 20 bp, Artificial Sequence
  chemically synthesized
gacccccatctttcctccaa

SEQ ID NO: 540001 - DNA, 20 bp, Artificial Sequence
  chemically synthesized
aatgtcacaacactcttcaa

SEQ ID NO: 540002 - DNA, 20 bp, Artificial Sequence
  chemically synthesized
gacatcaagataatgacaat

SEQ ID NO: 540003 - DNA, 20 bp, Artificial Sequence
  chemically synthesized
tcactgtcttctcaatttta

SEQ ID NO: 540004 - DNA, 20 bp, Artificial Sequence
  chemically synthesized
cagattatgtggaaaatcat

SEQ ID NO: 540005 - DNA, 20 bp, Artificial Sequence
  chemically synthesized
tatctaatctcagatggaaa

SEQ ID NO: 540006 - DNA, 20 bp, Artificial Sequence
  chemically synthesized
actctttcttttttaattat

SEQ ID NO: 540007 - DNA, 20 bp, Artificial Sequence
  chemically synthesized
tatatttctcaataattaaa

SEQ ID NO: 540008 - DNA, 20 bp, Artificial Sequence
  chemically synthesized
gttaattttttgtatttttg

SEQ ID NO: 540009 - DNA, 20 bp, Artificial Sequence
  chemically synthesized
ctattcaggaggctgaggca

SEQ ID NO: 540010 - DNA, 20 bp, Artificial Sequence
  chemically synthesized
aattattattattattacta

SEQ ID NO: 540011 - DNA, 20 bp, Artificial Sequence
  chemically synthesized
caccacaactgacattttgg

SEQ ID NO: 540012 - DNA, 20 bp, Artificial Sequence
  chemically synthesized
acaggaaagtctcttacaac

SEQ ID NO: 540013 - DNA, 20 bp, Artificial Sequence
  chemically synthesized
tgtcacaaccaaaaatgtct

SEQ ID NO: 540014 - DNA, 20 bp, Artificial Sequence
  chemically synthesized
aatttatccctcagcgtgca

SEQ ID NO: 540015 - DNA, 20 bp, Artificial Sequence
  chemically synthesized
gtatatcacttaggagtcag

SEQ ID NO: 540016 - DNA, 20 bp, Artificial Sequence
  chemically synthesized
catctgttaatacggctgac

SEQ ID NO: 540017 - DNA, 20 bp, Artificial Sequence
  chemically synthesized
cagataggcagttttagaga

SEQ ID NO: 540018 - DNA, 20 bp, Artificial Sequence
  chemically synthesized
gagtttcaatgaaatcacac

SEQ ID NO: 540019 - DNA, 20 bp, Artificial Sequence
  chemically synthesized
tagctggaacaaagcattac

SEQ ID NO: 540020 - DNA, 20 bp, Artificial Sequence
  chemically synthesized
gtaatgctttgttccagcta

SEQ ID NO: 540021 - DNA, 20 bp, Artificial Sequence
  chemically synthesized
tcatctaagagatgaaaaat

SEQ ID NO: 540022 - DNA, 20 bp, Artificial Sequence
  chemically synthesized
caagatctttcccatacatt

SEQ ID NO: 540023 - DNA, 20 bp, Artificial Sequence
  chemically synthesized
aaaattaaaagtagatcatt

SEQ ID NO: 540024 - DNA, 20 bp, Artificial Sequence
  chemically synthesized
atcaaattcctcttaatgtc

SEQ ID NO: 540025 - DNA, 20 bp, Artificial Sequence
  chemically synthesized
ttgtcctttatcttaataga

SEQ ID NO: 540026 - DNA, 20 bp, Artificial Sequence
  chemically synthesized
aatattttcatagctcatat

SEQ ID NO: 540027 - DNA, 20 bp, Artificial Sequence
  chemically synthesized
tttcagggaattgtatggtt

SEQ ID NO: 540028 - DNA, 20 bp, Artificial Sequence
  chemically synthesized
gaattgtatggtttcagaaa

SEQ ID NO: 540029 - DNA, 20 bp, Artificial Sequence
  chemically synthesized
ttagtaaaggattattaagt

SEQ ID NO: 540030 - DNA, 20 bp, Artificial Sequence
  chemically synthesized
atatttgtcattcatattac

SEQ ID NO: 540031 - DNA, 20 bp, Artificial Sequence
  chemically synthesized
catcagtttccgaatatgcc

SEQ ID NO: 540032 - DNA, 20 bp, Artificial Sequence
  chemically synthesized
ataactcccgttgtgggact

SEQ ID NO: 540033 - DNA, 20 bp, Artificial Sequence
  chemically synthesized
cacacatgagatcactaagg

SEQ ID NO: 540034 - DNA, 20 bp, Artificial Sequence
  chemically synthesized
gtaaggaactggccacataa

SEQ ID NO: 540035 - DNA, 20 bp, Artificial Sequence
  chemically synthesized
aatttttaatgagtttgcac

SEQ ID NO: 540036 - DNA, 20 bp, Artificial Sequence
  chemically synthesized
tacaccacagtttggaggta

SEQ ID NO: 540037 - DNA, 20 bp, Artificial Sequence
  chemically synthesized
gacgtgacaaagaggtcgtt

SEQ ID NO: 540038 - DNA, 20 bp, Artificial Sequence
  chemically synthesized
gatcacactcacacatgaca

SEQ ID NO: 540039 - DNA, 20 bp, Artificial Sequence
  chemically synthesized
ggtgtttttagtaaagcaat

SEQ ID NO: 540040 - DNA, 20 bp, Artificial Sequence
  chemically synthesized
taggaagcatcagaaatata

SEQ ID NO: 540041 - DNA, 20 bp, Artificial Sequence
  chemically synthesized
ataataatttttaggaagca

SEQ ID NO: 540042 - DNA, 20 bp, Artificial Sequence
  chemically synthesized
ctactcgggaggctgaggca

SEQ ID NO: 540043 - DNA, 20 bp, Artificial Sequence
  chemically synthesized
aatatttggaagtatagtta

SEQ ID NO: 540044 - DNA, 20 bp, Artificial Sequence
  chemically synthesized
tattcacattttcaaggtgt

SEQ ID NO: 540045 - DNA, 20 bp, Artificial Sequence
  chemically synthesized
taagttcattgttaattgtt

SEQ ID NO: 540046 - DNA, 20 bp, Artificial Sequence
  chemically synthesized
gcaaaaagtcttcataaaaa

SEQ ID NO: 540047 - DNA, 20 bp, Artificial Sequence
  chemically synthesized
acattattataattcccctg

SEQ ID NO: 540048 - DNA, 20 bp, Artificial Sequence
  chemically synthesized
ctgaaaatgaggatcacaga

SEQ ID NO: 540049 - DNA, 20 bp, Artificial Sequence
  chemically synthesized
aaccagtgtaattatacttg

SEQ ID NO: 540050 - DNA, 20 bp, Artificial Sequence
  chemically synthesized
tttttgaattatgagaagaa

SEQ ID NO: 540051 - DNA, 20 bp, Artificial Sequence
  chemically synthesized
tctcactttttgaattatga

SEQ ID NO: 540052 - DNA, 20 bp, Artificial Sequence
  chemically synthesized
ctcataattcaaaaagtgag

SEQ ID NO: 540053 - DNA, 20 bp, Artificial Sequence
  chemically synthesized
ttgaagcagtcatagacaat

SEQ ID NO: 540054 - DNA, 20 bp, Artificial Sequence
  chemically synthesized
gcaactattcaactctgctg

SEQ ID NO: 540055 - DNA, 20 bp, Artificial Sequence
  chemically synthesized
ttgaatagttgcaacagagt

SEQ ID NO: 540056 - DNA, 20 bp, Artificial Sequence
  chemically synthesized
tggccctttacgtttacatt

SEQ ID NO: 540057 - DNA, 20 bp, Artificial Sequence
  chemically synthesized
gaagctatggtaaattaaaa

SEQ ID NO: 540058 - DNA, 20 bp, Artificial Sequence
  chemically synthesized
cttcctggcaacacgcaatg

SEQ ID NO: 540059 - DNA, 20 bp, Artificial Sequence
  chemically synthesized
caacacgcaatgttagaaac

SEQ ID NO: 540060 - DNA, 20 bp, Artificial Sequence
  chemically synthesized
catactaaaatgtctccaga

SEQ ID NO: 540061 - DNA, 20 bp, Artificial Sequence
  chemically synthesized
ctctccatactaaaatgtct

SEQ ID NO: 540062 - DNA, 20 bp, Artificial Sequence
  chemically synthesized
ttagggccaaatgtttccct

SEQ ID NO: 540063 - DNA, 20 bp, Artificial Sequence
  chemically synthesized
gcctcacctctcaatagcat

SEQ ID NO: 540064 - DNA, 20 bp, Artificial Sequence
  chemically synthesized
tccccaagtccccactcgac

SEQ ID NO: 540065 - DNA, 20 bp, Artificial Sequence
  chemically synthesized
ttttacaatcctcttgtaag

SEQ ID NO: 540066 - DNA, 20 bp, Artificial Sequence
  chemically synthesized
ctccccacgattggctactt

SEQ ID NO: 540067 - DNA, 20 bp, Artificial Sequence
  chemically synthesized
aaaaagggcactctgatagg

SEQ ID NO: 540068 - DNA, 20 bp, Artificial Sequence
  chemically synthesized
tatctcaaatattgcatcca

SEQ ID NO: 540069 - DNA, 20 bp, Artificial Sequence
  chemically synthesized
tgcatccagaagaatgacac

SEQ ID NO: 540070 - DNA, 20 bp, Artificial Sequence
  chemically synthesized
atgcacagaattaataaaaa

SEQ ID NO: 540071 - DNA, 20 bp, Artificial Sequence
  chemically synthesized
gaaagtgggaaatattatgc

SEQ ID NO: 540072 - DNA, 20 bp, Artificial Sequence
  chemically synthesized
aactgagaaaggaaaacaat

SEQ ID NO: 540073 - DNA, 20 bp, Artificial Sequence
  chemically synthesized
agcagggataggatacaaac

SEQ ID NO: 540074 - DNA, 20 bp, Artificial Sequence
  chemically synthesized
tattaatgaatacaatcatt

SEQ ID NO: 540075 - DNA, 20 bp, Artificial Sequence
  chemically synthesized
aggtgacattttagctgagt

SEQ ID NO: 540076 - DNA, 20 bp, Artificial Sequence
  chemically synthesized
aagtgaggggttgggtagtc

SEQ ID NO: 540077 - DNA, 20 bp, Artificial Sequence
  chemically synthesized
ggggagaggaaaagagttgc

SEQ ID NO: 540078 - DNA, 20 bp, Artificial Sequence
  chemically synthesized
cttattattttcccatttca

SEQ ID NO: 540079 - DNA, 20 bp, Artificial Sequence
  chemically synthesized
atctccagaggtgtatgaca

SEQ ID NO: 540080 - DNA, 20 bp, Artificial Sequence
  chemically synthesized
tgagaatgtgacaacaaacc

SEQ ID NO: 540081 - DNA, 20 bp, Artificial Sequence
  chemically synthesized
cttgactaaaatagttctag

SEQ ID NO: 540082 - DNA, 20 bp, Artificial Sequence
  chemically synthesized
gacttctttcgctgaagtgt

SEQ ID NO: 540083 - DNA, 20 bp, Artificial Sequence
  chemically synthesized
gtgacaaagcccttctgggc

SEQ ID NO: 540084 - DNA, 20 bp, Artificial Sequence
  chemically synthesized
gtgacagcagattatgtttg

SEQ ID NO: 540085 - DNA, 20 bp, Artificial Sequence
  chemically synthesized
tgtcagagataaaggaacag

SEQ ID NO: 540086 - DNA, 20 bp, Artificial Sequence
  chemically synthesized
agagtgtcagagataaagga

SEQ ID NO: 540087 - DNA, 20 bp, Artificial Sequence
  chemically synthesized
ctttaaatgtggtactctgc

SEQ ID NO: 540088 - DNA, 20 bp, Artificial Sequence
  chemically synthesized
gggaaccactggtgtccgag

SEQ ID NO: 540089 - DNA, 20 bp, Artificial Sequence
  chemically synthesized
agagagagattgagagagag

SEQ ID NO: 540090 - DNA, 20 bp, Artificial Sequence
  chemically synthesized
tcaatctctctctctctctc

SEQ ID NO: 540091 - DNA, 20 bp, Artificial Sequence
  chemically synthesized
gagccagattataaatgctt

SEQ ID NO: 540092 - DNA, 20 bp, Artificial Sequence
  chemically synthesized
gagatttgggcaataaagag

SEQ ID NO: 540093 - DNA, 20 bp, Artificial Sequence
  chemically synthesized
tgataactgcagggtttttc

SEQ ID NO: 540094 - DNA, 20 bp, Artificial Sequence
  chemically synthesized
tataaatccatcagtcaata

SEQ ID NO: 540095 - DNA, 20 bp, Artificial Sequence
  chemically synthesized
catcagtcaatataagaaat

SEQ ID NO: 540096 - DNA, 20 bp, Artificial Sequence
  chemically synthesized
agtcaatataagaaatgcag

SEQ ID NO: 540097 - DNA, 20 bp, Artificial Sequence
  chemically synthesized
gaaaaacaatgttgcggatg

SEQ ID NO: 540098 - DNA, 20 bp, Artificial Sequence
  chemically synthesized
ttcctgaacatcccatcact

SEQ ID NO: 540099 - DNA, 20 bp, Artificial Sequence
  chemically synthesized
ttaagatatctagtaggcaa

SEQ ID NO: 540100 - DNA, 20 bp, Artificial Sequence
  chemically synthesized
ggtcttgagacttttgggtc

SEQ ID NO: 540101 - DNA, 20 bp, Artificial Sequence
  chemically synthesized
taaactacttttcatgtaca

SEQ ID NO: 540102 - DNA, 20 bp, Artificial Sequence
  chemically synthesized
aggttaactattgttaaaaa

SEQ ID NO: 540103 - DNA, 20 bp, Artificial Sequence
  chemically synthesized
atgaaataagccagaccaag

SEQ ID NO: 540104 - DNA, 20 bp, Artificial Sequence
  chemically synthesized
ctaaatgaaataagccagac

SEQ ID NO: 540105 - DNA, 20 bp, Artificial Sequence
  chemically synthesized
gtttacaaagaaatatggtc

SEQ ID NO: 540106 - DNA, 20 bp, Artificial Sequence
  chemically synthesized
atatgtagaaaacagtttac

SEQ ID NO: 540107 - DNA, 20 bp, Artificial Sequence
  chemically synthesized
tatggaagggctaagaatat

SEQ ID NO: 540108 - DNA, 20 bp, Artificial Sequence
  chemically synthesized
tggggtttctatggaagggc

SEQ ID NO: 540109 - DNA, 20 bp, Artificial Sequence
  chemically synthesized
tacatattcttagcccttcc

SEQ ID NO: 540110 - DNA, 20 bp, Artificial Sequence
  chemically synthesized
agagagagagagagagagag

SEQ ID NO: 540111 - DNA, 20 bp, Artificial Sequence
  chemically synthesized
cagtctggcaccagacaaaa

SEQ ID NO: 540112 - DNA, 20 bp, Artificial Sequence
  chemically synthesized
taaaagaacttacaaagtaa

SEQ ID NO: 540113 - DNA, 20 bp, Artificial Sequence
  chemically synthesized
attggatgtggtgatgagat

SEQ ID NO: 540114 - DNA, 20 bp, Artificial Sequence
  chemically synthesized
tataatggtcttcctaggta

SEQ ID NO: 540115 - DNA, 20 bp, Artificial Sequence
  chemically synthesized
aggtatcagaattttctttt

SEQ ID NO: 540116 - DNA, 20 bp, Artificial Sequence
  chemically synthesized
gaagaaaaacagtttctcaa

SEQ ID NO: 540117 - DNA, 20 bp, Artificial Sequence
  chemically synthesized
tcttgttttcgttactaaag

SEQ ID NO: 540118 - DNA, 20 bp, Artificial Sequence
  chemically synthesized
tataaattaacattccacag

SEQ ID NO: 540119 - DNA, 20 bp, Artificial Sequence
  chemically synthesized
attttggtgtctggatctta

SEQ ID NO: 540120 - DNA, 20 bp, Artificial Sequence
  chemically synthesized
cttaggagaaaataggacca

SEQ ID NO: 540121 - DNA, 20 bp, Artificial Sequence
  chemically synthesized
gaaataaacactgtccttac

SEQ ID NO: 540122 - DNA, 20 bp, Artificial Sequence
  chemically synthesized
gttcattttcctactgctat

SEQ ID NO: 540123 - DNA, 20 bp, Artificial Sequence
  chemically synthesized
gaactaatacataggattat

SEQ ID NO: 540124 - DNA, 20 bp, Artificial Sequence
  chemically synthesized
agtctccatcagacatcaat

SEQ ID NO: 540125 - DNA, 20 bp, Artificial Sequence
  chemically synthesized
acactaacttgctttccgca

SEQ ID NO: 540126 - DNA, 20 bp, Artificial Sequence
  chemically synthesized
aggcttgtaacttgctggta

SEQ ID NO: 540127 - DNA, 20 bp, Artificial Sequence
  chemically synthesized
tataaccagatgaccacatc

SEQ ID NO: 540128 - DNA, 20 bp, Artificial Sequence
  chemically synthesized
aaagcctggtgagctctaat

SEQ ID NO: 540129 - DNA, 20 bp, Artificial Sequence
  chemically synthesized
taacacactgttaggaaaat

SEQ ID NO: 540130 - DNA, 20 bp, Artificial Sequence
  chemically synthesized
actttgagcactaaaacctg

SEQ ID NO: 540131 - DNA, 20 bp, Artificial Sequence
  chemically synthesized
ggtgggcttggagagaccct

SEQ ID NO: 540132 - DNA, 20 bp, Artificial Sequence
  chemically synthesized
ctgagactgggtaatttata

SEQ ID NO: 540133 - DNA, 20 bp, Artificial Sequence
  chemically synthesized
actatcaggagaacagcatg

SEQ ID NO: 540134 - DNA, 20 bp, Artificial Sequence
  chemically synthesized
ttttatgtaagccatagtcc

SEQ ID NO: 540135 - DNA, 20 bp, Artificial Sequence
  chemically synthesized
caggtacttttttgtgctag

SEQ ID NO: 540136 - DNA, 20 bp, Artificial Sequence
  chemically synthesized
ggaagcaatgatatatccaa

SEQ ID NO: 540137 - DNA, 20 bp, Artificial Sequence
  chemically synthesized
cttgctaagataacttgaaa

SEQ ID NO: 540138 - DNA, 20 bp, Artificial Sequence
  chemically synthesized
atagtttttttatgaacaac

SEQ ID NO: 540139 - DNA, 20 bp, Artificial Sequence
  chemically synthesized
tctacagtggaatagggaat

SEQ ID NO: 540140 - DNA, 20 bp, Artificial Sequence
  chemically synthesized
aattcagaatttatattcta

SEQ ID NO: 540141 - DNA, 20 bp, Artificial Sequence
  chemically synthesized
tattactgtatccttttctg

SEQ ID NO: 540142 - DNA, 20 bp, Artificial Sequence
  chemically synthesized
atatttccagaccaatttca

SEQ ID NO: 540143 - DNA, 20 bp, Artificial Sequence
  chemically synthesized
tcctataattacctcttcca

SEQ ID NO: 540144 - DNA, 20 bp, Artificial Sequence
  chemically synthesized
ttttgaaaagtaaaagatta

SEQ ID NO: 540145 - DNA, 20 bp, Artificial Sequence
  chemically synthesized
atttcagctctctgacagtg

SEQ ID NO: 540146 - DNA, 20 bp, Artificial Sequence
  chemically synthesized
tgtgaaatatgtttcctgga

SEQ ID NO: 540147 - DNA, 20 bp, Artificial Sequence
  chemically synthesized
aaggcttttcatttggtgtt

SEQ ID NO: 540148 - DNA, 20 bp, Artificial Sequence
  chemically synthesized
ttacatacctctacctaaat

SEQ ID NO: 540149 - DNA, 20 bp, Artificial Sequence
  chemically synthesized
gcaaatgaaaacatcagtaa

SEQ ID NO: 540150 - DNA, 20 bp, Artificial Sequence
  chemically synthesized
aattagacttgtaagactgg

SEQ ID NO: 540151 - DNA, 20 bp, Artificial Sequence
  chemically synthesized
agatatgtgaatgtttagaa

SEQ ID NO: 540152 - DNA, 20 bp, Artificial Sequence
  chemically synthesized
attcaaagatatgtgaatgt

SEQ ID NO: 540153 - DNA, 20 bp, Artificial Sequence
  chemically synthesized
ctggaaaagaggatcatttt

SEQ ID NO: 540154 - DNA, 20 bp, Artificial Sequence
  chemically synthesized
gtacctttgggacaaggtgt

SEQ ID NO: 540155 - DNA, 20 bp, Artificial Sequence
  chemically synthesized
gagtaagttggcagggatca

SEQ ID NO: 540156 - DNA, 20 bp, Artificial Sequence
  chemically synthesized
cccacctgaatgaatgcttt

SEQ ID NO: 540157 - DNA, 20 bp, Artificial Sequence
  chemically synthesized
acttaaatgagtagatcaga

SEQ ID NO: 540158 - DNA, 20 bp, Artificial Sequence
  chemically synthesized
aattaaagaaaacataattt

SEQ ID NO: 540159 - DNA, 20 bp, Artificial Sequence
  chemically synthesized
actaacccaattcaataatt

SEQ ID NO: 540160 - DNA, 20 bp, Artificial Sequence
  chemically synthesized
atatatgtatgtatacatag

SEQ ID NO: 540161 - DNA, 20 bp, Artificial Sequence
  chemically synthesized
cagagataagctattaaaat

SEQ ID NO: 540162 - DNA, 20 bp, Artificial Sequence
  chemically synthesized
ctttttaggggatacagaag

SEQ ID NO: 540163 - DNA, 20 bp, Artificial Sequence
  chemically synthesized
ttatattattttcagtcatt

SEQ ID NO: 540164 - DNA, 20 bp, Artificial Sequence
  chemically synthesized
cattgtgtatacatactgtt

SEQ ID NO: 540165 - DNA, 20 bp, Artificial Sequence
  chemically synthesized
tacatttaggacttacagta

SEQ ID NO: 540166 - DNA, 20 bp, Artificial Sequence
  chemically synthesized
taacaatttatacaccttca

SEQ ID NO: 540167 - DNA, 20 bp, Artificial Sequence
  chemically synthesized
atgctgaagcctttccaatt

SEQ ID NO: 540168 - DNA, 20 bp, Artificial Sequence
  chemically synthesized
tatacagacaaaaattaggg

SEQ ID NO: 540169 - DNA, 20 bp, Artificial Sequence
  chemically synthesized
aatcttattcaaataggtga

SEQ ID NO: 540170 - DNA, 20 bp, Artificial Sequence
  chemically synthesized
ttattcaaataggtgagtag

SEQ ID NO: 540171 - DNA, 20 bp, Artificial Sequence
  chemically synthesized
tctaaccacttctcccaatt

SEQ ID NO: 540172 - DNA, 20 bp, Artificial Sequence
  chemically synthesized
tcttaaattgggagaagtgg

SEQ ID NO: 540173 - DNA, 20 bp, Artificial Sequence
  chemically synthesized
tggttagaaaaggcaagtgg

SEQ ID NO: 540174 - DNA, 20 bp, Artificial Sequence
  chemically synthesized
aaaaggcaagtggttagaaa

SEQ ID NO: 540175 - DNA, 20 bp, Artificial Sequence
  chemically synthesized
tacaaaataaagtagaagat

SEQ ID NO: 540176 - DNA, 20 bp, Artificial Sequence
  chemically synthesized
cactgtgaggacagctgttt

SEQ ID NO: 540177 - DNA, 20 bp, Artificial Sequence
  chemically synthesized
tttcgaatcattacctgtga

SEQ ID NO: 540178 - DNA, 20 bp, Artificial Sequence
  chemically synthesized
aagaaatataaactggcaca

SEQ ID NO: 540179 - DNA, 20 bp, Artificial Sequence
  chemically synthesized
gaaggtagaaaagagggagt

SEQ ID NO: 540180 - DNA, 20 bp, Artificial Sequence
  chemically synthesized
atgaactcaaagcctagaag

SEQ ID NO: 540181 - DNA, 20 bp, Artificial Sequence
  chemically synthesized
tgagggagccaaacagtgat

SEQ ID NO: 540182 - DNA, 20 bp, Artificial Sequence
  chemically synthesized
agaaacagattcaggaaggt

SEQ ID NO: 540183 - DNA, 20 bp, Artificial Sequence
  chemically synthesized
gccagactgggagttattgt

SEQ ID NO: 540184 - DNA, 20 bp, Artificial Sequence
  chemically synthesized
ccttcactttagaattaagc

SEQ ID NO: 540185 - DNA, 20 bp, Artificial Sequence
  chemically synthesized
tttcctgttttgccttcact

SEQ ID NO: 540186 - DNA, 20 bp, Artificial Sequence
  chemically synthesized
caaaacaggaaaagtcaaag

SEQ ID NO: 540187 - DNA, 20 bp, Artificial Sequence
  chemically synthesized
taatttgtagatattttaac

SEQ ID NO: 540188 - DNA, 20 bp, Artificial Sequence
  chemically synthesized
tatctacaaattatacttct

SEQ ID NO: 540189 - DNA, 20 bp, Artificial Sequence
  chemically synthesized
ttaattccacatttcatgta

SEQ ID NO: 540190 - DNA, 20 bp, Artificial Sequence
  chemically synthesized
atttttaagatctccgagag

SEQ ID NO: 540191 - DNA, 20 bp, Artificial Sequence
  chemically synthesized
gattttcattggtatcctgg

SEQ ID NO: 540192 - DNA, 20 bp, Artificial Sequence
  chemically synthesized
gtttttgtttgggaaaaaga

SEQ ID NO: 540193 - DNA, 20 bp, Artificial Sequence
  chemically synthesized
ctgaggtttttgtttgggaa

SEQ ID NO: 540194 - DNA, 20 bp, Artificial Sequence
  chemically synthesized
ctgacatgattgagctaacc

SEQ ID NO: 540195 - DNA, 20 bp, Artificial Sequence
  chemically synthesized
catgattgagctaacccaag

SEQ ID NO: 540196 - DNA, 20 bp, Artificial Sequence
  chemically synthesized
ttacgagtgtgagattaatg

SEQ ID NO: 540197 - DNA, 20 bp, Artificial Sequence
  chemically synthesized
ttccattaatctcacactcg

SEQ ID NO: 540198 - DNA, 20 bp, Artificial Sequence
  chemically synthesized
gatggactgaaatggataga

SEQ ID NO: 540199 - DNA, 20 bp, Artificial Sequence
  chemically synthesized
aagtgacaggacaaatgcat

SEQ ID NO: 540200 - DNA, 20 bp, Artificial Sequence
  chemically synthesized
ttcaaaggtggactaaaaat

SEQ ID NO: 540201 - DNA, 20 bp, Artificial Sequence
  chemically synthesized
tcagggcattttattatatt

SEQ ID NO: 540202 - DNA, 20 bp, Artificial Sequence
  chemically synthesized
tgttcaaatcaaatggaaaa

SEQ ID NO: 540203 - DNA, 20 bp, Artificial Sequence
  chemically synthesized
tttactctcttccccacctg

SEQ ID NO: 540204 - DNA, 20 bp, Artificial Sequence
  chemically synthesized
catatcagcagatgtggttc

SEQ ID NO: 540205 - DNA, 20 bp, Artificial Sequence
  chemically synthesized
ttacattaatgactatctaa

SEQ ID NO: 540206 - DNA, 20 bp, Artificial Sequence
  chemically synthesized
ccaaagcataaggggccatc

SEQ ID NO: 540207 - DNA, 20 bp, Artificial Sequence
  chemically synthesized
tcaatcagaaatgatttatt

SEQ ID NO: 540208 - DNA, 20 bp, Artificial Sequence
  chemically synthesized
cttctgtaaaagatgctcaa

SEQ ID NO: 540209 - DNA, 20 bp, Artificial Sequence
  chemically synthesized
agacgtaatgctttcctgtg

SEQ ID NO: 540210 - DNA, 20 bp, Artificial Sequence
  chemically synthesized
atgttggaagggaatggctt

SEQ ID NO: 540211 - DNA, 20 bp, Artificial Sequence
  chemically synthesized
catctcatatccctgtcccc

SEQ ID NO: 540212 - DNA, 20 bp, Artificial Sequence
  chemically synthesized
acatgtgttaatcttttcat

SEQ ID NO: 540213 - DNA, 20 bp, Artificial Sequence
  chemically synthesized
cttcacattttgtttcaata

SEQ ID NO: 540214 - DNA, 20 bp, Artificial Sequence
  chemically synthesized
tccatttaatataaagcctc

SEQ ID NO: 540215 - DNA, 20 bp, Artificial Sequence
  chemically synthesized
atataaagcctccaagaaac

SEQ ID NO: 540216 - DNA, 20 bp, Artificial Sequence
  chemically synthesized
cctaattttttaaaccaaaa

SEQ ID NO: 540217 - DNA, 20 bp, Artificial Sequence
  chemically synthesized
tgtgcttcattgaaagctaa

SEQ ID NO: 540218 - DNA, 20 bp, Artificial Sequence
  chemically synthesized
tgaagcacaatcaaattcct

SEQ ID NO: 540219 - DNA, 20 bp, Artificial Sequence
  chemically synthesized
tttattatgttgcagttgta

SEQ ID NO: 540220 - DNA, 20 bp, Artificial Sequence
  chemically synthesized
tatacctttctggtaatgat

SEQ ID NO: 540221 - DNA, 20 bp, Artificial Sequence
  chemically synthesized
taaaaaattctatatcatta

SEQ ID NO: 540222 - DNA, 20 bp, Artificial Sequence
  chemically synthesized
ctactagattaaggagctaa

SEQ ID NO: 540223 - DNA, 20 bp, Artificial Sequence
  chemically synthesized
cagtgtgctggcataaggct

SEQ ID NO: 540224 - DNA, 20 bp, Artificial Sequence
  chemically synthesized
cacaattacttcaaagtata

SEQ ID NO: 540225 - DNA, 20 bp, Artificial Sequence
  chemically synthesized
tgaatttaatacagttataa

SEQ ID NO: 540226 - DNA, 20 bp, Artificial Sequence
  chemically synthesized
gaaaagcataaaaatataca

SEQ ID NO: 540227 - DNA, 20 bp, Artificial Sequence
  chemically synthesized
gttaaataggattattgtgc

SEQ ID NO: 540228 - DNA, 20 bp, Artificial Sequence
  chemically synthesized
aaagaagaaatatttttaaa

SEQ ID NO: 540229 - DNA, 20 bp, Artificial Sequence
  chemically synthesized
atgataacctcaaaaggaaa

SEQ ID NO: 540230 - DNA, 20 bp, Artificial Sequence
  chemically synthesized
ctgcttccaatgccacaact

SEQ ID NO: 540231 - DNA, 20 bp, Artificial Sequence
  chemically synthesized
ttactatctgccccattaca

SEQ ID NO: 540232 - DNA, 20 bp, Artificial Sequence
  chemically synthesized
aaaaggaaggagaaggataa

SEQ ID NO: 540233 - DNA, 20 bp, Artificial Sequence
  chemically synthesized
ctttatgaggaagtaacatc

SEQ ID NO: 540234 - DNA, 20 bp, Artificial Sequence
  chemically synthesized
tggctcaaaacgtcagagat

SEQ ID NO: 540235 - DNA, 20 bp, Artificial Sequence
  chemically synthesized
aaaattttaaatatggttag

SEQ ID NO: 540236 - DNA, 20 bp, Artificial Sequence
  chemically synthesized
cataaatttattttttaatg

SEQ ID NO: 540237 - DNA, 20 bp, Artificial Sequence
  chemically synthesized
agagccagccctacctactt

SEQ ID NO: 540238 - DNA, 20 bp, Artificial Sequence
  chemically synthesized
ataccaggaaatcctaaagg

SEQ ID NO: 540239 - DNA, 20 bp, Artificial Sequence
  chemically synthesized
cagagcagaagatgggattg

SEQ ID NO: 540240 - DNA, 20 bp, Artificial Sequence
  chemically synthesized
ctcttgttgggaaataagac

SEQ ID NO: 540241 - DNA, 20 bp, Artificial Sequence
  chemically synthesized
atgatcaggtatcataagtg

SEQ ID NO: 540242 - DNA, 20 bp, Artificial Sequence
  chemically synthesized
caagagattttaaaccagtc

SEQ ID NO: 540243 - DNA, 20 bp, Artificial Sequence
  chemically synthesized
ttcattacatgaaggaacag

SEQ ID NO: 540244 - DNA, 20 bp, Artificial Sequence
  chemically synthesized
tactgtttagggaataatga

SEQ ID NO: 540245 - DNA, 20 bp, Artificial Sequence
  chemically synthesized
caaccatgcatcaaaaatat

SEQ ID NO: 540246 - DNA, 20 bp, Artificial Sequence
  chemically synthesized
gcattcacagatttgtaatc

SEQ ID NO: 540247 - DNA, 20 bp, Artificial Sequence
  chemically synthesized
cccagacccggcatccatgt

SEQ ID NO: 540248 - DNA, 20 bp, Artificial Sequence
  chemically synthesized
atgccgggtctgggcctcaa

SEQ ID NO: 540249 - DNA, 20 bp, Artificial Sequence
  chemically synthesized
actttgaatcctagcctgtg

SEQ ID NO: 540250 - DNA, 20 bp, Artificial Sequence
  chemically synthesized
tcaaagtcagccataaagat

SEQ ID NO: 540251 - DNA, 20 bp, Artificial Sequence
  chemically synthesized
ggttgccaatatgaaatgaa

SEQ ID NO: 540252 - DNA, 20 bp, Artificial Sequence
  chemically synthesized
gctgcagcaattccacatag

SEQ ID NO: 540253 - DNA, 20 bp, Artificial Sequence
  chemically synthesized
cctatgtggaattgctgcag

SEQ ID NO: 540254 - DNA, 20 bp, Artificial Sequence
  chemically synthesized
aaatatccatttaaaatata

SEQ ID NO: 540255 - DNA, 20 bp, Artificial Sequence
  chemically synthesized
caaatgatatccatgtttaa

SEQ ID NO: 540256 - DNA, 20 bp, Artificial Sequence
  chemically synthesized
ggatggtgttaaaccattca

SEQ ID NO: 540257 - DNA, 20 bp, Artificial Sequence
  chemically synthesized
ctagagcaggagcaagagag

SEQ ID NO: 540258 - DNA, 20 bp, Artificial Sequence
  chemically synthesized
acctgagactgggtaatgga

SEQ ID NO: 540259 - DNA, 20 bp, Artificial Sequence
  chemically synthesized
atcttttcttgcattgctat

SEQ ID NO: 540260 - DNA, 20 bp, Artificial Sequence
  chemically synthesized
ggtatttctttatagcaatg

SEQ ID NO: 540261 - DNA, 20 bp, Artificial Sequence
  chemically synthesized
taaaacaatattttgaacat

SEQ ID NO: 540262 - DNA, 20 bp, Artificial Sequence
  chemically synthesized
cacaatatataagaggtatg

SEQ ID NO: 540263 - DNA, 20 bp, Artificial Sequence
  chemically synthesized
caataaatcgatcccaagtg

SEQ ID NO: 540264 - DNA, 20 bp, Artificial Sequence
  chemically synthesized
accctttattttttgcacat

SEQ ID NO: 540265 - DNA, 20 bp, Artificial Sequence
  chemically synthesized
atcatacatcaatgatggat

SEQ ID NO: 540266 - DNA, 20 bp, Artificial Sequence
  chemically synthesized
tcatttgaatcaaatcttta

SEQ ID NO: 540267 - DNA, 20 bp, Artificial Sequence
  chemically synthesized
ctcaattacggtaatagaat

SEQ ID NO: 540268 - DNA, 20 bp, Artificial Sequence
  chemically synthesized
agcaaaactcaattacggta

SEQ ID NO: 540269 - DNA, 20 bp, Artificial Sequence
  chemically synthesized
agaagcacctagctacacaa

SEQ ID NO: 540270 - DNA, 20 bp, Artificial Sequence
  chemically synthesized
gtgtttctctgttcttagac

SEQ ID NO: 540271 - DNA, 20 bp, Artificial Sequence
  chemically synthesized
agcattctgggtctaagaac

SEQ ID NO: 540272 - DNA, 20 bp, Artificial Sequence
  chemically synthesized
tgcaaaggccctgagatgtt

SEQ ID NO: 540273 - DNA, 20 bp, Artificial Sequence
  chemically synthesized
tatgattatcctatatggat

SEQ ID NO: 540274 - DNA, 20 bp, Artificial Sequence
  chemically synthesized
attgagaaaggttgacttaa

SEQ ID NO: 540275 - DNA, 20 bp, Artificial Sequence
  chemically synthesized
ttaagaagaaaatggtaaag

SEQ ID NO: 540276 - DNA, 20 bp, Artificial Sequence
  chemically synthesized
acccaactctttattatggc

SEQ ID NO: 540277 - DNA, 20 bp, Artificial Sequence
  chemically synthesized
aatccatgagggccttaagc

SEQ ID NO: 540278 - DNA, 20 bp, Artificial Sequence
  chemically synthesized
cggtgtaggattgaatagga

SEQ ID NO: 540279 - DNA, 20 bp, Artificial Sequence
  chemically synthesized
agagaataacaacagtagta

SEQ ID NO: 540280 - DNA, 20 bp, Artificial Sequence
  chemically synthesized
aacaagcaggtttggaatca

SEQ ID NO: 540281 - DNA, 20 bp, Artificial Sequence
  chemically synthesized
taaagatggcagttaagtcc

SEQ ID NO: 540282 - DNA, 20 bp, Artificial Sequence
  chemically synthesized
cacctaggaggagagcgaaa

SEQ ID NO: 540283 - DNA, 20 bp, Artificial Sequence
  chemically synthesized
gaacaactcactgggacaca

SEQ ID NO: 540284 - DNA, 20 bp, Artificial Sequence
  chemically synthesized
gcatgtaaacgtatgtgaaa

SEQ ID NO: 540285 - DNA, 20 bp, Artificial Sequence
  chemically synthesized
aataaatgtacattttgtgg

SEQ ID NO: 540286 - DNA, 20 bp, Artificial Sequence
  chemically synthesized
gcttataagttttgtttcaa

SEQ ID NO: 540287 - DNA, 20 bp, Artificial Sequence
  chemically synthesized
aagaggcggaggaggagcta

SEQ ID NO: 540288 - DNA, 20 bp, Artificial Sequence
  chemically synthesized
aacagaagttattgtttcaa

SEQ ID NO: 540289 - DNA, 20 bp, Artificial Sequence
  chemically synthesized
acagatagaaagagggaaca

SEQ ID NO: 540290 - DNA, 20 bp, Artificial Sequence
  chemically synthesized
catttcccacaactgcacag

SEQ ID NO: 540291 - DNA, 20 bp, Artificial Sequence
  chemically synthesized
gccagcagaagaactagact

SEQ ID NO: 540292 - DNA, 20 bp, Artificial Sequence
  chemically synthesized
ttaaagacacagggaaatac

SEQ ID NO: 540293 - DNA, 20 bp, Artificial Sequence
  chemically synthesized
gtctttcacttcagtaatgt

SEQ ID NO: 540294 - DNA, 20 bp, Artificial Sequence
  chemically synthesized
cttcacagaggttctacctt

SEQ ID NO: 540295 - DNA, 20 bp, Artificial Sequence
  chemically synthesized
acagaggttctaccttgaag

SEQ ID NO: 540296 - DNA, 20 bp, Artificial Sequence
  chemically synthesized
gatgaaatggctggcaaaag

SEQ ID NO: 540297 - DNA, 20 bp, Artificial Sequence
  chemically synthesized
tgaacattggagatatttta

SEQ ID NO: 540298 - DNA, 20 bp, Artificial Sequence
  chemically synthesized
tcaatctattgatcatgttg

SEQ ID NO: 540299 - DNA, 20 bp, Artificial Sequence
  chemically synthesized
ctactcgggaggctgaggca

SEQ ID NO: 540300 - DNA, 20 bp, Artificial Sequence
  chemically synthesized
aaaaaaaaaaaacaaaaaca

SEQ ID NO: 540301 - DNA, 20 bp, Artificial Sequence
  chemically synthesized
tggattgtttgtaacacaaa

SEQ ID NO: 540302 - DNA, 20 bp, Artificial Sequence
  chemically synthesized
tagtgtgtcttattttccct

SEQ ID NO: 540303 - DNA, 20 bp, Artificial Sequence
  chemically synthesized
caaagctcatgaaaacataa

SEQ ID NO: 540304 - DNA, 20 bp, Artificial Sequence
  chemically synthesized
catgagctttgggatttggg

SEQ ID NO: 540305 - DNA, 20 bp, Artificial Sequence
  chemically synthesized
ccaataaatttttgatgtta

SEQ ID NO: 540306 - DNA, 20 bp, Artificial Sequence
  chemically synthesized
attggacatttaatctttta

SEQ ID NO: 540307 - DNA, 20 bp, Artificial Sequence
  chemically synthesized
catacatcccctttcatgct

SEQ ID NO: 540308 - DNA, 20 bp, Artificial Sequence
  chemically synthesized
aacatcttttagatttttca

SEQ ID NO: 540309 - DNA, 20 bp, Artificial Sequence
  chemically synthesized
aaaatcaataaaagtgccta

SEQ ID NO: 540310 - DNA, 20 bp, Artificial Sequence
  chemically synthesized
atttaaaaggttaaggaaat

SEQ ID NO: 540311 - DNA, 20 bp, Artificial Sequence
  chemically synthesized
gataagataataagataatt

SEQ ID NO: 540312 - DNA, 20 bp, Artificial Sequence
  chemically synthesized
gtgagggtgtgaggagtttg

SEQ ID NO: 540313 - DNA, 20 bp, Artificial Sequence
  chemically synthesized
tatgaagttcaatgcaaatt

SEQ ID NO: 540314 - DNA, 20 bp, Artificial Sequence
  chemically synthesized
tcttattcactaatcttatt

SEQ ID NO: 540315 - DNA, 20 bp, Artificial Sequence
  chemically synthesized
aactggttcaaaagagaata

SEQ ID NO: 540316 - DNA, 20 bp, Artificial Sequence
  chemically synthesized
gaagacaaaactggttcaaa

SEQ ID NO: 540317 - DNA, 20 bp, Artificial Sequence
  chemically synthesized
tcagcacagtgaaattttat

SEQ ID NO: 540318 - DNA, 20 bp, Artificial Sequence
  chemically synthesized
tttcactgtgctgataggtg

SEQ ID NO: 540319 - DNA, 20 bp, Artificial Sequence
  chemically synthesized
tgaataatggagaaaagtac

SEQ ID NO: 540320 - DNA, 20 bp, Artificial Sequence
  chemically synthesized
ctggggacattttgaataat

SEQ ID NO: 540321 - DNA, 20 bp, Artificial Sequence
  chemically synthesized
atcgctgtgctgctgatgga

SEQ ID NO: 540322 - DNA, 20 bp, Artificial Sequence
  chemically synthesized
ataaggaaataaagtaaact

SEQ ID NO: 540323 - DNA, 20 bp, Artificial Sequence
  chemically synthesized
cgtgcttattgtgaatgcga

SEQ ID NO: 540324 - DNA, 20 bp, Artificial Sequence
  chemically synthesized
ctactctttcatttatagtg

SEQ ID NO: 540325 - DNA, 20 bp, Artificial Sequence
  chemically synthesized
tctgtcttgatggtgcctca

SEQ ID NO: 540326 - DNA, 20 bp, Artificial Sequence
  chemically synthesized
tctcaaaaaaaaaagaaaag

SEQ ID NO: 540327 - DNA, 20 bp, Artificial Sequence
  chemically synthesized
actgtctcaaaaaaaaaaga

SEQ ID NO: 540328 - DNA, 20 bp, Artificial Sequence
  chemically synthesized
gtaagactgtctcaaaaaaa

SEQ ID NO: 540329 - DNA, 20 bp, Artificial Sequence
  chemically synthesized
tagggggctatgtttttgag

SEQ ID NO: 540330 - DNA, 20 bp, Artificial Sequence
  chemically synthesized
tcttttcattgtaaaagcct

SEQ ID NO: 540331 - DNA, 20 bp, Artificial Sequence
  chemically synthesized
ttcacagttggtgtgctgat

SEQ ID NO: 540332 - DNA, 20 bp, Artificial Sequence
  chemically synthesized
tgcacttttgaattgggatg

SEQ ID NO: 540333 - DNA, 20 bp, Artificial Sequence
  chemically synthesized
gaattgggatgagagaatgg

SEQ ID NO: 540334 - DNA, 20 bp, Artificial Sequence
  chemically synthesized
tgggagaggagcggagctgg

SEQ ID NO: 540335 - DNA, 20 bp, Artificial Sequence
  chemically synthesized
taaactttgagacttttgta

SEQ ID NO: 540336 - DNA, 20 bp, Artificial Sequence
  chemically synthesized
acgtggtgcctcatccaagc

SEQ ID NO: 540337 - DNA, 20 bp, Artificial Sequence
  chemically synthesized
taagatattttaagagagag

SEQ ID NO: 540338 - DNA, 20 bp, Artificial Sequence
  chemically synthesized
acaataagatattttaagag

SEQ ID NO: 540339 - DNA, 20 bp, Artificial Sequence
  chemically synthesized
acagcccataaatggaatgg

SEQ ID NO: 540340 - DNA, 20 bp, Artificial Sequence
  chemically synthesized
attgttgactgtacttacaa

SEQ ID NO: 540341 - DNA, 20 bp, Artificial Sequence
  chemically synthesized
tatcattgcactggagtctt

SEQ ID NO: 540342 - DNA, 20 bp, Artificial Sequence
  chemically synthesized
gatttgtaccttttgactta

SEQ ID NO: 540343 - DNA, 20 bp, Artificial Sequence
  chemically synthesized
gttggcagttacagcttatg

SEQ ID NO: 540344 - DNA, 20 bp, Artificial Sequence
  chemically synthesized
atagaatttttattttcaaa

SEQ ID NO: 540345 - DNA, 20 bp, Artificial Sequence
  chemically synthesized
tttggttaatttatgtattg

SEQ ID NO: 540346 - DNA, 20 bp, Artificial Sequence
  chemically synthesized
atatctgattttgagagagc

SEQ ID NO: 540347 - DNA, 20 bp, Artificial Sequence
  chemically synthesized
actgtaattaaaaatatagg

SEQ ID NO: 540348 - DNA, 20 bp, Artificial Sequence
  chemically synthesized
tctgtctcaaaagaaataaa

SEQ ID NO: 540349 - DNA, 20 bp, Artificial Sequence
  chemically synthesized
cagagtgagactctgtctca

SEQ ID NO: 540350 - DNA, 20 bp, Artificial Sequence
  chemically synthesized
aggcaggcagatcactaggt

SEQ ID NO: 540351 - DNA, 20 bp, Artificial Sequence
  chemically synthesized
gcccactgctttattttcaa

SEQ ID NO: 540352 - DNA, 20 bp, Artificial Sequence
  chemically synthesized
accttcagatggatgctaaa

SEQ ID NO: 540353 - DNA, 20 bp, Artificial Sequence
  chemically synthesized
ttgtcatgtggtatgtctga

SEQ ID NO: 540354 - DNA, 20 bp, Artificial Sequence
  chemically synthesized
ttagcctataaaccacagtt

SEQ ID NO: 540355 - DNA, 20 bp, Artificial Sequence
  chemically synthesized
cagtctggaaaagccagctt

SEQ ID NO: 540356 - DNA, 20 bp, Artificial Sequence
  chemically synthesized
aactgtattttaaaagtttt

SEQ ID NO: 540357 - DNA, 20 bp, Artificial Sequence
  chemically synthesized
tcaatcatatttccagcact

SEQ ID NO: 540358 - DNA, 20 bp, Artificial Sequence
  chemically synthesized
tgcagcactgtcctgaaact

SEQ ID NO: 540359 - DNA, 20 bp, Artificial Sequence
  chemically synthesized
tccctttcagaataccctca

SEQ ID NO: 540360 - DNA, 20 bp, Artificial Sequence
  chemically synthesized
atttagtaattgcctccctt

SEQ ID NO: 540361 - DNA, 20 bp, Artificial Sequence
  chemically synthesized
tggcaagggctgatggtctc

SEQ ID NO: 540362 - DNA, 20 bp, Artificial Sequence
  chemically synthesized
aacctatgtcttagagtgat

SEQ ID NO: 540363 - DNA, 20 bp, Artificial Sequence
  chemically synthesized
aatcttgaggaaactaataa

SEQ ID NO: 540364 - DNA, 20 bp, Artificial Sequence
  chemically synthesized
tactgttcatcagctagaag

SEQ ID NO: 540365 - DNA, 20 bp, Artificial Sequence
  chemically synthesized
aaatcataaagctaataaat

SEQ ID NO: 540366 - DNA, 20 bp, Artificial Sequence
  chemically synthesized
aaatttttgtctaagagtta

SEQ ID NO: 540367 - DNA, 20 bp, Artificial Sequence
  chemically synthesized
aaatactcccagcaagatag

SEQ ID NO: 540368 - DNA, 20 bp, Artificial Sequence
  chemically synthesized
catgctgttttaaaaattac

SEQ ID NO: 540369 - DNA, 20 bp, Artificial Sequence
  chemically synthesized
tcaactttacaagaatatac

SEQ ID NO: 540370 - DNA, 20 bp, Artificial Sequence
  chemically synthesized
atagtacaaaatcaacttta

SEQ ID NO: 540371 - DNA, 20 bp, Artificial Sequence
  chemically synthesized
tagaaaattaagaagccagt

SEQ ID NO: 540372 - DNA, 20 bp, Artificial Sequence
  chemically synthesized
agtgtaaggaagtataagtt

SEQ ID NO: 540373 - DNA, 20 bp, Artificial Sequence
  chemically synthesized
tacaaccttgtgacactcaa

SEQ ID NO: 540374 - DNA, 20 bp, Artificial Sequence
  chemically synthesized
gtcccttcttgcattgctat

SEQ ID NO: 540375 - DNA, 20 bp, Artificial Sequence
  chemically synthesized
cctgaaactgggtgctttaa

SEQ ID NO: 540376 - DNA, 20 bp, Artificial Sequence
  chemically synthesized
gcctgcagaaccgtaagtca

SEQ ID NO: 540377 - DNA, 20 bp, Artificial Sequence
  chemically synthesized
ttgatttttagtgaaacaaa

SEQ ID NO: 540378 - DNA, 20 bp, Artificial Sequence
  chemically synthesized
taagcgtgttggatgcatgg

SEQ ID NO: 540379 - DNA, 20 bp, Artificial Sequence
  chemically synthesized
aaagttgaaaagtgatggtg

SEQ ID NO: 540380 - DNA, 20 bp, Artificial Sequence
  chemically synthesized
gaattgtaaatccatgaaaa

SEQ ID NO: 540381 - DNA, 20 bp, Artificial Sequence
  chemically synthesized
gagcgatatgaaaataaggg

SEQ ID NO: 540382 - DNA, 20 bp, Artificial Sequence
  chemically synthesized
acccaaagagtaactagcca

SEQ ID NO: 540383 - DNA, 20 bp, Artificial Sequence
  chemically synthesized
tttaacatcaacacatttat

SEQ ID NO: 540384 - DNA, 20 bp, Artificial Sequence
  chemically synthesized
ccagggagattacctttatc

SEQ ID NO: 540385 - DNA, 20 bp, Artificial Sequence
  chemically synthesized
caagagaacagctgtgcagg

SEQ ID NO: 540386 - DNA, 20 bp, Artificial Sequence
  chemically synthesized
ggaggtggtagcaaggttcc

SEQ ID NO: 540387 - DNA, 20 bp, Artificial Sequence
  chemically synthesized
attttgatgatgaggaaact

SEQ ID NO: 540388 - DNA, 20 bp, Artificial Sequence
  chemically synthesized
actgaagaaaaagcgccagt

SEQ ID NO: 540389 - DNA, 20 bp, Artificial Sequence
  chemically synthesized
caacaccaagatcaaaagga

SEQ ID NO: 540390 - DNA, 20 bp, Artificial Sequence
  chemically synthesized
aagcaaaaatgcaagcaagt

SEQ ID NO: 540391 - DNA, 20 bp, Artificial Sequence
  chemically synthesized
gccaagttcatgaattatgt

SEQ ID NO: 540392 - DNA, 20 bp, Artificial Sequence
  chemically synthesized
ggcagtggaggaagtctctc

SEQ ID NO: 540393 - DNA, 20 bp, Artificial Sequence
  chemically synthesized
acagccagatatcaactgtt

SEQ ID NO: 540394 - DNA, 20 bp, Artificial Sequence
  chemically synthesized
tgttgtccagattccattgc

SEQ ID NO: 540395 - DNA, 20 bp, Artificial Sequence
  chemically synthesized
catgatggacgattagaggg

SEQ ID NO: 540396 - DNA, 20 bp, Artificial Sequence
  chemically synthesized
aaatggaattgtaatgatgt

SEQ ID NO: 540397 - DNA, 20 bp, Artificial Sequence
  chemically synthesized
tccttgggatatcattaaga

SEQ ID NO: 540398 - DNA, 20 bp, Artificial Sequence
  chemically synthesized
ttaatgatatcccaaggaga

SEQ ID NO: 540399 - DNA, 20 bp, Artificial Sequence
  chemically synthesized
cataaccagtgctatccttc

SEQ ID NO: 540400 - DNA, 20 bp, Artificial Sequence
  chemically synthesized
cagccataaattataaaaaa

SEQ ID NO: 540401 - DNA, 20 bp, Artificial Sequence
  chemically synthesized
attaaccgtggtcgtatatc

SEQ ID NO: 540402 - DNA, 20 bp, Artificial Sequence
  chemically synthesized
aattgtttttcccttgtcaa

SEQ ID NO: 540403 - DNA, 20 bp, Artificial Sequence
  chemically synthesized
aatggatacttactgtcatt

SEQ ID NO: 540404 - DNA, 20 bp, Artificial Sequence
  chemically synthesized
aagggcagtaagtaaacact

SEQ ID NO: 540405 - DNA, 20 bp, Artificial Sequence
  chemically synthesized
atgagactgtgagctcataa

SEQ ID NO: 540406 - DNA, 20 bp, Artificial Sequence
  chemically synthesized
tgaaggaagctcaatgtaag

SEQ ID NO: 540407 - DNA, 20 bp, Artificial Sequence
  chemically synthesized
tcaccaatatacctcggtac

SEQ ID NO: 540408 - DNA, 20 bp, Artificial Sequence
  chemically synthesized
taccgaggtatattggtgat

SEQ ID NO: 540409 - DNA, 20 bp, Artificial Sequence
  chemically synthesized
catgtttattatcttttcca

SEQ ID NO: 540410 - DNA, 20 bp, Artificial Sequence
  chemically synthesized
tcagcaagtgacagagttat

SEQ ID NO: 540411 - DNA, 20 bp, Artificial Sequence
  chemically synthesized
aagaaagttaagcagatctc

SEQ ID NO: 540412 - DNA, 20 bp, Artificial Sequence
  chemically synthesized
ttttgtaactcccccatctt

SEQ ID NO: 540413 - DNA, 20 bp, Artificial Sequence
  chemically synthesized
atgtcccaatctactccctc

SEQ ID NO: 540414 - DNA, 20 bp, Artificial Sequence
  chemically synthesized
gggagtagattgggacatgg

SEQ ID NO: 540415 - DNA, 20 bp, Artificial Sequence
  chemically synthesized
agggtagagccctctggtag

SEQ ID NO: 540416 - DNA, 20 bp, Artificial Sequence
  chemically synthesized
agagaaaagcaaatttaaag

SEQ ID NO: 540417 - DNA, 20 bp, Artificial Sequence
  chemically synthesized
acatcccttcttactgttcc

SEQ ID NO: 540418 - DNA, 20 bp, Artificial Sequence
  chemically synthesized
aacagtaagaagggatgtga

SEQ ID NO: 540419 - DNA, 20 bp, Artificial Sequence
  chemically synthesized
cattctggaagcaatgagaa

SEQ ID NO: 540420 - DNA, 20 bp, Artificial Sequence
  chemically synthesized
atttctgcttctcattgctt

SEQ ID NO: 540421 - DNA, 20 bp, Artificial Sequence
  chemically synthesized
atgctgattgcaaattccaa

SEQ ID NO: 540422 - DNA, 20 bp, Artificial Sequence
  chemically synthesized
taagagactacaaaaaatga

SEQ ID NO: 540423 - DNA, 20 bp, Artificial Sequence
  chemically synthesized
ctcttgataatttcatgctc

SEQ ID NO: 540424 - DNA, 20 bp, Artificial Sequence
  chemically synthesized
ttgcccatcaagtgtatctt

SEQ ID NO: 540425 - DNA, 20 bp, Artificial Sequence
  chemically synthesized
tactgggagtgtggtaccag

SEQ ID NO: 540426 - DNA, 20 bp, Artificial Sequence
  chemically synthesized
agccggaaaatttactgcta

SEQ ID NO: 540427 - DNA, 20 bp, Artificial Sequence
  chemically synthesized
ctagtgtatgtcttctagtt

SEQ ID NO: 540428 - DNA, 20 bp, Artificial Sequence
  chemically synthesized
cttcactgggaccctaacgt

SEQ ID NO: 540429 - DNA, 20 bp, Artificial Sequence
  chemically synthesized
ccagtgaagggcaacagatg

SEQ ID NO: 540430 - DNA, 20 bp, Artificial Sequence
  chemically synthesized
ctgctgagattcaaatgctg

SEQ ID NO: 540431 - DNA, 20 bp, Artificial Sequence
  chemically synthesized
acaatgtaaaaactgactat

SEQ ID NO: 540432 - DNA, 20 bp, Artificial Sequence
  chemically synthesized
agattgaattaaaggataat

SEQ ID NO: 540433 - DNA, 20 bp, Artificial Sequence
  chemically synthesized
tcactgacagtatctgctac

SEQ ID NO: 540434 - DNA, 20 bp, Artificial Sequence
  chemically synthesized
ttgctttcagcactcgcagc

SEQ ID NO: 540435 - DNA, 20 bp, Artificial Sequence
  chemically synthesized
gagtgctgaaagcaaggcga

SEQ ID NO: 540436 - DNA, 20 bp, Artificial Sequence
  chemically synthesized
tgaaagcaaggcgagaagaa

SEQ ID NO: 540437 - DNA, 20 bp, Artificial Sequence
  chemically synthesized
gctctctgaatctaaactct

SEQ ID NO: 540438 - DNA, 20 bp, Artificial Sequence
  chemically synthesized
tgggtcctttaaaaagtgct

SEQ ID NO: 540439 - DNA, 20 bp, Artificial Sequence
  chemically synthesized
taccatggttattagtgatt

SEQ ID NO: 540440 - DNA, 20 bp, Artificial Sequence
  chemically synthesized
agatgaggaacaaaagggag

SEQ ID NO: 540441 - DNA, 20 bp, Artificial Sequence
  chemically synthesized
tctcagatgaggaacaaaag

SEQ ID NO: 540442 - DNA, 20 bp, Artificial Sequence
  chemically synthesized
ctcaaatgtgaaatgtccag

SEQ ID NO: 540443 - DNA, 20 bp, Artificial Sequence
  chemically synthesized
ctctctggacatttcacatt

SEQ ID NO: 540444 - DNA, 20 bp, Artificial Sequence
  chemically synthesized
agggagtgtatttttcttca

SEQ ID NO: 540445 - DNA, 20 bp, Artificial Sequence
  chemically synthesized
gtttaacgtcatattctatt

SEQ ID NO: 540446 - DNA, 20 bp, Artificial Sequence
  chemically synthesized
atatttatatatgttgctgt

SEQ ID NO: 540447 - DNA, 20 bp, Artificial Sequence
  chemically synthesized
cactaacattgcaaaagata

SEQ ID NO: 540448 - DNA, 20 bp, Artificial Sequence
  chemically synthesized
aaaacagcagtttattcatg

SEQ ID NO: 540449 - DNA, 20 bp, Artificial Sequence
  chemically synthesized
gaaaatgtttgtagttgcca

SEQ ID NO: 540450 - DNA, 20 bp, Artificial Sequence
  chemically synthesized
gttttaaaacatgggctatg

SEQ ID NO: 540451 - DNA, 20 bp, Artificial Sequence
  chemically synthesized
ccttcagtgaaaataggaaa

SEQ ID NO: 540452 - DNA, 20 bp, Artificial Sequence
  chemically synthesized
actcatttcctagctaacaa

SEQ ID NO: 540453 - DNA, 20 bp, Artificial Sequence
  chemically synthesized
caagagcccttatgctttga

SEQ ID NO: 540454 - DNA, 20 bp, Artificial Sequence
  chemically synthesized
cgtctctaaacatccacact

SEQ ID NO: 540455 - DNA, 20 bp, Artificial Sequence
  chemically synthesized
ttatatttccattttagaga

SEQ ID NO: 540456 - DNA, 20 bp, Artificial Sequence
  chemically synthesized
aagagaaatcagagacatga

SEQ ID NO: 540457 - DNA, 20 bp, Artificial Sequence
  chemically synthesized
ggtcctttagcttaatagtt

SEQ ID NO: 540458 - DNA, 20 bp, Artificial Sequence
  chemically synthesized
taagtggttaaatgctggac

SEQ ID NO: 540459 - DNA, 20 bp, Artificial Sequence
  chemically synthesized
catgaggctctaatagaagt

SEQ ID NO: 540460 - DNA, 20 bp, Artificial Sequence
  chemically synthesized
aaatatcccatttttttacc

SEQ ID NO: 540461 - DNA, 20 bp, Artificial Sequence
  chemically synthesized
tatactgactgccaatagca

SEQ ID NO: 540462 - DNA, 20 bp, Artificial Sequence
  chemically synthesized
tatttttttcactttaaaga

SEQ ID NO: 540463 - DNA, 20 bp, Artificial Sequence
  chemically synthesized
tcatatgtacaattttcagt

SEQ ID NO: 540464 - DNA, 20 bp, Artificial Sequence
  chemically synthesized
tgattgactaataatgaata

SEQ ID NO: 540465 - DNA, 20 bp, Artificial Sequence
  chemically synthesized
aatcaacaaaggccaagata

SEQ ID NO: 540466 - DNA, 20 bp, Artificial Sequence
  chemically synthesized
acccattttacgataattac

SEQ ID NO: 540467 - DNA, 20 bp, Artificial Sequence
  chemically synthesized
ttggacataaaataaccagg

SEQ ID NO: 540468 - DNA, 20 bp, Artificial Sequence
  chemically synthesized
tcattcacagctcttttctg

SEQ ID NO: 540469 - DNA, 20 bp, Artificial Sequence
  chemically synthesized
atgtccaaggaaaaattctt

SEQ ID NO: 540470 - DNA, 20 bp, Artificial Sequence
  chemically synthesized
aagaatttttccttggacat

SEQ ID NO: 540471 - DNA, 20 bp, Artificial Sequence
  chemically synthesized
ttctcaatctatagatgaga

SEQ ID NO: 540472 - DNA, 20 bp, Artificial Sequence
  chemically synthesized
ttcttatctcatctatagat

SEQ ID NO: 540473 - DNA, 20 bp, Artificial Sequence
  chemically synthesized
ctactcgggaggctaaggca

SEQ ID NO: 540474 - DNA, 20 bp, Artificial Sequence
  chemically synthesized
tttcaactaaaccacactgt

SEQ ID NO: 540475 - DNA, 20 bp, Artificial Sequence
  chemically synthesized
tatcataatttaaaattttc

SEQ ID NO: 540476 - DNA, 20 bp, Artificial Sequence
  chemically synthesized
agaggaaattttggagattt

SEQ ID NO: 540477 - DNA, 20 bp, Artificial Sequence
  chemically synthesized
gaactgatcaagactcagat

SEQ ID NO: 540478 - DNA, 20 bp, Artificial Sequence
  chemically synthesized
tcttgatcagttcatgtatg

SEQ ID NO: 540479 - DNA, 20 bp, Artificial Sequence
  chemically synthesized
gctaaggaaagaacttcaca

SEQ ID NO: 540480 - DNA, 20 bp, Artificial Sequence
  chemically synthesized
ttggaaacaatttgatcttt

SEQ ID NO: 540481 - DNA, 20 bp, Artificial Sequence
  chemically synthesized
ctgtgttccagaacgaggtt

SEQ ID NO: 540482 - DNA, 20 bp, Artificial Sequence
  chemically synthesized
ttaaacaacacacttaatga

SEQ ID NO: 540483 - DNA, 20 bp, Artificial Sequence
  chemically synthesized
ataaatcaatttaaattaac

SEQ ID NO: 540484 - DNA, 20 bp, Artificial Sequence
  chemically synthesized
cagatgataaaattagtaga

SEQ ID NO: 540485 - DNA, 20 bp, Artificial Sequence
  chemically synthesized
gaatacagatataataactg

SEQ ID NO: 540486 - DNA, 20 bp, Artificial Sequence
  chemically synthesized
atatctgtattccatatagt

SEQ ID NO: 540487 - DNA, 20 bp, Artificial Sequence
  chemically synthesized
acatgttgagtagacacatg

SEQ ID NO: 540488 - DNA, 20 bp, Artificial Sequence
  chemically synthesized
gattatataaaacaaattac

SEQ ID NO: 540489 - DNA, 20 bp, Artificial Sequence
  chemically synthesized
catttaacatttcatcaaat

SEQ ID NO: 540490 - DNA, 20 bp, Artificial Sequence
  chemically synthesized
agcttaactgacttcaagaa

SEQ ID NO: 540491 - DNA, 20 bp, Artificial Sequence
  chemically synthesized
acttcaagaacaagaaacat

SEQ ID NO: 540492 - DNA, 20 bp, Artificial Sequence
  chemically synthesized
tccattttacaatggctttc

SEQ ID NO: 540493 - DNA, 20 bp, Artificial Sequence
  chemically synthesized
gaacaactatcctccaaaga

SEQ ID NO: 540494 - DNA, 20 bp, Artificial Sequence
  chemically synthesized
tgtgaaaaaaatcaagtaac

SEQ ID NO: 540495 - DNA, 20 bp, Artificial Sequence
  chemically synthesized
taaaatgttttggggtagat

SEQ ID NO: 540496 - DNA, 20 bp, Artificial Sequence
  chemically synthesized
aatatgtttctgcctctcag

SEQ ID NO: 540497 - DNA, 20 bp, Artificial Sequence
  chemically synthesized
atggggtttctgcctgagag

SEQ ID NO: 540498 - DNA, 20 bp, Artificial Sequence
  chemically synthesized
atatgataagctatttaaac

SEQ ID NO: 540499 - DNA, 20 bp, Artificial Sequence
  chemically synthesized
atttactatggaaacatatt

SEQ ID NO: 540500 - DNA, 20 bp, Artificial Sequence
  chemically synthesized
attgtagccaatttttaatg

SEQ ID NO: 540501 - DNA, 20 bp, Artificial Sequence
  chemically synthesized
taaattacatagtttaggca

SEQ ID NO: 540502 - DNA, 20 bp, Artificial Sequence
  chemically synthesized
tttcagaaggcattttgtca

SEQ ID NO: 540503 - DNA, 20 bp, Artificial Sequence
  chemically synthesized
gcattttgtcaatagaatat

SEQ ID NO: 540504 - DNA, 20 bp, Artificial Sequence
  chemically synthesized
acttagctaaaatgaagttg

SEQ ID NO: 540505 - DNA, 20 bp, Artificial Sequence
  chemically synthesized
tgtcatcattatattactag

SEQ ID NO: 540506 - DNA, 20 bp, Artificial Sequence
  chemically synthesized
ttgttgtcatcattatatta

SEQ ID NO: 540507 - DNA, 20 bp, Artificial Sequence
  chemically synthesized
ctcagaaagacacaaattcc

SEQ ID NO: 540508 - DNA, 20 bp, Artificial Sequence
  chemically synthesized
ctcaggaatttgtgtctttc

SEQ ID NO: 540509 - DNA, 20 bp, Artificial Sequence
  chemically synthesized
aacagaagctgaacagtttc

SEQ ID NO: 540510 - DNA, 20 bp, Artificial Sequence
  chemically synthesized
aggcgatttgacagatctgt

SEQ ID NO: 540511 - DNA, 20 bp, Artificial Sequence
  chemically synthesized
gcaggtaaaagcatatggat

SEQ ID NO: 540512 - DNA, 20 bp, Artificial Sequence
  chemically synthesized
atgaatatatttattgatta

SEQ ID NO: 540513 - DNA, 20 bp, Artificial Sequence
  chemically synthesized
taaaaaaatatatttttagg

SEQ ID NO: 540514 - DNA, 20 bp, Artificial Sequence
  chemically synthesized
aaaaatatatttttttaatt

SEQ ID NO: 540515 - DNA, 20 bp, Artificial Sequence
  chemically synthesized
gttaagatatttgtaaattt

SEQ ID NO: 540516 - DNA, 20 bp, Artificial Sequence
  chemically synthesized
caagaataatattgaaagtg

SEQ ID NO: 540517 - DNA, 20 bp, Artificial Sequence
  chemically synthesized
atgaacaggcagttttggat

SEQ ID NO: 540518 - DNA, 20 bp, Artificial Sequence
  chemically synthesized
gtatatttcaaaatagtgaa

SEQ ID NO: 540519 - DNA, 20 bp, Artificial Sequence
  chemically synthesized
attttaaattttctcaccac

SEQ ID NO: 540520 - DNA, 20 bp, Artificial Sequence
  chemically synthesized
catttataatttctctgtgg

SEQ ID NO: 540521 - DNA, 20 bp, Artificial Sequence
  chemically synthesized
gtttgaggctatggatctgc

SEQ ID NO: 540522 - DNA, 20 bp, Artificial Sequence
  chemically synthesized
tcatcttattttaaatattg

SEQ ID NO: 540523 - DNA, 20 bp, Artificial Sequence
  chemically synthesized
tgtgttaatactacacatgg

SEQ ID NO: 540524 - DNA, 20 bp, Artificial Sequence
  chemically synthesized
cagtcataaaagagactgag

SEQ ID NO: 540525 - DNA, 20 bp, Artificial Sequence
  chemically synthesized
ttacctaagacagttgcaca

SEQ ID NO: 540526 - DNA, 20 bp, Artificial Sequence
  chemically synthesized
acagcgtcagtgtccaacct

SEQ ID NO: 540527 - DNA, 20 bp, Artificial Sequence
  chemically synthesized
ttgcttcttaagaatagagt

SEQ ID NO: 540528 - DNA, 20 bp, Artificial Sequence
  chemically synthesized
aagtatgatccattgcttct

SEQ ID NO: 540529 - DNA, 20 bp, Artificial Sequence
  chemically synthesized
tgcctactgatgtcctgggc

SEQ ID NO: 540530 - DNA, 20 bp, Artificial Sequence
  chemically synthesized
tattattcccattttccatt

SEQ ID NO: 540531 - DNA, 20 bp, Artificial Sequence
  chemically synthesized
acaagagagcatgtgcactg

SEQ ID NO: 540532 - DNA, 20 bp, Artificial Sequence
  chemically synthesized
atttttcactaactacagtt

SEQ ID NO: 540533 - DNA, 20 bp, Artificial Sequence
  chemically synthesized
taactgtagttagtgaaaaa

SEQ ID NO: 540534 - DNA, 20 bp, Artificial Sequence
  chemically synthesized
tatattgtatctgaataact

SEQ ID NO: 540535 - DNA, 20 bp, Artificial Sequence
  chemically synthesized
gtcaaagagttgcttttgaa

SEQ ID NO: 540536 - DNA, 20 bp, Artificial Sequence
  chemically synthesized
aaaaatatagaaaaattata

SEQ ID NO: 540537 - DNA, 20 bp, Artificial Sequence
  chemically synthesized
ttgtagacaaattgaaaaat

SEQ ID NO: 540538 - DNA, 20 bp, Artificial Sequence
  chemically synthesized
tgtgcttttcatattgagag

SEQ ID NO: 540539 - DNA, 20 bp, Artificial Sequence
  chemically synthesized
ctcctcctgctaccacagtc

SEQ ID NO: 540540 - DNA, 20 bp, Artificial Sequence
  chemically synthesized
ggcatttatagcagtatgtc

SEQ ID NO: 540541 - DNA, 20 bp, Artificial Sequence
  chemically synthesized
ggtgtacaggatcctgaaat

SEQ ID NO: 540542 - DNA, 20 bp, Artificial Sequence
  chemically synthesized
ttaccaatatgatgagtgat

SEQ ID NO: 540543 - DNA, 20 bp, Artificial Sequence
  chemically synthesized
tagataacttgtaaaaagga

SEQ ID NO: 540544 - DNA, 20 bp, Artificial Sequence
  chemically synthesized
atgtaaaggaaagataactt

SEQ ID NO: 540545 - DNA, 20 bp, Artificial Sequence
  chemically synthesized
tcctttacattctcccaaga

SEQ ID NO: 540546 - DNA, 20 bp, Artificial Sequence
  chemically synthesized
cttacggttttcttctcttg

SEQ ID NO: 540547 - DNA, 20 bp, Artificial Sequence
  chemically synthesized
aagacagtagcaggggtcgg

SEQ ID NO: 540548 - DNA, 20 bp, Artificial Sequence
  chemically synthesized
aaaaagggaagaagggcatt

SEQ ID NO: 540549 - DNA, 20 bp, Artificial Sequence
  chemically synthesized
ttggattatacgaggagacg

SEQ ID NO: 540550 - DNA, 20 bp, Artificial Sequence
  chemically synthesized
aactattcaaacaaaatatt

SEQ ID NO: 540551 - DNA, 20 bp, Artificial Sequence
  chemically synthesized
gtaattttacgtagtaaatt

SEQ ID NO: 540552 - DNA, 20 bp, Artificial Sequence
  chemically synthesized
gtaaatctaactttgtaaaa

SEQ ID NO: 540553 - DNA, 20 bp, Artificial Sequence
  chemically synthesized
aatgaagcaaatggtaacaa

SEQ ID NO: 540554 - DNA, 20 bp, Artificial Sequence
  chemically synthesized
aagaaaaaaaactttttttc

SEQ ID NO: 540555 - DNA, 20 bp, Artificial Sequence
  chemically synthesized
gttttttttcttggcagtaa

SEQ ID NO: 540556 - DNA, 20 bp, Artificial Sequence
  chemically synthesized
tccatatttcttcttactgc

SEQ ID NO: 540557 - DNA, 20 bp, Artificial Sequence
  chemically synthesized
ggataataaatcaagtgatt

SEQ ID NO: 540558 - DNA, 20 bp, Artificial Sequence
  chemically synthesized
aataccggttgcacggtgaa

SEQ ID NO: 540559 - DNA, 20 bp, Artificial Sequence
  chemically synthesized
gactaacttgatttagaaca

SEQ ID NO: 540560 - DNA, 20 bp, Artificial Sequence
  chemically synthesized
ccctaaatgtaatttatgct

SEQ ID NO: 540561 - DNA, 20 bp, Artificial Sequence
  chemically synthesized
ataaaataaaagatgtaaaa

SEQ ID NO: 540562 - DNA, 20 bp, Artificial Sequence
  chemically synthesized
acacaaaggcagacagagtg

SEQ ID NO: 540563 - DNA, 20 bp, Artificial Sequence
  chemically synthesized
ccattcctgaattacttcac

SEQ ID NO: 540564 - DNA, 20 bp, Artificial Sequence
  chemically synthesized
ccatgcaatactactcagcc

SEQ ID NO: 540565 - DNA, 20 bp, Artificial Sequence
  chemically synthesized
cagccgaccaatgagtggat

SEQ ID NO: 540566 - DNA, 20 bp, Artificial Sequence
  chemically synthesized
ccgattatgtacctagagga

SEQ ID NO: 540567 - DNA, 20 bp, Artificial Sequence
  chemically synthesized
tagatctacttttagttctt

SEQ ID NO: 540568 - DNA, 20 bp, Artificial Sequence
  chemically synthesized
tttgatgtaggcatttggtg

SEQ ID NO: 540569 - DNA, 20 bp, Artificial Sequence
  chemically synthesized
acatcacacctgaaggaact

SEQ ID NO: 540570 - DNA, 20 bp, Artificial Sequence
  chemically synthesized
aaagccaacacaaagctcca

SEQ ID NO: 540571 - DNA, 20 bp, Artificial Sequence
  chemically synthesized
caacacaaagctccagaaga

SEQ ID NO: 540572 - DNA, 20 bp, Artificial Sequence
  chemically synthesized
tcaattttacttatcttttc

SEQ ID NO: 540573 - DNA, 20 bp, Artificial Sequence
  chemically synthesized
agaccagtagttagattaac

SEQ ID NO: 540574 - DNA, 20 bp, Artificial Sequence
  chemically synthesized
aacactgccagatgctgttt

SEQ ID NO: 540575 - DNA, 20 bp, Artificial Sequence
  chemically synthesized
atgcaaataaaatgaccaac

SEQ ID NO: 540576 - DNA, 20 bp, Artificial Sequence
  chemically synthesized
ggaatagacccacccataaa

SEQ ID NO: 540577 - DNA, 20 bp, Artificial Sequence
  chemically synthesized
ataaattagaaattccttct

SEQ ID NO: 540578 - DNA, 20 bp, Artificial Sequence
  chemically synthesized
atctgaatcattatttcagc

SEQ ID NO: 540579 - DNA, 20 bp, Artificial Sequence
  chemically synthesized
atggtgaccatcacccagac

SEQ ID NO: 540580 - DNA, 20 bp, Artificial Sequence
  chemically synthesized
agactaagacaatcatacag

SEQ ID NO: 540581 - DNA, 20 bp, Artificial Sequence
  chemically synthesized
cacttctatatatacactct

SEQ ID NO: 540582 - DNA, 20 bp, Artificial Sequence
  chemically synthesized
gtggtgagaatatacagcaa

SEQ ID NO: 540583 - DNA, 20 bp, Artificial Sequence
  chemically synthesized
ctgacaattccatgtggtgg

SEQ ID NO: 540584 - DNA, 20 bp, Artificial Sequence
  chemically synthesized
gaaatatcactgcttaccaa

SEQ ID NO: 540585 - DNA, 20 bp, Artificial Sequence
  chemically synthesized
gcctggaccattaatgggac

SEQ ID NO: 540586 - DNA, 20 bp, Artificial Sequence
  chemically synthesized
caaacggccaataaatatat

SEQ ID NO: 540587 - DNA, 20 bp, Artificial Sequence
  chemically synthesized
tttttgtcatctttacaaaa

SEQ ID NO: 540588 - DNA, 20 bp, Artificial Sequence
  chemically synthesized
aatgccatccaggtcaagat

SEQ ID NO: 540589 - DNA, 20 bp, Artificial Sequence
  chemically synthesized
agaaaagaacagataatcca

SEQ ID NO: 540590 - DNA, 20 bp, Artificial Sequence
  chemically synthesized
aaagaattcctacaaatctt

SEQ ID NO: 540591 - DNA, 20 bp, Artificial Sequence
  chemically synthesized
atgtgtgtattcataattat

SEQ ID NO: 540592 - DNA, 20 bp, Artificial Sequence
  chemically synthesized
atatgttaattaatataggg

SEQ ID NO: 540593 - DNA, 20 bp, Artificial Sequence
  chemically synthesized
agcttttacagtaaaataga

SEQ ID NO: 540594 - DNA, 20 bp, Artificial Sequence
  chemically synthesized
caggtgactaaaaactgaca

SEQ ID NO: 540595 - DNA, 20 bp, Artificial Sequence
  chemically synthesized
atttttgtatatagtttgaa

SEQ ID NO: 540596 - DNA, 20 bp, Artificial Sequence
  chemically synthesized
tacaagataatgcatgaaca

SEQ ID NO: 540597 - DNA, 20 bp, Artificial Sequence
  chemically synthesized
aaatatttatagaacaaggc

SEQ ID NO: 540598 - DNA, 20 bp, Artificial Sequence
  chemically synthesized
ctcaagtattataaacactg

SEQ ID NO: 540599 - DNA, 20 bp, Artificial Sequence
  chemically synthesized
gaagagaggggataaaggca

SEQ ID NO: 540600 - DNA, 20 bp, Artificial Sequence
  chemically synthesized
agaaataagggaaaaaatgt

SEQ ID NO: 540601 - DNA, 20 bp, Artificial Sequence
  chemically synthesized
gaatgcaataagtgaagtta

SEQ ID NO: 540602 - DNA, 20 bp, Artificial Sequence
  chemically synthesized
aatttatctttgctgtttat

SEQ ID NO: 540603 - DNA, 20 bp, Artificial Sequence
  chemically synthesized
tgatgttggtggtacaggtc

SEQ ID NO: 540604 - DNA, 20 bp, Artificial Sequence
  chemically synthesized
aacaagtttacctataaaaa

SEQ ID NO: 540605 - DNA, 20 bp, Artificial Sequence
  chemically synthesized
aagaggatggtattaaaccg

SEQ ID NO: 540606 - DNA, 20 bp, Artificial Sequence
  chemically synthesized
aaaagctccctgaggcctcc

SEQ ID NO: 540607 - DNA, 20 bp, Artificial Sequence
  chemically synthesized
ctatgcttcctgtagagcct

SEQ ID NO: 540608 - DNA, 20 bp, Artificial Sequence
  chemically synthesized
ggccattcttgcattgctat

SEQ ID NO: 540609 - DNA, 20 bp, Artificial Sequence
  chemically synthesized
ggtatttctttatagcaatg

SEQ ID NO: 540610 - DNA, 20 bp, Artificial Sequence
  chemically synthesized
tttagtcaatgatttccaag

SEQ ID NO: 540611 - DNA, 20 bp, Artificial Sequence
  chemically synthesized
aaatatagagacaagcatga

SEQ ID NO: 540612 - DNA, 20 bp, Artificial Sequence
  chemically synthesized
tatattttatcaattctaaa

SEQ ID NO: 540613 - DNA, 20 bp, Artificial Sequence
  chemically synthesized
attaaagagtcatttctggt

SEQ ID NO: 540614 - DNA, 20 bp, Artificial Sequence
  chemically synthesized
gaaaagttattaggagtttt

SEQ ID NO: 540615 - DNA, 20 bp, Artificial Sequence
  chemically synthesized
ggttgtctgttagagagcgc

SEQ ID NO: 540616 - DNA, 20 bp, Artificial Sequence
  chemically synthesized
atgtatactgtactgaaaac

SEQ ID NO: 540617 - DNA, 20 bp, Artificial Sequence
  chemically synthesized
tgtgggccttttgctgtatt

SEQ ID NO: 540618 - DNA, 20 bp, Artificial Sequence
  chemically synthesized
tccagtacactatgtacctc

SEQ ID NO: 540619 - DNA, 20 bp, Artificial Sequence
  chemically synthesized
cagttatctcacacataaac

SEQ ID NO: 540620 - DNA, 20 bp, Artificial Sequence
  chemically synthesized
tataaatttttaataccgac

SEQ ID NO: 540621 - DNA, 20 bp, Artificial Sequence
  chemically synthesized
ttttaataccgacacagaat

SEQ ID NO: 540622 - DNA, 20 bp, Artificial Sequence
  chemically synthesized
aataaaaaaatcaatctaca

SEQ ID NO: 540623 - DNA, 20 bp, Artificial Sequence
  chemically synthesized
cttgctaaattatttatctt

SEQ ID NO: 540624 - DNA, 20 bp, Artificial Sequence
  chemically synthesized
caagttcaacaccatcctaa

SEQ ID NO: 540625 - DNA, 20 bp, Artificial Sequence
  chemically synthesized
ttaaaaacagatgattggat

SEQ ID NO: 540626 - DNA, 20 bp, Artificial Sequence
  chemically synthesized
cattcacacacatataaata

SEQ ID NO: 540627 - DNA, 20 bp, Artificial Sequence
  chemically synthesized
aaatactacaaagccatagt

SEQ ID NO: 540628 - DNA, 20 bp, Artificial Sequence
  chemically synthesized
ttaagtggaataactcaaaa

SEQ ID NO: 540629 - DNA, 20 bp, Artificial Sequence
  chemically synthesized
aggataggaaattgcttaat

SEQ ID NO: 540630 - DNA, 20 bp, Artificial Sequence
  chemically synthesized
aaacaacactttagaaatct

SEQ ID NO: 540631 - DNA, 20 bp, Artificial Sequence
  chemically synthesized
agcaaagtttaaacaacact

SEQ ID NO: 540632 - DNA, 20 bp, Artificial Sequence
  chemically synthesized
ctgtggaggaggacgctgta

SEQ ID NO: 540633 - DNA, 20 bp, Artificial Sequence
  chemically synthesized
tatataagtatacacacata

SEQ ID NO: 540634 - DNA, 20 bp, Artificial Sequence
  chemically synthesized
atcagataccaagcataggt

SEQ ID NO: 540635 - DNA, 20 bp, Artificial Sequence
  chemically synthesized
tttaactccttagtaataac

SEQ ID NO: 540636 - DNA, 20 bp, Artificial Sequence
  chemically synthesized
gatttataaaagagaagggc

SEQ ID NO: 540637 - DNA, 20 bp, Artificial Sequence
  chemically synthesized
ctgtaaaaatacccaaagta

SEQ ID NO: 540638 - DNA, 20 bp, Artificial Sequence
  chemically synthesized
ttttaataccaagacctttt

SEQ ID NO: 540639 - DNA, 20 bp, Artificial Sequence
  chemically synthesized
accttttggagaaatcagct

SEQ ID NO: 540640 - DNA, 20 bp, Artificial Sequence
  chemically synthesized
gtatgtcagtttaaacttat

SEQ ID NO: 540641 - DNA, 20 bp, Artificial Sequence
  chemically synthesized
tatgttttgtgtttgaatga

SEQ ID NO: 540642 - DNA, 20 bp, Artificial Sequence
  chemically synthesized
ataggtgtaggaacttttac

SEQ ID NO: 540643 - DNA, 20 bp, Artificial Sequence
  chemically synthesized
cattttattcattttgcaaa

SEQ ID NO: 540644 - DNA, 20 bp, Artificial Sequence
  chemically synthesized
ttattgtcttgcattcctga

SEQ ID NO: 540645 - DNA, 20 bp, Artificial Sequence
  chemically synthesized
caaatgacacttaaaaaaaa

SEQ ID NO: 540646 - DNA, 20 bp, Artificial Sequence
  chemically synthesized
acactgtattagcttgtgaa

SEQ ID NO: 540647 - DNA, 20 bp, Artificial Sequence
  chemically synthesized
ttgaaatataaatttcatga

SEQ ID NO: 540648 - DNA, 20 bp, Artificial Sequence
  chemically synthesized
ttattttgagcaaatgctgc

SEQ ID NO: 540649 - DNA, 20 bp, Artificial Sequence
  chemically synthesized
tgatatataatgagaagtgt

SEQ ID NO: 540650 - DNA, 20 bp, Artificial Sequence
  chemically synthesized
atggaatttctcttgatttt

SEQ ID NO: 540651 - DNA, 20 bp, Artificial Sequence
  chemically synthesized
aggatgtttctgaaaaatca

SEQ ID NO: 540652 - DNA, 20 bp, Artificial Sequence
  chemically synthesized
caatataagcaacgatactt

SEQ ID NO: 540653 - DNA, 20 bp, Artificial Sequence
  chemically synthesized
aggttctcatggaggaaggt

SEQ ID NO: 540654 - DNA, 20 bp, Artificial Sequence
  chemically synthesized
attacttctaattggtagta

SEQ ID NO: 540655 - DNA, 20 bp, Artificial Sequence
  chemically synthesized
aggtggttacaaaaaagaat

SEQ ID NO: 540656 - DNA, 20 bp, Artificial Sequence
  chemically synthesized
ttcattaaggtggttacaaa

SEQ ID NO: 540657 - DNA, 20 bp, Artificial Sequence
  chemically synthesized
ttcggacacttaaaatttcc

SEQ ID NO: 540658 - DNA, 20 bp, Artificial Sequence
  chemically synthesized
ctatgctgtataatagatct

SEQ ID NO: 540659 - DNA, 20 bp, Artificial Sequence
  chemically synthesized
cactccttttgtcctgcttt

SEQ ID NO: 540660 - DNA, 20 bp, Artificial Sequence
  chemically synthesized
tgacactaatgtaaattaga

SEQ ID NO: 540661 - DNA, 20 bp, Artificial Sequence
  chemically synthesized
acactaaatgctccctaagg

SEQ ID NO: 540662 - DNA, 20 bp, Artificial Sequence
  chemically synthesized
caaatgagtataccttctga

SEQ ID NO: 540663 - DNA, 20 bp, Artificial Sequence
  chemically synthesized
ctactcgggaagctgaggcg

SEQ ID NO: 540664 - DNA, 20 bp, Artificial Sequence
  chemically synthesized
aagcactgttaggcaataaa

SEQ ID NO: 540665 - DNA, 20 bp, Artificial Sequence
  chemically synthesized
tatatttcacagggttgtta

SEQ ID NO: 540666 - DNA, 20 bp, Artificial Sequence
  chemically synthesized
attgagcacttactatgggc

SEQ ID NO: 540667 - DNA, 20 bp, Artificial Sequence
  chemically synthesized
cagtatataatttctgttat

SEQ ID NO: 540668 - DNA, 20 bp, Artificial Sequence
  chemically synthesized
aacttaatattttctaaata

SEQ ID NO: 540669 - DNA, 20 bp, Artificial Sequence
  chemically synthesized
tttcatctcattttccttta

SEQ ID NO: 540670 - DNA, 20 bp, Artificial Sequence
  chemically synthesized
ttatcttcccaaaagtatgg

SEQ ID NO: 540671 - DNA, 20 bp, Artificial Sequence
  chemically synthesized
atgcggagtatgaataaaaa

SEQ ID NO: 540672 - DNA, 20 bp, Artificial Sequence
  chemically synthesized
atatcattttggctgcctaa

SEQ ID NO: 540673 - DNA, 20 bp, Artificial Sequence
  chemically synthesized
atttgccgcagcagcctatg

SEQ ID NO: 540674 - DNA, 20 bp, Artificial Sequence
  chemically synthesized
atctttaattttttatggcc

SEQ ID NO: 540675 - DNA, 20 bp, Artificial Sequence
  chemically synthesized
gagaaaatagaatttcccgt

SEQ ID NO: 540676 - DNA, 20 bp, Artificial Sequence
  chemically synthesized
gaatagtagtaagagagaaa

SEQ ID NO: 540677 - DNA, 20 bp, Artificial Sequence
  chemically synthesized
gaaagtagaatagtagtaag

SEQ ID NO: 540678 - DNA, 20 bp, Artificial Sequence
  chemically synthesized
agtgagagaaaatagagaaa

SEQ ID NO: 540679 - DNA, 20 bp, Artificial Sequence
  chemically synthesized
tggtgccagtgagagaaaat

SEQ ID NO: 540680 - DNA, 20 bp, Artificial Sequence
  chemically synthesized
ggaaggtaatggtgccagtg

SEQ ID NO: 540681 - DNA, 20 bp, Artificial Sequence
  chemically synthesized
aagtaaaacttagtaaacat

SEQ ID NO: 540682 - DNA, 20 bp, Artificial Sequence
  chemically synthesized
ttggaaaattattttataat

SEQ ID NO: 540683 - DNA, 20 bp, Artificial Sequence
  chemically synthesized
caattataaaataattttcc

SEQ ID NO: 540684 - DNA, 20 bp, Artificial Sequence
  chemically synthesized
tataaaataattttccaaag

SEQ ID NO: 540685 - DNA, 20 bp, Artificial Sequence
  chemically synthesized
agatgttccaagtggcatta

SEQ ID NO: 540686 - DNA, 20 bp, Artificial Sequence
  chemically synthesized
atgccagattagcatttcaa

SEQ ID NO: 540687 - DNA, 20 bp, Artificial Sequence
  chemically synthesized
atgccagattagcatttcaa

SEQ ID NO: 540688 - DNA, 20 bp, Artificial Sequence
  chemically synthesized
tataagaggtcataagtagt

SEQ ID NO: 540689 - DNA, 20 bp, Artificial Sequence
  chemically synthesized
ccttatgggtgcaactcccg

SEQ ID NO: 540690 - DNA, 20 bp, Artificial Sequence
  chemically synthesized
ttactgtatctctattttta

SEQ ID NO: 540691 - DNA, 20 bp, Artificial Sequence
  chemically synthesized
agttccaggatgacaccatg

SEQ ID NO: 540692 - DNA, 20 bp, Artificial Sequence
  chemically synthesized
aagtatagcagctctaagtc

SEQ ID NO: 540693 - DNA, 20 bp, Artificial Sequence
  chemically synthesized
tgcacctgtgttttaataag

SEQ ID NO: 540694 - DNA, 20 bp, Artificial Sequence
  chemically synthesized
catgtgccttccggtgtggg

SEQ ID NO: 540695 - DNA, 20 bp, Artificial Sequence
  chemically synthesized
gaaacacctaaaatgataga

SEQ ID NO: 540696 - DNA, 20 bp, Artificial Sequence
  chemically synthesized
tagatgaaacacctaaaatg

SEQ ID NO: 540697 - DNA, 20 bp, Artificial Sequence
  chemically synthesized
ggcaagtaaatatagctgcc

SEQ ID NO: 540698 - DNA, 20 bp, Artificial Sequence
  chemically synthesized
taaatatagctgccgtagaa

SEQ ID NO: 540699 - DNA, 20 bp, Artificial Sequence
  chemically synthesized
gaagcaacattttaaaaaat

SEQ ID NO: 540700 - DNA, 20 bp, Artificial Sequence
  chemically synthesized
aaagaataacatgaacatgg

SEQ ID NO: 540701 - DNA, 20 bp, Artificial Sequence
  chemically synthesized
atggaaagaaaaagaacctt

SEQ ID NO: 540702 - DNA, 20 bp, Artificial Sequence
  chemically synthesized
taaaatatccacaaagctca

SEQ ID NO: 540703 - DNA, 20 bp, Artificial Sequence
  chemically synthesized
tcagcatcagacctctgcaa

SEQ ID NO: 540704 - DNA, 20 bp, Artificial Sequence
  chemically synthesized
taaaaaaacttcttggaggg

SEQ ID NO: 540705 - DNA, 20 bp, Artificial Sequence
  chemically synthesized
taaataaataaataaaagaa

SEQ ID NO: 540706 - DNA, 20 bp, Artificial Sequence
  chemically synthesized
aataaataaataaataaata

SEQ ID NO: 540707 - DNA, 20 bp, Artificial Sequence
  chemically synthesized
ctactcaggaggctaaggca

SEQ ID NO: 540708 - DNA, 20 bp, Artificial Sequence
  chemically synthesized
gagaccagactgagcaacat

SEQ ID NO: 540709 - DNA, 20 bp, Artificial Sequence
  chemically synthesized
ttttggcacaaaatgaagcc

SEQ ID NO: 540710 - DNA, 20 bp, Artificial Sequence
  chemically synthesized
agtcccatgaccacgagaga

SEQ ID NO: 540711 - DNA, 20 bp, Artificial Sequence
  chemically synthesized
ccatgaccacgagagaccag

SEQ ID NO: 540712 - DNA, 20 bp, Artificial Sequence
  chemically synthesized
aagaagggggtggtgagaag

SEQ ID NO: 540713 - DNA, 20 bp, Artificial Sequence
  chemically synthesized
tttgggacatggccagggca

SEQ ID NO: 540714 - DNA, 20 bp, Artificial Sequence
  chemically synthesized
ctcaatatggatatcactga

SEQ ID NO: 540715 - DNA, 20 bp, Artificial Sequence
  chemically synthesized
gtaaataataacataataat

SEQ ID NO: 540716 - DNA, 20 bp, Artificial Sequence
  chemically synthesized
tctaggttgcatgctcctta

SEQ ID NO: 540717 - DNA, 20 bp, Artificial Sequence
  chemically synthesized
tgacaggaggtggagctcag

SEQ ID NO: 540718 - DNA, 20 bp, Artificial Sequence
  chemically synthesized
atttttcaacagttgtcatg

SEQ ID NO: 540719 - DNA, 20 bp, Artificial Sequence
  chemically synthesized
attgtcattgtattaaaaaa

SEQ ID NO: 540720 - DNA, 20 bp, Artificial Sequence
  chemically synthesized
cacataacagctatcaggat

SEQ ID NO: 540721 - DNA, 20 bp, Artificial Sequence
  chemically synthesized
agagaactaataaatgataa

SEQ ID NO: 540722 - DNA, 20 bp, Artificial Sequence
  chemically synthesized
gactgacaacttaccgttca

SEQ ID NO: 540723 - DNA, 20 bp, Artificial Sequence
  chemically synthesized
tgtaccaacttaaatttcta

SEQ ID NO: 540724 - DNA, 20 bp, Artificial Sequence
  chemically synthesized
ggtcacaaactctcattctt

SEQ ID NO: 540725 - DNA, 20 bp, Artificial Sequence
  chemically synthesized
ttacatgaatggcagaaggc

SEQ ID NO: 540726 - DNA, 20 bp, Artificial Sequence
  chemically synthesized
aaaggatttatgtcataatt

SEQ ID NO: 540727 - DNA, 20 bp, Artificial Sequence
  chemically synthesized
aatgcaaagacttcataaac

SEQ ID NO: 540728 - DNA, 20 bp, Artificial Sequence
  chemically synthesized
cagcacaaagcaaaaattgt

SEQ ID NO: 540729 - DNA, 20 bp, Artificial Sequence
  chemically synthesized
atttaaaattttattaaaca

SEQ ID NO: 540730 - DNA, 20 bp, Artificial Sequence
  chemically synthesized
tatattatactcttacacaa

SEQ ID NO: 540731 - DNA, 20 bp, Artificial Sequence
  chemically synthesized
tgctccaggaattttgttac

SEQ ID NO: 540732 - DNA, 20 bp, Artificial Sequence
  chemically synthesized
agaaacctgtacagattgga

SEQ ID NO: 540733 - DNA, 20 bp, Artificial Sequence
  chemically synthesized
cagctgtataacagttgtag

SEQ ID NO: 540734 - DNA, 20 bp, Artificial Sequence
  chemically synthesized
gaggaagatgcaaagtggtg

SEQ ID NO: 540735 - DNA, 20 bp, Artificial Sequence
  chemically synthesized
taatatttttaagagaggta

SEQ ID NO: 540736 - DNA, 20 bp, Artificial Sequence
  chemically synthesized
taaagcttcttattgttacg

SEQ ID NO: 540737 - DNA, 20 bp, Artificial Sequence
  chemically synthesized
cttattgttacggtagaatg

SEQ ID NO: 540738 - DNA, 20 bp, Artificial Sequence
  chemically synthesized
caattccaaaatattagtgg

SEQ ID NO: 540739 - DNA, 20 bp, Artificial Sequence
  chemically synthesized
agaaagaaaccaagaaagac

SEQ ID NO: 540740 - DNA, 20 bp, Artificial Sequence
  chemically synthesized
taccaagtgaagaaagaaac

SEQ ID NO: 540741 - DNA, 20 bp, Artificial Sequence
  chemically synthesized
atatactctaccaagtgaag

SEQ ID NO: 540742 - DNA, 20 bp, Artificial Sequence
  chemically synthesized
aaaaatatactctaccaagt

SEQ ID NO: 540743 - DNA, 20 bp, Artificial Sequence
  chemically synthesized
ctcccctaaaccttttttcc

SEQ ID NO: 540744 - DNA, 20 bp, Artificial Sequence
  chemically synthesized
tgataaactataaattgtgc

SEQ ID NO: 540745 - DNA, 20 bp, Artificial Sequence
  chemically synthesized
atttggcagtttctgaaggt

SEQ ID NO: 540746 - DNA, 20 bp, Artificial Sequence
  chemically synthesized
cactctcagattcttgacct

SEQ ID NO: 540747 - DNA, 20 bp, Artificial Sequence
  chemically synthesized
aggcctcctgcaaagagcca

SEQ ID NO: 540748 - DNA, 20 bp, Artificial Sequence
  chemically synthesized
ctatggagatgcacgtatgc

SEQ ID NO: 540749 - DNA, 20 bp, Artificial Sequence
  chemically synthesized
agagagagagagagagagag

SEQ ID NO: 540750 - DNA, 20 bp, Artificial Sequence
  chemically synthesized
gtcatttccaagtgtaggtt

SEQ ID NO: 540751 - DNA, 20 bp, Artificial Sequence
  chemically synthesized
ctcttgaatagaagagcatc

SEQ ID NO: 540752 - DNA, 20 bp, Artificial Sequence
  chemically synthesized
agcaatagccatggaaaata

SEQ ID NO: 540753 - DNA, 20 bp, Artificial Sequence
  chemically synthesized
agaagttcacagatcagaaa

SEQ ID NO: 540754 - DNA, 20 bp, Artificial Sequence
  chemically synthesized
gacaaagagaagttcacaga

SEQ ID NO: 540755 - DNA, 20 bp, Artificial Sequence
  chemically synthesized
acactcattttcttcagttc

SEQ ID NO: 540756 - DNA, 20 bp, Artificial Sequence
  chemically synthesized
acatcagttttcttagaact

SEQ ID NO: 540757 - DNA, 20 bp, Artificial Sequence
  chemically synthesized
cagaagagaggcaactgtgg

SEQ ID NO: 540758 - DNA, 20 bp, Artificial Sequence
  chemically synthesized
agtgtcaatagtgtttatgt

SEQ ID NO: 540759 - DNA, 20 bp, Artificial Sequence
  chemically synthesized
accatgcagccatccacaac

SEQ ID NO: 540760 - DNA, 20 bp, Artificial Sequence
  chemically synthesized
tctatttgtgaaacacttac

SEQ ID NO: 540761 - DNA, 20 bp, Artificial Sequence
  chemically synthesized
gcatggaaaatgggagagta

SEQ ID NO: 540762 - DNA, 20 bp, Artificial Sequence
  chemically synthesized
caaaagtagaagataaattt

SEQ ID NO: 540763 - DNA, 20 bp, Artificial Sequence
  chemically synthesized
aagtctattaaaaatgaaga

SEQ ID NO: 540764 - DNA, 20 bp, Artificial Sequence
  chemically synthesized
aacccataaatttatacaat

SEQ ID NO: 540765 - DNA, 20 bp, Artificial Sequence
  chemically synthesized
actatagaaggtggtatttc

SEQ ID NO: 540766 - DNA, 20 bp, Artificial Sequence
  chemically synthesized
gagactagtcactgtattca

SEQ ID NO: 540767 - DNA, 20 bp, Artificial Sequence
  chemically synthesized
gagagacaaggcatagacct

SEQ ID NO: 540768 - DNA, 20 bp, Artificial Sequence
  chemically synthesized
taaatgaaacagaaatctct

SEQ ID NO: 540769 - DNA, 20 bp, Artificial Sequence
  chemically synthesized
acaatagccacataaatgaa

SEQ ID NO: 540770 - DNA, 20 bp, Artificial Sequence
  chemically synthesized
aaccaacataaaaacaaaaa

SEQ ID NO: 540771 - DNA, 20 bp, Artificial Sequence
  chemically synthesized
acatgtctcaaagatggaag

SEQ ID NO: 540772 - DNA, 20 bp, Artificial Sequence
  chemically synthesized
ggtcataaggccaaagccat

SEQ ID NO: 540773 - DNA, 20 bp, Artificial Sequence
  chemically synthesized
aaggccaaagccatccagaa

SEQ ID NO: 540774 - DNA, 20 bp, Artificial Sequence
  chemically synthesized
cttcccagcctccagaacgg

SEQ ID NO: 540775 - DNA, 20 bp, Artificial Sequence
  chemically synthesized
gtattgcaggtaggctctca

SEQ ID NO: 540776 - DNA, 20 bp, Artificial Sequence
  chemically synthesized
tataatctactgcccagagg

SEQ ID NO: 540777 - DNA, 20 bp, Artificial Sequence
  chemically synthesized
caaaagttgtttcagcctca

SEQ ID NO: 540778 - DNA, 20 bp, Artificial Sequence
  chemically synthesized
ccaatttgtttttcaggatc

SEQ ID NO: 540779 - DNA, 20 bp, Artificial Sequence
  chemically synthesized
aacgtgaacatggacctcca

SEQ ID NO: 540780 - DNA, 20 bp, Artificial Sequence
  chemically synthesized
cttatgggcctatgtaggtg

SEQ ID NO: 540781 - DNA, 20 bp, Artificial Sequence
  chemically synthesized
ctgtggtgcttgcattcgtg

SEQ ID NO: 540782 - DNA, 20 bp, Artificial Sequence
  chemically synthesized
tatttacagaaatgtaaagc

SEQ ID NO: 540783 - DNA, 20 bp, Artificial Sequence
  chemically synthesized
gtatttacagaaatatattt

SEQ ID NO: 540784 - DNA, 20 bp, Artificial Sequence
  chemically synthesized
tcaaatcatgatgtgtattt

SEQ ID NO: 540785 - DNA, 20 bp, Artificial Sequence
  chemically synthesized
atatttacagaactgtattt

SEQ ID NO: 540786 - DNA, 20 bp, Artificial Sequence
  chemically synthesized
caaaatacagcaatgaaaaa

SEQ ID NO: 540787 - DNA, 20 bp, Artificial Sequence
  chemically synthesized
agatgaggataacacttgga

SEQ ID NO: 540788 - DNA, 20 bp, Artificial Sequence
  chemically synthesized
aaggaagtctattttatgtg

SEQ ID NO: 540789 - DNA, 20 bp, Artificial Sequence
  chemically synthesized
ttaggattcaggcctccatg

SEQ ID NO: 540790 - DNA, 20 bp, Artificial Sequence
  chemically synthesized
tcatgttggaaataaagcca

SEQ ID NO: 540791 - DNA, 20 bp, Artificial Sequence
  chemically synthesized
tttcaggtaataaagcatat

SEQ ID NO: 540792 - DNA, 20 bp, Artificial Sequence
  chemically synthesized
acttttgctacttttccaaa

SEQ ID NO: 540793 - DNA, 20 bp, Artificial Sequence
  chemically synthesized
tgataagagaatccaaccct

SEQ ID NO: 540794 - DNA, 20 bp, Artificial Sequence
  chemically synthesized
tgatattattattgatgata

SEQ ID NO: 540795 - DNA, 20 bp, Artificial Sequence
  chemically synthesized
tatgggtccgtgaaatgagg

SEQ ID NO: 540796 - DNA, 20 bp, Artificial Sequence
  chemically synthesized
tagtttttttgtggtactga

SEQ ID NO: 540797 - DNA, 20 bp, Artificial Sequence
  chemically synthesized
gtactgaaaagaaagcaagc

SEQ ID NO: 540798 - DNA, 20 bp, Artificial Sequence
  chemically synthesized
ggaagaaggaaggaaggaag

SEQ ID NO: 540799 - DNA, 20 bp, Artificial Sequence
  chemically synthesized
aaggaaggaaggaagaaaca

SEQ ID NO: 540800 - DNA, 20 bp, Artificial Sequence
  chemically synthesized
aaggaaaggaaagcagaagt

SEQ ID NO: 540801 - DNA, 20 bp, Artificial Sequence
  chemically synthesized
aaggaaagcagaagtaaaga

SEQ ID NO: 540802 - DNA, 20 bp, Artificial Sequence
  chemically synthesized
aaagcagaagtaaagaaaag

SEQ ID NO: 540803 - DNA, 20 bp, Artificial Sequence
  chemically synthesized
agtaaagaaaagaaagaaaa

SEQ ID NO: 540804 - DNA, 20 bp, Artificial Sequence
  chemically synthesized
tatgatcctagggctagggt

SEQ ID NO: 540805 - DNA, 20 bp, Artificial Sequence
  chemically synthesized
gttatttttattattacgct

SEQ ID NO: 540806 - DNA, 20 bp, Artificial Sequence
  chemically synthesized
gataatagtgaaatataata

SEQ ID NO: 540807 - DNA, 20 bp, Artificial Sequence
  chemically synthesized
ggaaatacttgttaaatttt

SEQ ID NO: 540808 - DNA, 20 bp, Artificial Sequence
  chemically synthesized
ttatataaactaatacctga

SEQ ID NO: 540809 - DNA, 20 bp, Artificial Sequence
  chemically synthesized
gcaagactccttattttcaa

SEQ ID NO: 540810 - DNA, 20 bp, Artificial Sequence
  chemically synthesized
aaaaaagttcgttcctcttg

SEQ ID NO: 540811 - DNA, 20 bp, Artificial Sequence
  chemically synthesized
attcccaccccacctatgag

SEQ ID NO: 540812 - DNA, 20 bp, Artificial Sequence
  chemically synthesized
ttgttcttgcgatagtttac

SEQ ID NO: 540813 - DNA, 20 bp, Artificial Sequence
  chemically synthesized
caccatggaatactatgcag

SEQ ID NO: 540814 - DNA, 20 bp, Artificial Sequence
  chemically synthesized
ccaacaatgatagactggat

SEQ ID NO: 540815 - DNA, 20 bp, Artificial Sequence
  chemically synthesized
gattcctcagggatctagaa

SEQ ID NO: 540816 - DNA, 20 bp, Artificial Sequence
  chemically synthesized
acaggtgctggagaggatgt

SEQ ID NO: 540817 - DNA, 20 bp, Artificial Sequence
  chemically synthesized
gagatatcatctcacaccag

SEQ ID NO: 540818 - DNA, 20 bp, Artificial Sequence
  chemically synthesized
aatgaactcaaacaaattta

SEQ ID NO: 540819 - DNA, 20 bp, Artificial Sequence
  chemically synthesized
atctgacaaagggctaatat

SEQ ID NO: 540820 - DNA, 20 bp, Artificial Sequence
  chemically synthesized
aacagggaacctacaacatg

SEQ ID NO: 540821 - DNA, 20 bp, Artificial Sequence
  chemically synthesized
taaagagcttctgcacagca

SEQ ID NO: 540822 - DNA, 20 bp, Artificial Sequence
  chemically synthesized
ctaaaaccataaaaacccta

SEQ ID NO: 540823 - DNA, 20 bp, Artificial Sequence
  chemically synthesized
ggaagactggctagccatat

SEQ ID NO: 540824 - DNA, 20 bp, Artificial Sequence
  chemically synthesized
aatggaacagaacagagccc

SEQ ID NO: 540825 - DNA, 20 bp, Artificial Sequence
  chemically synthesized
gtagttttttccaattctgt

SEQ ID NO: 540826 - DNA, 20 bp, Artificial Sequence
  chemically synthesized
agctaccaatgcctttcttc

SEQ ID NO: 540827 - DNA, 20 bp, Artificial Sequence
  chemically synthesized
cattccatgctcatgggtag

SEQ ID NO: 540828 - DNA, 20 bp, Artificial Sequence
  chemically synthesized
cccattcacaattgcttcaa

SEQ ID NO: 540829 - DNA, 20 bp, Artificial Sequence
  chemically synthesized
gtttgtctgttgttggtgta

SEQ ID NO: 540830 - DNA, 20 bp, Artificial Sequence
  chemically synthesized
tcaggatacaaaatcaatgt

SEQ ID NO: 540831 - DNA, 20 bp, Artificial Sequence
  chemically synthesized
cagacgacatgattgtttat

SEQ ID NO: 540832 - DNA, 20 bp, Artificial Sequence
  chemically synthesized
acatgattatctcaatagat

SEQ ID NO: 540833 - DNA, 20 bp, Artificial Sequence
  chemically synthesized
ggcagagacacaaccaaaaa

SEQ ID NO: 540834 - DNA, 20 bp, Artificial Sequence
  chemically synthesized
gtctctgcccggctttggta

SEQ ID NO: 540835 - DNA, 20 bp, Artificial Sequence
  chemically synthesized
ttctgaaactattccaatca

SEQ ID NO: 540836 - DNA, 20 bp, Artificial Sequence
  chemically synthesized
agttcctccttgtacctctg

SEQ ID NO: 540837 - DNA, 20 bp, Artificial Sequence
  chemically synthesized
caaataaactagaaaatcta

SEQ ID NO: 540838 - DNA, 20 bp, Artificial Sequence
  chemically synthesized
aacacctctacacaaataaa

SEQ ID NO: 540839 - DNA, 20 bp, Artificial Sequence
  chemically synthesized
cagaaatacaaactaccgtc

SEQ ID NO: 540840 - DNA, 20 bp, Artificial Sequence
  chemically synthesized
gtgatatcaccaccgatccc

SEQ ID NO: 540841 - DNA, 20 bp, Artificial Sequence
  chemically synthesized
tggaattgcatatgtagagc

SEQ ID NO: 540842 - DNA, 20 bp, Artificial Sequence
  chemically synthesized
caagtttgaaaacgattgtc

SEQ ID NO: 540843 - DNA, 20 bp, Artificial Sequence
  chemically synthesized
catgatgtaaaattttaaaa

SEQ ID NO: 540844 - DNA, 20 bp, Artificial Sequence
  chemically synthesized
gaaaatactttggcatgtat

SEQ ID NO: 540845 - DNA, 20 bp, Artificial Sequence
  chemically synthesized
taatagattgtgctatttaa

SEQ ID NO: 540846 - DNA, 20 bp, Artificial Sequence
  chemically synthesized
catatctggctcaatattta

SEQ ID NO: 540847 - DNA, 20 bp, Artificial Sequence
  chemically synthesized
cagataatggaaagtttagg

SEQ ID NO: 540848 - DNA, 20 bp, Artificial Sequence
  chemically synthesized
tccagataatggaaagttta

SEQ ID NO: 540849 - DNA, 20 bp, Artificial Sequence
  chemically synthesized
aattgagttctaaaaaatga

SEQ ID NO: 540850 - DNA, 20 bp, Artificial Sequence
  chemically synthesized
tgatttctgtatttatatat

SEQ ID NO: 540851 - DNA, 20 bp, Artificial Sequence
  chemically synthesized
tcctttctgtatatataaat

SEQ ID NO: 540852 - DNA, 20 bp, Artificial Sequence
  chemically synthesized
cagttttatatttctagccc

SEQ ID NO: 540853 - DNA, 20 bp, Artificial Sequence
  chemically synthesized
ccctactatgattctgaggg

SEQ ID NO: 540854 - DNA, 20 bp, Artificial Sequence
  chemically synthesized
tgtggatgtcaaggataaat

SEQ ID NO: 540855 - DNA, 20 bp, Artificial Sequence
  chemically synthesized
ttgatttgaaggttttatga

SEQ ID NO: 540856 - DNA, 20 bp, Artificial Sequence
  chemically synthesized
ctgaccacaatcacttatga

SEQ ID NO: 540857 - DNA, 20 bp, Artificial Sequence
  chemically synthesized
aaattaaacaatgatgctac

SEQ ID NO: 540858 - DNA, 20 bp, Artificial Sequence
  chemically synthesized
gatatgtaaacagctccaaa

SEQ ID NO: 540859 - DNA, 20 bp, Artificial Sequence
  chemically synthesized
atatcttttaatctctgaac

SEQ ID NO: 540860 - DNA, 20 bp, Artificial Sequence
  chemically synthesized
acacctcgacaagcaagcac

SEQ ID NO: 540861 - DNA, 20 bp, Artificial Sequence
  chemically synthesized
taattagtatcctaatagaa

SEQ ID NO: 540862 - DNA, 20 bp, Artificial Sequence
  chemically synthesized
gtgccataattagtatccta

SEQ ID NO: 540863 - DNA, 20 bp, Artificial Sequence
  chemically synthesized
actattccaaaaaaaaaaac

SEQ ID NO: 540864 - DNA, 20 bp, Artificial Sequence
  chemically synthesized
cactatgccaagttaattat

SEQ ID NO: 540865 - DNA, 20 bp, Artificial Sequence
  chemically synthesized
ataattacaaccttgttttt

SEQ ID NO: 540866 - DNA, 20 bp, Artificial Sequence
  chemically synthesized
tgtttaaaatcctgataatt

SEQ ID NO: 540867 - DNA, 20 bp, Artificial Sequence
  chemically synthesized
atcctgtcttggtccctata

SEQ ID NO: 540868 - DNA, 20 bp, Artificial Sequence
  chemically synthesized
tatatagggaccaagacagg

SEQ ID NO: 540869 - DNA, 20 bp, Artificial Sequence
  chemically synthesized
aagacaggatagaaaagtac

SEQ ID NO: 540870 - DNA, 20 bp, Artificial Sequence
  chemically synthesized
gaataaaactaatgtctaac

SEQ ID NO: 540871 - DNA, 20 bp, Artificial Sequence
  chemically synthesized
attagttttattccagccta

SEQ ID NO: 540872 - DNA, 20 bp, Artificial Sequence
  chemically synthesized
tggtagagcatgggaatgaa

SEQ ID NO: 540873 - DNA, 20 bp, Artificial Sequence
  chemically synthesized
ttcattcccatgctctacca

SEQ ID NO: 540874 - DNA, 20 bp, Artificial Sequence
  chemically synthesized
gagctactgttcataatttc

SEQ ID NO: 540875 - DNA, 20 bp, Artificial Sequence
  chemically synthesized
cagagtgctaatggcaaggg

SEQ ID NO: 540876 - DNA, 20 bp, Artificial Sequence
  chemically synthesized
tattatgcctattttactta

SEQ ID NO: 540877 - DNA, 20 bp, Artificial Sequence
  chemically synthesized
ttttgtgtcgaatattgaca

SEQ ID NO: 540878 - DNA, 20 bp, Artificial Sequence
  chemically synthesized
tgaaccaaggacaagaatag

SEQ ID NO: 540879 - DNA, 20 bp, Artificial Sequence
  chemically synthesized
tccttgaaccaaggacaaga

SEQ ID NO: 540880 - DNA, 20 bp, Artificial Sequence
  chemically synthesized
ttcgatccttgaaccaagga

SEQ ID NO: 540881 - DNA, 20 bp, Artificial Sequence
  chemically synthesized
tatgtacaaaatagttttaa

SEQ ID NO: 540882 - DNA, 20 bp, Artificial Sequence
  chemically synthesized
ttaaggtcttcatcttgttc

SEQ ID NO: 540883 - DNA, 20 bp, Artificial Sequence
  chemically synthesized
tatgtgtttattttctgata

SEQ ID NO: 540884 - DNA, 20 bp, Artificial Sequence
  chemically synthesized
aagtattattatttctgcta

SEQ ID NO: 540885 - DNA, 20 bp, Artificial Sequence
  chemically synthesized
taataatactttatagtttt

SEQ ID NO: 540886 - DNA, 20 bp, Artificial Sequence
  chemically synthesized
aatattatcactttgaagac

SEQ ID NO: 540887 - DNA, 20 bp, Artificial Sequence
  chemically synthesized
aataaagcttaatagaaaag

SEQ ID NO: 540888 - DNA, 20 bp, Artificial Sequence
  chemically synthesized
aactaggcaaataaagctta

SEQ ID NO: 540889 - DNA, 20 bp, Artificial Sequence
  chemically synthesized
ggataggaatacgataagca

SEQ ID NO: 540890 - DNA, 20 bp, Artificial Sequence
  chemically synthesized
ggggaggcagaactgtgtac

SEQ ID NO: 540891 - DNA, 20 bp, Artificial Sequence
  chemically synthesized
cacaaaaaccatcgaggtat

SEQ ID NO: 540892 - DNA, 20 bp, Artificial Sequence
  chemically synthesized
ctgttcctgtgttagtttgc

SEQ ID NO: 540893 - DNA, 20 bp, Artificial Sequence
  chemically synthesized
cttagcaaactaacacagga

SEQ ID NO: 540894 - DNA, 20 bp, Artificial Sequence
  chemically synthesized
ctagggtagggatagcatta

SEQ ID NO: 540895 - DNA, 20 bp, Artificial Sequence
  chemically synthesized
atctcaaattgaatataaat

SEQ ID NO: 540896 - DNA, 20 bp, Artificial Sequence
  chemically synthesized
agataatattgagctggaga

SEQ ID NO: 540897 - DNA, 20 bp, Artificial Sequence
  chemically synthesized
cctgaaaacagaatggccac

SEQ ID NO: 540898 - DNA, 20 bp, Artificial Sequence
  chemically synthesized
tttagggaacctccctgaaa

SEQ ID NO: 540899 - DNA, 20 bp, Artificial Sequence
  chemically synthesized
ccagtaatccaagatcagcc

SEQ ID NO: 540900 - DNA, 20 bp, Artificial Sequence
  chemically synthesized
ccaagatcagccttagaaac

SEQ ID NO: 540901 - DNA, 20 bp, Artificial Sequence
  chemically synthesized
taaataagtaaaacaaaatt

SEQ ID NO: 540902 - DNA, 20 bp, Artificial Sequence
  chemically synthesized
ccatacacaagggctttctt

SEQ ID NO: 540903 - DNA, 20 bp, Artificial Sequence
  chemically synthesized
ttggaatgttcgaaattcta

SEQ ID NO: 540904 - DNA, 20 bp, Artificial Sequence
  chemically synthesized
gactgcagcatttctttttg

SEQ ID NO: 540905 - DNA, 20 bp, Artificial Sequence
  chemically synthesized
gctatgagatattctaacaa

SEQ ID NO: 540906 - DNA, 20 bp, Artificial Sequence
  chemically synthesized
aaacattcagctccaaaaag

SEQ ID NO: 540907 - DNA, 20 bp, Artificial Sequence
  chemically synthesized
gatcctgtctcaaaaactct

SEQ ID NO: 540908 - DNA, 20 bp, Artificial Sequence
  chemically synthesized
gtagagtttttgagacagga

SEQ ID NO: 540909 - DNA, 20 bp, Artificial Sequence
  chemically synthesized
tatatgttgaataaatgaat

SEQ ID NO: 540910 - DNA, 20 bp, Artificial Sequence
  chemically synthesized
ctttaaccctatcgacacta

SEQ ID NO: 540911 - DNA, 20 bp, Artificial Sequence
  chemically synthesized
cctatgtagcttttcatcct

SEQ ID NO: 540912 - DNA, 20 bp, Artificial Sequence
  chemically synthesized
atggcagaacgatgtaaagt

SEQ ID NO: 540913 - DNA, 20 bp, Artificial Sequence
  chemically synthesized
ctacttgggaggctgaggca

SEQ ID NO: 540914 - DNA, 20 bp, Artificial Sequence
  chemically synthesized
gaacgatagtgatgcccaga

SEQ ID NO: 540915 - DNA, 20 bp, Artificial Sequence
  chemically synthesized
actctgtctcaaaaacaaac

SEQ ID NO: 540916 - DNA, 20 bp, Artificial Sequence
  chemically synthesized
ctacttgggaggctgaggca

SEQ ID NO: 540917 - DNA, 20 bp, Artificial Sequence
  chemically synthesized
cacttcttatataaaacaaa

SEQ ID NO: 540918 - DNA, 20 bp, Artificial Sequence
  chemically synthesized
catacacactgtgaacttct

SEQ ID NO: 540919 - DNA, 20 bp, Artificial Sequence
  chemically synthesized
gtcatagaggtgagagagat

SEQ ID NO: 540920 - DNA, 20 bp, Artificial Sequence
  chemically synthesized
cattggtatagagtttcagt

SEQ ID NO: 540921 - DNA, 20 bp, Artificial Sequence
  chemically synthesized
caaccatgcaactatttgtc

SEQ ID NO: 540922 - DNA, 20 bp, Artificial Sequence
  chemically synthesized
catccctattttaggatgtg

SEQ ID NO: 540923 - DNA, 20 bp, Artificial Sequence
  chemically synthesized
gaatttcattcctttttaaa

SEQ ID NO: 540924 - DNA, 20 bp, Artificial Sequence
  chemically synthesized
tgtgtacactgaccaagaat

SEQ ID NO: 540925 - DNA, 20 bp, Artificial Sequence
  chemically synthesized
tgtacactgtgtacactgac

SEQ ID NO: 540926 - DNA, 20 bp, Artificial Sequence
  chemically synthesized
tattttactgtagagaaaag

SEQ ID NO: 540927 - DNA, 20 bp, Artificial Sequence
  chemically synthesized
atagcagcatattttactgt

SEQ ID NO: 540928 - DNA, 20 bp, Artificial Sequence
  chemically synthesized
tatttactatcttgttcctt

SEQ ID NO: 540929 - DNA, 20 bp, Artificial Sequence
  chemically synthesized
aagacctttcatgttgggaa

SEQ ID NO: 540930 - DNA, 20 bp, Artificial Sequence
  chemically synthesized
ttgttttctcatatgtaggc

SEQ ID NO: 540931 - DNA, 20 bp, Artificial Sequence
  chemically synthesized
ttttattctcggcctacata

SEQ ID NO: 540932 - DNA, 20 bp, Artificial Sequence
  chemically synthesized
tttacttctttatatgctat

SEQ ID NO: 540933 - DNA, 20 bp, Artificial Sequence
  chemically synthesized
ccaccccatcttcaataaaa

SEQ ID NO: 540934 - DNA, 20 bp, Artificial Sequence
  chemically synthesized
gtcaatattagattaacgag

SEQ ID NO: 540935 - DNA, 20 bp, Artificial Sequence
  chemically synthesized
tgtattgggtgcatatatat

SEQ ID NO: 540936 - DNA, 20 bp, Artificial Sequence
  chemically synthesized
gactttaaaccaacaaagat

SEQ ID NO: 540937 - DNA, 20 bp, Artificial Sequence
  chemically synthesized
gtaaagaccatcgaccctat

SEQ ID NO: 540938 - DNA, 20 bp, Artificial Sequence
  chemically synthesized
aaaaccggtaccagccactg

SEQ ID NO: 540939 - DNA, 20 bp, Artificial Sequence
  chemically synthesized
aactaagtttcataagcaaa

SEQ ID NO: 540940 - DNA, 20 bp, Artificial Sequence
  chemically synthesized
tcaataagggaattttcaac

SEQ ID NO: 540941 - DNA, 20 bp, Artificial Sequence
  chemically synthesized
gactaacagtggatcactct

SEQ ID NO: 540942 - DNA, 20 bp, Artificial Sequence
  chemically synthesized
gtaatgttaggggcagccag

SEQ ID NO: 540943 - DNA, 20 bp, Artificial Sequence
  chemically synthesized
cgagcaacttcagccaagtc

SEQ ID NO: 540944 - DNA, 20 bp, Artificial Sequence
  chemically synthesized
tcacaagcattcctatacac

SEQ ID NO: 540945 - DNA, 20 bp, Artificial Sequence
  chemically synthesized
cctattcacaattgctacaa

SEQ ID NO: 540946 - DNA, 20 bp, Artificial Sequence
  chemically synthesized
gagaactacaaaccactgtt

SEQ ID NO: 540947 - DNA, 20 bp, Artificial Sequence
  chemically synthesized
catttcatgctcgtggttag

SEQ ID NO: 540948 - DNA, 20 bp, Artificial Sequence
  chemically synthesized
ggctaccactgactttcttt

SEQ ID NO: 540949 - DNA, 20 bp, Artificial Sequence
  chemically synthesized
gtaatttttcctaattctgt

SEQ ID NO: 540950 - DNA, 20 bp, Artificial Sequence
  chemically synthesized
ccaatggaacagaacagagg

SEQ ID NO: 540951 - DNA, 20 bp, Artificial Sequence
  chemically synthesized
ggaaaactggctagtcatat

SEQ ID NO: 540952 - DNA, 20 bp, Artificial Sequence
  chemically synthesized
cgaaaaccatcaaaacccta

SEQ ID NO: 540953 - DNA, 20 bp, Artificial Sequence
  chemically synthesized
taaagagcttctacactgca

SEQ ID NO: 540954 - DNA, 20 bp, Artificial Sequence
  chemically synthesized
aacaggcaaactacagattg

SEQ ID NO: 540955 - DNA, 20 bp, Artificial Sequence
  chemically synthesized
aaggaacttaaacaaattta

SEQ ID NO: 540956 - DNA, 20 bp, Artificial Sequence
  chemically synthesized
acaagaaaaaaaaaaaccca

SEQ ID NO: 540957 - DNA, 20 bp, Artificial Sequence
  chemically synthesized
gagataccatctcacaccag

SEQ ID NO: 540958 - DNA, 20 bp, Artificial Sequence
  chemically synthesized
acagatgctggagaggatgt

SEQ ID NO: 540959 - DNA, 20 bp, Artificial Sequence
  chemically synthesized
gattcctcaaggatacagaa

SEQ ID NO: 540960 - DNA, 20 bp, Artificial Sequence
  chemically synthesized
cgtgtgcatgtgtctttata

SEQ ID NO: 540961 - DNA, 20 bp, Artificial Sequence
  chemically synthesized
ccatcaatgatagactggat

SEQ ID NO: 540962 - DNA, 20 bp, Artificial Sequence
  chemically synthesized
gaatactatgcagccataaa

SEQ ID NO: 540963 - DNA, 20 bp, Artificial Sequence
  chemically synthesized
ctgttcctgtgttagtttgc

SEQ ID NO: 540964 - DNA, 20 bp, Artificial Sequence
  chemically synthesized
ctcagcaaactaacacagga

SEQ ID NO: 540965 - DNA, 20 bp, Artificial Sequence
  chemically synthesized
gttcaactcccacttatggg

SEQ ID NO: 540966 - DNA, 20 bp, Artificial Sequence
  chemically synthesized
ttaggggagggatagcatta

SEQ ID NO: 540967 - DNA, 20 bp, Artificial Sequence
  chemically synthesized
cataaaatagcacaacttaa

SEQ ID NO: 540968 - DNA, 20 bp, Artificial Sequence
  chemically synthesized
taaatagaaaaataaatgat

SEQ ID NO: 540969 - DNA, 20 bp, Artificial Sequence
  chemically synthesized
gagtccacaatttgtagtat

SEQ ID NO: 540970 - DNA, 20 bp, Artificial Sequence
  chemically synthesized
atcctctttcatcttatgga

SEQ ID NO: 540971 - DNA, 20 bp, Artificial Sequence
  chemically synthesized
atttaaatatctgttactta

SEQ ID NO: 540972 - DNA, 20 bp, Artificial Sequence
  chemically synthesized
gaatataagtaaacattgag

SEQ ID NO: 540973 - DNA, 20 bp, Artificial Sequence
  chemically synthesized
acattgagtaagaaatgttt

SEQ ID NO: 540974 - DNA, 20 bp, Artificial Sequence
  chemically synthesized
tcgttgcgatgaatacagtt

SEQ ID NO: 540975 - DNA, 20 bp, Artificial Sequence
  chemically synthesized
ataggagacagtaaaaataa

SEQ ID NO: 540976 - DNA, 20 bp, Artificial Sequence
  chemically synthesized
tccaatatcccttctgtggt

SEQ ID NO: 540977 - DNA, 20 bp, Artificial Sequence
  chemically synthesized
cacgaaacctcaagggaaca

SEQ ID NO: 540978 - DNA, 20 bp, Artificial Sequence
  chemically synthesized
aggtattgacaaaggagagc

SEQ ID NO: 540979 - DNA, 20 bp, Artificial Sequence
  chemically synthesized
ataggtccccctaagatcat

SEQ ID NO: 540980 - DNA, 20 bp, Artificial Sequence
  chemically synthesized
ctaatttatgccaattacat

SEQ ID NO: 540981 - DNA, 20 bp, Artificial Sequence
  chemically synthesized
ttacatttagaaatttgaat

SEQ ID NO: 540982 - DNA, 20 bp, Artificial Sequence
  chemically synthesized
tagaaatttgaatctagaat

SEQ ID NO: 540983 - DNA, 20 bp, Artificial Sequence
  chemically synthesized
gtatggaataagggtatttt

SEQ ID NO: 540984 - DNA, 20 bp, Artificial Sequence
  chemically synthesized
cctaggccagaggctaacat

SEQ ID NO: 540985 - DNA, 20 bp, Artificial Sequence
  chemically synthesized
ttagcctctggcctaggagg

SEQ ID NO: 540986 - DNA, 20 bp, Artificial Sequence
  chemically synthesized
acacataaaattgtaaagcc

SEQ ID NO: 540987 - DNA, 20 bp, Artificial Sequence
  chemically synthesized
atttcaaacgggtagcccca

SEQ ID NO: 540988 - DNA, 20 bp, Artificial Sequence
  chemically synthesized
ttgaaatcaaagctatcaac

SEQ ID NO: 540989 - DNA, 20 bp, Artificial Sequence
  chemically synthesized
tgtgaagcaggagtgctgct

SEQ ID NO: 540990 - DNA, 20 bp, Artificial Sequence
  chemically synthesized
cagaaaggttaactctttca

SEQ ID NO: 540991 - DNA, 20 bp, Artificial Sequence
  chemically synthesized
tgacttgcgattgatgtcca

SEQ ID NO: 540992 - DNA, 20 bp, Artificial Sequence
  chemically synthesized
catgaaaacataaaaagtgt

SEQ ID NO: 540993 - DNA, 20 bp, Artificial Sequence
  chemically synthesized
attaaagtgcagggaggtat

SEQ ID NO: 540994 - DNA, 20 bp, Artificial Sequence
  chemically synthesized
gttttaatctgaggacatta

SEQ ID NO: 540995 - DNA, 20 bp, Artificial Sequence
  chemically synthesized
agtgctattgcatttaagat

SEQ ID NO: 540996 - DNA, 20 bp, Artificial Sequence
  chemically synthesized
gtttcaatgaatggctggcc

SEQ ID NO: 540997 - DNA, 20 bp, Artificial Sequence
  chemically synthesized
agaaaatggttgcactcaag

SEQ ID NO: 540998 - DNA, 20 bp, Artificial Sequence
  chemically synthesized
gtattattacccaacccaca

SEQ ID NO: 540999 - DNA, 20 bp, Artificial Sequence
  chemically synthesized
ccactccacgaaaaaatttc

SEQ ID NO: 541000 - DNA, 20 bp, Artificial Sequence
  chemically synthesized
tggagtgggtaataaataga

SEQ ID NO: 541001 - DNA, 20 bp, Artificial Sequence
  chemically synthesized
aaatagagcagaatattagg

SEQ ID NO: 541002 - DNA, 20 bp, Artificial Sequence
  chemically synthesized
atttgatttaatacctgagt

SEQ ID NO: 541003 - DNA, 20 bp, Artificial Sequence
  chemically synthesized
ctccgtgtgattacacacat

SEQ ID NO: 541004 - DNA, 20 bp, Artificial Sequence
  chemically synthesized
tgtgagtgaaagaaggcaga

SEQ ID NO: 541005 - DNA, 20 bp, Artificial Sequence
  chemically synthesized
ttttatagaattttataaaa

SEQ ID NO: 541006 - DNA, 20 bp, Artificial Sequence
  chemically synthesized
tatagataagtttgcgtttt

SEQ ID NO: 541007 - DNA, 20 bp, Artificial Sequence
  chemically synthesized
gataacaatcccagcaactg

SEQ ID NO: 541008 - DNA, 20 bp, Artificial Sequence
  chemically synthesized
agatcatacctaagctcttc

SEQ ID NO: 541009 - DNA, 20 bp, Artificial Sequence
  chemically synthesized
aaagaagtgcctgtctgctg

SEQ ID NO: 541010 - DNA, 20 bp, Artificial Sequence
  chemically synthesized
ggtttcttagtgagtgcttt

SEQ ID NO: 541011 - DNA, 20 bp, Artificial Sequence
  chemically synthesized
tttttcttaaaagcactcac

SEQ ID NO: 541012 - DNA, 20 bp, Artificial Sequence
  chemically synthesized
tctgtcttagagtctatgtc

SEQ ID NO: 541013 - DNA, 20 bp, Artificial Sequence
  chemically synthesized
atatgttgagaagttaaaat

SEQ ID NO: 541014 - DNA, 20 bp, Artificial Sequence
  chemically synthesized
gagaagttaaaatgtagaaa

SEQ ID NO: 541015 - DNA, 20 bp, Artificial Sequence
  chemically synthesized
ctgaaatctagcagtaagtt

SEQ ID NO: 541016 - DNA, 20 bp, Artificial Sequence
  chemically synthesized
aatacaggatacaagtactt

SEQ ID NO: 541017 - DNA, 20 bp, Artificial Sequence
  chemically synthesized
gagatatggctgattgcata

SEQ ID NO: 541018 - DNA, 20 bp, Artificial Sequence
  chemically synthesized
tgaggacgctggcatgtttg

SEQ ID NO: 541019 - DNA, 20 bp, Artificial Sequence
  chemically synthesized
taataaatccattcagcatt

SEQ ID NO: 541020 - DNA, 20 bp, Artificial Sequence
  chemically synthesized
aataacatgaaaatatgcca

SEQ ID NO: 541021 - DNA, 20 bp, Artificial Sequence
  chemically synthesized
gctctctcttcatcctaaag

SEQ ID NO: 541022 - DNA, 20 bp, Artificial Sequence
  chemically synthesized
tgagggataaatgagggttg

SEQ ID NO: 541023 - DNA, 20 bp, Artificial Sequence
  chemically synthesized
ctgctctcagcaaaccaaaa

SEQ ID NO: 541024 - DNA, 20 bp, Artificial Sequence
  chemically synthesized
tgtctacaaatttcttcaat

SEQ ID NO: 541025 - DNA, 20 bp, Artificial Sequence
  chemically synthesized
atgaattgtttttctacatt

SEQ ID NO: 541026 - DNA, 20 bp, Artificial Sequence
  chemically synthesized
agagagtgggatactgctat

SEQ ID NO: 541027 - DNA, 20 bp, Artificial Sequence
  chemically synthesized
gggaaactctggaacttcct

SEQ ID NO: 541028 - DNA, 20 bp, Artificial Sequence
  chemically synthesized
gaggtggtctcagagggaga

SEQ ID NO: 541029 - DNA, 20 bp, Artificial Sequence
  chemically synthesized
aatcttgaacactttgctgt

SEQ ID NO: 541030 - DNA, 20 bp, Artificial Sequence
  chemically synthesized
gggaagcagagcataaaagt

SEQ ID NO: 541031 - DNA, 20 bp, Artificial Sequence
  chemically synthesized
atttgcagcctgaagatgca

SEQ ID NO: 541032 - DNA, 20 bp, Artificial Sequence
  chemically synthesized
cagcctgaagatgcaataga

SEQ ID NO: 541033 - DNA, 20 bp, Artificial Sequence
  chemically synthesized
aagaaaaactcattttctga

SEQ ID NO: 541034 - DNA, 20 bp, Artificial Sequence
  chemically synthesized
tagtcagattgaatttctcc

SEQ ID NO: 541035 - DNA, 20 bp, Artificial Sequence
  chemically synthesized
aggagaaattcaatctgact

SEQ ID NO: 541036 - DNA, 20 bp, Artificial Sequence
  chemically synthesized
ctctactaggtcagtgcaga

SEQ ID NO: 541037 - DNA, 20 bp, Artificial Sequence
  chemically synthesized
aaatacacccattccagatg

SEQ ID NO: 541038 - DNA, 20 bp, Artificial Sequence
  chemically synthesized
tgctggtacctccattgtac

SEQ ID NO: 541039 - DNA, 20 bp, Artificial Sequence
  chemically synthesized
gggattacaggaactacaat

SEQ ID NO: 541040 - DNA, 20 bp, Artificial Sequence
  chemically synthesized
acatccttcttcatatggtg

SEQ ID NO: 541041 - DNA, 20 bp, Artificial Sequence
  chemically synthesized
tttagcattaataagtaaac

SEQ ID NO: 541042 - DNA, 20 bp, Artificial Sequence
  chemically synthesized
acgccattgtcatattaata

SEQ ID NO: 541043 - DNA, 20 bp, Artificial Sequence
  chemically synthesized
tacagatttacacatcatgg

SEQ ID NO: 541044 - DNA, 20 bp, Artificial Sequence
  chemically synthesized
aaatgttatgaaaatcattt

SEQ ID NO: 541045 - DNA, 20 bp, Artificial Sequence
  chemically synthesized
attttcatatgttgtacatg

SEQ ID NO: 541046 - DNA, 20 bp, Artificial Sequence
  chemically synthesized
gtataatcaaaaataaaaag

SEQ ID NO: 541047 - DNA, 20 bp, Artificial Sequence
  chemically synthesized
gatcaccgcatagctaaagg

SEQ ID NO: 541048 - DNA, 20 bp, Artificial Sequence
  chemically synthesized
gaaaatccttcccttactga

SEQ ID NO: 541049 - DNA, 20 bp, Artificial Sequence
  chemically synthesized
gtagtttaaggttgaagaac

SEQ ID NO: 541050 - DNA, 20 bp, Artificial Sequence
  chemically synthesized
aagcttttgaaatgtataaa

SEQ ID NO: 541051 - DNA, 20 bp, Artificial Sequence
  chemically synthesized
agatctagcccaattagatg

SEQ ID NO: 541052 - DNA, 20 bp, Artificial Sequence
  chemically synthesized
ccaaaatattttcatgtggc

SEQ ID NO: 541053 - DNA, 20 bp, Artificial Sequence
  chemically synthesized
tagttcattttgcctcatga

SEQ ID NO: 541054 - DNA, 20 bp, Artificial Sequence
  chemically synthesized
catgaggcaaaatgaactaa

SEQ ID NO: 541055 - DNA, 20 bp, Artificial Sequence
  chemically synthesized
caagaataaattagttttca

SEQ ID NO: 541056 - DNA, 20 bp, Artificial Sequence
  chemically synthesized
tgaaatatccctagagaaag

SEQ ID NO: 541057 - DNA, 20 bp, Artificial Sequence
  chemically synthesized
acaattcttgaaatatccct

SEQ ID NO: 541058 - DNA, 20 bp, Artificial Sequence
  chemically synthesized
tgctttctctagggatattt

SEQ ID NO: 541059 - DNA, 20 bp, Artificial Sequence
  chemically synthesized
gactttatgcacagttttgg

SEQ ID NO: 541060 - DNA, 20 bp, Artificial Sequence
  chemically synthesized
cctccagcaattctgtgacc

SEQ ID NO: 541061 - DNA, 20 bp, Artificial Sequence
  chemically synthesized
agggttacttttctttggtc

SEQ ID NO: 541062 - DNA, 20 bp, Artificial Sequence
  chemically synthesized
gttttgttaaatcaatactt

SEQ ID NO: 541063 - DNA, 20 bp, Artificial Sequence
  chemically synthesized
tgtcttttactatcaccaat

SEQ ID NO: 541064 - DNA, 20 bp, Artificial Sequence
  chemically synthesized
ttcaagtattttatgtcgtt

SEQ ID NO: 541065 - DNA, 20 bp, Artificial Sequence
  chemically synthesized
taaacaagtaagtcaataag

SEQ ID NO: 541066 - DNA, 20 bp, Artificial Sequence
  chemically synthesized
agtaagtcaataaggaagaa

SEQ ID NO: 541067 - DNA, 20 bp, Artificial Sequence
  chemically synthesized
aagacacagccacacaagcc

SEQ ID NO: 541068 - DNA, 20 bp, Artificial Sequence
  chemically synthesized
gatccagaggaatgcaggag

SEQ ID NO: 541069 - DNA, 20 bp, Artificial Sequence
  chemically synthesized
gcctaaagtctatctttgac

SEQ ID NO: 541070 - DNA, 20 bp, Artificial Sequence
  chemically synthesized
gaactagggcttaattccct

SEQ ID NO: 541071 - DNA, 20 bp, Artificial Sequence
  chemically synthesized
ttggagttgtgagaaagtta

SEQ ID NO: 541072 - DNA, 20 bp, Artificial Sequence
  chemically synthesized
gtggtaggatgttggagttg

SEQ ID NO: 541073 - DNA, 20 bp, Artificial Sequence
  chemically synthesized
caacatcctaccacagcttc

SEQ ID NO: 541074 - DNA, 20 bp, Artificial Sequence
  chemically synthesized
gcttcctagaatcactgccc

SEQ ID NO: 541075 - DNA, 20 bp, Artificial Sequence
  chemically synthesized
aaactgagacactcataatg

SEQ ID NO: 541076 - DNA, 20 bp, Artificial Sequence
  chemically synthesized
aagaatttatattattaata

SEQ ID NO: 541077 - DNA, 20 bp, Artificial Sequence
  chemically synthesized
aggaaaagcacttaactgga

SEQ ID NO: 541078 - DNA, 20 bp, Artificial Sequence
  chemically synthesized
agtaccttattcatttttca

SEQ ID NO: 541079 - DNA, 20 bp, Artificial Sequence
  chemically synthesized
gatagccccctaccccaagg

SEQ ID NO: 541080 - DNA, 20 bp, Artificial Sequence
  chemically synthesized
gtttatttaaaaactttaga

SEQ ID NO: 541081 - DNA, 20 bp, Artificial Sequence
  chemically synthesized
aattcatgcctcctcagaag

SEQ ID NO: 541082 - DNA, 20 bp, Artificial Sequence
  chemically synthesized
ccttaattcatgcctcctca

SEQ ID NO: 541083 - DNA, 20 bp, Artificial Sequence
  chemically synthesized
aaatgtaaatctcttaatat

SEQ ID NO: 541084 - DNA, 20 bp, Artificial Sequence
  chemically synthesized
ctagttttaaaagtatttat

SEQ ID NO: 541085 - DNA, 20 bp, Artificial Sequence
  chemically synthesized
gtttcagcagcttgagatag

SEQ ID NO: 541086 - DNA, 20 bp, Artificial Sequence
  chemically synthesized
tacaactgaaagaaaaatct

SEQ ID NO: 541087 - DNA, 20 bp, Artificial Sequence
  chemically synthesized
gtagatttttctttcagttg

SEQ ID NO: 541088 - DNA, 20 bp, Artificial Sequence
  chemically synthesized
gcattattttcttacaactg

SEQ ID NO: 541089 - DNA, 20 bp, Artificial Sequence
  chemically synthesized
tttgaagatgttggcttgga

SEQ ID NO: 541090 - DNA, 20 bp, Artificial Sequence
  chemically synthesized
caagcagctgcatgacaaag

SEQ ID NO: 541091 - DNA, 20 bp, Artificial Sequence
  chemically synthesized
aattttattatttactgact

SEQ ID NO: 541092 - DNA, 20 bp, Artificial Sequence
  chemically synthesized
agttaatgccccctgtaaaa

SEQ ID NO: 541093 - DNA, 20 bp, Artificial Sequence
  chemically synthesized
ttggggtacttttattttac

SEQ ID NO: 541094 - DNA, 20 bp, Artificial Sequence
  chemically synthesized
aagtaccccaacacattgaa

SEQ ID NO: 541095 - DNA, 20 bp, Artificial Sequence
  chemically synthesized
accccaacacattgaattag

SEQ ID NO: 541096 - DNA, 20 bp, Artificial Sequence
  chemically synthesized
aaacttgtgaaaaaatggat

SEQ ID NO: 541097 - DNA, 20 bp, Artificial Sequence
  chemically synthesized
ataaaacacagacaactctg

SEQ ID NO: 541098 - DNA, 20 bp, Artificial Sequence
  chemically synthesized
aatactgtaataaaattcta

SEQ ID NO: 541099 - DNA, 20 bp, Artificial Sequence
  chemically synthesized
tgaaataccacaccattcta

SEQ ID NO: 541100 - DNA, 20 bp, Artificial Sequence
  chemically synthesized
catatccaaagatcagggat

SEQ ID NO: 541101 - DNA, 20 bp, Artificial Sequence
  chemically synthesized
taaagatctcagaagggtaa

SEQ ID NO: 541102 - DNA, 20 bp, Artificial Sequence
  chemically synthesized
ctgccattccagcttgagcc

SEQ ID NO: 541103 - DNA, 20 bp, Artificial Sequence
  chemically synthesized
tactttgagtaatctctgat

SEQ ID NO: 541104 - DNA, 20 bp, Artificial Sequence
  chemically synthesized
acattactgagagatagggg

SEQ ID NO: 541105 - DNA, 20 bp, Artificial Sequence
  chemically synthesized
ctattttatggaaggtaccc

SEQ ID NO: 541106 - DNA, 20 bp, Artificial Sequence
  chemically synthesized
ggaaggtacccaaagaaatt

SEQ ID NO: 541107 - DNA, 20 bp, Artificial Sequence
  chemically synthesized
atgctataattttgaatatt

SEQ ID NO: 541108 - DNA, 20 bp, Artificial Sequence
  chemically synthesized
agacaagtgaaagaactgaa

SEQ ID NO: 541109 - DNA, 20 bp, Artificial Sequence
  chemically synthesized
catataaattactcaaaggc

SEQ ID NO: 541110 - DNA, 20 bp, Artificial Sequence
  chemically synthesized
tagccatactaggaaactac

SEQ ID NO: 541111 - DNA, 20 bp, Artificial Sequence
  chemically synthesized
ttttaaaacttgtatttcag

SEQ ID NO: 541112 - DNA, 20 bp, Artificial Sequence
  chemically synthesized
tgcctgtaaggcaattttca

SEQ ID NO: 541113 - DNA, 20 bp, Artificial Sequence
  chemically synthesized
tgtgaaaattgccttacagg

SEQ ID NO: 541114 - DNA, 20 bp, Artificial Sequence
  chemically synthesized
gtaaacagatttttaaagcg

SEQ ID NO: 541115 - DNA, 20 bp, Artificial Sequence
  chemically synthesized
taattgtgacaaacatcctc

SEQ ID NO: 541116 - DNA, 20 bp, Artificial Sequence
  chemically synthesized
gcaagcaagcaaacctttca

SEQ ID NO: 541117 - DNA, 20 bp, Artificial Sequence
  chemically synthesized
atacatgaacagtctctcat

SEQ ID NO: 541118 - DNA, 20 bp, Artificial Sequence
  chemically synthesized
atgtatctccaattccctaa

SEQ ID NO: 541119 - DNA, 20 bp, Artificial Sequence
  chemically synthesized
cttgagaaactctttggtta

SEQ ID NO: 541120 - DNA, 20 bp, Artificial Sequence
  chemically synthesized
ctgttaaccaaagagtttct

SEQ ID NO: 541121 - DNA, 20 bp, Artificial Sequence
  chemically synthesized
tctagaatgaataagtttct

SEQ ID NO: 541122 - DNA, 20 bp, Artificial Sequence
  chemically synthesized
tctcaagaaacttattcatt

SEQ ID NO: 541123 - DNA, 20 bp, Artificial Sequence
  chemically synthesized
cactcaaaagctgtaatatt

SEQ ID NO: 541124 - DNA, 20 bp, Artificial Sequence
  chemically synthesized
gtcaggactcctcaagcaca

SEQ ID NO: 541125 - DNA, 20 bp, Artificial Sequence
  chemically synthesized
ctttatgttcgagatcagta

SEQ ID NO: 541126 - DNA, 20 bp, Artificial Sequence
  chemically synthesized
ttccagatctatagacatca

SEQ ID NO: 541127 - DNA, 20 bp, Artificial Sequence
  chemically synthesized
aagaacataatccttgagca

SEQ ID NO: 541128 - DNA, 20 bp, Artificial Sequence
  chemically synthesized
gaggcaggctatgtagtgga

SEQ ID NO: 541129 - DNA, 20 bp, Artificial Sequence
  chemically synthesized
gagacgaataattttgagtt

SEQ ID NO: 541130 - DNA, 20 bp, Artificial Sequence
  chemically synthesized
ctctaaaattaaggttctct

SEQ ID NO: 541131 - DNA, 20 bp, Artificial Sequence
  chemically synthesized
gcaaggtccatcctacgtgt

SEQ ID NO: 541132 - DNA, 20 bp, Artificial Sequence
  chemically synthesized
gcttaggaaatgtgagaaat

SEQ ID NO: 541133 - DNA, 20 bp, Artificial Sequence
  chemically synthesized
aagctactgcttaggaaatg

SEQ ID NO: 541134 - DNA, 20 bp, Artificial Sequence
  chemically synthesized
gtcagacaaaagttgatgaa

SEQ ID NO: 541135 - DNA, 20 bp, Artificial Sequence
  chemically synthesized
tgatgaatgagaaattactt

SEQ ID NO: 541136 - DNA, 20 bp, Artificial Sequence
  chemically synthesized
agaaattactttgagaatat

SEQ ID NO: 541137 - DNA, 20 bp, Artificial Sequence
  chemically synthesized
aaacttctactcttatattg

SEQ ID NO: 541138 - DNA, 20 bp, Artificial Sequence
  chemically synthesized
tcagagttcataaaattagg

SEQ ID NO: 541139 - DNA, 20 bp, Artificial Sequence
  chemically synthesized
caaaaaaaaataaataagta

SEQ ID NO: 541140 - DNA, 20 bp, Artificial Sequence
  chemically synthesized
ttcagtcatgaaaaaaaaaa

SEQ ID NO: 541141 - DNA, 20 bp, Artificial Sequence
  chemically synthesized
aagtaaagataactcactca

SEQ ID NO: 541142 - DNA, 20 bp, Artificial Sequence
  chemically synthesized
gataactcactcagtagaaa

SEQ ID NO: 541143 - DNA, 20 bp, Artificial Sequence
  chemically synthesized
caaacttccagggtttttca

SEQ ID NO: 541144 - DNA, 20 bp, Artificial Sequence
  chemically synthesized
cttccagggtttttcaggag

SEQ ID NO: 541145 - DNA, 20 bp, Artificial Sequence
  chemically synthesized
aagtgttacagaagctcaag

SEQ ID NO: 541146 - DNA, 20 bp, Artificial Sequence
  chemically synthesized
ctgtgctaaatgtacttttc

SEQ ID NO: 541147 - DNA, 20 bp, Artificial Sequence
  chemically synthesized
aaaactcatctattccaggt

SEQ ID NO: 541148 - DNA, 20 bp, Artificial Sequence
  chemically synthesized
aatttgtgaaatgacaaaac

SEQ ID NO: 541149 - DNA, 20 bp, Artificial Sequence
  chemically synthesized
ggaaaaagactctaatacag

SEQ ID NO: 541150 - DNA, 20 bp, Artificial Sequence
  chemically synthesized
caaaggaaaaagactctaat

SEQ ID NO: 541151 - DNA, 20 bp, Artificial Sequence
  chemically synthesized
tcccctcatatactgaagaa

SEQ ID NO: 541152 - DNA, 20 bp, Artificial Sequence
  chemically synthesized
acaaaaatgttcaattactt

SEQ ID NO: 541153 - DNA, 20 bp, Artificial Sequence
  chemically synthesized
atctagtcaatttcttatct

SEQ ID NO: 541154 - DNA, 20 bp, Artificial Sequence
  chemically synthesized
agtttaaaactttcttcaga

SEQ ID NO: 541155 - DNA, 20 bp, Artificial Sequence
  chemically synthesized
aagtgaactgtgaagattta

SEQ ID NO: 541156 - DNA, 20 bp, Artificial Sequence
  chemically synthesized
tgcagaagataagctgatgg

SEQ ID NO: 541157 - DNA, 20 bp, Artificial Sequence
  chemically synthesized
aggtggtgaaagaatttaaa

SEQ ID NO: 541158 - DNA, 20 bp, Artificial Sequence
  chemically synthesized
gttgttaagagcaggtggtg

SEQ ID NO: 541159 - DNA, 20 bp, Artificial Sequence
  chemically synthesized
caccacctgctcttaacaac

SEQ ID NO: 541160 - DNA, 20 bp, Artificial Sequence
  chemically synthesized
tcttaacaactaagaattca

SEQ ID NO: 541161 - DNA, 20 bp, Artificial Sequence
  chemically synthesized
ttcaataagtcacaataaga

SEQ ID NO: 541162 - DNA, 20 bp, Artificial Sequence
  chemically synthesized
cttagattatacagccttca

SEQ ID NO: 541163 - DNA, 20 bp, Artificial Sequence
  chemically synthesized
ctctaatctgaaatatacaa

SEQ ID NO: 541164 - DNA, 20 bp, Artificial Sequence
  chemically synthesized
aaataaaccatcataaactt

SEQ ID NO: 541165 - DNA, 20 bp, Artificial Sequence
  chemically synthesized
gcatcaacttggcatgtatg

SEQ ID NO: 541166 - DNA, 20 bp, Artificial Sequence
  chemically synthesized
attttattggttgttgaatg

SEQ ID NO: 541167 - DNA, 20 bp, Artificial Sequence
  chemically synthesized
agtgcacaagatactcaaat

SEQ ID NO: 541168 - DNA, 20 bp, Artificial Sequence
  chemically synthesized
agttggatagaattcatttt

SEQ ID NO: 541169 - DNA, 20 bp, Artificial Sequence
  chemically synthesized
tttactaagtaactagttgg

SEQ ID NO: 541170 - DNA, 20 bp, Artificial Sequence
  chemically synthesized
agacggagtggtgcaagatg

SEQ ID NO: 541171 - DNA, 20 bp, Artificial Sequence
  chemically synthesized
attgtaacaactatgagcag

SEQ ID NO: 541172 - DNA, 20 bp, Artificial Sequence
  chemically synthesized
aactgctgtgctgtcacagt

SEQ ID NO: 541173 - DNA, 20 bp, Artificial Sequence
  chemically synthesized
cccacaatggtgaggcttgc

SEQ ID NO: 541174 - DNA, 20 bp, Artificial Sequence
  chemically synthesized
gctggtatccaagatgcaag

SEQ ID NO: 541175 - DNA, 20 bp, Artificial Sequence
  chemically synthesized
gtgttgtccaggagctgagc

SEQ ID NO: 541176 - DNA, 20 bp, Artificial Sequence
  chemically synthesized
cctcttggggggctaaggca

SEQ ID NO: 541177 - DNA, 20 bp, Artificial Sequence
  chemically synthesized
aacagagtgagatgctgtct

SEQ ID NO: 541178 - DNA, 20 bp, Artificial Sequence
  chemically synthesized
gagtgagatgctgtctcaag

SEQ ID NO: 541179 - DNA, 20 bp, Artificial Sequence
  chemically synthesized
agatgctgtctcaagaaaga

SEQ ID NO: 541180 - DNA, 20 bp, Artificial Sequence
  chemically synthesized
ctgtctcaagaaagaaaaga

SEQ ID NO: 541181 - DNA, 20 bp, Artificial Sequence
  chemically synthesized
ctcaagaaagaaaagaaaag

SEQ ID NO: 541182 - DNA, 20 bp, Artificial Sequence
  chemically synthesized
agaaaagaaaagaaagaaag

SEQ ID NO: 541183 - DNA, 20 bp, Artificial Sequence
  chemically synthesized
agatagaaaaaaaagagaga

SEQ ID NO: 541184 - DNA, 20 bp, Artificial Sequence
  chemically synthesized
gaaaaaaaagagagagaaga

SEQ ID NO: 541185 - DNA, 20 bp, Artificial Sequence
  chemically synthesized
aaaagagagagaagaaaaga

SEQ ID NO: 541186 - DNA, 20 bp, Artificial Sequence
  chemically synthesized
atattattcgagctcaggag

SEQ ID NO: 541187 - DNA, 20 bp, Artificial Sequence
  chemically synthesized
cattggacttaatctgcact

SEQ ID NO: 541188 - DNA, 20 bp, Artificial Sequence
  chemically synthesized
ggacatttaattcaatgagt

SEQ ID NO: 541189 - DNA, 20 bp, Artificial Sequence
  chemically synthesized
aataatctgtgtgctgagaa

SEQ ID NO: 541190 - DNA, 20 bp, Artificial Sequence
  chemically synthesized
ctgaccacaatggaatgaga

SEQ ID NO: 541191 - DNA, 20 bp, Artificial Sequence
  chemically synthesized
taaatgaccactgggtctat

SEQ ID NO: 541192 - DNA, 20 bp, Artificial Sequence
  chemically synthesized
aaaaatgtcttcaaaaaatg

SEQ ID NO: 541193 - DNA, 20 bp, Artificial Sequence
  chemically synthesized
acagcaaaactagtactaag

SEQ ID NO: 541194 - DNA, 20 bp, Artificial Sequence
  chemically synthesized
ctgtaggtgcttctatcaaa

SEQ ID NO: 541195 - DNA, 20 bp, Artificial Sequence
  chemically synthesized
aatcgaacccaaaattagtg

SEQ ID NO: 541196 - DNA, 20 bp, Artificial Sequence
  chemically synthesized
gaacccaaaattagtggaag

SEQ ID NO: 541197 - DNA, 20 bp, Artificial Sequence
  chemically synthesized
aagaaataataaagatcaga

SEQ ID NO: 541198 - DNA, 20 bp, Artificial Sequence
  chemically synthesized
gaaataaatgactttgtaat

SEQ ID NO: 541199 - DNA, 20 bp, Artificial Sequence
  chemically synthesized
aaatcttgagccagactaat

SEQ ID NO: 541200 - DNA, 20 bp, Artificial Sequence
  chemically synthesized
gaagacccaaataagtaaaa

SEQ ID NO: 541201 - DNA, 20 bp, Artificial Sequence
  chemically synthesized
caaataagtaaaatcagaaa

SEQ ID NO: 541202 - DNA, 20 bp, Artificial Sequence
  chemically synthesized
acctaccaagattaaaccat

SEQ ID NO: 541203 - DNA, 20 bp, Artificial Sequence
  chemically synthesized
ccttagtaaactctcccagt

SEQ ID NO: 541204 - DNA, 20 bp, Artificial Sequence
  chemically synthesized
aacaggcaacctacaaaatg

SEQ ID NO: 541205 - DNA, 20 bp, Artificial Sequence
  chemically synthesized
atctgacaaagggctaatat

SEQ ID NO: 541206 - DNA, 20 bp, Artificial Sequence
  chemically synthesized
aatgaactcaaacaaacgta

SEQ ID NO: 541207 - DNA, 20 bp, Artificial Sequence
  chemically synthesized
taaaatctaagacctcaaac

SEQ ID NO: 541208 - DNA, 20 bp, Artificial Sequence
  chemically synthesized
aactactacaaggaaacatt

SEQ ID NO: 541209 - DNA, 20 bp, Artificial Sequence
  chemically synthesized
ataaagtgaagagacaacca

SEQ ID NO: 541210 - DNA, 20 bp, Artificial Sequence
  chemically synthesized
aagagacaaccaacagaaag

SEQ ID NO: 541211 - DNA, 20 bp, Artificial Sequence
  chemically synthesized
atctcacaagggattaataa

SEQ ID NO: 541212 - DNA, 20 bp, Artificial Sequence
  chemically synthesized
gaaaaagtctaataattaga

SEQ ID NO: 541213 - DNA, 20 bp, Artificial Sequence
  chemically synthesized
gccatttgtatgtcttcttt

SEQ ID NO: 541214 - DNA, 20 bp, Artificial Sequence
  chemically synthesized
gctcagcatcactaatcatc

SEQ ID NO: 541215 - DNA, 20 bp, Artificial Sequence
  chemically synthesized
atgtcgttttaattggggtg

SEQ ID NO: 541216 - DNA, 20 bp, Artificial Sequence
  chemically synthesized
acaaatgctggagagagtgt

SEQ ID NO: 541217 - DNA, 20 bp, Artificial Sequence
  chemically synthesized
taaattagtacaaccaaaat

SEQ ID NO: 541218 - DNA, 20 bp, Artificial Sequence
  chemically synthesized
gagaatagtttggaggttcc

SEQ ID NO: 541219 - DNA, 20 bp, Artificial Sequence
  chemically synthesized
cactgctgggtatatatccc

SEQ ID NO: 541220 - DNA, 20 bp, Artificial Sequence
  chemically synthesized
ccatcaagagatgaatggac

SEQ ID NO: 541221 - DNA, 20 bp, Artificial Sequence
  chemically synthesized
agagtactattcagccataa

SEQ ID NO: 541222 - DNA, 20 bp, Artificial Sequence
  chemically synthesized
ttaaatgaaataagccaggc

SEQ ID NO: 541223 - DNA, 20 bp, Artificial Sequence
  chemically synthesized
ttacttggtacaaaaaatag

SEQ ID NO: 541224 - DNA, 20 bp, Artificial Sequence
  chemically synthesized
ttggtacaaaaaatagttag

SEQ ID NO: 541225 - DNA, 20 bp, Artificial Sequence
  chemically synthesized
aattttactgtttgtaaaac

SEQ ID NO: 541226 - DNA, 20 bp, Artificial Sequence
  chemically synthesized
ttttgaaaagtggaacataa

SEQ ID NO: 541227 - DNA, 20 bp, Artificial Sequence
  chemically synthesized
ggccactgttttactgactg

SEQ ID NO: 541228 - DNA, 20 bp, Artificial Sequence
  chemically synthesized
aaacaagcaagtcctgaact

SEQ ID NO: 541229 - DNA, 20 bp, Artificial Sequence
  chemically synthesized
acttcctaattctaccaagc

SEQ ID NO: 541230 - DNA, 20 bp, Artificial Sequence
  chemically synthesized
actgttggtttctgagcttg

SEQ ID NO: 541231 - DNA, 20 bp, Artificial Sequence
  chemically synthesized
gaaggattatcattgcagtc

SEQ ID NO: 541232 - DNA, 20 bp, Artificial Sequence
  chemically synthesized
tgcataatctgggagctttt

SEQ ID NO: 541233 - DNA, 20 bp, Artificial Sequence
  chemically synthesized
ctaatcctcacgttatcact

SEQ ID NO: 541234 - DNA, 20 bp, Artificial Sequence
  chemically synthesized
ctcacattacccatataagg

SEQ ID NO: 541235 - DNA, 20 bp, Artificial Sequence
  chemically synthesized
tatttccttaccttgacatg

SEQ ID NO: 541236 - DNA, 20 bp, Artificial Sequence
  chemically synthesized
attatttattgaatgtctca

SEQ ID NO: 541237 - DNA, 20 bp, Artificial Sequence
  chemically synthesized
actgagatagcaaattctta

SEQ ID NO: 541238 - DNA, 20 bp, Artificial Sequence
  chemically synthesized
ttcctaatgtgagtttctga

SEQ ID NO: 541239 - DNA, 20 bp, Artificial Sequence
  chemically synthesized
ctcacattaggaatgggctt

SEQ ID NO: 541240 - DNA, 20 bp, Artificial Sequence
  chemically synthesized
accaaataaatcagattcga

SEQ ID NO: 541241 - DNA, 20 bp, Artificial Sequence
  chemically synthesized
cgaaaggagagaaaacagga

SEQ ID NO: 541242 - DNA, 20 bp, Artificial Sequence
  chemically synthesized
aaaatgaaagaaacgaaagg

SEQ ID NO: 541243 - DNA, 20 bp, Artificial Sequence
  chemically synthesized
tgaagaaaaatgagaaaatg

SEQ ID NO: 541244 - DNA, 20 bp, Artificial Sequence
  chemically synthesized
ttgtgctacatgaagaaaaa

SEQ ID NO: 541245 - DNA, 20 bp, Artificial Sequence
  chemically synthesized
ggctgccatttgtgctacat

SEQ ID NO: 541246 - DNA, 20 bp, Artificial Sequence
  chemically synthesized
tgctatgagaactgaacaat

SEQ ID NO: 541247 - DNA, 20 bp, Artificial Sequence
  chemically synthesized
tgacctgtggaactgtggtt

SEQ ID NO: 541248 - DNA, 20 bp, Artificial Sequence
  chemically synthesized
tatgtgggcactactgcttt

SEQ ID NO: 541249 - DNA, 20 bp, Artificial Sequence
  chemically synthesized
tagttcagtccagcattcac

SEQ ID NO: 541250 - DNA, 20 bp, Artificial Sequence
  chemically synthesized
aatgcaagcagcatccacat

SEQ ID NO: 541251 - DNA, 20 bp, Artificial Sequence
  chemically synthesized
acagtgttgtataaagtaag

SEQ ID NO: 541252 - DNA, 20 bp, Artificial Sequence
  chemically synthesized
aagaaacctctaaaaaaatt

SEQ ID NO: 541253 - DNA, 20 bp, Artificial Sequence
  chemically synthesized
tagaggtttctttttttgct

SEQ ID NO: 541254 - DNA, 20 bp, Artificial Sequence
  chemically synthesized
attacatttctatagcaaaa

SEQ ID NO: 541255 - DNA, 20 bp, Artificial Sequence
  chemically synthesized
tgctatagaaatgtaataat

SEQ ID NO: 541256 - DNA, 20 bp, Artificial Sequence
  chemically synthesized
aacccaacatatctgactaa

SEQ ID NO: 541257 - DNA, 20 bp, Artificial Sequence
  chemically synthesized
acaaggtccctgtcaaacat

SEQ ID NO: 541258 - DNA, 20 bp, Artificial Sequence
  chemically synthesized
gctgtacagcaatttgtagt

SEQ ID NO: 541259 - DNA, 20 bp, Artificial Sequence
  chemically synthesized
ttagtgagtgtttcccactt

SEQ ID NO: 541260 - DNA, 20 bp, Artificial Sequence
  chemically synthesized
acaggatagtaaagatggta

SEQ ID NO: 541261 - DNA, 20 bp, Artificial Sequence
  chemically synthesized
gatagtaaagatggtatcag

SEQ ID NO: 541262 - DNA, 20 bp, Artificial Sequence
  chemically synthesized
ttcttaagtgttcattgaaa

SEQ ID NO: 541263 - DNA, 20 bp, Artificial Sequence
  chemically synthesized
cataagatctatctgggatt

SEQ ID NO: 541264 - DNA, 20 bp, Artificial Sequence
  chemically synthesized
tataggaaacatgtaaaaac

SEQ ID NO: 541265 - DNA, 20 bp, Artificial Sequence
  chemically synthesized
tgttgactgttagtgaacaa

SEQ ID NO: 541266 - DNA, 20 bp, Artificial Sequence
  chemically synthesized
catacattgtctttcagcaa

SEQ ID NO: 541267 - DNA, 20 bp, Artificial Sequence
  chemically synthesized
atttaatagagatgactgaa

SEQ ID NO: 541268 - DNA, 20 bp, Artificial Sequence
  chemically synthesized
ctgcttcattattttataag

SEQ ID NO: 541269 - DNA, 20 bp, Artificial Sequence
  chemically synthesized
ataacaggattgttttacag

SEQ ID NO: 541270 - DNA, 20 bp, Artificial Sequence
  chemically synthesized
caaatctgacatcaatagaa

SEQ ID NO: 541271 - DNA, 20 bp, Artificial Sequence
  chemically synthesized
cgttgccaaatctgacatca

SEQ ID NO: 541272 - DNA, 20 bp, Artificial Sequence
  chemically synthesized
ggtacaagtaacctaaacag

SEQ ID NO: 541273 - DNA, 20 bp, Artificial Sequence
  chemically synthesized
actaccatacatgtaccatt

SEQ ID NO: 541274 - DNA, 20 bp, Artificial Sequence
  chemically synthesized
tctaaatctctccaaggatt

SEQ ID NO: 541275 - DNA, 20 bp, Artificial Sequence
  chemically synthesized
tatcgactaactgccccttt

SEQ ID NO: 541276 - DNA, 20 bp, Artificial Sequence
  chemically synthesized
ttctgccagagaccctagtt

SEQ ID NO: 541277 - DNA, 20 bp, Artificial Sequence
  chemically synthesized
gtagaatgagcgacacacag

SEQ ID NO: 541278 - DNA, 20 bp, Artificial Sequence
  chemically synthesized
aggaagagcaggctaggcat

SEQ ID NO: 541279 - DNA, 20 bp, Artificial Sequence
  chemically synthesized
agagctaggtttaacaatgg

SEQ ID NO: 541280 - DNA, 20 bp, Artificial Sequence
  chemically synthesized
agtgactctagttactttag

SEQ ID NO: 541281 - DNA, 20 bp, Artificial Sequence
  chemically synthesized
aaggttctgagttacaacta

SEQ ID NO: 541282 - DNA, 20 bp, Artificial Sequence
  chemically synthesized
atggaatgaagctatcttac

SEQ ID NO: 541283 - DNA, 20 bp, Artificial Sequence
  chemically synthesized
gaagagcttcacagtcttgg

SEQ ID NO: 541284 - DNA, 20 bp, Artificial Sequence
  chemically synthesized
ttccctgagaactacagaga

SEQ ID NO: 541285 - DNA, 20 bp, Artificial Sequence
  chemically synthesized
cagggaaatttgaaagcatg

SEQ ID NO: 541286 - DNA, 20 bp, Artificial Sequence
  chemically synthesized
ttctgatgtataaaatagga

SEQ ID NO: 541287 - DNA, 20 bp, Artificial Sequence
  chemically synthesized
ttcttatcctattttataca

SEQ ID NO: 541288 - DNA, 20 bp, Artificial Sequence
  chemically synthesized
tgctcaagggcacatagata

SEQ ID NO: 541289 - DNA, 20 bp, Artificial Sequence
  chemically synthesized
gcacatagatagcagaaagg

SEQ ID NO: 541290 - DNA, 20 bp, Artificial Sequence
  chemically synthesized
acagctcctgaccaattcct

SEQ ID NO: 541291 - DNA, 20 bp, Artificial Sequence
  chemically synthesized
agggtggatctattggggct

SEQ ID NO: 541292 - DNA, 20 bp, Artificial Sequence
  chemically synthesized
aactctatcctttgtcaaaa

SEQ ID NO: 541293 - DNA, 20 bp, Artificial Sequence
  chemically synthesized
taccttcaccttagacttaa

SEQ ID NO: 541294 - DNA, 20 bp, Artificial Sequence
  chemically synthesized
ttactcatgagtaaagcgga

SEQ ID NO: 541295 - DNA, 20 bp, Artificial Sequence
  chemically synthesized
cggaggagaaacctcaaaaa

SEQ ID NO: 541296 - DNA, 20 bp, Artificial Sequence
  chemically synthesized
cctaccagttttgcactaaa

SEQ ID NO: 541297 - DNA, 20 bp, Artificial Sequence
  chemically synthesized
cacagtaatcactggctatc

SEQ ID NO: 541298 - DNA, 20 bp, Artificial Sequence
  chemically synthesized
taggggatggtgtgggtggc

SEQ ID NO: 541299 - DNA, 20 bp, Artificial Sequence
  chemically synthesized
gtgggtggcctagaatgctt

SEQ ID NO: 541300 - DNA, 20 bp, Artificial Sequence
  chemically synthesized
tgtctcaatgtgaaatgctg

SEQ ID NO: 541301 - DNA, 20 bp, Artificial Sequence
  chemically synthesized
aagccaggcttgataaaggc

SEQ ID NO: 541302 - DNA, 20 bp, Artificial Sequence
  chemically synthesized
ctactcgggaggctgaggca

SEQ ID NO: 541303 - DNA, 20 bp, Artificial Sequence
  chemically synthesized
caagcctcctctccgaaacc

SEQ ID NO: 541304 - DNA, 20 bp, Artificial Sequence
  chemically synthesized
gcctcccacacaagctcctt

SEQ ID NO: 541305 - DNA, 20 bp, Artificial Sequence
  chemically synthesized
ataaggagcttgtgtgggag

SEQ ID NO: 541306 - DNA, 20 bp, Artificial Sequence
  chemically synthesized
ccagacttggtggctaccgt

SEQ ID NO: 541307 - DNA, 20 bp, Artificial Sequence
  chemically synthesized
gactaatagttttaggattt

SEQ ID NO: 541308 - DNA, 20 bp, Artificial Sequence
  chemically synthesized
acttcagatgttgtcttttt

SEQ ID NO: 541309 - DNA, 20 bp, Artificial Sequence
  chemically synthesized
gcttgctatagggcaggcac

SEQ ID NO: 541310 - DNA, 20 bp, Artificial Sequence
  chemically synthesized
gtactataatctcattccct

SEQ ID NO: 541311 - DNA, 20 bp, Artificial Sequence
  chemically synthesized
agtaccaaagctcttacact

SEQ ID NO: 541312 - DNA, 20 bp, Artificial Sequence
  chemically synthesized
tgagacaactgagattaatg

SEQ ID NO: 541313 - DNA, 20 bp, Artificial Sequence
  chemically synthesized
taaaataggagtaaagatgg

SEQ ID NO: 541314 - DNA, 20 bp, Artificial Sequence
  chemically synthesized
acgaatgatttgatttcctc

SEQ ID NO: 541315 - DNA, 20 bp, Artificial Sequence
  chemically synthesized
acttttaatctaaaaatgta

SEQ ID NO: 541316 - DNA, 20 bp, Artificial Sequence
  chemically synthesized
gttgacttaattggggggtg

SEQ ID NO: 541317 - DNA, 20 bp, Artificial Sequence
  chemically synthesized
aaatatttcaattaagataa

SEQ ID NO: 541318 - DNA, 20 bp, Artificial Sequence
  chemically synthesized
tcagacaaatgagctgaact

SEQ ID NO: 541319 - DNA, 20 bp, Artificial Sequence
  chemically synthesized
tgatttgttttcagggaact

SEQ ID NO: 541320 - DNA, 20 bp, Artificial Sequence
  chemically synthesized
caaatcatttctgcaagtat

SEQ ID NO: 541321 - DNA, 20 bp, Artificial Sequence
  chemically synthesized
atatatttttcttgatactt

SEQ ID NO: 541322 - DNA, 20 bp, Artificial Sequence
  chemically synthesized
tgttttaaaatttttatatt

SEQ ID NO: 541323 - DNA, 20 bp, Artificial Sequence
  chemically synthesized
aaaaaatgaattagctgtct

SEQ ID NO: 541324 - DNA, 20 bp, Artificial Sequence
  chemically synthesized
tgaattagctgtctatagaa

SEQ ID NO: 541325 - DNA, 20 bp, Artificial Sequence
  chemically synthesized
aactttaaaaagtcaataat

SEQ ID NO: 541326 - DNA, 20 bp, Artificial Sequence
  chemically synthesized
tgggatggattatggacaga

SEQ ID NO: 541327 - DNA, 20 bp, Artificial Sequence
  chemically synthesized
ctcgtgagacctccaagtgt

SEQ ID NO: 541328 - DNA, 20 bp, Artificial Sequence
  chemically synthesized
gaaggattaggaaatgcagt

SEQ ID NO: 541329 - DNA, 20 bp, Artificial Sequence
  chemically synthesized
gcttgactttcaggacatat

SEQ ID NO: 541330 - DNA, 20 bp, Artificial Sequence
  chemically synthesized
agcttctatcagatctgtag

SEQ ID NO: 541331 - DNA, 20 bp, Artificial Sequence
  chemically synthesized
aatcttttcggctcttgtgt

SEQ ID NO: 541332 - DNA, 20 bp, Artificial Sequence
  chemically synthesized
atgatcccaattatgtttta

SEQ ID NO: 541333 - DNA, 20 bp, Artificial Sequence
  chemically synthesized
attatttgtataaagtgttg

SEQ ID NO: 541334 - DNA, 20 bp, Artificial Sequence
  chemically synthesized
gtaaaaatgggagactggag

SEQ ID NO: 541335 - DNA, 20 bp, Artificial Sequence
  chemically synthesized
tgatctctgactgcacctca

SEQ ID NO: 541336 - DNA, 20 bp, Artificial Sequence
  chemically synthesized
attccaatacatgcccagaa

SEQ ID NO: 541337 - DNA, 20 bp, Artificial Sequence
  chemically synthesized
tagctgattccaatacatgc

SEQ ID NO: 541338 - DNA, 20 bp, Artificial Sequence
  chemically synthesized
tttactttttgtataggaat

SEQ ID NO: 541339 - DNA, 20 bp, Artificial Sequence
  chemically synthesized
agattagtaagttttcaatc

SEQ ID NO: 541340 - DNA, 20 bp, Artificial Sequence
  chemically synthesized
caagagaccctaatagttag

SEQ ID NO: 541341 - DNA, 20 bp, Artificial Sequence
  chemically synthesized
ggattaagggttcccttgta

SEQ ID NO: 541342 - DNA, 20 bp, Artificial Sequence
  chemically synthesized
ctcttatctcatcctgtgac

SEQ ID NO: 541343 - DNA, 20 bp, Artificial Sequence
  chemically synthesized
acccaatatggtctaaaatg

SEQ ID NO: 541344 - DNA, 20 bp, Artificial Sequence
  chemically synthesized
ggaattgctgactccttttc

SEQ ID NO: 541345 - DNA, 20 bp, Artificial Sequence
  chemically synthesized
ccccttgtttagcatataat

SEQ ID NO: 541346 - DNA, 20 bp, Artificial Sequence
  chemically synthesized
tattaagaaagtaaaggaat

SEQ ID NO: 541347 - DNA, 20 bp, Artificial Sequence
  chemically synthesized
aaaagtaaaagcaagtttat

SEQ ID NO: 541348 - DNA, 20 bp, Artificial Sequence
  chemically synthesized
caagggcagaaatcttgaag

SEQ ID NO: 541349 - DNA, 20 bp, Artificial Sequence
  chemically synthesized
tggcaggtagaacagcaagg

SEQ ID NO: 541350 - DNA, 20 bp, Artificial Sequence
  chemically synthesized
aagaagtaagggaaccactg

SEQ ID NO: 541351 - DNA, 20 bp, Artificial Sequence
  chemically synthesized
tagagaaggcccctttaacg

SEQ ID NO: 541352 - DNA, 20 bp, Artificial Sequence
  chemically synthesized
atgttagtaataagtactat

SEQ ID NO: 541353 - DNA, 20 bp, Artificial Sequence
  chemically synthesized
gtttgtgatttttccgttaa

SEQ ID NO: 541354 - DNA, 20 bp, Artificial Sequence
  chemically synthesized
accacaaatgggttatacgg

SEQ ID NO: 541355 - DNA, 20 bp, Artificial Sequence
  chemically synthesized
caaatgggttatacgggaag

SEQ ID NO: 541356 - DNA, 20 bp, Artificial Sequence
  chemically synthesized
gtagtttttagcaaatttat

SEQ ID NO: 541357 - DNA, 20 bp, Artificial Sequence
  chemically synthesized
attcgtactaggaagaatag

SEQ ID NO: 541358 - DNA, 20 bp, Artificial Sequence
  chemically synthesized
aataacaaaattcgtactag

SEQ ID NO: 541359 - DNA, 20 bp, Artificial Sequence
  chemically synthesized
catgtgtaaggagcaatata

SEQ ID NO: 541360 - DNA, 20 bp, Artificial Sequence
  chemically synthesized
agtaggttttattgtagtag

SEQ ID NO: 541361 - DNA, 20 bp, Artificial Sequence
  chemically synthesized
agtaagaaaggatatggttt

SEQ ID NO: 541362 - DNA, 20 bp, Artificial Sequence
  chemically synthesized
aggatatggtttgaagaatt

SEQ ID NO: 541363 - DNA, 20 bp, Artificial Sequence
  chemically synthesized
cttagctggatgagaagaag

SEQ ID NO: 541364 - DNA, 20 bp, Artificial Sequence
  chemically synthesized
ccaaacattttctagaagtt

SEQ ID NO: 541365 - DNA, 20 bp, Artificial Sequence
  chemically synthesized
atacatgttttctctaactt

SEQ ID NO: 541366 - DNA, 20 bp, Artificial Sequence
  chemically synthesized
tatttggtcataggctcagg

SEQ ID NO: 541367 - DNA, 20 bp, Artificial Sequence
  chemically synthesized
ataatgtgctttgaatctca

SEQ ID NO: 541368 - DNA, 20 bp, Artificial Sequence
  chemically synthesized
cattagctactgaagtacag

SEQ ID NO: 541369 - DNA, 20 bp, Artificial Sequence
  chemically synthesized
aaataatatatcagtttgtt

SEQ ID NO: 541370 - DNA, 20 bp, Artificial Sequence
  chemically synthesized
aaaaatgctgaagtatttat

SEQ ID NO: 541371 - DNA, 20 bp, Artificial Sequence
  chemically synthesized
catgagagaatatttcagca

SEQ ID NO: 541372 - DNA, 20 bp, Artificial Sequence
  chemically synthesized
ttccgaaaaaagttctcatg

SEQ ID NO: 541373 - DNA, 20 bp, Artificial Sequence
  chemically synthesized
aagtttaggaaaacagctca

SEQ ID NO: 541374 - DNA, 20 bp, Artificial Sequence
  chemically synthesized
tttgatgcctcaaaggcttt

SEQ ID NO: 541375 - DNA, 20 bp, Artificial Sequence
  chemically synthesized
cagttactacaactctttgc

SEQ ID NO: 541376 - DNA, 20 bp, Artificial Sequence
  chemically synthesized
gcacctgatgtatcaggagg

SEQ ID NO: 541377 - DNA, 20 bp, Artificial Sequence
  chemically synthesized
tgtagtacaggagagaaatc

SEQ ID NO: 541378 - DNA, 20 bp, Artificial Sequence
  chemically synthesized
tgcaggggttgtagtacagg

SEQ ID NO: 541379 - DNA, 20 bp, Artificial Sequence
  chemically synthesized
aaacataagatctctggatg

SEQ ID NO: 541380 - DNA, 20 bp, Artificial Sequence
  chemically synthesized
ccatctcaaaaaaaaaaaaa

SEQ ID NO: 541381 - DNA, 20 bp, Artificial Sequence
  chemically synthesized
ctcgggaggaggctgaggca

SEQ ID NO: 541382 - DNA, 20 bp, Artificial Sequence
  chemically synthesized
caattttgactgaaaatagg

SEQ ID NO: 541383 - DNA, 20 bp, Artificial Sequence
  chemically synthesized
ctttccagatgacgggctct

SEQ ID NO: 541384 - DNA, 20 bp, Artificial Sequence
  chemically synthesized
acgtgaaatcttagaataag

SEQ ID NO: 541385 - DNA, 20 bp, Artificial Sequence
  chemically synthesized
tggaccacaaacgtgaaatc

SEQ ID NO: 541386 - DNA, 20 bp, Artificial Sequence
  chemically synthesized
gggtgatgtgagtgaatttc

SEQ ID NO: 541387 - DNA, 20 bp, Artificial Sequence
  chemically synthesized
caaggtgtacatagactgga

SEQ ID NO: 541388 - DNA, 20 bp, Artificial Sequence
  chemically synthesized
ttaaattgaggtgcgaaaca

SEQ ID NO: 541389 - DNA, 20 bp, Artificial Sequence
  chemically synthesized
aggtcaggtattaccataca

SEQ ID NO: 541390 - DNA, 20 bp, Artificial Sequence
  chemically synthesized
aaaagaaagaacaagccaac

SEQ ID NO: 541391 - DNA, 20 bp, Artificial Sequence
  chemically synthesized
aagccaacacagaaacaatc

SEQ ID NO: 541392 - DNA, 20 bp, Artificial Sequence
  chemically synthesized
gtcttttagcaatttcacat

SEQ ID NO: 541393 - DNA, 20 bp, Artificial Sequence
  chemically synthesized
gtttagggtgaaaagagtga

SEQ ID NO: 541394 - DNA, 20 bp, Artificial Sequence
  chemically synthesized
ggaaggagatgagtatccct

SEQ ID NO: 541395 - DNA, 20 bp, Artificial Sequence
  chemically synthesized
tcatcatctttcactataaa

SEQ ID NO: 541396 - DNA, 20 bp, Artificial Sequence
  chemically synthesized
acatcagaggcttgcttatt

SEQ ID NO: 541397 - DNA, 20 bp, Artificial Sequence
  chemically synthesized
aaaacaaaactcataataaa

SEQ ID NO: 541398 - DNA, 20 bp, Artificial Sequence
  chemically synthesized
tctaccaggtaaataaaagt

SEQ ID NO: 541399 - DNA, 20 bp, Artificial Sequence
  chemically synthesized
tctttacttttatttacctg

SEQ ID NO: 541400 - DNA, 20 bp, Artificial Sequence
  chemically synthesized
tagcctgattaggtcaggta

SEQ ID NO: 541401 - DNA, 20 bp, Artificial Sequence
  chemically synthesized
atgatggagacagtgactta

SEQ ID NO: 541402 - DNA, 20 bp, Artificial Sequence
  chemically synthesized
ccattggactggcagccaag

SEQ ID NO: 541403 - DNA, 20 bp, Artificial Sequence
  chemically synthesized
gcatagctgtaagcacccat

SEQ ID NO: 541404 - DNA, 20 bp, Artificial Sequence
  chemically synthesized
gagcaatgctacagcattcc

SEQ ID NO: 541405 - DNA, 20 bp, Artificial Sequence
  chemically synthesized
ggaaaactttctatcttaaa

SEQ ID NO: 541406 - DNA, 20 bp, Artificial Sequence
  chemically synthesized
ttttgcttttctcctttaag

SEQ ID NO: 541407 - DNA, 20 bp, Artificial Sequence
  chemically synthesized
tagctccttggtgcattctc

SEQ ID NO: 541408 - DNA, 20 bp, Artificial Sequence
  chemically synthesized
ccaattttgacagcattctc

SEQ ID NO: 541409 - DNA, 20 bp, Artificial Sequence
  chemically synthesized
gtgtcctcaaggcactgcac

SEQ ID NO: 541410 - DNA, 20 bp, Artificial Sequence
  chemically synthesized
agaaaaatggtatgtgcacc

SEQ ID NO: 541411 - DNA, 20 bp, Artificial Sequence
  chemically synthesized
attttactattttagtttgt

SEQ ID NO: 541412 - DNA, 20 bp, Artificial Sequence
  chemically synthesized
atggcttcctttttagaggg

SEQ ID NO: 541413 - DNA, 20 bp, Artificial Sequence
  chemically synthesized
ctatggcgatataaacatcc

SEQ ID NO: 541414 - DNA, 20 bp, Artificial Sequence
  chemically synthesized
taaacatccctagaatcact

SEQ ID NO: 541415 - DNA, 20 bp, Artificial Sequence
  chemically synthesized
ggaactattcagggagagaa

SEQ ID NO: 541416 - DNA, 20 bp, Artificial Sequence
  chemically synthesized
agataaggaactattcaggg

SEQ ID NO: 541417 - DNA, 20 bp, Artificial Sequence
  chemically synthesized
tggccaaaaataaacatctt

SEQ ID NO: 541418 - DNA, 20 bp, Artificial Sequence
  chemically synthesized
tatatttagaatttcctttt

SEQ ID NO: 541419 - DNA, 20 bp, Artificial Sequence
  chemically synthesized
aattccatttgtatgtatat

SEQ ID NO: 541420 - DNA, 20 bp, Artificial Sequence
  chemically synthesized
aattcgtgtacagatgcctt

SEQ ID NO: 541421 - DNA, 20 bp, Artificial Sequence
  chemically synthesized
cctgattatgcactgtgaat

SEQ ID NO: 541422 - DNA, 20 bp, Artificial Sequence
  chemically synthesized
gatacctaaagtaaggaaaa

SEQ ID NO: 541423 - DNA, 20 bp, Artificial Sequence
  chemically synthesized
ggtttttaaaggagacacat

SEQ ID NO: 541424 - DNA, 20 bp, Artificial Sequence
  chemically synthesized
acaggataaaaggagaagcc

SEQ ID NO: 541425 - DNA, 20 bp, Artificial Sequence
  chemically synthesized
aaaaggagaagccagagaat

SEQ ID NO: 541426 - DNA, 20 bp, Artificial Sequence
  chemically synthesized
agaagtctatcccttatgat

SEQ ID NO: 541427 - DNA, 20 bp, Artificial Sequence
  chemically synthesized
ttgtcactttacattaaatg

SEQ ID NO: 541428 - DNA, 20 bp, Artificial Sequence
  chemically synthesized
ctacttgggaggctaaggta

SEQ ID NO: 541429 - DNA, 20 bp, Artificial Sequence
  chemically synthesized
agtaattggatgttgaagat

SEQ ID NO: 541430 - DNA, 20 bp, Artificial Sequence
  chemically synthesized
tttgctcccttatttcatac

SEQ ID NO: 541431 - DNA, 20 bp, Artificial Sequence
  chemically synthesized
ctctcagtcaaaaatttcaa

SEQ ID NO: 541432 - DNA, 20 bp, Artificial Sequence
  chemically synthesized
aaagttcaatatatttcaaa

SEQ ID NO: 541433 - DNA, 20 bp, Artificial Sequence
  chemically synthesized
aaatgaaaactgagaaacca

SEQ ID NO: 541434 - DNA, 20 bp, Artificial Sequence
  chemically synthesized
tccttcagagaaatgaaaac

SEQ ID NO: 541435 - DNA, 20 bp, Artificial Sequence
  chemically synthesized
tctgctaatgttagtccttc

SEQ ID NO: 541436 - DNA, 20 bp, Artificial Sequence
  chemically synthesized
tgtagctgtcagacacagag

SEQ ID NO: 541437 - DNA, 20 bp, Artificial Sequence
  chemically synthesized
gctgtattcattcattaact

SEQ ID NO: 541438 - DNA, 20 bp, Artificial Sequence
  chemically synthesized
ctactcgggaggctgaggca

SEQ ID NO: 541439 - DNA, 20 bp, Artificial Sequence
  chemically synthesized
cttgggtatatactagtgat

SEQ ID NO: 541440 - DNA, 20 bp, Artificial Sequence
  chemically synthesized
ctggaatctcaccttctaca

SEQ ID NO: 541441 - DNA, 20 bp, Artificial Sequence
  chemically synthesized
ggagaataaagtaaacaaat

SEQ ID NO: 541442 - DNA, 20 bp, Artificial Sequence
  chemically synthesized
gcaaaactaaagcagggaag

SEQ ID NO: 541443 - DNA, 20 bp, Artificial Sequence
  chemically synthesized
aatgaaggataaagtggggg

SEQ ID NO: 541444 - DNA, 20 bp, Artificial Sequence
  chemically synthesized
agtaaagatctgaaggaaat

SEQ ID NO: 541445 - DNA, 20 bp, Artificial Sequence
  chemically synthesized
aatgcagaaattaaccattg

SEQ ID NO: 541446 - DNA, 20 bp, Artificial Sequence
  chemically synthesized
aaccattgaaagaaaaatca

SEQ ID NO: 541447 - DNA, 20 bp, Artificial Sequence
  chemically synthesized
tgtatgagctagcgactacc

SEQ ID NO: 541448 - DNA, 20 bp, Artificial Sequence
  chemically synthesized
gcgactaccagagaaatatc

SEQ ID NO: 541449 - DNA, 20 bp, Artificial Sequence
  chemically synthesized
attgggggttttgaacagaa

SEQ ID NO: 541450 - DNA, 20 bp, Artificial Sequence
  chemically synthesized
attccggatacattgtaaag

SEQ ID NO: 541451 - DNA, 20 bp, Artificial Sequence
  chemically synthesized
ccaattacatgtgtgttggt

SEQ ID NO: 541452 - DNA, 20 bp, Artificial Sequence
  chemically synthesized
aaaggccttaaggataacat

SEQ ID NO: 541453 - DNA, 20 bp, Artificial Sequence
  chemically synthesized
gagttgccattaactatagt

SEQ ID NO: 541454 - DNA, 20 bp, Artificial Sequence
  chemically synthesized
ttaatctcttccaaacttgc

SEQ ID NO: 541455 - DNA, 20 bp, Artificial Sequence
  chemically synthesized
tgtctacagggttgggtttg

SEQ ID NO: 541456 - DNA, 20 bp, Artificial Sequence
  chemically synthesized
gtcaaagtttgatttaagtg

SEQ ID NO: 541457 - DNA, 20 bp, Artificial Sequence
  chemically synthesized
aggggaggtgggaaagggga

SEQ ID NO: 541458 - DNA, 20 bp, Artificial Sequence
  chemically synthesized
acaccttgatgtagccttaa

SEQ ID NO: 541459 - DNA, 20 bp, Artificial Sequence
  chemically synthesized
atcaaggtgttttggggata

SEQ ID NO: 541460 - DNA, 20 bp, Artificial Sequence
  chemically synthesized
aacagaaatcgaagaagcta

SEQ ID NO: 541461 - DNA, 20 bp, Artificial Sequence
  chemically synthesized
ggtgggattatatacacctt

SEQ ID NO: 541462 - DNA, 20 bp, Artificial Sequence
  chemically synthesized
cagagtatttatttaactag

SEQ ID NO: 541463 - DNA, 20 bp, Artificial Sequence
  chemically synthesized
atctttttttccaggaaaaa

SEQ ID NO: 541464 - DNA, 20 bp, Artificial Sequence
  chemically synthesized
tgtatcagaaggatgtgtct

SEQ ID NO: 541465 - DNA, 20 bp, Artificial Sequence
  chemically synthesized
tttgaaaacattttctgcat

SEQ ID NO: 541466 - DNA, 20 bp, Artificial Sequence
  chemically synthesized
acgctatacagtttcttgat

SEQ ID NO: 541467 - DNA, 20 bp, Artificial Sequence
  chemically synthesized
gtatagcgtagtgcttaaga

SEQ ID NO: 541468 - DNA, 20 bp, Artificial Sequence
  chemically synthesized
tattatacccatactcagat

SEQ ID NO: 541469 - DNA, 20 bp, Artificial Sequence
  chemically synthesized
atacaagttactctaagtgt

SEQ ID NO: 541470 - DNA, 20 bp, Artificial Sequence
  chemically synthesized
agaagaaagcagcacaaaaa

SEQ ID NO: 541471 - DNA, 20 bp, Artificial Sequence
  chemically synthesized
tgtaactgaaatcatgaaaa

SEQ ID NO: 541472 - DNA, 20 bp, Artificial Sequence
  chemically synthesized
ttaacattctaaaagataag

SEQ ID NO: 541473 - DNA, 20 bp, Artificial Sequence
  chemically synthesized
taatatttctttcttatctt

SEQ ID NO: 541474 - DNA, 20 bp, Artificial Sequence
  chemically synthesized
atgcttaacattctaaaaga

SEQ ID NO: 541475 - DNA, 20 bp, Artificial Sequence
  chemically synthesized
taatgtcttgtaaaagtaaa

SEQ ID NO: 541476 - DNA, 20 bp, Artificial Sequence
  chemically synthesized
ctcacagcacattagatatc

SEQ ID NO: 541477 - DNA, 20 bp, Artificial Sequence
  chemically synthesized
ctaagaaaaaagtcctttat

SEQ ID NO: 541478 - DNA, 20 bp, Artificial Sequence
  chemically synthesized
gttgatgctctgtggcatct

SEQ ID NO: 541479 - DNA, 20 bp, Artificial Sequence
  chemically synthesized
tggactagaatcattttatc

SEQ ID NO: 541480 - DNA, 20 bp, Artificial Sequence
  chemically synthesized
atttacttagtgctgatgga

SEQ ID NO: 541481 - DNA, 20 bp, Artificial Sequence
  chemically synthesized
cacatcgcctaaatcatttt

SEQ ID NO: 541482 - DNA, 20 bp, Artificial Sequence
  chemically synthesized
tcattttacagaaaatccaa

SEQ ID NO: 541483 - DNA, 20 bp, Artificial Sequence
  chemically synthesized
atgccatatattttgaacta

SEQ ID NO: 541484 - DNA, 20 bp, Artificial Sequence
  chemically synthesized
actctaagaaatttgggatc

SEQ ID NO: 541485 - DNA, 20 bp, Artificial Sequence
  chemically synthesized
actaaagcgtatcctgactc

SEQ ID NO: 541486 - DNA, 20 bp, Artificial Sequence
  chemically synthesized
tccaaagcaatacaacaatc

SEQ ID NO: 541487 - DNA, 20 bp, Artificial Sequence
  chemically synthesized
gctcatgattgcatatgtaa

SEQ ID NO: 541488 - DNA, 20 bp, Artificial Sequence
  chemically synthesized
cagtaaactattttggtaaa

SEQ ID NO: 541489 - DNA, 20 bp, Artificial Sequence
  chemically synthesized
catattgttttacacagggg

SEQ ID NO: 541490 - DNA, 20 bp, Artificial Sequence
  chemically synthesized
tacatctaaaaaaaaaaaaa

SEQ ID NO: 541491 - DNA, 20 bp, Artificial Sequence
  chemically synthesized
tctaaaaaaaaaaaaaaaag

SEQ ID NO: 541492 - DNA, 20 bp, Artificial Sequence
  chemically synthesized
aaaaaaaaaaaaaagaaaga

SEQ ID NO: 541493 - DNA, 20 bp, Artificial Sequence
  chemically synthesized
ttaatcatacgtgatttaca

SEQ ID NO: 541494 - DNA, 20 bp, Artificial Sequence
  chemically synthesized
ttaatgatatatattaatat

SEQ ID NO: 541495 - DNA, 20 bp, Artificial Sequence
  chemically synthesized
catggttacaaatttaacca

SEQ ID NO: 541496 - DNA, 20 bp, Artificial Sequence
  chemically synthesized
tcaagactccaaagcaaaaa

SEQ ID NO: 541497 - DNA, 20 bp, Artificial Sequence
  chemically synthesized
aaaatattgaaactctaagc

SEQ ID NO: 541498 - DNA, 20 bp, Artificial Sequence
  chemically synthesized
atgggttttaagttactgaa

SEQ ID NO: 541499 - DNA, 20 bp, Artificial Sequence
  chemically synthesized
aataaatcaacacatttcat

SEQ ID NO: 541500 - DNA, 20 bp, Artificial Sequence
  chemically synthesized
aaacaacaattaaaaccaag

SEQ ID NO: 541501 - DNA, 20 bp, Artificial Sequence
  chemically synthesized
cttggtaaaagttatggtac

SEQ ID NO: 541502 - DNA, 20 bp, Artificial Sequence
  chemically synthesized
ttgtatatttatcttgaggt

SEQ ID NO: 541503 - DNA, 20 bp, Artificial Sequence
  chemically synthesized
ttttataccttaaataaata

SEQ ID NO: 541504 - DNA, 20 bp, Artificial Sequence
  chemically synthesized
taaagttgaaaaatcactaa

SEQ ID NO: 541505 - DNA, 20 bp, Artificial Sequence
  chemically synthesized
atttttcaactttagggtgg

SEQ ID NO: 541506 - DNA, 20 bp, Artificial Sequence
  chemically synthesized
cagataaacccattgtaagt

SEQ ID NO: 541507 - DNA, 20 bp, Artificial Sequence
  chemically synthesized
aaggaacattctgtacaata

SEQ ID NO: 541508 - DNA, 20 bp, Artificial Sequence
  chemically synthesized
tgatcatattcttctattgt

SEQ ID NO: 541509 - DNA, 20 bp, Artificial Sequence
  chemically synthesized
gctaaaaaaactttaaaata

SEQ ID NO: 541510 - DNA, 20 bp, Artificial Sequence
  chemically synthesized
attttaaagtttttttagct

SEQ ID NO: 541511 - DNA, 20 bp, Artificial Sequence
  chemically synthesized
tcctaaaaacaaattacctt

SEQ ID NO: 541512 - DNA, 20 bp, Artificial Sequence
  chemically synthesized
cgtggaaatttataactttc

SEQ ID NO: 541513 - DNA, 20 bp, Artificial Sequence
  chemically synthesized
tcatcaaacatcccaaattc

SEQ ID NO: 541514 - DNA, 20 bp, Artificial Sequence
  chemically synthesized
tgtattggaacctgaaaagc

SEQ ID NO: 541515 - DNA, 20 bp, Artificial Sequence
  chemically synthesized
atctatatgcatataagcat

SEQ ID NO: 541516 - DNA, 20 bp, Artificial Sequence
  chemically synthesized
gcttatatgcatatagattt

SEQ ID NO: 541517 - DNA, 20 bp, Artificial Sequence
  chemically synthesized
tagtaagcgctggtactaaa

SEQ ID NO: 541518 - DNA, 20 bp, Artificial Sequence
  chemically synthesized
tacatacacacagccaccag

SEQ ID NO: 541519 - DNA, 20 bp, Artificial Sequence
  chemically synthesized
gctttaagcagttttaggta

SEQ ID NO: 541520 - DNA, 20 bp, Artificial Sequence
  chemically synthesized
gagcacataactttcatttc

SEQ ID NO: 541521 - DNA, 20 bp, Artificial Sequence
  chemically synthesized
gtttttctaatccttttttc

SEQ ID NO: 541522 - DNA, 20 bp, Artificial Sequence
  chemically synthesized
tcatttctaagaaaaaagga

SEQ ID NO: 541523 - DNA, 20 bp, Artificial Sequence
  chemically synthesized
atctatcttaaaatggaaaa

SEQ ID NO: 541524 - DNA, 20 bp, Artificial Sequence
  chemically synthesized
tggatgggatgtgaagagtg

SEQ ID NO: 541525 - DNA, 20 bp, Artificial Sequence
  chemically synthesized
acatggggacaataaaccat

SEQ ID NO: 541526 - DNA, 20 bp, Artificial Sequence
  chemically synthesized
catggtttattgtccccatg

SEQ ID NO: 541527 - DNA, 20 bp, Artificial Sequence
  chemically synthesized
gtccaaatacgtagctgtgt

SEQ ID NO: 541528 - DNA, 20 bp, Artificial Sequence
  chemically synthesized
aagacaatgcatcatcctat

SEQ ID NO: 541529 - DNA, 20 bp, Artificial Sequence
  chemically synthesized
acttacaaatcatgaggctg

SEQ ID NO: 541530 - DNA, 20 bp, Artificial Sequence
  chemically synthesized
catcgtgtaaagtgtagaaa

SEQ ID NO: 541531 - DNA, 20 bp, Artificial Sequence
  chemically synthesized
taatccccatcgtgtaaagt

SEQ ID NO: 541532 - DNA, 20 bp, Artificial Sequence
  chemically synthesized
ttatgaaaacagtgctgctg

SEQ ID NO: 541533 - DNA, 20 bp, Artificial Sequence
  chemically synthesized
ataaaataatggttggggat

SEQ ID NO: 541534 - DNA, 20 bp, Artificial Sequence
  chemically synthesized
agagatttgtataaaatata

SEQ ID NO: 541535 - DNA, 20 bp, Artificial Sequence
  chemically synthesized
cccaagtcatataagctgtt

SEQ ID NO: 541536 - DNA, 20 bp, Artificial Sequence
  chemically synthesized
tgaaaaactcaatttttcta

SEQ ID NO: 541537 - DNA, 20 bp, Artificial Sequence
  chemically synthesized
aatgtgatcagtggtttctc

SEQ ID NO: 541538 - DNA, 20 bp, Artificial Sequence
  chemically synthesized
tattaatacattgtgacttt

SEQ ID NO: 541539 - DNA, 20 bp, Artificial Sequence
  chemically synthesized
ctgttagaactattaaacta

SEQ ID NO: 541540 - DNA, 20 bp, Artificial Sequence
  chemically synthesized
aatagcaagaggcaccatat

SEQ ID NO: 541541 - DNA, 20 bp, Artificial Sequence
  chemically synthesized
attatctaattctcctaata

SEQ ID NO: 541542 - DNA, 20 bp, Artificial Sequence
  chemically synthesized
gcttttctattctggtatta

SEQ ID NO: 541543 - DNA, 20 bp, Artificial Sequence
  chemically synthesized
ctaattctcctaataccaga

SEQ ID NO: 541544 - DNA, 20 bp, Artificial Sequence
  chemically synthesized
gctgtgaaacagattccaga

SEQ ID NO: 541545 - DNA, 20 bp, Artificial Sequence
  chemically synthesized
ccctacttcaaggcaagact

SEQ ID NO: 541546 - DNA, 20 bp, Artificial Sequence
  chemically synthesized
aatcgaagactaaaatatga

SEQ ID NO: 541547 - DNA, 20 bp, Artificial Sequence
  chemically synthesized
taactcagccccaagtcggc

SEQ ID NO: 541548 - DNA, 20 bp, Artificial Sequence
  chemically synthesized
gcttaagtttctgtatgacc

SEQ ID NO: 541549 - DNA, 20 bp, Artificial Sequence
  chemically synthesized
agatatatttctctggtcat

SEQ ID NO: 541550 - DNA, 20 bp, Artificial Sequence
  chemically synthesized
tctctaatttcaaaatattt

SEQ ID NO: 541551 - DNA, 20 bp, Artificial Sequence
  chemically synthesized
cttggacttggtcggtagtg

SEQ ID NO: 541552 - DNA, 20 bp, Artificial Sequence
  chemically synthesized
agaactgtaggggaccaata

SEQ ID NO: 541553 - DNA, 20 bp, Artificial Sequence
  chemically synthesized
agatcatgccactcaactgc

SEQ ID NO: 541554 - DNA, 20 bp, Artificial Sequence
  chemically synthesized
tacaattgctctcatctcat

SEQ ID NO: 541555 - DNA, 20 bp, Artificial Sequence
  chemically synthesized
caaaacaagccagtggaagg

SEQ ID NO: 541556 - DNA, 20 bp, Artificial Sequence
  chemically synthesized
gaattgccatttcaaatagg

SEQ ID NO: 541557 - DNA, 20 bp, Artificial Sequence
  chemically synthesized
ttttgggaaaaaaaaaaaaa

SEQ ID NO: 541558 - DNA, 20 bp, Artificial Sequence
  chemically synthesized
cagaatagaagcaagcaaac

SEQ ID NO: 541559 - DNA, 20 bp, Artificial Sequence
  chemically synthesized
ttttattataacattgggag

SEQ ID NO: 541560 - DNA, 20 bp, Artificial Sequence
  chemically synthesized
tttcactgttttataagcac

SEQ ID NO: 541561 - DNA, 20 bp, Artificial Sequence
  chemically synthesized
caggttttttgcattgctct

SEQ ID NO: 541562 - DNA, 20 bp, Artificial Sequence
  chemically synthesized
atgtagattttaaataggat

SEQ ID NO: 541563 - DNA, 20 bp, Artificial Sequence
  chemically synthesized
gatgaaaaacgtggccatat

SEQ ID NO: 541564 - DNA, 20 bp, Artificial Sequence
  chemically synthesized
aggaggaaataaatggaagg

SEQ ID NO: 541565 - DNA, 20 bp, Artificial Sequence
  chemically synthesized
agaaaagaaataaaataagg

SEQ ID NO: 541566 - DNA, 20 bp, Artificial Sequence
  chemically synthesized
gagggagggagaattgaaga

SEQ ID NO: 541567 - DNA, 20 bp, Artificial Sequence
  chemically synthesized
ggaaggagggagggagaatt

SEQ ID NO: 541568 - DNA, 20 bp, Artificial Sequence
  chemically synthesized
agagtgagggaaggagggag

SEQ ID NO: 541569 - DNA, 20 bp, Artificial Sequence
  chemically synthesized
gaaggaagggaggaagtaag

SEQ ID NO: 541570 - DNA, 20 bp, Artificial Sequence
  chemically synthesized
atattattctttatggtaga

SEQ ID NO: 541571 - DNA, 20 bp, Artificial Sequence
  chemically synthesized
aagacattctgctctaccat

SEQ ID NO: 541572 - DNA, 20 bp, Artificial Sequence
  chemically synthesized
tgctttaccttttgcaataa

SEQ ID NO: 541573 - DNA, 20 bp, Artificial Sequence
  chemically synthesized
aataagaacatagcttataa

SEQ ID NO: 541574 - DNA, 20 bp, Artificial Sequence
  chemically synthesized
attccctgaatgagggagca

SEQ ID NO: 541575 - DNA, 20 bp, Artificial Sequence
  chemically synthesized
agggagcagcagaatcactt

SEQ ID NO: 541576 - DNA, 20 bp, Artificial Sequence
  chemically synthesized
ccaaaggcatgaactatttc

SEQ ID NO: 541577 - DNA, 20 bp, Artificial Sequence
  chemically synthesized
gcatttacgtagagaaattc

SEQ ID NO: 541578 - DNA, 20 bp, Artificial Sequence
  chemically synthesized
tgtgtagttagcatttacgt

SEQ ID NO: 541579 - DNA, 20 bp, Artificial Sequence
  chemically synthesized
gatggggtcttaatcctgga

SEQ ID NO: 541580 - DNA, 20 bp, Artificial Sequence
  chemically synthesized
gcttcagagttaccctaact

SEQ ID NO: 541581 - DNA, 20 bp, Artificial Sequence
  chemically synthesized
tttgaaagcttatcctaaaa

SEQ ID NO: 541582 - DNA, 20 bp, Artificial Sequence
  chemically synthesized
tcaaatatttaactctctcc

SEQ ID NO: 541583 - DNA, 20 bp, Artificial Sequence
  chemically synthesized
taatttaaaacttacgatgc

SEQ ID NO: 541584 - DNA, 20 bp, Artificial Sequence
  chemically synthesized
tctcatatgaaagcatgaac

SEQ ID NO: 541585 - DNA, 20 bp, Artificial Sequence
  chemically synthesized
attaacttgcatttcatttt

SEQ ID NO: 541586 - DNA, 20 bp, Artificial Sequence
  chemically synthesized
gacaagagtacataatttta

SEQ ID NO: 541587 - DNA, 20 bp, Artificial Sequence
  chemically synthesized
tgttaatattggctctgaag

SEQ ID NO: 541588 - DNA, 20 bp, Artificial Sequence
  chemically synthesized
aatattggctctgaagtaag

SEQ ID NO: 541589 - DNA, 20 bp, Artificial Sequence
  chemically synthesized
aaggcagagctagagaagaa

SEQ ID NO: 541590 - DNA, 20 bp, Artificial Sequence
  chemically synthesized
ctagctaaggcagagctaga

SEQ ID NO: 541591 - DNA, 20 bp, Artificial Sequence
  chemically synthesized
ctattttagttgtattttgt

SEQ ID NO: 541592 - DNA, 20 bp, Artificial Sequence
  chemically synthesized
aaataatatgtaatatgtta

SEQ ID NO: 541593 - DNA, 20 bp, Artificial Sequence
  chemically synthesized
tacctcttagcctggcatac

SEQ ID NO: 541594 - DNA, 20 bp, Artificial Sequence
  chemically synthesized
ctgccatgagaacttagtta

SEQ ID NO: 541595 - DNA, 20 bp, Artificial Sequence
  chemically synthesized
aataaaataaagctgacatg

SEQ ID NO: 541596 - DNA, 20 bp, Artificial Sequence
  chemically synthesized
acttattggtacaatgaaga

SEQ ID NO: 541597 - DNA, 20 bp, Artificial Sequence
  chemically synthesized
aaatcacttattggtacaat

SEQ ID NO: 541598 - DNA, 20 bp, Artificial Sequence
  chemically synthesized
tgatttgacttttacttcaa

SEQ ID NO: 541599 - DNA, 20 bp, Artificial Sequence
  chemically synthesized
gacttttacttcaaacagaa

SEQ ID NO: 541600 - DNA, 20 bp, Artificial Sequence
  chemically synthesized
catacaggcaaatgtgtgat

SEQ ID NO: 541601 - DNA, 20 bp, Artificial Sequence
  chemically synthesized
aagataaatgaatgtaggat

SEQ ID NO: 541602 - DNA, 20 bp, Artificial Sequence
  chemically synthesized
tcatcattatttgccttact

SEQ ID NO: 541603 - DNA, 20 bp, Artificial Sequence
  chemically synthesized
agcctttaactggcagttat

SEQ ID NO: 541604 - DNA, 20 bp, Artificial Sequence
  chemically synthesized
aacatatggaataaaattga

SEQ ID NO: 541605 - DNA, 20 bp, Artificial Sequence
  chemically synthesized
catttttacatgcagtaggg

SEQ ID NO: 541606 - DNA, 20 bp, Artificial Sequence
  chemically synthesized
tttgagagacatcctaaaat

SEQ ID NO: 541607 - DNA, 20 bp, Artificial Sequence
  chemically synthesized
ctagggtagaaagacataag

SEQ ID NO: 541608 - DNA, 20 bp, Artificial Sequence
  chemically synthesized
gttggcttcagaaatctagg

SEQ ID NO: 541609 - DNA, 20 bp, Artificial Sequence
  chemically synthesized
acttgatagtgtggttggct

SEQ ID NO: 541610 - DNA, 20 bp, Artificial Sequence
  chemically synthesized
accacactatcaagtatttt

SEQ ID NO: 541611 - DNA, 20 bp, Artificial Sequence
  chemically synthesized
tcaaataagtagaaggcaca

SEQ ID NO: 541612 - DNA, 20 bp, Artificial Sequence
  chemically synthesized
tataccagcacactgtccgt

SEQ ID NO: 541613 - DNA, 20 bp, Artificial Sequence
  chemically synthesized
tgtagattcaattgtcagct

SEQ ID NO: 541614 - DNA, 20 bp, Artificial Sequence
  chemically synthesized
taattatatacctacttttt

SEQ ID NO: 541615 - DNA, 20 bp, Artificial Sequence
  chemically synthesized
taaggagagtagttttatcc

SEQ ID NO: 541616 - DNA, 20 bp, Artificial Sequence
  chemically synthesized
atgccagttgcaaattagaa

SEQ ID NO: 541617 - DNA, 20 bp, Artificial Sequence
  chemically synthesized
ttttaaatgccagttgcaaa

SEQ ID NO: 541618 - DNA, 20 bp, Artificial Sequence
  chemically synthesized
tatctagatttccaggaaaa

SEQ ID NO: 541619 - DNA, 20 bp, Artificial Sequence
  chemically synthesized
acaaaaacaggagctaatgt

SEQ ID NO: 541620 - DNA, 20 bp, Artificial Sequence
  chemically synthesized
tttatattttaaaaagaact

SEQ ID NO: 541621 - DNA, 20 bp, Artificial Sequence
  chemically synthesized
gtctagcacttggatcccag

SEQ ID NO: 541622 - DNA, 20 bp, Artificial Sequence
  chemically synthesized
gatccaagtgctagacatga

SEQ ID NO: 541623 - DNA, 20 bp, Artificial Sequence
  chemically synthesized
tatttattttttgctcttat

SEQ ID NO: 541624 - DNA, 20 bp, Artificial Sequence
  chemically synthesized
atactacttggcaggcaaat

SEQ ID NO: 541625 - DNA, 20 bp, Artificial Sequence
  chemically synthesized
tgggagaataatttcaatta

SEQ ID NO: 541626 - DNA, 20 bp, Artificial Sequence
  chemically synthesized
aattctagacaaagttattg

SEQ ID NO: 541627 - DNA, 20 bp, Artificial Sequence
  chemically synthesized
tattctcccaataactttgt

SEQ ID NO: 541628 - DNA, 20 bp, Artificial Sequence
  chemically synthesized
gagtatgaaaatcctaggtc

SEQ ID NO: 541629 - DNA, 20 bp, Artificial Sequence
  chemically synthesized
acttcattttttatatcatg

SEQ ID NO: 541630 - DNA, 20 bp, Artificial Sequence
  chemically synthesized
aagtagatgagatatctaaa

SEQ ID NO: 541631 - DNA, 20 bp, Artificial Sequence
  chemically synthesized
acttgtgatatagcaaattc

SEQ ID NO: 541632 - DNA, 20 bp, Artificial Sequence
  chemically synthesized
aatatccttttaaatgtaaa

SEQ ID NO: 541633 - DNA, 20 bp, Artificial Sequence
  chemically synthesized
catttacatttaaaaggata

SEQ ID NO: 541634 - DNA, 20 bp, Artificial Sequence
  chemically synthesized
cagagtttgataaataaaat

SEQ ID NO: 541635 - DNA, 20 bp, Artificial Sequence
  chemically synthesized
tcagaatttaacagatttct

SEQ ID NO: 541636 - DNA, 20 bp, Artificial Sequence
  chemically synthesized
tagtgaaattaagaatttct

SEQ ID NO: 541637 - DNA, 20 bp, Artificial Sequence
  chemically synthesized
ttatgatgaaatagtgaaat

SEQ ID NO: 541638 - DNA, 20 bp, Artificial Sequence
  chemically synthesized
ataagcattttacacattta

SEQ ID NO: 541639 - DNA, 20 bp, Artificial Sequence
  chemically synthesized
tttcactgacacattaaaca

SEQ ID NO: 541640 - DNA, 20 bp, Artificial Sequence
  chemically synthesized
gttatagcaactaacgtgaa

SEQ ID NO: 541641 - DNA, 20 bp, Artificial Sequence
  chemically synthesized
gcaccattaaataagtatta

SEQ ID NO: 541642 - DNA, 20 bp, Artificial Sequence
  chemically synthesized
gtttaatcaagggagttgtt

SEQ ID NO: 541643 - DNA, 20 bp, Artificial Sequence
  chemically synthesized
tggacatatcttgaaaatat

SEQ ID NO: 541644 - DNA, 20 bp, Artificial Sequence
  chemically synthesized
ttaacaaaagcagtgggaat

SEQ ID NO: 541645 - DNA, 20 bp, Artificial Sequence
  chemically synthesized
gtcctcatcactttttctta

SEQ ID NO: 541646 - DNA, 20 bp, Artificial Sequence
  chemically synthesized
tcttagaattatttttcttt

SEQ ID NO: 541647 - DNA, 20 bp, Artificial Sequence
  chemically synthesized
agaaaatagataaaaacatc

SEQ ID NO: 541648 - DNA, 20 bp, Artificial Sequence
  chemically synthesized
aactacatatcaaagaagaa

SEQ ID NO: 541649 - DNA, 20 bp, Artificial Sequence
  chemically synthesized
tgagaaaactacatatcaaa

SEQ ID NO: 541650 - DNA, 20 bp, Artificial Sequence
  chemically synthesized
caaatgaaagtaatgaagac

SEQ ID NO: 541651 - DNA, 20 bp, Artificial Sequence
  chemically synthesized
taattgtggattatagccag

SEQ ID NO: 541652 - DNA, 20 bp, Artificial Sequence
  chemically synthesized
gctgtatggtcaaatataat

SEQ ID NO: 541653 - DNA, 20 bp, Artificial Sequence
  chemically synthesized
ttttgactattttggtattt

SEQ ID NO: 541654 - DNA, 20 bp, Artificial Sequence
  chemically synthesized
ccactagccagactaataaa

SEQ ID NO: 541655 - DNA, 20 bp, Artificial Sequence
  chemically synthesized
ccagactaataaagaagaaa

SEQ ID NO: 541656 - DNA, 20 bp, Artificial Sequence
  chemically synthesized
ctaataaagaagaaaagaga

SEQ ID NO: 541657 - DNA, 20 bp, Artificial Sequence
  chemically synthesized
gggatatcaccaccgatccc

SEQ ID NO: 541658 - DNA, 20 bp, Artificial Sequence
  chemically synthesized
cagaaatacaaactaccatc

SEQ ID NO: 541659 - DNA, 20 bp, Artificial Sequence
  chemically synthesized
aacacctctacgcaaataaa

SEQ ID NO: 541660 - DNA, 20 bp, Artificial Sequence
  chemically synthesized
acgcaaataaactagaaaat

SEQ ID NO: 541661 - DNA, 20 bp, Artificial Sequence
  chemically synthesized
agctcctctttgtatctctg

SEQ ID NO: 541662 - DNA, 20 bp, Artificial Sequence
  chemically synthesized
aaactattccaagcaataca

SEQ ID NO: 541663 - DNA, 20 bp, Artificial Sequence
  chemically synthesized
gcctcataaaaagagttagg

SEQ ID NO: 541664 - DNA, 20 bp, Artificial Sequence
  chemically synthesized
cctggcaaagacacaacaaa

SEQ ID NO: 541665 - DNA, 20 bp, Artificial Sequence
  chemically synthesized
acatgattatctcaatagat

SEQ ID NO: 541666 - DNA, 20 bp, Artificial Sequence
  chemically synthesized
ctggccagggcaatcaggca

SEQ ID NO: 541667 - DNA, 20 bp, Artificial Sequence
  chemically synthesized
ccagggcaatcaggcaagag

SEQ ID NO: 541668 - DNA, 20 bp, Artificial Sequence
  chemically synthesized
ggcaatcaggcaagagaaag

SEQ ID NO: 541669 - DNA, 20 bp, Artificial Sequence
  chemically synthesized
cagatgacatgattgtatat

SEQ ID NO: 541670 - DNA, 20 bp, Artificial Sequence
  chemically synthesized
cccattaaaaattgctacaa

SEQ ID NO: 541671 - DNA, 20 bp, Artificial Sequence
  chemically synthesized
cattccatgcttatggaaag

SEQ ID NO: 541672 - DNA, 20 bp, Artificial Sequence
  chemically synthesized
agctaccattgactttcttc

SEQ ID NO: 541673 - DNA, 20 bp, Artificial Sequence
  chemically synthesized
gtagtttgttctaattctgt

SEQ ID NO: 541674 - DNA, 20 bp, Artificial Sequence
  chemically synthesized
caaaaaagggcccatatagc

SEQ ID NO: 541675 - DNA, 20 bp, Artificial Sequence
  chemically synthesized
atagccaagaaaatcctaag

SEQ ID NO: 541676 - DNA, 20 bp, Artificial Sequence
  chemically synthesized
aacggaacagaacagaggcc

SEQ ID NO: 541677 - DNA, 20 bp, Artificial Sequence
  chemically synthesized
ggaaaactggctggccatat

SEQ ID NO: 541678 - DNA, 20 bp, Artificial Sequence
  chemically synthesized
gttaatttttgtataaggtg

SEQ ID NO: 541679 - DNA, 20 bp, Artificial Sequence
  chemically synthesized
ctgaaaccataaaaactcta

SEQ ID NO: 541680 - DNA, 20 bp, Artificial Sequence
  chemically synthesized
tgagagtcaacaggcaacct

SEQ ID NO: 541681 - DNA, 20 bp, Artificial Sequence
  chemically synthesized
aacaggcaacctacagaatg

SEQ ID NO: 541682 - DNA, 20 bp, Artificial Sequence
  chemically synthesized
atctgacaaagggctattat

SEQ ID NO: 541683 - DNA, 20 bp, Artificial Sequence
  chemically synthesized
aaggaacttaaacaaattta

SEQ ID NO: 541684 - DNA, 20 bp, Artificial Sequence
  chemically synthesized
acaagaaaaaaaagacccca

SEQ ID NO: 541685 - DNA, 20 bp, Artificial Sequence
  chemically synthesized
atttacgcggccaacaaaca

SEQ ID NO: 541686 - DNA, 20 bp, Artificial Sequence
  chemically synthesized
cctcatcatcactggtcatt

SEQ ID NO: 541687 - DNA, 20 bp, Artificial Sequence
  chemically synthesized
gagatagcatctcacaccag

SEQ ID NO: 541688 - DNA, 20 bp, Artificial Sequence
  chemically synthesized
actgatgctggagaagatgt

SEQ ID NO: 541689 - DNA, 20 bp, Artificial Sequence
  chemically synthesized
gattcctcaaggatctagaa

SEQ ID NO: 541690 - DNA, 20 bp, Artificial Sequence
  chemically synthesized
gcagcactgttcacaatagc

SEQ ID NO: 541691 - DNA, 20 bp, Artificial Sequence
  chemically synthesized
ccaccagtgatagactggat

SEQ ID NO: 541692 - DNA, 20 bp, Artificial Sequence
  chemically synthesized
ggacactatgcagccataaa

SEQ ID NO: 541693 - DNA, 20 bp, Artificial Sequence
  chemically synthesized
ttgcaggaacatggatgaaa

SEQ ID NO: 541694 - DNA, 20 bp, Artificial Sequence
  chemically synthesized
ctgttcctgtgttagtttgc

SEQ ID NO: 541695 - DNA, 20 bp, Artificial Sequence
  chemically synthesized
ctcagcaaactaacacagga

SEQ ID NO: 541696 - DNA, 20 bp, Artificial Sequence
  chemically synthesized
caaggggagggatagcatta

SEQ ID NO: 541697 - DNA, 20 bp, Artificial Sequence
  chemically synthesized
ttaagtataattaaaaaaaa

SEQ ID NO: 541698 - DNA, 20 bp, Artificial Sequence
  chemically synthesized
aaaataaaaattagattcac

SEQ ID NO: 541699 - DNA, 20 bp, Artificial Sequence
  chemically synthesized
taataattcgtgctctcaga

SEQ ID NO: 541700 - DNA, 20 bp, Artificial Sequence
  chemically synthesized
tggatcttatttgctgagac

SEQ ID NO: 541701 - DNA, 20 bp, Artificial Sequence
  chemically synthesized
atagtcctaaaccagggctt

SEQ ID NO: 541702 - DNA, 20 bp, Artificial Sequence
  chemically synthesized
ggtttttagtttaatgttct

SEQ ID NO: 541703 - DNA, 20 bp, Artificial Sequence
  chemically synthesized
accattttcacctatctttc

SEQ ID NO: 541704 - DNA, 20 bp, Artificial Sequence
  chemically synthesized
agagagtaaaaggatgatta

SEQ ID NO: 541705 - DNA, 20 bp, Artificial Sequence
  chemically synthesized
ctgtacaagagttcaatttt

SEQ ID NO: 541706 - DNA, 20 bp, Artificial Sequence
  chemically synthesized
aatgatttctagaaccagat

SEQ ID NO: 541707 - DNA, 20 bp, Artificial Sequence
  chemically synthesized
ttgtaattctgtatctggtt

SEQ ID NO: 541708 - DNA, 20 bp, Artificial Sequence
  chemically synthesized
acctgatcgaaatactctta

SEQ ID NO: 541709 - DNA, 20 bp, Artificial Sequence
  chemically synthesized
ttagccattgaactgcaggt

SEQ ID NO: 541710 - DNA, 20 bp, Artificial Sequence
  chemically synthesized
gaacacattttctagaacac

SEQ ID NO: 541711 - DNA, 20 bp, Artificial Sequence
  chemically synthesized
ttttaatatttctaagtgtt

SEQ ID NO: 541712 - DNA, 20 bp, Artificial Sequence
  chemically synthesized
ttattgattatgttcaacca

SEQ ID NO: 541713 - DNA, 20 bp, Artificial Sequence
  chemically synthesized
aaaaggtatagtttattact

SEQ ID NO: 541714 - DNA, 20 bp, Artificial Sequence
  chemically synthesized
ttactttagaaaaatctgaa

SEQ ID NO: 541715 - DNA, 20 bp, Artificial Sequence
  chemically synthesized
ttaattatcagtagttgagg

SEQ ID NO: 541716 - DNA, 20 bp, Artificial Sequence
  chemically synthesized
ctaatttatctttataatgg

SEQ ID NO: 541717 - DNA, 20 bp, Artificial Sequence
  chemically synthesized
ctttccattataaagataaa

SEQ ID NO: 541718 - DNA, 20 bp, Artificial Sequence
  chemically synthesized
taattgtaatgagaagcatc

SEQ ID NO: 541719 - DNA, 20 bp, Artificial Sequence
  chemically synthesized
gtggtacagatcagctgact

SEQ ID NO: 541720 - DNA, 20 bp, Artificial Sequence
  chemically synthesized
gttgatcctgtgaactttct

SEQ ID NO: 541721 - DNA, 20 bp, Artificial Sequence
  chemically synthesized
cctgtgaactttcttgagaa

SEQ ID NO: 541722 - DNA, 20 bp, Artificial Sequence
  chemically synthesized
tttggaatatttctatttct

SEQ ID NO: 541723 - DNA, 20 bp, Artificial Sequence
  chemically synthesized
ggaaactgtgaactcatttt

SEQ ID NO: 541724 - DNA, 20 bp, Artificial Sequence
  chemically synthesized
acttaataacacggaatttt

SEQ ID NO: 541725 - DNA, 20 bp, Artificial Sequence
  chemically synthesized
tatcagattgctataataaa

SEQ ID NO: 541726 - DNA, 20 bp, Artificial Sequence
  chemically synthesized
ttttttgtaattttcatata

SEQ ID NO: 541727 - DNA, 20 bp, Artificial Sequence
  chemically synthesized
ttttcatatacaagaaacta

SEQ ID NO: 541728 - DNA, 20 bp, Artificial Sequence
  chemically synthesized
acagtcatgcgaatctataa

SEQ ID NO: 541729 - DNA, 20 bp, Artificial Sequence
  chemically synthesized
ttatttaaaaatcagtgtaa

SEQ ID NO: 541730 - DNA, 20 bp, Artificial Sequence
  chemically synthesized
acctggattttgcataaaga

SEQ ID NO: 541731 - DNA, 20 bp, Artificial Sequence
  chemically synthesized
ttaaaaatgaaaataaacac

SEQ ID NO: 541732 - DNA, 20 bp, Artificial Sequence
  chemically synthesized
tttttaaccatatatacccc

SEQ ID NO: 541733 - DNA, 20 bp, Artificial Sequence
  chemically synthesized
gaatatactagcctcatttt

SEQ ID NO: 541734 - DNA, 20 bp, Artificial Sequence
  chemically synthesized
tttcacatatctttttgttt

SEQ ID NO: 541735 - DNA, 20 bp, Artificial Sequence
  chemically synthesized
tagaaacaaaaagatatgtg

SEQ ID NO: 541736 - DNA, 20 bp, Artificial Sequence
  chemically synthesized
cctgtgcctatttacacagc

SEQ ID NO: 541737 - DNA, 20 bp, Artificial Sequence
  chemically synthesized
aaacaaattttatgtaatga

SEQ ID NO: 541738 - DNA, 20 bp, Artificial Sequence
  chemically synthesized
cctttgcagttatggccctt

SEQ ID NO: 541739 - DNA, 20 bp, Artificial Sequence
  chemically synthesized
gtaacctcaatgcatttaaa

SEQ ID NO: 541740 - DNA, 20 bp, Artificial Sequence
  chemically synthesized
catttatgagttatgaggtc

SEQ ID NO: 541741 - DNA, 20 bp, Artificial Sequence
  chemically synthesized
atgaggtcaaagaaactcaa

SEQ ID NO: 541742 - DNA, 20 bp, Artificial Sequence
  chemically synthesized
tttaaataatccataatatt

SEQ ID NO: 541743 - DNA, 20 bp, Artificial Sequence
  chemically synthesized
tcttagccccacaagtcttc

SEQ ID NO: 541744 - DNA, 20 bp, Artificial Sequence
  chemically synthesized
atgcctattataattgtcca

SEQ ID NO: 541745 - DNA, 20 bp, Artificial Sequence
  chemically synthesized
acagacaaaacgaagtactg

SEQ ID NO: 541746 - DNA, 20 bp, Artificial Sequence
  chemically synthesized
tgttttagtcaagtcactgg

SEQ ID NO: 541747 - DNA, 20 bp, Artificial Sequence
  chemically synthesized
catattggttatgaccgtgc

SEQ ID NO: 541748 - DNA, 20 bp, Artificial Sequence
  chemically synthesized
aaaaaaagggcctgtccatc

SEQ ID NO: 541749 - DNA, 20 bp, Artificial Sequence
  chemically synthesized
gtccatctcagaataattat

SEQ ID NO: 541750 - DNA, 20 bp, Artificial Sequence
  chemically synthesized
aatttaccccctttgtttaa

SEQ ID NO: 541751 - DNA, 20 bp, Artificial Sequence
  chemically synthesized
aatagtcaaggtaaaatatg

SEQ ID NO: 541752 - DNA, 20 bp, Artificial Sequence
  chemically synthesized
atattatttattttctaaag

SEQ ID NO: 541753 - DNA, 20 bp, Artificial Sequence
  chemically synthesized
tttaaaaattaattctaact

SEQ ID NO: 541754 - DNA, 20 bp, Artificial Sequence
  chemically synthesized
aaatttcatggtgtagaaag

SEQ ID NO: 541755 - DNA, 20 bp, Artificial Sequence
  chemically synthesized
aattaggtaaatttcatggt

SEQ ID NO: 541756 - DNA, 20 bp, Artificial Sequence
  chemically synthesized
gcatttttatacagattttc

SEQ ID NO: 541757 - DNA, 20 bp, Artificial Sequence
  chemically synthesized
taagtatggcctgtgagaga

SEQ ID NO: 541758 - DNA, 20 bp, Artificial Sequence
  chemically synthesized
tatggcctgtgagagaagag

SEQ ID NO: 541759 - DNA, 20 bp, Artificial Sequence
  chemically synthesized
taatttatatttaggaatat

SEQ ID NO: 541760 - DNA, 20 bp, Artificial Sequence
  chemically synthesized
taaagattgcattataaaat

SEQ ID NO: 541761 - DNA, 20 bp, Artificial Sequence
  chemically synthesized
tagctaatgtgctatgaatt

SEQ ID NO: 541762 - DNA, 20 bp, Artificial Sequence
  chemically synthesized
gtgtgaaaataaaagtaaca

SEQ ID NO: 541763 - DNA, 20 bp, Artificial Sequence
  chemically synthesized
tgtcaacttgagtagatttt

SEQ ID NO: 541764 - DNA, 20 bp, Artificial Sequence
  chemically synthesized
aggggtgtgacaaatgtaat

SEQ ID NO: 541765 - DNA, 20 bp, Artificial Sequence
  chemically synthesized
tattacatttgtcacacccc

SEQ ID NO: 541766 - DNA, 20 bp, Artificial Sequence
  chemically synthesized
tcaaggaagtattctcttca

SEQ ID NO: 541767 - DNA, 20 bp, Artificial Sequence
  chemically synthesized
atcactcgcatttctaatga

SEQ ID NO: 541768 - DNA, 20 bp, Artificial Sequence
  chemically synthesized
gtcattagctacacttgacg

SEQ ID NO: 541769 - DNA, 20 bp, Artificial Sequence
  chemically synthesized
tatagaacattgccatcatc

SEQ ID NO: 541770 - DNA, 20 bp, Artificial Sequence
  chemically synthesized
ctataggacagtgctaatct

SEQ ID NO: 541771 - DNA, 20 bp, Artificial Sequence
  chemically synthesized
aatgacaatacattttattt

SEQ ID NO: 541772 - DNA, 20 bp, Artificial Sequence
  chemically synthesized
gccctttggacagagactga

SEQ ID NO: 541773 - DNA, 20 bp, Artificial Sequence
  chemically synthesized
cttgtatgattgccattata

SEQ ID NO: 541774 - DNA, 20 bp, Artificial Sequence
  chemically synthesized
cttttataatggcaatcata

SEQ ID NO: 541775 - DNA, 20 bp, Artificial Sequence
  chemically synthesized
tataatggcaatcatacaag

SEQ ID NO: 541776 - DNA, 20 bp, Artificial Sequence
  chemically synthesized
attttaataagcaatttgaa

SEQ ID NO: 541777 - DNA, 20 bp, Artificial Sequence
  chemically synthesized
tgatagatataataccagca

SEQ ID NO: 541778 - DNA, 20 bp, Artificial Sequence
  chemically synthesized
taatgctggtattatatcta

SEQ ID NO: 541779 - DNA, 20 bp, Artificial Sequence
  chemically synthesized
ttcagtaaaatcaattggat

SEQ ID NO: 541780 - DNA, 20 bp, Artificial Sequence
  chemically synthesized
tgcaaatacagacacacaaa

SEQ ID NO: 541781 - DNA, 20 bp, Artificial Sequence
  chemically synthesized
gacacacaaaatagaaatgt

SEQ ID NO: 541782 - DNA, 20 bp, Artificial Sequence
  chemically synthesized
tggactcagttcaaagtgaa

SEQ ID NO: 541783 - DNA, 20 bp, Artificial Sequence
  chemically synthesized
caactaactgctacaattta

SEQ ID NO: 541784 - DNA, 20 bp, Artificial Sequence
  chemically synthesized
aaaaaaaattgcaggtgaag

SEQ ID NO: 541785 - DNA, 20 bp, Artificial Sequence
  chemically synthesized
gtatcttggcacgatctgag

SEQ ID NO: 541786 - DNA, 20 bp, Artificial Sequence
  chemically synthesized
ttttctctcatgcctaagtc

SEQ ID NO: 541787 - DNA, 20 bp, Artificial Sequence
  chemically synthesized
cattctttgacttaggcatg

SEQ ID NO: 541788 - DNA, 20 bp, Artificial Sequence
  chemically synthesized
cagaagacacaaggggctgg

SEQ ID NO: 541789 - DNA, 20 bp, Artificial Sequence
  chemically synthesized
tacatttaataaaaataaaa

SEQ ID NO: 541790 - DNA, 20 bp, Artificial Sequence
  chemically synthesized
taaaaggttaacattagagc

SEQ ID NO: 541791 - DNA, 20 bp, Artificial Sequence
  chemically synthesized
tttaaataacaatagacaac

SEQ ID NO: 541792 - DNA, 20 bp, Artificial Sequence
  chemically synthesized
aacaatagacaacttagaaa

SEQ ID NO: 541793 - DNA, 20 bp, Artificial Sequence
  chemically synthesized
atatcacaatttaaagacaa

SEQ ID NO: 541794 - DNA, 20 bp, Artificial Sequence
  chemically synthesized
ctattaagcaatgataagta

SEQ ID NO: 541795 - DNA, 20 bp, Artificial Sequence
  chemically synthesized
agcaatgataagtaccagaa

SEQ ID NO: 541796 - DNA, 20 bp, Artificial Sequence
  chemically synthesized
taataattaaaacaatcata

SEQ ID NO: 541797 - DNA, 20 bp, Artificial Sequence
  chemically synthesized
aaacgttacccaagtgcaaa

SEQ ID NO: 541798 - DNA, 20 bp, Artificial Sequence
  chemically synthesized
aataataaacagggacacat

SEQ ID NO: 541799 - DNA, 20 bp, Artificial Sequence
  chemically synthesized
tctgtcccatctattgaagt

SEQ ID NO: 541800 - DNA, 20 bp, Artificial Sequence
  chemically synthesized
gacagcaactttagagtttg

SEQ ID NO: 541801 - DNA, 20 bp, Artificial Sequence
  chemically synthesized
gcaactttagagtttgagag

SEQ ID NO: 541802 - DNA, 20 bp, Artificial Sequence
  chemically synthesized
acaaataaatgatacttgga

SEQ ID NO: 541803 - DNA, 20 bp, Artificial Sequence
  chemically synthesized
tagcttgaagatagttgaaa

SEQ ID NO: 541804 - DNA, 20 bp, Artificial Sequence
  chemically synthesized
aaaaaaagaggagagatatt

SEQ ID NO: 541805 - DNA, 20 bp, Artificial Sequence
  chemically synthesized
tttaatttggttggaacaca

SEQ ID NO: 541806 - DNA, 20 bp, Artificial Sequence
  chemically synthesized
agcattttgatatcaaaatt

SEQ ID NO: 541807 - DNA, 20 bp, Artificial Sequence
  chemically synthesized
taataaagatttcaaaacaa

SEQ ID NO: 541808 - DNA, 20 bp, Artificial Sequence
  chemically synthesized
tcaaaggcaaaatcctttaa

SEQ ID NO: 541809 - DNA, 20 bp, Artificial Sequence
  chemically synthesized
tttaattttggcgcaacact

SEQ ID NO: 541810 - DNA, 20 bp, Artificial Sequence
  chemically synthesized
taagatcaagcacgtattgg

SEQ ID NO: 541811 - DNA, 20 bp, Artificial Sequence
  chemically synthesized
gggtacggacatacagttgc

SEQ ID NO: 541812 - DNA, 20 bp, Artificial Sequence
  chemically synthesized
tgtaatattttgctacatgc

SEQ ID NO: 541813 - DNA, 20 bp, Artificial Sequence
  chemically synthesized
ctccatctataggctgttta

SEQ ID NO: 541814 - DNA, 20 bp, Artificial Sequence
  chemically synthesized
aatgctgcgttaatggtgat

SEQ ID NO: 541815 - DNA, 20 bp, Artificial Sequence
  chemically synthesized
tttttaaaaagtgaaagtca

SEQ ID NO: 541816 - DNA, 20 bp, Artificial Sequence
  chemically synthesized
aatgctgcgttaatggtgat

SEQ ID NO: 541817 - DNA, 20 bp, Artificial Sequence
  chemically synthesized
tctagtaatttttaccttat

SEQ ID NO: 541818 - DNA, 20 bp, Artificial Sequence
  chemically synthesized
tctacataaggtaaaaatta

SEQ ID NO: 541819 - DNA, 20 bp, Artificial Sequence
  chemically synthesized
caaaaaatacaaataaaaaa

SEQ ID NO: 541820 - DNA, 20 bp, Artificial Sequence
  chemically synthesized
tttgatgtcccaagtaaata

SEQ ID NO: 541821 - DNA, 20 bp, Artificial Sequence
  chemically synthesized
gaaacttttaaaagcatcaa

SEQ ID NO: 541822 - DNA, 20 bp, Artificial Sequence
  chemically synthesized
tctggattattatattttga

SEQ ID NO: 541823 - DNA, 20 bp, Artificial Sequence
  chemically synthesized
tctaatcaaaatataataat

SEQ ID NO: 541824 - DNA, 20 bp, Artificial Sequence
  chemically synthesized
tataataatccagaaatgta

SEQ ID NO: 541825 - DNA, 20 bp, Artificial Sequence
  chemically synthesized
tccagaaatgtagaagaata

SEQ ID NO: 541826 - DNA, 20 bp, Artificial Sequence
  chemically synthesized
tcatcatctaagactttcac

SEQ ID NO: 541827 - DNA, 20 bp, Artificial Sequence
  chemically synthesized
attttaaatataacagtcaa

SEQ ID NO: 541828 - DNA, 20 bp, Artificial Sequence
  chemically synthesized
tgttatatttaaaataatac

SEQ ID NO: 541829 - DNA, 20 bp, Artificial Sequence
  chemically synthesized
ctatatatactattcattgg

SEQ ID NO: 541830 - DNA, 20 bp, Artificial Sequence
  chemically synthesized
cttcagtgagggaggaatca

SEQ ID NO: 541831 - DNA, 20 bp, Artificial Sequence
  chemically synthesized
gagggaggaatcagcagaat

SEQ ID NO: 541832 - DNA, 20 bp, Artificial Sequence
  chemically synthesized
actaagacaaaattcagaag

SEQ ID NO: 541833 - DNA, 20 bp, Artificial Sequence
  chemically synthesized
tgctgttgcccatgaagtaa

SEQ ID NO: 541834 - DNA, 20 bp, Artificial Sequence
  chemically synthesized
aattaaataagtatcactaa

SEQ ID NO: 541835 - DNA, 20 bp, Artificial Sequence
  chemically synthesized
aagtgacttcaaatacatgg

SEQ ID NO: 541836 - DNA, 20 bp, Artificial Sequence
  chemically synthesized
tgtgcatatttcaaagaaga

SEQ ID NO: 541837 - DNA, 20 bp, Artificial Sequence
  chemically synthesized
attgttgtgcatatttcaaa

SEQ ID NO: 541838 - DNA, 20 bp, Artificial Sequence
  chemically synthesized
taggaactcgactaaaagat

SEQ ID NO: 541839 - DNA, 20 bp, Artificial Sequence
  chemically synthesized
caactctggaggttgaggca

SEQ ID NO: 541840 - DNA, 20 bp, Artificial Sequence
  chemically synthesized
ctccagcctgggtgacaggg

SEQ ID NO: 541841 - DNA, 20 bp, Artificial Sequence
  chemically synthesized
aaaagagataattaagttta

SEQ ID NO: 541842 - DNA, 20 bp, Artificial Sequence
  chemically synthesized
aataaagtgccactgtgtgt

SEQ ID NO: 541843 - DNA, 20 bp, Artificial Sequence
  chemically synthesized
aaaatatggtaatagtcact

SEQ ID NO: 541844 - DNA, 20 bp, Artificial Sequence
  chemically synthesized
attgagcgtaatctttggta

SEQ ID NO: 541845 - DNA, 20 bp, Artificial Sequence
  chemically synthesized
aaattcacaaaacttttaaa

SEQ ID NO: 541846 - DNA, 20 bp, Artificial Sequence
  chemically synthesized
acagagaacaagctatttta

SEQ ID NO: 541847 - DNA, 20 bp, Artificial Sequence
  chemically synthesized
ataaaattgttctattctgt

SEQ ID NO: 541848 - DNA, 20 bp, Artificial Sequence
  chemically synthesized
aaaacttgtaaattttctgg

SEQ ID NO: 541849 - DNA, 20 bp, Artificial Sequence
  chemically synthesized
tccttgtaaaagcagctaca

SEQ ID NO: 541850 - DNA, 20 bp, Artificial Sequence
  chemically synthesized
ttttcacttctcaaaacttt

SEQ ID NO: 541851 - DNA, 20 bp, Artificial Sequence
  chemically synthesized
cattttagttaattattatt

SEQ ID NO: 541852 - DNA, 20 bp, Artificial Sequence
  chemically synthesized
cattatgatcactgggaaat

SEQ ID NO: 541853 - DNA, 20 bp, Artificial Sequence
  chemically synthesized
tgtttacaattatgaaaagg

SEQ ID NO: 541854 - DNA, 20 bp, Artificial Sequence
  chemically synthesized
aggatgaaaatatttataca

SEQ ID NO: 541855 - DNA, 20 bp, Artificial Sequence
  chemically synthesized
gacaaaatacacaaaaaaga

SEQ ID NO: 541856 - DNA, 20 bp, Artificial Sequence
  chemically synthesized
cacatgtgacaaaataaatt

SEQ ID NO: 541857 - DNA, 20 bp, Artificial Sequence
  chemically synthesized
ttgaagtttcagaatgagga

SEQ ID NO: 541858 - DNA, 20 bp, Artificial Sequence
  chemically synthesized
tatattggttgcttgaagtt

SEQ ID NO: 541859 - DNA, 20 bp, Artificial Sequence
  chemically synthesized
tgaaacttcaagcaaccaat

SEQ ID NO: 541860 - DNA, 20 bp, Artificial Sequence
  chemically synthesized
ttttgttacaatgtccttta

SEQ ID NO: 541861 - DNA, 20 bp, Artificial Sequence
  chemically synthesized
aggacattgtaacaaaatga

SEQ ID NO: 541862 - DNA, 20 bp, Artificial Sequence
  chemically synthesized
cattgtaacaaaatgagaag

SEQ ID NO: 541863 - DNA, 20 bp, Artificial Sequence
  chemically synthesized
aacaaaatgagaagaaagaa

SEQ ID NO: 541864 - DNA, 20 bp, Artificial Sequence
  chemically synthesized
tgttgaaacccataattttg

SEQ ID NO: 541865 - DNA, 20 bp, Artificial Sequence
  chemically synthesized
taaagcaaagttttttaatg

SEQ ID NO: 541866 - DNA, 20 bp, Artificial Sequence
  chemically synthesized
ttttcaatggtccataagga

SEQ ID NO: 541867 - DNA, 20 bp, Artificial Sequence
  chemically synthesized
gggaaacagtgactaacaag

SEQ ID NO: 541868 - DNA, 20 bp, Artificial Sequence
  chemically synthesized
ttataatttgtctgctatca

SEQ ID NO: 541869 - DNA, 20 bp, Artificial Sequence
  chemically synthesized
tctagagcatgatggtaagg

SEQ ID NO: 541870 - DNA, 20 bp, Artificial Sequence
  chemically synthesized
ggagaccagcaaggaaatat

SEQ ID NO: 541871 - DNA, 20 bp, Artificial Sequence
  chemically synthesized
actcgagtgtatctacgaag

SEQ ID NO: 541872 - DNA, 20 bp, Artificial Sequence
  chemically synthesized
cacccagatagtctattaac

SEQ ID NO: 541873 - DNA, 20 bp, Artificial Sequence
  chemically synthesized
cagtgcatgggcacttctcg

SEQ ID NO: 541874 - DNA, 20 bp, Artificial Sequence
  chemically synthesized
aagtgcccatgcactgatat

SEQ ID NO: 541875 - DNA, 20 bp, Artificial Sequence
  chemically synthesized
atagcatatggtgctaaatt

SEQ ID NO: 541876 - DNA, 20 bp, Artificial Sequence
  chemically synthesized
ttaaataaagggtaaaaatg

SEQ ID NO: 541877 - DNA, 20 bp, Artificial Sequence
  chemically synthesized
ctggatcataaaggagggca

SEQ ID NO: 541878 - DNA, 20 bp, Artificial Sequence
  chemically synthesized
tagattttattcatctgttc

SEQ ID NO: 541879 - DNA, 20 bp, Artificial Sequence
  chemically synthesized
gagagtcttaagtaatcatt

SEQ ID NO: 541880 - DNA, 20 bp, Artificial Sequence
  chemically synthesized
cttaagtaatcattgaagaa

SEQ ID NO: 541881 - DNA, 20 bp, Artificial Sequence
  chemically synthesized
tttcaaagcaaatttagatt

SEQ ID NO: 541882 - DNA, 20 bp, Artificial Sequence
  chemically synthesized
acaatgaagaaaaaaaagaa

SEQ ID NO: 541883 - DNA, 20 bp, Artificial Sequence
  chemically synthesized
ataaatataactcatacaat

SEQ ID NO: 541884 - DNA, 20 bp, Artificial Sequence
  chemically synthesized
agataaatgtttattcaatg

SEQ ID NO: 541885 - DNA, 20 bp, Artificial Sequence
  chemically synthesized
tccatacacttagtgtgagt

SEQ ID NO: 541886 - DNA, 20 bp, Artificial Sequence
  chemically synthesized
ttaaaaatgaacaaaaaaag

SEQ ID NO: 541887 - DNA, 20 bp, Artificial Sequence
  chemically synthesized
cgatcactacccccatcatc

SEQ ID NO: 541888 - DNA, 20 bp, Artificial Sequence
  chemically synthesized
ggaatgactgtaacatcagt

SEQ ID NO: 541889 - DNA, 20 bp, Artificial Sequence
  chemically synthesized
tgtaatcatttccactatgc

SEQ ID NO: 541890 - DNA, 20 bp, Artificial Sequence
  chemically synthesized
atctatgattaatatatttt

SEQ ID NO: 541891 - DNA, 20 bp, Artificial Sequence
  chemically synthesized
ttttgcagtcaatatttcct

SEQ ID NO: 541892 - DNA, 20 bp, Artificial Sequence
  chemically synthesized
atgtgctaaatttccacttg

SEQ ID NO: 541893 - DNA, 20 bp, Artificial Sequence
  chemically synthesized
gtcaaatatattaataaaca

SEQ ID NO: 541894 - DNA, 20 bp, Artificial Sequence
  chemically synthesized
tagcacgttaaataaaaata

SEQ ID NO: 541895 - DNA, 20 bp, Artificial Sequence
  chemically synthesized
ggtaaatttgcttaaactta

SEQ ID NO: 541896 - DNA, 20 bp, Artificial Sequence
  chemically synthesized
attgaattcatcaagggtag

SEQ ID NO: 541897 - DNA, 20 bp, Artificial Sequence
  chemically synthesized
agttaaagcaaataatccaa

SEQ ID NO: 541898 - DNA, 20 bp, Artificial Sequence
  chemically synthesized
tataaaattcttaacacgca

SEQ ID NO: 541899 - DNA, 20 bp, Artificial Sequence
  chemically synthesized
gcaaaatttcttgtgcgtgt

SEQ ID NO: 541900 - DNA, 20 bp, Artificial Sequence
  chemically synthesized
agttttcattctaagcacta

SEQ ID NO: 541901 - DNA, 20 bp, Artificial Sequence
  chemically synthesized
ttttaagattctcttagtgc

SEQ ID NO: 541902 - DNA, 20 bp, Artificial Sequence
  chemically synthesized
ttcctggtcatgcactttat

SEQ ID NO: 541903 - DNA, 20 bp, Artificial Sequence
  chemically synthesized
gtgtggtgtatgtgcacaca

SEQ ID NO: 541904 - DNA, 20 bp, Artificial Sequence
  chemically synthesized
ttttgagtaaagaagttaag

SEQ ID NO: 541905 - DNA, 20 bp, Artificial Sequence
  chemically synthesized
agaaacgaaaagagccacat

SEQ ID NO: 541906 - DNA, 20 bp, Artificial Sequence
  chemically synthesized
gtattgtgtagagataggct

SEQ ID NO: 541907 - DNA, 20 bp, Artificial Sequence
  chemically synthesized
caccgttctttcaaattttc

SEQ ID NO: 541908 - DNA, 20 bp, Artificial Sequence
  chemically synthesized
ttccactgcatttgagggga

SEQ ID NO: 541909 - DNA, 20 bp, Artificial Sequence
  chemically synthesized
atgaaaacagcaagacatat

SEQ ID NO: 541910 - DNA, 20 bp, Artificial Sequence
  chemically synthesized
taggtactacctatggaaac

SEQ ID NO: 541911 - DNA, 20 bp, Artificial Sequence
  chemically synthesized
tggaaactgagaaacaatac

SEQ ID NO: 541912 - DNA, 20 bp, Artificial Sequence
  chemically synthesized
atgaaagtgtctattaaaaa

SEQ ID NO: 541913 - DNA, 20 bp, Artificial Sequence
  chemically synthesized
tgcaaaagaaaatgatgtgc

SEQ ID NO: 541914 - DNA, 20 bp, Artificial Sequence
  chemically synthesized
gatggaagatttaagctgca

SEQ ID NO: 541915 - DNA, 20 bp, Artificial Sequence
  chemically synthesized
tcaagattggtctttaagca

SEQ ID NO: 541916 - DNA, 20 bp, Artificial Sequence
  chemically synthesized
ataaagatcttttcagacac

SEQ ID NO: 541917 - DNA, 20 bp, Artificial Sequence
  chemically synthesized
gaacctagaattgtgtactg

SEQ ID NO: 541918 - DNA, 20 bp, Artificial Sequence
  chemically synthesized
aagaacatccacgtaggaac

SEQ ID NO: 541919 - DNA, 20 bp, Artificial Sequence
  chemically synthesized
atgatagaagccagaagacg

SEQ ID NO: 541920 - DNA, 20 bp, Artificial Sequence
  chemically synthesized
ttaaatactgctgtatttcc

SEQ ID NO: 541921 - DNA, 20 bp, Artificial Sequence
  chemically synthesized
ctgatgaatccaaaaaaagc

SEQ ID NO: 541922 - DNA, 20 bp, Artificial Sequence
  chemically synthesized
gcagaaaagattattaaaaa

SEQ ID NO: 541923 - DNA, 20 bp, Artificial Sequence
  chemically synthesized
ggaaactgagcaaatctgaa

SEQ ID NO: 541924 - DNA, 20 bp, Artificial Sequence
  chemically synthesized
cttaggattttcaaaactta

SEQ ID NO: 541925 - DNA, 20 bp, Artificial Sequence
  chemically synthesized
ttttaaaaattatattttat

SEQ ID NO: 541926 - DNA, 20 bp, Artificial Sequence
  chemically synthesized
tgttcagcgagtatcagctt

SEQ ID NO: 541927 - DNA, 20 bp, Artificial Sequence
  chemically synthesized
ccactatgatcatcaacaat

SEQ ID NO: 541928 - DNA, 20 bp, Artificial Sequence
  chemically synthesized
aacatattacaaggattaaa

SEQ ID NO: 541929 - DNA, 20 bp, Artificial Sequence
  chemically synthesized
attacaaaattgagctgaga

SEQ ID NO: 541930 - DNA, 20 bp, Artificial Sequence
  chemically synthesized
gcaccaggatgtagctgttt

SEQ ID NO: 541931 - DNA, 20 bp, Artificial Sequence
  chemically synthesized
aagaacattctgtctctaaa

SEQ ID NO: 541932 - DNA, 20 bp, Artificial Sequence
  chemically synthesized
aatgattttcttatttagag

SEQ ID NO: 541933 - DNA, 20 bp, Artificial Sequence
  chemically synthesized
gctgccagtgcaacatcctt

SEQ ID NO: 541934 - DNA, 20 bp, Artificial Sequence
  chemically synthesized
tgttgttatttcaaggcaaa

SEQ ID NO: 541935 - DNA, 20 bp, Artificial Sequence
  chemically synthesized
gtaataaaagcaactcattt

SEQ ID NO: 541936 - DNA, 20 bp, Artificial Sequence
  chemically synthesized
taaatttaagcagagatgta

SEQ ID NO: 541937 - DNA, 20 bp, Artificial Sequence
  chemically synthesized
taaggaaatcccaaacaaca

SEQ ID NO: 541938 - DNA, 20 bp, Artificial Sequence
  chemically synthesized
tgttcttcccatttttttct

SEQ ID NO: 541939 - DNA, 20 bp, Artificial Sequence
  chemically synthesized
tggtgaaataagaatattct

SEQ ID NO: 541940 - DNA, 20 bp, Artificial Sequence
  chemically synthesized
ttatttgagtgatggtgaaa

SEQ ID NO: 541941 - DNA, 20 bp, Artificial Sequence
  chemically synthesized
ttatttcaccatcactcaaa

SEQ ID NO: 541942 - DNA, 20 bp, Artificial Sequence
  chemically synthesized
ttcacatctagacagttgca

SEQ ID NO: 541943 - DNA, 20 bp, Artificial Sequence
  chemically synthesized
ctgtctagatgtgaaagtct

SEQ ID NO: 541944 - DNA, 20 bp, Artificial Sequence
  chemically synthesized
ctatagaatctaaccccttc

SEQ ID NO: 541945 - DNA, 20 bp, Artificial Sequence
  chemically synthesized
ccattagcatatcaaacgca

SEQ ID NO: 541946 - DNA, 20 bp, Artificial Sequence
  chemically synthesized
gatttgtccaaggatacatc

SEQ ID NO: 541947 - DNA, 20 bp, Artificial Sequence
  chemically synthesized
ttttctttgtcattttactg

SEQ ID NO: 541948 - DNA, 20 bp, Artificial Sequence
  chemically synthesized
ttttcttacagtaaaatgac

SEQ ID NO: 541949 - DNA, 20 bp, Artificial Sequence
  chemically synthesized
aacagattgagaccccgcct

SEQ ID NO: 541950 - DNA, 20 bp, Artificial Sequence
  chemically synthesized
gcttctcagaggctgaggca

SEQ ID NO: 541951 - DNA, 20 bp, Artificial Sequence
  chemically synthesized
tacatgctcttggaaggctg

SEQ ID NO: 541952 - DNA, 20 bp, Artificial Sequence
  chemically synthesized
tacttctagaagtaaccgta

SEQ ID NO: 541953 - DNA, 20 bp, Artificial Sequence
  chemically synthesized
gggaatataaaacatttata

SEQ ID NO: 541954 - DNA, 20 bp, Artificial Sequence
  chemically synthesized
tctaatggaatatttttcac

SEQ ID NO: 541955 - DNA, 20 bp, Artificial Sequence
  chemically synthesized
tctaggtgaaaaatattcca

SEQ ID NO: 541956 - DNA, 20 bp, Artificial Sequence
  chemically synthesized
gaaattggttgtgtttaagt

SEQ ID NO: 541957 - DNA, 20 bp, Artificial Sequence
  chemically synthesized
tggttgtgtttaagtataga

SEQ ID NO: 541958 - DNA, 20 bp, Artificial Sequence
  chemically synthesized
ggagctctctgccttcacca

SEQ ID NO: 541959 - DNA, 20 bp, Artificial Sequence
  chemically synthesized
ataatttacatggtaatgta

SEQ ID NO: 541960 - DNA, 20 bp, Artificial Sequence
  chemically synthesized
ttacatggtaatgtaagaga

SEQ ID NO: 541961 - DNA, 20 bp, Artificial Sequence
  chemically synthesized
tgcactattatttacttaag

SEQ ID NO: 541962 - DNA, 20 bp, Artificial Sequence
  chemically synthesized
cagctcaagtggaaatgtat

SEQ ID NO: 541963 - DNA, 20 bp, Artificial Sequence
  chemically synthesized
aagcccacttcagtgaagaa

SEQ ID NO: 541964 - DNA, 20 bp, Artificial Sequence
  chemically synthesized
aaaaaaaagcccacttcagt

SEQ ID NO: 541965 - DNA, 20 bp, Artificial Sequence
  chemically synthesized
gtttagcacttttttgctat

SEQ ID NO: 541966 - DNA, 20 bp, Artificial Sequence
  chemically synthesized
gactgatcctgtgtaaagag

SEQ ID NO: 541967 - DNA, 20 bp, Artificial Sequence
  chemically synthesized
aaggaaaacacagaatacta

SEQ ID NO: 541968 - DNA, 20 bp, Artificial Sequence
  chemically synthesized
tcagtgccaccaaggaaaac

SEQ ID NO: 541969 - DNA, 20 bp, Artificial Sequence
  chemically synthesized
taataaatgttcttatttac

SEQ ID NO: 541970 - DNA, 20 bp, Artificial Sequence
  chemically synthesized
ttttagcaaaaatctataga

SEQ ID NO: 541971 - DNA, 20 bp, Artificial Sequence
  chemically synthesized
agtttcacctgaacaaaaac

SEQ ID NO: 541972 - DNA, 20 bp, Artificial Sequence
  chemically synthesized
ggtgaaactagctgtatgtc

SEQ ID NO: 541973 - DNA, 20 bp, Artificial Sequence
  chemically synthesized
ataccaggtaaaacatgatt

SEQ ID NO: 541974 - DNA, 20 bp, Artificial Sequence
  chemically synthesized
ttaaatggatttttttccag

SEQ ID NO: 541975 - DNA, 20 bp, Artificial Sequence
  chemically synthesized
taaaaggagaatgtatacct

SEQ ID NO: 541976 - DNA, 20 bp, Artificial Sequence
  chemically synthesized
tcagatgccaaacgttaaaa

SEQ ID NO: 541977 - DNA, 20 bp, Artificial Sequence
  chemically synthesized
cacacaaatctgatgactgc

SEQ ID NO: 541978 - DNA, 20 bp, Artificial Sequence
  chemically synthesized
tgtgtttattctgtgaatct

SEQ ID NO: 541979 - DNA, 20 bp, Artificial Sequence
  chemically synthesized
agatacttttctctagattc

SEQ ID NO: 541980 - DNA, 20 bp, Artificial Sequence
  chemically synthesized
aaagtatctgcttatatatt

SEQ ID NO: 541981 - DNA, 20 bp, Artificial Sequence
  chemically synthesized
aatattttcataagtcatta

SEQ ID NO: 541982 - DNA, 20 bp, Artificial Sequence
  chemically synthesized
tttccaatgttaatatatat

SEQ ID NO: 541983 - DNA, 20 bp, Artificial Sequence
  chemically synthesized
tatatatacagaaaggagac

SEQ ID NO: 541984 - DNA, 20 bp, Artificial Sequence
  chemically synthesized
aatattaccttatttaatcc

SEQ ID NO: 541985 - DNA, 20 bp, Artificial Sequence
  chemically synthesized
ctaatatatttcctgttggt

SEQ ID NO: 541986 - DNA, 20 bp, Artificial Sequence
  chemically synthesized
ctaaaccaacaggaaatata

SEQ ID NO: 541987 - DNA, 20 bp, Artificial Sequence
  chemically synthesized
agggcaaacctggagatgat

SEQ ID NO: 541988 - DNA, 20 bp, Artificial Sequence
  chemically synthesized
atatatggtagtaataaagc

SEQ ID NO: 541989 - DNA, 20 bp, Artificial Sequence
  chemically synthesized
tttaagcctacagtttatat

SEQ ID NO: 541990 - DNA, 20 bp, Artificial Sequence
  chemically synthesized
aaaatcaaacaattagagaa

SEQ ID NO: 541991 - DNA, 20 bp, Artificial Sequence
  chemically synthesized
aaggagaatatagggggagg

SEQ ID NO: 541992 - DNA, 20 bp, Artificial Sequence
  chemically synthesized
atgcagcatatgccatagct

SEQ ID NO: 541993 - DNA, 20 bp, Artificial Sequence
  chemically synthesized
tcacaaatgactctagggcg

SEQ ID NO: 541994 - DNA, 20 bp, Artificial Sequence
  chemically synthesized
agatagatagacaggtgggt

SEQ ID NO: 541995 - DNA, 20 bp, Artificial Sequence
  chemically synthesized
aaagtaatcacaatctgtat

SEQ ID NO: 541996 - DNA, 20 bp, Artificial Sequence
  chemically synthesized
atatattaaagatccaaaat

SEQ ID NO: 541997 - DNA, 20 bp, Artificial Sequence
  chemically synthesized
gatctttaatatataaaact

SEQ ID NO: 541998 - DNA, 20 bp, Artificial Sequence
  chemically synthesized
gtttatgaggaaaatatatc

SEQ ID NO: 541999 - DNA, 20 bp, Artificial Sequence
  chemically synthesized
gacctggggaaaattggaat

SEQ ID NO: 542000 - DNA, 20 bp, Artificial Sequence
  chemically synthesized
attgaggtgaaactatttta

SEQ ID NO: 542001 - DNA, 20 bp, Artificial Sequence
  chemically synthesized
cgaaagattaaggcaatcaa

SEQ ID NO: 542002 - DNA, 20 bp, Artificial Sequence
  chemically synthesized
tctgagcaattggaagaata

SEQ ID NO: 542003 - DNA, 20 bp, Artificial Sequence
  chemically synthesized
tctcgtattcttccaattgc

SEQ ID NO: 542004 - DNA, 20 bp, Artificial Sequence
  chemically synthesized
tgaattattctgagcaattg

SEQ ID NO: 542005 - DNA, 20 bp, Artificial Sequence
  chemically synthesized
actttagggtattagattta

SEQ ID NO: 542006 - DNA, 20 bp, Artificial Sequence
  chemically synthesized
tgtgacttcttttaatactt

SEQ ID NO: 542007 - DNA, 20 bp, Artificial Sequence
  chemically synthesized
gatcatcatctgtaattata

SEQ ID NO: 542008 - DNA, 20 bp, Artificial Sequence
  chemically synthesized
taggaacaaaaatgtacctg

SEQ ID NO: 542009 - DNA, 20 bp, Artificial Sequence
  chemically synthesized
tctctctttaaaaaggcgat

SEQ ID NO: 542010 - DNA, 20 bp, Artificial Sequence
  chemically synthesized
agccattatctcattgactt

SEQ ID NO: 542011 - DNA, 20 bp, Artificial Sequence
  chemically synthesized
attatttatcatgtatacat

SEQ ID NO: 542012 - DNA, 20 bp, Artificial Sequence
  chemically synthesized
aattttgccaattaaagaca

SEQ ID NO: 542013 - DNA, 20 bp, Artificial Sequence
  chemically synthesized
gtgagggaaaccactcactt

SEQ ID NO: 542014 - DNA, 20 bp, Artificial Sequence
  chemically synthesized
attgatcgggaattgcagaa

SEQ ID NO: 542015 - DNA, 20 bp, Artificial Sequence
  chemically synthesized
caatttcaatatttacttaa

SEQ ID NO: 542016 - DNA, 20 bp, Artificial Sequence
  chemically synthesized
acaccagaggaatttagaag

SEQ ID NO: 542017 - DNA, 20 bp, Artificial Sequence
  chemically synthesized
caagacaccagaggaattta

SEQ ID NO: 542018 - DNA, 20 bp, Artificial Sequence
  chemically synthesized
atttattagggaccgtccac

SEQ ID NO: 542019 - DNA, 20 bp, Artificial Sequence
  chemically synthesized
aaaggtttgaggaactcaac

SEQ ID NO: 542020 - DNA, 20 bp, Artificial Sequence
  chemically synthesized
ataaaaagtgtaaaataata

SEQ ID NO: 542021 - DNA, 20 bp, Artificial Sequence
  chemically synthesized
caaagtcaattacaatttta

SEQ ID NO: 542022 - DNA, 20 bp, Artificial Sequence
  chemically synthesized
ttagactatgtaaagtgatt

SEQ ID NO: 542023 - DNA, 20 bp, Artificial Sequence
  chemically synthesized
tcaaatcaaagagaacgtta

SEQ ID NO: 542024 - DNA, 20 bp, Artificial Sequence
  chemically synthesized
aaaataaaggtaatgttgtt

SEQ ID NO: 542025 - DNA, 20 bp, Artificial Sequence
  chemically synthesized
tcttgtactgataccactga

SEQ ID NO: 542026 - DNA, 20 bp, Artificial Sequence
  chemically synthesized
ctcaaagaagaaaaaaggct

SEQ ID NO: 542027 - DNA, 20 bp, Artificial Sequence
  chemically synthesized
acaggatttgaggtctcaaa

SEQ ID NO: 542028 - DNA, 20 bp, Artificial Sequence
  chemically synthesized
gggacccatgtataggaagc

SEQ ID NO: 542029 - DNA, 20 bp, Artificial Sequence
  chemically synthesized
aagcaagtttgaacatgcta

SEQ ID NO: 542030 - DNA, 20 bp, Artificial Sequence
  chemically synthesized
caaggctaaagatatacatt

SEQ ID NO: 542031 - DNA, 20 bp, Artificial Sequence
  chemically synthesized
accaatatacattcatgttt

SEQ ID NO: 542032 - DNA, 20 bp, Artificial Sequence
  chemically synthesized
aggccattaatattttatga

SEQ ID NO: 542033 - DNA, 20 bp, Artificial Sequence
  chemically synthesized
aaacaattaactatttgaaa

SEQ ID NO: 542034 - DNA, 20 bp, Artificial Sequence
  chemically synthesized
ctcaatatcttctgtgatta

SEQ ID NO: 542035 - DNA, 20 bp, Artificial Sequence
  chemically synthesized
tgcatgcagctttcatttct

SEQ ID NO: 542036 - DNA, 20 bp, Artificial Sequence
  chemically synthesized
aaccctaattgctactttct

SEQ ID NO: 542037 - DNA, 20 bp, Artificial Sequence
  chemically synthesized
tttccaatggaatgaaattt

SEQ ID NO: 542038 - DNA, 20 bp, Artificial Sequence
  chemically synthesized
tctaaaatatttcataagga

SEQ ID NO: 542039 - DNA, 20 bp, Artificial Sequence
  chemically synthesized
tcacttatagcctgtatttg

SEQ ID NO: 542040 - DNA, 20 bp, Artificial Sequence
  chemically synthesized
cataactcacatctttgcca

SEQ ID NO: 542041 - DNA, 20 bp, Artificial Sequence
  chemically synthesized
tggtcatctggcattcctct

SEQ ID NO: 542042 - DNA, 20 bp, Artificial Sequence
  chemically synthesized
aaaagcacaccataatgtgt

SEQ ID NO: 542043 - DNA, 20 bp, Artificial Sequence
  chemically synthesized
actgctgataaatatagtaa

SEQ ID NO: 542044 - DNA, 20 bp, Artificial Sequence
  chemically synthesized
gtcaaccaaataaacactgc

SEQ ID NO: 542045 - DNA, 20 bp, Artificial Sequence
  chemically synthesized
ctgctttctacatgcaaata

SEQ ID NO: 542046 - DNA, 20 bp, Artificial Sequence
  chemically synthesized
ttttattctcttatttgcat

SEQ ID NO: 542047 - DNA, 20 bp, Artificial Sequence
  chemically synthesized
aagctcagcaattaaaagta

SEQ ID NO: 542048 - DNA, 20 bp, Artificial Sequence
  chemically synthesized
agaacttcctagatattatt

SEQ ID NO: 542049 - DNA, 20 bp, Artificial Sequence
  chemically synthesized
ttaaaactttattatgcctt

SEQ ID NO: 542050 - DNA, 20 bp, Artificial Sequence
  chemically synthesized
taaagttttaaaaataaata

SEQ ID NO: 542051 - DNA, 20 bp, Artificial Sequence
  chemically synthesized
gcaagcaaaatcaattaagt

SEQ ID NO: 542052 - DNA, 20 bp, Artificial Sequence
  chemically synthesized
gaaaaaaacctgcctaactg

SEQ ID NO: 542053 - DNA, 20 bp, Artificial Sequence
  chemically synthesized
gctgataaaaataaagcaca

SEQ ID NO: 542054 - DNA, 20 bp, Artificial Sequence
  chemically synthesized
tcccatctttcaattactac

SEQ ID NO: 542055 - DNA, 20 bp, Artificial Sequence
  chemically synthesized
aaataaagcatacacattga

SEQ ID NO: 542056 - DNA, 20 bp, Artificial Sequence
  chemically synthesized
atctgcttcagacttagtca

SEQ ID NO: 542057 - DNA, 20 bp, Artificial Sequence
  chemically synthesized
acaacaaagaatcacagatg

SEQ ID NO: 542058 - DNA, 20 bp, Artificial Sequence
  chemically synthesized
aagaggagacaacttacaac

SEQ ID NO: 542059 - DNA, 20 bp, Artificial Sequence
  chemically synthesized
aagacaatgagggtactgta

SEQ ID NO: 542060 - DNA, 20 bp, Artificial Sequence
  chemically synthesized
actgtacttgttgtttttga

SEQ ID NO: 542061 - DNA, 20 bp, Artificial Sequence
  chemically synthesized
aacctcaagtaccaaatgta

SEQ ID NO: 542062 - DNA, 20 bp, Artificial Sequence
  chemically synthesized
acacatttttaggggcacct

SEQ ID NO: 542063 - DNA, 20 bp, Artificial Sequence
  chemically synthesized
gaactacactaaaaaagcca

SEQ ID NO: 542064 - DNA, 20 bp, Artificial Sequence
  chemically synthesized
ttggcttttttagtgtagtt

SEQ ID NO: 542065 - DNA, 20 bp, Artificial Sequence
  chemically synthesized
gttctagaaattaaaacatt

SEQ ID NO: 542066 - DNA, 20 bp, Artificial Sequence
  chemically synthesized
taatattgagcatttaggtt

SEQ ID NO: 542067 - DNA, 20 bp, Artificial Sequence
  chemically synthesized
ctaaatgctcaatattaata

SEQ ID NO: 542068 - DNA, 20 bp, Artificial Sequence
  chemically synthesized
acatgcatatatgacatatt

SEQ ID NO: 542069 - DNA, 20 bp, Artificial Sequence
  chemically synthesized
aatatcttaattttctttac

SEQ ID NO: 542070 - DNA, 20 bp, Artificial Sequence
  chemically synthesized
aaaacattttatttctaagt

SEQ ID NO: 542071 - DNA, 20 bp, Artificial Sequence
  chemically synthesized
ttcacattctgagttgaaag

SEQ ID NO: 542072 - DNA, 20 bp, Artificial Sequence
  chemically synthesized
ttagttttctttctttcaac

SEQ ID NO: 542073 - DNA, 20 bp, Artificial Sequence
  chemically synthesized
agttttcacattctgagttg

SEQ ID NO: 542074 - DNA, 20 bp, Artificial Sequence
  chemically synthesized
cagagactggtcaataatct

SEQ ID NO: 542075 - DNA, 20 bp, Artificial Sequence
  chemically synthesized
tgttgtttttgtcctcagcc

SEQ ID NO: 542076 - DNA, 20 bp, Artificial Sequence
  chemically synthesized
aatctctacttcaggtcaaa

SEQ ID NO: 542077 - DNA, 20 bp, Artificial Sequence
  chemically synthesized
gcactggtaattgtaaaggt

SEQ ID NO: 542078 - DNA, 20 bp, Artificial Sequence
  chemically synthesized
ttgtgaaaaggaggatgaag

SEQ ID NO: 542079 - DNA, 20 bp, Artificial Sequence
  chemically synthesized
tgtacaaatattcaagccag

SEQ ID NO: 542080 - DNA, 20 bp, Artificial Sequence
  chemically synthesized
tgaaattagttgggattgaa

SEQ ID NO: 542081 - DNA, 20 bp, Artificial Sequence
  chemically synthesized
catgtgtgctcttcccaacc

SEQ ID NO: 542082 - DNA, 20 bp, Artificial Sequence
  chemically synthesized
gctgcttatttcatgggagt

SEQ ID NO: 542083 - DNA, 20 bp, Artificial Sequence
  chemically synthesized
taacatttatttcaatgaag

SEQ ID NO: 542084 - DNA, 20 bp, Artificial Sequence
  chemically synthesized
ttcaaaagtaggtcaggtca

SEQ ID NO: 542085 - DNA, 20 bp, Artificial Sequence
  chemically synthesized
gaaaattgctgggctattta

SEQ ID NO: 542086 - DNA, 20 bp, Artificial Sequence
  chemically synthesized
cagcatttgtaataaaaggc

SEQ ID NO: 542087 - DNA, 20 bp, Artificial Sequence
  chemically synthesized
ttctaatgaattttataaat

SEQ ID NO: 542088 - DNA, 20 bp, Artificial Sequence
  chemically synthesized
ttctgcatttataaaattca

SEQ ID NO: 542089 - DNA, 20 bp, Artificial Sequence
  chemically synthesized
taaatcaaaattacttttta

SEQ ID NO: 542090 - DNA, 20 bp, Artificial Sequence
  chemically synthesized
tttattagaaacataaacca

SEQ ID NO: 542091 - DNA, 20 bp, Artificial Sequence
  chemically synthesized
gtacctgaggatgcaaataa

SEQ ID NO: 542092 - DNA, 20 bp, Artificial Sequence
  chemically synthesized
aaataaggtcaaatttgact

SEQ ID NO: 542093 - DNA, 20 bp, Artificial Sequence
  chemically synthesized
tttacccaaatgtatttata

SEQ ID NO: 542094 - DNA, 20 bp, Artificial Sequence
  chemically synthesized
atttgggtaaatatgtctca

SEQ ID NO: 542095 - DNA, 20 bp, Artificial Sequence
  chemically synthesized
tcaagtaacagtaacctcag

SEQ ID NO: 542096 - DNA, 20 bp, Artificial Sequence
  chemically synthesized
cagtaacctcaggtagaaat

SEQ ID NO: 542097 - DNA, 20 bp, Artificial Sequence
  chemically synthesized
gcagaattgtcatcttatcc

SEQ ID NO: 542098 - DNA, 20 bp, Artificial Sequence
  chemically synthesized
gaacctaatatatttcacat

SEQ ID NO: 542099 - DNA, 20 bp, Artificial Sequence
  chemically synthesized
gtcattatcagttcaaaagt

SEQ ID NO: 542100 - DNA, 20 bp, Artificial Sequence
  chemically synthesized
tgaactgataatgaccagtc

SEQ ID NO: 542101 - DNA, 20 bp, Artificial Sequence
  chemically synthesized
ctccttttcaagggttttgt

SEQ ID NO: 542102 - DNA, 20 bp, Artificial Sequence
  chemically synthesized
agtatcaatgtattttatta

SEQ ID NO: 542103 - DNA, 20 bp, Artificial Sequence
  chemically synthesized
atgttctagtgttttaatgg

SEQ ID NO: 542104 - DNA, 20 bp, Artificial Sequence
  chemically synthesized
tgaaaacccatagatgacat

SEQ ID NO: 542105 - DNA, 20 bp, Artificial Sequence
  chemically synthesized
agtaaaatgttttagctctg

SEQ ID NO: 542106 - DNA, 20 bp, Artificial Sequence
  chemically synthesized
gaacaatacggataagtgta

SEQ ID NO: 542107 - DNA, 20 bp, Artificial Sequence
  chemically synthesized
tgagaatcatgtcatcatga

SEQ ID NO: 542108 - DNA, 20 bp, Artificial Sequence
  chemically synthesized
gtggttattcatgttgcata

SEQ ID NO: 542109 - DNA, 20 bp, Artificial Sequence
  chemically synthesized
agtaaaaagattaacaaccc

SEQ ID NO: 542110 - DNA, 20 bp, Artificial Sequence
  chemically synthesized
cataaaaaattgttaaattc

SEQ ID NO: 542111 - DNA, 20 bp, Artificial Sequence
  chemically synthesized
gttttacgcctgaatgactg

SEQ ID NO: 542112 - DNA, 20 bp, Artificial Sequence
  chemically synthesized
agcaaataaatagcataatg

SEQ ID NO: 542113 - DNA, 20 bp, Artificial Sequence
  chemically synthesized
cctgcatctattgagtataa

SEQ ID NO: 542114 - DNA, 20 bp, Artificial Sequence
  chemically synthesized
ttatgcctccttcaatgacc

SEQ ID NO: 542115 - DNA, 20 bp, Artificial Sequence
  chemically synthesized
tcatcttatctccatgttat

SEQ ID NO: 542116 - DNA, 20 bp, Artificial Sequence
  chemically synthesized
tattactaagatcaaatatg

SEQ ID NO: 542117 - DNA, 20 bp, Artificial Sequence
  chemically synthesized
gatggacacatagaagtttg

SEQ ID NO: 542118 - DNA, 20 bp, Artificial Sequence
  chemically synthesized
taatcaggaattatttggag

SEQ ID NO: 542119 - DNA, 20 bp, Artificial Sequence
  chemically synthesized
aaatgactgtaggttgaaca

SEQ ID NO: 542120 - DNA, 20 bp, Artificial Sequence
  chemically synthesized
ttatgaatatttactatgta

SEQ ID NO: 542121 - DNA, 20 bp, Artificial Sequence
  chemically synthesized
ttaaataacacaatttctat

SEQ ID NO: 542122 - DNA, 20 bp, Artificial Sequence
  chemically synthesized
aggtcttttgacatttctac

SEQ ID NO: 542123 - DNA, 20 bp, Artificial Sequence
  chemically synthesized
tttaaaaaaattaggaagat

SEQ ID NO: 542124 - DNA, 20 bp, Artificial Sequence
  chemically synthesized
actgtaaggttataaaattt

SEQ ID NO: 542125 - DNA, 20 bp, Artificial Sequence
  chemically synthesized
ttttatagtagtgcagctca

SEQ ID NO: 542126 - DNA, 20 bp, Artificial Sequence
  chemically synthesized
tttgttttttactatggcaa

SEQ ID NO: 542127 - DNA, 20 bp, Artificial Sequence
  chemically synthesized
aaaatatgtgtgggttttga

SEQ ID NO: 542128 - DNA, 20 bp, Artificial Sequence
  chemically synthesized
ccacatgtggccactgagct

SEQ ID NO: 542129 - DNA, 20 bp, Artificial Sequence
  chemically synthesized
gcaagataataagaccgacg

SEQ ID NO: 542130 - DNA, 20 bp, Artificial Sequence
  chemically synthesized
tgagatacacataaatgaga

SEQ ID NO: 542131 - DNA, 20 bp, Artificial Sequence
  chemically synthesized
caagctgagatacacataaa

SEQ ID NO: 542132 - DNA, 20 bp, Artificial Sequence
  chemically synthesized
taatattatattcctgtcta

SEQ ID NO: 542133 - DNA, 20 bp, Artificial Sequence
  chemically synthesized
atgctgaactagtgaactct

SEQ ID NO: 542134 - DNA, 20 bp, Artificial Sequence
  chemically synthesized
taggctatgcccattctaaa

SEQ ID NO: 542135 - DNA, 20 bp, Artificial Sequence
  chemically synthesized
gtgggaaagtgttttctgtt

SEQ ID NO: 542136 - DNA, 20 bp, Artificial Sequence
  chemically synthesized
ggaagaccaaggaatgacat

SEQ ID NO: 542137 - DNA, 20 bp, Artificial Sequence
  chemically synthesized
gtttcctttataaagttgca

SEQ ID NO: 542138 - DNA, 20 bp, Artificial Sequence
  chemically synthesized
tttataaaggaaacatgtaa

SEQ ID NO: 542139 - DNA, 20 bp, Artificial Sequence
  chemically synthesized
tgttttaaaatttggtgact

SEQ ID NO: 542140 - DNA, 20 bp, Artificial Sequence
  chemically synthesized
tatcatgcctgcttttcaat

SEQ ID NO: 542141 - DNA, 20 bp, Artificial Sequence
  chemically synthesized
acaaaataggttttagttat

SEQ ID NO: 542142 - DNA, 20 bp, Artificial Sequence
  chemically synthesized
acaaaagttataatattgca

SEQ ID NO: 542143 - DNA, 20 bp, Artificial Sequence
  chemically synthesized
tggacacataaagaagagac

SEQ ID NO: 542144 - DNA, 20 bp, Artificial Sequence
  chemically synthesized
taaagaagagacagagaaac

SEQ ID NO: 542145 - DNA, 20 bp, Artificial Sequence
  chemically synthesized
ttaacaaaggataacagact

SEQ ID NO: 542146 - DNA, 20 bp, Artificial Sequence
  chemically synthesized
ataaataaattttcaaagct

SEQ ID NO: 542147 - DNA, 20 bp, Artificial Sequence
  chemically synthesized
tttatcattacaatattgat

SEQ ID NO: 542148 - DNA, 20 bp, Artificial Sequence
  chemically synthesized
caatattgatatagaaaaat

SEQ ID NO: 542149 - DNA, 20 bp, Artificial Sequence
  chemically synthesized
gacaagtaacacactatagt

SEQ ID NO: 542150 - DNA, 20 bp, Artificial Sequence
  chemically synthesized
taagttcttttcctctacag

SEQ ID NO: 542151 - DNA, 20 bp, Artificial Sequence
  chemically synthesized
aagatactacatctatgcta

SEQ ID NO: 542152 - DNA, 20 bp, Artificial Sequence
  chemically synthesized
gctctaataattttaaaata

SEQ ID NO: 542153 - DNA, 20 bp, Artificial Sequence
  chemically synthesized
tttaaaattattagagcaaa

SEQ ID NO: 542154 - DNA, 20 bp, Artificial Sequence
  chemically synthesized
ttagagcaaacaagaaaatg

SEQ ID NO: 542155 - DNA, 20 bp, Artificial Sequence
  chemically synthesized
tttcattggttgcattcttt

SEQ ID NO: 542156 - DNA, 20 bp, Artificial Sequence
  chemically synthesized
cagtactttatctattctca

SEQ ID NO: 542157 - DNA, 20 bp, Artificial Sequence
  chemically synthesized
tgcaaaatatattcgtgggt

SEQ ID NO: 542158 - DNA, 20 bp, Artificial Sequence
  chemically synthesized
gaccttttataaagtttaac

SEQ ID NO: 542159 - DNA, 20 bp, Artificial Sequence
  chemically synthesized
aaaacaacctaagtaaatga

SEQ ID NO: 542160 - DNA, 20 bp, Artificial Sequence
  chemically synthesized
ggaagaaggaagggggaatg

SEQ ID NO: 542161 - DNA, 20 bp, Artificial Sequence
  chemically synthesized
gaacaaaaggtggtagggag

SEQ ID NO: 542162 - DNA, 20 bp, Artificial Sequence
  chemically synthesized
gtggaaaaaataagctaaca

SEQ ID NO: 542163 - DNA, 20 bp, Artificial Sequence
  chemically synthesized
ttttattttactaaaatgaa

SEQ ID NO: 542164 - DNA, 20 bp, Artificial Sequence
  chemically synthesized
atctcagttttcatgttttt

SEQ ID NO: 542165 - DNA, 20 bp, Artificial Sequence
  chemically synthesized
aattaaaaaaattaaaattt

SEQ ID NO: 542166 - DNA, 20 bp, Artificial Sequence
  chemically synthesized
aatttaaagaatatatatag

SEQ ID NO: 542167 - DNA, 20 bp, Artificial Sequence
  chemically synthesized
ggtgttaagttataatacga

SEQ ID NO: 542168 - DNA, 20 bp, Artificial Sequence
  chemically synthesized
ttgcattgataaatctgact

SEQ ID NO: 542169 - DNA, 20 bp, Artificial Sequence
  chemically synthesized
taatgtagaatatataagaa

SEQ ID NO: 542170 - DNA, 20 bp, Artificial Sequence
  chemically synthesized
cccatgtaatgtagaatata

SEQ ID NO: 542171 - DNA, 20 bp, Artificial Sequence
  chemically synthesized
cagtgaccttcccatgtaat

SEQ ID NO: 542172 - DNA, 20 bp, Artificial Sequence
  chemically synthesized
cttgtgaaagtctcttatcc

SEQ ID NO: 542173 - DNA, 20 bp, Artificial Sequence
  chemically synthesized
tacagttgtaatacatatat

SEQ ID NO: 542174 - DNA, 20 bp, Artificial Sequence
  chemically synthesized
cttagtaaaggatcaaagtc

SEQ ID NO: 542175 - DNA, 20 bp, Artificial Sequence
  chemically synthesized
tattctgaaattgatactaa

SEQ ID NO: 542176 - DNA, 20 bp, Artificial Sequence
  chemically synthesized
ttttctggttagtatcaatt

SEQ ID NO: 542177 - DNA, 20 bp, Artificial Sequence
  chemically synthesized
agtgaagtatatctaaatct

SEQ ID NO: 542178 - DNA, 20 bp, Artificial Sequence
  chemically synthesized
acaatctaagcaaattttat

SEQ ID NO: 542179 - DNA, 20 bp, Artificial Sequence
  chemically synthesized
accttcagcatcaatctgac

SEQ ID NO: 542180 - DNA, 20 bp, Artificial Sequence
  chemically synthesized
caatctgacctagaaaaatg

SEQ ID NO: 542181 - DNA, 20 bp, Artificial Sequence
  chemically synthesized
tagtccagtgatagttgtga

SEQ ID NO: 542182 - DNA, 20 bp, Artificial Sequence
  chemically synthesized
tgtatctgtgtatgcactgt

SEQ ID NO: 542183 - DNA, 20 bp, Artificial Sequence
  chemically synthesized
aacaattcggcataaacata

SEQ ID NO: 542184 - DNA, 20 bp, Artificial Sequence
  chemically synthesized
ggaaaataatatatggttgg

SEQ ID NO: 542185 - DNA, 20 bp, Artificial Sequence
  chemically synthesized
agcactaatgagtgaagact

SEQ ID NO: 542186 - DNA, 20 bp, Artificial Sequence
  chemically synthesized
ttagaaccctgagtaaattg

SEQ ID NO: 542187 - DNA, 20 bp, Artificial Sequence
  chemically synthesized
ggcagttttaatggagagga

SEQ ID NO: 542188 - DNA, 20 bp, Artificial Sequence
  chemically synthesized
tctgctgtaatcgactggag

SEQ ID NO: 542189 - DNA, 20 bp, Artificial Sequence
  chemically synthesized
agtcgattacagcagagacc

SEQ ID NO: 542190 - DNA, 20 bp, Artificial Sequence
  chemically synthesized
aaaactgatggaaaaaaatg

SEQ ID NO: 542191 - DNA, 20 bp, Artificial Sequence
  chemically synthesized
tcatctcccttattttgtag

SEQ ID NO: 542192 - DNA, 20 bp, Artificial Sequence
  chemically synthesized
atgacaagaaattccgaagc

SEQ ID NO: 542193 - DNA, 20 bp, Artificial Sequence
  chemically synthesized
cctgccaggactgttcatga

SEQ ID NO: 542194 - DNA, 20 bp, Artificial Sequence
  chemically synthesized
gtctagatttactatttggt

SEQ ID NO: 542195 - DNA, 20 bp, Artificial Sequence
  chemically synthesized
actctaaagagcccttgaat

SEQ ID NO: 542196 - DNA, 20 bp, Artificial Sequence
  chemically synthesized
acttagacatagactcaacc

SEQ ID NO: 542197 - DNA, 20 bp, Artificial Sequence
  chemically synthesized
ttatacaggataatattagg

SEQ ID NO: 542198 - DNA, 20 bp, Artificial Sequence
  chemically synthesized
tcctgtataacccctactat

SEQ ID NO: 542199 - DNA, 20 bp, Artificial Sequence
  chemically synthesized
taatcttttgttgattacaa

SEQ ID NO: 542200 - DNA, 20 bp, Artificial Sequence
  chemically synthesized
gatttatgaactaatctaat

SEQ ID NO: 542201 - DNA, 20 bp, Artificial Sequence
  chemically synthesized
cctgaattcaatcataggaa

SEQ ID NO: 542202 - DNA, 20 bp, Artificial Sequence
  chemically synthesized
aaatagactaacaattttta

SEQ ID NO: 542203 - DNA, 20 bp, Artificial Sequence
  chemically synthesized
acaaacaatgaaatggatat

SEQ ID NO: 542204 - DNA, 20 bp, Artificial Sequence
  chemically synthesized
cctaactttttcagtagtag

SEQ ID NO: 542205 - DNA, 20 bp, Artificial Sequence
  chemically synthesized
atttagaaggtaatctcacc

SEQ ID NO: 542206 - DNA, 20 bp, Artificial Sequence
  chemically synthesized
taagaaatacatgttttcaa

SEQ ID NO: 542207 - DNA, 20 bp, Artificial Sequence
  chemically synthesized
agggtataaagatccttgct

SEQ ID NO: 542208 - DNA, 20 bp, Artificial Sequence
  chemically synthesized
atcacgatgaaatgaaaaac

SEQ ID NO: 542209 - DNA, 20 bp, Artificial Sequence
  chemically synthesized
tcagttgcctttactaattt

SEQ ID NO: 542210 - DNA, 20 bp, Artificial Sequence
  chemically synthesized
ctacttgggaggctgaggca

SEQ ID NO: 542211 - DNA, 20 bp, Artificial Sequence
  chemically synthesized
ttccctagaaacataaggca

SEQ ID NO: 542212 - DNA, 20 bp, Artificial Sequence
  chemically synthesized
atgaacttcttttattttcc

SEQ ID NO: 542213 - DNA, 20 bp, Artificial Sequence
  chemically synthesized
aagtatacttacaaattcat

SEQ ID NO: 542214 - DNA, 20 bp, Artificial Sequence
  chemically synthesized
tcacagatattaaaaaatgg

SEQ ID NO: 542215 - DNA, 20 bp, Artificial Sequence
  chemically synthesized
actaagctatagaatattta

SEQ ID NO: 542216 - DNA, 20 bp, Artificial Sequence
  chemically synthesized
ttttaataaatcactaagct

SEQ ID NO: 542217 - DNA, 20 bp, Artificial Sequence
  chemically synthesized
taaaattgattaaagttttg

SEQ ID NO: 542218 - DNA, 20 bp, Artificial Sequence
  chemically synthesized
tgctgtctctctccatatgt

SEQ ID NO: 542219 - DNA, 20 bp, Artificial Sequence
  chemically synthesized
atgcatacaagctaaactat

SEQ ID NO: 542220 - DNA, 20 bp, Artificial Sequence
  chemically synthesized
tgatgagacactgtaatgcc

SEQ ID NO: 542221 - DNA, 20 bp, Artificial Sequence
  chemically synthesized
aaaaaacattggagtattta

SEQ ID NO: 542222 - DNA, 20 bp, Artificial Sequence
  chemically synthesized
tttaggtatatagataattg

SEQ ID NO: 542223 - DNA, 20 bp, Artificial Sequence
  chemically synthesized
tttgaaatgcaagtaattac

SEQ ID NO: 542224 - DNA, 20 bp, Artificial Sequence
  chemically synthesized
aaatgtataaatatagtgtt

SEQ ID NO: 542225 - DNA, 20 bp, Artificial Sequence
  chemically synthesized
atttgtgtatgatttgatga

SEQ ID NO: 542226 - DNA, 20 bp, Artificial Sequence
  chemically synthesized
cgtactttcaggggtcacct

SEQ ID NO: 542227 - DNA, 20 bp, Artificial Sequence
  chemically synthesized
gtacgtatgtaaactgcagc

SEQ ID NO: 542228 - DNA, 20 bp, Artificial Sequence
  chemically synthesized
ctgcagcatagaatgcagtc

SEQ ID NO: 542229 - DNA, 20 bp, Artificial Sequence
  chemically synthesized
ctatggcagcaaaagatgag

SEQ ID NO: 542230 - DNA, 20 bp, Artificial Sequence
  chemically synthesized
tcgatttgcagccatttcac

SEQ ID NO: 542231 - DNA, 20 bp, Artificial Sequence
  chemically synthesized
agtaattaatgaaggtcaag

SEQ ID NO: 542232 - DNA, 20 bp, Artificial Sequence
  chemically synthesized
gagcaagtgagcgagaagag

SEQ ID NO: 542233 - DNA, 20 bp, Artificial Sequence
  chemically synthesized
gaagagtgagaaagagagag

SEQ ID NO: 542234 - DNA, 20 bp, Artificial Sequence
  chemically synthesized
agaaagagagagagagaaag

SEQ ID NO: 542235 - DNA, 20 bp, Artificial Sequence
  chemically synthesized
gaaaatgagagcaagcacat

SEQ ID NO: 542236 - DNA, 20 bp, Artificial Sequence
  chemically synthesized
aaatgaaaatgcgtgtgatt

SEQ ID NO: 542237 - DNA, 20 bp, Artificial Sequence
  chemically synthesized
atataataaaataagactaa

SEQ ID NO: 542238 - DNA, 20 bp, Artificial Sequence
  chemically synthesized
cttgaaagtgctaggaagga

SEQ ID NO: 542239 - DNA, 20 bp, Artificial Sequence
  chemically synthesized
ctttattacattgagtgtca

SEQ ID NO: 542240 - DNA, 20 bp, Artificial Sequence
  chemically synthesized
tgacagaaaattcgtatgtg

SEQ ID NO: 542241 - DNA, 20 bp, Artificial Sequence
  chemically synthesized
cctcagtacctctgtatgtg

SEQ ID NO: 542242 - DNA, 20 bp, Artificial Sequence
  chemically synthesized
gaggcataaaaataaattgc

SEQ ID NO: 542243 - DNA, 20 bp, Artificial Sequence
  chemically synthesized
cataaaaataaattgcatag

SEQ ID NO: 542244 - DNA, 20 bp, Artificial Sequence
  chemically synthesized
tgattagttgtttactattt

SEQ ID NO: 542245 - DNA, 20 bp, Artificial Sequence
  chemically synthesized
gggaaaagagacatcatcaa

SEQ ID NO: 542246 - DNA, 20 bp, Artificial Sequence
  chemically synthesized
ttttatcggaatcatttttt

SEQ ID NO: 542247 - DNA, 20 bp, Artificial Sequence
  chemically synthesized
aacagtcagttttgagacta

SEQ ID NO: 542248 - DNA, 20 bp, Artificial Sequence
  chemically synthesized
attgttctttgtgttagaca

SEQ ID NO: 542249 - DNA, 20 bp, Artificial Sequence
  chemically synthesized
tagtaccaccattgacaaag

SEQ ID NO: 542250 - DNA, 20 bp, Artificial Sequence
  chemically synthesized
atacccaatgtaaactccgt

SEQ ID NO: 542251 - DNA, 20 bp, Artificial Sequence
  chemically synthesized
taactgagtgatggatttga

SEQ ID NO: 542252 - DNA, 20 bp, Artificial Sequence
  chemically synthesized
aaagggaaagataaaggaag

SEQ ID NO: 542253 - DNA, 20 bp, Artificial Sequence
  chemically synthesized
cttttggatgaatcagagaa

SEQ ID NO: 542254 - DNA, 20 bp, Artificial Sequence
  chemically synthesized
gacacacttttggatgaatc

SEQ ID NO: 542255 - DNA, 20 bp, Artificial Sequence
  chemically synthesized
aaacacatggaaacttttga

SEQ ID NO: 542256 - DNA, 20 bp, Artificial Sequence
  chemically synthesized
ctctgtacaattaaggaata

SEQ ID NO: 542257 - DNA, 20 bp, Artificial Sequence
  chemically synthesized
attggttagacaatattctt

SEQ ID NO: 542258 - DNA, 20 bp, Artificial Sequence
  chemically synthesized
agaacataggaaaaattctt

SEQ ID NO: 542259 - DNA, 20 bp, Artificial Sequence
  chemically synthesized
gttttaagtggtattttcat

SEQ ID NO: 542260 - DNA, 20 bp, Artificial Sequence
  chemically synthesized
atagaatattgcgtaaatat

SEQ ID NO: 542261 - DNA, 20 bp, Artificial Sequence
  chemically synthesized
aattaagagccagcatatac

SEQ ID NO: 542262 - DNA, 20 bp, Artificial Sequence
  chemically synthesized
agccagcatatacgtagaat

SEQ ID NO: 542263 - DNA, 20 bp, Artificial Sequence
  chemically synthesized
gaattgagaaattttcaaac

SEQ ID NO: 542264 - DNA, 20 bp, Artificial Sequence
  chemically synthesized
ttttacacccttctctgtca

SEQ ID NO: 542265 - DNA, 20 bp, Artificial Sequence
  chemically synthesized
ggttaaatcttttgttggta

SEQ ID NO: 542266 - DNA, 20 bp, Artificial Sequence
  chemically synthesized
caggctactcaaaaagagat

SEQ ID NO: 542267 - DNA, 20 bp, Artificial Sequence
  chemically synthesized
tgcagaatcatagtaaccat

SEQ ID NO: 542268 - DNA, 20 bp, Artificial Sequence
  chemically synthesized
agttataggtttaaaacctt

SEQ ID NO: 542269 - DNA, 20 bp, Artificial Sequence
  chemically synthesized
tttgaaaatccatccacaaa

SEQ ID NO: 542270 - DNA, 20 bp, Artificial Sequence
  chemically synthesized
ccacaaataagaaactgccc

SEQ ID NO: 542271 - DNA, 20 bp, Artificial Sequence
  chemically synthesized
aaatacagtagcaccatact

SEQ ID NO: 542272 - DNA, 20 bp, Artificial Sequence
  chemically synthesized
aggctaaaaaaatccctgct

SEQ ID NO: 542273 - DNA, 20 bp, Artificial Sequence
  chemically synthesized
tgcatttaaaagcattatta

SEQ ID NO: 542274 - DNA, 20 bp, Artificial Sequence
  chemically synthesized
tacccatgactttgtcacta

SEQ ID NO: 542275 - DNA, 20 bp, Artificial Sequence
  chemically synthesized
ttttagtctagggtatgtgg

SEQ ID NO: 542276 - DNA, 20 bp, Artificial Sequence
  chemically synthesized
ccctagactaaaatctccta

SEQ ID NO: 542277 - DNA, 20 bp, Artificial Sequence
  chemically synthesized
ctgttaaccttattgagaaa

SEQ ID NO: 542278 - DNA, 20 bp, Artificial Sequence
  chemically synthesized
tctgtatctgttaaccttat

SEQ ID NO: 542279 - DNA, 20 bp, Artificial Sequence
  chemically synthesized
gtggagctgatgtcttaatc

SEQ ID NO: 542280 - DNA, 20 bp, Artificial Sequence
  chemically synthesized
ccaaagcaaaacaaaatcat

SEQ ID NO: 542281 - DNA, 20 bp, Artificial Sequence
  chemically synthesized
aacagcaataacaggaaagt

SEQ ID NO: 542282 - DNA, 20 bp, Artificial Sequence
  chemically synthesized
ccagcctacatctaatttct

SEQ ID NO: 542283 - DNA, 20 bp, Artificial Sequence
  chemically synthesized
ttgtactgtaatttttttct

SEQ ID NO: 542284 - DNA, 20 bp, Artificial Sequence
  chemically synthesized
aaaaaattacagtacaagag

SEQ ID NO: 542285 - DNA, 20 bp, Artificial Sequence
  chemically synthesized
tacttaggtatattataaag

SEQ ID NO: 542286 - DNA, 20 bp, Artificial Sequence
  chemically synthesized
gaccaggaccttatggcgtg

SEQ ID NO: 542287 - DNA, 20 bp, Artificial Sequence
  chemically synthesized
atgccaaaggcaaaaccaaa

SEQ ID NO: 542288 - DNA, 20 bp, Artificial Sequence
  chemically synthesized
cctttggcatcggataaaca

SEQ ID NO: 542289 - DNA, 20 bp, Artificial Sequence
  chemically synthesized
taaaaccatatcttagaatt

SEQ ID NO: 542290 - DNA, 20 bp, Artificial Sequence
  chemically synthesized
atgtgacataaaaccatatc

SEQ ID NO: 542291 - DNA, 20 bp, Artificial Sequence
  chemically synthesized
aacacttacgattgataaat

SEQ ID NO: 542292 - DNA, 20 bp, Artificial Sequence
  chemically synthesized
atatgccagttactactgta

SEQ ID NO: 542293 - DNA, 20 bp, Artificial Sequence
  chemically synthesized
aatctcccagaatatattga

SEQ ID NO: 542294 - DNA, 20 bp, Artificial Sequence
  chemically synthesized
gagagacttctaataatctc

SEQ ID NO: 542295 - DNA, 20 bp, Artificial Sequence
  chemically synthesized
gagatggacatatacgcaaa

SEQ ID NO: 542296 - DNA, 20 bp, Artificial Sequence
  chemically synthesized
agatgccagtagactggaat

SEQ ID NO: 542297 - DNA, 20 bp, Artificial Sequence
  chemically synthesized
taattgcattgcttgtcatg

SEQ ID NO: 542298 - DNA, 20 bp, Artificial Sequence
  chemically synthesized
ttgcaggtagttcctgggtc

SEQ ID NO: 542299 - DNA, 20 bp, Artificial Sequence
  chemically synthesized
ttgtggaacttaagaaggca

SEQ ID NO: 542300 - DNA, 20 bp, Artificial Sequence
  chemically synthesized
ttttaatcaaagatatgact

SEQ ID NO: 542301 - DNA, 20 bp, Artificial Sequence
  chemically synthesized
tcaattagtatttcagatct

SEQ ID NO: 542302 - DNA, 20 bp, Artificial Sequence
  chemically synthesized
taaaacaatttgatatcata

SEQ ID NO: 542303 - DNA, 20 bp, Artificial Sequence
  chemically synthesized
gcaacgagaaggtatgaaag

SEQ ID NO: 542304 - DNA, 20 bp, Artificial Sequence
  chemically synthesized
tgtattcttttagtttacag

SEQ ID NO: 542305 - DNA, 20 bp, Artificial Sequence
  chemically synthesized
ggaattcttactgtaaacta

SEQ ID NO: 542306 - DNA, 20 bp, Artificial Sequence
  chemically synthesized
tgtgggaaactattagagcc

SEQ ID NO: 542307 - DNA, 20 bp, Artificial Sequence
  chemically synthesized
tctaatagtttcccacaaca

SEQ ID NO: 542308 - DNA, 20 bp, Artificial Sequence
  chemically synthesized
ttatagggttggcgagatgg

SEQ ID NO: 542309 - DNA, 20 bp, Artificial Sequence
  chemically synthesized
gcagaagaaggcatgtatgc

SEQ ID NO: 542310 - DNA, 20 bp, Artificial Sequence
  chemically synthesized
ctaggatcgattttagggct

SEQ ID NO: 542311 - DNA, 20 bp, Artificial Sequence
  chemically synthesized
aaataatatgttagacattg

SEQ ID NO: 542312 - DNA, 20 bp, Artificial Sequence
  chemically synthesized
actctaatttccttattata

SEQ ID NO: 542313 - DNA, 20 bp, Artificial Sequence
  chemically synthesized
catggggcatgacttcactg

SEQ ID NO: 542314 - DNA, 20 bp, Artificial Sequence
  chemically synthesized
cccatgttgatgggaaggat

SEQ ID NO: 542315 - DNA, 20 bp, Artificial Sequence
  chemically synthesized
ttgtagatatggggaatgaa

SEQ ID NO: 542316 - DNA, 20 bp, Artificial Sequence
  chemically synthesized
atctacaagtataattgctt

SEQ ID NO: 542317 - DNA, 20 bp, Artificial Sequence
  chemically synthesized
aaacatttcccttcaggggt

SEQ ID NO: 542318 - DNA, 20 bp, Artificial Sequence
  chemically synthesized
aaatacgaaatgggtggagg

SEQ ID NO: 542319 - DNA, 20 bp, Artificial Sequence
  chemically synthesized
tataagtccctgagaaattc

SEQ ID NO: 542320 - DNA, 20 bp, Artificial Sequence
  chemically synthesized
atcttaagaatataagtccc

SEQ ID NO: 542321 - DNA, 20 bp, Artificial Sequence
  chemically synthesized
atcagacagagaagttatct

SEQ ID NO: 542322 - DNA, 20 bp, Artificial Sequence
  chemically synthesized
tattacagggaacatgagta

SEQ ID NO: 542323 - DNA, 20 bp, Artificial Sequence
  chemically synthesized
aatatttgcaaatactaagt

SEQ ID NO: 542324 - DNA, 20 bp, Artificial Sequence
  chemically synthesized
ccctctcctgttctctgtga

SEQ ID NO: 542325 - DNA, 20 bp, Artificial Sequence
  chemically synthesized
gctacgtaacatattcgtgg

SEQ ID NO: 542326 - DNA, 20 bp, Artificial Sequence
  chemically synthesized
aaatgtgacaaatgcacatc

SEQ ID NO: 542327 - DNA, 20 bp, Artificial Sequence
  chemically synthesized
attgatatgattacagctgc

SEQ ID NO: 542328 - DNA, 20 bp, Artificial Sequence
  chemically synthesized
tttactattaggctaatgtg

SEQ ID NO: 542329 - DNA, 20 bp, Artificial Sequence
  chemically synthesized
aaaagtcaatacacattgct

SEQ ID NO: 542330 - DNA, 20 bp, Artificial Sequence
  chemically synthesized
acactgtattgtttattaaa

SEQ ID NO: 542331 - DNA, 20 bp, Artificial Sequence
  chemically synthesized
taaagaagaatttcatgaaa

SEQ ID NO: 542332 - DNA, 20 bp, Artificial Sequence
  chemically synthesized
atgaaagcagaatgaactga

SEQ ID NO: 542333 - DNA, 20 bp, Artificial Sequence
  chemically synthesized
atgcatcaagcagctgttac

SEQ ID NO: 542334 - DNA, 20 bp, Artificial Sequence
  chemically synthesized
gttatccagataatctagga

SEQ ID NO: 542335 - DNA, 20 bp, Artificial Sequence
  chemically synthesized
gctctcttattcagcaaagt

SEQ ID NO: 542336 - DNA, 20 bp, Artificial Sequence
  chemically synthesized
ttagagttagaccaattaaa

SEQ ID NO: 542337 - DNA, 20 bp, Artificial Sequence
  chemically synthesized
ggttgcacatcaaaatcacc

SEQ ID NO: 542338 - DNA, 20 bp, Artificial Sequence
  chemically synthesized
atgttgaaaaccacaggcaa

SEQ ID NO: 542339 - DNA, 20 bp, Artificial Sequence
  chemically synthesized
gactatcactcaataaaaac

SEQ ID NO: 542340 - DNA, 20 bp, Artificial Sequence
  chemically synthesized
ctttggctttcagttcactc

SEQ ID NO: 542341 - DNA, 20 bp, Artificial Sequence
  chemically synthesized
tttaactgaaggtgttaaat

SEQ ID NO: 542342 - DNA, 20 bp, Artificial Sequence
  chemically synthesized
taggaccaaatttttttttt

SEQ ID NO: 542343 - DNA, 20 bp, Artificial Sequence
  chemically synthesized
gtcatctgaaagttcaaatg

SEQ ID NO: 542344 - DNA, 20 bp, Artificial Sequence
  chemically synthesized
ctttgatgcttaaaacaaaa

SEQ ID NO: 542345 - DNA, 20 bp, Artificial Sequence
  chemically synthesized
ataaaatgttagtgattaaa

SEQ ID NO: 542346 - DNA, 20 bp, Artificial Sequence
  chemically synthesized
accatggctaaatttcaagt

SEQ ID NO: 542347 - DNA, 20 bp, Artificial Sequence
  chemically synthesized
cttagattactttaaaatta

SEQ ID NO: 542348 - DNA, 20 bp, Artificial Sequence
  chemically synthesized
acaaagcagttcttgagaga

SEQ ID NO: 542349 - DNA, 20 bp, Artificial Sequence
  chemically synthesized
ggtgacaaacactgatagct

SEQ ID NO: 542350 - DNA, 20 bp, Artificial Sequence
  chemically synthesized
tcagtgtttgtcacctcagc

SEQ ID NO: 542351 - DNA, 20 bp, Artificial Sequence
  chemically synthesized
cagcctagaaaattccatta

SEQ ID NO: 542352 - DNA, 20 bp, Artificial Sequence
  chemically synthesized
atgacaggaggaaagccatt

SEQ ID NO: 542353 - DNA, 20 bp, Artificial Sequence
  chemically synthesized
ttccaaattgtttaaaaggt

SEQ ID NO: 542354 - DNA, 20 bp, Artificial Sequence
  chemically synthesized
caaattatagttacagaaaa

SEQ ID NO: 542355 - DNA, 20 bp, Artificial Sequence
  chemically synthesized
catgtttccaaattatagtt

SEQ ID NO: 542356 - DNA, 20 bp, Artificial Sequence
  chemically synthesized
actgaagggacagctgcagg

SEQ ID NO: 542357 - DNA, 20 bp, Artificial Sequence
  chemically synthesized
ttcttaatgatcccacagag

SEQ ID NO: 542358 - DNA, 20 bp, Artificial Sequence
  chemically synthesized
ctaattcttaatgatcccac

SEQ ID NO: 542359 - DNA, 20 bp, Artificial Sequence
  chemically synthesized
ttctttctctgtgggatcat

SEQ ID NO: 542360 - DNA, 20 bp, Artificial Sequence
  chemically synthesized
ctctgtgggatcattaagaa

SEQ ID NO: 542361 - DNA, 20 bp, Artificial Sequence
  chemically synthesized
cttgaagagaattacgaact

SEQ ID NO: 542362 - DNA, 20 bp, Artificial Sequence
  chemically synthesized
taaagataccatctacttga

SEQ ID NO: 542363 - DNA, 20 bp, Artificial Sequence
  chemically synthesized
catattccaaaccatagata

SEQ ID NO: 542364 - DNA, 20 bp, Artificial Sequence
  chemically synthesized
tactatttaattctgagcag

SEQ ID NO: 542365 - DNA, 20 bp, Artificial Sequence
  chemically synthesized
catctaagttttcttcctgc

SEQ ID NO: 542366 - DNA, 20 bp, Artificial Sequence
  chemically synthesized
gtagaattggtctttcctaa

SEQ ID NO: 542367 - DNA, 20 bp, Artificial Sequence
  chemically synthesized
tttgataggccagtggcgtt

SEQ ID NO: 542368 - DNA, 20 bp, Artificial Sequence
  chemically synthesized
actggcctatcaaaaggatc

SEQ ID NO: 542369 - DNA, 20 bp, Artificial Sequence
  chemically synthesized
aagcagcaccctgtttgacc

SEQ ID NO: 542370 - DNA, 20 bp, Artificial Sequence
  chemically synthesized
ctgttttagcacaaaagcag

SEQ ID NO: 542371 - DNA, 20 bp, Artificial Sequence
  chemically synthesized
ttcttgagcttcctaataga

SEQ ID NO: 542372 - DNA, 20 bp, Artificial Sequence
  chemically synthesized
taggaagctcaagaagttgg

SEQ ID NO: 542373 - DNA, 20 bp, Artificial Sequence
  chemically synthesized
gaatggcttttgttaaaaag

SEQ ID NO: 542374 - DNA, 20 bp, Artificial Sequence
  chemically synthesized
aaggaacttaaacttgtcaa

SEQ ID NO: 542375 - DNA, 20 bp, Artificial Sequence
  chemically synthesized
atctgacaaaagaataatat

SEQ ID NO: 542376 - DNA, 20 bp, Artificial Sequence
  chemically synthesized
tgcaaactttgcatctgaca

SEQ ID NO: 542377 - DNA, 20 bp, Artificial Sequence
  chemically synthesized
aacagataacctcctgaatg

SEQ ID NO: 542378 - DNA, 20 bp, Artificial Sequence
  chemically synthesized
attaaagcttctgtacagaa

SEQ ID NO: 542379 - DNA, 20 bp, Artificial Sequence
  chemically synthesized
aattaaattaaagcttctgt

SEQ ID NO: 542380 - DNA, 20 bp, Artificial Sequence
  chemically synthesized
ttctggacactggcttaggc

SEQ ID NO: 542381 - DNA, 20 bp, Artificial Sequence
  chemically synthesized
ccctgaaactactaaaaatc

SEQ ID NO: 542382 - DNA, 20 bp, Artificial Sequence
  chemically synthesized
aatggaacagaatagagaac

SEQ ID NO: 542383 - DNA, 20 bp, Artificial Sequence
  chemically synthesized
tagacacctagatcaatgga

SEQ ID NO: 542384 - DNA, 20 bp, Artificial Sequence
  chemically synthesized
ttctaaaattcatatggaac

SEQ ID NO: 542385 - DNA, 20 bp, Artificial Sequence
  chemically synthesized
ttcttggttccatatgaatt

SEQ ID NO: 542386 - DNA, 20 bp, Artificial Sequence
  chemically synthesized
tgaatctaaagtaattttaa

SEQ ID NO: 542387 - DNA, 20 bp, Artificial Sequence
  chemically synthesized
aattttaaaaagaaagtaat

SEQ ID NO: 542388 - DNA, 20 bp, Artificial Sequence
  chemically synthesized
aaagaaagtaatcgagaaac

SEQ ID NO: 542389 - DNA, 20 bp, Artificial Sequence
  chemically synthesized
cttatttccctttttgtaaa

SEQ ID NO: 542390 - DNA, 20 bp, Artificial Sequence
  chemically synthesized
ttaagaacacttctattcag

SEQ ID NO: 542391 - DNA, 20 bp, Artificial Sequence
  chemically synthesized
gaatagcgcaaaccgagaac

SEQ ID NO: 542392 - DNA, 20 bp, Artificial Sequence
  chemically synthesized
tttcacaaggaaatcattga

SEQ ID NO: 542393 - DNA, 20 bp, Artificial Sequence
  chemically synthesized
catgcttcaatgtagataat

SEQ ID NO: 542394 - DNA, 20 bp, Artificial Sequence
  chemically synthesized
taataaagaaaaaaaaagcc

SEQ ID NO: 542395 - DNA, 20 bp, Artificial Sequence
  chemically synthesized
gtcctgttgctcaatcagca

SEQ ID NO: 542396 - DNA, 20 bp, Artificial Sequence
  chemically synthesized
taaaatcacatataagaaca

SEQ ID NO: 542397 - DNA, 20 bp, Artificial Sequence
  chemically synthesized
ttatatgtgattttagacac

SEQ ID NO: 542398 - DNA, 20 bp, Artificial Sequence
  chemically synthesized
tatctctgtgaggaaagaca

SEQ ID NO: 542399 - DNA, 20 bp, Artificial Sequence
  chemically synthesized
atatataatatatagtaaaa

SEQ ID NO: 542400 - DNA, 20 bp, Artificial Sequence
  chemically synthesized
ttacacaaaggataaaatat

SEQ ID NO: 542401 - DNA, 20 bp, Artificial Sequence
  chemically synthesized
gttataaaaatcaagcttct

SEQ ID NO: 542402 - DNA, 20 bp, Artificial Sequence
  chemically synthesized
cctttttaaagggcacagca

SEQ ID NO: 542403 - DNA, 20 bp, Artificial Sequence
  chemically synthesized
aactgatcttttggccagtg

SEQ ID NO: 542404 - DNA, 20 bp, Artificial Sequence
  chemically synthesized
tccatctcaaaataaataaa

SEQ ID NO: 542405 - DNA, 20 bp, Artificial Sequence
  chemically synthesized
gggaaaccaaatagataccg

SEQ ID NO: 542406 - DNA, 20 bp, Artificial Sequence
  chemically synthesized
ttaggcctaccataaaatac

SEQ ID NO: 542407 - DNA, 20 bp, Artificial Sequence
  chemically synthesized
tagttgtgatgggaccttat

SEQ ID NO: 542408 - DNA, 20 bp, Artificial Sequence
  chemically synthesized
aattaaataacataatctag

SEQ ID NO: 542409 - DNA, 20 bp, Artificial Sequence
  chemically synthesized
agtaagaaatgaaggaacag

SEQ ID NO: 542410 - DNA, 20 bp, Artificial Sequence
  chemically synthesized
taaggaggtgaaatgagtat

SEQ ID NO: 542411 - DNA, 20 bp, Artificial Sequence
  chemically synthesized
atctaacacttaagttttta

SEQ ID NO: 542412 - DNA, 20 bp, Artificial Sequence
  chemically synthesized
tttttcttacattacgaagc

SEQ ID NO: 542413 - DNA, 20 bp, Artificial Sequence
  chemically synthesized
tttttctcagcttcgtaatg

SEQ ID NO: 542414 - DNA, 20 bp, Artificial Sequence
  chemically synthesized
aggaaatttcctatcctaaa

SEQ ID NO: 542415 - DNA, 20 bp, Artificial Sequence
  chemically synthesized
ttggaagtattgctccaatt

SEQ ID NO: 542416 - DNA, 20 bp, Artificial Sequence
  chemically synthesized
ttttcaagatcaaaattagc

SEQ ID NO: 542417 - DNA, 20 bp, Artificial Sequence
  chemically synthesized
tttcctgtgatatgagaaaa

SEQ ID NO: 542418 - DNA, 20 bp, Artificial Sequence
  chemically synthesized
tactagtttttcctgtgata

SEQ ID NO: 542419 - DNA, 20 bp, Artificial Sequence
  chemically synthesized
atggcatttaaaaggtgaag

SEQ ID NO: 542420 - DNA, 20 bp, Artificial Sequence
  chemically synthesized
cgtgccaagcataattgaag

SEQ ID NO: 542421 - DNA, 20 bp, Artificial Sequence
  chemically synthesized
ttttcgtgccaagcataatt

SEQ ID NO: 542422 - DNA, 20 bp, Artificial Sequence
  chemically synthesized
tttgggtttgaaccagtcac

SEQ ID NO: 542423 - DNA, 20 bp, Artificial Sequence
  chemically synthesized
aattagatatagggccaagt

SEQ ID NO: 542424 - DNA, 20 bp, Artificial Sequence
  chemically synthesized
gtatagaaatgtgttctcag

SEQ ID NO: 542425 - DNA, 20 bp, Artificial Sequence
  chemically synthesized
cttctttccaggaaaaagat

SEQ ID NO: 542426 - DNA, 20 bp, Artificial Sequence
  chemically synthesized
gaaaatttttttctgtattc

SEQ ID NO: 542427 - DNA, 20 bp, Artificial Sequence
  chemically synthesized
gttatttattttctctgaat

SEQ ID NO: 542428 - DNA, 20 bp, Artificial Sequence
  chemically synthesized
tcctgcaactgagcttttaa

SEQ ID NO: 542429 - DNA, 20 bp, Artificial Sequence
  chemically synthesized
aaattaaaaattaataaaat

SEQ ID NO: 542430 - DNA, 20 bp, Artificial Sequence
  chemically synthesized
ctccaatattttttcctctc

SEQ ID NO: 542431 - DNA, 20 bp, Artificial Sequence
  chemically synthesized
taccaacatggctccatgaa

SEQ ID NO: 542432 - DNA, 20 bp, Artificial Sequence
  chemically synthesized
tttttcatggagccatgttg

SEQ ID NO: 542433 - DNA, 20 bp, Artificial Sequence
  chemically synthesized
catattcttataataaacaa

SEQ ID NO: 542434 - DNA, 20 bp, Artificial Sequence
  chemically synthesized
aacattcttattgtttatta

SEQ ID NO: 542435 - DNA, 20 bp, Artificial Sequence
  chemically synthesized
tttgctagaacttagtgcca

SEQ ID NO: 542436 - DNA, 20 bp, Artificial Sequence
  chemically synthesized
attgtggatatatttctatg

SEQ ID NO: 542437 - DNA, 20 bp, Artificial Sequence
  chemically synthesized
aaataataaaaaattcttgc

SEQ ID NO: 542438 - DNA, 20 bp, Artificial Sequence
  chemically synthesized
tatttaatatatattaaatt

SEQ ID NO: 542439 - DNA, 20 bp, Artificial Sequence
  chemically synthesized
ttcttgggtcaacagaactg

SEQ ID NO: 542440 - DNA, 20 bp, Artificial Sequence
  chemically synthesized
aaattttttaaaataataaa

SEQ ID NO: 542441 - DNA, 20 bp, Artificial Sequence
  chemically synthesized
gaattaagctctccacctac

SEQ ID NO: 542442 - DNA, 20 bp, Artificial Sequence
  chemically synthesized
ctccacctaccaagaaacca

SEQ ID NO: 542443 - DNA, 20 bp, Artificial Sequence
  chemically synthesized
taccaagaaaccatgagaaa

SEQ ID NO: 542444 - DNA, 20 bp, Artificial Sequence
  chemically synthesized
ttgaattttatgttaaaata

SEQ ID NO: 542445 - DNA, 20 bp, Artificial Sequence
  chemically synthesized
ctttaaaaataacaatcata

SEQ ID NO: 542446 - DNA, 20 bp, Artificial Sequence
  chemically synthesized
cttttatgattgttattttt

SEQ ID NO: 542447 - DNA, 20 bp, Artificial Sequence
  chemically synthesized
ataaattatctttattctat

SEQ ID NO: 542448 - DNA, 20 bp, Artificial Sequence
  chemically synthesized
attatctttattctataaag

SEQ ID NO: 542449 - DNA, 20 bp, Artificial Sequence
  chemically synthesized
ggcatttattttctttcttt

SEQ ID NO: 542450 - DNA, 20 bp, Artificial Sequence
  chemically synthesized
tagtaggaaaaaaaaaaagc

SEQ ID NO: 542451 - DNA, 20 bp, Artificial Sequence
  chemically synthesized
atagaaggcttgaatagtct

SEQ ID NO: 542452 - DNA, 20 bp, Artificial Sequence
  chemically synthesized
ttctatatgagaaggataac

SEQ ID NO: 542453 - DNA, 20 bp, Artificial Sequence
  chemically synthesized
caagtaatatgtttgaatga

SEQ ID NO: 542454 - DNA, 20 bp, Artificial Sequence
  chemically synthesized
attacatttattctgaaaga

SEQ ID NO: 542455 - DNA, 20 bp, Artificial Sequence
  chemically synthesized
taaattgtttttcttctctt

SEQ ID NO: 542456 - DNA, 20 bp, Artificial Sequence
  chemically synthesized
acctgaaagtgtgttgatat

SEQ ID NO: 542457 - DNA, 20 bp, Artificial Sequence
  chemically synthesized
gcatgaaatgattggccatc

SEQ ID NO: 542458 - DNA, 20 bp, Artificial Sequence
  chemically synthesized
attggccatcagagaaaggg

SEQ ID NO: 542459 - DNA, 20 bp, Artificial Sequence
  chemically synthesized
ttgccaaagtcgcatttcag

SEQ ID NO: 542460 - DNA, 20 bp, Artificial Sequence
  chemically synthesized
catattgccaaagtcgcatt

SEQ ID NO: 542461 - DNA, 20 bp, Artificial Sequence
  chemically synthesized
gtaaattatgaataagacct

SEQ ID NO: 542462 - DNA, 20 bp, Artificial Sequence
  chemically synthesized
gaaaagcacagattaatttt

SEQ ID NO: 542463 - DNA, 20 bp, Artificial Sequence
  chemically synthesized
ttacctttccccaggcaact

SEQ ID NO: 542464 - DNA, 20 bp, Artificial Sequence
  chemically synthesized
gaaaggaaatgaatgtcttg

SEQ ID NO: 542465 - DNA, 20 bp, Artificial Sequence
  chemically synthesized
acagaaagaaagcaacagtt

SEQ ID NO: 542466 - DNA, 20 bp, Artificial Sequence
  chemically synthesized
taattcttttcaggtaacag

SEQ ID NO: 542467 - DNA, 20 bp, Artificial Sequence
  chemically synthesized
gctttctttctgttacctga

SEQ ID NO: 542468 - DNA, 20 bp, Artificial Sequence
  chemically synthesized
attataattcttttcaggta

SEQ ID NO: 542469 - DNA, 20 bp, Artificial Sequence
  chemically synthesized
gaaaatagttattttaaata

SEQ ID NO: 542470 - DNA, 20 bp, Artificial Sequence
  chemically synthesized
aaatattattttaaaacgtg

SEQ ID NO: 542471 - DNA, 20 bp, Artificial Sequence
  chemically synthesized
tttttattcactcttaatat

SEQ ID NO: 542472 - DNA, 20 bp, Artificial Sequence
  chemically synthesized
gggtcttgtatgtcgtcatg

SEQ ID NO: 542473 - DNA, 20 bp, Artificial Sequence
  chemically synthesized
ttgtatgtcgtcatggtaga

SEQ ID NO: 542474 - DNA, 20 bp, Artificial Sequence
  chemically synthesized
ctttggctataaattatctt

SEQ ID NO: 542475 - DNA, 20 bp, Artificial Sequence
  chemically synthesized
acatgacagtaagttttcag

SEQ ID NO: 542476 - DNA, 20 bp, Artificial Sequence
  chemically synthesized
acaaatacttttaccttttg

SEQ ID NO: 542477 - DNA, 20 bp, Artificial Sequence
  chemically synthesized
taaaagtatttgtgtaatac

SEQ ID NO: 542478 - DNA, 20 bp, Artificial Sequence
  chemically synthesized
agatgtaacgaggatacagt

SEQ ID NO: 542479 - DNA, 20 bp, Artificial Sequence
  chemically synthesized
gacaatattcattcccatta

SEQ ID NO: 542480 - DNA, 20 bp, Artificial Sequence
  chemically synthesized
aaattatccatattctcaca

SEQ ID NO: 542481 - DNA, 20 bp, Artificial Sequence
  chemically synthesized
agatttgttcatttcttatg

SEQ ID NO: 542482 - DNA, 20 bp, Artificial Sequence
  chemically synthesized
ggcacatctgagaaggtggt

SEQ ID NO: 542483 - DNA, 20 bp, Artificial Sequence
  chemically synthesized
tgatgatttgactgccttta

SEQ ID NO: 542484 - DNA, 20 bp, Artificial Sequence
  chemically synthesized
gaggcaagaagatttgcctt

SEQ ID NO: 542485 - DNA, 20 bp, Artificial Sequence
  chemically synthesized
ctcctgaaagttccttgaac

SEQ ID NO: 542486 - DNA, 20 bp, Artificial Sequence
  chemically synthesized
tgcaaatcgttaattacaag

SEQ ID NO: 542487 - DNA, 20 bp, Artificial Sequence
  chemically synthesized
caagttagaaaatataactg

SEQ ID NO: 542488 - DNA, 20 bp, Artificial Sequence
  chemically synthesized
gtgaaaacacataccaaaga

SEQ ID NO: 542489 - DNA, 20 bp, Artificial Sequence
  chemically synthesized
aaaaggtgaaaacacatacc

SEQ ID NO: 542490 - DNA, 20 bp, Artificial Sequence
  chemically synthesized
agatataaatatttggctct

SEQ ID NO: 542491 - DNA, 20 bp, Artificial Sequence
  chemically synthesized
atcccatttgacagatgtgt

SEQ ID NO: 542492 - DNA, 20 bp, Artificial Sequence
  chemically synthesized
ccatccctaaaggtaaataa

SEQ ID NO: 542493 - DNA, 20 bp, Artificial Sequence
  chemically synthesized
caagatttggcttttgttgc

SEQ ID NO: 542494 - DNA, 20 bp, Artificial Sequence
  chemically synthesized
atgtgtgtgtacaaccaaaa

SEQ ID NO: 542495 - DNA, 20 bp, Artificial Sequence
  chemically synthesized
aataagaatctatctataag

SEQ ID NO: 542496 - DNA, 20 bp, Artificial Sequence
  chemically synthesized
ttggaattgttatcaaggtt

SEQ ID NO: 542497 - DNA, 20 bp, Artificial Sequence
  chemically synthesized
aatgtacgcacacctctcct

SEQ ID NO: 542498 - DNA, 20 bp, Artificial Sequence
  chemically synthesized
taggagaggtgtgcgtacat

SEQ ID NO: 542499 - DNA, 20 bp, Artificial Sequence
  chemically synthesized
agcatctgcccttttgactg

SEQ ID NO: 542500 - DNA, 20 bp, Artificial Sequence
  chemically synthesized
aatgcataggaaaaatatgc

SEQ ID NO: 542501 - DNA, 20 bp, Artificial Sequence
  chemically synthesized
atttttcctatgcattattg

SEQ ID NO: 542502 - DNA, 20 bp, Artificial Sequence
  chemically synthesized
gattccagattcaatatttc

SEQ ID NO: 542503 - DNA, 20 bp, Artificial Sequence
  chemically synthesized
actgcattagctctgggaag

SEQ ID NO: 542504 - DNA, 20 bp, Artificial Sequence
  chemically synthesized
ttccataaaaatcagagcat

SEQ ID NO: 542505 - DNA, 20 bp, Artificial Sequence
  chemically synthesized
ttacatggtgatgagtgggg

SEQ ID NO: 542506 - DNA, 20 bp, Artificial Sequence
  chemically synthesized
tctccccactcatcaccatg

SEQ ID NO: 542507 - DNA, 20 bp, Artificial Sequence
  chemically synthesized
acagcaaaaaggtaagacaa

SEQ ID NO: 542508 - DNA, 20 bp, Artificial Sequence
  chemically synthesized
cactcccagactccacactt

SEQ ID NO: 542509 - DNA, 20 bp, Artificial Sequence
  chemically synthesized
cccttctattttaaccatct

SEQ ID NO: 542510 - DNA, 20 bp, Artificial Sequence
  chemically synthesized
aagggttccttcttacataa

SEQ ID NO: 542511 - DNA, 20 bp, Artificial Sequence
  chemically synthesized
caatatttttattctcaggc

SEQ ID NO: 542512 - DNA, 20 bp, Artificial Sequence
  chemically synthesized
taagtcctatattctttgcc

SEQ ID NO: 542513 - DNA, 20 bp, Artificial Sequence
  chemically synthesized
tttttgaagtaaatattgat

SEQ ID NO: 542514 - DNA, 20 bp, Artificial Sequence
  chemically synthesized
tatttaactttaatagtatc

SEQ ID NO: 542515 - DNA, 20 bp, Artificial Sequence
  chemically synthesized
aaagcaaaataaaagtgtat

SEQ ID NO: 542516 - DNA, 20 bp, Artificial Sequence
  chemically synthesized
tattactatgtggcaaatgg

SEQ ID NO: 542517 - DNA, 20 bp, Artificial Sequence
  chemically synthesized
aatagggtttgacatcatta

SEQ ID NO: 542518 - DNA, 20 bp, Artificial Sequence
  chemically synthesized
tgccctgagttgattattat

SEQ ID NO: 542519 - DNA, 20 bp, Artificial Sequence
  chemically synthesized
aaaataacagaataaatcaa

SEQ ID NO: 542520 - DNA, 20 bp, Artificial Sequence
  chemically synthesized
agtaaatttaacataaaata

SEQ ID NO: 542521 - DNA, 20 bp, Artificial Sequence
  chemically synthesized
ctctattttaaaaagtaaac

SEQ ID NO: 542522 - DNA, 20 bp, Artificial Sequence
  chemically synthesized
tggatgagtattttttaaat

SEQ ID NO: 542523 - DNA, 20 bp, Artificial Sequence
  chemically synthesized
ttgtttaaagatcaccacag

SEQ ID NO: 542524 - DNA, 20 bp, Artificial Sequence
  chemically synthesized
gagatacctttatatcctct

SEQ ID NO: 542525 - DNA, 20 bp, Artificial Sequence
  chemically synthesized
tctcctactttgtttcaaaa

SEQ ID NO: 542526 - DNA, 20 bp, Artificial Sequence
  chemically synthesized
tcttattttgaaacaaagta

SEQ ID NO: 542527 - DNA, 20 bp, Artificial Sequence
  chemically synthesized
aatataaaaacaagactatc

SEQ ID NO: 542528 - DNA, 20 bp, Artificial Sequence
  chemically synthesized
ttagttgccaattccttacc

SEQ ID NO: 542529 - DNA, 20 bp, Artificial Sequence
  chemically synthesized
tctactttcaggctgagatg

SEQ ID NO: 542530 - DNA, 20 bp, Artificial Sequence
  chemically synthesized
gaaatatgaatgtccatgtt

SEQ ID NO: 542531 - DNA, 20 bp, Artificial Sequence
  chemically synthesized
aaattgtcacctcatcttag

SEQ ID NO: 542532 - DNA, 20 bp, Artificial Sequence
  chemically synthesized
aaatataactttttatcctc

SEQ ID NO: 542533 - DNA, 20 bp, Artificial Sequence
  chemically synthesized
tgacatttttggcagatgta

SEQ ID NO: 542534 - DNA, 20 bp, Artificial Sequence
  chemically synthesized
atttttggcagatgtagaag

SEQ ID NO: 542535 - DNA, 20 bp, Artificial Sequence
  chemically synthesized
cattttgaacaacaaaagac

SEQ ID NO: 542536 - DNA, 20 bp, Artificial Sequence
  chemically synthesized
cttttaattactagagcatt

SEQ ID NO: 542537 - DNA, 20 bp, Artificial Sequence
  chemically synthesized
cagacatatagaccaaagga

SEQ ID NO: 542538 - DNA, 20 bp, Artificial Sequence
  chemically synthesized
caactgatcaaccaaggggc

SEQ ID NO: 542539 - DNA, 20 bp, Artificial Sequence
  chemically synthesized
ttctcagaaccatttattga

SEQ ID NO: 542540 - DNA, 20 bp, Artificial Sequence
  chemically synthesized
ttctcttcaataaatggttc

SEQ ID NO: 542541 - DNA, 20 bp, Artificial Sequence
  chemically synthesized
ctgaacctataaaatgattt

SEQ ID NO: 542542 - DNA, 20 bp, Artificial Sequence
  chemically synthesized
tacttactatcataatctat

SEQ ID NO: 542543 - DNA, 20 bp, Artificial Sequence
  chemically synthesized
aaataaggaacacttacaac

SEQ ID NO: 542544 - DNA, 20 bp, Artificial Sequence
  chemically synthesized
gattaattattgtttcttaa

SEQ ID NO: 542545 - DNA, 20 bp, Artificial Sequence
  chemically synthesized
tttcgatgtggaattctcat

SEQ ID NO: 542546 - DNA, 20 bp, Artificial Sequence
  chemically synthesized
acatagagagagagaggtgt

SEQ ID NO: 542547 - DNA, 20 bp, Artificial Sequence
  chemically synthesized
aagactggacgtcagattgt

SEQ ID NO: 542548 - DNA, 20 bp, Artificial Sequence
  chemically synthesized
attatttcataatattatga

SEQ ID NO: 542549 - DNA, 20 bp, Artificial Sequence
  chemically synthesized
caattagaaatattaaatca

SEQ ID NO: 542550 - DNA, 20 bp, Artificial Sequence
  chemically synthesized
atatgcatgtgtgtagacaa

SEQ ID NO: 542551 - DNA, 20 bp, Artificial Sequence
  chemically synthesized
atgattaactctctgtttaa

SEQ ID NO: 542552 - DNA, 20 bp, Artificial Sequence
  chemically synthesized
aaatagaagtcatgtaaaat

SEQ ID NO: 542553 - DNA, 20 bp, Artificial Sequence
  chemically synthesized
taattcatccaaatttatgg

SEQ ID NO: 542554 - DNA, 20 bp, Artificial Sequence
  chemically synthesized
atatatattgaaattatgat

SEQ ID NO: 542555 - DNA, 20 bp, Artificial Sequence
  chemically synthesized
aatatatattgtatcatata

SEQ ID NO: 542556 - DNA, 20 bp, Artificial Sequence
  chemically synthesized
ctggttttcatcagcacttt

SEQ ID NO: 542557 - DNA, 20 bp, Artificial Sequence
  chemically synthesized
aattttgctttgtagttttc

SEQ ID NO: 542558 - DNA, 20 bp, Artificial Sequence
  chemically synthesized
acattacttttaaactgaaa

SEQ ID NO: 542559 - DNA, 20 bp, Artificial Sequence
  chemically synthesized
acagatatttttatatcttc

SEQ ID NO: 542560 - DNA, 20 bp, Artificial Sequence
  chemically synthesized
aagttcagagagtaaataat

SEQ ID NO: 542561 - DNA, 20 bp, Artificial Sequence
  chemically synthesized
tataaatgctttattttgat

SEQ ID NO: 542562 - DNA, 20 bp, Artificial Sequence
  chemically synthesized
aaaatatttataaacaaagg

SEQ ID NO: 542563 - DNA, 20 bp, Artificial Sequence
  chemically synthesized
caattgaagcagttctttca

SEQ ID NO: 542564 - DNA, 20 bp, Artificial Sequence
  chemically synthesized
tcctgacatttaaaccagaa

SEQ ID NO: 542565 - DNA, 20 bp, Artificial Sequence
  chemically synthesized
gtaacattagagacctgttt

SEQ ID NO: 542566 - DNA, 20 bp, Artificial Sequence
  chemically synthesized
tgagcacttttcgttctttt

SEQ ID NO: 542567 - DNA, 20 bp, Artificial Sequence
  chemically synthesized
agaaacttggaatagaaatg

SEQ ID NO: 542568 - DNA, 20 bp, Artificial Sequence
  chemically synthesized
cccccaaaaagaaacttgga

SEQ ID NO: 542569 - DNA, 20 bp, Artificial Sequence
  chemically synthesized
tccaagtttctttttggggg

SEQ ID NO: 542570 - DNA, 20 bp, Artificial Sequence
  chemically synthesized
ttaattattctcacccccaa

SEQ ID NO: 542571 - DNA, 20 bp, Artificial Sequence
  chemically synthesized
tatgaaaatatattatcgaa

SEQ ID NO: 542572 - DNA, 20 bp, Artificial Sequence
  chemically synthesized
tattttaagatatttgttaa

SEQ ID NO: 542573 - DNA, 20 bp, Artificial Sequence
  chemically synthesized
attgatattatggagtagat

SEQ ID NO: 542574 - DNA, 20 bp, Artificial Sequence
  chemically synthesized
aagtcacataaaatgaaaac

SEQ ID NO: 542575 - DNA, 20 bp, Artificial Sequence
  chemically synthesized
ttaaggctacagattacctg

SEQ ID NO: 542576 - DNA, 20 bp, Artificial Sequence
  chemically synthesized
tctcaggtaatctgtagcct

SEQ ID NO: 542577 - DNA, 20 bp, Artificial Sequence
  chemically synthesized
ttgcaataatcctaacaact

SEQ ID NO: 542578 - DNA, 20 bp, Artificial Sequence
  chemically synthesized
aatatattttaaatggaaat

SEQ ID NO: 542579 - DNA, 20 bp, Artificial Sequence
  chemically synthesized
tttccatttaaaatatattt

SEQ ID NO: 542580 - DNA, 20 bp, Artificial Sequence
  chemically synthesized
ataattctgctaagaactgt

SEQ ID NO: 542581 - DNA, 20 bp, Artificial Sequence
  chemically synthesized
tatattctgcacagttctta

SEQ ID NO: 542582 - DNA, 20 bp, Artificial Sequence
  chemically synthesized
tatagactcaaaaaagacac

SEQ ID NO: 542583 - DNA, 20 bp, Artificial Sequence
  chemically synthesized
agtaactgctcttttataag

SEQ ID NO: 542584 - DNA, 20 bp, Artificial Sequence
  chemically synthesized
gggtacctgcgtatttgcca

SEQ ID NO: 542585 - DNA, 20 bp, Artificial Sequence
  chemically synthesized
ccaattttgagcagcgtcta

SEQ ID NO: 542586 - DNA, 20 bp, Artificial Sequence
  chemically synthesized
tccatgaagtttcgattatt

SEQ ID NO: 542587 - DNA, 20 bp, Artificial Sequence
  chemically synthesized
tgcctttttacactgtcctt

SEQ ID NO: 542588 - DNA, 20 bp, Artificial Sequence
  chemically synthesized
gcctttatttctgaagatat

SEQ ID NO: 542589 - DNA, 20 bp, Artificial Sequence
  chemically synthesized
ttttatttttctgtatatct

SEQ ID NO: 542590 - DNA, 20 bp, Artificial Sequence
  chemically synthesized
cacaggaaaacatacatttg

SEQ ID NO: 542591 - DNA, 20 bp, Artificial Sequence
  chemically synthesized
ccttttatttagtataacat

SEQ ID NO: 542592 - DNA, 20 bp, Artificial Sequence
  chemically synthesized
ttgcacaggtatatgttatt

SEQ ID NO: 542593 - DNA, 20 bp, Artificial Sequence
  chemically synthesized
gagatcagtttagaagaaat

SEQ ID NO: 542594 - DNA, 20 bp, Artificial Sequence
  chemically synthesized
caagtcatgagatcagttta

SEQ ID NO: 542595 - DNA, 20 bp, Artificial Sequence
  chemically synthesized
ctaataatgctatcctccca

SEQ ID NO: 542596 - DNA, 20 bp, Artificial Sequence
  chemically synthesized
actttccaagaagacgaaat

SEQ ID NO: 542597 - DNA, 20 bp, Artificial Sequence
  chemically synthesized
gaggcaggtggatcacctaa

SEQ ID NO: 542598 - DNA, 20 bp, Artificial Sequence
  chemically synthesized
tttcataataatcccatagg

SEQ ID NO: 542599 - DNA, 20 bp, Artificial Sequence
  chemically synthesized
aggtaatttatatattatat

SEQ ID NO: 542600 - DNA, 20 bp, Artificial Sequence
  chemically synthesized
gtgacagggatgagatataa

SEQ ID NO: 542601 - DNA, 20 bp, Artificial Sequence
  chemically synthesized
ctctgtgggaggctgagaca

SEQ ID NO: 542602 - DNA, 20 bp, Artificial Sequence
  chemically synthesized
tttcagggaagctatgaatc

SEQ ID NO: 542603 - DNA, 20 bp, Artificial Sequence
  chemically synthesized
cagaaattcatatgttaaat

SEQ ID NO: 542604 - DNA, 20 bp, Artificial Sequence
  chemically synthesized
gatccctgcctataactggc

SEQ ID NO: 542605 - DNA, 20 bp, Artificial Sequence
  chemically synthesized
gctgattttgtatggatttg

SEQ ID NO: 542606 - DNA, 20 bp, Artificial Sequence
  chemically synthesized
aataatgactgaattttaaa

SEQ ID NO: 542607 - DNA, 20 bp, Artificial Sequence
  chemically synthesized
ttagattattataatttaga

SEQ ID NO: 542608 - DNA, 20 bp, Artificial Sequence
  chemically synthesized
ttatcttctaatgatatgta

SEQ ID NO: 542609 - DNA, 20 bp, Artificial Sequence
  chemically synthesized
tatagccctgaactgagtaa

SEQ ID NO: 542610 - DNA, 20 bp, Artificial Sequence
  chemically synthesized
atgtacctcaatattattcc

SEQ ID NO: 542611 - DNA, 20 bp, Artificial Sequence
  chemically synthesized
attatgaattacctaaatag

SEQ ID NO: 542612 - DNA, 20 bp, Artificial Sequence
  chemically synthesized
ttgctctcatttgttttaag

SEQ ID NO: 542613 - DNA, 20 bp, Artificial Sequence
  chemically synthesized
ggttgaataactaccttgtg

SEQ ID NO: 542614 - DNA, 20 bp, Artificial Sequence
  chemically synthesized
tattgatatgtttcgtgaac

SEQ ID NO: 542615 - DNA, 20 bp, Artificial Sequence
  chemically synthesized
gcatgacgttatttatagag

SEQ ID NO: 542616 - DNA, 20 bp, Artificial Sequence
  chemically synthesized
tttatagagcaagaaacatc

SEQ ID NO: 542617 - DNA, 20 bp, Artificial Sequence
  chemically synthesized
cacccataacatggagttgg

SEQ ID NO: 542618 - DNA, 20 bp, Artificial Sequence
  chemically synthesized
caactccatgttatgggtga

SEQ ID NO: 542619 - DNA, 20 bp, Artificial Sequence
  chemically synthesized
cacacaatgcttgtgttaag

SEQ ID NO: 542620 - DNA, 20 bp, Artificial Sequence
  chemically synthesized
cttgtgttaagagagaatca

SEQ ID NO: 542621 - DNA, 20 bp, Artificial Sequence
  chemically synthesized
gagaatcatcagaatctctc

SEQ ID NO: 542622 - DNA, 20 bp, Artificial Sequence
  chemically synthesized
tcagaatctctctcagaaaa

SEQ ID NO: 542623 - DNA, 20 bp, Artificial Sequence
  chemically synthesized
aaggtccatgaacagagaga

SEQ ID NO: 542624 - DNA, 20 bp, Artificial Sequence
  chemically synthesized
ctacttggttggctgaggca

SEQ ID NO: 542625 - DNA, 20 bp, Artificial Sequence
  chemically synthesized
caacccagatttaaagagct

SEQ ID NO: 542626 - DNA, 20 bp, Artificial Sequence
  chemically synthesized
ctctttgactgctttgacca

SEQ ID NO: 542627 - DNA, 20 bp, Artificial Sequence
  chemically synthesized
gattctaaaagggagcaccc

SEQ ID NO: 542628 - DNA, 20 bp, Artificial Sequence
  chemically synthesized
cattcttagggtgctccctt

SEQ ID NO: 542629 - DNA, 20 bp, Artificial Sequence
  chemically synthesized
ccatccaacatattatgctc

SEQ ID NO: 542630 - DNA, 20 bp, Artificial Sequence
  chemically synthesized
aacaatggactaaaatcaca

SEQ ID NO: 542631 - DNA, 20 bp, Artificial Sequence
  chemically synthesized
ccactaatggttttgcgtgt

SEQ ID NO: 542632 - DNA, 20 bp, Artificial Sequence
  chemically synthesized
tatggaaacaggaatgtgtc

SEQ ID NO: 542633 - DNA, 20 bp, Artificial Sequence
  chemically synthesized
actaaagcaaaacaaatgag

SEQ ID NO: 542634 - DNA, 20 bp, Artificial Sequence
  chemically synthesized
cacaccttgtctctcttcaa

SEQ ID NO: 542635 - DNA, 20 bp, Artificial Sequence
  chemically synthesized
aggagtttggcaaaatttaa

SEQ ID NO: 542636 - DNA, 20 bp, Artificial Sequence
  chemically synthesized
aaatttaacaagaaatgtag

SEQ ID NO: 542637 - DNA, 20 bp, Artificial Sequence
  chemically synthesized
cactatgtgtgtctgtacag

SEQ ID NO: 542638 - DNA, 20 bp, Artificial Sequence
  chemically synthesized
ttttcaagcgttagaggaaa

SEQ ID NO: 542639 - DNA, 20 bp, Artificial Sequence
  chemically synthesized
cacaaatttaactgacatgg

SEQ ID NO: 542640 - DNA, 20 bp, Artificial Sequence
  chemically synthesized
gaaagaaaagcaccaaataa

SEQ ID NO: 542641 - DNA, 20 bp, Artificial Sequence
  chemically synthesized
taaagagaaagaacagtcaa

SEQ ID NO: 542642 - DNA, 20 bp, Artificial Sequence
  chemically synthesized
gagaaagaacagtcaaagag

SEQ ID NO: 542643 - DNA, 20 bp, Artificial Sequence
  chemically synthesized
aaagagaaagaaaagaagaa

SEQ ID NO: 542644 - DNA, 20 bp, Artificial Sequence
  chemically synthesized
gaaaagaagaactagaaaag

SEQ ID NO: 542645 - DNA, 20 bp, Artificial Sequence
  chemically synthesized
aaatctcacatcaattgatg

SEQ ID NO: 542646 - DNA, 20 bp, Artificial Sequence
  chemically synthesized
atcaattgatgtgagaattt

SEQ ID NO: 542647 - DNA, 20 bp, Artificial Sequence
  chemically synthesized
gagagaagtggatgacgaga

SEQ ID NO: 542648 - DNA, 20 bp, Artificial Sequence
  chemically synthesized
ttaaaaaaacctgtttaaag

SEQ ID NO: 542649 - DNA, 20 bp, Artificial Sequence
  chemically synthesized
ggaggagaggtggctctttt

SEQ ID NO: 542650 - DNA, 20 bp, Artificial Sequence
  chemically synthesized
tatcattcttgggctagaca

SEQ ID NO: 542651 - DNA, 20 bp, Artificial Sequence
  chemically synthesized
tgattttctcatgtctagcc

SEQ ID NO: 542652 - DNA, 20 bp, Artificial Sequence
  chemically synthesized
agcaatgaagttttcttatc

SEQ ID NO: 542653 - DNA, 20 bp, Artificial Sequence
  chemically synthesized
agaaatgagaatttctcaga

SEQ ID NO: 542654 - DNA, 20 bp, Artificial Sequence
  chemically synthesized
gtagttgactactgaagaaa

SEQ ID NO: 542655 - DNA, 20 bp, Artificial Sequence
  chemically synthesized
aaccaatgtagttgactact

SEQ ID NO: 542656 - DNA, 20 bp, Artificial Sequence
  chemically synthesized
tatctgctgaggatgagagg

SEQ ID NO: 542657 - DNA, 20 bp, Artificial Sequence
  chemically synthesized
aggaaactgatttaaaaaaa

SEQ ID NO: 542658 - DNA, 20 bp, Artificial Sequence
  chemically synthesized
aaaaacaaaaaaaaaaaaaa

SEQ ID NO: 542659 - DNA, 20 bp, Artificial Sequence
  chemically synthesized
caaaaaaaaaaaaaaaaaga

SEQ ID NO: 542660 - DNA, 20 bp, Artificial Sequence
  chemically synthesized
atcttcatgtacaaatgaag

SEQ ID NO: 542661 - DNA, 20 bp, Artificial Sequence
  chemically synthesized
atcctccaaatggacatttg

SEQ ID NO: 542662 - DNA, 20 bp, Artificial Sequence
  chemically synthesized
aatggacatttgtgagaaaa

SEQ ID NO: 542663 - DNA, 20 bp, Artificial Sequence
  chemically synthesized
atatataagtaaattacaaa

SEQ ID NO: 542664 - DNA, 20 bp, Artificial Sequence
  chemically synthesized
gcagaaatatatgcaatgta

SEQ ID NO: 542665 - DNA, 20 bp, Artificial Sequence
  chemically synthesized
aatttaaaaaaattttaaaa

SEQ ID NO: 542666 - DNA, 20 bp, Artificial Sequence
  chemically synthesized
gaaaaacccatgctctgtga

SEQ ID NO: 542667 - DNA, 20 bp, Artificial Sequence
  chemically synthesized
tgatttaactagcatatggc

SEQ ID NO: 542668 - DNA, 20 bp, Artificial Sequence
  chemically synthesized
agaaagggttttggagggtc

SEQ ID NO: 542669 - DNA, 20 bp, Artificial Sequence
  chemically synthesized
ggttttggagggtcagagaa

SEQ ID NO: 542670 - DNA, 20 bp, Artificial Sequence
  chemically synthesized
aaagactgaatgtgagttag

SEQ ID NO: 542671 - DNA, 20 bp, Artificial Sequence
  chemically synthesized
tttgaaaaaaaaaattataa

SEQ ID NO: 542672 - DNA, 20 bp, Artificial Sequence
  chemically synthesized
tgctttgtaatgctgagctt

SEQ ID NO: 542673 - DNA, 20 bp, Artificial Sequence
  chemically synthesized
tacatatttccattaaatag

SEQ ID NO: 542674 - DNA, 20 bp, Artificial Sequence
  chemically synthesized
gaggatgagcttctgtgttt

SEQ ID NO: 542675 - DNA, 20 bp, Artificial Sequence
  chemically synthesized
ctacaaatatgcgaatttca

SEQ ID NO: 542676 - DNA, 20 bp, Artificial Sequence
  chemically synthesized
gcataatctactcaatgcat

SEQ ID NO: 542677 - DNA, 20 bp, Artificial Sequence
  chemically synthesized
tgtctataccacagaacttc

SEQ ID NO: 542678 - DNA, 20 bp, Artificial Sequence
  chemically synthesized
taatatatattgtgtatatc

SEQ ID NO: 542679 - DNA, 20 bp, Artificial Sequence
  chemically synthesized
tgttttacagcttacccata

SEQ ID NO: 542680 - DNA, 20 bp, Artificial Sequence
  chemically synthesized
cattttttacttatgtggtt

SEQ ID NO: 542681 - DNA, 20 bp, Artificial Sequence
  chemically synthesized
tagcgcaggcttattgtgaa

SEQ ID NO: 542682 - DNA, 20 bp, Artificial Sequence
  chemically synthesized
aaaagtaacttgtacaaata

SEQ ID NO: 542683 - DNA, 20 bp, Artificial Sequence
  chemically synthesized
catattctcataatgtcaaa

SEQ ID NO: 542684 - DNA, 20 bp, Artificial Sequence
  chemically synthesized
cattttcttttttgacatta

SEQ ID NO: 542685 - DNA, 20 bp, Artificial Sequence
  chemically synthesized
gacattatgagaatatgatg

SEQ ID NO: 542686 - DNA, 20 bp, Artificial Sequence
  chemically synthesized
tgaaagaaaataaaattgtg

SEQ ID NO: 542687 - DNA, 20 bp, Artificial Sequence
  chemically synthesized
cctcacatctttaggacaac

SEQ ID NO: 542688 - DNA, 20 bp, Artificial Sequence
  chemically synthesized
gatatggatagtaagcattt

SEQ ID NO: 542689 - DNA, 20 bp, Artificial Sequence
  chemically synthesized
aagccaggctgataatttca

SEQ ID NO: 542690 - DNA, 20 bp, Artificial Sequence
  chemically synthesized
tgttctcaatccagtacctt

SEQ ID NO: 542691 - DNA, 20 bp, Artificial Sequence
  chemically synthesized
ttatattacttgactttgat

SEQ ID NO: 542692 - DNA, 20 bp, Artificial Sequence
  chemically synthesized
attttctgttactatatata

SEQ ID NO: 542693 - DNA, 20 bp, Artificial Sequence
  chemically synthesized
ccattctcatatatatagta

SEQ ID NO: 542694 - DNA, 20 bp, Artificial Sequence
  chemically synthesized
gcagcaggctaaagtactta

SEQ ID NO: 542695 - DNA, 20 bp, Artificial Sequence
  chemically synthesized
gctaaagtacttaacagaat

SEQ ID NO: 542696 - DNA, 20 bp, Artificial Sequence
  chemically synthesized
attggagtttctgtggtgtc

SEQ ID NO: 542697 - DNA, 20 bp, Artificial Sequence
  chemically synthesized
tttttcctttctttgacacc

SEQ ID NO: 542698 - DNA, 20 bp, Artificial Sequence
  chemically synthesized
gtcaaagaaaggaaaaattt

SEQ ID NO: 542699 - DNA, 20 bp, Artificial Sequence
  chemically synthesized
aaggaaaaatttagagaaaa

SEQ ID NO: 542700 - DNA, 20 bp, Artificial Sequence
  chemically synthesized
aattttgaaattgctatttt

SEQ ID NO: 542701 - DNA, 20 bp, Artificial Sequence
  chemically synthesized
tggccacatatcacacgtac

SEQ ID NO: 542702 - DNA, 20 bp, Artificial Sequence
  chemically synthesized
tcacacgtacttagaaaacg

SEQ ID NO: 542703 - DNA, 20 bp, Artificial Sequence
  chemically synthesized
tttccaaagataggaaaatg

SEQ ID NO: 542704 - DNA, 20 bp, Artificial Sequence
  chemically synthesized
caagaaatataattattttc

SEQ ID NO: 542705 - DNA, 20 bp, Artificial Sequence
  chemically synthesized
taattcaacaagtaaaaaaa

SEQ ID NO: 542706 - DNA, 20 bp, Artificial Sequence
  chemically synthesized
ccccccccaagtagagttac

SEQ ID NO: 542707 - DNA, 20 bp, Artificial Sequence
  chemically synthesized
taaagaagttttgactttta

SEQ ID NO: 542708 - DNA, 20 bp, Artificial Sequence
  chemically synthesized
agccacagacactttttcct

SEQ ID NO: 542709 - DNA, 20 bp, Artificial Sequence
  chemically synthesized
ggttctgtggtcaagattac

SEQ ID NO: 542710 - DNA, 20 bp, Artificial Sequence
  chemically synthesized
attattacttgtaatatacc

SEQ ID NO: 542711 - DNA, 20 bp, Artificial Sequence
  chemically synthesized
ttctgtgaagaatgtctttg

SEQ ID NO: 542712 - DNA, 20 bp, Artificial Sequence
  chemically synthesized
ttctaacaaagacattcttc

SEQ ID NO: 542713 - DNA, 20 bp, Artificial Sequence
  chemically synthesized
caaagacattcttcacagaa

SEQ ID NO: 542714 - DNA, 20 bp, Artificial Sequence
  chemically synthesized
attgttttttctatttctgt

SEQ ID NO: 542715 - DNA, 20 bp, Artificial Sequence
  chemically synthesized
tatatggaactgcagcagac

SEQ ID NO: 542716 - DNA, 20 bp, Artificial Sequence
  chemically synthesized
ccaaatatatcctaagcaaa

SEQ ID NO: 542717 - DNA, 20 bp, Artificial Sequence
  chemically synthesized
caaacacacagcccaataga

SEQ ID NO: 542718 - DNA, 20 bp, Artificial Sequence
  chemically synthesized
ggaaaattggatatccaaat

SEQ ID NO: 542719 - DNA, 20 bp, Artificial Sequence
  chemically synthesized
acctctatcttgaaccgtat

SEQ ID NO: 542720 - DNA, 20 bp, Artificial Sequence
  chemically synthesized
ctcaaattatgaaactacca

SEQ ID NO: 542721 - DNA, 20 bp, Artificial Sequence
  chemically synthesized
actaccacaagaaaactttg

SEQ ID NO: 542722 - DNA, 20 bp, Artificial Sequence
  chemically synthesized
ctccagaacattggtctagg

SEQ ID NO: 542723 - DNA, 20 bp, Artificial Sequence
  chemically synthesized
tgtgcttgtgtggtatggtt

SEQ ID NO: 542724 - DNA, 20 bp, Artificial Sequence
  chemically synthesized
aagagacaacccatggaatg

SEQ ID NO: 542725 - DNA, 20 bp, Artificial Sequence
  chemically synthesized
atctgacaagggatcaataa

SEQ ID NO: 542726 - DNA, 20 bp, Artificial Sequence
  chemically synthesized
tctcaatatcactgatcata

SEQ ID NO: 542727 - DNA, 20 bp, Artificial Sequence
  chemically synthesized
acaaatgttggcgaggatat

SEQ ID NO: 542728 - DNA, 20 bp, Artificial Sequence
  chemically synthesized
cactgctgtgtatataccca

SEQ ID NO: 542729 - DNA, 20 bp, Artificial Sequence
  chemically synthesized
gctgtgtatatacccaaaag

SEQ ID NO: 542730 - DNA, 20 bp, Artificial Sequence
  chemically synthesized
agaaagaaaatcagtacact

SEQ ID NO: 542731 - DNA, 20 bp, Artificial Sequence
  chemically synthesized
ccattaaaaaacgaatggat

SEQ ID NO: 542732 - DNA, 20 bp, Artificial Sequence
  chemically synthesized
cagatgacatgattgtatat

SEQ ID NO: 542733 - DNA, 20 bp, Artificial Sequence
  chemically synthesized
cccatcaatacctaatttat

SEQ ID NO: 542734 - DNA, 20 bp, Artificial Sequence
  chemically synthesized
acatgattatctcaatagat

SEQ ID NO: 542735 - DNA, 20 bp, Artificial Sequence
  chemically synthesized
ggcagagacacaaccaaaaa

SEQ ID NO: 542736 - DNA, 20 bp, Artificial Sequence
  chemically synthesized
gtctctgcccggctttggta

SEQ ID NO: 542737 - DNA, 20 bp, Artificial Sequence
  chemically synthesized
ttctgaaactattccaatcc

SEQ ID NO: 542738 - DNA, 20 bp, Artificial Sequence
  chemically synthesized
gctcatcatcactggccatc

SEQ ID NO: 542739 - DNA, 20 bp, Artificial Sequence
  chemically synthesized
gagataccatctcacaccag

SEQ ID NO: 542740 - DNA, 20 bp, Artificial Sequence
  chemically synthesized
acaggtgctggagaggatgt

SEQ ID NO: 542741 - DNA, 20 bp, Artificial Sequence
  chemically synthesized
gattcctcagggatctagaa

SEQ ID NO: 542742 - DNA, 20 bp, Artificial Sequence
  chemically synthesized
ctcacaatgatacaatggat

SEQ ID NO: 542743 - DNA, 20 bp, Artificial Sequence
  chemically synthesized
ttgtccttgagatagtttgc

SEQ ID NO: 542744 - DNA, 20 bp, Artificial Sequence
  chemically synthesized
ttaaagtataataataaaaa

SEQ ID NO: 542745 - DNA, 20 bp, Artificial Sequence
  chemically synthesized
acagtactattcagccataa

SEQ ID NO: 542746 - DNA, 20 bp, Artificial Sequence
  chemically synthesized
ttaagtgaaataagccagtc

SEQ ID NO: 542747 - DNA, 20 bp, Artificial Sequence
  chemically synthesized
atggttaatgggtacaaaaa

SEQ ID NO: 542748 - DNA, 20 bp, Artificial Sequence
  chemically synthesized
cgtgcctacaaacattgaaa

SEQ ID NO: 542749 - DNA, 20 bp, Artificial Sequence
  chemically synthesized
ggaacattttggaatgctgc

SEQ ID NO: 542750 - DNA, 20 bp, Artificial Sequence
  chemically synthesized
aaagggctaattattaaagt

SEQ ID NO: 542751 - DNA, 20 bp, Artificial Sequence
  chemically synthesized
attaaaattcattaaatgga

SEQ ID NO: 542752 - DNA, 20 bp, Artificial Sequence
  chemically synthesized
tttttaaaaccctattgaat

SEQ ID NO: 542753 - DNA, 20 bp, Artificial Sequence
  chemically synthesized
gcaccaaagaaagataaaat

SEQ ID NO: 542754 - DNA, 20 bp, Artificial Sequence
  chemically synthesized
gccactcattagatagcacc

SEQ ID NO: 542755 - DNA, 20 bp, Artificial Sequence
  chemically synthesized
ataaatttgccagctatttg

SEQ ID NO: 542756 - DNA, 20 bp, Artificial Sequence
  chemically synthesized
acagctgaactttagtggtt

SEQ ID NO: 542757 - DNA, 20 bp, Artificial Sequence
  chemically synthesized
aacaatcacgataaacgctg

SEQ ID NO: 542758 - DNA, 20 bp, Artificial Sequence
  chemically synthesized
atttacttcaaagatagcac

SEQ ID NO: 542759 - DNA, 20 bp, Artificial Sequence
  chemically synthesized
taataatttcatccttatat

SEQ ID NO: 542760 - DNA, 20 bp, Artificial Sequence
  chemically synthesized
gtacacatcaaaataatatg

SEQ ID NO: 542761 - DNA, 20 bp, Artificial Sequence
  chemically synthesized
gttgtaggaaatgtaaaata

SEQ ID NO: 542762 - DNA, 20 bp, Artificial Sequence
  chemically synthesized
agaacttattactctccatt

SEQ ID NO: 542763 - DNA, 20 bp, Artificial Sequence
  chemically synthesized
ccatctactgggctgtgtaa

SEQ ID NO: 542764 - DNA, 20 bp, Artificial Sequence
  chemically synthesized
aattggataatttagtcaaa

SEQ ID NO: 542765 - DNA, 20 bp, Artificial Sequence
  chemically synthesized
attgatttatgagttagaca

SEQ ID NO: 542766 - DNA, 20 bp, Artificial Sequence
  chemically synthesized
ttacgttaaatgcactttaa

SEQ ID NO: 542767 - DNA, 20 bp, Artificial Sequence
  chemically synthesized
aaagaggggatttttaaagc

SEQ ID NO: 542768 - DNA, 20 bp, Artificial Sequence
  chemically synthesized
attaacaatgtgagtacaat

SEQ ID NO: 542769 - DNA, 20 bp, Artificial Sequence
  chemically synthesized
gaggttacaaaaaaatgaga

SEQ ID NO: 542770 - DNA, 20 bp, Artificial Sequence
  chemically synthesized
tgttctatttgttttttccc

SEQ ID NO: 542771 - DNA, 20 bp, Artificial Sequence
  chemically synthesized
aagattcaaaactaaaatta

SEQ ID NO: 542772 - DNA, 20 bp, Artificial Sequence
  chemically synthesized
tgacatgttaacaaatgggg

SEQ ID NO: 542773 - DNA, 20 bp, Artificial Sequence
  chemically synthesized
gggttagaaaaaaatgaatt

SEQ ID NO: 542774 - DNA, 20 bp, Artificial Sequence
  chemically synthesized
acaaattttaatttagacaa

SEQ ID NO: 542775 - DNA, 20 bp, Artificial Sequence
  chemically synthesized
ctaatggaaaatgggtgatg

SEQ ID NO: 542776 - DNA, 20 bp, Artificial Sequence
  chemically synthesized
gaggaaaaaatcaaaatagg

SEQ ID NO: 542777 - DNA, 20 bp, Artificial Sequence
  chemically synthesized
aacgttgacacagtcataga

SEQ ID NO: 542778 - DNA, 20 bp, Artificial Sequence
  chemically synthesized
agaatctttatagaagagtg

SEQ ID NO: 542779 - DNA, 20 bp, Artificial Sequence
  chemically synthesized
attctaatgtgtagctaatt

SEQ ID NO: 542780 - DNA, 20 bp, Artificial Sequence
  chemically synthesized
attctccaattagctacaca

SEQ ID NO: 542781 - DNA, 20 bp, Artificial Sequence
  chemically synthesized
tctttaggtggatttggtct

SEQ ID NO: 542782 - DNA, 20 bp, Artificial Sequence
  chemically synthesized
tcacgaaattgtgtgactgc

SEQ ID NO: 542783 - DNA, 20 bp, Artificial Sequence
  chemically synthesized
atggaaatatatcttagaaa

SEQ ID NO: 542784 - DNA, 20 bp, Artificial Sequence
  chemically synthesized
tctagatatggaaatatatc

SEQ ID NO: 542785 - DNA, 20 bp, Artificial Sequence
  chemically synthesized
ttaagaaaagatttattgaa

SEQ ID NO: 542786 - DNA, 20 bp, Artificial Sequence
  chemically synthesized
attttattaaagtacaaaat

SEQ ID NO: 542787 - DNA, 20 bp, Artificial Sequence
  chemically synthesized
gccaagtcaatcctaagcca

SEQ ID NO: 542788 - DNA, 20 bp, Artificial Sequence
  chemically synthesized
gtagttttttccaattctct

SEQ ID NO: 542789 - DNA, 20 bp, Artificial Sequence
  chemically synthesized
agctaccaatgcctttcttc

SEQ ID NO: 542790 - DNA, 20 bp, Artificial Sequence
  chemically synthesized
cccattcgcaattgcttcaa

SEQ ID NO: 542791 - DNA, 20 bp, Artificial Sequence
  chemically synthesized
gtttgtctgttattggtgta

SEQ ID NO: 542792 - DNA, 20 bp, Artificial Sequence
  chemically synthesized
cagatgacatgattgtatat

SEQ ID NO: 542793 - DNA, 20 bp, Artificial Sequence
  chemically synthesized
cccatcaatacctaatttat

SEQ ID NO: 542794 - DNA, 20 bp, Artificial Sequence
  chemically synthesized
acatgattatctcaatagat

SEQ ID NO: 542795 - DNA, 20 bp, Artificial Sequence
  chemically synthesized
gccttgtaatatacagaaaa

SEQ ID NO: 542796 - DNA, 20 bp, Artificial Sequence
  chemically synthesized
ttactgtagccttgtaatat

SEQ ID NO: 542797 - DNA, 20 bp, Artificial Sequence
  chemically synthesized
tttgacaaacctcacaaaaa

SEQ ID NO: 542798 - DNA, 20 bp, Artificial Sequence
  chemically synthesized
ggaaaactggctagccatat

SEQ ID NO: 542799 - DNA, 20 bp, Artificial Sequence
  chemically synthesized
ttaaaaccataaaaacccta

SEQ ID NO: 542800 - DNA, 20 bp, Artificial Sequence
  chemically synthesized
taaagagcttctgcacagca

SEQ ID NO: 542801 - DNA, 20 bp, Artificial Sequence
  chemically synthesized
tcagagtgaacaggcaacct

SEQ ID NO: 542802 - DNA, 20 bp, Artificial Sequence
  chemically synthesized
ctctgacaaagggctaatat

SEQ ID NO: 542803 - DNA, 20 bp, Artificial Sequence
  chemically synthesized
aatgaactcaaacaaatgta

SEQ ID NO: 542804 - DNA, 20 bp, Artificial Sequence
  chemically synthesized
gctcatcatcactggccatc

SEQ ID NO: 542805 - DNA, 20 bp, Artificial Sequence
  chemically synthesized
gagataccatctcacaccag

SEQ ID NO: 542806 - DNA, 20 bp, Artificial Sequence
  chemically synthesized
acaggtgctggagaggatgt

SEQ ID NO: 542807 - DNA, 20 bp, Artificial Sequence
  chemically synthesized
gattcctcagggatctagaa

SEQ ID NO: 542808 - DNA, 20 bp, Artificial Sequence
  chemically synthesized
tggttccaagtctttgctat

SEQ ID NO: 542809 - DNA, 20 bp, Artificial Sequence
  chemically synthesized
ctcacaatgatacaatggat

SEQ ID NO: 542810 - DNA, 20 bp, Artificial Sequence
  chemically synthesized
ttgtccttgcgatagtttgc

SEQ ID NO: 542811 - DNA, 20 bp, Artificial Sequence
  chemically synthesized
cagaagcaaagcttacactt

SEQ ID NO: 542812 - DNA, 20 bp, Artificial Sequence
  chemically synthesized
aacataattttaaatccaat

SEQ ID NO: 542813 - DNA, 20 bp, Artificial Sequence
  chemically synthesized
aattcagaatctgagggccc

SEQ ID NO: 542814 - DNA, 20 bp, Artificial Sequence
  chemically synthesized
ttggcatttattactatagg

SEQ ID NO: 542815 - DNA, 20 bp, Artificial Sequence
  chemically synthesized
atataacaagagtatggttg

SEQ ID NO: 542816 - DNA, 20 bp, Artificial Sequence
  chemically synthesized
atctcaaacgatcttaaaat

SEQ ID NO: 542817 - DNA, 20 bp, Artificial Sequence
  chemically synthesized
atctgcgtgaccagtatatg

SEQ ID NO: 542818 - DNA, 20 bp, Artificial Sequence
  chemically synthesized
taagctaaatataccattta

SEQ ID NO: 542819 - DNA, 20 bp, Artificial Sequence
  chemically synthesized
taaatataccatttatgaga

SEQ ID NO: 542820 - DNA, 20 bp, Artificial Sequence
  chemically synthesized
ttatctttaagtgcaaattt

SEQ ID NO: 542821 - DNA, 20 bp, Artificial Sequence
  chemically synthesized
gaaagaaagaaaagaaagga

SEQ ID NO: 542822 - DNA, 20 bp, Artificial Sequence
  chemically synthesized
atagatagatgaaagaaaga

SEQ ID NO: 542823 - DNA, 20 bp, Artificial Sequence
  chemically synthesized
gatagatagatagatgaaag

SEQ ID NO: 542824 - DNA, 20 bp, Artificial Sequence
  chemically synthesized
gatagatagatagatagatg

SEQ ID NO: 542825 - DNA, 20 bp, Artificial Sequence
  chemically synthesized
gtgtaagatgaaggatccac

SEQ ID NO: 542826 - DNA, 20 bp, Artificial Sequence
  chemically synthesized
gagtacctgagaactctgtt

SEQ ID NO: 542827 - DNA, 20 bp, Artificial Sequence
  chemically synthesized
taaaataaaaccctggagca

SEQ ID NO: 542828 - DNA, 20 bp, Artificial Sequence
  chemically synthesized
caatggtaatacataatatt

SEQ ID NO: 542829 - DNA, 20 bp, Artificial Sequence
  chemically synthesized
atgaaatttcagatctactt

SEQ ID NO: 542830 - DNA, 20 bp, Artificial Sequence
  chemically synthesized
aaatgttattaactacatca

SEQ ID NO: 542831 - DNA, 20 bp, Artificial Sequence
  chemically synthesized
atttttattgtagtattttt

SEQ ID NO: 542832 - DNA, 20 bp, Artificial Sequence
  chemically synthesized
atcctgaatccatttctaaa

SEQ ID NO: 542833 - DNA, 20 bp, Artificial Sequence
  chemically synthesized
cactgtgtgttttttcttat

SEQ ID NO: 542834 - DNA, 20 bp, Artificial Sequence
  chemically synthesized
gtttgtacttcaaaatgcat

SEQ ID NO: 542835 - DNA, 20 bp, Artificial Sequence
  chemically synthesized
gtcatgtagttcttctcaat

SEQ ID NO: 542836 - DNA, 20 bp, Artificial Sequence
  chemically synthesized
cattacactttctatacatg

SEQ ID NO: 542837 - DNA, 20 bp, Artificial Sequence
  chemically synthesized
tgtaatattttcttacatgt

SEQ ID NO: 542838 - DNA, 20 bp, Artificial Sequence
  chemically synthesized
acttacacaagccaggttct

SEQ ID NO: 542839 - DNA, 20 bp, Artificial Sequence
  chemically synthesized
atgaagaaagagaattttgg

SEQ ID NO: 542840 - DNA, 20 bp, Artificial Sequence
  chemically synthesized
ttgcaatagtggatgaagaa

SEQ ID NO: 542841 - DNA, 20 bp, Artificial Sequence
  chemically synthesized
atacaattgcaatagtggat

SEQ ID NO: 542842 - DNA, 20 bp, Artificial Sequence
  chemically synthesized
ccatattgtctaactttgac

SEQ ID NO: 542843 - DNA, 20 bp, Artificial Sequence
  chemically synthesized
acactattttaattctcatt

SEQ ID NO: 542844 - DNA, 20 bp, Artificial Sequence
  chemically synthesized
gtttacctgtttttctagaa

SEQ ID NO: 542845 - DNA, 20 bp, Artificial Sequence
  chemically synthesized
aaacgtgtttacctgttttt

SEQ ID NO: 542846 - DNA, 20 bp, Artificial Sequence
  chemically synthesized
gactgctttccaacaatgcc

SEQ ID NO: 542847 - DNA, 20 bp, Artificial Sequence
  chemically synthesized
tctatcttataaaaagaaaa

SEQ ID NO: 542848 - DNA, 20 bp, Artificial Sequence
  chemically synthesized
agcgagactctatcttataa

SEQ ID NO: 542849 - DNA, 20 bp, Artificial Sequence
  chemically synthesized
ctactcgggaggctgaggca

SEQ ID NO: 542850 - DNA, 20 bp, Artificial Sequence
  chemically synthesized
accataggatagtaaatggt

SEQ ID NO: 542851 - DNA, 20 bp, Artificial Sequence
  chemically synthesized
gcttttagtatagtttgaag

SEQ ID NO: 542852 - DNA, 20 bp, Artificial Sequence
  chemically synthesized
gactatttggaggtaggtag

SEQ ID NO: 542853 - DNA, 20 bp, Artificial Sequence
  chemically synthesized
ctagttgaataaatttaaag

SEQ ID NO: 542854 - DNA, 20 bp, Artificial Sequence
  chemically synthesized
ttgttgaagtaataaaaaca

SEQ ID NO: 542855 - DNA, 20 bp, Artificial Sequence
  chemically synthesized
atttattgttcagcaggatt

SEQ ID NO: 542856 - DNA, 20 bp, Artificial Sequence
  chemically synthesized
aaaggtgattgtggaagagt

SEQ ID NO: 542857 - DNA, 20 bp, Artificial Sequence
  chemically synthesized
gcactcattcagctctgttg

SEQ ID NO: 542858 - DNA, 20 bp, Artificial Sequence
  chemically synthesized
tgatagaaaaaaaatgtgaa

SEQ ID NO: 542859 - DNA, 20 bp, Artificial Sequence
  chemically synthesized
atcaggaggaacattcgacc

SEQ ID NO: 542860 - DNA, 20 bp, Artificial Sequence
  chemically synthesized
gttcaagagatttggtttgc

SEQ ID NO: 542861 - DNA, 20 bp, Artificial Sequence
  chemically synthesized
gagatacatgtacaatctgt

SEQ ID NO: 542862 - DNA, 20 bp, Artificial Sequence
  chemically synthesized
gaatcagctccttgtcaaaa

SEQ ID NO: 542863 - DNA, 20 bp, Artificial Sequence
  chemically synthesized
caaattgtgaaagaaagtag

SEQ ID NO: 542864 - DNA, 20 bp, Artificial Sequence
  chemically synthesized
tttctgtaatccaaattgtg

SEQ ID NO: 542865 - DNA, 20 bp, Artificial Sequence
  chemically synthesized
tttctttcacaatttggatt

SEQ ID NO: 542866 - DNA, 20 bp, Artificial Sequence
  chemically synthesized
gggtttatgttactgctgaa

SEQ ID NO: 542867 - DNA, 20 bp, Artificial Sequence
  chemically synthesized
taacagagtagttgtaaaag

SEQ ID NO: 542868 - DNA, 20 bp, Artificial Sequence
  chemically synthesized
cctcagtcatgctctgtggg

SEQ ID NO: 542869 - DNA, 20 bp, Artificial Sequence
  chemically synthesized
tcttggtttttatattatat

SEQ ID NO: 542870 - DNA, 20 bp, Artificial Sequence
  chemically synthesized
tgttataggctggcttcact

SEQ ID NO: 542871 - DNA, 20 bp, Artificial Sequence
  chemically synthesized
ttaaggtatgggtagaatga

SEQ ID NO: 542872 - DNA, 20 bp, Artificial Sequence
  chemically synthesized
gaattgaagttaaggtatgg

SEQ ID NO: 542873 - DNA, 20 bp, Artificial Sequence
  chemically synthesized
agatgtagagttgagagttg

SEQ ID NO: 542874 - DNA, 20 bp, Artificial Sequence
  chemically synthesized
agtgttagcttttggtggtt

SEQ ID NO: 542875 - DNA, 20 bp, Artificial Sequence
  chemically synthesized
gatagaggaagtagaaatat

SEQ ID NO: 542876 - DNA, 20 bp, Artificial Sequence
  chemically synthesized
tgaaggacatgatagaggaa

SEQ ID NO: 542877 - DNA, 20 bp, Artificial Sequence
  chemically synthesized
agtaaagacaatggagagag

SEQ ID NO: 542878 - DNA, 20 bp, Artificial Sequence
  chemically synthesized
tggcagagtaaaatgccagt

SEQ ID NO: 542879 - DNA, 20 bp, Artificial Sequence
  chemically synthesized
aaggacagtaaagaatcact

SEQ ID NO: 542880 - DNA, 20 bp, Artificial Sequence
  chemically synthesized
gcttttatttgaaggacagt

SEQ ID NO: 542881 - DNA, 20 bp, Artificial Sequence
  chemically synthesized
caaaaaaaaaaaaaaaaaaa

SEQ ID NO: 542882 - DNA, 20 bp, Artificial Sequence
  chemically synthesized
ctacttgagaggctgaggca

SEQ ID NO: 542883 - DNA, 20 bp, Artificial Sequence
  chemically synthesized
ttactccctgctctagctat

SEQ ID NO: 542884 - DNA, 20 bp, Artificial Sequence
  chemically synthesized
gggaacaacatgtttaaggc

SEQ ID NO: 542885 - DNA, 20 bp, Artificial Sequence
  chemically synthesized
aattagccaataaaaggaag

SEQ ID NO: 542886 - DNA, 20 bp, Artificial Sequence
  chemically synthesized
tacaaaattcaaagaacatg

SEQ ID NO: 542887 - DNA, 20 bp, Artificial Sequence
  chemically synthesized
atgttacgtgctctaacttg

SEQ ID NO: 542888 - DNA, 20 bp, Artificial Sequence
  chemically synthesized
gttatggcacatacaaagtg

SEQ ID NO: 542889 - DNA, 20 bp, Artificial Sequence
  chemically synthesized
tcattgctcaataccagttc

SEQ ID NO: 542890 - DNA, 20 bp, Artificial Sequence
  chemically synthesized
tgactgggtgaaaagtataa

SEQ ID NO: 542891 - DNA, 20 bp, Artificial Sequence
  chemically synthesized
agtataaggagaaattttaa

SEQ ID NO: 542892 - DNA, 20 bp, Artificial Sequence
  chemically synthesized
gagaaattttaatgagaaaa

SEQ ID NO: 542893 - DNA, 20 bp, Artificial Sequence
  chemically synthesized
aagacgaaaatggatttaca

SEQ ID NO: 542894 - DNA, 20 bp, Artificial Sequence
  chemically synthesized
ctgtttttgtattaaaagtg

SEQ ID NO: 542895 - DNA, 20 bp, Artificial Sequence
  chemically synthesized
atgggggtgggacattattt

SEQ ID NO: 542896 - DNA, 20 bp, Artificial Sequence
  chemically synthesized
atcttggatacagaatttta

SEQ ID NO: 542897 - DNA, 20 bp, Artificial Sequence
  chemically synthesized
ctcggtcaccaatcttggat

SEQ ID NO: 542898 - DNA, 20 bp, Artificial Sequence
  chemically synthesized
agcctacccacagctcttcc

SEQ ID NO: 542899 - DNA, 20 bp, Artificial Sequence
  chemically synthesized
cagcattgtgacaggtggtt

SEQ ID NO: 542900 - DNA, 20 bp, Artificial Sequence
  chemically synthesized
ttaattgtataggatgtaat

SEQ ID NO: 542901 - DNA, 20 bp, Artificial Sequence
  chemically synthesized
atctagcctcaaaattcttt

SEQ ID NO: 542902 - DNA, 20 bp, Artificial Sequence
  chemically synthesized
agaaaaagttaggtttctaa

SEQ ID NO: 542903 - DNA, 20 bp, Artificial Sequence
  chemically synthesized
cagctcatagaatctcatga

SEQ ID NO: 542904 - DNA, 20 bp, Artificial Sequence
  chemically synthesized
cacactgttcctttcagctc

SEQ ID NO: 542905 - DNA, 20 bp, Artificial Sequence
  chemically synthesized
ctgaaaggaacagtgtggct

SEQ ID NO: 542906 - DNA, 20 bp, Artificial Sequence
  chemically synthesized
cctcatgtcaatgcaagctt

SEQ ID NO: 542907 - DNA, 20 bp, Artificial Sequence
  chemically synthesized
gcttatgccatgactagttg

SEQ ID NO: 542908 - DNA, 20 bp, Artificial Sequence
  chemically synthesized
gggtgcgcctaatcagatgt

SEQ ID NO: 542909 - DNA, 20 bp, Artificial Sequence
  chemically synthesized
caggtcaagcgggcagaaag

SEQ ID NO: 542910 - DNA, 20 bp, Artificial Sequence
  chemically synthesized
agacagcacaggtcaagcgg

SEQ ID NO: 542911 - DNA, 20 bp, Artificial Sequence
  chemically synthesized
tgtctcattgaatgaagttt

SEQ ID NO: 542912 - DNA, 20 bp, Artificial Sequence
  chemically synthesized
tctgattttttgttgttgtt

SEQ ID NO: 542913 - DNA, 20 bp, Artificial Sequence
  chemically synthesized
aagaggaattatatagctag

SEQ ID NO: 542914 - DNA, 20 bp, Artificial Sequence
  chemically synthesized
aacagcaaatataaggaaag

SEQ ID NO: 542915 - DNA, 20 bp, Artificial Sequence
  chemically synthesized
tcaatgacaaaaatataaaa

SEQ ID NO: 542916 - DNA, 20 bp, Artificial Sequence
  chemically synthesized
acaatcctagtaatggttac

SEQ ID NO: 542917 - DNA, 20 bp, Artificial Sequence
  chemically synthesized
atggaaatataaaataagtt

SEQ ID NO: 542918 - DNA, 20 bp, Artificial Sequence
  chemically synthesized
ttatttttaaaatggaaatg

SEQ ID NO: 542919 - DNA, 20 bp, Artificial Sequence
  chemically synthesized
aaatcaaagtgtagcatgtc

SEQ ID NO: 542920 - DNA, 20 bp, Artificial Sequence
  chemically synthesized
catgtctaagaaactctgga

SEQ ID NO: 542921 - DNA, 20 bp, Artificial Sequence
  chemically synthesized
gcatgctttaaaaagccaaa

SEQ ID NO: 542922 - DNA, 20 bp, Artificial Sequence
  chemically synthesized
gcttatgcttgcaaatggat

SEQ ID NO: 542923 - DNA, 20 bp, Artificial Sequence
  chemically synthesized
caaaaatccttctttactca

SEQ ID NO: 542924 - DNA, 20 bp, Artificial Sequence
  chemically synthesized
caattaatgcactaccctaa

SEQ ID NO: 542925 - DNA, 20 bp, Artificial Sequence
  chemically synthesized
aacctgactgtccgtacctt

SEQ ID NO: 542926 - DNA, 20 bp, Artificial Sequence
  chemically synthesized
tatggaatatgttttatttt

SEQ ID NO: 542927 - DNA, 20 bp, Artificial Sequence
  chemically synthesized
aatcctactcaacctgccct

SEQ ID NO: 542928 - DNA, 20 bp, Artificial Sequence
  chemically synthesized
actgaagttgagactctggg

SEQ ID NO: 542929 - DNA, 20 bp, Artificial Sequence
  chemically synthesized
gcaacctgttagtaggtaaa

SEQ ID NO: 542930 - DNA, 20 bp, Artificial Sequence
  chemically synthesized
tttgttcaagtgccaagtac

SEQ ID NO: 542931 - DNA, 20 bp, Artificial Sequence
  chemically synthesized
ccaaaattctaagacaacag

SEQ ID NO: 542932 - DNA, 20 bp, Artificial Sequence
  chemically synthesized
attgaattctatctgttgtc

SEQ ID NO: 542933 - DNA, 20 bp, Artificial Sequence
  chemically synthesized
tgccctgctatttccatctc

SEQ ID NO: 542934 - DNA, 20 bp, Artificial Sequence
  chemically synthesized
actaaaactctctgaaggtt

SEQ ID NO: 542935 - DNA, 20 bp, Artificial Sequence
  chemically synthesized
aaactctctgaaggttttag

SEQ ID NO: 542936 - DNA, 20 bp, Artificial Sequence
  chemically synthesized
tgcttctgaagatgtctgct

SEQ ID NO: 542937 - DNA, 20 bp, Artificial Sequence
  chemically synthesized
cttgataggtaaaaaatgaa

SEQ ID NO: 542938 - DNA, 20 bp, Artificial Sequence
  chemically synthesized
tccacgttcacttgacctat

SEQ ID NO: 542939 - DNA, 20 bp, Artificial Sequence
  chemically synthesized
ctcctacttcccaagacatt

SEQ ID NO: 542940 - DNA, 20 bp, Artificial Sequence
  chemically synthesized
agtgcagttaaaaaaaaaaa

SEQ ID NO: 542941 - DNA, 20 bp, Artificial Sequence
  chemically synthesized
tctaaccacacttgccttcc

SEQ ID NO: 542942 - DNA, 20 bp, Artificial Sequence
  chemically synthesized
agtctttattacctcagagg

SEQ ID NO: 542943 - DNA, 20 bp, Artificial Sequence
  chemically synthesized
cgtagtttcagccagataga

SEQ ID NO: 542944 - DNA, 20 bp, Artificial Sequence
  chemically synthesized
tcaaataaagcaaaggcaaa

SEQ ID NO: 542945 - DNA, 20 bp, Artificial Sequence
  chemically synthesized
atgatagacatccagatcat

SEQ ID NO: 542946 - DNA, 20 bp, Artificial Sequence
  chemically synthesized
agaatgtggtccagcagaag

SEQ ID NO: 542947 - DNA, 20 bp, Artificial Sequence
  chemically synthesized
gtctgaagagataaagaact

SEQ ID NO: 542948 - DNA, 20 bp, Artificial Sequence
  chemically synthesized
ggcatgcttctttaaagacc

SEQ ID NO: 542949 - DNA, 20 bp, Artificial Sequence
  chemically synthesized
aggaattatttaaggaccac

SEQ ID NO: 542950 - DNA, 20 bp, Artificial Sequence
  chemically synthesized
ctaagaatgttctatttgtc

SEQ ID NO: 542951 - DNA, 20 bp, Artificial Sequence
  chemically synthesized
gctaattttttgtattttta

SEQ ID NO: 542952 - DNA, 20 bp, Artificial Sequence
  chemically synthesized
ctacgcaggaggctgaggca

SEQ ID NO: 542953 - DNA, 20 bp, Artificial Sequence
  chemically synthesized
cttaatgaaatgttttccaa

SEQ ID NO: 542954 - DNA, 20 bp, Artificial Sequence
  chemically synthesized
agggaattaaatggagatta

SEQ ID NO: 542955 - DNA, 20 bp, Artificial Sequence
  chemically synthesized
gaagaggataatttacaaca

SEQ ID NO: 542956 - DNA, 20 bp, Artificial Sequence
  chemically synthesized
ggatgaactaatttgaaaac

SEQ ID NO: 542957 - DNA, 20 bp, Artificial Sequence
  chemically synthesized
agttcatcctattttttcct

SEQ ID NO: 542958 - DNA, 20 bp, Artificial Sequence
  chemically synthesized
ctcacactgtgttccttgga

SEQ ID NO: 542959 - DNA, 20 bp, Artificial Sequence
  chemically synthesized
actaggtttgaacacacctg

SEQ ID NO: 542960 - DNA, 20 bp, Artificial Sequence
  chemically synthesized
ctataattttctttaccagg

SEQ ID NO: 542961 - DNA, 20 bp, Artificial Sequence
  chemically synthesized
catttatattctttcctggt

SEQ ID NO: 542962 - DNA, 20 bp, Artificial Sequence
  chemically synthesized
aagtaaagcattgagcattg

SEQ ID NO: 542963 - DNA, 20 bp, Artificial Sequence
  chemically synthesized
taaatggatgcagcaagaat

SEQ ID NO: 542964 - DNA, 20 bp, Artificial Sequence
  chemically synthesized
atgaggataaatggatgcag

SEQ ID NO: 542965 - DNA, 20 bp, Artificial Sequence
  chemically synthesized
atgctttatttaagcttcaa

SEQ ID NO: 542966 - DNA, 20 bp, Artificial Sequence
  chemically synthesized
ggtggctcctgaaggtacct

SEQ ID NO: 542967 - DNA, 20 bp, Artificial Sequence
  chemically synthesized
tcctgatatggaatagtgag

SEQ ID NO: 542968 - DNA, 20 bp, Artificial Sequence
  chemically synthesized
caatgctgaccaagtcatcc

SEQ ID NO: 542969 - DNA, 20 bp, Artificial Sequence
  chemically synthesized
gaaaagatgagaagtcaaaa

SEQ ID NO: 542970 - DNA, 20 bp, Artificial Sequence
  chemically synthesized
taggaattcagactctcagg

SEQ ID NO: 542971 - DNA, 20 bp, Artificial Sequence
  chemically synthesized
tcccatacatcatattaagt

SEQ ID NO: 542972 - DNA, 20 bp, Artificial Sequence
  chemically synthesized
gtgaaatacagccttgataa

SEQ ID NO: 542973 - DNA, 20 bp, Artificial Sequence
  chemically synthesized
gcagagatctctaatgcaca

SEQ ID NO: 542974 - DNA, 20 bp, Artificial Sequence
  chemically synthesized
acaacttggaggacaaaata

SEQ ID NO: 542975 - DNA, 20 bp, Artificial Sequence
  chemically synthesized
atagacaagactgcagtttt

SEQ ID NO: 542976 - DNA, 20 bp, Artificial Sequence
  chemically synthesized
acctactcctaaagcactat

SEQ ID NO: 542977 - DNA, 20 bp, Artificial Sequence
  chemically synthesized
tttaggagtaggttgggagt

SEQ ID NO: 542978 - DNA, 20 bp, Artificial Sequence
  chemically synthesized
tagggaacagataaacactg

SEQ ID NO: 542979 - DNA, 20 bp, Artificial Sequence
  chemically synthesized
aatacattaagcttgctgaa

SEQ ID NO: 542980 - DNA, 20 bp, Artificial Sequence
  chemically synthesized
tggaattatttggcatggga

SEQ ID NO: 542981 - DNA, 20 bp, Artificial Sequence
  chemically synthesized
caaaaatctgctgcagtttc

SEQ ID NO: 542982 - DNA, 20 bp, Artificial Sequence
  chemically synthesized
agccatagttccctgctgaa

SEQ ID NO: 542983 - DNA, 20 bp, Artificial Sequence
  chemically synthesized
agatagatgatctctgtatt

SEQ ID NO: 542984 - DNA, 20 bp, Artificial Sequence
  chemically synthesized
tgtcatgagcagtggttggg

SEQ ID NO: 542985 - DNA, 20 bp, Artificial Sequence
  chemically synthesized
ttcacaaacctgaataatca

SEQ ID NO: 542986 - DNA, 20 bp, Artificial Sequence
  chemically synthesized
ctcaattaaaatctactaaa

SEQ ID NO: 542987 - DNA, 20 bp, Artificial Sequence
  chemically synthesized
tcaccaaaattacacagata

SEQ ID NO: 542988 - DNA, 20 bp, Artificial Sequence
  chemically synthesized
aaggtctatgaagaccgaag

SEQ ID NO: 542989 - DNA, 20 bp, Artificial Sequence
  chemically synthesized
tctatgaagaccgaagttag

SEQ ID NO: 542990 - DNA, 20 bp, Artificial Sequence
  chemically synthesized
caacaacgaaaaataacagg

SEQ ID NO: 542991 - DNA, 20 bp, Artificial Sequence
  chemically synthesized
gaaattggtattaatgctgg

SEQ ID NO: 542992 - DNA, 20 bp, Artificial Sequence
  chemically synthesized
aatatacgaaacatagtgag

SEQ ID NO: 542993 - DNA, 20 bp, Artificial Sequence
  chemically synthesized
tgaaagtatcaaagaaaatt

SEQ ID NO: 542994 - DNA, 20 bp, Artificial Sequence
  chemically synthesized
aatttttcattgaaagtatc

SEQ ID NO: 542995 - DNA, 20 bp, Artificial Sequence
  chemically synthesized
gggacactggaatacactgc

SEQ ID NO: 542996 - DNA, 20 bp, Artificial Sequence
  chemically synthesized
ttttaaaaaaataaacattt

SEQ ID NO: 542997 - DNA, 20 bp, Artificial Sequence
  chemically synthesized
cagatttgattattcaatct

SEQ ID NO: 542998 - DNA, 20 bp, Artificial Sequence
  chemically synthesized
gaatctatgaagtagcttgc

SEQ ID NO: 542999 - DNA, 20 bp, Artificial Sequence
  chemically synthesized
tcagaacagtattgtgtgtt

SEQ ID NO: 543000 - DNA, 20 bp, Artificial Sequence
  chemically synthesized
aagtttatcaatgtaccttt

SEQ ID NO: 543001 - DNA, 20 bp, Artificial Sequence
  chemically synthesized
ggtacattgataaacttaaa

SEQ ID NO: 543002 - DNA, 20 bp, Artificial Sequence
  chemically synthesized
ggcctaccaaaaaaaaaaaa

SEQ ID NO: 543003 - DNA, 20 bp, Artificial Sequence
  chemically synthesized
tttttttttggtaggccctt

SEQ ID NO: 543004 - DNA, 20 bp, Artificial Sequence
  chemically synthesized
gaaaagctattccaacttca

SEQ ID NO: 543005 - DNA, 20 bp, Artificial Sequence
  chemically synthesized
tgttcgtctgtatgcctatt

SEQ ID NO: 543006 - DNA, 20 bp, Artificial Sequence
  chemically synthesized
ataatggaattactacttac

SEQ ID NO: 543007 - DNA, 20 bp, Artificial Sequence
  chemically synthesized
atgattcatggtgattaaaa

SEQ ID NO: 543008 - DNA, 20 bp, Artificial Sequence
  chemically synthesized
ttttaaaatattattaaaaa

SEQ ID NO: 543009 - DNA, 20 bp, Artificial Sequence
  chemically synthesized
tcacacaattgatggtagga

SEQ ID NO: 543010 - DNA, 20 bp, Artificial Sequence
  chemically synthesized
atgtatcttcttttgttatt

SEQ ID NO: 543011 - DNA, 20 bp, Artificial Sequence
  chemically synthesized
aggaaaaatttctaatttac

SEQ ID NO: 543012 - DNA, 20 bp, Artificial Sequence
  chemically synthesized
tatgctattttctttgtaaa

SEQ ID NO: 543013 - DNA, 20 bp, Artificial Sequence
  chemically synthesized
tagcccagacctctttaatg

SEQ ID NO: 543014 - DNA, 20 bp, Artificial Sequence
  chemically synthesized
gagtgattacattttgaggg

SEQ ID NO: 543015 - DNA, 20 bp, Artificial Sequence
  chemically synthesized
atcctttttactacttaagg

SEQ ID NO: 543016 - DNA, 20 bp, Artificial Sequence
  chemically synthesized
tatatccattattaacacac

SEQ ID NO: 543017 - DNA, 20 bp, Artificial Sequence
  chemically synthesized
aacaataaatgctttaatat

SEQ ID NO: 543018 - DNA, 20 bp, Artificial Sequence
  chemically synthesized
atttgggggactcagggaag

SEQ ID NO: 543019 - DNA, 20 bp, Artificial Sequence
  chemically synthesized
cataatttgggggactcagg

SEQ ID NO: 543020 - DNA, 20 bp, Artificial Sequence
  chemically synthesized
ttggaagaagatacttcaga

SEQ ID NO: 543021 - DNA, 20 bp, Artificial Sequence
  chemically synthesized
agactagaatcctagttgtt

SEQ ID NO: 543022 - DNA, 20 bp, Artificial Sequence
  chemically synthesized
atgctaatcaaagataacgc

SEQ ID NO: 543023 - DNA, 20 bp, Artificial Sequence
  chemically synthesized
aaccacacacatacagccgc

SEQ ID NO: 543024 - DNA, 20 bp, Artificial Sequence
  chemically synthesized
gttctaaataaaattatttt

SEQ ID NO: 543025 - DNA, 20 bp, Artificial Sequence
  chemically synthesized
ttattttgcagaaaattacg

SEQ ID NO: 543026 - DNA, 20 bp, Artificial Sequence
  chemically synthesized
ttaaaatcaggagaagtgtt

SEQ ID NO: 543027 - DNA, 20 bp, Artificial Sequence
  chemically synthesized
ctgcacggtaaagggggttg

SEQ ID NO: 543028 - DNA, 20 bp, Artificial Sequence
  chemically synthesized
gaggtggagagtagtaagtt

SEQ ID NO: 543029 - DNA, 20 bp, Artificial Sequence
  chemically synthesized
attgactttggaagtgggaa

SEQ ID NO: 543030 - DNA, 20 bp, Artificial Sequence
  chemically synthesized
gtagtataagggaagatcca

SEQ ID NO: 543031 - DNA, 20 bp, Artificial Sequence
  chemically synthesized
tgaaattgaatagtaatagg

SEQ ID NO: 543032 - DNA, 20 bp, Artificial Sequence
  chemically synthesized
tgtgatgatgaaaaaatgag

SEQ ID NO: 543033 - DNA, 20 bp, Artificial Sequence
  chemically synthesized
aatctgtgatgatgaaaaaa

SEQ ID NO: 543034 - DNA, 20 bp, Artificial Sequence
  chemically synthesized
tgagattaagatttggtaaa

SEQ ID NO: 543035 - DNA, 20 bp, Artificial Sequence
  chemically synthesized
tatttaatgagagaaggagc

SEQ ID NO: 543036 - DNA, 20 bp, Artificial Sequence
  chemically synthesized
cagtcacatagaccaatgaa

SEQ ID NO: 543037 - DNA, 20 bp, Artificial Sequence
  chemically synthesized
aatgaaacagaatggaaagc

SEQ ID NO: 543038 - DNA, 20 bp, Artificial Sequence
  chemically synthesized
taactggctaaccgtataca

SEQ ID NO: 543039 - DNA, 20 bp, Artificial Sequence
  chemically synthesized
aacagacaaactacagaacg

SEQ ID NO: 543040 - DNA, 20 bp, Artificial Sequence
  chemically synthesized
atctgataaaggtttaacat

SEQ ID NO: 543041 - DNA, 20 bp, Artificial Sequence
  chemically synthesized
acagatgctgttgggatggc

SEQ ID NO: 543042 - DNA, 20 bp, Artificial Sequence
  chemically synthesized
ctattcacaatagcaaagat

SEQ ID NO: 543043 - DNA, 20 bp, Artificial Sequence
  chemically synthesized
ccctccatggtagactagat

SEQ ID NO: 543044 - DNA, 20 bp, Artificial Sequence
  chemically synthesized
ttcctgcattagtttgctaa

SEQ ID NO: 543045 - DNA, 20 bp, Artificial Sequence
  chemically synthesized
tataagtgggagctaaataa

SEQ ID NO: 543046 - DNA, 20 bp, Artificial Sequence
  chemically synthesized
actgggtcctacttgaggat

SEQ ID NO: 543047 - DNA, 20 bp, Artificial Sequence
  chemically synthesized
gaatgggaggaaggggagga

SEQ ID NO: 543048 - DNA, 20 bp, Artificial Sequence
  chemically synthesized
accatctttcagatctgcta

SEQ ID NO: 543049 - DNA, 20 bp, Artificial Sequence
  chemically synthesized
ctgctaagagaaaggctggt

SEQ ID NO: 543050 - DNA, 20 bp, Artificial Sequence
  chemically synthesized
gaaaggctggtaaagaaaga

SEQ ID NO: 543051 - DNA, 20 bp, Artificial Sequence
  chemically synthesized
tcattttaaaagttttggta

SEQ ID NO: 543052 - DNA, 20 bp, Artificial Sequence
  chemically synthesized
gagatggcattaacagaggt

SEQ ID NO: 543053 - DNA, 20 bp, Artificial Sequence
  chemically synthesized
gtagcctatgagatatccaa

SEQ ID NO: 543054 - DNA, 20 bp, Artificial Sequence
  chemically synthesized
aagtattataaagagtgaat

SEQ ID NO: 543055 - DNA, 20 bp, Artificial Sequence
  chemically synthesized
catgtctggaaaatataagg

SEQ ID NO: 543056 - DNA, 20 bp, Artificial Sequence
  chemically synthesized
atgactggaattatctattc

SEQ ID NO: 543057 - DNA, 20 bp, Artificial Sequence
  chemically synthesized
gatatagaaagcctgaggag

SEQ ID NO: 543058 - DNA, 20 bp, Artificial Sequence
  chemically synthesized
caaaaatgatggaaggggat

SEQ ID NO: 543059 - DNA, 20 bp, Artificial Sequence
  chemically synthesized
atttttgtagcaatattctc

SEQ ID NO: 543060 - DNA, 20 bp, Artificial Sequence
  chemically synthesized
atgaaatggatgaatttcta

SEQ ID NO: 543061 - DNA, 20 bp, Artificial Sequence
  chemically synthesized
taaaagctatgcaaataagt

SEQ ID NO: 543062 - DNA, 20 bp, Artificial Sequence
  chemically synthesized
ttataatatatttttaaaat

SEQ ID NO: 543063 - DNA, 20 bp, Artificial Sequence
  chemically synthesized
ggaaagagaagaattcaaga

SEQ ID NO: 543064 - DNA, 20 bp, Artificial Sequence
  chemically synthesized
agagaaagtaaatggaaaga

SEQ ID NO: 543065 - DNA, 20 bp, Artificial Sequence
  chemically synthesized
gggaaaagtataataaatgc

SEQ ID NO: 543066 - DNA, 20 bp, Artificial Sequence
  chemically synthesized
agtgagctaactgcccatct

SEQ ID NO: 543067 - DNA, 20 bp, Artificial Sequence
  chemically synthesized
actcttaaatttgtaacaag

SEQ ID NO: 543068 - DNA, 20 bp, Artificial Sequence
  chemically synthesized
aacttttgtctggtgtcttg

SEQ ID NO: 543069 - DNA, 20 bp, Artificial Sequence
  chemically synthesized
aaaaatccacagaataacaa

SEQ ID NO: 543070 - DNA, 20 bp, Artificial Sequence
  chemically synthesized
aacacgtaaagcaaaaatcc

SEQ ID NO: 543071 - DNA, 20 bp, Artificial Sequence
  chemically synthesized
tacggagtgagactctgtca

SEQ ID NO: 543072 - DNA, 20 bp, Artificial Sequence
  chemically synthesized
ctgcttgggaggctgaggtg

SEQ ID NO: 543073 - DNA, 20 bp, Artificial Sequence
  chemically synthesized
aattcaaaatacattgtttt

SEQ ID NO: 543074 - DNA, 20 bp, Artificial Sequence
  chemically synthesized
atatataaatgtagaaattt

SEQ ID NO: 543075 - DNA, 20 bp, Artificial Sequence
  chemically synthesized
aatacatttaatatataaat

SEQ ID NO: 543076 - DNA, 20 bp, Artificial Sequence
  chemically synthesized
aaaaaaaggaaagaaaagaa

SEQ ID NO: 543077 - DNA, 20 bp, Artificial Sequence
  chemically synthesized
aaaaaaaaaaaaaggaaaga

SEQ ID NO: 543078 - DNA, 20 bp, Artificial Sequence
  chemically synthesized
aaaaaaaaaaaaaaaaaagg

SEQ ID NO: 543079 - DNA, 20 bp, Artificial Sequence
  chemically synthesized
ctactcgggaggctgagaca

SEQ ID NO: 543080 - DNA, 20 bp, Artificial Sequence
  chemically synthesized
gaaatagaaaaaaatagatg

SEQ ID NO: 543081 - DNA, 20 bp, Artificial Sequence
  chemically synthesized
aagatggtagaaaaatagaa

SEQ ID NO: 543082 - DNA, 20 bp, Artificial Sequence
  chemically synthesized
aaagaaaagatggtagaaaa

SEQ ID NO: 543083 - DNA, 20 bp, Artificial Sequence
  chemically synthesized
ataaaataaaagaaaagatg

SEQ ID NO: 543084 - DNA, 20 bp, Artificial Sequence
  chemically synthesized
tgtgagatgagcataaaata

SEQ ID NO: 543085 - DNA, 20 bp, Artificial Sequence
  chemically synthesized
caagaaagaaggaaaacaaa

SEQ ID NO: 543086 - DNA, 20 bp, Artificial Sequence
  chemically synthesized
tcaatcagtacgcagtaaag

SEQ ID NO: 543087 - DNA, 20 bp, Artificial Sequence
  chemically synthesized
catccacctgggaaacaatc

SEQ ID NO: 543088 - DNA, 20 bp, Artificial Sequence
  chemically synthesized
acagccacaagcccttttat

SEQ ID NO: 543089 - DNA, 20 bp, Artificial Sequence
  chemically synthesized
catttgttgcaaaaaatata

SEQ ID NO: 543090 - DNA, 20 bp, Artificial Sequence
  chemically synthesized
agtatgaagaattagaagta

SEQ ID NO: 543091 - DNA, 20 bp, Artificial Sequence
  chemically synthesized
aaaatgtctaaaataagtat

SEQ ID NO: 543092 - DNA, 20 bp, Artificial Sequence
  chemically synthesized
aagaactaattttgttgagt

SEQ ID NO: 543093 - DNA, 20 bp, Artificial Sequence
  chemically synthesized
ttgaaaaaattaccgtcaac

SEQ ID NO: 543094 - DNA, 20 bp, Artificial Sequence
  chemically synthesized
ttcttatctacaacaatgaa

SEQ ID NO: 543095 - DNA, 20 bp, Artificial Sequence
  chemically synthesized
agacatatcacagtgaaagt

SEQ ID NO: 543096 - DNA, 20 bp, Artificial Sequence
  chemically synthesized
ataacaggcaaagtaaataa

SEQ ID NO: 543097 - DNA, 20 bp, Artificial Sequence
  chemically synthesized
cagtgacataaaccacttaa

SEQ ID NO: 543098 - DNA, 20 bp, Artificial Sequence
  chemically synthesized
cttgtatgtcataatttttt

SEQ ID NO: 543099 - DNA, 20 bp, Artificial Sequence
  chemically synthesized
ctcaaaaaaattatgacata

SEQ ID NO: 543100 - DNA, 20 bp, Artificial Sequence
  chemically synthesized
gttacagaataataataata

SEQ ID NO: 543101 - DNA, 20 bp, Artificial Sequence
  chemically synthesized
cttatgttaagtgttctgtt

SEQ ID NO: 543102 - DNA, 20 bp, Artificial Sequence
  chemically synthesized
atacagtcaaactaatggaa

SEQ ID NO: 543103 - DNA, 20 bp, Artificial Sequence
  chemically synthesized
ctacatgaagtaagccagac

SEQ ID NO: 543104 - DNA, 20 bp, Artificial Sequence
  chemically synthesized
ccattgacaggtgaaaggaa

SEQ ID NO: 543105 - DNA, 20 bp, Artificial Sequence
  chemically synthesized
tatatccaaaggaaattgaa

SEQ ID NO: 543106 - DNA, 20 bp, Artificial Sequence
  chemically synthesized
cctcaaaaaaaaaattaaaa

SEQ ID NO: 543107 - DNA, 20 bp, Artificial Sequence
  chemically synthesized
gacaagtttggcaagaatgt

SEQ ID NO: 543108 - DNA, 20 bp, Artificial Sequence
  chemically synthesized
tcaagagatgacaagtttgg

SEQ ID NO: 543109 - DNA, 20 bp, Artificial Sequence
  chemically synthesized
ttagaatggcagttacttaa

SEQ ID NO: 543110 - DNA, 20 bp, Artificial Sequence
  chemically synthesized
gatatatgtcttcacatctg

SEQ ID NO: 543111 - DNA, 20 bp, Artificial Sequence
  chemically synthesized
gccatatgtaggtcttcatt

SEQ ID NO: 543112 - DNA, 20 bp, Artificial Sequence
  chemically synthesized
gagttttcaaagaggagaat

SEQ ID NO: 543113 - DNA, 20 bp, Artificial Sequence
  chemically synthesized
tcaatgggagttttcaaaga

SEQ ID NO: 543114 - DNA, 20 bp, Artificial Sequence
  chemically synthesized
aatagatacaggggtgggga

SEQ ID NO: 543115 - DNA, 20 bp, Artificial Sequence
  chemically synthesized
tgatttaaaagaaaactaaa

SEQ ID NO: 543116 - DNA, 20 bp, Artificial Sequence
  chemically synthesized
tagttgaaagaaatgattta

SEQ ID NO: 543117 - DNA, 20 bp, Artificial Sequence
  chemically synthesized
atatataaacatattagttg

SEQ ID NO: 543118 - DNA, 20 bp, Artificial Sequence
  chemically synthesized
taaacaactacaattaaaaa

SEQ ID NO: 543119 - DNA, 20 bp, Artificial Sequence
  chemically synthesized
aaacattgtaaaaatggaat

SEQ ID NO: 543120 - DNA, 20 bp, Artificial Sequence
  chemically synthesized
aatgttattgaagttataaa

SEQ ID NO: 543121 - DNA, 20 bp, Artificial Sequence
  chemically synthesized
aaataaataggtaaaatatt

SEQ ID NO: 543122 - DNA, 20 bp, Artificial Sequence
  chemically synthesized
tacttctagaattccggata

SEQ ID NO: 543123 - DNA, 20 bp, Artificial Sequence
  chemically synthesized
aacgaacggtgagtttactt

SEQ ID NO: 543124 - DNA, 20 bp, Artificial Sequence
  chemically synthesized
cacacactcactcacacgca

SEQ ID NO: 543125 - DNA, 20 bp, Artificial Sequence
  chemically synthesized
tgtatattatcacaaagggt

SEQ ID NO: 543126 - DNA, 20 bp, Artificial Sequence
  chemically synthesized
ctcaagagttcctcacctta

SEQ ID NO: 543127 - DNA, 20 bp, Artificial Sequence
  chemically synthesized
ctcactgtgagtgcaaagta

SEQ ID NO: 543128 - DNA, 20 bp, Artificial Sequence
  chemically synthesized
tatgtttgttctctctgcag

SEQ ID NO: 543129 - DNA, 20 bp, Artificial Sequence
  chemically synthesized
atcagtaagataatgggcag

SEQ ID NO: 543130 - DNA, 20 bp, Artificial Sequence
  chemically synthesized
gaattaagtcatttgatgga

SEQ ID NO: 543131 - DNA, 20 bp, Artificial Sequence
  chemically synthesized
tcataaatgttactattaca

SEQ ID NO: 543132 - DNA, 20 bp, Artificial Sequence
  chemically synthesized
ttaatatcctttcaatttct

SEQ ID NO: 543133 - DNA, 20 bp, Artificial Sequence
  chemically synthesized
gtttttcatattcccattct

SEQ ID NO: 543134 - DNA, 20 bp, Artificial Sequence
  chemically synthesized
ggaaagactccatctcaaaa

SEQ ID NO: 543135 - DNA, 20 bp, Artificial Sequence
  chemically synthesized
aggctattgtgagaactaaa

SEQ ID NO: 543136 - DNA, 20 bp, Artificial Sequence
  chemically synthesized
tgctgcttggttaccctgtt

SEQ ID NO: 543137 - DNA, 20 bp, Artificial Sequence
  chemically synthesized
ctttcaaatcattactgtga

SEQ ID NO: 543138 - DNA, 20 bp, Artificial Sequence
  chemically synthesized
atatagtgctatatgattat

SEQ ID NO: 543139 - DNA, 20 bp, Artificial Sequence
  chemically synthesized
gttctgcataattgcagcta

SEQ ID NO: 543140 - DNA, 20 bp, Artificial Sequence
  chemically synthesized
tagcaaatctggctgaggca

SEQ ID NO: 543141 - DNA, 20 bp, Artificial Sequence
  chemically synthesized
aaaaataaaataaaataaaa

SEQ ID NO: 543142 - DNA, 20 bp, Artificial Sequence
  chemically synthesized
gtttaaccaaccaaaaatca

SEQ ID NO: 543143 - DNA, 20 bp, Artificial Sequence
  chemically synthesized
aatcatggcctaaaacaaat

SEQ ID NO: 543144 - DNA, 20 bp, Artificial Sequence
  chemically synthesized
gtacattaatgtgttataat

SEQ ID NO: 543145 - DNA, 20 bp, Artificial Sequence
  chemically synthesized
tataacacattaatgtacaa

SEQ ID NO: 543146 - DNA, 20 bp, Artificial Sequence
  chemically synthesized
gataaattatctgagaggct

SEQ ID NO: 543147 - DNA, 20 bp, Artificial Sequence
  chemically synthesized
aagactgttgtttcgatgca

SEQ ID NO: 543148 - DNA, 20 bp, Artificial Sequence
  chemically synthesized
tcaaagtgctgagcaaagcc

SEQ ID NO: 543149 - DNA, 20 bp, Artificial Sequence
  chemically synthesized
gcttatcacaggctgataca

SEQ ID NO: 543150 - DNA, 20 bp, Artificial Sequence
  chemically synthesized
aatttttgagggctgatact

SEQ ID NO: 543151 - DNA, 20 bp, Artificial Sequence
  chemically synthesized
tatcatgtcagctggcaagg

SEQ ID NO: 543152 - DNA, 20 bp, Artificial Sequence
  chemically synthesized
cccagagtcacaggtttgaa

SEQ ID NO: 543153 - DNA, 20 bp, Artificial Sequence
  chemically synthesized
gtggggaaccattgaatttg

SEQ ID NO: 543154 - DNA, 20 bp, Artificial Sequence
  chemically synthesized
gtgagctgaagctagtgtga

SEQ ID NO: 543155 - DNA, 20 bp, Artificial Sequence
  chemically synthesized
aaggctggattcaaacttct

SEQ ID NO: 543156 - DNA, 20 bp, Artificial Sequence
  chemically synthesized
aggaaataaaagagatctct

SEQ ID NO: 543157 - DNA, 20 bp, Artificial Sequence
  chemically synthesized
agtcagggtccagacagggc

SEQ ID NO: 543158 - DNA, 20 bp, Artificial Sequence
  chemically synthesized
gaaaatacttgaaacttggg

SEQ ID NO: 543159 - DNA, 20 bp, Artificial Sequence
  chemically synthesized
ttaaagcataaacttttgaa

SEQ ID NO: 543160 - DNA, 20 bp, Artificial Sequence
  chemically synthesized
ttatgctttaaaaactcagt

SEQ ID NO: 543161 - DNA, 20 bp, Artificial Sequence
  chemically synthesized
taaaccctgacatttccccc

SEQ ID NO: 543162 - DNA, 20 bp, Artificial Sequence
  chemically synthesized
agagtaagctattcctaagg

SEQ ID NO: 543163 - DNA, 20 bp, Artificial Sequence
  chemically synthesized
tacctgacactgatattcaa

SEQ ID NO: 543164 - DNA, 20 bp, Artificial Sequence
  chemically synthesized
ctaccctcacatacttctct

SEQ ID NO: 543165 - DNA, 20 bp, Artificial Sequence
  chemically synthesized
ataacgtatgaagagaaaaa

SEQ ID NO: 543166 - DNA, 20 bp, Artificial Sequence
  chemically synthesized
acaaataatataacgtatga

SEQ ID NO: 543167 - DNA, 20 bp, Artificial Sequence
  chemically synthesized
aaggaagagttactgatttc

SEQ ID NO: 543168 - DNA, 20 bp, Artificial Sequence
  chemically synthesized
aagaatggattatttgtcaa

SEQ ID NO: 543169 - DNA, 20 bp, Artificial Sequence
  chemically synthesized
gtgttttgcatactatctcc

SEQ ID NO: 543170 - DNA, 20 bp, Artificial Sequence
  chemically synthesized
agtatgcaaaacactgacta

SEQ ID NO: 543171 - DNA, 20 bp, Artificial Sequence
  chemically synthesized
gatatatgaaaatttatcta

SEQ ID NO: 543172 - DNA, 20 bp, Artificial Sequence
  chemically synthesized
agaaatgtagtgttatttat

SEQ ID NO: 543173 - DNA, 20 bp, Artificial Sequence
  chemically synthesized
ataaataatatggggtacta

SEQ ID NO: 543174 - DNA, 20 bp, Artificial Sequence
  chemically synthesized
gaataaaatgagacagcgag

SEQ ID NO: 543175 - DNA, 20 bp, Artificial Sequence
  chemically synthesized
gggatgtctcagttgccttt

SEQ ID NO: 543176 - DNA, 20 bp, Artificial Sequence
  chemically synthesized
acatgctataatacacatgt

SEQ ID NO: 543177 - DNA, 20 bp, Artificial Sequence
  chemically synthesized
cttcatgtagttccctccaa

SEQ ID NO: 543178 - DNA, 20 bp, Artificial Sequence
  chemically synthesized
caatgtatttagaaaaaaaa

SEQ ID NO: 543179 - DNA, 20 bp, Artificial Sequence
  chemically synthesized
ttgctgataatccaatgtat

SEQ ID NO: 543180 - DNA, 20 bp, Artificial Sequence
  chemically synthesized
ataatcccatgaagattcat

SEQ ID NO: 543181 - DNA, 20 bp, Artificial Sequence
  chemically synthesized
ccactagctatcagagaagt

SEQ ID NO: 543182 - DNA, 20 bp, Artificial Sequence
  chemically synthesized
tcttgagagagtactctttt

SEQ ID NO: 543183 - DNA, 20 bp, Artificial Sequence
  chemically synthesized
gaaaaagagtactctctcaa

SEQ ID NO: 543184 - DNA, 20 bp, Artificial Sequence
  chemically synthesized
cttcactattcttttcgtgg

SEQ ID NO: 543185 - DNA, 20 bp, Artificial Sequence
  chemically synthesized
atgatcttttctcaccacga

SEQ ID NO: 543186 - DNA, 20 bp, Artificial Sequence
  chemically synthesized
attattgggatgtacgtaac

SEQ ID NO: 543187 - DNA, 20 bp, Artificial Sequence
  chemically synthesized
atctcagtgtcataggcatg

SEQ ID NO: 543188 - DNA, 20 bp, Artificial Sequence
  chemically synthesized
tattgagtttgctcaaaatt

SEQ ID NO: 543189 - DNA, 20 bp, Artificial Sequence
  chemically synthesized
tacattgtcctattaagttt

SEQ ID NO: 543190 - DNA, 20 bp, Artificial Sequence
  chemically synthesized
gttataaatatcttgagttg

SEQ ID NO: 543191 - DNA, 20 bp, Artificial Sequence
  chemically synthesized
tagatcaccacgtatcaagg

SEQ ID NO: 543192 - DNA, 20 bp, Artificial Sequence
  chemically synthesized
tttgaaattatgaccacaac

SEQ ID NO: 543193 - DNA, 20 bp, Artificial Sequence
  chemically synthesized
gaagccataatgaagagcat

SEQ ID NO: 543194 - DNA, 20 bp, Artificial Sequence
  chemically synthesized
caaaggaatgttaaggaaag

SEQ ID NO: 543195 - DNA, 20 bp, Artificial Sequence
  chemically synthesized
catcactgaaactgtgagag

SEQ ID NO: 543196 - DNA, 20 bp, Artificial Sequence
  chemically synthesized
tcagcaatgtgttacatgtt

SEQ ID NO: 543197 - DNA, 20 bp, Artificial Sequence
  chemically synthesized
tgtaacacattgctgattca

SEQ ID NO: 543198 - DNA, 20 bp, Artificial Sequence
  chemically synthesized
ttacaaattctattctgtct

SEQ ID NO: 543199 - DNA, 20 bp, Artificial Sequence
  chemically synthesized
aaggtatttctttagacaga

SEQ ID NO: 543200 - DNA, 20 bp, Artificial Sequence
  chemically synthesized
aatgtaaggtatttctttag

SEQ ID NO: 543201 - DNA, 20 bp, Artificial Sequence
  chemically synthesized
gcataaattattcaagatgt

SEQ ID NO: 543202 - DNA, 20 bp, Artificial Sequence
  chemically synthesized
tatgtaatgaatatgttgtt

SEQ ID NO: 543203 - DNA, 20 bp, Artificial Sequence
  chemically synthesized
accaaatagaagacaaatcc

SEQ ID NO: 543204 - DNA, 20 bp, Artificial Sequence
  chemically synthesized
caaacaagtggctaaatgaa

SEQ ID NO: 543205 - DNA, 20 bp, Artificial Sequence
  chemically synthesized
catgagttattgtcatactt

SEQ ID NO: 543206 - DNA, 20 bp, Artificial Sequence
  chemically synthesized
gccaacatgcccaaacttcc

SEQ ID NO: 543207 - DNA, 20 bp, Artificial Sequence
  chemically synthesized
acatgcccaaacttcctaag

SEQ ID NO: 543208 - DNA, 20 bp, Artificial Sequence
  chemically synthesized
atcacagattaaatattatg

SEQ ID NO: 543209 - DNA, 20 bp, Artificial Sequence
  chemically synthesized
cctctacaatcaaaagtcat

SEQ ID NO: 543210 - DNA, 20 bp, Artificial Sequence
  chemically synthesized
ccaacattgcagtctgggaa

SEQ ID NO: 543211 - DNA, 20 bp, Artificial Sequence
  chemically synthesized
gataaatttcagaggaggtc

SEQ ID NO: 543212 - DNA, 20 bp, Artificial Sequence
  chemically synthesized
aaatatgtcttcttagtaat

SEQ ID NO: 543213 - DNA, 20 bp, Artificial Sequence
  chemically synthesized
aatatacctcaaggaaataa

SEQ ID NO: 543214 - DNA, 20 bp, Artificial Sequence
  chemically synthesized
gcagaactttaaaatttcta

SEQ ID NO: 543215 - DNA, 20 bp, Artificial Sequence
  chemically synthesized
attttcttctatattttctt

SEQ ID NO: 543216 - DNA, 20 bp, Artificial Sequence
  chemically synthesized
aatttctacaagaaaatata

SEQ ID NO: 543217 - DNA, 20 bp, Artificial Sequence
  chemically synthesized
tattcttctctatgccaaag

SEQ ID NO: 543218 - DNA, 20 bp, Artificial Sequence
  chemically synthesized
atttctgactttggcataga

SEQ ID NO: 543219 - DNA, 20 bp, Artificial Sequence
  chemically synthesized
atctcgtaaaaaactgaccg

SEQ ID NO: 543220 - DNA, 20 bp, Artificial Sequence
  chemically synthesized
tgaaaaacagactcaaaata

SEQ ID NO: 543221 - DNA, 20 bp, Artificial Sequence
  chemically synthesized
actgcaacatctgtaacaca

SEQ ID NO: 543222 - DNA, 20 bp, Artificial Sequence
  chemically synthesized
aataacccaatcgataatga

SEQ ID NO: 543223 - DNA, 20 bp, Artificial Sequence
  chemically synthesized
aacctgaaccaaaatcttaa

SEQ ID NO: 543224 - DNA, 20 bp, Artificial Sequence
  chemically synthesized
tgtgtactgaaatggccatt

SEQ ID NO: 543225 - DNA, 20 bp, Artificial Sequence
  chemically synthesized
tatgtgaatgttcaccttat

SEQ ID NO: 543226 - DNA, 20 bp, Artificial Sequence
  chemically synthesized
tttttgatatgtgcatcctc

SEQ ID NO: 543227 - DNA, 20 bp, Artificial Sequence
  chemically synthesized
ggaaataatgtccactgcaa

SEQ ID NO: 543228 - DNA, 20 bp, Artificial Sequence
  chemically synthesized
atataccgtcatctttaaac

SEQ ID NO: 543229 - DNA, 20 bp, Artificial Sequence
  chemically synthesized
aatctcatcaaaaagaacca

SEQ ID NO: 543230 - DNA, 20 bp, Artificial Sequence
  chemically synthesized
ccaatagacataatcaccat

SEQ ID NO: 543231 - DNA, 20 bp, Artificial Sequence
  chemically synthesized
taggaagatgcgagagagga

SEQ ID NO: 543232 - DNA, 20 bp, Artificial Sequence
  chemically synthesized
attcaacagttacaaagcta

SEQ ID NO: 543233 - DNA, 20 bp, Artificial Sequence
  chemically synthesized
gttctctatgttcatagccc

SEQ ID NO: 543234 - DNA, 20 bp, Artificial Sequence
  chemically synthesized
gtgttttgctttaaaaggtg

SEQ ID NO: 543235 - DNA, 20 bp, Artificial Sequence
  chemically synthesized
tttcccactgggatctttgc

SEQ ID NO: 543236 - DNA, 20 bp, Artificial Sequence
  chemically synthesized
ctaccttgctgatttaactg

SEQ ID NO: 543237 - DNA, 20 bp, Artificial Sequence
  chemically synthesized
gaattggagctaaaagccac

SEQ ID NO: 543238 - DNA, 20 bp, Artificial Sequence
  chemically synthesized
cttaaaattactttgaaatc

SEQ ID NO: 543239 - DNA, 20 bp, Artificial Sequence
  chemically synthesized
tgtatatagaacctcaggtg

SEQ ID NO: 543240 - DNA, 20 bp, Artificial Sequence
  chemically synthesized
tatagaacctcaggtgtgag

SEQ ID NO: 543241 - DNA, 20 bp, Artificial Sequence
  chemically synthesized
agaaaaagagggaaatgaaa

SEQ ID NO: 543242 - DNA, 20 bp, Artificial Sequence
  chemically synthesized
aggcaagccagggaaatggg

SEQ ID NO: 543243 - DNA, 20 bp, Artificial Sequence
  chemically synthesized
atacaaaaactcaatagccc

SEQ ID NO: 543244 - DNA, 20 bp, Artificial Sequence
  chemically synthesized
gtcattagttgtaacaaatg

SEQ ID NO: 543245 - DNA, 20 bp, Artificial Sequence
  chemically synthesized
tggcaagtggaattcacacc

SEQ ID NO: 543246 - DNA, 20 bp, Artificial Sequence
  chemically synthesized
taaaccagggcttgtgaaaa

SEQ ID NO: 543247 - DNA, 20 bp, Artificial Sequence
  chemically synthesized
ccccataaaagggtgagaaa

SEQ ID NO: 543248 - DNA, 20 bp, Artificial Sequence
  chemically synthesized
tacctatccccataaaaggg

SEQ ID NO: 543249 - DNA, 20 bp, Artificial Sequence
  chemically synthesized
tagtacctcgtagtgtttaa

SEQ ID NO: 543250 - DNA, 20 bp, Artificial Sequence
  chemically synthesized
tatcgacagtagatctgtat

SEQ ID NO: 543251 - DNA, 20 bp, Artificial Sequence
  chemically synthesized
aatttatacagacgcaggag

SEQ ID NO: 543252 - DNA, 20 bp, Artificial Sequence
  chemically synthesized
ataaaaagtaatgagatccc

SEQ ID NO: 543253 - DNA, 20 bp, Artificial Sequence
  chemically synthesized
taagttgtttaaaggaatac

SEQ ID NO: 543254 - DNA, 20 bp, Artificial Sequence
  chemically synthesized
atagaattaatcacaaaaaa

SEQ ID NO: 543255 - DNA, 20 bp, Artificial Sequence
  chemically synthesized
gaaacaactcaataaaatat

SEQ ID NO: 543256 - DNA, 20 bp, Artificial Sequence
  chemically synthesized
ggcgtaatttatccttcaat

SEQ ID NO: 543257 - DNA, 20 bp, Artificial Sequence
  chemically synthesized
tacgccacaggcagctgaag

SEQ ID NO: 543258 - DNA, 20 bp, Artificial Sequence
  chemically synthesized
tgagagttggaagacagatt

SEQ ID NO: 543259 - DNA, 20 bp, Artificial Sequence
  chemically synthesized
caaaattgagcagatagaga

SEQ ID NO: 543260 - DNA, 20 bp, Artificial Sequence
  chemically synthesized
gagcagatagagataagaat

SEQ ID NO: 543261 - DNA, 20 bp, Artificial Sequence
  chemically synthesized
ggggatagtcttaatagctc

SEQ ID NO: 543262 - DNA, 20 bp, Artificial Sequence
  chemically synthesized
aggaatgaagagattgggaa

SEQ ID NO: 543263 - DNA, 20 bp, Artificial Sequence
  chemically synthesized
aaagacaatgcagaaccact

SEQ ID NO: 543264 - DNA, 20 bp, Artificial Sequence
  chemically synthesized
ctgcagagcagacaggacga

SEQ ID NO: 543265 - DNA, 20 bp, Artificial Sequence
  chemically synthesized
agagaaaatttaaaggtacc

SEQ ID NO: 543266 - DNA, 20 bp, Artificial Sequence
  chemically synthesized
aaggtaccagagaaaatgat

SEQ ID NO: 543267 - DNA, 20 bp, Artificial Sequence
  chemically synthesized
actcacactcaaggaaagag

SEQ ID NO: 543268 - DNA, 20 bp, Artificial Sequence
  chemically synthesized
acactcaaggaaagagcaag

SEQ ID NO: 543269 - DNA, 20 bp, Artificial Sequence
  chemically synthesized
tattattgttagagaggtat

SEQ ID NO: 543270 - DNA, 20 bp, Artificial Sequence
  chemically synthesized
ttcaatatgaatagggaatg

SEQ ID NO: 543271 - DNA, 20 bp, Artificial Sequence
  chemically synthesized
ttgttattaatacgaaaact

SEQ ID NO: 543272 - DNA, 20 bp, Artificial Sequence
  chemically synthesized
aaatgatactccgtgattca

SEQ ID NO: 543273 - DNA, 20 bp, Artificial Sequence
  chemically synthesized
atttaaggacattaagaaca

SEQ ID NO: 543274 - DNA, 20 bp, Artificial Sequence
  chemically synthesized
ggtgttttatttaaacattg

SEQ ID NO: 543275 - DNA, 20 bp, Artificial Sequence
  chemically synthesized
tgatggcactgtacatgtct

SEQ ID NO: 543276 - DNA, 20 bp, Artificial Sequence
  chemically synthesized
agtgctatataaaatataac

SEQ ID NO: 543277 - DNA, 20 bp, Artificial Sequence
  chemically synthesized
taagatacgtcattatatcc

SEQ ID NO: 543278 - DNA, 20 bp, Artificial Sequence
  chemically synthesized
tgaggagtgaattgcattta

SEQ ID NO: 543279 - DNA, 20 bp, Artificial Sequence
  chemically synthesized
agtgaattgcatttaaaaga

SEQ ID NO: 543280 - DNA, 20 bp, Artificial Sequence
  chemically synthesized
aagagcttagaactgataat

SEQ ID NO: 543281 - DNA, 20 bp, Artificial Sequence
  chemically synthesized
atgttgagggtttgatattt

SEQ ID NO: 543282 - DNA, 20 bp, Artificial Sequence
  chemically synthesized
cccttggcacagtattttca

SEQ ID NO: 543283 - DNA, 20 bp, Artificial Sequence
  chemically synthesized
atgcttatctgaatttagat

SEQ ID NO: 543284 - DNA, 20 bp, Artificial Sequence
  chemically synthesized
tagtaaaaacatacttctct

SEQ ID NO: 543285 - DNA, 20 bp, Artificial Sequence
  chemically synthesized
agtttatgtacatacaaaaa

SEQ ID NO: 543286 - DNA, 20 bp, Artificial Sequence
  chemically synthesized
agatcattgtctataaatct

SEQ ID NO: 543287 - DNA, 20 bp, Artificial Sequence
  chemically synthesized
ttatgacctaataatagtaa

SEQ ID NO: 543288 - DNA, 20 bp, Artificial Sequence
  chemically synthesized
tactaggctaagtagtttaa

SEQ ID NO: 543289 - DNA, 20 bp, Artificial Sequence
  chemically synthesized
atacataattcataagttgt

SEQ ID NO: 543290 - DNA, 20 bp, Artificial Sequence
  chemically synthesized
gacatatcattgacaaagac

SEQ ID NO: 543291 - DNA, 20 bp, Artificial Sequence
  chemically synthesized
tctttagctctctgaaaaat

SEQ ID NO: 543292 - DNA, 20 bp, Artificial Sequence
  chemically synthesized
agaaagaaattatatgattc

SEQ ID NO: 543293 - DNA, 20 bp, Artificial Sequence
  chemically synthesized
tctaactgggatgttgtgag

SEQ ID NO: 543294 - DNA, 20 bp, Artificial Sequence
  chemically synthesized
tcattctaactgggatgttg

SEQ ID NO: 543295 - DNA, 20 bp, Artificial Sequence
  chemically synthesized
tctttctcacaacatcccag

SEQ ID NO: 543296 - DNA, 20 bp, Artificial Sequence
  chemically synthesized
tcacaacatcccagttagaa

SEQ ID NO: 543297 - DNA, 20 bp, Artificial Sequence
  chemically synthesized
ttagttgaaattggaaagtt

SEQ ID NO: 543298 - DNA, 20 bp, Artificial Sequence
  chemically synthesized
gttaaagaaataatttatta

SEQ ID NO: 543299 - DNA, 20 bp, Artificial Sequence
  chemically synthesized
agaatacaacagatctgtaa

SEQ ID NO: 543300 - DNA, 20 bp, Artificial Sequence
  chemically synthesized
atacaattgtttggaaaagg

SEQ ID NO: 543301 - DNA, 20 bp, Artificial Sequence
  chemically synthesized
gttaaaaaatatttggcagt

SEQ ID NO: 543302 - DNA, 20 bp, Artificial Sequence
  chemically synthesized
taagttaaaggatacttaac

SEQ ID NO: 543303 - DNA, 20 bp, Artificial Sequence
  chemically synthesized
tttaggaacatattttgata

SEQ ID NO: 543304 - DNA, 20 bp, Artificial Sequence
  chemically synthesized
tgataaaagaaagtttcgtt

SEQ ID NO: 543305 - DNA, 20 bp, Artificial Sequence
  chemically synthesized
tcgagaattgaaaacacatg

SEQ ID NO: 543306 - DNA, 20 bp, Artificial Sequence
  chemically synthesized
attgaaaacacatgagagaa

SEQ ID NO: 543307 - DNA, 20 bp, Artificial Sequence
  chemically synthesized
agtggaaaataaactgtttc

SEQ ID NO: 543308 - DNA, 20 bp, Artificial Sequence
  chemically synthesized
aggctaaagttgcaattaat

SEQ ID NO: 543309 - DNA, 20 bp, Artificial Sequence
  chemically synthesized
ttgtccagaaggagagaaga

SEQ ID NO: 543310 - DNA, 20 bp, Artificial Sequence
  chemically synthesized
tcattattttttgcaatgag

SEQ ID NO: 543311 - DNA, 20 bp, Artificial Sequence
  chemically synthesized
ttcaaatgcgtacatgtatt

SEQ ID NO: 543312 - DNA, 20 bp, Artificial Sequence
  chemically synthesized
ttatttatgtgtgccatgta

SEQ ID NO: 543313 - DNA, 20 bp, Artificial Sequence
  chemically synthesized
ctcaattccccattcagcta

SEQ ID NO: 543314 - DNA, 20 bp, Artificial Sequence
  chemically synthesized
agctgaatggggaattgaga

SEQ ID NO: 543315 - DNA, 20 bp, Artificial Sequence
  chemically synthesized
atgactagagtttaatcctg

SEQ ID NO: 543316 - DNA, 20 bp, Artificial Sequence
  chemically synthesized
ttaatcctgttagaaagccc

SEQ ID NO: 543317 - DNA, 20 bp, Artificial Sequence
  chemically synthesized
gggttatcccattcaggggt

SEQ ID NO: 543318 - DNA, 20 bp, Artificial Sequence
  chemically synthesized
taacaattagggaagatgat

SEQ ID NO: 543319 - DNA, 20 bp, Artificial Sequence
  chemically synthesized
aaaagtgggattcagtggcc

SEQ ID NO: 543320 - DNA, 20 bp, Artificial Sequence
  chemically synthesized
ccttaaaagtatgcattatg

SEQ ID NO: 543321 - DNA, 20 bp, Artificial Sequence
  chemically synthesized
aaatgcaaattgttttgtct

SEQ ID NO: 543322 - DNA, 20 bp, Artificial Sequence
  chemically synthesized
atgccaaaaagctgatttat

SEQ ID NO: 543323 - DNA, 20 bp, Artificial Sequence
  chemically synthesized
tgttacctctatattggaca

SEQ ID NO: 543324 - DNA, 20 bp, Artificial Sequence
  chemically synthesized
gacccgcttaacagaaacta

SEQ ID NO: 543325 - DNA, 20 bp, Artificial Sequence
  chemically synthesized
gaacatttgagacccgctta

SEQ ID NO: 543326 - DNA, 20 bp, Artificial Sequence
  chemically synthesized
ccaagcaactatataaaaat

SEQ ID NO: 543327 - DNA, 20 bp, Artificial Sequence
  chemically synthesized
atctgagcctcttattaaac

SEQ ID NO: 543328 - DNA, 20 bp, Artificial Sequence
  chemically synthesized
gatgatgaatttctctacta

SEQ ID NO: 543329 - DNA, 20 bp, Artificial Sequence
  chemically synthesized
tttctaccttttctcctagt

SEQ ID NO: 543330 - DNA, 20 bp, Artificial Sequence
  chemically synthesized
tttctctactaggagaaaag

SEQ ID NO: 543331 - DNA, 20 bp, Artificial Sequence
  chemically synthesized
ccgtttttatgaggatttgt

SEQ ID NO: 543332 - DNA, 20 bp, Artificial Sequence
  chemically synthesized
tatcatagttagattcatgg

SEQ ID NO: 543333 - DNA, 20 bp, Artificial Sequence
  chemically synthesized
ctcacccaagactcactgaa

SEQ ID NO: 543334 - DNA, 20 bp, Artificial Sequence
  chemically synthesized
cagagtgctgggccctgacc

SEQ ID NO: 543335 - DNA, 20 bp, Artificial Sequence
  chemically synthesized
ttcctgcatctgaatggaca

SEQ ID NO: 543336 - DNA, 20 bp, Artificial Sequence
  chemically synthesized
accagaacttacacataaag

SEQ ID NO: 543337 - DNA, 20 bp, Artificial Sequence
  chemically synthesized
atctctccctgatactcaaa

SEQ ID NO: 543338 - DNA, 20 bp, Artificial Sequence
  chemically synthesized
tgttagtatcttctgacaat

SEQ ID NO: 543339 - DNA, 20 bp, Artificial Sequence
  chemically synthesized
ccaggtagtgaagttgcctt

SEQ ID NO: 543340 - DNA, 20 bp, Artificial Sequence
  chemically synthesized
tgagtagcaggctgaaaact

SEQ ID NO: 543341 - DNA, 20 bp, Artificial Sequence
  chemically synthesized
ccatatataaatagacgcag

SEQ ID NO: 543342 - DNA, 20 bp, Artificial Sequence
  chemically synthesized
gagaaaggaattgagataca

SEQ ID NO: 543343 - DNA, 20 bp, Artificial Sequence
  chemically synthesized
tatgagtgacacacaatgga

SEQ ID NO: 543344 - DNA, 20 bp, Artificial Sequence
  chemically synthesized
gaaaggaaaaaagagatgaa

SEQ ID NO: 543345 - DNA, 20 bp, Artificial Sequence
  chemically synthesized
cacacttctctctctgctta

SEQ ID NO: 543346 - DNA, 20 bp, Artificial Sequence
  chemically synthesized
cacccctgaggaaaacttta

SEQ ID NO: 543347 - DNA, 20 bp, Artificial Sequence
  chemically synthesized
caatggtttttcttgtccat

SEQ ID NO: 543348 - DNA, 20 bp, Artificial Sequence
  chemically synthesized
cagtttttattctaaatgga

SEQ ID NO: 543349 - DNA, 20 bp, Artificial Sequence
  chemically synthesized
ctgaagctaattgggaagag

SEQ ID NO: 543350 - DNA, 20 bp, Artificial Sequence
  chemically synthesized
gaccctgaagctaattggga

SEQ ID NO: 543351 - DNA, 20 bp, Artificial Sequence
  chemically synthesized
gcagaagctatgctctctga

SEQ ID NO: 543352 - DNA, 20 bp, Artificial Sequence
  chemically synthesized
ttgacttatagagcatttat

SEQ ID NO: 543353 - DNA, 20 bp, Artificial Sequence
  chemically synthesized
gagggtggtaggatgctatt

SEQ ID NO: 543354 - DNA, 20 bp, Artificial Sequence
  chemically synthesized
gtaaacatggattttgaaat

SEQ ID NO: 543355 - DNA, 20 bp, Artificial Sequence
  chemically synthesized
cctcaccacacgctagaaca

SEQ ID NO: 543356 - DNA, 20 bp, Artificial Sequence
  chemically synthesized
ataaatatgctattgctaga

SEQ ID NO: 543357 - DNA, 20 bp, Artificial Sequence
  chemically synthesized
atttctagagtattaaaaac

SEQ ID NO: 543358 - DNA, 20 bp, Artificial Sequence
  chemically synthesized
aattctgtgtttttaatact

SEQ ID NO: 543359 - DNA, 20 bp, Artificial Sequence
  chemically synthesized
tgtgtgtataaaactataat

SEQ ID NO: 543360 - DNA, 20 bp, Artificial Sequence
  chemically synthesized
aatatctattatagttaata

SEQ ID NO: 543361 - DNA, 20 bp, Artificial Sequence
  chemically synthesized
ttatataattaaatggtaat

SEQ ID NO: 543362 - DNA, 20 bp, Artificial Sequence
  chemically synthesized
atactgtgctaggcattgtg

SEQ ID NO: 543363 - DNA, 20 bp, Artificial Sequence
  chemically synthesized
gggtatcagaatgtctgctt

SEQ ID NO: 543364 - DNA, 20 bp, Artificial Sequence
  chemically synthesized
cttcgtttgtgaactgggta

SEQ ID NO: 543365 - DNA, 20 bp, Artificial Sequence
  chemically synthesized
ttatgtgctagcaagaactt

SEQ ID NO: 543366 - DNA, 20 bp, Artificial Sequence
  chemically synthesized
tatattttgtcctattgttt

SEQ ID NO: 543367 - DNA, 20 bp, Artificial Sequence
  chemically synthesized
acccgtagcctttaatatgg

SEQ ID NO: 543368 - DNA, 20 bp, Artificial Sequence
  chemically synthesized
tatttagtgtttccaaattc

SEQ ID NO: 543369 - DNA, 20 bp, Artificial Sequence
  chemically synthesized
tggtagtttgaaggcatttc

SEQ ID NO: 543370 - DNA, 20 bp, Artificial Sequence
  chemically synthesized
acattataaatttgtctttt

SEQ ID NO: 543371 - DNA, 20 bp, Artificial Sequence
  chemically synthesized
aatcatgtagtattaagaga

SEQ ID NO: 543372 - DNA, 20 bp, Artificial Sequence
  chemically synthesized
aaggaaataaatggaaaaag

SEQ ID NO: 543373 - DNA, 20 bp, Artificial Sequence
  chemically synthesized
aacaaaggaaataaatggaa

SEQ ID NO: 543374 - DNA, 20 bp, Artificial Sequence
  chemically synthesized
agatgaaggtaaaaaaaaaa

SEQ ID NO: 543375 - DNA, 20 bp, Artificial Sequence
  chemically synthesized
tataaaactccagatgaatt

SEQ ID NO: 543376 - DNA, 20 bp, Artificial Sequence
  chemically synthesized
ttggagaaaactgtaagcct

SEQ ID NO: 543377 - DNA, 20 bp, Artificial Sequence
  chemically synthesized
gaggccttgaagggaggttt

SEQ ID NO: 543378 - DNA, 20 bp, Artificial Sequence
  chemically synthesized
tgttttgtggaaggtctatg

SEQ ID NO: 543379 - DNA, 20 bp, Artificial Sequence
  chemically synthesized
atttcatcagtatgtaaata

SEQ ID NO: 543380 - DNA, 20 bp, Artificial Sequence
  chemically synthesized
aagtaaaaagcttatatgca

SEQ ID NO: 543381 - DNA, 20 bp, Artificial Sequence
  chemically synthesized
gacaatgcttttctgtgaat

SEQ ID NO: 543382 - DNA, 20 bp, Artificial Sequence
  chemically synthesized
agccttgtttttctccattc

SEQ ID NO: 543383 - DNA, 20 bp, Artificial Sequence
  chemically synthesized
aagtaattttattggcatac

SEQ ID NO: 543384 - DNA, 20 bp, Artificial Sequence
  chemically synthesized
aaaacattatgaaagaacac

SEQ ID NO: 543385 - DNA, 20 bp, Artificial Sequence
  chemically synthesized
gatacatgattatgaagttc

SEQ ID NO: 543386 - DNA, 20 bp, Artificial Sequence
  chemically synthesized
aacttcataatcatgtatct

SEQ ID NO: 543387 - DNA, 20 bp, Artificial Sequence
  chemically synthesized
cagaaactctcataaattaa

SEQ ID NO: 543388 - DNA, 20 bp, Artificial Sequence
  chemically synthesized
aaaagagtctgtctgtggtt

SEQ ID NO: 543389 - DNA, 20 bp, Artificial Sequence
  chemically synthesized
aatgagtaatggagtccatt

SEQ ID NO: 543390 - DNA, 20 bp, Artificial Sequence
  chemically synthesized
tggactccattactcattaa

SEQ ID NO: 543391 - DNA, 20 bp, Artificial Sequence
  chemically synthesized
tgcaaaacttaaaacatcta

SEQ ID NO: 543392 - DNA, 20 bp, Artificial Sequence
  chemically synthesized
aatgttgtttcaaccagaga

SEQ ID NO: 543393 - DNA, 20 bp, Artificial Sequence
  chemically synthesized
ttgcccaatagtaaatatgt

SEQ ID NO: 543394 - DNA, 20 bp, Artificial Sequence
  chemically synthesized
caatatgtcttgcaattgta

SEQ ID NO: 543395 - DNA, 20 bp, Artificial Sequence
  chemically synthesized
caatgaacctataataaact

SEQ ID NO: 543396 - DNA, 20 bp, Artificial Sequence
  chemically synthesized
atttttgctattttataaat

SEQ ID NO: 543397 - DNA, 20 bp, Artificial Sequence
  chemically synthesized
tcctgctgctaaatttctac

SEQ ID NO: 543398 - DNA, 20 bp, Artificial Sequence
  chemically synthesized
taacagagcagagtttctaa

SEQ ID NO: 543399 - DNA, 20 bp, Artificial Sequence
  chemically synthesized
agatttgatgttcggctgta

SEQ ID NO: 543400 - DNA, 20 bp, Artificial Sequence
  chemically synthesized
tgtaagagaaatataggaga

SEQ ID NO: 543401 - DNA, 20 bp, Artificial Sequence
  chemically synthesized
gtataccccagtctactacc

SEQ ID NO: 543402 - DNA, 20 bp, Artificial Sequence
  chemically synthesized
ggtatgcaggtctaggatca

SEQ ID NO: 543403 - DNA, 20 bp, Artificial Sequence
  chemically synthesized
agggaaaactaagagataat

SEQ ID NO: 543404 - DNA, 20 bp, Artificial Sequence
  chemically synthesized
aaaactaagagataattaag

SEQ ID NO: 543405 - DNA, 20 bp, Artificial Sequence
  chemically synthesized
ccctgacaaaatctgcttta

SEQ ID NO: 543406 - DNA, 20 bp, Artificial Sequence
  chemically synthesized
gaagggaaggagtgaaatgg

SEQ ID NO: 543407 - DNA, 20 bp, Artificial Sequence
  chemically synthesized
gtaatatctcctgtcattta

SEQ ID NO: 543408 - DNA, 20 bp, Artificial Sequence
  chemically synthesized
tttaaatgacaggagatatt

SEQ ID NO: 543409 - DNA, 20 bp, Artificial Sequence
  chemically synthesized
ttcccatcattcccatcagt

SEQ ID NO: 543410 - DNA, 20 bp, Artificial Sequence
  chemically synthesized
agctggccttagacaaaagc

SEQ ID NO: 543411 - DNA, 20 bp, Artificial Sequence
  chemically synthesized
taccgagaaaatataagcaa

SEQ ID NO: 543412 - DNA, 20 bp, Artificial Sequence
  chemically synthesized
aaactagcttcttgttttac

SEQ ID NO: 543413 - DNA, 20 bp, Artificial Sequence
  chemically synthesized
aaacaagaagctagtttttt

SEQ ID NO: 543414 - DNA, 20 bp, Artificial Sequence
  chemically synthesized
cccaaagagtatactgaccc

SEQ ID NO: 543415 - DNA, 20 bp, Artificial Sequence
  chemically synthesized
agacaatgatctgcaagctg

SEQ ID NO: 543416 - DNA, 20 bp, Artificial Sequence
  chemically synthesized
tataaccatatattatttac

SEQ ID NO: 543417 - DNA, 20 bp, Artificial Sequence
  chemically synthesized
acaaatagaaacctacatat

SEQ ID NO: 543418 - DNA, 20 bp, Artificial Sequence
  chemically synthesized
gtttgttagatagaaaacaa

SEQ ID NO: 543419 - DNA, 20 bp, Artificial Sequence
  chemically synthesized
tcactgtacatgtttgttag

SEQ ID NO: 543420 - DNA, 20 bp, Artificial Sequence
  chemically synthesized
aaaaaggttaaacaactttt

SEQ ID NO: 543421 - DNA, 20 bp, Artificial Sequence
  chemically synthesized
cataaactgcctgtgtgatt

SEQ ID NO: 543422 - DNA, 20 bp, Artificial Sequence
  chemically synthesized
gacacacgcggtcaaatact

SEQ ID NO: 543423 - DNA, 20 bp, Artificial Sequence
  chemically synthesized
catctatgctgctgcaaatg

SEQ ID NO: 543424 - DNA, 20 bp, Artificial Sequence
  chemically synthesized
gaatattatgtagctttaaa

SEQ ID NO: 543425 - DNA, 20 bp, Artificial Sequence
  chemically synthesized
ggttcctcaaaaaattacaa

SEQ ID NO: 543426 - DNA, 20 bp, Artificial Sequence
  chemically synthesized
acattccaaccaacaccata

SEQ ID NO: 543427 - DNA, 20 bp, Artificial Sequence
  chemically synthesized
ctaagtgttggcaagaatgt

SEQ ID NO: 543428 - DNA, 20 bp, Artificial Sequence
  chemically synthesized
caaaagatactaagtgttgg

SEQ ID NO: 543429 - DNA, 20 bp, Artificial Sequence
  chemically synthesized
gtcatttctctaaagaatac

SEQ ID NO: 543430 - DNA, 20 bp, Artificial Sequence
  chemically synthesized
gtcatttctacgtattcttt

SEQ ID NO: 543431 - DNA, 20 bp, Artificial Sequence
  chemically synthesized
acttgaatagtcatttctct

SEQ ID NO: 543432 - DNA, 20 bp, Artificial Sequence
  chemically synthesized
tgaatatttccttccattcc

SEQ ID NO: 543433 - DNA, 20 bp, Artificial Sequence
  chemically synthesized
caaactcacagaactagaga

SEQ ID NO: 543434 - DNA, 20 bp, Artificial Sequence
  chemically synthesized
cgtaaactcttagagatgga

SEQ ID NO: 543435 - DNA, 20 bp, Artificial Sequence
  chemically synthesized
ggggaaatcttctcaatagg

SEQ ID NO: 543436 - DNA, 20 bp, Artificial Sequence
  chemically synthesized
atcttagccatatttatttc

SEQ ID NO: 543437 - DNA, 20 bp, Artificial Sequence
  chemically synthesized
ttgtaggtcattgtgatttt

SEQ ID NO: 543438 - DNA, 20 bp, Artificial Sequence
  chemically synthesized
gacctacaatgtagctcata

SEQ ID NO: 543439 - DNA, 20 bp, Artificial Sequence
  chemically synthesized
agtctagaggaagaatgagg

SEQ ID NO: 543440 - DNA, 20 bp, Artificial Sequence
  chemically synthesized
tgtttgttgatagtctagag

SEQ ID NO: 543441 - DNA, 20 bp, Artificial Sequence
  chemically synthesized
gatctaatgggatctgttaa

SEQ ID NO: 543442 - DNA, 20 bp, Artificial Sequence
  chemically synthesized
acagaatgaaaagacaatcc

SEQ ID NO: 543443 - DNA, 20 bp, Artificial Sequence
  chemically synthesized
cacagcaaaggaaacagtaa

SEQ ID NO: 543444 - DNA, 20 bp, Artificial Sequence
  chemically synthesized
tttcctttgctgtgcagaag

SEQ ID NO: 543445 - DNA, 20 bp, Artificial Sequence
  chemically synthesized
tagaaactcagatatcataa

SEQ ID NO: 543446 - DNA, 20 bp, Artificial Sequence
  chemically synthesized
ctgaacagttatttccaaaa

SEQ ID NO: 543447 - DNA, 20 bp, Artificial Sequence
  chemically synthesized
gagaacagcatggaggttcc

SEQ ID NO: 543448 - DNA, 20 bp, Artificial Sequence
  chemically synthesized
tagggattgcaattgtccag

SEQ ID NO: 543449 - DNA, 20 bp, Artificial Sequence
  chemically synthesized
gctgcatattcctattagaa

SEQ ID NO: 543450 - DNA, 20 bp, Artificial Sequence
  chemically synthesized
aaaaagagtgggaaaatgag

SEQ ID NO: 543451 - DNA, 20 bp, Artificial Sequence
  chemically synthesized
gaggagctcaaaggaagcca

SEQ ID NO: 543452 - DNA, 20 bp, Artificial Sequence
  chemically synthesized
attctgccagaaaatgaagt

SEQ ID NO: 543453 - DNA, 20 bp, Artificial Sequence
  chemically synthesized
tttctccacttcattttctg

SEQ ID NO: 543454 - DNA, 20 bp, Artificial Sequence
  chemically synthesized
tgttgtgtcaaggaattctg

SEQ ID NO: 543455 - DNA, 20 bp, Artificial Sequence
  chemically synthesized
tcagctttaatttcgcctct

SEQ ID NO: 543456 - DNA, 20 bp, Artificial Sequence
  chemically synthesized
aacactctactgactaccca

SEQ ID NO: 543457 - DNA, 20 bp, Artificial Sequence
  chemically synthesized
acttatatctgatcattttt

SEQ ID NO: 543458 - DNA, 20 bp, Artificial Sequence
  chemically synthesized
gatcatttttttagaaatag

SEQ ID NO: 543459 - DNA, 20 bp, Artificial Sequence
  chemically synthesized
gaagtgtaaatctatgcatt

SEQ ID NO: 543460 - DNA, 20 bp, Artificial Sequence
  chemically synthesized
ttaccaattcagcattccag

SEQ ID NO: 543461 - DNA, 20 bp, Artificial Sequence
  chemically synthesized
atacatataatattctaaga

SEQ ID NO: 543462 - DNA, 20 bp, Artificial Sequence
  chemically synthesized
ctgatctccattttctaatc

SEQ ID NO: 543463 - DNA, 20 bp, Artificial Sequence
  chemically synthesized
cttatgtctgttatatgtac

SEQ ID NO: 543464 - DNA, 20 bp, Artificial Sequence
  chemically synthesized
agcactgacttacttcagga

SEQ ID NO: 543465 - DNA, 20 bp, Artificial Sequence
  chemically synthesized
tttgaaaatgaaaaaaaaaa

SEQ ID NO: 543466 - DNA, 20 bp, Artificial Sequence
  chemically synthesized
ctgctaagtaaactttcaaa

SEQ ID NO: 543467 - DNA, 20 bp, Artificial Sequence
  chemically synthesized
tatctataaaatattcttct

SEQ ID NO: 543468 - DNA, 20 bp, Artificial Sequence
  chemically synthesized
gagtttctcatttttctaca

SEQ ID NO: 543469 - DNA, 20 bp, Artificial Sequence
  chemically synthesized
aatattcttctgtagaaaaa

SEQ ID NO: 543470 - DNA, 20 bp, Artificial Sequence
  chemically synthesized
aattaagattcagtaaccat

SEQ ID NO: 543471 - DNA, 20 bp, Artificial Sequence
  chemically synthesized
tacttgtggggactgagatg

SEQ ID NO: 543472 - DNA, 20 bp, Artificial Sequence
  chemically synthesized
catggctaatatatgtgtat

SEQ ID NO: 543473 - DNA, 20 bp, Artificial Sequence
  chemically synthesized
atgtataataataatgggat

SEQ ID NO: 543474 - DNA, 20 bp, Artificial Sequence
  chemically synthesized
ttattatacatttatgttct

SEQ ID NO: 543475 - DNA, 20 bp, Artificial Sequence
  chemically synthesized
catggattggaaataatgac

SEQ ID NO: 543476 - DNA, 20 bp, Artificial Sequence
  chemically synthesized
tttagtatgacagttgtgtt

SEQ ID NO: 543477 - DNA, 20 bp, Artificial Sequence
  chemically synthesized
catgaaaatatttagatatg

SEQ ID NO: 543478 - DNA, 20 bp, Artificial Sequence
  chemically synthesized
ctagaaaaaagattaatttg

SEQ ID NO: 543479 - DNA, 20 bp, Artificial Sequence
  chemically synthesized
aatgaaggtgggcagaagat

SEQ ID NO: 543480 - DNA, 20 bp, Artificial Sequence
  chemically synthesized
gaatatcactgactaaaagc

SEQ ID NO: 543481 - DNA, 20 bp, Artificial Sequence
  chemically synthesized
atattagatatgaaacatag

SEQ ID NO: 543482 - DNA, 20 bp, Artificial Sequence
  chemically synthesized
ttatttgtattctacttata

SEQ ID NO: 543483 - DNA, 20 bp, Artificial Sequence
  chemically synthesized
tccttttgtttctgatataa

SEQ ID NO: 543484 - DNA, 20 bp, Artificial Sequence
  chemically synthesized
aataaatttaatatttctgg

SEQ ID NO: 543485 - DNA, 20 bp, Artificial Sequence
  chemically synthesized
attttcacacatttttctaa

SEQ ID NO: 543486 - DNA, 20 bp, Artificial Sequence
  chemically synthesized
attttcaaacacaggatact

SEQ ID NO: 543487 - DNA, 20 bp, Artificial Sequence
  chemically synthesized
ataccattgtcatgcagcag

SEQ ID NO: 543488 - DNA, 20 bp, Artificial Sequence
  chemically synthesized
gtatgaatagtaatttatca

SEQ ID NO: 543489 - DNA, 20 bp, Artificial Sequence
  chemically synthesized
atgcagtataatttaaaggt

SEQ ID NO: 543490 - DNA, 20 bp, Artificial Sequence
  chemically synthesized
aatgtcactagtgccaatgt

SEQ ID NO: 543491 - DNA, 20 bp, Artificial Sequence
  chemically synthesized
gctgtgacaatcaaaaacgt

SEQ ID NO: 543492 - DNA, 20 bp, Artificial Sequence
  chemically synthesized
gcactgtttcagctgctttt

SEQ ID NO: 543493 - DNA, 20 bp, Artificial Sequence
  chemically synthesized
aatggcctgcccttggggat

SEQ ID NO: 543494 - DNA, 20 bp, Artificial Sequence
  chemically synthesized
aagggcaggccattcctcct

SEQ ID NO: 543495 - DNA, 20 bp, Artificial Sequence
  chemically synthesized
cagaatcacatacaaaccct

SEQ ID NO: 543496 - DNA, 20 bp, Artificial Sequence
  chemically synthesized
gccttataacgggtctcgtt

SEQ ID NO: 543497 - DNA, 20 bp, Artificial Sequence
  chemically synthesized
ctctaagtagttcttgaggc

SEQ ID NO: 543498 - DNA, 20 bp, Artificial Sequence
  chemically synthesized
attaaatcatatccccctct

SEQ ID NO: 543499 - DNA, 20 bp, Artificial Sequence
  chemically synthesized
ttaagttacaaaacaactca

SEQ ID NO: 543500 - DNA, 20 bp, Artificial Sequence
  chemically synthesized
gactatttaaactgtcatct

SEQ ID NO: 543501 - DNA, 20 bp, Artificial Sequence
  chemically synthesized
agaaaaaaaggtaatacggg

SEQ ID NO: 543502 - DNA, 20 bp, Artificial Sequence
  chemically synthesized
tttttagaagtggcaaaaca

SEQ ID NO: 543503 - DNA, 20 bp, Artificial Sequence
  chemically synthesized
atgtaaatttaagtaaaaca

SEQ ID NO: 543504 - DNA, 20 bp, Artificial Sequence
  chemically synthesized
acattgaaaatatgtgctcc

SEQ ID NO: 543505 - DNA, 20 bp, Artificial Sequence
  chemically synthesized
ctacttgggaggctgaggca

SEQ ID NO: 543506 - DNA, 20 bp, Artificial Sequence
  chemically synthesized
gcatcactgtagatcagtaa

SEQ ID NO: 543507 - DNA, 20 bp, Artificial Sequence
  chemically synthesized
taataacaataaaaacttaa

SEQ ID NO: 543508 - DNA, 20 bp, Artificial Sequence
  chemically synthesized
accgagaaagaaagagttct

SEQ ID NO: 543509 - DNA, 20 bp, Artificial Sequence
  chemically synthesized
tttagttagctaataccgag

SEQ ID NO: 543510 - DNA, 20 bp, Artificial Sequence
  chemically synthesized
agaatttagttagctaatac

SEQ ID NO: 543511 - DNA, 20 bp, Artificial Sequence
  chemically synthesized
ctctgctatagattaaatag

SEQ ID NO: 543512 - DNA, 20 bp, Artificial Sequence
  chemically synthesized
tgaaacctgtgagtatatta

SEQ ID NO: 543513 - DNA, 20 bp, Artificial Sequence
  chemically synthesized
tccagtataatctccccatc

SEQ ID NO: 543514 - DNA, 20 bp, Artificial Sequence
  chemically synthesized
aaggaaggtgagaaggagag

SEQ ID NO: 543515 - DNA, 20 bp, Artificial Sequence
  chemically synthesized
agagggagatagacagggag

SEQ ID NO: 543516 - DNA, 20 bp, Artificial Sequence
  chemically synthesized
acacctaccttcctccttca

SEQ ID NO: 543517 - DNA, 20 bp, Artificial Sequence
  chemically synthesized
gtacacatatgtttataagt

SEQ ID NO: 543518 - DNA, 20 bp, Artificial Sequence
  chemically synthesized
tactaataaccactcaagct

SEQ ID NO: 543519 - DNA, 20 bp, Artificial Sequence
  chemically synthesized
tctgttttggagactttgaa

SEQ ID NO: 543520 - DNA, 20 bp, Artificial Sequence
  chemically synthesized
ctgttctggaggtcagaagt

SEQ ID NO: 543521 - DNA, 20 bp, Artificial Sequence
  chemically synthesized
atgatactcctaagaaatta

SEQ ID NO: 543522 - DNA, 20 bp, Artificial Sequence
  chemically synthesized
ttaatgtcctatgatactcc

SEQ ID NO: 543523 - DNA, 20 bp, Artificial Sequence
  chemically synthesized
tccatatatgtatatgtgca

SEQ ID NO: 543524 - DNA, 20 bp, Artificial Sequence
  chemically synthesized
tttttataagtagcaaaaca

SEQ ID NO: 543525 - DNA, 20 bp, Artificial Sequence
  chemically synthesized
ggtaatcatttagcttatga

SEQ ID NO: 543526 - DNA, 20 bp, Artificial Sequence
  chemically synthesized
tcctattggtaatggtgaaa

SEQ ID NO: 543527 - DNA, 20 bp, Artificial Sequence
  chemically synthesized
aaaattcattctaaaaacac

SEQ ID NO: 543528 - DNA, 20 bp, Artificial Sequence
  chemically synthesized
taggagttttctcagtgttt

SEQ ID NO: 543529 - DNA, 20 bp, Artificial Sequence
  chemically synthesized
tttgcttattccttctagga

SEQ ID NO: 543530 - DNA, 20 bp, Artificial Sequence
  chemically synthesized
acaagtaaataaaaatgagg

SEQ ID NO: 543531 - DNA, 20 bp, Artificial Sequence
  chemically synthesized
ggaaatatcaatcagaattt

SEQ ID NO: 543532 - DNA, 20 bp, Artificial Sequence
  chemically synthesized
aaattagccggaaatatcaa

SEQ ID NO: 543533 - DNA, 20 bp, Artificial Sequence
  chemically synthesized
accactgtgaaagagatgtc

SEQ ID NO: 543534 - DNA, 20 bp, Artificial Sequence
  chemically synthesized
tgagatatatttgacattgt

SEQ ID NO: 543535 - DNA, 20 bp, Artificial Sequence
  chemically synthesized
taataatattgatatatgga

SEQ ID NO: 543536 - DNA, 20 bp, Artificial Sequence
  chemically synthesized
tcccaccataatactacata

SEQ ID NO: 543537 - DNA, 20 bp, Artificial Sequence
  chemically synthesized
ggattcaaggatagttttgt

SEQ ID NO: 543538 - DNA, 20 bp, Artificial Sequence
  chemically synthesized
taagaaattacatgtgttat

SEQ ID NO: 543539 - DNA, 20 bp, Artificial Sequence
  chemically synthesized
ctaaagttatgatcctactg

SEQ ID NO: 543540 - DNA, 20 bp, Artificial Sequence
  chemically synthesized
tataggtcacattatagggg

SEQ ID NO: 543541 - DNA, 20 bp, Artificial Sequence
  chemically synthesized
taataatggaaattgttgaa

SEQ ID NO: 543542 - DNA, 20 bp, Artificial Sequence
  chemically synthesized
taatttacaggagtggaaaa

SEQ ID NO: 543543 - DNA, 20 bp, Artificial Sequence
  chemically synthesized
tctgtatctgatggaaataa

SEQ ID NO: 543544 - DNA, 20 bp, Artificial Sequence
  chemically synthesized
gaagtaaaaaaattacaaga

SEQ ID NO: 543545 - DNA, 20 bp, Artificial Sequence
  chemically synthesized
caagactttcttccttactc

SEQ ID NO: 543546 - DNA, 20 bp, Artificial Sequence
  chemically synthesized
tttttttttctgtgagtaag

SEQ ID NO: 543547 - DNA, 20 bp, Artificial Sequence
  chemically synthesized
aaaacaccagagacaatttt

SEQ ID NO: 543548 - DNA, 20 bp, Artificial Sequence
  chemically synthesized
tttccactgaaaaagatagg

SEQ ID NO: 543549 - DNA, 20 bp, Artificial Sequence
  chemically synthesized
gaataagagtggagaaaaca

SEQ ID NO: 543550 - DNA, 20 bp, Artificial Sequence
  chemically synthesized
aaatgtgcaagaataagagt

SEQ ID NO: 543551 - DNA, 20 bp, Artificial Sequence
  chemically synthesized
aacataagaataaaaatgtg

SEQ ID NO: 543552 - DNA, 20 bp, Artificial Sequence
  chemically synthesized
aactagtaaacttttaaaca

SEQ ID NO: 543553 - DNA, 20 bp, Artificial Sequence
  chemically synthesized
agctaccatttggtattgta

SEQ ID NO: 543554 - DNA, 20 bp, Artificial Sequence
  chemically synthesized
ttttttgaagtaatgtattc

SEQ ID NO: 543555 - DNA, 20 bp, Artificial Sequence
  chemically synthesized
tcaaatttaaactttatcac

SEQ ID NO: 543556 - DNA, 20 bp, Artificial Sequence
  chemically synthesized
ctgagataatatgtgcattt

SEQ ID NO: 543557 - DNA, 20 bp, Artificial Sequence
  chemically synthesized
actaatacgttttcatgtct

SEQ ID NO: 543558 - DNA, 20 bp, Artificial Sequence
  chemically synthesized
ctactcaggaggctaaggca

SEQ ID NO: 543559 - DNA, 20 bp, Artificial Sequence
  chemically synthesized
ctgcactccagcctgggcaa

SEQ ID NO: 543560 - DNA, 20 bp, Artificial Sequence
  chemically synthesized
atatactaatatgggaaatg

SEQ ID NO: 543561 - DNA, 20 bp, Artificial Sequence
  chemically synthesized
atgttaaaaaaatgtagcta

SEQ ID NO: 543562 - DNA, 20 bp, Artificial Sequence
  chemically synthesized
ttcaaatgtctcattacatt

SEQ ID NO: 543563 - DNA, 20 bp, Artificial Sequence
  chemically synthesized
agttgactgaatccactcat

SEQ ID NO: 543564 - DNA, 20 bp, Artificial Sequence
  chemically synthesized
tccaggaactcctatgaata

SEQ ID NO: 543565 - DNA, 20 bp, Artificial Sequence
  chemically synthesized
actgattttacccaccagtt

SEQ ID NO: 543566 - DNA, 20 bp, Artificial Sequence
  chemically synthesized
agatgtattgattttgatta

SEQ ID NO: 543567 - DNA, 20 bp, Artificial Sequence
  chemically synthesized
tgggcaaactaccatacttg

SEQ ID NO: 543568 - DNA, 20 bp, Artificial Sequence
  chemically synthesized
gatataacctttaaataata

SEQ ID NO: 543569 - DNA, 20 bp, Artificial Sequence
  chemically synthesized
tcaggacatgggtccagcag

SEQ ID NO: 543570 - DNA, 20 bp, Artificial Sequence
  chemically synthesized
aaactttatcaaaagggaaa

SEQ ID NO: 543571 - DNA, 20 bp, Artificial Sequence
  chemically synthesized
tatcaaaagggaaaaaagaa

SEQ ID NO: 543572 - DNA, 20 bp, Artificial Sequence
  chemically synthesized
agtttcaaatattaacaaaa

SEQ ID NO: 543573 - DNA, 20 bp, Artificial Sequence
  chemically synthesized
tcgttttataaggtcaggaa

SEQ ID NO: 543574 - DNA, 20 bp, Artificial Sequence
  chemically synthesized
aaaacagataagggcaggaa

SEQ ID NO: 543575 - DNA, 20 bp, Artificial Sequence
  chemically synthesized
aggtgatacagatggtattt

SEQ ID NO: 543576 - DNA, 20 bp, Artificial Sequence
  chemically synthesized
cacaggtttattataagaat

SEQ ID NO: 543577 - DNA, 20 bp, Artificial Sequence
  chemically synthesized
tatgtctcacaggtttatta

SEQ ID NO: 543578 - DNA, 20 bp, Artificial Sequence
  chemically synthesized
ttgttaatcccaattgcaat

SEQ ID NO: 543579 - DNA, 20 bp, Artificial Sequence
  chemically synthesized
catattttagggataatcca

SEQ ID NO: 543580 - DNA, 20 bp, Artificial Sequence
  chemically synthesized
gggataatccaaaagaaatt

SEQ ID NO: 543581 - DNA, 20 bp, Artificial Sequence
  chemically synthesized
cacttactgtatttttaatt

SEQ ID NO: 543582 - DNA, 20 bp, Artificial Sequence
  chemically synthesized
aaaatacagtaagtgaaaaa

SEQ ID NO: 543583 - DNA, 20 bp, Artificial Sequence
  chemically synthesized
agcaaatttgacaggggtaa

SEQ ID NO: 543584 - DNA, 20 bp, Artificial Sequence
  chemically synthesized
cggtctaatatatatgcatc

SEQ ID NO: 543585 - DNA, 20 bp, Artificial Sequence
  chemically synthesized
tgcagtgtgatttcatgtat

SEQ ID NO: 543586 - DNA, 20 bp, Artificial Sequence
  chemically synthesized
attccttctacactaaatga

SEQ ID NO: 543587 - DNA, 20 bp, Artificial Sequence
  chemically synthesized
tggcaatggatgctgaaatg

SEQ ID NO: 543588 - DNA, 20 bp, Artificial Sequence
  chemically synthesized
gtactacaaatatcttttaa

SEQ ID NO: 543589 - DNA, 20 bp, Artificial Sequence
  chemically synthesized
aataaatgcatcaggttaat

SEQ ID NO: 543590 - DNA, 20 bp, Artificial Sequence
  chemically synthesized
gtggggaaggttggggggag

SEQ ID NO: 543591 - DNA, 20 bp, Artificial Sequence
  chemically synthesized
tctatgaggacacacaggca

SEQ ID NO: 543592 - DNA, 20 bp, Artificial Sequence
  chemically synthesized
ccattcctgagttacttcac

SEQ ID NO: 543593 - DNA, 20 bp, Artificial Sequence
  chemically synthesized
ccatcactgaatgagtggtt

SEQ ID NO: 543594 - DNA, 20 bp, Artificial Sequence
  chemically synthesized
gtgataccaccttactcttg

SEQ ID NO: 543595 - DNA, 20 bp, Artificial Sequence
  chemically synthesized
ctacaacaaactcaaatcag

SEQ ID NO: 543596 - DNA, 20 bp, Artificial Sequence
  chemically synthesized
atctgacaaaggactaatat

SEQ ID NO: 543597 - DNA, 20 bp, Artificial Sequence
  chemically synthesized
atccttgcctaagccaatgt

SEQ ID NO: 543598 - DNA, 20 bp, Artificial Sequence
  chemically synthesized
gttttttccaatgttatctt

SEQ ID NO: 543599 - DNA, 20 bp, Artificial Sequence
  chemically synthesized
agcaaacaaaaacatacagt

SEQ ID NO: 543600 - DNA, 20 bp, Artificial Sequence
  chemically synthesized
aacagaacagaatagagaac

SEQ ID NO: 543601 - DNA, 20 bp, Artificial Sequence
  chemically synthesized
taggcacatagaccaacaga

SEQ ID NO: 543602 - DNA, 20 bp, Artificial Sequence
  chemically synthesized
tttttggttccatattaatt

SEQ ID NO: 543603 - DNA, 20 bp, Artificial Sequence
  chemically synthesized
aattttttttctaattctgt

SEQ ID NO: 543604 - DNA, 20 bp, Artificial Sequence
  chemically synthesized
cagcatcattcttcacagaa

SEQ ID NO: 543605 - DNA, 20 bp, Artificial Sequence
  chemically synthesized
aaataacagcatcattcttc

SEQ ID NO: 543606 - DNA, 20 bp, Artificial Sequence
  chemically synthesized
aaaactaccaaacactgctg

SEQ ID NO: 543607 - DNA, 20 bp, Artificial Sequence
  chemically synthesized
tataccaacaacgaccaagc

SEQ ID NO: 543608 - DNA, 20 bp, Artificial Sequence
  chemically synthesized
gctgaattattttatcagtt

SEQ ID NO: 543609 - DNA, 20 bp, Artificial Sequence
  chemically synthesized
tcaaaaccctaaggattcct

SEQ ID NO: 543610 - DNA, 20 bp, Artificial Sequence
  chemically synthesized
ccagagcagtcagacaagag

SEQ ID NO: 543611 - DNA, 20 bp, Artificial Sequence
  chemically synthesized
ctagccagagcagtcagaca

SEQ ID NO: 543612 - DNA, 20 bp, Artificial Sequence
  chemically synthesized
ttttgtttattaataatcat

SEQ ID NO: 543613 - DNA, 20 bp, Artificial Sequence
  chemically synthesized
gttttcattaaacagaaaga

SEQ ID NO: 543614 - DNA, 20 bp, Artificial Sequence
  chemically synthesized
agtgtttcagttttcattaa

SEQ ID NO: 543615 - DNA, 20 bp, Artificial Sequence
  chemically synthesized
ttggacagatcagaagttat

SEQ ID NO: 543616 - DNA, 20 bp, Artificial Sequence
  chemically synthesized
gtttatttcttaaagctaca

SEQ ID NO: 543617 - DNA, 20 bp, Artificial Sequence
  chemically synthesized
tggaaattcttttgtagctt

SEQ ID NO: 543618 - DNA, 20 bp, Artificial Sequence
  chemically synthesized
tccacataagaaaatcagaa

SEQ ID NO: 543619 - DNA, 20 bp, Artificial Sequence
  chemically synthesized
ttacattccacataagaaaa

SEQ ID NO: 543620 - DNA, 20 bp, Artificial Sequence
  chemically synthesized
tagtgtcattacattccaca

SEQ ID NO: 543621 - DNA, 20 bp, Artificial Sequence
  chemically synthesized
gcaggccagggaatgccagt

SEQ ID NO: 543622 - DNA, 20 bp, Artificial Sequence
  chemically synthesized
tcttcttatctgaaacagat

SEQ ID NO: 543623 - DNA, 20 bp, Artificial Sequence
  chemically synthesized
tctaaatctgtttcagataa

SEQ ID NO: 543624 - DNA, 20 bp, Artificial Sequence
  chemically synthesized
aatctgtttcagataagaag

SEQ ID NO: 543625 - DNA, 20 bp, Artificial Sequence
  chemically synthesized
cttgtgatcccaacatagga

SEQ ID NO: 543626 - DNA, 20 bp, Artificial Sequence
  chemically synthesized
ctcactttttttccttttat

SEQ ID NO: 543627 - DNA, 20 bp, Artificial Sequence
  chemically synthesized
aatatgtaacttttttctct

SEQ ID NO: 543628 - DNA, 20 bp, Artificial Sequence
  chemically synthesized
gtcataggaatactttcttt

SEQ ID NO: 543629 - DNA, 20 bp, Artificial Sequence
  chemically synthesized
ggtcctttagcagccgaata

SEQ ID NO: 543630 - DNA, 20 bp, Artificial Sequence
  chemically synthesized
gcagtttttaaacaaaaggt

SEQ ID NO: 543631 - DNA, 20 bp, Artificial Sequence
  chemically synthesized
ggggctaaagggaaaagaag

SEQ ID NO: 543632 - DNA, 20 bp, Artificial Sequence
  chemically synthesized
ttagctcttttgttatcaca

SEQ ID NO: 543633 - DNA, 20 bp, Artificial Sequence
  chemically synthesized
ttgacatagactcatgtgta

SEQ ID NO: 543634 - DNA, 20 bp, Artificial Sequence
  chemically synthesized
tatctcgatagttatgtctc

SEQ ID NO: 543635 - DNA, 20 bp, Artificial Sequence
  chemically synthesized
ctcttgaaaaatagaactac

SEQ ID NO: 543636 - DNA, 20 bp, Artificial Sequence
  chemically synthesized
aaaataggcacttaagcatc

SEQ ID NO: 543637 - DNA, 20 bp, Artificial Sequence
  chemically synthesized
atattggacagttcatacaa

SEQ ID NO: 543638 - DNA, 20 bp, Artificial Sequence
  chemically synthesized
tttgaaaatattgtttcatc

SEQ ID NO: 543639 - DNA, 20 bp, Artificial Sequence
  chemically synthesized
tatatttaattttaaatgtt

SEQ ID NO: 543640 - DNA, 20 bp, Artificial Sequence
  chemically synthesized
ttctatctaagcactatcca

SEQ ID NO: 543641 - DNA, 20 bp, Artificial Sequence
  chemically synthesized
cccatgtaatccatttaggg

SEQ ID NO: 543642 - DNA, 20 bp, Artificial Sequence
  chemically synthesized
tttgtcagtgttcacatttt

SEQ ID NO: 543643 - DNA, 20 bp, Artificial Sequence
  chemically synthesized
gtgaacactgacaaaggtgt

SEQ ID NO: 543644 - DNA, 20 bp, Artificial Sequence
  chemically synthesized
aaacaacttatatattgaca

SEQ ID NO: 543645 - DNA, 20 bp, Artificial Sequence
  chemically synthesized
aggcatattttgactggagg

SEQ ID NO: 543646 - DNA, 20 bp, Artificial Sequence
  chemically synthesized
accacaccaagtgccctttg

SEQ ID NO: 543647 - DNA, 20 bp, Artificial Sequence
  chemically synthesized
gaattttatctaagatcacc

SEQ ID NO: 543648 - DNA, 20 bp, Artificial Sequence
  chemically synthesized
ttatacttacacaaagttgg

SEQ ID NO: 543649 - DNA, 20 bp, Artificial Sequence
  chemically synthesized
taagtataaactaccacact

SEQ ID NO: 543650 - DNA, 20 bp, Artificial Sequence
  chemically synthesized
ccacactacagaaatattta

SEQ ID NO: 543651 - DNA, 20 bp, Artificial Sequence
  chemically synthesized
gaaaaagggaaaattcagca

SEQ ID NO: 543652 - DNA, 20 bp, Artificial Sequence
  chemically synthesized
ctaagtggatagagctgctt

SEQ ID NO: 543653 - DNA, 20 bp, Artificial Sequence
  chemically synthesized
tctatgtttcaaaattggta

SEQ ID NO: 543654 - DNA, 20 bp, Artificial Sequence
  chemically synthesized
gggaaggtgttgatcaaatg

SEQ ID NO: 543655 - DNA, 20 bp, Artificial Sequence
  chemically synthesized
tcaaattatagaaacagaaa

SEQ ID NO: 543656 - DNA, 20 bp, Artificial Sequence
  chemically synthesized
aaaaaagtcaaattatagaa

SEQ ID NO: 543657 - DNA, 20 bp, Artificial Sequence
  chemically synthesized
atccaaaaaaaagtcaaatt

SEQ ID NO: 543658 - DNA, 20 bp, Artificial Sequence
  chemically synthesized
actgtatgatctcacttata

SEQ ID NO: 543659 - DNA, 20 bp, Artificial Sequence
  chemically synthesized
ctagctgaaatgagccaggc

SEQ ID NO: 543660 - DNA, 20 bp, Artificial Sequence
  chemically synthesized
tatctacatggtggcaaatg

SEQ ID NO: 543661 - DNA, 20 bp, Artificial Sequence
  chemically synthesized
ctattacaggacgaatggat

SEQ ID NO: 543662 - DNA, 20 bp, Artificial Sequence
  chemically synthesized
aagaggcagctcacagatca

SEQ ID NO: 543663 - DNA, 20 bp, Artificial Sequence
  chemically synthesized
ggagttaatatccaaaatat

SEQ ID NO: 543664 - DNA, 20 bp, Artificial Sequence
  chemically synthesized
aacctcaaaaaactcaacag

SEQ ID NO: 543665 - DNA, 20 bp, Artificial Sequence
  chemically synthesized
gccattggtgcctcttattg

SEQ ID NO: 543666 - DNA, 20 bp, Artificial Sequence
  chemically synthesized
atgctcaacatctctaaaca

SEQ ID NO: 543667 - DNA, 20 bp, Artificial Sequence
  chemically synthesized
ataaatgttggagaggctgt

SEQ ID NO: 543668 - DNA, 20 bp, Artificial Sequence
  chemically synthesized
gtgtctacgtgtttatatac

SEQ ID NO: 543669 - DNA, 20 bp, Artificial Sequence
  chemically synthesized
aaagaattgttccctgacct

SEQ ID NO: 543670 - DNA, 20 bp, Artificial Sequence
  chemically synthesized
tatgtgcttattgtgagata

SEQ ID NO: 543671 - DNA, 20 bp, Artificial Sequence
  chemically synthesized
tgttgcattgctccttcact

SEQ ID NO: 543672 - DNA, 20 bp, Artificial Sequence
  chemically synthesized
tacctcttacagagacagta

SEQ ID NO: 543673 - DNA, 20 bp, Artificial Sequence
  chemically synthesized
agatattcttgccagaattg

SEQ ID NO: 543674 - DNA, 20 bp, Artificial Sequence
  chemically synthesized
ttattttctttcaattctgg

SEQ ID NO: 543675 - DNA, 20 bp, Artificial Sequence
  chemically synthesized
tagcacagaagatattcttg

SEQ ID NO: 543676 - DNA, 20 bp, Artificial Sequence
  chemically synthesized
aactacagttgtgataagat

SEQ ID NO: 543677 - DNA, 20 bp, Artificial Sequence
  chemically synthesized
agaagcaggaagacttgtgg

SEQ ID NO: 543678 - DNA, 20 bp, Artificial Sequence
  chemically synthesized
ccctctagctggtatgtgaa

SEQ ID NO: 543679 - DNA, 20 bp, Artificial Sequence
  chemically synthesized
aagagcagtagacatttccg

SEQ ID NO: 543680 - DNA, 20 bp, Artificial Sequence
  chemically synthesized
aagattaggacaagatgagg

SEQ ID NO: 543681 - DNA, 20 bp, Artificial Sequence
  chemically synthesized
tccagaagacataagggagg

SEQ ID NO: 543682 - DNA, 20 bp, Artificial Sequence
  chemically synthesized
aaacacaaattgccaaaggt

SEQ ID NO: 543683 - DNA, 20 bp, Artificial Sequence
  chemically synthesized
aaggacattaggagaaatga

SEQ ID NO: 543684 - DNA, 20 bp, Artificial Sequence
  chemically synthesized
aagttggagaaaggacatta

SEQ ID NO: 543685 - DNA, 20 bp, Artificial Sequence
  chemically synthesized
tgccagctatatgataagtt

SEQ ID NO: 543686 - DNA, 20 bp, Artificial Sequence
  chemically synthesized
atgatgttagaaccaaacct

SEQ ID NO: 543687 - DNA, 20 bp, Artificial Sequence
  chemically synthesized
ttggttctaacatcatctcc

SEQ ID NO: 543688 - DNA, 20 bp, Artificial Sequence
  chemically synthesized
tgtcttcatggagcttattg

SEQ ID NO: 543689 - DNA, 20 bp, Artificial Sequence
  chemically synthesized
cactaggtaatatacatggt

SEQ ID NO: 543690 - DNA, 20 bp, Artificial Sequence
  chemically synthesized
cactttttcactaataaatt

SEQ ID NO: 543691 - DNA, 20 bp, Artificial Sequence
  chemically synthesized
atctaatggtgtagaacaga

SEQ ID NO: 543692 - DNA, 20 bp, Artificial Sequence
  chemically synthesized
tggtttagttttgcaaaaat

SEQ ID NO: 543693 - DNA, 20 bp, Artificial Sequence
  chemically synthesized
atctttttccttctttacat

SEQ ID NO: 543694 - DNA, 20 bp, Artificial Sequence
  chemically synthesized
ttgtagataattgtttcaac

SEQ ID NO: 543695 - DNA, 20 bp, Artificial Sequence
  chemically synthesized
atgttatatgctagatgaat

SEQ ID NO: 543696 - DNA, 20 bp, Artificial Sequence
  chemically synthesized
agtttactggttttcagtct

SEQ ID NO: 543697 - DNA, 20 bp, Artificial Sequence
  chemically synthesized
caataggcaaatctgtacag

SEQ ID NO: 543698 - DNA, 20 bp, Artificial Sequence
  chemically synthesized
tgttactgagcaataaaaag

SEQ ID NO: 543699 - DNA, 20 bp, Artificial Sequence
  chemically synthesized
ccatccagtgatgactatat

SEQ ID NO: 543700 - DNA, 20 bp, Artificial Sequence
  chemically synthesized
ttcataatagccaaaacgta

SEQ ID NO: 543701 - DNA, 20 bp, Artificial Sequence
  chemically synthesized
tcattttacctaaccctcag

SEQ ID NO: 543702 - DNA, 20 bp, Artificial Sequence
  chemically synthesized
gagtaaaaagtgctttgaaa

SEQ ID NO: 543703 - DNA, 20 bp, Artificial Sequence
  chemically synthesized
gttacctgacataagtgata

SEQ ID NO: 543704 - DNA, 20 bp, Artificial Sequence
  chemically synthesized
caaagtactgtggaggaata

SEQ ID NO: 543705 - DNA, 20 bp, Artificial Sequence
  chemically synthesized
ggtatgaaatttaaaaaaga

SEQ ID NO: 543706 - DNA, 20 bp, Artificial Sequence
  chemically synthesized
atcatttactttaaagatgt

SEQ ID NO: 543707 - DNA, 20 bp, Artificial Sequence
  chemically synthesized
aaaaatgaaaagctgggaaa

SEQ ID NO: 543708 - DNA, 20 bp, Artificial Sequence
  chemically synthesized
ttcaccatataatatcattt

SEQ ID NO: 543709 - DNA, 20 bp, Artificial Sequence
  chemically synthesized
gcttttctttgtaaatattt

SEQ ID NO: 543710 - DNA, 20 bp, Artificial Sequence
  chemically synthesized
tgaattctttaaatatttac

SEQ ID NO: 543711 - DNA, 20 bp, Artificial Sequence
  chemically synthesized
aatttgggacagagattttt

SEQ ID NO: 543712 - DNA, 20 bp, Artificial Sequence
  chemically synthesized
gacagatgaatgaccacctt

SEQ ID NO: 543713 - DNA, 20 bp, Artificial Sequence
  chemically synthesized
ggtcattcatctgtctctga

SEQ ID NO: 543714 - DNA, 20 bp, Artificial Sequence
  chemically synthesized
aagcaattcaggaagagaca

SEQ ID NO: 543715 - DNA, 20 bp, Artificial Sequence
  chemically synthesized
ccagtagtaaaatgtagccc

SEQ ID NO: 543716 - DNA, 20 bp, Artificial Sequence
  chemically synthesized
aatactcttcagataaattg

SEQ ID NO: 543717 - DNA, 20 bp, Artificial Sequence
  chemically synthesized
aatcagatgttttgaatata

SEQ ID NO: 543718 - DNA, 20 bp, Artificial Sequence
  chemically synthesized
tcataataattttgtgactt

SEQ ID NO: 543719 - DNA, 20 bp, Artificial Sequence
  chemically synthesized
cttgttaatacaggttgtag

SEQ ID NO: 543720 - DNA, 20 bp, Artificial Sequence
  chemically synthesized
tagggagaatggttccattt

SEQ ID NO: 543721 - DNA, 20 bp, Artificial Sequence
  chemically synthesized
ttttctgatgtgcaggccag

SEQ ID NO: 543722 - DNA, 20 bp, Artificial Sequence
  chemically synthesized
ctttctctctggcctgcaca

SEQ ID NO: 543723 - DNA, 20 bp, Artificial Sequence
  chemically synthesized
attcaaagcatagccctgaa

SEQ ID NO: 543724 - DNA, 20 bp, Artificial Sequence
  chemically synthesized
tacccttcacaaatatctga

SEQ ID NO: 543725 - DNA, 20 bp, Artificial Sequence
  chemically synthesized
ttatattttgcagaaatgaa

SEQ ID NO: 543726 - DNA, 20 bp, Artificial Sequence
  chemically synthesized
atatatgtaatttatatttt

SEQ ID NO: 543727 - DNA, 20 bp, Artificial Sequence
  chemically synthesized
ctactcaggaggctgaggca

SEQ ID NO: 543728 - DNA, 20 bp, Artificial Sequence
  chemically synthesized
atatgtttaattctgaagat

SEQ ID NO: 543729 - DNA, 20 bp, Artificial Sequence
  chemically synthesized
ttcttagcttttcttaatct

SEQ ID NO: 543730 - DNA, 20 bp, Artificial Sequence
  chemically synthesized
aaactatattaggaaaggaa

SEQ ID NO: 543731 - DNA, 20 bp, Artificial Sequence
  chemically synthesized
catatgtaatttaaaatggt

SEQ ID NO: 543732 - DNA, 20 bp, Artificial Sequence
  chemically synthesized
gtgaagaaagtcattgtcca

SEQ ID NO: 543733 - DNA, 20 bp, Artificial Sequence
  chemically synthesized
tttggacaatgactttcttc

SEQ ID NO: 543734 - DNA, 20 bp, Artificial Sequence
  chemically synthesized
gtagttttttccaattctgt

SEQ ID NO: 543735 - DNA, 20 bp, Artificial Sequence
  chemically synthesized
aatggaacagaacagagccc

SEQ ID NO: 543736 - DNA, 20 bp, Artificial Sequence
  chemically synthesized
ggaaaactggctagccatat

SEQ ID NO: 543737 - DNA, 20 bp, Artificial Sequence
  chemically synthesized
ctaaaaccataaaaacccta

SEQ ID NO: 543738 - DNA, 20 bp, Artificial Sequence
  chemically synthesized
taaagagcttctgcacagca

SEQ ID NO: 543739 - DNA, 20 bp, Artificial Sequence
  chemically synthesized
aacaggcaacctacaaaatg

SEQ ID NO: 543740 - DNA, 20 bp, Artificial Sequence
  chemically synthesized
atctgacaaagggctaatat

SEQ ID NO: 543741 - DNA, 20 bp, Artificial Sequence
  chemically synthesized
aacgaactcaaaaaaattta

SEQ ID NO: 543742 - DNA, 20 bp, Artificial Sequence
  chemically synthesized
gaacatgaaaacatttatgt

SEQ ID NO: 543743 - DNA, 20 bp, Artificial Sequence
  chemically synthesized
aattcatatatatgctgtct

SEQ ID NO: 543744 - DNA, 20 bp, Artificial Sequence
  chemically synthesized
attggaacatgagcccatta

SEQ ID NO: 543745 - DNA, 20 bp, Artificial Sequence
  chemically synthesized
acatgagcccattagaagaa

SEQ ID NO: 543746 - DNA, 20 bp, Artificial Sequence
  chemically synthesized
ttagaagaaagagaaaatgg

SEQ ID NO: 543747 - DNA, 20 bp, Artificial Sequence
  chemically synthesized
aagctcagatttcaattcgt

SEQ ID NO: 543748 - DNA, 20 bp, Artificial Sequence
  chemically synthesized
acttttgtattaggagaggc

SEQ ID NO: 543749 - DNA, 20 bp, Artificial Sequence
  chemically synthesized
acattagtcttgcaaccatg

SEQ ID NO: 543750 - DNA, 20 bp, Artificial Sequence
  chemically synthesized
ctgtatttatgtttttttaa

SEQ ID NO: 543751 - DNA, 20 bp, Artificial Sequence
  chemically synthesized
tgagaggatttatatttgaa

SEQ ID NO: 543752 - DNA, 20 bp, Artificial Sequence
  chemically synthesized
taaatcctctcaaaccagtg

SEQ ID NO: 543753 - DNA, 20 bp, Artificial Sequence
  chemically synthesized
agttggtatatatccatgga

SEQ ID NO: 543754 - DNA, 20 bp, Artificial Sequence
  chemically synthesized
tatatttctgtactataaat

SEQ ID NO: 543755 - DNA, 20 bp, Artificial Sequence
  chemically synthesized
taatattctgtatttatagt

SEQ ID NO: 543756 - DNA, 20 bp, Artificial Sequence
  chemically synthesized
tttttcccgttcagggggct

SEQ ID NO: 543757 - DNA, 20 bp, Artificial Sequence
  chemically synthesized
cagttgagaccttaatgttc

SEQ ID NO: 543758 - DNA, 20 bp, Artificial Sequence
  chemically synthesized
ttgttcacatctttttaaac

SEQ ID NO: 543759 - DNA, 20 bp, Artificial Sequence
  chemically synthesized
tgagataagcatataatttt

SEQ ID NO: 543760 - DNA, 20 bp, Artificial Sequence
  chemically synthesized
gtgggggttagagagcctta

SEQ ID NO: 543761 - DNA, 20 bp, Artificial Sequence
  chemically synthesized
aaaaccagttctgccgatca

SEQ ID NO: 543762 - DNA, 20 bp, Artificial Sequence
  chemically synthesized
ctccaaataaaataaaacgc

SEQ ID NO: 543763 - DNA, 20 bp, Artificial Sequence
  chemically synthesized
ccattggtgtctattaattt

SEQ ID NO: 543764 - DNA, 20 bp, Artificial Sequence
  chemically synthesized
aatagacaccaatgggtctg

SEQ ID NO: 543765 - DNA, 20 bp, Artificial Sequence
  chemically synthesized
gttgagacttttgtgataag

SEQ ID NO: 543766 - DNA, 20 bp, Artificial Sequence
  chemically synthesized
aactaagatgcaaagctttg

SEQ ID NO: 543767 - DNA, 20 bp, Artificial Sequence
  chemically synthesized
ggaggcagagataaagagag

SEQ ID NO: 543768 - DNA, 20 bp, Artificial Sequence
  chemically synthesized
gcagagataaagagagagag

SEQ ID NO: 543769 - DNA, 20 bp, Artificial Sequence
  chemically synthesized
gtgtgtatacatgcagagag

SEQ ID NO: 543770 - DNA, 20 bp, Artificial Sequence
  chemically synthesized
ttctgagagttctagaagtg

SEQ ID NO: 543771 - DNA, 20 bp, Artificial Sequence
  chemically synthesized
ttctctcacttctagaactc

SEQ ID NO: 543772 - DNA, 20 bp, Artificial Sequence
  chemically synthesized
ttaagtgtctctaatgtgtt

SEQ ID NO: 543773 - DNA, 20 bp, Artificial Sequence
  chemically synthesized
taactactatatctgaatct

SEQ ID NO: 543774 - DNA, 20 bp, Artificial Sequence
  chemically synthesized
gtaacatcagatttttgtgg

SEQ ID NO: 543775 - DNA, 20 bp, Artificial Sequence
  chemically synthesized
ttgagatgcattttgtaatt

SEQ ID NO: 543776 - DNA, 20 bp, Artificial Sequence
  chemically synthesized
attacaaaatgcatctcaat

SEQ ID NO: 543777 - DNA, 20 bp, Artificial Sequence
  chemically synthesized
cagaaagtatacttttggat

SEQ ID NO: 543778 - DNA, 20 bp, Artificial Sequence
  chemically synthesized
agtttgctgaggaaataaac

SEQ ID NO: 543779 - DNA, 20 bp, Artificial Sequence
  chemically synthesized
ctcagcaaactaacacaaga

SEQ ID NO: 543780 - DNA, 20 bp, Artificial Sequence
  chemically synthesized
gaaattcaaagctattttga

SEQ ID NO: 543781 - DNA, 20 bp, Artificial Sequence
  chemically synthesized
gtattggacccaaaaagtga

SEQ ID NO: 543782 - DNA, 20 bp, Artificial Sequence
  chemically synthesized
ggaaaggtgacaaggttgat

SEQ ID NO: 543783 - DNA, 20 bp, Artificial Sequence
  chemically synthesized
aaagaatggcttaaataaag

SEQ ID NO: 543784 - DNA, 20 bp, Artificial Sequence
  chemically synthesized
attcatttgcatactgtaaa

SEQ ID NO: 543785 - DNA, 20 bp, Artificial Sequence
  chemically synthesized
tatgtgcttttcgcggggaa

SEQ ID NO: 543786 - DNA, 20 bp, Artificial Sequence
  chemically synthesized
aaggattatgccttcaagtg

SEQ ID NO: 543787 - DNA, 20 bp, Artificial Sequence
  chemically synthesized
tgtaagtggacaaaagggcc

SEQ ID NO: 543788 - DNA, 20 bp, Artificial Sequence
  chemically synthesized
cttcacttttttccctgcct

SEQ ID NO: 543789 - DNA, 20 bp, Artificial Sequence
  chemically synthesized
ggccggcttaaggaatcctc

SEQ ID NO: 543790 - DNA, 20 bp, Artificial Sequence
  chemically synthesized
ggatcagtgagagagcagtt

SEQ ID NO: 543791 - DNA, 20 bp, Artificial Sequence
  chemically synthesized
gagttcttaccccttttagt

SEQ ID NO: 543792 - DNA, 20 bp, Artificial Sequence
  chemically synthesized
ttttaaaaatatctttttgt

SEQ ID NO: 543793 - DNA, 20 bp, Artificial Sequence
  chemically synthesized
agtggaatccatggaaatag

SEQ ID NO: 543794 - DNA, 20 bp, Artificial Sequence
  chemically synthesized
gactatgtttcactcgtcac

SEQ ID NO: 543795 - DNA, 20 bp, Artificial Sequence
  chemically synthesized
taactacgccaaatacaatt

SEQ ID NO: 543796 - DNA, 20 bp, Artificial Sequence
  chemically synthesized
taaagttcaaaatgtaagca

SEQ ID NO: 543797 - DNA, 20 bp, Artificial Sequence
  chemically synthesized
actgtcttcttggaaattgc

SEQ ID NO: 543798 - DNA, 20 bp, Artificial Sequence
  chemically synthesized
tcagttaaaaatttgtaagg

SEQ ID NO: 543799 - DNA, 20 bp, Artificial Sequence
  chemically synthesized
tccaattgttgtagctgatt

SEQ ID NO: 543800 - DNA, 20 bp, Artificial Sequence
  chemically synthesized
agtctctcacttagcaactg

SEQ ID NO: 543801 - DNA, 20 bp, Artificial Sequence
  chemically synthesized
gctatctgcattaacaccct

SEQ ID NO: 543802 - DNA, 20 bp, Artificial Sequence
  chemically synthesized
tctgcattaacaccctctag

SEQ ID NO: 543803 - DNA, 20 bp, Artificial Sequence
  chemically synthesized
tcccctgaacccacagactg

SEQ ID NO: 543804 - DNA, 20 bp, Artificial Sequence
  chemically synthesized
catatttacacatttatatc

SEQ ID NO: 543805 - DNA, 20 bp, Artificial Sequence
  chemically synthesized
caagtaataagacataagat

SEQ ID NO: 543806 - DNA, 20 bp, Artificial Sequence
  chemically synthesized
aagacataagatgtagaaaa

SEQ ID NO: 543807 - DNA, 20 bp, Artificial Sequence
  chemically synthesized
taatcttctgtaaatgaaat

SEQ ID NO: 543808 - DNA, 20 bp, Artificial Sequence
  chemically synthesized
tttatttcatttacagaaga

SEQ ID NO: 543809 - DNA, 20 bp, Artificial Sequence
  chemically synthesized
ctactcgggaggctgaggca

SEQ ID NO: 543810 - DNA, 20 bp, Artificial Sequence
  chemically synthesized
atattgtccatggatgcgag

SEQ ID NO: 543811 - DNA, 20 bp, Artificial Sequence
  chemically synthesized
aaatttaaaaatgtttcaca

SEQ ID NO: 543812 - DNA, 20 bp, Artificial Sequence
  chemically synthesized
catctgtagtaataccaaac

SEQ ID NO: 543813 - DNA, 20 bp, Artificial Sequence
  chemically synthesized
catggtacatagtaggtact

SEQ ID NO: 543814 - DNA, 20 bp, Artificial Sequence
  chemically synthesized
actatataagctaataaatc

SEQ ID NO: 543815 - DNA, 20 bp, Artificial Sequence
  chemically synthesized
cttatatagttttcttaatg

SEQ ID NO: 543816 - DNA, 20 bp, Artificial Sequence
  chemically synthesized
tctcttttatattctgtcat

SEQ ID NO: 543817 - DNA, 20 bp, Artificial Sequence
  chemically synthesized
tcttaatgacagaatataaa

SEQ ID NO: 543818 - DNA, 20 bp, Artificial Sequence
  chemically synthesized
tattcagtatttccaaagta

SEQ ID NO: 543819 - DNA, 20 bp, Artificial Sequence
  chemically synthesized
acttttaggtattttaacct

SEQ ID NO: 543820 - DNA, 20 bp, Artificial Sequence
  chemically synthesized
cctttaactaaattatatta

SEQ ID NO: 543821 - DNA, 20 bp, Artificial Sequence
  chemically synthesized
aaaaagtctgaagaacgtct

SEQ ID NO: 543822 - DNA, 20 bp, Artificial Sequence
  chemically synthesized
aatgagatacaatggaaata

SEQ ID NO: 543823 - DNA, 20 bp, Artificial Sequence
  chemically synthesized
atggaaataatagaatgtaa

SEQ ID NO: 543824 - DNA, 20 bp, Artificial Sequence
  chemically synthesized
ccttaagcattaggaggata

SEQ ID NO: 543825 - DNA, 20 bp, Artificial Sequence
  chemically synthesized
atttggtataaagtgtaaga

SEQ ID NO: 543826 - DNA, 20 bp, Artificial Sequence
  chemically synthesized
tctaattatctttttatttt

SEQ ID NO: 543827 - DNA, 20 bp, Artificial Sequence
  chemically synthesized
tctggaaaataaaaagataa

SEQ ID NO: 543828 - DNA, 20 bp, Artificial Sequence
  chemically synthesized
ataattagaaaatatactgg

SEQ ID NO: 543829 - DNA, 20 bp, Artificial Sequence
  chemically synthesized
tctaaatgatcagatattta

SEQ ID NO: 543830 - DNA, 20 bp, Artificial Sequence
  chemically synthesized
ccaggtattaaacaggcaaa

SEQ ID NO: 543831 - DNA, 20 bp, Artificial Sequence
  chemically synthesized
taaatgagacgggaacacag

SEQ ID NO: 543832 - DNA, 20 bp, Artificial Sequence
  chemically synthesized
gagaaatcactttgtgtccc

SEQ ID NO: 543833 - DNA, 20 bp, Artificial Sequence
  chemically synthesized
tgttgcaatatatcactgta

SEQ ID NO: 543834 - DNA, 20 bp, Artificial Sequence
  chemically synthesized
gtaaaagaaatttaaatggt

SEQ ID NO: 543835 - DNA, 20 bp, Artificial Sequence
  chemically synthesized
tagcaaaaagggggaggcag

SEQ ID NO: 543836 - DNA, 20 bp, Artificial Sequence
  chemically synthesized
ggggaggcaggcagaaaggc

SEQ ID NO: 543837 - DNA, 20 bp, Artificial Sequence
  chemically synthesized
aaaggcagagaaatgaccgg

SEQ ID NO: 543838 - DNA, 20 bp, Artificial Sequence
  chemically synthesized
gaactccggtctctttaacg

SEQ ID NO: 543839 - DNA, 20 bp, Artificial Sequence
  chemically synthesized
tttaatcctcatttcatgga

SEQ ID NO: 543840 - DNA, 20 bp, Artificial Sequence
  chemically synthesized
ccatgaaatgaggattaaaa

SEQ ID NO: 543841 - DNA, 20 bp, Artificial Sequence
  chemically synthesized
tgccatatagaggaaatgaa

SEQ ID NO: 543842 - DNA, 20 bp, Artificial Sequence
  chemically synthesized
gaggaaatgaaaaagaatat

SEQ ID NO: 543843 - DNA, 20 bp, Artificial Sequence
  chemically synthesized
ctcttgctctgttgcccagg

SEQ ID NO: 543844 - DNA, 20 bp, Artificial Sequence
  chemically synthesized
ctcacatgattataaatgtg

SEQ ID NO: 543845 - DNA, 20 bp, Artificial Sequence
  chemically synthesized
tcatgtgagattgaagttat

SEQ ID NO: 543846 - DNA, 20 bp, Artificial Sequence
  chemically synthesized
gtggaaatttctagatgtta

SEQ ID NO: 543847 - DNA, 20 bp, Artificial Sequence
  chemically synthesized
tatgtcttttctagtaacat

SEQ ID NO: 543848 - DNA, 20 bp, Artificial Sequence
  chemically synthesized
gaaaagacataatgttgggc

SEQ ID NO: 543849 - DNA, 20 bp, Artificial Sequence
  chemically synthesized
gtctccactggcagtatcta

SEQ ID NO: 543850 - DNA, 20 bp, Artificial Sequence
  chemically synthesized
aatagaattctcagcttgga

SEQ ID NO: 543851 - DNA, 20 bp, Artificial Sequence
  chemically synthesized
atactctttctactccaagc

SEQ ID NO: 543852 - DNA, 20 bp, Artificial Sequence
  chemically synthesized
gtacctctcttcaattaaaa

SEQ ID NO: 543853 - DNA, 20 bp, Artificial Sequence
  chemically synthesized
cagaactactgttgattttc

SEQ ID NO: 543854 - DNA, 20 bp, Artificial Sequence
  chemically synthesized
aaaggttttaatggactttc

SEQ ID NO: 543855 - DNA, 20 bp, Artificial Sequence
  chemically synthesized
gaaagtccattaaaaccttt

SEQ ID NO: 543856 - DNA, 20 bp, Artificial Sequence
  chemically synthesized
gctttgaaccctttttcatt

SEQ ID NO: 543857 - DNA, 20 bp, Artificial Sequence
  chemically synthesized
aattgttttatatgtattcc

SEQ ID NO: 543858 - DNA, 20 bp, Artificial Sequence
  chemically synthesized
atatttacacttacaaactc

SEQ ID NO: 543859 - DNA, 20 bp, Artificial Sequence
  chemically synthesized
cttaaatagctaacacaaaa

SEQ ID NO: 543860 - DNA, 20 bp, Artificial Sequence
  chemically synthesized
ctaattttgtgttagctatt

SEQ ID NO: 543861 - DNA, 20 bp, Artificial Sequence
  chemically synthesized
aaccattttgttgtagcaca

SEQ ID NO: 543862 - DNA, 20 bp, Artificial Sequence
  chemically synthesized
cagactatttcaggggttgt

SEQ ID NO: 543863 - DNA, 20 bp, Artificial Sequence
  chemically synthesized
gtacagtgcataacagactg

SEQ ID NO: 543864 - DNA, 20 bp, Artificial Sequence
  chemically synthesized
tcattagccatgaagccagg

SEQ ID NO: 543865 - DNA, 20 bp, Artificial Sequence
  chemically synthesized
tttccagagctcttgaatta

SEQ ID NO: 543866 - DNA, 20 bp, Artificial Sequence
  chemically synthesized
gaattaaaagaatatttgga

SEQ ID NO: 543867 - DNA, 20 bp, Artificial Sequence
  chemically synthesized
tactttaagtcagtgtggtc

SEQ ID NO: 543868 - DNA, 20 bp, Artificial Sequence
  chemically synthesized
tgtgtgtgtccatgtgtgtg

SEQ ID NO: 543869 - DNA, 20 bp, Artificial Sequence
  chemically synthesized
tttggagattagacttaaac

SEQ ID NO: 543870 - DNA, 20 bp, Artificial Sequence
  chemically synthesized
cattatactaagtgtcatgt

SEQ ID NO: 543871 - DNA, 20 bp, Artificial Sequence
  chemically synthesized
ctaagtgtcatgtggagaaa

SEQ ID NO: 543872 - DNA, 20 bp, Artificial Sequence
  chemically synthesized
atgagctatgaaccaaaata

SEQ ID NO: 543873 - DNA, 20 bp, Artificial Sequence
  chemically synthesized
aactgttgtaattaaatggc

SEQ ID NO: 543874 - DNA, 20 bp, Artificial Sequence
  chemically synthesized
cttagactcttaattaacac

SEQ ID NO: 543875 - DNA, 20 bp, Artificial Sequence
  chemically synthesized
taacacacagaaaactacaa

SEQ ID NO: 543876 - DNA, 20 bp, Artificial Sequence
  chemically synthesized
acataattatagtatctcct

SEQ ID NO: 543877 - DNA, 20 bp, Artificial Sequence
  chemically synthesized
agactgttcaaattaaaatc

SEQ ID NO: 543878 - DNA, 20 bp, Artificial Sequence
  chemically synthesized
ttagcaatattattaaagca

SEQ ID NO: 543879 - DNA, 20 bp, Artificial Sequence
  chemically synthesized
gttataaataatttagaaat

SEQ ID NO: 543880 - DNA, 20 bp, Artificial Sequence
  chemically synthesized
tacaaaatgttataaataat

SEQ ID NO: 543881 - DNA, 20 bp, Artificial Sequence
  chemically synthesized
ataacattttgtatttaaat

SEQ ID NO: 543882 - DNA, 20 bp, Artificial Sequence
  chemically synthesized
aaattctttattttactttt

SEQ ID NO: 543883 - DNA, 20 bp, Artificial Sequence
  chemically synthesized
tctttcttaaaaagtaaaat

SEQ ID NO: 543884 - DNA, 20 bp, Artificial Sequence
  chemically synthesized
taattggttggataaatgtg

SEQ ID NO: 543885 - DNA, 20 bp, Artificial Sequence
  chemically synthesized
caaaatttcatgccaaaatg

SEQ ID NO: 543886 - DNA, 20 bp, Artificial Sequence
  chemically synthesized
tttatttggaatttttaacc

SEQ ID NO: 543887 - DNA, 20 bp, Artificial Sequence
  chemically synthesized
aaaaattccaaataaattag

SEQ ID NO: 543888 - DNA, 20 bp, Artificial Sequence
  chemically synthesized
tcaaatgtgaagagttgtat

SEQ ID NO: 543889 - DNA, 20 bp, Artificial Sequence
  chemically synthesized
ttaaaaatcagttgtacgtt

SEQ ID NO: 543890 - DNA, 20 bp, Artificial Sequence
  chemically synthesized
ttcaacatcacttaagtaat

SEQ ID NO: 543891 - DNA, 20 bp, Artificial Sequence
  chemically synthesized
cttcaatgcttcatagacat

SEQ ID NO: 543892 - DNA, 20 bp, Artificial Sequence
  chemically synthesized
tcatagacatttagaaacgg

SEQ ID NO: 543893 - DNA, 20 bp, Artificial Sequence
  chemically synthesized
ctgaagtaaaatttaagtta

SEQ ID NO: 543894 - DNA, 20 bp, Artificial Sequence
  chemically synthesized
tgtaattcatcagtttgctt

SEQ ID NO: 543895 - DNA, 20 bp, Artificial Sequence
  chemically synthesized
ttaaactactttttaaaaat

SEQ ID NO: 543896 - DNA, 20 bp, Artificial Sequence
  chemically synthesized
cttagggcaaattattttaa

SEQ ID NO: 543897 - DNA, 20 bp, Artificial Sequence
  chemically synthesized
atacatataaaatatagttc

SEQ ID NO: 543898 - DNA, 20 bp, Artificial Sequence
  chemically synthesized
tattcatagtgtaaaaatat

SEQ ID NO: 543899 - DNA, 20 bp, Artificial Sequence
  chemically synthesized
tacattcttgccctttttgt

SEQ ID NO: 543900 - DNA, 20 bp, Artificial Sequence
  chemically synthesized
tcctttctatacaaaaaggg

SEQ ID NO: 543901 - DNA, 20 bp, Artificial Sequence
  chemically synthesized
aagctcttaaatttataagt

SEQ ID NO: 543902 - DNA, 20 bp, Artificial Sequence
  chemically synthesized
aattgctggactcctagttt

SEQ ID NO: 543903 - DNA, 20 bp, Artificial Sequence
  chemically synthesized
atctcacaatttgcacaatc

SEQ ID NO: 543904 - DNA, 20 bp, Artificial Sequence
  chemically synthesized
aaacggaacaaatagataag

SEQ ID NO: 543905 - DNA, 20 bp, Artificial Sequence
  chemically synthesized
ccttaattttgcttttctaa

SEQ ID NO: 543906 - DNA, 20 bp, Artificial Sequence
  chemically synthesized
attaattgaccagattctgt

SEQ ID NO: 543907 - DNA, 20 bp, Artificial Sequence
  chemically synthesized
gttctaatttttggaggcat

SEQ ID NO: 543908 - DNA, 20 bp, Artificial Sequence
  chemically synthesized
agaactatgagggaaataat

SEQ ID NO: 543909 - DNA, 20 bp, Artificial Sequence
  chemically synthesized
ttaaatgatcgtgtgactag

SEQ ID NO: 543910 - DNA, 20 bp, Artificial Sequence
  chemically synthesized
atcagaaataatttaaacat

SEQ ID NO: 543911 - DNA, 20 bp, Artificial Sequence
  chemically synthesized
gcttacctacactgaattaa

SEQ ID NO: 543912 - DNA, 20 bp, Artificial Sequence
  chemically synthesized
agttgttatgtaagttcccc

SEQ ID NO: 543913 - DNA, 20 bp, Artificial Sequence
  chemically synthesized
gggaacttacataacaacta

SEQ ID NO: 543914 - DNA, 20 bp, Artificial Sequence
  chemically synthesized
agtcatgggactcattagaa

SEQ ID NO: 543915 - DNA, 20 bp, Artificial Sequence
  chemically synthesized
tcaaaagttcagtggtcttc

SEQ ID NO: 543916 - DNA, 20 bp, Artificial Sequence
  chemically synthesized
aggcaaaaaataacttatac

SEQ ID NO: 543917 - DNA, 20 bp, Artificial Sequence
  chemically synthesized
gttgtgcatgtcagcttttt

SEQ ID NO: 543918 - DNA, 20 bp, Artificial Sequence
  chemically synthesized
aacttttgaggcactgagta

SEQ ID NO: 543919 - DNA, 20 bp, Artificial Sequence
  chemically synthesized
aattttaatttattcttgaa

SEQ ID NO: 543920 - DNA, 20 bp, Artificial Sequence
  chemically synthesized
aagtttttgtctttcttttt

SEQ ID NO: 543921 - DNA, 20 bp, Artificial Sequence
  chemically synthesized
aggaagtgataaaaagtaac

SEQ ID NO: 543922 - DNA, 20 bp, Artificial Sequence
  chemically synthesized
aatttaagaaaataaggtta

SEQ ID NO: 543923 - DNA, 20 bp, Artificial Sequence
  chemically synthesized
tagaatttatccaaataatt

SEQ ID NO: 543924 - DNA, 20 bp, Artificial Sequence
  chemically synthesized
taaattttaatgcaaatctg

SEQ ID NO: 543925 - DNA, 20 bp, Artificial Sequence
  chemically synthesized
atattttatcagtctgtagc

SEQ ID NO: 543926 - DNA, 20 bp, Artificial Sequence
  chemically synthesized
ttggaagaaaatgggatgtg

SEQ ID NO: 543927 - DNA, 20 bp, Artificial Sequence
  chemically synthesized
attcaactttgagttcattg

SEQ ID NO: 543928 - DNA, 20 bp, Artificial Sequence
  chemically synthesized
taatgctaaggaaattatta

SEQ ID NO: 543929 - DNA, 20 bp, Artificial Sequence
  chemically synthesized
taatttccttagcattaaaa

SEQ ID NO: 543930 - DNA, 20 bp, Artificial Sequence
  chemically synthesized
gcgagaaaaagctgagaagt

SEQ ID NO: 543931 - DNA, 20 bp, Artificial Sequence
  chemically synthesized
tcatgctgcaggccatagag

SEQ ID NO: 543932 - DNA, 20 bp, Artificial Sequence
  chemically synthesized
gtttttgatggcaaaagtgt

SEQ ID NO: 543933 - DNA, 20 bp, Artificial Sequence
  chemically synthesized
ataatgtaaaaaaaagctga

SEQ ID NO: 543934 - DNA, 20 bp, Artificial Sequence
  chemically synthesized
cagtcttgcgttgaaatgta

SEQ ID NO: 543935 - DNA, 20 bp, Artificial Sequence
  chemically synthesized
ggcggtattaaaaatcaaat

SEQ ID NO: 543936 - DNA, 20 bp, Artificial Sequence
  chemically synthesized
aaactaccataaataattta

SEQ ID NO: 543937 - DNA, 20 bp, Artificial Sequence
  chemically synthesized
gagtactttgattatttttg

SEQ ID NO: 543938 - DNA, 20 bp, Artificial Sequence
  chemically synthesized
cttaagggaaataaaggaat

SEQ ID NO: 543939 - DNA, 20 bp, Artificial Sequence
  chemically synthesized
attatttcagttaacaatag

SEQ ID NO: 543940 - DNA, 20 bp, Artificial Sequence
  chemically synthesized
aaccttctgcctcaaattca

SEQ ID NO: 543941 - DNA, 20 bp, Artificial Sequence
  chemically synthesized
gtcttaaaaaatagtctcat

SEQ ID NO: 543942 - DNA, 20 bp, Artificial Sequence
  chemically synthesized
gtcagcatgacttgaaaata

SEQ ID NO: 543943 - DNA, 20 bp, Artificial Sequence
  chemically synthesized
tttcatataatatggcaata

SEQ ID NO: 543944 - DNA, 20 bp, Artificial Sequence
  chemically synthesized
gcaatatcagaaatagttgc

SEQ ID NO: 543945 - DNA, 20 bp, Artificial Sequence
  chemically synthesized
ctgaaaagactatctaattt

SEQ ID NO: 543946 - DNA, 20 bp, Artificial Sequence
  chemically synthesized
agagtgagactctgtctcaa

SEQ ID NO: 543947 - DNA, 20 bp, Artificial Sequence
  chemically synthesized
aactctttaaaataaatttt

SEQ ID NO: 543948 - DNA, 20 bp, Artificial Sequence
  chemically synthesized
cagacaggtaaatcaatgga

SEQ ID NO: 543949 - DNA, 20 bp, Artificial Sequence
  chemically synthesized
aggtaaatcaatggaacaga

SEQ ID NO: 543950 - DNA, 20 bp, Artificial Sequence
  chemically synthesized
aatggaacagaatagaaagc

SEQ ID NO: 543951 - DNA, 20 bp, Artificial Sequence
  chemically synthesized
aggaaccaaggcaatacagt

SEQ ID NO: 543952 - DNA, 20 bp, Artificial Sequence
  chemically synthesized
tctttatatccatgtgtatc

SEQ ID NO: 543953 - DNA, 20 bp, Artificial Sequence
  chemically synthesized
catggatataaagatgggaa

SEQ ID NO: 543954 - DNA, 20 bp, Artificial Sequence
  chemically synthesized
taaatacatttccactgaat

SEQ ID NO: 543955 - DNA, 20 bp, Artificial Sequence
  chemically synthesized
aactcctagcagatagcagt

SEQ ID NO: 543956 - DNA, 20 bp, Artificial Sequence
  chemically synthesized
caccaaagggatgatccatg

SEQ ID NO: 543957 - DNA, 20 bp, Artificial Sequence
  chemically synthesized
aaagggatgatccatgaaag

SEQ ID NO: 543958 - DNA, 20 bp, Artificial Sequence
  chemically synthesized
agatgctgccaaaagaacga

SEQ ID NO: 543959 - DNA, 20 bp, Artificial Sequence
  chemically synthesized
aaaagaaaagccacaggctc

SEQ ID NO: 543960 - DNA, 20 bp, Artificial Sequence
  chemically synthesized
ttacgaaagacatatctggt

SEQ ID NO: 543961 - DNA, 20 bp, Artificial Sequence
  chemically synthesized
agttctttgtgtatttcgga

SEQ ID NO: 543962 - DNA, 20 bp, Artificial Sequence
  chemically synthesized
gagataccactacacaccta

SEQ ID NO: 543963 - DNA, 20 bp, Artificial Sequence
  chemically synthesized
tgacaaaaccaaaagccgac

SEQ ID NO: 543964 - DNA, 20 bp, Artificial Sequence
  chemically synthesized
tgtgccattttgcattgcca

SEQ ID NO: 543965 - DNA, 20 bp, Artificial Sequence
  chemically synthesized
tagtagaatgtttacttttg

SEQ ID NO: 543966 - DNA, 20 bp, Artificial Sequence
  chemically synthesized
catgattgctggatcatata

SEQ ID NO: 543967 - DNA, 20 bp, Artificial Sequence
  chemically synthesized
ctacacttctctcctaatct

SEQ ID NO: 543968 - DNA, 20 bp, Artificial Sequence
  chemically synthesized
ttgtaaatttgtttaaactc

SEQ ID NO: 543969 - DNA, 20 bp, Artificial Sequence
  chemically synthesized
aaaaaaaaagccaatcattc

SEQ ID NO: 543970 - DNA, 20 bp, Artificial Sequence
  chemically synthesized
tataaaatactaattaaaac

SEQ ID NO: 543971 - DNA, 20 bp, Artificial Sequence
  chemically synthesized
tcagctaagagataggtatt

SEQ ID NO: 543972 - DNA, 20 bp, Artificial Sequence
  chemically synthesized
ctcagttttgtctaattagt

SEQ ID NO: 543973 - DNA, 20 bp, Artificial Sequence
  chemically synthesized
aaaactaataagttgagaaa

SEQ ID NO: 543974 - DNA, 20 bp, Artificial Sequence
  chemically synthesized
gatcacaaaaactaataagt

SEQ ID NO: 543975 - DNA, 20 bp, Artificial Sequence
  chemically synthesized
tataacatttaccttttaat

SEQ ID NO: 543976 - DNA, 20 bp, Artificial Sequence
  chemically synthesized
agcaccctgagcatcttaga

SEQ ID NO: 543977 - DNA, 20 bp, Artificial Sequence
  chemically synthesized
taaatatgtaatgtaaatat

SEQ ID NO: 543978 - DNA, 20 bp, Artificial Sequence
  chemically synthesized
gacaggaggatttggggtgt

SEQ ID NO: 543979 - DNA, 20 bp, Artificial Sequence
  chemically synthesized
gtccagaatttgaactttat

SEQ ID NO: 543980 - DNA, 20 bp, Artificial Sequence
  chemically synthesized
cagaaaacaatatacagatg

SEQ ID NO: 543981 - DNA, 20 bp, Artificial Sequence
  chemically synthesized
aaaagctcaatgtagataaa

SEQ ID NO: 543982 - DNA, 20 bp, Artificial Sequence
  chemically synthesized
tttgtgaaatgatataaaaa

SEQ ID NO: 543983 - DNA, 20 bp, Artificial Sequence
  chemically synthesized
atctctttattctaagctta

SEQ ID NO: 543984 - DNA, 20 bp, Artificial Sequence
  chemically synthesized
attaattgattctagtaagc

SEQ ID NO: 543985 - DNA, 20 bp, Artificial Sequence
  chemically synthesized
tgttactgagactatttata

SEQ ID NO: 543986 - DNA, 20 bp, Artificial Sequence
  chemically synthesized
tatgtatgtcataataattg

SEQ ID NO: 543987 - DNA, 20 bp, Artificial Sequence
  chemically synthesized
gtcataataattgtaagaaa

SEQ ID NO: 543988 - DNA, 20 bp, Artificial Sequence
  chemically synthesized
gttgtataccattttataca

SEQ ID NO: 543989 - DNA, 20 bp, Artificial Sequence
  chemically synthesized
gcaacagcagagcatgtctg

SEQ ID NO: 543990 - DNA, 20 bp, Artificial Sequence
  chemically synthesized
ttcaaaaaggtgtgagcgta

SEQ ID NO: 543991 - DNA, 20 bp, Artificial Sequence
  chemically synthesized
cacaaggaatgccgggtcac

SEQ ID NO: 543992 - DNA, 20 bp, Artificial Sequence
  chemically synthesized
cataaagagacacatagacc

SEQ ID NO: 543993 - DNA, 20 bp, Artificial Sequence
  chemically synthesized
tgaatgagacagtgaagagc

SEQ ID NO: 543994 - DNA, 20 bp, Artificial Sequence
  chemically synthesized
tacataggaaatactgaggt

SEQ ID NO: 543995 - DNA, 20 bp, Artificial Sequence
  chemically synthesized
ggagctaggaataattaagc

SEQ ID NO: 543996 - DNA, 20 bp, Artificial Sequence
  chemically synthesized
attattgaagttacctttaa

SEQ ID NO: 543997 - DNA, 20 bp, Artificial Sequence
  chemically synthesized
ggtaacttcaataatcttaa

SEQ ID NO: 543998 - DNA, 20 bp, Artificial Sequence
  chemically synthesized
agagcgagactccgtctcaa

SEQ ID NO: 543999 - DNA, 20 bp, Artificial Sequence
  chemically synthesized
ctactcaggaggctgaggaa

SEQ ID NO: 544000 - DNA, 20 bp, Artificial Sequence
  chemically synthesized
gtatgggtggccagatccca

SEQ ID NO: 544001 - DNA, 20 bp, Artificial Sequence
  chemically synthesized
ctgtgagttaatgggagacg

SEQ ID NO: 544002 - DNA, 20 bp, Artificial Sequence
  chemically synthesized
ctaccgtctcccattaactc

SEQ ID NO: 544003 - DNA, 20 bp, Artificial Sequence
  chemically synthesized
agaaatatacattaaaaagc

SEQ ID NO: 544004 - DNA, 20 bp, Artificial Sequence
  chemically synthesized
agttttgatgggactgagta

SEQ ID NO: 544005 - DNA, 20 bp, Artificial Sequence
  chemically synthesized
aaattagcaaatacttctaa

SEQ ID NO: 544006 - DNA, 20 bp, Artificial Sequence
  chemically synthesized
ttcctttgtttaggccaaaa

SEQ ID NO: 544007 - DNA, 20 bp, Artificial Sequence
  chemically synthesized
gctctaacctcaaaacatag

SEQ ID NO: 544008 - DNA, 20 bp, Artificial Sequence
  chemically synthesized
atgtttagcagcagaagaat

SEQ ID NO: 544009 - DNA, 20 bp, Artificial Sequence
  chemically synthesized
aatcacgatgtttagcagca

SEQ ID NO: 544010 - DNA, 20 bp, Artificial Sequence
  chemically synthesized
aaggtaagcgtgtggctgca

SEQ ID NO: 544011 - DNA, 20 bp, Artificial Sequence
  chemically synthesized
ttagtgataagttccaagga

SEQ ID NO: 544012 - DNA, 20 bp, Artificial Sequence
  chemically synthesized
cttcatttccatctttccca

SEQ ID NO: 544013 - DNA, 20 bp, Artificial Sequence
  chemically synthesized
atggattaaatcaaagtatt

SEQ ID NO: 544014 - DNA, 20 bp, Artificial Sequence
  chemically synthesized
ccctaactaatatgcagttt

SEQ ID NO: 544015 - DNA, 20 bp, Artificial Sequence
  chemically synthesized
ccagtatcaggacttgagct

SEQ ID NO: 544016 - DNA, 20 bp, Artificial Sequence
  chemically synthesized
ggtaataaaccaatacctaa

SEQ ID NO: 544017 - DNA, 20 bp, Artificial Sequence
  chemically synthesized
taaaccaatacctaagtaga

SEQ ID NO: 544018 - DNA, 20 bp, Artificial Sequence
  chemically synthesized
aatccatgagtcaaaacttg

SEQ ID NO: 544019 - DNA, 20 bp, Artificial Sequence
  chemically synthesized
cattgaagatgaaatatata

SEQ ID NO: 544020 - DNA, 20 bp, Artificial Sequence
  chemically synthesized
ctactcgggaggctgaggca

SEQ ID NO: 544021 - DNA, 20 bp, Artificial Sequence
  chemically synthesized
aaaaaaaaaaaaaaaaaaaa

SEQ ID NO: 544022 - DNA, 20 bp, Artificial Sequence
  chemically synthesized
aaaaaaaaaaaaaaaaaaga

SEQ ID NO: 544023 - DNA, 20 bp, Artificial Sequence
  chemically synthesized
agaagcatttttcctaacaa

SEQ ID NO: 544024 - DNA, 20 bp, Artificial Sequence
  chemically synthesized
cttcatgaggacgaaattta

SEQ ID NO: 544025 - DNA, 20 bp, Artificial Sequence
  chemically synthesized
ctctatagaaaaacacacat

SEQ ID NO: 544026 - DNA, 20 bp, Artificial Sequence
  chemically synthesized
catatatgataaacagctct

SEQ ID NO: 544027 - DNA, 20 bp, Artificial Sequence
  chemically synthesized
ttaaattatgctattaacat

SEQ ID NO: 544028 - DNA, 20 bp, Artificial Sequence
  chemically synthesized
aattatgtgtactaaataat

SEQ ID NO: 544029 - DNA, 20 bp, Artificial Sequence
  chemically synthesized
ggcatcagtaaatcaatgta

SEQ ID NO: 544030 - DNA, 20 bp, Artificial Sequence
  chemically synthesized
ttataattcttcatgatctc

SEQ ID NO: 544031 - DNA, 20 bp, Artificial Sequence
  chemically synthesized
tgaaaattcttagagatcat

SEQ ID NO: 544032 - DNA, 20 bp, Artificial Sequence
  chemically synthesized
tatataatattcaataaaag

SEQ ID NO: 544033 - DNA, 20 bp, Artificial Sequence
  chemically synthesized
aaagtaaaataatttgaagc

SEQ ID NO: 544034 - DNA, 20 bp, Artificial Sequence
  chemically synthesized
ttcataatgttagagaagat

SEQ ID NO: 544035 - DNA, 20 bp, Artificial Sequence
  chemically synthesized
actccgacattagaagtaat

SEQ ID NO: 544036 - DNA, 20 bp, Artificial Sequence
  chemically synthesized
tcaaagggtaaaacttcatt

SEQ ID NO: 544037 - DNA, 20 bp, Artificial Sequence
  chemically synthesized
tcacgttcaagtcctgattt

SEQ ID NO: 544038 - DNA, 20 bp, Artificial Sequence
  chemically synthesized
ttcaattccattgttggttt

SEQ ID NO: 544039 - DNA, 20 bp, Artificial Sequence
  chemically synthesized
tggaattgaaatgaaaatgg

SEQ ID NO: 544040 - DNA, 20 bp, Artificial Sequence
  chemically synthesized
gggctgtctctaagagtatg

SEQ ID NO: 544041 - DNA, 20 bp, Artificial Sequence
  chemically synthesized
aaaattttaggacactcaac

SEQ ID NO: 544042 - DNA, 20 bp, Artificial Sequence
  chemically synthesized
tcatatcttaatacagtaaa

SEQ ID NO: 544043 - DNA, 20 bp, Artificial Sequence
  chemically synthesized
tgtctgtgtttataatcatt

SEQ ID NO: 544044 - DNA, 20 bp, Artificial Sequence
  chemically synthesized
gattggacttgtgaatggta

SEQ ID NO: 544045 - DNA, 20 bp, Artificial Sequence
  chemically synthesized
caccctgcaaacagcctaat

SEQ ID NO: 544046 - DNA, 20 bp, Artificial Sequence
  chemically synthesized
tgtttgcagggtgaaaggaa

SEQ ID NO: 544047 - DNA, 20 bp, Artificial Sequence
  chemically synthesized
tgcagggtgaaaggaaggag

SEQ ID NO: 544048 - DNA, 20 bp, Artificial Sequence
  chemically synthesized
agatatatcaccctgggttt

SEQ ID NO: 544049 - DNA, 20 bp, Artificial Sequence
  chemically synthesized
aatgaatgaggatatccaga

SEQ ID NO: 544050 - DNA, 20 bp, Artificial Sequence
  chemically synthesized
agaagaaacacaaggactct

SEQ ID NO: 544051 - DNA, 20 bp, Artificial Sequence
  chemically synthesized
ctctgaagaatatcaatatt

SEQ ID NO: 544052 - DNA, 20 bp, Artificial Sequence
  chemically synthesized
actgaattggaacaaatggc

SEQ ID NO: 544053 - DNA, 20 bp, Artificial Sequence
  chemically synthesized
aacaaatggccaagaatgtg

SEQ ID NO: 544054 - DNA, 20 bp, Artificial Sequence
  chemically synthesized
gaatgtgaaagaattaatca

SEQ ID NO: 544055 - DNA, 20 bp, Artificial Sequence
  chemically synthesized
atcccataagccaagcgagg

SEQ ID NO: 544056 - DNA, 20 bp, Artificial Sequence
  chemically synthesized
gagcacaaatacccacaatt

SEQ ID NO: 544057 - DNA, 20 bp, Artificial Sequence
  chemically synthesized
aaagcttgaaataattgttg

SEQ ID NO: 544058 - DNA, 20 bp, Artificial Sequence
  chemically synthesized
ctcaaaaaaataatcttatt

SEQ ID NO: 544059 - DNA, 20 bp, Artificial Sequence
  chemically synthesized
gtagctgaattgaggagatg

SEQ ID NO: 544060 - DNA, 20 bp, Artificial Sequence
  chemically synthesized
cacagggatgctgaaataac

SEQ ID NO: 544061 - DNA, 20 bp, Artificial Sequence
  chemically synthesized
cctagtgccaaagtcttcaa

SEQ ID NO: 544062 - DNA, 20 bp, Artificial Sequence
  chemically synthesized
tcttttgtacccccactact

SEQ ID NO: 544063 - DNA, 20 bp, Artificial Sequence
  chemically synthesized
aaattggtttccacgtatga

SEQ ID NO: 544064 - DNA, 20 bp, Artificial Sequence
  chemically synthesized
cagaggaagtgaagcaagga

SEQ ID NO: 544065 - DNA, 20 bp, Artificial Sequence
  chemically synthesized
gaaagtgcaatagagcagag

SEQ ID NO: 544066 - DNA, 20 bp, Artificial Sequence
  chemically synthesized
agagcagagagagaaagata

SEQ ID NO: 544067 - DNA, 20 bp, Artificial Sequence
  chemically synthesized
aaacacagataacagagata

SEQ ID NO: 544068 - DNA, 20 bp, Artificial Sequence
  chemically synthesized
ctgcacttgattaccctctt

SEQ ID NO: 544069 - DNA, 20 bp, Artificial Sequence
  chemically synthesized
cacggaaaaaattcgagttg

SEQ ID NO: 544070 - DNA, 20 bp, Artificial Sequence
  chemically synthesized
tctgaactgcagtgatacta

SEQ ID NO: 544071 - DNA, 20 bp, Artificial Sequence
  chemically synthesized
gtaaagcccaagattgtgtc

SEQ ID NO: 544072 - DNA, 20 bp, Artificial Sequence
  chemically synthesized
ttcctatgcacataaaggct

SEQ ID NO: 544073 - DNA, 20 bp, Artificial Sequence
  chemically synthesized
tctgggagcttgtcagaaat

SEQ ID NO: 544074 - DNA, 20 bp, Artificial Sequence
  chemically synthesized
tgacattatctgggagcttg

SEQ ID NO: 544075 - DNA, 20 bp, Artificial Sequence
  chemically synthesized
gtggtccagggacattttga

SEQ ID NO: 544076 - DNA, 20 bp, Artificial Sequence
  chemically synthesized
agcatttgaaaggagtaaat

SEQ ID NO: 544077 - DNA, 20 bp, Artificial Sequence
  chemically synthesized
taaaccgacaggtgatgtag

SEQ ID NO: 544078 - DNA, 20 bp, Artificial Sequence
  chemically synthesized
atatgtattaaaaatccttg

SEQ ID NO: 544079 - DNA, 20 bp, Artificial Sequence
  chemically synthesized
gtcccattttagtaggcaat

SEQ ID NO: 544080 - DNA, 20 bp, Artificial Sequence
  chemically synthesized
ttaagaatgatgttgttatt

SEQ ID NO: 544081 - DNA, 20 bp, Artificial Sequence
  chemically synthesized
taaaggggactcacaaggta

SEQ ID NO: 544082 - DNA, 20 bp, Artificial Sequence
  chemically synthesized
gatcaaagctgtcttaagat

SEQ ID NO: 544083 - DNA, 20 bp, Artificial Sequence
  chemically synthesized
ataaagaaacagagtatcag

SEQ ID NO: 544084 - DNA, 20 bp, Artificial Sequence
  chemically synthesized
gagtatcagacagaaacctg

SEQ ID NO: 544085 - DNA, 20 bp, Artificial Sequence
  chemically synthesized
taattaattttctactacta

SEQ ID NO: 544086 - DNA, 20 bp, Artificial Sequence
  chemically synthesized
tgagggaaattctcttagta

SEQ ID NO: 544087 - DNA, 20 bp, Artificial Sequence
  chemically synthesized
ctgaaagataatatataatt

SEQ ID NO: 544088 - DNA, 20 bp, Artificial Sequence
  chemically synthesized
ttcccatttcttgaaacaat

SEQ ID NO: 544089 - DNA, 20 bp, Artificial Sequence
  chemically synthesized
tagactattctaaattgttt

SEQ ID NO: 544090 - DNA, 20 bp, Artificial Sequence
  chemically synthesized
ctaaaaaatagatttttttt

SEQ ID NO: 544091 - DNA, 20 bp, Artificial Sequence
  chemically synthesized
cttcatgatttgaatcctgg

SEQ ID NO: 544092 - DNA, 20 bp, Artificial Sequence
  chemically synthesized
cattttatttactctgcctg

SEQ ID NO: 544093 - DNA, 20 bp, Artificial Sequence
  chemically synthesized
ctgctaccacatgtaaatac

SEQ ID NO: 544094 - DNA, 20 bp, Artificial Sequence
  chemically synthesized
tgacagggattgatgactat

SEQ ID NO: 544095 - DNA, 20 bp, Artificial Sequence
  chemically synthesized
gaataactttttgataacag

SEQ ID NO: 544096 - DNA, 20 bp, Artificial Sequence
  chemically synthesized
gtagaatagagtaaaataga

SEQ ID NO: 544097 - DNA, 20 bp, Artificial Sequence
  chemically synthesized
gtagagtagaatagagtaaa

SEQ ID NO: 544098 - DNA, 20 bp, Artificial Sequence
  chemically synthesized
agcttgcacaattgtgtaga

SEQ ID NO: 544099 - DNA, 20 bp, Artificial Sequence
  chemically synthesized
ggcatccctagtcagtcaca

SEQ ID NO: 544100 - DNA, 20 bp, Artificial Sequence
  chemically synthesized
ctagtcagtcacagaagaat

SEQ ID NO: 544101 - DNA, 20 bp, Artificial Sequence
  chemically synthesized
gcaaaatcaaagtttagcct

SEQ ID NO: 544102 - DNA, 20 bp, Artificial Sequence
  chemically synthesized
tcgcattaatctatcaacta

SEQ ID NO: 544103 - DNA, 20 bp, Artificial Sequence
  chemically synthesized
aaggcaacttctcagactta

SEQ ID NO: 544104 - DNA, 20 bp, Artificial Sequence
  chemically synthesized
atatagaagaaagagataat

SEQ ID NO: 544105 - DNA, 20 bp, Artificial Sequence
  chemically synthesized
aaattgctttttttaatata

SEQ ID NO: 544106 - DNA, 20 bp, Artificial Sequence
  chemically synthesized
gcaggagtctcagattgaga

SEQ ID NO: 544107 - DNA, 20 bp, Artificial Sequence
  chemically synthesized
gtcaggcaggagtctcagat

SEQ ID NO: 544108 - DNA, 20 bp, Artificial Sequence
  chemically synthesized
ttctcataaatactttccaa

SEQ ID NO: 544109 - DNA, 20 bp, Artificial Sequence
  chemically synthesized
ttctttttggaaagtattta

SEQ ID NO: 544110 - DNA, 20 bp, Artificial Sequence
  chemically synthesized
aggcagtatgattggagact

SEQ ID NO: 544111 - DNA, 20 bp, Artificial Sequence
  chemically synthesized
ttactattgtcccatttgtg

SEQ ID NO: 544112 - DNA, 20 bp, Artificial Sequence
  chemically synthesized
cttatataattgttgtcttc

SEQ ID NO: 544113 - DNA, 20 bp, Artificial Sequence
  chemically synthesized
tgctccagttgatgccacat

SEQ ID NO: 544114 - DNA, 20 bp, Artificial Sequence
  chemically synthesized
cagttgatgccacatagaga

SEQ ID NO: 544115 - DNA, 20 bp, Artificial Sequence
  chemically synthesized
caaagggcactgcctacgtt

SEQ ID NO: 544116 - DNA, 20 bp, Artificial Sequence
  chemically synthesized
ctgcctacgttgaagaatta

SEQ ID NO: 544117 - DNA, 20 bp, Artificial Sequence
  chemically synthesized
tctatacctaaatcaccaga

SEQ ID NO: 544118 - DNA, 20 bp, Artificial Sequence
  chemically synthesized
ttaagtgaaataagccaggt

SEQ ID NO: 544119 - DNA, 20 bp, Artificial Sequence
  chemically synthesized
aaaaaaaaaaaatcaaacta

SEQ ID NO: 544120 - DNA, 20 bp, Artificial Sequence
  chemically synthesized
aactaagataacaacaagcc

SEQ ID NO: 544121 - DNA, 20 bp, Artificial Sequence
  chemically synthesized
cagtgtgtaaaataaacagg

SEQ ID NO: 544122 - DNA, 20 bp, Artificial Sequence
  chemically synthesized
atcaatgaaagtattataaa

SEQ ID NO: 544123 - DNA, 20 bp, Artificial Sequence
  chemically synthesized
ctttgaatcatataaaccag

SEQ ID NO: 544124 - DNA, 20 bp, Artificial Sequence
  chemically synthesized
acaatagcctgcaacaaatg

SEQ ID NO: 544125 - DNA, 20 bp, Artificial Sequence
  chemically synthesized
tgtttaaaaattaaacagat

SEQ ID NO: 544126 - DNA, 20 bp, Artificial Sequence
  chemically synthesized
attaatggaacacaaagccc

SEQ ID NO: 544127 - DNA, 20 bp, Artificial Sequence
  chemically synthesized
tacctaaccaaagaattttg

SEQ ID NO: 544128 - DNA, 20 bp, Artificial Sequence
  chemically synthesized
ggaattggtgatacctaacc

SEQ ID NO: 544129 - DNA, 20 bp, Artificial Sequence
  chemically synthesized
ataggatgagatggagcttc

SEQ ID NO: 544130 - DNA, 20 bp, Artificial Sequence
  chemically synthesized
attgacctcaataccatggg

SEQ ID NO: 544131 - DNA, 20 bp, Artificial Sequence
  chemically synthesized
ttttaatcaacattatgaat

SEQ ID NO: 544132 - DNA, 20 bp, Artificial Sequence
  chemically synthesized
aacaaagtagggaagtgaaa

SEQ ID NO: 544133 - DNA, 20 bp, Artificial Sequence
  chemically synthesized
caagatcatctgagagagct

SEQ ID NO: 544134 - DNA, 20 bp, Artificial Sequence
  chemically synthesized
atgatcttgttccctacctt

SEQ ID NO: 544135 - DNA, 20 bp, Artificial Sequence
  chemically synthesized
cagatgcttgagcaaaagta

SEQ ID NO: 544136 - DNA, 20 bp, Artificial Sequence
  chemically synthesized
cgtctcaaaataaacaaata

SEQ ID NO: 544137 - DNA, 20 bp, Artificial Sequence
  chemically synthesized
gtggcatcatgaagccaaag

SEQ ID NO: 544138 - DNA, 20 bp, Artificial Sequence
  chemically synthesized
tcatagaaatagaaggcaaa

SEQ ID NO: 544139 - DNA, 20 bp, Artificial Sequence
  chemically synthesized
agaaaaaattaccaatggtc

SEQ ID NO: 544140 - DNA, 20 bp, Artificial Sequence
  chemically synthesized
gtggaggaggatggacctgc

SEQ ID NO: 544141 - DNA, 20 bp, Artificial Sequence
  chemically synthesized
ttctactctactatctctca

SEQ ID NO: 544142 - DNA, 20 bp, Artificial Sequence
  chemically synthesized
ctgaattagagatatacata

SEQ ID NO: 544143 - DNA, 20 bp, Artificial Sequence
  chemically synthesized
gatattaaacttcccaaact

SEQ ID NO: 544144 - DNA, 20 bp, Artificial Sequence
  chemically synthesized
aactgggtagcttataaacc

SEQ ID NO: 544145 - DNA, 20 bp, Artificial Sequence
  chemically synthesized
agcatacatattcaggagac

SEQ ID NO: 544146 - DNA, 20 bp, Artificial Sequence
  chemically synthesized
ttatgcgtcaattaaaaaag

SEQ ID NO: 544147 - DNA, 20 bp, Artificial Sequence
  chemically synthesized
tatatttcaaagtagctaga

SEQ ID NO: 544148 - DNA, 20 bp, Artificial Sequence
  chemically synthesized
caaagactttctcatttttc

SEQ ID NO: 544149 - DNA, 20 bp, Artificial Sequence
  chemically synthesized
gttctttattctaagaaaaa

SEQ ID NO: 544150 - DNA, 20 bp, Artificial Sequence
  chemically synthesized
tgaaattttgttctttattc

SEQ ID NO: 544151 - DNA, 20 bp, Artificial Sequence
  chemically synthesized
gtacttgaataaaagacaaa

SEQ ID NO: 544152 - DNA, 20 bp, Artificial Sequence
  chemically synthesized
tgtcttttattcaagtactt

SEQ ID NO: 544153 - DNA, 20 bp, Artificial Sequence
  chemically synthesized
aagaatagctctgaattact

SEQ ID NO: 544154 - DNA, 20 bp, Artificial Sequence
  chemically synthesized
attggaggaggaacaagaat

SEQ ID NO: 544155 - DNA, 20 bp, Artificial Sequence
  chemically synthesized
ttattccattggaggaggaa

SEQ ID NO: 544156 - DNA, 20 bp, Artificial Sequence
  chemically synthesized
catttgatttagactatctc

SEQ ID NO: 544157 - DNA, 20 bp, Artificial Sequence
  chemically synthesized
ctaggctggcatgacagctg

SEQ ID NO: 544158 - DNA, 20 bp, Artificial Sequence
  chemically synthesized
aatctgctgaagcctatgtt

SEQ ID NO: 544159 - DNA, 20 bp, Artificial Sequence
  chemically synthesized
caatgtcaattcaacgccta

SEQ ID NO: 544160 - DNA, 20 bp, Artificial Sequence
  chemically synthesized
tgtttgcacactgtaggggc

SEQ ID NO: 544161 - DNA, 20 bp, Artificial Sequence
  chemically synthesized
ttactatgactcacttcagg

SEQ ID NO: 544162 - DNA, 20 bp, Artificial Sequence
  chemically synthesized
cctgaagtgagtcatagtaa

SEQ ID NO: 544163 - DNA, 20 bp, Artificial Sequence
  chemically synthesized
ctatgacctaccttgaagaa

SEQ ID NO: 544164 - DNA, 20 bp, Artificial Sequence
  chemically synthesized
cttcttcttcaaggtaggtc

SEQ ID NO: 544165 - DNA, 20 bp, Artificial Sequence
  chemically synthesized
tccaaagccaaccataaaag

SEQ ID NO: 544166 - DNA, 20 bp, Artificial Sequence
  chemically synthesized
tttttatggctagctaatag

SEQ ID NO: 544167 - DNA, 20 bp, Artificial Sequence
  chemically synthesized
ctatcaaacaaaagtatgtc

SEQ ID NO: 544168 - DNA, 20 bp, Artificial Sequence
  chemically synthesized
aaccagccaggcctgtctgt

SEQ ID NO: 544169 - DNA, 20 bp, Artificial Sequence
  chemically synthesized
taacaaaagataggttaaca

SEQ ID NO: 544170 - DNA, 20 bp, Artificial Sequence
  chemically synthesized
tcaacatgcatgttatagga

SEQ ID NO: 544171 - DNA, 20 bp, Artificial Sequence
  chemically synthesized
accaccacctccaattcact

SEQ ID NO: 544172 - DNA, 20 bp, Artificial Sequence
  chemically synthesized
cctccaattcactgcagaaa

SEQ ID NO: 544173 - DNA, 20 bp, Artificial Sequence
  chemically synthesized
agtaaataattttcattcca

SEQ ID NO: 544174 - DNA, 20 bp, Artificial Sequence
  chemically synthesized
ctactcgggaggctgaggca

SEQ ID NO: 544175 - DNA, 20 bp, Artificial Sequence
  chemically synthesized
agccaccgcgcccggcccca

SEQ ID NO: 544176 - DNA, 20 bp, Artificial Sequence
  chemically synthesized
aactccataaagaacagaga

SEQ ID NO: 544177 - DNA, 20 bp, Artificial Sequence
  chemically synthesized
acaacaggatgtgaaattct

SEQ ID NO: 544178 - DNA, 20 bp, Artificial Sequence
  chemically synthesized
gaatgaggaaagacctttct

SEQ ID NO: 544179 - DNA, 20 bp, Artificial Sequence
  chemically synthesized
atatgtttctttgttccatt

SEQ ID NO: 544180 - DNA, 20 bp, Artificial Sequence
  chemically synthesized
cttcttttctaaaatggaac

SEQ ID NO: 544181 - DNA, 20 bp, Artificial Sequence
  chemically synthesized
atcaagatatcacaataatg

SEQ ID NO: 544182 - DNA, 20 bp, Artificial Sequence
  chemically synthesized
agctcagagcttgaattgtg

SEQ ID NO: 544183 - DNA, 20 bp, Artificial Sequence
  chemically synthesized
atccactggcagaatattgg

SEQ ID NO: 544184 - DNA, 20 bp, Artificial Sequence
  chemically synthesized
agagatgaggctatccactg

SEQ ID NO: 544185 - DNA, 20 bp, Artificial Sequence
  chemically synthesized
ctcacttagtgcaaagtatg

SEQ ID NO: 544186 - DNA, 20 bp, Artificial Sequence
  chemically synthesized
gaagaagcaaaaatacatgt

SEQ ID NO: 544187 - DNA, 20 bp, Artificial Sequence
  chemically synthesized
aagtggggaaaaaagaatta

SEQ ID NO: 544188 - DNA, 20 bp, Artificial Sequence
  chemically synthesized
gagttgttaaagtggggaaa

SEQ ID NO: 544189 - DNA, 20 bp, Artificial Sequence
  chemically synthesized
gaaataatcattttgtgaac

SEQ ID NO: 544190 - DNA, 20 bp, Artificial Sequence
  chemically synthesized
cagaatattcatcaataatt

SEQ ID NO: 544191 - DNA, 20 bp, Artificial Sequence
  chemically synthesized
atatacttgaagaatagagg

SEQ ID NO: 544192 - DNA, 20 bp, Artificial Sequence
  chemically synthesized
tgaggttttaagatatactt

SEQ ID NO: 544193 - DNA, 20 bp, Artificial Sequence
  chemically synthesized
ctgatgagtatatttgtaaa

SEQ ID NO: 544194 - DNA, 20 bp, Artificial Sequence
  chemically synthesized
ctcctttacaaatatactca

SEQ ID NO: 544195 - DNA, 20 bp, Artificial Sequence
  chemically synthesized
gtgtagtaatacacttttgc

SEQ ID NO: 544196 - DNA, 20 bp, Artificial Sequence
  chemically synthesized
ctgtttgtacaatataatac

SEQ ID NO: 544197 - DNA, 20 bp, Artificial Sequence
  chemically synthesized
tacaaacatctcaaagaact

SEQ ID NO: 544198 - DNA, 20 bp, Artificial Sequence
  chemically synthesized
ggttatgtggcagtcactgt

SEQ ID NO: 544199 - DNA, 20 bp, Artificial Sequence
  chemically synthesized
atatttaaacatcttagcat

SEQ ID NO: 544200 - DNA, 20 bp, Artificial Sequence
  chemically synthesized
aaaacttataagcctcatcc

SEQ ID NO: 544201 - DNA, 20 bp, Artificial Sequence
  chemically synthesized
tagctaattaaaatgttcat

SEQ ID NO: 544202 - DNA, 20 bp, Artificial Sequence
  chemically synthesized
atttcttctttaataccaac

SEQ ID NO: 544203 - DNA, 20 bp, Artificial Sequence
  chemically synthesized
tattctttgttggtattaaa

SEQ ID NO: 544204 - DNA, 20 bp, Artificial Sequence
  chemically synthesized
tcacttcggaaaactctgaa

SEQ ID NO: 544205 - DNA, 20 bp, Artificial Sequence
  chemically synthesized
aagagtagagagaggttgat

SEQ ID NO: 544206 - DNA, 20 bp, Artificial Sequence
  chemically synthesized
ctttaaaaaaaaatcgagta

SEQ ID NO: 544207 - DNA, 20 bp, Artificial Sequence
  chemically synthesized
attattatatttttggaatt

SEQ ID NO: 544208 - DNA, 20 bp, Artificial Sequence
  chemically synthesized
ggggaaatcctatttaacca

SEQ ID NO: 544209 - DNA, 20 bp, Artificial Sequence
  chemically synthesized
ctactcgggaggctgaggca

SEQ ID NO: 544210 - DNA, 20 bp, Artificial Sequence
  chemically synthesized
gaacgagactcagtctcaaa

SEQ ID NO: 544211 - DNA, 20 bp, Artificial Sequence
  chemically synthesized
ttaatttacccaagaaaata

SEQ ID NO: 544212 - DNA, 20 bp, Artificial Sequence
  chemically synthesized
atcgaagaaattaatttacc

SEQ ID NO: 544213 - DNA, 20 bp, Artificial Sequence
  chemically synthesized
gcaagaagtcgctgaagatc

SEQ ID NO: 544214 - DNA, 20 bp, Artificial Sequence
  chemically synthesized
tgtctaaagacctgggatca

SEQ ID NO: 544215 - DNA, 20 bp, Artificial Sequence
  chemically synthesized
caaactcaaccaattgtcaa

SEQ ID NO: 544216 - DNA, 20 bp, Artificial Sequence
  chemically synthesized
aagaaatacattggtttggt

SEQ ID NO: 544217 - DNA, 20 bp, Artificial Sequence
  chemically synthesized
attaaaaaaaaaaaaaaaaa

SEQ ID NO: 544218 - DNA, 20 bp, Artificial Sequence
  chemically synthesized
ctactcgggaggctgaggca

SEQ ID NO: 544219 - DNA, 20 bp, Artificial Sequence
  chemically synthesized
agacatcaatcaagtacatt

SEQ ID NO: 544220 - DNA, 20 bp, Artificial Sequence
  chemically synthesized
actgcactccagcctgggtg

SEQ ID NO: 544221 - DNA, 20 bp, Artificial Sequence
  chemically synthesized
gtactcgggaggctgaggca

SEQ ID NO: 544222 - DNA, 20 bp, Artificial Sequence
  chemically synthesized
tgagacaggtctcagttaat

SEQ ID NO: 544223 - DNA, 20 bp, Artificial Sequence
  chemically synthesized
aaagcatttgtattgtagac

SEQ ID NO: 544224 - DNA, 20 bp, Artificial Sequence
  chemically synthesized
ttaaaattacacatataaaa

SEQ ID NO: 544225 - DNA, 20 bp, Artificial Sequence
  chemically synthesized
tttaggacaaggtaaacgcc

SEQ ID NO: 544226 - DNA, 20 bp, Artificial Sequence
  chemically synthesized
gacaatattttgtgcttgga

SEQ ID NO: 544227 - DNA, 20 bp, Artificial Sequence
  chemically synthesized
aagggcatgtattttaaaaa

SEQ ID NO: 544228 - DNA, 20 bp, Artificial Sequence
  chemically synthesized
tgatattcatcttggcaccc

SEQ ID NO: 544229 - DNA, 20 bp, Artificial Sequence
  chemically synthesized
agaatcgttgattgcagtga

SEQ ID NO: 544230 - DNA, 20 bp, Artificial Sequence
  chemically synthesized
aatattttgacgtctggtag

SEQ ID NO: 544231 - DNA, 20 bp, Artificial Sequence
  chemically synthesized
ctgttcaatcatgtcacact

SEQ ID NO: 544232 - DNA, 20 bp, Artificial Sequence
  chemically synthesized
gttttgtttaaatatctttg

SEQ ID NO: 544233 - DNA, 20 bp, Artificial Sequence
  chemically synthesized
caaccttaaaaattaaaagg

SEQ ID NO: 544234 - DNA, 20 bp, Artificial Sequence
  chemically synthesized
atgtagcagtatctgacatt

SEQ ID NO: 544235 - DNA, 20 bp, Artificial Sequence
  chemically synthesized
ctttgaaacacacttctgtg

SEQ ID NO: 544236 - DNA, 20 bp, Artificial Sequence
  chemically synthesized
aatcaccttaacacaggtta

SEQ ID NO: 544237 - DNA, 20 bp, Artificial Sequence
  chemically synthesized
aggatttcatctatcattta

SEQ ID NO: 544238 - DNA, 20 bp, Artificial Sequence
  chemically synthesized
ccatattttcgttatgcaga

SEQ ID NO: 544239 - DNA, 20 bp, Artificial Sequence
  chemically synthesized
ttcatggaagttttacttac

SEQ ID NO: 544240 - DNA, 20 bp, Artificial Sequence
  chemically synthesized
gtaccttgaagccataatac

SEQ ID NO: 544241 - DNA, 20 bp, Artificial Sequence
  chemically synthesized
ccataatacatagaatccct

SEQ ID NO: 544242 - DNA, 20 bp, Artificial Sequence
  chemically synthesized
aaaactacttgctacataat

SEQ ID NO: 544243 - DNA, 20 bp, Artificial Sequence
  chemically synthesized
ctttcattcaaatttaaaga

SEQ ID NO: 544244 - DNA, 20 bp, Artificial Sequence
  chemically synthesized
atcaggtcacaggctttcaa

SEQ ID NO: 544245 - DNA, 20 bp, Artificial Sequence
  chemically synthesized
aaaaagaaaacttaatcgct

SEQ ID NO: 544246 - DNA, 20 bp, Artificial Sequence
  chemically synthesized
tttttgcagattgatcatga

SEQ ID NO: 544247 - DNA, 20 bp, Artificial Sequence
  chemically synthesized
caaaagaaaaatgtagtgtt

SEQ ID NO: 544248 - DNA, 20 bp, Artificial Sequence
  chemically synthesized
tttctcgtttatttggaaca

SEQ ID NO: 544249 - DNA, 20 bp, Artificial Sequence
  chemically synthesized
tttcttttgttccaaataaa

SEQ ID NO: 544250 - DNA, 20 bp, Artificial Sequence
  chemically synthesized
aaaaataaggataagtcaat

SEQ ID NO: 544251 - DNA, 20 bp, Artificial Sequence
  chemically synthesized
ctacgctatcttggattata

SEQ ID NO: 544252 - DNA, 20 bp, Artificial Sequence
  chemically synthesized
tcatattttaatgaaaaatt

SEQ ID NO: 544253 - DNA, 20 bp, Artificial Sequence
  chemically synthesized
tgagaaattgtatcatcaga

SEQ ID NO: 544254 - DNA, 20 bp, Artificial Sequence
  chemically synthesized
atgatacaatttctcacatc

SEQ ID NO: 544255 - DNA, 20 bp, Artificial Sequence
  chemically synthesized
gcttaatattttctctgatg

SEQ ID NO: 544256 - DNA, 20 bp, Artificial Sequence
  chemically synthesized
gaaaaagacatctaaatttt

SEQ ID NO: 544257 - DNA, 20 bp, Artificial Sequence
  chemically synthesized
acactagagtcaatgatact

SEQ ID NO: 544258 - DNA, 20 bp, Artificial Sequence
  chemically synthesized
gaatgtagaacagacataat

SEQ ID NO: 544259 - DNA, 20 bp, Artificial Sequence
  chemically synthesized
aatgcttgactgggactcct

SEQ ID NO: 544260 - DNA, 20 bp, Artificial Sequence
  chemically synthesized
gccaatgataacaatgtgtc

SEQ ID NO: 544261 - DNA, 20 bp, Artificial Sequence
  chemically synthesized
tactctcacacgtgagaaag

SEQ ID NO: 544262 - DNA, 20 bp, Artificial Sequence
  chemically synthesized
aatatgactactctcacacg

SEQ ID NO: 544263 - DNA, 20 bp, Artificial Sequence
  chemically synthesized
aaaagccacaattggaataa

SEQ ID NO: 544264 - DNA, 20 bp, Artificial Sequence
  chemically synthesized
actcaactctgctgctatag

SEQ ID NO: 544265 - DNA, 20 bp, Artificial Sequence
  chemically synthesized
tatttactctctggcccttt

SEQ ID NO: 544266 - DNA, 20 bp, Artificial Sequence
  chemically synthesized
ttcatagactgggaaggggg

SEQ ID NO: 544267 - DNA, 20 bp, Artificial Sequence
  chemically synthesized
ccattgcatatttttgagag

SEQ ID NO: 544268 - DNA, 20 bp, Artificial Sequence
  chemically synthesized
atacttctgctggaggcaaa

SEQ ID NO: 544269 - DNA, 20 bp, Artificial Sequence
  chemically synthesized
aatgttagaaaagttttaag

SEQ ID NO: 544270 - DNA, 20 bp, Artificial Sequence
  chemically synthesized
gaagaagtactaataaaatg

SEQ ID NO: 544271 - DNA, 20 bp, Artificial Sequence
  chemically synthesized
attatgagtccacatcattt

SEQ ID NO: 544272 - DNA, 20 bp, Artificial Sequence
  chemically synthesized
taatgactacagaagtgttc

SEQ ID NO: 544273 - DNA, 20 bp, Artificial Sequence
  chemically synthesized
aattgtagcctatagaactg

SEQ ID NO: 544274 - DNA, 20 bp, Artificial Sequence
  chemically synthesized
ggaaacagtcacatcacatg

SEQ ID NO: 544275 - DNA, 20 bp, Artificial Sequence
  chemically synthesized
ggctgttcttgcactgttat

SEQ ID NO: 544276 - DNA, 20 bp, Artificial Sequence
  chemically synthesized
gctgtgtcctcccaaggcag

SEQ ID NO: 544277 - DNA, 20 bp, Artificial Sequence
  chemically synthesized
tggagattagagcttcaata

SEQ ID NO: 544278 - DNA, 20 bp, Artificial Sequence
  chemically synthesized
cttagtaaagtcttccctgg

SEQ ID NO: 544279 - DNA, 20 bp, Artificial Sequence
  chemically synthesized
ctgaccagggaagactttac

SEQ ID NO: 544280 - DNA, 20 bp, Artificial Sequence
  chemically synthesized
aagaatactctcagaagatg

SEQ ID NO: 544281 - DNA, 20 bp, Artificial Sequence
  chemically synthesized
actctcagaagatgtcagaa

SEQ ID NO: 544282 - DNA, 20 bp, Artificial Sequence
  chemically synthesized
aacaatgtctcctttcccca

SEQ ID NO: 544283 - DNA, 20 bp, Artificial Sequence
  chemically synthesized
cttaagccacttaatctccc

SEQ ID NO: 544284 - DNA, 20 bp, Artificial Sequence
  chemically synthesized
cctctaatacagaaagtaca

SEQ ID NO: 544285 - DNA, 20 bp, Artificial Sequence
  chemically synthesized
gaaatgtatatccctctaat

SEQ ID NO: 544286 - DNA, 20 bp, Artificial Sequence
  chemically synthesized
ttgttcatttggaggcaatg

SEQ ID NO: 544287 - DNA, 20 bp, Artificial Sequence
  chemically synthesized
aatattggaaggtgggagga

SEQ ID NO: 544288 - DNA, 20 bp, Artificial Sequence
  chemically synthesized
tgccacccaaggtagttgga

SEQ ID NO: 544289 - DNA, 20 bp, Artificial Sequence
  chemically synthesized
acagcagagatacatctgct

SEQ ID NO: 544290 - DNA, 20 bp, Artificial Sequence
  chemically synthesized
gaagagggagctagctatcc

SEQ ID NO: 544291 - DNA, 20 bp, Artificial Sequence
  chemically synthesized
actaaagttaggactgccag

SEQ ID NO: 544292 - DNA, 20 bp, Artificial Sequence
  chemically synthesized
taactttagtttaatctctg

SEQ ID NO: 544293 - DNA, 20 bp, Artificial Sequence
  chemically synthesized
cctagagctggagaaacaat

SEQ ID NO: 544294 - DNA, 20 bp, Artificial Sequence
  chemically synthesized
ctgctaatatccctagagct

SEQ ID NO: 544295 - DNA, 20 bp, Artificial Sequence
  chemically synthesized
aggaattggctaagcaggta

SEQ ID NO: 544296 - DNA, 20 bp, Artificial Sequence
  chemically synthesized
caggttttgtgcgagtcttg

SEQ ID NO: 544297 - DNA, 20 bp, Artificial Sequence
  chemically synthesized
cattataggtgtacagatga

SEQ ID NO: 544298 - DNA, 20 bp, Artificial Sequence
  chemically synthesized
ctccagtaaacgccttgagg

SEQ ID NO: 544299 - DNA, 20 bp, Artificial Sequence
  chemically synthesized
gcctctgcaaggttagataa

SEQ ID NO: 544300 - DNA, 20 bp, Artificial Sequence
  chemically synthesized
aggtaacatgggaatgggaa

SEQ ID NO: 544301 - DNA, 20 bp, Artificial Sequence
  chemically synthesized
ggaaaaagaaaggtatctaa

SEQ ID NO: 544302 - DNA, 20 bp, Artificial Sequence
  chemically synthesized
atctaaagagaatcttaggc

SEQ ID NO: 544303 - DNA, 20 bp, Artificial Sequence
  chemically synthesized
gcagagaaaacagtaggtac

SEQ ID NO: 544304 - DNA, 20 bp, Artificial Sequence
  chemically synthesized
ggtacaaagaaacagaagct

SEQ ID NO: 544305 - DNA, 20 bp, Artificial Sequence
  chemically synthesized
tgtttgctattagtctgtaa

SEQ ID NO: 544306 - DNA, 20 bp, Artificial Sequence
  chemically synthesized
caatgtactccttcctttgt

SEQ ID NO: 544307 - DNA, 20 bp, Artificial Sequence
  chemically synthesized
attgagataagaagcttgag

SEQ ID NO: 544308 - DNA, 20 bp, Artificial Sequence
  chemically synthesized
gtaggcagctaaagatcaca

SEQ ID NO: 544309 - DNA, 20 bp, Artificial Sequence
  chemically synthesized
taaatcttgaaatgcatggc

SEQ ID NO: 544310 - DNA, 20 bp, Artificial Sequence
  chemically synthesized
agagaggtgagatcagaggc

SEQ ID NO: 544311 - DNA, 20 bp, Artificial Sequence
  chemically synthesized
aaatcagttaaaaatttcat

SEQ ID NO: 544312 - DNA, 20 bp, Artificial Sequence
  chemically synthesized
agagtgaaggcagcaaggat

SEQ ID NO: 544313 - DNA, 20 bp, Artificial Sequence
  chemically synthesized
agaaaaaaataacaaactaa

SEQ ID NO: 544314 - DNA, 20 bp, Artificial Sequence
  chemically synthesized
gtcattcacatcatagtctc

SEQ ID NO: 544315 - DNA, 20 bp, Artificial Sequence
  chemically synthesized
aactatattttagattccag

SEQ ID NO: 544316 - DNA, 20 bp, Artificial Sequence
  chemically synthesized
acatcaggagagagggagag

SEQ ID NO: 544317 - DNA, 20 bp, Artificial Sequence
  chemically synthesized
caaaaaataaagcatcataa

SEQ ID NO: 544318 - DNA, 20 bp, Artificial Sequence
  chemically synthesized
gacagggaagatatactctg

SEQ ID NO: 544319 - DNA, 20 bp, Artificial Sequence
  chemically synthesized
aaacaggagagaacaatgtc

SEQ ID NO: 544320 - DNA, 20 bp, Artificial Sequence
  chemically synthesized
aatgtcccagaaactgcagg

SEQ ID NO: 544321 - DNA, 20 bp, Artificial Sequence
  chemically synthesized
tgacctttgtcttgtgcttg

SEQ ID NO: 544322 - DNA, 20 bp, Artificial Sequence
  chemically synthesized
agagtatgagagggtaaagg

SEQ ID NO: 544323 - DNA, 20 bp, Artificial Sequence
  chemically synthesized
attttgttcgttttttgagt

SEQ ID NO: 544324 - DNA, 20 bp, Artificial Sequence
  chemically synthesized
cttccagaatgcaaggcgta

SEQ ID NO: 544325 - DNA, 20 bp, Artificial Sequence
  chemically synthesized
cttttacgccttgcattctg

SEQ ID NO: 544326 - DNA, 20 bp, Artificial Sequence
  chemically synthesized
ctatgtgaaaatgtattctt

SEQ ID NO: 544327 - DNA, 20 bp, Artificial Sequence
  chemically synthesized
atgctcaattcaagctgtga

SEQ ID NO: 544328 - DNA, 20 bp, Artificial Sequence
  chemically synthesized
gacatcacacaggtaacgaa

SEQ ID NO: 544329 - DNA, 20 bp, Artificial Sequence
  chemically synthesized
ccatatgcttgtttcatcca

SEQ ID NO: 544330 - DNA, 20 bp, Artificial Sequence
  chemically synthesized
ccagatggcctgaagcaact

SEQ ID NO: 544331 - DNA, 20 bp, Artificial Sequence
  chemically synthesized
gacccccgcccctgcccaca

SEQ ID NO: 544332 - DNA, 20 bp, Artificial Sequence
  chemically synthesized
atgggggctgtcataaggaa

SEQ ID NO: 544333 - DNA, 20 bp, Artificial Sequence
  chemically synthesized
tgggccctaaatcagtagca

SEQ ID NO: 544334 - DNA, 20 bp, Artificial Sequence
  chemically synthesized
cagaatcacgtgggaccttg

SEQ ID NO: 544335 - DNA, 20 bp, Artificial Sequence
  chemically synthesized
aataggcgtggagtggtgcc

SEQ ID NO: 544336 - DNA, 20 bp, Artificial Sequence
  chemically synthesized
tgggcaccactccacgccta

SEQ ID NO: 544337 - DNA, 20 bp, Artificial Sequence
  chemically synthesized
ccactccacgcctattagaa

SEQ ID NO: 544338 - DNA, 20 bp, Artificial Sequence
  chemically synthesized
cccttcccaaacctgctgaa

SEQ ID NO: 544339 - DNA, 20 bp, Artificial Sequence
  chemically synthesized
ctagagaatgctatgggatc

SEQ ID NO: 544340 - DNA, 20 bp, Artificial Sequence
  chemically synthesized
ctctgatcccatagcattct

SEQ ID NO: 544341 - DNA, 20 bp, Artificial Sequence
  chemically synthesized
aatatagtaatgtgaattct

SEQ ID NO: 544342 - DNA, 20 bp, Artificial Sequence
  chemically synthesized
taaatcaatagcagtgtttt

SEQ ID NO: 544343 - DNA, 20 bp, Artificial Sequence
  chemically synthesized
gattatgttgtcttatgcat

SEQ ID NO: 544344 - DNA, 20 bp, Artificial Sequence
  chemically synthesized
taaaaaaaaaaaaaaaagaa

SEQ ID NO: 544345 - DNA, 20 bp, Artificial Sequence
  chemically synthesized
ttttgttaaaaaaaaaaaaa

SEQ ID NO: 544346 - DNA, 20 bp, Artificial Sequence
  chemically synthesized
atgacattgcaactataaca

SEQ ID NO: 544347 - DNA, 20 bp, Artificial Sequence
  chemically synthesized
gtttacaggttaattgaggt

SEQ ID NO: 544348 - DNA, 20 bp, Artificial Sequence
  chemically synthesized
tttgcctattggcacagccc

SEQ ID NO: 544349 - DNA, 20 bp, Artificial Sequence
  chemically synthesized
tacaactttcagattttagt

SEQ ID NO: 544350 - DNA, 20 bp, Artificial Sequence
  chemically synthesized
aaattgtgtcacatctctgg

SEQ ID NO: 544351 - DNA, 20 bp, Artificial Sequence
  chemically synthesized
catctggacagcagccataa

SEQ ID NO: 544352 - DNA, 20 bp, Artificial Sequence
  chemically synthesized
gaaaatcaaacaaacaaaaa

SEQ ID NO: 544353 - DNA, 20 bp, Artificial Sequence
  chemically synthesized
aaacagaaacaaactgaaaa

SEQ ID NO: 544354 - DNA, 20 bp, Artificial Sequence
  chemically synthesized
gttaggatgcaggaaatagc

SEQ ID NO: 544355 - DNA, 20 bp, Artificial Sequence
  chemically synthesized
tttccctccagggtaagcag

SEQ ID NO: 544356 - DNA, 20 bp, Artificial Sequence
  chemically synthesized
tatacttttgtagcaaccag

SEQ ID NO: 544357 - DNA, 20 bp, Artificial Sequence
  chemically synthesized
attgcaggaataatttgcta

SEQ ID NO: 544358 - DNA, 20 bp, Artificial Sequence
  chemically synthesized
ttttgcaaatctcagtgtaa

SEQ ID NO: 544359 - DNA, 20 bp, Artificial Sequence
  chemically synthesized
atgcaataaatacaacatat

SEQ ID NO: 544360 - DNA, 20 bp, Artificial Sequence
  chemically synthesized
ctaaatgtaccttagatagt

SEQ ID NO: 544361 - DNA, 20 bp, Artificial Sequence
  chemically synthesized
gatagttaagaaactatgtg

SEQ ID NO: 544362 - DNA, 20 bp, Artificial Sequence
  chemically synthesized
acaattccaggaagagctag

SEQ ID NO: 544363 - DNA, 20 bp, Artificial Sequence
  chemically synthesized
tcctttgttttgacgggcaa

SEQ ID NO: 544364 - DNA, 20 bp, Artificial Sequence
  chemically synthesized
aaggtagacataaaattagt

SEQ ID NO: 544365 - DNA, 20 bp, Artificial Sequence
  chemically synthesized
gacataaaattagtggagaa

SEQ ID NO: 544366 - DNA, 20 bp, Artificial Sequence
  chemically synthesized
tattcattttagtaaatcaa

SEQ ID NO: 544367 - DNA, 20 bp, Artificial Sequence
  chemically synthesized
ctaattataataaataagga

SEQ ID NO: 544368 - DNA, 20 bp, Artificial Sequence
  chemically synthesized
taaataaggaaaagaaagta

SEQ ID NO: 544369 - DNA, 20 bp, Artificial Sequence
  chemically synthesized
ttcctgttttcctcttcaaa

SEQ ID NO: 544370 - DNA, 20 bp, Artificial Sequence
  chemically synthesized
aataaacattatctcaaacc

SEQ ID NO: 544371 - DNA, 20 bp, Artificial Sequence
  chemically synthesized
ctatggtctccaccaccaaa

SEQ ID NO: 544372 - DNA, 20 bp, Artificial Sequence
  chemically synthesized
atgacagttgttttataaag

SEQ ID NO: 544373 - DNA, 20 bp, Artificial Sequence
  chemically synthesized
aaaaatcattgcttttggaa

SEQ ID NO: 544374 - DNA, 20 bp, Artificial Sequence
  chemically synthesized
gctactcgggaggttgaggc

SEQ ID NO: 544375 - DNA, 20 bp, Artificial Sequence
  chemically synthesized
ctgtctcaaaataaaagaag

SEQ ID NO: 544376 - DNA, 20 bp, Artificial Sequence
  chemically synthesized
atttatgttagcttttattt

SEQ ID NO: 544377 - DNA, 20 bp, Artificial Sequence
  chemically synthesized
agaagtcccattgggcacat

SEQ ID NO: 544378 - DNA, 20 bp, Artificial Sequence
  chemically synthesized
cttattattggctcctgttt

SEQ ID NO: 544379 - DNA, 20 bp, Artificial Sequence
  chemically synthesized
gtcttcaggacttgcctaat

SEQ ID NO: 544380 - DNA, 20 bp, Artificial Sequence
  chemically synthesized
acatcttactaggaataata

SEQ ID NO: 544381 - DNA, 20 bp, Artificial Sequence
  chemically synthesized
gcactctactcacgatggta

SEQ ID NO: 544382 - DNA, 20 bp, Artificial Sequence
  chemically synthesized
cctgaaagttgttgccacaa

SEQ ID NO: 544383 - DNA, 20 bp, Artificial Sequence
  chemically synthesized
tatttattacctatcctatc

SEQ ID NO: 544384 - DNA, 20 bp, Artificial Sequence
  chemically synthesized
caaatggttgaaaataatca

SEQ ID NO: 544385 - DNA, 20 bp, Artificial Sequence
  chemically synthesized
agccaagctgacacaaccag

SEQ ID NO: 544386 - DNA, 20 bp, Artificial Sequence
  chemically synthesized
aaataccatgtcagatgttc

SEQ ID NO: 544387 - DNA, 20 bp, Artificial Sequence
  chemically synthesized
aactcatggaacacttgaca

SEQ ID NO: 544388 - DNA, 20 bp, Artificial Sequence
  chemically synthesized
tgtttttaagcagcatatgt

SEQ ID NO: 544389 - DNA, 20 bp, Artificial Sequence
  chemically synthesized
tttaacgttctttcttaatc

SEQ ID NO: 544390 - DNA, 20 bp, Artificial Sequence
  chemically synthesized
agttattgtaattctaagat

SEQ ID NO: 544391 - DNA, 20 bp, Artificial Sequence
  chemically synthesized
actgatctttttgtgactat

SEQ ID NO: 544392 - DNA, 20 bp, Artificial Sequence
  chemically synthesized
aaagtcttatcttgaaggtg

SEQ ID NO: 544393 - DNA, 20 bp, Artificial Sequence
  chemically synthesized
acaagcaggccctttataag

SEQ ID NO: 544394 - DNA, 20 bp, Artificial Sequence
  chemically synthesized
ttataaggaagaaaaaaaaa

SEQ ID NO: 544395 - DNA, 20 bp, Artificial Sequence
  chemically synthesized
aaggaagaaaaaaaaaaaag

SEQ ID NO: 544396 - DNA, 20 bp, Artificial Sequence
  chemically synthesized
aagaaaaaaaaaaaagaaag

SEQ ID NO: 544397 - DNA, 20 bp, Artificial Sequence
  chemically synthesized
ctggggtgaaagaagaaact

SEQ ID NO: 544398 - DNA, 20 bp, Artificial Sequence
  chemically synthesized
ctatagtttcttctttcacc

SEQ ID NO: 544399 - DNA, 20 bp, Artificial Sequence
  chemically synthesized
tggtgttttctggggtgaaa

SEQ ID NO: 544400 - DNA, 20 bp, Artificial Sequence
  chemically synthesized
cacaagaaatcactatcgca

SEQ ID NO: 544401 - DNA, 20 bp, Artificial Sequence
  chemically synthesized
agtacattttaaaactttca

SEQ ID NO: 544402 - DNA, 20 bp, Artificial Sequence
  chemically synthesized
tgtaatgtcagttaatgtag

SEQ ID NO: 544403 - DNA, 20 bp, Artificial Sequence
  chemically synthesized
ttttcacttcagcaatattt

SEQ ID NO: 544404 - DNA, 20 bp, Artificial Sequence
  chemically synthesized
cttttatctgcaaatgaagt

SEQ ID NO: 544405 - DNA, 20 bp, Artificial Sequence
  chemically synthesized
gctctcaccttttcctaatt

SEQ ID NO: 544406 - DNA, 20 bp, Artificial Sequence
  chemically synthesized
gaaacagaggtcagacattg

SEQ ID NO: 544407 - DNA, 20 bp, Artificial Sequence
  chemically synthesized
ggagtggcaaaggaaaataa

SEQ ID NO: 544408 - DNA, 20 bp, Artificial Sequence
  chemically synthesized
aaataaggggtgggggcaga

SEQ ID NO: 544409 - DNA, 20 bp, Artificial Sequence
  chemically synthesized
acagcatgtagaattaacta

SEQ ID NO: 544410 - DNA, 20 bp, Artificial Sequence
  chemically synthesized
gtaaacattttaaacagcat

SEQ ID NO: 544411 - DNA, 20 bp, Artificial Sequence
  chemically synthesized
taaatgcttattaatagttt

SEQ ID NO: 544412 - DNA, 20 bp, Artificial Sequence
  chemically synthesized
cactggagacacttcttggt

SEQ ID NO: 544413 - DNA, 20 bp, Artificial Sequence
  chemically synthesized
tgagaggagctctgtgagac

SEQ ID NO: 544414 - DNA, 20 bp, Artificial Sequence
  chemically synthesized
ttggtaggctaaaaggatac

SEQ ID NO: 544415 - DNA, 20 bp, Artificial Sequence
  chemically synthesized
aaaacctgtgcttggcaaat

SEQ ID NO: 544416 - DNA, 20 bp, Artificial Sequence
  chemically synthesized
gatctccatagattcattat

SEQ ID NO: 544417 - DNA, 20 bp, Artificial Sequence
  chemically synthesized
caagttatgtcaagatgaaa

SEQ ID NO: 544418 - DNA, 20 bp, Artificial Sequence
  chemically synthesized
ttagttttatttctagtcaa

SEQ ID NO: 544419 - DNA, 20 bp, Artificial Sequence
  chemically synthesized
aaactacattttctttttga

SEQ ID NO: 544420 - DNA, 20 bp, Artificial Sequence
  chemically synthesized
atttgaatattttttaacca

SEQ ID NO: 544421 - DNA, 20 bp, Artificial Sequence
  chemically synthesized
catgagaaaacttgctttgc

SEQ ID NO: 544422 - DNA, 20 bp, Artificial Sequence
  chemically synthesized
ttctagcctccactgtatgc

SEQ ID NO: 544423 - DNA, 20 bp, Artificial Sequence
  chemically synthesized
gaagataatattttgcagat

SEQ ID NO: 544424 - DNA, 20 bp, Artificial Sequence
  chemically synthesized
cctaattttaaacatacaga

SEQ ID NO: 544425 - DNA, 20 bp, Artificial Sequence
  chemically synthesized
catgaattagcttggtattt

SEQ ID NO: 544426 - DNA, 20 bp, Artificial Sequence
  chemically synthesized
accacgaaaatattaatatt

SEQ ID NO: 544427 - DNA, 20 bp, Artificial Sequence
  chemically synthesized
taaaaatatactcaaccttt

SEQ ID NO: 544428 - DNA, 20 bp, Artificial Sequence
  chemically synthesized
aatatactcaaccttttaag

SEQ ID NO: 544429 - DNA, 20 bp, Artificial Sequence
  chemically synthesized
tacttcatttccttcgggat

SEQ ID NO: 544430 - DNA, 20 bp, Artificial Sequence
  chemically synthesized
tttccttcgggatggagaaa

SEQ ID NO: 544431 - DNA, 20 bp, Artificial Sequence
  chemically synthesized
tcaaaacctacttcatacaa

SEQ ID NO: 544432 - DNA, 20 bp, Artificial Sequence
  chemically synthesized
tattgacacttaattatgtg

SEQ ID NO: 544433 - DNA, 20 bp, Artificial Sequence
  chemically synthesized
agagctcactactccctgaa

SEQ ID NO: 544434 - DNA, 20 bp, Artificial Sequence
  chemically synthesized
gggaaagtttgcttgcatgc

SEQ ID NO: 544435 - DNA, 20 bp, Artificial Sequence
  chemically synthesized
ttcaaatcttagaatatcag

SEQ ID NO: 544436 - DNA, 20 bp, Artificial Sequence
  chemically synthesized
tgattattagatttcaaatc

SEQ ID NO: 544437 - DNA, 20 bp, Artificial Sequence
  chemically synthesized
ttgactatggtgtccaaagc

SEQ ID NO: 544438 - DNA, 20 bp, Artificial Sequence
  chemically synthesized
tttggacaccatagtcaatc

SEQ ID NO: 544439 - DNA, 20 bp, Artificial Sequence
  chemically synthesized
gctgaataacttacacagtt

SEQ ID NO: 544440 - DNA, 20 bp, Artificial Sequence
  chemically synthesized
tcaataaacattagaatttt

SEQ ID NO: 544441 - DNA, 20 bp, Artificial Sequence
  chemically synthesized
gaatatatattcaataaaca

SEQ ID NO: 544442 - DNA, 20 bp, Artificial Sequence
  chemically synthesized
atatattcactataggacat

SEQ ID NO: 544443 - DNA, 20 bp, Artificial Sequence
  chemically synthesized
gacattcagaaatgagtaaa

SEQ ID NO: 544444 - DNA, 20 bp, Artificial Sequence
  chemically synthesized
tctgttttcataacatttaa

SEQ ID NO: 544445 - DNA, 20 bp, Artificial Sequence
  chemically synthesized
aaatgttaaaatgctagctg

SEQ ID NO: 544446 - DNA, 20 bp, Artificial Sequence
  chemically synthesized
gttgtttccaaaagttactg

SEQ ID NO: 544447 - DNA, 20 bp, Artificial Sequence
  chemically synthesized
aacattggttgatttttgac

SEQ ID NO: 544448 - DNA, 20 bp, Artificial Sequence
  chemically synthesized
tgatttttgacagagaaagt

SEQ ID NO: 544449 - DNA, 20 bp, Artificial Sequence
  chemically synthesized
acagaaatatacactgtgca

SEQ ID NO: 544450 - DNA, 20 bp, Artificial Sequence
  chemically synthesized
actttggaaactaaaggaat

SEQ ID NO: 544451 - DNA, 20 bp, Artificial Sequence
  chemically synthesized
aaaatgttgcatttgtaagc

SEQ ID NO: 544452 - DNA, 20 bp, Artificial Sequence
  chemically synthesized
ccatagatcttaatatataa

SEQ ID NO: 544453 - DNA, 20 bp, Artificial Sequence
  chemically synthesized
tactcctgtcactcaatgca

SEQ ID NO: 544454 - DNA, 20 bp, Artificial Sequence
  chemically synthesized
gaggaaaacttcaagcatga

SEQ ID NO: 544455 - DNA, 20 bp, Artificial Sequence
  chemically synthesized
ttaatatggcagagtcaaaa

SEQ ID NO: 544456 - DNA, 20 bp, Artificial Sequence
  chemically synthesized
atggcagagtcaaaactaga

SEQ ID NO: 544457 - DNA, 20 bp, Artificial Sequence
  chemically synthesized
aatagactcataatcaaaat

SEQ ID NO: 544458 - DNA, 20 bp, Artificial Sequence
  chemically synthesized
actctaaaatgatatcatga

SEQ ID NO: 544459 - DNA, 20 bp, Artificial Sequence
  chemically synthesized
taaaatgaatagtattttaa

SEQ ID NO: 544460 - DNA, 20 bp, Artificial Sequence
  chemically synthesized
tagtaaaaatgggaaatagt

SEQ ID NO: 544461 - DNA, 20 bp, Artificial Sequence
  chemically synthesized
gttactcttactttaaagat

SEQ ID NO: 544462 - DNA, 20 bp, Artificial Sequence
  chemically synthesized
cttgcttgtaacacacctgt

SEQ ID NO: 544463 - DNA, 20 bp, Artificial Sequence
  chemically synthesized
agggcttcctgttcaagacc

SEQ ID NO: 544464 - DNA, 20 bp, Artificial Sequence
  chemically synthesized
tatgtagccagtcctggttt

SEQ ID NO: 544465 - DNA, 20 bp, Artificial Sequence
  chemically synthesized
cttcaaatttccctgagcgt

SEQ ID NO: 544466 - DNA, 20 bp, Artificial Sequence
  chemically synthesized
ctaaacgctcagggaaattt

SEQ ID NO: 544467 - DNA, 20 bp, Artificial Sequence
  chemically synthesized
tatgagtaagaaggttgagt

SEQ ID NO: 544468 - DNA, 20 bp, Artificial Sequence
  chemically synthesized
aaatttacattttctcattc

SEQ ID NO: 544469 - DNA, 20 bp, Artificial Sequence
  chemically synthesized
tcttccaatttttctcagaa

SEQ ID NO: 544470 - DNA, 20 bp, Artificial Sequence
  chemically synthesized
aaatgctcttccaatttttc

SEQ ID NO: 544471 - DNA, 20 bp, Artificial Sequence
  chemically synthesized
tgggaaaaacaaactatgct

SEQ ID NO: 544472 - DNA, 20 bp, Artificial Sequence
  chemically synthesized
acaagtggaagagaagatgg

SEQ ID NO: 544473 - DNA, 20 bp, Artificial Sequence
  chemically synthesized
taaaaaatgcacatttaaaa

SEQ ID NO: 544474 - DNA, 20 bp, Artificial Sequence
  chemically synthesized
aagtacatcaaagcaaattt

SEQ ID NO: 544475 - DNA, 20 bp, Artificial Sequence
  chemically synthesized
ctaataaactggagacagtg

SEQ ID NO: 544476 - DNA, 20 bp, Artificial Sequence
  chemically synthesized
ttaacaactgggacacattc

SEQ ID NO: 544477 - DNA, 20 bp, Artificial Sequence
  chemically synthesized
attgtctaaggatgaatttc

SEQ ID NO: 544478 - DNA, 20 bp, Artificial Sequence
  chemically synthesized
agttgggcataaaacaatct

SEQ ID NO: 544479 - DNA, 20 bp, Artificial Sequence
  chemically synthesized
tggaccacagtgcaataaaa

SEQ ID NO: 544480 - DNA, 20 bp, Artificial Sequence
  chemically synthesized
gggtaaacaataaaattaag

SEQ ID NO: 544481 - DNA, 20 bp, Artificial Sequence
  chemically synthesized
aataaaattaaggcagaaat

SEQ ID NO: 544482 - DNA, 20 bp, Artificial Sequence
  chemically synthesized
atttaaaaagatgtaacata

SEQ ID NO: 544483 - DNA, 20 bp, Artificial Sequence
  chemically synthesized
aaaacgaacatcacaaggaa

SEQ ID NO: 544484 - DNA, 20 bp, Artificial Sequence
  chemically synthesized
aaaatgagatgcaaaaaagc

SEQ ID NO: 544485 - DNA, 20 bp, Artificial Sequence
  chemically synthesized
tctttattattaattatttc

SEQ ID NO: 544486 - DNA, 20 bp, Artificial Sequence
  chemically synthesized
taataaagatagaccactac

SEQ ID NO: 544487 - DNA, 20 bp, Artificial Sequence
  chemically synthesized
agaccactacctagaataat

SEQ ID NO: 544488 - DNA, 20 bp, Artificial Sequence
  chemically synthesized
gggatgttaccattgacccc

SEQ ID NO: 544489 - DNA, 20 bp, Artificial Sequence
  chemically synthesized
accattgaccccacagaaat

SEQ ID NO: 544490 - DNA, 20 bp, Artificial Sequence
  chemically synthesized
aacacccctatgcacacaag

SEQ ID NO: 544491 - DNA, 20 bp, Artificial Sequence
  chemically synthesized
tagaagcaatggataaattg

SEQ ID NO: 544492 - DNA, 20 bp, Artificial Sequence
  chemically synthesized
actttccaagtttgaaccag

SEQ ID NO: 544493 - DNA, 20 bp, Artificial Sequence
  chemically synthesized
aggaacaaaaagcccaccaa

SEQ ID NO: 544494 - DNA, 20 bp, Artificial Sequence
  chemically synthesized
atcaggacaatgcttccctc

SEQ ID NO: 544495 - DNA, 20 bp, Artificial Sequence
  chemically synthesized
gcagacacacaacaaccaaa

SEQ ID NO: 544496 - DNA, 20 bp, Artificial Sequence
  chemically synthesized
catagatgcaaaaatagtca

SEQ ID NO: 544497 - DNA, 20 bp, Artificial Sequence
  chemically synthesized
acatgatcatttcagtagat

SEQ ID NO: 544498 - DNA, 20 bp, Artificial Sequence
  chemically synthesized
aaatctcattgaacatagta

SEQ ID NO: 544499 - DNA, 20 bp, Artificial Sequence
  chemically synthesized
ctagccaaagcaatcaggaa

SEQ ID NO: 544500 - DNA, 20 bp, Artificial Sequence
  chemically synthesized
gtcccattcataattgtcaa

SEQ ID NO: 544501 - DNA, 20 bp, Artificial Sequence
  chemically synthesized
gaggtgaaacactgctaaac

SEQ ID NO: 544502 - DNA, 20 bp, Artificial Sequence
  chemically synthesized
aaaaatattctatgctcatg

SEQ ID NO: 544503 - DNA, 20 bp, Artificial Sequence
  chemically synthesized
atattgattcttccatgagc

SEQ ID NO: 544504 - DNA, 20 bp, Artificial Sequence
  chemically synthesized
tcatggaagaatcaatattg

SEQ ID NO: 544505 - DNA, 20 bp, Artificial Sequence
  chemically synthesized
caataacattcttcactgaa

SEQ ID NO: 544506 - DNA, 20 bp, Artificial Sequence
  chemically synthesized
tagtctttttcttattcagt

SEQ ID NO: 544507 - DNA, 20 bp, Artificial Sequence
  chemically synthesized
agttggagccactaaaagag

SEQ ID NO: 544508 - DNA, 20 bp, Artificial Sequence
  chemically synthesized
gccaaggtaatcctaagcaa

SEQ ID NO: 544509 - DNA, 20 bp, Artificial Sequence
  chemically synthesized
cagacacataaaccaatgga

SEQ ID NO: 544510 - DNA, 20 bp, Artificial Sequence
  chemically synthesized
aatggaaaagaatagagagt

SEQ ID NO: 544511 - DNA, 20 bp, Artificial Sequence
  chemically synthesized
taaagaacttctacacaaca

SEQ ID NO: 544512 - DNA, 20 bp, Artificial Sequence
  chemically synthesized
acagagtaaacagacaacct

SEQ ID NO: 544513 - DNA, 20 bp, Artificial Sequence
  chemically synthesized
aacagacaacctgcagaatg

SEQ ID NO: 544514 - DNA, 20 bp, Artificial Sequence
  chemically synthesized
gcaaaggacatgaacccttt

SEQ ID NO: 544515 - DNA, 20 bp, Artificial Sequence
  chemically synthesized
ttccagaaaaagacatacat

SEQ ID NO: 544516 - DNA, 20 bp, Artificial Sequence
  chemically synthesized
aagataccatttgacaccag

SEQ ID NO: 544517 - DNA, 20 bp, Artificial Sequence
  chemically synthesized
acagatgctggcaaggttgc

SEQ ID NO: 544518 - DNA, 20 bp, Artificial Sequence
  chemically synthesized
gatttcccaaacaacgaaaa

SEQ ID NO: 544519 - DNA, 20 bp, Artificial Sequence
  chemically synthesized
acaattattgggtataccaa

SEQ ID NO: 544520 - DNA, 20 bp, Artificial Sequence
  chemically synthesized
atctcttttttcatggctgc

SEQ ID NO: 544521 - DNA, 20 bp, Artificial Sequence
  chemically synthesized
gtttatctcccacttagaag

SEQ ID NO: 544522 - DNA, 20 bp, Artificial Sequence
  chemically synthesized
aacaaaatgaatttaaaatt

SEQ ID NO: 544523 - DNA, 20 bp, Artificial Sequence
  chemically synthesized
cccttcctccaacactgaag

SEQ ID NO: 544524 - DNA, 20 bp, Artificial Sequence
  chemically synthesized
gagaacaaagagacaattta

SEQ ID NO: 544525 - DNA, 20 bp, Artificial Sequence
  chemically synthesized
taaatgctcacatcaaatag

SEQ ID NO: 544526 - DNA, 20 bp, Artificial Sequence
  chemically synthesized
gcaaaccaagagcaaacaaa

SEQ ID NO: 544527 - DNA, 20 bp, Artificial Sequence
  chemically synthesized
cttctagttagactaataag

SEQ ID NO: 544528 - DNA, 20 bp, Artificial Sequence
  chemically synthesized
ctaataaggaagaaaagaga

SEQ ID NO: 544529 - DNA, 20 bp, Artificial Sequence
  chemically synthesized
ggaatatcaccaataattct

SEQ ID NO: 544530 - DNA, 20 bp, Artificial Sequence
  chemically synthesized
tgatggttgtttgtatttct

SEQ ID NO: 544531 - DNA, 20 bp, Artificial Sequence
  chemically synthesized
aacacctctatgcacataaa

SEQ ID NO: 544532 - DNA, 20 bp, Artificial Sequence
  chemically synthesized
ttatggttcagtcttagagg

SEQ ID NO: 544533 - DNA, 20 bp, Artificial Sequence
  chemically synthesized
agctcttctttgtaccgcta

SEQ ID NO: 544534 - DNA, 20 bp, Artificial Sequence
  chemically synthesized
gacctcataatataagtttg

SEQ ID NO: 544535 - DNA, 20 bp, Artificial Sequence
  chemically synthesized
gagagagagagagaaggaaa

SEQ ID NO: 544536 - DNA, 20 bp, Artificial Sequence
  chemically synthesized
gagagagagaaggaaagaag

SEQ ID NO: 544537 - DNA, 20 bp, Artificial Sequence
  chemically synthesized
gagagaaggaaagaagaaag

SEQ ID NO: 544538 - DNA, 20 bp, Artificial Sequence
  chemically synthesized
gaaggaaagaagaaagaaag

SEQ ID NO: 544539 - DNA, 20 bp, Artificial Sequence
  chemically synthesized
gaaagaagaaagaaagaaag

SEQ ID NO: 544540 - DNA, 20 bp, Artificial Sequence
  chemically synthesized
gaagaaagaaagaaagaaag

SEQ ID NO: 544541 - DNA, 20 bp, Artificial Sequence
  chemically synthesized
aaagaaagaaagaaagaaag

SEQ ID NO: 544542 - DNA, 20 bp, Artificial Sequence
  chemically synthesized
aaagaaagaaagaaagaaag

SEQ ID NO: 544543 - DNA, 20 bp, Artificial Sequence
  chemically synthesized
aaagaaagaaagaaagaaag

SEQ ID NO: 544544 - DNA, 20 bp, Artificial Sequence
  chemically synthesized
aaagaaagaaagaaagaaag

SEQ ID NO: 544545 - DNA, 20 bp, Artificial Sequence
  chemically synthesized
aaagaaagaaagaaagaaag

SEQ ID NO: 544546 - DNA, 20 bp, Artificial Sequence
  chemically synthesized
aaagaaagaaagaaagaaag

SEQ ID NO: 544547 - DNA, 20 bp, Artificial Sequence
  chemically synthesized
aaagaaagaaagaaagaaag

SEQ ID NO: 544548 - DNA, 20 bp, Artificial Sequence
  chemically synthesized
aaagaaagaaagaaagaaag

SEQ ID NO: 544549 - DNA, 20 bp, Artificial Sequence
  chemically synthesized
aaagaaagaaagaaagaaag

SEQ ID NO: 544550 - DNA, 20 bp, Artificial Sequence
  chemically synthesized
agaaagagagagagagggag

SEQ ID NO: 544551 - DNA, 20 bp, Artificial Sequence
  chemically synthesized
agagagagagagggagagag

SEQ ID NO: 544552 - DNA, 20 bp, Artificial Sequence
  chemically synthesized
aaagaaagagagagagagag

SEQ ID NO: 544553 - DNA, 20 bp, Artificial Sequence
  chemically synthesized
aaagagagagagagagagag

SEQ ID NO: 544554 - DNA, 20 bp, Artificial Sequence
  chemically synthesized
agagagagagagaaagaaag

SEQ ID NO: 544555 - DNA, 20 bp, Artificial Sequence
  chemically synthesized
agagagagaaagaaagagag

SEQ ID NO: 544556 - DNA, 20 bp, Artificial Sequence
  chemically synthesized
agagaaagaaagagagaaag

SEQ ID NO: 544557 - DNA, 20 bp, Artificial Sequence
  chemically synthesized
tggatttggtttgctggtat

SEQ ID NO: 544558 - DNA, 20 bp, Artificial Sequence
  chemically synthesized
tccttcgatacctagtttat

SEQ ID NO: 544559 - DNA, 20 bp, Artificial Sequence
  chemically synthesized
ctgaccagggcaatcaggga

SEQ ID NO: 544560 - DNA, 20 bp, Artificial Sequence
  chemically synthesized
ccagggcaatcagggaagag

SEQ ID NO: 544561 - DNA, 20 bp, Artificial Sequence
  chemically synthesized
cagatgacatgaacctatat

SEQ ID NO: 544562 - DNA, 20 bp, Artificial Sequence
  chemically synthesized
atactacaaggttacagtca

SEQ ID NO: 544563 - DNA, 20 bp, Artificial Sequence
  chemically synthesized
cagacacatagaccaatgaa

SEQ ID NO: 544564 - DNA, 20 bp, Artificial Sequence
  chemically synthesized
aatgaaacagaatagagaac

SEQ ID NO: 544565 - DNA, 20 bp, Artificial Sequence
  chemically synthesized
tagtgctgggatagtcctat

SEQ ID NO: 544566 - DNA, 20 bp, Artificial Sequence
  chemically synthesized
cccaaacaataaaaacctta

SEQ ID NO: 544567 - DNA, 20 bp, Artificial Sequence
  chemically synthesized
tcagagtaaataaacagcct

SEQ ID NO: 544568 - DNA, 20 bp, Artificial Sequence
  chemically synthesized
aataaacagcctacagaatg

SEQ ID NO: 544569 - DNA, 20 bp, Artificial Sequence
  chemically synthesized
aaggaacttaaacaaattta

SEQ ID NO: 544570 - DNA, 20 bp, Artificial Sequence
  chemically synthesized
atgtgacctaaaacgatatg

SEQ ID NO: 544571 - DNA, 20 bp, Artificial Sequence
  chemically synthesized
actcaacatcattgatcatg

SEQ ID NO: 544572 - DNA, 20 bp, Artificial Sequence
  chemically synthesized
gagataacatctcacgccag

SEQ ID NO: 544573 - DNA, 20 bp, Artificial Sequence
  chemically synthesized
atagatgctggtgaggttgt

SEQ ID NO: 544574 - DNA, 20 bp, Artificial Sequence
  chemically synthesized
tttttctgcctctaagtctt

SEQ ID NO: 544575 - DNA, 20 bp, Artificial Sequence
  chemically synthesized
gatttctcaaagacttagag

SEQ ID NO: 544576 - DNA, 20 bp, Artificial Sequence
  chemically synthesized
cacatgcatgtatctttata

SEQ ID NO: 544577 - DNA, 20 bp, Artificial Sequence
  chemically synthesized
tcatcaatgatagacaagat

SEQ ID NO: 544578 - DNA, 20 bp, Artificial Sequence
  chemically synthesized
cctgaaactgagtgatttat

SEQ ID NO: 544579 - DNA, 20 bp, Artificial Sequence
  chemically synthesized
ggaaagttaaaagtttcaat

SEQ ID NO: 544580 - DNA, 20 bp, Artificial Sequence
  chemically synthesized
agtatctaaatattcaaata

SEQ ID NO: 544581 - DNA, 20 bp, Artificial Sequence
  chemically synthesized
tttgaatatttagatactta

SEQ ID NO: 544582 - DNA, 20 bp, Artificial Sequence
  chemically synthesized
tattgtaatgcctggatcat

SEQ ID NO: 544583 - DNA, 20 bp, Artificial Sequence
  chemically synthesized
gattatcttattcaaaagat

SEQ ID NO: 544584 - DNA, 20 bp, Artificial Sequence
  chemically synthesized
atacacacacatatataaat

SEQ ID NO: 544585 - DNA, 20 bp, Artificial Sequence
  chemically synthesized
acatcataactattatatag

SEQ ID NO: 544586 - DNA, 20 bp, Artificial Sequence
  chemically synthesized
aagatttgcatctctaagca

SEQ ID NO: 544587 - DNA, 20 bp, Artificial Sequence
  chemically synthesized
tatttatatgttgaactttg

SEQ ID NO: 544588 - DNA, 20 bp, Artificial Sequence
  chemically synthesized
tttcaatgtcagtacttatt

SEQ ID NO: 544589 - DNA, 20 bp, Artificial Sequence
  chemically synthesized
tatcatataatatttatttc

SEQ ID NO: 544590 - DNA, 20 bp, Artificial Sequence
  chemically synthesized
taaattggacagacagtttt

SEQ ID NO: 544591 - DNA, 20 bp, Artificial Sequence
  chemically synthesized
tgtctttagtacaaattgta

SEQ ID NO: 544592 - DNA, 20 bp, Artificial Sequence
  chemically synthesized
gtagaggaaggccagatgga

SEQ ID NO: 544593 - DNA, 20 bp, Artificial Sequence
  chemically synthesized
gataatatccatccctaatt

SEQ ID NO: 544594 - DNA, 20 bp, Artificial Sequence
  chemically synthesized
agagtttcacataaaagcaa

SEQ ID NO: 544595 - DNA, 20 bp, Artificial Sequence
  chemically synthesized
tttagaactcgatggccact

SEQ ID NO: 544596 - DNA, 20 bp, Artificial Sequence
  chemically synthesized
tttcctttaaatttataaat

SEQ ID NO: 544597 - DNA, 20 bp, Artificial Sequence
  chemically synthesized
ctccaactataataggtatt

SEQ ID NO: 544598 - DNA, 20 bp, Artificial Sequence
  chemically synthesized
aaaaaaaaaaaaaaaaaaaa

SEQ ID NO: 544599 - DNA, 20 bp, Artificial Sequence
  chemically synthesized
ctacttgggaggctgaggca

SEQ ID NO: 544600 - DNA, 20 bp, Artificial Sequence
  chemically synthesized
ttcctcaggttaaagtttta

SEQ ID NO: 544601 - DNA, 20 bp, Artificial Sequence
  chemically synthesized
tttccttcttacttaaggtc

SEQ ID NO: 544602 - DNA, 20 bp, Artificial Sequence
  chemically synthesized
taagcctgatgccaattaaa

SEQ ID NO: 544603 - DNA, 20 bp, Artificial Sequence
  chemically synthesized
aggtctacaaaatgatgctc

SEQ ID NO: 544604 - DNA, 20 bp, Artificial Sequence
  chemically synthesized
ggttaaaatagaggatcttt

SEQ ID NO: 544605 - DNA, 20 bp, Artificial Sequence
  chemically synthesized
aatagaggatctttaaagaa

SEQ ID NO: 544606 - DNA, 20 bp, Artificial Sequence
  chemically synthesized
tttaaagaatgagaattaac

SEQ ID NO: 544607 - DNA, 20 bp, Artificial Sequence
  chemically synthesized
ctcagaaaagaagaacatgt

SEQ ID NO: 544608 - DNA, 20 bp, Artificial Sequence
  chemically synthesized
ttattatacccaaaatgcaa

SEQ ID NO: 544609 - DNA, 20 bp, Artificial Sequence
  chemically synthesized
acattcaaggatgcccaaaa

SEQ ID NO: 544610 - DNA, 20 bp, Artificial Sequence
  chemically synthesized
ttaagataaaatacatatgc

SEQ ID NO: 544611 - DNA, 20 bp, Artificial Sequence
  chemically synthesized
cttaaagaggtgctcacagt

SEQ ID NO: 544612 - DNA, 20 bp, Artificial Sequence
  chemically synthesized
catacaactttccttattcc

SEQ ID NO: 544613 - DNA, 20 bp, Artificial Sequence
  chemically synthesized
tgtagttttgtggattttta

SEQ ID NO: 544614 - DNA, 20 bp, Artificial Sequence
  chemically synthesized
taaaaaaataaatgtgatag

SEQ ID NO: 544615 - DNA, 20 bp, Artificial Sequence
  chemically synthesized
ctcagcaaactaatgcggga

SEQ ID NO: 544616 - DNA, 20 bp, Artificial Sequence
  chemically synthesized
ctgttcccgcattagtttgc

SEQ ID NO: 544617 - DNA, 20 bp, Artificial Sequence
  chemically synthesized
ccatcaatgatagactggat

SEQ ID NO: 544618 - DNA, 20 bp, Artificial Sequence
  chemically synthesized
ctattcacaatagcaaagac

SEQ ID NO: 544619 - DNA, 20 bp, Artificial Sequence
  chemically synthesized
ggttcctcaaagaactagaa

SEQ ID NO: 544620 - DNA, 20 bp, Artificial Sequence
  chemically synthesized
acagacgctggcatggtttc

SEQ ID NO: 544621 - DNA, 20 bp, Artificial Sequence
  chemically synthesized
agcacaccatctcacgccag

SEQ ID NO: 544622 - DNA, 20 bp, Artificial Sequence
  chemically synthesized
acaaacttccctgagctaga

SEQ ID NO: 544623 - DNA, 20 bp, Artificial Sequence
  chemically synthesized
aacgtaacaggagcggataa

SEQ ID NO: 544624 - DNA, 20 bp, Artificial Sequence
  chemically synthesized
catgaatgacctgatagagc

SEQ ID NO: 544625 - DNA, 20 bp, Artificial Sequence
  chemically synthesized
ctgaatagaccaagcagagg

SEQ ID NO: 544626 - DNA, 20 bp, Artificial Sequence
  chemically synthesized
atcttgctgaaataagacag

SEQ ID NO: 544627 - DNA, 20 bp, Artificial Sequence
  chemically synthesized
taagacaggcagaaaagatt

SEQ ID NO: 544628 - DNA, 20 bp, Artificial Sequence
  chemically synthesized
aggcagaaaagattagagaa

SEQ ID NO: 544629 - DNA, 20 bp, Artificial Sequence
  chemically synthesized
gaaaagattagagaaaaaga

SEQ ID NO: 544630 - DNA, 20 bp, Artificial Sequence
  chemically synthesized
ttccccaaacagtctttgct

SEQ ID NO: 544631 - DNA, 20 bp, Artificial Sequence
  chemically synthesized
tccaggagaacttctccaat

SEQ ID NO: 544632 - DNA, 20 bp, Artificial Sequence
  chemically synthesized
tttttctttcatttaaacct

SEQ ID NO: 544633 - DNA, 20 bp, Artificial Sequence
  chemically synthesized
caattctccaggtttaaatg

SEQ ID NO: 544634 - DNA, 20 bp, Artificial Sequence
  chemically synthesized
aaaatgttaaggacagccag

SEQ ID NO: 544635 - DNA, 20 bp, Artificial Sequence
  chemically synthesized
gggtaacagcagatctctca

SEQ ID NO: 544636 - DNA, 20 bp, Artificial Sequence
  chemically synthesized
ggctaatattcaacaccgtg

SEQ ID NO: 544637 - DNA, 20 bp, Artificial Sequence
  chemically synthesized
atattcaacaccgtgaaaga

SEQ ID NO: 544638 - DNA, 20 bp, Artificial Sequence
  chemically synthesized
gaaagaaaagaatttccaag

SEQ ID NO: 544639 - DNA, 20 bp, Artificial Sequence
  chemically synthesized
agtaagcttcataagtgaag

SEQ ID NO: 544640 - DNA, 20 bp, Artificial Sequence
  chemically synthesized
atcgatcagggccaaggcaa

SEQ ID NO: 544641 - DNA, 20 bp, Artificial Sequence
  chemically synthesized
tgctatctggaggcttacaa

SEQ ID NO: 544642 - DNA, 20 bp, Artificial Sequence
  chemically synthesized
agttattatctctccaacat

SEQ ID NO: 544643 - DNA, 20 bp, Artificial Sequence
  chemically synthesized
ttagaaggtagcctaagaag

SEQ ID NO: 544644 - DNA, 20 bp, Artificial Sequence
  chemically synthesized
ttcttttaaataattagtat

SEQ ID NO: 544645 - DNA, 20 bp, Artificial Sequence
  chemically synthesized
ttctttatactaattattta

SEQ ID NO: 544646 - DNA, 20 bp, Artificial Sequence
  chemically synthesized
cattttctataatgattgtg

SEQ ID NO: 544647 - DNA, 20 bp, Artificial Sequence
  chemically synthesized
atttttctcccacaatcatt

SEQ ID NO: 544648 - DNA, 20 bp, Artificial Sequence
  chemically synthesized
aaattacataaggagaattc

SEQ ID NO: 544649 - DNA, 20 bp, Artificial Sequence
  chemically synthesized
ccttgattaaaattacataa

SEQ ID NO: 544650 - DNA, 20 bp, Artificial Sequence
  chemically synthesized
aggtcaatttaacatggata

SEQ ID NO: 544651 - DNA, 20 bp, Artificial Sequence
  chemically synthesized
aaatggagctactcaggaaa

SEQ ID NO: 544652 - DNA, 20 bp, Artificial Sequence
  chemically synthesized
gtttttgagctcacaggaag

SEQ ID NO: 544653 - DNA, 20 bp, Artificial Sequence
  chemically synthesized
taatttttggaaaggcaatg

SEQ ID NO: 544654 - DNA, 20 bp, Artificial Sequence
  chemically synthesized
agaaaactgaaacataagct

SEQ ID NO: 544655 - DNA, 20 bp, Artificial Sequence
  chemically synthesized
ttacacgctcctattgtggg

SEQ ID NO: 544656 - DNA, 20 bp, Artificial Sequence
  chemically synthesized
agataaaatggaggcataga

SEQ ID NO: 544657 - DNA, 20 bp, Artificial Sequence
  chemically synthesized
aaaaccagtattcttttatt

SEQ ID NO: 544658 - DNA, 20 bp, Artificial Sequence
  chemically synthesized
acttgtataattctataata

SEQ ID NO: 544659 - DNA, 20 bp, Artificial Sequence
  chemically synthesized
gaagccttatttttaattcc

SEQ ID NO: 544660 - DNA, 20 bp, Artificial Sequence
  chemically synthesized
tgatttgattattccaattg

SEQ ID NO: 544661 - DNA, 20 bp, Artificial Sequence
  chemically synthesized
tcagggagcattgtggaaaa

SEQ ID NO: 544662 - DNA, 20 bp, Artificial Sequence
  chemically synthesized
tgagcctaaaataaatgttt

SEQ ID NO: 544663 - DNA, 20 bp, Artificial Sequence
  chemically synthesized
catattcctaaacattttgc

SEQ ID NO: 544664 - DNA, 20 bp, Artificial Sequence
  chemically synthesized
aaagattgccattatttgat

SEQ ID NO: 544665 - DNA, 20 bp, Artificial Sequence
  chemically synthesized
aaaatggtcagttgccgtgt

SEQ ID NO: 544666 - DNA, 20 bp, Artificial Sequence
  chemically synthesized
acgttaaaaaattataattt

SEQ ID NO: 544667 - DNA, 20 bp, Artificial Sequence
  chemically synthesized
acttatcagatgtcaggtct

SEQ ID NO: 544668 - DNA, 20 bp, Artificial Sequence
  chemically synthesized
ttataatgccaggctatgtg

SEQ ID NO: 544669 - DNA, 20 bp, Artificial Sequence
  chemically synthesized
ttgtcttatgtagttggatg

SEQ ID NO: 544670 - DNA, 20 bp, Artificial Sequence
  chemically synthesized
tatgaaatcagcagtctatg

SEQ ID NO: 544671 - DNA, 20 bp, Artificial Sequence
  chemically synthesized
tacactaataaaaaactttc

SEQ ID NO: 544672 - DNA, 20 bp, Artificial Sequence
  chemically synthesized
tgagaaaaatgaaacttagg

SEQ ID NO: 544673 - DNA, 20 bp, Artificial Sequence
  chemically synthesized
agccaactccgttttactct

SEQ ID NO: 544674 - DNA, 20 bp, Artificial Sequence
  chemically synthesized
tccccgttactattgggctg

SEQ ID NO: 544675 - DNA, 20 bp, Artificial Sequence
  chemically synthesized
cttttgcctgtcttgttgtt

SEQ ID NO: 544676 - DNA, 20 bp, Artificial Sequence
  chemically synthesized
ctccaacaacaagacaggca

SEQ ID NO: 544677 - DNA, 20 bp, Artificial Sequence
  chemically synthesized
caagatcttctttcaacact

SEQ ID NO: 544678 - DNA, 20 bp, Artificial Sequence
  chemically synthesized
gttttaaaagcggatctaga

SEQ ID NO: 544679 - DNA, 20 bp, Artificial Sequence
  chemically synthesized
aacaggttttaaaagcggat

SEQ ID NO: 544680 - DNA, 20 bp, Artificial Sequence
  chemically synthesized
gcttttaaaacctgttaaaa

SEQ ID NO: 544681 - DNA, 20 bp, Artificial Sequence
  chemically synthesized
ctgttaaaacaagaaagatc

SEQ ID NO: 544682 - DNA, 20 bp, Artificial Sequence
  chemically synthesized
tatttgctcatttgcataga

SEQ ID NO: 544683 - DNA, 20 bp, Artificial Sequence
  chemically synthesized
gcccgcaaaggatcaaaagt

SEQ ID NO: 544684 - DNA, 20 bp, Artificial Sequence
  chemically synthesized
aaaagttcagaaaaatagag

SEQ ID NO: 544685 - DNA, 20 bp, Artificial Sequence
  chemically synthesized
aattatcccaagaagtttga

SEQ ID NO: 544686 - DNA, 20 bp, Artificial Sequence
  chemically synthesized
agaagtttgaagagaaaaga

SEQ ID NO: 544687 - DNA, 20 bp, Artificial Sequence
  chemically synthesized
tttgaagagaaaagaagaga

SEQ ID NO: 544688 - DNA, 20 bp, Artificial Sequence
  chemically synthesized
aagagaaaagaaactcaaac

SEQ ID NO: 544689 - DNA, 20 bp, Artificial Sequence
  chemically synthesized
agagctaccttgaaatattt

SEQ ID NO: 544690 - DNA, 20 bp, Artificial Sequence
  chemically synthesized
aatcaggtaccaggagtact

SEQ ID NO: 544691 - DNA, 20 bp, Artificial Sequence
  chemically synthesized
ctgaagaaaagctagtgagc

SEQ ID NO: 544692 - DNA, 20 bp, Artificial Sequence
  chemically synthesized
aagctagtgagctgagaaaa

SEQ ID NO: 544693 - DNA, 20 bp, Artificial Sequence
  chemically synthesized
atccaaataatcacagcatt

SEQ ID NO: 544694 - DNA, 20 bp, Artificial Sequence
  chemically synthesized
caaagttactgagtcaagta

SEQ ID NO: 544695 - DNA, 20 bp, Artificial Sequence
  chemically synthesized
taaacaaaggagaagaagga

SEQ ID NO: 544696 - DNA, 20 bp, Artificial Sequence
  chemically synthesized
gaagaaggaagagaaataaa

SEQ ID NO: 544697 - DNA, 20 bp, Artificial Sequence
  chemically synthesized
tgcattgatagctctgaact

SEQ ID NO: 544698 - DNA, 20 bp, Artificial Sequence
  chemically synthesized
tcaattagtttgtcttttac

SEQ ID NO: 544699 - DNA, 20 bp, Artificial Sequence
  chemically synthesized
tcagtatttttctaagtttg

SEQ ID NO: 544700 - DNA, 20 bp, Artificial Sequence
  chemically synthesized
tctattgcattctttcaaac

SEQ ID NO: 544701 - DNA, 20 bp, Artificial Sequence
  chemically synthesized
agactccaactcaaaacaaa

SEQ ID NO: 544702 - DNA, 20 bp, Artificial Sequence
  chemically synthesized
agctactcgtgaggctgaca

SEQ ID NO: 544703 - DNA, 20 bp, Artificial Sequence
  chemically synthesized
attgtgcctctttccatagt

SEQ ID NO: 544704 - DNA, 20 bp, Artificial Sequence
  chemically synthesized
atcctctttgacttacttac

SEQ ID NO: 544705 - DNA, 20 bp, Artificial Sequence
  chemically synthesized
tgacttacttactcagaatg

SEQ ID NO: 544706 - DNA, 20 bp, Artificial Sequence
  chemically synthesized
aacatgtcagaagaggagtg

SEQ ID NO: 544707 - DNA, 20 bp, Artificial Sequence
  chemically synthesized
gttttattattaagccacat

SEQ ID NO: 544708 - DNA, 20 bp, Artificial Sequence
  chemically synthesized
aacagagcaagactccatct

SEQ ID NO: 544709 - DNA, 20 bp, Artificial Sequence
  chemically synthesized
actgaaagacagaaaaagag

SEQ ID NO: 544710 - DNA, 20 bp, Artificial Sequence
  chemically synthesized
tgggagatgactactgaaag

SEQ ID NO: 544711 - DNA, 20 bp, Artificial Sequence
  chemically synthesized
gattattaactgagggagga

SEQ ID NO: 544712 - DNA, 20 bp, Artificial Sequence
  chemically synthesized
attaactgagggaggaaaag

SEQ ID NO: 544713 - DNA, 20 bp, Artificial Sequence
  chemically synthesized
ggggccagatacattagatc

SEQ ID NO: 544714 - DNA, 20 bp, Artificial Sequence
  chemically synthesized
acattagatcatagaattca

SEQ ID NO: 544715 - DNA, 20 bp, Artificial Sequence
  chemically synthesized
acatgtaagacctaagctta

SEQ ID NO: 544716 - DNA, 20 bp, Artificial Sequence
  chemically synthesized
ctatggttaattattgatat

SEQ ID NO: 544717 - DNA, 20 bp, Artificial Sequence
  chemically synthesized
tgccagagacccatagagct

SEQ ID NO: 544718 - DNA, 20 bp, Artificial Sequence
  chemically synthesized
aggtggcaaaaggaagatct

SEQ ID NO: 544719 - DNA, 20 bp, Artificial Sequence
  chemically synthesized
aaaggccagctgggatagta

SEQ ID NO: 544720 - DNA, 20 bp, Artificial Sequence
  chemically synthesized
tctcatcaggaatacgcata

SEQ ID NO: 544721 - DNA, 20 bp, Artificial Sequence
  chemically synthesized
aactcaattttgccaatata

SEQ ID NO: 544722 - DNA, 20 bp, Artificial Sequence
  chemically synthesized
tcccaaagtacaactggtga

SEQ ID NO: 544723 - DNA, 20 bp, Artificial Sequence
  chemically synthesized
gttctcatcttgaaagaaca

SEQ ID NO: 544724 - DNA, 20 bp, Artificial Sequence
  chemically synthesized
agaattacctgaaaggcttg

SEQ ID NO: 544725 - DNA, 20 bp, Artificial Sequence
  chemically synthesized
ccatcttcagacctactgat

SEQ ID NO: 544726 - DNA, 20 bp, Artificial Sequence
  chemically synthesized
cctttgatcccacagccatt

SEQ ID NO: 544727 - DNA, 20 bp, Artificial Sequence
  chemically synthesized
aaacgccaacagtccccaca

SEQ ID NO: 544728 - DNA, 20 bp, Artificial Sequence
  chemically synthesized
cgtgggaagatccaagtcaa

SEQ ID NO: 544729 - DNA, 20 bp, Artificial Sequence
  chemically synthesized
tgaggtgaattataagactt

SEQ ID NO: 544730 - DNA, 20 bp, Artificial Sequence
  chemically synthesized
gggataaaaatgaagggaaa

SEQ ID NO: 544731 - DNA, 20 bp, Artificial Sequence
  chemically synthesized
ttgctgactcaggcagtgaa

SEQ ID NO: 544732 - DNA, 20 bp, Artificial Sequence
  chemically synthesized
aacaaaacctgacagctggt

SEQ ID NO: 544733 - DNA, 20 bp, Artificial Sequence
  chemically synthesized
actatcaaatgacaagacct

SEQ ID NO: 544734 - DNA, 20 bp, Artificial Sequence
  chemically synthesized
gtcaccttgcttgtgaacaa

SEQ ID NO: 544735 - DNA, 20 bp, Artificial Sequence
  chemically synthesized
gggccataaaaatgctcttt

SEQ ID NO: 544736 - DNA, 20 bp, Artificial Sequence
  chemically synthesized
ctatgttaacatttttgtga

SEQ ID NO: 544737 - DNA, 20 bp, Artificial Sequence
  chemically synthesized
aacatagaggcacattattg

SEQ ID NO: 544738 - DNA, 20 bp, Artificial Sequence
  chemically synthesized
ttccaagagaaaatcgagat

SEQ ID NO: 544739 - DNA, 20 bp, Artificial Sequence
  chemically synthesized
atctactcagtttgtttcca

SEQ ID NO: 544740 - DNA, 20 bp, Artificial Sequence
  chemically synthesized
tttacatgtgtaatgagatt

SEQ ID NO: 544741 - DNA, 20 bp, Artificial Sequence
  chemically synthesized
tgttgactagatttaccaat

SEQ ID NO: 544742 - DNA, 20 bp, Artificial Sequence
  chemically synthesized
tctttggaaagtaccacatg

SEQ ID NO: 544743 - DNA, 20 bp, Artificial Sequence
  chemically synthesized
attagatttcatttcctcat

SEQ ID NO: 544744 - DNA, 20 bp, Artificial Sequence
  chemically synthesized
gcttgtgactttttcagcac

SEQ ID NO: 544745 - DNA, 20 bp, Artificial Sequence
  chemically synthesized
agatatattgctagttaaat

SEQ ID NO: 544746 - DNA, 20 bp, Artificial Sequence
  chemically synthesized
atggattacatctccttaaa

SEQ ID NO: 544747 - DNA, 20 bp, Artificial Sequence
  chemically synthesized
catccattcctctagatatg

SEQ ID NO: 544748 - DNA, 20 bp, Artificial Sequence
  chemically synthesized
aagtggtatcacaaaagtga

SEQ ID NO: 544749 - DNA, 20 bp, Artificial Sequence
  chemically synthesized
tggtttacacaactagaatc

SEQ ID NO: 544750 - DNA, 20 bp, Artificial Sequence
  chemically synthesized
taatcagttggtttacacaa

SEQ ID NO: 544751 - DNA, 20 bp, Artificial Sequence
  chemically synthesized
gagggttattagccctaaca

SEQ ID NO: 544752 - DNA, 20 bp, Artificial Sequence
  chemically synthesized
ttaagataagaagagaaaca

SEQ ID NO: 544753 - DNA, 20 bp, Artificial Sequence
  chemically synthesized
cattgggcattaagataaga

SEQ ID NO: 544754 - DNA, 20 bp, Artificial Sequence
  chemically synthesized
atcaaacatcttcctaccaa

SEQ ID NO: 544755 - DNA, 20 bp, Artificial Sequence
  chemically synthesized
ggagccattgagagtttgca

SEQ ID NO: 544756 - DNA, 20 bp, Artificial Sequence
  chemically synthesized
gtgactgccgaaaatagagt

SEQ ID NO: 544757 - DNA, 20 bp, Artificial Sequence
  chemically synthesized
ttgataagaaattattgctc

SEQ ID NO: 544758 - DNA, 20 bp, Artificial Sequence
  chemically synthesized
acaagctagcttattattga

SEQ ID NO: 544759 - DNA, 20 bp, Artificial Sequence
  chemically synthesized
gtggaaaaatttacttaagt

SEQ ID NO: 544760 - DNA, 20 bp, Artificial Sequence
  chemically synthesized
atcaaatctatcaaaaattt

SEQ ID NO: 544761 - DNA, 20 bp, Artificial Sequence
  chemically synthesized
aaattttaagaaatcataaa

SEQ ID NO: 544762 - DNA, 20 bp, Artificial Sequence
  chemically synthesized
tatcagaccggcctctttta

SEQ ID NO: 544763 - DNA, 20 bp, Artificial Sequence
  chemically synthesized
atgataaaattcacagagta

SEQ ID NO: 544764 - DNA, 20 bp, Artificial Sequence
  chemically synthesized
tctttggcaataaatggatt

SEQ ID NO: 544765 - DNA, 20 bp, Artificial Sequence
  chemically synthesized
tctgaaatccatttattgcc

SEQ ID NO: 544766 - DNA, 20 bp, Artificial Sequence
  chemically synthesized
tataaatacctcgagtgttt

SEQ ID NO: 544767 - DNA, 20 bp, Artificial Sequence
  chemically synthesized
gtaactctcacatattattc

SEQ ID NO: 544768 - DNA, 20 bp, Artificial Sequence
  chemically synthesized
aaatagactgacgttgattc

SEQ ID NO: 544769 - DNA, 20 bp, Artificial Sequence
  chemically synthesized
taaaattaataaagtaatac

SEQ ID NO: 544770 - DNA, 20 bp, Artificial Sequence
  chemically synthesized
tcttgataaaacatagcata

SEQ ID NO: 544771 - DNA, 20 bp, Artificial Sequence
  chemically synthesized
tagttttttcccactttaat

SEQ ID NO: 544772 - DNA, 20 bp, Artificial Sequence
  chemically synthesized
ttttataagaccattgaaag

SEQ ID NO: 544773 - DNA, 20 bp, Artificial Sequence
  chemically synthesized
gcctttttagtgcatggctt

SEQ ID NO: 544774 - DNA, 20 bp, Artificial Sequence
  chemically synthesized
aaaaggcactgcaagacatt

SEQ ID NO: 544775 - DNA, 20 bp, Artificial Sequence
  chemically synthesized
aagaacaggtgtgtcatgtg

SEQ ID NO: 544776 - DNA, 20 bp, Artificial Sequence
  chemically synthesized
cttatttaaatgtaagcaga

SEQ ID NO: 544777 - DNA, 20 bp, Artificial Sequence
  chemically synthesized
caccaagtcttgtacctttc

SEQ ID NO: 544778 - DNA, 20 bp, Artificial Sequence
  chemically synthesized
taggtttgaaaatacaccct

SEQ ID NO: 544779 - DNA, 20 bp, Artificial Sequence
  chemically synthesized
aataaaagtctaactactaa

SEQ ID NO: 544780 - DNA, 20 bp, Artificial Sequence
  chemically synthesized
attgaaacaatcttgcataa

SEQ ID NO: 544781 - DNA, 20 bp, Artificial Sequence
  chemically synthesized
tgcctaccatttggattgta

SEQ ID NO: 544782 - DNA, 20 bp, Artificial Sequence
  chemically synthesized
agtaatagaatttaagttac

SEQ ID NO: 544783 - DNA, 20 bp, Artificial Sequence
  chemically synthesized
attgaaaaatctacatagta

SEQ ID NO: 544784 - DNA, 20 bp, Artificial Sequence
  chemically synthesized
tttaatacttttgtaataat

SEQ ID NO: 544785 - DNA, 20 bp, Artificial Sequence
  chemically synthesized
ctcactagagtagtttagaa

SEQ ID NO: 544786 - DNA, 20 bp, Artificial Sequence
  chemically synthesized
agttttctcactagagtagt

SEQ ID NO: 544787 - DNA, 20 bp, Artificial Sequence
  chemically synthesized
ctgtttctaaactactctag

SEQ ID NO: 544788 - DNA, 20 bp, Artificial Sequence
  chemically synthesized
ttttgaaatgcttcctttgc

SEQ ID NO: 544789 - DNA, 20 bp, Artificial Sequence
  chemically synthesized
ttgtaactttttcatataaa

SEQ ID NO: 544790 - DNA, 20 bp, Artificial Sequence
  chemically synthesized
ttaaaggtccaatatatata

SEQ ID NO: 544791 - DNA, 20 bp, Artificial Sequence
  chemically synthesized
tatatattggacctttaaag

SEQ ID NO: 544792 - DNA, 20 bp, Artificial Sequence
  chemically synthesized
attgacgtgctttattttat

SEQ ID NO: 544793 - DNA, 20 bp, Artificial Sequence
  chemically synthesized
tattttatatagaattagag

SEQ ID NO: 544794 - DNA, 20 bp, Artificial Sequence
  chemically synthesized
catatgtagtataaagtaac

SEQ ID NO: 544795 - DNA, 20 bp, Artificial Sequence
  chemically synthesized
ctactggggaggctgaggca

SEQ ID NO: 544796 - DNA, 20 bp, Artificial Sequence
  chemically synthesized
aacgtgactctcctagtcac

SEQ ID NO: 544797 - DNA, 20 bp, Artificial Sequence
  chemically synthesized
tggtgatagattaaacaatt

SEQ ID NO: 544798 - DNA, 20 bp, Artificial Sequence
  chemically synthesized
gcaataacattgatatttat

SEQ ID NO: 544799 - DNA, 20 bp, Artificial Sequence
  chemically synthesized
cataattcaaaataagttga

SEQ ID NO: 544800 - DNA, 20 bp, Artificial Sequence
  chemically synthesized
taaaaaaatgcaagtatgtt

SEQ ID NO: 544801 - DNA, 20 bp, Artificial Sequence
  chemically synthesized
tggttaatagattagttgtg

SEQ ID NO: 544802 - DNA, 20 bp, Artificial Sequence
  chemically synthesized
gggagaaaaaagcttcaaat

SEQ ID NO: 544803 - DNA, 20 bp, Artificial Sequence
  chemically synthesized
atgcatcccattagtacatc

SEQ ID NO: 544804 - DNA, 20 bp, Artificial Sequence
  chemically synthesized
ctatccgtgaaattgcgaag

SEQ ID NO: 544805 - DNA, 20 bp, Artificial Sequence
  chemically synthesized
aagtctatccgtgaaattgc

SEQ ID NO: 544806 - DNA, 20 bp, Artificial Sequence
  chemically synthesized
aggttcccaacttaataagg

SEQ ID NO: 544807 - DNA, 20 bp, Artificial Sequence
  chemically synthesized
agttgggaaccttttcacat

SEQ ID NO: 544808 - DNA, 20 bp, Artificial Sequence
  chemically synthesized
ggtggcagttcaaatatgcc

SEQ ID NO: 544809 - DNA, 20 bp, Artificial Sequence
  chemically synthesized
ctcagtacctgtctaggttc

SEQ ID NO: 544810 - DNA, 20 bp, Artificial Sequence
  chemically synthesized
aaaatattaaatgaaaaatt

SEQ ID NO: 544811 - DNA, 20 bp, Artificial Sequence
  chemically synthesized
ttactggcagtcaaccacag

SEQ ID NO: 544812 - DNA, 20 bp, Artificial Sequence
  chemically synthesized
tggtcttgaacttctggccc

SEQ ID NO: 544813 - DNA, 20 bp, Artificial Sequence
  chemically synthesized
acttctggcccccagaatgg

SEQ ID NO: 544814 - DNA, 20 bp, Artificial Sequence
  chemically synthesized
aagatagatggattcttttt

SEQ ID NO: 544815 - DNA, 20 bp, Artificial Sequence
  chemically synthesized
ttagccaagtatttcttgaa

SEQ ID NO: 544816 - DNA, 20 bp, Artificial Sequence
  chemically synthesized
aataataataccaacccgtt

SEQ ID NO: 544817 - DNA, 20 bp, Artificial Sequence
  chemically synthesized
tctattttactgtattcact

SEQ ID NO: 544818 - DNA, 20 bp, Artificial Sequence
  chemically synthesized
gtcttgtgttggaaaccttt

SEQ ID NO: 544819 - DNA, 20 bp, Artificial Sequence
  chemically synthesized
gagtaagataggtttaagca

SEQ ID NO: 544820 - DNA, 20 bp, Artificial Sequence
  chemically synthesized
tgcttaaacctatcttactc

SEQ ID NO: 544821 - DNA, 20 bp, Artificial Sequence
  chemically synthesized
agtgtaagcggaaaagtgaa

SEQ ID NO: 544822 - DNA, 20 bp, Artificial Sequence
  chemically synthesized
ttggccttaatttgaattac

SEQ ID NO: 544823 - DNA, 20 bp, Artificial Sequence
  chemically synthesized
acaaaattgttagacaagtg

SEQ ID NO: 544824 - DNA, 20 bp, Artificial Sequence
  chemically synthesized
aaagaaccactgtattagga

SEQ ID NO: 544825 - DNA, 20 bp, Artificial Sequence
  chemically synthesized
ggattagaaacctcttctct

SEQ ID NO: 544826 - DNA, 20 bp, Artificial Sequence
  chemically synthesized
ctatacgtaaatagaaactc

SEQ ID NO: 544827 - DNA, 20 bp, Artificial Sequence
  chemically synthesized
caagggattcctatacgtaa

SEQ ID NO: 544828 - DNA, 20 bp, Artificial Sequence
  chemically synthesized
cattggttttacatttatgt

SEQ ID NO: 544829 - DNA, 20 bp, Artificial Sequence
  chemically synthesized
cacttactgctgagacaaaa

SEQ ID NO: 544830 - DNA, 20 bp, Artificial Sequence
  chemically synthesized
accaaacaaaggaattcaga

SEQ ID NO: 544831 - DNA, 20 bp, Artificial Sequence
  chemically synthesized
tgaatttactggagccaggg

SEQ ID NO: 544832 - DNA, 20 bp, Artificial Sequence
  chemically synthesized
gggctttatgaaagagggag

SEQ ID NO: 544833 - DNA, 20 bp, Artificial Sequence
  chemically synthesized
tgataaagtaagagaaaaat

SEQ ID NO: 544834 - DNA, 20 bp, Artificial Sequence
  chemically synthesized
gcatagttgttgataaagta

SEQ ID NO: 544835 - DNA, 20 bp, Artificial Sequence
  chemically synthesized
aaacaaaaatccattatgag

SEQ ID NO: 544836 - DNA, 20 bp, Artificial Sequence
  chemically synthesized
atggtgcttcagttcagttt

SEQ ID NO: 544837 - DNA, 20 bp, Artificial Sequence
  chemically synthesized
caggatcatttaaatagaag

SEQ ID NO: 544838 - DNA, 20 bp, Artificial Sequence
  chemically synthesized
ctttcagcacaattgcaaag

SEQ ID NO: 544839 - DNA, 20 bp, Artificial Sequence
  chemically synthesized
gacattaaataatatcctgc

SEQ ID NO: 544840 - DNA, 20 bp, Artificial Sequence
  chemically synthesized
cagtctgttcaattgggata

SEQ ID NO: 544841 - DNA, 20 bp, Artificial Sequence
  chemically synthesized
tattatctctatttcactgg

SEQ ID NO: 544842 - DNA, 20 bp, Artificial Sequence
  chemically synthesized
tgtgataaatctggagcatg

SEQ ID NO: 544843 - DNA, 20 bp, Artificial Sequence
  chemically synthesized
aaacataagctttatcaagt

SEQ ID NO: 544844 - DNA, 20 bp, Artificial Sequence
  chemically synthesized
gataaagcttatgttttata

SEQ ID NO: 544845 - DNA, 20 bp, Artificial Sequence
  chemically synthesized
aaagactctgtctcaaagaa

SEQ ID NO: 544846 - DNA, 20 bp, Artificial Sequence
  chemically synthesized
acagagaaagactctgtctc

SEQ ID NO: 544847 - DNA, 20 bp, Artificial Sequence
  chemically synthesized
tgctctccagcctaggggac

SEQ ID NO: 544848 - DNA, 20 bp, Artificial Sequence
  chemically synthesized
ctacttgggaaactgaggca

SEQ ID NO: 544849 - DNA, 20 bp, Artificial Sequence
  chemically synthesized
acatcacaacttttcatcca

SEQ ID NO: 544850 - DNA, 20 bp, Artificial Sequence
  chemically synthesized
cattttattaggtatgtacg

SEQ ID NO: 544851 - DNA, 20 bp, Artificial Sequence
  chemically synthesized
cataagataatgtaggtgta

SEQ ID NO: 544852 - DNA, 20 bp, Artificial Sequence
  chemically synthesized
ctaaatgaagagcctgtgct

SEQ ID NO: 544853 - DNA, 20 bp, Artificial Sequence
  chemically synthesized
actcctgctctggttactat

SEQ ID NO: 544854 - DNA, 20 bp, Artificial Sequence
  chemically synthesized
atttgctttctctagagagg

SEQ ID NO: 544855 - DNA, 20 bp, Artificial Sequence
  chemically synthesized
taagaatttctaacctctct

SEQ ID NO: 544856 - DNA, 20 bp, Artificial Sequence
  chemically synthesized
gaaaaaaatgtgacatgaac

SEQ ID NO: 544857 - DNA, 20 bp, Artificial Sequence
  chemically synthesized
tagatgcaatagaccaattc

SEQ ID NO: 544858 - DNA, 20 bp, Artificial Sequence
  chemically synthesized
taaacctagcaagcatatta

SEQ ID NO: 544859 - DNA, 20 bp, Artificial Sequence
  chemically synthesized
taaaggaaaaactatgaatc

SEQ ID NO: 544860 - DNA, 20 bp, Artificial Sequence
  chemically synthesized
ccaggtttagtttattacag

SEQ ID NO: 544861 - DNA, 20 bp, Artificial Sequence
  chemically synthesized
gaagaaaggcttttttagca

SEQ ID NO: 544862 - DNA, 20 bp, Artificial Sequence
  chemically synthesized
gtcatgtgatttgacatata

SEQ ID NO: 544863 - DNA, 20 bp, Artificial Sequence
  chemically synthesized
ttgacatatagcagaataaa

SEQ ID NO: 544864 - DNA, 20 bp, Artificial Sequence
  chemically synthesized
aaattttatcatatattttt

SEQ ID NO: 544865 - DNA, 20 bp, Artificial Sequence
  chemically synthesized
tccggtagtgataaaacctc

SEQ ID NO: 544866 - DNA, 20 bp, Artificial Sequence
  chemically synthesized
cttccctctgagacttaaaa

SEQ ID NO: 544867 - DNA, 20 bp, Artificial Sequence
  chemically synthesized
catgaaaaataattggaaag

SEQ ID NO: 544868 - DNA, 20 bp, Artificial Sequence
  chemically synthesized
aaaaataattggaaagggag

SEQ ID NO: 544869 - DNA, 20 bp, Artificial Sequence
  chemically synthesized
atggtacctggatacaagac

SEQ ID NO: 544870 - DNA, 20 bp, Artificial Sequence
  chemically synthesized
ttttctatttgtgctgatat

SEQ ID NO: 544871 - DNA, 20 bp, Artificial Sequence
  chemically synthesized
atttctttatatcagcacaa

SEQ ID NO: 544872 - DNA, 20 bp, Artificial Sequence
  chemically synthesized
acagcaaaaatataaaaacc

SEQ ID NO: 544873 - DNA, 20 bp, Artificial Sequence
  chemically synthesized
aaacccaagaaataaatctc

SEQ ID NO: 544874 - DNA, 20 bp, Artificial Sequence
  chemically synthesized
aaaactataaaacattattg

SEQ ID NO: 544875 - DNA, 20 bp, Artificial Sequence
  chemically synthesized
tattctctggatcaacttgt

SEQ ID NO: 544876 - DNA, 20 bp, Artificial Sequence
  chemically synthesized
gattctgtacaagttgatcc

SEQ ID NO: 544877 - DNA, 20 bp, Artificial Sequence
  chemically synthesized
cttgtgaaccctgcccccaa

SEQ ID NO: 544878 - DNA, 20 bp, Artificial Sequence
  chemically synthesized
tcaagataatctttaaaaag

SEQ ID NO: 544879 - DNA, 20 bp, Artificial Sequence
  chemically synthesized
tttccctaaagtaagcgctc

SEQ ID NO: 544880 - DNA, 20 bp, Artificial Sequence
  chemically synthesized
gatttacatctcaaagaggc

SEQ ID NO: 544881 - DNA, 20 bp, Artificial Sequence
  chemically synthesized
agagatggctcctaggtcct

SEQ ID NO: 544882 - DNA, 20 bp, Artificial Sequence
  chemically synthesized
ttaagcactgaggagagcta

SEQ ID NO: 544883 - DNA, 20 bp, Artificial Sequence
  chemically synthesized
tctactgaaagaaagacagg

SEQ ID NO: 544884 - DNA, 20 bp, Artificial Sequence
  chemically synthesized
tctctcctgtctttctttca

SEQ ID NO: 544885 - DNA, 20 bp, Artificial Sequence
  chemically synthesized
gatggaaatcatttctactg

SEQ ID NO: 544886 - DNA, 20 bp, Artificial Sequence
  chemically synthesized
aaatgcaccagacaaacagg

SEQ ID NO: 544887 - DNA, 20 bp, Artificial Sequence
  chemically synthesized
ctgtatctggtaatattgta

SEQ ID NO: 544888 - DNA, 20 bp, Artificial Sequence
  chemically synthesized
ctattcaggaggttgaggca

SEQ ID NO: 544889 - DNA, 20 bp, Artificial Sequence
  chemically synthesized
gccactgcactccagcctgg

SEQ ID NO: 544890 - DNA, 20 bp, Artificial Sequence
  chemically synthesized
tagcatgaggacaggcaagt

SEQ ID NO: 544891 - DNA, 20 bp, Artificial Sequence
  chemically synthesized
tgtcatctttgacgaaaata

SEQ ID NO: 544892 - DNA, 20 bp, Artificial Sequence
  chemically synthesized
ttttcgtcaaagatgacacc

SEQ ID NO: 544893 - DNA, 20 bp, Artificial Sequence
  chemically synthesized
tgaaacaacaagttggcact

SEQ ID NO: 544894 - DNA, 20 bp, Artificial Sequence
  chemically synthesized
agcaacccaggaccatagct

SEQ ID NO: 544895 - DNA, 20 bp, Artificial Sequence
  chemically synthesized
acaaaagtacactaaacata

SEQ ID NO: 544896 - DNA, 20 bp, Artificial Sequence
  chemically synthesized
aaggcaaggtacccattcaa

SEQ ID NO: 544897 - DNA, 20 bp, Artificial Sequence
  chemically synthesized
aaaaatgtaatataaacagc

SEQ ID NO: 544898 - DNA, 20 bp, Artificial Sequence
  chemically synthesized
atataaacagcaaagaatac

SEQ ID NO: 544899 - DNA, 20 bp, Artificial Sequence
  chemically synthesized
taaactaaaataaatcagta

SEQ ID NO: 544900 - DNA, 20 bp, Artificial Sequence
  chemically synthesized
aataaatcagtaagagaaat

SEQ ID NO: 544901 - DNA, 20 bp, Artificial Sequence
  chemically synthesized
agagaaatatagaaaatcca

SEQ ID NO: 544902 - DNA, 20 bp, Artificial Sequence
  chemically synthesized
gagatgacattataaagtca

SEQ ID NO: 544903 - DNA, 20 bp, Artificial Sequence
  chemically synthesized
gtactttcatttactactgg

SEQ ID NO: 544904 - DNA, 20 bp, Artificial Sequence
  chemically synthesized
atatgcatatacccaatgat

SEQ ID NO: 544905 - DNA, 20 bp, Artificial Sequence
  chemically synthesized
ttttgtattaggtatttacc

SEQ ID NO: 544906 - DNA, 20 bp, Artificial Sequence
  chemically synthesized
aaacaaccccaattttctga

SEQ ID NO: 544907 - DNA, 20 bp, Artificial Sequence
  chemically synthesized
ccacattttacatattctgt

SEQ ID NO: 544908 - DNA, 20 bp, Artificial Sequence
  chemically synthesized
ttattaattttcatcgctgg

SEQ ID NO: 544909 - DNA, 20 bp, Artificial Sequence
  chemically synthesized
aacatactatgattccacat

SEQ ID NO: 544910 - DNA, 20 bp, Artificial Sequence
  chemically synthesized
attatgttaaataagcaggc

SEQ ID NO: 544911 - DNA, 20 bp, Artificial Sequence
  chemically synthesized
ggatctcatagagctagaga

SEQ ID NO: 544912 - DNA, 20 bp, Artificial Sequence
  chemically synthesized
gtattaacacttgcattcat

SEQ ID NO: 544913 - DNA, 20 bp, Artificial Sequence
  chemically synthesized
acacagtgaaacccatctct

SEQ ID NO: 544914 - DNA, 20 bp, Artificial Sequence
  chemically synthesized
ctactcgggagtctgaggta

SEQ ID NO: 544915 - DNA, 20 bp, Artificial Sequence
  chemically synthesized
aaaaaaaaaaaaaaaaaaaa

SEQ ID NO: 544916 - DNA, 20 bp, Artificial Sequence
  chemically synthesized
atttgataatttttatcatg

SEQ ID NO: 544917 - DNA, 20 bp, Artificial Sequence
  chemically synthesized
tcaactcataaattataaag

SEQ ID NO: 544918 - DNA, 20 bp, Artificial Sequence
  chemically synthesized
tcataaattataaagtcaga

SEQ ID NO: 544919 - DNA, 20 bp, Artificial Sequence
  chemically synthesized
ctttggatgttcaaatttca

SEQ ID NO: 544920 - DNA, 20 bp, Artificial Sequence
  chemically synthesized
aatggcacatgattcagtta

SEQ ID NO: 544921 - DNA, 20 bp, Artificial Sequence
  chemically synthesized
ccttactgaacagtgtcgtt

SEQ ID NO: 544922 - DNA, 20 bp, Artificial Sequence
  chemically synthesized
ctgaacagtgtcgttctaga

SEQ ID NO: 544923 - DNA, 20 bp, Artificial Sequence
  chemically synthesized
tagaacaacactgttctaga

SEQ ID NO: 544924 - DNA, 20 bp, Artificial Sequence
  chemically synthesized
tagaacagtgttgttctaga

SEQ ID NO: 544925 - DNA, 20 bp, Artificial Sequence
  chemically synthesized
ctaatcagcaacgggggaat

SEQ ID NO: 544926 - DNA, 20 bp, Artificial Sequence
  chemically synthesized
cccaatctctcaaattcata

SEQ ID NO: 544927 - DNA, 20 bp, Artificial Sequence
  chemically synthesized
actatgaatttgagagattg

SEQ ID NO: 544928 - DNA, 20 bp, Artificial Sequence
  chemically synthesized
tgccaaccctatatcacaaa

SEQ ID NO: 544929 - DNA, 20 bp, Artificial Sequence
  chemically synthesized
aatgttagaccctatcaaat

SEQ ID NO: 544930 - DNA, 20 bp, Artificial Sequence
  chemically synthesized
agtatgagaaagaaaatttt

SEQ ID NO: 544931 - DNA, 20 bp, Artificial Sequence
  chemically synthesized
tatcttcgggatagtatgag

SEQ ID NO: 544932 - DNA, 20 bp, Artificial Sequence
  chemically synthesized
tacatatcttcgggatagta

SEQ ID NO: 544933 - DNA, 20 bp, Artificial Sequence
  chemically synthesized
taactgacatttaggtgatg

SEQ ID NO: 544934 - DNA, 20 bp, Artificial Sequence
  chemically synthesized
atactgtgaaaggtagttgt

SEQ ID NO: 544935 - DNA, 20 bp, Artificial Sequence
  chemically synthesized
aaaataacaaagccacttgg

SEQ ID NO: 544936 - DNA, 20 bp, Artificial Sequence
  chemically synthesized
gtgctatatctcagttacaa

SEQ ID NO: 544937 - DNA, 20 bp, Artificial Sequence
  chemically synthesized
aaatctggataagtagacaa

SEQ ID NO: 544938 - DNA, 20 bp, Artificial Sequence
  chemically synthesized
actgttggtcaaaataattg

SEQ ID NO: 544939 - DNA, 20 bp, Artificial Sequence
  chemically synthesized
gattctcaaaattactttca

SEQ ID NO: 544940 - DNA, 20 bp, Artificial Sequence
  chemically synthesized
ttttcttatgaaagtaattt

SEQ ID NO: 544941 - DNA, 20 bp, Artificial Sequence
  chemically synthesized
ttttaaagctgaagttctct

SEQ ID NO: 544942 - DNA, 20 bp, Artificial Sequence
  chemically synthesized
gaagttctctacagaatgag

SEQ ID NO: 544943 - DNA, 20 bp, Artificial Sequence
  chemically synthesized
cttccaatacaggtggagtg

SEQ ID NO: 544944 - DNA, 20 bp, Artificial Sequence
  chemically synthesized
ccacagctcttatcgcattg

SEQ ID NO: 544945 - DNA, 20 bp, Artificial Sequence
  chemically synthesized
ggtaattaagaggagaaact

SEQ ID NO: 544946 - DNA, 20 bp, Artificial Sequence
  chemically synthesized
ttgttgtaaggtaattaaga

SEQ ID NO: 544947 - DNA, 20 bp, Artificial Sequence
  chemically synthesized
cagacggttggatataattc

SEQ ID NO: 544948 - DNA, 20 bp, Artificial Sequence
  chemically synthesized
aggttcattcagttatctta

SEQ ID NO: 544949 - DNA, 20 bp, Artificial Sequence
  chemically synthesized
cttgtatctgacaatgcagg

SEQ ID NO: 544950 - DNA, 20 bp, Artificial Sequence
  chemically synthesized
taatgtgctttactctttta

SEQ ID NO: 544951 - DNA, 20 bp, Artificial Sequence
  chemically synthesized
tttgataatttcatctatgt

SEQ ID NO: 544952 - DNA, 20 bp, Artificial Sequence
  chemically synthesized
aggtcgtaacatacagggta

SEQ ID NO: 544953 - DNA, 20 bp, Artificial Sequence
  chemically synthesized
ataccttgtaggccaaagta

SEQ ID NO: 544954 - DNA, 20 bp, Artificial Sequence
  chemically synthesized
ttatgatatggcctatacct

SEQ ID NO: 544955 - DNA, 20 bp, Artificial Sequence
  chemically synthesized
taataaatacaagataaggt

SEQ ID NO: 544956 - DNA, 20 bp, Artificial Sequence
  chemically synthesized
cacttatcatgacacctgta

SEQ ID NO: 544957 - DNA, 20 bp, Artificial Sequence
  chemically synthesized
tgccagtgcaatgacaaaaa

SEQ ID NO: 544958 - DNA, 20 bp, Artificial Sequence
  chemically synthesized
atgtgttcagaagataatta

SEQ ID NO: 544959 - DNA, 20 bp, Artificial Sequence
  chemically synthesized
atgacattttgaaaaaccat

SEQ ID NO: 544960 - DNA, 20 bp, Artificial Sequence
  chemically synthesized
ctcagatggcagcatcctgt

SEQ ID NO: 544961 - DNA, 20 bp, Artificial Sequence
  chemically synthesized
cttcacaggatgctgccatc

SEQ ID NO: 544962 - DNA, 20 bp, Artificial Sequence
  chemically synthesized
cagtctgtgattgcattaac

SEQ ID NO: 544963 - DNA, 20 bp, Artificial Sequence
  chemically synthesized
agatgtacgtatgtatatat

SEQ ID NO: 544964 - DNA, 20 bp, Artificial Sequence
  chemically synthesized
ttacatcctattgttttaag

SEQ ID NO: 544965 - DNA, 20 bp, Artificial Sequence
  chemically synthesized
tatagctatgtcctgaggag

SEQ ID NO: 544966 - DNA, 20 bp, Artificial Sequence
  chemically synthesized
ccttctaagttaatatggga

SEQ ID NO: 544967 - DNA, 20 bp, Artificial Sequence
  chemically synthesized
tcctcaaatggcttccttcc

SEQ ID NO: 544968 - DNA, 20 bp, Artificial Sequence
  chemically synthesized
ttcagcacgtaaatcagata

SEQ ID NO: 544969 - DNA, 20 bp, Artificial Sequence
  chemically synthesized
actcacccacgaacactcat

SEQ ID NO: 544970 - DNA, 20 bp, Artificial Sequence
  chemically synthesized
tgctaaaaggttcaggaaaa

SEQ ID NO: 544971 - DNA, 20 bp, Artificial Sequence
  chemically synthesized
cagatgacattaaacaattt

SEQ ID NO: 544972 - DNA, 20 bp, Artificial Sequence
  chemically synthesized
tagcgaatgtagcttagttc

SEQ ID NO: 544973 - DNA, 20 bp, Artificial Sequence
  chemically synthesized
tattaactgcatgagataag

SEQ ID NO: 544974 - DNA, 20 bp, Artificial Sequence
  chemically synthesized
ccaggttttccttcttgaaa

SEQ ID NO: 544975 - DNA, 20 bp, Artificial Sequence
  chemically synthesized
cactctcacagacacacccg

SEQ ID NO: 544976 - DNA, 20 bp, Artificial Sequence
  chemically synthesized
tacatttaggagtttatcat

SEQ ID NO: 544977 - DNA, 20 bp, Artificial Sequence
  chemically synthesized
ttcctaataaaaataattat

SEQ ID NO: 544978 - DNA, 20 bp, Artificial Sequence
  chemically synthesized
agcactttggaaggctgggg

SEQ ID NO: 544979 - DNA, 20 bp, Artificial Sequence
  chemically synthesized
ggagaattaaaagtatatga

SEQ ID NO: 544980 - DNA, 20 bp, Artificial Sequence
  chemically synthesized
aagttactgcctaatatttt

SEQ ID NO: 544981 - DNA, 20 bp, Artificial Sequence
  chemically synthesized
attcaaatgccttttatatg

SEQ ID NO: 544982 - DNA, 20 bp, Artificial Sequence
  chemically synthesized
tctgtgtggtcatagaacca

SEQ ID NO: 544983 - DNA, 20 bp, Artificial Sequence
  chemically synthesized
gctctcaacttttaacttgt

SEQ ID NO: 544984 - DNA, 20 bp, Artificial Sequence
  chemically synthesized
ctctaatgaaaatgtcttcc

SEQ ID NO: 544985 - DNA, 20 bp, Artificial Sequence
  chemically synthesized
tgtttctaataaagaaagaa

SEQ ID NO: 544986 - DNA, 20 bp, Artificial Sequence
  chemically synthesized
tgtttctccttctttcttta

SEQ ID NO: 544987 - DNA, 20 bp, Artificial Sequence
  chemically synthesized
gggagataactgtttctaat

SEQ ID NO: 544988 - DNA, 20 bp, Artificial Sequence
  chemically synthesized
aaagactataaaaagaccat

SEQ ID NO: 544989 - DNA, 20 bp, Artificial Sequence
  chemically synthesized
tgatttaccatttatccatc

SEQ ID NO: 544990 - DNA, 20 bp, Artificial Sequence
  chemically synthesized
ggaggcagactggctcctgg

SEQ ID NO: 544991 - DNA, 20 bp, Artificial Sequence
  chemically synthesized
gcagaaaggagcagatccac

SEQ ID NO: 544992 - DNA, 20 bp, Artificial Sequence
  chemically synthesized
gagaaacccctccttcaagc

SEQ ID NO: 544993 - DNA, 20 bp, Artificial Sequence
  chemically synthesized
ttctgggtggagtttgtggc

SEQ ID NO: 544994 - DNA, 20 bp, Artificial Sequence
  chemically synthesized
atggacatccatggataggc

SEQ ID NO: 544995 - DNA, 20 bp, Artificial Sequence
  chemically synthesized
catggatgtccatggaccaa

SEQ ID NO: 544996 - DNA, 20 bp, Artificial Sequence
  chemically synthesized
agttcttgtcccatgtccag

SEQ ID NO: 544997 - DNA, 20 bp, Artificial Sequence
  chemically synthesized
actcaccatgctatgggcaa

SEQ ID NO: 544998 - DNA, 20 bp, Artificial Sequence
  chemically synthesized
cttgggtgtcactttgccag

SEQ ID NO: 544999 - DNA, 20 bp, Artificial Sequence
  chemically synthesized
tatgatttagatcttagctt

SEQ ID NO: 545000 - DNA, 20 bp, Artificial Sequence
  chemically synthesized
tttaaaaatgagcaaatgtt

SEQ ID NO: 545001 - DNA, 20 bp, Artificial Sequence
  chemically synthesized
tctcagtctccctctttgta

SEQ ID NO: 545002 - DNA, 20 bp, Artificial Sequence
  chemically synthesized
ccaggtaagacagttaaaaa

SEQ ID NO: 545003 - DNA, 20 bp, Artificial Sequence
  chemically synthesized
tcaaatgggatgtggaatgc

SEQ ID NO: 545004 - DNA, 20 bp, Artificial Sequence
  chemically synthesized
tgccagttaacttatttgat

SEQ ID NO: 545005 - DNA, 20 bp, Artificial Sequence
  chemically synthesized
agggacaagctgaacctttg

SEQ ID NO: 545006 - DNA, 20 bp, Artificial Sequence
  chemically synthesized
acaagctgaacctttgagag

SEQ ID NO: 545007 - DNA, 20 bp, Artificial Sequence
  chemically synthesized
attatcggagagcacacttt

SEQ ID NO: 545008 - DNA, 20 bp, Artificial Sequence
  chemically synthesized
ttcataagctatgtcatctt

SEQ ID NO: 545009 - DNA, 20 bp, Artificial Sequence
  chemically synthesized
tgaagaaaaccaaagacagg

SEQ ID NO: 545010 - DNA, 20 bp, Artificial Sequence
  chemically synthesized
gtcttctttggaaaaggttt

SEQ ID NO: 545011 - DNA, 20 bp, Artificial Sequence
  chemically synthesized
tctaaaggtattttaaagtt

SEQ ID NO: 545012 - DNA, 20 bp, Artificial Sequence
  chemically synthesized
aatcctaaaatatcatcata

SEQ ID NO: 545013 - DNA, 20 bp, Artificial Sequence
  chemically synthesized
atatcatcataatagaattt

SEQ ID NO: 545014 - DNA, 20 bp, Artificial Sequence
  chemically synthesized
agcctctggatggcatttca

SEQ ID NO: 545015 - DNA, 20 bp, Artificial Sequence
  chemically synthesized
acaggtatttggatccccta

SEQ ID NO: 545016 - DNA, 20 bp, Artificial Sequence
  chemically synthesized
aattagaagaattacaggaa

SEQ ID NO: 545017 - DNA, 20 bp, Artificial Sequence
  chemically synthesized
gattctggtagacgtaatta

SEQ ID NO: 545018 - DNA, 20 bp, Artificial Sequence
  chemically synthesized
aattcttctaattacgtcta

SEQ ID NO: 545019 - DNA, 20 bp, Artificial Sequence
  chemically synthesized
ccacagtctctgaagctacc

SEQ ID NO: 545020 - DNA, 20 bp, Artificial Sequence
  chemically synthesized
tggtacagaaggaggagtaa

SEQ ID NO: 545021 - DNA, 20 bp, Artificial Sequence
  chemically synthesized
tatatcacttgcaaagaacc

SEQ ID NO: 545022 - DNA, 20 bp, Artificial Sequence
  chemically synthesized
catcagttccttcagtccca

SEQ ID NO: 545023 - DNA, 20 bp, Artificial Sequence
  chemically synthesized
ggaactgatgggatggaatc

SEQ ID NO: 545024 - DNA, 20 bp, Artificial Sequence
  chemically synthesized
cattaaaaggaatcaagtgg

SEQ ID NO: 545025 - DNA, 20 bp, Artificial Sequence
  chemically synthesized
ttagtagatgtctttgggcc

SEQ ID NO: 545026 - DNA, 20 bp, Artificial Sequence
  chemically synthesized
tttgggccaaagaaataaag

SEQ ID NO: 545027 - DNA, 20 bp, Artificial Sequence
  chemically synthesized
taaggtgaaaatgaaagcaa

SEQ ID NO: 545028 - DNA, 20 bp, Artificial Sequence
  chemically synthesized
aaatggaaatactccatgcc

SEQ ID NO: 545029 - DNA, 20 bp, Artificial Sequence
  chemically synthesized
gggtaaaatctaatacttta

SEQ ID NO: 545030 - DNA, 20 bp, Artificial Sequence
  chemically synthesized
cgcagttagttactattgta

SEQ ID NO: 545031 - DNA, 20 bp, Artificial Sequence
  chemically synthesized
cagctgaagtgctgtgattt

SEQ ID NO: 545032 - DNA, 20 bp, Artificial Sequence
  chemically synthesized
caatttatatattaaaatac

SEQ ID NO: 545033 - DNA, 20 bp, Artificial Sequence
  chemically synthesized
ttgaaaagtattttaaaaat

SEQ ID NO: 545034 - DNA, 20 bp, Artificial Sequence
  chemically synthesized
ctaccaccaccatgtgagtg

SEQ ID NO: 545035 - DNA, 20 bp, Artificial Sequence
  chemically synthesized
aaatcatttcaacacacatg

SEQ ID NO: 545036 - DNA, 20 bp, Artificial Sequence
  chemically synthesized
atgggagtacctgagatgta

SEQ ID NO: 545037 - DNA, 20 bp, Artificial Sequence
  chemically synthesized
aaattttgctgagcgtcata

SEQ ID NO: 545038 - DNA, 20 bp, Artificial Sequence
  chemically synthesized
tatctagagaagacaaatgt

SEQ ID NO: 545039 - DNA, 20 bp, Artificial Sequence
  chemically synthesized
aggaaaaaagtccttgaaag

SEQ ID NO: 545040 - DNA, 20 bp, Artificial Sequence
  chemically synthesized
gggtaatcaagagaaggtgt

SEQ ID NO: 545041 - DNA, 20 bp, Artificial Sequence
  chemically synthesized
agtgagaatccgtctccaaa

SEQ ID NO: 545042 - DNA, 20 bp, Artificial Sequence
  chemically synthesized
ttccaccctgggtgacacag

SEQ ID NO: 545043 - DNA, 20 bp, Artificial Sequence
  chemically synthesized
ctactcgggaggctgaggca

SEQ ID NO: 545044 - DNA, 20 bp, Artificial Sequence
  chemically synthesized
ccaatagatttctatcatac

SEQ ID NO: 545045 - DNA, 20 bp, Artificial Sequence
  chemically synthesized
aaattttctttcttagtatg

SEQ ID NO: 545046 - DNA, 20 bp, Artificial Sequence
  chemically synthesized
tagatttctatcatactaag

SEQ ID NO: 545047 - DNA, 20 bp, Artificial Sequence
  chemically synthesized
tagtcaggtgctagatcata

SEQ ID NO: 545048 - DNA, 20 bp, Artificial Sequence
  chemically synthesized
attctgaaacactgtgaggg

SEQ ID NO: 545049 - DNA, 20 bp, Artificial Sequence
  chemically synthesized
attctcgccctcacagtgtt

SEQ ID NO: 545050 - DNA, 20 bp, Artificial Sequence
  chemically synthesized
agaaatgatttaaacatctg

SEQ ID NO: 545051 - DNA, 20 bp, Artificial Sequence
  chemically synthesized
tacattgagtcctgaatgat

SEQ ID NO: 545052 - DNA, 20 bp, Artificial Sequence
  chemically synthesized
atactatgattaaaaaaatg

SEQ ID NO: 545053 - DNA, 20 bp, Artificial Sequence
  chemically synthesized
aaaaggactaagctgataca

SEQ ID NO: 545054 - DNA, 20 bp, Artificial Sequence
  chemically synthesized
caaagattacaatataatag

SEQ ID NO: 545055 - DNA, 20 bp, Artificial Sequence
  chemically synthesized
tcacaattacactaacctca

SEQ ID NO: 545056 - DNA, 20 bp, Artificial Sequence
  chemically synthesized
aactgaaccctaggataaaa

SEQ ID NO: 545057 - DNA, 20 bp, Artificial Sequence
  chemically synthesized
ttcagagccacatttgtaag

SEQ ID NO: 545058 - DNA, 20 bp, Artificial Sequence
  chemically synthesized
gaagtctcaaatagctattc

SEQ ID NO: 545059 - DNA, 20 bp, Artificial Sequence
  chemically synthesized
tgttatgtaacaaaatgttc

SEQ ID NO: 545060 - DNA, 20 bp, Artificial Sequence
  chemically synthesized
ttgttacataacacaagagt

SEQ ID NO: 545061 - DNA, 20 bp, Artificial Sequence
  chemically synthesized
aagtagggacagcacgtttg

SEQ ID NO: 545062 - DNA, 20 bp, Artificial Sequence
  chemically synthesized
acattttcaagtgaagcaat

SEQ ID NO: 545063 - DNA, 20 bp, Artificial Sequence
  chemically synthesized
ccagtcctgtcttatataac

SEQ ID NO: 545064 - DNA, 20 bp, Artificial Sequence
  chemically synthesized
cagaaaagaattgactaaat

SEQ ID NO: 545065 - DNA, 20 bp, Artificial Sequence
  chemically synthesized
tatactcattgaaggacaga

SEQ ID NO: 545066 - DNA, 20 bp, Artificial Sequence
  chemically synthesized
ttatatatactcattgaagg

SEQ ID NO: 545067 - DNA, 20 bp, Artificial Sequence
  chemically synthesized
tatattttacttaagaagtg

SEQ ID NO: 545068 - DNA, 20 bp, Artificial Sequence
  chemically synthesized
aatcagaacaactaagtaat

SEQ ID NO: 545069 - DNA, 20 bp, Artificial Sequence
  chemically synthesized
taaacccttgatcaatatgg

SEQ ID NO: 545070 - DNA, 20 bp, Artificial Sequence
  chemically synthesized
attcctaattagctgagaaa

SEQ ID NO: 545071 - DNA, 20 bp, Artificial Sequence
  chemically synthesized
tagtttaattcctaattagc

SEQ ID NO: 545072 - DNA, 20 bp, Artificial Sequence
  chemically synthesized
tttatttcgcatttgaagtc

SEQ ID NO: 545073 - DNA, 20 bp, Artificial Sequence
  chemically synthesized
tacactgattcttacaagta

SEQ ID NO: 545074 - DNA, 20 bp, Artificial Sequence
  chemically synthesized
tctggcgtttctgctacttg

SEQ ID NO: 545075 - DNA, 20 bp, Artificial Sequence
  chemically synthesized
aaggccttgatcattggggt

SEQ ID NO: 545076 - DNA, 20 bp, Artificial Sequence
  chemically synthesized
ctgcctgtttctccagttgg

SEQ ID NO: 545077 - DNA, 20 bp, Artificial Sequence
  chemically synthesized
gaattcatttctttccaact

SEQ ID NO: 545078 - DNA, 20 bp, Artificial Sequence
  chemically synthesized
ttattttttttaaatactct

SEQ ID NO: 545079 - DNA, 20 bp, Artificial Sequence
  chemically synthesized
tacacaaaaatgtttgtctg

SEQ ID NO: 545080 - DNA, 20 bp, Artificial Sequence
  chemically synthesized
gtatttttttctttatgaca

SEQ ID NO: 545081 - DNA, 20 bp, Artificial Sequence
  chemically synthesized
ttggccttttctcttgtcat

SEQ ID NO: 545082 - DNA, 20 bp, Artificial Sequence
  chemically synthesized
ccaacagtgagatgtaacat

SEQ ID NO: 545083 - DNA, 20 bp, Artificial Sequence
  chemically synthesized
tttaactagagacttattta

SEQ ID NO: 545084 - DNA, 20 bp, Artificial Sequence
  chemically synthesized
gatggcatttaaaagaagta

SEQ ID NO: 545085 - DNA, 20 bp, Artificial Sequence
  chemically synthesized
cttgacatggacaagagcca

SEQ ID NO: 545086 - DNA, 20 bp, Artificial Sequence
  chemically synthesized
agttggttttcaaaagtggc

SEQ ID NO: 545087 - DNA, 20 bp, Artificial Sequence
  chemically synthesized
aagggtaaaatagcatagat

SEQ ID NO: 545088 - DNA, 20 bp, Artificial Sequence
  chemically synthesized
gtattattttacatgtgttc

SEQ ID NO: 545089 - DNA, 20 bp, Artificial Sequence
  chemically synthesized
attaatcgaaaggcagtata

SEQ ID NO: 545090 - DNA, 20 bp, Artificial Sequence
  chemically synthesized
ctgagtctatgctatggcca

SEQ ID NO: 545091 - DNA, 20 bp, Artificial Sequence
  chemically synthesized
cacacacacaaaacacaccc

SEQ ID NO: 545092 - DNA, 20 bp, Artificial Sequence
  chemically synthesized
cacacataaggaaagactaa

SEQ ID NO: 545093 - DNA, 20 bp, Artificial Sequence
  chemically synthesized
ataaaatttgcaaaggacat

SEQ ID NO: 545094 - DNA, 20 bp, Artificial Sequence
  chemically synthesized
ataaaaacttcaagtacaga

SEQ ID NO: 545095 - DNA, 20 bp, Artificial Sequence
  chemically synthesized
cctaccaccccatcatttcc

SEQ ID NO: 545096 - DNA, 20 bp, Artificial Sequence
  chemically synthesized
atcttcctcaacaggctacc

SEQ ID NO: 545097 - DNA, 20 bp, Artificial Sequence
  chemically synthesized
acactgattttatctttttg

SEQ ID NO: 545098 - DNA, 20 bp, Artificial Sequence
  chemically synthesized
atttggtagcttaggagttg

SEQ ID NO: 545099 - DNA, 20 bp, Artificial Sequence
  chemically synthesized
aggggactcaataaatacga

SEQ ID NO: 545100 - DNA, 20 bp, Artificial Sequence
  chemically synthesized
gatgcttccaggaattacac

SEQ ID NO: 545101 - DNA, 20 bp, Artificial Sequence
  chemically synthesized
aataaccaatcacgtgactt

SEQ ID NO: 545102 - DNA, 20 bp, Artificial Sequence
  chemically synthesized
ttcaatcttcttaaccacat

SEQ ID NO: 545103 - DNA, 20 bp, Artificial Sequence
  chemically synthesized
tattagcatctaattagttg

SEQ ID NO: 545104 - DNA, 20 bp, Artificial Sequence
  chemically synthesized
tctattagaaaggatgatag

SEQ ID NO: 545105 - DNA, 20 bp, Artificial Sequence
  chemically synthesized
tcctgcacttatgatgtcta

SEQ ID NO: 545106 - DNA, 20 bp, Artificial Sequence
  chemically synthesized
tagacatcataagtgcagga

SEQ ID NO: 545107 - DNA, 20 bp, Artificial Sequence
  chemically synthesized
acagcaaagttttaaggtct

SEQ ID NO: 545108 - DNA, 20 bp, Artificial Sequence
  chemically synthesized
tacctcatctgatggttatc

SEQ ID NO: 545109 - DNA, 20 bp, Artificial Sequence
  chemically synthesized
tagaaagagtaggaaaggca

SEQ ID NO: 545110 - DNA, 20 bp, Artificial Sequence
  chemically synthesized
ggtgggtgcatgcatggatt

SEQ ID NO: 545111 - DNA, 20 bp, Artificial Sequence
  chemically synthesized
ttttaattctgtaactatat

SEQ ID NO: 545112 - DNA, 20 bp, Artificial Sequence
  chemically synthesized
catacattctgcatatagtt

SEQ ID NO: 545113 - DNA, 20 bp, Artificial Sequence
  chemically synthesized
tactgaaaataattattgaa

SEQ ID NO: 545114 - DNA, 20 bp, Artificial Sequence
  chemically synthesized
tgctatgcattgtgctgcta

SEQ ID NO: 545115 - DNA, 20 bp, Artificial Sequence
  chemically synthesized
acaggaatataggcttatga

SEQ ID NO: 545116 - DNA, 20 bp, Artificial Sequence
  chemically synthesized
ggtagctacacattaaatac

SEQ ID NO: 545117 - DNA, 20 bp, Artificial Sequence
  chemically synthesized
tcactggaatctcaaaatgg

SEQ ID NO: 545118 - DNA, 20 bp, Artificial Sequence
  chemically synthesized
cagacaggtcaaagttaaaa

SEQ ID NO: 545119 - DNA, 20 bp, Artificial Sequence
  chemically synthesized
gtacattctgtggtggtaga

SEQ ID NO: 545120 - DNA, 20 bp, Artificial Sequence
  chemically synthesized
gaacattctattctaccacc

SEQ ID NO: 545121 - DNA, 20 bp, Artificial Sequence
  chemically synthesized
ataatgtacattctgtggtg

SEQ ID NO: 545122 - DNA, 20 bp, Artificial Sequence
  chemically synthesized
gataatgatccacgtgcaga

SEQ ID NO: 545123 - DNA, 20 bp, Artificial Sequence
  chemically synthesized
tgcaccacagtggaaaaaaa

SEQ ID NO: 545124 - DNA, 20 bp, Artificial Sequence
  chemically synthesized
ctttggacaatgaaatcaag

SEQ ID NO: 545125 - DNA, 20 bp, Artificial Sequence
  chemically synthesized
taactgcctacaccaaaaag

SEQ ID NO: 545126 - DNA, 20 bp, Artificial Sequence
  chemically synthesized
taatattgtacttcaatgaa

SEQ ID NO: 545127 - DNA, 20 bp, Artificial Sequence
  chemically synthesized
acaaaccgaaaccaaagcta

SEQ ID NO: 545128 - DNA, 20 bp, Artificial Sequence
  chemically synthesized
aaaccaaagctagcagaata

SEQ ID NO: 545129 - DNA, 20 bp, Artificial Sequence
  chemically synthesized
ttaattttgtttatcttttc

SEQ ID NO: 545130 - DNA, 20 bp, Artificial Sequence
  chemically synthesized
aggccactagctagattaac

SEQ ID NO: 545131 - DNA, 20 bp, Artificial Sequence
  chemically synthesized
gattaaccaagaaaaaaaca

SEQ ID NO: 545132 - DNA, 20 bp, Artificial Sequence
  chemically synthesized
gtgacgttacaactgatacc

SEQ ID NO: 545133 - DNA, 20 bp, Artificial Sequence
  chemically synthesized
ggcatctctaggtacacaaa

SEQ ID NO: 545134 - DNA, 20 bp, Artificial Sequence
  chemically synthesized
accagttctttgcatgtctg

SEQ ID NO: 545135 - DNA, 20 bp, Artificial Sequence
  chemically synthesized
ggcttcgtagaattaattag

SEQ ID NO: 545136 - DNA, 20 bp, Artificial Sequence
  chemically synthesized
atcatggtgatactggcttc

SEQ ID NO: 545137 - DNA, 20 bp, Artificial Sequence
  chemically synthesized
catagatgcaaaaatcctca

SEQ ID NO: 545138 - DNA, 20 bp, Artificial Sequence
  chemically synthesized
atatgtgattcaccacataa

SEQ ID NO: 545139 - DNA, 20 bp, Artificial Sequence
  chemically synthesized
atatgatcatctcaatagat

SEQ ID NO: 545140 - DNA, 20 bp, Artificial Sequence
  chemically synthesized
ctagctagagcaatcaggca

SEQ ID NO: 545141 - DNA, 20 bp, Artificial Sequence
  chemically synthesized
ctagagcaatcaggcaagag

SEQ ID NO: 545142 - DNA, 20 bp, Artificial Sequence
  chemically synthesized
aaaggcatccaaattgggaa

SEQ ID NO: 545143 - DNA, 20 bp, Artificial Sequence
  chemically synthesized
taaaatcctatcatcagtga

SEQ ID NO: 545144 - DNA, 20 bp, Artificial Sequence
  chemically synthesized
ctgatgataggattttacat

SEQ ID NO: 545145 - DNA, 20 bp, Artificial Sequence
  chemically synthesized
agcttgatcattattggtgt

SEQ ID NO: 545146 - DNA, 20 bp, Artificial Sequence
  chemically synthesized
aattaccaacatcatttttc

SEQ ID NO: 545147 - DNA, 20 bp, Artificial Sequence
  chemically synthesized
caacatcatttttcacagaa

SEQ ID NO: 545148 - DNA, 20 bp, Artificial Sequence
  chemically synthesized
aaaaagatagtaaaatacat

SEQ ID NO: 545149 - DNA, 20 bp, Artificial Sequence
  chemically synthesized
gtcaaagcaatgctaagcaa

SEQ ID NO: 545150 - DNA, 20 bp, Artificial Sequence
  chemically synthesized
atattggatagtcataagca

SEQ ID NO: 545151 - DNA, 20 bp, Artificial Sequence
  chemically synthesized
ctgaaaatataaaaatccta

SEQ ID NO: 545152 - DNA, 20 bp, Artificial Sequence
  chemically synthesized
ttctcgacactggcttgggc

SEQ ID NO: 545153 - DNA, 20 bp, Artificial Sequence
  chemically synthesized
aaaaaaacaaaaaacaatca

SEQ ID NO: 545154 - DNA, 20 bp, Artificial Sequence
  chemically synthesized
acagaatgaacagacaactt

SEQ ID NO: 545155 - DNA, 20 bp, Artificial Sequence
  chemically synthesized
atctaacaaaaaactaatat

SEQ ID NO: 545156 - DNA, 20 bp, Artificial Sequence
  chemically synthesized
atctaaaagtaactcaacaa

SEQ ID NO: 545157 - DNA, 20 bp, Artificial Sequence
  chemically synthesized
acaagtggccaacaaacata

SEQ ID NO: 545158 - DNA, 20 bp, Artificial Sequence
  chemically synthesized
gctcaacatcactaatcatc

SEQ ID NO: 545159 - DNA, 20 bp, Artificial Sequence
  chemically synthesized
aagtgaaataatcacatcat

SEQ ID NO: 545160 - DNA, 20 bp, Artificial Sequence
  chemically synthesized
ggtacaaaaattacagttag

SEQ ID NO: 545161 - DNA, 20 bp, Artificial Sequence
  chemically synthesized
attgggtacaaaaattacag

SEQ ID NO: 545162 - DNA, 20 bp, Artificial Sequence
  chemically synthesized
ttaagtgaaataagccaggc

SEQ ID NO: 545163 - DNA, 20 bp, Artificial Sequence
  chemically synthesized
acaggtgttggcaaggatgt

SEQ ID NO: 545164 - DNA, 20 bp, Artificial Sequence
  chemically synthesized
tgttggcaaggatgtggaga

SEQ ID NO: 545165 - DNA, 20 bp, Artificial Sequence
  chemically synthesized
tagttgtgttttaagttctt

SEQ ID NO: 545166 - DNA, 20 bp, Artificial Sequence
  chemically synthesized
atagcactatttacaatagc

SEQ ID NO: 545167 - DNA, 20 bp, Artificial Sequence
  chemically synthesized
ccatcagtaaatgattggat

SEQ ID NO: 545168 - DNA, 20 bp, Artificial Sequence
  chemically synthesized
ccacagaacactacacagcc

SEQ ID NO: 545169 - DNA, 20 bp, Artificial Sequence
  chemically synthesized
ctaagtgaagtaacttggaa

SEQ ID NO: 545170 - DNA, 20 bp, Artificial Sequence
  chemically synthesized
caacatgttctcgcttataa

SEQ ID NO: 545171 - DNA, 20 bp, Artificial Sequence
  chemically synthesized
atgtgaatacgtcagaaatg

SEQ ID NO: 545172 - DNA, 20 bp, Artificial Sequence
  chemically synthesized
gcaaggataatgtgaatacg

SEQ ID NO: 545173 - DNA, 20 bp, Artificial Sequence
  chemically synthesized
tatttccatgaatctcagtg

SEQ ID NO: 545174 - DNA, 20 bp, Artificial Sequence
  chemically synthesized
ataatgtgattaccaagtta

SEQ ID NO: 545175 - DNA, 20 bp, Artificial Sequence
  chemically synthesized
gagtactaccagatgtacca

SEQ ID NO: 545176 - DNA, 20 bp, Artificial Sequence
  chemically synthesized
ccagtagaaatctactagta

SEQ ID NO: 545177 - DNA, 20 bp, Artificial Sequence
  chemically synthesized
ctactagtattagaaatcca

SEQ ID NO: 545178 - DNA, 20 bp, Artificial Sequence
  chemically synthesized
cactagaaattctgttcata

SEQ ID NO: 545179 - DNA, 20 bp, Artificial Sequence
  chemically synthesized
gtttaatatttctgttatga

SEQ ID NO: 545180 - DNA, 20 bp, Artificial Sequence
  chemically synthesized
aggatagttctccatattct

SEQ ID NO: 545181 - DNA, 20 bp, Artificial Sequence
  chemically synthesized
ttgaatatgatactttttct

SEQ ID NO: 545182 - DNA, 20 bp, Artificial Sequence
  chemically synthesized
tgcattttagggaaacctta

SEQ ID NO: 545183 - DNA, 20 bp, Artificial Sequence
  chemically synthesized
catgagactaactcagtaaa

SEQ ID NO: 545184 - DNA, 20 bp, Artificial Sequence
  chemically synthesized
tattgattcagtaacattac

SEQ ID NO: 545185 - DNA, 20 bp, Artificial Sequence
  chemically synthesized
tcagattattatttacttta

SEQ ID NO: 545186 - DNA, 20 bp, Artificial Sequence
  chemically synthesized
agtaaataataatctgatag

SEQ ID NO: 545187 - DNA, 20 bp, Artificial Sequence
  chemically synthesized
gaaatacttgatttgtaaaa

SEQ ID NO: 545188 - DNA, 20 bp, Artificial Sequence
  chemically synthesized
ttggaatatgatgcttgtta

SEQ ID NO: 545189 - DNA, 20 bp, Artificial Sequence
  chemically synthesized
agaagacatctaatatccca

SEQ ID NO: 545190 - DNA, 20 bp, Artificial Sequence
  chemically synthesized
aaaaaaaaattcataaagct

SEQ ID NO: 545191 - DNA, 20 bp, Artificial Sequence
  chemically synthesized
atcaaactttcatgcccttg

SEQ ID NO: 545192 - DNA, 20 bp, Artificial Sequence
  chemically synthesized
ctaagcactctgaaaacaca

SEQ ID NO: 545193 - DNA, 20 bp, Artificial Sequence
  chemically synthesized
aaataaaatgaaacttcata

SEQ ID NO: 545194 - DNA, 20 bp, Artificial Sequence
  chemically synthesized
aagaaaataggcagtgaaaa

SEQ ID NO: 545195 - DNA, 20 bp, Artificial Sequence
  chemically synthesized
tgggacttgagattggtaat

SEQ ID NO: 545196 - DNA, 20 bp, Artificial Sequence
  chemically synthesized
caagtcccaattgcccagtc

SEQ ID NO: 545197 - DNA, 20 bp, Artificial Sequence
  chemically synthesized
tattggttttgatttgatat

SEQ ID NO: 545198 - DNA, 20 bp, Artificial Sequence
  chemically synthesized
ttgaggataaataaaagagc

SEQ ID NO: 545199 - DNA, 20 bp, Artificial Sequence
  chemically synthesized
attattcatgagaaattaaa

SEQ ID NO: 545200 - DNA, 20 bp, Artificial Sequence
  chemically synthesized
taacaggaaaccattattca

SEQ ID NO: 545201 - DNA, 20 bp, Artificial Sequence
  chemically synthesized
acatgggtgctgtgaagaat

SEQ ID NO: 545202 - DNA, 20 bp, Artificial Sequence
  chemically synthesized
ttatagcacatgggtgctgt

SEQ ID NO: 545203 - DNA, 20 bp, Artificial Sequence
  chemically synthesized
ggtttgttcagtgatatgga

SEQ ID NO: 545204 - DNA, 20 bp, Artificial Sequence
  chemically synthesized
atgaaatgtcagatcctttg

SEQ ID NO: 545205 - DNA, 20 bp, Artificial Sequence
  chemically synthesized
gtctgcctttaactaacctt

SEQ ID NO: 545206 - DNA, 20 bp, Artificial Sequence
  chemically synthesized
aatacaaactaagtagcctc

SEQ ID NO: 545207 - DNA, 20 bp, Artificial Sequence
  chemically synthesized
acatataaccttcactgaag

SEQ ID NO: 545208 - DNA, 20 bp, Artificial Sequence
  chemically synthesized
aacaaagactttacaaatta

SEQ ID NO: 545209 - DNA, 20 bp, Artificial Sequence
  chemically synthesized
acaaaagtctaaatctctca

SEQ ID NO: 545210 - DNA, 20 bp, Artificial Sequence
  chemically synthesized
aatttattagtgatgttgac

SEQ ID NO: 545211 - DNA, 20 bp, Artificial Sequence
  chemically synthesized
ggtcttttttgtcttaaggg

SEQ ID NO: 545212 - DNA, 20 bp, Artificial Sequence
  chemically synthesized
cttaagacaaaaaagaccag

SEQ ID NO: 545213 - DNA, 20 bp, Artificial Sequence
  chemically synthesized
aggttcgatttgtttactcc

SEQ ID NO: 545214 - DNA, 20 bp, Artificial Sequence
  chemically synthesized
tcatagacattgctgtaggg

SEQ ID NO: 545215 - DNA, 20 bp, Artificial Sequence
  chemically synthesized
tcaattggctgcaccatttg

SEQ ID NO: 545216 - DNA, 20 bp, Artificial Sequence
  chemically synthesized
aactctttactctgggtaac

SEQ ID NO: 545217 - DNA, 20 bp, Artificial Sequence
  chemically synthesized
gcattttattatgaggcagg

SEQ ID NO: 545218 - DNA, 20 bp, Artificial Sequence
  chemically synthesized
agatagcaaaggatcctgtc

SEQ ID NO: 545219 - DNA, 20 bp, Artificial Sequence
  chemically synthesized
gcaggcgacctctgatctga

SEQ ID NO: 545220 - DNA, 20 bp, Artificial Sequence
  chemically synthesized
tgattgcagatgacaaaatt

SEQ ID NO: 545221 - DNA, 20 bp, Artificial Sequence
  chemically synthesized
ttgtcatctgcaatcatctt

SEQ ID NO: 545222 - DNA, 20 bp, Artificial Sequence
  chemically synthesized
gatgcattttgttgtcagaa

SEQ ID NO: 545223 - DNA, 20 bp, Artificial Sequence
  chemically synthesized
cgctttgcagctttttttcc

SEQ ID NO: 545224 - DNA, 20 bp, Artificial Sequence
  chemically synthesized
ttgccacacttcataaaaca

SEQ ID NO: 545225 - DNA, 20 bp, Artificial Sequence
  chemically synthesized
agactaaaaggagcatacat

SEQ ID NO: 545226 - DNA, 20 bp, Artificial Sequence
  chemically synthesized
cttctcgccaaaattgttgc

SEQ ID NO: 545227 - DNA, 20 bp, Artificial Sequence
  chemically synthesized
agttggccttactctctgag

SEQ ID NO: 545228 - DNA, 20 bp, Artificial Sequence
  chemically synthesized
aatgactatgaaattgcctt

SEQ ID NO: 545229 - DNA, 20 bp, Artificial Sequence
  chemically synthesized
tcaaggcaatttcatagtca

SEQ ID NO: 545230 - DNA, 20 bp, Artificial Sequence
  chemically synthesized
tttcattcacattatatctt

SEQ ID NO: 545231 - DNA, 20 bp, Artificial Sequence
  chemically synthesized
caaaacatttcaggtacctg

SEQ ID NO: 545232 - DNA, 20 bp, Artificial Sequence
  chemically synthesized
gctccaaaagagcagtagaa

SEQ ID NO: 545233 - DNA, 20 bp, Artificial Sequence
  chemically synthesized
cttttggaagttgaagtatt

SEQ ID NO: 545234 - DNA, 20 bp, Artificial Sequence
  chemically synthesized
aactgtgactggaaggaaca

SEQ ID NO: 545235 - DNA, 20 bp, Artificial Sequence
  chemically synthesized
caaacttctcccactagaag

SEQ ID NO: 545236 - DNA, 20 bp, Artificial Sequence
  chemically synthesized
gggaatctctgaaagactgt

SEQ ID NO: 545237 - DNA, 20 bp, Artificial Sequence
  chemically synthesized
aagactgtggagaatatacc

SEQ ID NO: 545238 - DNA, 20 bp, Artificial Sequence
  chemically synthesized
aaagttgatagagaaatcct

SEQ ID NO: 545239 - DNA, 20 bp, Artificial Sequence
  chemically synthesized
aatgaggagtaaaagttgat

SEQ ID NO: 545240 - DNA, 20 bp, Artificial Sequence
  chemically synthesized
ctggctgaaatggttctgca

SEQ ID NO: 545241 - DNA, 20 bp, Artificial Sequence
  chemically synthesized
aaataattgaaaaaatattt

SEQ ID NO: 545242 - DNA, 20 bp, Artificial Sequence
  chemically synthesized
taatgatagctggtgaacta

SEQ ID NO: 545243 - DNA, 20 bp, Artificial Sequence
  chemically synthesized
ggcttccctgggcgacattg

SEQ ID NO: 545244 - DNA, 20 bp, Artificial Sequence
  chemically synthesized
gcctacactggaagttacat

SEQ ID NO: 545245 - DNA, 20 bp, Artificial Sequence
  chemically synthesized
atcaactgtattgcaattat

SEQ ID NO: 545246 - DNA, 20 bp, Artificial Sequence
  chemically synthesized
cttaaaaaaaactctagaac

SEQ ID NO: 545247 - DNA, 20 bp, Artificial Sequence
  chemically synthesized
tgactgaatattataaaaag

SEQ ID NO: 545248 - DNA, 20 bp, Artificial Sequence
  chemically synthesized
gaacaatttgggacacacac

SEQ ID NO: 545249 - DNA, 20 bp, Artificial Sequence
  chemically synthesized
agcaccctcataattttgga

SEQ ID NO: 545250 - DNA, 20 bp, Artificial Sequence
  chemically synthesized
ttattgtagaagtctcaata

SEQ ID NO: 545251 - DNA, 20 bp, Artificial Sequence
  chemically synthesized
ccagttatgctccctcgctg

SEQ ID NO: 545252 - DNA, 20 bp, Artificial Sequence
  chemically synthesized
tggaaatgtacaagtaaact

SEQ ID NO: 545253 - DNA, 20 bp, Artificial Sequence
  chemically synthesized
tttaaaaaatgtcatattct

SEQ ID NO: 545254 - DNA, 20 bp, Artificial Sequence
  chemically synthesized
gtctgaagcattgcttttct

SEQ ID NO: 545255 - DNA, 20 bp, Artificial Sequence
  chemically synthesized
ctaggcttttcgtatttgga

SEQ ID NO: 545256 - DNA, 20 bp, Artificial Sequence
  chemically synthesized
gctgctgtaacaaaaataac

SEQ ID NO: 545257 - DNA, 20 bp, Artificial Sequence
  chemically synthesized
ctgagaatgaggtaatttag

SEQ ID NO: 545258 - DNA, 20 bp, Artificial Sequence
  chemically synthesized
atccatcagggctcctccct

SEQ ID NO: 545259 - DNA, 20 bp, Artificial Sequence
  chemically synthesized
cagatgacatggttgatggg

SEQ ID NO: 545260 - DNA, 20 bp, Artificial Sequence
  chemically synthesized
tacacagagtttgctttcta

SEQ ID NO: 545261 - DNA, 20 bp, Artificial Sequence
  chemically synthesized
cttatgttgcgtgctttcta

SEQ ID NO: 545262 - DNA, 20 bp, Artificial Sequence
  chemically synthesized
atgactggctaacaaaaaca

SEQ ID NO: 545263 - DNA, 20 bp, Artificial Sequence
  chemically synthesized
gttttaatggatctccagaa

SEQ ID NO: 545264 - DNA, 20 bp, Artificial Sequence
  chemically synthesized
catagagttttaatggatct

SEQ ID NO: 545265 - DNA, 20 bp, Artificial Sequence
  chemically synthesized
gaacatcacaatgtaaaaca

SEQ ID NO: 545266 - DNA, 20 bp, Artificial Sequence
  chemically synthesized
tttgtgaactattataagtc

SEQ ID NO: 545267 - DNA, 20 bp, Artificial Sequence
  chemically synthesized
agttgactatgtgaaagttt

SEQ ID NO: 545268 - DNA, 20 bp, Artificial Sequence
  chemically synthesized
ccaccacacatactaaataa

SEQ ID NO: 545269 - DNA, 20 bp, Artificial Sequence
  chemically synthesized
ctcttgaagggaaaagtgac

SEQ ID NO: 545270 - DNA, 20 bp, Artificial Sequence
  chemically synthesized
ttgtgtttttttttttgacc

SEQ ID NO: 545271 - DNA, 20 bp, Artificial Sequence
  chemically synthesized
gaatctaggcttcaagagag

SEQ ID NO: 545272 - DNA, 20 bp, Artificial Sequence
  chemically synthesized
ctaatacagtattttatcct

SEQ ID NO: 545273 - DNA, 20 bp, Artificial Sequence
  chemically synthesized
ttgcgtcatgatctgaagac

SEQ ID NO: 545274 - DNA, 20 bp, Artificial Sequence
  chemically synthesized
ttgatacacacaaatagact

SEQ ID NO: 545275 - DNA, 20 bp, Artificial Sequence
  chemically synthesized
tgctttttccccacaaagat

SEQ ID NO: 545276 - DNA, 20 bp, Artificial Sequence
  chemically synthesized
tcaaattataagatcaatgt

SEQ ID NO: 545277 - DNA, 20 bp, Artificial Sequence
  chemically synthesized
caaaaaatagtttaaggaaa

SEQ ID NO: 545278 - DNA, 20 bp, Artificial Sequence
  chemically synthesized
cttttggctatgacagtttc

SEQ ID NO: 545279 - DNA, 20 bp, Artificial Sequence
  chemically synthesized
aaaaactgccagaaaaattc

SEQ ID NO: 545280 - DNA, 20 bp, Artificial Sequence
  chemically synthesized
gccagcacttttaaaaactg

SEQ ID NO: 545281 - DNA, 20 bp, Artificial Sequence
  chemically synthesized
cttttcacactgttttttaa

SEQ ID NO: 545282 - DNA, 20 bp, Artificial Sequence
  chemically synthesized
aatagagacaaatctccaat

SEQ ID NO: 545283 - DNA, 20 bp, Artificial Sequence
  chemically synthesized
ctaacactaggaaagggaat

SEQ ID NO: 545284 - DNA, 20 bp, Artificial Sequence
  chemically synthesized
ctatattccctttcctagtg

SEQ ID NO: 545285 - DNA, 20 bp, Artificial Sequence
  chemically synthesized
aaaaggaaccagaacactgt

SEQ ID NO: 545286 - DNA, 20 bp, Artificial Sequence
  chemically synthesized
ttttttttttttttttcttt

SEQ ID NO: 545287 - DNA, 20 bp, Artificial Sequence
  chemically synthesized
gggtttcagtaacattcttt

SEQ ID NO: 545288 - DNA, 20 bp, Artificial Sequence
  chemically synthesized
ctcttcaacattttgagtta

SEQ ID NO: 545289 - DNA, 20 bp, Artificial Sequence
  chemically synthesized
gtcatctcaacttctagttt

SEQ ID NO: 545290 - DNA, 20 bp, Artificial Sequence
  chemically synthesized
atgctgctgaatccacagac

SEQ ID NO: 545291 - DNA, 20 bp, Artificial Sequence
  chemically synthesized
gcggggcaagtagtactaca

SEQ ID NO: 545292 - DNA, 20 bp, Artificial Sequence
  chemically synthesized
aaggtcaaagtacgcaacta

SEQ ID NO: 545293 - DNA, 20 bp, Artificial Sequence
  chemically synthesized
atgctgtcttggttactatg

SEQ ID NO: 545294 - DNA, 20 bp, Artificial Sequence
  chemically synthesized
gcaaatgctaccaggaaaag

SEQ ID NO: 545295 - DNA, 20 bp, Artificial Sequence
  chemically synthesized
aaagtaagaatctacatgca

SEQ ID NO: 545296 - DNA, 20 bp, Artificial Sequence
  chemically synthesized
tcaaaactctcaatctatta

SEQ ID NO: 545297 - DNA, 20 bp, Artificial Sequence
  chemically synthesized
aattttaatttttttgctgt

SEQ ID NO: 545298 - DNA, 20 bp, Artificial Sequence
  chemically synthesized
acagagtaaagagatatcca

SEQ ID NO: 545299 - DNA, 20 bp, Artificial Sequence
  chemically synthesized
taaagagatatccaatagaa

SEQ ID NO: 545300 - DNA, 20 bp, Artificial Sequence
  chemically synthesized
ggggttcatataaaaatatg

SEQ ID NO: 545301 - DNA, 20 bp, Artificial Sequence
  chemically synthesized
aaattcaaccaactccatag

SEQ ID NO: 545302 - DNA, 20 bp, Artificial Sequence
  chemically synthesized
tgaggtatcagcttacttgc

SEQ ID NO: 545303 - DNA, 20 bp, Artificial Sequence
  chemically synthesized
tgtgtgcatgtgtctttttg

SEQ ID NO: 545304 - DNA, 20 bp, Artificial Sequence
  chemically synthesized
ttatcagtggtaaactggat

SEQ ID NO: 545305 - DNA, 20 bp, Artificial Sequence
  chemically synthesized
agagtaagattatgttcttt

SEQ ID NO: 545306 - DNA, 20 bp, Artificial Sequence
  chemically synthesized
attatccttagcaaaataac

SEQ ID NO: 545307 - DNA, 20 bp, Artificial Sequence
  chemically synthesized
cttagcaaaataacgcagaa

SEQ ID NO: 545308 - DNA, 20 bp, Artificial Sequence
  chemically synthesized
gtttggagggtggcagaagg

SEQ ID NO: 545309 - DNA, 20 bp, Artificial Sequence
  chemically synthesized
aattaacgatatctttgtca

SEQ ID NO: 545310 - DNA, 20 bp, Artificial Sequence
  chemically synthesized
taaaaattactaattaaaaa

SEQ ID NO: 545311 - DNA, 20 bp, Artificial Sequence
  chemically synthesized
ggaaatgaaatcagtatgtc

SEQ ID NO: 545312 - DNA, 20 bp, Artificial Sequence
  chemically synthesized
ccaccaacatatgaacggat

SEQ ID NO: 545313 - DNA, 20 bp, Artificial Sequence
  chemically synthesized
gaatactattcagccataaa

SEQ ID NO: 545314 - DNA, 20 bp, Artificial Sequence
  chemically synthesized
gttaagtgaaataagccagt

SEQ ID NO: 545315 - DNA, 20 bp, Artificial Sequence
  chemically synthesized
agtgaaataagccagtaaag

SEQ ID NO: 545316 - DNA, 20 bp, Artificial Sequence
  chemically synthesized
tagggtttaaaaagcaatgt

SEQ ID NO: 545317 - DNA, 20 bp, Artificial Sequence
  chemically synthesized
acctagcatccccggaactg

SEQ ID NO: 545318 - DNA, 20 bp, Artificial Sequence
  chemically synthesized
gagctgttgccggagctcag

SEQ ID NO: 545319 - DNA, 20 bp, Artificial Sequence
  chemically synthesized
caattccagccactccacag

SEQ ID NO: 545320 - DNA, 20 bp, Artificial Sequence
  chemically synthesized
cagtaagaaacagaagagga

SEQ ID NO: 545321 - DNA, 20 bp, Artificial Sequence
  chemically synthesized
ggccaagaggaacctgggta

SEQ ID NO: 545322 - DNA, 20 bp, Artificial Sequence
  chemically synthesized
ctctttgaacagagcaagaa

SEQ ID NO: 545323 - DNA, 20 bp, Artificial Sequence
  chemically synthesized
ggaatatgaaatgcatattg

SEQ ID NO: 545324 - DNA, 20 bp, Artificial Sequence
  chemically synthesized
aacattgcaatcagaagtta

SEQ ID NO: 545325 - DNA, 20 bp, Artificial Sequence
  chemically synthesized
aagtagacattttattttta

SEQ ID NO: 545326 - DNA, 20 bp, Artificial Sequence
  chemically synthesized
agacataaatacaaaaataa

SEQ ID NO: 545327 - DNA, 20 bp, Artificial Sequence
  chemically synthesized
atacaaaaataattagaata

SEQ ID NO: 545328 - DNA, 20 bp, Artificial Sequence
  chemically synthesized
tataaactctttctagacgg

SEQ ID NO: 545329 - DNA, 20 bp, Artificial Sequence
  chemically synthesized
tcacaggtctttctttccgt

SEQ ID NO: 545330 - DNA, 20 bp, Artificial Sequence
  chemically synthesized
ttcagatttggggcagagct

SEQ ID NO: 545331 - DNA, 20 bp, Artificial Sequence
  chemically synthesized
atgagaccttgtctctatta

SEQ ID NO: 545332 - DNA, 20 bp, Artificial Sequence
  chemically synthesized
tttctgtatcccacttataa

SEQ ID NO: 545333 - DNA, 20 bp, Artificial Sequence
  chemically synthesized
tttctctttataagtgggat

SEQ ID NO: 545334 - DNA, 20 bp, Artificial Sequence
  chemically synthesized
ggggatttttggggtaggga

SEQ ID NO: 545335 - DNA, 20 bp, Artificial Sequence
  chemically synthesized
tttcagaaccactaatgaag

SEQ ID NO: 545336 - DNA, 20 bp, Artificial Sequence
  chemically synthesized
caacagcatcagcccatccc

SEQ ID NO: 545337 - DNA, 20 bp, Artificial Sequence
  chemically synthesized
caagactcacacttactgaa

SEQ ID NO: 545338 - DNA, 20 bp, Artificial Sequence
  chemically synthesized
cagaaactctgggatgaggt

SEQ ID NO: 545339 - DNA, 20 bp, Artificial Sequence
  chemically synthesized
aatttgggtgagttgtgttt

SEQ ID NO: 545340 - DNA, 20 bp, Artificial Sequence
  chemically synthesized
atgttaatatcttggtctct

SEQ ID NO: 545341 - DNA, 20 bp, Artificial Sequence
  chemically synthesized
aagtggaggtgaagtcagga

SEQ ID NO: 545342 - DNA, 20 bp, Artificial Sequence
  chemically synthesized
aagtgtgactgccaactgcc

SEQ ID NO: 545343 - DNA, 20 bp, Artificial Sequence
  chemically synthesized
attttctcaattaaaacatc

SEQ ID NO: 545344 - DNA, 20 bp, Artificial Sequence
  chemically synthesized
ggattctgagatgttttaat

SEQ ID NO: 545345 - DNA, 20 bp, Artificial Sequence
  chemically synthesized
gtcaaggcctgtagtaagga

SEQ ID NO: 545346 - DNA, 20 bp, Artificial Sequence
  chemically synthesized
ccaaatgcctattgtagaag

SEQ ID NO: 545347 - DNA, 20 bp, Artificial Sequence
  chemically synthesized
cccaaccccgtgaatttaaa

SEQ ID NO: 545348 - DNA, 20 bp, Artificial Sequence
  chemically synthesized
taaattcacggggttgggtc

SEQ ID NO: 545349 - DNA, 20 bp, Artificial Sequence
  chemically synthesized
ttgaatgacaacattccagg

SEQ ID NO: 545350 - DNA, 20 bp, Artificial Sequence
  chemically synthesized
agtatcaaagggtatcagac

SEQ ID NO: 545351 - DNA, 20 bp, Artificial Sequence
  chemically synthesized
ctcacttccttgctaatcac

SEQ ID NO: 545352 - DNA, 20 bp, Artificial Sequence
  chemically synthesized
actgtactcgagcctgggta

SEQ ID NO: 545353 - DNA, 20 bp, Artificial Sequence
  chemically synthesized
tctttaacctaccactatcc

SEQ ID NO: 545354 - DNA, 20 bp, Artificial Sequence
  chemically synthesized
cagtggcatgtgaagccagt

SEQ ID NO: 545355 - DNA, 20 bp, Artificial Sequence
  chemically synthesized
tcaacaaagaaattgaaata

SEQ ID NO: 545356 - DNA, 20 bp, Artificial Sequence
  chemically synthesized
atgaagccattttcatcaac

SEQ ID NO: 545357 - DNA, 20 bp, Artificial Sequence
  chemically synthesized
tttagaatgttagctggaaa

SEQ ID NO: 545358 - DNA, 20 bp, Artificial Sequence
  chemically synthesized
ttccaaatttatttacatct

SEQ ID NO: 545359 - DNA, 20 bp, Artificial Sequence
  chemically synthesized
agagagccgagggagtggaa

SEQ ID NO: 545360 - DNA, 20 bp, Artificial Sequence
  chemically synthesized
ttccaatcgttcagatcatc

SEQ ID NO: 545361 - DNA, 20 bp, Artificial Sequence
  chemically synthesized
ttcatatgtacattaaagtt

SEQ ID NO: 545362 - DNA, 20 bp, Artificial Sequence
  chemically synthesized
cccaacccaggcctactgac

SEQ ID NO: 545363 - DNA, 20 bp, Artificial Sequence
  chemically synthesized
cttgggcagttgttagaaat

SEQ ID NO: 545364 - DNA, 20 bp, Artificial Sequence
  chemically synthesized
tgatatcccttgggcagttg

SEQ ID NO: 545365 - DNA, 20 bp, Artificial Sequence
  chemically synthesized
catttgaaaaatactacgtc

SEQ ID NO: 545366 - DNA, 20 bp, Artificial Sequence
  chemically synthesized
gggaatgccagctttgcttt

SEQ ID NO: 545367 - DNA, 20 bp, Artificial Sequence
  chemically synthesized
tttgctttacagaaactctg

SEQ ID NO: 545368 - DNA, 20 bp, Artificial Sequence
  chemically synthesized
acgccgtttcaaaaaacaaa

SEQ ID NO: 545369 - DNA, 20 bp, Artificial Sequence
  chemically synthesized
cgtttcaaaaaacaaaaaag

SEQ ID NO: 545370 - DNA, 20 bp, Artificial Sequence
  chemically synthesized
agttctggacaacactggtt

SEQ ID NO: 545371 - DNA, 20 bp, Artificial Sequence
  chemically synthesized
tgtatacctatagtgcacac

SEQ ID NO: 545372 - DNA, 20 bp, Artificial Sequence
  chemically synthesized
atatgtatggctagtaaggc

SEQ ID NO: 545373 - DNA, 20 bp, Artificial Sequence
  chemically synthesized
aggctctcaggcccaattcc

SEQ ID NO: 545374 - DNA, 20 bp, Artificial Sequence
  chemically synthesized
tattataatgaaagtctaga

SEQ ID NO: 545375 - DNA, 20 bp, Artificial Sequence
  chemically synthesized
atacaattacatgatttaag

SEQ ID NO: 545376 - DNA, 20 bp, Artificial Sequence
  chemically synthesized
gaaagataccagtacaaatt

SEQ ID NO: 545377 - DNA, 20 bp, Artificial Sequence
  chemically synthesized
tacttttaaatgcacgccat

SEQ ID NO: 545378 - DNA, 20 bp, Artificial Sequence
  chemically synthesized
gttcaagaccagcctggcca

SEQ ID NO: 545379 - DNA, 20 bp, Artificial Sequence
  chemically synthesized
ctactcaggaggctgaggca

SEQ ID NO: 545380 - DNA, 20 bp, Artificial Sequence
  chemically synthesized
tatctataagaaccaccttg

SEQ ID NO: 545381 - DNA, 20 bp, Artificial Sequence
  chemically synthesized
agaagcatctagttgcatat

SEQ ID NO: 545382 - DNA, 20 bp, Artificial Sequence
  chemically synthesized
ttatatgcaactagatgctt

SEQ ID NO: 545383 - DNA, 20 bp, Artificial Sequence
  chemically synthesized
gcttttgtttcattctctat

SEQ ID NO: 545384 - DNA, 20 bp, Artificial Sequence
  chemically synthesized
cccccaatacctttcttaat

SEQ ID NO: 545385 - DNA, 20 bp, Artificial Sequence
  chemically synthesized
ctggggaaggaatagcatta

SEQ ID NO: 545386 - DNA, 20 bp, Artificial Sequence
  chemically synthesized
gcgagttgtgcacatgcatc

SEQ ID NO: 545387 - DNA, 20 bp, Artificial Sequence
  chemically synthesized
ataataataataaaagaggg

SEQ ID NO: 545388 - DNA, 20 bp, Artificial Sequence
  chemically synthesized
taataaaagagggagagaaa

SEQ ID NO: 545389 - DNA, 20 bp, Artificial Sequence
  chemically synthesized
aaagagggagagaaaaaaga

SEQ ID NO: 545390 - DNA, 20 bp, Artificial Sequence
  chemically synthesized
aatccaagataggttaaaaa

SEQ ID NO: 545391 - DNA, 20 bp, Artificial Sequence
  chemically synthesized
tataaaaaggtactaattga

SEQ ID NO: 545392 - DNA, 20 bp, Artificial Sequence
  chemically synthesized
cccattccccaacaattcaa

SEQ ID NO: 545393 - DNA, 20 bp, Artificial Sequence
  chemically synthesized
aaaatatctattatgtaccc

SEQ ID NO: 545394 - DNA, 20 bp, Artificial Sequence
  chemically synthesized
taaagagtaattttgatctt

SEQ ID NO: 545395 - DNA, 20 bp, Artificial Sequence
  chemically synthesized
tacaaaataataattgtgtg

SEQ ID NO: 545396 - DNA, 20 bp, Artificial Sequence
  chemically synthesized
tgattataaatattaaaaaa

SEQ ID NO: 545397 - DNA, 20 bp, Artificial Sequence
  chemically synthesized
gcatgatgtttactttaatg

SEQ ID NO: 545398 - DNA, 20 bp, Artificial Sequence
  chemically synthesized
aattggaatgtttgtcacat

SEQ ID NO: 545399 - DNA, 20 bp, Artificial Sequence
  chemically synthesized
tgaactcatggagatagaga

SEQ ID NO: 545400 - DNA, 20 bp, Artificial Sequence
  chemically synthesized
ttgattaaaataagcccggc

SEQ ID NO: 545401 - DNA, 20 bp, Artificial Sequence
  chemically synthesized
aagtcttaagcttgactaag

SEQ ID NO: 545402 - DNA, 20 bp, Artificial Sequence
  chemically synthesized
tgacaagtcttaagcttgac

SEQ ID NO: 545403 - DNA, 20 bp, Artificial Sequence
  chemically synthesized
aaccaaacccaaaattagta

SEQ ID NO: 545404 - DNA, 20 bp, Artificial Sequence
  chemically synthesized
gaatgatacaccttaaagag

SEQ ID NO: 545405 - DNA, 20 bp, Artificial Sequence
  chemically synthesized
gtttcctttttcattcgttt

SEQ ID NO: 545406 - DNA, 20 bp, Artificial Sequence
  chemically synthesized
aagaagttaagaaggaaact

SEQ ID NO: 545407 - DNA, 20 bp, Artificial Sequence
  chemically synthesized
atatatcaagatatcagtag

SEQ ID NO: 545408 - DNA, 20 bp, Artificial Sequence
  chemically synthesized
cttgatatattcagttgtga

SEQ ID NO: 545409 - DNA, 20 bp, Artificial Sequence
  chemically synthesized
gttctgccacgaaacaagtc

SEQ ID NO: 545410 - DNA, 20 bp, Artificial Sequence
  chemically synthesized
aattatccatgtgctgagaa

SEQ ID NO: 545411 - DNA, 20 bp, Artificial Sequence
  chemically synthesized
catccagacataaaatcaac

SEQ ID NO: 545412 - DNA, 20 bp, Artificial Sequence
  chemically synthesized
aagggacaacgccggtcatt

SEQ ID NO: 545413 - DNA, 20 bp, Artificial Sequence
  chemically synthesized
gaaacctattttgtctgata

SEQ ID NO: 545414 - DNA, 20 bp, Artificial Sequence
  chemically synthesized
acacaataatctgttactta

SEQ ID NO: 545415 - DNA, 20 bp, Artificial Sequence
  chemically synthesized
attgagtgacagaatggata

SEQ ID NO: 545416 - DNA, 20 bp, Artificial Sequence
  chemically synthesized
caatctaaatacattgagtg

SEQ ID NO: 545417 - DNA, 20 bp, Artificial Sequence
  chemically synthesized
aagagaaggccacaaaacaa

SEQ ID NO: 545418 - DNA, 20 bp, Artificial Sequence
  chemically synthesized
tagtaagacaggaaggaaag

SEQ ID NO: 545419 - DNA, 20 bp, Artificial Sequence
  chemically synthesized
agaatgtataacatatgacc

SEQ ID NO: 545420 - DNA, 20 bp, Artificial Sequence
  chemically synthesized
ctcaggtacataaaaattaa

SEQ ID NO: 545421 - DNA, 20 bp, Artificial Sequence
  chemically synthesized
gtggtaactatgaggtttgt

SEQ ID NO: 545422 - DNA, 20 bp, Artificial Sequence
  chemically synthesized
ttgcataaacaaataagcaa

SEQ ID NO: 545423 - DNA, 20 bp, Artificial Sequence
  chemically synthesized
gacactataataagatataa

SEQ ID NO: 545424 - DNA, 20 bp, Artificial Sequence
  chemically synthesized
gttataatattctctttgta

SEQ ID NO: 545425 - DNA, 20 bp, Artificial Sequence
  chemically synthesized
ttgttactattctgttacaa

SEQ ID NO: 545426 - DNA, 20 bp, Artificial Sequence
  chemically synthesized
aaagggcgttcttcaatctt

SEQ ID NO: 545427 - DNA, 20 bp, Artificial Sequence
  chemically synthesized
aacgccctttaccatttctt

SEQ ID NO: 545428 - DNA, 20 bp, Artificial Sequence
  chemically synthesized
ttaacaccaaaccttttcta

SEQ ID NO: 545429 - DNA, 20 bp, Artificial Sequence
  chemically synthesized
tctgtcagcttttctttgtc

SEQ ID NO: 545430 - DNA, 20 bp, Artificial Sequence
  chemically synthesized
aaatgaagactttctaagac

SEQ ID NO: 545431 - DNA, 20 bp, Artificial Sequence
  chemically synthesized
aaatcctcttcatacttgaa

SEQ ID NO: 545432 - DNA, 20 bp, Artificial Sequence
  chemically synthesized
attttcatagatatactatt

SEQ ID NO: 545433 - DNA, 20 bp, Artificial Sequence
  chemically synthesized
tgaaggaaaagacttttatt

SEQ ID NO: 545434 - DNA, 20 bp, Artificial Sequence
  chemically synthesized
catataaaaaaaaaaatcac

SEQ ID NO: 545435 - DNA, 20 bp, Artificial Sequence
  chemically synthesized
aacttccaaaggtcaaggat

SEQ ID NO: 545436 - DNA, 20 bp, Artificial Sequence
  chemically synthesized
aagaattgatcaagcaggag

SEQ ID NO: 545437 - DNA, 20 bp, Artificial Sequence
  chemically synthesized
acagaagaattgatcaagca

SEQ ID NO: 545438 - DNA, 20 bp, Artificial Sequence
  chemically synthesized
tgcgtcagagacgagtaaca

SEQ ID NO: 545439 - DNA, 20 bp, Artificial Sequence
  chemically synthesized
aaagatttaactgacatact

SEQ ID NO: 545440 - DNA, 20 bp, Artificial Sequence
  chemically synthesized
gtcagttaaatctttcaact

SEQ ID NO: 545441 - DNA, 20 bp, Artificial Sequence
  chemically synthesized
taacaaagggattgaaataa

SEQ ID NO: 545442 - DNA, 20 bp, Artificial Sequence
  chemically synthesized
agatagtacagagaaggaat

SEQ ID NO: 545443 - DNA, 20 bp, Artificial Sequence
  chemically synthesized
agatatgtgacctttcagac

SEQ ID NO: 545444 - DNA, 20 bp, Artificial Sequence
  chemically synthesized
ccggaagcatcaagaccatc

SEQ ID NO: 545445 - DNA, 20 bp, Artificial Sequence
  chemically synthesized
tctttgttgaggggaaggaa

SEQ ID NO: 545446 - DNA, 20 bp, Artificial Sequence
  chemically synthesized
gatatttctttatagcattg

SEQ ID NO: 545447 - DNA, 20 bp, Artificial Sequence
  chemically synthesized
ggccattctcacaatgctat

SEQ ID NO: 545448 - DNA, 20 bp, Artificial Sequence
  chemically synthesized
tctgatactgggtaatttat

SEQ ID NO: 545449 - DNA, 20 bp, Artificial Sequence
  chemically synthesized
ttttaaccaactggatctga

SEQ ID NO: 545450 - DNA, 20 bp, Artificial Sequence
  chemically synthesized
ggatagtgctaaaccattca

SEQ ID NO: 545451 - DNA, 20 bp, Artificial Sequence
  chemically synthesized
ccccaaggtctttacttatt

SEQ ID NO: 545452 - DNA, 20 bp, Artificial Sequence
  chemically synthesized
attttacgggctcataggta

SEQ ID NO: 545453 - DNA, 20 bp, Artificial Sequence
  chemically synthesized
caaaagggtgaaattggtca

SEQ ID NO: 545454 - DNA, 20 bp, Artificial Sequence
  chemically synthesized
gcagctttggaagctgaacc

SEQ ID NO: 545455 - DNA, 20 bp, Artificial Sequence
  chemically synthesized
gggccactgtcctccagact

SEQ ID NO: 545456 - DNA, 20 bp, Artificial Sequence
  chemically synthesized
agatccggaggcctaagagg

SEQ ID NO: 545457 - DNA, 20 bp, Artificial Sequence
  chemically synthesized
ggcttctgagcaaccacttg

SEQ ID NO: 545458 - DNA, 20 bp, Artificial Sequence
  chemically synthesized
atttgcaacatggatatgtg

SEQ ID NO: 545459 - DNA, 20 bp, Artificial Sequence
  chemically synthesized
ctactctctgatgcaggagc

SEQ ID NO: 545460 - DNA, 20 bp, Artificial Sequence
  chemically synthesized
cgtcttgaacattttgctgc

SEQ ID NO: 545461 - DNA, 20 bp, Artificial Sequence
  chemically synthesized
gctgtcgaggtctcagatgg

SEQ ID NO: 545462 - DNA, 20 bp, Artificial Sequence
  chemically synthesized
caatgcgagagtggcctagt

SEQ ID NO: 545463 - DNA, 20 bp, Artificial Sequence
  chemically synthesized
ggccactctcgcattgctat

SEQ ID NO: 545464 - DNA, 20 bp, Artificial Sequence
  chemically synthesized
cctgagactgagtaatttat

SEQ ID NO: 545465 - DNA, 20 bp, Artificial Sequence
  chemically synthesized
ttttaaacaaccagatcttg

SEQ ID NO: 545466 - DNA, 20 bp, Artificial Sequence
  chemically synthesized
actatatcaactcaagaacc

SEQ ID NO: 545467 - DNA, 20 bp, Artificial Sequence
  chemically synthesized
ggggtgccagcttagccaca

SEQ ID NO: 545468 - DNA, 20 bp, Artificial Sequence
  chemically synthesized
agtctctcccttcagggcag

SEQ ID NO: 545469 - DNA, 20 bp, Artificial Sequence
  chemically synthesized
cagctgtggtggctacaggg

SEQ ID NO: 545470 - DNA, 20 bp, Artificial Sequence
  chemically synthesized
aagagaaggaccccgtcctg

SEQ ID NO: 545471 - DNA, 20 bp, Artificial Sequence
  chemically synthesized
tcttctggcccagggtgtgt

SEQ ID NO: 545472 - DNA, 20 bp, Artificial Sequence
  chemically synthesized
cttatgaagaagagaggaga

SEQ ID NO: 545473 - DNA, 20 bp, Artificial Sequence
  chemically synthesized
ttagatgaaccctagacagg

SEQ ID NO: 545474 - DNA, 20 bp, Artificial Sequence
  chemically synthesized
agggagagctggtataggtg

SEQ ID NO: 545475 - DNA, 20 bp, Artificial Sequence
  chemically synthesized
cctggtttttgggttgtatc

SEQ ID NO: 545476 - DNA, 20 bp, Artificial Sequence
  chemically synthesized
aaattgaacaactgtccaca

SEQ ID NO: 545477 - DNA, 20 bp, Artificial Sequence
  chemically synthesized
aagtttattgtggaggaggt

SEQ ID NO: 545478 - DNA, 20 bp, Artificial Sequence
  chemically synthesized
tgtatcattaaatataggaa

SEQ ID NO: 545479 - DNA, 20 bp, Artificial Sequence
  chemically synthesized
aatcatgatatattataatc

SEQ ID NO: 545480 - DNA, 20 bp, Artificial Sequence
  chemically synthesized
aatggcaaacatgttttaat

SEQ ID NO: 545481 - DNA, 20 bp, Artificial Sequence
  chemically synthesized
agaaaagcaacattcattta

SEQ ID NO: 545482 - DNA, 20 bp, Artificial Sequence
  chemically synthesized
gtgaaatataagctttaaag

SEQ ID NO: 545483 - DNA, 20 bp, Artificial Sequence
  chemically synthesized
cagatgctgagggtacccat

SEQ ID NO: 545484 - DNA, 20 bp, Artificial Sequence
  chemically synthesized
ccctcagcatctgtgaagct

SEQ ID NO: 545485 - DNA, 20 bp, Artificial Sequence
  chemically synthesized
gctgagtctagtaaggaata

SEQ ID NO: 545486 - DNA, 20 bp, Artificial Sequence
  chemically synthesized
ctaatatagtagtttccatt

SEQ ID NO: 545487 - DNA, 20 bp, Artificial Sequence
  chemically synthesized
gaaagaaggtgctgtaaaga

SEQ ID NO: 545488 - DNA, 20 bp, Artificial Sequence
  chemically synthesized
acaacctcacagtaaatagt

SEQ ID NO: 545489 - DNA, 20 bp, Artificial Sequence
  chemically synthesized
taaagttccccatccaacaa

SEQ ID NO: 545490 - DNA, 20 bp, Artificial Sequence
  chemically synthesized
ttttcctacttaatggaatg

SEQ ID NO: 545491 - DNA, 20 bp, Artificial Sequence
  chemically synthesized
tgtttttatactgaattcta

SEQ ID NO: 545492 - DNA, 20 bp, Artificial Sequence
  chemically synthesized
gacacattttcgattttctc

SEQ ID NO: 545493 - DNA, 20 bp, Artificial Sequence
  chemically synthesized
catgagccaccacgcctggc

SEQ ID NO: 545494 - DNA, 20 bp, Artificial Sequence
  chemically synthesized
ctactggggaggctgaacca

SEQ ID NO: 545495 - DNA, 20 bp, Artificial Sequence
  chemically synthesized
gagactctgtctcaaaaaaa

SEQ ID NO: 545496 - DNA, 20 bp, Artificial Sequence
  chemically synthesized
ctgtctcaaaaaaaaaagaa

SEQ ID NO: 545497 - DNA, 20 bp, Artificial Sequence
  chemically synthesized
caaaaaaaaaagaaaaagaa

SEQ ID NO: 545498 - DNA, 20 bp, Artificial Sequence
  chemically synthesized
ttgccataatgtatttgcca

SEQ ID NO: 545499 - DNA, 20 bp, Artificial Sequence
  chemically synthesized
cttcctgattaaatgctttt

SEQ ID NO: 545500 - DNA, 20 bp, Artificial Sequence
  chemically synthesized
taaatgcttttaaagaaaat

SEQ ID NO: 545501 - DNA, 20 bp, Artificial Sequence
  chemically synthesized
actgtttaaattatctctag

SEQ ID NO: 545502 - DNA, 20 bp, Artificial Sequence
  chemically synthesized
ttctatttccacataaatga

SEQ ID NO: 545503 - DNA, 20 bp, Artificial Sequence
  chemically synthesized
agttatactacttatacatt

SEQ ID NO: 545504 - DNA, 20 bp, Artificial Sequence
  chemically synthesized
cttagtacaaaaattcccaa

SEQ ID NO: 545505 - DNA, 20 bp, Artificial Sequence
  chemically synthesized
atagagactggataatttat

SEQ ID NO: 545506 - DNA, 20 bp, Artificial Sequence
  chemically synthesized
tcggcatggctggggaggcc

SEQ ID NO: 545507 - DNA, 20 bp, Artificial Sequence
  chemically synthesized
atcagcattatttatctttg

SEQ ID NO: 545508 - DNA, 20 bp, Artificial Sequence
  chemically synthesized
ctctctcatttctgtgaatt

SEQ ID NO: 545509 - DNA, 20 bp, Artificial Sequence
  chemically synthesized
aagctaaatttctggaattc

SEQ ID NO: 545510 - DNA, 20 bp, Artificial Sequence
  chemically synthesized
tatcacatttttaattattg

SEQ ID NO: 545511 - DNA, 20 bp, Artificial Sequence
  chemically synthesized
gtctgttatatattattgca

SEQ ID NO: 545512 - DNA, 20 bp, Artificial Sequence
  chemically synthesized
agcaccatttttagagctcc

SEQ ID NO: 545513 - DNA, 20 bp, Artificial Sequence
  chemically synthesized
tatttggcccacgtcacttg

SEQ ID NO: 545514 - DNA, 20 bp, Artificial Sequence
  chemically synthesized
ctaactgaaattaagacaga

SEQ ID NO: 545515 - DNA, 20 bp, Artificial Sequence
  chemically synthesized
tcattctgatatatacagaa

SEQ ID NO: 545516 - DNA, 20 bp, Artificial Sequence
  chemically synthesized
caattctgattctgtatata

SEQ ID NO: 545517 - DNA, 20 bp, Artificial Sequence
  chemically synthesized
cagctctcattctgatatat

SEQ ID NO: 545518 - DNA, 20 bp, Artificial Sequence
  chemically synthesized
acattactggaagaagtaaa

SEQ ID NO: 545519 - DNA, 20 bp, Artificial Sequence
  chemically synthesized
cgcaaacttcactgcacttg

SEQ ID NO: 545520 - DNA, 20 bp, Artificial Sequence
  chemically synthesized
tggcatatgtgagagtggat

SEQ ID NO: 545521 - DNA, 20 bp, Artificial Sequence
  chemically synthesized
accatcaatgctttgactgg

SEQ ID NO: 545522 - DNA, 20 bp, Artificial Sequence
  chemically synthesized
attgtagttaggacatgcag

SEQ ID NO: 545523 - DNA, 20 bp, Artificial Sequence
  chemically synthesized
gcatgtcctaactacaatta

SEQ ID NO: 545524 - DNA, 20 bp, Artificial Sequence
  chemically synthesized
ttaattagtttattcataga

SEQ ID NO: 545525 - DNA, 20 bp, Artificial Sequence
  chemically synthesized
ggtaggaggtaaggaattcg

SEQ ID NO: 545526 - DNA, 20 bp, Artificial Sequence
  chemically synthesized
ataatgtagtgtttaaaaca

SEQ ID NO: 545527 - DNA, 20 bp, Artificial Sequence
  chemically synthesized
caatgtttatatgatttaaa

SEQ ID NO: 545528 - DNA, 20 bp, Artificial Sequence
  chemically synthesized
ttgtattagcttttacctca

SEQ ID NO: 545529 - DNA, 20 bp, Artificial Sequence
  chemically synthesized
aatttatgtccataaaagca

SEQ ID NO: 545530 - DNA, 20 bp, Artificial Sequence
  chemically synthesized
gggaaaatacaatagcaagg

SEQ ID NO: 545531 - DNA, 20 bp, Artificial Sequence
  chemically synthesized
aatgagagtgtggttatgaa

SEQ ID NO: 545532 - DNA, 20 bp, Artificial Sequence
  chemically synthesized
agagtgtggttatgaaggag

SEQ ID NO: 545533 - DNA, 20 bp, Artificial Sequence
  chemically synthesized
agggagcatgagcaggatga

SEQ ID NO: 545534 - DNA, 20 bp, Artificial Sequence
  chemically synthesized
aaaaaaaatgactgaggcaa

SEQ ID NO: 545535 - DNA, 20 bp, Artificial Sequence
  chemically synthesized
tgaggcaattagaaaaggct

SEQ ID NO: 545536 - DNA, 20 bp, Artificial Sequence
  chemically synthesized
aaaattatataatacttcat

SEQ ID NO: 545537 - DNA, 20 bp, Artificial Sequence
  chemically synthesized
gcaaaattattataaaatgt

SEQ ID NO: 545538 - DNA, 20 bp, Artificial Sequence
  chemically synthesized
acaaaactataaagtagaga

SEQ ID NO: 545539 - DNA, 20 bp, Artificial Sequence
  chemically synthesized
actataaagtagagaacaga

SEQ ID NO: 545540 - DNA, 20 bp, Artificial Sequence
  chemically synthesized
agttcacataaataagtgtt

SEQ ID NO: 545541 - DNA, 20 bp, Artificial Sequence
  chemically synthesized
tggagaggattttatgtaag

SEQ ID NO: 545542 - DNA, 20 bp, Artificial Sequence
  chemically synthesized
ccatcaacaattatgcaaaa

SEQ ID NO: 545543 - DNA, 20 bp, Artificial Sequence
  chemically synthesized
tatgtaggtgagagataggt

SEQ ID NO: 545544 - DNA, 20 bp, Artificial Sequence
  chemically synthesized
ggctttgtcttgcacttagt

SEQ ID NO: 545545 - DNA, 20 bp, Artificial Sequence
  chemically synthesized
agattaaaatgtaatgtgat

SEQ ID NO: 545546 - DNA, 20 bp, Artificial Sequence
  chemically synthesized
agccaagaaaaaaaagaaca

SEQ ID NO: 545547 - DNA, 20 bp, Artificial Sequence
  chemically synthesized
attctgtagaggctggcagc

SEQ ID NO: 545548 - DNA, 20 bp, Artificial Sequence
  chemically synthesized
tttcttggctgccagcctct

SEQ ID NO: 545549 - DNA, 20 bp, Artificial Sequence
  chemically synthesized
ttaacttttgttatatcaac

SEQ ID NO: 545550 - DNA, 20 bp, Artificial Sequence
  chemically synthesized
taagccttggtttagcgatt

SEQ ID NO: 545551 - DNA, 20 bp, Artificial Sequence
  chemically synthesized
aaaccctgtcttaggtagag

SEQ ID NO: 545552 - DNA, 20 bp, Artificial Sequence
  chemically synthesized
actctgaagtaatcatatat

SEQ ID NO: 545553 - DNA, 20 bp, Artificial Sequence
  chemically synthesized
agtttccattatcatggtca

SEQ ID NO: 545554 - DNA, 20 bp, Artificial Sequence
  chemically synthesized
ttacataatggcttatcaca

SEQ ID NO: 545555 - DNA, 20 bp, Artificial Sequence
  chemically synthesized
attatttgagcaacacaaat

SEQ ID NO: 545556 - DNA, 20 bp, Artificial Sequence
  chemically synthesized
attcatttttaaggaatttt

SEQ ID NO: 545557 - DNA, 20 bp, Artificial Sequence
  chemically synthesized
ttttgtacgtgttacagctt

SEQ ID NO: 545558 - DNA, 20 bp, Artificial Sequence
  chemically synthesized
ttcctcatccccatcccact

SEQ ID NO: 545559 - DNA, 20 bp, Artificial Sequence
  chemically synthesized
aatgaacatctttttaaatg

SEQ ID NO: 545560 - DNA, 20 bp, Artificial Sequence
  chemically synthesized
tttttatgtttcagataagc

SEQ ID NO: 545561 - DNA, 20 bp, Artificial Sequence
  chemically synthesized
tgctgtgtgaaattgagttg

SEQ ID NO: 545562 - DNA, 20 bp, Artificial Sequence
  chemically synthesized
tttattgaaaatggggagtg

SEQ ID NO: 545563 - DNA, 20 bp, Artificial Sequence
  chemically synthesized
taaagcaacctcaaacaaaa

SEQ ID NO: 545564 - DNA, 20 bp, Artificial Sequence
  chemically synthesized
gcaaatagaagttctaacct

SEQ ID NO: 545565 - DNA, 20 bp, Artificial Sequence
  chemically synthesized
ttttaagctcaggccttttg

SEQ ID NO: 545566 - DNA, 20 bp, Artificial Sequence
  chemically synthesized
atagatttatttttaaatga

SEQ ID NO: 545567 - DNA, 20 bp, Artificial Sequence
  chemically synthesized
atataaatcaaaacacatat

SEQ ID NO: 545568 - DNA, 20 bp, Artificial Sequence
  chemically synthesized
agatctgcttgttaccttta

SEQ ID NO: 545569 - DNA, 20 bp, Artificial Sequence
  chemically synthesized
tataagaaatatgtcatttt

SEQ ID NO: 545570 - DNA, 20 bp, Artificial Sequence
  chemically synthesized
agtatggctatgaattatct

SEQ ID NO: 545571 - DNA, 20 bp, Artificial Sequence
  chemically synthesized
atagccatactgtattttaa

SEQ ID NO: 545572 - DNA, 20 bp, Artificial Sequence
  chemically synthesized
tgacacgaaacttctcttct

SEQ ID NO: 545573 - DNA, 20 bp, Artificial Sequence
  chemically synthesized
tttaatgtttggaggaaaac

SEQ ID NO: 545574 - DNA, 20 bp, Artificial Sequence
  chemically synthesized
cctagaaaataataactatg

SEQ ID NO: 545575 - DNA, 20 bp, Artificial Sequence
  chemically synthesized
gggagactggttggattttc

SEQ ID NO: 545576 - DNA, 20 bp, Artificial Sequence
  chemically synthesized
aatccaaccagtctcccttg

SEQ ID NO: 545577 - DNA, 20 bp, Artificial Sequence
  chemically synthesized
tgtgtgccttgggaacaaac

SEQ ID NO: 545578 - DNA, 20 bp, Artificial Sequence
  chemically synthesized
caggaaaattatcagaagat

SEQ ID NO: 545579 - DNA, 20 bp, Artificial Sequence
  chemically synthesized
aatcagcttacttcccaatt

SEQ ID NO: 545580 - DNA, 20 bp, Artificial Sequence
  chemically synthesized
aaggaatttaatttgtattt

SEQ ID NO: 545581 - DNA, 20 bp, Artificial Sequence
  chemically synthesized
ctcagcactgccttgacaca

SEQ ID NO: 545582 - DNA, 20 bp, Artificial Sequence
  chemically synthesized
tattcctgttggccgatcag

SEQ ID NO: 545583 - DNA, 20 bp, Artificial Sequence
  chemically synthesized
ccttcaatggttgctctcca

SEQ ID NO: 545584 - DNA, 20 bp, Artificial Sequence
  chemically synthesized
ctttcaccacttccacatca

SEQ ID NO: 545585 - DNA, 20 bp, Artificial Sequence
  chemically synthesized
gtgcttgcaatgtgtcctca

SEQ ID NO: 545586 - DNA, 20 bp, Artificial Sequence
  chemically synthesized
tatatgtaagttattataaa

SEQ ID NO: 545587 - DNA, 20 bp, Artificial Sequence
  chemically synthesized
aataacttacatatacatta

SEQ ID NO: 545588 - DNA, 20 bp, Artificial Sequence
  chemically synthesized
cagaccagtaaaggcatcag

SEQ ID NO: 545589 - DNA, 20 bp, Artificial Sequence
  chemically synthesized
aggggaaaggaaggcaaaat

SEQ ID NO: 545590 - DNA, 20 bp, Artificial Sequence
  chemically synthesized
gaaaggaaggcaaaatttag

SEQ ID NO: 545591 - DNA, 20 bp, Artificial Sequence
  chemically synthesized
tcacagaagtcattatgctg

SEQ ID NO: 545592 - DNA, 20 bp, Artificial Sequence
  chemically synthesized
ttaattagcaggatattaag

SEQ ID NO: 545593 - DNA, 20 bp, Artificial Sequence
  chemically synthesized
aggtaccctggatcttctct

SEQ ID NO: 545594 - DNA, 20 bp, Artificial Sequence
  chemically synthesized
agagcaagcaaggaggtcga

SEQ ID NO: 545595 - DNA, 20 bp, Artificial Sequence
  chemically synthesized
ggtcgattagaaaaatctgg

SEQ ID NO: 545596 - DNA, 20 bp, Artificial Sequence
  chemically synthesized
gagcagaacaaacaaatatt

SEQ ID NO: 545597 - DNA, 20 bp, Artificial Sequence
  chemically synthesized
atattggagaaatatttgta

SEQ ID NO: 545598 - DNA, 20 bp, Artificial Sequence
  chemically synthesized
gggatttcataatctcaccc

SEQ ID NO: 545599 - DNA, 20 bp, Artificial Sequence
  chemically synthesized
gacctttctctgccactttt

SEQ ID NO: 545600 - DNA, 20 bp, Artificial Sequence
  chemically synthesized
ccagtttctataaaagtggc

SEQ ID NO: 545601 - DNA, 20 bp, Artificial Sequence
  chemically synthesized
tgttctaacccctaagacct

SEQ ID NO: 545602 - DNA, 20 bp, Artificial Sequence
  chemically synthesized
tgcacagggccctgagcgca

SEQ ID NO: 545603 - DNA, 20 bp, Artificial Sequence
  chemically synthesized
cagtaagtttagtaagattc

SEQ ID NO: 545604 - DNA, 20 bp, Artificial Sequence
  chemically synthesized
cagcaagaaggcaatttttt

SEQ ID NO: 545605 - DNA, 20 bp, Artificial Sequence
  chemically synthesized
ttcaagaaaatacaaacgac

SEQ ID NO: 545606 - DNA, 20 bp, Artificial Sequence
  chemically synthesized
cttatgctgaaattgatgat

SEQ ID NO: 545607 - DNA, 20 bp, Artificial Sequence
  chemically synthesized
tgctgaaattgatgatatag

SEQ ID NO: 545608 - DNA, 20 bp, Artificial Sequence
  chemically synthesized
attgttcccattttacagaa

SEQ ID NO: 545609 - DNA, 20 bp, Artificial Sequence
  chemically synthesized
cttccataataagattgtgg

SEQ ID NO: 545610 - DNA, 20 bp, Artificial Sequence
  chemically synthesized
ttacacaggattgaattttg

SEQ ID NO: 545611 - DNA, 20 bp, Artificial Sequence
  chemically synthesized
ctcagacaaaatatttaggt

SEQ ID NO: 545612 - DNA, 20 bp, Artificial Sequence
  chemically synthesized
atcaattcaactatatatat

SEQ ID NO: 545613 - DNA, 20 bp, Artificial Sequence
  chemically synthesized
attgtttttcaaattgtaag

SEQ ID NO: 545614 - DNA, 20 bp, Artificial Sequence
  chemically synthesized
taggaatattttaaaattaa

SEQ ID NO: 545615 - DNA, 20 bp, Artificial Sequence
  chemically synthesized
ccaattttgttttacaaact

SEQ ID NO: 545616 - DNA, 20 bp, Artificial Sequence
  chemically synthesized
aaacaaaattggaaatggct

SEQ ID NO: 545617 - DNA, 20 bp, Artificial Sequence
  chemically synthesized
gactaagcaaaccgacgaaa

SEQ ID NO: 545618 - DNA, 20 bp, Artificial Sequence
  chemically synthesized
tctatggaaaatatacaaat

SEQ ID NO: 545619 - DNA, 20 bp, Artificial Sequence
  chemically synthesized
aaataaaacgatgtttaatc

SEQ ID NO: 545620 - DNA, 20 bp, Artificial Sequence
  chemically synthesized
caaaatatgtttttatcatc

SEQ ID NO: 545621 - DNA, 20 bp, Artificial Sequence
  chemically synthesized
aagaacaaaaaccaactttc

SEQ ID NO: 545622 - DNA, 20 bp, Artificial Sequence
  chemically synthesized
gttctttatagatctattta

SEQ ID NO: 545623 - DNA, 20 bp, Artificial Sequence
  chemically synthesized
ttatttgcccaatgtactga

SEQ ID NO: 545624 - DNA, 20 bp, Artificial Sequence
  chemically synthesized
gggaaaaaaaaaaaacaaaa

SEQ ID NO: 545625 - DNA, 20 bp, Artificial Sequence
  chemically synthesized
ctcgggaggctgaggtagga

SEQ ID NO: 545626 - DNA, 20 bp, Artificial Sequence
  chemically synthesized
aggcggagcttgcagtgagc

SEQ ID NO: 545627 - DNA, 20 bp, Artificial Sequence
  chemically synthesized
aaaaaaaaaaaggtgaaaga

SEQ ID NO: 545628 - DNA, 20 bp, Artificial Sequence
  chemically synthesized
aaaaggtgaaagagcagaaa

SEQ ID NO: 545629 - DNA, 20 bp, Artificial Sequence
  chemically synthesized
ctgttttagtccagcaatgt

SEQ ID NO: 545630 - DNA, 20 bp, Artificial Sequence
  chemically synthesized
attatgactagaaattgtct

SEQ ID NO: 545631 - DNA, 20 bp, Artificial Sequence
  chemically synthesized
tctacgagtagaaattatga

SEQ ID NO: 545632 - DNA, 20 bp, Artificial Sequence
  chemically synthesized
tctagtcataatttctactc

SEQ ID NO: 545633 - DNA, 20 bp, Artificial Sequence
  chemically synthesized
tagtcagagaaattctacga

SEQ ID NO: 545634 - DNA, 20 bp, Artificial Sequence
  chemically synthesized
tactcgtagaatttctctga

SEQ ID NO: 545635 - DNA, 20 bp, Artificial Sequence
  chemically synthesized
cattagaaccatttctagtc

SEQ ID NO: 545636 - DNA, 20 bp, Artificial Sequence
  chemically synthesized
cagttaccccatctataaaa

SEQ ID NO: 545637 - DNA, 20 bp, Artificial Sequence
  chemically synthesized
gctaagcacattctagatcc

SEQ ID NO: 545638 - DNA, 20 bp, Artificial Sequence
  chemically synthesized
tgcagagcatttcttgggat

SEQ ID NO: 545639 - DNA, 20 bp, Artificial Sequence
  chemically synthesized
gaattgcccaaatcatgctt

SEQ ID NO: 545640 - DNA, 20 bp, Artificial Sequence
  chemically synthesized
cccagcaaaccacaaagctc

SEQ ID NO: 545641 - DNA, 20 bp, Artificial Sequence
  chemically synthesized
tatgatacatttaaatgaac

SEQ ID NO: 545642 - DNA, 20 bp, Artificial Sequence
  chemically synthesized
tactgaggggtaaaaagatt

SEQ ID NO: 545643 - DNA, 20 bp, Artificial Sequence
  chemically synthesized
caggtactaatcctggttgt

SEQ ID NO: 545644 - DNA, 20 bp, Artificial Sequence
  chemically synthesized
aaaacacagcggaaatgtgt

SEQ ID NO: 545645 - DNA, 20 bp, Artificial Sequence
  chemically synthesized
tggtttacgtgttatatctg

SEQ ID NO: 545646 - DNA, 20 bp, Artificial Sequence
  chemically synthesized
atgattactgaagtgattta

SEQ ID NO: 545647 - DNA, 20 bp, Artificial Sequence
  chemically synthesized
cactacaacagatcagggtg

SEQ ID NO: 545648 - DNA, 20 bp, Artificial Sequence
  chemically synthesized
agtaggatgaggaaatggaa

SEQ ID NO: 545649 - DNA, 20 bp, Artificial Sequence
  chemically synthesized
tatgatcaatctctttaaat

SEQ ID NO: 545650 - DNA, 20 bp, Artificial Sequence
  chemically synthesized
caatactcaatctcaaaaaa

SEQ ID NO: 545651 - DNA, 20 bp, Artificial Sequence
  chemically synthesized
ctactcgggaggctgaggca

SEQ ID NO: 545652 - DNA, 20 bp, Artificial Sequence
  chemically synthesized
ttgattgaatttgtggaaat

SEQ ID NO: 545653 - DNA, 20 bp, Artificial Sequence
  chemically synthesized
atatcacactgaggaagata

SEQ ID NO: 545654 - DNA, 20 bp, Artificial Sequence
  chemically synthesized
ctgaggaagataccagaata

SEQ ID NO: 545655 - DNA, 20 bp, Artificial Sequence
  chemically synthesized
acagttttttaaaaacataa

SEQ ID NO: 545656 - DNA, 20 bp, Artificial Sequence
  chemically synthesized
tgacacatgccttcttttag

SEQ ID NO: 545657 - DNA, 20 bp, Artificial Sequence
  chemically synthesized
gacttgacacatgccttctt

SEQ ID NO: 545658 - DNA, 20 bp, Artificial Sequence
  chemically synthesized
gtgagtggttctgcaatagt

SEQ ID NO: 545659 - DNA, 20 bp, Artificial Sequence
  chemically synthesized
tcactattgcagaaccactc

SEQ ID NO: 545660 - DNA, 20 bp, Artificial Sequence
  chemically synthesized
aaccttttgtttaataggct

SEQ ID NO: 545661 - DNA, 20 bp, Artificial Sequence
  chemically synthesized
ttgtccttgcgttagcttgc

SEQ ID NO: 545662 - DNA, 20 bp, Artificial Sequence
  chemically synthesized
ccatcgatgatagactggat

SEQ ID NO: 545663 - DNA, 20 bp, Artificial Sequence
  chemically synthesized
aattcctcaaggatctagaa

SEQ ID NO: 545664 - DNA, 20 bp, Artificial Sequence
  chemically synthesized
acaggtgctggagaggatgt

SEQ ID NO: 545665 - DNA, 20 bp, Artificial Sequence
  chemically synthesized
tgagataccattgcacatag

SEQ ID NO: 545666 - DNA, 20 bp, Artificial Sequence
  chemically synthesized
gctcatcatcactggccatc

SEQ ID NO: 545667 - DNA, 20 bp, Artificial Sequence
  chemically synthesized
aaagaagtcaaacaaattta

SEQ ID NO: 545668 - DNA, 20 bp, Artificial Sequence
  chemically synthesized
atctggcaaagggctaatat

SEQ ID NO: 545669 - DNA, 20 bp, Artificial Sequence
  chemically synthesized
aacaggcaacctacagaatg

SEQ ID NO: 545670 - DNA, 20 bp, Artificial Sequence
  chemically synthesized
tcatagtgaacaggcaacct

SEQ ID NO: 545671 - DNA, 20 bp, Artificial Sequence
  chemically synthesized
caaggagcttctgcaaagca

SEQ ID NO: 545672 - DNA, 20 bp, Artificial Sequence
  chemically synthesized
cctaaaaccataaaaaccta

SEQ ID NO: 545673 - DNA, 20 bp, Artificial Sequence
  chemically synthesized
ggaaaactggctagccatat

SEQ ID NO: 545674 - DNA, 20 bp, Artificial Sequence
  chemically synthesized
tatctgatctttgacaaacc

SEQ ID NO: 545675 - DNA, 20 bp, Artificial Sequence
  chemically synthesized
aatggaacagaacaaagccc

SEQ ID NO: 545676 - DNA, 20 bp, Artificial Sequence
  chemically synthesized
aaaacagcatggtactggta

SEQ ID NO: 545677 - DNA, 20 bp, Artificial Sequence
  chemically synthesized
gtagttttttccaattccgt

SEQ ID NO: 545678 - DNA, 20 bp, Artificial Sequence
  chemically synthesized
cattctatgctcatggatag

SEQ ID NO: 545679 - DNA, 20 bp, Artificial Sequence
  chemically synthesized
gattcttcctatccatgagc

SEQ ID NO: 545680 - DNA, 20 bp, Artificial Sequence
  chemically synthesized
tccattcacaattgcttcaa

SEQ ID NO: 545681 - DNA, 20 bp, Artificial Sequence
  chemically synthesized
ctctgtctgttattggtgta

SEQ ID NO: 545682 - DNA, 20 bp, Artificial Sequence
  chemically synthesized
cagatgacatgattgtatat

SEQ ID NO: 545683 - DNA, 20 bp, Artificial Sequence
  chemically synthesized
acatgattatctccatagat

SEQ ID NO: 545684 - DNA, 20 bp, Artificial Sequence
  chemically synthesized
gcatataaacagaaccaaag

SEQ ID NO: 545685 - DNA, 20 bp, Artificial Sequence
  chemically synthesized
gcagagacaaaacaaaaaaa

SEQ ID NO: 545686 - DNA, 20 bp, Artificial Sequence
  chemically synthesized
ttctgaaactattccaatga

SEQ ID NO: 545687 - DNA, 20 bp, Artificial Sequence
  chemically synthesized
agctcttccttgtacctctg

SEQ ID NO: 545688 - DNA, 20 bp, Artificial Sequence
  chemically synthesized
aacacctctacgcaaataaa

SEQ ID NO: 545689 - DNA, 20 bp, Artificial Sequence
  chemically synthesized
cagaaattcaaactaccatc

SEQ ID NO: 545690 - DNA, 20 bp, Artificial Sequence
  chemically synthesized
gggatatcaccaccgatccc

SEQ ID NO: 545691 - DNA, 20 bp, Artificial Sequence
  chemically synthesized
aagactaataagaaaagaga

SEQ ID NO: 545692 - DNA, 20 bp, Artificial Sequence
  chemically synthesized
tagatcgctagcaagactaa

SEQ ID NO: 545693 - DNA, 20 bp, Artificial Sequence
  chemically synthesized
attcaaaagctagcagaagg

SEQ ID NO: 545694 - DNA, 20 bp, Artificial Sequence
  chemically synthesized
tatagcactgaatgcccaca

SEQ ID NO: 545695 - DNA, 20 bp, Artificial Sequence
  chemically synthesized
gagaacaaagacacaacata

SEQ ID NO: 545696 - DNA, 20 bp, Artificial Sequence
  chemically synthesized
gggtacataacgaaatgaag

SEQ ID NO: 545697 - DNA, 20 bp, Artificial Sequence
  chemically synthesized
atcaaactagaactctggat

SEQ ID NO: 545698 - DNA, 20 bp, Artificial Sequence
  chemically synthesized
ccctcagcaaatgtaaaaga

SEQ ID NO: 545699 - DNA, 20 bp, Artificial Sequence
  chemically synthesized
taagtgtgatgtggtgctga

SEQ ID NO: 545700 - DNA, 20 bp, Artificial Sequence
  chemically synthesized
agaatgtcaacaaggatatc

SEQ ID NO: 545701 - DNA, 20 bp, Artificial Sequence
  chemically synthesized
acattagacagatcagtgag

SEQ ID NO: 545702 - DNA, 20 bp, Artificial Sequence
  chemically synthesized
tctaatactacataaagggt

SEQ ID NO: 545703 - DNA, 20 bp, Artificial Sequence
  chemically synthesized
tcttcaccctttatgtagta

SEQ ID NO: 545704 - DNA, 20 bp, Artificial Sequence
  chemically synthesized
ttaggggacaatttggctat

SEQ ID NO: 545705 - DNA, 20 bp, Artificial Sequence
  chemically synthesized
ttaagagaagtaagtctgaa

SEQ ID NO: 545706 - DNA, 20 bp, Artificial Sequence
  chemically synthesized
ttatagtaaaatctcagctg

SEQ ID NO: 545707 - DNA, 20 bp, Artificial Sequence
  chemically synthesized
gagagacatctgattttata

SEQ ID NO: 545708 - DNA, 20 bp, Artificial Sequence
  chemically synthesized
gaagcacaaatgaccttaaa

SEQ ID NO: 545709 - DNA, 20 bp, Artificial Sequence
  chemically synthesized
tagaattagagaaattagag

SEQ ID NO: 545710 - DNA, 20 bp, Artificial Sequence
  chemically synthesized
aagatataaatggtagaatt

SEQ ID NO: 545711 - DNA, 20 bp, Artificial Sequence
  chemically synthesized
tatacccaaagatataaatg

SEQ ID NO: 545712 - DNA, 20 bp, Artificial Sequence
  chemically synthesized
ggaataaaatataaaataag

SEQ ID NO: 545713 - DNA, 20 bp, Artificial Sequence
  chemically synthesized
tgtggattataatagccaag

SEQ ID NO: 545714 - DNA, 20 bp, Artificial Sequence
  chemically synthesized
tttcttccttcttgatttta

SEQ ID NO: 545715 - DNA, 20 bp, Artificial Sequence
  chemically synthesized
tttctcataaaatcaagaag

SEQ ID NO: 545716 - DNA, 20 bp, Artificial Sequence
  chemically synthesized
ataaaatcaagaaggaagaa

SEQ ID NO: 545717 - DNA, 20 bp, Artificial Sequence
  chemically synthesized
tctgaccttccattgattta

SEQ ID NO: 545718 - DNA, 20 bp, Artificial Sequence
  chemically synthesized
ctaaatcaatggaaggtcag

SEQ ID NO: 545719 - DNA, 20 bp, Artificial Sequence
  chemically synthesized
gagaaaataatagaagattt

SEQ ID NO: 545720 - DNA, 20 bp, Artificial Sequence
  chemically synthesized
tattataaacttgcttttaa

SEQ ID NO: 545721 - DNA, 20 bp, Artificial Sequence
  chemically synthesized
gcatcaataaaaaaactttc

SEQ ID NO: 545722 - DNA, 20 bp, Artificial Sequence
  chemically synthesized
tgtgccatctaataaatttc

SEQ ID NO: 545723 - DNA, 20 bp, Artificial Sequence
  chemically synthesized
ttatatgaaacagtaagaac

SEQ ID NO: 545724 - DNA, 20 bp, Artificial Sequence
  chemically synthesized
ccccccttttagggtgtttg

SEQ ID NO: 545725 - DNA, 20 bp, Artificial Sequence
  chemically synthesized
aggattaaggaaaataacat

SEQ ID NO: 545726 - DNA, 20 bp, Artificial Sequence
  chemically synthesized
tgcacttaaataatattcct

SEQ ID NO: 545727 - DNA, 20 bp, Artificial Sequence
  chemically synthesized
gctaagaatattataaatga

SEQ ID NO: 545728 - DNA, 20 bp, Artificial Sequence
  chemically synthesized
ggaataaatgagtacatagc

SEQ ID NO: 545729 - DNA, 20 bp, Artificial Sequence
  chemically synthesized
tattccacaagtctatatgt

SEQ ID NO: 545730 - DNA, 20 bp, Artificial Sequence
  chemically synthesized
acaagagatgtccccaaaat

SEQ ID NO: 545731 - DNA, 20 bp, Artificial Sequence
  chemically synthesized
agtcttggatcaaataacag

SEQ ID NO: 545732 - DNA, 20 bp, Artificial Sequence
  chemically synthesized
tacctattatctagcccttt

SEQ ID NO: 545733 - DNA, 20 bp, Artificial Sequence
  chemically synthesized
taatcaacagtgagaagttc

SEQ ID NO: 545734 - DNA, 20 bp, Artificial Sequence
  chemically synthesized
agagtgggaaagtgacccaa

SEQ ID NO: 545735 - DNA, 20 bp, Artificial Sequence
  chemically synthesized
gctgtatataacaatgtctc

SEQ ID NO: 545736 - DNA, 20 bp, Artificial Sequence
  chemically synthesized
ttgtttttatttagtgcaac

SEQ ID NO: 545737 - DNA, 20 bp, Artificial Sequence
  chemically synthesized
agaaaagatgtgtcaattta

SEQ ID NO: 545738 - DNA, 20 bp, Artificial Sequence
  chemically synthesized
cttggagaaaatttacctag

SEQ ID NO: 545739 - DNA, 20 bp, Artificial Sequence
  chemically synthesized
tgaatatagctaatgtcctt

SEQ ID NO: 545740 - DNA, 20 bp, Artificial Sequence
  chemically synthesized
cataaataaagagaaagcac

SEQ ID NO: 545741 - DNA, 20 bp, Artificial Sequence
  chemically synthesized
aaggtatgtaacataaataa

SEQ ID NO: 545742 - DNA, 20 bp, Artificial Sequence
  chemically synthesized
tggtatatccttcataaggg

SEQ ID NO: 545743 - DNA, 20 bp, Artificial Sequence
  chemically synthesized
tgaggacattttttttccta

SEQ ID NO: 545744 - DNA, 20 bp, Artificial Sequence
  chemically synthesized
tttccatgacagagcaggga

SEQ ID NO: 545745 - DNA, 20 bp, Artificial Sequence
  chemically synthesized
aaaggaataggaagagattc

SEQ ID NO: 545746 - DNA, 20 bp, Artificial Sequence
  chemically synthesized
tcttcagagcctgccatttc

SEQ ID NO: 545747 - DNA, 20 bp, Artificial Sequence
  chemically synthesized
gaaatctaccagagtcttcc

SEQ ID NO: 545748 - DNA, 20 bp, Artificial Sequence
  chemically synthesized
cgcagtaagtcttttgcatt

SEQ ID NO: 545749 - DNA, 20 bp, Artificial Sequence
  chemically synthesized
ctgaggaaatggaagcatga

SEQ ID NO: 545750 - DNA, 20 bp, Artificial Sequence
  chemically synthesized
gaaccctaagtgaggtgaac

SEQ ID NO: 545751 - DNA, 20 bp, Artificial Sequence
  chemically synthesized
tacctacagaaaataaatgg

SEQ ID NO: 545752 - DNA, 20 bp, Artificial Sequence
  chemically synthesized
tccatttattttctgtaggt

SEQ ID NO: 545753 - DNA, 20 bp, Artificial Sequence
  chemically synthesized
ttataaaatattctatacct

SEQ ID NO: 545754 - DNA, 20 bp, Artificial Sequence
  chemically synthesized
agcttctgtattaacaatat

SEQ ID NO: 545755 - DNA, 20 bp, Artificial Sequence
  chemically synthesized
ttctcaaattatttccaaaa

SEQ ID NO: 545756 - DNA, 20 bp, Artificial Sequence
  chemically synthesized
ttctgcttttggaaataatt

SEQ ID NO: 545757 - DNA, 20 bp, Artificial Sequence
  chemically synthesized
taggaaatctattttactac

SEQ ID NO: 545758 - DNA, 20 bp, Artificial Sequence
  chemically synthesized
agattatgttatcttaagta

SEQ ID NO: 545759 - DNA, 20 bp, Artificial Sequence
  chemically synthesized
aggcttatttaagaattaag

SEQ ID NO: 545760 - DNA, 20 bp, Artificial Sequence
  chemically synthesized
tcacaggcttatttaagaat

SEQ ID NO: 545761 - DNA, 20 bp, Artificial Sequence
  chemically synthesized
tgtctcttcacaggcttatt

SEQ ID NO: 545762 - DNA, 20 bp, Artificial Sequence
  chemically synthesized
tcttcatcatctaaattctt

SEQ ID NO: 545763 - DNA, 20 bp, Artificial Sequence
  chemically synthesized
agttctggtggtaaattcta

SEQ ID NO: 545764 - DNA, 20 bp, Artificial Sequence
  chemically synthesized
ggagacctgattcataaagg

SEQ ID NO: 545765 - DNA, 20 bp, Artificial Sequence
  chemically synthesized
tttttgtaataactcaaggg

SEQ ID NO: 545766 - DNA, 20 bp, Artificial Sequence
  chemically synthesized
tctgtgagtgtatgagagac

SEQ ID NO: 545767 - DNA, 20 bp, Artificial Sequence
  chemically synthesized
tctaagtctctcatacactc

SEQ ID NO: 545768 - DNA, 20 bp, Artificial Sequence
  chemically synthesized
tgaaaaagactggatgaatc

SEQ ID NO: 545769 - DNA, 20 bp, Artificial Sequence
  chemically synthesized
tcatccagtctttttcaccc

SEQ ID NO: 545770 - DNA, 20 bp, Artificial Sequence
  chemically synthesized
ataaacatataaaattggtc

SEQ ID NO: 545771 - DNA, 20 bp, Artificial Sequence
  chemically synthesized
tatatagacaagctatctgt

SEQ ID NO: 545772 - DNA, 20 bp, Artificial Sequence
  chemically synthesized
tatttgttctactttggaaa

SEQ ID NO: 545773 - DNA, 20 bp, Artificial Sequence
  chemically synthesized
actttggaaagcagaaatgg

SEQ ID NO: 545774 - DNA, 20 bp, Artificial Sequence
  chemically synthesized
gaaagcagaaatggaaagaa

SEQ ID NO: 545775 - DNA, 20 bp, Artificial Sequence
  chemically synthesized
aatggaaagaaacagaataa

SEQ ID NO: 545776 - DNA, 20 bp, Artificial Sequence
  chemically synthesized
agaggctattttgaaaatat

SEQ ID NO: 545777 - DNA, 20 bp, Artificial Sequence
  chemically synthesized
tttataagtattatgcaaat

SEQ ID NO: 545778 - DNA, 20 bp, Artificial Sequence
  chemically synthesized
ctatatataaaaacttccaa

SEQ ID NO: 545779 - DNA, 20 bp, Artificial Sequence
  chemically synthesized
attaaaattatgcaaattga

SEQ ID NO: 545780 - DNA, 20 bp, Artificial Sequence
  chemically synthesized
aaattgagtagaaaactcat

SEQ ID NO: 545781 - DNA, 20 bp, Artificial Sequence
  chemically synthesized
gggaagccatttaaggtaaa

SEQ ID NO: 545782 - DNA, 20 bp, Artificial Sequence
  chemically synthesized
agaaatcgtcacaagtatgc

SEQ ID NO: 545783 - DNA, 20 bp, Artificial Sequence
  chemically synthesized
tatgcttagaatttcctgat

SEQ ID NO: 545784 - DNA, 20 bp, Artificial Sequence
  chemically synthesized
atggttgttgtagggcagtg

SEQ ID NO: 545785 - DNA, 20 bp, Artificial Sequence
  chemically synthesized
tgtactctgataaactactc

SEQ ID NO: 545786 - DNA, 20 bp, Artificial Sequence
  chemically synthesized
gctgtgaaaggccaaatgaa

SEQ ID NO: 545787 - DNA, 20 bp, Artificial Sequence
  chemically synthesized
acagctcattagtacctcaa

SEQ ID NO: 545788 - DNA, 20 bp, Artificial Sequence
  chemically synthesized
aggcaaaggatggaaaggct

SEQ ID NO: 545789 - DNA, 20 bp, Artificial Sequence
  chemically synthesized
caaggagcaaatttatttgt

SEQ ID NO: 545790 - DNA, 20 bp, Artificial Sequence
  chemically synthesized
ataatcttgagtggagtcta

SEQ ID NO: 545791 - DNA, 20 bp, Artificial Sequence
  chemically synthesized
gatatctatccttgccttga

SEQ ID NO: 545792 - DNA, 20 bp, Artificial Sequence
  chemically synthesized
cttgaggagaaataagggaa

SEQ ID NO: 545793 - DNA, 20 bp, Artificial Sequence
  chemically synthesized
attattattttgctttttaa

SEQ ID NO: 545794 - DNA, 20 bp, Artificial Sequence
  chemically synthesized
atttgtactaagtgacagag

SEQ ID NO: 545795 - DNA, 20 bp, Artificial Sequence
  chemically synthesized
tatagccatatacaaaacag

SEQ ID NO: 545796 - DNA, 20 bp, Artificial Sequence
  chemically synthesized
cactgaaggcatgctaatca

SEQ ID NO: 545797 - DNA, 20 bp, Artificial Sequence
  chemically synthesized
tagaaggatgtaagtgttat

SEQ ID NO: 545798 - DNA, 20 bp, Artificial Sequence
  chemically synthesized
agtactagggaaaatatcat

SEQ ID NO: 545799 - DNA, 20 bp, Artificial Sequence
  chemically synthesized
cggtggaaaaggaagccaga

SEQ ID NO: 545800 - DNA, 20 bp, Artificial Sequence
  chemically synthesized
ggaagccagagaagaaacat

SEQ ID NO: 545801 - DNA, 20 bp, Artificial Sequence
  chemically synthesized
caccttaaccaggtatatat

SEQ ID NO: 545802 - DNA, 20 bp, Artificial Sequence
  chemically synthesized
ctactcgggaggctgaggca

SEQ ID NO: 545803 - DNA, 20 bp, Artificial Sequence
  chemically synthesized
ctcacacctgatgttgttga

SEQ ID NO: 545804 - DNA, 20 bp, Artificial Sequence
  chemically synthesized
ctaatcaacaacatcaggtg

SEQ ID NO: 545805 - DNA, 20 bp, Artificial Sequence
  chemically synthesized
gtatctaagtttggagtttg

SEQ ID NO: 545806 - DNA, 20 bp, Artificial Sequence
  chemically synthesized
aggaggctagataagatcat

SEQ ID NO: 545807 - DNA, 20 bp, Artificial Sequence
  chemically synthesized
aattaaaatcaaagcagatg

SEQ ID NO: 545808 - DNA, 20 bp, Artificial Sequence
  chemically synthesized
agcagatgctagaaaaacag

SEQ ID NO: 545809 - DNA, 20 bp, Artificial Sequence
  chemically synthesized
aacctggaatgtgtggtgcc

SEQ ID NO: 545810 - DNA, 20 bp, Artificial Sequence
  chemically synthesized
ggatactggttgtgatatat

SEQ ID NO: 545811 - DNA, 20 bp, Artificial Sequence
  chemically synthesized
gctagagaagtgtagtgtac

SEQ ID NO: 545812 - DNA, 20 bp, Artificial Sequence
  chemically synthesized
aagtgtagtgtaccgagaat

SEQ ID NO: 545813 - DNA, 20 bp, Artificial Sequence
  chemically synthesized
ctaaggttcagtggtacaga

SEQ ID NO: 545814 - DNA, 20 bp, Artificial Sequence
  chemically synthesized
gaacactaaggttcagtggt

SEQ ID NO: 545815 - DNA, 20 bp, Artificial Sequence
  chemically synthesized
tcgtctgaaaatgggaataa

SEQ ID NO: 545816 - DNA, 20 bp, Artificial Sequence
  chemically synthesized
acttagatcacaatggatat

SEQ ID NO: 545817 - DNA, 20 bp, Artificial Sequence
  chemically synthesized
tctcataagaacacgtccaa

SEQ ID NO: 545818 - DNA, 20 bp, Artificial Sequence
  chemically synthesized
gatcattctccacactgcat

SEQ ID NO: 545819 - DNA, 20 bp, Artificial Sequence
  chemically synthesized
gatcattctggatgcagtgt

SEQ ID NO: 545820 - DNA, 20 bp, Artificial Sequence
  chemically synthesized
gacaaggacagtacagttgt

SEQ ID NO: 545821 - DNA, 20 bp, Artificial Sequence
  chemically synthesized
ctaagcaaactaacccagga

SEQ ID NO: 545822 - DNA, 20 bp, Artificial Sequence
  chemically synthesized
ctgttcctgggttagtttgc

SEQ ID NO: 545823 - DNA, 20 bp, Artificial Sequence
  chemically synthesized
gaatactatgcgaccataaa

SEQ ID NO: 545824 - DNA, 20 bp, Artificial Sequence
  chemically synthesized
ccatcaatgatagactggat

SEQ ID NO: 545825 - DNA, 20 bp, Artificial Sequence
  chemically synthesized
ctacttgggaggctgaggaa

SEQ ID NO: 545826 - DNA, 20 bp, Artificial Sequence
  chemically synthesized
ttcaaaaccaccatatgacc

SEQ ID NO: 545827 - DNA, 20 bp, Artificial Sequence
  chemically synthesized
atattattcagtccttaaaa

SEQ ID NO: 545828 - DNA, 20 bp, Artificial Sequence
  chemically synthesized
ttgctacaacatggatgagc

SEQ ID NO: 545829 - DNA, 20 bp, Artificial Sequence
  chemically synthesized
gagcctagaatacattacac

SEQ ID NO: 545830 - DNA, 20 bp, Artificial Sequence
  chemically synthesized
agctctagaactcctcatgc

SEQ ID NO: 545831 - DNA, 20 bp, Artificial Sequence
  chemically synthesized
gacacgataaattggaggat

SEQ ID NO: 545832 - DNA, 20 bp, Artificial Sequence
  chemically synthesized
acatttcctccataaaacta

SEQ ID NO: 545833 - DNA, 20 bp, Artificial Sequence
  chemically synthesized
ctaggggtcaacattatgtg

SEQ ID NO: 545834 - DNA, 20 bp, Artificial Sequence
  chemically synthesized
cagtgtcaaatagacaaaat

SEQ ID NO: 545835 - DNA, 20 bp, Artificial Sequence
  chemically synthesized
aaaaaaaaaaacacaaaagc

SEQ ID NO: 545836 - DNA, 20 bp, Artificial Sequence
  chemically synthesized
tttaccattatctgacttga

SEQ ID NO: 545837 - DNA, 20 bp, Artificial Sequence
  chemically synthesized
ctactagtgaggctaaggca

SEQ ID NO: 545838 - DNA, 20 bp, Artificial Sequence
  chemically synthesized
atcaactttgtggactgaga

SEQ ID NO: 545839 - DNA, 20 bp, Artificial Sequence
  chemically synthesized
tattttttttacctcaagtg

SEQ ID NO: 545840 - DNA, 20 bp, Artificial Sequence
  chemically synthesized
aatgcaacagactattccat

SEQ ID NO: 545841 - DNA, 20 bp, Artificial Sequence
  chemically synthesized
tctgttgcattattcagtca

SEQ ID NO: 545842 - DNA, 20 bp, Artificial Sequence
  chemically synthesized
aggaaccttttaagccaact

SEQ ID NO: 545843 - DNA, 20 bp, Artificial Sequence
  chemically synthesized
tacagagactacggcattga

SEQ ID NO: 545844 - DNA, 20 bp, Artificial Sequence
  chemically synthesized
atttttcaggacaaaaatgt

SEQ ID NO: 545845 - DNA, 20 bp, Artificial Sequence
  chemically synthesized
tgttaatatttcagattggg

SEQ ID NO: 545846 - DNA, 20 bp, Artificial Sequence
  chemically synthesized
aggagatgggatagttcata

SEQ ID NO: 545847 - DNA, 20 bp, Artificial Sequence
  chemically synthesized
cttactttcatcactgaacc

SEQ ID NO: 545848 - DNA, 20 bp, Artificial Sequence
  chemically synthesized
tggaaaacaagaaataatac

SEQ ID NO: 545849 - DNA, 20 bp, Artificial Sequence
  chemically synthesized
ttaagtataagtgtggaaaa

SEQ ID NO: 545850 - DNA, 20 bp, Artificial Sequence
  chemically synthesized
aaatttgaagaggttcaagg

SEQ ID NO: 545851 - DNA, 20 bp, Artificial Sequence
  chemically synthesized
aaaagtacatgaaatttcac

SEQ ID NO: 545852 - DNA, 20 bp, Artificial Sequence
  chemically synthesized
cagatcagttaagaccagtg

SEQ ID NO: 545853 - DNA, 20 bp, Artificial Sequence
  chemically synthesized
tgaaagtgtcaaggttgcct

SEQ ID NO: 545854 - DNA, 20 bp, Artificial Sequence
  chemically synthesized
cttcactttgtggagctaaa

SEQ ID NO: 545855 - DNA, 20 bp, Artificial Sequence
  chemically synthesized
ttttataaggagatcatccc

SEQ ID NO: 545856 - DNA, 20 bp, Artificial Sequence
  chemically synthesized
tttaaaagtatcactgttga

SEQ ID NO: 545857 - DNA, 20 bp, Artificial Sequence
  chemically synthesized
caaaggccagaagacataac

SEQ ID NO: 545858 - DNA, 20 bp, Artificial Sequence
  chemically synthesized
ccttgttctatttggaattt

SEQ ID NO: 545859 - DNA, 20 bp, Artificial Sequence
  chemically synthesized
agattcatcagtgcaacctg

SEQ ID NO: 545860 - DNA, 20 bp, Artificial Sequence
  chemically synthesized
ttatttttaaatcatttgaa

SEQ ID NO: 545861 - DNA, 20 bp, Artificial Sequence
  chemically synthesized
ttacaatgcttttggcattc

SEQ ID NO: 545862 - DNA, 20 bp, Artificial Sequence
  chemically synthesized
tgtgtgtgtgtgtgtgagtg

SEQ ID NO: 545863 - DNA, 20 bp, Artificial Sequence
  chemically synthesized
gtttatgttggaacacaatt

SEQ ID NO: 545864 - DNA, 20 bp, Artificial Sequence
  chemically synthesized
tatctctcaccttggatctt

SEQ ID NO: 545865 - DNA, 20 bp, Artificial Sequence
  chemically synthesized
acagtttgatgtctggtaat

SEQ ID NO: 545866 - DNA, 20 bp, Artificial Sequence
  chemically synthesized
gtacatacacacacacactc

SEQ ID NO: 545867 - DNA, 20 bp, Artificial Sequence
  chemically synthesized
tatcagagagtaaaatatat

SEQ ID NO: 545868 - DNA, 20 bp, Artificial Sequence
  chemically synthesized
agaggtgcagattatatttg

SEQ ID NO: 545869 - DNA, 20 bp, Artificial Sequence
  chemically synthesized
taaaagtcaataaaacttat

SEQ ID NO: 545870 - DNA, 20 bp, Artificial Sequence
  chemically synthesized
ttagattactttgtaaagga

SEQ ID NO: 545871 - DNA, 20 bp, Artificial Sequence
  chemically synthesized
aaatgtgtactatagaattt

SEQ ID NO: 545872 - DNA, 20 bp, Artificial Sequence
  chemically synthesized
actggtcttaaatgtgtact

SEQ ID NO: 545873 - DNA, 20 bp, Artificial Sequence
  chemically synthesized
ttaagaccagtcatctgtga

SEQ ID NO: 545874 - DNA, 20 bp, Artificial Sequence
  chemically synthesized
accttgaggggtgttttttc

SEQ ID NO: 545875 - DNA, 20 bp, Artificial Sequence
  chemically synthesized
atatgataaaatgaaaaatg

SEQ ID NO: 545876 - DNA, 20 bp, Artificial Sequence
  chemically synthesized
ataaaatgaaaaatgacaga

SEQ ID NO: 545877 - DNA, 20 bp, Artificial Sequence
  chemically synthesized
aaacaatgacaaattggctt

SEQ ID NO: 545878 - DNA, 20 bp, Artificial Sequence
  chemically synthesized
acaggtcctaaagtattgct

SEQ ID NO: 545879 - DNA, 20 bp, Artificial Sequence
  chemically synthesized
gatagagggcagtccctttg

SEQ ID NO: 545880 - DNA, 20 bp, Artificial Sequence
  chemically synthesized
atataaaacacagcattttc

SEQ ID NO: 545881 - DNA, 20 bp, Artificial Sequence
  chemically synthesized
tgtgtctaattttattggat

SEQ ID NO: 545882 - DNA, 20 bp, Artificial Sequence
  chemically synthesized
tttaataatataaatcctta

SEQ ID NO: 545883 - DNA, 20 bp, Artificial Sequence
  chemically synthesized
tgtccagagttctgcttgac

SEQ ID NO: 545884 - DNA, 20 bp, Artificial Sequence
  chemically synthesized
atttttcctttgacataagc

SEQ ID NO: 545885 - DNA, 20 bp, Artificial Sequence
  chemically synthesized
cataacaaaactgtataggg

SEQ ID NO: 545886 - DNA, 20 bp, Artificial Sequence
  chemically synthesized
atatttggattaaaggctta

SEQ ID NO: 545887 - DNA, 20 bp, Artificial Sequence
  chemically synthesized
gggaattattggcttatgta

SEQ ID NO: 545888 - DNA, 20 bp, Artificial Sequence
  chemically synthesized
taattcccaaggtttaatta

SEQ ID NO: 545889 - DNA, 20 bp, Artificial Sequence
  chemically synthesized
attacaagaaatctttaatg

SEQ ID NO: 545890 - DNA, 20 bp, Artificial Sequence
  chemically synthesized
acatacacatacacacacat

SEQ ID NO: 545891 - DNA, 20 bp, Artificial Sequence
  chemically synthesized
caataatggaaaactcttct

SEQ ID NO: 545892 - DNA, 20 bp, Artificial Sequence
  chemically synthesized
gataccaaagtccatataaa

SEQ ID NO: 545893 - DNA, 20 bp, Artificial Sequence
  chemically synthesized
caacactattaggagatttg

SEQ ID NO: 545894 - DNA, 20 bp, Artificial Sequence
  chemically synthesized
acctactggcctctttaaac

SEQ ID NO: 545895 - DNA, 20 bp, Artificial Sequence
  chemically synthesized
actggcctctttaaaccaag

SEQ ID NO: 545896 - DNA, 20 bp, Artificial Sequence
  chemically synthesized
tggttacttgtttttgaagt

SEQ ID NO: 545897 - DNA, 20 bp, Artificial Sequence
  chemically synthesized
gtttttgaagtacagaaaaa

SEQ ID NO: 545898 - DNA, 20 bp, Artificial Sequence
  chemically synthesized
tatgaacagagacaggagag

SEQ ID NO: 545899 - DNA, 20 bp, Artificial Sequence
  chemically synthesized
gctttgcacaatcccctgac

SEQ ID NO: 545900 - DNA, 20 bp, Artificial Sequence
  chemically synthesized
ttgaagcctaaaaccaaatc

SEQ ID NO: 545901 - DNA, 20 bp, Artificial Sequence
  chemically synthesized
agtaaacaaatctgattgcc

SEQ ID NO: 545902 - DNA, 20 bp, Artificial Sequence
  chemically synthesized
acttttaaacaacacaataa

SEQ ID NO: 545903 - DNA, 20 bp, Artificial Sequence
  chemically synthesized
aaaactaaactaaatttata

SEQ ID NO: 545904 - DNA, 20 bp, Artificial Sequence
  chemically synthesized
tactgtgccatcagagagta

SEQ ID NO: 545905 - DNA, 20 bp, Artificial Sequence
  chemically synthesized
atctaagagtttccaagcag

SEQ ID NO: 545906 - DNA, 20 bp, Artificial Sequence
  chemically synthesized
ccttgtttacagctaaatgt

SEQ ID NO: 545907 - DNA, 20 bp, Artificial Sequence
  chemically synthesized
caaatgtactcaagatacaa

SEQ ID NO: 545908 - DNA, 20 bp, Artificial Sequence
  chemically synthesized
gaagatgatataagtacata

SEQ ID NO: 545909 - DNA, 20 bp, Artificial Sequence
  chemically synthesized
aatagcatcagtgtcattaa

SEQ ID NO: 545910 - DNA, 20 bp, Artificial Sequence
  chemically synthesized
ttattcatcaaatggaattt

SEQ ID NO: 545911 - DNA, 20 bp, Artificial Sequence
  chemically synthesized
tttcacaggcttgctataaa

SEQ ID NO: 545912 - DNA, 20 bp, Artificial Sequence
  chemically synthesized
agtggaagagagagaattgg

SEQ ID NO: 545913 - DNA, 20 bp, Artificial Sequence
  chemically synthesized
ctctttcaggagtggaagag

SEQ ID NO: 545914 - DNA, 20 bp, Artificial Sequence
  chemically synthesized
gtttgggaactggtaatgag

SEQ ID NO: 545915 - DNA, 20 bp, Artificial Sequence
  chemically synthesized
acaaattataaatcaggcaa

SEQ ID NO: 545916 - DNA, 20 bp, Artificial Sequence
  chemically synthesized
tcattttagcatacaggtta

SEQ ID NO: 545917 - DNA, 20 bp, Artificial Sequence
  chemically synthesized
aacacacacacaatctcatt

SEQ ID NO: 545918 - DNA, 20 bp, Artificial Sequence
  chemically synthesized
gagaaaattgataagctggt

SEQ ID NO: 545919 - DNA, 20 bp, Artificial Sequence
  chemically synthesized
taatatatccattttacact

SEQ ID NO: 545920 - DNA, 20 bp, Artificial Sequence
  chemically synthesized
agtgtaaaatggatatatta

SEQ ID NO: 545921 - DNA, 20 bp, Artificial Sequence
  chemically synthesized
ctaataaaatgattcagagc

SEQ ID NO: 545922 - DNA, 20 bp, Artificial Sequence
  chemically synthesized
agttgaccaaagtagtatgg

SEQ ID NO: 545923 - DNA, 20 bp, Artificial Sequence
  chemically synthesized
atgaacattttataaggtgt

SEQ ID NO: 545924 - DNA, 20 bp, Artificial Sequence
  chemically synthesized
agggctctattgcttcaact

SEQ ID NO: 545925 - DNA, 20 bp, Artificial Sequence
  chemically synthesized
aggacttatctgtctgtacc

SEQ ID NO: 545926 - DNA, 20 bp, Artificial Sequence
  chemically synthesized
ctcaccataccctatttttc

SEQ ID NO: 545927 - DNA, 20 bp, Artificial Sequence
  chemically synthesized
ccaaaatggcaatgaaattc

SEQ ID NO: 545928 - DNA, 20 bp, Artificial Sequence
  chemically synthesized
tttggggcaatgaattcttt

SEQ ID NO: 545929 - DNA, 20 bp, Artificial Sequence
  chemically synthesized
gaatttcaatcatattctca

SEQ ID NO: 545930 - DNA, 20 bp, Artificial Sequence
  chemically synthesized
gtacacatagtgtaaaggat

SEQ ID NO: 545931 - DNA, 20 bp, Artificial Sequence
  chemically synthesized
attactaattactgaaggat

SEQ ID NO: 545932 - DNA, 20 bp, Artificial Sequence
  chemically synthesized
gtgttaatcattgtccgtaa

SEQ ID NO: 545933 - DNA, 20 bp, Artificial Sequence
  chemically synthesized
ttcaaaaatcacaatttaat

SEQ ID NO: 545934 - DNA, 20 bp, Artificial Sequence
  chemically synthesized
tcactgacaaatgaaaattc

SEQ ID NO: 545935 - DNA, 20 bp, Artificial Sequence
  chemically synthesized
acttagaacaaaggttatat

SEQ ID NO: 545936 - DNA, 20 bp, Artificial Sequence
  chemically synthesized
tttggagatataatttattt

SEQ ID NO: 545937 - DNA, 20 bp, Artificial Sequence
  chemically synthesized
cacattaatttcattaacaa

SEQ ID NO: 545938 - DNA, 20 bp, Artificial Sequence
  chemically synthesized
ttccaaattttaagaggtag

SEQ ID NO: 545939 - DNA, 20 bp, Artificial Sequence
  chemically synthesized
agcattccaaattttaagag

SEQ ID NO: 545940 - DNA, 20 bp, Artificial Sequence
  chemically synthesized
taatagattccaataactta

SEQ ID NO: 545941 - DNA, 20 bp, Artificial Sequence
  chemically synthesized
tatacttagcagctcaattt

SEQ ID NO: 545942 - DNA, 20 bp, Artificial Sequence
  chemically synthesized
gtaaatgaaaaaagctagac

SEQ ID NO: 545943 - DNA, 20 bp, Artificial Sequence
  chemically synthesized
attttagatacctggtgtga

SEQ ID NO: 545944 - DNA, 20 bp, Artificial Sequence
  chemically synthesized
tatctaaaattgccaaactc

SEQ ID NO: 545945 - DNA, 20 bp, Artificial Sequence
  chemically synthesized
gcttttagaggctgaaagga

SEQ ID NO: 545946 - DNA, 20 bp, Artificial Sequence
  chemically synthesized
caacgttgtgtagcagatct

SEQ ID NO: 545947 - DNA, 20 bp, Artificial Sequence
  chemically synthesized
atctgttgagtgtccttaca

SEQ ID NO: 545948 - DNA, 20 bp, Artificial Sequence
  chemically synthesized
aatgtgttgaaaattgttag

SEQ ID NO: 545949 - DNA, 20 bp, Artificial Sequence
  chemically synthesized
acatttagtaagtagcagaa

SEQ ID NO: 545950 - DNA, 20 bp, Artificial Sequence
  chemically synthesized
tatgagtacattctacgaaa

SEQ ID NO: 545951 - DNA, 20 bp, Artificial Sequence
  chemically synthesized
ttagtgtttattcttgtttc

SEQ ID NO: 545952 - DNA, 20 bp, Artificial Sequence
  chemically synthesized
ataatataactctgactgtg

SEQ ID NO: 545953 - DNA, 20 bp, Artificial Sequence
  chemically synthesized
ttccctgccccatgaccaaa

SEQ ID NO: 545954 - DNA, 20 bp, Artificial Sequence
  chemically synthesized
aaattttctcttcacaaagg

SEQ ID NO: 545955 - DNA, 20 bp, Artificial Sequence
  chemically synthesized
tcacattctgtcctttgtga

SEQ ID NO: 545956 - DNA, 20 bp, Artificial Sequence
  chemically synthesized
agttcctagtcatttattta

SEQ ID NO: 545957 - DNA, 20 bp, Artificial Sequence
  chemically synthesized
aacataaaacaaatgtactg

SEQ ID NO: 545958 - DNA, 20 bp, Artificial Sequence
  chemically synthesized
atgaagcaaaacatataact

SEQ ID NO: 545959 - DNA, 20 bp, Artificial Sequence
  chemically synthesized
caggggaagttaatagaagg

SEQ ID NO: 545960 - DNA, 20 bp, Artificial Sequence
  chemically synthesized
tcagaacaaaagtaaataaa

SEQ ID NO: 545961 - DNA, 20 bp, Artificial Sequence
  chemically synthesized
aaaagtaaataaaatagaaa

SEQ ID NO: 545962 - DNA, 20 bp, Artificial Sequence
  chemically synthesized
aaatagaaactagaaaaaca

SEQ ID NO: 545963 - DNA, 20 bp, Artificial Sequence
  chemically synthesized
cacttaacaaggacaaaaaa

SEQ ID NO: 545964 - DNA, 20 bp, Artificial Sequence
  chemically synthesized
tttgaattacatttagttca

SEQ ID NO: 545965 - DNA, 20 bp, Artificial Sequence
  chemically synthesized
ggaatcttaatgtcaggcag

SEQ ID NO: 545966 - DNA, 20 bp, Artificial Sequence
  chemically synthesized
atgtcaggcagtgagaaaaa

SEQ ID NO: 545967 - DNA, 20 bp, Artificial Sequence
  chemically synthesized
ctaaagatgggggtgatgaa

SEQ ID NO: 545968 - DNA, 20 bp, Artificial Sequence
  chemically synthesized
tactgagactgaaactgaca

SEQ ID NO: 545969 - DNA, 20 bp, Artificial Sequence
  chemically synthesized
gctactcagaggctgaggca

SEQ ID NO: 545970 - DNA, 20 bp, Artificial Sequence
  chemically synthesized
tctaaacgttacgttaaata

SEQ ID NO: 545971 - DNA, 20 bp, Artificial Sequence
  chemically synthesized
tctaatatttaacgtaacgt

SEQ ID NO: 545972 - DNA, 20 bp, Artificial Sequence
  chemically synthesized
ttatagacagcctttggctt

SEQ ID NO: 545973 - DNA, 20 bp, Artificial Sequence
  chemically synthesized
tttctcaataaattaaagca

SEQ ID NO: 545974 - DNA, 20 bp, Artificial Sequence
  chemically synthesized
attcttatgctttaatttat

SEQ ID NO: 545975 - DNA, 20 bp, Artificial Sequence
  chemically synthesized
ttttcaaaatgtacttaaaa

SEQ ID NO: 545976 - DNA, 20 bp, Artificial Sequence
  chemically synthesized
tttctgtgtgtgtgtgctgg

SEQ ID NO: 545977 - DNA, 20 bp, Artificial Sequence
  chemically synthesized
tttctccccagcacacacac

SEQ ID NO: 545978 - DNA, 20 bp, Artificial Sequence
  chemically synthesized
cacagtcaaagttgttttga

SEQ ID NO: 545979 - DNA, 20 bp, Artificial Sequence
  chemically synthesized
aaaggtagaaaatgtatgga

SEQ ID NO: 545980 - DNA, 20 bp, Artificial Sequence
  chemically synthesized
ctatcacttactggtcaaag

SEQ ID NO: 545981 - DNA, 20 bp, Artificial Sequence
  chemically synthesized
tctttttgctattaggcgat

SEQ ID NO: 545982 - DNA, 20 bp, Artificial Sequence
  chemically synthesized
tttacgaggcttagataaga

SEQ ID NO: 545983 - DNA, 20 bp, Artificial Sequence
  chemically synthesized
agctttttacgaggcttaga

SEQ ID NO: 545984 - DNA, 20 bp, Artificial Sequence
  chemically synthesized
ctagcgtgatgaatgggatc

SEQ ID NO: 545985 - DNA, 20 bp, Artificial Sequence
  chemically synthesized
taatagaagagttacgtata

SEQ ID NO: 545986 - DNA, 20 bp, Artificial Sequence
  chemically synthesized
tattgctgttcactcaactc

SEQ ID NO: 545987 - DNA, 20 bp, Artificial Sequence
  chemically synthesized
atcgcaaactggggcatata

SEQ ID NO: 545988 - DNA, 20 bp, Artificial Sequence
  chemically synthesized
aaactccaagaggaaaagga

SEQ ID NO: 545989 - DNA, 20 bp, Artificial Sequence
  chemically synthesized
tggcatatcaaatagggtag

SEQ ID NO: 545990 - DNA, 20 bp, Artificial Sequence
  chemically synthesized
taggccagtgtatctggagc

SEQ ID NO: 545991 - DNA, 20 bp, Artificial Sequence
  chemically synthesized
ataatttcactttacactcg

SEQ ID NO: 545992 - DNA, 20 bp, Artificial Sequence
  chemically synthesized
tattccacaagacccatcga

SEQ ID NO: 545993 - DNA, 20 bp, Artificial Sequence
  chemically synthesized
gatttaaggcttgcaaagga

SEQ ID NO: 545994 - DNA, 20 bp, Artificial Sequence
  chemically synthesized
tgatatttgaatactcgcta

SEQ ID NO: 545995 - DNA, 20 bp, Artificial Sequence
  chemically synthesized
acactgctaaatttatgttg

SEQ ID NO: 545996 - DNA, 20 bp, Artificial Sequence
  chemically synthesized
tcgtattacatgtctcaaag

SEQ ID NO: 545997 - DNA, 20 bp, Artificial Sequence
  chemically synthesized
ggtctcacccaacttagaac

SEQ ID NO: 545998 - DNA, 20 bp, Artificial Sequence
  chemically synthesized
aattgccagcacaagacctt

SEQ ID NO: 545999 - DNA, 20 bp, Artificial Sequence
  chemically synthesized
cccagtcactccgcaaaggg

SEQ ID NO: 546000 - DNA, 20 bp, Artificial Sequence
  chemically synthesized
gtgaaatttaataaccagat

SEQ ID NO: 546001 - DNA, 20 bp, Artificial Sequence
  chemically synthesized
atgcaggttaaagactgctg

SEQ ID NO: 546002 - DNA, 20 bp, Artificial Sequence
  chemically synthesized
tattgagtaattagtatgtc

SEQ ID NO: 546003 - DNA, 20 bp, Artificial Sequence
  chemically synthesized
aatcgccactccttctttca

SEQ ID NO: 546004 - DNA, 20 bp, Artificial Sequence
  chemically synthesized
gattcctcagggatctagaa

SEQ ID NO: 546005 - DNA, 20 bp, Artificial Sequence
  chemically synthesized
ccaacaatgatagactggat

SEQ ID NO: 546006 - DNA, 20 bp, Artificial Sequence
  chemically synthesized
ttgtccttgcgatagtttgc

SEQ ID NO: 546007 - DNA, 20 bp, Artificial Sequence
  chemically synthesized
taaaagtataataaaaaaaa

SEQ ID NO: 546008 - DNA, 20 bp, Artificial Sequence
  chemically synthesized
agtataataaaaaaaaaaag

SEQ ID NO: 546009 - DNA, 20 bp, Artificial Sequence
  chemically synthesized
aagttgtaagagggcttatg

SEQ ID NO: 546010 - DNA, 20 bp, Artificial Sequence
  chemically synthesized
ctgataattttgcagaacat

SEQ ID NO: 546011 - DNA, 20 bp, Artificial Sequence
  chemically synthesized
aaattcataaagaacatgag

SEQ ID NO: 546012 - DNA, 20 bp, Artificial Sequence
  chemically synthesized
tgataaatcaataagtaaaa

SEQ ID NO: 546013 - DNA, 20 bp, Artificial Sequence
  chemically synthesized
tgtattggttatgatgcttt

SEQ ID NO: 546014 - DNA, 20 bp, Artificial Sequence
  chemically synthesized
atcataaccaatacatgatg

SEQ ID NO: 546015 - DNA, 20 bp, Artificial Sequence
  chemically synthesized
taatcatgctctatgaagca

SEQ ID NO: 546016 - DNA, 20 bp, Artificial Sequence
  chemically synthesized
taaattataaagtagaagta

SEQ ID NO: 546017 - DNA, 20 bp, Artificial Sequence
  chemically synthesized
aatttagatcattaatggaa

SEQ ID NO: 546018 - DNA, 20 bp, Artificial Sequence
  chemically synthesized
acctgaaaaagtcatttcaa

SEQ ID NO: 546019 - DNA, 20 bp, Artificial Sequence
  chemically synthesized
ataaagtaaatttgaatgtt

SEQ ID NO: 546020 - DNA, 20 bp, Artificial Sequence
  chemically synthesized
ttagcaatctgacacacaat

SEQ ID NO: 546021 - DNA, 20 bp, Artificial Sequence
  chemically synthesized
ttataaaaatagaactttaa

SEQ ID NO: 546022 - DNA, 20 bp, Artificial Sequence
  chemically synthesized
tgaattggtatgcagatgat

SEQ ID NO: 546023 - DNA, 20 bp, Artificial Sequence
  chemically synthesized
tacagtcattttttaaatta

SEQ ID NO: 546024 - DNA, 20 bp, Artificial Sequence
  chemically synthesized
tttgttcattataaagttta

SEQ ID NO: 546025 - DNA, 20 bp, Artificial Sequence
  chemically synthesized
ctaaataaggtatctcttca

SEQ ID NO: 546026 - DNA, 20 bp, Artificial Sequence
  chemically synthesized
ccccttaagcatgtcaatgt

SEQ ID NO: 546027 - DNA, 20 bp, Artificial Sequence
  chemically synthesized
atatgcaaggatatgtgctg

SEQ ID NO: 546028 - DNA, 20 bp, Artificial Sequence
  chemically synthesized
gcctaattttaatccctgct

SEQ ID NO: 546029 - DNA, 20 bp, Artificial Sequence
  chemically synthesized
aaaaaaaaaaaaaaaaaaaa

SEQ ID NO: 546030 - DNA, 20 bp, Artificial Sequence
  chemically synthesized
aaaaaaaaaaaaaaaaaaga

SEQ ID NO: 546031 - DNA, 20 bp, Artificial Sequence
  chemically synthesized
aaaaaaaaaaaaagaaaaga

SEQ ID NO: 546032 - DNA, 20 bp, Artificial Sequence
  chemically synthesized
aaaaaaaagaaaagaaaaga

SEQ ID NO: 546033 - DNA, 20 bp, Artificial Sequence
  chemically synthesized
aaaagaaaagaaaagaaaag

SEQ ID NO: 546034 - DNA, 20 bp, Artificial Sequence
  chemically synthesized
atataaggttaataatttaa

SEQ ID NO: 546035 - DNA, 20 bp, Artificial Sequence
  chemically synthesized
tattacaatctattttgttt

SEQ ID NO: 546036 - DNA, 20 bp, Artificial Sequence
  chemically synthesized
tgtaataaaattaatgcaaa

SEQ ID NO: 546037 - DNA, 20 bp, Artificial Sequence
  chemically synthesized
aatcaaattacttaatgaat

SEQ ID NO: 546038 - DNA, 20 bp, Artificial Sequence
  chemically synthesized
tagaaactagagatcgccct

SEQ ID NO: 546039 - DNA, 20 bp, Artificial Sequence
  chemically synthesized
catgtacctaagattacaga

SEQ ID NO: 546040 - DNA, 20 bp, Artificial Sequence
  chemically synthesized
ttgtatgtgtaatttaatac

SEQ ID NO: 546041 - DNA, 20 bp, Artificial Sequence
  chemically synthesized
gatttgaaatttcatttgtg

SEQ ID NO: 546042 - DNA, 20 bp, Artificial Sequence
  chemically synthesized
aggctcctgattaagaagtt

SEQ ID NO: 546043 - DNA, 20 bp, Artificial Sequence
  chemically synthesized
caactaacctggattcttca

SEQ ID NO: 546044 - DNA, 20 bp, Artificial Sequence
  chemically synthesized
agaacttacaagattcttct

SEQ ID NO: 546045 - DNA, 20 bp, Artificial Sequence
  chemically synthesized
gaagtatcagtgttacatcc

SEQ ID NO: 546046 - DNA, 20 bp, Artificial Sequence
  chemically synthesized
gggtccatcctagtcaaggg

SEQ ID NO: 546047 - DNA, 20 bp, Artificial Sequence
  chemically synthesized
agtgacccaaagagtaccaa

SEQ ID NO: 546048 - DNA, 20 bp, Artificial Sequence
  chemically synthesized
gccctgaacccatctgagac

SEQ ID NO: 546049 - DNA, 20 bp, Artificial Sequence
  chemically synthesized
cccagaatcaaaagagataa

SEQ ID NO: 546050 - DNA, 20 bp, Artificial Sequence
  chemically synthesized
aaatcaagtctttatggaag

SEQ ID NO: 546051 - DNA, 20 bp, Artificial Sequence
  chemically synthesized
ccataaagacttgatttgta

SEQ ID NO: 546052 - DNA, 20 bp, Artificial Sequence
  chemically synthesized
tttatgggatttgtcggttc

SEQ ID NO: 546053 - DNA, 20 bp, Artificial Sequence
  chemically synthesized
agagacaaaaaagtcatttt

SEQ ID NO: 546054 - DNA, 20 bp, Artificial Sequence
  chemically synthesized
atataattttaccaaccatt

SEQ ID NO: 546055 - DNA, 20 bp, Artificial Sequence
  chemically synthesized
aaaattatatatcatctctt

SEQ ID NO: 546056 - DNA, 20 bp, Artificial Sequence
  chemically synthesized
aaaaatataagtcaaaaaat

SEQ ID NO: 546057 - DNA, 20 bp, Artificial Sequence
  chemically synthesized
ttcaataagtagttaagggt

SEQ ID NO: 546058 - DNA, 20 bp, Artificial Sequence
  chemically synthesized
taattaatgcatagtgtatg

SEQ ID NO: 546059 - DNA, 20 bp, Artificial Sequence
  chemically synthesized
aagtatctttattttagaga

SEQ ID NO: 546060 - DNA, 20 bp, Artificial Sequence
  chemically synthesized
atgagaaaactgagtaatag

SEQ ID NO: 546061 - DNA, 20 bp, Artificial Sequence
  chemically synthesized
catgtttattttgatgtaaa

SEQ ID NO: 546062 - DNA, 20 bp, Artificial Sequence
  chemically synthesized
ttacatcaaaataaacatga

SEQ ID NO: 546063 - DNA, 20 bp, Artificial Sequence
  chemically synthesized
atgtatttgggacatggatg

SEQ ID NO: 546064 - DNA, 20 bp, Artificial Sequence
  chemically synthesized
agaaaatttcctattcttat

SEQ ID NO: 546065 - DNA, 20 bp, Artificial Sequence
  chemically synthesized
atataagtgataattctaaa

SEQ ID NO: 546066 - DNA, 20 bp, Artificial Sequence
  chemically synthesized
aattatcacttatatgtcaa

SEQ ID NO: 546067 - DNA, 20 bp, Artificial Sequence
  chemically synthesized
ttgtaagatttttttgaaga

SEQ ID NO: 546068 - DNA, 20 bp, Artificial Sequence
  chemically synthesized
cactatgaacaattttacac

SEQ ID NO: 546069 - DNA, 20 bp, Artificial Sequence
  chemically synthesized
ctaaaaacatggttaaattc

SEQ ID NO: 546070 - DNA, 20 bp, Artificial Sequence
  chemically synthesized
gtaatttttaaactctcaac

SEQ ID NO: 546071 - DNA, 20 bp, Artificial Sequence
  chemically synthesized
ttttctttaaaaaatgtttg

SEQ ID NO: 546072 - DNA, 20 bp, Artificial Sequence
  chemically synthesized
atttctatcaaacatttttt

SEQ ID NO: 546073 - DNA, 20 bp, Artificial Sequence
  chemically synthesized
taaggtcagcattaccaaag

SEQ ID NO: 546074 - DNA, 20 bp, Artificial Sequence
  chemically synthesized
aaagccagaaaaagacatcc

SEQ ID NO: 546075 - DNA, 20 bp, Artificial Sequence
  chemically synthesized
aaaatttgccagaattttgt

SEQ ID NO: 546076 - DNA, 20 bp, Artificial Sequence
  chemically synthesized
taatgtgttgttaaaatttg

SEQ ID NO: 546077 - DNA, 20 bp, Artificial Sequence
  chemically synthesized
tagtatgatacaccacgtta

SEQ ID NO: 546078 - DNA, 20 bp, Artificial Sequence
  chemically synthesized
ttcctcctgttcctgatttc

SEQ ID NO: 546079 - DNA, 20 bp, Artificial Sequence
  chemically synthesized
attgccatcggtagaagtgg

SEQ ID NO: 546080 - DNA, 20 bp, Artificial Sequence
  chemically synthesized
ggcaatactggaagtccttg

SEQ ID NO: 546081 - DNA, 20 bp, Artificial Sequence
  chemically synthesized
aaaaagtaaaggtatataaa

SEQ ID NO: 546082 - DNA, 20 bp, Artificial Sequence
  chemically synthesized
aaggtatataaatcagaaat

SEQ ID NO: 546083 - DNA, 20 bp, Artificial Sequence
  chemically synthesized
cagatgacataatcttatga

SEQ ID NO: 546084 - DNA, 20 bp, Artificial Sequence
  chemically synthesized
aatcttatgaatagaaaacc

SEQ ID NO: 546085 - DNA, 20 bp, Artificial Sequence
  chemically synthesized
ttgtgaatggaatttgtctc

SEQ ID NO: 546086 - DNA, 20 bp, Artificial Sequence
  chemically synthesized
tccattcacaagagcaccaa

SEQ ID NO: 546087 - DNA, 20 bp, Artificial Sequence
  chemically synthesized
aaaactataaaacattgatg

SEQ ID NO: 546088 - DNA, 20 bp, Artificial Sequence
  chemically synthesized
ttaaaattgtcattacattc

SEQ ID NO: 546089 - DNA, 20 bp, Artificial Sequence
  chemically synthesized
aaattccaatggcatttttc

SEQ ID NO: 546090 - DNA, 20 bp, Artificial Sequence
  chemically synthesized
atggcatttttcacagaaac

SEQ ID NO: 546091 - DNA, 20 bp, Artificial Sequence
  chemically synthesized
tgaaattcatatggaaccac

SEQ ID NO: 546092 - DNA, 20 bp, Artificial Sequence
  chemically synthesized
ccaaatggctaaatcaacct

SEQ ID NO: 546093 - DNA, 20 bp, Artificial Sequence
  chemically synthesized
cagacatatagaccaataga

SEQ ID NO: 546094 - DNA, 20 bp, Artificial Sequence
  chemically synthesized
ctcaatccataaaactccta

SEQ ID NO: 546095 - DNA, 20 bp, Artificial Sequence
  chemically synthesized
aagcaataaaagcaaaaaaa

SEQ ID NO: 546096 - DNA, 20 bp, Artificial Sequence
  chemically synthesized
taaaactaaaaatcttctgt

SEQ ID NO: 546097 - DNA, 20 bp, Artificial Sequence
  chemically synthesized
caaaccatatatatatatta

SEQ ID NO: 546098 - DNA, 20 bp, Artificial Sequence
  chemically synthesized
accctcctaatagctctgag

SEQ ID NO: 546099 - DNA, 20 bp, Artificial Sequence
  chemically synthesized
ttaaataaaatgaattatat

SEQ ID NO: 546100 - DNA, 20 bp, Artificial Sequence
  chemically synthesized
gttgctgtctttttgataac

SEQ ID NO: 546101 - DNA, 20 bp, Artificial Sequence
  chemically synthesized
ggttatcttctaaaatatat

SEQ ID NO: 546102 - DNA, 20 bp, Artificial Sequence
  chemically synthesized
accatttgggtgtcgtcttt

SEQ ID NO: 546103 - DNA, 20 bp, Artificial Sequence
  chemically synthesized
cagggaaatgtaaatgaaaa

SEQ ID NO: 546104 - DNA, 20 bp, Artificial Sequence
  chemically synthesized
cacttttggatatttatcca

SEQ ID NO: 546105 - DNA, 20 bp, Artificial Sequence
  chemically synthesized
ccactgatggatgaggggat

SEQ ID NO: 546106 - DNA, 20 bp, Artificial Sequence
  chemically synthesized
agattactattaatattcaa

SEQ ID NO: 546107 - DNA, 20 bp, Artificial Sequence
  chemically synthesized
attttacatacctcttataa

SEQ ID NO: 546108 - DNA, 20 bp, Artificial Sequence
  chemically synthesized
gaaggttcagctatgaaaga

SEQ ID NO: 546109 - DNA, 20 bp, Artificial Sequence
  chemically synthesized
acaagttgtacaacagatct

SEQ ID NO: 546110 - DNA, 20 bp, Artificial Sequence
  chemically synthesized
ggtacactgaagacttctga

SEQ ID NO: 546111 - DNA, 20 bp, Artificial Sequence
  chemically synthesized
actgaacaaattacccagaa

SEQ ID NO: 546112 - DNA, 20 bp, Artificial Sequence
  chemically synthesized
gatgtgactgaacaaattac

SEQ ID NO: 546113 - DNA, 20 bp, Artificial Sequence
  chemically synthesized
cctcagactgtccacatatt

SEQ ID NO: 546114 - DNA, 20 bp, Artificial Sequence
  chemically synthesized
atagtaatgccttttataaa

SEQ ID NO: 546115 - DNA, 20 bp, Artificial Sequence
  chemically synthesized
aaaaaaggatatccttttcc

SEQ ID NO: 546116 - DNA, 20 bp, Artificial Sequence
  chemically synthesized
gttgtgagtttgtttataaa

SEQ ID NO: 546117 - DNA, 20 bp, Artificial Sequence
  chemically synthesized
taagattttgtggtctgatc

SEQ ID NO: 546118 - DNA, 20 bp, Artificial Sequence
  chemically synthesized
actcctaataactatatgag

SEQ ID NO: 546119 - DNA, 20 bp, Artificial Sequence
  chemically synthesized
ggaaactgaggcccagagtt

SEQ ID NO: 546120 - DNA, 20 bp, Artificial Sequence
  chemically synthesized
ttacttgctatgtgaccttc

SEQ ID NO: 546121 - DNA, 20 bp, Artificial Sequence
  chemically synthesized
taggtaagagtgatgtcata

SEQ ID NO: 546122 - DNA, 20 bp, Artificial Sequence
  chemically synthesized
atgtggtcagcctctagaag

SEQ ID NO: 546123 - DNA, 20 bp, Artificial Sequence
  chemically synthesized
ttccttttggaggctgtaga

SEQ ID NO: 546124 - DNA, 20 bp, Artificial Sequence
  chemically synthesized
gcttaatttttgtgttttca

SEQ ID NO: 546125 - DNA, 20 bp, Artificial Sequence
  chemically synthesized
atccagaagaaagtgttttc

SEQ ID NO: 546126 - DNA, 20 bp, Artificial Sequence
  chemically synthesized
aaaacactttcttctggatt

SEQ ID NO: 546127 - DNA, 20 bp, Artificial Sequence
  chemically synthesized
atgtggcattctggaatcca

SEQ ID NO: 546128 - DNA, 20 bp, Artificial Sequence
  chemically synthesized
aaaaggtggctagaaagggg

SEQ ID NO: 546129 - DNA, 20 bp, Artificial Sequence
  chemically synthesized
aaaggggctgaaaaaggtgg

SEQ ID NO: 546130 - DNA, 20 bp, Artificial Sequence
  chemically synthesized
tatttggccagttgcttaag

SEQ ID NO: 546131 - DNA, 20 bp, Artificial Sequence
  chemically synthesized
atgtgacttatgaaataatt

SEQ ID NO: 546132 - DNA, 20 bp, Artificial Sequence
  chemically synthesized
ctagcatagcatatctggta

SEQ ID NO: 546133 - DNA, 20 bp, Artificial Sequence
  chemically synthesized
ctatgctagaggatcatgaa

SEQ ID NO: 546134 - DNA, 20 bp, Artificial Sequence
  chemically synthesized
ctactcgggaggctgaggca

SEQ ID NO: 546135 - DNA, 20 bp, Artificial Sequence
  chemically synthesized
acagcaggaggataataaaa

SEQ ID NO: 546136 - DNA, 20 bp, Artificial Sequence
  chemically synthesized
tgtgtgcgtaacgcaatata

SEQ ID NO: 546137 - DNA, 20 bp, Artificial Sequence
  chemically synthesized
caatatataagaatcaccgt

SEQ ID NO: 546138 - DNA, 20 bp, Artificial Sequence
  chemically synthesized
ctgccacttactaattaggc

SEQ ID NO: 546139 - DNA, 20 bp, Artificial Sequence
  chemically synthesized
gaataacattaaaaaatgga

SEQ ID NO: 546140 - DNA, 20 bp, Artificial Sequence
  chemically synthesized
taaaagaacaagtacagaga

SEQ ID NO: 546141 - DNA, 20 bp, Artificial Sequence
  chemically synthesized
aagctaaagaagttggaaga

SEQ ID NO: 546142 - DNA, 20 bp, Artificial Sequence
  chemically synthesized
agagccaggtaatgaaagac

SEQ ID NO: 546143 - DNA, 20 bp, Artificial Sequence
  chemically synthesized
aacccgctgagtgtagaggc

SEQ ID NO: 546144 - DNA, 20 bp, Artificial Sequence
  chemically synthesized
agaaaaatgtttcatcagtg

SEQ ID NO: 546145 - DNA, 20 bp, Artificial Sequence
  chemically synthesized
aagccatttgtctctgtgat

SEQ ID NO: 546146 - DNA, 20 bp, Artificial Sequence
  chemically synthesized
gtgtttacttgctggtctac

SEQ ID NO: 546147 - DNA, 20 bp, Artificial Sequence
  chemically synthesized
acaggctggatctgattcca

SEQ ID NO: 546148 - DNA, 20 bp, Artificial Sequence
  chemically synthesized
ctgatatgcttcctttagtg

SEQ ID NO: 546149 - DNA, 20 bp, Artificial Sequence
  chemically synthesized
ttggtaatatttacacaaag

SEQ ID NO: 546150 - DNA, 20 bp, Artificial Sequence
  chemically synthesized
gatgaggtgaaaatgtgcta

SEQ ID NO: 546151 - DNA, 20 bp, Artificial Sequence
  chemically synthesized
gtgctaccagaataggcatt

SEQ ID NO: 546152 - DNA, 20 bp, Artificial Sequence
  chemically synthesized
gaataggcattggagaaaac

SEQ ID NO: 546153 - DNA, 20 bp, Artificial Sequence
  chemically synthesized
tcgatggagagtcaagaggt

SEQ ID NO: 546154 - DNA, 20 bp, Artificial Sequence
  chemically synthesized
ggtcataactatttcaaagc

SEQ ID NO: 546155 - DNA, 20 bp, Artificial Sequence
  chemically synthesized
tgctaggattgctagatttg

SEQ ID NO: 546156 - DNA, 20 bp, Artificial Sequence
  chemically synthesized
attgtatggaacccaatata

SEQ ID NO: 546157 - DNA, 20 bp, Artificial Sequence
  chemically synthesized
ctccactgagtcttcctcat

SEQ ID NO: 546158 - DNA, 20 bp, Artificial Sequence
  chemically synthesized
tagaaagtactaaacattgc

SEQ ID NO: 546159 - DNA, 20 bp, Artificial Sequence
  chemically synthesized
agcaggctctgtagtattta

SEQ ID NO: 546160 - DNA, 20 bp, Artificial Sequence
  chemically synthesized
tgcagttatatttttcttac

SEQ ID NO: 546161 - DNA, 20 bp, Artificial Sequence
  chemically synthesized
tctaaaatatatattctatg

SEQ ID NO: 546162 - DNA, 20 bp, Artificial Sequence
  chemically synthesized
tcttacatagaatatatatt

SEQ ID NO: 546163 - DNA, 20 bp, Artificial Sequence
  chemically synthesized
gaatagataaaataattcac

SEQ ID NO: 546164 - DNA, 20 bp, Artificial Sequence
  chemically synthesized
tgtatttcctttacgtagat

SEQ ID NO: 546165 - DNA, 20 bp, Artificial Sequence
  chemically synthesized
gaggttattacataatgaaa

SEQ ID NO: 546166 - DNA, 20 bp, Artificial Sequence
  chemically synthesized
ttacgggaattcatatttat

SEQ ID NO: 546167 - DNA, 20 bp, Artificial Sequence
  chemically synthesized
agagaagactcaataacaaa

SEQ ID NO: 546168 - DNA, 20 bp, Artificial Sequence
  chemically synthesized
aaggactactttccaacatg

SEQ ID NO: 546169 - DNA, 20 bp, Artificial Sequence
  chemically synthesized
tattcgaaattggtatactc

SEQ ID NO: 546170 - DNA, 20 bp, Artificial Sequence
  chemically synthesized
tttttatttactttggattt

SEQ ID NO: 546171 - DNA, 20 bp, Artificial Sequence
  chemically synthesized
taaatccaaagtaaataaaa

SEQ ID NO: 546172 - DNA, 20 bp, Artificial Sequence
  chemically synthesized
aagagctctccacacattca

SEQ ID NO: 546173 - DNA, 20 bp, Artificial Sequence
  chemically synthesized
tctcaggcacaaacaacagt

SEQ ID NO: 546174 - DNA, 20 bp, Artificial Sequence
  chemically synthesized
tcttcactgttgtttgtgcc

SEQ ID NO: 546175 - DNA, 20 bp, Artificial Sequence
  chemically synthesized
atccaaaccacccactgttg

SEQ ID NO: 546176 - DNA, 20 bp, Artificial Sequence
  chemically synthesized
attcttcgttacataattgt

SEQ ID NO: 546177 - DNA, 20 bp, Artificial Sequence
  chemically synthesized
attctatacaattatgtaac

SEQ ID NO: 546178 - DNA, 20 bp, Artificial Sequence
  chemically synthesized
aactatttcaaataaacaat

SEQ ID NO: 546179 - DNA, 20 bp, Artificial Sequence
  chemically synthesized
tcaggataacaattttgaaa

SEQ ID NO: 546180 - DNA, 20 bp, Artificial Sequence
  chemically synthesized
atcaactagaacaaagagct

SEQ ID NO: 546181 - DNA, 20 bp, Artificial Sequence
  chemically synthesized
tacctaaaaatgcatataaa

SEQ ID NO: 546182 - DNA, 20 bp, Artificial Sequence
  chemically synthesized
cctttacacactttacctgt

SEQ ID NO: 546183 - DNA, 20 bp, Artificial Sequence
  chemically synthesized
atccttttagagtctcaaat

SEQ ID NO: 546184 - DNA, 20 bp, Artificial Sequence
  chemically synthesized
tccagagactaattagaaca

SEQ ID NO: 546185 - DNA, 20 bp, Artificial Sequence
  chemically synthesized
acagagtagctttcattaga

SEQ ID NO: 546186 - DNA, 20 bp, Artificial Sequence
  chemically synthesized
ttaccgctttggttctcagt

SEQ ID NO: 546187 - DNA, 20 bp, Artificial Sequence
  chemically synthesized
gtatccacaatataaattaa

SEQ ID NO: 546188 - DNA, 20 bp, Artificial Sequence
  chemically synthesized
attgtggtgcatgggataaa

SEQ ID NO: 546189 - DNA, 20 bp, Artificial Sequence
  chemically synthesized
cttcatatcctttgccacat

SEQ ID NO: 546190 - DNA, 20 bp, Artificial Sequence
  chemically synthesized
tgtgaagtatgtcattagta

SEQ ID NO: 546191 - DNA, 20 bp, Artificial Sequence
  chemically synthesized
ttaagtgaaataagccaggc

SEQ ID NO: 546192 - DNA, 20 bp, Artificial Sequence
  chemically synthesized
tgaattcatagaagtagaga

SEQ ID NO: 546193 - DNA, 20 bp, Artificial Sequence
  chemically synthesized
cttataatcagaacacctga

SEQ ID NO: 546194 - DNA, 20 bp, Artificial Sequence
  chemically synthesized
tcatggttctgatacttgca

SEQ ID NO: 546195 - DNA, 20 bp, Artificial Sequence
  chemically synthesized
caggtgattcatatgtacat

SEQ ID NO: 546196 - DNA, 20 bp, Artificial Sequence
  chemically synthesized
cctggggatcttttaaaact

SEQ ID NO: 546197 - DNA, 20 bp, Artificial Sequence
  chemically synthesized
tagctttggaattctgaagc

SEQ ID NO: 546198 - DNA, 20 bp, Artificial Sequence
  chemically synthesized
gaattggagatttctaggct

SEQ ID NO: 546199 - DNA, 20 bp, Artificial Sequence
  chemically synthesized
gaagtatagtatctactata

SEQ ID NO: 546200 - DNA, 20 bp, Artificial Sequence
  chemically synthesized
cttcaccgtatcttgaaatt

SEQ ID NO: 546201 - DNA, 20 bp, Artificial Sequence
  chemically synthesized
gtgagaaggaagaacatttt

SEQ ID NO: 546202 - DNA, 20 bp, Artificial Sequence
  chemically synthesized
tattaaataaaaccatgatg

SEQ ID NO: 546203 - DNA, 20 bp, Artificial Sequence
  chemically synthesized
gaattcaaaactgccagtag

SEQ ID NO: 546204 - DNA, 20 bp, Artificial Sequence
  chemically synthesized
ggtagaaataagtaattttt

SEQ ID NO: 546205 - DNA, 20 bp, Artificial Sequence
  chemically synthesized
atttcatcaacatacatttt

SEQ ID NO: 546206 - DNA, 20 bp, Artificial Sequence
  chemically synthesized
ttatccaggaaatttgaaag

SEQ ID NO: 546207 - DNA, 20 bp, Artificial Sequence
  chemically synthesized
tttcttattccaaattagaa

SEQ ID NO: 546208 - DNA, 20 bp, Artificial Sequence
  chemically synthesized
attctgcttctaatttggaa

SEQ ID NO: 546209 - DNA, 20 bp, Artificial Sequence
  chemically synthesized
caaagtaattgcattgctga

SEQ ID NO: 546210 - DNA, 20 bp, Artificial Sequence
  chemically synthesized
taattcagtttcctatttaa

SEQ ID NO: 546211 - DNA, 20 bp, Artificial Sequence
  chemically synthesized
attcggggcagtgggaatat

SEQ ID NO: 546212 - DNA, 20 bp, Artificial Sequence
  chemically synthesized
atgaaactggtagattgtac

SEQ ID NO: 546213 - DNA, 20 bp, Artificial Sequence
  chemically synthesized
gagggatcatcaacagcaaa

SEQ ID NO: 546214 - DNA, 20 bp, Artificial Sequence
  chemically synthesized
ttaaagtaaattctttaagt

SEQ ID NO: 546215 - DNA, 20 bp, Artificial Sequence
  chemically synthesized
cagcaatccattctgtactt

SEQ ID NO: 546216 - DNA, 20 bp, Artificial Sequence
  chemically synthesized
gattgctggaggaaaacttg

SEQ ID NO: 546217 - DNA, 20 bp, Artificial Sequence
  chemically synthesized
gaagtcatttttgatccatc

SEQ ID NO: 546218 - DNA, 20 bp, Artificial Sequence
  chemically synthesized
gttggctgggggaagcatga

SEQ ID NO: 546219 - DNA, 20 bp, Artificial Sequence
  chemically synthesized
gagaccattgttaattagtt

SEQ ID NO: 546220 - DNA, 20 bp, Artificial Sequence
  chemically synthesized
ctgactccccccgcaaaacc

SEQ ID NO: 546221 - DNA, 20 bp, Artificial Sequence
  chemically synthesized
ggtttgtttttgtgttaatg

SEQ ID NO: 546222 - DNA, 20 bp, Artificial Sequence
  chemically synthesized
atactattaacaggaagcca

SEQ ID NO: 546223 - DNA, 20 bp, Artificial Sequence
  chemically synthesized
ctaagtgattgtcatgtgct

SEQ ID NO: 546224 - DNA, 20 bp, Artificial Sequence
  chemically synthesized
gtgatcacctaagtatttgt

SEQ ID NO: 546225 - DNA, 20 bp, Artificial Sequence
  chemically synthesized
tacagaggacagttaaagtc

SEQ ID NO: 546226 - DNA, 20 bp, Artificial Sequence
  chemically synthesized
gttaaagtcatagaaattga

SEQ ID NO: 546227 - DNA, 20 bp, Artificial Sequence
  chemically synthesized
atccaatctttgaagccgtc

SEQ ID NO: 546228 - DNA, 20 bp, Artificial Sequence
  chemically synthesized
cctcaaatatgaaacactca

SEQ ID NO: 546229 - DNA, 20 bp, Artificial Sequence
  chemically synthesized
aaaggctagtcaaaatcaga

SEQ ID NO: 546230 - DNA, 20 bp, Artificial Sequence
  chemically synthesized
atacactgagatagtatctg

SEQ ID NO: 546231 - DNA, 20 bp, Artificial Sequence
  chemically synthesized
ctttcaacatgccctcaccc

SEQ ID NO: 546232 - DNA, 20 bp, Artificial Sequence
  chemically synthesized
ccattcctgcctgtcccttg

SEQ ID NO: 546233 - DNA, 20 bp, Artificial Sequence
  chemically synthesized
ggacaggcaggaatggaaat

SEQ ID NO: 546234 - DNA, 20 bp, Artificial Sequence
  chemically synthesized
aaactgtgagaggatgtcat

SEQ ID NO: 546235 - DNA, 20 bp, Artificial Sequence
  chemically synthesized
aaaataaataaattcactga

SEQ ID NO: 546236 - DNA, 20 bp, Artificial Sequence
  chemically synthesized
tcactgagaagaaaaggaat

SEQ ID NO: 546237 - DNA, 20 bp, Artificial Sequence
  chemically synthesized
tggtcataaactagccatag

SEQ ID NO: 546238 - DNA, 20 bp, Artificial Sequence
  chemically synthesized
agaatgctcaaaatatgaaa

SEQ ID NO: 546239 - DNA, 20 bp, Artificial Sequence
  chemically synthesized
acttccagcactttgtcctt

SEQ ID NO: 546240 - DNA, 20 bp, Artificial Sequence
  chemically synthesized
gccatgatatggtctacaac

SEQ ID NO: 546241 - DNA, 20 bp, Artificial Sequence
  chemically synthesized
gtatatagtgacttgtaagt

SEQ ID NO: 546242 - DNA, 20 bp, Artificial Sequence
  chemically synthesized
gctaaggcagaacatatctt

SEQ ID NO: 546243 - DNA, 20 bp, Artificial Sequence
  chemically synthesized
taatggcctatatttatcca

SEQ ID NO: 546244 - DNA, 20 bp, Artificial Sequence
  chemically synthesized
acatgcttatggtgtaacta

SEQ ID NO: 546245 - DNA, 20 bp, Artificial Sequence
  chemically synthesized
tcaccatcatcttgttacaa

SEQ ID NO: 546246 - DNA, 20 bp, Artificial Sequence
  chemically synthesized
acaggtgccggagaggatgt

SEQ ID NO: 546247 - DNA, 20 bp, Artificial Sequence
  chemically synthesized
gagataccatctcacaccag

SEQ ID NO: 546248 - DNA, 20 bp, Artificial Sequence
  chemically synthesized
gctcatcatcactggccatc

SEQ ID NO: 546249 - DNA, 20 bp, Artificial Sequence
  chemically synthesized
aatgtctcagggatctagaa

SEQ ID NO: 546250 - DNA, 20 bp, Artificial Sequence
  chemically synthesized
ccaacaatgatagactggat

SEQ ID NO: 546251 - DNA, 20 bp, Artificial Sequence
  chemically synthesized
ttgtccttgtgatagtttgc

SEQ ID NO: 546252 - DNA, 20 bp, Artificial Sequence
  chemically synthesized
ctattcgggaggctgaggtt

SEQ ID NO: 546253 - DNA, 20 bp, Artificial Sequence
  chemically synthesized
caaacaaacaaaaaattaaa

SEQ ID NO: 546254 - DNA, 20 bp, Artificial Sequence
  chemically synthesized
ctactcgggaggctgaggca

SEQ ID NO: 546255 - DNA, 20 bp, Artificial Sequence
  chemically synthesized
ctatattgaaaatatgagac

SEQ ID NO: 546256 - DNA, 20 bp, Artificial Sequence
  chemically synthesized
cccagagatatgttctcatg

SEQ ID NO: 546257 - DNA, 20 bp, Artificial Sequence
  chemically synthesized
tacagtggcaagtggtaaac

SEQ ID NO: 546258 - DNA, 20 bp, Artificial Sequence
  chemically synthesized
gatagtttttggaaattaaa

SEQ ID NO: 546259 - DNA, 20 bp, Artificial Sequence
  chemically synthesized
cctgttgattagggcacacg

SEQ ID NO: 546260 - DNA, 20 bp, Artificial Sequence
  chemically synthesized
gtcagcatgggagactacag

SEQ ID NO: 546261 - DNA, 20 bp, Artificial Sequence
  chemically synthesized
caggcatgtcgagagaattg

SEQ ID NO: 546262 - DNA, 20 bp, Artificial Sequence
  chemically synthesized
ttcccacaacaggcatgtcg

SEQ ID NO: 546263 - DNA, 20 bp, Artificial Sequence
  chemically synthesized
actttttctagcagcagagg

SEQ ID NO: 546264 - DNA, 20 bp, Artificial Sequence
  chemically synthesized
actttttctttcctctgctg

SEQ ID NO: 546265 - DNA, 20 bp, Artificial Sequence
  chemically synthesized
atacttgatacacagtgagg

SEQ ID NO: 546266 - DNA, 20 bp, Artificial Sequence
  chemically synthesized
gaaatcccaaaatataccag

SEQ ID NO: 546267 - DNA, 20 bp, Artificial Sequence
  chemically synthesized
ttttgaaatcccaaaatata

SEQ ID NO: 546268 - DNA, 20 bp, Artificial Sequence
  chemically synthesized
taattagggatgatgttaac

SEQ ID NO: 546269 - DNA, 20 bp, Artificial Sequence
  chemically synthesized
caattaatcacgttttataa

SEQ ID NO: 546270 - DNA, 20 bp, Artificial Sequence
  chemically synthesized
tccatttcctaattcctaag

SEQ ID NO: 546271 - DNA, 20 bp, Artificial Sequence
  chemically synthesized
atcatatgtcatacgcaaca

SEQ ID NO: 546272 - DNA, 20 bp, Artificial Sequence
  chemically synthesized
cagcatgcctccagtagtgc

SEQ ID NO: 546273 - DNA, 20 bp, Artificial Sequence
  chemically synthesized
cctaattacaatggtggaag

SEQ ID NO: 546274 - DNA, 20 bp, Artificial Sequence
  chemically synthesized
caatgtgaaaaaaatgcaat

SEQ ID NO: 546275 - DNA, 20 bp, Artificial Sequence
  chemically synthesized
atcaaatgtgaagcattgat

SEQ ID NO: 546276 - DNA, 20 bp, Artificial Sequence
  chemically synthesized
ataagggataactttataaa

SEQ ID NO: 546277 - DNA, 20 bp, Artificial Sequence
  chemically synthesized
gagaatgtaataaatgatgt

SEQ ID NO: 546278 - DNA, 20 bp, Artificial Sequence
  chemically synthesized
gtatattttttgaatagtga

SEQ ID NO: 546279 - DNA, 20 bp, Artificial Sequence
  chemically synthesized
aaacaagaccaatgtgtgaa

SEQ ID NO: 546280 - DNA, 20 bp, Artificial Sequence
  chemically synthesized
aatgaatcaaaaatgcaaaa

SEQ ID NO: 546281 - DNA, 20 bp, Artificial Sequence
  chemically synthesized
atgagttaagacctaatggg

SEQ ID NO: 546282 - DNA, 20 bp, Artificial Sequence
  chemically synthesized
tattatgtttattttttata

SEQ ID NO: 546283 - DNA, 20 bp, Artificial Sequence
  chemically synthesized
attgagcactgcttgaaggg

SEQ ID NO: 546284 - DNA, 20 bp, Artificial Sequence
  chemically synthesized
tcttttgcagaattttgtag

SEQ ID NO: 546285 - DNA, 20 bp, Artificial Sequence
  chemically synthesized
taccaaactgaatctctttt

SEQ ID NO: 546286 - DNA, 20 bp, Artificial Sequence
  chemically synthesized
caaaagagattcagtttggt

SEQ ID NO: 546287 - DNA, 20 bp, Artificial Sequence
  chemically synthesized
ttcaccactctcttgtgagt

SEQ ID NO: 546288 - DNA, 20 bp, Artificial Sequence
  chemically synthesized
atttttggaaatgtgatcaa

SEQ ID NO: 546289 - DNA, 20 bp, Artificial Sequence
  chemically synthesized
tttgaagaacatctcatgct

SEQ ID NO: 546290 - DNA, 20 bp, Artificial Sequence
  chemically synthesized
aataatattgactgatatct

SEQ ID NO: 546291 - DNA, 20 bp, Artificial Sequence
  chemically synthesized
tttacaattatcattatttg

SEQ ID NO: 546292 - DNA, 20 bp, Artificial Sequence
  chemically synthesized
gctttttaagctcagatata

SEQ ID NO: 546293 - DNA, 20 bp, Artificial Sequence
  chemically synthesized
atatgagaaagggattcaat

SEQ ID NO: 546294 - DNA, 20 bp, Artificial Sequence
  chemically synthesized
agcaacttcaaagactaaat

SEQ ID NO: 546295 - DNA, 20 bp, Artificial Sequence
  chemically synthesized
gagaaaaggaaaggctttgc

SEQ ID NO: 546296 - DNA, 20 bp, Artificial Sequence
  chemically synthesized
cagccactgagaaaaggaaa

SEQ ID NO: 546297 - DNA, 20 bp, Artificial Sequence
  chemically synthesized
tttaaccctcatccagccac

SEQ ID NO: 546298 - DNA, 20 bp, Artificial Sequence
  chemically synthesized
agaagaactggaagctatac

SEQ ID NO: 546299 - DNA, 20 bp, Artificial Sequence
  chemically synthesized
gggcctgtctttcctgatga

SEQ ID NO: 546300 - DNA, 20 bp, Artificial Sequence
  chemically synthesized
gattaggaaagctttccctc

SEQ ID NO: 546301 - DNA, 20 bp, Artificial Sequence
  chemically synthesized
gtatgataaatggatagcta

SEQ ID NO: 546302 - DNA, 20 bp, Artificial Sequence
  chemically synthesized
tttactaattgagcacatct

SEQ ID NO: 546303 - DNA, 20 bp, Artificial Sequence
  chemically synthesized
actggtattatgaatttgga

SEQ ID NO: 546304 - DNA, 20 bp, Artificial Sequence
  chemically synthesized
caatgagggtatgaagaaat

SEQ ID NO: 546305 - DNA, 20 bp, Artificial Sequence
  chemically synthesized
cattttaccaatgagggtat

SEQ ID NO: 546306 - DNA, 20 bp, Artificial Sequence
  chemically synthesized
caagtgtccaataaatagtt

SEQ ID NO: 546307 - DNA, 20 bp, Artificial Sequence
  chemically synthesized
tgatcctgaggtttcacatt

SEQ ID NO: 546308 - DNA, 20 bp, Artificial Sequence
  chemically synthesized
tacaagttgtgtttcctcca

SEQ ID NO: 546309 - DNA, 20 bp, Artificial Sequence
  chemically synthesized
aggacattcacttgggaaaa

SEQ ID NO: 546310 - DNA, 20 bp, Artificial Sequence
  chemically synthesized
aataaaacctatgatggact

SEQ ID NO: 546311 - DNA, 20 bp, Artificial Sequence
  chemically synthesized
aaatactttattacaatgta

SEQ ID NO: 546312 - DNA, 20 bp, Artificial Sequence
  chemically synthesized
gacatttcatgtctctagag

SEQ ID NO: 546313 - DNA, 20 bp, Artificial Sequence
  chemically synthesized
ttaacatagtatgacatgat

SEQ ID NO: 546314 - DNA, 20 bp, Artificial Sequence
  chemically synthesized
tgtaaatgcgtgagtacagt

SEQ ID NO: 546315 - DNA, 20 bp, Artificial Sequence
  chemically synthesized
catttacatttaaacaaatt

SEQ ID NO: 546316 - DNA, 20 bp, Artificial Sequence
  chemically synthesized
taaacaaattttagaattat

SEQ ID NO: 546317 - DNA, 20 bp, Artificial Sequence
  chemically synthesized
ccacttagagaataagcaga

SEQ ID NO: 546318 - DNA, 20 bp, Artificial Sequence
  chemically synthesized
tgtgaaagggtcagccactt

SEQ ID NO: 546319 - DNA, 20 bp, Artificial Sequence
  chemically synthesized
gagattgaaagaagagggaa

SEQ ID NO: 546320 - DNA, 20 bp, Artificial Sequence
  chemically synthesized
ctctggagcagggaaataat

SEQ ID NO: 546321 - DNA, 20 bp, Artificial Sequence
  chemically synthesized
gctactatatagtaggaata

SEQ ID NO: 546322 - DNA, 20 bp, Artificial Sequence
  chemically synthesized
atatattaacaaataggtga

SEQ ID NO: 546323 - DNA, 20 bp, Artificial Sequence
  chemically synthesized
taacagaaccctagcaataa

SEQ ID NO: 546324 - DNA, 20 bp, Artificial Sequence
  chemically synthesized
ttccaataaacccattgtcc

SEQ ID NO: 546325 - DNA, 20 bp, Artificial Sequence
  chemically synthesized
gtgaaagcagtgtgcgttca

SEQ ID NO: 546326 - DNA, 20 bp, Artificial Sequence
  chemically synthesized
caatgggtacacatggacat

SEQ ID NO: 546327 - DNA, 20 bp, Artificial Sequence
  chemically synthesized
ctaagtgaaataagtcagaa

SEQ ID NO: 546328 - DNA, 20 bp, Artificial Sequence
  chemically synthesized
atcatcctaagtgaaataag

SEQ ID NO: 546329 - DNA, 20 bp, Artificial Sequence
  chemically synthesized
tttcttagaagtaaaccgca

SEQ ID NO: 546330 - DNA, 20 bp, Artificial Sequence
  chemically synthesized
tttcttgtgcggtttacttc

SEQ ID NO: 546331 - DNA, 20 bp, Artificial Sequence
  chemically synthesized
accataatgaaaccataatg

SEQ ID NO: 546332 - DNA, 20 bp, Artificial Sequence
  chemically synthesized
tagttaatagtgtgttgtat

SEQ ID NO: 546333 - DNA, 20 bp, Artificial Sequence
  chemically synthesized
cattgtgtataactatatag

SEQ ID NO: 546334 - DNA, 20 bp, Artificial Sequence
  chemically synthesized
ctattcaggaggctgaggca

SEQ ID NO: 546335 - DNA, 20 bp, Artificial Sequence
  chemically synthesized
gagtgagacttcatctcaaa

SEQ ID NO: 546336 - DNA, 20 bp, Artificial Sequence
  chemically synthesized
ctaagtgaaataagcaagac

SEQ ID NO: 546337 - DNA, 20 bp, Artificial Sequence
  chemically synthesized
gtgaaataagcaagacacag

SEQ ID NO: 546338 - DNA, 20 bp, Artificial Sequence
  chemically synthesized
tttgagatcattttacataa

SEQ ID NO: 546339 - DNA, 20 bp, Artificial Sequence
  chemically synthesized
ctagccaatattatatgacg

SEQ ID NO: 546340 - DNA, 20 bp, Artificial Sequence
  chemically synthesized
tataatattggctaggttct

SEQ ID NO: 546341 - DNA, 20 bp, Artificial Sequence
  chemically synthesized
gactcaaacaataaatacga

SEQ ID NO: 546342 - DNA, 20 bp, Artificial Sequence
  chemically synthesized
atccaaatcatatcaatatg

SEQ ID NO: 546343 - DNA, 20 bp, Artificial Sequence
  chemically synthesized
cttacatggccagagaagga

SEQ ID NO: 546344 - DNA, 20 bp, Artificial Sequence
  chemically synthesized
tcaggtagtttatagcaatg

SEQ ID NO: 546345 - DNA, 20 bp, Artificial Sequence
  chemically synthesized
caatgcgagaaaggactaat

SEQ ID NO: 546346 - DNA, 20 bp, Artificial Sequence
  chemically synthesized
atgatttagggtatatggta

SEQ ID NO: 546347 - DNA, 20 bp, Artificial Sequence
  chemically synthesized
catcttaaatgttttgctgg

SEQ ID NO: 546348 - DNA, 20 bp, Artificial Sequence
  chemically synthesized
gggaagcagagcataaaagt

SEQ ID NO: 546349 - DNA, 20 bp, Artificial Sequence
  chemically synthesized
atttgcagcctgaccatgtg

SEQ ID NO: 546350 - DNA, 20 bp, Artificial Sequence
  chemically synthesized
ttgaatttcccccaccaccc

SEQ ID NO: 546351 - DNA, 20 bp, Artificial Sequence
  chemically synthesized
agagcatccacctagatttc

SEQ ID NO: 546352 - DNA, 20 bp, Artificial Sequence
  chemically synthesized
gggccactgtcctccagagc

SEQ ID NO: 546353 - DNA, 20 bp, Artificial Sequence
  chemically synthesized
caaaagagttaaatcgatca

SEQ ID NO: 546354 - DNA, 20 bp, Artificial Sequence
  chemically synthesized
cctgtgactgggtaatttat

SEQ ID NO: 546355 - DNA, 20 bp, Artificial Sequence
  chemically synthesized
ttaaatacattaccaagtcc

SEQ ID NO: 546356 - DNA, 20 bp, Artificial Sequence
  chemically synthesized
tagttctggcttcctgactt

SEQ ID NO: 546357 - DNA, 20 bp, Artificial Sequence
  chemically synthesized
gaatcagactattttgctac

SEQ ID NO: 546358 - DNA, 20 bp, Artificial Sequence
  chemically synthesized
ttggaagcaaatagcttcaa

SEQ ID NO: 546359 - DNA, 20 bp, Artificial Sequence
  chemically synthesized
acagagaaacaaattgataa

SEQ ID NO: 546360 - DNA, 20 bp, Artificial Sequence
  chemically synthesized
tcatcaccctacactcacac

SEQ ID NO: 546361 - DNA, 20 bp, Artificial Sequence
  chemically synthesized
ctgtgtgagtgtagggtgat

SEQ ID NO: 546362 - DNA, 20 bp, Artificial Sequence
  chemically synthesized
gtaaagtatacatatgttgc

SEQ ID NO: 546363 - DNA, 20 bp, Artificial Sequence
  chemically synthesized
tagtacaatgacccaaagtt

SEQ ID NO: 546364 - DNA, 20 bp, Artificial Sequence
  chemically synthesized
gggtcattgtactaaataaa

SEQ ID NO: 546365 - DNA, 20 bp, Artificial Sequence
  chemically synthesized
caatatccaaaatatttcca

SEQ ID NO: 546366 - DNA, 20 bp, Artificial Sequence
  chemically synthesized
gcttggtgtgcagttatttc

SEQ ID NO: 546367 - DNA, 20 bp, Artificial Sequence
  chemically synthesized
atactatatgacctgaccca

SEQ ID NO: 546368 - DNA, 20 bp, Artificial Sequence
  chemically synthesized
tctgtcagatagaaacagtc

SEQ ID NO: 546369 - DNA, 20 bp, Artificial Sequence
  chemically synthesized
gtgttgagtggctctgtcag

SEQ ID NO: 546370 - DNA, 20 bp, Artificial Sequence
  chemically synthesized
ttagaaaaggtaacaacaat

SEQ ID NO: 546371 - DNA, 20 bp, Artificial Sequence
  chemically synthesized
gttaccttttctaatttttt

SEQ ID NO: 546372 - DNA, 20 bp, Artificial Sequence
  chemically synthesized
ccctcccattctgaaaaaaa

SEQ ID NO: 546373 - DNA, 20 bp, Artificial Sequence
  chemically synthesized
tgtaaaagaaaatgtaagta

SEQ ID NO: 546374 - DNA, 20 bp, Artificial Sequence
  chemically synthesized
taagtaaaaaaacgattgta

SEQ ID NO: 546375 - DNA, 20 bp, Artificial Sequence
  chemically synthesized
gggatttttttaacgccttt

SEQ ID NO: 546376 - DNA, 20 bp, Artificial Sequence
  chemically synthesized
tgggtgttgaataagcaaac

SEQ ID NO: 546377 - DNA, 20 bp, Artificial Sequence
  chemically synthesized
attttaacatcatttttaat

SEQ ID NO: 546378 - DNA, 20 bp, Artificial Sequence
  chemically synthesized
tgacatattttagataaata

SEQ ID NO: 546379 - DNA, 20 bp, Artificial Sequence
  chemically synthesized
tttgatctatgcatacatta

SEQ ID NO: 546380 - DNA, 20 bp, Artificial Sequence
  chemically synthesized
ataagttgaatacatagaca

SEQ ID NO: 546381 - DNA, 20 bp, Artificial Sequence
  chemically synthesized
ttatctaacatctgaaatct

SEQ ID NO: 546382 - DNA, 20 bp, Artificial Sequence
  chemically synthesized
ctaagtgaaataagcaagac

SEQ ID NO: 546383 - DNA, 20 bp, Artificial Sequence
  chemically synthesized
ctgagtgtccactgacagat

SEQ ID NO: 546384 - DNA, 20 bp, Artificial Sequence
  chemically synthesized
ccactcctgggtatagaccc

SEQ ID NO: 546385 - DNA, 20 bp, Artificial Sequence
  chemically synthesized
taaaaagcttctggaaagca

SEQ ID NO: 546386 - DNA, 20 bp, Artificial Sequence
  chemically synthesized
tatcacatcaaaatttcagg

SEQ ID NO: 546387 - DNA, 20 bp, Artificial Sequence
  chemically synthesized
ctaaaatcataagactccta

SEQ ID NO: 546388 - DNA, 20 bp, Artificial Sequence
  chemically synthesized
cagacacataaactgatgga

SEQ ID NO: 546389 - DNA, 20 bp, Artificial Sequence
  chemically synthesized
tctaaatggcattttttttc

SEQ ID NO: 546390 - DNA, 20 bp, Artificial Sequence
  chemically synthesized
tccacggatgcaactgtaga

SEQ ID NO: 546391 - DNA, 20 bp, Artificial Sequence
  chemically synthesized
cctaatacaatgtaaatgct

SEQ ID NO: 546392 - DNA, 20 bp, Artificial Sequence
  chemically synthesized
tatttaagacccaatttaaa

SEQ ID NO: 546393 - DNA, 20 bp, Artificial Sequence
  chemically synthesized
aaaattctatttatgataac

SEQ ID NO: 546394 - DNA, 20 bp, Artificial Sequence
  chemically synthesized
tttattctatgttatcataa

SEQ ID NO: 546395 - DNA, 20 bp, Artificial Sequence
  chemically synthesized
agaaacccctaaggactcca

SEQ ID NO: 546396 - DNA, 20 bp, Artificial Sequence
  chemically synthesized
caaatggtatgatcgtatat

SEQ ID NO: 546397 - DNA, 20 bp, Artificial Sequence
  chemically synthesized
tacgatcataccatttgcaa

SEQ ID NO: 546398 - DNA, 20 bp, Artificial Sequence
  chemically synthesized
acatgattatctcaatacat

SEQ ID NO: 546399 - DNA, 20 bp, Artificial Sequence
  chemically synthesized
caatgcgacatactacatta

SEQ ID NO: 546400 - DNA, 20 bp, Artificial Sequence
  chemically synthesized
gtcaaacagacaccgcaaga

SEQ ID NO: 546401 - DNA, 20 bp, Artificial Sequence
  chemically synthesized
aattactctttaaatgtttg

SEQ ID NO: 546402 - DNA, 20 bp, Artificial Sequence
  chemically synthesized
attgtacactgaacattagc

SEQ ID NO: 546403 - DNA, 20 bp, Artificial Sequence
  chemically synthesized
taataactgttttggtatgg

SEQ ID NO: 546404 - DNA, 20 bp, Artificial Sequence
  chemically synthesized
ggcttccttaggctccattt

SEQ ID NO: 546405 - DNA, 20 bp, Artificial Sequence
  chemically synthesized
aaaaaaatctcataatgttt

SEQ ID NO: 546406 - DNA, 20 bp, Artificial Sequence
  chemically synthesized
tgccttaagtacatccagta

SEQ ID NO: 546407 - DNA, 20 bp, Artificial Sequence
  chemically synthesized
tgaaaggatttcctcaagaa

SEQ ID NO: 546408 - DNA, 20 bp, Artificial Sequence
  chemically synthesized
ggaatgtataaatatacaat

SEQ ID NO: 546409 - DNA, 20 bp, Artificial Sequence
  chemically synthesized
aactgaacagaaatttattt

SEQ ID NO: 546410 - DNA, 20 bp, Artificial Sequence
  chemically synthesized
atgaaaatgataagaactga

SEQ ID NO: 546411 - DNA, 20 bp, Artificial Sequence
  chemically synthesized
ttgatttacaattcagttag

SEQ ID NO: 546412 - DNA, 20 bp, Artificial Sequence
  chemically synthesized
attgtaaatttataatatga

SEQ ID NO: 546413 - DNA, 20 bp, Artificial Sequence
  chemically synthesized
ccagagttgtgttcttggca

SEQ ID NO: 546414 - DNA, 20 bp, Artificial Sequence
  chemically synthesized
tgtatctgtgtaacacaaca

SEQ ID NO: 546415 - DNA, 20 bp, Artificial Sequence
  chemically synthesized
atacaatcctaatccttgct

SEQ ID NO: 546416 - DNA, 20 bp, Artificial Sequence
  chemically synthesized
actgttattgcagaaatggc

SEQ ID NO: 546417 - DNA, 20 bp, Artificial Sequence
  chemically synthesized
cgtttattttaactgttatt

SEQ ID NO: 546418 - DNA, 20 bp, Artificial Sequence
  chemically synthesized
cttatatattagagtcttta

SEQ ID NO: 546419 - DNA, 20 bp, Artificial Sequence
  chemically synthesized
ctctaatatataagggtgtt

SEQ ID NO: 546420 - DNA, 20 bp, Artificial Sequence
  chemically synthesized
tgatccatgatatgagaggc

SEQ ID NO: 546421 - DNA, 20 bp, Artificial Sequence
  chemically synthesized
ttaaagatgtcaagtatttt

SEQ ID NO: 546422 - DNA, 20 bp, Artificial Sequence
  chemically synthesized
caaaaaaggtcattatataa

SEQ ID NO: 546423 - DNA, 20 bp, Artificial Sequence
  chemically synthesized
ttaatgggtacaaaaattcc

SEQ ID NO: 546424 - DNA, 20 bp, Artificial Sequence
  chemically synthesized
tgggtacaaaaattccttag

SEQ ID NO: 546425 - DNA, 20 bp, Artificial Sequence
  chemically synthesized
gcagtaaataataatcacat

SEQ ID NO: 546426 - DNA, 20 bp, Artificial Sequence
  chemically synthesized
gtttgtatgtgtatatatgt

SEQ ID NO: 546427 - DNA, 20 bp, Artificial Sequence
  chemically synthesized
tagattaagagatataccta

SEQ ID NO: 546428 - DNA, 20 bp, Artificial Sequence
  chemically synthesized
atatattggataaaagtata

SEQ ID NO: 546429 - DNA, 20 bp, Artificial Sequence
  chemically synthesized
gttacaaatttattacagct

SEQ ID NO: 546430 - DNA, 20 bp, Artificial Sequence
  chemically synthesized
atagtagtgtcattgcctcc

SEQ ID NO: 546431 - DNA, 20 bp, Artificial Sequence
  chemically synthesized
gaactaataatatgatcaaa

SEQ ID NO: 546432 - DNA, 20 bp, Artificial Sequence
  chemically synthesized
agcacatccaatgtctgtgt

SEQ ID NO: 546433 - DNA, 20 bp, Artificial Sequence
  chemically synthesized
gaattaattatcacatattc

SEQ ID NO: 546434 - DNA, 20 bp, Artificial Sequence
  chemically synthesized
tgatggattcagatattatt

SEQ ID NO: 546435 - DNA, 20 bp, Artificial Sequence
  chemically synthesized
acatctagtaaacgttaggc

SEQ ID NO: 546436 - DNA, 20 bp, Artificial Sequence
  chemically synthesized
tagcaaaaaaaagatctgct

SEQ ID NO: 546437 - DNA, 20 bp, Artificial Sequence
  chemically synthesized
gtcagttgcttgaacattaa

SEQ ID NO: 546438 - DNA, 20 bp, Artificial Sequence
  chemically synthesized
aatgcaagcagaggcctgat

SEQ ID NO: 546439 - DNA, 20 bp, Artificial Sequence
  chemically synthesized
catagaaacctttatattta

SEQ ID NO: 546440 - DNA, 20 bp, Artificial Sequence
  chemically synthesized
tatgtgtgtatatatacatc

SEQ ID NO: 546441 - DNA, 20 bp, Artificial Sequence
  chemically synthesized
actgctgtaaaacatgatta

SEQ ID NO: 546442 - DNA, 20 bp, Artificial Sequence
  chemically synthesized
gcatgtaatttacacacagc

SEQ ID NO: 546443 - DNA, 20 bp, Artificial Sequence
  chemically synthesized
gcctctatcaatcaatattt

SEQ ID NO: 546444 - DNA, 20 bp, Artificial Sequence
  chemically synthesized
ctgcttgtactaaaacttgt

SEQ ID NO: 546445 - DNA, 20 bp, Artificial Sequence
  chemically synthesized
gtgtctggcaagcttcctaa

SEQ ID NO: 546446 - DNA, 20 bp, Artificial Sequence
  chemically synthesized
ctaacacaatttaactcact

SEQ ID NO: 546447 - DNA, 20 bp, Artificial Sequence
  chemically synthesized
agacatttcaccttggccta

SEQ ID NO: 546448 - DNA, 20 bp, Artificial Sequence
  chemically synthesized
tatctttgggaatataatgc

SEQ ID NO: 546449 - DNA, 20 bp, Artificial Sequence
  chemically synthesized
aaatacaggaagaagaagag

SEQ ID NO: 546450 - DNA, 20 bp, Artificial Sequence
  chemically synthesized
attaaacaattaaggaaaga

SEQ ID NO: 546451 - DNA, 20 bp, Artificial Sequence
  chemically synthesized
cagtttaagaactgtggaaa

SEQ ID NO: 546452 - DNA, 20 bp, Artificial Sequence
  chemically synthesized
aagaggcagaagatacatac

SEQ ID NO: 546453 - DNA, 20 bp, Artificial Sequence
  chemically synthesized
aagcatataatactcctctt

SEQ ID NO: 546454 - DNA, 20 bp, Artificial Sequence
  chemically synthesized
tttaacaaaaacttacaagg

SEQ ID NO: 546455 - DNA, 20 bp, Artificial Sequence
  chemically synthesized
cccttgtaagtttttgttaa

SEQ ID NO: 546456 - DNA, 20 bp, Artificial Sequence
  chemically synthesized
tcttaaggagctttttatac

SEQ ID NO: 546457 - DNA, 20 bp, Artificial Sequence
  chemically synthesized
agctttttatactaagaaat

SEQ ID NO: 546458 - DNA, 20 bp, Artificial Sequence
  chemically synthesized
ttactttgataggaaagtca

SEQ ID NO: 546459 - DNA, 20 bp, Artificial Sequence
  chemically synthesized
ctttagttttgctagtacat

SEQ ID NO: 546460 - DNA, 20 bp, Artificial Sequence
  chemically synthesized
tagctcagcctcctgagtaa

SEQ ID NO: 546461 - DNA, 20 bp, Artificial Sequence
  chemically synthesized
agtagtaagagataagacta

SEQ ID NO: 546462 - DNA, 20 bp, Artificial Sequence
  chemically synthesized
gactaaaagaaaggacagga

SEQ ID NO: 546463 - DNA, 20 bp, Artificial Sequence
  chemically synthesized
atatgaaagagatgggagat

SEQ ID NO: 546464 - DNA, 20 bp, Artificial Sequence
  chemically synthesized
cagaaaattttcagccatga

SEQ ID NO: 546465 - DNA, 20 bp, Artificial Sequence
  chemically synthesized
ttaaaacttgaaatattgga

SEQ ID NO: 546466 - DNA, 20 bp, Artificial Sequence
  chemically synthesized
ctggtacctcagatggaaat

SEQ ID NO: 546467 - DNA, 20 bp, Artificial Sequence
  chemically synthesized
gggagttccctttcctagtc

SEQ ID NO: 546468 - DNA, 20 bp, Artificial Sequence
  chemically synthesized
gttagaaggaaaactaacaa

SEQ ID NO: 546469 - DNA, 20 bp, Artificial Sequence
  chemically synthesized
gataaaaccacaaagatggg

SEQ ID NO: 546470 - DNA, 20 bp, Artificial Sequence
  chemically synthesized
aaagatggggaagaaacaga

SEQ ID NO: 546471 - DNA, 20 bp, Artificial Sequence
  chemically synthesized
aaaactttgaaaaacattta

SEQ ID NO: 546472 - DNA, 20 bp, Artificial Sequence
  chemically synthesized
acatttagaagaatgtataa

SEQ ID NO: 546473 - DNA, 20 bp, Artificial Sequence
  chemically synthesized
ccaaggctagagaagtacgt

SEQ ID NO: 546474 - DNA, 20 bp, Artificial Sequence
  chemically synthesized
ggagccgatgcgatcaactg

SEQ ID NO: 546475 - DNA, 20 bp, Artificial Sequence
  chemically synthesized
agaagggaagtttagaggaa

SEQ ID NO: 546476 - DNA, 20 bp, Artificial Sequence
  chemically synthesized
gtttagaggaaaaagaataa

SEQ ID NO: 546477 - DNA, 20 bp, Artificial Sequence
  chemically synthesized
aaagaaatgagcaaagcctc

SEQ ID NO: 546478 - DNA, 20 bp, Artificial Sequence
  chemically synthesized
ggtgtacctgaaagtgatgg

SEQ ID NO: 546479 - DNA, 20 bp, Artificial Sequence
  chemically synthesized
cattcagattcaggaaatac

SEQ ID NO: 546480 - DNA, 20 bp, Artificial Sequence
  chemically synthesized
aaagtgttaagggcagccag

SEQ ID NO: 546481 - DNA, 20 bp, Artificial Sequence
  chemically synthesized
ggccaatattcaacattctt

SEQ ID NO: 546482 - DNA, 20 bp, Artificial Sequence
  chemically synthesized
atattcaacattcttaaaga

SEQ ID NO: 546483 - DNA, 20 bp, Artificial Sequence
  chemically synthesized
gggttgaaaattcttttctt

SEQ ID NO: 546484 - DNA, 20 bp, Artificial Sequence
  chemically synthesized
taaagaaaagaattttcaac

SEQ ID NO: 546485 - DNA, 20 bp, Artificial Sequence
  chemically synthesized
aactaagcttcataagtaaa

SEQ ID NO: 546486 - DNA, 20 bp, Artificial Sequence
  chemically synthesized
gtaaagaccattgagactag

SEQ ID NO: 546487 - DNA, 20 bp, Artificial Sequence
  chemically synthesized
acattagacagatcaacgag

SEQ ID NO: 546488 - DNA, 20 bp, Artificial Sequence
  chemically synthesized
gaactctccaccccaaatca

SEQ ID NO: 546489 - DNA, 20 bp, Artificial Sequence
  chemically synthesized
taggtgtggtgtggtgctga

SEQ ID NO: 546490 - DNA, 20 bp, Artificial Sequence
  chemically synthesized
tcctcagcaaatgtagaaga

SEQ ID NO: 546491 - DNA, 20 bp, Artificial Sequence
  chemically synthesized
cagtgcaatcaaactagaac

SEQ ID NO: 546492 - DNA, 20 bp, Artificial Sequence
  chemically synthesized
atcaaactagaactcagaat

SEQ ID NO: 546493 - DNA, 20 bp, Artificial Sequence
  chemically synthesized
gggtgcataatgaaatgaag

SEQ ID NO: 546494 - DNA, 20 bp, Artificial Sequence
  chemically synthesized
gagaacaaagacacaacata

SEQ ID NO: 546495 - DNA, 20 bp, Artificial Sequence
  chemically synthesized
tatagcactaaatgcccaca

SEQ ID NO: 546496 - DNA, 20 bp, Artificial Sequence
  chemically synthesized
taacatcacaattaaaagaa

SEQ ID NO: 546497 - DNA, 20 bp, Artificial Sequence
  chemically synthesized
attcaaaagctagcagaaga

SEQ ID NO: 546498 - DNA, 20 bp, Artificial Sequence
  chemically synthesized
agactgctagcaagactaat

SEQ ID NO: 546499 - DNA, 20 bp, Artificial Sequence
  chemically synthesized
ctaataaagaaaaaaagaga

SEQ ID NO: 546500 - DNA, 20 bp, Artificial Sequence
  chemically synthesized
gggatatcaccactgatccc

SEQ ID NO: 546501 - DNA, 20 bp, Artificial Sequence
  chemically synthesized
cagaaatacaaactaccatc

SEQ ID NO: 546502 - DNA, 20 bp, Artificial Sequence
  chemically synthesized
aacacctctacgcaaataaa

SEQ ID NO: 546503 - DNA, 20 bp, Artificial Sequence
  chemically synthesized
caaataaactagaaaatcta

SEQ ID NO: 546504 - DNA, 20 bp, Artificial Sequence
  chemically synthesized
ttctgaaactattccaatca

SEQ ID NO: 546505 - DNA, 20 bp, Artificial Sequence
  chemically synthesized
ggcagagacacaaccaaaaa

SEQ ID NO: 546506 - DNA, 20 bp, Artificial Sequence
  chemically synthesized
acatgattatctccatagat

SEQ ID NO: 546507 - DNA, 20 bp, Artificial Sequence
  chemically synthesized
aagggtattcaattaggaaa

SEQ ID NO: 546508 - DNA, 20 bp, Artificial Sequence
  chemically synthesized
cagatgacatgattgtatat

SEQ ID NO: 546509 - DNA, 20 bp, Artificial Sequence
  chemically synthesized
gcttgtctgttgttggtgta

SEQ ID NO: 546510 - DNA, 20 bp, Artificial Sequence
  chemically synthesized
cccattcacaattgcttcaa

SEQ ID NO: 546511 - DNA, 20 bp, Artificial Sequence
  chemically synthesized
cattccatgctcatgggtag

SEQ ID NO: 546512 - DNA, 20 bp, Artificial Sequence
  chemically synthesized
agctaccaatgcctttcttc

SEQ ID NO: 546513 - DNA, 20 bp, Artificial Sequence
  chemically synthesized
gtagttttttccaattctgt

SEQ ID NO: 546514 - DNA, 20 bp, Artificial Sequence
  chemically synthesized
aatggaacagaacagagccc

SEQ ID NO: 546515 - DNA, 20 bp, Artificial Sequence
  chemically synthesized
tatctgatctttgacaaacc

SEQ ID NO: 546516 - DNA, 20 bp, Artificial Sequence
  chemically synthesized
ggaaaactggctagccatat

SEQ ID NO: 546517 - DNA, 20 bp, Artificial Sequence
  chemically synthesized
ctaaaaccataaaaaccctg

SEQ ID NO: 546518 - DNA, 20 bp, Artificial Sequence
  chemically synthesized
taaagagcttctgcacaaca

SEQ ID NO: 546519 - DNA, 20 bp, Artificial Sequence
  chemically synthesized
aacaggcaacctacaaaatg

SEQ ID NO: 546520 - DNA, 20 bp, Artificial Sequence
  chemically synthesized
atctgacaaagggctaatat

SEQ ID NO: 546521 - DNA, 20 bp, Artificial Sequence
  chemically synthesized
aatgaactcaaacaaattta

SEQ ID NO: 546522 - DNA, 20 bp, Artificial Sequence
  chemically synthesized
gctgcataaatgtcttcttt

SEQ ID NO: 546523 - DNA, 20 bp, Artificial Sequence
  chemically synthesized
gctcatcatcactgggcatc

SEQ ID NO: 546524 - DNA, 20 bp, Artificial Sequence
  chemically synthesized
gagataccatctcacaccag

SEQ ID NO: 546525 - DNA, 20 bp, Artificial Sequence
  chemically synthesized
acaggtgctggagaggatgt

SEQ ID NO: 546526 - DNA, 20 bp, Artificial Sequence
  chemically synthesized
cattcctcagggatctagaa

SEQ ID NO: 546527 - DNA, 20 bp, Artificial Sequence
  chemically synthesized
ccaacaatgatagagtggat

SEQ ID NO: 546528 - DNA, 20 bp, Artificial Sequence
  chemically synthesized
ttgttcttgcgatagtttac

SEQ ID NO: 546529 - DNA, 20 bp, Artificial Sequence
  chemically synthesized
gttcaattcccacctatgag

SEQ ID NO: 546530 - DNA, 20 bp, Artificial Sequence
  chemically synthesized
aagcttaaagtataataata

SEQ ID NO: 546531 - DNA, 20 bp, Artificial Sequence
  chemically synthesized
atttatgagcatgatatttt

SEQ ID NO: 546532 - DNA, 20 bp, Artificial Sequence
  chemically synthesized
ggccatttgggctgagtttt

SEQ ID NO: 546533 - DNA, 20 bp, Artificial Sequence
  chemically synthesized
gtttgaaatctggatgtaaa

SEQ ID NO: 546534 - DNA, 20 bp, Artificial Sequence
  chemically synthesized
taatgtgatttagtgtgagg

SEQ ID NO: 546535 - DNA, 20 bp, Artificial Sequence
  chemically synthesized
accataaaatagtcattttc

SEQ ID NO: 546536 - DNA, 20 bp, Artificial Sequence
  chemically synthesized
agttttataagacctaatta

SEQ ID NO: 546537 - DNA, 20 bp, Artificial Sequence
  chemically synthesized
tttttaatggaataagatca

SEQ ID NO: 546538 - DNA, 20 bp, Artificial Sequence
  chemically synthesized
attaaaaacatgtatctgtg

SEQ ID NO: 546539 - DNA, 20 bp, Artificial Sequence
  chemically synthesized
ctgatttagtgaagcagcaa

SEQ ID NO: 546540 - DNA, 20 bp, Artificial Sequence
  chemically synthesized
ataactgacaaaaaaataaa

SEQ ID NO: 546541 - DNA, 20 bp, Artificial Sequence
  chemically synthesized
gcaaccacattattggatgc

SEQ ID NO: 546542 - DNA, 20 bp, Artificial Sequence
  chemically synthesized
taaaatcatcactcccttat

SEQ ID NO: 546543 - DNA, 20 bp, Artificial Sequence
  chemically synthesized
gtagaagcaaactgttgagg

SEQ ID NO: 546544 - DNA, 20 bp, Artificial Sequence
  chemically synthesized
aagcaattgtaaggcttaaa

SEQ ID NO: 546545 - DNA, 20 bp, Artificial Sequence
  chemically synthesized
gtgtcaccggcagtccaaga

SEQ ID NO: 546546 - DNA, 20 bp, Artificial Sequence
  chemically synthesized
ctgctgtgtcaccggcagtc

SEQ ID NO: 546547 - DNA, 20 bp, Artificial Sequence
  chemically synthesized
acttgtcacccgtctgcaga

SEQ ID NO: 546548 - DNA, 20 bp, Artificial Sequence
  chemically synthesized
taggaagctgtcccaaattc

SEQ ID NO: 546549 - DNA, 20 bp, Artificial Sequence
  chemically synthesized
aaattcactctgaaattcaa

SEQ ID NO: 546550 - DNA, 20 bp, Artificial Sequence
  chemically synthesized
agaatataattagtgactgt

SEQ ID NO: 546551 - DNA, 20 bp, Artificial Sequence
  chemically synthesized
ctgttgagaatacagttttg

SEQ ID NO: 546552 - DNA, 20 bp, Artificial Sequence
  chemically synthesized
gacagcttttaagggattaa

SEQ ID NO: 546553 - DNA, 20 bp, Artificial Sequence
  chemically synthesized
attaaggagaaaatggatat

SEQ ID NO: 546554 - DNA, 20 bp, Artificial Sequence
  chemically synthesized
gaaaatgtaacttcaggcat

SEQ ID NO: 546555 - DNA, 20 bp, Artificial Sequence
  chemically synthesized
ttcataccataggactgtta

SEQ ID NO: 546556 - DNA, 20 bp, Artificial Sequence
  chemically synthesized
cctcatctagaaaatgaaag

SEQ ID NO: 546557 - DNA, 20 bp, Artificial Sequence
  chemically synthesized
tccctgagccttttcctcat

SEQ ID NO: 546558 - DNA, 20 bp, Artificial Sequence
  chemically synthesized
aggaaaaggctcagggatct

SEQ ID NO: 546559 - DNA, 20 bp, Artificial Sequence
  chemically synthesized
aactgttttcaagcgcactc

SEQ ID NO: 546560 - DNA, 20 bp, Artificial Sequence
  chemically synthesized
ttgaaaacagttcatgaaac

SEQ ID NO: 546561 - DNA, 20 bp, Artificial Sequence
  chemically synthesized
ggtataggcaatacttctag

SEQ ID NO: 546562 - DNA, 20 bp, Artificial Sequence
  chemically synthesized
aattaaattccaccagagga

SEQ ID NO: 546563 - DNA, 20 bp, Artificial Sequence
  chemically synthesized
catagtgtggttctcagaca

SEQ ID NO: 546564 - DNA, 20 bp, Artificial Sequence
  chemically synthesized
tgtactctagacctacagga

SEQ ID NO: 546565 - DNA, 20 bp, Artificial Sequence
  chemically synthesized
ttctcaaacttgaacatgca

SEQ ID NO: 546566 - DNA, 20 bp, Artificial Sequence
  chemically synthesized
actatcaggagcctggaata

SEQ ID NO: 546567 - DNA, 20 bp, Artificial Sequence
  chemically synthesized
agtgacatgaagtttggcgg

SEQ ID NO: 546568 - DNA, 20 bp, Artificial Sequence
  chemically synthesized
tatctcagcgactcaaaaga

SEQ ID NO: 546569 - DNA, 20 bp, Artificial Sequence
  chemically synthesized
tctgatatctcagcgactca

SEQ ID NO: 546570 - DNA, 20 bp, Artificial Sequence
  chemically synthesized
tcttttgagtcgctgagata

SEQ ID NO: 546571 - DNA, 20 bp, Artificial Sequence
  chemically synthesized
tacactacattatgcatcta

SEQ ID NO: 546572 - DNA, 20 bp, Artificial Sequence
  chemically synthesized
atgggaatcactattaaacc

SEQ ID NO: 546573 - DNA, 20 bp, Artificial Sequence
  chemically synthesized
attgtcacataaataagaga

SEQ ID NO: 546574 - DNA, 20 bp, Artificial Sequence
  chemically synthesized
acaatatttatctttcggtg

SEQ ID NO: 546575 - DNA, 20 bp, Artificial Sequence
  chemically synthesized
aagcattatataatcataaa

SEQ ID NO: 546576 - DNA, 20 bp, Artificial Sequence
  chemically synthesized
cactcacaaaatggtctaat

SEQ ID NO: 546577 - DNA, 20 bp, Artificial Sequence
  chemically synthesized
gcaagtctatgagaaagatc

SEQ ID NO: 546578 - DNA, 20 bp, Artificial Sequence
  chemically synthesized
aattttacccagcaagtcta

SEQ ID NO: 546579 - DNA, 20 bp, Artificial Sequence
  chemically synthesized
gggcatgttatgtaaacact

SEQ ID NO: 546580 - DNA, 20 bp, Artificial Sequence
  chemically synthesized
gttagtatatttggtaacct

SEQ ID NO: 546581 - DNA, 20 bp, Artificial Sequence
  chemically synthesized
atgctcaatgtcatagtgta

SEQ ID NO: 546582 - DNA, 20 bp, Artificial Sequence
  chemically synthesized
ctgtaataatcataataacg

SEQ ID NO: 546583 - DNA, 20 bp, Artificial Sequence
  chemically synthesized
ttacaataaagcgatgtgat

SEQ ID NO: 546584 - DNA, 20 bp, Artificial Sequence
  chemically synthesized
atctcatgaaaacttttgac

SEQ ID NO: 546585 - DNA, 20 bp, Artificial Sequence
  chemically synthesized
gattttgtgtttaaaaaggg

SEQ ID NO: 546586 - DNA, 20 bp, Artificial Sequence
  chemically synthesized
ctgtctgctggattgtacaa

SEQ ID NO: 546587 - DNA, 20 bp, Artificial Sequence
  chemically synthesized
aaaagaatttgcatatgata

SEQ ID NO: 546588 - DNA, 20 bp, Artificial Sequence
  chemically synthesized
tgcacatttgtacaaacaca

SEQ ID NO: 546589 - DNA, 20 bp, Artificial Sequence
  chemically synthesized
tttgccattactttcaatgg

SEQ ID NO: 546590 - DNA, 20 bp, Artificial Sequence
  chemically synthesized
tgcaccaacttaatatattt

SEQ ID NO: 546591 - DNA, 20 bp, Artificial Sequence
  chemically synthesized
cagaagatgcagtgacaata

SEQ ID NO: 546592 - DNA, 20 bp, Artificial Sequence
  chemically synthesized
tgtcttttatttttaggagg

SEQ ID NO: 546593 - DNA, 20 bp, Artificial Sequence
  chemically synthesized
attcacatcccagtgggcac

SEQ ID NO: 546594 - DNA, 20 bp, Artificial Sequence
  chemically synthesized
agaggagagtaaatgggaca

SEQ ID NO: 546595 - DNA, 20 bp, Artificial Sequence
  chemically synthesized
caggaatgagacctaagcaa

SEQ ID NO: 546596 - DNA, 20 bp, Artificial Sequence
  chemically synthesized
ataaggaaaaaggctggggc

SEQ ID NO: 546597 - DNA, 20 bp, Artificial Sequence
  chemically synthesized
atgatccccattttacagat

SEQ ID NO: 546598 - DNA, 20 bp, Artificial Sequence
  chemically synthesized
agacttatcctttgaagaga

SEQ ID NO: 546599 - DNA, 20 bp, Artificial Sequence
  chemically synthesized
ctcaatttgactggggactt

SEQ ID NO: 546600 - DNA, 20 bp, Artificial Sequence
  chemically synthesized
ttaccctgtctttatgattt

SEQ ID NO: 546601 - DNA, 20 bp, Artificial Sequence
  chemically synthesized
atatctgagccaaaatcaaa

SEQ ID NO: 546602 - DNA, 20 bp, Artificial Sequence
  chemically synthesized
actcatggttagaatcctaa

SEQ ID NO: 546603 - DNA, 20 bp, Artificial Sequence
  chemically synthesized
caacattctaacactcatgg

SEQ ID NO: 546604 - DNA, 20 bp, Artificial Sequence
  chemically synthesized
taggattctaaccatgagtg

SEQ ID NO: 546605 - DNA, 20 bp, Artificial Sequence
  chemically synthesized
ttccaataatttctgaatgc

SEQ ID NO: 546606 - DNA, 20 bp, Artificial Sequence
  chemically synthesized
acggtcacttttcttggcat

SEQ ID NO: 546607 - DNA, 20 bp, Artificial Sequence
  chemically synthesized
gcccttatcttgggggaacc

SEQ ID NO: 546608 - DNA, 20 bp, Artificial Sequence
  chemically synthesized
gggaactgtgtgaggccctg

SEQ ID NO: 546609 - DNA, 20 bp, Artificial Sequence
  chemically synthesized
atttggtgcctaataaatat

SEQ ID NO: 546610 - DNA, 20 bp, Artificial Sequence
  chemically synthesized
aagatggttgcagaaatgat

SEQ ID NO: 546611 - DNA, 20 bp, Artificial Sequence
  chemically synthesized
atccttcctagaagatggtt

SEQ ID NO: 546612 - DNA, 20 bp, Artificial Sequence
  chemically synthesized
ggcaaaaaaaaaaaaaattg

SEQ ID NO: 546613 - DNA, 20 bp, Artificial Sequence
  chemically synthesized
atttaacagttgaaaccatg

SEQ ID NO: 546614 - DNA, 20 bp, Artificial Sequence
  chemically synthesized
aaagcacattaaattagacc

SEQ ID NO: 546615 - DNA, 20 bp, Artificial Sequence
  chemically synthesized
cttctaaaatcatacgtatt

SEQ ID NO: 546616 - DNA, 20 bp, Artificial Sequence
  chemically synthesized
aatttgactcataatcacat

SEQ ID NO: 546617 - DNA, 20 bp, Artificial Sequence
  chemically synthesized
gtgatctcagttgtttttgg

SEQ ID NO: 546618 - DNA, 20 bp, Artificial Sequence
  chemically synthesized
ggcaagaaaaaagtaattgg

SEQ ID NO: 546619 - DNA, 20 bp, Artificial Sequence
  chemically synthesized
ggcaagaaaaaagtaattgg

SEQ ID NO: 546620 - DNA, 20 bp, Artificial Sequence
  chemically synthesized
aagtaattggcaagaaagcc

SEQ ID NO: 546621 - DNA, 20 bp, Artificial Sequence
  chemically synthesized
ttggcaagaaagccagagaa

SEQ ID NO: 546622 - DNA, 20 bp, Artificial Sequence
  chemically synthesized
tgtgttgatacagaacaaga

SEQ ID NO: 546623 - DNA, 20 bp, Artificial Sequence
  chemically synthesized
ttaaggtatttcaaaagaca

SEQ ID NO: 546624 - DNA, 20 bp, Artificial Sequence
  chemically synthesized
gcacatttgtggcttgtagc

SEQ ID NO: 546625 - DNA, 20 bp, Artificial Sequence
  chemically synthesized
tacaagccacaaatgtgctt

SEQ ID NO: 546626 - DNA, 20 bp, Artificial Sequence
  chemically synthesized
ctatctcagctggaccaata

SEQ ID NO: 546627 - DNA, 20 bp, Artificial Sequence
  chemically synthesized
tacctcgagaaaacttttat

SEQ ID NO: 546628 - DNA, 20 bp, Artificial Sequence
  chemically synthesized
ttttgaaattatgactacct

SEQ ID NO: 546629 - DNA, 20 bp, Artificial Sequence
  chemically synthesized
tttgcagcttatcagtttaa

SEQ ID NO: 546630 - DNA, 20 bp, Artificial Sequence
  chemically synthesized
acatttttattaaggaaaat

SEQ ID NO: 546631 - DNA, 20 bp, Artificial Sequence
  chemically synthesized
tagatttgaagagtaaaaat

SEQ ID NO: 546632 - DNA, 20 bp, Artificial Sequence
  chemically synthesized
gtaaaaataagccataattc

SEQ ID NO: 546633 - DNA, 20 bp, Artificial Sequence
  chemically synthesized
tgataagagactttcaattc

SEQ ID NO: 546634 - DNA, 20 bp, Artificial Sequence
  chemically synthesized
accaagtcatgttattacct

SEQ ID NO: 546635 - DNA, 20 bp, Artificial Sequence
  chemically synthesized
acagatttgcaaatagcccc

SEQ ID NO: 546636 - DNA, 20 bp, Artificial Sequence
  chemically synthesized
tctggagtcaagctttcata

SEQ ID NO: 546637 - DNA, 20 bp, Artificial Sequence
  chemically synthesized
tgttcacgttttttattttt

SEQ ID NO: 546638 - DNA, 20 bp, Artificial Sequence
  chemically synthesized
aagaaaatctacaccatcca

SEQ ID NO: 546639 - DNA, 20 bp, Artificial Sequence
  chemically synthesized
cagcgtcacctgggaccttt

SEQ ID NO: 546640 - DNA, 20 bp, Artificial Sequence
  chemically synthesized
agtatctcagggagtgagac

SEQ ID NO: 546641 - DNA, 20 bp, Artificial Sequence
  chemically synthesized
atgtgtcgattaaacattaa

SEQ ID NO: 546642 - DNA, 20 bp, Artificial Sequence
  chemically synthesized
attttgaaacttcccaacac

SEQ ID NO: 546643 - DNA, 20 bp, Artificial Sequence
  chemically synthesized
tgatttcatagaagcaggca

SEQ ID NO: 546644 - DNA, 20 bp, Artificial Sequence
  chemically synthesized
ggaatattattcagccataa

SEQ ID NO: 546645 - DNA, 20 bp, Artificial Sequence
  chemically synthesized
aatctgttttaacaaggcct

SEQ ID NO: 546646 - DNA, 20 bp, Artificial Sequence
  chemically synthesized
ttctcaaacttgagtgcaca

SEQ ID NO: 546647 - DNA, 20 bp, Artificial Sequence
  chemically synthesized
tgtcccaaacaggttaatcc

SEQ ID NO: 546648 - DNA, 20 bp, Artificial Sequence
  chemically synthesized
cctgggagacagttgtggct

SEQ ID NO: 546649 - DNA, 20 bp, Artificial Sequence
  chemically synthesized
ccaggagttccagacaagac

SEQ ID NO: 546650 - DNA, 20 bp, Artificial Sequence
  chemically synthesized
tttgagagcaaagcacagcc

SEQ ID NO: 546651 - DNA, 20 bp, Artificial Sequence
  chemically synthesized
aagcacagccacagaaaaaa

SEQ ID NO: 546652 - DNA, 20 bp, Artificial Sequence
  chemically synthesized
cgtatttcccttttatcctt

SEQ ID NO: 546653 - DNA, 20 bp, Artificial Sequence
  chemically synthesized
ggctaattcgtgtattttta

SEQ ID NO: 546654 - DNA, 20 bp, Artificial Sequence
  chemically synthesized
tactcggggaggctgaggca

SEQ ID NO: 546655 - DNA, 20 bp, Artificial Sequence
  chemically synthesized
ctccgtctcaaaaaaaaaaa

SEQ ID NO: 546656 - DNA, 20 bp, Artificial Sequence
  chemically synthesized
tctcaaaaaaaaaaaaaaga

SEQ ID NO: 546657 - DNA, 20 bp, Artificial Sequence
  chemically synthesized
aaaaaaaaaaaaagaaaaga

SEQ ID NO: 546658 - DNA, 20 bp, Artificial Sequence
  chemically synthesized
aaaaaaaagaaaagaaaaga

SEQ ID NO: 546659 - DNA, 20 bp, Artificial Sequence
  chemically synthesized
aagaaaagaaaagaaaagaa

SEQ ID NO: 546660 - DNA, 20 bp, Artificial Sequence
  chemically synthesized
atttaatcctgttatacaga

SEQ ID NO: 546661 - DNA, 20 bp, Artificial Sequence
  chemically synthesized
ataattacatctacagaact

SEQ ID NO: 546662 - DNA, 20 bp, Artificial Sequence
  chemically synthesized
atgtattattaaagggaaat

SEQ ID NO: 546663 - DNA, 20 bp, Artificial Sequence
  chemically synthesized
aatatggcaaccaaattatc

SEQ ID NO: 546664 - DNA, 20 bp, Artificial Sequence
  chemically synthesized
tgacacagtctttttacatc

SEQ ID NO: 546665 - DNA, 20 bp, Artificial Sequence
  chemically synthesized
ttagtacccatagaggtgag

SEQ ID NO: 546666 - DNA, 20 bp, Artificial Sequence
  chemically synthesized
tgccacgtaggtccccaatg

SEQ ID NO: 546667 - DNA, 20 bp, Artificial Sequence
  chemically synthesized
gtgactcagcagataggaaa

SEQ ID NO: 546668 - DNA, 20 bp, Artificial Sequence
  chemically synthesized
cataccatttagctggggag

SEQ ID NO: 546669 - DNA, 20 bp, Artificial Sequence
  chemically synthesized
atcaccattttaatagttat

SEQ ID NO: 546670 - DNA, 20 bp, Artificial Sequence
  chemically synthesized
ctgttaaaaagtcataaagg

SEQ ID NO: 546671 - DNA, 20 bp, Artificial Sequence
  chemically synthesized
gagtacaataatgatattat

SEQ ID NO: 546672 - DNA, 20 bp, Artificial Sequence
  chemically synthesized
cttaggagcagagagcaggg

SEQ ID NO: 546673 - DNA, 20 bp, Artificial Sequence
  chemically synthesized
cttcccctgctctctgctcc

SEQ ID NO: 546674 - DNA, 20 bp, Artificial Sequence
  chemically synthesized
cctaagaattacatttctta

SEQ ID NO: 546675 - DNA, 20 bp, Artificial Sequence
  chemically synthesized
tttccttaggaaaattctaa

SEQ ID NO: 546676 - DNA, 20 bp, Artificial Sequence
  chemically synthesized
gaattttcctaaggaaatgg

SEQ ID NO: 546677 - DNA, 20 bp, Artificial Sequence
  chemically synthesized
actcattattgaatcaatag

SEQ ID NO: 546678 - DNA, 20 bp, Artificial Sequence
  chemically synthesized
tatgagtgtcttctatatat

SEQ ID NO: 546679 - DNA, 20 bp, Artificial Sequence
  chemically synthesized
tgacttgtgatttacaacat

SEQ ID NO: 546680 - DNA, 20 bp, Artificial Sequence
  chemically synthesized
aaactagcatagcattagag

SEQ ID NO: 546681 - DNA, 20 bp, Artificial Sequence
  chemically synthesized
tttcaaactctatccatcct

SEQ ID NO: 546682 - DNA, 20 bp, Artificial Sequence
  chemically synthesized
atgtatttatattttaatct

SEQ ID NO: 546683 - DNA, 20 bp, Artificial Sequence
  chemically synthesized
tttaaaaattctgacaaaag

SEQ ID NO: 546684 - DNA, 20 bp, Artificial Sequence
  chemically synthesized
ggaagtttttctcccttttg

SEQ ID NO: 546685 - DNA, 20 bp, Artificial Sequence
  chemically synthesized
ttgatttacatttggaaaga

SEQ ID NO: 546686 - DNA, 20 bp, Artificial Sequence
  chemically synthesized
cacttattttagaagtaaat

SEQ ID NO: 546687 - DNA, 20 bp, Artificial Sequence
  chemically synthesized
tttccaaaacctgacacagg

SEQ ID NO: 546688 - DNA, 20 bp, Artificial Sequence
  chemically synthesized
actgctgataaagtcatgcc

SEQ ID NO: 546689 - DNA, 20 bp, Artificial Sequence
  chemically synthesized
caagatgctgataatgatgt

SEQ ID NO: 546690 - DNA, 20 bp, Artificial Sequence
  chemically synthesized
tgatttagcgttatctggtg

SEQ ID NO: 546691 - DNA, 20 bp, Artificial Sequence
  chemically synthesized
cagcctgacaatgtgataaa

SEQ ID NO: 546692 - DNA, 20 bp, Artificial Sequence
  chemically synthesized
aagaaaatcacactttctga

SEQ ID NO: 546693 - DNA, 20 bp, Artificial Sequence
  chemically synthesized
cagtgggcgtgaatttcttc

SEQ ID NO: 546694 - DNA, 20 bp, Artificial Sequence
  chemically synthesized
agaagaaattcacgcccact

SEQ ID NO: 546695 - DNA, 20 bp, Artificial Sequence
  chemically synthesized
aatgttaatcaccaagacaa

SEQ ID NO: 546696 - DNA, 20 bp, Artificial Sequence
  chemically synthesized
acctctgctagggcagtgca

SEQ ID NO: 546697 - DNA, 20 bp, Artificial Sequence
  chemically synthesized
gggccactgtcctccagacc

SEQ ID NO: 546698 - DNA, 20 bp, Artificial Sequence
  chemically synthesized
aaatatagcccttccaaata

SEQ ID NO: 546699 - DNA, 20 bp, Artificial Sequence
  chemically synthesized
ttacaggaatgacagagggc

SEQ ID NO: 546700 - DNA, 20 bp, Artificial Sequence
  chemically synthesized
tgtgaggcttccccatccac

SEQ ID NO: 546701 - DNA, 20 bp, Artificial Sequence
  chemically synthesized
ggaatctgtatctggaggaa

SEQ ID NO: 546702 - DNA, 20 bp, Artificial Sequence
  chemically synthesized
gaatgaatttattgaagaca

SEQ ID NO: 546703 - DNA, 20 bp, Artificial Sequence
  chemically synthesized
gactttgcattgagtctacc

SEQ ID NO: 546704 - DNA, 20 bp, Artificial Sequence
  chemically synthesized
tagaacacccacagctgagg

SEQ ID NO: 546705 - DNA, 20 bp, Artificial Sequence
  chemically synthesized
tagttatttgtgtcagattt

SEQ ID NO: 546706 - DNA, 20 bp, Artificial Sequence
  chemically synthesized
attctaaaaatgctaaatta

SEQ ID NO: 546707 - DNA, 20 bp, Artificial Sequence
  chemically synthesized
tttctgttaatttagcattt

SEQ ID NO: 546708 - DNA, 20 bp, Artificial Sequence
  chemically synthesized
attaacatgtagacgcaagt

SEQ ID NO: 546709 - DNA, 20 bp, Artificial Sequence
  chemically synthesized
acggggtcaaaacccacaaa

SEQ ID NO: 546710 - DNA, 20 bp, Artificial Sequence
  chemically synthesized
gtggggggtcaaaatgaaga

SEQ ID NO: 546711 - DNA, 20 bp, Artificial Sequence
  chemically synthesized
acttaaaagctgtgtggccc

SEQ ID NO: 546712 - DNA, 20 bp, Artificial Sequence
  chemically synthesized
tgggagagtgagctctgtat

SEQ ID NO: 546713 - DNA, 20 bp, Artificial Sequence
  chemically synthesized
ttagccactgttttactcaa

SEQ ID NO: 546714 - DNA, 20 bp, Artificial Sequence
  chemically synthesized
ctaaattaatagcttgttct

SEQ ID NO: 546715 - DNA, 20 bp, Artificial Sequence
  chemically synthesized
cttatcgcagatttaaacat

SEQ ID NO: 546716 - DNA, 20 bp, Artificial Sequence
  chemically synthesized
tcaatagcatttatactgtt

SEQ ID NO: 546717 - DNA, 20 bp, Artificial Sequence
  chemically synthesized
tccctactcatcacattgct

SEQ ID NO: 546718 - DNA, 20 bp, Artificial Sequence
  chemically synthesized
ttacttacagtatcaatttc

SEQ ID NO: 546719 - DNA, 20 bp, Artificial Sequence
  chemically synthesized
gaagacaatatttttagagg

SEQ ID NO: 546720 - DNA, 20 bp, Artificial Sequence
  chemically synthesized
gaatacagctatatgaattt

SEQ ID NO: 546721 - DNA, 20 bp, Artificial Sequence
  chemically synthesized
gggattcttaccaaaaagat

SEQ ID NO: 546722 - DNA, 20 bp, Artificial Sequence
  chemically synthesized
tgtattctaaatctttttgg

SEQ ID NO: 546723 - DNA, 20 bp, Artificial Sequence
  chemically synthesized
aacttttcatctattagaat

SEQ ID NO: 546724 - DNA, 20 bp, Artificial Sequence
  chemically synthesized
cacagggaacttttcatcta

SEQ ID NO: 546725 - DNA, 20 bp, Artificial Sequence
  chemically synthesized
aatatttgtaattaagaact

SEQ ID NO: 546726 - DNA, 20 bp, Artificial Sequence
  chemically synthesized
aattaagtagctaatactat

SEQ ID NO: 546727 - DNA, 20 bp, Artificial Sequence
  chemically synthesized
ttcctcaattgggaagtgat

SEQ ID NO: 546728 - DNA, 20 bp, Artificial Sequence
  chemically synthesized
cttgctgattacagtgcaat

SEQ ID NO: 546729 - DNA, 20 bp, Artificial Sequence
  chemically synthesized
caagcttaatctagggcaaa

SEQ ID NO: 546730 - DNA, 20 bp, Artificial Sequence
  chemically synthesized
gtcattcagttgcagtaact

SEQ ID NO: 546731 - DNA, 20 bp, Artificial Sequence
  chemically synthesized
taaaatgcatttgttccaca

SEQ ID NO: 546732 - DNA, 20 bp, Artificial Sequence
  chemically synthesized
atgcatttgttccacagaag

SEQ ID NO: 546733 - DNA, 20 bp, Artificial Sequence
  chemically synthesized
atctcaccattccggctcaa

SEQ ID NO: 546734 - DNA, 20 bp, Artificial Sequence
  chemically synthesized
attaacctggacttttcgta

SEQ ID NO: 546735 - DNA, 20 bp, Artificial Sequence
  chemically synthesized
taatgaaatttatgattcaa

SEQ ID NO: 546736 - DNA, 20 bp, Artificial Sequence
  chemically synthesized
aaatgtgaatgtctagtagg

SEQ ID NO: 546737 - DNA, 20 bp, Artificial Sequence
  chemically synthesized
acattttcccaactttacag

SEQ ID NO: 546738 - DNA, 20 bp, Artificial Sequence
  chemically synthesized
gaagactaatttggtcttga

SEQ ID NO: 546739 - DNA, 20 bp, Artificial Sequence
  chemically synthesized
accaaattagtcttcgtcag

SEQ ID NO: 546740 - DNA, 20 bp, Artificial Sequence
  chemically synthesized
catgttaagtaaattcgaaa

SEQ ID NO: 546741 - DNA, 20 bp, Artificial Sequence
  chemically synthesized
tgtatgcttgaaaatttcaa

SEQ ID NO: 546742 - DNA, 20 bp, Artificial Sequence
  chemically synthesized
ccctgaatcatataacttgt

SEQ ID NO: 546743 - DNA, 20 bp, Artificial Sequence
  chemically synthesized
ttatatgattcagggatata

SEQ ID NO: 546744 - DNA, 20 bp, Artificial Sequence
  chemically synthesized
gaaagttgggctaaaactag

SEQ ID NO: 546745 - DNA, 20 bp, Artificial Sequence
  chemically synthesized
agcccaactttcaaggctct

SEQ ID NO: 546746 - DNA, 20 bp, Artificial Sequence
  chemically synthesized
accaaaccatatcagaatcg

SEQ ID NO: 546747 - DNA, 20 bp, Artificial Sequence
  chemically synthesized
gaagaaacaaccaaaccata

SEQ ID NO: 546748 - DNA, 20 bp, Artificial Sequence
  chemically synthesized
ctacaattcaagatttgggg

SEQ ID NO: 546749 - DNA, 20 bp, Artificial Sequence
  chemically synthesized
cgagatctgatggttttata

SEQ ID NO: 546750 - DNA, 20 bp, Artificial Sequence
  chemically synthesized
ttccatggagacaggcaaga

SEQ ID NO: 546751 - DNA, 20 bp, Artificial Sequence
  chemically synthesized
agggtgttaaccctctaaca

SEQ ID NO: 546752 - DNA, 20 bp, Artificial Sequence
  chemically synthesized
agaaccttatagaactgtcc

SEQ ID NO: 546753 - DNA, 20 bp, Artificial Sequence
  chemically synthesized
ctgattatcaaagaaactag

SEQ ID NO: 546754 - DNA, 20 bp, Artificial Sequence
  chemically synthesized
gccatgattggctgattatc

SEQ ID NO: 546755 - DNA, 20 bp, Artificial Sequence
  chemically synthesized
ttcccccaaagcaaagcctg

SEQ ID NO: 546756 - DNA, 20 bp, Artificial Sequence
  chemically synthesized
cctctctggcccctaaagct

SEQ ID NO: 546757 - DNA, 20 bp, Artificial Sequence
  chemically synthesized
catgtagcaacacgcaggga

SEQ ID NO: 546758 - DNA, 20 bp, Artificial Sequence
  chemically synthesized
tgtgttcatttggatgagta

SEQ ID NO: 546759 - DNA, 20 bp, Artificial Sequence
  chemically synthesized
actgtcagtggtcataaagg

SEQ ID NO: 546760 - DNA, 20 bp, Artificial Sequence
  chemically synthesized
actttgttatctcgtaatct

SEQ ID NO: 546761 - DNA, 20 bp, Artificial Sequence
  chemically synthesized
gagctgaaacttaaagatag

SEQ ID NO: 546762 - DNA, 20 bp, Artificial Sequence
  chemically synthesized
gaatgctgtagaaatatatg

SEQ ID NO: 546763 - DNA, 20 bp, Artificial Sequence
  chemically synthesized
ctttatagtgtatgaatgct

SEQ ID NO: 546764 - DNA, 20 bp, Artificial Sequence
  chemically synthesized
cagaggaccccagagaaaaa

SEQ ID NO: 546765 - DNA, 20 bp, Artificial Sequence
  chemically synthesized
gtattgtgccagaggacccc

SEQ ID NO: 546766 - DNA, 20 bp, Artificial Sequence
  chemically synthesized
gaagtaacaaagacaggact

SEQ ID NO: 546767 - DNA, 20 bp, Artificial Sequence
  chemically synthesized
gaaatgcatctaagggggaa

SEQ ID NO: 546768 - DNA, 20 bp, Artificial Sequence
  chemically synthesized
aatcagaatgaacattgaat

SEQ ID NO: 546769 - DNA, 20 bp, Artificial Sequence
  chemically synthesized
gggaaagtgctacctggaaa

SEQ ID NO: 546770 - DNA, 20 bp, Artificial Sequence
  chemically synthesized
agtgaaaggattaagctagg

SEQ ID NO: 546771 - DNA, 20 bp, Artificial Sequence
  chemically synthesized
tatgatagccttattgccat

SEQ ID NO: 546772 - DNA, 20 bp, Artificial Sequence
  chemically synthesized
aaaataataagaaaattgct

SEQ ID NO: 546773 - DNA, 20 bp, Artificial Sequence
  chemically synthesized
accaaaaatatataaaataa

SEQ ID NO: 546774 - DNA, 20 bp, Artificial Sequence
  chemically synthesized
gtttcatatataatgctacc

SEQ ID NO: 546775 - DNA, 20 bp, Artificial Sequence
  chemically synthesized
ccccgccccccccccccccc

SEQ ID NO: 546776 - DNA, 20 bp, Artificial Sequence
  chemically synthesized
tggaaaattgttagaatcct

SEQ ID NO: 546777 - DNA, 20 bp, Artificial Sequence
  chemically synthesized
actttctgagtggaaaattg

SEQ ID NO: 546778 - DNA, 20 bp, Artificial Sequence
  chemically synthesized
ggattctaacaattttccac

SEQ ID NO: 546779 - DNA, 20 bp, Artificial Sequence
  chemically synthesized
aaataagatagaggataaaa

SEQ ID NO: 546780 - DNA, 20 bp, Artificial Sequence
  chemically synthesized
gataaaaaaagaattctgaa

SEQ ID NO: 546781 - DNA, 20 bp, Artificial Sequence
  chemically synthesized
attccatgtatttttctgct

SEQ ID NO: 546782 - DNA, 20 bp, Artificial Sequence
  chemically synthesized
gggatttttgtgacatttaa

SEQ ID NO: 546783 - DNA, 20 bp, Artificial Sequence
  chemically synthesized
caaggatcaattagataata

SEQ ID NO: 546784 - DNA, 20 bp, Artificial Sequence
  chemically synthesized
tacctcatgataaatgttag

SEQ ID NO: 546785 - DNA, 20 bp, Artificial Sequence
  chemically synthesized
ctgccctactttgttgccac

SEQ ID NO: 546786 - DNA, 20 bp, Artificial Sequence
  chemically synthesized
caagctctattgaaaataga

SEQ ID NO: 546787 - DNA, 20 bp, Artificial Sequence
  chemically synthesized
tagaagagaaatggaaaggt

SEQ ID NO: 546788 - DNA, 20 bp, Artificial Sequence
  chemically synthesized
ctaatctcaagggacataca

SEQ ID NO: 546789 - DNA, 20 bp, Artificial Sequence
  chemically synthesized
gaggaaggcatattcaaggt

SEQ ID NO: 546790 - DNA, 20 bp, Artificial Sequence
  chemically synthesized
aaggcaaaagcaccaatgaa

SEQ ID NO: 546791 - DNA, 20 bp, Artificial Sequence
  chemically synthesized
ccttgataggtagaaatagg

SEQ ID NO: 546792 - DNA, 20 bp, Artificial Sequence
  chemically synthesized
ttagagaaaggccttgatag

SEQ ID NO: 546793 - DNA, 20 bp, Artificial Sequence
  chemically synthesized
gtacatttgggctatatttt

SEQ ID NO: 546794 - DNA, 20 bp, Artificial Sequence
  chemically synthesized
tgcaatcacttgagagagag

SEQ ID NO: 546795 - DNA, 20 bp, Artificial Sequence
  chemically synthesized
atacagtagctgtgcttctt

SEQ ID NO: 546796 - DNA, 20 bp, Artificial Sequence
  chemically synthesized
ttatatactggggatttagt

SEQ ID NO: 546797 - DNA, 20 bp, Artificial Sequence
  chemically synthesized
aagagagacactcagaagtc

SEQ ID NO: 546798 - DNA, 20 bp, Artificial Sequence
  chemically synthesized
agtcttagaattgtgtgctt

SEQ ID NO: 546799 - DNA, 20 bp, Artificial Sequence
  chemically synthesized
attgtgtgcttctagaatac

SEQ ID NO: 546800 - DNA, 20 bp, Artificial Sequence
  chemically synthesized
ggagtagacagactcagtcc

SEQ ID NO: 546801 - DNA, 20 bp, Artificial Sequence
  chemically synthesized
actaccaggatggtgccatt

SEQ ID NO: 546802 - DNA, 20 bp, Artificial Sequence
  chemically synthesized
cagagctgctagatctgcta

SEQ ID NO: 546803 - DNA, 20 bp, Artificial Sequence
  chemically synthesized
actgggtttcactgtgttag

SEQ ID NO: 546804 - DNA, 20 bp, Artificial Sequence
  chemically synthesized
agcaagactctgtctcaaaa

SEQ ID NO: 546805 - DNA, 20 bp, Artificial Sequence
  chemically synthesized
tgtctcaaaaaaagaaaaaa

SEQ ID NO: 546806 - DNA, 20 bp, Artificial Sequence
  chemically synthesized
gttactgagttaagcaatca

SEQ ID NO: 546807 - DNA, 20 bp, Artificial Sequence
  chemically synthesized
tactgtatagccagtagcta

SEQ ID NO: 546808 - DNA, 20 bp, Artificial Sequence
  chemically synthesized
tttcttctctgcttccccta

SEQ ID NO: 546809 - DNA, 20 bp, Artificial Sequence
  chemically synthesized
attctagtaggggaagcaga

SEQ ID NO: 546810 - DNA, 20 bp, Artificial Sequence
  chemically synthesized
gccgaaaggtctcatcttca

SEQ ID NO: 546811 - DNA, 20 bp, Artificial Sequence
  chemically synthesized
ctgaagactctacattgtac

SEQ ID NO: 546812 - DNA, 20 bp, Artificial Sequence
  chemically synthesized
taaatgaccccattaatgca

SEQ ID NO: 546813 - DNA, 20 bp, Artificial Sequence
  chemically synthesized
cgtagcttaattgacttgaa

SEQ ID NO: 546814 - DNA, 20 bp, Artificial Sequence
  chemically synthesized
gattaattagcatgatcatt

SEQ ID NO: 546815 - DNA, 20 bp, Artificial Sequence
  chemically synthesized
cattcaaaagtattgtttat

SEQ ID NO: 546816 - DNA, 20 bp, Artificial Sequence
  chemically synthesized
ttttggcacttgtcagccta

SEQ ID NO: 546817 - DNA, 20 bp, Artificial Sequence
  chemically synthesized
atgctctaaacaccactaag

SEQ ID NO: 546818 - DNA, 20 bp, Artificial Sequence
  chemically synthesized
agtgtctaccttgatatctt

SEQ ID NO: 546819 - DNA, 20 bp, Artificial Sequence
  chemically synthesized
tacgtcaaattccaattaac

SEQ ID NO: 546820 - DNA, 20 bp, Artificial Sequence
  chemically synthesized
gattttcgttatcagtttag

SEQ ID NO: 546821 - DNA, 20 bp, Artificial Sequence
  chemically synthesized
aaacattttctaaaacttta

SEQ ID NO: 546822 - DNA, 20 bp, Artificial Sequence
  chemically synthesized
ataagctttcttgtaaagtt

SEQ ID NO: 546823 - DNA, 20 bp, Artificial Sequence
  chemically synthesized
aattgtatgcttataaatga

SEQ ID NO: 546824 - DNA, 20 bp, Artificial Sequence
  chemically synthesized
cagtaaaatgcatagataaa

SEQ ID NO: 546825 - DNA, 20 bp, Artificial Sequence
  chemically synthesized
gctctagatagctcatacaa

SEQ ID NO: 546826 - DNA, 20 bp, Artificial Sequence
  chemically synthesized
agtagaatattattcagcct

SEQ ID NO: 546827 - DNA, 20 bp, Artificial Sequence
  chemically synthesized
aaatgtggtaaatgtataca

SEQ ID NO: 546828 - DNA, 20 bp, Artificial Sequence
  chemically synthesized
cacttctgggaatatactca

SEQ ID NO: 546829 - DNA, 20 bp, Artificial Sequence
  chemically synthesized
ggtttctcaaaatatagaac

SEQ ID NO: 546830 - DNA, 20 bp, Artificial Sequence
  chemically synthesized
taattctacgttctatattt

SEQ ID NO: 546831 - DNA, 20 bp, Artificial Sequence
  chemically synthesized
ccaaaaaaaaaaaaaaaaac

SEQ ID NO: 546832 - DNA, 20 bp, Artificial Sequence
  chemically synthesized
ggtcttactggccaaacttt

SEQ ID NO: 546833 - DNA, 20 bp, Artificial Sequence
  chemically synthesized
aaaatgaataaatgagttga

SEQ ID NO: 546834 - DNA, 20 bp, Artificial Sequence
  chemically synthesized
tatcatcgtagaattcaaca

SEQ ID NO: 546835 - DNA, 20 bp, Artificial Sequence
  chemically synthesized
cacagttaaattatatcatc

SEQ ID NO: 546836 - DNA, 20 bp, Artificial Sequence
  chemically synthesized
ggacagtactaaaccattca

SEQ ID NO: 546837 - DNA, 20 bp, Artificial Sequence
  chemically synthesized
ttcataagaactctctatca

SEQ ID NO: 546838 - DNA, 20 bp, Artificial Sequence
  chemically synthesized
gaggcctcaggaaacataaa

SEQ ID NO: 546839 - DNA, 20 bp, Artificial Sequence
  chemically synthesized
tcatgcttcctgtacagcct

SEQ ID NO: 546840 - DNA, 20 bp, Artificial Sequence
  chemically synthesized
tctgaaactgggtaaattat

SEQ ID NO: 546841 - DNA, 20 bp, Artificial Sequence
  chemically synthesized
gtccattcttgcattgctct

SEQ ID NO: 546842 - DNA, 20 bp, Artificial Sequence
  chemically synthesized
gatatttctttagagcaatg

SEQ ID NO: 546843 - DNA, 20 bp, Artificial Sequence
  chemically synthesized
cactaaaagctcaggctaca

SEQ ID NO: 546844 - DNA, 20 bp, Artificial Sequence
  chemically synthesized
gaagaaagcgtagacatttg

SEQ ID NO: 546845 - DNA, 20 bp, Artificial Sequence
  chemically synthesized
ccaaaagtacagaactttta

SEQ ID NO: 546846 - DNA, 20 bp, Artificial Sequence
  chemically synthesized
aatgaagccacaaatgttgc

SEQ ID NO: 546847 - DNA, 20 bp, Artificial Sequence
  chemically synthesized
aaaaaagggaatgtagaaca

SEQ ID NO: 546848 - DNA, 20 bp, Artificial Sequence
  chemically synthesized
tagttgaaacgatcttgaaa

SEQ ID NO: 546849 - DNA, 20 bp, Artificial Sequence
  chemically synthesized
tgatagagttgtctatttct

SEQ ID NO: 546850 - DNA, 20 bp, Artificial Sequence
  chemically synthesized
aaatcccaattagtttttct

SEQ ID NO: 546851 - DNA, 20 bp, Artificial Sequence
  chemically synthesized
tacacattcagtgccatctc

SEQ ID NO: 546852 - DNA, 20 bp, Artificial Sequence
  chemically synthesized
acaactacaaaacaatcctg

SEQ ID NO: 546853 - DNA, 20 bp, Artificial Sequence
  chemically synthesized
gcagtaaataaaatcaatat

SEQ ID NO: 546854 - DNA, 20 bp, Artificial Sequence
  chemically synthesized
ggttttttgtgtggaaatct

SEQ ID NO: 546855 - DNA, 20 bp, Artificial Sequence
  chemically synthesized
cagatgatatgatcttatat

SEQ ID NO: 546856 - DNA, 20 bp, Artificial Sequence
  chemically synthesized
caatgcatttcaaattttca

SEQ ID NO: 546857 - DNA, 20 bp, Artificial Sequence
  chemically synthesized
atatggcatacaaagtgatg

SEQ ID NO: 546858 - DNA, 20 bp, Artificial Sequence
  chemically synthesized
ggcaagcattaaagacttta

SEQ ID NO: 546859 - DNA, 20 bp, Artificial Sequence
  chemically synthesized
tggacagcttgaattgaatc

SEQ ID NO: 546860 - DNA, 20 bp, Artificial Sequence
  chemically synthesized
atgaaattactaattcatga

SEQ ID NO: 546861 - DNA, 20 bp, Artificial Sequence
  chemically synthesized
taaatggctacttttttgga

SEQ ID NO: 546862 - DNA, 20 bp, Artificial Sequence
  chemically synthesized
agggaaccctggtgtaaaat

SEQ ID NO: 546863 - DNA, 20 bp, Artificial Sequence
  chemically synthesized
gtaaaatttagaaaacagat

SEQ ID NO: 546864 - DNA, 20 bp, Artificial Sequence
  chemically synthesized
ttcataaatggagatggact

SEQ ID NO: 546865 - DNA, 20 bp, Artificial Sequence
  chemically synthesized
tcagaattgggactataagt

SEQ ID NO: 546866 - DNA, 20 bp, Artificial Sequence
  chemically synthesized
ctctaaattggatataaacg

SEQ ID NO: 546867 - DNA, 20 bp, Artificial Sequence
  chemically synthesized
tgcctctaaaatagaggaga

SEQ ID NO: 546868 - DNA, 20 bp, Artificial Sequence
  chemically synthesized
ggcagtctgaagtctttcaa

SEQ ID NO: 546869 - DNA, 20 bp, Artificial Sequence
  chemically synthesized
cattagcttaatattccaga

SEQ ID NO: 546870 - DNA, 20 bp, Artificial Sequence
  chemically synthesized
aagcatcggttcttgtgaca

SEQ ID NO: 546871 - DNA, 20 bp, Artificial Sequence
  chemically synthesized
tgtctgtaaatctctgtttg

SEQ ID NO: 546872 - DNA, 20 bp, Artificial Sequence
  chemically synthesized
aaggtgcaatacaccatgct

SEQ ID NO: 546873 - DNA, 20 bp, Artificial Sequence
  chemically synthesized
cattatgtaaattgactttg

SEQ ID NO: 546874 - DNA, 20 bp, Artificial Sequence
  chemically synthesized
tggtgagattaaagtaaaac

SEQ ID NO: 546875 - DNA, 20 bp, Artificial Sequence
  chemically synthesized
agaaacgtcagtggatacca

SEQ ID NO: 546876 - DNA, 20 bp, Artificial Sequence
  chemically synthesized
aattttatttataacacaca

SEQ ID NO: 546877 - DNA, 20 bp, Artificial Sequence
  chemically synthesized
ctgtctactatggcagacac

SEQ ID NO: 546878 - DNA, 20 bp, Artificial Sequence
  chemically synthesized
atttccgtcagatgctgtct

SEQ ID NO: 546879 - DNA, 20 bp, Artificial Sequence
  chemically synthesized
ttacgatattgacacatctc

SEQ ID NO: 546880 - DNA, 20 bp, Artificial Sequence
  chemically synthesized
acgagtgggcaaagattgta

SEQ ID NO: 546881 - DNA, 20 bp, Artificial Sequence
  chemically synthesized
taaatcaacaaaattcaatg

SEQ ID NO: 546882 - DNA, 20 bp, Artificial Sequence
  chemically synthesized
aatggaaccttaagtatacc

SEQ ID NO: 546883 - DNA, 20 bp, Artificial Sequence
  chemically synthesized
tttactgacattccttcatt

SEQ ID NO: 546884 - DNA, 20 bp, Artificial Sequence
  chemically synthesized
gggaccacgattttcttaac

SEQ ID NO: 546885 - DNA, 20 bp, Artificial Sequence
  chemically synthesized
cattagattcaattctatgt

SEQ ID NO: 546886 - DNA, 20 bp, Artificial Sequence
  chemically synthesized
aaatctatactttaaaagct

SEQ ID NO: 546887 - DNA, 20 bp, Artificial Sequence
  chemically synthesized
ttgaagagggggaagcaaat

SEQ ID NO: 546888 - DNA, 20 bp, Artificial Sequence
  chemically synthesized
aaggtagagccacaacaaag

SEQ ID NO: 546889 - DNA, 20 bp, Artificial Sequence
  chemically synthesized
cacaacaaaggcagaaaaat

SEQ ID NO: 546890 - DNA, 20 bp, Artificial Sequence
  chemically synthesized
ccgagactggacgatttaca

SEQ ID NO: 546891 - DNA, 20 bp, Artificial Sequence
  chemically synthesized
ggggtggcctcacaatcatg

SEQ ID NO: 546892 - DNA, 20 bp, Artificial Sequence
  chemically synthesized
ctcacgagacttaccactat

SEQ ID NO: 546893 - DNA, 20 bp, Artificial Sequence
  chemically synthesized
tttaacacataagtgccaaa

SEQ ID NO: 546894 - DNA, 20 bp, Artificial Sequence
  chemically synthesized
attaattcttatttaaatca

SEQ ID NO: 546895 - DNA, 20 bp, Artificial Sequence
  chemically synthesized
tttgtttctgatgatttaaa

SEQ ID NO: 546896 - DNA, 20 bp, Artificial Sequence
  chemically synthesized
gatgatttaaataagaatta

SEQ ID NO: 546897 - DNA, 20 bp, Artificial Sequence
  chemically synthesized
accacagaatttgaggtgac

SEQ ID NO: 546898 - DNA, 20 bp, Artificial Sequence
  chemically synthesized
tggctataagctgtagtacc

SEQ ID NO: 546899 - DNA, 20 bp, Artificial Sequence
  chemically synthesized
tactcaatttactaataaaa

SEQ ID NO: 546900 - DNA, 20 bp, Artificial Sequence
  chemically synthesized
acattactatccaggaaaaa

SEQ ID NO: 546901 - DNA, 20 bp, Artificial Sequence
  chemically synthesized
ggtgtaactgaaggttagtt

SEQ ID NO: 546902 - DNA, 20 bp, Artificial Sequence
  chemically synthesized
ggaagcaataaaaggcaggc

SEQ ID NO: 546903 - DNA, 20 bp, Artificial Sequence
  chemically synthesized
catagaaagccggattttgt

SEQ ID NO: 546904 - DNA, 20 bp, Artificial Sequence
  chemically synthesized
aacatggggttgtattaaca

SEQ ID NO: 546905 - DNA, 20 bp, Artificial Sequence
  chemically synthesized
gttttgggggatcatccagc

SEQ ID NO: 546906 - DNA, 20 bp, Artificial Sequence
  chemically synthesized
gggatcatccagcagagaat

SEQ ID NO: 546907 - DNA, 20 bp, Artificial Sequence
  chemically synthesized
ctctagtattgctattcgga

SEQ ID NO: 546908 - DNA, 20 bp, Artificial Sequence
  chemically synthesized
acatcaattgatcatcaagc

SEQ ID NO: 546909 - DNA, 20 bp, Artificial Sequence
  chemically synthesized
cgccctcaaatacatttagg

SEQ ID NO: 546910 - DNA, 20 bp, Artificial Sequence
  chemically synthesized
aatgaatgattaaattacta

SEQ ID NO: 546911 - DNA, 20 bp, Artificial Sequence
  chemically synthesized
atgaagcttaaattctagga

SEQ ID NO: 546912 - DNA, 20 bp, Artificial Sequence
  chemically synthesized
ccttatttttatttctagtc

SEQ ID NO: 546913 - DNA, 20 bp, Artificial Sequence
  chemically synthesized
caggtcatggcaagtcctat

SEQ ID NO: 546914 - DNA, 20 bp, Artificial Sequence
  chemically synthesized
gaatcctgtgatgactctct

SEQ ID NO: 546915 - DNA, 20 bp, Artificial Sequence
  chemically synthesized
tttcacatggcttcaaaatt

SEQ ID NO: 546916 - DNA, 20 bp, Artificial Sequence
  chemically synthesized
aggctggcatgatcactaaa

SEQ ID NO: 546917 - DNA, 20 bp, Artificial Sequence
  chemically synthesized
atttagtgatcatgccagcc

SEQ ID NO: 546918 - DNA, 20 bp, Artificial Sequence
  chemically synthesized
gttttcacttgctgaaaact

SEQ ID NO: 546919 - DNA, 20 bp, Artificial Sequence
  chemically synthesized
tctgaaatagcaaaagtggt

SEQ ID NO: 546920 - DNA, 20 bp, Artificial Sequence
  chemically synthesized
ctcaaactaaaagcactgat

SEQ ID NO: 546921 - DNA, 20 bp, Artificial Sequence
  chemically synthesized
gatgttgagcccatccttga

SEQ ID NO: 546922 - DNA, 20 bp, Artificial Sequence
  chemically synthesized
tacagaagaagatagaacta

SEQ ID NO: 546923 - DNA, 20 bp, Artificial Sequence
  chemically synthesized
taaatgacctcagggagaaa

SEQ ID NO: 546924 - DNA, 20 bp, Artificial Sequence
  chemically synthesized
acctgtttaaatgacctcag

SEQ ID NO: 546925 - DNA, 20 bp, Artificial Sequence
  chemically synthesized
gtgggatgtaagtgcatata

SEQ ID NO: 546926 - DNA, 20 bp, Artificial Sequence
  chemically synthesized
actaatataagtcattgtta

SEQ ID NO: 546927 - DNA, 20 bp, Artificial Sequence
  chemically synthesized
aaaggttaggaaagggagat

SEQ ID NO: 546928 - DNA, 20 bp, Artificial Sequence
  chemically synthesized
gttcccccttgtaaacgtag

SEQ ID NO: 546929 - DNA, 20 bp, Artificial Sequence
  chemically synthesized
tgctgttcccccttgtaaac

SEQ ID NO: 546930 - DNA, 20 bp, Artificial Sequence
  chemically synthesized
catagggagaaatgatcaac

SEQ ID NO: 546931 - DNA, 20 bp, Artificial Sequence
  chemically synthesized
atattagttcacttacatag

SEQ ID NO: 546932 - DNA, 20 bp, Artificial Sequence
  chemically synthesized
gtttaagctcaagtagattt

SEQ ID NO: 546933 - DNA, 20 bp, Artificial Sequence
  chemically synthesized
gtatgctctcgacagattgg

SEQ ID NO: 546934 - DNA, 20 bp, Artificial Sequence
  chemically synthesized
ttagtttatgaatgaatacc

SEQ ID NO: 546935 - DNA, 20 bp, Artificial Sequence
  chemically synthesized
cctggtatttatagctagcg

SEQ ID NO: 546936 - DNA, 20 bp, Artificial Sequence
  chemically synthesized
gagcgagagaaagaaaaata

SEQ ID NO: 546937 - DNA, 20 bp, Artificial Sequence
  chemically synthesized
ttaaaaaaggagagcgagag

SEQ ID NO: 546938 - DNA, 20 bp, Artificial Sequence
  chemically synthesized
agctttaaaaaaggagagcg

SEQ ID NO: 546939 - DNA, 20 bp, Artificial Sequence
  chemically synthesized
gaaaatatagtattgaaaac

SEQ ID NO: 546940 - DNA, 20 bp, Artificial Sequence
  chemically synthesized
gtagattttaaaaaacatgt

SEQ ID NO: 546941 - DNA, 20 bp, Artificial Sequence
  chemically synthesized
taaataaaaatataggtcag

SEQ ID NO: 546942 - DNA, 20 bp, Artificial Sequence
  chemically synthesized
agtgtaaactaaagcccaga

SEQ ID NO: 546943 - DNA, 20 bp, Artificial Sequence
  chemically synthesized
atctggcccatcctggaaca

SEQ ID NO: 546944 - DNA, 20 bp, Artificial Sequence
  chemically synthesized
ggtttaagataaatgggccc

SEQ ID NO: 546945 - DNA, 20 bp, Artificial Sequence
  chemically synthesized
gggatgtctgaaattcctta

SEQ ID NO: 546946 - DNA, 20 bp, Artificial Sequence
  chemically synthesized
atgggactaagaccggaggg

SEQ ID NO: 546947 - DNA, 20 bp, Artificial Sequence
  chemically synthesized
taagtgatagaactacctag

SEQ ID NO: 546948 - DNA, 20 bp, Artificial Sequence
  chemically synthesized
atactaagtgatagaactac

SEQ ID NO: 546949 - DNA, 20 bp, Artificial Sequence
  chemically synthesized
aatacctgagactgggtaat

SEQ ID NO: 546950 - DNA, 20 bp, Artificial Sequence
  chemically synthesized
cctgagactgggtaatttag

SEQ ID NO: 546951 - DNA, 20 bp, Artificial Sequence
  chemically synthesized
aggcttgggaggggccggga

SEQ ID NO: 546952 - DNA, 20 bp, Artificial Sequence
  chemically synthesized
ctttgaccagtttcccccat

SEQ ID NO: 546953 - DNA, 20 bp, Artificial Sequence
  chemically synthesized
tgacaacttgcaccatgcac

SEQ ID NO: 546954 - DNA, 20 bp, Artificial Sequence
  chemically synthesized
agaggcccaccatctagacc

SEQ ID NO: 546955 - DNA, 20 bp, Artificial Sequence
  chemically synthesized
gcctacggctgtgcagaagg

SEQ ID NO: 546956 - DNA, 20 bp, Artificial Sequence
  chemically synthesized
atttgcataagtaaagagaa

SEQ ID NO: 546957 - DNA, 20 bp, Artificial Sequence
  chemically synthesized
gggagtaagtcaagcctgct

SEQ ID NO: 546958 - DNA, 20 bp, Artificial Sequence
  chemically synthesized
cagcaggcttgacttactcc

SEQ ID NO: 546959 - DNA, 20 bp, Artificial Sequence
  chemically synthesized
cagcctgtccatgcggcaga

SEQ ID NO: 546960 - DNA, 20 bp, Artificial Sequence
  chemically synthesized
atttgcagcctgtccatgcg

SEQ ID NO: 546961 - DNA, 20 bp, Artificial Sequence
  chemically synthesized
ttatgctctgctttcctttt

SEQ ID NO: 546962 - DNA, 20 bp, Artificial Sequence
  chemically synthesized
acgcatataaccgtatgttt

SEQ ID NO: 546963 - DNA, 20 bp, Artificial Sequence
  chemically synthesized
gagatgatttagggtatctg

SEQ ID NO: 546964 - DNA, 20 bp, Artificial Sequence
  chemically synthesized
ggggggggggtcagaagaag

SEQ ID NO: 546965 - DNA, 20 bp, Artificial Sequence
  chemically synthesized
cagtgtgaaaacagactaaa

SEQ ID NO: 546966 - DNA, 20 bp, Artificial Sequence
  chemically synthesized
aattatatcaacttattaat

SEQ ID NO: 546967 - DNA, 20 bp, Artificial Sequence
  chemically synthesized
ataaattgtttccaatacaa

SEQ ID NO: 546968 - DNA, 20 bp, Artificial Sequence
  chemically synthesized
ttagttttgaggtgtcacaa

SEQ ID NO: 546969 - DNA, 20 bp, Artificial Sequence
  chemically synthesized
ttcattcattttatcagtgc

SEQ ID NO: 546970 - DNA, 20 bp, Artificial Sequence
  chemically synthesized
tatcagtgctcgtttttaat

SEQ ID NO: 546971 - DNA, 20 bp, Artificial Sequence
  chemically synthesized
atgctgcgaaacaaagtgac

SEQ ID NO: 546972 - DNA, 20 bp, Artificial Sequence
  chemically synthesized
gcattatcaatttatccagg

SEQ ID NO: 546973 - DNA, 20 bp, Artificial Sequence
  chemically synthesized
tggtaggattccccccccaa

SEQ ID NO: 546974 - DNA, 20 bp, Artificial Sequence
  chemically synthesized
ttaagcaagtatggaatttc

SEQ ID NO: 546975 - DNA, 20 bp, Artificial Sequence
  chemically synthesized
tgctttgaggttaagttttc

SEQ ID NO: 546976 - DNA, 20 bp, Artificial Sequence
  chemically synthesized
aattttaagattgtttatgg

SEQ ID NO: 546977 - DNA, 20 bp, Artificial Sequence
  chemically synthesized
tgaaataataacagtaagaa

SEQ ID NO: 546978 - DNA, 20 bp, Artificial Sequence
  chemically synthesized
aatgactgaaataataacag

SEQ ID NO: 546979 - DNA, 20 bp, Artificial Sequence
  chemically synthesized
gcttccttcagatggggtga

SEQ ID NO: 546980 - DNA, 20 bp, Artificial Sequence
  chemically synthesized
gatggggtgattagaataaa

SEQ ID NO: 546981 - DNA, 20 bp, Artificial Sequence
  chemically synthesized
caggacttcgcagttttcca

SEQ ID NO: 546982 - DNA, 20 bp, Artificial Sequence
  chemically synthesized
gaaaggtaaagatttgctca

SEQ ID NO: 546983 - DNA, 20 bp, Artificial Sequence
  chemically synthesized
gcatctgaaatttccttgca

SEQ ID NO: 546984 - DNA, 20 bp, Artificial Sequence
  chemically synthesized
acagttactgtgtaaaaatt

SEQ ID NO: 546985 - DNA, 20 bp, Artificial Sequence
  chemically synthesized
gcagcgatgtgcacagggca

SEQ ID NO: 546986 - DNA, 20 bp, Artificial Sequence
  chemically synthesized
catacaagaagcaatcccag

SEQ ID NO: 546987 - DNA, 20 bp, Artificial Sequence
  chemically synthesized
ttcagacatatatcagtttt

SEQ ID NO: 546988 - DNA, 20 bp, Artificial Sequence
  chemically synthesized
tgctgttaattaaaaataat

SEQ ID NO: 546989 - DNA, 20 bp, Artificial Sequence
  chemically synthesized
attttaaaagatgtttagca

SEQ ID NO: 546990 - DNA, 20 bp, Artificial Sequence
  chemically synthesized
tgattcaagtcccgaaccct

SEQ ID NO: 546991 - DNA, 20 bp, Artificial Sequence
  chemically synthesized
caagtacaacagaccagagc

SEQ ID NO: 546992 - DNA, 20 bp, Artificial Sequence
  chemically synthesized
gaccagagctaagaaactga

SEQ ID NO: 546993 - DNA, 20 bp, Artificial Sequence
  chemically synthesized
catgatctcttctagaattt

SEQ ID NO: 546994 - DNA, 20 bp, Artificial Sequence
  chemically synthesized
ggaaagaaacatgatctctt

SEQ ID NO: 546995 - DNA, 20 bp, Artificial Sequence
  chemically synthesized
ctataaaagctagaaaaggg

SEQ ID NO: 546996 - DNA, 20 bp, Artificial Sequence
  chemically synthesized
atattggaggtctataaaag

SEQ ID NO: 546997 - DNA, 20 bp, Artificial Sequence
  chemically synthesized
tacctactgttgttcgcttt

SEQ ID NO: 546998 - DNA, 20 bp, Artificial Sequence
  chemically synthesized
taggcctgagtgatataatt

SEQ ID NO: 546999 - DNA, 20 bp, Artificial Sequence
  chemically synthesized
atatttaatacttgggaata

SEQ ID NO: 547000 - DNA, 20 bp, Artificial Sequence
  chemically synthesized
gcagctatcaaaaaatagga

SEQ ID NO: 547001 - DNA, 20 bp, Artificial Sequence
  chemically synthesized
ttatccttgcgatagtttgc

SEQ ID NO: 547002 - DNA, 20 bp, Artificial Sequence
  chemically synthesized
gtataataaaaaaatcaaaa

SEQ ID NO: 547003 - DNA, 20 bp, Artificial Sequence
  chemically synthesized
ttataatttaaatattttcc

SEQ ID NO: 547004 - DNA, 20 bp, Artificial Sequence
  chemically synthesized
aagcctgatataaattttac

SEQ ID NO: 547005 - DNA, 20 bp, Artificial Sequence
  chemically synthesized
gtaaaaattgactgttacaa

SEQ ID NO: 547006 - DNA, 20 bp, Artificial Sequence
  chemically synthesized
gctacattcatcgtataatt

SEQ ID NO: 547007 - DNA, 20 bp, Artificial Sequence
  chemically synthesized
taagaatgtcggcttctagt

SEQ ID NO: 547008 - DNA, 20 bp, Artificial Sequence
  chemically synthesized
ctaaatagttctgtcgggca

SEQ ID NO: 547009 - DNA, 20 bp, Artificial Sequence
  chemically synthesized
ttttataacagcttattctg

SEQ ID NO: 547010 - DNA, 20 bp, Artificial Sequence
  chemically synthesized
tgataattgtatgcattctt

SEQ ID NO: 547011 - DNA, 20 bp, Artificial Sequence
  chemically synthesized
caagaagctgcagaaggttc

SEQ ID NO: 547012 - DNA, 20 bp, Artificial Sequence
  chemically synthesized
gctactttgttgtctaagct

SEQ ID NO: 547013 - DNA, 20 bp, Artificial Sequence
  chemically synthesized
taatgtaaaagccgtgtctt

SEQ ID NO: 547014 - DNA, 20 bp, Artificial Sequence
  chemically synthesized
ctactcgggaggctgaggca

SEQ ID NO: 547015 - DNA, 20 bp, Artificial Sequence
  chemically synthesized
agcgagcctctgtctcaaaa

SEQ ID NO: 547016 - DNA, 20 bp, Artificial Sequence
  chemically synthesized
aactccactggaacattaag

SEQ ID NO: 547017 - DNA, 20 bp, Artificial Sequence
  chemically synthesized
ttgagttatatatgagaatg

SEQ ID NO: 547018 - DNA, 20 bp, Artificial Sequence
  chemically synthesized
ccggtatattgagttatata

SEQ ID NO: 547019 - DNA, 20 bp, Artificial Sequence
  chemically synthesized
cttaattacataatacttat

SEQ ID NO: 547020 - DNA, 20 bp, Artificial Sequence
  chemically synthesized
attactggagtagaggcaag

SEQ ID NO: 547021 - DNA, 20 bp, Artificial Sequence
  chemically synthesized
acgaatgtagtatgtctggg

SEQ ID NO: 547022 - DNA, 20 bp, Artificial Sequence
  chemically synthesized
gcttactttacctatctcag

SEQ ID NO: 547023 - DNA, 20 bp, Artificial Sequence
  chemically synthesized
aaaactagcctaaacataag

SEQ ID NO: 547024 - DNA, 20 bp, Artificial Sequence
  chemically synthesized
ccatatatttggggaaatag

SEQ ID NO: 547025 - DNA, 20 bp, Artificial Sequence
  chemically synthesized
atcttgctatcttagtttga

SEQ ID NO: 547026 - DNA, 20 bp, Artificial Sequence
  chemically synthesized
tattcatgtaggctcccagg

SEQ ID NO: 547027 - DNA, 20 bp, Artificial Sequence
  chemically synthesized
aatagtaacatggtaatttt

SEQ ID NO: 547028 - DNA, 20 bp, Artificial Sequence
  chemically synthesized
gataatatttaatacatata

SEQ ID NO: 547029 - DNA, 20 bp, Artificial Sequence
  chemically synthesized
aatattatcattaaaaatca

SEQ ID NO: 547030 - DNA, 20 bp, Artificial Sequence
  chemically synthesized
cacaaaacaaaacaaaaaac

SEQ ID NO: 547031 - DNA, 20 bp, Artificial Sequence
  chemically synthesized
ctttgttgatttaacccttc

SEQ ID NO: 547032 - DNA, 20 bp, Artificial Sequence
  chemically synthesized
ctgcatttcacagctgaacc

SEQ ID NO: 547033 - DNA, 20 bp, Artificial Sequence
  chemically synthesized
gctagatgattgtgtgtaaa

SEQ ID NO: 547034 - DNA, 20 bp, Artificial Sequence
  chemically synthesized
aaaagagaattaagttaaat

SEQ ID NO: 547035 - DNA, 20 bp, Artificial Sequence
  chemically synthesized
gagaattaagttaaatccag

SEQ ID NO: 547036 - DNA, 20 bp, Artificial Sequence
  chemically synthesized
gtcaagttcttcctgcagtc

SEQ ID NO: 547037 - DNA, 20 bp, Artificial Sequence
  chemically synthesized
cctgcagtcacagaaaaaga

SEQ ID NO: 547038 - DNA, 20 bp, Artificial Sequence
  chemically synthesized
aatatggaataagcacgtca

SEQ ID NO: 547039 - DNA, 20 bp, Artificial Sequence
  chemically synthesized
atacaataaaaattaacagg

SEQ ID NO: 547040 - DNA, 20 bp, Artificial Sequence
  chemically synthesized
atgcatgtgtaaccctgaac

SEQ ID NO: 547041 - DNA, 20 bp, Artificial Sequence
  chemically synthesized
tgaacctagaaattaaacac

SEQ ID NO: 547042 - DNA, 20 bp, Artificial Sequence
  chemically synthesized
atgccttatagattatactt

SEQ ID NO: 547043 - DNA, 20 bp, Artificial Sequence
  chemically synthesized
aggacatctacttataaaac

SEQ ID NO: 547044 - DNA, 20 bp, Artificial Sequence
  chemically synthesized
tcttaacctttttgagagct

SEQ ID NO: 547045 - DNA, 20 bp, Artificial Sequence
  chemically synthesized
attttaagtcaacatttaca

SEQ ID NO: 547046 - DNA, 20 bp, Artificial Sequence
  chemically synthesized
gcaattaatcacctccaaca

SEQ ID NO: 547047 - DNA, 20 bp, Artificial Sequence
  chemically synthesized
ctaatgaacaactttcaaca

SEQ ID NO: 547048 - DNA, 20 bp, Artificial Sequence
  chemically synthesized
aataaatccagaacttttta

SEQ ID NO: 547049 - DNA, 20 bp, Artificial Sequence
  chemically synthesized
ttagaaatcacacatgttaa

SEQ ID NO: 547050 - DNA, 20 bp, Artificial Sequence
  chemically synthesized
tagtggtggactttatcact

SEQ ID NO: 547051 - DNA, 20 bp, Artificial Sequence
  chemically synthesized
caattaacttccaaggaact

SEQ ID NO: 547052 - DNA, 20 bp, Artificial Sequence
  chemically synthesized
ggtatatttaaaatcccata

SEQ ID NO: 547053 - DNA, 20 bp, Artificial Sequence
  chemically synthesized
cataaatatttgtacattta

SEQ ID NO: 547054 - DNA, 20 bp, Artificial Sequence
  chemically synthesized
gacagaatgtgaactaattc

SEQ ID NO: 547055 - DNA, 20 bp, Artificial Sequence
  chemically synthesized
ataggtaactgttatataag

SEQ ID NO: 547056 - DNA, 20 bp, Artificial Sequence
  chemically synthesized
ccccaggcttactttgttca

SEQ ID NO: 547057 - DNA, 20 bp, Artificial Sequence
  chemically synthesized
aaatgcttatgtagcatctg

SEQ ID NO: 547058 - DNA, 20 bp, Artificial Sequence
  chemically synthesized
aagaatttacaatgtcagac

SEQ ID NO: 547059 - DNA, 20 bp, Artificial Sequence
  chemically synthesized
aagaataaaaagtaggggct

SEQ ID NO: 547060 - DNA, 20 bp, Artificial Sequence
  chemically synthesized
ttgaccacatcattaataaa

SEQ ID NO: 547061 - DNA, 20 bp, Artificial Sequence
  chemically synthesized
tggaatgaaaatgtttaaaa

SEQ ID NO: 547062 - DNA, 20 bp, Artificial Sequence
  chemically synthesized
ttgaaggaatgttcttattg

SEQ ID NO: 547063 - DNA, 20 bp, Artificial Sequence
  chemically synthesized
ttttaagcaaaatcattata

SEQ ID NO: 547064 - DNA, 20 bp, Artificial Sequence
  chemically synthesized
tatctttgcattcatcataa

SEQ ID NO: 547065 - DNA, 20 bp, Artificial Sequence
  chemically synthesized
aatattaagggactataaga

SEQ ID NO: 547066 - DNA, 20 bp, Artificial Sequence
  chemically synthesized
caaaattcgagatataatag

SEQ ID NO: 547067 - DNA, 20 bp, Artificial Sequence
  chemically synthesized
actaggttttaaaagactga

SEQ ID NO: 547068 - DNA, 20 bp, Artificial Sequence
  chemically synthesized
gaagtggggaaaaaactagt

SEQ ID NO: 547069 - DNA, 20 bp, Artificial Sequence
  chemically synthesized
acttgcccaactgattctat

SEQ ID NO: 547070 - DNA, 20 bp, Artificial Sequence
  chemically synthesized
taatatctaagtttttctgt

SEQ ID NO: 547071 - DNA, 20 bp, Artificial Sequence
  chemically synthesized
taaaaaaaaaagctattatc

SEQ ID NO: 547072 - DNA, 20 bp, Artificial Sequence
  chemically synthesized
catctaattttagagttaac

SEQ ID NO: 547073 - DNA, 20 bp, Artificial Sequence
  chemically synthesized
ataactttagtgtggcttgg

SEQ ID NO: 547074 - DNA, 20 bp, Artificial Sequence
  chemically synthesized
tttactatgatgtttccttg

SEQ ID NO: 547075 - DNA, 20 bp, Artificial Sequence
  chemically synthesized
tcaaggaaacatcatagtaa

SEQ ID NO: 547076 - DNA, 20 bp, Artificial Sequence
  chemically synthesized
aaaagttttataaactagag

SEQ ID NO: 547077 - DNA, 20 bp, Artificial Sequence
  chemically synthesized
agtaaccttttagttaatgc

SEQ ID NO: 547078 - DNA, 20 bp, Artificial Sequence
  chemically synthesized
ctacagaatataatcttatg

SEQ ID NO: 547079 - DNA, 20 bp, Artificial Sequence
  chemically synthesized
attccctacttgtaactact

SEQ ID NO: 547080 - DNA, 20 bp, Artificial Sequence
  chemically synthesized
ctctacctcctagagttttt

SEQ ID NO: 547081 - DNA, 20 bp, Artificial Sequence
  chemically synthesized
ttgaattggttcccagactc

SEQ ID NO: 547082 - DNA, 20 bp, Artificial Sequence
  chemically synthesized
catatgacgtaatgactaca

SEQ ID NO: 547083 - DNA, 20 bp, Artificial Sequence
  chemically synthesized
accagccttcaggagacttg

SEQ ID NO: 547084 - DNA, 20 bp, Artificial Sequence
  chemically synthesized
agagagagagagagagagag

SEQ ID NO: 547085 - DNA, 20 bp, Artificial Sequence
  chemically synthesized
agccagcagtattcctcaga

SEQ ID NO: 547086 - DNA, 20 bp, Artificial Sequence
  chemically synthesized
gtattcctcagaccagaaaa

SEQ ID NO: 547087 - DNA, 20 bp, Artificial Sequence
  chemically synthesized
atttaacttataaattaggc

SEQ ID NO: 547088 - DNA, 20 bp, Artificial Sequence
  chemically synthesized
accacggttgaccatgggta

SEQ ID NO: 547089 - DNA, 20 bp, Artificial Sequence
  chemically synthesized
tccagttattttgcctgcct

SEQ ID NO: 547090 - DNA, 20 bp, Artificial Sequence
  chemically synthesized
atttggcccgtaatatgagc

SEQ ID NO: 547091 - DNA, 20 bp, Artificial Sequence
  chemically synthesized
ccaaaactagttggctctgt

SEQ ID NO: 547092 - DNA, 20 bp, Artificial Sequence
  chemically synthesized
tgctgcctaggaaaatgaac

SEQ ID NO: 547093 - DNA, 20 bp, Artificial Sequence
  chemically synthesized
attatcttaactcttaatcc

SEQ ID NO: 547094 - DNA, 20 bp, Artificial Sequence
  chemically synthesized
gattaagagttaagataata

SEQ ID NO: 547095 - DNA, 20 bp, Artificial Sequence
  chemically synthesized
tacctagcaaacaagagtga

SEQ ID NO: 547096 - DNA, 20 bp, Artificial Sequence
  chemically synthesized
cagtgtggtttacttgacat

SEQ ID NO: 547097 - DNA, 20 bp, Artificial Sequence
  chemically synthesized
aaggcaggagatacactgtc

SEQ ID NO: 547098 - DNA, 20 bp, Artificial Sequence
  chemically synthesized
caattatactcacagatgga

SEQ ID NO: 547099 - DNA, 20 bp, Artificial Sequence
  chemically synthesized
gcagagctgataaagaacta

SEQ ID NO: 547100 - DNA, 20 bp, Artificial Sequence
  chemically synthesized
gatgagagaggcaggcaaaa

SEQ ID NO: 547101 - DNA, 20 bp, Artificial Sequence
  chemically synthesized
gcttcacggacatgtttgtg

SEQ ID NO: 547102 - DNA, 20 bp, Artificial Sequence
  chemically synthesized
ggcaagtttcttaatcctaa

SEQ ID NO: 547103 - DNA, 20 bp, Artificial Sequence
  chemically synthesized
caaaacattctctttaggat

SEQ ID NO: 547104 - DNA, 20 bp, Artificial Sequence
  chemically synthesized
attgctaacagttctgttaa

SEQ ID NO: 547105 - DNA, 20 bp, Artificial Sequence
  chemically synthesized
aggcttagtcattttttaag

SEQ ID NO: 547106 - DNA, 20 bp, Artificial Sequence
  chemically synthesized
gcccttttataggataagat

SEQ ID NO: 547107 - DNA, 20 bp, Artificial Sequence
  chemically synthesized
cctataaaagggcatatctc

SEQ ID NO: 547108 - DNA, 20 bp, Artificial Sequence
  chemically synthesized
gagagtatcctgcagctaag

SEQ ID NO: 547109 - DNA, 20 bp, Artificial Sequence
  chemically synthesized
gattttattggacagtcttg

SEQ ID NO: 547110 - DNA, 20 bp, Artificial Sequence
  chemically synthesized
tttatatcactgatgataaa

SEQ ID NO: 547111 - DNA, 20 bp, Artificial Sequence
  chemically synthesized
tcagcaatattaacatctca

SEQ ID NO: 547112 - DNA, 20 bp, Artificial Sequence
  chemically synthesized
tatgatatccagttgaaaag

SEQ ID NO: 547113 - DNA, 20 bp, Artificial Sequence
  chemically synthesized
tactttgaatacattaacta

SEQ ID NO: 547114 - DNA, 20 bp, Artificial Sequence
  chemically synthesized
agaggctccctaacatgggg

SEQ ID NO: 547115 - DNA, 20 bp, Artificial Sequence
  chemically synthesized
aggattgtaggaatcttgta

SEQ ID NO: 547116 - DNA, 20 bp, Artificial Sequence
  chemically synthesized
cattcatactgtttacatcc

SEQ ID NO: 547117 - DNA, 20 bp, Artificial Sequence
  chemically synthesized
aagtatactactatatacat

SEQ ID NO: 547118 - DNA, 20 bp, Artificial Sequence
  chemically synthesized
agaggagactagataaaaca

SEQ ID NO: 547119 - DNA, 20 bp, Artificial Sequence
  chemically synthesized
tttatgtcctagaaggtaaa

SEQ ID NO: 547120 - DNA, 20 bp, Artificial Sequence
  chemically synthesized
gtaaaggagaaactaaaggt

SEQ ID NO: 547121 - DNA, 20 bp, Artificial Sequence
  chemically synthesized
ctcaaaagccaaagacaaaa

SEQ ID NO: 547122 - DNA, 20 bp, Artificial Sequence
  chemically synthesized
gtgcttttctcttgctgttt

SEQ ID NO: 547123 - DNA, 20 bp, Artificial Sequence
  chemically synthesized
agagaattctaaaaacagca

SEQ ID NO: 547124 - DNA, 20 bp, Artificial Sequence
  chemically synthesized
aaaagcaccttgtcacttat

SEQ ID NO: 547125 - DNA, 20 bp, Artificial Sequence
  chemically synthesized
gattaacagtgaatttctca

SEQ ID NO: 547126 - DNA, 20 bp, Artificial Sequence
  chemically synthesized
ctggcctgtaaggtttcttc

SEQ ID NO: 547127 - DNA, 20 bp, Artificial Sequence
  chemically synthesized
aagaaaccttacaggccaga

SEQ ID NO: 547128 - DNA, 20 bp, Artificial Sequence
  chemically synthesized
atgttatattaaacttgctg

SEQ ID NO: 547129 - DNA, 20 bp, Artificial Sequence
  chemically synthesized
aggtagccttcataaatcaa

SEQ ID NO: 547130 - DNA, 20 bp, Artificial Sequence
  chemically synthesized
tcaccatgatactggcctta

SEQ ID NO: 547131 - DNA, 20 bp, Artificial Sequence
  chemically synthesized
gagtcctatacctggaagtg

SEQ ID NO: 547132 - DNA, 20 bp, Artificial Sequence
  chemically synthesized
tgcaaacacacaaaaaaaat

SEQ ID NO: 547133 - DNA, 20 bp, Artificial Sequence
  chemically synthesized
gttactcaaatgttaccact

SEQ ID NO: 547134 - DNA, 20 bp, Artificial Sequence
  chemically synthesized
tgataatgagggaaaaaaat

SEQ ID NO: 547135 - DNA, 20 bp, Artificial Sequence
  chemically synthesized
aaccataaatcaataaaatg

SEQ ID NO: 547136 - DNA, 20 bp, Artificial Sequence
  chemically synthesized
gtgaaatgagtttattttag

SEQ ID NO: 547137 - DNA, 20 bp, Artificial Sequence
  chemically synthesized
cgtgttgggtgtatgtatgt

SEQ ID NO: 547138 - DNA, 20 bp, Artificial Sequence
  chemically synthesized
cacttagacaaaaaattaac

SEQ ID NO: 547139 - DNA, 20 bp, Artificial Sequence
  chemically synthesized
gagaatgttctgtgtgctta

SEQ ID NO: 547140 - DNA, 20 bp, Artificial Sequence
  chemically synthesized
cataacatatggtctgtcct

SEQ ID NO: 547141 - DNA, 20 bp, Artificial Sequence
  chemically synthesized
aggacagaccatatgttatg

SEQ ID NO: 547142 - DNA, 20 bp, Artificial Sequence
  chemically synthesized
aacacaaggaaataacaaaa

SEQ ID NO: 547143 - DNA, 20 bp, Artificial Sequence
  chemically synthesized
tgaatgaccattgggtcaag

SEQ ID NO: 547144 - DNA, 20 bp, Artificial Sequence
  chemically synthesized
agtacttcaaggagctagtc

SEQ ID NO: 547145 - DNA, 20 bp, Artificial Sequence
  chemically synthesized
gaaaaaaaaacaaaccaaac

SEQ ID NO: 547146 - DNA, 20 bp, Artificial Sequence
  chemically synthesized
cctaaaaattgagcaaaact

SEQ ID NO: 547147 - DNA, 20 bp, Artificial Sequence
  chemically synthesized
aaagcacttgctagactaac

SEQ ID NO: 547148 - DNA, 20 bp, Artificial Sequence
  chemically synthesized
gagacattacaactgatacc

SEQ ID NO: 547149 - DNA, 20 bp, Artificial Sequence
  chemically synthesized
tacaaccaaccgtggatcaa

SEQ ID NO: 547150 - DNA, 20 bp, Artificial Sequence
  chemically synthesized
caaccgtggatcaagaagaa

SEQ ID NO: 547151 - DNA, 20 bp, Artificial Sequence
  chemically synthesized
aggagaattggtaaagtttg

SEQ ID NO: 547152 - DNA, 20 bp, Artificial Sequence
  chemically synthesized
tttttcttggaacacttaca

SEQ ID NO: 547153 - DNA, 20 bp, Artificial Sequence
  chemically synthesized
caattctcctgtaagtgttc

SEQ ID NO: 547154 - DNA, 20 bp, Artificial Sequence
  chemically synthesized
atcagggtaatgctggcttc

SEQ ID NO: 547155 - DNA, 20 bp, Artificial Sequence
  chemically synthesized
catccctgatgaacactgat

SEQ ID NO: 547156 - DNA, 20 bp, Artificial Sequence
  chemically synthesized
ttggattgctagcattttgt

SEQ ID NO: 547157 - DNA, 20 bp, Artificial Sequence
  chemically synthesized
aatatgacatattacatcaa

SEQ ID NO: 547158 - DNA, 20 bp, Artificial Sequence
  chemically synthesized
tacatcaaacagaatgaaaa

SEQ ID NO: 547159 - DNA, 20 bp, Artificial Sequence
  chemically synthesized
tgaccattccagttttatag

SEQ ID NO: 547160 - DNA, 20 bp, Artificial Sequence
  chemically synthesized
ggtcctagccagagcaatca

SEQ ID NO: 547161 - DNA, 20 bp, Artificial Sequence
  chemically synthesized
ctagccagagcaatcaagag

SEQ ID NO: 547162 - DNA, 20 bp, Artificial Sequence
  chemically synthesized
aaatacaaggcgtcctaata

SEQ ID NO: 547163 - DNA, 20 bp, Artificial Sequence
  chemically synthesized
tctttgttaataacttatag

SEQ ID NO: 547164 - DNA, 20 bp, Artificial Sequence
  chemically synthesized
tagaaaaagctaaaccctca

SEQ ID NO: 547165 - DNA, 20 bp, Artificial Sequence
  chemically synthesized
agccagttcattattggtat

SEQ ID NO: 547166 - DNA, 20 bp, Artificial Sequence
  chemically synthesized
tataccaataatgaactggc

SEQ ID NO: 547167 - DNA, 20 bp, Artificial Sequence
  chemically synthesized
ccaataatgaactggctgag

SEQ ID NO: 547168 - DNA, 20 bp, Artificial Sequence
  chemically synthesized
catcccatgtttatcggtca

SEQ ID NO: 547169 - DNA, 20 bp, Artificial Sequence
  chemically synthesized
ttcaatgtagaatgctttga

SEQ ID NO: 547170 - DNA, 20 bp, Artificial Sequence
  chemically synthesized
tagggactgcattattcaat

SEQ ID NO: 547171 - DNA, 20 bp, Artificial Sequence
  chemically synthesized
attgaataatgcagtcccta

SEQ ID NO: 547172 - DNA, 20 bp, Artificial Sequence
  chemically synthesized
aatgcagtccctatcagaat

SEQ ID NO: 547173 - DNA, 20 bp, Artificial Sequence
  chemically synthesized
cttgacaaaacagcaaggtg

SEQ ID NO: 547174 - DNA, 20 bp, Artificial Sequence
  chemically synthesized
aatggaatagattagagaac

SEQ ID NO: 547175 - DNA, 20 bp, Artificial Sequence
  chemically synthesized
acaccttcttcaaatggtgc

SEQ ID NO: 547176 - DNA, 20 bp, Artificial Sequence
  chemically synthesized
gatccctgtctctcaccata

SEQ ID NO: 547177 - DNA, 20 bp, Artificial Sequence
  chemically synthesized
ataaatagataattgggact

SEQ ID NO: 547178 - DNA, 20 bp, Artificial Sequence
  chemically synthesized
aagagacaacctgctgaatg

SEQ ID NO: 547179 - DNA, 20 bp, Artificial Sequence
  chemically synthesized
gttggtcatttgtcttcttt

SEQ ID NO: 547180 - DNA, 20 bp, Artificial Sequence
  chemically synthesized
gagccatcatcttgccccag

SEQ ID NO: 547181 - DNA, 20 bp, Artificial Sequence
  chemically synthesized
aatggctattattaaaaaga

SEQ ID NO: 547182 - DNA, 20 bp, Artificial Sequence
  chemically synthesized
tcttaatacattgttgtagt

SEQ ID NO: 547183 - DNA, 20 bp, Artificial Sequence
  chemically synthesized
tatttctatgtttagttttt

SEQ ID NO: 547184 - DNA, 20 bp, Artificial Sequence
  chemically synthesized
gatttctcaaaaaactaaac

SEQ ID NO: 547185 - DNA, 20 bp, Artificial Sequence
  chemically synthesized
gcatatacttttcctgatag

SEQ ID NO: 547186 - DNA, 20 bp, Artificial Sequence
  chemically synthesized
ccattagtgaacaaatggat

SEQ ID NO: 547187 - DNA, 20 bp, Artificial Sequence
  chemically synthesized
gaatactcttcatccataaa

SEQ ID NO: 547188 - DNA, 20 bp, Artificial Sequence
  chemically synthesized
gcagtttcattcatgttggt

SEQ ID NO: 547189 - DNA, 20 bp, Artificial Sequence
  chemically synthesized
tttttacacctatatatgag

SEQ ID NO: 547190 - DNA, 20 bp, Artificial Sequence
  chemically synthesized
cccctttctgctgttgaaca

SEQ ID NO: 547191 - DNA, 20 bp, Artificial Sequence
  chemically synthesized
atatattctaatgttcaaca

SEQ ID NO: 547192 - DNA, 20 bp, Artificial Sequence
  chemically synthesized
taaaaataaaagttctaaaa

SEQ ID NO: 547193 - DNA, 20 bp, Artificial Sequence
  chemically synthesized
atgtcacatgcattttatat

SEQ ID NO: 547194 - DNA, 20 bp, Artificial Sequence
  chemically synthesized
cacattgggaggccaaggca

SEQ ID NO: 547195 - DNA, 20 bp, Artificial Sequence
  chemically synthesized
tatcactgacttaaaaccac

SEQ ID NO: 547196 - DNA, 20 bp, Artificial Sequence
  chemically synthesized
accattctaatgatggtaaa

SEQ ID NO: 547197 - DNA, 20 bp, Artificial Sequence
  chemically synthesized
tttattctcatttaccatca

SEQ ID NO: 547198 - DNA, 20 bp, Artificial Sequence
  chemically synthesized
gccaaggcaaaattctgtga

SEQ ID NO: 547199 - DNA, 20 bp, Artificial Sequence
  chemically synthesized
tgatatctgtgtttcttgtc

SEQ ID NO: 547200 - DNA, 20 bp, Artificial Sequence
  chemically synthesized
catgagatattaggtttgat

SEQ ID NO: 547201 - DNA, 20 bp, Artificial Sequence
  chemically synthesized
cacaatgagttcatgagact

SEQ ID NO: 547202 - DNA, 20 bp, Artificial Sequence
  chemically synthesized
agacattaataaattaataa

SEQ ID NO: 547203 - DNA, 20 bp, Artificial Sequence
  chemically synthesized
ataattcttacctagataac

SEQ ID NO: 547204 - DNA, 20 bp, Artificial Sequence
  chemically synthesized
gagattctcagttatctagg

SEQ ID NO: 547205 - DNA, 20 bp, Artificial Sequence
  chemically synthesized
aggttctatgccaaatttgt

SEQ ID NO: 547206 - DNA, 20 bp, Artificial Sequence
  chemically synthesized
atttaaattccccaactgag

SEQ ID NO: 547207 - DNA, 20 bp, Artificial Sequence
  chemically synthesized
caaatcagcccctaggggag

SEQ ID NO: 547208 - DNA, 20 bp, Artificial Sequence
  chemically synthesized
taaaatggtgacaaatcata

SEQ ID NO: 547209 - DNA, 20 bp, Artificial Sequence
  chemically synthesized
tagaagaatgtgaaagatta

SEQ ID NO: 547210 - DNA, 20 bp, Artificial Sequence
  chemically synthesized
tagtgactggttccaactgc

SEQ ID NO: 547211 - DNA, 20 bp, Artificial Sequence
  chemically synthesized
tttttttatggtatctgaac

SEQ ID NO: 547212 - DNA, 20 bp, Artificial Sequence
  chemically synthesized
aatatatttaagaaaatatt

SEQ ID NO: 547213 - DNA, 20 bp, Artificial Sequence
  chemically synthesized
tctgcagttgaaaatatatt

SEQ ID NO: 547214 - DNA, 20 bp, Artificial Sequence
  chemically synthesized
ctctatatacggtatttcaa

SEQ ID NO: 547215 - DNA, 20 bp, Artificial Sequence
  chemically synthesized
cattatagagtaccttgttt

SEQ ID NO: 547216 - DNA, 20 bp, Artificial Sequence
  chemically synthesized
taaattaactctaatcctcc

SEQ ID NO: 547217 - DNA, 20 bp, Artificial Sequence
  chemically synthesized
acattttgataccataatgg

SEQ ID NO: 547218 - DNA, 20 bp, Artificial Sequence
  chemically synthesized
atagaatttgctataaaaga

SEQ ID NO: 547219 - DNA, 20 bp, Artificial Sequence
  chemically synthesized
aaataatcatggaaagatac

SEQ ID NO: 547220 - DNA, 20 bp, Artificial Sequence
  chemically synthesized
gtttttatagccttcttttc

SEQ ID NO: 547221 - DNA, 20 bp, Artificial Sequence
  chemically synthesized
gtgatgcagggattagccaa

SEQ ID NO: 547222 - DNA, 20 bp, Artificial Sequence
  chemically synthesized
agggattagccaagcagaaa

SEQ ID NO: 547223 - DNA, 20 bp, Artificial Sequence
  chemically synthesized
tcccctttattttgacttcc

SEQ ID NO: 547224 - DNA, 20 bp, Artificial Sequence
  chemically synthesized
aggaaggacactaggactcg

SEQ ID NO: 547225 - DNA, 20 bp, Artificial Sequence
  chemically synthesized
gatgtcttttgaatattagt

SEQ ID NO: 547226 - DNA, 20 bp, Artificial Sequence
  chemically synthesized
aaccaatctgtttgaaactc

SEQ ID NO: 547227 - DNA, 20 bp, Artificial Sequence
  chemically synthesized
gaaacccacgaccaacgcat

SEQ ID NO: 547228 - DNA, 20 bp, Artificial Sequence
  chemically synthesized
tgtagaatgtactgtcttac

SEQ ID NO: 547229 - DNA, 20 bp, Artificial Sequence
  chemically synthesized
acagagaaatcataacggga

SEQ ID NO: 547230 - DNA, 20 bp, Artificial Sequence
  chemically synthesized
tatgttagcatctaaacaca

SEQ ID NO: 547231 - DNA, 20 bp, Artificial Sequence
  chemically synthesized
aaccttgtaggatttcatat

SEQ ID NO: 547232 - DNA, 20 bp, Artificial Sequence
  chemically synthesized
tttaaacataagctttgttg

SEQ ID NO: 547233 - DNA, 20 bp, Artificial Sequence
  chemically synthesized
gattgaagctatatttggtt

SEQ ID NO: 547234 - DNA, 20 bp, Artificial Sequence
  chemically synthesized
gagaataatgaaacatttgg

SEQ ID NO: 547235 - DNA, 20 bp, Artificial Sequence
  chemically synthesized
taaattagttatgcccctta

SEQ ID NO: 547236 - DNA, 20 bp, Artificial Sequence
  chemically synthesized
catgatgttggctactctcc

SEQ ID NO: 547237 - DNA, 20 bp, Artificial Sequence
  chemically synthesized
aagaaaaaaataataactca

SEQ ID NO: 547238 - DNA, 20 bp, Artificial Sequence
  chemically synthesized
gataatctcaatgatgattc

SEQ ID NO: 547239 - DNA, 20 bp, Artificial Sequence
  chemically synthesized
tggtttccctaacacaatgg

SEQ ID NO: 547240 - DNA, 20 bp, Artificial Sequence
  chemically synthesized
ttgcagccataagtaaactt

SEQ ID NO: 547241 - DNA, 20 bp, Artificial Sequence
  chemically synthesized
ctcagcaaactaacatagga

SEQ ID NO: 547242 - DNA, 20 bp, Artificial Sequence
  chemically synthesized
ctgttcctatgttagtttgc

SEQ ID NO: 547243 - DNA, 20 bp, Artificial Sequence
  chemically synthesized
ccatcaatgatagactggat

SEQ ID NO: 547244 - DNA, 20 bp, Artificial Sequence
  chemically synthesized
tgaatagtgctgaaataagc

SEQ ID NO: 547245 - DNA, 20 bp, Artificial Sequence
  chemically synthesized
gattgctcaaggatctagag

SEQ ID NO: 547246 - DNA, 20 bp, Artificial Sequence
  chemically synthesized
acagatgctggagagaatat

SEQ ID NO: 547247 - DNA, 20 bp, Artificial Sequence
  chemically synthesized
caggaaacaacagatgctgg

SEQ ID NO: 547248 - DNA, 20 bp, Artificial Sequence
  chemically synthesized
gagataccatctcatgctag

SEQ ID NO: 547249 - DNA, 20 bp, Artificial Sequence
  chemically synthesized
gttcatcatcactggtcatt

SEQ ID NO: 547250 - DNA, 20 bp, Artificial Sequence
  chemically synthesized
gggctaatatccagaatcta

SEQ ID NO: 547251 - DNA, 20 bp, Artificial Sequence
  chemically synthesized
atctgacaaagggctaatat

SEQ ID NO: 547252 - DNA, 20 bp, Artificial Sequence
  chemically synthesized
aacaggcagcctataggatg

SEQ ID NO: 547253 - DNA, 20 bp, Artificial Sequence
  chemically synthesized
taaatagctcctgcacagca

SEQ ID NO: 547254 - DNA, 20 bp, Artificial Sequence
  chemically synthesized
tgaaacaccaaaagcaatgg

SEQ ID NO: 547255 - DNA, 20 bp, Artificial Sequence
  chemically synthesized
ctaaaaccataaaaacccta

SEQ ID NO: 547256 - DNA, 20 bp, Artificial Sequence
  chemically synthesized
aatggaacagaacagaggcc

SEQ ID NO: 547257 - DNA, 20 bp, Artificial Sequence
  chemically synthesized
tagtttttttctaattctgt

SEQ ID NO: 547258 - DNA, 20 bp, Artificial Sequence
  chemically synthesized
aattcactttcttcacagaa

SEQ ID NO: 547259 - DNA, 20 bp, Artificial Sequence
  chemically synthesized
agctacaattcactttcttc

SEQ ID NO: 547260 - DNA, 20 bp, Artificial Sequence
  chemically synthesized
cattccatgcttatggatag

SEQ ID NO: 547261 - DNA, 20 bp, Artificial Sequence
  chemically synthesized
ttacaattgctacaaggaga

SEQ ID NO: 547262 - DNA, 20 bp, Artificial Sequence
  chemically synthesized
cccatttacaattgctacaa

SEQ ID NO: 547263 - DNA, 20 bp, Artificial Sequence
  chemically synthesized
cagatgacatgattgtatat

SEQ ID NO: 547264 - DNA, 20 bp, Artificial Sequence
  chemically synthesized
caatcatgtcatctgcaaac

SEQ ID NO: 547265 - DNA, 20 bp, Artificial Sequence
  chemically synthesized
ccagcacaatcaggcaggag

SEQ ID NO: 547266 - DNA, 20 bp, Artificial Sequence
  chemically synthesized
ctggccagcacaatcaggca

SEQ ID NO: 547267 - DNA, 20 bp, Artificial Sequence
  chemically synthesized
acatgattatctcaatagat

SEQ ID NO: 547268 - DNA, 20 bp, Artificial Sequence
  chemically synthesized
atgcaagattagtttaacat

SEQ ID NO: 547269 - DNA, 20 bp, Artificial Sequence
  chemically synthesized
ttctgaaactattccaaaca

SEQ ID NO: 547270 - DNA, 20 bp, Artificial Sequence
  chemically synthesized
agctcctctttgtacctctg

SEQ ID NO: 547271 - DNA, 20 bp, Artificial Sequence
  chemically synthesized
caaataaactagaaaatcta

SEQ ID NO: 547272 - DNA, 20 bp, Artificial Sequence
  chemically synthesized
aacatctccacgcaaataaa

SEQ ID NO: 547273 - DNA, 20 bp, Artificial Sequence
  chemically synthesized
cagaaatacaaactaccatc

SEQ ID NO: 547274 - DNA, 20 bp, Artificial Sequence
  chemically synthesized
gggatatcaccactgatccc

SEQ ID NO: 547275 - DNA, 20 bp, Artificial Sequence
  chemically synthesized
ctaaaaaagaagaaaagaga

SEQ ID NO: 547276 - DNA, 20 bp, Artificial Sequence
  chemically synthesized
tggctagccagactaaaaaa

SEQ ID NO: 547277 - DNA, 20 bp, Artificial Sequence
  chemically synthesized
tatagcactaaatgcccaca

SEQ ID NO: 547278 - DNA, 20 bp, Artificial Sequence
  chemically synthesized
gagaacaaacacacaatgta

SEQ ID NO: 547279 - DNA, 20 bp, Artificial Sequence
  chemically synthesized
gggtaaataatgaaattaag

SEQ ID NO: 547280 - DNA, 20 bp, Artificial Sequence
  chemically synthesized
atctaattagaatgcgggat

SEQ ID NO: 547281 - DNA, 20 bp, Artificial Sequence
  chemically synthesized
cagatcacagtgcaatctaa

SEQ ID NO: 547282 - DNA, 20 bp, Artificial Sequence
  chemically synthesized
aatactcctcagcaaatgca

SEQ ID NO: 547283 - DNA, 20 bp, Artificial Sequence
  chemically synthesized
ttccaattatgtcgtcaatt

SEQ ID NO: 547284 - DNA, 20 bp, Artificial Sequence
  chemically synthesized
taagtgcaatgtggtgctga

SEQ ID NO: 547285 - DNA, 20 bp, Artificial Sequence
  chemically synthesized
gaactctccaccccaaatca

SEQ ID NO: 547286 - DNA, 20 bp, Artificial Sequence
  chemically synthesized
atattagacagatcaacgag

SEQ ID NO: 547287 - DNA, 20 bp, Artificial Sequence
  chemically synthesized
tcagactgctgtgctggcag

SEQ ID NO: 547288 - DNA, 20 bp, Artificial Sequence
  chemically synthesized
gagatgccctgcccagagag

SEQ ID NO: 547289 - DNA, 20 bp, Artificial Sequence
  chemically synthesized
ctctgggcagggcatctctg

SEQ ID NO: 547290 - DNA, 20 bp, Artificial Sequence
  chemically synthesized
ctgtttgaaggaaaactaaa

SEQ ID NO: 547291 - DNA, 20 bp, Artificial Sequence
  chemically synthesized
tcaacaaaaaggacatccac

SEQ ID NO: 547292 - DNA, 20 bp, Artificial Sequence
  chemically synthesized
acaagagaacaaaactggat

SEQ ID NO: 547293 - DNA, 20 bp, Artificial Sequence
  chemically synthesized
atagctcaatcgatccagca

SEQ ID NO: 547294 - DNA, 20 bp, Artificial Sequence
  chemically synthesized
taaagtgtgaagacaagatt

SEQ ID NO: 547295 - DNA, 20 bp, Artificial Sequence
  chemically synthesized
tgaagacaagattagagaaa

SEQ ID NO: 547296 - DNA, 20 bp, Artificial Sequence
  chemically synthesized
gttcgccgggataatatcct

SEQ ID NO: 547297 - DNA, 20 bp, Artificial Sequence
  chemically synthesized
aaaatgttcaggacagtcaa

SEQ ID NO: 547298 - DNA, 20 bp, Artificial Sequence
  chemically synthesized
gactaacagcagatctttct

SEQ ID NO: 547299 - DNA, 20 bp, Artificial Sequence
  chemically synthesized
ttctggcttgtagggtttct

SEQ ID NO: 547300 - DNA, 20 bp, Artificial Sequence
  chemically synthesized
ttctgagttaaaaattattt

SEQ ID NO: 547301 - DNA, 20 bp, Artificial Sequence
  chemically synthesized
ttcttaaaataatttttaac

SEQ ID NO: 547302 - DNA, 20 bp, Artificial Sequence
  chemically synthesized
aactaagcttcataagcgaa

SEQ ID NO: 547303 - DNA, 20 bp, Artificial Sequence
  chemically synthesized
gcttcataagcgaaggagaa

SEQ ID NO: 547304 - DNA, 20 bp, Artificial Sequence
  chemically synthesized
gtaaacaccatcgacaccat

SEQ ID NO: 547305 - DNA, 20 bp, Artificial Sequence
  chemically synthesized
aaagtctattttatcagaga

SEQ ID NO: 547306 - DNA, 20 bp, Artificial Sequence
  chemically synthesized
agtttaaagtctattttatc

SEQ ID NO: 547307 - DNA, 20 bp, Artificial Sequence
  chemically synthesized
gccaacattagatcaacgag

SEQ ID NO: 547308 - DNA, 20 bp, Artificial Sequence
  chemically synthesized
gaactctccaccccaaatca

SEQ ID NO: 547309 - DNA, 20 bp, Artificial Sequence
  chemically synthesized
taagtatgatgtggtgctga

SEQ ID NO: 547310 - DNA, 20 bp, Artificial Sequence
  chemically synthesized
ttctaattatgtgatcaatt

SEQ ID NO: 547311 - DNA, 20 bp, Artificial Sequence
  chemically synthesized
aacactcctcagcaaatgca

SEQ ID NO: 547312 - DNA, 20 bp, Artificial Sequence
  chemically synthesized
aacaaattagaactcaggat

SEQ ID NO: 547313 - DNA, 20 bp, Artificial Sequence
  chemically synthesized
gaataactactgggtaaata

SEQ ID NO: 547314 - DNA, 20 bp, Artificial Sequence
  chemically synthesized
gggtaaataacagaattctg

SEQ ID NO: 547315 - DNA, 20 bp, Artificial Sequence
  chemically synthesized
aaagaacttctttatttctg

SEQ ID NO: 547316 - DNA, 20 bp, Artificial Sequence
  chemically synthesized
gagaacaaagatacaatgtg

SEQ ID NO: 547317 - DNA, 20 bp, Artificial Sequence
  chemically synthesized
tacagcactaaatgcccaca

SEQ ID NO: 547318 - DNA, 20 bp, Artificial Sequence
  chemically synthesized
aatcaaaagctagcagaaga

SEQ ID NO: 547319 - DNA, 20 bp, Artificial Sequence
  chemically synthesized
agactgctagatagactaat

SEQ ID NO: 547320 - DNA, 20 bp, Artificial Sequence
  chemically synthesized
gactaataaagaaaaataga

SEQ ID NO: 547321 - DNA, 20 bp, Artificial Sequence
  chemically synthesized
gggatatcaccactgatccc

SEQ ID NO: 547322 - DNA, 20 bp, Artificial Sequence
  chemically synthesized
cagaaatacaaactaccatc

SEQ ID NO: 547323 - DNA, 20 bp, Artificial Sequence
  chemically synthesized
tcaattggaagagtctatat

SEQ ID NO: 547324 - DNA, 20 bp, Artificial Sequence
  chemically synthesized
ctcctaagtgggaagtatat

SEQ ID NO: 547325 - DNA, 20 bp, Artificial Sequence
  chemically synthesized
gtaggttgacgagcctgtaa

SEQ ID NO: 547326 - DNA, 20 bp, Artificial Sequence
  chemically synthesized
aatgggcatccacatcataa

SEQ ID NO: 547327 - DNA, 20 bp, Artificial Sequence
  chemically synthesized
tctagtgctcctttgaactt

SEQ ID NO: 547328 - DNA, 20 bp, Artificial Sequence
  chemically synthesized
aaagccattttgtcacttaa

SEQ ID NO: 547329 - DNA, 20 bp, Artificial Sequence
  chemically synthesized
atgaaaggataggacacaca

SEQ ID NO: 547330 - DNA, 20 bp, Artificial Sequence
  chemically synthesized
ttttctcttagttcagtgag

SEQ ID NO: 547331 - DNA, 20 bp, Artificial Sequence
  chemically synthesized
ctttctacctcactgaacta

SEQ ID NO: 547332 - DNA, 20 bp, Artificial Sequence
  chemically synthesized
cccctgtttttagctctaag

SEQ ID NO: 547333 - DNA, 20 bp, Artificial Sequence
  chemically synthesized
gccatgcattatccaaagga

SEQ ID NO: 547334 - DNA, 20 bp, Artificial Sequence
  chemically synthesized
taaatgagatataacaagca

SEQ ID NO: 547335 - DNA, 20 bp, Artificial Sequence
  chemically synthesized
gccagtgaatttattatcaa

SEQ ID NO: 547336 - DNA, 20 bp, Artificial Sequence
  chemically synthesized
atatggatggtaggtcccat

SEQ ID NO: 547337 - DNA, 20 bp, Artificial Sequence
  chemically synthesized
tttagagtgtagtaaagcct

SEQ ID NO: 547338 - DNA, 20 bp, Artificial Sequence
  chemically synthesized
tctgcctatcaactaaagaa

SEQ ID NO: 547339 - DNA, 20 bp, Artificial Sequence
  chemically synthesized
agatactggtattttgagaa

SEQ ID NO: 547340 - DNA, 20 bp, Artificial Sequence
  chemically synthesized
tatgtagttttgtattttgt

SEQ ID NO: 547341 - DNA, 20 bp, Artificial Sequence
  chemically synthesized
atactaaaagcagtggtagt

SEQ ID NO: 547342 - DNA, 20 bp, Artificial Sequence
  chemically synthesized
gccagatatcaattaggcat

SEQ ID NO: 547343 - DNA, 20 bp, Artificial Sequence
  chemically synthesized
aaagacaaatataaatcaat

SEQ ID NO: 547344 - DNA, 20 bp, Artificial Sequence
  chemically synthesized
taaaattattacttgtttaa

SEQ ID NO: 547345 - DNA, 20 bp, Artificial Sequence
  chemically synthesized
tttttttttttttttttttg

SEQ ID NO: 547346 - DNA, 20 bp, Artificial Sequence
  chemically synthesized
aaaaaaaaaaaaaaaaaaaa

SEQ ID NO: 547347 - DNA, 20 bp, Artificial Sequence
  chemically synthesized
aaaaaaaaaaaaaaaaaaag

SEQ ID NO: 547348 - DNA, 20 bp, Artificial Sequence
  chemically synthesized
aaaaaaaaaaaaaaagaaag

SEQ ID NO: 547349 - DNA, 20 bp, Artificial Sequence
  chemically synthesized
aaaaaaaaaaagaaagaaag

SEQ ID NO: 547350 - DNA, 20 bp, Artificial Sequence
  chemically synthesized
aaaaaaagaaagaaagaaag

SEQ ID NO: 547351 - DNA, 20 bp, Artificial Sequence
  chemically synthesized
aaagaaagaaagaaagaaag

SEQ ID NO: 547352 - DNA, 20 bp, Artificial Sequence
  chemically synthesized
gagtgagaccctgtatcaaa

SEQ ID NO: 547353 - DNA, 20 bp, Artificial Sequence
  chemically synthesized
gcaataaagatgtggggaaa

SEQ ID NO: 547354 - DNA, 20 bp, Artificial Sequence
  chemically synthesized
atggagataatgagtgttta

SEQ ID NO: 547355 - DNA, 20 bp, Artificial Sequence
  chemically synthesized
tattgaggaagggagaacag

SEQ ID NO: 547356 - DNA, 20 bp, Artificial Sequence
  chemically synthesized
acatttaattcaaaatgtat

SEQ ID NO: 547357 - DNA, 20 bp, Artificial Sequence
  chemically synthesized
atggaatatgaggaaagaga

SEQ ID NO: 547358 - DNA, 20 bp, Artificial Sequence
  chemically synthesized
ctactcaggaggctgaggtt

SEQ ID NO: 547359 - DNA, 20 bp, Artificial Sequence
  chemically synthesized
gtctcctaaatagataaatg

SEQ ID NO: 547360 - DNA, 20 bp, Artificial Sequence
  chemically synthesized
agtataaagcagataaggag

SEQ ID NO: 547361 - DNA, 20 bp, Artificial Sequence
  chemically synthesized
gaatagtataaagcagataa

SEQ ID NO: 547362 - DNA, 20 bp, Artificial Sequence
  chemically synthesized
cgttaaatagtaagtgttaa

SEQ ID NO: 547363 - DNA, 20 bp, Artificial Sequence
  chemically synthesized
agtggaagagaaagatacac

SEQ ID NO: 547364 - DNA, 20 bp, Artificial Sequence
  chemically synthesized
ctgtgtatctttctcttcca

SEQ ID NO: 547365 - DNA, 20 bp, Artificial Sequence
  chemically synthesized
agattgtacattctagtgga

SEQ ID NO: 547366 - DNA, 20 bp, Artificial Sequence
  chemically synthesized
aaatatttatcaactacacg

SEQ ID NO: 547367 - DNA, 20 bp, Artificial Sequence
  chemically synthesized
ataccatgttacttgataat

SEQ ID NO: 547368 - DNA, 20 bp, Artificial Sequence
  chemically synthesized
aggattttaaatttaatgag

SEQ ID NO: 547369 - DNA, 20 bp, Artificial Sequence
  chemically synthesized
atgtgaaaaaacacagacaa

SEQ ID NO: 547370 - DNA, 20 bp, Artificial Sequence
  chemically synthesized
tttgtaaaatctgaagcggt

SEQ ID NO: 547371 - DNA, 20 bp, Artificial Sequence
  chemically synthesized
atttaatctgtctttcagcc

SEQ ID NO: 547372 - DNA, 20 bp, Artificial Sequence
  chemically synthesized
ttaaaaaaaatgtattgata

SEQ ID NO: 547373 - DNA, 20 bp, Artificial Sequence
  chemically synthesized
ttctctaacgctcacacaac

SEQ ID NO: 547374 - DNA, 20 bp, Artificial Sequence
  chemically synthesized
ttctaagttgtgtgagcgtt

SEQ ID NO: 547375 - DNA, 20 bp, Artificial Sequence
  chemically synthesized
tatctcccaccacttgatac

SEQ ID NO: 547376 - DNA, 20 bp, Artificial Sequence
  chemically synthesized
agtggtgggagataggttta

SEQ ID NO: 547377 - DNA, 20 bp, Artificial Sequence
  chemically synthesized
gtgggagataggtttaaaag

SEQ ID NO: 547378 - DNA, 20 bp, Artificial Sequence
  chemically synthesized
ttctcaaaggtgtctgtgat

SEQ ID NO: 547379 - DNA, 20 bp, Artificial Sequence
  chemically synthesized
ttctgaatcacagacacctt

SEQ ID NO: 547380 - DNA, 20 bp, Artificial Sequence
  chemically synthesized
aacagagtctacatacagtt

SEQ ID NO: 547381 - DNA, 20 bp, Artificial Sequence
  chemically synthesized
gccaattttgaattacagtt

SEQ ID NO: 547382 - DNA, 20 bp, Artificial Sequence
  chemically synthesized
ctactcaggaggctgaggca

SEQ ID NO: 547383 - DNA, 20 bp, Artificial Sequence
  chemically synthesized
actagagtagaagcaattaa

SEQ ID NO: 547384 - DNA, 20 bp, Artificial Sequence
  chemically synthesized
cttctactctagttaataca

SEQ ID NO: 547385 - DNA, 20 bp, Artificial Sequence
  chemically synthesized
tataaaaaaatttaaaaatt

SEQ ID NO: 547386 - DNA, 20 bp, Artificial Sequence
  chemically synthesized
tttttttactcccattgcct

SEQ ID NO: 547387 - DNA, 20 bp, Artificial Sequence
  chemically synthesized
aggacataggtgggaacata

SEQ ID NO: 547388 - DNA, 20 bp, Artificial Sequence
  chemically synthesized
cttgtatactatgccataga

SEQ ID NO: 547389 - DNA, 20 bp, Artificial Sequence
  chemically synthesized
caaggttaaattgagtatga

SEQ ID NO: 547390 - DNA, 20 bp, Artificial Sequence
  chemically synthesized
ttggttcaatgctttttgaa

SEQ ID NO: 547391 - DNA, 20 bp, Artificial Sequence
  chemically synthesized
taattaattttaatagtata

SEQ ID NO: 547392 - DNA, 20 bp, Artificial Sequence
  chemically synthesized
attaacattacagcaaaata

SEQ ID NO: 547393 - DNA, 20 bp, Artificial Sequence
  chemically synthesized
tacaaatactactgatgcaa

SEQ ID NO: 547394 - DNA, 20 bp, Artificial Sequence
  chemically synthesized
aggtggagaagaggcgagag

SEQ ID NO: 547395 - DNA, 20 bp, Artificial Sequence
  chemically synthesized
cttttgaccaatatgaaaaa

SEQ ID NO: 547396 - DNA, 20 bp, Artificial Sequence
  chemically synthesized
attttaaatttttaccaagt

SEQ ID NO: 547397 - DNA, 20 bp, Artificial Sequence
  chemically synthesized
tggagtaaatacctatactg

SEQ ID NO: 547398 - DNA, 20 bp, Artificial Sequence
  chemically synthesized
agaaattagtttgtcaacaa

SEQ ID NO: 547399 - DNA, 20 bp, Artificial Sequence
  chemically synthesized
tagctgacagtgactgcatc

SEQ ID NO: 547400 - DNA, 20 bp, Artificial Sequence
  chemically synthesized
gaatcaggagcaaagggaaa

SEQ ID NO: 547401 - DNA, 20 bp, Artificial Sequence
  chemically synthesized
aaattagaagcaaatgaaca

SEQ ID NO: 547402 - DNA, 20 bp, Artificial Sequence
  chemically synthesized
taaaacccaatgataattgc

SEQ ID NO: 547403 - DNA, 20 bp, Artificial Sequence
  chemically synthesized
attgggttttaacacaaaaa

SEQ ID NO: 547404 - DNA, 20 bp, Artificial Sequence
  chemically synthesized
aaccatttttttctttagat

SEQ ID NO: 547405 - DNA, 20 bp, Artificial Sequence
  chemically synthesized
gatgttcatattctttatct

SEQ ID NO: 547406 - DNA, 20 bp, Artificial Sequence
  chemically synthesized
ataaatgaggatattttgac

SEQ ID NO: 547407 - DNA, 20 bp, Artificial Sequence
  chemically synthesized
tgtattacctacaaatgtat

SEQ ID NO: 547408 - DNA, 20 bp, Artificial Sequence
  chemically synthesized
atgtattcagaaatcattaa

SEQ ID NO: 547409 - DNA, 20 bp, Artificial Sequence
  chemically synthesized
agcattgacttaaaacacag

SEQ ID NO: 547410 - DNA, 20 bp, Artificial Sequence
  chemically synthesized
aaacattttcttctgtcata

SEQ ID NO: 547411 - DNA, 20 bp, Artificial Sequence
  chemically synthesized
acattgtttctcgtatgaca

SEQ ID NO: 547412 - DNA, 20 bp, Artificial Sequence
  chemically synthesized
cttggactgagctttacctt

SEQ ID NO: 547413 - DNA, 20 bp, Artificial Sequence
  chemically synthesized
aatcctgcttctagaaaagc

SEQ ID NO: 547414 - DNA, 20 bp, Artificial Sequence
  chemically synthesized
ttcctatgccaatcctgctt

SEQ ID NO: 547415 - DNA, 20 bp, Artificial Sequence
  chemically synthesized
aaaaaaaaaaaaaatcaaag

SEQ ID NO: 547416 - DNA, 20 bp, Artificial Sequence
  chemically synthesized
taaatgaattaataacagtt

SEQ ID NO: 547417 - DNA, 20 bp, Artificial Sequence
  chemically synthesized
ttcatttactgaactttaca

SEQ ID NO: 547418 - DNA, 20 bp, Artificial Sequence
  chemically synthesized
aaaaaaaatctttttcatct

SEQ ID NO: 547419 - DNA, 20 bp, Artificial Sequence
  chemically synthesized
tcttttgtggattttaataa

SEQ ID NO: 547420 - DNA, 20 bp, Artificial Sequence
  chemically synthesized
acacaatgttttgaatacca

SEQ ID NO: 547421 - DNA, 20 bp, Artificial Sequence
  chemically synthesized
atcagatacgtagtgtggag

SEQ ID NO: 547422 - DNA, 20 bp, Artificial Sequence
  chemically synthesized
catcatcagatacgtagtgt

SEQ ID NO: 547423 - DNA, 20 bp, Artificial Sequence
  chemically synthesized
caacaccattctcggcaaag

SEQ ID NO: 547424 - DNA, 20 bp, Artificial Sequence
  chemically synthesized
aggttgtattctaactttgc

SEQ ID NO: 547425 - DNA, 20 bp, Artificial Sequence
  chemically synthesized
ttccattggaatgaactaat

SEQ ID NO: 547426 - DNA, 20 bp, Artificial Sequence
  chemically synthesized
tgattgtcggacccagctca

SEQ ID NO: 547427 - DNA, 20 bp, Artificial Sequence
  chemically synthesized
catgtggaaataaattttca

SEQ ID NO: 547428 - DNA, 20 bp, Artificial Sequence
  chemically synthesized
tccttgatcttcagtgataa

SEQ ID NO: 547429 - DNA, 20 bp, Artificial Sequence
  chemically synthesized
gagaatagacttaacttctg

SEQ ID NO: 547430 - DNA, 20 bp, Artificial Sequence
  chemically synthesized
cagaatagactcctagcctt

SEQ ID NO: 547431 - DNA, 20 bp, Artificial Sequence
  chemically synthesized
atggcatagataccaatgaa

SEQ ID NO: 547432 - DNA, 20 bp, Artificial Sequence
  chemically synthesized
taaatgttgggtctaatatg

SEQ ID NO: 547433 - DNA, 20 bp, Artificial Sequence
  chemically synthesized
agacccaacatttactgttt

SEQ ID NO: 547434 - DNA, 20 bp, Artificial Sequence
  chemically synthesized
taaccttgcatgtaagatac

SEQ ID NO: 547435 - DNA, 20 bp, Artificial Sequence
  chemically synthesized
ttggctgaactgaaaagaag

SEQ ID NO: 547436 - DNA, 20 bp, Artificial Sequence
  chemically synthesized
aatgtttgcctacctaaaat

SEQ ID NO: 547437 - DNA, 20 bp, Artificial Sequence
  chemically synthesized
tttctgcatcagatgactca

SEQ ID NO: 547438 - DNA, 20 bp, Artificial Sequence
  chemically synthesized
attcttctgagtcatctgat

SEQ ID NO: 547439 - DNA, 20 bp, Artificial Sequence
  chemically synthesized
atgaaacttagaaaaaatgc

SEQ ID NO: 547440 - DNA, 20 bp, Artificial Sequence
  chemically synthesized
cgtcactgcattcatgaaac

SEQ ID NO: 547441 - DNA, 20 bp, Artificial Sequence
  chemically synthesized
catgaatgcagtgacgcttc

SEQ ID NO: 547442 - DNA, 20 bp, Artificial Sequence
  chemically synthesized
aactgtctacatcttttatt

SEQ ID NO: 547443 - DNA, 20 bp, Artificial Sequence
  chemically synthesized
aaaaaataaaattgtcatat

SEQ ID NO: 547444 - DNA, 20 bp, Artificial Sequence
  chemically synthesized
aggttgagcaatttataatt

SEQ ID NO: 547445 - DNA, 20 bp, Artificial Sequence
  chemically synthesized
ccccaaaggtgagcctgtaa

SEQ ID NO: 547446 - DNA, 20 bp, Artificial Sequence
  chemically synthesized
aaagaagttgcagcagagga

SEQ ID NO: 547447 - DNA, 20 bp, Artificial Sequence
  chemically synthesized
ctgctcttctgcagagcttc

SEQ ID NO: 547448 - DNA, 20 bp, Artificial Sequence
  chemically synthesized
tgatacaatttgcaattaca

SEQ ID NO: 547449 - DNA, 20 bp, Artificial Sequence
  chemically synthesized
aatggcaacgctaattcact

SEQ ID NO: 547450 - DNA, 20 bp, Artificial Sequence
  chemically synthesized
agtttagcactccgaaaaaa

SEQ ID NO: 547451 - DNA, 20 bp, Artificial Sequence
  chemically synthesized
aaagaattgcacttaagaag

SEQ ID NO: 547452 - DNA, 20 bp, Artificial Sequence
  chemically synthesized
aattttatttgagatggaca

SEQ ID NO: 547453 - DNA, 20 bp, Artificial Sequence
  chemically synthesized
taataacatagtatgttgca

SEQ ID NO: 547454 - DNA, 20 bp, Artificial Sequence
  chemically synthesized
ccgctcgttatctgatagat

SEQ ID NO: 547455 - DNA, 20 bp, Artificial Sequence
  chemically synthesized
gggcttctaccatttaatag

SEQ ID NO: 547456 - DNA, 20 bp, Artificial Sequence
  chemically synthesized
ggtgtaaaaaaaaaaaaaaa

SEQ ID NO: 547457 - DNA, 20 bp, Artificial Sequence
  chemically synthesized
ctataagagaggtctcagac

SEQ ID NO: 547458 - DNA, 20 bp, Artificial Sequence
  chemically synthesized
ctacttgggaggctgaggca

SEQ ID NO: 547459 - DNA, 20 bp, Artificial Sequence
  chemically synthesized
tgaacaacttgcaagcaagt

SEQ ID NO: 547460 - DNA, 20 bp, Artificial Sequence
  chemically synthesized
gtcaacaattcagagtgcat

SEQ ID NO: 547461 - DNA, 20 bp, Artificial Sequence
  chemically synthesized
cctaatccattgtatgtaag

SEQ ID NO: 547462 - DNA, 20 bp, Artificial Sequence
  chemically synthesized
aattaatatgtgctggcaac

SEQ ID NO: 547463 - DNA, 20 bp, Artificial Sequence
  chemically synthesized
cagtaagcggggagagggga

SEQ ID NO: 547464 - DNA, 20 bp, Artificial Sequence
  chemically synthesized
aagtagcattaagcctgttc

SEQ ID NO: 547465 - DNA, 20 bp, Artificial Sequence
  chemically synthesized
ctactcgggaggctgaggca

SEQ ID NO: 547466 - DNA, 20 bp, Artificial Sequence
  chemically synthesized
aaaaaggcaaatacatatgg

SEQ ID NO: 547467 - DNA, 20 bp, Artificial Sequence
  chemically synthesized
gaaaaatgactgtaaatgga

SEQ ID NO: 547468 - DNA, 20 bp, Artificial Sequence
  chemically synthesized
atgcaaattgaattttacac

SEQ ID NO: 547469 - DNA, 20 bp, Artificial Sequence
  chemically synthesized
catttaaaaaatttggaggc

SEQ ID NO: 547470 - DNA, 20 bp, Artificial Sequence
  chemically synthesized
tttcttatcacgattaagtg

SEQ ID NO: 547471 - DNA, 20 bp, Artificial Sequence
  chemically synthesized
attctcccacttaatcgtga

SEQ ID NO: 547472 - DNA, 20 bp, Artificial Sequence
  chemically synthesized
ttattgccaataaaagatta

SEQ ID NO: 547473 - DNA, 20 bp, Artificial Sequence
  chemically synthesized
ttattggcaataatttatgt

SEQ ID NO: 547474 - DNA, 20 bp, Artificial Sequence
  chemically synthesized
atgttaagaatacccaagac

SEQ ID NO: 547475 - DNA, 20 bp, Artificial Sequence
  chemically synthesized
tggagcagggtttgttattg

SEQ ID NO: 547476 - DNA, 20 bp, Artificial Sequence
  chemically synthesized
tataatcctccactggcagg

SEQ ID NO: 547477 - DNA, 20 bp, Artificial Sequence
  chemically synthesized
attcactaaatcaacctgtt

SEQ ID NO: 547478 - DNA, 20 bp, Artificial Sequence
  chemically synthesized
ttctgagttgtaattccata

SEQ ID NO: 547479 - DNA, 20 bp, Artificial Sequence
  chemically synthesized
ttctagtatggaattacaac

SEQ ID NO: 547480 - DNA, 20 bp, Artificial Sequence
  chemically synthesized
tttagtaaaacgcctctgtt

SEQ ID NO: 547481 - DNA, 20 bp, Artificial Sequence
  chemically synthesized
taaaatgctggtgagggtgt

SEQ ID NO: 547482 - DNA, 20 bp, Artificial Sequence
  chemically synthesized
taagtacatgttcagttttg

SEQ ID NO: 547483 - DNA, 20 bp, Artificial Sequence
  chemically synthesized
tcatacagtatgctaccctt

SEQ ID NO: 547484 - DNA, 20 bp, Artificial Sequence
  chemically synthesized
agtcttgaaaagacaaagtt

SEQ ID NO: 547485 - DNA, 20 bp, Artificial Sequence
  chemically synthesized
caaagttacagaaatagaga

SEQ ID NO: 547486 - DNA, 20 bp, Artificial Sequence
  chemically synthesized
cgaaggggagattgatcatt

SEQ ID NO: 547487 - DNA, 20 bp, Artificial Sequence
  chemically synthesized
ggagattgatcattcaagaa

SEQ ID NO: 547488 - DNA, 20 bp, Artificial Sequence
  chemically synthesized
tcctcatatggcagtagagg

SEQ ID NO: 547489 - DNA, 20 bp, Artificial Sequence
  chemically synthesized
tcatctgattgtcactatca

SEQ ID NO: 547490 - DNA, 20 bp, Artificial Sequence
  chemically synthesized
aaagactcaagcagttaagc

SEQ ID NO: 547491 - DNA, 20 bp, Artificial Sequence
  chemically synthesized
ttttggttataaacatagag

SEQ ID NO: 547492 - DNA, 20 bp, Artificial Sequence
  chemically synthesized
catttatgttgtagtttgta

SEQ ID NO: 547493 - DNA, 20 bp, Artificial Sequence
  chemically synthesized
attttaggtacctcatataa

SEQ ID NO: 547494 - DNA, 20 bp, Artificial Sequence
  chemically synthesized
cctaaaatagccaaattcat

SEQ ID NO: 547495 - DNA, 20 bp, Artificial Sequence
  chemically synthesized
gtcatcaccgctatccatct

SEQ ID NO: 547496 - DNA, 20 bp, Artificial Sequence
  chemically synthesized
gcggtgatgactacccaaca

SEQ ID NO: 547497 - DNA, 20 bp, Artificial Sequence
  chemically synthesized
ctgaattatacactaaaaaa

SEQ ID NO: 547498 - DNA, 20 bp, Artificial Sequence
  chemically synthesized
gccgttggtttgtcttcttt

SEQ ID NO: 547499 - DNA, 20 bp, Artificial Sequence
  chemically synthesized
gttgaacatcactaatcatc

SEQ ID NO: 547500 - DNA, 20 bp, Artificial Sequence
  chemically synthesized
acaatgaaatattacatcac

SEQ ID NO: 547501 - DNA, 20 bp, Artificial Sequence
  chemically synthesized
gtaagttgtggcaaagatgt

SEQ ID NO: 547502 - DNA, 20 bp, Artificial Sequence
  chemically synthesized
tagttttatttgtaattttt

SEQ ID NO: 547503 - DNA, 20 bp, Artificial Sequence
  chemically synthesized
tttggaatatatacccagca

SEQ ID NO: 547504 - DNA, 20 bp, Artificial Sequence
  chemically synthesized
aggaaacaaatcaatatgtc

SEQ ID NO: 547505 - DNA, 20 bp, Artificial Sequence
  chemically synthesized
taagtgtccatcagtagatg

SEQ ID NO: 547506 - DNA, 20 bp, Artificial Sequence
  chemically synthesized
ccatcagtagatgaaagaat

SEQ ID NO: 547507 - DNA, 20 bp, Artificial Sequence
  chemically synthesized
actactcggacttaaaaagc

SEQ ID NO: 547508 - DNA, 20 bp, Artificial Sequence
  chemically synthesized
tcaaatgacataagccaggc

SEQ ID NO: 547509 - DNA, 20 bp, Artificial Sequence
  chemically synthesized
aattttaaaatgttgagctc

SEQ ID NO: 547510 - DNA, 20 bp, Artificial Sequence
  chemically synthesized
ttgtattttgaaaattgcta

SEQ ID NO: 547511 - DNA, 20 bp, Artificial Sequence
  chemically synthesized
tctcacggaagcccaagggg

SEQ ID NO: 547512 - DNA, 20 bp, Artificial Sequence
  chemically synthesized
tcagtattgattaaatctgt

SEQ ID NO: 547513 - DNA, 20 bp, Artificial Sequence
  chemically synthesized
aagaaaaaatagattggaat

SEQ ID NO: 547514 - DNA, 20 bp, Artificial Sequence
  chemically synthesized
aatgaagaaaagtatcaggt

SEQ ID NO: 547515 - DNA, 20 bp, Artificial Sequence
  chemically synthesized
tatcaggtggagaaagcatg

SEQ ID NO: 547516 - DNA, 20 bp, Artificial Sequence
  chemically synthesized
tggagatattatattcaggg

SEQ ID NO: 547517 - DNA, 20 bp, Artificial Sequence
  chemically synthesized
aggtgggaggagggagagga

SEQ ID NO: 547518 - DNA, 20 bp, Artificial Sequence
  chemically synthesized
ctacttgggaggctgaggca

SEQ ID NO: 547519 - DNA, 20 bp, Artificial Sequence
  chemically synthesized
gagaccagcctgaccaacat

SEQ ID NO: 547520 - DNA, 20 bp, Artificial Sequence
  chemically synthesized
cttagcaaactagtgcatga

SEQ ID NO: 547521 - DNA, 20 bp, Artificial Sequence
  chemically synthesized
tccatcaacagtagactgat

SEQ ID NO: 547522 - DNA, 20 bp, Artificial Sequence
  chemically synthesized
gattcctcaaagaagttaaa

SEQ ID NO: 547523 - DNA, 20 bp, Artificial Sequence
  chemically synthesized
ccacactgctttccacaatg

SEQ ID NO: 547524 - DNA, 20 bp, Artificial Sequence
  chemically synthesized
aggtgtttccacctgccttc

SEQ ID NO: 547525 - DNA, 20 bp, Artificial Sequence
  chemically synthesized
cctgccttcctagaaacaat

SEQ ID NO: 547526 - DNA, 20 bp, Artificial Sequence
  chemically synthesized
tttagaattacatattttaa

SEQ ID NO: 547527 - DNA, 20 bp, Artificial Sequence
  chemically synthesized
catattttaaccagaatgta

SEQ ID NO: 547528 - DNA, 20 bp, Artificial Sequence
  chemically synthesized
tgatcatacaaacaaaacta

SEQ ID NO: 547529 - DNA, 20 bp, Artificial Sequence
  chemically synthesized
aaggaaaagaaaactaccat

SEQ ID NO: 547530 - DNA, 20 bp, Artificial Sequence
  chemically synthesized
ctcttaaaattcaagaagga

SEQ ID NO: 547531 - DNA, 20 bp, Artificial Sequence
  chemically synthesized
gtaaataagagataacattt

SEQ ID NO: 547532 - DNA, 20 bp, Artificial Sequence
  chemically synthesized
tacaaaattttgttgaatta

SEQ ID NO: 547533 - DNA, 20 bp, Artificial Sequence
  chemically synthesized
agctattccaaagcatatga

SEQ ID NO: 547534 - DNA, 20 bp, Artificial Sequence
  chemically synthesized
atgaatttaacgtaaccctt

SEQ ID NO: 547535 - DNA, 20 bp, Artificial Sequence
  chemically synthesized
gttacgttaaattcatttgt

SEQ ID NO: 547536 - DNA, 20 bp, Artificial Sequence
  chemically synthesized
ggaaaattagactgattact

SEQ ID NO: 547537 - DNA, 20 bp, Artificial Sequence
  chemically synthesized
acaaatcactaaaattgaga

SEQ ID NO: 547538 - DNA, 20 bp, Artificial Sequence
  chemically synthesized
ttttagtgatttgtattgta

SEQ ID NO: 547539 - DNA, 20 bp, Artificial Sequence
  chemically synthesized
gtacgagaaaatcaagtttt

SEQ ID NO: 547540 - DNA, 20 bp, Artificial Sequence
  chemically synthesized
gacgcatgacagcagataca

SEQ ID NO: 547541 - DNA, 20 bp, Artificial Sequence
  chemically synthesized
taaaaactagacgagataaa

SEQ ID NO: 547542 - DNA, 20 bp, Artificial Sequence
  chemically synthesized
ccagtcataacaaagaaaac

SEQ ID NO: 547543 - DNA, 20 bp, Artificial Sequence
  chemically synthesized
aaacctatcccagtcataac

SEQ ID NO: 547544 - DNA, 20 bp, Artificial Sequence
  chemically synthesized
attcaacgtagaaaattgaa

SEQ ID NO: 547545 - DNA, 20 bp, Artificial Sequence
  chemically synthesized
aaataaaaattgtattcaac

SEQ ID NO: 547546 - DNA, 20 bp, Artificial Sequence
  chemically synthesized
catcttaagaaattgtaaaa

SEQ ID NO: 547547 - DNA, 20 bp, Artificial Sequence
  chemically synthesized
aataaaagaagtatgcatct

SEQ ID NO: 547548 - DNA, 20 bp, Artificial Sequence
  chemically synthesized
agcctcttaaagctttttgt

SEQ ID NO: 547549 - DNA, 20 bp, Artificial Sequence
  chemically synthesized
cttcaaactaccaaggagtg

SEQ ID NO: 547550 - DNA, 20 bp, Artificial Sequence
  chemically synthesized
ttataagagcaacaagctta

SEQ ID NO: 547551 - DNA, 20 bp, Artificial Sequence
  chemically synthesized
ttatgacttacagctaatag

SEQ ID NO: 547552 - DNA, 20 bp, Artificial Sequence
  chemically synthesized
aagaggaaatagtactgaat

SEQ ID NO: 547553 - DNA, 20 bp, Artificial Sequence
  chemically synthesized
acataattctggaatgtgta

SEQ ID NO: 547554 - DNA, 20 bp, Artificial Sequence
  chemically synthesized
ttttttttctaatacacatt

SEQ ID NO: 547555 - DNA, 20 bp, Artificial Sequence
  chemically synthesized
cattccagaattatgtcttt

SEQ ID NO: 547556 - DNA, 20 bp, Artificial Sequence
  chemically synthesized
acatctgtctactaagcaaa

SEQ ID NO: 547557 - DNA, 20 bp, Artificial Sequence
  chemically synthesized
gcatgttattacattttcac

SEQ ID NO: 547558 - DNA, 20 bp, Artificial Sequence
  chemically synthesized
ataacatgccttgagttttt

SEQ ID NO: 547559 - DNA, 20 bp, Artificial Sequence
  chemically synthesized
ttcaaatgtaattttggagg

SEQ ID NO: 547560 - DNA, 20 bp, Artificial Sequence
  chemically synthesized
ggaaacttattgtgactcca

SEQ ID NO: 547561 - DNA, 20 bp, Artificial Sequence
  chemically synthesized
aatattaaaatgtgaactct

SEQ ID NO: 547562 - DNA, 20 bp, Artificial Sequence
  chemically synthesized
aagttacaataagcagtctg

SEQ ID NO: 547563 - DNA, 20 bp, Artificial Sequence
  chemically synthesized
gcagtctgtaagaattgcac

SEQ ID NO: 547564 - DNA, 20 bp, Artificial Sequence
  chemically synthesized
gcaggagactactccatact

SEQ ID NO: 547565 - DNA, 20 bp, Artificial Sequence
  chemically synthesized
gaaatgattatatattaatc

SEQ ID NO: 547566 - DNA, 20 bp, Artificial Sequence
  chemically synthesized
tgtctcgaacaagcaaatga

SEQ ID NO: 547567 - DNA, 20 bp, Artificial Sequence
  chemically synthesized
tcctgaaggaaagtgggata

SEQ ID NO: 547568 - DNA, 20 bp, Artificial Sequence
  chemically synthesized
tgaataaaatattgacgatg

SEQ ID NO: 547569 - DNA, 20 bp, Artificial Sequence
  chemically synthesized
atattgatatattcaagatt

SEQ ID NO: 547570 - DNA, 20 bp, Artificial Sequence
  chemically synthesized
attcaagatttaagaatact

SEQ ID NO: 547571 - DNA, 20 bp, Artificial Sequence
  chemically synthesized
ttgttcctgtcaataatctt

SEQ ID NO: 547572 - DNA, 20 bp, Artificial Sequence
  chemically synthesized
tgttatttttgatttgcttt

SEQ ID NO: 547573 - DNA, 20 bp, Artificial Sequence
  chemically synthesized
tttgatttgctttacagaaa

SEQ ID NO: 547574 - DNA, 20 bp, Artificial Sequence
  chemically synthesized
agcagactagggttcatcaa

SEQ ID NO: 547575 - DNA, 20 bp, Artificial Sequence
  chemically synthesized
agaaaatagtaaataagacg

SEQ ID NO: 547576 - DNA, 20 bp, Artificial Sequence
  chemically synthesized
gtgtggtttgtgtatgagag

SEQ ID NO: 547577 - DNA, 20 bp, Artificial Sequence
  chemically synthesized
gcggttttaacttggaagtt

SEQ ID NO: 547578 - DNA, 20 bp, Artificial Sequence
  chemically synthesized
caattcctttgaaacaaatg

SEQ ID NO: 547579 - DNA, 20 bp, Artificial Sequence
  chemically synthesized
aggatatttcagggttcctt

SEQ ID NO: 547580 - DNA, 20 bp, Artificial Sequence
  chemically synthesized
gtttgagttgatttccttaa

SEQ ID NO: 547581 - DNA, 20 bp, Artificial Sequence
  chemically synthesized
atgagaacgaaatgaaatga

SEQ ID NO: 547582 - DNA, 20 bp, Artificial Sequence
  chemically synthesized
ccttccaacattctagataa

SEQ ID NO: 547583 - DNA, 20 bp, Artificial Sequence
  chemically synthesized
aaaaagcaaattctgtttat

SEQ ID NO: 547584 - DNA, 20 bp, Artificial Sequence
  chemically synthesized
taaagacttctccatattca

SEQ ID NO: 547585 - DNA, 20 bp, Artificial Sequence
  chemically synthesized
aatacatgcatctctcaatg

SEQ ID NO: 547586 - DNA, 20 bp, Artificial Sequence
  chemically synthesized
tcgacgtatttatgatttaa

SEQ ID NO: 547587 - DNA, 20 bp, Artificial Sequence
  chemically synthesized
ccttccttatctccgtattt

SEQ ID NO: 547588 - DNA, 20 bp, Artificial Sequence
  chemically synthesized
gaattatttttgattcagat

SEQ ID NO: 547589 - DNA, 20 bp, Artificial Sequence
  chemically synthesized
agtatctttgtagtgagtac

SEQ ID NO: 547590 - DNA, 20 bp, Artificial Sequence
  chemically synthesized
gtgagtggtcaaaaatagtt

SEQ ID NO: 547591 - DNA, 20 bp, Artificial Sequence
  chemically synthesized
ccactcactatatgccacgc

SEQ ID NO: 547592 - DNA, 20 bp, Artificial Sequence
  chemically synthesized
atatgccacgcatagaatgt

SEQ ID NO: 547593 - DNA, 20 bp, Artificial Sequence
  chemically synthesized
gatcactctgatacattgca

SEQ ID NO: 547594 - DNA, 20 bp, Artificial Sequence
  chemically synthesized
tatactgcctctttgacaat

SEQ ID NO: 547595 - DNA, 20 bp, Artificial Sequence
  chemically synthesized
atacaagtgtctcataatcc

SEQ ID NO: 547596 - DNA, 20 bp, Artificial Sequence
  chemically synthesized
aactcaacaaaattccttat

SEQ ID NO: 547597 - DNA, 20 bp, Artificial Sequence
  chemically synthesized
aagatacttgagtgacatta

SEQ ID NO: 547598 - DNA, 20 bp, Artificial Sequence
  chemically synthesized
tcaatttgaagttgaatata

SEQ ID NO: 547599 - DNA, 20 bp, Artificial Sequence
  chemically synthesized
aggtatactaagggggatgg

SEQ ID NO: 547600 - DNA, 20 bp, Artificial Sequence
  chemically synthesized
gggaagaataaacaactcac

SEQ ID NO: 547601 - DNA, 20 bp, Artificial Sequence
  chemically synthesized
atctacctcttctgcaaact

SEQ ID NO: 547602 - DNA, 20 bp, Artificial Sequence
  chemically synthesized
tgtggactgacaattttgtg

SEQ ID NO: 547603 - DNA, 20 bp, Artificial Sequence
  chemically synthesized
aatacatattttggagcatg

SEQ ID NO: 547604 - DNA, 20 bp, Artificial Sequence
  chemically synthesized
tttatgtgtcctttaagtat

SEQ ID NO: 547605 - DNA, 20 bp, Artificial Sequence
  chemically synthesized
tactagttttaaagaacatt

SEQ ID NO: 547606 - DNA, 20 bp, Artificial Sequence
  chemically synthesized
gaagacgaggacacaagctt

SEQ ID NO: 547607 - DNA, 20 bp, Artificial Sequence
  chemically synthesized
tttttgtctggtaaaggaac

SEQ ID NO: 547608 - DNA, 20 bp, Artificial Sequence
  chemically synthesized
taaaagtgcaaatatctaat

SEQ ID NO: 547609 - DNA, 20 bp, Artificial Sequence
  chemically synthesized
ttacccattaaatatctttg

SEQ ID NO: 547610 - DNA, 20 bp, Artificial Sequence
  chemically synthesized
aaacaaaagtgggacagggc

SEQ ID NO: 547611 - DNA, 20 bp, Artificial Sequence
  chemically synthesized
tgggacagggcaaagaaata

SEQ ID NO: 547612 - DNA, 20 bp, Artificial Sequence
  chemically synthesized
acctagagctgatgtagaga

SEQ ID NO: 547613 - DNA, 20 bp, Artificial Sequence
  chemically synthesized
gcgaacaaaatacaaaatcc

SEQ ID NO: 547614 - DNA, 20 bp, Artificial Sequence
  chemically synthesized
tttggaaagccacttattga

SEQ ID NO: 547615 - DNA, 20 bp, Artificial Sequence
  chemically synthesized
catgctaaaacagccaccac

SEQ ID NO: 547616 - DNA, 20 bp, Artificial Sequence
  chemically synthesized
aacgccaggacagggaaagg

SEQ ID NO: 547617 - DNA, 20 bp, Artificial Sequence
  chemically synthesized
tgaggagctagtttagaact

SEQ ID NO: 547618 - DNA, 20 bp, Artificial Sequence
  chemically synthesized
aatgaccttgacttaatgat

SEQ ID NO: 547619 - DNA, 20 bp, Artificial Sequence
  chemically synthesized
ctaattctataaacctatga

SEQ ID NO: 547620 - DNA, 20 bp, Artificial Sequence
  chemically synthesized
gggtttcttttcataggttt

SEQ ID NO: 547621 - DNA, 20 bp, Artificial Sequence
  chemically synthesized
caagaaattgataattgcta

SEQ ID NO: 547622 - DNA, 20 bp, Artificial Sequence
  chemically synthesized
tgataagtttgtccacacac

SEQ ID NO: 547623 - DNA, 20 bp, Artificial Sequence
  chemically synthesized
ctactggggaggctgaggca

SEQ ID NO: 547624 - DNA, 20 bp, Artificial Sequence
  chemically synthesized
aaaccaaaaacgggttttac

SEQ ID NO: 547625 - DNA, 20 bp, Artificial Sequence
  chemically synthesized
ggaaatattaagtatgagat

SEQ ID NO: 547626 - DNA, 20 bp, Artificial Sequence
  chemically synthesized
aatgtgatccagacaaggag

SEQ ID NO: 547627 - DNA, 20 bp, Artificial Sequence
  chemically synthesized
gaactaaagataaagaaata

SEQ ID NO: 547628 - DNA, 20 bp, Artificial Sequence
  chemically synthesized
ggaaagcaggaactaaagat

SEQ ID NO: 547629 - DNA, 20 bp, Artificial Sequence
  chemically synthesized
gcattccatatgaaaaccca

SEQ ID NO: 547630 - DNA, 20 bp, Artificial Sequence
  chemically synthesized
attcatgttatttaataaca

SEQ ID NO: 547631 - DNA, 20 bp, Artificial Sequence
  chemically synthesized
tggagacaaccagagccaga

SEQ ID NO: 547632 - DNA, 20 bp, Artificial Sequence
  chemically synthesized
tcttctggagacaaccagag

SEQ ID NO: 547633 - DNA, 20 bp, Artificial Sequence
  chemically synthesized
tctggctctggttgtctcca

SEQ ID NO: 547634 - DNA, 20 bp, Artificial Sequence
  chemically synthesized
gtccttagtccccaaattag

SEQ ID NO: 547635 - DNA, 20 bp, Artificial Sequence
  chemically synthesized
ttctgtgcgaaatgaggact

SEQ ID NO: 547636 - DNA, 20 bp, Artificial Sequence
  chemically synthesized
ttctcaagtcctcatttcgc

SEQ ID NO: 547637 - DNA, 20 bp, Artificial Sequence
  chemically synthesized
agtgataccttagtctctcc

SEQ ID NO: 547638 - DNA, 20 bp, Artificial Sequence
  chemically synthesized
aactgagcccctaggtatct

SEQ ID NO: 547639 - DNA, 20 bp, Artificial Sequence
  chemically synthesized
ttaaaggaagaaactatggt

SEQ ID NO: 547640 - DNA, 20 bp, Artificial Sequence
  chemically synthesized
aaacgtggggaggattaaag

SEQ ID NO: 547641 - DNA, 20 bp, Artificial Sequence
  chemically synthesized
gtgtaatcaggggaatattt

SEQ ID NO: 547642 - DNA, 20 bp, Artificial Sequence
  chemically synthesized
tgatattaaacacgtggcat

SEQ ID NO: 547643 - DNA, 20 bp, Artificial Sequence
  chemically synthesized
ctgaactctcaacaaggcat

SEQ ID NO: 547644 - DNA, 20 bp, Artificial Sequence
  chemically synthesized
ctatgctttagtgttgagat

SEQ ID NO: 547645 - DNA, 20 bp, Artificial Sequence
  chemically synthesized
agaaatgctgctaaatccat

SEQ ID NO: 547646 - DNA, 20 bp, Artificial Sequence
  chemically synthesized
taacgaaaacgtatcgcaca

SEQ ID NO: 547647 - DNA, 20 bp, Artificial Sequence
  chemically synthesized
acttagagtgtcattttatt

SEQ ID NO: 547648 - DNA, 20 bp, Artificial Sequence
  chemically synthesized
gacaaaatgaaaaatcagtg

SEQ ID NO: 547649 - DNA, 20 bp, Artificial Sequence
  chemically synthesized
gcacatgtaccccagaactt

SEQ ID NO: 547650 - DNA, 20 bp, Artificial Sequence
  chemically synthesized
ctaggggagggatagaatta

SEQ ID NO: 547651 - DNA, 20 bp, Artificial Sequence
  chemically synthesized
ggtggggggctaggggaggg

SEQ ID NO: 547652 - DNA, 20 bp, Artificial Sequence
  chemically synthesized
ctcagcaaactaacacaaga

SEQ ID NO: 547653 - DNA, 20 bp, Artificial Sequence
  chemically synthesized
ctgttcttgtgttagtttgc

SEQ ID NO: 547654 - DNA, 20 bp, Artificial Sequence
  chemically synthesized
aatactatgcagccataaaa

SEQ ID NO: 547655 - DNA, 20 bp, Artificial Sequence
  chemically synthesized
ccatcagtgatagactggat

SEQ ID NO: 547656 - DNA, 20 bp, Artificial Sequence
  chemically synthesized
aaaatgcttatcacttgtca

SEQ ID NO: 547657 - DNA, 20 bp, Artificial Sequence
  chemically synthesized
gagataccatttaacaacag

SEQ ID NO: 547658 - DNA, 20 bp, Artificial Sequence
  chemically synthesized
aagtcagcaaaagatgctgg

SEQ ID NO: 547659 - DNA, 20 bp, Artificial Sequence
  chemically synthesized
aaagatgctggagagaatat

SEQ ID NO: 547660 - DNA, 20 bp, Artificial Sequence
  chemically synthesized
gattcctcaaggatctggaa

SEQ ID NO: 547661 - DNA, 20 bp, Artificial Sequence
  chemically synthesized
tgtgtgcatgtgtcttcata

SEQ ID NO: 547662 - DNA, 20 bp, Artificial Sequence
  chemically synthesized
caatgactaaaaaaacacta

SEQ ID NO: 547663 - DNA, 20 bp, Artificial Sequence
  chemically synthesized
tagtaaggtgggggtgagaa

SEQ ID NO: 547664 - DNA, 20 bp, Artificial Sequence
  chemically synthesized
tcctatatgagcagagacct

SEQ ID NO: 547665 - DNA, 20 bp, Artificial Sequence
  chemically synthesized
agtgaataaaaaagagatac

SEQ ID NO: 547666 - DNA, 20 bp, Artificial Sequence
  chemically synthesized
gaacacacccaagctcaact

SEQ ID NO: 547667 - DNA, 20 bp, Artificial Sequence
  chemically synthesized
aactttagtttgcttattag

SEQ ID NO: 547668 - DNA, 20 bp, Artificial Sequence
  chemically synthesized
gtttatacttatgacaaaat

SEQ ID NO: 547669 - DNA, 20 bp, Artificial Sequence
  chemically synthesized
ctactcatgaggctgaggca

SEQ ID NO: 547670 - DNA, 20 bp, Artificial Sequence
  chemically synthesized
aggcgggtggatcatgatgt

SEQ ID NO: 547671 - DNA, 20 bp, Artificial Sequence
  chemically synthesized
ttccaagtttggtttctgca

SEQ ID NO: 547672 - DNA, 20 bp, Artificial Sequence
  chemically synthesized
aaacctcaagacattctcat

SEQ ID NO: 547673 - DNA, 20 bp, Artificial Sequence
  chemically synthesized
aggaggttctatattttctg

SEQ ID NO: 547674 - DNA, 20 bp, Artificial Sequence
  chemically synthesized
cagggaaggccacatttctt

SEQ ID NO: 547675 - DNA, 20 bp, Artificial Sequence
  chemically synthesized
gaatataagtgaatataaaa

SEQ ID NO: 547676 - DNA, 20 bp, Artificial Sequence
  chemically synthesized
atattcatttaataatttca

SEQ ID NO: 547677 - DNA, 20 bp, Artificial Sequence
  chemically synthesized
cgaaactccacgggccatat

SEQ ID NO: 547678 - DNA, 20 bp, Artificial Sequence
  chemically synthesized
aattgaagtggaatatgcat

SEQ ID NO: 547679 - DNA, 20 bp, Artificial Sequence
  chemically synthesized
ttacacatgtgtatttactg

SEQ ID NO: 547680 - DNA, 20 bp, Artificial Sequence
  chemically synthesized
gtaagtcagtaaaacgcata

SEQ ID NO: 547681 - DNA, 20 bp, Artificial Sequence
  chemically synthesized
ccgtttttgaaatttaattg

SEQ ID NO: 547682 - DNA, 20 bp, Artificial Sequence
  chemically synthesized
tgctctgtaatatcccatca

SEQ ID NO: 547683 - DNA, 20 bp, Artificial Sequence
  chemically synthesized
gccaaaaacacatatatatg

SEQ ID NO: 547684 - DNA, 20 bp, Artificial Sequence
  chemically synthesized
ctattgtagacatacaagtt

SEQ ID NO: 547685 - DNA, 20 bp, Artificial Sequence
  chemically synthesized
ctgtaacttgtatgtctaca

SEQ ID NO: 547686 - DNA, 20 bp, Artificial Sequence
  chemically synthesized
acaatagaattgctgggtgg

SEQ ID NO: 547687 - DNA, 20 bp, Artificial Sequence
  chemically synthesized
acaaattcaagaatcatatt

SEQ ID NO: 547688 - DNA, 20 bp, Artificial Sequence
  chemically synthesized
acaaaaggtgttcacaaatt

SEQ ID NO: 547689 - DNA, 20 bp, Artificial Sequence
  chemically synthesized
ttcaatttcagtttctcatt

SEQ ID NO: 547690 - DNA, 20 bp, Artificial Sequence
  chemically synthesized
aaattttaggttttctagaa

SEQ ID NO: 547691 - DNA, 20 bp, Artificial Sequence
  chemically synthesized
ttttttaaattttaggtttt

SEQ ID NO: 547692 - DNA, 20 bp, Artificial Sequence
  chemically synthesized
ctaaaatttaaaaaaaaaat

SEQ ID NO: 547693 - DNA, 20 bp, Artificial Sequence
  chemically synthesized
taacattgagttaaatctat

SEQ ID NO: 547694 - DNA, 20 bp, Artificial Sequence
  chemically synthesized
attacaaaacaaatacaaaa

SEQ ID NO: 547695 - DNA, 20 bp, Artificial Sequence
  chemically synthesized
gagagagagagaacaatgca

SEQ ID NO: 547696 - DNA, 20 bp, Artificial Sequence
  chemically synthesized
ttatatttttatgacctgtt

SEQ ID NO: 547697 - DNA, 20 bp, Artificial Sequence
  chemically synthesized
tcataaaaatataaagtttt

SEQ ID NO: 547698 - DNA, 20 bp, Artificial Sequence
  chemically synthesized
agtgagtaaaaaggtaatcc

SEQ ID NO: 547699 - DNA, 20 bp, Artificial Sequence
  chemically synthesized
tcaaaacaaagggctcatat

SEQ ID NO: 547700 - DNA, 20 bp, Artificial Sequence
  chemically synthesized
atccaaagcatgtttcaaaa

SEQ ID NO: 547701 - DNA, 20 bp, Artificial Sequence
  chemically synthesized
atctgcctactccaagggaa

SEQ ID NO: 547702 - DNA, 20 bp, Artificial Sequence
  chemically synthesized
cccttggagtaggcagatag

SEQ ID NO: 547703 - DNA, 20 bp, Artificial Sequence
  chemically synthesized
agcaggcaagggagccccat

SEQ ID NO: 547704 - DNA, 20 bp, Artificial Sequence
  chemically synthesized
ttacactattacaatgagca

SEQ ID NO: 547705 - DNA, 20 bp, Artificial Sequence
  chemically synthesized
agtgtttagctcgtacttat

SEQ ID NO: 547706 - DNA, 20 bp, Artificial Sequence
  chemically synthesized
ctaagtaaactaacacagaa

SEQ ID NO: 547707 - DNA, 20 bp, Artificial Sequence
  chemically synthesized
attatcctaagtaaactaac

SEQ ID NO: 547708 - DNA, 20 bp, Artificial Sequence
  chemically synthesized
caatactatgcagccacaga

SEQ ID NO: 547709 - DNA, 20 bp, Artificial Sequence
  chemically synthesized
aaatacaatactatgcagcc

SEQ ID NO: 547710 - DNA, 20 bp, Artificial Sequence
  chemically synthesized
ctactcgggaggctgaggta

SEQ ID NO: 547711 - DNA, 20 bp, Artificial Sequence
  chemically synthesized
tgtaaaactcaatcctgcat

SEQ ID NO: 547712 - DNA, 20 bp, Artificial Sequence
  chemically synthesized
tgtagcttgactgtccccag

SEQ ID NO: 547713 - DNA, 20 bp, Artificial Sequence
  chemically synthesized
agtgaagaaaagagcggaac

SEQ ID NO: 547714 - DNA, 20 bp, Artificial Sequence
  chemically synthesized
ctgtttcaaaatgtagcagt

SEQ ID NO: 547715 - DNA, 20 bp, Artificial Sequence
  chemically synthesized
cttcactgctacattttgaa

SEQ ID NO: 547716 - DNA, 20 bp, Artificial Sequence
  chemically synthesized
taacaatattaaagttacac

SEQ ID NO: 547717 - DNA, 20 bp, Artificial Sequence
  chemically synthesized
tatcagtgtcattgacatta

SEQ ID NO: 547718 - DNA, 20 bp, Artificial Sequence
  chemically synthesized
gagtccatcggactaataaa

SEQ ID NO: 547719 - DNA, 20 bp, Artificial Sequence
  chemically synthesized
ctagatttttcactccgcag

SEQ ID NO: 547720 - DNA, 20 bp, Artificial Sequence
  chemically synthesized
tacagagatgtttgtcttag

SEQ ID NO: 547721 - DNA, 20 bp, Artificial Sequence
  chemically synthesized
gacagattttaggatgttaa

SEQ ID NO: 547722 - DNA, 20 bp, Artificial Sequence
  chemically synthesized
accaagtggttcagaggaga

SEQ ID NO: 547723 - DNA, 20 bp, Artificial Sequence
  chemically synthesized
tctccaagcatataaattat

SEQ ID NO: 547724 - DNA, 20 bp, Artificial Sequence
  chemically synthesized
ttagtacataaatatttggt

SEQ ID NO: 547725 - DNA, 20 bp, Artificial Sequence
  chemically synthesized
tgttgcacaaaacactgccg

SEQ ID NO: 547726 - DNA, 20 bp, Artificial Sequence
  chemically synthesized
ctactcgggaggctgagaca

SEQ ID NO: 547727 - DNA, 20 bp, Artificial Sequence
  chemically synthesized
tccatctcaaaaaaaaaaaa

SEQ ID NO: 547728 - DNA, 20 bp, Artificial Sequence
  chemically synthesized
ctcaaaaaaaaaaaaaaaga

SEQ ID NO: 547729 - DNA, 20 bp, Artificial Sequence
  chemically synthesized
aaaaaaaaaaaaagaaaaga

SEQ ID NO: 547730 - DNA, 20 bp, Artificial Sequence
  chemically synthesized
aaaaaaaagaaaagaaaaga

SEQ ID NO: 547731 - DNA, 20 bp, Artificial Sequence
  chemically synthesized
aaagaaaagaaaagaaaaga

SEQ ID NO: 547732 - DNA, 20 bp, Artificial Sequence
  chemically synthesized
agaaaagaaaagaaaagaaa

SEQ ID NO: 547733 - DNA, 20 bp, Artificial Sequence
  chemically synthesized
gaaaagaaaagaaaaaagaa

SEQ ID NO: 547734 - DNA, 20 bp, Artificial Sequence
  chemically synthesized
aaagaaaaagaaaagcaaag

SEQ ID NO: 547735 - DNA, 20 bp, Artificial Sequence
  chemically synthesized
aaaagaaaagcaaagtaaga

SEQ ID NO: 547736 - DNA, 20 bp, Artificial Sequence
  chemically synthesized
aagaactggtctgatttaca

SEQ ID NO: 547737 - DNA, 20 bp, Artificial Sequence
  chemically synthesized
agggctttggccccaaatgc

SEQ ID NO: 547738 - DNA, 20 bp, Artificial Sequence
  chemically synthesized
ttttgttttgttctcagcca

SEQ ID NO: 547739 - DNA, 20 bp, Artificial Sequence
  chemically synthesized
gcagagagaccgacaatcta

SEQ ID NO: 547740 - DNA, 20 bp, Artificial Sequence
  chemically synthesized
ttagcataaaccaaccactc

SEQ ID NO: 547741 - DNA, 20 bp, Artificial Sequence
  chemically synthesized
cataccaaaataggctttgt

SEQ ID NO: 547742 - DNA, 20 bp, Artificial Sequence
  chemically synthesized
ccccaactgggctatagaat

SEQ ID NO: 547743 - DNA, 20 bp, Artificial Sequence
  chemically synthesized
cagtaatccccaactgggct

SEQ ID NO: 547744 - DNA, 20 bp, Artificial Sequence
  chemically synthesized
ttactgcatgaccaccaatg

SEQ ID NO: 547745 - DNA, 20 bp, Artificial Sequence
  chemically synthesized
taaaaacattttctagtaag

SEQ ID NO: 547746 - DNA, 20 bp, Artificial Sequence
  chemically synthesized
ggaattgtttttctatctta

SEQ ID NO: 547747 - DNA, 20 bp, Artificial Sequence
  chemically synthesized
aaaaacaattcccaaacttt

SEQ ID NO: 547748 - DNA, 20 bp, Artificial Sequence
  chemically synthesized
ggacaattaaggtaatcttc

SEQ ID NO: 547749 - DNA, 20 bp, Artificial Sequence
  chemically synthesized
taagatacaacttttgggat

SEQ ID NO: 547750 - DNA, 20 bp, Artificial Sequence
  chemically synthesized
atttattaagttgtagagtt

SEQ ID NO: 547751 - DNA, 20 bp, Artificial Sequence
  chemically synthesized
taaaacaggttatcataatg

SEQ ID NO: 547752 - DNA, 20 bp, Artificial Sequence
  chemically synthesized
taagggcttgtagtaaggta

SEQ ID NO: 547753 - DNA, 20 bp, Artificial Sequence
  chemically synthesized
gcccttattagctattgccc

SEQ ID NO: 547754 - DNA, 20 bp, Artificial Sequence
  chemically synthesized
ttaagtccatttttaacaga

SEQ ID NO: 547755 - DNA, 20 bp, Artificial Sequence
  chemically synthesized
aacaactgctctgatttaca

SEQ ID NO: 547756 - DNA, 20 bp, Artificial Sequence
  chemically synthesized
gctttgacctcaaatgcaga

SEQ ID NO: 547757 - DNA, 20 bp, Artificial Sequence
  chemically synthesized
cattgtacatatggtttctg

SEQ ID NO: 547758 - DNA, 20 bp, Artificial Sequence
  chemically synthesized
tatcgacacactgaattctg

SEQ ID NO: 547759 - DNA, 20 bp, Artificial Sequence
  chemically synthesized
ataggagttaaatgcaagac

SEQ ID NO: 547760 - DNA, 20 bp, Artificial Sequence
  chemically synthesized
ttctagggtgaggaactact

SEQ ID NO: 547761 - DNA, 20 bp, Artificial Sequence
  chemically synthesized
attaaggctaaccttatgaa

SEQ ID NO: 547762 - DNA, 20 bp, Artificial Sequence
  chemically synthesized
ttacctcttagattttcctc

SEQ ID NO: 547763 - DNA, 20 bp, Artificial Sequence
  chemically synthesized
tagattttcctccaagaatg

SEQ ID NO: 547764 - DNA, 20 bp, Artificial Sequence
  chemically synthesized
ggtggaaagtgggagaaata

SEQ ID NO: 547765 - DNA, 20 bp, Artificial Sequence
  chemically synthesized
cctctttttggtggaaagtg

SEQ ID NO: 547766 - DNA, 20 bp, Artificial Sequence
  chemically synthesized
aaataaaaaaaaaatacatg

SEQ ID NO: 547767 - DNA, 20 bp, Artificial Sequence
  chemically synthesized
tttaagttcccacttcagga

SEQ ID NO: 547768 - DNA, 20 bp, Artificial Sequence
  chemically synthesized
cttgccttacaatcataaaa

SEQ ID NO: 547769 - DNA, 20 bp, Artificial Sequence
  chemically synthesized
ccaaatgcagatgcttctga

SEQ ID NO: 547770 - DNA, 20 bp, Artificial Sequence
  chemically synthesized
ggaggcatgtatactataga

SEQ ID NO: 547771 - DNA, 20 bp, Artificial Sequence
  chemically synthesized
ggagtagaagatatatctct

SEQ ID NO: 547772 - DNA, 20 bp, Artificial Sequence
  chemically synthesized
atatatctctacagaaacta

SEQ ID NO: 547773 - DNA, 20 bp, Artificial Sequence
  chemically synthesized
ttagaggtgattctgcttta

SEQ ID NO: 547774 - DNA, 20 bp, Artificial Sequence
  chemically synthesized
gattttgcctttctcataaa

SEQ ID NO: 547775 - DNA, 20 bp, Artificial Sequence
  chemically synthesized
aatttcagatactgctacta

SEQ ID NO: 547776 - DNA, 20 bp, Artificial Sequence
  chemically synthesized
acctaattagtaatagcatt

SEQ ID NO: 547777 - DNA, 20 bp, Artificial Sequence
  chemically synthesized
gcacactacccatttgatat

SEQ ID NO: 547778 - DNA, 20 bp, Artificial Sequence
  chemically synthesized
tgtgccaacatcataagttt

SEQ ID NO: 547779 - DNA, 20 bp, Artificial Sequence
  chemically synthesized
gtaacaaagtaggactgact

SEQ ID NO: 547780 - DNA, 20 bp, Artificial Sequence
  chemically synthesized
aggactgacttcagaataca

SEQ ID NO: 547781 - DNA, 20 bp, Artificial Sequence
  chemically synthesized
tatggatacgtagcatatgt

SEQ ID NO: 547782 - DNA, 20 bp, Artificial Sequence
  chemically synthesized
tgtctcttctgtataggact

SEQ ID NO: 547783 - DNA, 20 bp, Artificial Sequence
  chemically synthesized
ctgtctaccccaactgtctg

SEQ ID NO: 547784 - DNA, 20 bp, Artificial Sequence
  chemically synthesized
tggggtagacagaagtacaa

SEQ ID NO: 547785 - DNA, 20 bp, Artificial Sequence
  chemically synthesized
agatatctgacaatatatac

SEQ ID NO: 547786 - DNA, 20 bp, Artificial Sequence
  chemically synthesized
gagacgaaggctatgattta

SEQ ID NO: 547787 - DNA, 20 bp, Artificial Sequence
  chemically synthesized
gggggcttaaactctacttt

SEQ ID NO: 547788 - DNA, 20 bp, Artificial Sequence
  chemically synthesized
ggcttttatacataatgact

SEQ ID NO: 547789 - DNA, 20 bp, Artificial Sequence
  chemically synthesized
tttggcatactctaccgcct

SEQ ID NO: 547790 - DNA, 20 bp, Artificial Sequence
  chemically synthesized
acatagttttatgacatcta

SEQ ID NO: 547791 - DNA, 20 bp, Artificial Sequence
  chemically synthesized
aaacttagtagaatttcaga

SEQ ID NO: 547792 - DNA, 20 bp, Artificial Sequence
  chemically synthesized
gaaagttaactttaaactta

SEQ ID NO: 547793 - DNA, 20 bp, Artificial Sequence
  chemically synthesized
actggtatgtgacttatttt

SEQ ID NO: 547794 - DNA, 20 bp, Artificial Sequence
  chemically synthesized
gaatatagattctatgaagg

SEQ ID NO: 547795 - DNA, 20 bp, Artificial Sequence
  chemically synthesized
ctgtattttttctctccttc

SEQ ID NO: 547796 - DNA, 20 bp, Artificial Sequence
  chemically synthesized
ccactctgactggtatattc

SEQ ID NO: 547797 - DNA, 20 bp, Artificial Sequence
  chemically synthesized
aaaatttgagttatccagta

SEQ ID NO: 547798 - DNA, 20 bp, Artificial Sequence
  chemically synthesized
taagtatgttactgctaatc

SEQ ID NO: 547799 - DNA, 20 bp, Artificial Sequence
  chemically synthesized
tgtggctctttgtcatgaaa

SEQ ID NO: 547800 - DNA, 20 bp, Artificial Sequence
  chemically synthesized
aagattgaaagaacaagaac

SEQ ID NO: 547801 - DNA, 20 bp, Artificial Sequence
  chemically synthesized
tgacaaaagaaagacaaatg

SEQ ID NO: 547802 - DNA, 20 bp, Artificial Sequence
  chemically synthesized
cgatttggtgaagtatgaca

SEQ ID NO: 547803 - DNA, 20 bp, Artificial Sequence
  chemically synthesized
aggggattgtagggttttaa

SEQ ID NO: 547804 - DNA, 20 bp, Artificial Sequence
  chemically synthesized
tatagaacttagagtccagc

SEQ ID NO: 547805 - DNA, 20 bp, Artificial Sequence
  chemically synthesized
ggtactattacatagaagca

SEQ ID NO: 547806 - DNA, 20 bp, Artificial Sequence
  chemically synthesized
actttgaatttcacacaagt

SEQ ID NO: 547807 - DNA, 20 bp, Artificial Sequence
  chemically synthesized
tctatttgagtagaatttca

SEQ ID NO: 547808 - DNA, 20 bp, Artificial Sequence
  chemically synthesized
ttgaaaatggatctatttga

SEQ ID NO: 547809 - DNA, 20 bp, Artificial Sequence
  chemically synthesized
taacacaaaaccctaacatg

SEQ ID NO: 547810 - DNA, 20 bp, Artificial Sequence
  chemically synthesized
cctaacatgctagaattttt

SEQ ID NO: 547811 - DNA, 20 bp, Artificial Sequence
  chemically synthesized
tctttcccgctaccgctgct

SEQ ID NO: 547812 - DNA, 20 bp, Artificial Sequence
  chemically synthesized
acagtgggaagcaacacagg

SEQ ID NO: 547813 - DNA, 20 bp, Artificial Sequence
  chemically synthesized
cttctggccctgggtgtatt

SEQ ID NO: 547814 - DNA, 20 bp, Artificial Sequence
  chemically synthesized
ggaacttgctaccttgaaga

SEQ ID NO: 547815 - DNA, 20 bp, Artificial Sequence
  chemically synthesized
aagagaagaatccagtcctg

SEQ ID NO: 547816 - DNA, 20 bp, Artificial Sequence
  chemically synthesized
tcctcaggccccaggtgagt

SEQ ID NO: 547817 - DNA, 20 bp, Artificial Sequence
  chemically synthesized
ctgcttatgaaatgggaaag

SEQ ID NO: 547818 - DNA, 20 bp, Artificial Sequence
  chemically synthesized
acaggatcctaaaagcagca

SEQ ID NO: 547819 - DNA, 20 bp, Artificial Sequence
  chemically synthesized
aactagtaacaggcttctca

SEQ ID NO: 547820 - DNA, 20 bp, Artificial Sequence
  chemically synthesized
cagtgaaaatctccttccaa

SEQ ID NO: 547821 - DNA, 20 bp, Artificial Sequence
  chemically synthesized
tcaacaccagacctgttcta

SEQ ID NO: 547822 - DNA, 20 bp, Artificial Sequence
  chemically synthesized
tgttctacaagaaatgctaa

SEQ ID NO: 547823 - DNA, 20 bp, Artificial Sequence
  chemically synthesized
aagaagaggaccttaactag

SEQ ID NO: 547824 - DNA, 20 bp, Artificial Sequence
  chemically synthesized
ttgcataaacaagaaagcaa

SEQ ID NO: 547825 - DNA, 20 bp, Artificial Sequence
  chemically synthesized
gacaacactggttgcataaa

SEQ ID NO: 547826 - DNA, 20 bp, Artificial Sequence
  chemically synthesized
gattcacaaaatttaaaaag

SEQ ID NO: 547827 - DNA, 20 bp, Artificial Sequence
  chemically synthesized
agaaataaaagcatgccact

SEQ ID NO: 547828 - DNA, 20 bp, Artificial Sequence
  chemically synthesized
aaaaaggaagacaggatgga

SEQ ID NO: 547829 - DNA, 20 bp, Artificial Sequence
  chemically synthesized
aagagaaagccacaaaacaa

SEQ ID NO: 547830 - DNA, 20 bp, Artificial Sequence
  chemically synthesized
tctccaatcaaaacacagtg

SEQ ID NO: 547831 - DNA, 20 bp, Artificial Sequence
  chemically synthesized
aagactcaatctgttgccta

SEQ ID NO: 547832 - DNA, 20 bp, Artificial Sequence
  chemically synthesized
gaaatatattttgtttgatg

SEQ ID NO: 547833 - DNA, 20 bp, Artificial Sequence
  chemically synthesized
cctaacatatggcccatcct

SEQ ID NO: 547834 - DNA, 20 bp, Artificial Sequence
  chemically synthesized
ctgaccacagttgaatgaac

SEQ ID NO: 547835 - DNA, 20 bp, Artificial Sequence
  chemically synthesized
attgacccactgatcattca

SEQ ID NO: 547836 - DNA, 20 bp, Artificial Sequence
  chemically synthesized
tgaatgatcagtgggtcaat

SEQ ID NO: 547837 - DNA, 20 bp, Artificial Sequence
  chemically synthesized
ctgtgtttacagttttgttt

SEQ ID NO: 547838 - DNA, 20 bp, Artificial Sequence
  chemically synthesized
gtatcaaaaaaaaaaaaaaa

SEQ ID NO: 547839 - DNA, 20 bp, Artificial Sequence
  chemically synthesized
aaacaatacatcttaaagaa

SEQ ID NO: 547840 - DNA, 20 bp, Artificial Sequence
  chemically synthesized
gatgtaaaaagtctcccagt

SEQ ID NO: 547841 - DNA, 20 bp, Artificial Sequence
  chemically synthesized
gtcaggctaatattggcctc

SEQ ID NO: 547842 - DNA, 20 bp, Artificial Sequence
  chemically synthesized
cacgaaaaccagacagatat

SEQ ID NO: 547843 - DNA, 20 bp, Artificial Sequence
  chemically synthesized
caatgtgatagatcgtatga

SEQ ID NO: 547844 - DNA, 20 bp, Artificial Sequence
  chemically synthesized
aacacagtaaaagccacata

SEQ ID NO: 547845 - DNA, 20 bp, Artificial Sequence
  chemically synthesized
gcatccttgttacagatctt

SEQ ID NO: 547846 - DNA, 20 bp, Artificial Sequence
  chemically synthesized
ctacaagtcctagctagatc

SEQ ID NO: 547847 - DNA, 20 bp, Artificial Sequence
  chemically synthesized
aagtcctagctagatcaaag

SEQ ID NO: 547848 - DNA, 20 bp, Artificial Sequence
  chemically synthesized
agggcatccagattgaaaag

SEQ ID NO: 547849 - DNA, 20 bp, Artificial Sequence
  chemically synthesized
cagacacatagaccaatgga

SEQ ID NO: 547850 - DNA, 20 bp, Artificial Sequence
  chemically synthesized
aggtgccaagaacatacact

SEQ ID NO: 547851 - DNA, 20 bp, Artificial Sequence
  chemically synthesized
atcttttcaataaatggtgc

SEQ ID NO: 547852 - DNA, 20 bp, Artificial Sequence
  chemically synthesized
aaactggatatggatatgca

SEQ ID NO: 547853 - DNA, 20 bp, Artificial Sequence
  chemically synthesized
ctcaaactatgaaactacta

SEQ ID NO: 547854 - DNA, 20 bp, Artificial Sequence
  chemically synthesized
gtgcttggtagggtattgct

SEQ ID NO: 547855 - DNA, 20 bp, Artificial Sequence
  chemically synthesized
gacacaacacacagagtagg

SEQ ID NO: 547856 - DNA, 20 bp, Artificial Sequence
  chemically synthesized
taaggggctcaaacaactcc

SEQ ID NO: 547857 - DNA, 20 bp, Artificial Sequence
  chemically synthesized
ttgacatttgtgtcatctct

SEQ ID NO: 547858 - DNA, 20 bp, Artificial Sequence
  chemically synthesized
ggttgtcactatcattgatc

SEQ ID NO: 547859 - DNA, 20 bp, Artificial Sequence
  chemically synthesized
tactgccgggtatataccca

SEQ ID NO: 547860 - DNA, 20 bp, Artificial Sequence
  chemically synthesized
agaaaggaaatcagtttgtc

SEQ ID NO: 547861 - DNA, 20 bp, Artificial Sequence
  chemically synthesized
ccattaacaaatgaatggat

SEQ ID NO: 547862 - DNA, 20 bp, Artificial Sequence
  chemically synthesized
tgaactcatggagacagaga

SEQ ID NO: 547863 - DNA, 20 bp, Artificial Sequence
  chemically synthesized
tagtgggtacaaaaatctag

SEQ ID NO: 547864 - DNA, 20 bp, Artificial Sequence
  chemically synthesized
tcaacaatttactgtacatt

SEQ ID NO: 547865 - DNA, 20 bp, Artificial Sequence
  chemically synthesized
aagtggaatgtttgtggcac

SEQ ID NO: 547866 - DNA, 20 bp, Artificial Sequence
  chemically synthesized
aagtgaagtatctgtcacct

SEQ ID NO: 547867 - DNA, 20 bp, Artificial Sequence
  chemically synthesized
taaggaaagctctctagtaa

SEQ ID NO: 547868 - DNA, 20 bp, Artificial Sequence
  chemically synthesized
tgaagttcttggcagcacta

SEQ ID NO: 547869 - DNA, 20 bp, Artificial Sequence
  chemically synthesized
actgcaatgtgtccattgtt

SEQ ID NO: 547870 - DNA, 20 bp, Artificial Sequence
  chemically synthesized
agagatacttgtttttatga

SEQ ID NO: 547871 - DNA, 20 bp, Artificial Sequence
  chemically synthesized
atgaaaagaaaaaatccagg

SEQ ID NO: 547872 - DNA, 20 bp, Artificial Sequence
  chemically synthesized
ggtgagagaagtcttggagt

SEQ ID NO: 547873 - DNA, 20 bp, Artificial Sequence
  chemically synthesized
ggcaaaggtcaaaaacgcag

SEQ ID NO: 547874 - DNA, 20 bp, Artificial Sequence
  chemically synthesized
cctagctggggcaccgagag

SEQ ID NO: 547875 - DNA, 20 bp, Artificial Sequence
  chemically synthesized
agagaaagcagtgaggtgat

SEQ ID NO: 547876 - DNA, 20 bp, Artificial Sequence
  chemically synthesized
gaatatggtgaatatgacta

SEQ ID NO: 547877 - DNA, 20 bp, Artificial Sequence
  chemically synthesized
attctgagaagcactctatt

SEQ ID NO: 547878 - DNA, 20 bp, Artificial Sequence
  chemically synthesized
attctctaatagagtgcttc

SEQ ID NO: 547879 - DNA, 20 bp, Artificial Sequence
  chemically synthesized
tttcctggaaggatgctctg

SEQ ID NO: 547880 - DNA, 20 bp, Artificial Sequence
  chemically synthesized
agcataaagtatatgctttc

SEQ ID NO: 547881 - DNA, 20 bp, Artificial Sequence
  chemically synthesized
ctacttgggaggctgaggca

SEQ ID NO: 547882 - DNA, 20 bp, Artificial Sequence
  chemically synthesized
ctggggtattcatactacag

SEQ ID NO: 547883 - DNA, 20 bp, Artificial Sequence
  chemically synthesized
aggaaaattagaaccatcca

SEQ ID NO: 547884 - DNA, 20 bp, Artificial Sequence
  chemically synthesized
tcctgcctgcaacttactct

SEQ ID NO: 547885 - DNA, 20 bp, Artificial Sequence
  chemically synthesized
aagtaacccaagtttcagaa

SEQ ID NO: 547886 - DNA, 20 bp, Artificial Sequence
  chemically synthesized
aatagtgaataaattgtgcc

SEQ ID NO: 547887 - DNA, 20 bp, Artificial Sequence
  chemically synthesized
gaggcacaatttattcacta

SEQ ID NO: 547888 - DNA, 20 bp, Artificial Sequence
  chemically synthesized
tttacacctagaatttggtc

SEQ ID NO: 547889 - DNA, 20 bp, Artificial Sequence
  chemically synthesized
cgagttaaacgtttttacac

SEQ ID NO: 547890 - DNA, 20 bp, Artificial Sequence
  chemically synthesized
ccatgtctctactaaaaata

SEQ ID NO: 547891 - DNA, 20 bp, Artificial Sequence
  chemically synthesized
ctactcgagaggctgaggca

SEQ ID NO: 547892 - DNA, 20 bp, Artificial Sequence
  chemically synthesized
gataatataaaaatattata

SEQ ID NO: 547893 - DNA, 20 bp, Artificial Sequence
  chemically synthesized
aaaatattatattagaaagt

SEQ ID NO: 547894 - DNA, 20 bp, Artificial Sequence
  chemically synthesized
cccacagggatgccaaacta

SEQ ID NO: 547895 - DNA, 20 bp, Artificial Sequence
  chemically synthesized
agatggtacagaggatgcac

SEQ ID NO: 547896 - DNA, 20 bp, Artificial Sequence
  chemically synthesized
cttaaaaatagtcaaaagaa

SEQ ID NO: 547897 - DNA, 20 bp, Artificial Sequence
  chemically synthesized
gatgaaaggggagaacaaca

SEQ ID NO: 547898 - DNA, 20 bp, Artificial Sequence
  chemically synthesized
gccattaaaggttgaatttt

SEQ ID NO: 547899 - DNA, 20 bp, Artificial Sequence
  chemically synthesized
aatcctttttagtatgaaat

SEQ ID NO: 547900 - DNA, 20 bp, Artificial Sequence
  chemically synthesized
gaagcacaaacagtgttcaa

SEQ ID NO: 547901 - DNA, 20 bp, Artificial Sequence
  chemically synthesized
caaatcaaagtaaaaaaatt

SEQ ID NO: 547902 - DNA, 20 bp, Artificial Sequence
  chemically synthesized
accaatacaactctgaagaa

SEQ ID NO: 547903 - DNA, 20 bp, Artificial Sequence
  chemically synthesized
taaaagaccaatacaactct

SEQ ID NO: 547904 - DNA, 20 bp, Artificial Sequence
  chemically synthesized
aaagggatcaatacgtttca

SEQ ID NO: 547905 - DNA, 20 bp, Artificial Sequence
  chemically synthesized
gccatggacataactgtcgc

SEQ ID NO: 547906 - DNA, 20 bp, Artificial Sequence
  chemically synthesized
aaaaatatcgcaaataccac

SEQ ID NO: 547907 - DNA, 20 bp, Artificial Sequence
  chemically synthesized
agaacgctgctgaccagctc

SEQ ID NO: 547908 - DNA, 20 bp, Artificial Sequence
  chemically synthesized
taccttttccaactcatatt

SEQ ID NO: 547909 - DNA, 20 bp, Artificial Sequence
  chemically synthesized
tctatgtatattattccgca

SEQ ID NO: 547910 - DNA, 20 bp, Artificial Sequence
  chemically synthesized
atattaccagcatcgagatt

SEQ ID NO: 547911 - DNA, 20 bp, Artificial Sequence
  chemically synthesized
ccagcatcgagatttaagaa

SEQ ID NO: 547912 - DNA, 20 bp, Artificial Sequence
  chemically synthesized
ccctatgtggaagctcccct

SEQ ID NO: 547913 - DNA, 20 bp, Artificial Sequence
  chemically synthesized
tctttaggtgactcctttca

SEQ ID NO: 547914 - DNA, 20 bp, Artificial Sequence
  chemically synthesized
ttgaaaggagtcacctaaag

SEQ ID NO: 547915 - DNA, 20 bp, Artificial Sequence
  chemically synthesized
tgctggttttgtattttgag

SEQ ID NO: 547916 - DNA, 20 bp, Artificial Sequence
  chemically synthesized
tagatttatgcagagggaat

SEQ ID NO: 547917 - DNA, 20 bp, Artificial Sequence
  chemically synthesized
gaatggtatgatgccatgaa

SEQ ID NO: 547918 - DNA, 20 bp, Artificial Sequence
  chemically synthesized
taagaatgttgactgtacac

SEQ ID NO: 547919 - DNA, 20 bp, Artificial Sequence
  chemically synthesized
gtgccttactcttttcatct

SEQ ID NO: 547920 - DNA, 20 bp, Artificial Sequence
  chemically synthesized
acgtgtgatagctaacactt

SEQ ID NO: 547921 - DNA, 20 bp, Artificial Sequence
  chemically synthesized
gacgatatggattatttggc

SEQ ID NO: 547922 - DNA, 20 bp, Artificial Sequence
  chemically synthesized
aagggaccaacttcaaaata

SEQ ID NO: 547923 - DNA, 20 bp, Artificial Sequence
  chemically synthesized
tgtctggtatggtacctagc

SEQ ID NO: 547924 - DNA, 20 bp, Artificial Sequence
  chemically synthesized
aaatgttatcacctggaggt

SEQ ID NO: 547925 - DNA, 20 bp, Artificial Sequence
  chemically synthesized
cactactactcttagactcc

SEQ ID NO: 547926 - DNA, 20 bp, Artificial Sequence
  chemically synthesized
gttctctctctatgtagtaa

SEQ ID NO: 547927 - DNA, 20 bp, Artificial Sequence
  chemically synthesized
tggtaagagagggagagagg

SEQ ID NO: 547928 - DNA, 20 bp, Artificial Sequence
  chemically synthesized
caaaagtggagagtagggcc

SEQ ID NO: 547929 - DNA, 20 bp, Artificial Sequence
  chemically synthesized
caatgccagggatgtccata

SEQ ID NO: 547930 - DNA, 20 bp, Artificial Sequence
  chemically synthesized
ttacaatgacatcaccagag

SEQ ID NO: 547931 - DNA, 20 bp, Artificial Sequence
  chemically synthesized
aatctggctatgaagatcat

SEQ ID NO: 547932 - DNA, 20 bp, Artificial Sequence
  chemically synthesized
atgttactctattaagtaca

SEQ ID NO: 547933 - DNA, 20 bp, Artificial Sequence
  chemically synthesized
taattttattaatatttcct

SEQ ID NO: 547934 - DNA, 20 bp, Artificial Sequence
  chemically synthesized
caaaaaactgggtttaactt

SEQ ID NO: 547935 - DNA, 20 bp, Artificial Sequence
  chemically synthesized
ctactagggacgcggaggca

SEQ ID NO: 547936 - DNA, 20 bp, Artificial Sequence
  chemically synthesized
tcatgtatctatgtgaatca

SEQ ID NO: 547937 - DNA, 20 bp, Artificial Sequence
  chemically synthesized
tcccaatggttgcttttctg

SEQ ID NO: 547938 - DNA, 20 bp, Artificial Sequence
  chemically synthesized
cttgtaccataccgtttctg

SEQ ID NO: 547939 - DNA, 20 bp, Artificial Sequence
  chemically synthesized
aataacactgattcttcaaa

SEQ ID NO: 547940 - DNA, 20 bp, Artificial Sequence
  chemically synthesized
agcctatagatttctttttt

SEQ ID NO: 547941 - DNA, 20 bp, Artificial Sequence
  chemically synthesized
acttgggaggctaaggtggg

SEQ ID NO: 547942 - DNA, 20 bp, Artificial Sequence
  chemically synthesized
agttccagggaaattgcaga

SEQ ID NO: 547943 - DNA, 20 bp, Artificial Sequence
  chemically synthesized
gtagggtaattgagaaatta

SEQ ID NO: 547944 - DNA, 20 bp, Artificial Sequence
  chemically synthesized
caactgcaccgtagggtaat

SEQ ID NO: 547945 - DNA, 20 bp, Artificial Sequence
  chemically synthesized
ccttacaggcatggaagaag

SEQ ID NO: 547946 - DNA, 20 bp, Artificial Sequence
  chemically synthesized
agacccttacaggcatggaa

SEQ ID NO: 547947 - DNA, 20 bp, Artificial Sequence
  chemically synthesized
tctacaggaagttccaaatc

SEQ ID NO: 547948 - DNA, 20 bp, Artificial Sequence
  chemically synthesized
aaatcaaagaaattggaaac

SEQ ID NO: 547949 - DNA, 20 bp, Artificial Sequence
  chemically synthesized
atatttgacaatatttgact

SEQ ID NO: 547950 - DNA, 20 bp, Artificial Sequence
  chemically synthesized
atatgactctacctcatgta

SEQ ID NO: 547951 - DNA, 20 bp, Artificial Sequence
  chemically synthesized
ttaaacagcagttgcaaagt

SEQ ID NO: 547952 - DNA, 20 bp, Artificial Sequence
  chemically synthesized
agatatattaaactatcttt

SEQ ID NO: 547953 - DNA, 20 bp, Artificial Sequence
  chemically synthesized
ccttttggaaatgatagaag

SEQ ID NO: 547954 - DNA, 20 bp, Artificial Sequence
  chemically synthesized
ctgaccttttggaaatgata

SEQ ID NO: 547955 - DNA, 20 bp, Artificial Sequence
  chemically synthesized
aattttcctaatgtatatat

SEQ ID NO: 547956 - DNA, 20 bp, Artificial Sequence
  chemically synthesized
caataggaatttgggacttt

SEQ ID NO: 547957 - DNA, 20 bp, Artificial Sequence
  chemically synthesized
ggctttttatattaactaaa

SEQ ID NO: 547958 - DNA, 20 bp, Artificial Sequence
  chemically synthesized
aggctatataaatcaaaata

SEQ ID NO: 547959 - DNA, 20 bp, Artificial Sequence
  chemically synthesized
aaatgaggtagtagtaaaca

SEQ ID NO: 547960 - DNA, 20 bp, Artificial Sequence
  chemically synthesized
tggcacttttcagtggatct

SEQ ID NO: 547961 - DNA, 20 bp, Artificial Sequence
  chemically synthesized
tattatgcatcatactgtcc

SEQ ID NO: 547962 - DNA, 20 bp, Artificial Sequence
  chemically synthesized
aacagagtgaaaatccctga

SEQ ID NO: 547963 - DNA, 20 bp, Artificial Sequence
  chemically synthesized
agttatgtttgaaagggtga

SEQ ID NO: 547964 - DNA, 20 bp, Artificial Sequence
  chemically synthesized
atttttcagacatcttctgt

SEQ ID NO: 547965 - DNA, 20 bp, Artificial Sequence
  chemically synthesized
aagagccctaggagttttta

SEQ ID NO: 547966 - DNA, 20 bp, Artificial Sequence
  chemically synthesized
tttttatgagaaatatcaag

SEQ ID NO: 547967 - DNA, 20 bp, Artificial Sequence
  chemically synthesized
atagcacatgagtcagatct

SEQ ID NO: 547968 - DNA, 20 bp, Artificial Sequence
  chemically synthesized
gagatctgactcatgtgcta

SEQ ID NO: 547969 - DNA, 20 bp, Artificial Sequence
  chemically synthesized
ctccaatgcaatcttgcaaa

SEQ ID NO: 547970 - DNA, 20 bp, Artificial Sequence
  chemically synthesized
gcaatagttttgtcagtttc

SEQ ID NO: 547971 - DNA, 20 bp, Artificial Sequence
  chemically synthesized
ctacttggaaggctgaggca

SEQ ID NO: 547972 - DNA, 20 bp, Artificial Sequence
  chemically synthesized
ctgatttttgtattttttta

SEQ ID NO: 547973 - DNA, 20 bp, Artificial Sequence
  chemically synthesized
aagtcttacgaaaggtagct

SEQ ID NO: 547974 - DNA, 20 bp, Artificial Sequence
  chemically synthesized
cagtaaaaatctagcaaatg

SEQ ID NO: 547975 - DNA, 20 bp, Artificial Sequence
  chemically synthesized
tggaaattatagcttataat

SEQ ID NO: 547976 - DNA, 20 bp, Artificial Sequence
  chemically synthesized
gtcacctttagttagtgttt

SEQ ID NO: 547977 - DNA, 20 bp, Artificial Sequence
  chemically synthesized
ttattttaaaatgcattttt

SEQ ID NO: 547978 - DNA, 20 bp, Artificial Sequence
  chemically synthesized
aattttttctttgagctttg

SEQ ID NO: 547979 - DNA, 20 bp, Artificial Sequence
  chemically synthesized
atttttttcttacaaagctc

SEQ ID NO: 547980 - DNA, 20 bp, Artificial Sequence
  chemically synthesized
aaaaatttaaaattgcccta

SEQ ID NO: 547981 - DNA, 20 bp, Artificial Sequence
  chemically synthesized
ggttgcacagatctgtggaa

SEQ ID NO: 547982 - DNA, 20 bp, Artificial Sequence
  chemically synthesized
gtctccatccgagtggcctg

SEQ ID NO: 547983 - DNA, 20 bp, Artificial Sequence
  chemically synthesized
gtctttaccctgctggctct

SEQ ID NO: 547984 - DNA, 20 bp, Artificial Sequence
  chemically synthesized
gggacctgttaaaaaagcaa

SEQ ID NO: 547985 - DNA, 20 bp, Artificial Sequence
  chemically synthesized
actagacaaactcatgaaga

SEQ ID NO: 547986 - DNA, 20 bp, Artificial Sequence
  chemically synthesized
aacattacaggagctgttaa

SEQ ID NO: 547987 - DNA, 20 bp, Artificial Sequence
  chemically synthesized
ataaccaaatagaccaagca

SEQ ID NO: 547988 - DNA, 20 bp, Artificial Sequence
  chemically synthesized
taacaccagcagacaagatt

SEQ ID NO: 547989 - DNA, 20 bp, Artificial Sequence
  chemically synthesized
agcagacaagattagagaaa

SEQ ID NO: 547990 - DNA, 20 bp, Artificial Sequence
  chemically synthesized
atgcaaaggaatgaatagac

SEQ ID NO: 547991 - DNA, 20 bp, Artificial Sequence
  chemically synthesized
ctcttgcctgattgccctgg

SEQ ID NO: 547992 - DNA, 20 bp, Artificial Sequence
  chemically synthesized
ctggccagggcaatcaggca

SEQ ID NO: 547993 - DNA, 20 bp, Artificial Sequence
  chemically synthesized
ccagggcaatcaggcaagag

SEQ ID NO: 547994 - DNA, 20 bp, Artificial Sequence
  chemically synthesized
aaactgtctcttctgtgtat

SEQ ID NO: 547995 - DNA, 20 bp, Artificial Sequence
  chemically synthesized
cccatttacaatggctacaa

SEQ ID NO: 547996 - DNA, 20 bp, Artificial Sequence
  chemically synthesized
agaacattccatgctcatgg

SEQ ID NO: 547997 - DNA, 20 bp, Artificial Sequence
  chemically synthesized
atctaccattgacattattc

SEQ ID NO: 547998 - DNA, 20 bp, Artificial Sequence
  chemically synthesized
cattgacattattcacagaa

SEQ ID NO: 547999 - DNA, 20 bp, Artificial Sequence
  chemically synthesized
ttattcacagaattagaaaa

SEQ ID NO: 548000 - DNA, 20 bp, Artificial Sequence
  chemically synthesized
cccaaaacatcatggtactg

SEQ ID NO: 548001 - DNA, 20 bp, Artificial Sequence
  chemically synthesized
ggaagactggctagccatat

SEQ ID NO: 548002 - DNA, 20 bp, Artificial Sequence
  chemically synthesized
cactaactataaaaaccctg

SEQ ID NO: 548003 - DNA, 20 bp, Artificial Sequence
  chemically synthesized
aaaaaccacaaaacccatca

SEQ ID NO: 548004 - DNA, 20 bp, Artificial Sequence
  chemically synthesized
tcagaatgaacaggcaaact

SEQ ID NO: 548005 - DNA, 20 bp, Artificial Sequence
  chemically synthesized
cttacggcaaggatgcaggg

SEQ ID NO: 548006 - DNA, 20 bp, Artificial Sequence
  chemically synthesized
ggaaaaatagaccaagatta

SEQ ID NO: 548007 - DNA, 20 bp, Artificial Sequence
  chemically synthesized
ggtttcagaagacactgaag

SEQ ID NO: 548008 - DNA, 20 bp, Artificial Sequence
  chemically synthesized
ctagggtttcagaagacact

SEQ ID NO: 548009 - DNA, 20 bp, Artificial Sequence
  chemically synthesized
cttcagtgtcttctgaaacc

SEQ ID NO: 548010 - DNA, 20 bp, Artificial Sequence
  chemically synthesized
ccataacaaactctccttac

SEQ ID NO: 548011 - DNA, 20 bp, Artificial Sequence
  chemically synthesized
gcatcagttaatatgttaaa

SEQ ID NO: 548012 - DNA, 20 bp, Artificial Sequence
  chemically synthesized
aagtacacatatatagcttc

SEQ ID NO: 548013 - DNA, 20 bp, Artificial Sequence
  chemically synthesized
aatagattccagggaattac

SEQ ID NO: 548014 - DNA, 20 bp, Artificial Sequence
  chemically synthesized
tcccactctgagactaagtt

SEQ ID NO: 548015 - DNA, 20 bp, Artificial Sequence
  chemically synthesized
agaaaccctatataggttta

SEQ ID NO: 548016 - DNA, 20 bp, Artificial Sequence
  chemically synthesized
gttaagatgtaccttgcttg

SEQ ID NO: 548017 - DNA, 20 bp, Artificial Sequence
  chemically synthesized
taaagggacttaagtcacat

SEQ ID NO: 548018 - DNA, 20 bp, Artificial Sequence
  chemically synthesized
gtaggatggttcgaggtagg

SEQ ID NO: 548019 - DNA, 20 bp, Artificial Sequence
  chemically synthesized
agacagtaagctccagaaat

SEQ ID NO: 548020 - DNA, 20 bp, Artificial Sequence
  chemically synthesized
tcttcttgagacagtaagct

SEQ ID NO: 548021 - DNA, 20 bp, Artificial Sequence
  chemically synthesized
acaacattttacatgctaag

SEQ ID NO: 548022 - DNA, 20 bp, Artificial Sequence
  chemically synthesized
tagaaataaagtcaactgaa

SEQ ID NO: 548023 - DNA, 20 bp, Artificial Sequence
  chemically synthesized
ataccttgaattgtatctct

SEQ ID NO: 548024 - DNA, 20 bp, Artificial Sequence
  chemically synthesized
aaggagattttataaaaagg

SEQ ID NO: 548025 - DNA, 20 bp, Artificial Sequence
  chemically synthesized
agcaatcaaaaagggaacta

SEQ ID NO: 548026 - DNA, 20 bp, Artificial Sequence
  chemically synthesized
tgtatgtgaacgaggaggga

SEQ ID NO: 548027 - DNA, 20 bp, Artificial Sequence
  chemically synthesized
ttctaatatatactaaagtc

SEQ ID NO: 548028 - DNA, 20 bp, Artificial Sequence
  chemically synthesized
tagtcctctgtacacttgga

SEQ ID NO: 548029 - DNA, 20 bp, Artificial Sequence
  chemically synthesized
aatcagtggtaaagctgagc

SEQ ID NO: 548030 - DNA, 20 bp, Artificial Sequence
  chemically synthesized
ttcatataagaaatgaatgc

SEQ ID NO: 548031 - DNA, 20 bp, Artificial Sequence
  chemically synthesized
taacctacttcattttcata

SEQ ID NO: 548032 - DNA, 20 bp, Artificial Sequence
  chemically synthesized
tgagtgctgagagtatcctt

SEQ ID NO: 548033 - DNA, 20 bp, Artificial Sequence
  chemically synthesized
cacagtcccctattctgtgt

SEQ ID NO: 548034 - DNA, 20 bp, Artificial Sequence
  chemically synthesized
gccttatttagattctagac

SEQ ID NO: 548035 - DNA, 20 bp, Artificial Sequence
  chemically synthesized
aatgataacattgtaaaagc

SEQ ID NO: 548036 - DNA, 20 bp, Artificial Sequence
  chemically synthesized
tttcatgtgcaaacaaatgt

SEQ ID NO: 548037 - DNA, 20 bp, Artificial Sequence
  chemically synthesized
gagcaccagttgaggttttg

SEQ ID NO: 548038 - DNA, 20 bp, Artificial Sequence
  chemically synthesized
taacaacaatgaaaacctta

SEQ ID NO: 548039 - DNA, 20 bp, Artificial Sequence
  chemically synthesized
acaatgggtgaacacagatt

SEQ ID NO: 548040 - DNA, 20 bp, Artificial Sequence
  chemically synthesized
ctttgtatcaatagagaata

SEQ ID NO: 548041 - DNA, 20 bp, Artificial Sequence
  chemically synthesized
agctcaatctttgtatcaat

SEQ ID NO: 548042 - DNA, 20 bp, Artificial Sequence
  chemically synthesized
tattgatacaaagattgagc

SEQ ID NO: 548043 - DNA, 20 bp, Artificial Sequence
  chemically synthesized
gattgagcttagaaaatgta

SEQ ID NO: 548044 - DNA, 20 bp, Artificial Sequence
  chemically synthesized
gaaaactggcagtttttagg

SEQ ID NO: 548045 - DNA, 20 bp, Artificial Sequence
  chemically synthesized
gcacaaacaagccaggcgag

SEQ ID NO: 548046 - DNA, 20 bp, Artificial Sequence
  chemically synthesized
gactctagctgagaagggca

SEQ ID NO: 548047 - DNA, 20 bp, Artificial Sequence
  chemically synthesized
tttacagcagttatgatgga

SEQ ID NO: 548048 - DNA, 20 bp, Artificial Sequence
  chemically synthesized
gacaaatccgagctttaagg

SEQ ID NO: 548049 - DNA, 20 bp, Artificial Sequence
  chemically synthesized
cttagcaacttgtctgccaa

SEQ ID NO: 548050 - DNA, 20 bp, Artificial Sequence
  chemically synthesized
ttagcctctttatgggtttc

SEQ ID NO: 548051 - DNA, 20 bp, Artificial Sequence
  chemically synthesized
ggctcccagagtgagtattc

SEQ ID NO: 548052 - DNA, 20 bp, Artificial Sequence
  chemically synthesized
cttaatgcttaatgccattg

SEQ ID NO: 548053 - DNA, 20 bp, Artificial Sequence
  chemically synthesized
gtgtcagttgacatcacttg

SEQ ID NO: 548054 - DNA, 20 bp, Artificial Sequence
  chemically synthesized
gtcaactgacaccacacaga

SEQ ID NO: 548055 - DNA, 20 bp, Artificial Sequence
  chemically synthesized
gggtgttttgttacatagta

SEQ ID NO: 548056 - DNA, 20 bp, Artificial Sequence
  chemically synthesized
ggcaatagtaaatcagggaa

SEQ ID NO: 548057 - DNA, 20 bp, Artificial Sequence
  chemically synthesized
gacagggtgtaatctgttaa

SEQ ID NO: 548058 - DNA, 20 bp, Artificial Sequence
  chemically synthesized
cagtgtaggctggaggaaaa

SEQ ID NO: 548059 - DNA, 20 bp, Artificial Sequence
  chemically synthesized
aggatactttcaacctgctg

SEQ ID NO: 548060 - DNA, 20 bp, Artificial Sequence
  chemically synthesized
tccctacagaagggaaaaga

SEQ ID NO: 548061 - DNA, 20 bp, Artificial Sequence
  chemically synthesized
caggcccggttgtaagcacc

SEQ ID NO: 548062 - DNA, 20 bp, Artificial Sequence
  chemically synthesized
tttaaaattagtcaaagcaa

SEQ ID NO: 548063 - DNA, 20 bp, Artificial Sequence
  chemically synthesized
attgaaatttacttggggtc

SEQ ID NO: 548064 - DNA, 20 bp, Artificial Sequence
  chemically synthesized
gtgtctggtcacagaagcag

SEQ ID NO: 548065 - DNA, 20 bp, Artificial Sequence
  chemically synthesized
ggaacccaaaaccaagtctt

SEQ ID NO: 548066 - DNA, 20 bp, Artificial Sequence
  chemically synthesized
ataggcaagataccacaact

SEQ ID NO: 548067 - DNA, 20 bp, Artificial Sequence
  chemically synthesized
gtgtttgataggtgtagcag

SEQ ID NO: 548068 - DNA, 20 bp, Artificial Sequence
  chemically synthesized
atcattggatatggttagaa

SEQ ID NO: 548069 - DNA, 20 bp, Artificial Sequence
  chemically synthesized
ggtggtatcattggatatgg

SEQ ID NO: 548070 - DNA, 20 bp, Artificial Sequence
  chemically synthesized
gatgtaattaaaggatgtgg

SEQ ID NO: 548071 - DNA, 20 bp, Artificial Sequence
  chemically synthesized
aagatttgaggattataggt

SEQ ID NO: 548072 - DNA, 20 bp, Artificial Sequence
  chemically synthesized
caaaaatacaatctacagaa

SEQ ID NO: 548073 - DNA, 20 bp, Artificial Sequence
  chemically synthesized
agaacacaaaaatacaatct

SEQ ID NO: 548074 - DNA, 20 bp, Artificial Sequence
  chemically synthesized
attcattcaaacagagcctt

SEQ ID NO: 548075 - DNA, 20 bp, Artificial Sequence
  chemically synthesized
atggcaaggcacatgggaat

SEQ ID NO: 548076 - DNA, 20 bp, Artificial Sequence
  chemically synthesized
ctgttcaacagctccaaatt

SEQ ID NO: 548077 - DNA, 20 bp, Artificial Sequence
  chemically synthesized
tattgattataaatcatttg

SEQ ID NO: 548078 - DNA, 20 bp, Artificial Sequence
  chemically synthesized
cctctagcaattattctgat

SEQ ID NO: 548079 - DNA, 20 bp, Artificial Sequence
  chemically synthesized
ctcttaagactgattctgca

SEQ ID NO: 548080 - DNA, 20 bp, Artificial Sequence
  chemically synthesized
ttctttgtttacatctagct

SEQ ID NO: 548081 - DNA, 20 bp, Artificial Sequence
  chemically synthesized
aagagccctgtggttatcat

SEQ ID NO: 548082 - DNA, 20 bp, Artificial Sequence
  chemically synthesized
ttctaatataaacaaaaagt

SEQ ID NO: 548083 - DNA, 20 bp, Artificial Sequence
  chemically synthesized
ttctgaactttttgtttata

SEQ ID NO: 548084 - DNA, 20 bp, Artificial Sequence
  chemically synthesized
ttgtactatagctagagtta

SEQ ID NO: 548085 - DNA, 20 bp, Artificial Sequence
  chemically synthesized
agaagtagaataggaatggg

SEQ ID NO: 548086 - DNA, 20 bp, Artificial Sequence
  chemically synthesized
caagtaggtgagcaagagaa

SEQ ID NO: 548087 - DNA, 20 bp, Artificial Sequence
  chemically synthesized
tggtaaagcccatgtggaga

SEQ ID NO: 548088 - DNA, 20 bp, Artificial Sequence
  chemically synthesized
cccattcctagtattttcaa

SEQ ID NO: 548089 - DNA, 20 bp, Artificial Sequence
  chemically synthesized
ctactcgggaggctaaggca

SEQ ID NO: 548090 - DNA, 20 bp, Artificial Sequence
  chemically synthesized
ctgattaatctttaacttcg

SEQ ID NO: 548091 - DNA, 20 bp, Artificial Sequence
  chemically synthesized
gtagttttgtagtatagcta

SEQ ID NO: 548092 - DNA, 20 bp, Artificial Sequence
  chemically synthesized
actacagtatctgtattact

SEQ ID NO: 548093 - DNA, 20 bp, Artificial Sequence
  chemically synthesized
actgccaatggtttgattag

SEQ ID NO: 548094 - DNA, 20 bp, Artificial Sequence
  chemically synthesized
gagaccagcctgaccgagat

SEQ ID NO: 548095 - DNA, 20 bp, Artificial Sequence
  chemically synthesized
tctggctgtgagaggcatag

SEQ ID NO: 548096 - DNA, 20 bp, Artificial Sequence
  chemically synthesized
ggtgataaacagcattggag

SEQ ID NO: 548097 - DNA, 20 bp, Artificial Sequence
  chemically synthesized
gatgtggaaatgaagctctc

SEQ ID NO: 548098 - DNA, 20 bp, Artificial Sequence
  chemically synthesized
agagcttcatttccacatct

SEQ ID NO: 548099 - DNA, 20 bp, Artificial Sequence
  chemically synthesized
gttacatttggtggctatat

SEQ ID NO: 548100 - DNA, 20 bp, Artificial Sequence
  chemically synthesized
ttttttttatgttttgcata

SEQ ID NO: 548101 - DNA, 20 bp, Artificial Sequence
  chemically synthesized
aaattgatatcaactataga

SEQ ID NO: 548102 - DNA, 20 bp, Artificial Sequence
  chemically synthesized
actacagtgccaggtatatg

SEQ ID NO: 548103 - DNA, 20 bp, Artificial Sequence
  chemically synthesized
cgtgagccactgcgcctagc

SEQ ID NO: 548104 - DNA, 20 bp, Artificial Sequence
  chemically synthesized
gagaccagcctgaccaacat

SEQ ID NO: 548105 - DNA, 20 bp, Artificial Sequence
  chemically synthesized
ctactcaggaggctgaggca

SEQ ID NO: 548106 - DNA, 20 bp, Artificial Sequence
  chemically synthesized
gcaaaactccatctcaaaaa

SEQ ID NO: 548107 - DNA, 20 bp, Artificial Sequence
  chemically synthesized
ctccatctcaaaaaaaagaa

SEQ ID NO: 548108 - DNA, 20 bp, Artificial Sequence
  chemically synthesized
atcatcagattacaggtttg

SEQ ID NO: 548109 - DNA, 20 bp, Artificial Sequence
  chemically synthesized
taagatttttagctttttaa

SEQ ID NO: 548110 - DNA, 20 bp, Artificial Sequence
  chemically synthesized
tgaatacaaacaggtatgaa

SEQ ID NO: 548111 - DNA, 20 bp, Artificial Sequence
  chemically synthesized
ttagaactagcttcaaagag

SEQ ID NO: 548112 - DNA, 20 bp, Artificial Sequence
  chemically synthesized
gtttttagaactagcttcaa

SEQ ID NO: 548113 - DNA, 20 bp, Artificial Sequence
  chemically synthesized
tgaagctagttctaaaaaca

SEQ ID NO: 548114 - DNA, 20 bp, Artificial Sequence
  chemically synthesized
taacttgctttaccttggct

SEQ ID NO: 548115 - DNA, 20 bp, Artificial Sequence
  chemically synthesized
cttcacagaaagaaaccagt

SEQ ID NO: 548116 - DNA, 20 bp, Artificial Sequence
  chemically synthesized
aatcataattgtcttcacag

SEQ ID NO: 548117 - DNA, 20 bp, Artificial Sequence
  chemically synthesized
cagaaatcataattgtcttc

SEQ ID NO: 548118 - DNA, 20 bp, Artificial Sequence
  chemically synthesized
gtatacaattattcatagac

SEQ ID NO: 548119 - DNA, 20 bp, Artificial Sequence
  chemically synthesized
ttacttttccaagattaata

SEQ ID NO: 548120 - DNA, 20 bp, Artificial Sequence
  chemically synthesized
ttgccaatgtgaaggagctg

SEQ ID NO: 548121 - DNA, 20 bp, Artificial Sequence
  chemically synthesized
ctggctttactgactgactc

SEQ ID NO: 548122 - DNA, 20 bp, Artificial Sequence
  chemically synthesized
gttttgtttttcaaaagctt

SEQ ID NO: 548123 - DNA, 20 bp, Artificial Sequence
  chemically synthesized
tcagcttcatcgcccctgct

SEQ ID NO: 548124 - DNA, 20 bp, Artificial Sequence
  chemically synthesized
agggctgggaagacaaaagg

SEQ ID NO: 548125 - DNA, 20 bp, Artificial Sequence
  chemically synthesized
aaaccacttgagtgactgta

SEQ ID NO: 548126 - DNA, 20 bp, Artificial Sequence
  chemically synthesized
cagccagggtcagttaacag

SEQ ID NO: 548127 - DNA, 20 bp, Artificial Sequence
  chemically synthesized
atatgtggtctttggaagaa

SEQ ID NO: 548128 - DNA, 20 bp, Artificial Sequence
  chemically synthesized
aatataatatgtggtctttg

SEQ ID NO: 548129 - DNA, 20 bp, Artificial Sequence
  chemically synthesized
gtcattattttataaaagta

SEQ ID NO: 548130 - DNA, 20 bp, Artificial Sequence
  chemically synthesized
caactgagttccatctacag

SEQ ID NO: 548131 - DNA, 20 bp, Artificial Sequence
  chemically synthesized
aatacaactgagttccatct

SEQ ID NO: 548132 - DNA, 20 bp, Artificial Sequence
  chemically synthesized
tttgattcaactgtccatgg

SEQ ID NO: 548133 - DNA, 20 bp, Artificial Sequence
  chemically synthesized
aggcaggaagaattgcatgt

SEQ ID NO: 548134 - DNA, 20 bp, Artificial Sequence
  chemically synthesized
agggcttaccttagaggcag

SEQ ID NO: 548135 - DNA, 20 bp, Artificial Sequence
  chemically synthesized
ctgcagaaagccctgcaggt

SEQ ID NO: 548136 - DNA, 20 bp, Artificial Sequence
  chemically synthesized
ctttactattaagacatact

SEQ ID NO: 548137 - DNA, 20 bp, Artificial Sequence
  chemically synthesized
atttgtaatatgcttgtgat

SEQ ID NO: 548138 - DNA, 20 bp, Artificial Sequence
  chemically synthesized
ccaaaaggaacccaaggaaa

SEQ ID NO: 548139 - DNA, 20 bp, Artificial Sequence
  chemically synthesized
atcagaaagggtaattctgc

SEQ ID NO: 548140 - DNA, 20 bp, Artificial Sequence
  chemically synthesized
atgtaagagcaactttctaa

SEQ ID NO: 548141 - DNA, 20 bp, Artificial Sequence
  chemically synthesized
gttgaagtttgacctcaaaa

SEQ ID NO: 548142 - DNA, 20 bp, Artificial Sequence
  chemically synthesized
ccaaataagaaatgagagta

SEQ ID NO: 548143 - DNA, 20 bp, Artificial Sequence
  chemically synthesized
agcaattaccagtgtccaaa

SEQ ID NO: 548144 - DNA, 20 bp, Artificial Sequence
  chemically synthesized
atttatactttaaaaatgca

SEQ ID NO: 548145 - DNA, 20 bp, Artificial Sequence
  chemically synthesized
aagctggtagcatgttaact

SEQ ID NO: 548146 - DNA, 20 bp, Artificial Sequence
  chemically synthesized
ttcacaaattaaatttgttg

SEQ ID NO: 548147 - DNA, 20 bp, Artificial Sequence
  chemically synthesized
ctacttgggaggctgaggca

SEQ ID NO: 548148 - DNA, 20 bp, Artificial Sequence
  chemically synthesized
aaaaaaaaaaaaaaaaaaaa

SEQ ID NO: 548149 - DNA, 20 bp, Artificial Sequence
  chemically synthesized
catctacagaacattaatat

SEQ ID NO: 548150 - DNA, 20 bp, Artificial Sequence
  chemically synthesized
actcaacatatctaataaag

SEQ ID NO: 548151 - DNA, 20 bp, Artificial Sequence
  chemically synthesized
agggatagagtacatcaaaa

SEQ ID NO: 548152 - DNA, 20 bp, Artificial Sequence
  chemically synthesized
gtaacattgtatgtattggt

SEQ ID NO: 548153 - DNA, 20 bp, Artificial Sequence
  chemically synthesized
tttgtataggttgaaccact

SEQ ID NO: 548154 - DNA, 20 bp, Artificial Sequence
  chemically synthesized
aatcattatgttgaatatgt

SEQ ID NO: 548155 - DNA, 20 bp, Artificial Sequence
  chemically synthesized
ttaaaccaatggagagtctg

SEQ ID NO: 548156 - DNA, 20 bp, Artificial Sequence
  chemically synthesized
gtagagtggagcatagctta

SEQ ID NO: 548157 - DNA, 20 bp, Artificial Sequence
  chemically synthesized
cactaggttcaaacttgcaa

SEQ ID NO: 548158 - DNA, 20 bp, Artificial Sequence
  chemically synthesized
agcctgaaatttaagaacta

SEQ ID NO: 548159 - DNA, 20 bp, Artificial Sequence
  chemically synthesized
actgtatttatacccatgcc

SEQ ID NO: 548160 - DNA, 20 bp, Artificial Sequence
  chemically synthesized
tgaacagattagcatcatga

SEQ ID NO: 548161 - DNA, 20 bp, Artificial Sequence
  chemically synthesized
aatctcattaactgaacaaa

SEQ ID NO: 548162 - DNA, 20 bp, Artificial Sequence
  chemically synthesized
caaaatattaagcctactaa

SEQ ID NO: 548163 - DNA, 20 bp, Artificial Sequence
  chemically synthesized
tgcaaagcctaaggctttga

SEQ ID NO: 548164 - DNA, 20 bp, Artificial Sequence
  chemically synthesized
tcccaattgtatataaatat

SEQ ID NO: 548165 - DNA, 20 bp, Artificial Sequence
  chemically synthesized
gctagatgatgttgttaaat

SEQ ID NO: 548166 - DNA, 20 bp, Artificial Sequence
  chemically synthesized
tgtgttgaaatttccctatt

SEQ ID NO: 548167 - DNA, 20 bp, Artificial Sequence
  chemically synthesized
tctacattttatgtgatgca

SEQ ID NO: 548168 - DNA, 20 bp, Artificial Sequence
  chemically synthesized
tagaagcgaaatttgagggt

SEQ ID NO: 548169 - DNA, 20 bp, Artificial Sequence
  chemically synthesized
tacaaattagtcaagcagaa

SEQ ID NO: 548170 - DNA, 20 bp, Artificial Sequence
  chemically synthesized
cttgactacaaattagtcaa

SEQ ID NO: 548171 - DNA, 20 bp, Artificial Sequence
  chemically synthesized
gtattattttaaaaacatgc

SEQ ID NO: 548172 - DNA, 20 bp, Artificial Sequence
  chemically synthesized
ctactcgggaggctgaggca

SEQ ID NO: 548173 - DNA, 20 bp, Artificial Sequence
  chemically synthesized
aaaaaactaaatgcctaact

SEQ ID NO: 548174 - DNA, 20 bp, Artificial Sequence
  chemically synthesized
cgatcacatctaaataaata

SEQ ID NO: 548175 - DNA, 20 bp, Artificial Sequence
  chemically synthesized
atgataacaatgactttaag

SEQ ID NO: 548176 - DNA, 20 bp, Artificial Sequence
  chemically synthesized
ctacttgggaggctgaggca

SEQ ID NO: 548177 - DNA, 20 bp, Artificial Sequence
  chemically synthesized
ctccagcctggatgacagag

SEQ ID NO: 548178 - DNA, 20 bp, Artificial Sequence
  chemically synthesized
caaaaaaaataaataaataa

SEQ ID NO: 548179 - DNA, 20 bp, Artificial Sequence
  chemically synthesized
ggacccttatctgttatata

SEQ ID NO: 548180 - DNA, 20 bp, Artificial Sequence
  chemically synthesized
acctgaaactaaaactacta

SEQ ID NO: 548181 - DNA, 20 bp, Artificial Sequence
  chemically synthesized
ctactcaggaggctgaggca

SEQ ID NO: 548182 - DNA, 20 bp, Artificial Sequence
  chemically synthesized
aagggacaactcatggagca

SEQ ID NO: 548183 - DNA, 20 bp, Artificial Sequence
  chemically synthesized
gattaatatccaaaaatata

SEQ ID NO: 548184 - DNA, 20 bp, Artificial Sequence
  chemically synthesized
atgctatcaccccacacctg

SEQ ID NO: 548185 - DNA, 20 bp, Artificial Sequence
  chemically synthesized
ctagttatcctttgtctttt

SEQ ID NO: 548186 - DNA, 20 bp, Artificial Sequence
  chemically synthesized
caaaggataactagtgttgg

SEQ ID NO: 548187 - DNA, 20 bp, Artificial Sequence
  chemically synthesized
ggaacactattcaactttaa

SEQ ID NO: 548188 - DNA, 20 bp, Artificial Sequence
  chemically synthesized
taattttccgtgcctggact

SEQ ID NO: 548189 - DNA, 20 bp, Artificial Sequence
  chemically synthesized
tagtatctaggctcagagac

SEQ ID NO: 548190 - DNA, 20 bp, Artificial Sequence
  chemically synthesized
actattttcctggactggat

SEQ ID NO: 548191 - DNA, 20 bp, Artificial Sequence
  chemically synthesized
gactggatggagaatgtaaa

SEQ ID NO: 548192 - DNA, 20 bp, Artificial Sequence
  chemically synthesized
aaagttatgtcagacccagg

SEQ ID NO: 548193 - DNA, 20 bp, Artificial Sequence
  chemically synthesized
tcagcaggatatagggtaca

SEQ ID NO: 548194 - DNA, 20 bp, Artificial Sequence
  chemically synthesized
tcaatgggtttttggaggat

SEQ ID NO: 548195 - DNA, 20 bp, Artificial Sequence
  chemically synthesized
ctttcatatctctgtacggt

SEQ ID NO: 548196 - DNA, 20 bp, Artificial Sequence
  chemically synthesized
cattgatcagttagggtggg

SEQ ID NO: 548197 - DNA, 20 bp, Artificial Sequence
  chemically synthesized
tttgtcattctccccaccct

SEQ ID NO: 548198 - DNA, 20 bp, Artificial Sequence
  chemically synthesized
aagtacattctcaagggtgg

SEQ ID NO: 548199 - DNA, 20 bp, Artificial Sequence
  chemically synthesized
gcgtgacaatcaggtcccct

SEQ ID NO: 548200 - DNA, 20 bp, Artificial Sequence
  chemically synthesized
gaaatttaagacaaaacccc

SEQ ID NO: 548201 - DNA, 20 bp, Artificial Sequence
  chemically synthesized
atataaattaagttcagatt

SEQ ID NO: 548202 - DNA, 20 bp, Artificial Sequence
  chemically synthesized
gatccttatgtggggatttc

SEQ ID NO: 548203 - DNA, 20 bp, Artificial Sequence
  chemically synthesized
taggtgctggacaatgattc

SEQ ID NO: 548204 - DNA, 20 bp, Artificial Sequence
  chemically synthesized
cgtaaccgggcactgctagt

SEQ ID NO: 548205 - DNA, 20 bp, Artificial Sequence
  chemically synthesized
gggtagttccataggtcctc

SEQ ID NO: 548206 - DNA, 20 bp, Artificial Sequence
  chemically synthesized
ttccataggtcctcgcagaa

SEQ ID NO: 548207 - DNA, 20 bp, Artificial Sequence
  chemically synthesized
cgcgaaaagtttgagtcctt

SEQ ID NO: 548208 - DNA, 20 bp, Artificial Sequence
  chemically synthesized
gttgagactacaccttggag

SEQ ID NO: 548209 - DNA, 20 bp, Artificial Sequence
  chemically synthesized
gtttttcctatccaactcca

SEQ ID NO: 548210 - DNA, 20 bp, Artificial Sequence
  chemically synthesized
ggatgtttcgccttcttacc

SEQ ID NO: 548211 - DNA, 20 bp, Artificial Sequence
  chemically synthesized
catcccagattgtctaaaaa

SEQ ID NO: 548212 - DNA, 20 bp, Artificial Sequence
  chemically synthesized
caatgaagttatggttaatg

SEQ ID NO: 548213 - DNA, 20 bp, Artificial Sequence
  chemically synthesized
gagacattttacgttagtga

SEQ ID NO: 548214 - DNA, 20 bp, Artificial Sequence
  chemically synthesized
ctccaggccagtgctgtcca

SEQ ID NO: 548215 - DNA, 20 bp, Artificial Sequence
  chemically synthesized
ccctctgtatatgaggggat

SEQ ID NO: 548216 - DNA, 20 bp, Artificial Sequence
  chemically synthesized
attaagatggcctaacaaca

SEQ ID NO: 548217 - DNA, 20 bp, Artificial Sequence
  chemically synthesized
aaagggaaagaaaaggaaaa

SEQ ID NO: 548218 - DNA, 20 bp, Artificial Sequence
  chemically synthesized
tcatgaaacctattaaaggg

SEQ ID NO: 548219 - DNA, 20 bp, Artificial Sequence
  chemically synthesized
ttaataggtttcatgaaaat

SEQ ID NO: 548220 - DNA, 20 bp, Artificial Sequence
  chemically synthesized
ataaagcgatgtaggacaaa

SEQ ID NO: 548221 - DNA, 20 bp, Artificial Sequence
  chemically synthesized
gacagttggaaagtgttgga

SEQ ID NO: 548222 - DNA, 20 bp, Artificial Sequence
  chemically synthesized
tcatccaaattttactgatc

SEQ ID NO: 548223 - DNA, 20 bp, Artificial Sequence
  chemically synthesized
tttattgttagcaaagatta

SEQ ID NO: 548224 - DNA, 20 bp, Artificial Sequence
  chemically synthesized
gaaaaaatgattaggctggg

SEQ ID NO: 548225 - DNA, 20 bp, Artificial Sequence
  chemically synthesized
tggcaggattccaggtctga

SEQ ID NO: 548226 - DNA, 20 bp, Artificial Sequence
  chemically synthesized
gaacagtatagccacgtgac

SEQ ID NO: 548227 - DNA, 20 bp, Artificial Sequence
  chemically synthesized
caagttacttcctgaaaagc

SEQ ID NO: 548228 - DNA, 20 bp, Artificial Sequence
  chemically synthesized
ccagggctgaaaacctaaaa

SEQ ID NO: 548229 - DNA, 20 bp, Artificial Sequence
  chemically synthesized
acaacatggcgtggggggca

SEQ ID NO: 548230 - DNA, 20 bp, Artificial Sequence
  chemically synthesized
aaagagtagaactctgtctc

SEQ ID NO: 548231 - DNA, 20 bp, Artificial Sequence
  chemically synthesized
acttggtgtgtaatgttatg

SEQ ID NO: 548232 - DNA, 20 bp, Artificial Sequence
  chemically synthesized
cgatcattgtggccagagag

SEQ ID NO: 548233 - DNA, 20 bp, Artificial Sequence
  chemically synthesized
actctaacataaacttccca

SEQ ID NO: 548234 - DNA, 20 bp, Artificial Sequence
  chemically synthesized
gactgagagtagttaattca

SEQ ID NO: 548235 - DNA, 20 bp, Artificial Sequence
  chemically synthesized
atcaaaacaaaaatgtcaca

SEQ ID NO: 548236 - DNA, 20 bp, Artificial Sequence
  chemically synthesized
gaagcatggggtaaaaaggt

SEQ ID NO: 548237 - DNA, 20 bp, Artificial Sequence
  chemically synthesized
ggaaagaaatggaagacatg

SEQ ID NO: 548238 - DNA, 20 bp, Artificial Sequence
  chemically synthesized
ggtattctcattttttaagg

SEQ ID NO: 548239 - DNA, 20 bp, Artificial Sequence
  chemically synthesized
ccatttctttccttaaaaaa

SEQ ID NO: 548240 - DNA, 20 bp, Artificial Sequence
  chemically synthesized
tccagctccactacaatatt

SEQ ID NO: 548241 - DNA, 20 bp, Artificial Sequence
  chemically synthesized
gctgcttttttgtggatatg

SEQ ID NO: 548242 - DNA, 20 bp, Artificial Sequence
  chemically synthesized
gccatcctattaagtaggaa

SEQ ID NO: 548243 - DNA, 20 bp, Artificial Sequence
  chemically synthesized
gcctttggtcaacggggtgt

SEQ ID NO: 548244 - DNA, 20 bp, Artificial Sequence
  chemically synthesized
gcctctggacgtgacacatc

SEQ ID NO: 548245 - DNA, 20 bp, Artificial Sequence
  chemically synthesized
agccaaaccccgcatgacca

SEQ ID NO: 548246 - DNA, 20 bp, Artificial Sequence
  chemically synthesized
atcaggttcaagagactgag

SEQ ID NO: 548247 - DNA, 20 bp, Artificial Sequence
  chemically synthesized
acaggagaagtgccttacct

SEQ ID NO: 548248 - DNA, 20 bp, Artificial Sequence
  chemically synthesized
gcaataatgtgcgcataccc

SEQ ID NO: 548249 - DNA, 20 bp, Artificial Sequence
  chemically synthesized
tagactgggcagcttaaaca

SEQ ID NO: 548250 - DNA, 20 bp, Artificial Sequence
  chemically synthesized
acttaaagcctccagaactg

SEQ ID NO: 548251 - DNA, 20 bp, Artificial Sequence
  chemically synthesized
tctgatccggtggcccgtgt

SEQ ID NO: 548252 - DNA, 20 bp, Artificial Sequence
  chemically synthesized
ataacaacaagtgaaggact

SEQ ID NO: 548253 - DNA, 20 bp, Artificial Sequence
  chemically synthesized
tcactttcatatagctcata

SEQ ID NO: 548254 - DNA, 20 bp, Artificial Sequence
  chemically synthesized
aaaggagagctgtagttgtt

SEQ ID NO: 548255 - DNA, 20 bp, Artificial Sequence
  chemically synthesized
gctggtgcccaagaatgctc

SEQ ID NO: 548256 - DNA, 20 bp, Artificial Sequence
  chemically synthesized
gtgtctgaccagctggtgcc

SEQ ID NO: 548257 - DNA, 20 bp, Artificial Sequence
  chemically synthesized
caggtgtatataaggcaata

SEQ ID NO: 548258 - DNA, 20 bp, Artificial Sequence
  chemically synthesized
aggcttccaggccttagcaa

SEQ ID NO: 548259 - DNA, 20 bp, Artificial Sequence
  chemically synthesized
attctctctaccaccctcaa

SEQ ID NO: 548260 - DNA, 20 bp, Artificial Sequence
  chemically synthesized
tttctaattgagggtggtag

SEQ ID NO: 548261 - DNA, 20 bp, Artificial Sequence
  chemically synthesized
ctcagccgaatatataaata

SEQ ID NO: 548262 - DNA, 20 bp, Artificial Sequence
  chemically synthesized
taatcttataattgttcata

SEQ ID NO: 548263 - DNA, 20 bp, Artificial Sequence
  chemically synthesized
atcacggctgtaatgactta

SEQ ID NO: 548264 - DNA, 20 bp, Artificial Sequence
  chemically synthesized
tctaagagcacagcctctga

SEQ ID NO: 548265 - DNA, 20 bp, Artificial Sequence
  chemically synthesized
tgtacacagctgtgcgatga

SEQ ID NO: 548266 - DNA, 20 bp, Artificial Sequence
  chemically synthesized
actttaacgcctttcatcat

SEQ ID NO: 548267 - DNA, 20 bp, Artificial Sequence
  chemically synthesized
aataaagcaaagagtcacat

SEQ ID NO: 548268 - DNA, 20 bp, Artificial Sequence
  chemically synthesized
acaggaataatgagaagtaa

SEQ ID NO: 548269 - DNA, 20 bp, Artificial Sequence
  chemically synthesized
cttgagggctaacctataga

SEQ ID NO: 548270 - DNA, 20 bp, Artificial Sequence
  chemically synthesized
cacttagttttcactgtgtt

SEQ ID NO: 548271 - DNA, 20 bp, Artificial Sequence
  chemically synthesized
cctcaatgtgaaaaccctca

SEQ ID NO: 548272 - DNA, 20 bp, Artificial Sequence
  chemically synthesized
aatgaattaagaaatttatc

SEQ ID NO: 548273 - DNA, 20 bp, Artificial Sequence
  chemically synthesized
taatattttttacaatgaat

SEQ ID NO: 548274 - DNA, 20 bp, Artificial Sequence
  chemically synthesized
tgaccaaaattttaatgttt

SEQ ID NO: 548275 - DNA, 20 bp, Artificial Sequence
  chemically synthesized
ggggaaatataaggaggagt

SEQ ID NO: 548276 - DNA, 20 bp, Artificial Sequence
  chemically synthesized
ttttcagataaagcacaggt

SEQ ID NO: 548277 - DNA, 20 bp, Artificial Sequence
  chemically synthesized
tgatttcaagttgctaaagc

SEQ ID NO: 548278 - DNA, 20 bp, Artificial Sequence
  chemically synthesized
tgattgcagagaataaagaa

SEQ ID NO: 548279 - DNA, 20 bp, Artificial Sequence
  chemically synthesized
ttgtattgattgcagagaat

SEQ ID NO: 548280 - DNA, 20 bp, Artificial Sequence
  chemically synthesized
acacattttgtattgattgc

SEQ ID NO: 548281 - DNA, 20 bp, Artificial Sequence
  chemically synthesized
ttccatttgctgcggaaagt

SEQ ID NO: 548282 - DNA, 20 bp, Artificial Sequence
  chemically synthesized
cgcagcaaatggaaacgtaa

SEQ ID NO: 548283 - DNA, 20 bp, Artificial Sequence
  chemically synthesized
ctgacatcccctttattttg

SEQ ID NO: 548284 - DNA, 20 bp, Artificial Sequence
  chemically synthesized
tagcatcacaaatcccatat

SEQ ID NO: 548285 - DNA, 20 bp, Artificial Sequence
  chemically synthesized
gagttttttccaccaaaagc

SEQ ID NO: 548286 - DNA, 20 bp, Artificial Sequence
  chemically synthesized
ctcagagcccaggaacttct

SEQ ID NO: 548287 - DNA, 20 bp, Artificial Sequence
  chemically synthesized
aattctttcctaggcaaagc

SEQ ID NO: 548288 - DNA, 20 bp, Artificial Sequence
  chemically synthesized
gattcttggctttgcctagg

SEQ ID NO: 548289 - DNA, 20 bp, Artificial Sequence
  chemically synthesized
cagaagttaccacccctttc

SEQ ID NO: 548290 - DNA, 20 bp, Artificial Sequence
  chemically synthesized
caacggaagtgagaaaaaca

SEQ ID NO: 548291 - DNA, 20 bp, Artificial Sequence
  chemically synthesized
caggcagcgaccaacggaag

SEQ ID NO: 548292 - DNA, 20 bp, Artificial Sequence
  chemically synthesized
ccattcccagaggataaagt

SEQ ID NO: 548293 - DNA, 20 bp, Artificial Sequence
  chemically synthesized
aactcctacctcaggcttgc

SEQ ID NO: 548294 - DNA, 20 bp, Artificial Sequence
  chemically synthesized
tttatttttcaagaggaact

SEQ ID NO: 548295 - DNA, 20 bp, Artificial Sequence
  chemically synthesized
tcagtctagcagtgtccatg

SEQ ID NO: 548296 - DNA, 20 bp, Artificial Sequence
  chemically synthesized
acggacattgtgtaaattgg

SEQ ID NO: 548297 - DNA, 20 bp, Artificial Sequence
  chemically synthesized
ttttaatttagtataatatc

SEQ ID NO: 548298 - DNA, 20 bp, Artificial Sequence
  chemically synthesized
gtgagccaccgcacccggcc

SEQ ID NO: 548299 - DNA, 20 bp, Artificial Sequence
  chemically synthesized
ctactcaggaggctgaggca

SEQ ID NO: 548300 - DNA, 20 bp, Artificial Sequence
  chemically synthesized
ccgtctcaaaaaaaaaaaaa

SEQ ID NO: 548301 - DNA, 20 bp, Artificial Sequence
  chemically synthesized
ctcaaaaaaaaaaaaaaaag

SEQ ID NO: 548302 - DNA, 20 bp, Artificial Sequence
  chemically synthesized
aaaaaaaaaaaaagaaagaa

SEQ ID NO: 548303 - DNA, 20 bp, Artificial Sequence
  chemically synthesized
aaaaaaagaaagaaaaagaa

SEQ ID NO: 548304 - DNA, 20 bp, Artificial Sequence
  chemically synthesized
aaagaaagaaaaagaaaaag

SEQ ID NO: 548305 - DNA, 20 bp, Artificial Sequence
  chemically synthesized
aaagaaaaagaaaaagaaag

SEQ ID NO: 548306 - DNA, 20 bp, Artificial Sequence
  chemically synthesized
tgtttgtacttaattctaat

SEQ ID NO: 548307 - DNA, 20 bp, Artificial Sequence
  chemically synthesized
agaatccataacattctgca

SEQ ID NO: 548308 - DNA, 20 bp, Artificial Sequence
  chemically synthesized
tatttataccagaaccaata

SEQ ID NO: 548309 - DNA, 20 bp, Artificial Sequence
  chemically synthesized
aagtcaaactcttactttac

SEQ ID NO: 548310 - DNA, 20 bp, Artificial Sequence
  chemically synthesized
agaggttttgttgataaaaa

SEQ ID NO: 548311 - DNA, 20 bp, Artificial Sequence
  chemically synthesized
tttgtaggagatcatagaga

SEQ ID NO: 548312 - DNA, 20 bp, Artificial Sequence
  chemically synthesized
caaaaatgaaaattgggaag

SEQ ID NO: 548313 - DNA, 20 bp, Artificial Sequence
  chemically synthesized
ttctcttaaagaaaaattga

SEQ ID NO: 548314 - DNA, 20 bp, Artificial Sequence
  chemically synthesized
agagtgagggcccttctctt

SEQ ID NO: 548315 - DNA, 20 bp, Artificial Sequence
  chemically synthesized
ggcagttgaatggcttgagc

SEQ ID NO: 548316 - DNA, 20 bp, Artificial Sequence
  chemically synthesized
ttcctcataatcacttcact

SEQ ID NO: 548317 - DNA, 20 bp, Artificial Sequence
  chemically synthesized
aatattgtattattatttat

SEQ ID NO: 548318 - DNA, 20 bp, Artificial Sequence
  chemically synthesized
gatgaaaatgcttgttatat

SEQ ID NO: 548319 - DNA, 20 bp, Artificial Sequence
  chemically synthesized
gtagtcagtggtatattttg

SEQ ID NO: 548320 - DNA, 20 bp, Artificial Sequence
  chemically synthesized
tatagttttgattatttata

SEQ ID NO: 548321 - DNA, 20 bp, Artificial Sequence
  chemically synthesized
tatattcttttccctttaaa

SEQ ID NO: 548322 - DNA, 20 bp, Artificial Sequence
  chemically synthesized
acaattcttttttaaaggga

SEQ ID NO: 548323 - DNA, 20 bp, Artificial Sequence
  chemically synthesized
aaagtgttgaaatttttaaa

SEQ ID NO: 548324 - DNA, 20 bp, Artificial Sequence
  chemically synthesized
ttgcttttgaaactgactga

SEQ ID NO: 548325 - DNA, 20 bp, Artificial Sequence
  chemically synthesized
aaacgctgaattacgatcat

SEQ ID NO: 548326 - DNA, 20 bp, Artificial Sequence
  chemically synthesized
atcatatagaaaattataaa

SEQ ID NO: 548327 - DNA, 20 bp, Artificial Sequence
  chemically synthesized
aatagcatatgtttttgtaa

SEQ ID NO: 548328 - DNA, 20 bp, Artificial Sequence
  chemically synthesized
aatctttgtattaatttttg

SEQ ID NO: 548329 - DNA, 20 bp, Artificial Sequence
  chemically synthesized
acacacacacacacacacac

SEQ ID NO: 548330 - DNA, 20 bp, Artificial Sequence
  chemically synthesized
tggacattttcttcactgac

SEQ ID NO: 548331 - DNA, 20 bp, Artificial Sequence
  chemically synthesized
aaaattttttctgagtcagt

SEQ ID NO: 548332 - DNA, 20 bp, Artificial Sequence
  chemically synthesized
aaagtgtttctatagttcca

SEQ ID NO: 548333 - DNA, 20 bp, Artificial Sequence
  chemically synthesized
cctcgctttctgctggaact

SEQ ID NO: 548334 - DNA, 20 bp, Artificial Sequence
  chemically synthesized
gcagaaagcgaggtgcatta

SEQ ID NO: 548335 - DNA, 20 bp, Artificial Sequence
  chemically synthesized
gaaaaatattcatgatatat

SEQ ID NO: 548336 - DNA, 20 bp, Artificial Sequence
  chemically synthesized
gtgttgctaatttccaaatt

SEQ ID NO: 548337 - DNA, 20 bp, Artificial Sequence
  chemically synthesized
acaagctttcatttctataa

SEQ ID NO: 548338 - DNA, 20 bp, Artificial Sequence
  chemically synthesized
atcttttgccatttcttttt

SEQ ID NO: 548339 - DNA, 20 bp, Artificial Sequence
  chemically synthesized
tccaggaagcagcatatata

SEQ ID NO: 548340 - DNA, 20 bp, Artificial Sequence
  chemically synthesized
aagcagcatatataggagaa

SEQ ID NO: 548341 - DNA, 20 bp, Artificial Sequence
  chemically synthesized
tttcttgacttgtttttaat

SEQ ID NO: 548342 - DNA, 20 bp, Artificial Sequence
  chemically synthesized
tttctaaattaaaaacaagt

SEQ ID NO: 548343 - DNA, 20 bp, Artificial Sequence
  chemically synthesized
aaaacaagtcaagaaactat

SEQ ID NO: 548344 - DNA, 20 bp, Artificial Sequence
  chemically synthesized
ctactcaggaggctgaggca

SEQ ID NO: 548345 - DNA, 20 bp, Artificial Sequence
  chemically synthesized
tcaaaaaaaaaaaaaaaaaa

SEQ ID NO: 548346 - DNA, 20 bp, Artificial Sequence
  chemically synthesized
aaaaaaaaaaaagaaactaa

SEQ ID NO: 548347 - DNA, 20 bp, Artificial Sequence
  chemically synthesized
ataaaaatcataactcttca

SEQ ID NO: 548348 - DNA, 20 bp, Artificial Sequence
  chemically synthesized
gggactgggagtgagcattt

SEQ ID NO: 548349 - DNA, 20 bp, Artificial Sequence
  chemically synthesized
tccacccaagataaattaaa

SEQ ID NO: 548350 - DNA, 20 bp, Artificial Sequence
  chemically synthesized
atattataatgataatatca

SEQ ID NO: 548351 - DNA, 20 bp, Artificial Sequence
  chemically synthesized
gaaataataatagctgcacc

SEQ ID NO: 548352 - DNA, 20 bp, Artificial Sequence
  chemically synthesized
ggaaaggtgtagcttggctt

SEQ ID NO: 548353 - DNA, 20 bp, Artificial Sequence
  chemically synthesized
tctctatatattttatattt

SEQ ID NO: 548354 - DNA, 20 bp, Artificial Sequence
  chemically synthesized
tcttaaaatataaaatatat

SEQ ID NO: 548355 - DNA, 20 bp, Artificial Sequence
  chemically synthesized
ttatttggcccactaaatgt

SEQ ID NO: 548356 - DNA, 20 bp, Artificial Sequence
  chemically synthesized
ctaaatgtttagaaatagca

SEQ ID NO: 548357 - DNA, 20 bp, Artificial Sequence
  chemically synthesized
aaaattcaagaaggttttga

SEQ ID NO: 548358 - DNA, 20 bp, Artificial Sequence
  chemically synthesized
actccatctccaaaaaaaga

SEQ ID NO: 548359 - DNA, 20 bp, Artificial Sequence
  chemically synthesized
gcgagactccatctccaaaa

SEQ ID NO: 548360 - DNA, 20 bp, Artificial Sequence
  chemically synthesized
ctacttgggaggctgaggca

SEQ ID NO: 548361 - DNA, 20 bp, Artificial Sequence
  chemically synthesized
ttgtctcgttgctcaaaaag

SEQ ID NO: 548362 - DNA, 20 bp, Artificial Sequence
  chemically synthesized
ctcaaaaagtaagaaaaata

SEQ ID NO: 548363 - DNA, 20 bp, Artificial Sequence
  chemically synthesized
gtcccaatatagggatgtgt

SEQ ID NO: 548364 - DNA, 20 bp, Artificial Sequence
  chemically synthesized
gggaccatatgaccttccac

SEQ ID NO: 548365 - DNA, 20 bp, Artificial Sequence
  chemically synthesized
aaattttacattattttgcg

SEQ ID NO: 548366 - DNA, 20 bp, Artificial Sequence
  chemically synthesized
tgagaacttaattgctcaca

SEQ ID NO: 548367 - DNA, 20 bp, Artificial Sequence
  chemically synthesized
gctagactaatccccttagc

SEQ ID NO: 548368 - DNA, 20 bp, Artificial Sequence
  chemically synthesized
gaaattgttcaaattatttt

SEQ ID NO: 548369 - DNA, 20 bp, Artificial Sequence
  chemically synthesized
ttaccataaaaagacatggt

SEQ ID NO: 548370 - DNA, 20 bp, Artificial Sequence
  chemically synthesized
atgctaagacccaaagaatg

SEQ ID NO: 548371 - DNA, 20 bp, Artificial Sequence
  chemically synthesized
tggtgtttatgctaagaccc

SEQ ID NO: 548372 - DNA, 20 bp, Artificial Sequence
  chemically synthesized
aatctcagtagcaccaagat

SEQ ID NO: 548373 - DNA, 20 bp, Artificial Sequence
  chemically synthesized
tcaggtcaacccaccataat

SEQ ID NO: 548374 - DNA, 20 bp, Artificial Sequence
  chemically synthesized
acggcaaaaccacccagagt

SEQ ID NO: 548375 - DNA, 20 bp, Artificial Sequence
  chemically synthesized
atgaataactgtctgattgc

SEQ ID NO: 548376 - DNA, 20 bp, Artificial Sequence
  chemically synthesized
ggatggtgctacaccattaa

SEQ ID NO: 548377 - DNA, 20 bp, Artificial Sequence
  chemically synthesized
cctgacactggataatttat

SEQ ID NO: 548378 - DNA, 20 bp, Artificial Sequence
  chemically synthesized
gtccattctggcattgctgt

SEQ ID NO: 548379 - DNA, 20 bp, Artificial Sequence
  chemically synthesized
ggtatttctttacagcaatg

SEQ ID NO: 548380 - DNA, 20 bp, Artificial Sequence
  chemically synthesized
aggtttggaatttactcttg

SEQ ID NO: 548381 - DNA, 20 bp, Artificial Sequence
  chemically synthesized
tcagcatttggagcaacctt

SEQ ID NO: 548382 - DNA, 20 bp, Artificial Sequence
  chemically synthesized
ttcatgatcataatatttat

SEQ ID NO: 548383 - DNA, 20 bp, Artificial Sequence
  chemically synthesized
ttatgatcatgaacaatata

SEQ ID NO: 548384 - DNA, 20 bp, Artificial Sequence
  chemically synthesized
actatgatatcatccaaatt

SEQ ID NO: 548385 - DNA, 20 bp, Artificial Sequence
  chemically synthesized
ttttctcatgaatttacact

SEQ ID NO: 548386 - DNA, 20 bp, Artificial Sequence
  chemically synthesized
cattctatagtgtaaattca

SEQ ID NO: 548387 - DNA, 20 bp, Artificial Sequence
  chemically synthesized
caatgaaatgaacatcacag

SEQ ID NO: 548388 - DNA, 20 bp, Artificial Sequence
  chemically synthesized
aaaatcaatatgataagttt

SEQ ID NO: 548389 - DNA, 20 bp, Artificial Sequence
  chemically synthesized
aagggaaggagattatgaga

SEQ ID NO: 548390 - DNA, 20 bp, Artificial Sequence
  chemically synthesized
atatgaagggaaggagatta

SEQ ID NO: 548391 - DNA, 20 bp, Artificial Sequence
  chemically synthesized
catacagttctacgaggaaa

SEQ ID NO: 548392 - DNA, 20 bp, Artificial Sequence
  chemically synthesized
ttgaattaatcactaatagg

SEQ ID NO: 548393 - DNA, 20 bp, Artificial Sequence
  chemically synthesized
gaattctgatgattttgaag

SEQ ID NO: 548394 - DNA, 20 bp, Artificial Sequence
  chemically synthesized
attttcttccttcaaaatca

SEQ ID NO: 548395 - DNA, 20 bp, Artificial Sequence
  chemically synthesized
ttatgaaatacaaagcttta

SEQ ID NO: 548396 - DNA, 20 bp, Artificial Sequence
  chemically synthesized
aaagacagtttctcaacatt

SEQ ID NO: 548397 - DNA, 20 bp, Artificial Sequence
  chemically synthesized
attgaattattcttgaatgt

SEQ ID NO: 548398 - DNA, 20 bp, Artificial Sequence
  chemically synthesized
gtttattttgctaaaataag

SEQ ID NO: 548399 - DNA, 20 bp, Artificial Sequence
  chemically synthesized
cccaaatccctctctacctc

SEQ ID NO: 548400 - DNA, 20 bp, Artificial Sequence
  chemically synthesized
attctcctttcaaaaagtta

SEQ ID NO: 548401 - DNA, 20 bp, Artificial Sequence
  chemically synthesized
tttctgctaactttttgaaa

SEQ ID NO: 548402 - DNA, 20 bp, Artificial Sequence
  chemically synthesized
tagaacaggagattaaaata

SEQ ID NO: 548403 - DNA, 20 bp, Artificial Sequence
  chemically synthesized
atttgattttgaaaagtagg

SEQ ID NO: 548404 - DNA, 20 bp, Artificial Sequence
  chemically synthesized
atctaaagtctcatgagaag

SEQ ID NO: 548405 - DNA, 20 bp, Artificial Sequence
  chemically synthesized
ttagatctaaagtctcatga

SEQ ID NO: 548406 - DNA, 20 bp, Artificial Sequence
  chemically synthesized
attcagatgtcaaagtattt

SEQ ID NO: 548407 - DNA, 20 bp, Artificial Sequence
  chemically synthesized
aggttgatatttgctacata

SEQ ID NO: 548408 - DNA, 20 bp, Artificial Sequence
  chemically synthesized
acataagagaaagatgtgtt

SEQ ID NO: 548409 - DNA, 20 bp, Artificial Sequence
  chemically synthesized
acaagactacataatccttt

SEQ ID NO: 548410 - DNA, 20 bp, Artificial Sequence
  chemically synthesized
cctgagtataactatggtac

SEQ ID NO: 548411 - DNA, 20 bp, Artificial Sequence
  chemically synthesized
agtataactatggtactaag

SEQ ID NO: 548412 - DNA, 20 bp, Artificial Sequence
  chemically synthesized
aggtaggatttatctgccat

SEQ ID NO: 548413 - DNA, 20 bp, Artificial Sequence
  chemically synthesized
taaagaatagttcactgcta

SEQ ID NO: 548414 - DNA, 20 bp, Artificial Sequence
  chemically synthesized
actgctataagaatttctta

SEQ ID NO: 548415 - DNA, 20 bp, Artificial Sequence
  chemically synthesized
ttatccagtagagtttcttg

SEQ ID NO: 548416 - DNA, 20 bp, Artificial Sequence
  chemically synthesized
tctagattgtgaactcatcc

SEQ ID NO: 548417 - DNA, 20 bp, Artificial Sequence
  chemically synthesized
ttgactctctactgttactt

SEQ ID NO: 548418 - DNA, 20 bp, Artificial Sequence
  chemically synthesized
acagactaagctgagacttg

SEQ ID NO: 548419 - DNA, 20 bp, Artificial Sequence
  chemically synthesized
catgttgcagagtactatgg

SEQ ID NO: 548420 - DNA, 20 bp, Artificial Sequence
  chemically synthesized
atgctgaatccacggttttt

SEQ ID NO: 548421 - DNA, 20 bp, Artificial Sequence
  chemically synthesized
aaagcagtacacacatccag

SEQ ID NO: 548422 - DNA, 20 bp, Artificial Sequence
  chemically synthesized
atcattaattgtgcaaaagt

SEQ ID NO: 548423 - DNA, 20 bp, Artificial Sequence
  chemically synthesized
gctttcttagttaaaaatag

SEQ ID NO: 548424 - DNA, 20 bp, Artificial Sequence
  chemically synthesized
acattcttactatttttaac

SEQ ID NO: 548425 - DNA, 20 bp, Artificial Sequence
  chemically synthesized
atggggtggatggcaggatt

SEQ ID NO: 548426 - DNA, 20 bp, Artificial Sequence
  chemically synthesized
gtaaaccaaaattccaaatg

SEQ ID NO: 548427 - DNA, 20 bp, Artificial Sequence
  chemically synthesized
acatagacaggacacattga

SEQ ID NO: 548428 - DNA, 20 bp, Artificial Sequence
  chemically synthesized
aggacacattgatcagaaaa

SEQ ID NO: 548429 - DNA, 20 bp, Artificial Sequence
  chemically synthesized
tatgtcagggattagaaatt

SEQ ID NO: 548430 - DNA, 20 bp, Artificial Sequence
  chemically synthesized
tgatacatttatgtcaggga

SEQ ID NO: 548431 - DNA, 20 bp, Artificial Sequence
  chemically synthesized
caaaatcacacaataattta

SEQ ID NO: 548432 - DNA, 20 bp, Artificial Sequence
  chemically synthesized
cacacaataatttaatagaa

SEQ ID NO: 548433 - DNA, 20 bp, Artificial Sequence
  chemically synthesized
taattctaaccctaaatcat

SEQ ID NO: 548434 - DNA, 20 bp, Artificial Sequence
  chemically synthesized
attttcttgatgatttaggg

SEQ ID NO: 548435 - DNA, 20 bp, Artificial Sequence
  chemically synthesized
gtacatgtggatgttcaccc

SEQ ID NO: 548436 - DNA, 20 bp, Artificial Sequence
  chemically synthesized
atctaaaaaaaataaaagaa

SEQ ID NO: 548437 - DNA, 20 bp, Artificial Sequence
  chemically synthesized
gactctatctaaaaaaaata

SEQ ID NO: 548438 - DNA, 20 bp, Artificial Sequence
  chemically synthesized
ggcaggagaatcgcttggca

SEQ ID NO: 548439 - DNA, 20 bp, Artificial Sequence
  chemically synthesized
ctactcaggaggctgaggca

SEQ ID NO: 548440 - DNA, 20 bp, Artificial Sequence
  chemically synthesized
tctctactaaaaatgcacac

SEQ ID NO: 548441 - DNA, 20 bp, Artificial Sequence
  chemically synthesized
ccgccctagaacacactttc

SEQ ID NO: 548442 - DNA, 20 bp, Artificial Sequence
  chemically synthesized
aaagatattttgaaactttc

SEQ ID NO: 548443 - DNA, 20 bp, Artificial Sequence
  chemically synthesized
agaaagaaagatactacttg

SEQ ID NO: 548444 - DNA, 20 bp, Artificial Sequence
  chemically synthesized
taagacatggctttgtggag

SEQ ID NO: 548445 - DNA, 20 bp, Artificial Sequence
  chemically synthesized
gctctaagacatggctttgt

SEQ ID NO: 548446 - DNA, 20 bp, Artificial Sequence
  chemically synthesized
tgggtattaaaccagtatga

SEQ ID NO: 548447 - DNA, 20 bp, Artificial Sequence
  chemically synthesized
ttctcaaggcatgatatagc

SEQ ID NO: 548448 - DNA, 20 bp, Artificial Sequence
  chemically synthesized
caataaaggattcagaggtt

SEQ ID NO: 548449 - DNA, 20 bp, Artificial Sequence
  chemically synthesized
tacagagtttaatgtgaaag

SEQ ID NO: 548450 - DNA, 20 bp, Artificial Sequence
  chemically synthesized
ttttaaatgcagacaattgt

SEQ ID NO: 548451 - DNA, 20 bp, Artificial Sequence
  chemically synthesized
aattcaaagtaaatccacag

SEQ ID NO: 548452 - DNA, 20 bp, Artificial Sequence
  chemically synthesized
aagtttgacattgtcaagtg

SEQ ID NO: 548453 - DNA, 20 bp, Artificial Sequence
  chemically synthesized
gtgttagaatttgggagcaa

SEQ ID NO: 548454 - DNA, 20 bp, Artificial Sequence
  chemically synthesized
aagcagaatttttaagttcg

SEQ ID NO: 548455 - DNA, 20 bp, Artificial Sequence
  chemically synthesized
tttggcataatcttggaaac

SEQ ID NO: 548456 - DNA, 20 bp, Artificial Sequence
  chemically synthesized
ttagaaatacatcatgtcag

SEQ ID NO: 548457 - DNA, 20 bp, Artificial Sequence
  chemically synthesized
aaagtcatttgatatttaaa

SEQ ID NO: 548458 - DNA, 20 bp, Artificial Sequence
  chemically synthesized
taaatcagaaagcttaaatt

SEQ ID NO: 548459 - DNA, 20 bp, Artificial Sequence
  chemically synthesized
gaaccttgtttgtaatagga

SEQ ID NO: 548460 - DNA, 20 bp, Artificial Sequence
  chemically synthesized
gcattatgtcatattccgtc

SEQ ID NO: 548461 - DNA, 20 bp, Artificial Sequence
  chemically synthesized
tagcaacataatgctgattg

SEQ ID NO: 548462 - DNA, 20 bp, Artificial Sequence
  chemically synthesized
gattgaaagaaacagtcaca

SEQ ID NO: 548463 - DNA, 20 bp, Artificial Sequence
  chemically synthesized
catatatatgtattactaaa

SEQ ID NO: 548464 - DNA, 20 bp, Artificial Sequence
  chemically synthesized
agtataacaacatcaaccta

SEQ ID NO: 548465 - DNA, 20 bp, Artificial Sequence
  chemically synthesized
taaaccctcatcttttagtg

SEQ ID NO: 548466 - DNA, 20 bp, Artificial Sequence
  chemically synthesized
atatatataactagaagctt

SEQ ID NO: 548467 - DNA, 20 bp, Artificial Sequence
  chemically synthesized
gtcagtcactttgcaacttt

SEQ ID NO: 548468 - DNA, 20 bp, Artificial Sequence
  chemically synthesized
tcacgactttgtccaaagtt

SEQ ID NO: 548469 - DNA, 20 bp, Artificial Sequence
  chemically synthesized
aggaggggacctgatgtccc

SEQ ID NO: 548470 - DNA, 20 bp, Artificial Sequence
  chemically synthesized
gtactcataattgtccctct

SEQ ID NO: 548471 - DNA, 20 bp, Artificial Sequence
  chemically synthesized
agacccctctgaggaatgct

SEQ ID NO: 548472 - DNA, 20 bp, Artificial Sequence
  chemically synthesized
tcgcctcaggcttagctttt

SEQ ID NO: 548473 - DNA, 20 bp, Artificial Sequence
  chemically synthesized
ctaagcatccccctgagagg

SEQ ID NO: 548474 - DNA, 20 bp, Artificial Sequence
  chemically synthesized
aatgaacacagactgcagag

SEQ ID NO: 548475 - DNA, 20 bp, Artificial Sequence
  chemically synthesized
gaccctcaggttagagacac

SEQ ID NO: 548476 - DNA, 20 bp, Artificial Sequence
  chemically synthesized
tttaaaacagcaataaagtc

SEQ ID NO: 548477 - DNA, 20 bp, Artificial Sequence
  chemically synthesized
gcaagagtactaagcgactc

SEQ ID NO: 548478 - DNA, 20 bp, Artificial Sequence
  chemically synthesized
atttgcaaaaggaaacatga

SEQ ID NO: 548479 - DNA, 20 bp, Artificial Sequence
  chemically synthesized
aacctgattacatagtagtc

SEQ ID NO: 548480 - DNA, 20 bp, Artificial Sequence
  chemically synthesized
cctcatgcatcatcccatcc

SEQ ID NO: 548481 - DNA, 20 bp, Artificial Sequence
  chemically synthesized
gtccccattttttttttgga

SEQ ID NO: 548482 - DNA, 20 bp, Artificial Sequence
  chemically synthesized
atatccagtaattagtgtag

SEQ ID NO: 548483 - DNA, 20 bp, Artificial Sequence
  chemically synthesized
cttaaccaccaactgaagga

SEQ ID NO: 548484 - DNA, 20 bp, Artificial Sequence
  chemically synthesized
agcaaaatattaaaatttta

SEQ ID NO: 548485 - DNA, 20 bp, Artificial Sequence
  chemically synthesized
gtaagcggtcgcctaaaaat

SEQ ID NO: 548486 - DNA, 20 bp, Artificial Sequence
  chemically synthesized
tacctcctccccttcctctc

SEQ ID NO: 548487 - DNA, 20 bp, Artificial Sequence
  chemically synthesized
ttccccttttgaacttaagg

SEQ ID NO: 548488 - DNA, 20 bp, Artificial Sequence
  chemically synthesized
agaatacttactccatgaaa

SEQ ID NO: 548489 - DNA, 20 bp, Artificial Sequence
  chemically synthesized
attcttccacataatgggaa

SEQ ID NO: 548490 - DNA, 20 bp, Artificial Sequence
  chemically synthesized
attcttattcccattatgtg

SEQ ID NO: 548491 - DNA, 20 bp, Artificial Sequence
  chemically synthesized
ctcagtttttaatacatgaa

SEQ ID NO: 548492 - DNA, 20 bp, Artificial Sequence
  chemically synthesized
catgtattaaaaactgaggc

SEQ ID NO: 548493 - DNA, 20 bp, Artificial Sequence
  chemically synthesized
tacaaaatacccatgaagtt

SEQ ID NO: 548494 - DNA, 20 bp, Artificial Sequence
  chemically synthesized
gcccagtcaaaagaggttga

SEQ ID NO: 548495 - DNA, 20 bp, Artificial Sequence
  chemically synthesized
ctaatagctgtgaccacctc

SEQ ID NO: 548496 - DNA, 20 bp, Artificial Sequence
  chemically synthesized
atgaaataaaatattattat

SEQ ID NO: 548497 - DNA, 20 bp, Artificial Sequence
  chemically synthesized
tcagcattttaattgtgtta

SEQ ID NO: 548498 - DNA, 20 bp, Artificial Sequence
  chemically synthesized
atatttctagttacccttcg

SEQ ID NO: 548499 - DNA, 20 bp, Artificial Sequence
  chemically synthesized
tatattctgacgaagggtaa

SEQ ID NO: 548500 - DNA, 20 bp, Artificial Sequence
  chemically synthesized
cacacctgactcaatttaga

SEQ ID NO: 548501 - DNA, 20 bp, Artificial Sequence
  chemically synthesized
ttactacttgattccaatgt

SEQ ID NO: 548502 - DNA, 20 bp, Artificial Sequence
  chemically synthesized
acttgattccaatgtccaga

SEQ ID NO: 548503 - DNA, 20 bp, Artificial Sequence
  chemically synthesized
tatataccttactaaaaccc

SEQ ID NO: 548504 - DNA, 20 bp, Artificial Sequence
  chemically synthesized
tttactgttgtcataagcat

SEQ ID NO: 548505 - DNA, 20 bp, Artificial Sequence
  chemically synthesized
gtttattatactaccatata

SEQ ID NO: 548506 - DNA, 20 bp, Artificial Sequence
  chemically synthesized
tatatttcaaaatagctaga

SEQ ID NO: 548507 - DNA, 20 bp, Artificial Sequence
  chemically synthesized
aattataatgatcccatcac

SEQ ID NO: 548508 - DNA, 20 bp, Artificial Sequence
  chemically synthesized
tgagaactcactcactatca

SEQ ID NO: 548509 - DNA, 20 bp, Artificial Sequence
  chemically synthesized
cctgagactgggtgatttat

SEQ ID NO: 548510 - DNA, 20 bp, Artificial Sequence
  chemically synthesized
aagtgacaatatagagttag

SEQ ID NO: 548511 - DNA, 20 bp, Artificial Sequence
  chemically synthesized
tcttctggctctattcagaa

SEQ ID NO: 548512 - DNA, 20 bp, Artificial Sequence
  chemically synthesized
tgaataaatcctcctcattt

SEQ ID NO: 548513 - DNA, 20 bp, Artificial Sequence
  chemically synthesized
gcttcatttttcagagtcat

SEQ ID NO: 548514 - DNA, 20 bp, Artificial Sequence
  chemically synthesized
aactcaataacattcatctg

SEQ ID NO: 548515 - DNA, 20 bp, Artificial Sequence
  chemically synthesized
tctgctagaaaaaaaaaaaa

SEQ ID NO: 548516 - DNA, 20 bp, Artificial Sequence
  chemically synthesized
ctagaaaaaaaaaaaaaaag

SEQ ID NO: 548517 - DNA, 20 bp, Artificial Sequence
  chemically synthesized
gaaagcattttaaatctgtt

SEQ ID NO: 548518 - DNA, 20 bp, Artificial Sequence
  chemically synthesized
tgaaacatttttaatgctat

SEQ ID NO: 548519 - DNA, 20 bp, Artificial Sequence
  chemically synthesized
aggttcttacaggtgctaca

SEQ ID NO: 548520 - DNA, 20 bp, Artificial Sequence
  chemically synthesized
agggagactaattccacctc

SEQ ID NO: 548521 - DNA, 20 bp, Artificial Sequence
  chemically synthesized
cgttcaaaagcttggtaggt

SEQ ID NO: 548522 - DNA, 20 bp, Artificial Sequence
  chemically synthesized
atcaaaatcaggaagtccag

SEQ ID NO: 548523 - DNA, 20 bp, Artificial Sequence
  chemically synthesized
acaaatcgggactgaattca

SEQ ID NO: 548524 - DNA, 20 bp, Artificial Sequence
  chemically synthesized
ttatattttatttactcttc

SEQ ID NO: 548525 - DNA, 20 bp, Artificial Sequence
  chemically synthesized
aaatatagaaaagtagatga

SEQ ID NO: 548526 - DNA, 20 bp, Artificial Sequence
  chemically synthesized
tatttggtgatgaagaaaat

SEQ ID NO: 548527 - DNA, 20 bp, Artificial Sequence
  chemically synthesized
gactgcctgtatttggtgat

SEQ ID NO: 548528 - DNA, 20 bp, Artificial Sequence
  chemically synthesized
atatatagttatatatctcc

SEQ ID NO: 548529 - DNA, 20 bp, Artificial Sequence
  chemically synthesized
aaattaaattaattgagatc

SEQ ID NO: 548530 - DNA, 20 bp, Artificial Sequence
  chemically synthesized
atatattattatattttaac

SEQ ID NO: 548531 - DNA, 20 bp, Artificial Sequence
  chemically synthesized
gatagataaatgtaaagctg

SEQ ID NO: 548532 - DNA, 20 bp, Artificial Sequence
  chemically synthesized
tgcaaatgaatttcacagac

SEQ ID NO: 548533 - DNA, 20 bp, Artificial Sequence
  chemically synthesized
agagaaagagatgggaggga

SEQ ID NO: 548534 - DNA, 20 bp, Artificial Sequence
  chemically synthesized
agagggtaggagagaagaag

SEQ ID NO: 548535 - DNA, 20 bp, Artificial Sequence
  chemically synthesized
ttgaatttttgataaacaca

SEQ ID NO: 548536 - DNA, 20 bp, Artificial Sequence
  chemically synthesized
ccaatataataagtgttatt

SEQ ID NO: 548537 - DNA, 20 bp, Artificial Sequence
  chemically synthesized
gaaataaacaagatgttcag

SEQ ID NO: 548538 - DNA, 20 bp, Artificial Sequence
  chemically synthesized
aaggcatttttaaatatggt

SEQ ID NO: 548539 - DNA, 20 bp, Artificial Sequence
  chemically synthesized
catacatttatttacactat

SEQ ID NO: 548540 - DNA, 20 bp, Artificial Sequence
  chemically synthesized
gaaccagtctctaggtggta

SEQ ID NO: 548541 - DNA, 20 bp, Artificial Sequence
  chemically synthesized
gaaggaatattataacttgc

SEQ ID NO: 548542 - DNA, 20 bp, Artificial Sequence
  chemically synthesized
ataacttgcaaagaaaacga

SEQ ID NO: 548543 - DNA, 20 bp, Artificial Sequence
  chemically synthesized
aaagaaaacgaacagaattc

SEQ ID NO: 548544 - DNA, 20 bp, Artificial Sequence
  chemically synthesized
gtatgtacagcagatatctg

SEQ ID NO: 548545 - DNA, 20 bp, Artificial Sequence
  chemically synthesized
gcagatatctgaaagaatac

SEQ ID NO: 548546 - DNA, 20 bp, Artificial Sequence
  chemically synthesized
ggaggctagctaacataata

SEQ ID NO: 548547 - DNA, 20 bp, Artificial Sequence
  chemically synthesized
gtaaacaaaaaagaacgcat

SEQ ID NO: 548548 - DNA, 20 bp, Artificial Sequence
  chemically synthesized
taacactaaaaatattttac

SEQ ID NO: 548549 - DNA, 20 bp, Artificial Sequence
  chemically synthesized
tcattgtaaatttagggata

SEQ ID NO: 548550 - DNA, 20 bp, Artificial Sequence
  chemically synthesized
atccctaaatttacaatgaa

SEQ ID NO: 548551 - DNA, 20 bp, Artificial Sequence
  chemically synthesized
cagggctttcaaacctatct

SEQ ID NO: 548552 - DNA, 20 bp, Artificial Sequence
  chemically synthesized
tttcatacttgaaagggaca

SEQ ID NO: 548553 - DNA, 20 bp, Artificial Sequence
  chemically synthesized
gtatacattgaaggaaatta

SEQ ID NO: 548554 - DNA, 20 bp, Artificial Sequence
  chemically synthesized
ctttcttgtttgttagcttt

SEQ ID NO: 548555 - DNA, 20 bp, Artificial Sequence
  chemically synthesized
tattctcaaaagctaacaaa

SEQ ID NO: 548556 - DNA, 20 bp, Artificial Sequence
  chemically synthesized
gtgtttacttagaggagtct

SEQ ID NO: 548557 - DNA, 20 bp, Artificial Sequence
  chemically synthesized
tctaggttgtgtgctcctta

SEQ ID NO: 548558 - DNA, 20 bp, Artificial Sequence
  chemically synthesized
caatagggttctcgctccta

SEQ ID NO: 548559 - DNA, 20 bp, Artificial Sequence
  chemically synthesized
accaatcggtccgtgacctg

SEQ ID NO: 548560 - DNA, 20 bp, Artificial Sequence
  chemically synthesized
aataaaaatctagaacagtt

SEQ ID NO: 548561 - DNA, 20 bp, Artificial Sequence
  chemically synthesized
atactacaaccattttactg

SEQ ID NO: 548562 - DNA, 20 bp, Artificial Sequence
  chemically synthesized
tatatttttcctatatttta

SEQ ID NO: 548563 - DNA, 20 bp, Artificial Sequence
  chemically synthesized
tttaacagaaattcttcttg

SEQ ID NO: 548564 - DNA, 20 bp, Artificial Sequence
  chemically synthesized
gaattctatgtttctctcaa

SEQ ID NO: 548565 - DNA, 20 bp, Artificial Sequence
  chemically synthesized
aaattcttcttgagagaaac

SEQ ID NO: 548566 - DNA, 20 bp, Artificial Sequence
  chemically synthesized
aatgtctataaataggagac

SEQ ID NO: 548567 - DNA, 20 bp, Artificial Sequence
  chemically synthesized
ttgcacaaccacttttaccg

SEQ ID NO: 548568 - DNA, 20 bp, Artificial Sequence
  chemically synthesized
ctactcggtaggctgaggtg

SEQ ID NO: 548569 - DNA, 20 bp, Artificial Sequence
  chemically synthesized
tctttttacatcaccactac

SEQ ID NO: 548570 - DNA, 20 bp, Artificial Sequence
  chemically synthesized
acaatccctgaaaaacctat

SEQ ID NO: 548571 - DNA, 20 bp, Artificial Sequence
  chemically synthesized
attaggaaaagatacccaag

SEQ ID NO: 548572 - DNA, 20 bp, Artificial Sequence
  chemically synthesized
atagattatcacttttaatt

SEQ ID NO: 548573 - DNA, 20 bp, Artificial Sequence
  chemically synthesized
attatagaaaatgaagcttt

SEQ ID NO: 548574 - DNA, 20 bp, Artificial Sequence
  chemically synthesized
aggaaatgccacgataaaaa

SEQ ID NO: 548575 - DNA, 20 bp, Artificial Sequence
  chemically synthesized
aatagaatcttttgtaagca

SEQ ID NO: 548576 - DNA, 20 bp, Artificial Sequence
  chemically synthesized
tggtttgtttttcaatatca

SEQ ID NO: 548577 - DNA, 20 bp, Artificial Sequence
  chemically synthesized
tgagtctcaattttatgaaa

SEQ ID NO: 548578 - DNA, 20 bp, Artificial Sequence
  chemically synthesized
caattttatgaaataagaaa

SEQ ID NO: 548579 - DNA, 20 bp, Artificial Sequence
  chemically synthesized
cctgtctccacgaaaaataa

SEQ ID NO: 548580 - DNA, 20 bp, Artificial Sequence
  chemically synthesized
ctactcaggaggtgcaggtg

SEQ ID NO: 548581 - DNA, 20 bp, Artificial Sequence
  chemically synthesized
aagctaataaattccatcac

SEQ ID NO: 548582 - DNA, 20 bp, Artificial Sequence
  chemically synthesized
tattttctcactctttcaga

SEQ ID NO: 548583 - DNA, 20 bp, Artificial Sequence
  chemically synthesized
gattttctcctctgaaagag

SEQ ID NO: 548584 - DNA, 20 bp, Artificial Sequence
  chemically synthesized
aaagagtgagaaaatattct

SEQ ID NO: 548585 - DNA, 20 bp, Artificial Sequence
  chemically synthesized
ttgtaatgtaaactgtttct

SEQ ID NO: 548586 - DNA, 20 bp, Artificial Sequence
  chemically synthesized
acttcagcagtaggtcagca

SEQ ID NO: 548587 - DNA, 20 bp, Artificial Sequence
  chemically synthesized
agtagaatcctcatatcccc

SEQ ID NO: 548588 - DNA, 20 bp, Artificial Sequence
  chemically synthesized
tttttttttttttttttttt

SEQ ID NO: 548589 - DNA, 20 bp, Artificial Sequence
  chemically synthesized
aagttccttggaggatacta

SEQ ID NO: 548590 - DNA, 20 bp, Artificial Sequence
  chemically synthesized
agtatcctccaaggaacttt

SEQ ID NO: 548591 - DNA, 20 bp, Artificial Sequence
  chemically synthesized
aggcactgctaaaaaggctt

SEQ ID NO: 548592 - DNA, 20 bp, Artificial Sequence
  chemically synthesized
ctactaaacgttataatctt

SEQ ID NO: 548593 - DNA, 20 bp, Artificial Sequence
  chemically synthesized
tccatactcaatttaaagat

SEQ ID NO: 548594 - DNA, 20 bp, Artificial Sequence
  chemically synthesized
cattactgagtatgtatccc

SEQ ID NO: 548595 - DNA, 20 bp, Artificial Sequence
  chemically synthesized
aatataattcagacatgaaa

SEQ ID NO: 548596 - DNA, 20 bp, Artificial Sequence
  chemically synthesized
ctaagtgcaataagccaggc

SEQ ID NO: 548597 - DNA, 20 bp, Artificial Sequence
  chemically synthesized
tgggctcatagaagtagaga

SEQ ID NO: 548598 - DNA, 20 bp, Artificial Sequence
  chemically synthesized
ggcttgcagagatattgatc

SEQ ID NO: 548599 - DNA, 20 bp, Artificial Sequence
  chemically synthesized
tacaaaatttcatttagaca

SEQ ID NO: 548600 - DNA, 20 bp, Artificial Sequence
  chemically synthesized
tacattgttatgaaccacct

SEQ ID NO: 548601 - DNA, 20 bp, Artificial Sequence
  chemically synthesized
ctactcaggaggctgaggca

SEQ ID NO: 548602 - DNA, 20 bp, Artificial Sequence
  chemically synthesized
taaatagttaattttaatgg

SEQ ID NO: 548603 - DNA, 20 bp, Artificial Sequence
  chemically synthesized
actgggaaggtatgcctgtg

SEQ ID NO: 548604 - DNA, 20 bp, Artificial Sequence
  chemically synthesized
gatttggacagaagggaatg

SEQ ID NO: 548605 - DNA, 20 bp, Artificial Sequence
  chemically synthesized
atttgtttattgccttatag

SEQ ID NO: 548606 - DNA, 20 bp, Artificial Sequence
  chemically synthesized
aaaaaaaaaaaaaaaaaaag

SEQ ID NO: 548607 - DNA, 20 bp, Artificial Sequence
  chemically synthesized
aaaaaaaaaaaaaaaaaaaa

SEQ ID NO: 548608 - DNA, 20 bp, Artificial Sequence
  chemically synthesized
aagaccagcctgaccaacat

SEQ ID NO: 548609 - DNA, 20 bp, Artificial Sequence
  chemically synthesized
tgtctgtgtttagtaagata

SEQ ID NO: 548610 - DNA, 20 bp, Artificial Sequence
  chemically synthesized
actaaacacagacaaatgat

SEQ ID NO: 548611 - DNA, 20 bp, Artificial Sequence
  chemically synthesized
aaatttttagaaagattaat

SEQ ID NO: 548612 - DNA, 20 bp, Artificial Sequence
  chemically synthesized
aagaacataagagcaaattt

SEQ ID NO: 548613 - DNA, 20 bp, Artificial Sequence
  chemically synthesized
gcacacacggattatttgat

SEQ ID NO: 548614 - DNA, 20 bp, Artificial Sequence
  chemically synthesized
aggcagtttccattttccca

SEQ ID NO: 548615 - DNA, 20 bp, Artificial Sequence
  chemically synthesized
aattgtatgcatgattttga

SEQ ID NO: 548616 - DNA, 20 bp, Artificial Sequence
  chemically synthesized
aaatatttaatatttttatc

SEQ ID NO: 548617 - DNA, 20 bp, Artificial Sequence
  chemically synthesized
tatttatatcatataaaaca

SEQ ID NO: 548618 - DNA, 20 bp, Artificial Sequence
  chemically synthesized
catataaaacattagaaata

SEQ ID NO: 548619 - DNA, 20 bp, Artificial Sequence
  chemically synthesized
aaaaaaggggttcttatgac

SEQ ID NO: 548620 - DNA, 20 bp, Artificial Sequence
  chemically synthesized
cgccacactctgcttgctag

SEQ ID NO: 548621 - DNA, 20 bp, Artificial Sequence
  chemically synthesized
tattttaaaaatctcttatt

SEQ ID NO: 548622 - DNA, 20 bp, Artificial Sequence
  chemically synthesized
aacctaaagtttgtaatgtc

SEQ ID NO: 548623 - DNA, 20 bp, Artificial Sequence
  chemically synthesized
gaacaaggaattggtgaaca

SEQ ID NO: 548624 - DNA, 20 bp, Artificial Sequence
  chemically synthesized
gactgaatggatttcgggat

SEQ ID NO: 548625 - DNA, 20 bp, Artificial Sequence
  chemically synthesized
cctggaagcagtggtgctta

SEQ ID NO: 548626 - DNA, 20 bp, Artificial Sequence
  chemically synthesized
tctacgttttttgatttgaa

SEQ ID NO: 548627 - DNA, 20 bp, Artificial Sequence
  chemically synthesized
acagtgagagagagagagag

SEQ ID NO: 548628 - DNA, 20 bp, Artificial Sequence
  chemically synthesized
tttgcagtagaggaaacaaa

SEQ ID NO: 548629 - DNA, 20 bp, Artificial Sequence
  chemically synthesized
taaaatataataataatata

SEQ ID NO: 548630 - DNA, 20 bp, Artificial Sequence
  chemically synthesized
caaagggagggatagcatta

SEQ ID NO: 548631 - DNA, 20 bp, Artificial Sequence
  chemically synthesized
ctcagcaaactaaaacagga

SEQ ID NO: 548632 - DNA, 20 bp, Artificial Sequence
  chemically synthesized
ctgttcctgttttagtttgc

SEQ ID NO: 548633 - DNA, 20 bp, Artificial Sequence
  chemically synthesized
ccatcaaagatagactggat

SEQ ID NO: 548634 - DNA, 20 bp, Artificial Sequence
  chemically synthesized
tactatactgaaagtcaaaa

SEQ ID NO: 548635 - DNA, 20 bp, Artificial Sequence
  chemically synthesized
atctctgtacttgaaagtag

SEQ ID NO: 548636 - DNA, 20 bp, Artificial Sequence
  chemically synthesized
ttaggtctagtattctactt

SEQ ID NO: 548637 - DNA, 20 bp, Artificial Sequence
  chemically synthesized
ggaagttcctctttctctaa

SEQ ID NO: 548638 - DNA, 20 bp, Artificial Sequence
  chemically synthesized
atttatacaactaaaacgtt

SEQ ID NO: 548639 - DNA, 20 bp, Artificial Sequence
  chemically synthesized
gtgaaataccaaaaataggg

SEQ ID NO: 548640 - DNA, 20 bp, Artificial Sequence
  chemically synthesized
tcacccaagcattcaagatt

SEQ ID NO: 548641 - DNA, 20 bp, Artificial Sequence
  chemically synthesized
catgtaaagatttatcaaat

SEQ ID NO: 548642 - DNA, 20 bp, Artificial Sequence
  chemically synthesized
tagtaaatatatataatgca

SEQ ID NO: 548643 - DNA, 20 bp, Artificial Sequence
  chemically synthesized
aacctagtatagtgtgtcat

SEQ ID NO: 548644 - DNA, 20 bp, Artificial Sequence
  chemically synthesized
catagacttgagttaggtgt

SEQ ID NO: 548645 - DNA, 20 bp, Artificial Sequence
  chemically synthesized
tataatatatgaatcatata

SEQ ID NO: 548646 - DNA, 20 bp, Artificial Sequence
  chemically synthesized
agtcaggcatgttgtgcaac

SEQ ID NO: 548647 - DNA, 20 bp, Artificial Sequence
  chemically synthesized
gcactctccccctagcaatt

SEQ ID NO: 548648 - DNA, 20 bp, Artificial Sequence
  chemically synthesized
gcatatttattacaaataaa

SEQ ID NO: 548649 - DNA, 20 bp, Artificial Sequence
  chemically synthesized
tgaacaaaagattcagcaaa

SEQ ID NO: 548650 - DNA, 20 bp, Artificial Sequence
  chemically synthesized
gtaggctgaggtataaatca

SEQ ID NO: 548651 - DNA, 20 bp, Artificial Sequence
  chemically synthesized
ttgtcacattatcaaacact

SEQ ID NO: 548652 - DNA, 20 bp, Artificial Sequence
  chemically synthesized
gccagctaactgagtgtaac

SEQ ID NO: 548653 - DNA, 20 bp, Artificial Sequence
  chemically synthesized
actagaactaaaatgagggt

SEQ ID NO: 548654 - DNA, 20 bp, Artificial Sequence
  chemically synthesized
tccttattgatatggctaca

SEQ ID NO: 548655 - DNA, 20 bp, Artificial Sequence
  chemically synthesized
ctaaggcatttggaataaag

SEQ ID NO: 548656 - DNA, 20 bp, Artificial Sequence
  chemically synthesized
tgaataaatatcataagggt

SEQ ID NO: 548657 - DNA, 20 bp, Artificial Sequence
  chemically synthesized
agagtcgtgggtacatattg

SEQ ID NO: 548658 - DNA, 20 bp, Artificial Sequence
  chemically synthesized
tataaattggtatgactaga

SEQ ID NO: 548659 - DNA, 20 bp, Artificial Sequence
  chemically synthesized
tgtacaagcccgaaaaggct

SEQ ID NO: 548660 - DNA, 20 bp, Artificial Sequence
  chemically synthesized
gctgaaataaatcagtgatc

SEQ ID NO: 548661 - DNA, 20 bp, Artificial Sequence
  chemically synthesized
ctcagaagttttgcacgtaa

SEQ ID NO: 548662 - DNA, 20 bp, Artificial Sequence
  chemically synthesized
cagcctctatttttccatca

SEQ ID NO: 548663 - DNA, 20 bp, Artificial Sequence
  chemically synthesized
aattaagttgactcccagat

SEQ ID NO: 548664 - DNA, 20 bp, Artificial Sequence
  chemically synthesized
tagttatctctaatcaaata

SEQ ID NO: 548665 - DNA, 20 bp, Artificial Sequence
  chemically synthesized
atttgattagagataactat

SEQ ID NO: 548666 - DNA, 20 bp, Artificial Sequence
  chemically synthesized
ttgagaaaacatggtttatg

SEQ ID NO: 548667 - DNA, 20 bp, Artificial Sequence
  chemically synthesized
aaaatattttcccgttttga

SEQ ID NO: 548668 - DNA, 20 bp, Artificial Sequence
  chemically synthesized
gaagtagagactagagatat

SEQ ID NO: 548669 - DNA, 20 bp, Artificial Sequence
  chemically synthesized
cccagttcagtttaatatgc

SEQ ID NO: 548670 - DNA, 20 bp, Artificial Sequence
  chemically synthesized
tctggcacaaatggatctat

SEQ ID NO: 548671 - DNA, 20 bp, Artificial Sequence
  chemically synthesized
atagatgcacatcaacttaa

SEQ ID NO: 548672 - DNA, 20 bp, Artificial Sequence
  chemically synthesized
gtcagaaagcaatccaagcc

SEQ ID NO: 548673 - DNA, 20 bp, Artificial Sequence
  chemically synthesized
attccactgaagcagaatag

SEQ ID NO: 548674 - DNA, 20 bp, Artificial Sequence
  chemically synthesized
cacaacgacattccactgaa

SEQ ID NO: 548675 - DNA, 20 bp, Artificial Sequence
  chemically synthesized
ttacaatagatgcatctctt

SEQ ID NO: 548676 - DNA, 20 bp, Artificial Sequence
  chemically synthesized
ctgtgcttccaagatgtatt

SEQ ID NO: 548677 - DNA, 20 bp, Artificial Sequence
  chemically synthesized
aaagagagaccatatcttta

SEQ ID NO: 548678 - DNA, 20 bp, Artificial Sequence
  chemically synthesized
ggggttcaagcctgggtgac

SEQ ID NO: 548679 - DNA, 20 bp, Artificial Sequence
  chemically synthesized
aaacaattttaaatttaaaa

SEQ ID NO: 548680 - DNA, 20 bp, Artificial Sequence
  chemically synthesized
aatgtgatatttgatgcata

SEQ ID NO: 548681 - DNA, 20 bp, Artificial Sequence
  chemically synthesized
tacccaggattaactaccat

SEQ ID NO: 548682 - DNA, 20 bp, Artificial Sequence
  chemically synthesized
acaaaacaaatgagcaaaca

SEQ ID NO: 548683 - DNA, 20 bp, Artificial Sequence
  chemically synthesized
cccttgtattagacaacact

SEQ ID NO: 548684 - DNA, 20 bp, Artificial Sequence
  chemically synthesized
ctactcgggaggctgaggca

SEQ ID NO: 548685 - DNA, 20 bp, Artificial Sequence
  chemically synthesized
ccccgtctctactaaaaata

SEQ ID NO: 548686 - DNA, 20 bp, Artificial Sequence
  chemically synthesized
atatgtactatctggccctt

SEQ ID NO: 548687 - DNA, 20 bp, Artificial Sequence
  chemically synthesized
tatgatcacatgtaagaata

SEQ ID NO: 548688 - DNA, 20 bp, Artificial Sequence
  chemically synthesized
taattaactatgatcacatg

SEQ ID NO: 548689 - DNA, 20 bp, Artificial Sequence
  chemically synthesized
tattcagcgcaaaaaggatt

SEQ ID NO: 548690 - DNA, 20 bp, Artificial Sequence
  chemically synthesized
cacaaagtcacacaaacatt

SEQ ID NO: 548691 - DNA, 20 bp, Artificial Sequence
  chemically synthesized
tttggaaataagagtagagt

SEQ ID NO: 548692 - DNA, 20 bp, Artificial Sequence
  chemically synthesized
cggttgtctaagggggagag

SEQ ID NO: 548693 - DNA, 20 bp, Artificial Sequence
  chemically synthesized
atctcattttaatgatttca

SEQ ID NO: 548694 - DNA, 20 bp, Artificial Sequence
  chemically synthesized
gtgtgtgtgaaatattaaga

SEQ ID NO: 548695 - DNA, 20 bp, Artificial Sequence
  chemically synthesized
acacacacaaaaaaaactgt

SEQ ID NO: 548696 - DNA, 20 bp, Artificial Sequence
  chemically synthesized
acaagagcaaaactccgtct

SEQ ID NO: 548697 - DNA, 20 bp, Artificial Sequence
  chemically synthesized
ctactccggagtctgaggca

SEQ ID NO: 548698 - DNA, 20 bp, Artificial Sequence
  chemically synthesized
tgaaaccttcacaaagtttc

SEQ ID NO: 548699 - DNA, 20 bp, Artificial Sequence
  chemically synthesized
agcagggaggaagaaaaggg

SEQ ID NO: 548700 - DNA, 20 bp, Artificial Sequence
  chemically synthesized
tcaagaaaaaaagcagggag

SEQ ID NO: 548701 - DNA, 20 bp, Artificial Sequence
  chemically synthesized
cttttggggaaattttattt

SEQ ID NO: 548702 - DNA, 20 bp, Artificial Sequence
  chemically synthesized
ttatatacagttttatccca

SEQ ID NO: 548703 - DNA, 20 bp, Artificial Sequence
  chemically synthesized
ttaactcaatcagagtcccg

SEQ ID NO: 548704 - DNA, 20 bp, Artificial Sequence
  chemically synthesized
ggcctcacataccccgagat

SEQ ID NO: 548705 - DNA, 20 bp, Artificial Sequence
  chemically synthesized
gaactagagagccagaccca

SEQ ID NO: 548706 - DNA, 20 bp, Artificial Sequence
  chemically synthesized
agcaggaggagtacagtgga

SEQ ID NO: 548707 - DNA, 20 bp, Artificial Sequence
  chemically synthesized
aggacacaaagcacagtggt

SEQ ID NO: 548708 - DNA, 20 bp, Artificial Sequence
  chemically synthesized
gatttgaaaggacaagaggg

SEQ ID NO: 548709 - DNA, 20 bp, Artificial Sequence
  chemically synthesized
tgatgagtacctgttttact

SEQ ID NO: 548710 - DNA, 20 bp, Artificial Sequence
  chemically synthesized
aatgtaaattaccaagagaa

SEQ ID NO: 548711 - DNA, 20 bp, Artificial Sequence
  chemically synthesized
ttcaaaggactgtagagctt

SEQ ID NO: 548712 - DNA, 20 bp, Artificial Sequence
  chemically synthesized
aggtgggtatagtccagttg

SEQ ID NO: 548713 - DNA, 20 bp, Artificial Sequence
  chemically synthesized
tactaccaaccccagttact

SEQ ID NO: 548714 - DNA, 20 bp, Artificial Sequence
  chemically synthesized
cgactgtattagatttaaaa

SEQ ID NO: 548715 - DNA, 20 bp, Artificial Sequence
  chemically synthesized
accagaaaacaagcccctat

SEQ ID NO: 548716 - DNA, 20 bp, Artificial Sequence
  chemically synthesized
ttacttgatctatgaactgg

SEQ ID NO: 548717 - DNA, 20 bp, Artificial Sequence
  chemically synthesized
gttaagtaattaaccacaat

SEQ ID NO: 548718 - DNA, 20 bp, Artificial Sequence
  chemically synthesized
tgacaacattataaacttta

SEQ ID NO: 548719 - DNA, 20 bp, Artificial Sequence
  chemically synthesized
aaaaaatagttgttgcagag

SEQ ID NO: 548720 - DNA, 20 bp, Artificial Sequence
  chemically synthesized
tgaatacactattagaacaa

SEQ ID NO: 548721 - DNA, 20 bp, Artificial Sequence
  chemically synthesized
ggaagaagtgagtgacattc

SEQ ID NO: 548722 - DNA, 20 bp, Artificial Sequence
  chemically synthesized
tttttggtcattagtgtttc

SEQ ID NO: 548723 - DNA, 20 bp, Artificial Sequence
  chemically synthesized
atataaggaaggaacaccac

SEQ ID NO: 548724 - DNA, 20 bp, Artificial Sequence
  chemically synthesized
aataaaaaatgatgatgtag

SEQ ID NO: 548725 - DNA, 20 bp, Artificial Sequence
  chemically synthesized
agggactaaaaggaaaggaa

SEQ ID NO: 548726 - DNA, 20 bp, Artificial Sequence
  chemically synthesized
ttgataaactgtacatttat

SEQ ID NO: 548727 - DNA, 20 bp, Artificial Sequence
  chemically synthesized
tttccactattctggtaagt

SEQ ID NO: 548728 - DNA, 20 bp, Artificial Sequence
  chemically synthesized
acacatgctttctttactta

SEQ ID NO: 548729 - DNA, 20 bp, Artificial Sequence
  chemically synthesized
tttaacttatatggagagtc

SEQ ID NO: 548730 - DNA, 20 bp, Artificial Sequence
  chemically synthesized
gctatttttagatggatata

SEQ ID NO: 548731 - DNA, 20 bp, Artificial Sequence
  chemically synthesized
agcttgaaaattactggtat

SEQ ID NO: 548732 - DNA, 20 bp, Artificial Sequence
  chemically synthesized
atcacagatgacacaaacaa

SEQ ID NO: 548733 - DNA, 20 bp, Artificial Sequence
  chemically synthesized
ctttccatactcatggatta

SEQ ID NO: 548734 - DNA, 20 bp, Artificial Sequence
  chemically synthesized
tagttattttgtgtctgtgg

SEQ ID NO: 548735 - DNA, 20 bp, Artificial Sequence
  chemically synthesized
aatggaacaaagtagagaac

SEQ ID NO: 548736 - DNA, 20 bp, Artificial Sequence
  chemically synthesized
ggactggctagccatatgtg

SEQ ID NO: 548737 - DNA, 20 bp, Artificial Sequence
  chemically synthesized
aaatgtaagacctcaaacta

SEQ ID NO: 548738 - DNA, 20 bp, Artificial Sequence
  chemically synthesized
ctcaaactagaagaattgta

SEQ ID NO: 548739 - DNA, 20 bp, Artificial Sequence
  chemically synthesized
aagaattgtagaagaaaacc

SEQ ID NO: 548740 - DNA, 20 bp, Artificial Sequence
  chemically synthesized
tgctttcctaaccccaatgt

SEQ ID NO: 548741 - DNA, 20 bp, Artificial Sequence
  chemically synthesized
taaaaagcttctgcacagca

SEQ ID NO: 548742 - DNA, 20 bp, Artificial Sequence
  chemically synthesized
aacagacaacctacggaaca

SEQ ID NO: 548743 - DNA, 20 bp, Artificial Sequence
  chemically synthesized
atcacacaaaggttcaatat

SEQ ID NO: 548744 - DNA, 20 bp, Artificial Sequence
  chemically synthesized
gctgaataacattaattgtc

SEQ ID NO: 548745 - DNA, 20 bp, Artificial Sequence
  chemically synthesized
gagataccatcgcacaccag

SEQ ID NO: 548746 - DNA, 20 bp, Artificial Sequence
  chemically synthesized
acaaatgctggtgaagccgc

SEQ ID NO: 548747 - DNA, 20 bp, Artificial Sequence
  chemically synthesized
aggcagtttggagatttccc

SEQ ID NO: 548748 - DNA, 20 bp, Artificial Sequence
  chemically synthesized
acatcattggtggactggat

SEQ ID NO: 548749 - DNA, 20 bp, Artificial Sequence
  chemically synthesized
gaatactatgcagccataaa

SEQ ID NO: 548750 - DNA, 20 bp, Artificial Sequence
  chemically synthesized
taaagctggacttcaagttg

SEQ ID NO: 548751 - DNA, 20 bp, Artificial Sequence
  chemically synthesized
agagtaggaaagaagagagt

SEQ ID NO: 548752 - DNA, 20 bp, Artificial Sequence
  chemically synthesized
ctttcctactctgcaggtta

SEQ ID NO: 548753 - DNA, 20 bp, Artificial Sequence
  chemically synthesized
cactcccttctcaaaaggta

SEQ ID NO: 548754 - DNA, 20 bp, Artificial Sequence
  chemically synthesized
tacgtgtacataagagagac

SEQ ID NO: 548755 - DNA, 20 bp, Artificial Sequence
  chemically synthesized
atttgagagattactgagtg

SEQ ID NO: 548756 - DNA, 20 bp, Artificial Sequence
  chemically synthesized
ctagttgggaggctgaggca

SEQ ID NO: 548757 - DNA, 20 bp, Artificial Sequence
  chemically synthesized
ctctgtctcaaaaaacaaaa

SEQ ID NO: 548758 - DNA, 20 bp, Artificial Sequence
  chemically synthesized
aaacaaaaaaagaaaaaaaa

SEQ ID NO: 548759 - DNA, 20 bp, Artificial Sequence
  chemically synthesized
caatttacctctgctacttt

SEQ ID NO: 548760 - DNA, 20 bp, Artificial Sequence
  chemically synthesized
tgtttatatgttttcaattt

SEQ ID NO: 548761 - DNA, 20 bp, Artificial Sequence
  chemically synthesized
taaaattaaaagtagacttt

SEQ ID NO: 548762 - DNA, 20 bp, Artificial Sequence
  chemically synthesized
agactttacagaatttggga

SEQ ID NO: 548763 - DNA, 20 bp, Artificial Sequence
  chemically synthesized
agaaattcagtaggagaagt

SEQ ID NO: 548764 - DNA, 20 bp, Artificial Sequence
  chemically synthesized
catacttttgacactgtttt

SEQ ID NO: 548765 - DNA, 20 bp, Artificial Sequence
  chemically synthesized
acatttaaggtcttcatgta

SEQ ID NO: 548766 - DNA, 20 bp, Artificial Sequence
  chemically synthesized
gactgtagaccatgaaaaaa

SEQ ID NO: 548767 - DNA, 20 bp, Artificial Sequence
  chemically synthesized
ccatgaaaaaatgagaaaat

SEQ ID NO: 548768 - DNA, 20 bp, Artificial Sequence
  chemically synthesized
tattacagatttgtcacgca

SEQ ID NO: 548769 - DNA, 20 bp, Artificial Sequence
  chemically synthesized
atttgtcacgcattagaaaa

SEQ ID NO: 548770 - DNA, 20 bp, Artificial Sequence
  chemically synthesized
aaatatctgcctctgaggag

SEQ ID NO: 548771 - DNA, 20 bp, Artificial Sequence
  chemically synthesized
tacactttttaaaattccaa

SEQ ID NO: 548772 - DNA, 20 bp, Artificial Sequence
  chemically synthesized
gcatttccagggaaattatc

SEQ ID NO: 548773 - DNA, 20 bp, Artificial Sequence
  chemically synthesized
gcagtttgcaataccaatca

SEQ ID NO: 548774 - DNA, 20 bp, Artificial Sequence
  chemically synthesized
taccccatatatttggacaa

SEQ ID NO: 548775 - DNA, 20 bp, Artificial Sequence
  chemically synthesized
ggttggagtggagtggataa

SEQ ID NO: 548776 - DNA, 20 bp, Artificial Sequence
  chemically synthesized
ttaagtgaaatgaaccagac

SEQ ID NO: 548777 - DNA, 20 bp, Artificial Sequence
  chemically synthesized
gcctaattttaagcatacag

SEQ ID NO: 548778 - DNA, 20 bp, Artificial Sequence
  chemically synthesized
attgaatcttacaaatcaat

SEQ ID NO: 548779 - DNA, 20 bp, Artificial Sequence
  chemically synthesized
aggcgatggtagagaactat

SEQ ID NO: 548780 - DNA, 20 bp, Artificial Sequence
  chemically synthesized
ttctctaccatcgcctcatt

SEQ ID NO: 548781 - DNA, 20 bp, Artificial Sequence
  chemically synthesized
gtggatagagatggactatg

SEQ ID NO: 548782 - DNA, 20 bp, Artificial Sequence
  chemically synthesized
aaacagattagtgaaacaaa

SEQ ID NO: 548783 - DNA, 20 bp, Artificial Sequence
  chemically synthesized
ctactcgggaggctgcggca

SEQ ID NO: 548784 - DNA, 20 bp, Artificial Sequence
  chemically synthesized
agcaatatagatgaggatta

SEQ ID NO: 548785 - DNA, 20 bp, Artificial Sequence
  chemically synthesized
caggaagacattggatgtga

SEQ ID NO: 548786 - DNA, 20 bp, Artificial Sequence
  chemically synthesized
acaaattaagctaaaatctg

SEQ ID NO: 548787 - DNA, 20 bp, Artificial Sequence
  chemically synthesized
taaaatattaatattcccac

SEQ ID NO: 548788 - DNA, 20 bp, Artificial Sequence
  chemically synthesized
aagcctttactggaaaaata

SEQ ID NO: 548789 - DNA, 20 bp, Artificial Sequence
  chemically synthesized
attttcaataggttgttaaa

SEQ ID NO: 548790 - DNA, 20 bp, Artificial Sequence
  chemically synthesized
gttaaaagagaaattagcat

SEQ ID NO: 548791 - DNA, 20 bp, Artificial Sequence
  chemically synthesized
tcattaagaaaagaaaaaac

SEQ ID NO: 548792 - DNA, 20 bp, Artificial Sequence
  chemically synthesized
agtcccaaagctcattaaga

SEQ ID NO: 548793 - DNA, 20 bp, Artificial Sequence
  chemically synthesized
aaattagtcccaaagctcat

SEQ ID NO: 548794 - DNA, 20 bp, Artificial Sequence
  chemically synthesized
tcagtgaaagaagccaagta

SEQ ID NO: 548795 - DNA, 20 bp, Artificial Sequence
  chemically synthesized
tacttggcttctttcactga

SEQ ID NO: 548796 - DNA, 20 bp, Artificial Sequence
  chemically synthesized
cattaaaattagaaatataa

SEQ ID NO: 548797 - DNA, 20 bp, Artificial Sequence
  chemically synthesized
tgaaggtatcctcattaaaa

SEQ ID NO: 548798 - DNA, 20 bp, Artificial Sequence
  chemically synthesized
aaacaaaacttttagcaatg

SEQ ID NO: 548799 - DNA, 20 bp, Artificial Sequence
  chemically synthesized
aatctgtccctaatttagga

SEQ ID NO: 548800 - DNA, 20 bp, Artificial Sequence
  chemically synthesized
gaaaaagtattgataaatga

SEQ ID NO: 548801 - DNA, 20 bp, Artificial Sequence
  chemically synthesized
aaacatatatgcctactata

SEQ ID NO: 548802 - DNA, 20 bp, Artificial Sequence
  chemically synthesized
taacttcaaaaatactatat

SEQ ID NO: 548803 - DNA, 20 bp, Artificial Sequence
  chemically synthesized
gaaacctttaaaaagcagta

SEQ ID NO: 548804 - DNA, 20 bp, Artificial Sequence
  chemically synthesized
ctgctttttaaaggtttctt

SEQ ID NO: 548805 - DNA, 20 bp, Artificial Sequence
  chemically synthesized
gaactaaacatttgattctg

SEQ ID NO: 548806 - DNA, 20 bp, Artificial Sequence
  chemically synthesized
ataagaacaaagctgtaatc

SEQ ID NO: 548807 - DNA, 20 bp, Artificial Sequence
  chemically synthesized
tacattgtttttgtaacagg

SEQ ID NO: 548808 - DNA, 20 bp, Artificial Sequence
  chemically synthesized
aaagatacaacaataactat

SEQ ID NO: 548809 - DNA, 20 bp, Artificial Sequence
  chemically synthesized
agatttttatagacagatat

SEQ ID NO: 548810 - DNA, 20 bp, Artificial Sequence
  chemically synthesized
tctgttttgttataaaatgt

SEQ ID NO: 548811 - DNA, 20 bp, Artificial Sequence
  chemically synthesized
agaaaatccagccatatgaa

SEQ ID NO: 548812 - DNA, 20 bp, Artificial Sequence
  chemically synthesized
atacaaaagcccgtaaattc

SEQ ID NO: 548813 - DNA, 20 bp, Artificial Sequence
  chemically synthesized
tgccacctaaaccaattaaa

SEQ ID NO: 548814 - DNA, 20 bp, Artificial Sequence
  chemically synthesized
gcagaggaccattgagcttg

SEQ ID NO: 548815 - DNA, 20 bp, Artificial Sequence
  chemically synthesized
ataagccttaagttttaatc

SEQ ID NO: 548816 - DNA, 20 bp, Artificial Sequence
  chemically synthesized
tgcaaatctttaattgcctt

SEQ ID NO: 548817 - DNA, 20 bp, Artificial Sequence
  chemically synthesized
cagttttccttaagcaagtt

SEQ ID NO: 548818 - DNA, 20 bp, Artificial Sequence
  chemically synthesized
atctggccttcagcctaact

SEQ ID NO: 548819 - DNA, 20 bp, Artificial Sequence
  chemically synthesized
aaataaaagtaaggagaaaa

SEQ ID NO: 548820 - DNA, 20 bp, Artificial Sequence
  chemically synthesized
tttttatgaaataaaagtaa

SEQ ID NO: 548821 - DNA, 20 bp, Artificial Sequence
  chemically synthesized
ctgagaacaagtaaatgcaa

SEQ ID NO: 548822 - DNA, 20 bp, Artificial Sequence
  chemically synthesized
ctaattgcatttacttgttc

SEQ ID NO: 548823 - DNA, 20 bp, Artificial Sequence
  chemically synthesized
tagtttgtacacgagttgcc

SEQ ID NO: 548824 - DNA, 20 bp, Artificial Sequence
  chemically synthesized
tagccataaagctgttcatt

SEQ ID NO: 548825 - DNA, 20 bp, Artificial Sequence
  chemically synthesized
cctctgctcctccccttaac

SEQ ID NO: 548826 - DNA, 20 bp, Artificial Sequence
  chemically synthesized
gcttccaggaagatgtttta

SEQ ID NO: 548827 - DNA, 20 bp, Artificial Sequence
  chemically synthesized
taaataaggtgacaagtcta

SEQ ID NO: 548828 - DNA, 20 bp, Artificial Sequence
  chemically synthesized
cccactcaaaattgacagtg

SEQ ID NO: 548829 - DNA, 20 bp, Artificial Sequence
  chemically synthesized
cacacaccagggacggaggg

SEQ ID NO: 548830 - DNA, 20 bp, Artificial Sequence
  chemically synthesized
aaacccctcttggccttggg

SEQ ID NO: 548831 - DNA, 20 bp, Artificial Sequence
  chemically synthesized
atccattctctgtagtttca

SEQ ID NO: 548832 - DNA, 20 bp, Artificial Sequence
  chemically synthesized
ccagattcttgtgaaactac

SEQ ID NO: 548833 - DNA, 20 bp, Artificial Sequence
  chemically synthesized
gtggagctttagtttgatgt

SEQ ID NO: 548834 - DNA, 20 bp, Artificial Sequence
  chemically synthesized
tctttcataatgtccaggtg

SEQ ID NO: 548835 - DNA, 20 bp, Artificial Sequence
  chemically synthesized
acaattaagcaggtagaaag

SEQ ID NO: 548836 - DNA, 20 bp, Artificial Sequence
  chemically synthesized
agatacaattaagcaggtag

SEQ ID NO: 548837 - DNA, 20 bp, Artificial Sequence
  chemically synthesized
gcacagatacaattaagcag

SEQ ID NO: 548838 - DNA, 20 bp, Artificial Sequence
  chemically synthesized
gttcaccgcagatgcattta

SEQ ID NO: 548839 - DNA, 20 bp, Artificial Sequence
  chemically synthesized
ccttagcttctcttgcttct

SEQ ID NO: 548840 - DNA, 20 bp, Artificial Sequence
  chemically synthesized
atttgttaattcaaggcact

SEQ ID NO: 548841 - DNA, 20 bp, Artificial Sequence
  chemically synthesized
gcaagcttgcctaaaagtga

SEQ ID NO: 548842 - DNA, 20 bp, Artificial Sequence
  chemically synthesized
ctaaaagtgaggagaattat

SEQ ID NO: 548843 - DNA, 20 bp, Artificial Sequence
  chemically synthesized
atttatgtgtaaggaaaaga

SEQ ID NO: 548844 - DNA, 20 bp, Artificial Sequence
  chemically synthesized
ggcatgataggggatgaaac

SEQ ID NO: 548845 - DNA, 20 bp, Artificial Sequence
  chemically synthesized
ggcaacactttgaatgtaaa

SEQ ID NO: 548846 - DNA, 20 bp, Artificial Sequence
  chemically synthesized
cccatttaatattttaatct

SEQ ID NO: 548847 - DNA, 20 bp, Artificial Sequence
  chemically synthesized
gggatgggaaacacaatggt

SEQ ID NO: 548848 - DNA, 20 bp, Artificial Sequence
  chemically synthesized
gaaacacaatggtaaagaat

SEQ ID NO: 548849 - DNA, 20 bp, Artificial Sequence
  chemically synthesized
caaattcatccaaagcttgt

SEQ ID NO: 548850 - DNA, 20 bp, Artificial Sequence
  chemically synthesized
cttttctttcagggacatat

SEQ ID NO: 548851 - DNA, 20 bp, Artificial Sequence
  chemically synthesized
cctttctgaatatgtccctg

SEQ ID NO: 548852 - DNA, 20 bp, Artificial Sequence
  chemically synthesized
tatagccatgaactagattt

SEQ ID NO: 548853 - DNA, 20 bp, Artificial Sequence
  chemically synthesized
gtatcagctatttaattctc

SEQ ID NO: 548854 - DNA, 20 bp, Artificial Sequence
  chemically synthesized
taaaatgatacttatttcta

SEQ ID NO: 548855 - DNA, 20 bp, Artificial Sequence
  chemically synthesized
gtagcaaagctggaattcaa

SEQ ID NO: 548856 - DNA, 20 bp, Artificial Sequence
  chemically synthesized
tgttcccgaattgtgctttc

SEQ ID NO: 548857 - DNA, 20 bp, Artificial Sequence
  chemically synthesized
tacactgcactttctaccca

SEQ ID NO: 548858 - DNA, 20 bp, Artificial Sequence
  chemically synthesized
ggaataagtaattctgatgg

SEQ ID NO: 548859 - DNA, 20 bp, Artificial Sequence
  chemically synthesized
atttcctaagatcagtcatt

SEQ ID NO: 548860 - DNA, 20 bp, Artificial Sequence
  chemically synthesized
tccttctgaattcataaaaa

SEQ ID NO: 548861 - DNA, 20 bp, Artificial Sequence
  chemically synthesized
tggacaaaattcaatggaca

SEQ ID NO: 548862 - DNA, 20 bp, Artificial Sequence
  chemically synthesized
acgtcacacacaccataaac

SEQ ID NO: 548863 - DNA, 20 bp, Artificial Sequence
  chemically synthesized
aggctcattccttctgcgat

SEQ ID NO: 548864 - DNA, 20 bp, Artificial Sequence
  chemically synthesized
tggccactctctgtattcca

SEQ ID NO: 548865 - DNA, 20 bp, Artificial Sequence
  chemically synthesized
ctcggacagagtctgtaggg

SEQ ID NO: 548866 - DNA, 20 bp, Artificial Sequence
  chemically synthesized
ttccccttaaaattatatgt

SEQ ID NO: 548867 - DNA, 20 bp, Artificial Sequence
  chemically synthesized
aggggaaaatatcaatattt

SEQ ID NO: 548868 - DNA, 20 bp, Artificial Sequence
  chemically synthesized
ggttaagtgggctattgaac

SEQ ID NO: 548869 - DNA, 20 bp, Artificial Sequence
  chemically synthesized
gtttaaggtaatagaatatg

SEQ ID NO: 548870 - DNA, 20 bp, Artificial Sequence
  chemically synthesized
ttttcgatcagtttaaggta

SEQ ID NO: 548871 - DNA, 20 bp, Artificial Sequence
  chemically synthesized
tcaagtaattcatctcaaca

SEQ ID NO: 548872 - DNA, 20 bp, Artificial Sequence
  chemically synthesized
gatgaattacttgacagtca

SEQ ID NO: 548873 - DNA, 20 bp, Artificial Sequence
  chemically synthesized
cagaaaggagaaacccatgg

SEQ ID NO: 548874 - DNA, 20 bp, Artificial Sequence
  chemically synthesized
ggtgggaaaggtttcagaaa

SEQ ID NO: 548875 - DNA, 20 bp, Artificial Sequence
  chemically synthesized
gactgggggtgggaaaggtt

SEQ ID NO: 548876 - DNA, 20 bp, Artificial Sequence
  chemically synthesized
acctttcccacccccagtcc

SEQ ID NO: 548877 - DNA, 20 bp, Artificial Sequence
  chemically synthesized
aaagcattattcatataatc

SEQ ID NO: 548878 - DNA, 20 bp, Artificial Sequence
  chemically synthesized
atagtaagtgtatttatttc

SEQ ID NO: 548879 - DNA, 20 bp, Artificial Sequence
  chemically synthesized
accagagcctatatccccaa

SEQ ID NO: 548880 - DNA, 20 bp, Artificial Sequence
  chemically synthesized
tccccaaatagaattattta

SEQ ID NO: 548881 - DNA, 20 bp, Artificial Sequence
  chemically synthesized
tcctctttttaaatattcat

SEQ ID NO: 548882 - DNA, 20 bp, Artificial Sequence
  chemically synthesized
ttcatgtagaatagccttaa

SEQ ID NO: 548883 - DNA, 20 bp, Artificial Sequence
  chemically synthesized
agacttactgagatccagat

SEQ ID NO: 548884 - DNA, 20 bp, Artificial Sequence
  chemically synthesized
gctggcattcatacatggtt

SEQ ID NO: 548885 - DNA, 20 bp, Artificial Sequence
  chemically synthesized
ctactcggggagctgaggcg

SEQ ID NO: 548886 - DNA, 20 bp, Artificial Sequence
  chemically synthesized
ctcccacgagactgtgattt

SEQ ID NO: 548887 - DNA, 20 bp, Artificial Sequence
  chemically synthesized
actgcttcatgttccatata

SEQ ID NO: 548888 - DNA, 20 bp, Artificial Sequence
  chemically synthesized
gaccttacttcatatgagag

SEQ ID NO: 548889 - DNA, 20 bp, Artificial Sequence
  chemically synthesized
tctgaaatttaacataaggt

SEQ ID NO: 548890 - DNA, 20 bp, Artificial Sequence
  chemically synthesized
aatgtgaactttcaatatta

SEQ ID NO: 548891 - DNA, 20 bp, Artificial Sequence
  chemically synthesized
ctactcgggaggctgaggca

SEQ ID NO: 548892 - DNA, 20 bp, Artificial Sequence
  chemically synthesized
aaaaaaaaaaaaaaaaagaa

SEQ ID NO: 548893 - DNA, 20 bp, Artificial Sequence
  chemically synthesized
aaaaaaaaaaaagaagaaga

SEQ ID NO: 548894 - DNA, 20 bp, Artificial Sequence
  chemically synthesized
catctttgcctttattaaga

SEQ ID NO: 548895 - DNA, 20 bp, Artificial Sequence
  chemically synthesized
ttaatatttatcattttttt

SEQ ID NO: 548896 - DNA, 20 bp, Artificial Sequence
  chemically synthesized
attatcattggtgtatataa

SEQ ID NO: 548897 - DNA, 20 bp, Artificial Sequence
  chemically synthesized
cacttacaaggagcttgaga

SEQ ID NO: 548898 - DNA, 20 bp, Artificial Sequence
  chemically synthesized
aaaaataccaacaaatcaat

SEQ ID NO: 548899 - DNA, 20 bp, Artificial Sequence
  chemically synthesized
caatgacctgtaataaagtt

SEQ ID NO: 548900 - DNA, 20 bp, Artificial Sequence
  chemically synthesized
aacaattttatattgccttg

SEQ ID NO: 548901 - DNA, 20 bp, Artificial Sequence
  chemically synthesized
tcaaagacagtatgctatca

SEQ ID NO: 548902 - DNA, 20 bp, Artificial Sequence
  chemically synthesized
gtaacctcttggtaacacat

SEQ ID NO: 548903 - DNA, 20 bp, Artificial Sequence
  chemically synthesized
aataaaacatctttttgtgg

SEQ ID NO: 548904 - DNA, 20 bp, Artificial Sequence
  chemically synthesized
aggtgcagcagcagttggct

SEQ ID NO: 548905 - DNA, 20 bp, Artificial Sequence
  chemically synthesized
aactgaactgtgccaacatg

SEQ ID NO: 548906 - DNA, 20 bp, Artificial Sequence
  chemically synthesized
aactgtgccaacatgataga

SEQ ID NO: 548907 - DNA, 20 bp, Artificial Sequence
  chemically synthesized
agtggaaactctttctttaa

SEQ ID NO: 548908 - DNA, 20 bp, Artificial Sequence
  chemically synthesized
ttctgggtcacattctattt

SEQ ID NO: 548909 - DNA, 20 bp, Artificial Sequence
  chemically synthesized
tggtggacaaactaggaact

SEQ ID NO: 548910 - DNA, 20 bp, Artificial Sequence
  chemically synthesized
tgaacttaaaagttaaaaac

SEQ ID NO: 548911 - DNA, 20 bp, Artificial Sequence
  chemically synthesized
cttagcaaactaatacagta

SEQ ID NO: 548912 - DNA, 20 bp, Artificial Sequence
  chemically synthesized
gtatactgcgtagccataag

SEQ ID NO: 548913 - DNA, 20 bp, Artificial Sequence
  chemically synthesized
catggtatactgcgtagcca

SEQ ID NO: 548914 - DNA, 20 bp, Artificial Sequence
  chemically synthesized
aattcctcaaagacctacag

SEQ ID NO: 548915 - DNA, 20 bp, Artificial Sequence
  chemically synthesized
gctcaacatcactaatcatt

SEQ ID NO: 548916 - DNA, 20 bp, Artificial Sequence
  chemically synthesized
aaggaacttaaacaaatcta

SEQ ID NO: 548917 - DNA, 20 bp, Artificial Sequence
  chemically synthesized
agcagacaaactacagaatg

SEQ ID NO: 548918 - DNA, 20 bp, Artificial Sequence
  chemically synthesized
acagagtgagcagacaaact

SEQ ID NO: 548919 - DNA, 20 bp, Artificial Sequence
  chemically synthesized
ttgatagtttcctttgctgt

SEQ ID NO: 548920 - DNA, 20 bp, Artificial Sequence
  chemically synthesized
tggctagccacatgcagaag

SEQ ID NO: 548921 - DNA, 20 bp, Artificial Sequence
  chemically synthesized
aatggaacaaaacagagaac

SEQ ID NO: 548922 - DNA, 20 bp, Artificial Sequence
  chemically synthesized
caaggcaatactaagcaaaa

SEQ ID NO: 548923 - DNA, 20 bp, Artificial Sequence
  chemically synthesized
tgagattcttcagagaacta

SEQ ID NO: 548924 - DNA, 20 bp, Artificial Sequence
  chemically synthesized
atagtttcttctagttctct

SEQ ID NO: 548925 - DNA, 20 bp, Artificial Sequence
  chemically synthesized
tgagattcttcagagaacta

SEQ ID NO: 548926 - DNA, 20 bp, Artificial Sequence
  chemically synthesized
atagtttcttctagttctct

SEQ ID NO: 548927 - DNA, 20 bp, Artificial Sequence
  chemically synthesized
cattccatgttcatggatag

SEQ ID NO: 548928 - DNA, 20 bp, Artificial Sequence
  chemically synthesized
cctcaaagaaatcagagatg

SEQ ID NO: 548929 - DNA, 20 bp, Artificial Sequence
  chemically synthesized
agaactaccaaacactcctc

SEQ ID NO: 548930 - DNA, 20 bp, Artificial Sequence
  chemically synthesized
cacattcacaactgccatag

SEQ ID NO: 548931 - DNA, 20 bp, Artificial Sequence
  chemically synthesized
caatcacattcacaactgcc

SEQ ID NO: 548932 - DNA, 20 bp, Artificial Sequence
  chemically synthesized
tgttgcatgcagtgcaacag

SEQ ID NO: 548933 - DNA, 20 bp, Artificial Sequence
  chemically synthesized
ttcctatacaccaacaacag

SEQ ID NO: 548934 - DNA, 20 bp, Artificial Sequence
  chemically synthesized
cagacaacatgatgctatat

SEQ ID NO: 548935 - DNA, 20 bp, Artificial Sequence
  chemically synthesized
ccagggaaatcaggcaagag

SEQ ID NO: 548936 - DNA, 20 bp, Artificial Sequence
  chemically synthesized
ctgaccagggaaatcaggca

SEQ ID NO: 548937 - DNA, 20 bp, Artificial Sequence
  chemically synthesized
gcatattcttattatgatga

SEQ ID NO: 548938 - DNA, 20 bp, Artificial Sequence
  chemically synthesized
ttcctttcttctcatcataa

SEQ ID NO: 548939 - DNA, 20 bp, Artificial Sequence
  chemically synthesized
actgaaaaactggagcctgt

SEQ ID NO: 548940 - DNA, 20 bp, Artificial Sequence
  chemically synthesized
ttaacattatgatagagata

SEQ ID NO: 548941 - DNA, 20 bp, Artificial Sequence
  chemically synthesized
gagagaggggaatgctaact

SEQ ID NO: 548942 - DNA, 20 bp, Artificial Sequence
  chemically synthesized
catggtgtatacatatagtc

SEQ ID NO: 548943 - DNA, 20 bp, Artificial Sequence
  chemically synthesized
gtttgcttcttgagacaaat

SEQ ID NO: 548944 - DNA, 20 bp, Artificial Sequence
  chemically synthesized
atctgtcagagttccagaag

SEQ ID NO: 548945 - DNA, 20 bp, Artificial Sequence
  chemically synthesized
caatatctgtcagagttcca

SEQ ID NO: 548946 - DNA, 20 bp, Artificial Sequence
  chemically synthesized
caaaggtaaaaataagcact

SEQ ID NO: 548947 - DNA, 20 bp, Artificial Sequence
  chemically synthesized
ggtaaaaataagcacttcag

SEQ ID NO: 548948 - DNA, 20 bp, Artificial Sequence
  chemically synthesized
aagaaaactgattttccaca

SEQ ID NO: 548949 - DNA, 20 bp, Artificial Sequence
  chemically synthesized
ggcataggctccagatggaa

SEQ ID NO: 548950 - DNA, 20 bp, Artificial Sequence
  chemically synthesized
catataataataaaataaat

SEQ ID NO: 548951 - DNA, 20 bp, Artificial Sequence
  chemically synthesized
aagcaattatactaatgtca

SEQ ID NO: 548952 - DNA, 20 bp, Artificial Sequence
  chemically synthesized
actcagatcaccacttggat

SEQ ID NO: 548953 - DNA, 20 bp, Artificial Sequence
  chemically synthesized
aacaaagtgtattaaaaata

SEQ ID NO: 548954 - DNA, 20 bp, Artificial Sequence
  chemically synthesized
aagttttaaaaagcaaaggg

SEQ ID NO: 548955 - DNA, 20 bp, Artificial Sequence
  chemically synthesized
attgataagcactgtttatt

SEQ ID NO: 548956 - DNA, 20 bp, Artificial Sequence
  chemically synthesized
attttatttcacttaatttc

SEQ ID NO: 548957 - DNA, 20 bp, Artificial Sequence
  chemically synthesized
caatagaaataaggtttttc

SEQ ID NO: 548958 - DNA, 20 bp, Artificial Sequence
  chemically synthesized
tgaagatacagagattttca

SEQ ID NO: 548959 - DNA, 20 bp, Artificial Sequence
  chemically synthesized
tatctaacaatcatgtctct

SEQ ID NO: 548960 - DNA, 20 bp, Artificial Sequence
  chemically synthesized
tatgaaaggaagaagaaaaa

SEQ ID NO: 548961 - DNA, 20 bp, Artificial Sequence
  chemically synthesized
ttgtacacatatgaaaggaa

SEQ ID NO: 548962 - DNA, 20 bp, Artificial Sequence
  chemically synthesized
agaagtgtttttcctcccta

SEQ ID NO: 548963 - DNA, 20 bp, Artificial Sequence
  chemically synthesized
tattaccaacctgctattta

SEQ ID NO: 548964 - DNA, 20 bp, Artificial Sequence
  chemically synthesized
atacttacaaacttcataat

SEQ ID NO: 548965 - DNA, 20 bp, Artificial Sequence
  chemically synthesized
cacctaatttgaatttggct

SEQ ID NO: 548966 - DNA, 20 bp, Artificial Sequence
  chemically synthesized
agtccctggatctagggtca

SEQ ID NO: 548967 - DNA, 20 bp, Artificial Sequence
  chemically synthesized
gtggcaaaatgggtgagatg

SEQ ID NO: 548968 - DNA, 20 bp, Artificial Sequence
  chemically synthesized
ccctcttgacttgacatcac

SEQ ID NO: 548969 - DNA, 20 bp, Artificial Sequence
  chemically synthesized
caaccttgtaggttgtccca

SEQ ID NO: 548970 - DNA, 20 bp, Artificial Sequence
  chemically synthesized
aggctttttcaaatcctggg

SEQ ID NO: 548971 - DNA, 20 bp, Artificial Sequence
  chemically synthesized
gctcctgctacaagagccat

SEQ ID NO: 548972 - DNA, 20 bp, Artificial Sequence
  chemically synthesized
caccacattcaaaccataaa

SEQ ID NO: 548973 - DNA, 20 bp, Artificial Sequence
  chemically synthesized
actctaccatctgaagatgc

SEQ ID NO: 548974 - DNA, 20 bp, Artificial Sequence
  chemically synthesized
agatgcttagaattcaatgt

SEQ ID NO: 548975 - DNA, 20 bp, Artificial Sequence
  chemically synthesized
aaaaacaaaaacttgttgga

SEQ ID NO: 548976 - DNA, 20 bp, Artificial Sequence
  chemically synthesized
ccccacttaaggtgcatttc

SEQ ID NO: 548977 - DNA, 20 bp, Artificial Sequence
  chemically synthesized
tttggcagctttgagttttc

SEQ ID NO: 548978 - DNA, 20 bp, Artificial Sequence
  chemically synthesized
ggagttttaaagggagaatg

SEQ ID NO: 548979 - DNA, 20 bp, Artificial Sequence
  chemically synthesized
ggtgactgggagttttaaag

SEQ ID NO: 548980 - DNA, 20 bp, Artificial Sequence
  chemically synthesized
atatatattgcctcccattc

SEQ ID NO: 548981 - DNA, 20 bp, Artificial Sequence
  chemically synthesized
tatctttcaataggattttc

SEQ ID NO: 548982 - DNA, 20 bp, Artificial Sequence
  chemically synthesized
cataccaaaacgaaacaaaa

SEQ ID NO: 548983 - DNA, 20 bp, Artificial Sequence
  chemically synthesized
caaaataataacaacaaaag

SEQ ID NO: 548984 - DNA, 20 bp, Artificial Sequence
  chemically synthesized
taattgaatgctgaggttaa

SEQ ID NO: 548985 - DNA, 20 bp, Artificial Sequence
  chemically synthesized
cttctaaaggctctgcctta

SEQ ID NO: 548986 - DNA, 20 bp, Artificial Sequence
  chemically synthesized
ctaataaggcagagccttta

SEQ ID NO: 548987 - DNA, 20 bp, Artificial Sequence
  chemically synthesized
cctttagaagaatgcttgac

SEQ ID NO: 548988 - DNA, 20 bp, Artificial Sequence
  chemically synthesized
tattttaattagcatactgt

SEQ ID NO: 548989 - DNA, 20 bp, Artificial Sequence
  chemically synthesized
acgagacgagctttaacagc

SEQ ID NO: 548990 - DNA, 20 bp, Artificial Sequence
  chemically synthesized
tgttcagatgaaattatcca

SEQ ID NO: 548991 - DNA, 20 bp, Artificial Sequence
  chemically synthesized
aatgacaacagcatacaata

SEQ ID NO: 548992 - DNA, 20 bp, Artificial Sequence
  chemically synthesized
gtgtcatcagccttccccag

SEQ ID NO: 548993 - DNA, 20 bp, Artificial Sequence
  chemically synthesized
ttttttgcaaagatctgaat

SEQ ID NO: 548994 - DNA, 20 bp, Artificial Sequence
  chemically synthesized
aaatcaaataaaacagaagt

SEQ ID NO: 548995 - DNA, 20 bp, Artificial Sequence
  chemically synthesized
agtaataaacaggccagttt

SEQ ID NO: 548996 - DNA, 20 bp, Artificial Sequence
  chemically synthesized
gaagctgagcttggttcttt

SEQ ID NO: 548997 - DNA, 20 bp, Artificial Sequence
  chemically synthesized
tccacacatatgggaaggtt

SEQ ID NO: 548998 - DNA, 20 bp, Artificial Sequence
  chemically synthesized
ttcactatgcttttgtcagc

SEQ ID NO: 548999 - DNA, 20 bp, Artificial Sequence
  chemically synthesized
gtactagtgtaagacagggg

SEQ ID NO: 549000 - DNA, 20 bp, Artificial Sequence
  chemically synthesized
tagtgtaagacaggggcaag

SEQ ID NO: 549001 - DNA, 20 bp, Artificial Sequence
  chemically synthesized
tatacacgcatgccacatat

SEQ ID NO: 549002 - DNA, 20 bp, Artificial Sequence
  chemically synthesized
ttcattttgggataaagaag

SEQ ID NO: 549003 - DNA, 20 bp, Artificial Sequence
  chemically synthesized
agcacactcaaaatttatgc

SEQ ID NO: 549004 - DNA, 20 bp, Artificial Sequence
  chemically synthesized
tctctggattatttattcat

SEQ ID NO: 549005 - DNA, 20 bp, Artificial Sequence
  chemically synthesized
ccaaagtgtataaaggtcat

SEQ ID NO: 549006 - DNA, 20 bp, Artificial Sequence
  chemically synthesized
ctattcgggaggatgaggca

SEQ ID NO: 549007 - DNA, 20 bp, Artificial Sequence
  chemically synthesized
ttatactatgaggcaaccaa

SEQ ID NO: 549008 - DNA, 20 bp, Artificial Sequence
  chemically synthesized
agaccagcctggccaacatg

SEQ ID NO: 549009 - DNA, 20 bp, Artificial Sequence
  chemically synthesized
ctactagggaggctgaggca

SEQ ID NO: 549010 - DNA, 20 bp, Artificial Sequence
  chemically synthesized
tttttactcaagatgattgt

SEQ ID NO: 549011 - DNA, 20 bp, Artificial Sequence
  chemically synthesized
cactctcccttttcattttt

SEQ ID NO: 549012 - DNA, 20 bp, Artificial Sequence
  chemically synthesized
ctactcgggaggctgaggca

SEQ ID NO: 549013 - DNA, 20 bp, Artificial Sequence
  chemically synthesized
tcggggatttgcctcaaaac

SEQ ID NO: 549014 - DNA, 20 bp, Artificial Sequence
  chemically synthesized
tatgtttgaaattcttcata

SEQ ID NO: 549015 - DNA, 20 bp, Artificial Sequence
  chemically synthesized
ccatttattttttctcttat

SEQ ID NO: 549016 - DNA, 20 bp, Artificial Sequence
  chemically synthesized
aatgacaagatatgtcagcc

SEQ ID NO: 549017 - DNA, 20 bp, Artificial Sequence
  chemically synthesized
tatgaacttcagtcaagtaa

SEQ ID NO: 549018 - DNA, 20 bp, Artificial Sequence
  chemically synthesized
tatttatgcttgcatgtttt

SEQ ID NO: 549019 - DNA, 20 bp, Artificial Sequence
  chemically synthesized
gaatctttgcattggacaag

SEQ ID NO: 549020 - DNA, 20 bp, Artificial Sequence
  chemically synthesized
aagatctatgtatacatttt

SEQ ID NO: 549021 - DNA, 20 bp, Artificial Sequence
  chemically synthesized
cagagaacagattaaaacac

SEQ ID NO: 549022 - DNA, 20 bp, Artificial Sequence
  chemically synthesized
attagcgtagctgatagagg

SEQ ID NO: 549023 - DNA, 20 bp, Artificial Sequence
  chemically synthesized
gtcaagcatcagtccaaatt

SEQ ID NO: 549024 - DNA, 20 bp, Artificial Sequence
  chemically synthesized
ggacaatgatgcaaattgga

SEQ ID NO: 549025 - DNA, 20 bp, Artificial Sequence
  chemically synthesized
atcctgcccagccaagcact

SEQ ID NO: 549026 - DNA, 20 bp, Artificial Sequence
  chemically synthesized
agctgattatgatggagatc

SEQ ID NO: 549027 - DNA, 20 bp, Artificial Sequence
  chemically synthesized
cagaaagcatcaacaggaag

SEQ ID NO: 549028 - DNA, 20 bp, Artificial Sequence
  chemically synthesized
gaagatctgtgatggagatc

SEQ ID NO: 549029 - DNA, 20 bp, Artificial Sequence
  chemically synthesized
aagtagagaagtgagataga

SEQ ID NO: 549030 - DNA, 20 bp, Artificial Sequence
  chemically synthesized
ttcttcaggttaataataga

SEQ ID NO: 549031 - DNA, 20 bp, Artificial Sequence
  chemically synthesized
ttctcatctattattaacct

SEQ ID NO: 549032 - DNA, 20 bp, Artificial Sequence
  chemically synthesized
cccgcagtggcaaacccatc

SEQ ID NO: 549033 - DNA, 20 bp, Artificial Sequence
  chemically synthesized
ctcatctttttttccttcct

SEQ ID NO: 549034 - DNA, 20 bp, Artificial Sequence
  chemically synthesized
tgaattggaagttgctggtt

SEQ ID NO: 549035 - DNA, 20 bp, Artificial Sequence
  chemically synthesized
ggcactgtcttgaagaatgc

SEQ ID NO: 549036 - DNA, 20 bp, Artificial Sequence
  chemically synthesized
gcttcacatggcactgtctt

SEQ ID NO: 549037 - DNA, 20 bp, Artificial Sequence
  chemically synthesized
acagtgctgtcacaaaagag

SEQ ID NO: 549038 - DNA, 20 bp, Artificial Sequence
  chemically synthesized
agtataatactgaaaagtgt

SEQ ID NO: 549039 - DNA, 20 bp, Artificial Sequence
  chemically synthesized
agaaaatgatagtctgttaa

SEQ ID NO: 549040 - DNA, 20 bp, Artificial Sequence
  chemically synthesized
gactatcattttcttgagag

SEQ ID NO: 549041 - DNA, 20 bp, Artificial Sequence
  chemically synthesized
gaagacccaattcttgctct

SEQ ID NO: 549042 - DNA, 20 bp, Artificial Sequence
  chemically synthesized
cagattctgaagaaaatggt

SEQ ID NO: 549043 - DNA, 20 bp, Artificial Sequence
  chemically synthesized
gatattcttcaccattttct

SEQ ID NO: 549044 - DNA, 20 bp, Artificial Sequence
  chemically synthesized
gaccagcataagcagattct

SEQ ID NO: 549045 - DNA, 20 bp, Artificial Sequence
  chemically synthesized
tcagtggtgttaaatcactg

SEQ ID NO: 549046 - DNA, 20 bp, Artificial Sequence
  chemically synthesized
ttctcctttatttcctttca

SEQ ID NO: 549047 - DNA, 20 bp, Artificial Sequence
  chemically synthesized
gctacttgggaggctgaggc

SEQ ID NO: 549048 - DNA, 20 bp, Artificial Sequence
  chemically synthesized
actgccctccagcctgggag

SEQ ID NO: 549049 - DNA, 20 bp, Artificial Sequence
  chemically synthesized
tttttttttttttttttgag

SEQ ID NO: 549050 - DNA, 20 bp, Artificial Sequence
  chemically synthesized
ttctgggtggtttataaaga

SEQ ID NO: 549051 - DNA, 20 bp, Artificial Sequence
  chemically synthesized
ttctgctctttataaaccac

SEQ ID NO: 549052 - DNA, 20 bp, Artificial Sequence
  chemically synthesized
tatgtatgtggtagcacgtg

SEQ ID NO: 549053 - DNA, 20 bp, Artificial Sequence
  chemically synthesized
aatgagtggtatgagactaa

SEQ ID NO: 549054 - DNA, 20 bp, Artificial Sequence
  chemically synthesized
ttttactattacctagctac

SEQ ID NO: 549055 - DNA, 20 bp, Artificial Sequence
  chemically synthesized
tgaagggcaaactccttgaa

SEQ ID NO: 549056 - DNA, 20 bp, Artificial Sequence
  chemically synthesized
ctcatctgatcaaagttatt

SEQ ID NO: 549057 - DNA, 20 bp, Artificial Sequence
  chemically synthesized
aggttatccaaagagtagta

SEQ ID NO: 549058 - DNA, 20 bp, Artificial Sequence
  chemically synthesized
ttttacagtgtgtaaagcaa

SEQ ID NO: 549059 - DNA, 20 bp, Artificial Sequence
  chemically synthesized
ctttacaaatatgctttgct

SEQ ID NO: 549060 - DNA, 20 bp, Artificial Sequence
  chemically synthesized
atgtgaaataatcacatcat

SEQ ID NO: 549061 - DNA, 20 bp, Artificial Sequence
  chemically synthesized
ctccccaggaggctgaggca

SEQ ID NO: 549062 - DNA, 20 bp, Artificial Sequence
  chemically synthesized
ttcttcttattgtgccttat

SEQ ID NO: 549063 - DNA, 20 bp, Artificial Sequence
  chemically synthesized
ttctgaataaggcacaataa

SEQ ID NO: 549064 - DNA, 20 bp, Artificial Sequence
  chemically synthesized
tgttaagactaaataaagaa

SEQ ID NO: 549065 - DNA, 20 bp, Artificial Sequence
  chemically synthesized
tttcagtgttaagactaaat

SEQ ID NO: 549066 - DNA, 20 bp, Artificial Sequence
  chemically synthesized
tatctaccatgtgaaattag

SEQ ID NO: 549067 - DNA, 20 bp, Artificial Sequence
  chemically synthesized
aaagtgaatatagaaaagta

SEQ ID NO: 549068 - DNA, 20 bp, Artificial Sequence
  chemically synthesized
ataataggaaaaaagtgaat

SEQ ID NO: 549069 - DNA, 20 bp, Artificial Sequence
  chemically synthesized
aaaaaacaacaacaataaca

SEQ ID NO: 549070 - DNA, 20 bp, Artificial Sequence
  chemically synthesized
ctactcaggaggctgaggca

SEQ ID NO: 549071 - DNA, 20 bp, Artificial Sequence
  chemically synthesized
gtacaacaaatgatttgact

SEQ ID NO: 549072 - DNA, 20 bp, Artificial Sequence
  chemically synthesized
acactatataagtggcatgt

SEQ ID NO: 549073 - DNA, 20 bp, Artificial Sequence
  chemically synthesized
acaaattattggtatgggga

SEQ ID NO: 549074 - DNA, 20 bp, Artificial Sequence
  chemically synthesized
cataccgaaaacatgttata

SEQ ID NO: 549075 - DNA, 20 bp, Artificial Sequence
  chemically synthesized
atagaacatagaaaattata

SEQ ID NO: 549076 - DNA, 20 bp, Artificial Sequence
  chemically synthesized
aatactatagaacatagaac

SEQ ID NO: 549077 - DNA, 20 bp, Artificial Sequence
  chemically synthesized
atccatatatatttaacttt

SEQ ID NO: 549078 - DNA, 20 bp, Artificial Sequence
  chemically synthesized
actttctattcagtcaaatt

SEQ ID NO: 549079 - DNA, 20 bp, Artificial Sequence
  chemically synthesized
gaattcttgaatttgactga

SEQ ID NO: 549080 - DNA, 20 bp, Artificial Sequence
  chemically synthesized
actgaatagaaagtggtggc

SEQ ID NO: 549081 - DNA, 20 bp, Artificial Sequence
  chemically synthesized
atttggcttacaggttcagg

SEQ ID NO: 549082 - DNA, 20 bp, Artificial Sequence
  chemically synthesized
ggagaaaagtaaatttcatg

SEQ ID NO: 549083 - DNA, 20 bp, Artificial Sequence
  chemically synthesized
tatccatatttaacatatgg

SEQ ID NO: 549084 - DNA, 20 bp, Artificial Sequence
  chemically synthesized
tctaattcataggattctta

SEQ ID NO: 549085 - DNA, 20 bp, Artificial Sequence
  chemically synthesized
aatcaggcattaaattctca

SEQ ID NO: 549086 - DNA, 20 bp, Artificial Sequence
  chemically synthesized
taaaccaaaacgtttggcac

SEQ ID NO: 549087 - DNA, 20 bp, Artificial Sequence
  chemically synthesized
ttgacatttggaagaatttg

SEQ ID NO: 549088 - DNA, 20 bp, Artificial Sequence
  chemically synthesized
ccacatatagttgacatttg

SEQ ID NO: 549089 - DNA, 20 bp, Artificial Sequence
  chemically synthesized
tctaccatcttgccactaaa

SEQ ID NO: 549090 - DNA, 20 bp, Artificial Sequence
  chemically synthesized
aatgattaaatttaaaatca

SEQ ID NO: 549091 - DNA, 20 bp, Artificial Sequence
  chemically synthesized
gcttggaaccctgagttacc

SEQ ID NO: 549092 - DNA, 20 bp, Artificial Sequence
  chemically synthesized
gcaagttcacatgtaggcct

SEQ ID NO: 549093 - DNA, 20 bp, Artificial Sequence
  chemically synthesized
accccaaaatgttttcttaa

SEQ ID NO: 549094 - DNA, 20 bp, Artificial Sequence
  chemically synthesized
agtgagttgtattttctcat

SEQ ID NO: 549095 - DNA, 20 bp, Artificial Sequence
  chemically synthesized
tgcctttttttaatcaaggc

SEQ ID NO: 549096 - DNA, 20 bp, Artificial Sequence
  chemically synthesized
aaaaaaaggcacgtccacta

SEQ ID NO: 549097 - DNA, 20 bp, Artificial Sequence
  chemically synthesized
tatgtttctttatcccataa

SEQ ID NO: 549098 - DNA, 20 bp, Artificial Sequence
  chemically synthesized
ttttattctgattatgggat

SEQ ID NO: 549099 - DNA, 20 bp, Artificial Sequence
  chemically synthesized
ttttaaggtccattcatatt

SEQ ID NO: 549100 - DNA, 20 bp, Artificial Sequence
  chemically synthesized
gaatactttcatcatcccca

SEQ ID NO: 549101 - DNA, 20 bp, Artificial Sequence
  chemically synthesized
actatcatcactatctagtt

SEQ ID NO: 549102 - DNA, 20 bp, Artificial Sequence
  chemically synthesized
caagggaaaaatacgtttat

SEQ ID NO: 549103 - DNA, 20 bp, Artificial Sequence
  chemically synthesized
aaacaaaaatgaacaaaccc

SEQ ID NO: 549104 - DNA, 20 bp, Artificial Sequence
  chemically synthesized
aagttttattgtgcagatgg

SEQ ID NO: 549105 - DNA, 20 bp, Artificial Sequence
  chemically synthesized
tccctcattgtttgctacca

SEQ ID NO: 549106 - DNA, 20 bp, Artificial Sequence
  chemically synthesized
atgggagaggataaatgaag

SEQ ID NO: 549107 - DNA, 20 bp, Artificial Sequence
  chemically synthesized
ccactgactaaacattttat

SEQ ID NO: 549108 - DNA, 20 bp, Artificial Sequence
  chemically synthesized
atgtaatcaggaagaaattt

SEQ ID NO: 549109 - DNA, 20 bp, Artificial Sequence
  chemically synthesized
ctgccactggatgtaatcag

SEQ ID NO: 549110 - DNA, 20 bp, Artificial Sequence
  chemically synthesized
caatatccaataaacccagc

SEQ ID NO: 549111 - DNA, 20 bp, Artificial Sequence
  chemically synthesized
ttactatgctttttaaattt

SEQ ID NO: 549112 - DNA, 20 bp, Artificial Sequence
  chemically synthesized
agacagtaagccagctcctg
